United States Patent 11,254,933 (CRISPR/CAS TRANSCRIPTIONAL MODULATION) - sequence listing, part 8

SEQ ID NO: 326780 - DNA, 20 bp, human
gctttcctgtcttcttagtt

SEQ ID NO: 326781 - DNA, 20 bp, human
gagctaagacatgtgtcaga

SEQ ID NO: 326782 - DNA, 20 bp, human
gtggaatagatatctataat

SEQ ID NO: 326783 - DNA, 20 bp, human
gtccattttcttaggattga

SEQ ID NO: 326784 - DNA, 20 bp, human
gttttcctaactaagaagac

SEQ ID NO: 326785 - DNA, 20 bp, human
gctaaaatattgtctatgtt

SEQ ID NO: 326786 - DNA, 20 bp, human
gactcactgtctgtgacgtc

SEQ ID NO: 326787 - DNA, 20 bp, human
gacgcaccgagtcagaaact

SEQ ID NO: 326788 - DNA, 20 bp, human
gcaatccctttatcctctct

SEQ ID NO: 326789 - DNA, 20 bp, human
gtgttctatgagcatagtct

SEQ ID NO: 326790 - DNA, 20 bp, human
gccgagtcagaaactgggtt

SEQ ID NO: 326791 - DNA, 20 bp, human
gaatcaatttgagacaacat

SEQ ID NO: 326792 - DNA, 20 bp, human
gtttctgactcggtgcgtct

SEQ ID NO: 326793 - DNA, 20 bp, human
gtagaacacttatctgcagt

SEQ ID NO: 326794 - DNA, 20 bp, human
gacagtgagtgtggcagtgc

SEQ ID NO: 326795 - DNA, 20 bp, human
ggaggcctagagaggataaa

SEQ ID NO: 326796 - DNA, 20 bp, human
gcacacacgtaccacacgta

SEQ ID NO: 326797 - DNA, 20 bp, human
gcatggaattaccatacgtg

SEQ ID NO: 326798 - DNA, 20 bp, human
gttgtagaatagcttgaggg

SEQ ID NO: 326799 - DNA, 20 bp, human
gggtacaatgtagtagccat

SEQ ID NO: 326800 - DNA, 20 bp, human
gtgtaggaagagcaagacta

SEQ ID NO: 326801 - DNA, 20 bp, human
gggaaggtgtgttgaaactg

SEQ ID NO: 326802 - DNA, 20 bp, human
ggtagtagccattggtttgt

SEQ ID NO: 326803 - DNA, 20 bp, human
gactcaaaccaacaaaccaa

SEQ ID NO: 326804 - DNA, 20 bp, human
gatcttgtcccatgactaac

SEQ ID NO: 326805 - DNA, 20 bp, human
gatatttcataagatatatt

SEQ ID NO: 326806 - DNA, 20 bp, human
gttggtccttacatttttga

SEQ ID NO: 326807 - DNA, 20 bp, human
gtttttgaaggcaactcaag

SEQ ID NO: 326808 - DNA, 20 bp, human
gtgcaacttagtgtcctcca

SEQ ID NO: 326809 - DNA, 20 bp, human
gatattatgtaggttcatag

SEQ ID NO: 326810 - DNA, 20 bp, human
gatgtagattacaactagaa

SEQ ID NO: 326811 - DNA, 20 bp, human
gaactttatctgacccatgg

SEQ ID NO: 326812 - DNA, 20 bp, human
gagttgccttcaaaaatgta

SEQ ID NO: 326813 - DNA, 20 bp, human
gaataactttatctgaccca

SEQ ID NO: 326814 - DNA, 20 bp, human
gtgattcttcgtgagtgttc

SEQ ID NO: 326815 - DNA, 20 bp, human
ggaatcaaatgatggaaaga

SEQ ID NO: 326816 - DNA, 20 bp, human
gttactcaactcatagtctt

SEQ ID NO: 326817 - DNA, 20 bp, human
gactgcttaaacaaataaaa

SEQ ID NO: 326818 - DNA, 20 bp, human
gaaagtgaacacagtgtggt

SEQ ID NO: 326819 - DNA, 20 bp, human
gtggtgggagatttttaaca

SEQ ID NO: 326820 - DNA, 20 bp, human
gtttctcatcaaataatcta

SEQ ID NO: 326821 - DNA, 20 bp, human
gagtggattgaatttaattt

SEQ ID NO: 326822 - DNA, 20 bp, human
gaactgtggttatacatcct

SEQ ID NO: 326823 - DNA, 20 bp, human
ggtactgtttttctattata

SEQ ID NO: 326824 - DNA, 20 bp, human
gaagacagttgactctgccc

SEQ ID NO: 326825 - DNA, 20 bp, human
gtgcttttcatacaagtttc

SEQ ID NO: 326826 - DNA, 20 bp, human
ggacttgttgatcacattca

SEQ ID NO: 326827 - DNA, 20 bp, human
ggtgcatcgttgtaatacta

SEQ ID NO: 326828 - DNA, 20 bp, human
gacaagtcataaacattttc

SEQ ID NO: 326829 - DNA, 20 bp, human
gtcaataacttcatgttagc

SEQ ID NO: 326830 - DNA, 20 bp, human
gtctagatccatttgcaagg

SEQ ID NO: 326831 - DNA, 20 bp, human
gtttcagtacctccttgctg

SEQ ID NO: 326832 - DNA, 20 bp, human
gagtgttaagagcttttcaa

SEQ ID NO: 326833 - DNA, 20 bp, human
gattgataccaccttgcaaa

SEQ ID NO: 326834 - DNA, 20 bp, human
gtcaaagagggagaaattga

SEQ ID NO: 326835 - DNA, 20 bp, human
gagagtttgcattgtcaaag

SEQ ID NO: 326836 - DNA, 20 bp, human
gtttggggaaacatccctgt

SEQ ID NO: 326837 - DNA, 20 bp, human
gaacatccctgtaggtcaat

SEQ ID NO: 326838 - DNA, 20 bp, human
gaacaaagtgactagaccat

SEQ ID NO: 326839 - DNA, 20 bp, human
gttagtcctattgacctaca

SEQ ID NO: 326840 - DNA, 20 bp, human
gggtggtgcttggaacagga

SEQ ID NO: 326841 - DNA, 20 bp, human
gtcacttaagtcagaagtga

SEQ ID NO: 326842 - DNA, 20 bp, human
gaaaaggtctgctggtgaaa

SEQ ID NO: 326843 - DNA, 20 bp, human
gtttttagacatgactataa

SEQ ID NO: 326844 - DNA, 20 bp, human
gtctataatttaataaactc

SEQ ID NO: 326845 - DNA, 20 bp, human
ggctgtcctctccttatcat

SEQ ID NO: 326846 - DNA, 20 bp, human
gggtggataagtttgacagc

SEQ ID NO: 326847 - DNA, 20 bp, human
gtaaaaaccaggtatagcca

SEQ ID NO: 326848 - DNA, 20 bp, human
gtaactgcgctaataattct

SEQ ID NO: 326849 - DNA, 20 bp, human
gagccatggctaatgaaaag

SEQ ID NO: 326850 - DNA, 20 bp, human
gcatggctaatgaaaagtgg

SEQ ID NO: 326851 - DNA, 20 bp, human
gtaaaatctctgttggtcaa

SEQ ID NO: 326852 - DNA, 20 bp, human
gcgaactctcattgacctcc

SEQ ID NO: 326853 - DNA, 20 bp, human
gtggtggtgctacatttgga

SEQ ID NO: 326854 - DNA, 20 bp, human
gttctttgacatgagtgtcc

SEQ ID NO: 326855 - DNA, 20 bp, human
ggcgatctgtgaagtaaaga

SEQ ID NO: 326856 - DNA, 20 bp, human
gtagatggaacaagtcacta

SEQ ID NO: 326857 - DNA, 20 bp, human
ggtcactagggtgggtgaaa

SEQ ID NO: 326858 - DNA, 20 bp, human
gatggaacaagtcactaggg

SEQ ID NO: 326859 - DNA, 20 bp, human
gaaatcctagaccttaggga

SEQ ID NO: 326860 - DNA, 20 bp, human
gtgtgggagggactttagta

SEQ ID NO: 326861 - DNA, 20 bp, human
gtgggtgaggtgtgaatgga

SEQ ID NO: 326862 - DNA, 20 bp, human
gaagcgaaatcctagacctt

SEQ ID NO: 326863 - DNA, 20 bp, human
gaagagtttttcactgtggg

SEQ ID NO: 326864 - DNA, 20 bp, human
gctctccctccctaaggtct

SEQ ID NO: 326865 - DNA, 20 bp, human
gcatcatgaggattgcagtt

SEQ ID NO: 326866 - DNA, 20 bp, human
gctgatgcttatacttatga

SEQ ID NO: 326867 - DNA, 20 bp, human
gaagttggagagtacagtga

SEQ ID NO: 326868 - DNA, 20 bp, human
gagaaaagaaagctaacatg

SEQ ID NO: 326869 - DNA, 20 bp, human
gtggtcaacccaaggaacag

SEQ ID NO: 326870 - DNA, 20 bp, human
ggacttactacacaagtcag

SEQ ID NO: 326871 - DNA, 20 bp, human
gaacagcaatggtcaaccca

SEQ ID NO: 326872 - DNA, 20 bp, human
ggtataagcatcagattggg

SEQ ID NO: 326873 - DNA, 20 bp, human
gagcacaggccacaaacact

SEQ ID NO: 326874 - DNA, 20 bp, human
gcaagctcacctctgttcct

SEQ ID NO: 326875 - DNA, 20 bp, human
ggataggtatgggagaatac

SEQ ID NO: 326876 - DNA, 20 bp, human
gaagaatagtgtaagatgac

SEQ ID NO: 326877 - DNA, 20 bp, human
gatttcagctacttcaaagc

SEQ ID NO: 326878 - DNA, 20 bp, human
gagtataagtagttcaaaaa

SEQ ID NO: 326879 - DNA, 20 bp, human
gtgcgtactatcttactagc

SEQ ID NO: 326880 - DNA, 20 bp, human
gacactattcttgaagtgtt

SEQ ID NO: 326881 - DNA, 20 bp, human
gatttctagtagtctttcag

SEQ ID NO: 326882 - DNA, 20 bp, human
gatgatctatctgaaaaaag

SEQ ID NO: 326883 - DNA, 20 bp, human
gtgctgtgaaacctcaggta

SEQ ID NO: 326884 - DNA, 20 bp, human
gacttttggtaaacatttgc

SEQ ID NO: 326885 - DNA, 20 bp, human
gctgggaaactcaatgttaa

SEQ ID NO: 326886 - DNA, 20 bp, human
ggacccatgacaaaatgaac

SEQ ID NO: 326887 - DNA, 20 bp, human
gagcctgttcattttgtcat

SEQ ID NO: 326888 - DNA, 20 bp, human
gaaaagcaacaggtcattat

SEQ ID NO: 326889 - DNA, 20 bp, human
gaagtgccctcatttgaata

SEQ ID NO: 326890 - DNA, 20 bp, human
gatgtcaggtgagaagttgc

SEQ ID NO: 326891 - DNA, 20 bp, human
gaagactattggaagatggc

SEQ ID NO: 326892 - DNA, 20 bp, human
gcgtgtccttattcaaatga

SEQ ID NO: 326893 - DNA, 20 bp, human
gtaaaaataacaaaagcaac

SEQ ID NO: 326894 - DNA, 20 bp, human
gcttcaagactattggaaga

SEQ ID NO: 326895 - DNA, 20 bp, human
ggatggcaggattaaaaata

SEQ ID NO: 326896 - DNA, 20 bp, human
gccaactgcagttactggtg

SEQ ID NO: 326897 - DNA, 20 bp, human
gaggagccaactgcagttac

SEQ ID NO: 326898 - DNA, 20 bp, human
gacatgtaagatactgacag

SEQ ID NO: 326899 - DNA, 20 bp, human
gggagtagatgtgtttttat

SEQ ID NO: 326900 - DNA, 20 bp, human
gctgcagttactggtgaggc

SEQ ID NO: 326901 - DNA, 20 bp, human
gaaaaacacatctactccaa

SEQ ID NO: 326902 - DNA, 20 bp, human
gcctacacctgagttttaaa

SEQ ID NO: 326903 - DNA, 20 bp, human
gatagatgagtattttagaa

SEQ ID NO: 326904 - DNA, 20 bp, human
gtctgaaacataaagtgtgt

SEQ ID NO: 326905 - DNA, 20 bp, human
gttacatgttgatattcctc

SEQ ID NO: 326906 - DNA, 20 bp, human
gagcttccgtgcaatcacac

SEQ ID NO: 326907 - DNA, 20 bp, human
gaatatagagattgttgtta

SEQ ID NO: 326908 - DNA, 20 bp, human
gggacaggtgaactctttca

SEQ ID NO: 326909 - DNA, 20 bp, human
gggaatggccaatatgtgtc

SEQ ID NO: 326910 - DNA, 20 bp, human
gtagcgtggattttgtgatg

SEQ ID NO: 326911 - DNA, 20 bp, human
gcctgttgaccatgtatcat

SEQ ID NO: 326912 - DNA, 20 bp, human
ggatccatagggagataatc

SEQ ID NO: 326913 - DNA, 20 bp, human
gccttcttaacaactgtaaa

SEQ ID NO: 326914 - DNA, 20 bp, human
gaatatattcctatgataca

SEQ ID NO: 326915 - DNA, 20 bp, human
gttgttgttagggaaaatga

SEQ ID NO: 326916 - DNA, 20 bp, human
ggctgctactgctatgttca

SEQ ID NO: 326917 - DNA, 20 bp, human
gactgctatgttcagggctc

SEQ ID NO: 326918 - DNA, 20 bp, human
ggacagaggctggtcctgac

SEQ ID NO: 326919 - DNA, 20 bp, human
gtccgtggatatagccaaga

SEQ ID NO: 326920 - DNA, 20 bp, human
gagtttctgcccagacctct

SEQ ID NO: 326921 - DNA, 20 bp, human
gtggaacaacccagaggtct

SEQ ID NO: 326922 - DNA, 20 bp, human
gggaaaatgctggttaagat

SEQ ID NO: 326923 - DNA, 20 bp, human
gcctgactgggtgattgcaa

SEQ ID NO: 326924 - DNA, 20 bp, human
ggcagtagaattttgcttgc

SEQ ID NO: 326925 - DNA, 20 bp, human
ggccttcttggctatatcca

SEQ ID NO: 326926 - DNA, 20 bp, human
gtagtgtgaggttggatcat

SEQ ID NO: 326927 - DNA, 20 bp, human
gagccccaaaatacacatat

SEQ ID NO: 326928 - DNA, 20 bp, human
ggcaaaaatggccatttcat

SEQ ID NO: 326929 - DNA, 20 bp, human
gaaaaagacagctcctggaa

SEQ ID NO: 326930 - DNA, 20 bp, human
gaagccaatatgtgtatttt

SEQ ID NO: 326931 - DNA, 20 bp, human
gtgatcttctagtgtgaggt

SEQ ID NO: 326932 - DNA, 20 bp, human
ggtcccaaagagtcaaatag

SEQ ID NO: 326933 - DNA, 20 bp, human
gtgggtcaataatgacgctc

SEQ ID NO: 326934 - DNA, 20 bp, human
gtggaaaggggttttggaat

SEQ ID NO: 326935 - DNA, 20 bp, human
ggtggtggttggatgtaggc

SEQ ID NO: 326936 - DNA, 20 bp, human
gtgagacagtcagggtctca

SEQ ID NO: 326937 - DNA, 20 bp, human
ggagtcgctcatagtcaact

SEQ ID NO: 326938 - DNA, 20 bp, human
gcagggtctcaaggatctaa

SEQ ID NO: 326939 - DNA, 20 bp, human
ggtctcaggcatgaatgact

SEQ ID NO: 326940 - DNA, 20 bp, human
gaacctcaagccatcttcag

SEQ ID NO: 326941 - DNA, 20 bp, human
gttcatgcctgagacagtca

SEQ ID NO: 326942 - DNA, 20 bp, human
gtgaacacaaaggaatttga

SEQ ID NO: 326943 - DNA, 20 bp, human
gtgaagctttgctccactga

SEQ ID NO: 326944 - DNA, 20 bp, human
gacacttttgcttccttcag

SEQ ID NO: 326945 - DNA, 20 bp, human
gaggaatttgatggatttga

SEQ ID NO: 326946 - DNA, 20 bp, human
gcttacaatacatcagctat

SEQ ID NO: 326947 - DNA, 20 bp, human
gtagccttcaatatatgagc

SEQ ID NO: 326948 - DNA, 20 bp, human
gggtcattgcacacaaaata

SEQ ID NO: 326949 - DNA, 20 bp, human
gagggtatacagaattaaat

SEQ ID NO: 326950 - DNA, 20 bp, human
gacatttgcagcaaaatatg

SEQ ID NO: 326951 - DNA, 20 bp, human
gctatggagtcaagatactt

SEQ ID NO: 326952 - DNA, 20 bp, human
gatgcactgtgtagacaagc

SEQ ID NO: 326953 - DNA, 20 bp, human
gaagaggagaagctgggatt

SEQ ID NO: 326954 - DNA, 20 bp, human
gtgtgctgaaaaagaaatga

SEQ ID NO: 326955 - DNA, 20 bp, human
ggactccatagtttcttctg

SEQ ID NO: 326956 - DNA, 20 bp, human
gggggcctatcgggggtctg

SEQ ID NO: 326957 - DNA, 20 bp, human
gggcttaatgcctagacgat

SEQ ID NO: 326958 - DNA, 20 bp, human
gctccccacagacccccgat

SEQ ID NO: 326959 - DNA, 20 bp, human
ggggactgaggactaggctg

SEQ ID NO: 326960 - DNA, 20 bp, human
gacctgtgggactgaggact

SEQ ID NO: 326961 - DNA, 20 bp, human
gaaaatatataatgcattct

SEQ ID NO: 326962 - DNA, 20 bp, human
ggcctagtcctcagtcccac

SEQ ID NO: 326963 - DNA, 20 bp, human
ggaatgcttgagaatattag

SEQ ID NO: 326964 - DNA, 20 bp, human
gactgagagtcagtatttct

SEQ ID NO: 326965 - DNA, 20 bp, human
gactcgccacattaactttt

SEQ ID NO: 326966 - DNA, 20 bp, human
gtaattcgccaagagagtag

SEQ ID NO: 326967 - DNA, 20 bp, human
gtattagtaagcaacatata

SEQ ID NO: 326968 - DNA, 20 bp, human
gttcacaccgtattagcaga

SEQ ID NO: 326969 - DNA, 20 bp, human
gtacgatccatctgctaata

SEQ ID NO: 326970 - DNA, 20 bp, human
gtcaatatgttacaacatga

SEQ ID NO: 326971 - DNA, 20 bp, human
gggcatattcatcagtagca

SEQ ID NO: 326972 - DNA, 20 bp, human
ggtacataaacaatggaaat

SEQ ID NO: 326973 - DNA, 20 bp, human
gatggttttatcactcaaaa

SEQ ID NO: 326974 - DNA, 20 bp, human
gttcttttggatatgtgtta

SEQ ID NO: 326975 - DNA, 20 bp, human
gtagcaatgtagacagacat

SEQ ID NO: 326976 - DNA, 20 bp, human
gtgaggggataaattgttca

SEQ ID NO: 326977 - DNA, 20 bp, human
gatacctgtgcctagggcca

SEQ ID NO: 326978 - DNA, 20 bp, human
gttcaaggcttcctggccat

SEQ ID NO: 326979 - DNA, 20 bp, human
gctgaaccttcttcctttct

SEQ ID NO: 326980 - DNA, 20 bp, human
gatagtcatacctgtgccta

SEQ ID NO: 326981 - DNA, 20 bp, human
ggtctaacggaaaaggtgag

SEQ ID NO: 326982 - DNA, 20 bp, human
gtctaaggccccacaaggtc

SEQ ID NO: 326983 - DNA, 20 bp, human
gcaccttttccgttagacat

SEQ ID NO: 326984 - DNA, 20 bp, human
ggaaagtctaaggccccaca

SEQ ID NO: 326985 - DNA, 20 bp, human
gttcgcaggttgaaagtcta

SEQ ID NO: 326986 - DNA, 20 bp, human
gagggaaatggagtaactgt

SEQ ID NO: 326987 - DNA, 20 bp, human
gtctgcatcagttattctgg

SEQ ID NO: 326988 - DNA, 20 bp, human
gagaagagatatagggcaag

SEQ ID NO: 326989 - DNA, 20 bp, human
gtctaaatatcccacattaa

SEQ ID NO: 326990 - DNA, 20 bp, human
ggacagaagtatccgaacta

SEQ ID NO: 326991 - DNA, 20 bp, human
ggacagattgtatcagatgt

SEQ ID NO: 326992 - DNA, 20 bp, human
gctgtctgcatcagttattc

SEQ ID NO: 326993 - DNA, 20 bp, human
gctataaagaaacaaattac

SEQ ID NO: 326994 - DNA, 20 bp, human
gtggtttctttccattaatg

SEQ ID NO: 326995 - DNA, 20 bp, human
gtcagtaattagtttatgac

SEQ ID NO: 326996 - DNA, 20 bp, human
gatagccaggtcagatgcgg

SEQ ID NO: 326997 - DNA, 20 bp, human
gaacctgaactgattaagac

SEQ ID NO: 326998 - DNA, 20 bp, human
gaaacaaatcatagactagg

SEQ ID NO: 326999 - DNA, 20 bp, human
gttttcacagttcacgaggc

SEQ ID NO: 327000 - DNA, 20 bp, human
gtacctgtcttaatcagttc

SEQ ID NO: 327001 - DNA, 20 bp, human
ggttctgattctccatgctc

SEQ ID NO: 327002 - DNA, 20 bp, human
gaacaaacaaatcatagact

SEQ ID NO: 327003 - DNA, 20 bp, human
gactttttaaaagatctttg

SEQ ID NO: 327004 - DNA, 20 bp, human
gttacttttcacagttcacg

SEQ ID NO: 327005 - DNA, 20 bp, human
gaccatagccaggtcagatg

SEQ ID NO: 327006 - DNA, 20 bp, human
ggctcataggaacttctatg

SEQ ID NO: 327007 - DNA, 20 bp, human
ggtcccggggaagaggttgc

SEQ ID NO: 327008 - DNA, 20 bp, human
gagaagttcctatgagcaca

SEQ ID NO: 327009 - DNA, 20 bp, human
gcaactactactaccatcta

SEQ ID NO: 327010 - DNA, 20 bp, human
gaataataagactaaggaga

SEQ ID NO: 327011 - DNA, 20 bp, human
gttaaaatagatttgaggtg

SEQ ID NO: 327012 - DNA, 20 bp, human
gaggttttccatgtgctcat

SEQ ID NO: 327013 - DNA, 20 bp, human
gttgctcataggtccataga

SEQ ID NO: 327014 - DNA, 20 bp, human
gctgaattctgcaattacca

SEQ ID NO: 327015 - DNA, 20 bp, human
gagaattaatcaaggctcct

SEQ ID NO: 327016 - DNA, 20 bp, human
gggctatgagctatttttac

SEQ ID NO: 327017 - DNA, 20 bp, human
gagctcatagccctttgtta

SEQ ID NO: 327018 - DNA, 20 bp, human
gaaaaaacaaccgtaacaaa

SEQ ID NO: 327019 - DNA, 20 bp, human
gcttcagtttctagtttagg

SEQ ID NO: 327020 - DNA, 20 bp, human
gtaagaaaccatggagaaac

SEQ ID NO: 327021 - DNA, 20 bp, human
gaggtagtaaaaatccaaca

SEQ ID NO: 327022 - DNA, 20 bp, human
gattttaactgttcccttgt

SEQ ID NO: 327023 - DNA, 20 bp, human
gggaacagttaaaattatcc

SEQ ID NO: 327024 - DNA, 20 bp, human
gtttactacctgtttctcca

SEQ ID NO: 327025 - DNA, 20 bp, human
gcttatgaaagaagctgtct

SEQ ID NO: 327026 - DNA, 20 bp, human
gttatggagcccatagattt

SEQ ID NO: 327027 - DNA, 20 bp, human
gctattgctatgtccccggc

SEQ ID NO: 327028 - DNA, 20 bp, human
gtcctcccttcccaaatcta

SEQ ID NO: 327029 - DNA, 20 bp, human
ggaccccatcaaggaccatg

SEQ ID NO: 327030 - DNA, 20 bp, human
gtgctggggagtcagactgg

SEQ ID NO: 327031 - DNA, 20 bp, human
gtcacctcatggtccttgat

SEQ ID NO: 327032 - DNA, 20 bp, human
gtactgtgctaattgtggga

SEQ ID NO: 327033 - DNA, 20 bp, human
gggttgctggggagtcagac

SEQ ID NO: 327034 - DNA, 20 bp, human
gagactgggggtattttaga

SEQ ID NO: 327035 - DNA, 20 bp, human
gcaactgagtatgctttgat

SEQ ID NO: 327036 - DNA, 20 bp, human
ggaggctatagactagtcta

SEQ ID NO: 327037 - DNA, 20 bp, human
gtgccctgaccttattggaa

SEQ ID NO: 327038 - DNA, 20 bp, human
gtccccttccaataaggtca

SEQ ID NO: 327039 - DNA, 20 bp, human
gctaaggcatggtcatgcca

SEQ ID NO: 327040 - DNA, 20 bp, human
gtgtctatgtgagtagactg

SEQ ID NO: 327041 - DNA, 20 bp, human
gaggaatataatgaacttaa

SEQ ID NO: 327042 - DNA, 20 bp, human
gatagagtccccttccaata

SEQ ID NO: 327043 - DNA, 20 bp, human
gattaaatagtggtaaagag

SEQ ID NO: 327044 - DNA, 20 bp, human
gatttcatctacaactgtgt

SEQ ID NO: 327045 - DNA, 20 bp, human
ggaatatgccctgaccttat

SEQ ID NO: 327046 - DNA, 20 bp, human
ggcaaaggatatgtgagctg

SEQ ID NO: 327047 - DNA, 20 bp, human
gaggaggggtaggagtttga

SEQ ID NO: 327048 - DNA, 20 bp, human
gttaggaaagagtacaggac

SEQ ID NO: 327049 - DNA, 20 bp, human
ggtacaggactggtttgaat

SEQ ID NO: 327050 - DNA, 20 bp, human
gactcaagccctctttgtgg

SEQ ID NO: 327051 - DNA, 20 bp, human
ggctagttaggaaagagtac

SEQ ID NO: 327052 - DNA, 20 bp, human
ggagattcagagattcttat

SEQ ID NO: 327053 - DNA, 20 bp, human
gcagcactgaaaggcaagtg

SEQ ID NO: 327054 - DNA, 20 bp, human
gattggcatgggctatttag

SEQ ID NO: 327055 - DNA, 20 bp, human
gggactggtttgaatgggtg

SEQ ID NO: 327056 - DNA, 20 bp, human
gggggagtcatgtcatatag

SEQ ID NO: 327057 - DNA, 20 bp, human
ggataacacagaaaagtccc

SEQ ID NO: 327058 - DNA, 20 bp, human
gagctatggggctattaggt

SEQ ID NO: 327059 - DNA, 20 bp, human
gatggcttggttttaatctg

SEQ ID NO: 327060 - DNA, 20 bp, human
gaatctgcctgctgaaaggg

SEQ ID NO: 327061 - DNA, 20 bp, human
gctgctgaaagggaggtcag

SEQ ID NO: 327062 - DNA, 20 bp, human
gtctgtaaatgttagctatg

SEQ ID NO: 327063 - DNA, 20 bp, human
gtgttagctatggggctatt

SEQ ID NO: 327064 - DNA, 20 bp, human
gagaacatttaccttaaacc

SEQ ID NO: 327065 - DNA, 20 bp, human
gaatttaagtcacatttatc

SEQ ID NO: 327066 - DNA, 20 bp, human
gtgcttcatcccactaacgc

SEQ ID NO: 327067 - DNA, 20 bp, human
gtgagggttaggaatcacta

SEQ ID NO: 327068 - DNA, 20 bp, human
gctcgtgaaagtgaagagtt

SEQ ID NO: 327069 - DNA, 20 bp, human
gggatgaagcaccaacacaa

SEQ ID NO: 327070 - DNA, 20 bp, human
gaacttaaaaatgaccaaac

SEQ ID NO: 327071 - DNA, 20 bp, human
gagttctcccccggcgttag

SEQ ID NO: 327072 - DNA, 20 bp, human
ggtaaacacaactgagggtt

SEQ ID NO: 327073 - DNA, 20 bp, human
gaactgttttaaactctaac

SEQ ID NO: 327074 - DNA, 20 bp, human
gggtggtttggcaaccagtt

SEQ ID NO: 327075 - DNA, 20 bp, human
gtagatttaaaggataaagg

SEQ ID NO: 327076 - DNA, 20 bp, human
gcccccaaactgaggatcat

SEQ ID NO: 327077 - DNA, 20 bp, human
gggatgaagcacccacacaa

SEQ ID NO: 327078 - DNA, 20 bp, human
gtcacctatgatcctcagtt

SEQ ID NO: 327079 - DNA, 20 bp, human
gaggaagtgccttactgtaa

SEQ ID NO: 327080 - DNA, 20 bp, human
gggctgcagccattacagta

SEQ ID NO: 327081 - DNA, 20 bp, human
ggatgatttggggaccagtt

SEQ ID NO: 327082 - DNA, 20 bp, human
gctaacatctctagaatata

SEQ ID NO: 327083 - DNA, 20 bp, human
gtgcttcatcccattaacgc

SEQ ID NO: 327084 - DNA, 20 bp, human
gctcgtaaaagtgaagagac

SEQ ID NO: 327085 - DNA, 20 bp, human
gcccagttggttctaaatgt

SEQ ID NO: 327086 - DNA, 20 bp, human
gcatccattagttccttctc

SEQ ID NO: 327087 - DNA, 20 bp, human
ggttcctgagaaggaactaa

SEQ ID NO: 327088 - DNA, 20 bp, human
gaatgacattgtgattgttt

SEQ ID NO: 327089 - DNA, 20 bp, human
gattgtttgggttcctgaga

SEQ ID NO: 327090 - DNA, 20 bp, human
ggctctatgtatcctatcac

SEQ ID NO: 327091 - DNA, 20 bp, human
gggattgtgtcaccagtgat

SEQ ID NO: 327092 - DNA, 20 bp, human
gtcttcccatgatgtgtcaa

SEQ ID NO: 327093 - DNA, 20 bp, human
gagagccattgacacatcat

SEQ ID NO: 327094 - DNA, 20 bp, human
ggtaaaatgaccatctaata

SEQ ID NO: 327095 - DNA, 20 bp, human
gagtatccagtgttatagaa

SEQ ID NO: 327096 - DNA, 20 bp, human
gccacaaatcagtatttcat

SEQ ID NO: 327097 - DNA, 20 bp, human
gagtcaacatcataggactt

SEQ ID NO: 327098 - DNA, 20 bp, human
gggcgatttcatgataaaat

SEQ ID NO: 327099 - DNA, 20 bp, human
ggaagatttttgctcaagat

SEQ ID NO: 327100 - DNA, 20 bp, human
gtaaagattggtgaaaacag

SEQ ID NO: 327101 - DNA, 20 bp, human
gaaacagtggtaaatgaaag

SEQ ID NO: 327102 - DNA, 20 bp, human
gacatcataggactttgggc

SEQ ID NO: 327103 - DNA, 20 bp, human
gaatactgatttgtggcctc

SEQ ID NO: 327104 - DNA, 20 bp, human
gtaatcagctaaatctaatg

SEQ ID NO: 327105 - DNA, 20 bp, human
gatttgtaagtcaacatcat

SEQ ID NO: 327106 - DNA, 20 bp, human
gcaagcccatggcaaacaga

SEQ ID NO: 327107 - DNA, 20 bp, human
gtataatataccctacataa

SEQ ID NO: 327108 - DNA, 20 bp, human
gggtagaaaagcctgtgagg

SEQ ID NO: 327109 - DNA, 20 bp, human
ggtgggtagaaaagcctgtg

SEQ ID NO: 327110 - DNA, 20 bp, human
gaaaaatcgcattgtatcaa

SEQ ID NO: 327111 - DNA, 20 bp, human
ggggacagtgagcaagccca

SEQ ID NO: 327112 - DNA, 20 bp, human
gtctgagatgtgcagggacg

SEQ ID NO: 327113 - DNA, 20 bp, human
gtcaagatttcacactgaaa

SEQ ID NO: 327114 - DNA, 20 bp, human
gcgtgtgtatccccttatgt

SEQ ID NO: 327115 - DNA, 20 bp, human
gcataatgcaacatttgtca

SEQ ID NO: 327116 - DNA, 20 bp, human
ggccctaaccacttcatact

SEQ ID NO: 327117 - DNA, 20 bp, human
gcaagatggttttatatcct

SEQ ID NO: 327118 - DNA, 20 bp, human
ggtgtcatttaggagaattc

SEQ ID NO: 327119 - DNA, 20 bp, human
gcttctaccaacagagtaat

SEQ ID NO: 327120 - DNA, 20 bp, human
gaaaatgctgcaatacaaga

SEQ ID NO: 327121 - DNA, 20 bp, human
gttcactatgttaataacta

SEQ ID NO: 327122 - DNA, 20 bp, human
gatggaaacacgtgtcattt

SEQ ID NO: 327123 - DNA, 20 bp, human
gacccagtatgaagtggtta

SEQ ID NO: 327124 - DNA, 20 bp, human
gttcatgagcataattgagt

SEQ ID NO: 327125 - DNA, 20 bp, human
gctctgcttcttttataggg

SEQ ID NO: 327126 - DNA, 20 bp, human
ggaaagagtccatgctatta

SEQ ID NO: 327127 - DNA, 20 bp, human
gtataagtaccctgcaatga

SEQ ID NO: 327128 - DNA, 20 bp, human
ggatagcaggatcattgaca

SEQ ID NO: 327129 - DNA, 20 bp, human
gtggcagtttgccctaactt

SEQ ID NO: 327130 - DNA, 20 bp, human
ggcattacaaatgaagcaca

SEQ ID NO: 327131 - DNA, 20 bp, human
gttaaatccagccaaagtta

SEQ ID NO: 327132 - DNA, 20 bp, human
gtctgtattccttcattgca

SEQ ID NO: 327133 - DNA, 20 bp, human
gggtgagaagacctgatagc

SEQ ID NO: 327134 - DNA, 20 bp, human
gcatgcatgtggaagtgtgc

SEQ ID NO: 327135 - DNA, 20 bp, human
gtatatataaggatagaaag

SEQ ID NO: 327136 - DNA, 20 bp, human
gcatccattagttccttctc

SEQ ID NO: 327137 - DNA, 20 bp, human
ggttcctgagaaggaactaa

SEQ ID NO: 327138 - DNA, 20 bp, human
gaatgacattgtgattgttt

SEQ ID NO: 327139 - DNA, 20 bp, human
gattgtttgggttcctgaga

SEQ ID NO: 327140 - DNA, 20 bp, human
ggctctatgtatcctatcat

SEQ ID NO: 327141 - DNA, 20 bp, human
gggattgtgtcaccaatgat

SEQ ID NO: 327142 - DNA, 20 bp, human
gagagccattgacacatcat

SEQ ID NO: 327143 - DNA, 20 bp, human
gtcttcccatgatgtgtcaa

SEQ ID NO: 327144 - DNA, 20 bp, human
gagtatccagtgttatagaa

SEQ ID NO: 327145 - DNA, 20 bp, human
gacaatcccttctataacac

SEQ ID NO: 327146 - DNA, 20 bp, human
gaactagtgtaaatgcagac

SEQ ID NO: 327147 - DNA, 20 bp, human
gagtcagttaacagaaggag

SEQ ID NO: 327148 - DNA, 20 bp, human
gcaagttaagtaaaattctg

SEQ ID NO: 327149 - DNA, 20 bp, human
gccaaatatggaagagaaag

SEQ ID NO: 327150 - DNA, 20 bp, human
gcacatttttgctatcagaa

SEQ ID NO: 327151 - DNA, 20 bp, human
gtactctggattaaaggatt

SEQ ID NO: 327152 - DNA, 20 bp, human
gaagtaaaattctgtgggac

SEQ ID NO: 327153 - DNA, 20 bp, human
gctcagtcagcaaggttttt

SEQ ID NO: 327154 - DNA, 20 bp, human
gctgctttactctggattaa

SEQ ID NO: 327155 - DNA, 20 bp, human
gattaaaggatttggcataa

SEQ ID NO: 327156 - DNA, 20 bp, human
ggaaaagcaccttttgatag

SEQ ID NO: 327157 - DNA, 20 bp, human
gctggggtccagtataccca

SEQ ID NO: 327158 - DNA, 20 bp, human
gtcaaaaggtgcttttcctt

SEQ ID NO: 327159 - DNA, 20 bp, human
gggaagcctaggaagtaaat

SEQ ID NO: 327160 - DNA, 20 bp, human
gaaacggaaatttttttcac

SEQ ID NO: 327161 - DNA, 20 bp, human
ggttatttgaataattagag

SEQ ID NO: 327162 - DNA, 20 bp, human
ggaggttgaataattagaaa

SEQ ID NO: 327163 - DNA, 20 bp, human
gcacacacagagagacagtt

SEQ ID NO: 327164 - DNA, 20 bp, human
gatgtgtgttttggaagcct

SEQ ID NO: 327165 - DNA, 20 bp, human
gcttgaagtttgatacttaa

SEQ ID NO: 327166 - DNA, 20 bp, human
gaggcaaagtcagttatcag

SEQ ID NO: 327167 - DNA, 20 bp, human
gcagacattcagaaatcgag

SEQ ID NO: 327168 - DNA, 20 bp, human
ggataaaagttccatctaaa

SEQ ID NO: 327169 - DNA, 20 bp, human
ggccaagagagaagtaacta

SEQ ID NO: 327170 - DNA, 20 bp, human
gaagtcagttatcagtggaa

SEQ ID NO: 327171 - DNA, 20 bp, human
gaagagagaagtaactaagg

SEQ ID NO: 327172 - DNA, 20 bp, human
gaatgtggctgtaagttcta

SEQ ID NO: 327173 - DNA, 20 bp, human
gtccaaacaggtacagagac

SEQ ID NO: 327174 - DNA, 20 bp, human
gtgtctgttctccatttaga

SEQ ID NO: 327175 - DNA, 20 bp, human
gatagttacaaggataatca

SEQ ID NO: 327176 - DNA, 20 bp, human
gcatcagctaaactggtatc

SEQ ID NO: 327177 - DNA, 20 bp, human
gttagaaatcccttcaaata

SEQ ID NO: 327178 - DNA, 20 bp, human
gtcaggataccttatttgaa

SEQ ID NO: 327179 - DNA, 20 bp, human
ggggctgaatttaacagtca

SEQ ID NO: 327180 - DNA, 20 bp, human
gcccagagattctcctactg

SEQ ID NO: 327181 - DNA, 20 bp, human
ggaacaaatatactggggat

SEQ ID NO: 327182 - DNA, 20 bp, human
gcaacaatgagactggttta

SEQ ID NO: 327183 - DNA, 20 bp, human
gctgaatttaacagtcatgg

SEQ ID NO: 327184 - DNA, 20 bp, human
gatggcggtatcgattctag

SEQ ID NO: 327185 - DNA, 20 bp, human
gtcttcaagtgctgctctgc

SEQ ID NO: 327186 - DNA, 20 bp, human
ggtctggactatgtcatcag

SEQ ID NO: 327187 - DNA, 20 bp, human
gttgcctcatgtgagcacta

SEQ ID NO: 327188 - DNA, 20 bp, human
gtccatagggcaaatgggac

SEQ ID NO: 327189 - DNA, 20 bp, human
gatgacatagtccagaccag

SEQ ID NO: 327190 - DNA, 20 bp, human
gtggcccatttgaatgatgt

SEQ ID NO: 327191 - DNA, 20 bp, human
gcactagggagagtacaatg

SEQ ID NO: 327192 - DNA, 20 bp, human
gaggaagtagggcaatgaat

SEQ ID NO: 327193 - DNA, 20 bp, human
ggatccaacatcattcaaat

SEQ ID NO: 327194 - DNA, 20 bp, human
gagaaataaagttaatgttg

SEQ ID NO: 327195 - DNA, 20 bp, human
gttcaaatgggccactggtc

SEQ ID NO: 327196 - DNA, 20 bp, human
gaactgtagaggactgatga

SEQ ID NO: 327197 - DNA, 20 bp, human
gtgaggggcttctttctcca

SEQ ID NO: 327198 - DNA, 20 bp, human
ggaggactgatgaggggcta

SEQ ID NO: 327199 - DNA, 20 bp, human
gtatttacaaccaactgtag

SEQ ID NO: 327200 - DNA, 20 bp, human
gaagcatacagacttctatt

SEQ ID NO: 327201 - DNA, 20 bp, human
ggctttggaaaggcttcttc

SEQ ID NO: 327202 - DNA, 20 bp, human
ggcccctcaatggaacatga

SEQ ID NO: 327203 - DNA, 20 bp, human
gatacagacttctatttggt

SEQ ID NO: 327204 - DNA, 20 bp, human
gatataaactctgggaagac

SEQ ID NO: 327205 - DNA, 20 bp, human
gttccatcatgttccattga

SEQ ID NO: 327206 - DNA, 20 bp, human
ggagacgctgggatgcggaa

SEQ ID NO: 327207 - DNA, 20 bp, human
gttgcggccactgagtagga

SEQ ID NO: 327208 - DNA, 20 bp, human
gcatcccagcgtctccacag

SEQ ID NO: 327209 - DNA, 20 bp, human
gatgcggaagggtcagaacc

SEQ ID NO: 327210 - DNA, 20 bp, human
gacaggctatcacctgggaa

SEQ ID NO: 327211 - DNA, 20 bp, human
ggaggtaaggagaatcaaac

SEQ ID NO: 327212 - DNA, 20 bp, human
gttagttgcggccactgagt

SEQ ID NO: 327213 - DNA, 20 bp, human
gaggaagagtggatgcaaga

SEQ ID NO: 327214 - DNA, 20 bp, human
gttgggaggtagtggtagga

SEQ ID NO: 327215 - DNA, 20 bp, human
gagacacagaggctgctact

SEQ ID NO: 327216 - DNA, 20 bp, human
ggtaacatatgcataacaca

SEQ ID NO: 327217 - DNA, 20 bp, human
gaaaatgctgagtaatatag

SEQ ID NO: 327218 - DNA, 20 bp, human
gtcctaaatgccatgcatgt

SEQ ID NO: 327219 - DNA, 20 bp, human
ggcccttgtaaagtataata

SEQ ID NO: 327220 - DNA, 20 bp, human
gggaaatggacctacatgca

SEQ ID NO: 327221 - DNA, 20 bp, human
gtacccacggtagttctttg

SEQ ID NO: 327222 - DNA, 20 bp, human
gtttattaagataggttagg

SEQ ID NO: 327223 - DNA, 20 bp, human
gacctacatgcatggcattt

SEQ ID NO: 327224 - DNA, 20 bp, human
gtttccacaaagaactaccg

SEQ ID NO: 327225 - DNA, 20 bp, human
gtaaacactactgaaaacac

SEQ ID NO: 327226 - DNA, 20 bp, human
gctaataatagctatctatg

SEQ ID NO: 327227 - DNA, 20 bp, human
gtctgtaaatatcttcaaac

SEQ ID NO: 327228 - DNA, 20 bp, human
gagatagctattattagatt

SEQ ID NO: 327229 - DNA, 20 bp, human
gttgtttgtttcagatgaca

SEQ ID NO: 327230 - DNA, 20 bp, human
gttaaattttagaaatactt

SEQ ID NO: 327231 - DNA, 20 bp, human
ggtgaaagttgtttaaaatc

SEQ ID NO: 327232 - DNA, 20 bp, human
gtcctgaatttttctgtttc

SEQ ID NO: 327233 - DNA, 20 bp, human
gctctaatttctcaatgtta

SEQ ID NO: 327234 - DNA, 20 bp, human
gtctttgattttttgtcatt

SEQ ID NO: 327235 - DNA, 20 bp, human
gacatgaataagttctctag

SEQ ID NO: 327236 - DNA, 20 bp, human
gagggagggcctcagtcaga

SEQ ID NO: 327237 - DNA, 20 bp, human
gccctcattgtcttggtaca

SEQ ID NO: 327238 - DNA, 20 bp, human
gttcaaaaatgacctgaaga

SEQ ID NO: 327239 - DNA, 20 bp, human
ggggggtgtgtggatgtctt

SEQ ID NO: 327240 - DNA, 20 bp, human
gtgatctagtggagcgagac

SEQ ID NO: 327241 - DNA, 20 bp, human
gttatataacacagtcaggg

SEQ ID NO: 327242 - DNA, 20 bp, human
gctagaaaggttctgtgggg

SEQ ID NO: 327243 - DNA, 20 bp, human
gtggacgtgcatcatgaaac

SEQ ID NO: 327244 - DNA, 20 bp, human
gttgctagaaaggttctgtg

SEQ ID NO: 327245 - DNA, 20 bp, human
gatgaaacaggttgctagaa

SEQ ID NO: 327246 - DNA, 20 bp, human
gggtatcctgagttaatctt

SEQ ID NO: 327247 - DNA, 20 bp, human
gcgtgaaaggacagacacga

SEQ ID NO: 327248 - DNA, 20 bp, human
gacaagagcacttacgactc

SEQ ID NO: 327249 - DNA, 20 bp, human
gtcaagctgaggcttcagat

SEQ ID NO: 327250 - DNA, 20 bp, human
gattaactcaggataccctt

SEQ ID NO: 327251 - DNA, 20 bp, human
gaaacatgatcatcttatga

SEQ ID NO: 327252 - DNA, 20 bp, human
gattatcataagcggggaag

SEQ ID NO: 327253 - DNA, 20 bp, human
gtcagaaagagccaaagtac

SEQ ID NO: 327254 - DNA, 20 bp, human
ggcttcagataggattccca

SEQ ID NO: 327255 - DNA, 20 bp, human
gcatgatcatcttatgaagg

SEQ ID NO: 327256 - DNA, 20 bp, human
gacatcagaactagccaaga

SEQ ID NO: 327257 - DNA, 20 bp, human
ggatactgtgaaagccctct

SEQ ID NO: 327258 - DNA, 20 bp, human
gaaagcggcactgtggagag

SEQ ID NO: 327259 - DNA, 20 bp, human
gctattaaaaagcggcactg

SEQ ID NO: 327260 - DNA, 20 bp, human
gaaggatgttagagttcatg

SEQ ID NO: 327261 - DNA, 20 bp, human
gtggctataaatatactgtt

SEQ ID NO: 327262 - DNA, 20 bp, human
ggagctagaaatactcaact

SEQ ID NO: 327263 - DNA, 20 bp, human
gtcgtattttaaatagttag

SEQ ID NO: 327264 - DNA, 20 bp, human
gaagtctgttgcttcttaat

SEQ ID NO: 327265 - DNA, 20 bp, human
gtggtagagttttctgcata

SEQ ID NO: 327266 - DNA, 20 bp, human
gagggaagccagttaaatcc

SEQ ID NO: 327267 - DNA, 20 bp, human
ggatctaaaatacctgccta

SEQ ID NO: 327268 - DNA, 20 bp, human
ggcatcagagagacaaacta

SEQ ID NO: 327269 - DNA, 20 bp, human
gcaacttacttcagattcca

SEQ ID NO: 327270 - DNA, 20 bp, human
gagtaaatataatgcatgtt

SEQ ID NO: 327271 - DNA, 20 bp, human
gaagacacaatttgatatca

SEQ ID NO: 327272 - DNA, 20 bp, human
gtactacaaaaggaaagatt

SEQ ID NO: 327273 - DNA, 20 bp, human
gtacttcagattccagggca

SEQ ID NO: 327274 - DNA, 20 bp, human
gattatttccaggatttaac

SEQ ID NO: 327275 - DNA, 20 bp, human
gaataatgcattgcaacatt

SEQ ID NO: 327276 - DNA, 20 bp, human
gttgctagttgaatgttctg

SEQ ID NO: 327277 - DNA, 20 bp, human
gctgaggtaagctagtaaag

SEQ ID NO: 327278 - DNA, 20 bp, human
gtacctcagtatccagggca

SEQ ID NO: 327279 - DNA, 20 bp, human
gtagcttacctcagtatcca

SEQ ID NO: 327280 - DNA, 20 bp, human
gctttcataaggacatgatg

SEQ ID NO: 327281 - DNA, 20 bp, human
gttcacaaggccaagatgac

SEQ ID NO: 327282 - DNA, 20 bp, human
gagacagtagtgctttcata

SEQ ID NO: 327283 - DNA, 20 bp, human
ggagacaaccacaaggtacg

SEQ ID NO: 327284 - DNA, 20 bp, human
gattgcactgcattatctac

SEQ ID NO: 327285 - DNA, 20 bp, human
gtgtggagaagagtagagcc

SEQ ID NO: 327286 - DNA, 20 bp, human
gaagagcaagagcagacatt

SEQ ID NO: 327287 - DNA, 20 bp, human
gaaagataacacatcacata

SEQ ID NO: 327288 - DNA, 20 bp, human
ggaacagctaagatatttga

SEQ ID NO: 327289 - DNA, 20 bp, human
gaatacttttttgggtaggc

SEQ ID NO: 327290 - DNA, 20 bp, human
gaaacatcatcatcttttgc

SEQ ID NO: 327291 - DNA, 20 bp, human
ggccacaccaacttccacaa

SEQ ID NO: 327292 - DNA, 20 bp, human
gtaacatacaatactttttt

SEQ ID NO: 327293 - DNA, 20 bp, human
gtatttcaagttacagaaaa

SEQ ID NO: 327294 - DNA, 20 bp, human
gatggcgatcattgaaagtc

SEQ ID NO: 327295 - DNA, 20 bp, human
gaaggggaaatttattttaa

SEQ ID NO: 327296 - DNA, 20 bp, human
gacatgagctgagaggatca

SEQ ID NO: 327297 - DNA, 20 bp, human
ggtgaaaaatgaatagttta

SEQ ID NO: 327298 - DNA, 20 bp, human
gtaaagatgagcctttgaac

SEQ ID NO: 327299 - DNA, 20 bp, human
gcactaatgtgctgctgact

SEQ ID NO: 327300 - DNA, 20 bp, human
gtttcttcattccagttcaa

SEQ ID NO: 327301 - DNA, 20 bp, human
ggtgtcacattggtactaac

SEQ ID NO: 327302 - DNA, 20 bp, human
gattgtaagcacaatcagat

SEQ ID NO: 327303 - DNA, 20 bp, human
gtgtaaatatgcactttgat

SEQ ID NO: 327304 - DNA, 20 bp, human
gtcacattggtactaactgg

SEQ ID NO: 327305 - DNA, 20 bp, human
gttatgaatgattacaactt

SEQ ID NO: 327306 - DNA, 20 bp, human
gcgcccatggatttatgttg

SEQ ID NO: 327307 - DNA, 20 bp, human
gaagtggcatttcccgccca

SEQ ID NO: 327308 - DNA, 20 bp, human
gaatatatcggtgtaaaaat

SEQ ID NO: 327309 - DNA, 20 bp, human
gttcctcaacataaatccat

SEQ ID NO: 327310 - DNA, 20 bp, human
gggtcttcacaacatgtttt

SEQ ID NO: 327311 - DNA, 20 bp, human
gattatactgtaaacgactg

SEQ ID NO: 327312 - DNA, 20 bp, human
gtcaaatgatgtatttatgc

SEQ ID NO: 327313 - DNA, 20 bp, human
gatgttgaggaaagttctat

SEQ ID NO: 327314 - DNA, 20 bp, human
gaaagtaatgaggtcaagaa

SEQ ID NO: 327315 - DNA, 20 bp, human
gcggcactgtactctagtcc

SEQ ID NO: 327316 - DNA, 20 bp, human
gcccaccttttgaagttata

SEQ ID NO: 327317 - DNA, 20 bp, human
gtgctagtgcttacttccat

SEQ ID NO: 327318 - DNA, 20 bp, human
ggcagagcaatggtggaatg

SEQ ID NO: 327319 - DNA, 20 bp, human
gaatgagctacttctctcta

SEQ ID NO: 327320 - DNA, 20 bp, human
gaataattgaagacatgtag

SEQ ID NO: 327321 - DNA, 20 bp, human
gtctatgggatgggagtctt

SEQ ID NO: 327322 - DNA, 20 bp, human
gtaactctagctcatgtgtc

SEQ ID NO: 327323 - DNA, 20 bp, human
gaccaaattttaacccaggt

SEQ ID NO: 327324 - DNA, 20 bp, human
gtagagttagcgctttacta

SEQ ID NO: 327325 - DNA, 20 bp, human
gaaaagagaggttaacttac

SEQ ID NO: 327326 - DNA, 20 bp, human
gctgctgtccagtacattca

SEQ ID NO: 327327 - DNA, 20 bp, human
gagcagatggatactcacac

SEQ ID NO: 327328 - DNA, 20 bp, human
gtggtgatgagccttggaaa

SEQ ID NO: 327329 - DNA, 20 bp, human
gagagttgtctcttatctat

SEQ ID NO: 327330 - DNA, 20 bp, human
gcactagacaatgtttgacc

SEQ ID NO: 327331 - DNA, 20 bp, human
gtctattggatgatctcgta

SEQ ID NO: 327332 - DNA, 20 bp, human
gctggtgcctctgacttcct

SEQ ID NO: 327333 - DNA, 20 bp, human
ggaggaatccatgaatgtac

SEQ ID NO: 327334 - DNA, 20 bp, human
ggctggatggtgatgagcct

SEQ ID NO: 327335 - DNA, 20 bp, human
gtgtttgaccaggaagaaca

SEQ ID NO: 327336 - DNA, 20 bp, human
gactaagatagtccataatc

SEQ ID NO: 327337 - DNA, 20 bp, human
gttaatccaaatgttaattc

SEQ ID NO: 327338 - DNA, 20 bp, human
gaatattgtgttcctgatta

SEQ ID NO: 327339 - DNA, 20 bp, human
gtattgcttgtatctgtagc

SEQ ID NO: 327340 - DNA, 20 bp, human
gtctcaatgaagcatataaa

SEQ ID NO: 327341 - DNA, 20 bp, human
gtacagcaaaatagagtgat

SEQ ID NO: 327342 - DNA, 20 bp, human
gaaattatttttatattttc

SEQ ID NO: 327343 - DNA, 20 bp, human
gatctaattgctttttaata

SEQ ID NO: 327344 - DNA, 20 bp, human
gattgtgaatttttataagt

SEQ ID NO: 327345 - DNA, 20 bp, human
gacatccctgaattaacatt

SEQ ID NO: 327346 - DNA, 20 bp, human
gcacagcaggctcatgatgt

SEQ ID NO: 327347 - DNA, 20 bp, human
gcctaattaacaaatataga

SEQ ID NO: 327348 - DNA, 20 bp, human
gttcagagcatcatcacagc

SEQ ID NO: 327349 - DNA, 20 bp, human
gataaaatcactggttatgg

SEQ ID NO: 327350 - DNA, 20 bp, human
gacaaatatagaaggggtga

SEQ ID NO: 327351 - DNA, 20 bp, human
gggttatggtggtgtctgac

SEQ ID NO: 327352 - DNA, 20 bp, human
gtcaataaaatcactggtta

SEQ ID NO: 327353 - DNA, 20 bp, human
gaaatgattgcaaaaactag

SEQ ID NO: 327354 - DNA, 20 bp, human
gtcatgtgtgctgatatttt

SEQ ID NO: 327355 - DNA, 20 bp, human
gtaattagggatctactgta

SEQ ID NO: 327356 - DNA, 20 bp, human
gtgtttattgatgtaagggg

SEQ ID NO: 327357 - DNA, 20 bp, human
gttgatgtaagggggggagc

SEQ ID NO: 327358 - DNA, 20 bp, human
ggagctcctaaacctatcct

SEQ ID NO: 327359 - DNA, 20 bp, human
ggtgtgatattcatttagtt

SEQ ID NO: 327360 - DNA, 20 bp, human
ggtgtgtttattgatgtaag

SEQ ID NO: 327361 - DNA, 20 bp, human
gtgtcctcagattaaatgaa

SEQ ID NO: 327362 - DNA, 20 bp, human
gtgatcttcactaaaagaag

SEQ ID NO: 327363 - DNA, 20 bp, human
gatttgaaagtgaccgaatg

SEQ ID NO: 327364 - DNA, 20 bp, human
gattcccttcatttaatctg

SEQ ID NO: 327365 - DNA, 20 bp, human
gtcttcactaaaagaagagg

SEQ ID NO: 327366 - DNA, 20 bp, human
gccaaggcgcctgtggcaag

SEQ ID NO: 327367 - DNA, 20 bp, human
gtggtggccgggtcggtgat

SEQ ID NO: 327368 - DNA, 20 bp, human
gtggccgcagcgggtcctga

SEQ ID NO: 327369 - DNA, 20 bp, human
ggcgagtgagcccagggcgc

SEQ ID NO: 327370 - DNA, 20 bp, human
ggcaacccgagacgtccttc

SEQ ID NO: 327371 - DNA, 20 bp, human
gttggggccaatcaccgacc

SEQ ID NO: 327372 - DNA, 20 bp, human
gcctgccagaaggacgtctc

SEQ ID NO: 327373 - DNA, 20 bp, human
gccggaggacgcgctccttc

SEQ ID NO: 327374 - DNA, 20 bp, human
gaagagcaataaagacaagt

SEQ ID NO: 327375 - DNA, 20 bp, human
gggccatgtgccagacatgt

SEQ ID NO: 327376 - DNA, 20 bp, human
gaggcactgtgatgtgacgt

SEQ ID NO: 327377 - DNA, 20 bp, human
gacataaagtgaggagaaca

SEQ ID NO: 327378 - DNA, 20 bp, human
ggagcactttttcaatatga

SEQ ID NO: 327379 - DNA, 20 bp, human
gtcagaccgcatttgattac

SEQ ID NO: 327380 - DNA, 20 bp, human
ggcggtctgaaaatattgca

SEQ ID NO: 327381 - DNA, 20 bp, human
gttgattacaggagaaacca

SEQ ID NO: 327382 - DNA, 20 bp, human
gtttctcctgtaatcaaatg

SEQ ID NO: 327383 - DNA, 20 bp, human
gaaagtgaggagaacaaggt

SEQ ID NO: 327384 - DNA, 20 bp, human
gtataaaaatagtttatata

SEQ ID NO: 327385 - DNA, 20 bp, human
gaagcaaaacagtgaatgag

SEQ ID NO: 327386 - DNA, 20 bp, human
gtaagaagtcagatcaaaga

SEQ ID NO: 327387 - DNA, 20 bp, human
ggtctcaagaatttactgag

SEQ ID NO: 327388 - DNA, 20 bp, human
gaatacaaattatgtcaata

SEQ ID NO: 327389 - DNA, 20 bp, human
gactttatcagaagtatgtg

SEQ ID NO: 327390 - DNA, 20 bp, human
ggaaattcgtctttatctgc

SEQ ID NO: 327391 - DNA, 20 bp, human
gaatatctggtaacaaatgt

SEQ ID NO: 327392 - DNA, 20 bp, human
gttatatctgaattagtgtc

SEQ ID NO: 327393 - DNA, 20 bp, human
gaagatttctctttcaaaat

SEQ ID NO: 327394 - DNA, 20 bp, human
gtatttctcagaaaaatatc

SEQ ID NO: 327395 - DNA, 20 bp, human
gagaaaataatagtgtatat

SEQ ID NO: 327396 - DNA, 20 bp, human
gaggcactatgatgcaacat

SEQ ID NO: 327397 - DNA, 20 bp, human
gctgcaggggttgcattcca

SEQ ID NO: 327398 - DNA, 20 bp, human
gtgcaacccctgcagataat

SEQ ID NO: 327399 - DNA, 20 bp, human
gaaatgagtacagtacaacg

SEQ ID NO: 327400 - DNA, 20 bp, human
gcagtgtcaactgcaatttc

SEQ ID NO: 327401 - DNA, 20 bp, human
gcacttcataaattatcagt

SEQ ID NO: 327402 - DNA, 20 bp, human
gtcagactgcagttgatcac

SEQ ID NO: 327403 - DNA, 20 bp, human
gcatgatgaaataaagtgaa

SEQ ID NO: 327404 - DNA, 20 bp, human
gaggcattcactggaggcct

SEQ ID NO: 327405 - DNA, 20 bp, human
gactatggaaagcaaaacag

SEQ ID NO: 327406 - DNA, 20 bp, human
gcaaaaataatagtgtattt

SEQ ID NO: 327407 - DNA, 20 bp, human
gatagtgactttctatgcat

SEQ ID NO: 327408 - DNA, 20 bp, human
gctcatcaaatgtgaaactc

SEQ ID NO: 327409 - DNA, 20 bp, human
gtctattgaagttgtaatag

SEQ ID NO: 327410 - DNA, 20 bp, human
gatgtatctgagtttgcgtc

SEQ ID NO: 327411 - DNA, 20 bp, human
ggcattccaagcccccccag

SEQ ID NO: 327412 - DNA, 20 bp, human
gtttcaaacatccactgggg

SEQ ID NO: 327413 - DNA, 20 bp, human
gaacatccactgggggggct

SEQ ID NO: 327414 - DNA, 20 bp, human
gaacttcaatagaatatgaa

SEQ ID NO: 327415 - DNA, 20 bp, human
ggtaattcgcccttatctgc

SEQ ID NO: 327416 - DNA, 20 bp, human
gtatgcttcgctctcataat

SEQ ID NO: 327417 - DNA, 20 bp, human
gacacgatttataagacact

SEQ ID NO: 327418 - DNA, 20 bp, human
gttgttctaagatttattct

SEQ ID NO: 327419 - DNA, 20 bp, human
ggaaatacttctcgtgtttt

SEQ ID NO: 327420 - DNA, 20 bp, human
gatttcagagataaattgat

SEQ ID NO: 327421 - DNA, 20 bp, human
gcttataaatcgtgtgattt

SEQ ID NO: 327422 - DNA, 20 bp, human
gcaaaaccatcttattaatt

SEQ ID NO: 327423 - DNA, 20 bp, human
ggtttaccaaattaataaga

SEQ ID NO: 327424 - DNA, 20 bp, human
gtagtaagctttgttgtata

SEQ ID NO: 327425 - DNA, 20 bp, human
gatacagattttgttaacac

SEQ ID NO: 327426 - DNA, 20 bp, human
gtggggattaccgtgtgatg

SEQ ID NO: 327427 - DNA, 20 bp, human
gaatccgtaacactgggcta

SEQ ID NO: 327428 - DNA, 20 bp, human
ggattaccgtgtgatggggg

SEQ ID NO: 327429 - DNA, 20 bp, human
gcatgcaaagactgagacac

SEQ ID NO: 327430 - DNA, 20 bp, human
gtccatttctagtactgtga

SEQ ID NO: 327431 - DNA, 20 bp, human
ggctatggaaaaaatggcct

SEQ ID NO: 327432 - DNA, 20 bp, human
gtcatgttctgataagaggg

SEQ ID NO: 327433 - DNA, 20 bp, human
gaatagtagacatttttact

SEQ ID NO: 327434 - DNA, 20 bp, human
gggggaggcagggattagag

SEQ ID NO: 327435 - DNA, 20 bp, human
gtttccatagcccagtgtta

SEQ ID NO: 327436 - DNA, 20 bp, human
gactaaaggaaggtaactga

SEQ ID NO: 327437 - DNA, 20 bp, human
gaaggaaggtaactgaaggt

SEQ ID NO: 327438 - DNA, 20 bp, human
gatactgtgacatactctac

SEQ ID NO: 327439 - DNA, 20 bp, human
gggctgcaggtaggatggta

SEQ ID NO: 327440 - DNA, 20 bp, human
gttagtcatggtaaattgtg

SEQ ID NO: 327441 - DNA, 20 bp, human
gagttaccttcctttagtca

SEQ ID NO: 327442 - DNA, 20 bp, human
gaataagcttgtaccttctt

SEQ ID NO: 327443 - DNA, 20 bp, human
gactgtacatgtgggtaagt

SEQ ID NO: 327444 - DNA, 20 bp, human
ggaaataattgtaaaagcaa

SEQ ID NO: 327445 - DNA, 20 bp, human
gaagtgtacaggtgtcccca

SEQ ID NO: 327446 - DNA, 20 bp, human
gacactcggaagagaaactt

SEQ ID NO: 327447 - DNA, 20 bp, human
gcggaagagaaacttaggac

SEQ ID NO: 327448 - DNA, 20 bp, human
gctccataattttatcagtg

SEQ ID NO: 327449 - DNA, 20 bp, human
gagtgttaacagaaactgtt

SEQ ID NO: 327450 - DNA, 20 bp, human
gtctttgttcacattatagt

SEQ ID NO: 327451 - DNA, 20 bp, human
gacttttagtttcttacttc

SEQ ID NO: 327452 - DNA, 20 bp, human
gagttgagaaaaaggacact

SEQ ID NO: 327453 - DNA, 20 bp, human
gtgattttggtaaattttgc

SEQ ID NO: 327454 - DNA, 20 bp, human
gctctaaactgtaaagtaat

SEQ ID NO: 327455 - DNA, 20 bp, human
gaatatttcagttgagaaaa

SEQ ID NO: 327456 - DNA, 20 bp, human
gaacaggcttctgatgtttt

SEQ ID NO: 327457 - DNA, 20 bp, human
gcctactatcatgtgaataa

SEQ ID NO: 327458 - DNA, 20 bp, human
ggtagtttggtgatcaatac

SEQ ID NO: 327459 - DNA, 20 bp, human
gatatctactacatgatcaa

SEQ ID NO: 327460 - DNA, 20 bp, human
gtttggtgatcaatacagga

SEQ ID NO: 327461 - DNA, 20 bp, human
gtaaattgatagagaaattc

SEQ ID NO: 327462 - DNA, 20 bp, human
gtagtattgtgttggtcaca

SEQ ID NO: 327463 - DNA, 20 bp, human
gacattttcttaactctggt

SEQ ID NO: 327464 - DNA, 20 bp, human
gaatgcttagaagaaaagtt

SEQ ID NO: 327465 - DNA, 20 bp, human
gaacatcagaagcctgttac

SEQ ID NO: 327466 - DNA, 20 bp, human
ggacggaaagagacagtagg

SEQ ID NO: 327467 - DNA, 20 bp, human
gggtgagggcctcaaatgtc

SEQ ID NO: 327468 - DNA, 20 bp, human
gttgctcagaagatttggac

SEQ ID NO: 327469 - DNA, 20 bp, human
gatgcacaaccggacatttg

SEQ ID NO: 327470 - DNA, 20 bp, human
gcatatccctggcccaagga

SEQ ID NO: 327471 - DNA, 20 bp, human
gaatgtccggttgtgcatga

SEQ ID NO: 327472 - DNA, 20 bp, human
gcaaaggtgatagaggcctg

SEQ ID NO: 327473 - DNA, 20 bp, human
gaccctctcagtgtccacaa

SEQ ID NO: 327474 - DNA, 20 bp, human
gacccagcagagcatatccc

SEQ ID NO: 327475 - DNA, 20 bp, human
gccaacttgctcagaagatt

SEQ ID NO: 327476 - DNA, 20 bp, human
gacacgcatacaccggacca

SEQ ID NO: 327477 - DNA, 20 bp, human
gtagcatggtatgcaacctt

SEQ ID NO: 327478 - DNA, 20 bp, human
gacagcagttacgcatacca

SEQ ID NO: 327479 - DNA, 20 bp, human
ggcgtaactgctgtgtagca

SEQ ID NO: 327480 - DNA, 20 bp, human
gaagggcaacagaaactcaa

SEQ ID NO: 327481 - DNA, 20 bp, human
gacccgtacttgtagctaaa

SEQ ID NO: 327482 - DNA, 20 bp, human
gagttacgcataccatggtc

SEQ ID NO: 327483 - DNA, 20 bp, human
gcagtgacttgtgacccaaa

SEQ ID NO: 327484 - DNA, 20 bp, human
gttcaaaacatctttggtgc

SEQ ID NO: 327485 - DNA, 20 bp, human
gtgtcccagacaaattataa

SEQ ID NO: 327486 - DNA, 20 bp, human
gtagctctgtaaaatcccat

SEQ ID NO: 327487 - DNA, 20 bp, human
gctgattccccatctagaat

SEQ ID NO: 327488 - DNA, 20 bp, human
ggcccaaatcccattcccat

SEQ ID NO: 327489 - DNA, 20 bp, human
gaatgggatttgggcaatac

SEQ ID NO: 327490 - DNA, 20 bp, human
gatttcattcccattctaga

SEQ ID NO: 327491 - DNA, 20 bp, human
gtagtgactatataatctat

SEQ ID NO: 327492 - DNA, 20 bp, human
gagagtcatgtctgcaaaaa

SEQ ID NO: 327493 - DNA, 20 bp, human
gttgcagacatgactcttga

SEQ ID NO: 327494 - DNA, 20 bp, human
gaagcaaacatacttttacg

SEQ ID NO: 327495 - DNA, 20 bp, human
gatttatattctcaatgaag

SEQ ID NO: 327496 - DNA, 20 bp, human
ggtagaggtgacacttctga

SEQ ID NO: 327497 - DNA, 20 bp, human
gctagaggctagagaagaac

SEQ ID NO: 327498 - DNA, 20 bp, human
ggaaggagctgttctctgac

SEQ ID NO: 327499 - DNA, 20 bp, human
gtccttctatattgcgtcta

SEQ ID NO: 327500 - DNA, 20 bp, human
gcatcatgaagcaaaaacca

SEQ ID NO: 327501 - DNA, 20 bp, human
gaccatagacgcaatataga

SEQ ID NO: 327502 - DNA, 20 bp, human
gaagggttaggataactatt

SEQ ID NO: 327503 - DNA, 20 bp, human
gtggttcatcatgctgctgg

SEQ ID NO: 327504 - DNA, 20 bp, human
gacatggatgtatcgcatag

SEQ ID NO: 327505 - DNA, 20 bp, human
gatcatgctgctggaggtta

SEQ ID NO: 327506 - DNA, 20 bp, human
gcaaagccctgactcccagt

SEQ ID NO: 327507 - DNA, 20 bp, human
ggctgtgcctactgggagtc

SEQ ID NO: 327508 - DNA, 20 bp, human
gagtttctggacatatgtac

SEQ ID NO: 327509 - DNA, 20 bp, human
gaggaaaagctgtgcctact

SEQ ID NO: 327510 - DNA, 20 bp, human
gagtgagaatacccggtgtt

SEQ ID NO: 327511 - DNA, 20 bp, human
gggacaaaaaaccaaacacc

SEQ ID NO: 327512 - DNA, 20 bp, human
gacctatgagtgagaatacc

SEQ ID NO: 327513 - DNA, 20 bp, human
ggggctttgaatcacgacct

SEQ ID NO: 327514 - DNA, 20 bp, human
ggtactggatatgttatccc

SEQ ID NO: 327515 - DNA, 20 bp, human
ggagaaagaagaggctttta

SEQ ID NO: 327516 - DNA, 20 bp, human
ggaacagctttatgaaagtc

SEQ ID NO: 327517 - DNA, 20 bp, human
gtctagataactgacttttt

SEQ ID NO: 327518 - DNA, 20 bp, human
gctgacatactattcctggt

SEQ ID NO: 327519 - DNA, 20 bp, human
gtatgtaggaagagcccacc

SEQ ID NO: 327520 - DNA, 20 bp, human
gagttctgtactctacaggc

SEQ ID NO: 327521 - DNA, 20 bp, human
gctaggcgaaatgggaaata

SEQ ID NO: 327522 - DNA, 20 bp, human
gagaaaagatcacctacttc

SEQ ID NO: 327523 - DNA, 20 bp, human
gagtcacaaatagacgtctg

SEQ ID NO: 327524 - DNA, 20 bp, human
gtcatagttctgtactctac

SEQ ID NO: 327525 - DNA, 20 bp, human
ggcttctgacatactattcc

SEQ ID NO: 327526 - DNA, 20 bp, human
gaataagatcgacttgacct

SEQ ID NO: 327527 - DNA, 20 bp, human
gtgtacaagtgtgtcaagaa

SEQ ID NO: 327528 - DNA, 20 bp, human
gtactcaacttacatgtatc

SEQ ID NO: 327529 - DNA, 20 bp, human
ggaacttagagtctagtata

SEQ ID NO: 327530 - DNA, 20 bp, human
gtgtagtcatgaacaaacca

SEQ ID NO: 327531 - DNA, 20 bp, human
ggtcaagaatggtgtaaatt

SEQ ID NO: 327532 - DNA, 20 bp, human
gctgctcaggcagttctctc

SEQ ID NO: 327533 - DNA, 20 bp, human
gcatcctcaccaatgtaagg

SEQ ID NO: 327534 - DNA, 20 bp, human
gcaccctatcctattgaatc

SEQ ID NO: 327535 - DNA, 20 bp, human
gaggagagcagtgtaggatg

SEQ ID NO: 327536 - DNA, 20 bp, human
gaggatcaggccatgctgtg

SEQ ID NO: 327537 - DNA, 20 bp, human
gcatggcctgatcctatggg

SEQ ID NO: 327538 - DNA, 20 bp, human
gcagcatggcctgatcctat

SEQ ID NO: 327539 - DNA, 20 bp, human
gggcctgatcctatgggagg

SEQ ID NO: 327540 - DNA, 20 bp, human
gttgaacctcctcctcccat

SEQ ID NO: 327541 - DNA, 20 bp, human
gaggaggaggttcaaacatc

SEQ ID NO: 327542 - DNA, 20 bp, human
gctgatcctatgggaggagg

SEQ ID NO: 327543 - DNA, 20 bp, human
ggtgctaacctgagtcccgt

SEQ ID NO: 327544 - DNA, 20 bp, human
gccccagacccacgggactc

SEQ ID NO: 327545 - DNA, 20 bp, human
gaacctgagtcccgtgggtc

SEQ ID NO: 327546 - DNA, 20 bp, human
gcttaggtcaagttgtatct

SEQ ID NO: 327547 - DNA, 20 bp, human
gtgaggaaagtggacttaaa

SEQ ID NO: 327548 - DNA, 20 bp, human
gcttaaatggagatatataa

SEQ ID NO: 327549 - DNA, 20 bp, human
gtaatggtagaagaaattta

SEQ ID NO: 327550 - DNA, 20 bp, human
gaaagttttcgtgaggaaag

SEQ ID NO: 327551 - DNA, 20 bp, human
ggaactacgaaacagatctg

SEQ ID NO: 327552 - DNA, 20 bp, human
gctacgaaacagatctgggg

SEQ ID NO: 327553 - DNA, 20 bp, human
gctaagtcaagagtgaagac

SEQ ID NO: 327554 - DNA, 20 bp, human
ggactcagtgatggaaatca

SEQ ID NO: 327555 - DNA, 20 bp, human
gagtctctaaccatcccaca

SEQ ID NO: 327556 - DNA, 20 bp, human
gccctaactcccagtgagca

SEQ ID NO: 327557 - DNA, 20 bp, human
ggtttccggacatacgtact

SEQ ID NO: 327558 - DNA, 20 bp, human
gcatacccagtacgtatgtc

SEQ ID NO: 327559 - DNA, 20 bp, human
ggccatgctcactgggagtt

SEQ ID NO: 327560 - DNA, 20 bp, human
gttcaactctcaagaattag

SEQ ID NO: 327561 - DNA, 20 bp, human
gttacacaaggaccacataa

SEQ ID NO: 327562 - DNA, 20 bp, human
gagatattattgttcttcaa

SEQ ID NO: 327563 - DNA, 20 bp, human
ggacctatcttgaatatgtt

SEQ ID NO: 327564 - DNA, 20 bp, human
gacccaaacatattcaagat

SEQ ID NO: 327565 - DNA, 20 bp, human
gctttattttaggttacaca

SEQ ID NO: 327566 - DNA, 20 bp, human
gcttaggtcaagtcgcatgt

SEQ ID NO: 327567 - DNA, 20 bp, human
gtgaggaaagtggacttaaa

SEQ ID NO: 327568 - DNA, 20 bp, human
gcttaaatggagatatataa

SEQ ID NO: 327569 - DNA, 20 bp, human
gtaatggtagaagaaattta

SEQ ID NO: 327570 - DNA, 20 bp, human
ggaactacgaaacagatctg

SEQ ID NO: 327571 - DNA, 20 bp, human
gctacgaaacagatctgggg

SEQ ID NO: 327572 - DNA, 20 bp, human
ggactcagtgatggaaatca

SEQ ID NO: 327573 - DNA, 20 bp, human
gctaagtcaagagtgaagac

SEQ ID NO: 327574 - DNA, 20 bp, human
gatggttagagactgaagta

SEQ ID NO: 327575 - DNA, 20 bp, human
ggtaacacagtgttagtgtt

SEQ ID NO: 327576 - DNA, 20 bp, human
gtctagataactgacttttt

SEQ ID NO: 327577 - DNA, 20 bp, human
gagaaaagatcacctacttc

SEQ ID NO: 327578 - DNA, 20 bp, human
gctaggcgaaatgggaaata

SEQ ID NO: 327579 - DNA, 20 bp, human
gcaggatcatttgaaatcct

SEQ ID NO: 327580 - DNA, 20 bp, human
gctgacatactattcctggt

SEQ ID NO: 327581 - DNA, 20 bp, human
gtatgtaggaagagcccacc

SEQ ID NO: 327582 - DNA, 20 bp, human
gagttctgtactctacaggc

SEQ ID NO: 327583 - DNA, 20 bp, human
gagtcacaaatagacgtctg

SEQ ID NO: 327584 - DNA, 20 bp, human
gtcatagttctgtactctac

SEQ ID NO: 327585 - DNA, 20 bp, human
gttaatgatctgtatgatat

SEQ ID NO: 327586 - DNA, 20 bp, human
gtaaccaaagaaaggcccat

SEQ ID NO: 327587 - DNA, 20 bp, human
ggcccatgggcctgtagatt

SEQ ID NO: 327588 - DNA, 20 bp, human
gaggcccatgggcctttctt

SEQ ID NO: 327589 - DNA, 20 bp, human
gcccaaatctacaggcccat

SEQ ID NO: 327590 - DNA, 20 bp, human
gaactaagaattcacaactg

SEQ ID NO: 327591 - DNA, 20 bp, human
gtcacaactgtggatcaaaa

SEQ ID NO: 327592 - DNA, 20 bp, human
gttataacagacactctcat

SEQ ID NO: 327593 - DNA, 20 bp, human
ggttgtgaattcttagttcc

SEQ ID NO: 327594 - DNA, 20 bp, human
ggtagaagggtgcaaatgtt

SEQ ID NO: 327595 - DNA, 20 bp, human
gcactattcatgtctgcata

SEQ ID NO: 327596 - DNA, 20 bp, human
gaggatcaggccatgctgtg

SEQ ID NO: 327597 - DNA, 20 bp, human
gcatggcctgatcctatggg

SEQ ID NO: 327598 - DNA, 20 bp, human
gcagcatggcctgatcctat

SEQ ID NO: 327599 - DNA, 20 bp, human
gggcctgatcctatgggagg

SEQ ID NO: 327600 - DNA, 20 bp, human
gttgaacctcctcctcccat

SEQ ID NO: 327601 - DNA, 20 bp, human
gaggaggaggttcaaacatc

SEQ ID NO: 327602 - DNA, 20 bp, human
gctgatcctatgggaggagg

SEQ ID NO: 327603 - DNA, 20 bp, human
ggtgctaacctgagtcccgt

SEQ ID NO: 327604 - DNA, 20 bp, human
gccccagacccacgggactc

SEQ ID NO: 327605 - DNA, 20 bp, human
gaactataggccagaagaat

SEQ ID NO: 327606 - DNA, 20 bp, human
gttcaacattaggaccccat

SEQ ID NO: 327607 - DNA, 20 bp, human
gaaatgaaggatcctctcta

SEQ ID NO: 327608 - DNA, 20 bp, human
gcattcatcttcatcccatg

SEQ ID NO: 327609 - DNA, 20 bp, human
ggaaaatctgggccctagag

SEQ ID NO: 327610 - DNA, 20 bp, human
gaggatccttcatttggagt

SEQ ID NO: 327611 - DNA, 20 bp, human
gtggagccaactccaaatga

SEQ ID NO: 327612 - DNA, 20 bp, human
ggcaattgatacttggctta

SEQ ID NO: 327613 - DNA, 20 bp, human
gacattatctgcctgatcat

SEQ ID NO: 327614 - DNA, 20 bp, human
gtaggccattggctcaaatt

SEQ ID NO: 327615 - DNA, 20 bp, human
ggctccatttacttaaaatg

SEQ ID NO: 327616 - DNA, 20 bp, human
gaaagcaaaaccattctgac

SEQ ID NO: 327617 - DNA, 20 bp, human
gaaaactgcctgattttggt

SEQ ID NO: 327618 - DNA, 20 bp, human
gttcataataaatgcttctc

SEQ ID NO: 327619 - DNA, 20 bp, human
gcaaatgaaagatttgacat

SEQ ID NO: 327620 - DNA, 20 bp, human
gacagagtgtttatccttta

SEQ ID NO: 327621 - DNA, 20 bp, human
gatatcacaaatccacgttc

SEQ ID NO: 327622 - DNA, 20 bp, human
gttgcaacttatccagaacg

SEQ ID NO: 327623 - DNA, 20 bp, human
gctcaaatggagtaccataa

SEQ ID NO: 327624 - DNA, 20 bp, human
gcattctcactcacttatga

SEQ ID NO: 327625 - DNA, 20 bp, human
gccttgactgtgaaggttgt

SEQ ID NO: 327626 - DNA, 20 bp, human
gatacccagagagtggacat

SEQ ID NO: 327627 - DNA, 20 bp, human
gagctggggtcacatggatt

SEQ ID NO: 327628 - DNA, 20 bp, human
ggatcctatgtccactctct

SEQ ID NO: 327629 - DNA, 20 bp, human
gcgtatgctctgagagatgc

SEQ ID NO: 327630 - DNA, 20 bp, human
gtcaggcatgaaatagacca

SEQ ID NO: 327631 - DNA, 20 bp, human
ggctgttgaactgaagaatt

SEQ ID NO: 327632 - DNA, 20 bp, human
gactcgtattcctgtgacac

SEQ ID NO: 327633 - DNA, 20 bp, human
gctgttggacaattctcttt

SEQ ID NO: 327634 - DNA, 20 bp, human
gcctcttagctggggtcaca

SEQ ID NO: 327635 - DNA, 20 bp, human
ggagaattgtccaacagtcc

SEQ ID NO: 327636 - DNA, 20 bp, human
ggggcccccaccgctgtgtt

SEQ ID NO: 327637 - DNA, 20 bp, human
gccctcctggctcctagaat

SEQ ID NO: 327638 - DNA, 20 bp, human
gccgctgtgttagggagata

SEQ ID NO: 327639 - DNA, 20 bp, human
gtctccctaacacagcggtg

SEQ ID NO: 327640 - DNA, 20 bp, human
gaagctttgggacataatag

SEQ ID NO: 327641 - DNA, 20 bp, human
gatctcaacaactgaagctt

SEQ ID NO: 327642 - DNA, 20 bp, human
gcaagactttgcctgctgaa

SEQ ID NO: 327643 - DNA, 20 bp, human
ggctgaagggggttgtccga

SEQ ID NO: 327644 - DNA, 20 bp, human
gagttcttctctttgtggta

SEQ ID NO: 327645 - DNA, 20 bp, human
gttcatgtgtcagagacctt

SEQ ID NO: 327646 - DNA, 20 bp, human
gctgggctaatggtaggatg

SEQ ID NO: 327647 - DNA, 20 bp, human
gaggaaaagatgtgataacc

SEQ ID NO: 327648 - DNA, 20 bp, human
gtttaaaagtgaactcccca

SEQ ID NO: 327649 - DNA, 20 bp, human
gataacctggaggatgaacc

SEQ ID NO: 327650 - DNA, 20 bp, human
ggagttcacttttaaacttg

SEQ ID NO: 327651 - DNA, 20 bp, human
gctagcttataaagaatcat

SEQ ID NO: 327652 - DNA, 20 bp, human
gaaaaatccaggtgaccttg

SEQ ID NO: 327653 - DNA, 20 bp, human
gcagttagcatgatgtcccc

SEQ ID NO: 327654 - DNA, 20 bp, human
ggaaagtttgaaatagatgc

SEQ ID NO: 327655 - DNA, 20 bp, human
gcccagtacttaaattttat

SEQ ID NO: 327656 - DNA, 20 bp, human
gcaactccatataactgttg

SEQ ID NO: 327657 - DNA, 20 bp, human
gagctcccaacttatagaaa

SEQ ID NO: 327658 - DNA, 20 bp, human
gttggaggcagtgctactgg

SEQ ID NO: 327659 - DNA, 20 bp, human
gactctcagctacattgccg

SEQ ID NO: 327660 - DNA, 20 bp, human
ggatttggaggcagtgctac

SEQ ID NO: 327661 - DNA, 20 bp, human
gtctagagactccagtccct

SEQ ID NO: 327662 - DNA, 20 bp, human
ggctcctgccaaaaacctca

SEQ ID NO: 327663 - DNA, 20 bp, human
ggagtctctagaaaaattcg

SEQ ID NO: 327664 - DNA, 20 bp, human
gttggcaggagcctagggac

SEQ ID NO: 327665 - DNA, 20 bp, human
gtccaaatccagtgaagtga

SEQ ID NO: 327666 - DNA, 20 bp, human
gaaagcacacatacctgctc

SEQ ID NO: 327667 - DNA, 20 bp, human
gagaaccctgctgacttctg

SEQ ID NO: 327668 - DNA, 20 bp, human
gtctgaattggtgaagggat

SEQ ID NO: 327669 - DNA, 20 bp, human
ggtatgtgtgctttctgaat

SEQ ID NO: 327670 - DNA, 20 bp, human
ggtgctttctgaattggtga

SEQ ID NO: 327671 - DNA, 20 bp, human
gttctaaggaaatttttatg

SEQ ID NO: 327672 - DNA, 20 bp, human
gttccttttcagggtgtgag

SEQ ID NO: 327673 - DNA, 20 bp, human
gttattgagataaaattata

SEQ ID NO: 327674 - DNA, 20 bp, human
gtgttttgcagtagtttcta

SEQ ID NO: 327675 - DNA, 20 bp, human
gtgtgagaggagtcctgagc

SEQ ID NO: 327676 - DNA, 20 bp, human
gtccactctgaataagagaa

SEQ ID NO: 327677 - DNA, 20 bp, human
gctaaaggactgactgacct

SEQ ID NO: 327678 - DNA, 20 bp, human
ggtgaagtcctggaacaaac

SEQ ID NO: 327679 - DNA, 20 bp, human
gaggactaggattcaaacaa

SEQ ID NO: 327680 - DNA, 20 bp, human
gacaaacaggcagcaggact

SEQ ID NO: 327681 - DNA, 20 bp, human
gtcccagcctggttaggcat

SEQ ID NO: 327682 - DNA, 20 bp, human
gttaccccccatgcctaacc

SEQ ID NO: 327683 - DNA, 20 bp, human
ggagtggaaatcactggctt

SEQ ID NO: 327684 - DNA, 20 bp, human
gcactggcttgggaatcata

SEQ ID NO: 327685 - DNA, 20 bp, human
gcctgctgcctgtttgttcc

SEQ ID NO: 327686 - DNA, 20 bp, human
ggcagtgggtagctcttcat

SEQ ID NO: 327687 - DNA, 20 bp, human
gggctgcagctagaatcagt

SEQ ID NO: 327688 - DNA, 20 bp, human
ggctagaatcagtaggctgg

SEQ ID NO: 327689 - DNA, 20 bp, human
gcttctcaagacaccatccc

SEQ ID NO: 327690 - DNA, 20 bp, human
gcatctctgaatgagacgct

SEQ ID NO: 327691 - DNA, 20 bp, human
gttagtgtctatccaaggca

SEQ ID NO: 327692 - DNA, 20 bp, human
gtgtcttgagaagagtaatg

SEQ ID NO: 327693 - DNA, 20 bp, human
gcctcaaatttttcactata

SEQ ID NO: 327694 - DNA, 20 bp, human
gatcagttagtgtctatcca

SEQ ID NO: 327695 - DNA, 20 bp, human
gttttcactatagggagcag

SEQ ID NO: 327696 - DNA, 20 bp, human
gagggccgggcaagtagaag

SEQ ID NO: 327697 - DNA, 20 bp, human
gctggggggcgggttggagg

SEQ ID NO: 327698 - DNA, 20 bp, human
gtgtacttctggtttgaaca

SEQ ID NO: 327699 - DNA, 20 bp, human
gtacttgtacagagggaacg

SEQ ID NO: 327700 - DNA, 20 bp, human
gagacccccttctacttgcc

SEQ ID NO: 327701 - DNA, 20 bp, human
gtacagagggaacgtggcag

SEQ ID NO: 327702 - DNA, 20 bp, human
gcctgcaaataaagttattc

SEQ ID NO: 327703 - DNA, 20 bp, human
gagagtaaacaagtgtagtg

SEQ ID NO: 327704 - DNA, 20 bp, human
gacaagtgtagtgtggccta

SEQ ID NO: 327705 - DNA, 20 bp, human
gtatttgcaggcgtaagcac

SEQ ID NO: 327706 - DNA, 20 bp, human
gacagctgtcctcgccacag

SEQ ID NO: 327707 - DNA, 20 bp, human
gtttcagctagcagaggatg

SEQ ID NO: 327708 - DNA, 20 bp, human
gctcgccacaggggggaaat

SEQ ID NO: 327709 - DNA, 20 bp, human
gtggaggaggtcaacgagtg

SEQ ID NO: 327710 - DNA, 20 bp, human
ggacaaggtggtggtgtcat

SEQ ID NO: 327711 - DNA, 20 bp, human
ggttacccatttcccccctg

SEQ ID NO: 327712 - DNA, 20 bp, human
gatagttctcatgttgttcc

SEQ ID NO: 327713 - DNA, 20 bp, human
gtgatccctcagagagcaat

SEQ ID NO: 327714 - DNA, 20 bp, human
gtcatcccaaactaataagc

SEQ ID NO: 327715 - DNA, 20 bp, human
ggcatttaaaaacataaccc

SEQ ID NO: 327716 - DNA, 20 bp, human
ggaggatgagagggacaagg

SEQ ID NO: 327717 - DNA, 20 bp, human
gatagttgctcttgccggaa

SEQ ID NO: 327718 - DNA, 20 bp, human
gtgtatctcgtaacttcatg

SEQ ID NO: 327719 - DNA, 20 bp, human
gagattatagttgctcttgc

SEQ ID NO: 327720 - DNA, 20 bp, human
gaatctcactatattcaaaa

SEQ ID NO: 327721 - DNA, 20 bp, human
ggaattttccccgggcgcag

SEQ ID NO: 327722 - DNA, 20 bp, human
ggcagaggatgagagggaca

SEQ ID NO: 327723 - DNA, 20 bp, human
gttgccggaagggggaaaat

SEQ ID NO: 327724 - DNA, 20 bp, human
gtgaggtgttggaggagtga

SEQ ID NO: 327725 - DNA, 20 bp, human
gttacccattttcccccttc

SEQ ID NO: 327726 - DNA, 20 bp, human
ggccctggtcagggaaaacg

SEQ ID NO: 327727 - DNA, 20 bp, human
gaatacgctatgcaggtgat

SEQ ID NO: 327728 - DNA, 20 bp, human
gctgtgtgaggccctggtca

SEQ ID NO: 327729 - DNA, 20 bp, human
gaaatgggacatggatgaag

SEQ ID NO: 327730 - DNA, 20 bp, human
gcatttttacaaatgggaca

SEQ ID NO: 327731 - DNA, 20 bp, human
gtaggagaaatacgctatgc

SEQ ID NO: 327732 - DNA, 20 bp, human
gtgctttaactgcaatgatg

SEQ ID NO: 327733 - DNA, 20 bp, human
ggaggcttcatgattttaac

SEQ ID NO: 327734 - DNA, 20 bp, human
gttggggagtggggagctag

SEQ ID NO: 327735 - DNA, 20 bp, human
gttggtgcagcaaatcagca

SEQ ID NO: 327736 - DNA, 20 bp, human
ggagggatatagaattttca

SEQ ID NO: 327737 - DNA, 20 bp, human
ggcaccccaatcagctttga

SEQ ID NO: 327738 - DNA, 20 bp, human
ggaaggcctattggacagtt

SEQ ID NO: 327739 - DNA, 20 bp, human
gcttagtgggtattctgtac

SEQ ID NO: 327740 - DNA, 20 bp, human
gctgtccatcaaagctgatt

SEQ ID NO: 327741 - DNA, 20 bp, human
gtctaactctaagtcttagt

SEQ ID NO: 327742 - DNA, 20 bp, human
ggcaactactacaaatgtga

SEQ ID NO: 327743 - DNA, 20 bp, human
gtgaaaacaaaatcttctga

SEQ ID NO: 327744 - DNA, 20 bp, human
gatatagaattttcaaggga

SEQ ID NO: 327745 - DNA, 20 bp, human
gtattgagtataaatggccg

SEQ ID NO: 327746 - DNA, 20 bp, human
ggatcgggaaaattaaaaat

SEQ ID NO: 327747 - DNA, 20 bp, human
ggggaagagctaattatgaa

SEQ ID NO: 327748 - DNA, 20 bp, human
gaggaagaaatgggttgatc

SEQ ID NO: 327749 - DNA, 20 bp, human
gatgaaaataaggaagaaat

SEQ ID NO: 327750 - DNA, 20 bp, human
gatcaattgaacatgtcagt

SEQ ID NO: 327751 - DNA, 20 bp, human
gatttaatgaaatgaaaata

SEQ ID NO: 327752 - DNA, 20 bp, human
gaaatgtaagttaccttaag

SEQ ID NO: 327753 - DNA, 20 bp, human
gtggtaaataaaataccaaa

SEQ ID NO: 327754 - DNA, 20 bp, human
gtgtcttagctgagatataa

SEQ ID NO: 327755 - DNA, 20 bp, human
gtaaaacactaaatcaaact

SEQ ID NO: 327756 - DNA, 20 bp, human
gcaccaagaataatctcttc

SEQ ID NO: 327757 - DNA, 20 bp, human
gttccagaagagattattct

SEQ ID NO: 327758 - DNA, 20 bp, human
gagtaagtttcttgagatga

SEQ ID NO: 327759 - DNA, 20 bp, human
gctgatttaaaacattttat

SEQ ID NO: 327760 - DNA, 20 bp, human
gaacatcctttgaggcatga

SEQ ID NO: 327761 - DNA, 20 bp, human
gtcattccttcatgcctcaa

SEQ ID NO: 327762 - DNA, 20 bp, human
ggactaatgaacatcctttg

SEQ ID NO: 327763 - DNA, 20 bp, human
gatgaagttctagcagtaga

SEQ ID NO: 327764 - DNA, 20 bp, human
gaccacaagtacaaacataa

SEQ ID NO: 327765 - DNA, 20 bp, human
gagggcaagatgggctcttt

SEQ ID NO: 327766 - DNA, 20 bp, human
ggggatcatagagtttttgt

SEQ ID NO: 327767 - DNA, 20 bp, human
gcctaccctatgcaagacac

SEQ ID NO: 327768 - DNA, 20 bp, human
gcttgaccagtgtcttgcat

SEQ ID NO: 327769 - DNA, 20 bp, human
gtggaataatatgacctggg

SEQ ID NO: 327770 - DNA, 20 bp, human
gctggggagtaaataaatgg

SEQ ID NO: 327771 - DNA, 20 bp, human
gtagtcaatgtttattcatt

SEQ ID NO: 327772 - DNA, 20 bp, human
gtaatatgacctgggaggct

SEQ ID NO: 327773 - DNA, 20 bp, human
gcaaaagagtcaggagcaga

SEQ ID NO: 327774 - DNA, 20 bp, human
ggagttggaataatatgacc

SEQ ID NO: 327775 - DNA, 20 bp, human
gacttagattggcatttctg

SEQ ID NO: 327776 - DNA, 20 bp, human
gattgtcaataataagccat

SEQ ID NO: 327777 - DNA, 20 bp, human
gtagaatgatctgtatattt

SEQ ID NO: 327778 - DNA, 20 bp, human
gatattataatggtactgtc

SEQ ID NO: 327779 - DNA, 20 bp, human
gaatattttgtactgtgttg

SEQ ID NO: 327780 - DNA, 20 bp, human
ggaatgtcgctctgtcctct

SEQ ID NO: 327781 - DNA, 20 bp, human
gaaagtaaacattaatttag

SEQ ID NO: 327782 - DNA, 20 bp, human
gtgaaattgcaactttccaa

SEQ ID NO: 327783 - DNA, 20 bp, human
gtatttttttctgagtgaaa

SEQ ID NO: 327784 - DNA, 20 bp, human
gaaatagattctaaatttag

SEQ ID NO: 327785 - DNA, 20 bp, human
gaaacattaatttaggggtt

SEQ ID NO: 327786 - DNA, 20 bp, human
gtctcttcccaaaactctct

SEQ ID NO: 327787 - DNA, 20 bp, human
gaattatgcaagtattccat

SEQ ID NO: 327788 - DNA, 20 bp, human
gtagttataaaattttatat

SEQ ID NO: 327789 - DNA, 20 bp, human
gtgaagattataggttttat

SEQ ID NO: 327790 - DNA, 20 bp, human
gataggttttgttttaccta

SEQ ID NO: 327791 - DNA, 20 bp, human
gatttagtattgaagattat

SEQ ID NO: 327792 - DNA, 20 bp, human
gcctattcctagagagtttt

SEQ ID NO: 327793 - DNA, 20 bp, human
gtttgaaacaactacactct

SEQ ID NO: 327794 - DNA, 20 bp, human
gagatggcagagcagtgaaa

SEQ ID NO: 327795 - DNA, 20 bp, human
gcagtgaaaaggcaaagttt

SEQ ID NO: 327796 - DNA, 20 bp, human
gtgaggatcttttctgagat

SEQ ID NO: 327797 - DNA, 20 bp, human
gtctgctaagttccattatc

SEQ ID NO: 327798 - DNA, 20 bp, human
gaggaaaaagttttgagttt

SEQ ID NO: 327799 - DNA, 20 bp, human
gtgtgggctgagatccagta

SEQ ID NO: 327800 - DNA, 20 bp, human
gggagctggaagccagataa

SEQ ID NO: 327801 - DNA, 20 bp, human
gtgtgtgttttttatgatgt

SEQ ID NO: 327802 - DNA, 20 bp, human
gctggcttccagctccttac

SEQ ID NO: 327803 - DNA, 20 bp, human
gctgagatccagtaaggagc

SEQ ID NO: 327804 - DNA, 20 bp, human
gtgggatatttctctagtga

SEQ ID NO: 327805 - DNA, 20 bp, human
gacttttgtagcacacaggc

SEQ ID NO: 327806 - DNA, 20 bp, human
gcagtctcccgattaggaat

SEQ ID NO: 327807 - DNA, 20 bp, human
gaacaagaggttcaatatgg

SEQ ID NO: 327808 - DNA, 20 bp, human
gataaagcagtctcccgatt

SEQ ID NO: 327809 - DNA, 20 bp, human
gagaaacaagaggttcaata

SEQ ID NO: 327810 - DNA, 20 bp, human
gacctctaaattttgagaga

SEQ ID NO: 327811 - DNA, 20 bp, human
gattggcatcaaatgagagc

SEQ ID NO: 327812 - DNA, 20 bp, human
gagaggttcaatatggggga

SEQ ID NO: 327813 - DNA, 20 bp, human
gactagtaaatgatcaaagc

SEQ ID NO: 327814 - DNA, 20 bp, human
gtccttctctcaaaatttag

SEQ ID NO: 327815 - DNA, 20 bp, human
gaaacagcgtatagttcaag

SEQ ID NO: 327816 - DNA, 20 bp, human
gttggaagaaagtgttgaag

SEQ ID NO: 327817 - DNA, 20 bp, human
gtacaagccttggttagctt

SEQ ID NO: 327818 - DNA, 20 bp, human
gatgatgccaaagctaacca

SEQ ID NO: 327819 - DNA, 20 bp, human
gtaagatattatctacaggg

SEQ ID NO: 327820 - DNA, 20 bp, human
gtttcttattggatacattc

SEQ ID NO: 327821 - DNA, 20 bp, human
gcttattggatacattctgg

SEQ ID NO: 327822 - DNA, 20 bp, human
gacatttaccttccttgaat

SEQ ID NO: 327823 - DNA, 20 bp, human
ggatattatctacagggtgg

SEQ ID NO: 327824 - DNA, 20 bp, human
gtgaagtggtcattaaaatt

SEQ ID NO: 327825 - DNA, 20 bp, human
ggctgtgctatgtgatgtta

SEQ ID NO: 327826 - DNA, 20 bp, human
gctgttaactttagcatcac

SEQ ID NO: 327827 - DNA, 20 bp, human
gtgtgaatagcatcatgcct

SEQ ID NO: 327828 - DNA, 20 bp, human
ggatttcaggagatttcagg

SEQ ID NO: 327829 - DNA, 20 bp, human
gatataaaacaaactaaagc

SEQ ID NO: 327830 - DNA, 20 bp, human
ggaattaaactttcttcttg

SEQ ID NO: 327831 - DNA, 20 bp, human
gagtagagaagtagagaatt

SEQ ID NO: 327832 - DNA, 20 bp, human
ggaaagtttaattcaaagta

SEQ ID NO: 327833 - DNA, 20 bp, human
gggttggttacactttttgt

SEQ ID NO: 327834 - DNA, 20 bp, human
gtatcaatttgtattagcat

SEQ ID NO: 327835 - DNA, 20 bp, human
gagaattttggaacagaaga

SEQ ID NO: 327836 - DNA, 20 bp, human
gcaacactgcaaaacagcag

SEQ ID NO: 327837 - DNA, 20 bp, human
gagctggcttagaattagta

SEQ ID NO: 327838 - DNA, 20 bp, human
gatagatcacagaacgtagc

SEQ ID NO: 327839 - DNA, 20 bp, human
gagtatctaatacacatact

SEQ ID NO: 327840 - DNA, 20 bp, human
gtccatcacccccaaaaacc

SEQ ID NO: 327841 - DNA, 20 bp, human
gtcctggtttttgggggtga

SEQ ID NO: 327842 - DNA, 20 bp, human
gtcttgttttattgtagtac

SEQ ID NO: 327843 - DNA, 20 bp, human
gattatactttctcttgtta

SEQ ID NO: 327844 - DNA, 20 bp, human
gtctttagtcctggtttttg

SEQ ID NO: 327845 - DNA, 20 bp, human
gtagagccagaaagggagtt

SEQ ID NO: 327846 - DNA, 20 bp, human
gtgtgtatactcaatcatct

SEQ ID NO: 327847 - DNA, 20 bp, human
gaggttactgtcaatatgag

SEQ ID NO: 327848 - DNA, 20 bp, human
gtacaaagacttgtactagt

SEQ ID NO: 327849 - DNA, 20 bp, human
gtacaagtctttgtatgtct

SEQ ID NO: 327850 - DNA, 20 bp, human
gggctgaggttctgcaaagc

SEQ ID NO: 327851 - DNA, 20 bp, human
gagattgacaatgaatttaa

SEQ ID NO: 327852 - DNA, 20 bp, human
gtgtatgtcttggatgaagt

SEQ ID NO: 327853 - DNA, 20 bp, human
gtaaactgtaaattcctata

SEQ ID NO: 327854 - DNA, 20 bp, human
gtcttggatgaagtgggctg

SEQ ID NO: 327855 - DNA, 20 bp, human
gatctcaagaaaaaccttat

SEQ ID NO: 327856 - DNA, 20 bp, human
ggtaagaataaattgggcac

SEQ ID NO: 327857 - DNA, 20 bp, human
gatcgagaatttcctctcac

SEQ ID NO: 327858 - DNA, 20 bp, human
gagtcctggtaagaataaat

SEQ ID NO: 327859 - DNA, 20 bp, human
ggaagaaaggtatgactcac

SEQ ID NO: 327860 - DNA, 20 bp, human
gtagtcagacacttaggcac

SEQ ID NO: 327861 - DNA, 20 bp, human
gcgatcctagtcagacactt

SEQ ID NO: 327862 - DNA, 20 bp, human
gtctacatcctttgaattcc

SEQ ID NO: 327863 - DNA, 20 bp, human
gtgtggatacttctttgtcc

SEQ ID NO: 327864 - DNA, 20 bp, human
gaattcaaaggatgtagaca

SEQ ID NO: 327865 - DNA, 20 bp, human
gtgaattcctggtctgagca

SEQ ID NO: 327866 - DNA, 20 bp, human
gaggaaagccctccacgggg

SEQ ID NO: 327867 - DNA, 20 bp, human
gggaacttcctccccgtgga

SEQ ID NO: 327868 - DNA, 20 bp, human
gatactgtagggcgtggtca

SEQ ID NO: 327869 - DNA, 20 bp, human
gagcttaggaaagccctcca

SEQ ID NO: 327870 - DNA, 20 bp, human
gatatggaacttcctccccg

SEQ ID NO: 327871 - DNA, 20 bp, human
gtgaggacagcatggccgaa

SEQ ID NO: 327872 - DNA, 20 bp, human
gtcaatccgagatgtagctt

SEQ ID NO: 327873 - DNA, 20 bp, human
ggacatgaaacctgtggttg

SEQ ID NO: 327874 - DNA, 20 bp, human
gggttcacaaggcactatgt

SEQ ID NO: 327875 - DNA, 20 bp, human
gtgtaatatactgtagggcg

SEQ ID NO: 327876 - DNA, 20 bp, human
gttctcctatagaactactt

SEQ ID NO: 327877 - DNA, 20 bp, human
ggcaaaaactacaaccgcat

SEQ ID NO: 327878 - DNA, 20 bp, human
gtttcccaaagtagttctat

SEQ ID NO: 327879 - DNA, 20 bp, human
gcttaaagcagaataaaggg

SEQ ID NO: 327880 - DNA, 20 bp, human
gagtgcagaaacttcccatg

SEQ ID NO: 327881 - DNA, 20 bp, human
gtacaggaatacattttgat

SEQ ID NO: 327882 - DNA, 20 bp, human
gctttggaggtcaaaagttc

SEQ ID NO: 327883 - DNA, 20 bp, human
gtgtggctgctcctggttta

SEQ ID NO: 327884 - DNA, 20 bp, human
gcttgtcacttatactgctt

SEQ ID NO: 327885 - DNA, 20 bp, human
gtttcagatttcagttagtc

SEQ ID NO: 327886 - DNA, 20 bp, human
gaaagagactattgtggcat

SEQ ID NO: 327887 - DNA, 20 bp, human
ggcatgggaaatataaaaat

SEQ ID NO: 327888 - DNA, 20 bp, human
gctgcaaagaggccccccac

SEQ ID NO: 327889 - DNA, 20 bp, human
gtaaatggagcatccagtct

SEQ ID NO: 327890 - DNA, 20 bp, human
gcttaacagattcaagtatt

SEQ ID NO: 327891 - DNA, 20 bp, human
gtattcaagataaacagagg

SEQ ID NO: 327892 - DNA, 20 bp, human
gtacaattcaatccagtggg

SEQ ID NO: 327893 - DNA, 20 bp, human
gccatacaattcaatccagt

SEQ ID NO: 327894 - DNA, 20 bp, human
gagaacaccttgagtttcac

SEQ ID NO: 327895 - DNA, 20 bp, human
gttagtttgttgtgagaata

SEQ ID NO: 327896 - DNA, 20 bp, human
gtctctggatcgtttacaag

SEQ ID NO: 327897 - DNA, 20 bp, human
gggctcagaaccaaggtttt

SEQ ID NO: 327898 - DNA, 20 bp, human
gctaggtgctgtcttgtctc

SEQ ID NO: 327899 - DNA, 20 bp, human
ggagcccctgagccctgaaa

SEQ ID NO: 327900 - DNA, 20 bp, human
gaagacagcacctagtataa

SEQ ID NO: 327901 - DNA, 20 bp, human
ggctcaggggctcagaacca

SEQ ID NO: 327902 - DNA, 20 bp, human
gcaaagattcatatagtggt

SEQ ID NO: 327903 - DNA, 20 bp, human
gtggatggcgttaagatttc

SEQ ID NO: 327904 - DNA, 20 bp, human
gggcaggttgtatatacttc

SEQ ID NO: 327905 - DNA, 20 bp, human
gcataaggatgctcatcata

SEQ ID NO: 327906 - DNA, 20 bp, human
gctccaaaggcataaaactc

SEQ ID NO: 327907 - DNA, 20 bp, human
gtgccattttcaatttttga

SEQ ID NO: 327908 - DNA, 20 bp, human
ggaagcttcgtctaaatgtc

SEQ ID NO: 327909 - DNA, 20 bp, human
gagcatagacaagggaagcg

SEQ ID NO: 327910 - DNA, 20 bp, human
gatgttgtaagtggttctgc

SEQ ID NO: 327911 - DNA, 20 bp, human
gtggcatgcagggatgcatc

SEQ ID NO: 327912 - DNA, 20 bp, human
ggcaactgaatatttattca

SEQ ID NO: 327913 - DNA, 20 bp, human
gtctaaatgtctggcatgca

SEQ ID NO: 327914 - DNA, 20 bp, human
gtgtttacacaactagttac

SEQ ID NO: 327915 - DNA, 20 bp, human
gataaggagaatgttgtaag

SEQ ID NO: 327916 - DNA, 20 bp, human
gcactctgaccagagagaga

SEQ ID NO: 327917 - DNA, 20 bp, human
gtgaggatacagacatgtga

SEQ ID NO: 327918 - DNA, 20 bp, human
gatgactacacagaaaaact

SEQ ID NO: 327919 - DNA, 20 bp, human
ggtaaataccttgggttaac

SEQ ID NO: 327920 - DNA, 20 bp, human
gctgtgtagtcatgatgacc

SEQ ID NO: 327921 - DNA, 20 bp, human
gttcttattgtaaatacctt

SEQ ID NO: 327922 - DNA, 20 bp, human
gtagtccatccatctctctc

SEQ ID NO: 327923 - DNA, 20 bp, human
gtttgcctatgctttaccaa

SEQ ID NO: 327924 - DNA, 20 bp, human
gtatctccattttatatacg

SEQ ID NO: 327925 - DNA, 20 bp, human
ggaggagcctaaccaacatt

SEQ ID NO: 327926 - DNA, 20 bp, human
gcaagtcagtatgccaccac

SEQ ID NO: 327927 - DNA, 20 bp, human
gcagacacagtgagtgcata

SEQ ID NO: 327928 - DNA, 20 bp, human
ggtaatctttcatccagtgg

SEQ ID NO: 327929 - DNA, 20 bp, human
ggatgactgaatcaaaaacc

SEQ ID NO: 327930 - DNA, 20 bp, human
ggatttggctcagaattagg

SEQ ID NO: 327931 - DNA, 20 bp, human
gtgggtaatctttcatccag

SEQ ID NO: 327932 - DNA, 20 bp, human
ggtgagagaactttgtctcc

SEQ ID NO: 327933 - DNA, 20 bp, human
gtgtcttttcacttaagatt

SEQ ID NO: 327934 - DNA, 20 bp, human
gggatgacccaacctcaaaa

SEQ ID NO: 327935 - DNA, 20 bp, human
gaaagacaacactagatttt

SEQ ID NO: 327936 - DNA, 20 bp, human
gatggctcctggtaagtagt

SEQ ID NO: 327937 - DNA, 20 bp, human
gttggaaggtaagtaggtgg

SEQ ID NO: 327938 - DNA, 20 bp, human
gagtatacccactacttacc

SEQ ID NO: 327939 - DNA, 20 bp, human
gggacagtgacttgcttggt

SEQ ID NO: 327940 - DNA, 20 bp, human
gcaattgattcatgtgccat

SEQ ID NO: 327941 - DNA, 20 bp, human
gtggaggacagtgacttgct

SEQ ID NO: 327942 - DNA, 20 bp, human
ggtcggagagaagaattaat

SEQ ID NO: 327943 - DNA, 20 bp, human
ggccaaataactaatgtgta

SEQ ID NO: 327944 - DNA, 20 bp, human
gcatttatttattcttgtaa

SEQ ID NO: 327945 - DNA, 20 bp, human
gaccttacacattagttatt

SEQ ID NO: 327946 - DNA, 20 bp, human
gcctggacttccacttagag

SEQ ID NO: 327947 - DNA, 20 bp, human
gtccagggtgcatgtgatga

SEQ ID NO: 327948 - DNA, 20 bp, human
gtccacttagaggggtcagc

SEQ ID NO: 327949 - DNA, 20 bp, human
ggggtcagctggctgctatt

SEQ ID NO: 327950 - DNA, 20 bp, human
ggccagctgacccctctaag

SEQ ID NO: 327951 - DNA, 20 bp, human
gcagaggagagctaggtcta

SEQ ID NO: 327952 - DNA, 20 bp, human
ggcatgtgatgagggttatt

SEQ ID NO: 327953 - DNA, 20 bp, human
gtggctgctatttggcatta

SEQ ID NO: 327954 - DNA, 20 bp, human
gcacccaaatagaacatcct

SEQ ID NO: 327955 - DNA, 20 bp, human
gcttcccaggatgttctatt

SEQ ID NO: 327956 - DNA, 20 bp, human
gaacagaggataaaagaata

SEQ ID NO: 327957 - DNA, 20 bp, human
gaatacttaaaaattaacag

SEQ ID NO: 327958 - DNA, 20 bp, human
gttatctcgcactacttccc

SEQ ID NO: 327959 - DNA, 20 bp, human
ggaattataaggcatagcca

SEQ ID NO: 327960 - DNA, 20 bp, human
gttatggcatagacttaatc

SEQ ID NO: 327961 - DNA, 20 bp, human
gagcagaatgatataaaatg

SEQ ID NO: 327962 - DNA, 20 bp, human
gggaataaacctaacattaa

SEQ ID NO: 327963 - DNA, 20 bp, human
gccgagataactgaattata

SEQ ID NO: 327964 - DNA, 20 bp, human
gcttgaagaagagaaggaga

SEQ ID NO: 327965 - DNA, 20 bp, human
gcagtgtctccattaatgtt

SEQ ID NO: 327966 - DNA, 20 bp, human
gtcctcctcctcactcttct

SEQ ID NO: 327967 - DNA, 20 bp, human
gttagcccagaagagtgagg

SEQ ID NO: 327968 - DNA, 20 bp, human
gaaaatgaaaggattctgta

SEQ ID NO: 327969 - DNA, 20 bp, human
gcacctaccttcttcataac

SEQ ID NO: 327970 - DNA, 20 bp, human
gccagaaggtaaacacaaaa

SEQ ID NO: 327971 - DNA, 20 bp, human
gtctcttccagttatgaaga

SEQ ID NO: 327972 - DNA, 20 bp, human
gttccagttatgaagaaggt

SEQ ID NO: 327973 - DNA, 20 bp, human
gatgagatggttctattagt

SEQ ID NO: 327974 - DNA, 20 bp, human
gagcataatacttataacaa

SEQ ID NO: 327975 - DNA, 20 bp, human
ggctattcccagatctcttc

SEQ ID NO: 327976 - DNA, 20 bp, human
gaacagaggataaaagaata

SEQ ID NO: 327977 - DNA, 20 bp, human
gaatacttaaaaattaacag

SEQ ID NO: 327978 - DNA, 20 bp, human
gagtgaagtgagaaaaagtg

SEQ ID NO: 327979 - DNA, 20 bp, human
gttatggcatagacttaatc

SEQ ID NO: 327980 - DNA, 20 bp, human
ggaattataaggcatagcca

SEQ ID NO: 327981 - DNA, 20 bp, human
gctgagataactgaattata

SEQ ID NO: 327982 - DNA, 20 bp, human
gagcagaatgatataaaatg

SEQ ID NO: 327983 - DNA, 20 bp, human
ggagagacaagcataaataa

SEQ ID NO: 327984 - DNA, 20 bp, human
gaataatggtattttatatt

SEQ ID NO: 327985 - DNA, 20 bp, human
gggaataaacctaacattaa

SEQ ID NO: 327986 - DNA, 20 bp, human
gaacagaggataaaagaata

SEQ ID NO: 327987 - DNA, 20 bp, human
gaatacttaaaaattaacag

SEQ ID NO: 327988 - DNA, 20 bp, human
gctatctcgcactacttccc

SEQ ID NO: 327989 - DNA, 20 bp, human
gccgagataactgaattata

SEQ ID NO: 327990 - DNA, 20 bp, human
ggaattataaggcatagcca

SEQ ID NO: 327991 - DNA, 20 bp, human
gttatggcatagacttaatc

SEQ ID NO: 327992 - DNA, 20 bp, human
gagcagaatgatataaaatg

SEQ ID NO: 327993 - DNA, 20 bp, human
gcagtgtctccattaatgtt

SEQ ID NO: 327994 - DNA, 20 bp, human
gcttgaagaagagaaggaga

SEQ ID NO: 327995 - DNA, 20 bp, human
gaactgcagaggctatttcc

SEQ ID NO: 327996 - DNA, 20 bp, human
ggtaggctgagtgaagaatg

SEQ ID NO: 327997 - DNA, 20 bp, human
gtgactgaaattgtctctaa

SEQ ID NO: 327998 - DNA, 20 bp, human
ggaaaggaattagacagagt

SEQ ID NO: 327999 - DNA, 20 bp, human
gaaaggtaagggtatcaaag

SEQ ID NO: 328000 - DNA, 20 bp, human
gggacaaaaagcattgatgt

SEQ ID NO: 328001 - DNA, 20 bp, human
ggtgacaaaatttacaatag

SEQ ID NO: 328002 - DNA, 20 bp, human
gttctgtgcaacgtattttc

SEQ ID NO: 328003 - DNA, 20 bp, human
gagtataaaggtttttggtt

SEQ ID NO: 328004 - DNA, 20 bp, human
gactcctttacttacttgaa

SEQ ID NO: 328005 - DNA, 20 bp, human
ggttgtcagaaaactagaca

SEQ ID NO: 328006 - DNA, 20 bp, human
gttgaaagagtgtgaaaaag

SEQ ID NO: 328007 - DNA, 20 bp, human
gcaggaaactgttagttgag

SEQ ID NO: 328008 - DNA, 20 bp, human
gaaaacttatcttaccactt

SEQ ID NO: 328009 - DNA, 20 bp, human
gaagacttttccttcacttt

SEQ ID NO: 328010 - DNA, 20 bp, human
ggttagttgagtggcctggc

SEQ ID NO: 328011 - DNA, 20 bp, human
ggttttttctaattatgaca

SEQ ID NO: 328012 - DNA, 20 bp, human
gtaaaaattaaattaacgaa

SEQ ID NO: 328013 - DNA, 20 bp, human
gataaagatgtacttcattc

SEQ ID NO: 328014 - DNA, 20 bp, human
gaactgttagttgagtggcc

SEQ ID NO: 328015 - DNA, 20 bp, human
gatttgctagccaaaagtga

SEQ ID NO: 328016 - DNA, 20 bp, human
gactatttgggatacttctc

SEQ ID NO: 328017 - DNA, 20 bp, human
gacaaggacccttacttttg

SEQ ID NO: 328018 - DNA, 20 bp, human
gttacccaggtgtcctgtag

SEQ ID NO: 328019 - DNA, 20 bp, human
gagaatcagaagacctctac

SEQ ID NO: 328020 - DNA, 20 bp, human
gtaagtgagaataaggggta

SEQ ID NO: 328021 - DNA, 20 bp, human
gaagacctctacaggacacc

SEQ ID NO: 328022 - DNA, 20 bp, human
gacaaaattccacaaaagta

SEQ ID NO: 328023 - DNA, 20 bp, human
gcaaggcacttgaacttaca

SEQ ID NO: 328024 - DNA, 20 bp, human
gctgaattctactgactatt

SEQ ID NO: 328025 - DNA, 20 bp, human
gcagtcagtgattttactaa

SEQ ID NO: 328026 - DNA, 20 bp, human
gaaaatgcctgtcaactgcc

SEQ ID NO: 328027 - DNA, 20 bp, human
gcatttgcagcaacacctca

SEQ ID NO: 328028 - DNA, 20 bp, human
gtgaaaatcactaagagagt

SEQ ID NO: 328029 - DNA, 20 bp, human
gttcatatatgtaaacattg

SEQ ID NO: 328030 - DNA, 20 bp, human
gcatgtgccaggcagttgac

SEQ ID NO: 328031 - DNA, 20 bp, human
gacttaatacaatgtccttg

SEQ ID NO: 328032 - DNA, 20 bp, human
gttgatcactttcatgtgcc

SEQ ID NO: 328033 - DNA, 20 bp, human
gaatgatgtcacttaatatg

SEQ ID NO: 328034 - DNA, 20 bp, human
gaaagtttcaattagacaga

SEQ ID NO: 328035 - DNA, 20 bp, human
ggctgggaaggagaagggtg

SEQ ID NO: 328036 - DNA, 20 bp, human
ggaagattgcgttaaagggg

SEQ ID NO: 328037 - DNA, 20 bp, human
gtatggaagattgcgttaaa

SEQ ID NO: 328038 - DNA, 20 bp, human
gaaatcagtctaaaaatcta

SEQ ID NO: 328039 - DNA, 20 bp, human
gtgacttaaaaagttagata

SEQ ID NO: 328040 - DNA, 20 bp, human
ggttcaaaaatggcaaacta

SEQ ID NO: 328041 - DNA, 20 bp, human
gcttaaggataactgctagg

SEQ ID NO: 328042 - DNA, 20 bp, human
ggtaatattctttcttgatg

SEQ ID NO: 328043 - DNA, 20 bp, human
gatgtggttgatagttacat

SEQ ID NO: 328044 - DNA, 20 bp, human
gcatttactttagaaaaaat

SEQ ID NO: 328045 - DNA, 20 bp, human
gttaaaggggagggttgtca

SEQ ID NO: 328046 - DNA, 20 bp, human
gcatataagtgtatcttcat

SEQ ID NO: 328047 - DNA, 20 bp, human
gagagcttgtggtttgcttc

SEQ ID NO: 328048 - DNA, 20 bp, human
gagcccactggtggaagata

SEQ ID NO: 328049 - DNA, 20 bp, human
gggaaaccaacagcatcaat

SEQ ID NO: 328050 - DNA, 20 bp, human
gccactggtggaagataagg

SEQ ID NO: 328051 - DNA, 20 bp, human
gcaggaaatctgtgactttc

SEQ ID NO: 328052 - DNA, 20 bp, human
gtggtttagtctgaattcct

SEQ ID NO: 328053 - DNA, 20 bp, human
gaatttcttaaggtcattat

SEQ ID NO: 328054 - DNA, 20 bp, human
ggtcacagatttcctgaaga

SEQ ID NO: 328055 - DNA, 20 bp, human
gctagataagtgagttagcg

SEQ ID NO: 328056 - DNA, 20 bp, human
gtttcaatacctatgattta

SEQ ID NO: 328057 - DNA, 20 bp, human
gtctttccatccttctcatt

SEQ ID NO: 328058 - DNA, 20 bp, human
gcaaacaggaaactttatct

SEQ ID NO: 328059 - DNA, 20 bp, human
gcattatagtgaagtttcga

SEQ ID NO: 328060 - DNA, 20 bp, human
gagaatgatattatcttggt

SEQ ID NO: 328061 - DNA, 20 bp, human
gtactttaacagttcatctc

SEQ ID NO: 328062 - DNA, 20 bp, human
gatttctgaaagtagataat

SEQ ID NO: 328063 - DNA, 20 bp, human
gatcagtaaggatatcttta

SEQ ID NO: 328064 - DNA, 20 bp, human
gacatacatgtttagtcatt

SEQ ID NO: 328065 - DNA, 20 bp, human
gaatagatggacaaataggt

SEQ ID NO: 328066 - DNA, 20 bp, human
gccagctccacaagcctcat

SEQ ID NO: 328067 - DNA, 20 bp, human
gggactatccaaaaactcaa

SEQ ID NO: 328068 - DNA, 20 bp, human
gcataatagtatgtctggat

SEQ ID NO: 328069 - DNA, 20 bp, human
gaatagtatgtctggatagg

SEQ ID NO: 328070 - DNA, 20 bp, human
gtcctactgtataaaagaca

SEQ ID NO: 328071 - DNA, 20 bp, human
ggaggccataatagtatgtc

SEQ ID NO: 328072 - DNA, 20 bp, human
ggtaggaaatgagcttaccc

SEQ ID NO: 328073 - DNA, 20 bp, human
ggcttgtggagctggactct

SEQ ID NO: 328074 - DNA, 20 bp, human
gctcatgacaacaagactag

SEQ ID NO: 328075 - DNA, 20 bp, human
gtgaattaagaatactttta

SEQ ID NO: 328076 - DNA, 20 bp, human
gacataatctcaagaagtgc

SEQ ID NO: 328077 - DNA, 20 bp, human
gtatgttatcccaatatata

SEQ ID NO: 328078 - DNA, 20 bp, human
gaaaatcatactcttatcaa

SEQ ID NO: 328079 - DNA, 20 bp, human
gaatagaaataagaaaatat

SEQ ID NO: 328080 - DNA, 20 bp, human
gcttgtattccttatatatt

SEQ ID NO: 328081 - DNA, 20 bp, human
gttttcttatttctattagt

SEQ ID NO: 328082 - DNA, 20 bp, human
gagaatactataataataaa

SEQ ID NO: 328083 - DNA, 20 bp, human
gtctctgaagtaatttatga

SEQ ID NO: 328084 - DNA, 20 bp, human
gtggaataaacaatagaaaa

SEQ ID NO: 328085 - DNA, 20 bp, human
gatttatgaaggtttttcta

SEQ ID NO: 328086 - DNA, 20 bp, human
gatgtgatgaacttataaat

SEQ ID NO: 328087 - DNA, 20 bp, human
gaccaaggattaagctatac

SEQ ID NO: 328088 - DNA, 20 bp, human
gcaggttttggttacgctta

SEQ ID NO: 328089 - DNA, 20 bp, human
gttgcaaaatcatgccaacc

SEQ ID NO: 328090 - DNA, 20 bp, human
gcatagctgtatgttgtggc

SEQ ID NO: 328091 - DNA, 20 bp, human
gtagcttaatccttggtaac

SEQ ID NO: 328092 - DNA, 20 bp, human
gcttgcatagctgtatgttg

SEQ ID NO: 328093 - DNA, 20 bp, human
gacctgtatagcttaatcct

SEQ ID NO: 328094 - DNA, 20 bp, human
ggattaagctatacaggttt

SEQ ID NO: 328095 - DNA, 20 bp, human
gggctggttacctgttacca

SEQ ID NO: 328096 - DNA, 20 bp, human
gaccaaggattaagctgtac

SEQ ID NO: 328097 - DNA, 20 bp, human
gttgggaaatcttgccaact

SEQ ID NO: 328098 - DNA, 20 bp, human
gcaggttttggttacagtta

SEQ ID NO: 328099 - DNA, 20 bp, human
gcatagctgtatgttgtggc

SEQ ID NO: 328100 - DNA, 20 bp, human
gcagcttaatccttggtaac

SEQ ID NO: 328101 - DNA, 20 bp, human
gatgtgatgaagttacaaat

SEQ ID NO: 328102 - DNA, 20 bp, human
gtcacatactctctccctct

SEQ ID NO: 328103 - DNA, 20 bp, human
ggattaagctgtacaggttt

SEQ ID NO: 328104 - DNA, 20 bp, human
gcttgcatagctgtatgttg

SEQ ID NO: 328105 - DNA, 20 bp, human
gttatatctgataaaccaag

SEQ ID NO: 328106 - DNA, 20 bp, human
gggaattacacaggaattga

SEQ ID NO: 328107 - DNA, 20 bp, human
gaatgtctaggaaaattttg

SEQ ID NO: 328108 - DNA, 20 bp, human
gttccatgatttaagaatgt

SEQ ID NO: 328109 - DNA, 20 bp, human
gttcctacattcttaaatca

SEQ ID NO: 328110 - DNA, 20 bp, human
ggatgataagacagagggta

SEQ ID NO: 328111 - DNA, 20 bp, human
gtaggaactgggaattacac

SEQ ID NO: 328112 - DNA, 20 bp, human
ggtctaggaaaattttgggg

SEQ ID NO: 328113 - DNA, 20 bp, human
ggagggttagctcttttctt

SEQ ID NO: 328114 - DNA, 20 bp, human
ggtaattcccagttcctagc

SEQ ID NO: 328115 - DNA, 20 bp, human
gagagttaccagctaggaac

SEQ ID NO: 328116 - DNA, 20 bp, human
gatgaagtcctcaataactg

SEQ ID NO: 328117 - DNA, 20 bp, human
gcatatgcctcatacaaatc

SEQ ID NO: 328118 - DNA, 20 bp, human
ggaacatcaaccaaatgaac

SEQ ID NO: 328119 - DNA, 20 bp, human
gtgttcactcatgtgagact

SEQ ID NO: 328120 - DNA, 20 bp, human
ggagaaaagggaattatttc

SEQ ID NO: 328121 - DNA, 20 bp, human
gacagtagaagtgatttctt

SEQ ID NO: 328122 - DNA, 20 bp, human
gttatttagaccagttcatt

SEQ ID NO: 328123 - DNA, 20 bp, human
gtatctaaaaacttttataa

SEQ ID NO: 328124 - DNA, 20 bp, human
gtgatgttctatagagaaaa

SEQ ID NO: 328125 - DNA, 20 bp, human
gttttagataaacattccta

SEQ ID NO: 328126 - DNA, 20 bp, human
gtagaagcctgaggttaaat

SEQ ID NO: 328127 - DNA, 20 bp, human
gcataagttgtcttcagcta

SEQ ID NO: 328128 - DNA, 20 bp, human
gagaatagaagggttaactc

SEQ ID NO: 328129 - DNA, 20 bp, human
gcagctacggaacattggtt

SEQ ID NO: 328130 - DNA, 20 bp, human
ggacaaataatgttcttatc

SEQ ID NO: 328131 - DNA, 20 bp, human
ggtcttcagctacggaacat

SEQ ID NO: 328132 - DNA, 20 bp, human
gaagtagcctggaatcctac

SEQ ID NO: 328133 - DNA, 20 bp, human
gtaggtaacttcactcctgt

SEQ ID NO: 328134 - DNA, 20 bp, human
gtattctgtgacaggaagaa

SEQ ID NO: 328135 - DNA, 20 bp, human
gaacgtattttattttagtg

SEQ ID NO: 328136 - DNA, 20 bp, human
gggttcagagagtaaatatc

SEQ ID NO: 328137 - DNA, 20 bp, human
ggatcaatccctgccctagt

SEQ ID NO: 328138 - DNA, 20 bp, human
gcagtgtgctagagagctaa

SEQ ID NO: 328139 - DNA, 20 bp, human
gttgctaatgcttagtgcta

SEQ ID NO: 328140 - DNA, 20 bp, human
gatctggtattcaattaaaa

SEQ ID NO: 328141 - DNA, 20 bp, human
gattcatacctactagggca

SEQ ID NO: 328142 - DNA, 20 bp, human
gctaaaaccaacgttgtagg

SEQ ID NO: 328143 - DNA, 20 bp, human
gatattaaaattctatcata

SEQ ID NO: 328144 - DNA, 20 bp, human
gaaactaaaaccaacgttgt

SEQ ID NO: 328145 - DNA, 20 bp, human
gtgggattcaaaatttatta

SEQ ID NO: 328146 - DNA, 20 bp, human
gctagctccaccattatcaa

SEQ ID NO: 328147 - DNA, 20 bp, human
ggagagtactccattgataa

SEQ ID NO: 328148 - DNA, 20 bp, human
gacacaatgacgtggacatt

SEQ ID NO: 328149 - DNA, 20 bp, human
gagtactccattgataatgg

SEQ ID NO: 328150 - DNA, 20 bp, human
gagaaagaaacacaatgacg

SEQ ID NO: 328151 - DNA, 20 bp, human
gctcttatattgatagaatg

SEQ ID NO: 328152 - DNA, 20 bp, human
gtattttagcaagttttatc

SEQ ID NO: 328153 - DNA, 20 bp, human
gagagatttagtttttttta

SEQ ID NO: 328154 - DNA, 20 bp, human
gtgcaatttaaaagcactac

SEQ ID NO: 328155 - DNA, 20 bp, human
gaagttttatcgggtaatat

SEQ ID NO: 328156 - DNA, 20 bp, human
gaaccctcgcagacctattt

SEQ ID NO: 328157 - DNA, 20 bp, human
gtaggtctgcgagggttcaa

SEQ ID NO: 328158 - DNA, 20 bp, human
gaaccaaaataggtctgcga

SEQ ID NO: 328159 - DNA, 20 bp, human
ggagatgccaggagatggtt

SEQ ID NO: 328160 - DNA, 20 bp, human
ggagatggttaggaacaaac

SEQ ID NO: 328161 - DNA, 20 bp, human
gggttaggaacaaacaggaa

SEQ ID NO: 328162 - DNA, 20 bp, human
gactagaaatccttcgtgtg

SEQ ID NO: 328163 - DNA, 20 bp, human
gggagaatagccgcacacga

SEQ ID NO: 328164 - DNA, 20 bp, human
ggcagacctattttggtttg

SEQ ID NO: 328165 - DNA, 20 bp, human
gctttcttactccataatct

SEQ ID NO: 328166 - DNA, 20 bp, human
gaatcacagtagatcaaaag

SEQ ID NO: 328167 - DNA, 20 bp, human
ggatcacattcgttcacttc

SEQ ID NO: 328168 - DNA, 20 bp, human
gcgaatgtgatcttatcttg

SEQ ID NO: 328169 - DNA, 20 bp, human
gatctactgtgattttccgt

SEQ ID NO: 328170 - DNA, 20 bp, human
ggtgagttgatgtgataatc

SEQ ID NO: 328171 - DNA, 20 bp, human
gaacatatatatgagattga

SEQ ID NO: 328172 - DNA, 20 bp, human
gggcgtatgttttcacttat

SEQ ID NO: 328173 - DNA, 20 bp, human
gatttctaacgcagaaccaa

SEQ ID NO: 328174 - DNA, 20 bp, human
gtgaaacaacttctgtattt

SEQ ID NO: 328175 - DNA, 20 bp, human
gaggcatggcagtattcaaa

SEQ ID NO: 328176 - DNA, 20 bp, human
gggagagaacaaactcaaga

SEQ ID NO: 328177 - DNA, 20 bp, human
gcaggatgatgatagtcctc

SEQ ID NO: 328178 - DNA, 20 bp, human
gcaaaatcgaggcttatgtt

SEQ ID NO: 328179 - DNA, 20 bp, human
gatagtcctcaggcctggga

SEQ ID NO: 328180 - DNA, 20 bp, human
gcatgttttggggaaaacca

SEQ ID NO: 328181 - DNA, 20 bp, human
gccgcaacactacaaaatcg

SEQ ID NO: 328182 - DNA, 20 bp, human
ggatgatagtcctcaggcct

SEQ ID NO: 328183 - DNA, 20 bp, human
gcattagaaacatccttccc

SEQ ID NO: 328184 - DNA, 20 bp, human
gtcccagggttctgattaaa

SEQ ID NO: 328185 - DNA, 20 bp, human
gcttgtctcagaacatgttt

SEQ ID NO: 328186 - DNA, 20 bp, human
gtgtgtgtggctggaataaa

SEQ ID NO: 328187 - DNA, 20 bp, human
gggactgctagggtcctcaa

SEQ ID NO: 328188 - DNA, 20 bp, human
gaagcatctcagctatgcaa

SEQ ID NO: 328189 - DNA, 20 bp, human
gtagaactaaagtgtggaaa

SEQ ID NO: 328190 - DNA, 20 bp, human
gaaacactttgggactgcta

SEQ ID NO: 328191 - DNA, 20 bp, human
ggagttagttatgtgtagaa

SEQ ID NO: 328192 - DNA, 20 bp, human
gttctgagttggaaattgaa

SEQ ID NO: 328193 - DNA, 20 bp, human
gctaacagtccttcacaaat

SEQ ID NO: 328194 - DNA, 20 bp, human
gtccagtggaaacagattag

SEQ ID NO: 328195 - DNA, 20 bp, human
gagctgagatgcttctgagt

SEQ ID NO: 328196 - DNA, 20 bp, human
gtatcataatgaagagagat

SEQ ID NO: 328197 - DNA, 20 bp, human
gtaactgcaaaatttaaacc

SEQ ID NO: 328198 - DNA, 20 bp, human
gcgccaaaatatccactctc

SEQ ID NO: 328199 - DNA, 20 bp, human
gtaccagagagtggatattt

SEQ ID NO: 328200 - DNA, 20 bp, human
gtacagatacacctgacctc

SEQ ID NO: 328201 - DNA, 20 bp, human
gtaaatcctagtgaattaac

SEQ ID NO: 328202 - DNA, 20 bp, human
ggtgatccgcttgcttgtgt

SEQ ID NO: 328203 - DNA, 20 bp, human
gccaaataaatgagaatatc

SEQ ID NO: 328204 - DNA, 20 bp, human
gtgccttgggtttgtatatc

SEQ ID NO: 328205 - DNA, 20 bp, human
gggatttactcatattttac

SEQ ID NO: 328206 - DNA, 20 bp, human
gtaaacgctggtcaattaac

SEQ ID NO: 328207 - DNA, 20 bp, human
gtaagaggagtcttttgtgg

SEQ ID NO: 328208 - DNA, 20 bp, human
gtacaaacatatccacttac

SEQ ID NO: 328209 - DNA, 20 bp, human
gaatctgtcgtataatacat

SEQ ID NO: 328210 - DNA, 20 bp, human
gacaagttcaacaatacctt

SEQ ID NO: 328211 - DNA, 20 bp, human
gacaagcccttatatataag

SEQ ID NO: 328212 - DNA, 20 bp, human
gcacttactggtaagtaccc

SEQ ID NO: 328213 - DNA, 20 bp, human
gagactcctcttatatataa

SEQ ID NO: 328214 - DNA, 20 bp, human
gattaatcacatagaactga

SEQ ID NO: 328215 - DNA, 20 bp, human
ggtaaaatattagtaaacgc

SEQ ID NO: 328216 - DNA, 20 bp, human
gcctaaaaagtcaccaactt

SEQ ID NO: 328217 - DNA, 20 bp, human
gctatactcaaaggcatatt

SEQ ID NO: 328218 - DNA, 20 bp, human
gtcagttttgtgaggataag

SEQ ID NO: 328219 - DNA, 20 bp, human
gagaagtgaatttaccatgc

SEQ ID NO: 328220 - DNA, 20 bp, human
gctaacaacttgtcctaagt

SEQ ID NO: 328221 - DNA, 20 bp, human
gattcgtatactatactcaa

SEQ ID NO: 328222 - DNA, 20 bp, human
ggtgactttttaggattttt

SEQ ID NO: 328223 - DNA, 20 bp, human
gatttatatggtttcagatc

SEQ ID NO: 328224 - DNA, 20 bp, human
gtgaaaagcagtcatgcttt

SEQ ID NO: 328225 - DNA, 20 bp, human
ggagaatatgaacttgttta

SEQ ID NO: 328226 - DNA, 20 bp, human
gagtaccctcaaaatagttg

SEQ ID NO: 328227 - DNA, 20 bp, human
gaacaagcagcgggcttgtt

SEQ ID NO: 328228 - DNA, 20 bp, human
gttatccgcaactattttga

SEQ ID NO: 328229 - DNA, 20 bp, human
gagtctgtgatccacaactc

SEQ ID NO: 328230 - DNA, 20 bp, human
ggctgtgattactgaccatt

SEQ ID NO: 328231 - DNA, 20 bp, human
gagcttggccaccagagttg

SEQ ID NO: 328232 - DNA, 20 bp, human
ggtacatgctattcttcttc

SEQ ID NO: 328233 - DNA, 20 bp, human
gagacgcagctaacaagcag

SEQ ID NO: 328234 - DNA, 20 bp, human
gacataaatggataataatc

SEQ ID NO: 328235 - DNA, 20 bp, human
gtctaacagttacttgagct

SEQ ID NO: 328236 - DNA, 20 bp, human
gttgactcttggtcccaaat

SEQ ID NO: 328237 - DNA, 20 bp, human
ggaacaaaggagtcctattt

SEQ ID NO: 328238 - DNA, 20 bp, human
gtgtatgcttcatagtgaat

SEQ ID NO: 328239 - DNA, 20 bp, human
gaatttgaactgactcaact

SEQ ID NO: 328240 - DNA, 20 bp, human
gccatatgataaataatagg

SEQ ID NO: 328241 - DNA, 20 bp, human
gcttggatagtaacacagta

SEQ ID NO: 328242 - DNA, 20 bp, human
gttgtaagcctgtactcaca

SEQ ID NO: 328243 - DNA, 20 bp, human
ggaataagcattttcctcag

SEQ ID NO: 328244 - DNA, 20 bp, human
gttttgttatttgttattct

SEQ ID NO: 328245 - DNA, 20 bp, human
gtcaatgttgctatctcaag

SEQ ID NO: 328246 - DNA, 20 bp, human
ggtaggtaggagatagatcc

SEQ ID NO: 328247 - DNA, 20 bp, human
gctactgtgaaggcaattac

SEQ ID NO: 328248 - DNA, 20 bp, human
gtccaagaatttgattacgt

SEQ ID NO: 328249 - DNA, 20 bp, human
gtgaaggcaattacaggttt

SEQ ID NO: 328250 - DNA, 20 bp, human
gacttggcctccagatttca

SEQ ID NO: 328251 - DNA, 20 bp, human
gactagtccatgaaatctgg

SEQ ID NO: 328252 - DNA, 20 bp, human
gttagggatcactactgtga

SEQ ID NO: 328253 - DNA, 20 bp, human
gattctatggggcattcaag

SEQ ID NO: 328254 - DNA, 20 bp, human
gaaagaattcgtattctatg

SEQ ID NO: 328255 - DNA, 20 bp, human
ggccactaccactgtagcta

SEQ ID NO: 328256 - DNA, 20 bp, human
gcctgggagatcctaggtat

SEQ ID NO: 328257 - DNA, 20 bp, human
gcttgctgtcactgaaagtc

SEQ ID NO: 328258 - DNA, 20 bp, human
gtgtcactgaaagtcaggac

SEQ ID NO: 328259 - DNA, 20 bp, human
gcctgactggtggtattata

SEQ ID NO: 328260 - DNA, 20 bp, human
gttactctatgtaagattat

SEQ ID NO: 328261 - DNA, 20 bp, human
gtgaacaggtagaattctca

SEQ ID NO: 328262 - DNA, 20 bp, human
ggtaatggcctgaaacttat

SEQ ID NO: 328263 - DNA, 20 bp, human
gtgataatttagtcattcct

SEQ ID NO: 328264 - DNA, 20 bp, human
ggactggtggtattataggg

SEQ ID NO: 328265 - DNA, 20 bp, human
ggtggatgtaaaggtttccc

SEQ ID NO: 328266 - DNA, 20 bp, human
gttcacacactgagattcat

SEQ ID NO: 328267 - DNA, 20 bp, human
ggaatctgcttgtgcagcac

SEQ ID NO: 328268 - DNA, 20 bp, human
gggtctgggttcagatttag

SEQ ID NO: 328269 - DNA, 20 bp, human
ggccttggagggtcagggta

SEQ ID NO: 328270 - DNA, 20 bp, human
ggcagcactggggccttgga

SEQ ID NO: 328271 - DNA, 20 bp, human
gggtaaggctcaagatgtcc

SEQ ID NO: 328272 - DNA, 20 bp, human
gctggggttagggtgggtct

SEQ ID NO: 328273 - DNA, 20 bp, human
gctgatgtatcctggggtta

SEQ ID NO: 328274 - DNA, 20 bp, human
gcctgcaagtctactctgat

SEQ ID NO: 328275 - DNA, 20 bp, human
gactagggttcagaattacc

SEQ ID NO: 328276 - DNA, 20 bp, human
gcccccaggcatatcctccc

SEQ ID NO: 328277 - DNA, 20 bp, human
gcagggaggtccaagggagt

SEQ ID NO: 328278 - DNA, 20 bp, human
gaggatcccagcagcccatc

SEQ ID NO: 328279 - DNA, 20 bp, human
gccctgggaggatatgcctg

SEQ ID NO: 328280 - DNA, 20 bp, human
ggggcagaatgctgtccaaa

SEQ ID NO: 328281 - DNA, 20 bp, human
gtacctgctgatgtaccctt

SEQ ID NO: 328282 - DNA, 20 bp, human
gtatggggaggagaggcaat

SEQ ID NO: 328283 - DNA, 20 bp, human
gtctagagtcctcccctgat

SEQ ID NO: 328284 - DNA, 20 bp, human
gcctgaccagggaggtccaa

SEQ ID NO: 328285 - DNA, 20 bp, human
gcactagcccactgtggttc

SEQ ID NO: 328286 - DNA, 20 bp, human
ggctgcaaagaaccacaggt

SEQ ID NO: 328287 - DNA, 20 bp, human
gcggtggctatgtgctttat

SEQ ID NO: 328288 - DNA, 20 bp, human
gtcactagcagtcactctga

SEQ ID NO: 328289 - DNA, 20 bp, human
gttggactctcactcataat

SEQ ID NO: 328290 - DNA, 20 bp, human
gaggagttaaggggtggagt

SEQ ID NO: 328291 - DNA, 20 bp, human
gtgctgctgcaaagaaccac

SEQ ID NO: 328292 - DNA, 20 bp, human
gattatgaggttccttttaa

SEQ ID NO: 328293 - DNA, 20 bp, human
gatagatactgaggagttaa

SEQ ID NO: 328294 - DNA, 20 bp, human
gtgaataatcatagatactg

SEQ ID NO: 328295 - DNA, 20 bp, human
gattatgcaattacttacgg

SEQ ID NO: 328296 - DNA, 20 bp, human
gaactatttctgattatgag

SEQ ID NO: 328297 - DNA, 20 bp, human
gcagatcttatctatgacct

SEQ ID NO: 328298 - DNA, 20 bp, human
gcacaaaatattcaaaattg

SEQ ID NO: 328299 - DNA, 20 bp, human
gagatctccagatatttgcc

SEQ ID NO: 328300 - DNA, 20 bp, human
gtggttcttcagtgaccata

SEQ ID NO: 328301 - DNA, 20 bp, human
gcattttcatccaacactat

SEQ ID NO: 328302 - DNA, 20 bp, human
gagttgtttacctatagtgt

SEQ ID NO: 328303 - DNA, 20 bp, human
gaaccatggatatttttaag

SEQ ID NO: 328304 - DNA, 20 bp, human
ggaaaatgtataaaatcata

SEQ ID NO: 328305 - DNA, 20 bp, human
gtcttaatatattctgtaaa

SEQ ID NO: 328306 - DNA, 20 bp, human
gggagagaaatgtgtagctc

SEQ ID NO: 328307 - DNA, 20 bp, human
gtatgggcctgtgtgtccca

SEQ ID NO: 328308 - DNA, 20 bp, human
gttgtttaggaattttactg

SEQ ID NO: 328309 - DNA, 20 bp, human
gacacacaggcccatatatg

SEQ ID NO: 328310 - DNA, 20 bp, human
gtcaacaagtactggaaagc

SEQ ID NO: 328311 - DNA, 20 bp, human
gtttgatgtggcacagttca

SEQ ID NO: 328312 - DNA, 20 bp, human
gttttactggggatttatat

SEQ ID NO: 328313 - DNA, 20 bp, human
gcatatatgtggtaataggg

SEQ ID NO: 328314 - DNA, 20 bp, human
gtgtgaaacactgacagact

SEQ ID NO: 328315 - DNA, 20 bp, human
gatctccaagagttggtgta

SEQ ID NO: 328316 - DNA, 20 bp, human
gcaggactggatctagagat

SEQ ID NO: 328317 - DNA, 20 bp, human
gggcataggggagaactggg

SEQ ID NO: 328318 - DNA, 20 bp, human
ggatggcataggggagaact

SEQ ID NO: 328319 - DNA, 20 bp, human
gactggatctagagatggga

SEQ ID NO: 328320 - DNA, 20 bp, human
gagacttttgatggatgagg

SEQ ID NO: 328321 - DNA, 20 bp, human
gatagcagggcagttaagcc

SEQ ID NO: 328322 - DNA, 20 bp, human
gagggcagttaagccaggac

SEQ ID NO: 328323 - DNA, 20 bp, human
gagtaggctaatctgaagcc

SEQ ID NO: 328324 - DNA, 20 bp, human
gttcctagacccagtagaaa

SEQ ID NO: 328325 - DNA, 20 bp, human
ggaacatcttggaagaatct

SEQ ID NO: 328326 - DNA, 20 bp, human
ggcccctgggtgcatcccac

SEQ ID NO: 328327 - DNA, 20 bp, human
gtcctcaaaaagatactgag

SEQ ID NO: 328328 - DNA, 20 bp, human
ggtgaagtgatgagccaaac

SEQ ID NO: 328329 - DNA, 20 bp, human
gagactagtaaaaactctag

SEQ ID NO: 328330 - DNA, 20 bp, human
gatctccaactcacccagtt

SEQ ID NO: 328331 - DNA, 20 bp, human
gaacccacagtgccagcaga

SEQ ID NO: 328332 - DNA, 20 bp, human
gtctagtggctaagaagacc

SEQ ID NO: 328333 - DNA, 20 bp, human
gctccctctgctggcactgt

SEQ ID NO: 328334 - DNA, 20 bp, human
ggaattcagcctccctctgc

SEQ ID NO: 328335 - DNA, 20 bp, human
gtcctctcagtatctttttg

SEQ ID NO: 328336 - DNA, 20 bp, human
gggccatagtagaaactctg

SEQ ID NO: 328337 - DNA, 20 bp, human
gaagagatgagtgtcttact

SEQ ID NO: 328338 - DNA, 20 bp, human
ggatgagtgtcttactggga

SEQ ID NO: 328339 - DNA, 20 bp, human
gagtgtcttactgggaaggc

SEQ ID NO: 328340 - DNA, 20 bp, human
gtacacaaacgattagaacc

SEQ ID NO: 328341 - DNA, 20 bp, human
gtttcccaacacaccctctt

SEQ ID NO: 328342 - DNA, 20 bp, human
gtgcacgggcatgagaaggt

SEQ ID NO: 328343 - DNA, 20 bp, human
gtaagacactcatctcttta

SEQ ID NO: 328344 - DNA, 20 bp, human
gaaccacagagtttctacta

SEQ ID NO: 328345 - DNA, 20 bp, human
gatctctttaaggaagcaac

SEQ ID NO: 328346 - DNA, 20 bp, human
ggcagtcatgagcttttcat

SEQ ID NO: 328347 - DNA, 20 bp, human
gaaaagctcatgactgcctc

SEQ ID NO: 328348 - DNA, 20 bp, human
gtcctgactttcttctcttg

SEQ ID NO: 328349 - DNA, 20 bp, human
gggaaaaggacagtgggctg

SEQ ID NO: 328350 - DNA, 20 bp, human
gactgcttttgagatgatgc

SEQ ID NO: 328351 - DNA, 20 bp, human
ggttgtgtgcttggatggag

SEQ ID NO: 328352 - DNA, 20 bp, human
gagctcatgactgcctctgg

SEQ ID NO: 328353 - DNA, 20 bp, human
gggtaattgactgcctccag

SEQ ID NO: 328354 - DNA, 20 bp, human
gttgtgttatcagtagcact

SEQ ID NO: 328355 - DNA, 20 bp, human
gatcatgttgtgtgcttgga

SEQ ID NO: 328356 - DNA, 20 bp, human
gcgtctaacctcacagagga

SEQ ID NO: 328357 - DNA, 20 bp, human
gccagcttccttcctctgtg

SEQ ID NO: 328358 - DNA, 20 bp, human
gggaagctggtatctcttgt

SEQ ID NO: 328359 - DNA, 20 bp, human
gaatgtggactacacaaata

SEQ ID NO: 328360 - DNA, 20 bp, human
gaagtcagagtgaatgtcga

SEQ ID NO: 328361 - DNA, 20 bp, human
gtattaaggagcacaaattc

SEQ ID NO: 328362 - DNA, 20 bp, human
gtcaaaagagataactttga

SEQ ID NO: 328363 - DNA, 20 bp, human
gctttcgtctaacctcacag

SEQ ID NO: 328364 - DNA, 20 bp, human
gtctctggcaagaaatacgt

SEQ ID NO: 328365 - DNA, 20 bp, human
ggagtacaaataatggaatg

SEQ ID NO: 328366 - DNA, 20 bp, human
gaggaaaactggtgagggcg

SEQ ID NO: 328367 - DNA, 20 bp, human
ggtaaatgaaatcatggtag

SEQ ID NO: 328368 - DNA, 20 bp, human
ggtggagtagataatactaa

SEQ ID NO: 328369 - DNA, 20 bp, human
gcttaagggttgagcaataa

SEQ ID NO: 328370 - DNA, 20 bp, human
gatgggaagaactatactta

SEQ ID NO: 328371 - DNA, 20 bp, human
gtacagaggaaaactggtga

SEQ ID NO: 328372 - DNA, 20 bp, human
gctaaaggtgatgatgacca

SEQ ID NO: 328373 - DNA, 20 bp, human
gccaggaaattgccaaggat

SEQ ID NO: 328374 - DNA, 20 bp, human
ggagattggcagaattcata

SEQ ID NO: 328375 - DNA, 20 bp, human
gtacagatgttgctagagtc

SEQ ID NO: 328376 - DNA, 20 bp, human
ggggagcagtctgcagaatt

SEQ ID NO: 328377 - DNA, 20 bp, human
gagtctgcagaattgggcta

SEQ ID NO: 328378 - DNA, 20 bp, human
gaagggaagattagctgtgt

SEQ ID NO: 328379 - DNA, 20 bp, human
gatatatattccgtcatcaa

SEQ ID NO: 328380 - DNA, 20 bp, human
gatgaagaaaaagtagcaat

SEQ ID NO: 328381 - DNA, 20 bp, human
gatgctgctacaaaagtcaa

SEQ ID NO: 328382 - DNA, 20 bp, human
gcggaatatatattaattca

SEQ ID NO: 328383 - DNA, 20 bp, human
ggacattagctaatgagaat

SEQ ID NO: 328384 - DNA, 20 bp, human
gctatgacataaaaaataac

SEQ ID NO: 328385 - DNA, 20 bp, human
ggaatgggagtgggaaaatg

SEQ ID NO: 328386 - DNA, 20 bp, human
gtatgtgagtgcatgagtca

SEQ ID NO: 328387 - DNA, 20 bp, human
gaggataacactacagggag

SEQ ID NO: 328388 - DNA, 20 bp, human
gaaaaataggataacactac

SEQ ID NO: 328389 - DNA, 20 bp, human
gttaggatgggtgcgtgcac

SEQ ID NO: 328390 - DNA, 20 bp, human
ggctgcatatactattagga

SEQ ID NO: 328391 - DNA, 20 bp, human
ggaatgctgcatatactatt

SEQ ID NO: 328392 - DNA, 20 bp, human
gaaaaggctaaattctgaaa

SEQ ID NO: 328393 - DNA, 20 bp, human
gccaaaatgtaagtatctta

SEQ ID NO: 328394 - DNA, 20 bp, human
gttagaaataaaggagtaat

SEQ ID NO: 328395 - DNA, 20 bp, human
gagtgtttgtcataaaggga

SEQ ID NO: 328396 - DNA, 20 bp, human
gtgtatatgatgtacaggag

SEQ ID NO: 328397 - DNA, 20 bp, human
gaaggttaaatagtatatct

SEQ ID NO: 328398 - DNA, 20 bp, human
gtgaatgcagagggcatttg

SEQ ID NO: 328399 - DNA, 20 bp, human
gcacgtgcagatgaatgcag

SEQ ID NO: 328400 - DNA, 20 bp, human
gcatcatatacaagtataaa

SEQ ID NO: 328401 - DNA, 20 bp, human
gatcagttatcctctgttct

SEQ ID NO: 328402 - DNA, 20 bp, human
gatacttgtatatgatgtac

SEQ ID NO: 328403 - DNA, 20 bp, human
gaaaggaaatggacccagga

SEQ ID NO: 328404 - DNA, 20 bp, human
gtcagatgatcagagaggcc

SEQ ID NO: 328405 - DNA, 20 bp, human
gccaggctaatgagacaatt

SEQ ID NO: 328406 - DNA, 20 bp, human
ggctggctacgtcatctgga

SEQ ID NO: 328407 - DNA, 20 bp, human
gatctggagggggagaaaac

SEQ ID NO: 328408 - DNA, 20 bp, human
gcgaagtgaagagtaatctt

SEQ ID NO: 328409 - DNA, 20 bp, human
gaagaagaccattttctcaa

SEQ ID NO: 328410 - DNA, 20 bp, human
gacttggagacggcacaaaa

SEQ ID NO: 328411 - DNA, 20 bp, human
gttataccagtaaagagccg

SEQ ID NO: 328412 - DNA, 20 bp, human
gaagaacctcggctctttac

SEQ ID NO: 328413 - DNA, 20 bp, human
gtagaaatttcattgtattc

SEQ ID NO: 328414 - DNA, 20 bp, human
gaataatttttcaagaacct

SEQ ID NO: 328415 - DNA, 20 bp, human
gaaatttttaccactatcct

SEQ ID NO: 328416 - DNA, 20 bp, human
gagcaaaatcacctggacag

SEQ ID NO: 328417 - DNA, 20 bp, human
gatacatcactgttttcagg

SEQ ID NO: 328418 - DNA, 20 bp, human
gttgctggttctaatgtatt

SEQ ID NO: 328419 - DNA, 20 bp, human
gacaggcactgtgccataat

SEQ ID NO: 328420 - DNA, 20 bp, human
gaatcacctggacaggggat

SEQ ID NO: 328421 - DNA, 20 bp, human
gagactcaatataatgagtt

SEQ ID NO: 328422 - DNA, 20 bp, human
ggagatacatcactgttttc

SEQ ID NO: 328423 - DNA, 20 bp, human
gtttcaggtggggcattcac

SEQ ID NO: 328424 - DNA, 20 bp, human
gtagaaccagcaaaatcacc

SEQ ID NO: 328425 - DNA, 20 bp, human
gtcccaatgaaagagaatag

SEQ ID NO: 328426 - DNA, 20 bp, human
gaggttgcaaaggagacatg

SEQ ID NO: 328427 - DNA, 20 bp, human
gtagatgtatgtattaactt

SEQ ID NO: 328428 - DNA, 20 bp, human
gatgacagggacaaaagacc

SEQ ID NO: 328429 - DNA, 20 bp, human
gttctggtacatagtccaca

SEQ ID NO: 328430 - DNA, 20 bp, human
gtggcaaatataggttgcaa

SEQ ID NO: 328431 - DNA, 20 bp, human
gtgtcatctccttccatggg

SEQ ID NO: 328432 - DNA, 20 bp, human
gattgtttccaatgagccat

SEQ ID NO: 328433 - DNA, 20 bp, human
gttggaaacaatatatgaca

SEQ ID NO: 328434 - DNA, 20 bp, human
gtaaatgggtcagaatctga

SEQ ID NO: 328435 - DNA, 20 bp, human
gtctgtgtcatctccttcca

SEQ ID NO: 328436 - DNA, 20 bp, human
gcctgtggatcctttcttta

SEQ ID NO: 328437 - DNA, 20 bp, human
gctttcagtgactttggtaa

SEQ ID NO: 328438 - DNA, 20 bp, human
gggattagacggcttttttc

SEQ ID NO: 328439 - DNA, 20 bp, human
gttttctggttcatgactat

SEQ ID NO: 328440 - DNA, 20 bp, human
gctacattagccataaagaa

SEQ ID NO: 328441 - DNA, 20 bp, human
gtcactgaaagacaaacatc

SEQ ID NO: 328442 - DNA, 20 bp, human
ggtttgtctttcagtgactt

SEQ ID NO: 328443 - DNA, 20 bp, human
gcaaaattaaatggattaga

SEQ ID NO: 328444 - DNA, 20 bp, human
gaagaaaggatccacaggcc

SEQ ID NO: 328445 - DNA, 20 bp, human
gtgtcttaatcattttcaat

SEQ ID NO: 328446 - DNA, 20 bp, human
gagagtgaggccaaactctg

SEQ ID NO: 328447 - DNA, 20 bp, human
gtctgcaaaggaagcactat

SEQ ID NO: 328448 - DNA, 20 bp, human
gagaaggggagggaaattaa

SEQ ID NO: 328449 - DNA, 20 bp, human
gggacaagtacaacacaggt

SEQ ID NO: 328450 - DNA, 20 bp, human
ggaacaaaatcttggggaaa

SEQ ID NO: 328451 - DNA, 20 bp, human
gacagaagctctatctgcaa

SEQ ID NO: 328452 - DNA, 20 bp, human
gaacacagaccattacaaag

SEQ ID NO: 328453 - DNA, 20 bp, human
gaaatgcagaacaaaatctt

SEQ ID NO: 328454 - DNA, 20 bp, human
gcaagtacaacacaggtagg

SEQ ID NO: 328455 - DNA, 20 bp, human
ggtggaaaatgctgcttgtg

SEQ ID NO: 328456 - DNA, 20 bp, human
gtggtgcataaggagtactg

SEQ ID NO: 328457 - DNA, 20 bp, human
gactgcccctgtgtaaagga

SEQ ID NO: 328458 - DNA, 20 bp, human
gattacttggagatattgtc

SEQ ID NO: 328459 - DNA, 20 bp, human
gtatgcgctttaattatgaa

SEQ ID NO: 328460 - DNA, 20 bp, human
gacaagggaggtgatggtat

SEQ ID NO: 328461 - DNA, 20 bp, human
gaatgactgcccctgtgtaa

SEQ ID NO: 328462 - DNA, 20 bp, human
gccagggtggctggtgcata

SEQ ID NO: 328463 - DNA, 20 bp, human
gatgcaaatatgaaaggtgg

SEQ ID NO: 328464 - DNA, 20 bp, human
gaaatattttcaggccaggg

SEQ ID NO: 328465 - DNA, 20 bp, human
ggcgctttaattatgaatgg

SEQ ID NO: 328466 - DNA, 20 bp, human
gtctacagataatcacacac

SEQ ID NO: 328467 - DNA, 20 bp, human
gacaggcccgatgacagtta

SEQ ID NO: 328468 - DNA, 20 bp, human
gcgggcctgtaagtatatgc

SEQ ID NO: 328469 - DNA, 20 bp, human
gaaggcctgcatatacttac

SEQ ID NO: 328470 - DNA, 20 bp, human
gataggctctgcacagttac

SEQ ID NO: 328471 - DNA, 20 bp, human
gtaattatttacggagaata

SEQ ID NO: 328472 - DNA, 20 bp, human
gcagaagccataactgtcat

SEQ ID NO: 328473 - DNA, 20 bp, human
gtatgcaggccttgtgcata

SEQ ID NO: 328474 - DNA, 20 bp, human
gtagagtgtccatatgcaca

SEQ ID NO: 328475 - DNA, 20 bp, human
gacacagctttaagaatttc

SEQ ID NO: 328476 - DNA, 20 bp, human
gaatgatgtgcaggatatgg

SEQ ID NO: 328477 - DNA, 20 bp, human
gaggtcaataaatgatgtgc

SEQ ID NO: 328478 - DNA, 20 bp, human
gactccctaggtaagagaaa

SEQ ID NO: 328479 - DNA, 20 bp, human
gcatgatgtggatggactag

SEQ ID NO: 328480 - DNA, 20 bp, human
gaggccttccctttctaaac

SEQ ID NO: 328481 - DNA, 20 bp, human
gccctgtaacatcagatatt

SEQ ID NO: 328482 - DNA, 20 bp, human
gttagaaagggaaggcctct

SEQ ID NO: 328483 - DNA, 20 bp, human
gtaaaggaatgagactccct

SEQ ID NO: 328484 - DNA, 20 bp, human
gataaatgatgtgcaggata

SEQ ID NO: 328485 - DNA, 20 bp, human
gtaccaagaccagtttagaa

SEQ ID NO: 328486 - DNA, 20 bp, human
gcacacaggcttctgcagtt

SEQ ID NO: 328487 - DNA, 20 bp, human
gactgtatacagagcacttt

SEQ ID NO: 328488 - DNA, 20 bp, human
gaatctgcatgtaaccacac

SEQ ID NO: 328489 - DNA, 20 bp, human
ggcagtgaggttatattgat

SEQ ID NO: 328490 - DNA, 20 bp, human
ggctaaagtaaaaagtattc

SEQ ID NO: 328491 - DNA, 20 bp, human
gtagcccttaaatgtagtgg

SEQ ID NO: 328492 - DNA, 20 bp, human
gcccctttgaattttgaaca

SEQ ID NO: 328493 - DNA, 20 bp, human
gttgaattttgaacaaggta

SEQ ID NO: 328494 - DNA, 20 bp, human
gtcctagcccttaaatgtag

SEQ ID NO: 328495 - DNA, 20 bp, human
gaggggttctttggtgatga

SEQ ID NO: 328496 - DNA, 20 bp, human
gaagactcacttctttccag

SEQ ID NO: 328497 - DNA, 20 bp, human
gaacaataatctgtgttgag

SEQ ID NO: 328498 - DNA, 20 bp, human
ggggctacttaggaaagtaa

SEQ ID NO: 328499 - DNA, 20 bp, human
gtctttccagaggataatcg

SEQ ID NO: 328500 - DNA, 20 bp, human
gctagaggtaatggtatagg

SEQ ID NO: 328501 - DNA, 20 bp, human
gggcttcctcgattatcctc

SEQ ID NO: 328502 - DNA, 20 bp, human
gtaagcaatattgcctatga

SEQ ID NO: 328503 - DNA, 20 bp, human
gactcttatcagtgtgctag

SEQ ID NO: 328504 - DNA, 20 bp, human
ggcaatgcatatttatatta

SEQ ID NO: 328505 - DNA, 20 bp, human
gtagcacctcatataacctc

SEQ ID NO: 328506 - DNA, 20 bp, human
gatgaccctagcagagtaag

SEQ ID NO: 328507 - DNA, 20 bp, human
ggtaaaacgatcagattcat

SEQ ID NO: 328508 - DNA, 20 bp, human
ggtggagcaagaatcactaa

SEQ ID NO: 328509 - DNA, 20 bp, human
gtacacatgaggaataaagt

SEQ ID NO: 328510 - DNA, 20 bp, human
gaatacctcttactctgcta

SEQ ID NO: 328511 - DNA, 20 bp, human
gctcactttatcctgattcc

SEQ ID NO: 328512 - DNA, 20 bp, human
ggttagcaggatctctagta

SEQ ID NO: 328513 - DNA, 20 bp, human
gtaaattctggtaggaaaag

SEQ ID NO: 328514 - DNA, 20 bp, human
gtgaattgtagagtactagt

SEQ ID NO: 328515 - DNA, 20 bp, human
gccagaatttattacacatg

SEQ ID NO: 328516 - DNA, 20 bp, human
gcctgagcaacattggtacc

SEQ ID NO: 328517 - DNA, 20 bp, human
gtaccaatgttgctcaggag

SEQ ID NO: 328518 - DNA, 20 bp, human
gataagactggttctattcc

SEQ ID NO: 328519 - DNA, 20 bp, human
gatgttgctcaggagaggct

SEQ ID NO: 328520 - DNA, 20 bp, human
ggtctttgatattaggtgaa

SEQ ID NO: 328521 - DNA, 20 bp, human
gctcaactattcctctattt

SEQ ID NO: 328522 - DNA, 20 bp, human
gtttctatagacactgaccc

SEQ ID NO: 328523 - DNA, 20 bp, human
gatgcataacaacacagaaa

SEQ ID NO: 328524 - DNA, 20 bp, human
gttatatatattcatgagta

SEQ ID NO: 328525 - DNA, 20 bp, human
gtatttttgcttcacgatca

SEQ ID NO: 328526 - DNA, 20 bp, human
gaggaagagtgtaaccagtc

SEQ ID NO: 328527 - DNA, 20 bp, human
gaagctgtgcaaactactgg

SEQ ID NO: 328528 - DNA, 20 bp, human
gtatgggagaacagtgtata

SEQ ID NO: 328529 - DNA, 20 bp, human
gctgtgcaaactactggggg

SEQ ID NO: 328530 - DNA, 20 bp, human
ggaaagaaaagattctcttc

SEQ ID NO: 328531 - DNA, 20 bp, human
gagagtgtaaccagtctgga

SEQ ID NO: 328532 - DNA, 20 bp, human
gacctgtctgaaatgaacaa

SEQ ID NO: 328533 - DNA, 20 bp, human
gtagaagctgtgcaaactac

SEQ ID NO: 328534 - DNA, 20 bp, human
gagaagcaaacagttgtctt

SEQ ID NO: 328535 - DNA, 20 bp, human
gctaaacaatgatgtccata

SEQ ID NO: 328536 - DNA, 20 bp, human
gttaacctgggcatggggtt

SEQ ID NO: 328537 - DNA, 20 bp, human
gagcagaacacaagtcccta

SEQ ID NO: 328538 - DNA, 20 bp, human
ggaacacaagtccctaagga

SEQ ID NO: 328539 - DNA, 20 bp, human
gctcgtgaattccttcctta

SEQ ID NO: 328540 - DNA, 20 bp, human
gtgaatagaaacttgtaagg

SEQ ID NO: 328541 - DNA, 20 bp, human
gattcactcaagtgccttat

SEQ ID NO: 328542 - DNA, 20 bp, human
gtgacttgtgaccacagcta

SEQ ID NO: 328543 - DNA, 20 bp, human
gccataaactcatacagtac

SEQ ID NO: 328544 - DNA, 20 bp, human
gagtccctacaggagatttc

SEQ ID NO: 328545 - DNA, 20 bp, human
gttaacttaacctgggcatg

SEQ ID NO: 328546 - DNA, 20 bp, human
gaaagggtatggaatgggga

SEQ ID NO: 328547 - DNA, 20 bp, human
gcagatgaaagggtatggaa

SEQ ID NO: 328548 - DNA, 20 bp, human
gttagtctctgaggtcacga

SEQ ID NO: 328549 - DNA, 20 bp, human
gaagctcagatgaaagggta

SEQ ID NO: 328550 - DNA, 20 bp, human
gatgcacacaataaagtcta

SEQ ID NO: 328551 - DNA, 20 bp, human
gagggtgtaatccataactg

SEQ ID NO: 328552 - DNA, 20 bp, human
gtgaacaatgaatacaaatt

SEQ ID NO: 328553 - DNA, 20 bp, human
ggtatgaaagctcagatgaa

SEQ ID NO: 328554 - DNA, 20 bp, human
gttgttcatggatcagctca

SEQ ID NO: 328555 - DNA, 20 bp, human
gatgatcaatttagtctctg

SEQ ID NO: 328556 - DNA, 20 bp, human
ggggactaataaagggtaca

SEQ ID NO: 328557 - DNA, 20 bp, human
gcaaccaagggactaataaa

SEQ ID NO: 328558 - DNA, 20 bp, human
ggattacaaaacacagtaac

SEQ ID NO: 328559 - DNA, 20 bp, human
ggcgaaatgccgattaattc

SEQ ID NO: 328560 - DNA, 20 bp, human
gattagtcccttggttgaag

SEQ ID NO: 328561 - DNA, 20 bp, human
gcttacacattaaaaattga

SEQ ID NO: 328562 - DNA, 20 bp, human
gaaatgccgattaattcagg

SEQ ID NO: 328563 - DNA, 20 bp, human
gtgtctcctcctgaattaat

SEQ ID NO: 328564 - DNA, 20 bp, human
gaggatattaggcttaatct

SEQ ID NO: 328565 - DNA, 20 bp, human
gtgtgtatctttgatttttc

SEQ ID NO: 328566 - DNA, 20 bp, human
gtttgcaggtgggatagcac

SEQ ID NO: 328567 - DNA, 20 bp, human
gtctaagacaactttcataa

SEQ ID NO: 328568 - DNA, 20 bp, human
gtacttctccatgtctatga

SEQ ID NO: 328569 - DNA, 20 bp, human
gctagcagccttcatagaca

SEQ ID NO: 328570 - DNA, 20 bp, human
ggagattcaaatttctttga

SEQ ID NO: 328571 - DNA, 20 bp, human
gagatgggatatcaattcta

SEQ ID NO: 328572 - DNA, 20 bp, human
gaacaagaggtaatctttgc

SEQ ID NO: 328573 - DNA, 20 bp, human
ggacaactttcataaaggaa

SEQ ID NO: 328574 - DNA, 20 bp, human
ggtctagcaatggaaacaag

SEQ ID NO: 328575 - DNA, 20 bp, human
gggaatttagcttaactgaa

SEQ ID NO: 328576 - DNA, 20 bp, human
gagtgacggtaaatgtttgt

SEQ ID NO: 328577 - DNA, 20 bp, human
ggccacatgcaggccacaaa

SEQ ID NO: 328578 - DNA, 20 bp, human
ggccttattgagaaatcaag

SEQ ID NO: 328579 - DNA, 20 bp, human
gataaaaacactgggtgctc

SEQ ID NO: 328580 - DNA, 20 bp, human
gtccacttgatttctcaata

SEQ ID NO: 328581 - DNA, 20 bp, human
gttgggagtgtagtttgaat

SEQ ID NO: 328582 - DNA, 20 bp, human
ggtttttataaacagcttaa

SEQ ID NO: 328583 - DNA, 20 bp, human
ggaccaagattgacatttca

SEQ ID NO: 328584 - DNA, 20 bp, human
ggttgcttttggccacatgc

SEQ ID NO: 328585 - DNA, 20 bp, human
gttttctagcagggtttcgt

SEQ ID NO: 328586 - DNA, 20 bp, human
ggctacagggggaacaactc

SEQ ID NO: 328587 - DNA, 20 bp, human
gagtggtcagtaataccaag

SEQ ID NO: 328588 - DNA, 20 bp, human
ggggaataaagttagctaca

SEQ ID NO: 328589 - DNA, 20 bp, human
gtgccatgtcatggaaactg

SEQ ID NO: 328590 - DNA, 20 bp, human
ggtgggaccaaggctacagg

SEQ ID NO: 328591 - DNA, 20 bp, human
gagagataatgcacagaata

SEQ ID NO: 328592 - DNA, 20 bp, human
gatggtgggaccaaggctac

SEQ ID NO: 328593 - DNA, 20 bp, human
gttgtattaattcagacatg

SEQ ID NO: 328594 - DNA, 20 bp, human
ggttgttccccctgtagcct

SEQ ID NO: 328595 - DNA, 20 bp, human
gcattatgtcattgattcca

SEQ ID NO: 328596 - DNA, 20 bp, human
gtcagtgaccctattattat

SEQ ID NO: 328597 - DNA, 20 bp, human
gcaagaatatcactcctcga

SEQ ID NO: 328598 - DNA, 20 bp, human
gaatcacaaggcagagactt

SEQ ID NO: 328599 - DNA, 20 bp, human
gatagagcctagatagtccc

SEQ ID NO: 328600 - DNA, 20 bp, human
gtgggaccagaattgactac

SEQ ID NO: 328601 - DNA, 20 bp, human
gtaaaccaaagcttaagcct

SEQ ID NO: 328602 - DNA, 20 bp, human
ggtggtgcttgagatcatgt

SEQ ID NO: 328603 - DNA, 20 bp, human
gccactgcaggtaggctatg

SEQ ID NO: 328604 - DNA, 20 bp, human
ggatgcactgaagtgtcaga

SEQ ID NO: 328605 - DNA, 20 bp, human
gttttgcagtatgaccttcg

SEQ ID NO: 328606 - DNA, 20 bp, human
gtgagtctagtcagtacatt

SEQ ID NO: 328607 - DNA, 20 bp, human
gggtgtgtgccttaagcatt

SEQ ID NO: 328608 - DNA, 20 bp, human
gaggacagatttaatttgaa

SEQ ID NO: 328609 - DNA, 20 bp, human
gagcccaaactccacccttt

SEQ ID NO: 328610 - DNA, 20 bp, human
gacaaagaccccagatattc

SEQ ID NO: 328611 - DNA, 20 bp, human
gtgtcaacacctaatgctta

SEQ ID NO: 328612 - DNA, 20 bp, human
gcacagagttgttcagttca

SEQ ID NO: 328613 - DNA, 20 bp, human
gtcagtcttctttcccataa

SEQ ID NO: 328614 - DNA, 20 bp, human
gtagcattgcctctgtgagc

SEQ ID NO: 328615 - DNA, 20 bp, human
gtgtgatatatacactgtct

SEQ ID NO: 328616 - DNA, 20 bp, human
ggggagaggtgtggtaagtg

SEQ ID NO: 328617 - DNA, 20 bp, human
ggagacgagataagaggtac

SEQ ID NO: 328618 - DNA, 20 bp, human
ggaaatggacttattgaagg

SEQ ID NO: 328619 - DNA, 20 bp, human
ggcaatggcacattgagtag

SEQ ID NO: 328620 - DNA, 20 bp, human
gcagtataagagttgtgctg

SEQ ID NO: 328621 - DNA, 20 bp, human
gctgtactgcttagtgactt

SEQ ID NO: 328622 - DNA, 20 bp, human
gaatgtaaggtgaatgtaca

SEQ ID NO: 328623 - DNA, 20 bp, human
ggagttagagacgagataag

SEQ ID NO: 328624 - DNA, 20 bp, human
gactcaggtacaattagaat

SEQ ID NO: 328625 - DNA, 20 bp, human
ggataagaactggtcatatt

SEQ ID NO: 328626 - DNA, 20 bp, human
gcactcagaaatttggttgt

SEQ ID NO: 328627 - DNA, 20 bp, human
gatctctcagatcatcagtg

SEQ ID NO: 328628 - DNA, 20 bp, human
gggaccattaaaatgcatta

SEQ ID NO: 328629 - DNA, 20 bp, human
ggattataaatctatgagat

SEQ ID NO: 328630 - DNA, 20 bp, human
gtggaatttttaaaagttgg

SEQ ID NO: 328631 - DNA, 20 bp, human
gtatttattcttgggtactc

SEQ ID NO: 328632 - DNA, 20 bp, human
ggacaaacaaaattatttct

SEQ ID NO: 328633 - DNA, 20 bp, human
gttcttggcactcagaaatt

SEQ ID NO: 328634 - DNA, 20 bp, human
gaaaataattgatgtttgat

SEQ ID NO: 328635 - DNA, 20 bp, human
gctgactgatatttattctt

SEQ ID NO: 328636 - DNA, 20 bp, human
ggatatgtcctctgtgaagc

SEQ ID NO: 328637 - DNA, 20 bp, human
ggtcacttatgtataattgt

SEQ ID NO: 328638 - DNA, 20 bp, human
gttgtgtgccaatacacaat

SEQ ID NO: 328639 - DNA, 20 bp, human
ggtgcttcacatgctgtcat

SEQ ID NO: 328640 - DNA, 20 bp, human
ggtgcatcccggcttcacag

SEQ ID NO: 328641 - DNA, 20 bp, human
gatgtcacacaactagattc

SEQ ID NO: 328642 - DNA, 20 bp, human
gaactttttacttatggcta

SEQ ID NO: 328643 - DNA, 20 bp, human
gaaatacaactttttactta

SEQ ID NO: 328644 - DNA, 20 bp, human
ggtctttttactgtgcatcc

SEQ ID NO: 328645 - DNA, 20 bp, human
gtaatcttcctattgtgtat

SEQ ID NO: 328646 - DNA, 20 bp, human
ggatgggactattggatacc

SEQ ID NO: 328647 - DNA, 20 bp, human
gtattggataccagggtgat

SEQ ID NO: 328648 - DNA, 20 bp, human
ggtacttatgtcattcaaaa

SEQ ID NO: 328649 - DNA, 20 bp, human
gtaatcaaacccaatcaccc

SEQ ID NO: 328650 - DNA, 20 bp, human
gatatacaaggcttttggat

SEQ ID NO: 328651 - DNA, 20 bp, human
gatcaatatttttcttgacc

SEQ ID NO: 328652 - DNA, 20 bp, human
gggcttttggatgggactat

SEQ ID NO: 328653 - DNA, 20 bp, human
gtctaccatgcctggctaat

SEQ ID NO: 328654 - DNA, 20 bp, human
gttattatatacaaggcttt

SEQ ID NO: 328655 - DNA, 20 bp, human
gagtgttattattatataca

SEQ ID NO: 328656 - DNA, 20 bp, human
gtacgtgtaggagtagtgca

SEQ ID NO: 328657 - DNA, 20 bp, human
gcctgagagagccttctaat

SEQ ID NO: 328658 - DNA, 20 bp, human
gctaattggatgtcagcaga

SEQ ID NO: 328659 - DNA, 20 bp, human
gattggatgtcagcagaggg

SEQ ID NO: 328660 - DNA, 20 bp, human
gtgtaggagtagtgcagggc

SEQ ID NO: 328661 - DNA, 20 bp, human
ggggtggggaatcaggcttc

SEQ ID NO: 328662 - DNA, 20 bp, human
gggctgcctgctgcagtggt

SEQ ID NO: 328663 - DNA, 20 bp, human
ggggtttggatggataatta

SEQ ID NO: 328664 - DNA, 20 bp, human
gtcagcttcttcagctgtat

SEQ ID NO: 328665 - DNA, 20 bp, human
gttataacttttggttaggg

SEQ ID NO: 328666 - DNA, 20 bp, human
gtacaaacacgcaacaaatt

SEQ ID NO: 328667 - DNA, 20 bp, human
gaaagtgaactacctatcat

SEQ ID NO: 328668 - DNA, 20 bp, human
gatgttcaggctcaggttgt

SEQ ID NO: 328669 - DNA, 20 bp, human
ggacttgataaataatggtg

SEQ ID NO: 328670 - DNA, 20 bp, human
gcactaggatgttcaggctc

SEQ ID NO: 328671 - DNA, 20 bp, human
gttcctaaagagtaagtgaa

SEQ ID NO: 328672 - DNA, 20 bp, human
gggctgaaatttgccttact

SEQ ID NO: 328673 - DNA, 20 bp, human
gtctttaggaagccaatgat

SEQ ID NO: 328674 - DNA, 20 bp, human
gtcttacactggtaacatac

SEQ ID NO: 328675 - DNA, 20 bp, human
gatttcagccaatattctaa

SEQ ID NO: 328676 - DNA, 20 bp, human
gtaaacagtacagctgtctg

SEQ ID NO: 328677 - DNA, 20 bp, human
gacaacttgtggtttctagc

SEQ ID NO: 328678 - DNA, 20 bp, human
gaggatgtcatggggacatg

SEQ ID NO: 328679 - DNA, 20 bp, human
gctgtactgtttaaagtgat

SEQ ID NO: 328680 - DNA, 20 bp, human
gcctcagtgtcatgtcactg

SEQ ID NO: 328681 - DNA, 20 bp, human
gttgtcataggtacaacttg

SEQ ID NO: 328682 - DNA, 20 bp, human
gtatgattacaaactagctg

SEQ ID NO: 328683 - DNA, 20 bp, human
gcaaaataagtgcagcagaa

SEQ ID NO: 328684 - DNA, 20 bp, human
gcatggggacatggggacta

SEQ ID NO: 328685 - DNA, 20 bp, human
ggttagaataaggatgtcat

SEQ ID NO: 328686 - DNA, 20 bp, human
ggacttaaacagtacatcgt

SEQ ID NO: 328687 - DNA, 20 bp, human
gagtgctccctgtaatgcaa

SEQ ID NO: 328688 - DNA, 20 bp, human
gtatcccagcagctttgggt

SEQ ID NO: 328689 - DNA, 20 bp, human
gaggacgccattgcattaca

SEQ ID NO: 328690 - DNA, 20 bp, human
gcccagaagctcagggaacc

SEQ ID NO: 328691 - DNA, 20 bp, human
gggtaataaaatagagataa

SEQ ID NO: 328692 - DNA, 20 bp, human
gggttggttcccagaagctc

SEQ ID NO: 328693 - DNA, 20 bp, human
gtattccagttcaagtttac

SEQ ID NO: 328694 - DNA, 20 bp, human
gcccacctgtaaacttgaac

SEQ ID NO: 328695 - DNA, 20 bp, human
gggaaccaacccaaagctgc

SEQ ID NO: 328696 - DNA, 20 bp, human
ggactagacaaaggtttaga

SEQ ID NO: 328697 - DNA, 20 bp, human
ggatgaccaatcccaaatga

SEQ ID NO: 328698 - DNA, 20 bp, human
gtattaacataaatagtgaa

SEQ ID NO: 328699 - DNA, 20 bp, human
gtatgagtgtttctagcctg

SEQ ID NO: 328700 - DNA, 20 bp, human
gctttgccttcatttgggat

SEQ ID NO: 328701 - DNA, 20 bp, human
gttccatctcaaatgtactt

SEQ ID NO: 328702 - DNA, 20 bp, human
gtggtgtgtaataaaaagag

SEQ ID NO: 328703 - DNA, 20 bp, human
gagtgcataatttgttagat

SEQ ID NO: 328704 - DNA, 20 bp, human
gattgtgtttgataagacac

SEQ ID NO: 328705 - DNA, 20 bp, human
gttatgcactacttactgaa

SEQ ID NO: 328706 - DNA, 20 bp, human
gctcccctctactgtcctca

SEQ ID NO: 328707 - DNA, 20 bp, human
gcccaagattacacacagac

SEQ ID NO: 328708 - DNA, 20 bp, human
gttccctgaggacagtagag

SEQ ID NO: 328709 - DNA, 20 bp, human
gcgtcagcaagtatggtgaa

SEQ ID NO: 328710 - DNA, 20 bp, human
gccttcccaagattacacag

SEQ ID NO: 328711 - DNA, 20 bp, human
gccaagtgcgtcagcaagta

SEQ ID NO: 328712 - DNA, 20 bp, human
ggtgaaagagacagtgatct

SEQ ID NO: 328713 - DNA, 20 bp, human
gttaagaggtagaaagcatg

SEQ ID NO: 328714 - DNA, 20 bp, human
gttctctggactccagtgtc

SEQ ID NO: 328715 - DNA, 20 bp, human
gaagagacagtgatcttgga

SEQ ID NO: 328716 - DNA, 20 bp, human
gcagaagtcaaataaagttg

SEQ ID NO: 328717 - DNA, 20 bp, human
gagactgttgttaatatatg

SEQ ID NO: 328718 - DNA, 20 bp, human
gttctggaaatattccacag

SEQ ID NO: 328719 - DNA, 20 bp, human
gtggcaaaatctcatctctg

SEQ ID NO: 328720 - DNA, 20 bp, human
gaggagctggttcattattg

SEQ ID NO: 328721 - DNA, 20 bp, human
gagggtcattcatgaataaa

SEQ ID NO: 328722 - DNA, 20 bp, human
gtgcttattagacatacaag

SEQ ID NO: 328723 - DNA, 20 bp, human
gaaattctaaacagaagagt

SEQ ID NO: 328724 - DNA, 20 bp, human
gattcatgaataaaaggagc

SEQ ID NO: 328725 - DNA, 20 bp, human
gtaaaaataaaatagaaaat

SEQ ID NO: 328726 - DNA, 20 bp, human
ggaggcaggagttgatccca

SEQ ID NO: 328727 - DNA, 20 bp, human
gttagctatctcacccaaaa

SEQ ID NO: 328728 - DNA, 20 bp, human
gaactacaaaatgcctgaga

SEQ ID NO: 328729 - DNA, 20 bp, human
ggctatctcacccaaaatgg

SEQ ID NO: 328730 - DNA, 20 bp, human
ggctaataccacctataatg

SEQ ID NO: 328731 - DNA, 20 bp, human
gtgtcctaataattactcac

SEQ ID NO: 328732 - DNA, 20 bp, human
gttttgaacccaaaatccct

SEQ ID NO: 328733 - DNA, 20 bp, human
gggtaagtcaggtcatgtct

SEQ ID NO: 328734 - DNA, 20 bp, human
gtgtgtgcctcaggtaagtc

SEQ ID NO: 328735 - DNA, 20 bp, human
gaggaaagatcaacggaact

SEQ ID NO: 328736 - DNA, 20 bp, human
gaggtggctgggctttaact

SEQ ID NO: 328737 - DNA, 20 bp, human
gggagctgaagacaaaactc

SEQ ID NO: 328738 - DNA, 20 bp, human
gtcaacaagcatagagcata

SEQ ID NO: 328739 - DNA, 20 bp, human
gatagggaacccaaatccaa

SEQ ID NO: 328740 - DNA, 20 bp, human
ggtcctcagcaagttatgaa

SEQ ID NO: 328741 - DNA, 20 bp, human
ggaagggaactgaatttagt

SEQ ID NO: 328742 - DNA, 20 bp, human
gaaagtctttgcctagcagg

SEQ ID NO: 328743 - DNA, 20 bp, human
gtttctactttattattaga

SEQ ID NO: 328744 - DNA, 20 bp, human
gtgaaaagtctttgcctagc

SEQ ID NO: 328745 - DNA, 20 bp, human
gctttgcctagcaggtggct

SEQ ID NO: 328746 - DNA, 20 bp, human
gaggccaactaagagagtag

SEQ ID NO: 328747 - DNA, 20 bp, human
gtatatttgaggtgtagggg

SEQ ID NO: 328748 - DNA, 20 bp, human
ggcatatatttgaggtgtag

SEQ ID NO: 328749 - DNA, 20 bp, human
gtaggttttgccacatgttc

SEQ ID NO: 328750 - DNA, 20 bp, human
ggtttacaaagtgtgtgttt

SEQ ID NO: 328751 - DNA, 20 bp, human
gaaaagcagctaaattatgc

SEQ ID NO: 328752 - DNA, 20 bp, human
gacctagtatgaaagccttt

SEQ ID NO: 328753 - DNA, 20 bp, human
gaaatgaatgcatatatttg

SEQ ID NO: 328754 - DNA, 20 bp, human
gagttggcctgagaatcaga

SEQ ID NO: 328755 - DNA, 20 bp, human
gtgtaaacagattttactaa

SEQ ID NO: 328756 - DNA, 20 bp, human
gagatgagagatgcagtcta

SEQ ID NO: 328757 - DNA, 20 bp, human
ggattcatcttcaaaatcga

SEQ ID NO: 328758 - DNA, 20 bp, human
gggatagctgtttaatacag

SEQ ID NO: 328759 - DNA, 20 bp, human
gactatacacattaggagtt

SEQ ID NO: 328760 - DNA, 20 bp, human
gaggcatccattacataatg

SEQ ID NO: 328761 - DNA, 20 bp, human
gtacttgatgtaagatgaaa

SEQ ID NO: 328762 - DNA, 20 bp, human
gtctaagaactatacacatt

SEQ ID NO: 328763 - DNA, 20 bp, human
gtagcattactttaaaaata

SEQ ID NO: 328764 - DNA, 20 bp, human
gaaataacctcattatgtaa

SEQ ID NO: 328765 - DNA, 20 bp, human
gttaattttggttccagctt

SEQ ID NO: 328766 - DNA, 20 bp, human
gtgtacctgcacaatgcttc

SEQ ID NO: 328767 - DNA, 20 bp, human
ggctgagagtattacgtata

SEQ ID NO: 328768 - DNA, 20 bp, human
gctgacaattcaagaaaggc

SEQ ID NO: 328769 - DNA, 20 bp, human
ggtccatttccagtgcttgt

SEQ ID NO: 328770 - DNA, 20 bp, human
gcaggttcttgattaattca

SEQ ID NO: 328771 - DNA, 20 bp, human
gttatataatgaatcaccag

SEQ ID NO: 328772 - DNA, 20 bp, human
gcatgctgacaattcaagaa

SEQ ID NO: 328773 - DNA, 20 bp, human
gagaacctgaagcattgtgc

SEQ ID NO: 328774 - DNA, 20 bp, human
gttccaacaagcactggaaa

SEQ ID NO: 328775 - DNA, 20 bp, human
gaaatgtttcactcttctga

SEQ ID NO: 328776 - DNA, 20 bp, human
gtcaataaagagttaactgt

SEQ ID NO: 328777 - DNA, 20 bp, human
gaccctccagacacaacttc

SEQ ID NO: 328778 - DNA, 20 bp, human
gtactacaagtcttttgatt

SEQ ID NO: 328779 - DNA, 20 bp, human
gaggatgatagaatgaattc

SEQ ID NO: 328780 - DNA, 20 bp, human
gagcataataaaaggtatgt

SEQ ID NO: 328781 - DNA, 20 bp, human
gctccagaagttgtgtctgg

SEQ ID NO: 328782 - DNA, 20 bp, human
ggccagacaagaaaaatagt

SEQ ID NO: 328783 - DNA, 20 bp, human
gatttagtgtgtattaacta

SEQ ID NO: 328784 - DNA, 20 bp, human
gaagtgaaaagcataataaa

SEQ ID NO: 328785 - DNA, 20 bp, human
gcttctccagaagttgtgtc

SEQ ID NO: 328786 - DNA, 20 bp, human
gtctgcttcttcaatgacct

SEQ ID NO: 328787 - DNA, 20 bp, human
gggtcatagaatctaattac

SEQ ID NO: 328788 - DNA, 20 bp, human
ggaggaggtgttaacttctt

SEQ ID NO: 328789 - DNA, 20 bp, human
ggcccactgacagcatgagg

SEQ ID NO: 328790 - DNA, 20 bp, human
gtaggaaaataagtgacacg

SEQ ID NO: 328791 - DNA, 20 bp, human
gatagttctacagtaaatga

SEQ ID NO: 328792 - DNA, 20 bp, human
gggtgttaacttcttgggaa

SEQ ID NO: 328793 - DNA, 20 bp, human
gtgtgatgtgttatactttg

SEQ ID NO: 328794 - DNA, 20 bp, human
gattacaggtagacatagat

SEQ ID NO: 328795 - DNA, 20 bp, human
gatgtatattgcaatatctc

SEQ ID NO: 328796 - DNA, 20 bp, human
gtgtgagttaacttgagtta

SEQ ID NO: 328797 - DNA, 20 bp, human
gacatctgctgatactacct

SEQ ID NO: 328798 - DNA, 20 bp, human
ggaaaatgttatttagatgg

SEQ ID NO: 328799 - DNA, 20 bp, human
gaagtgcagcgcgtttaaag

SEQ ID NO: 328800 - DNA, 20 bp, human
ggttgggaggttacttaacg

SEQ ID NO: 328801 - DNA, 20 bp, human
gtaacattttctgctatcaa

SEQ ID NO: 328802 - DNA, 20 bp, human
ggattttgtcatttgattaa

SEQ ID NO: 328803 - DNA, 20 bp, human
ggttaagagcatggtaatta

SEQ ID NO: 328804 - DNA, 20 bp, human
ggagttggcaaaatctttag

SEQ ID NO: 328805 - DNA, 20 bp, human
ggaagaatatctgtgatgtt

SEQ ID NO: 328806 - DNA, 20 bp, human
gcactcttgaattcctgata

SEQ ID NO: 328807 - DNA, 20 bp, human
gactgctaaggttcaaagtt

SEQ ID NO: 328808 - DNA, 20 bp, human
gtctgataccacagtatgtg

SEQ ID NO: 328809 - DNA, 20 bp, human
gctgtggtatcagactgcta

SEQ ID NO: 328810 - DNA, 20 bp, human
gttcaagagtgcctgacctt

SEQ ID NO: 328811 - DNA, 20 bp, human
gaaaactatgaatatatact

SEQ ID NO: 328812 - DNA, 20 bp, human
gaatatctacaattggtctt

SEQ ID NO: 328813 - DNA, 20 bp, human
gatataagcttcccaaggtc

SEQ ID NO: 328814 - DNA, 20 bp, human
gttgaacttcctcaacgtgc

SEQ ID NO: 328815 - DNA, 20 bp, human
gatcatgtttatttaggttt

SEQ ID NO: 328816 - DNA, 20 bp, human
gcatgggcatgttttagatc

SEQ ID NO: 328817 - DNA, 20 bp, human
gttcggtaatctatgaaatt

SEQ ID NO: 328818 - DNA, 20 bp, human
gagttgcattttgcggtcat

SEQ ID NO: 328819 - DNA, 20 bp, human
gtacttgtttccaggagtcc

SEQ ID NO: 328820 - DNA, 20 bp, human
gcagactaattaattggaac

SEQ ID NO: 328821 - DNA, 20 bp, human
gttcatagattaccgaacta

SEQ ID NO: 328822 - DNA, 20 bp, human
gaaacaagtaattacaatac

SEQ ID NO: 328823 - DNA, 20 bp, human
gtctatgaaattaggagttc

SEQ ID NO: 328824 - DNA, 20 bp, human
gaatggaatagcatgaaatt

SEQ ID NO: 328825 - DNA, 20 bp, human
ggttttagatccgggactcc

SEQ ID NO: 328826 - DNA, 20 bp, human
gtgaagaaaaagggtcttcg

SEQ ID NO: 328827 - DNA, 20 bp, human
gcacttcaggcatgtgacat

SEQ ID NO: 328828 - DNA, 20 bp, human
gaatagacttttgaagaaaa

SEQ ID NO: 328829 - DNA, 20 bp, human
gaaagcttggttctatctac

SEQ ID NO: 328830 - DNA, 20 bp, human
gatttcctagatcaaaatta

SEQ ID NO: 328831 - DNA, 20 bp, human
gttaatgagagaattctatg

SEQ ID NO: 328832 - DNA, 20 bp, human
gaattttgtgtctgagtaaa

SEQ ID NO: 328833 - DNA, 20 bp, human
ggtaaatggagtcataggaa

SEQ ID NO: 328834 - DNA, 20 bp, human
gatatgaaaacacaatttag

SEQ ID NO: 328835 - DNA, 20 bp, human
ggatgtacatataaagcatc

SEQ ID NO: 328836 - DNA, 20 bp, human
gtgtaatctgctgaatccag

SEQ ID NO: 328837 - DNA, 20 bp, human
gagttccagatgagtcatct

SEQ ID NO: 328838 - DNA, 20 bp, human
gcaagcctatcttctggctc

SEQ ID NO: 328839 - DNA, 20 bp, human
gtagatctaaagcataggct

SEQ ID NO: 328840 - DNA, 20 bp, human
ggagtcgttctcaagctcaa

SEQ ID NO: 328841 - DNA, 20 bp, human
gacatactgggaaccgctct

SEQ ID NO: 328842 - DNA, 20 bp, human
gttctatagatctaaagcat

SEQ ID NO: 328843 - DNA, 20 bp, human
gacctcattatattgttgag

SEQ ID NO: 328844 - DNA, 20 bp, human
gtttatgttgctcacatact

SEQ ID NO: 328845 - DNA, 20 bp, human
gacatacaaattgcctagag

SEQ ID NO: 328846 - DNA, 20 bp, human
ggagcaagatagcctatcta

SEQ ID NO: 328847 - DNA, 20 bp, human
gaaaagctataatataacag

SEQ ID NO: 328848 - DNA, 20 bp, human
gtccaatgaaagtatgagaa

SEQ ID NO: 328849 - DNA, 20 bp, human
gataaggaagttaaggctca

SEQ ID NO: 328850 - DNA, 20 bp, human
gaatgaaagtatgagaaggg

SEQ ID NO: 328851 - DNA, 20 bp, human
ggaggatggaatgataaaaa

SEQ ID NO: 328852 - DNA, 20 bp, human
gtaatataacagagggttct

SEQ ID NO: 328853 - DNA, 20 bp, human
gttgattctgacccctagat

SEQ ID NO: 328854 - DNA, 20 bp, human
gtattattggaagtagaatg

SEQ ID NO: 328855 - DNA, 20 bp, human
gcttttaattcatatgagat

SEQ ID NO: 328856 - DNA, 20 bp, human
gcaaggccgcgctttttcta

SEQ ID NO: 328857 - DNA, 20 bp, human
gtagatgagtcatcttgatc

SEQ ID NO: 328858 - DNA, 20 bp, human
gataattaatgcactgcatt

SEQ ID NO: 328859 - DNA, 20 bp, human
gagattccctagaaaaagcg

SEQ ID NO: 328860 - DNA, 20 bp, human
gcaagttattgctacaatga

SEQ ID NO: 328861 - DNA, 20 bp, human
ggtcagcttttactgtgctc

SEQ ID NO: 328862 - DNA, 20 bp, human
gttaaattatgaagcacagg

SEQ ID NO: 328863 - DNA, 20 bp, human
gttggtatgggtccaaagca

SEQ ID NO: 328864 - DNA, 20 bp, human
gcatttaaattatgaagcac

SEQ ID NO: 328865 - DNA, 20 bp, human
ggcactgcatttggttgtca

SEQ ID NO: 328866 - DNA, 20 bp, human
gcctacctaactcccagtac

SEQ ID NO: 328867 - DNA, 20 bp, human
gctgggagttaggtaggctt

SEQ ID NO: 328868 - DNA, 20 bp, human
gcaggttttgagaggttacg

SEQ ID NO: 328869 - DNA, 20 bp, human
gagaagaaagcatcctgtac

SEQ ID NO: 328870 - DNA, 20 bp, human
gcaatggcaaggccatggcc

SEQ ID NO: 328871 - DNA, 20 bp, human
gcacagcaattttgttgcac

SEQ ID NO: 328872 - DNA, 20 bp, human
gaggagggagataagagcaa

SEQ ID NO: 328873 - DNA, 20 bp, human
gaagagcaatggcaaggcca

SEQ ID NO: 328874 - DNA, 20 bp, human
ggttagaaacaggttttgag

SEQ ID NO: 328875 - DNA, 20 bp, human
gggagataagagcaatggca

SEQ ID NO: 328876 - DNA, 20 bp, human
gggatgaggcccactatttg

SEQ ID NO: 328877 - DNA, 20 bp, human
ggcaatagtaggaagttccc

SEQ ID NO: 328878 - DNA, 20 bp, human
gcttctgttcagaaggttga

SEQ ID NO: 328879 - DNA, 20 bp, human
gttcagaaggttgatggagc

SEQ ID NO: 328880 - DNA, 20 bp, human
gctggagaattggcaatagt

SEQ ID NO: 328881 - DNA, 20 bp, human
gtattcttgaaaagcagaac

SEQ ID NO: 328882 - DNA, 20 bp, human
gtgactaaaccacaaatagt

SEQ ID NO: 328883 - DNA, 20 bp, human
gcacaaaggaaaccttctca

SEQ ID NO: 328884 - DNA, 20 bp, human
gatgtcaatcatactaaaaa

SEQ ID NO: 328885 - DNA, 20 bp, human
ggcaaaaaccaccacttaca

SEQ ID NO: 328886 - DNA, 20 bp, human
gacaaaccaagccaagtctt

SEQ ID NO: 328887 - DNA, 20 bp, human
gtcctgccaaagcaaaatat

SEQ ID NO: 328888 - DNA, 20 bp, human
ggcatgaggtatgttcttct

SEQ ID NO: 328889 - DNA, 20 bp, human
gctcaccccatattttgctt

SEQ ID NO: 328890 - DNA, 20 bp, human
gatgactttctttgattaaa

SEQ ID NO: 328891 - DNA, 20 bp, human
gggaaaatattgtagaaatc

SEQ ID NO: 328892 - DNA, 20 bp, human
gtaaactaataaagattctg

SEQ ID NO: 328893 - DNA, 20 bp, human
gaaggagaaggaatagttac

SEQ ID NO: 328894 - DNA, 20 bp, human
gcataacagctgcctgcatg

SEQ ID NO: 328895 - DNA, 20 bp, human
gacagaaagtgtaataaaaa

SEQ ID NO: 328896 - DNA, 20 bp, human
gataggtgctgtgtcaagac

SEQ ID NO: 328897 - DNA, 20 bp, human
gtctctgttaatatcctgat

SEQ ID NO: 328898 - DNA, 20 bp, human
gtttctttgcagaactggtg

SEQ ID NO: 328899 - DNA, 20 bp, human
gatcccctctgtagaatata

SEQ ID NO: 328900 - DNA, 20 bp, human
gcaccttatattctacagag

SEQ ID NO: 328901 - DNA, 20 bp, human
gttatgaaatcaagcaattc

SEQ ID NO: 328902 - DNA, 20 bp, human
gattttttgttagaaattgt

SEQ ID NO: 328903 - DNA, 20 bp, human
gtggagaaagcaacatttaa

SEQ ID NO: 328904 - DNA, 20 bp, human
gaatacttattttactttac

SEQ ID NO: 328905 - DNA, 20 bp, human
ggagttatcatttctatcta

SEQ ID NO: 328906 - DNA, 20 bp, human
gcatccttcaggagccgtaa

SEQ ID NO: 328907 - DNA, 20 bp, human
gacaacaaactcatagattc

SEQ ID NO: 328908 - DNA, 20 bp, human
gatacctttacggctcctga

SEQ ID NO: 328909 - DNA, 20 bp, human
ggggtgattgaataccttta

SEQ ID NO: 328910 - DNA, 20 bp, human
ggcacaaatgttaagcgtta

SEQ ID NO: 328911 - DNA, 20 bp, human
gtcagtcatcatattatacg

SEQ ID NO: 328912 - DNA, 20 bp, human
gttatgtagaatgcttaagg

SEQ ID NO: 328913 - DNA, 20 bp, human
gattttgaagtcaaattttc

SEQ ID NO: 328914 - DNA, 20 bp, human
ggagaatgagaaaataagaa

SEQ ID NO: 328915 - DNA, 20 bp, human
gcatttatgtagaatgctta

SEQ ID NO: 328916 - DNA, 20 bp, human
gggaatattagaggacccat

SEQ ID NO: 328917 - DNA, 20 bp, human
gttaataggacagtcacata

SEQ ID NO: 328918 - DNA, 20 bp, human
gttcacagaaatagagtatg

SEQ ID NO: 328919 - DNA, 20 bp, human
gaattatgacatattattct

SEQ ID NO: 328920 - DNA, 20 bp, human
gtgtattgaattggagttgt

SEQ ID NO: 328921 - DNA, 20 bp, human
ggtcactctttttgctgctt

SEQ ID NO: 328922 - DNA, 20 bp, human
gagagataaagtatgaattt

SEQ ID NO: 328923 - DNA, 20 bp, human
ggaagtaagaggaatattag

SEQ ID NO: 328924 - DNA, 20 bp, human
gcatgtaaatgcttacccat

SEQ ID NO: 328925 - DNA, 20 bp, human
gtgtaggcttctcaaatcac

SEQ ID NO: 328926 - DNA, 20 bp, human
gagaagaagaaactgtactc

SEQ ID NO: 328927 - DNA, 20 bp, human
gaacaggaaagatttttgta

SEQ ID NO: 328928 - DNA, 20 bp, human
gatagagattcatcagctat

SEQ ID NO: 328929 - DNA, 20 bp, human
gattggggaagaggtgctga

SEQ ID NO: 328930 - DNA, 20 bp, human
gcagatttaggtaaaacaag

SEQ ID NO: 328931 - DNA, 20 bp, human
gaagtttaagatacttcaca

SEQ ID NO: 328932 - DNA, 20 bp, human
gatgaaaaaatgatatattt

SEQ ID NO: 328933 - DNA, 20 bp, human
gagtagaaaaattgtttgac

SEQ ID NO: 328934 - DNA, 20 bp, human
gaattagaaacttgttagta

SEQ ID NO: 328935 - DNA, 20 bp, human
gtgtatgcacaacatttata

SEQ ID NO: 328936 - DNA, 20 bp, human
gcctgtgtctggtacatgaa

SEQ ID NO: 328937 - DNA, 20 bp, human
gaatggaggtcctggggaat

SEQ ID NO: 328938 - DNA, 20 bp, human
gggtacatgaatggaggtcc

SEQ ID NO: 328939 - DNA, 20 bp, human
gatgggcacagtcttgaatg

SEQ ID NO: 328940 - DNA, 20 bp, human
gagaaaatatgctgcgggat

SEQ ID NO: 328941 - DNA, 20 bp, human
gaataggtttttgaaatgtc

SEQ ID NO: 328942 - DNA, 20 bp, human
gataaataagaaatcctata

SEQ ID NO: 328943 - DNA, 20 bp, human
gtctggatttactaaattta

SEQ ID NO: 328944 - DNA, 20 bp, human
gatcacacataaaaattatc

SEQ ID NO: 328945 - DNA, 20 bp, human
gacgtggcatttatttcatc

SEQ ID NO: 328946 - DNA, 20 bp, human
gtacacaattcatcagttgt

SEQ ID NO: 328947 - DNA, 20 bp, human
gttctgttgacattgtatga

SEQ ID NO: 328948 - DNA, 20 bp, human
gtgcagtaattaactgattt

SEQ ID NO: 328949 - DNA, 20 bp, human
gaattagaaacttcttagta

SEQ ID NO: 328950 - DNA, 20 bp, human
gaagcttaagattcttcata

SEQ ID NO: 328951 - DNA, 20 bp, human
gagaagaggaaactggactc

SEQ ID NO: 328952 - DNA, 20 bp, human
gtgctgcaagaagaggaaac

SEQ ID NO: 328953 - DNA, 20 bp, human
gaaatgaaaatgatatattt

SEQ ID NO: 328954 - DNA, 20 bp, human
ggaaaatatgctgcaagaag

SEQ ID NO: 328955 - DNA, 20 bp, human
gctgatttaggtaaaagtag

SEQ ID NO: 328956 - DNA, 20 bp, human
gatacagcaaatactggggg

SEQ ID NO: 328957 - DNA, 20 bp, human
gtgcttcccagcacacttga

SEQ ID NO: 328958 - DNA, 20 bp, human
gaggtggccatcaagtgtgc

SEQ ID NO: 328959 - DNA, 20 bp, human
gaatagatggaaactgtttt

SEQ ID NO: 328960 - DNA, 20 bp, human
gaacagtttccatctattac

SEQ ID NO: 328961 - DNA, 20 bp, human
gcttatacagcaaatactgg

SEQ ID NO: 328962 - DNA, 20 bp, human
gggcttgaggtaggagcttt

SEQ ID NO: 328963 - DNA, 20 bp, human
gatcaaaggaggagggcttg

SEQ ID NO: 328964 - DNA, 20 bp, human
gagctttaggctaaataagt

SEQ ID NO: 328965 - DNA, 20 bp, human
ggtattcatgaaggtagcct

SEQ ID NO: 328966 - DNA, 20 bp, human
gtgaatgtactaaatttttg

SEQ ID NO: 328967 - DNA, 20 bp, human
ggtaaaagtatgctgcagaa

SEQ ID NO: 328968 - DNA, 20 bp, human
gagaaaggaaacagtgattc

SEQ ID NO: 328969 - DNA, 20 bp, human
gttgatgaaccctatatttg

SEQ ID NO: 328970 - DNA, 20 bp, human
gacttgatactaaggtcaaa

SEQ ID NO: 328971 - DNA, 20 bp, human
gaaagatatttgaaagacgc

SEQ ID NO: 328972 - DNA, 20 bp, human
ggtaatgaaaaaaatctgtc

SEQ ID NO: 328973 - DNA, 20 bp, human
gctcatgtgtaatctaattt

SEQ ID NO: 328974 - DNA, 20 bp, human
gatggaaataataatgaatt

SEQ ID NO: 328975 - DNA, 20 bp, human
gtatttaaatcctcaaatat

SEQ ID NO: 328976 - DNA, 20 bp, human
gagacatgatccatgcacat

SEQ ID NO: 328977 - DNA, 20 bp, human
gtaggaagtcaactgttcaa

SEQ ID NO: 328978 - DNA, 20 bp, human
ggtggtgtgatgaaatatgc

SEQ ID NO: 328979 - DNA, 20 bp, human
gcaaaatattaaacaattac

SEQ ID NO: 328980 - DNA, 20 bp, human
ggcatggatcatgtctgatt

SEQ ID NO: 328981 - DNA, 20 bp, human
gagttgacttcctatgtgca

SEQ ID NO: 328982 - DNA, 20 bp, human
gtatcatatttcatggttgc

SEQ ID NO: 328983 - DNA, 20 bp, human
gttcaggatttgatagatac

SEQ ID NO: 328984 - DNA, 20 bp, human
gcttgactgagtaaatagag

SEQ ID NO: 328985 - DNA, 20 bp, human
gttagtaatatcatatttca

SEQ ID NO: 328986 - DNA, 20 bp, human
gactactgatgttgttcttc

SEQ ID NO: 328987 - DNA, 20 bp, human
gtaagcacataaagtgtcac

SEQ ID NO: 328988 - DNA, 20 bp, human
gagactcataatttgtcagg

SEQ ID NO: 328989 - DNA, 20 bp, human
gttacacatcgatttctatg

SEQ ID NO: 328990 - DNA, 20 bp, human
gctcctttctggtaattttt

SEQ ID NO: 328991 - DNA, 20 bp, human
gattcaatgaaactcctttc

SEQ ID NO: 328992 - DNA, 20 bp, human
gctctataaatagaaaatac

SEQ ID NO: 328993 - DNA, 20 bp, human
gtcttctttcttgaattctg

SEQ ID NO: 328994 - DNA, 20 bp, human
ggatagactcataatttgtc

SEQ ID NO: 328995 - DNA, 20 bp, human
gagtgttttatcagttttgg

SEQ ID NO: 328996 - DNA, 20 bp, human
gtggtgcatgccccattcat

SEQ ID NO: 328997 - DNA, 20 bp, human
gggggcatgcaccaaagtcc

SEQ ID NO: 328998 - DNA, 20 bp, human
gcaaagaggtaattccttta

SEQ ID NO: 328999 - DNA, 20 bp, human
gctattaggtactattaaaa

SEQ ID NO: 329000 - DNA, 20 bp, human
gttcattctccccatgaatg

SEQ ID NO: 329001 - DNA, 20 bp, human
gagattatcttcacaaagat

SEQ ID NO: 329002 - DNA, 20 bp, human
ggtttcatcactagccaaag

SEQ ID NO: 329003 - DNA, 20 bp, human
gaatggaacgacagacagtg

SEQ ID NO: 329004 - DNA, 20 bp, human
gccaccctccactgtcaagt

SEQ ID NO: 329005 - DNA, 20 bp, human
gagtggggcctacttgacag

SEQ ID NO: 329006 - DNA, 20 bp, human
gtgcacaaggatgacttttg

SEQ ID NO: 329007 - DNA, 20 bp, human
gtgcgagaatgagtctcctg

SEQ ID NO: 329008 - DNA, 20 bp, human
gctactacttttgtggctat

SEQ ID NO: 329009 - DNA, 20 bp, human
gtcaatgtttgtatatgtag

SEQ ID NO: 329010 - DNA, 20 bp, human
gctcattctcgcagtgaatt

SEQ ID NO: 329011 - DNA, 20 bp, human
ggaacttctccatatagtat

SEQ ID NO: 329012 - DNA, 20 bp, human
gcatatacaaacattgaaat

SEQ ID NO: 329013 - DNA, 20 bp, human
gccacaaaagtagtagcctc

SEQ ID NO: 329014 - DNA, 20 bp, human
gcagctttacctatactata

SEQ ID NO: 329015 - DNA, 20 bp, human
gtgggcatgcaccaaattcc

SEQ ID NO: 329016 - DNA, 20 bp, human
gcatcctcacatacttctag

SEQ ID NO: 329017 - DNA, 20 bp, human
gtcacagacactgacacttt

SEQ ID NO: 329018 - DNA, 20 bp, human
gaaactaggggacccctatc

SEQ ID NO: 329019 - DNA, 20 bp, human
ggatgtatttagaaacagca

SEQ ID NO: 329020 - DNA, 20 bp, human
gtgtcccctagaagtatgtg

SEQ ID NO: 329021 - DNA, 20 bp, human
gctgacccttaggattcaca

SEQ ID NO: 329022 - DNA, 20 bp, human
gccactttaaacatcttccc

SEQ ID NO: 329023 - DNA, 20 bp, human
gtcctctacttgttgtaaaa

SEQ ID NO: 329024 - DNA, 20 bp, human
ggagaacaatgaaccagata

SEQ ID NO: 329025 - DNA, 20 bp, human
gtcctaagggtcagagcttg

SEQ ID NO: 329026 - DNA, 20 bp, human
gaacactagcacactcactg

SEQ ID NO: 329027 - DNA, 20 bp, human
gtgtatacagggaaattaga

SEQ ID NO: 329028 - DNA, 20 bp, human
gatcatggattgtgtaccca

SEQ ID NO: 329029 - DNA, 20 bp, human
gtatgccgatgtaaaatctg

SEQ ID NO: 329030 - DNA, 20 bp, human
gagtgagaaaaaatgtatca

SEQ ID NO: 329031 - DNA, 20 bp, human
gatattttcagacaagccct

SEQ ID NO: 329032 - DNA, 20 bp, human
gctgaccacagattttacat

SEQ ID NO: 329033 - DNA, 20 bp, human
gaattagaaacattctgctt

SEQ ID NO: 329034 - DNA, 20 bp, human
ggataaagctttcctgccct

SEQ ID NO: 329035 - DNA, 20 bp, human
gtaatttccctgtatacaaa

SEQ ID NO: 329036 - DNA, 20 bp, human
gtggagttggctaagaaaat

SEQ ID NO: 329037 - DNA, 20 bp, human
gcactgaatcattgggaatg

SEQ ID NO: 329038 - DNA, 20 bp, human
ggtaccaattccctaaacca

SEQ ID NO: 329039 - DNA, 20 bp, human
gtagggaattggtactcttg

SEQ ID NO: 329040 - DNA, 20 bp, human
gcagccatggtttagggaat

SEQ ID NO: 329041 - DNA, 20 bp, human
gtcaatgtcagccatggttt

SEQ ID NO: 329042 - DNA, 20 bp, human
gttagccaactccaaatatt

SEQ ID NO: 329043 - DNA, 20 bp, human
gcagcttttcactgaatcat

SEQ ID NO: 329044 - DNA, 20 bp, human
gtgaatttgaaagagtaagg

SEQ ID NO: 329045 - DNA, 20 bp, human
gatttgaatttgaaagagta

SEQ ID NO: 329046 - DNA, 20 bp, human
gagcaaagaacagaaatttt

SEQ ID NO: 329047 - DNA, 20 bp, human
gaaaagatatcagaagaagt

SEQ ID NO: 329048 - DNA, 20 bp, human
gacattggcacagaatcatt

SEQ ID NO: 329049 - DNA, 20 bp, human
gcacagaatcattaggaaag

SEQ ID NO: 329050 - DNA, 20 bp, human
gtctttctcagttgagacat

SEQ ID NO: 329051 - DNA, 20 bp, human
gtttggagtaagctaggaaa

SEQ ID NO: 329052 - DNA, 20 bp, human
gtatctccccatcactgtag

SEQ ID NO: 329053 - DNA, 20 bp, human
gaattttccactacagtgat

SEQ ID NO: 329054 - DNA, 20 bp, human
gtcaatatttggagtaagct

SEQ ID NO: 329055 - DNA, 20 bp, human
gtgattttgatataatcata

SEQ ID NO: 329056 - DNA, 20 bp, human
gcagattaaaacagacatat

SEQ ID NO: 329057 - DNA, 20 bp, human
gaatacaatatcagagctgg

SEQ ID NO: 329058 - DNA, 20 bp, human
gtcttggtgtactccacatt

SEQ ID NO: 329059 - DNA, 20 bp, human
ggttatttgcatctttcaaa

SEQ ID NO: 329060 - DNA, 20 bp, human
gctttcaaatggataaataa

SEQ ID NO: 329061 - DNA, 20 bp, human
gattttattcaaacttcgtg

SEQ ID NO: 329062 - DNA, 20 bp, human
gtggagtacaccaagaagac

SEQ ID NO: 329063 - DNA, 20 bp, human
gaaggtaaggcacacagcta

SEQ ID NO: 329064 - DNA, 20 bp, human
gtatgtttgtgtaagttatg

SEQ ID NO: 329065 - DNA, 20 bp, human
gagaagacaggtataaatgt

SEQ ID NO: 329066 - DNA, 20 bp, human
ggcgcccggccgacagtcat

SEQ ID NO: 329067 - DNA, 20 bp, human
gataagatatcagacatgga

SEQ ID NO: 329068 - DNA, 20 bp, human
gaaaacctatgactgtcggc

SEQ ID NO: 329069 - DNA, 20 bp, human
gtcttggtgaattctacatt

SEQ ID NO: 329070 - DNA, 20 bp, human
gaataataagatatcagaca

SEQ ID NO: 329071 - DNA, 20 bp, human
gattattttcaaggtttgtg

SEQ ID NO: 329072 - DNA, 20 bp, human
gatggagggaaactgaagat

SEQ ID NO: 329073 - DNA, 20 bp, human
ggtttattgaaaaaagtaat

SEQ ID NO: 329074 - DNA, 20 bp, human
gacttaaaacctatgactgt

SEQ ID NO: 329075 - DNA, 20 bp, human
gcatttggtaattattttca

SEQ ID NO: 329076 - DNA, 20 bp, human
gtctgggtactaccataaac

SEQ ID NO: 329077 - DNA, 20 bp, human
gaaactggttttggtaatta

SEQ ID NO: 329078 - DNA, 20 bp, human
gtattagtaatgtaatgcct

SEQ ID NO: 329079 - DNA, 20 bp, human
ggctacatgacccactttaa

SEQ ID NO: 329080 - DNA, 20 bp, human
gaaagaagtggcctttaaag

SEQ ID NO: 329081 - DNA, 20 bp, human
gtgacacgtattaggagaaa

SEQ ID NO: 329082 - DNA, 20 bp, human
gatgtagcatgaatagaatt

SEQ ID NO: 329083 - DNA, 20 bp, human
gtcgaaagttatctatttct

SEQ ID NO: 329084 - DNA, 20 bp, human
gcataatggtgttgagagca

SEQ ID NO: 329085 - DNA, 20 bp, human
ggaattcagtgacacgtatt

SEQ ID NO: 329086 - DNA, 20 bp, human
gtcagtgcctgttatgtaac

SEQ ID NO: 329087 - DNA, 20 bp, human
ggtataaagggagcatctga

SEQ ID NO: 329088 - DNA, 20 bp, human
ggctaatagatattgtataa

SEQ ID NO: 329089 - DNA, 20 bp, human
gacagagcctgttacataac

SEQ ID NO: 329090 - DNA, 20 bp, human
gtgtataattgttatataat

SEQ ID NO: 329091 - DNA, 20 bp, human
ggccatcaaagtcaagttaa

SEQ ID NO: 329092 - DNA, 20 bp, human
gttacaatgaaaaagagatt

SEQ ID NO: 329093 - DNA, 20 bp, human
gagaagtaatgaaataatct

SEQ ID NO: 329094 - DNA, 20 bp, human
gattttaaagataattacaa

SEQ ID NO: 329095 - DNA, 20 bp, human
gtatccctcatttccaatga

SEQ ID NO: 329096 - DNA, 20 bp, human
gaacagaagctgaatttgaa

SEQ ID NO: 329097 - DNA, 20 bp, human
ggaggaaaactgccaaaaag

SEQ ID NO: 329098 - DNA, 20 bp, human
ggagcccaacctgtttgctc

SEQ ID NO: 329099 - DNA, 20 bp, human
gctccaggaagggatcggat

SEQ ID NO: 329100 - DNA, 20 bp, human
gcacaaagaacaagatcctc

SEQ ID NO: 329101 - DNA, 20 bp, human
gtctgcccagtattataatc

SEQ ID NO: 329102 - DNA, 20 bp, human
gaaaaagcaatatttgcccg

SEQ ID NO: 329103 - DNA, 20 bp, human
gatgcgcgtaaagagagaaa

SEQ ID NO: 329104 - DNA, 20 bp, human
gcaccaatccgatcccttcc

SEQ ID NO: 329105 - DNA, 20 bp, human
ggttgctttcttattcctcc

SEQ ID NO: 329106 - DNA, 20 bp, human
gtaaagagctgcagatgctg

SEQ ID NO: 329107 - DNA, 20 bp, human
gatctatagcaaaggaaagt

SEQ ID NO: 329108 - DNA, 20 bp, human
gttgcaaaaatgtacaatac

SEQ ID NO: 329109 - DNA, 20 bp, human
gtcatggacatctatagcaa

SEQ ID NO: 329110 - DNA, 20 bp, human
gaaaagtgaaactacaatca

SEQ ID NO: 329111 - DNA, 20 bp, human
gagatcagaaatttttacat

SEQ ID NO: 329112 - DNA, 20 bp, human
gtactaacagaatttgactt

SEQ ID NO: 329113 - DNA, 20 bp, human
ggtcaaattctgttagtaac

SEQ ID NO: 329114 - DNA, 20 bp, human
gcattagcgctttagcattt

SEQ ID NO: 329115 - DNA, 20 bp, human
gtttgaaacaatttctccat

SEQ ID NO: 329116 - DNA, 20 bp, human
gcataaacaatgaaacccta

SEQ ID NO: 329117 - DNA, 20 bp, human
gttcattaatatatacatga

SEQ ID NO: 329118 - DNA, 20 bp, human
gcctgagccagtaatttgat

SEQ ID NO: 329119 - DNA, 20 bp, human
gtgaatgcctatcaaattac

SEQ ID NO: 329120 - DNA, 20 bp, human
gataagaataataaaaggta

SEQ ID NO: 329121 - DNA, 20 bp, human
ggacttataagaataataaa

SEQ ID NO: 329122 - DNA, 20 bp, human
gttaaaaatacaaattgaaa

SEQ ID NO: 329123 - DNA, 20 bp, human
gagtgcttcatattatttta

SEQ ID NO: 329124 - DNA, 20 bp, human
gtgaacagatgtatcattca

SEQ ID NO: 329125 - DNA, 20 bp, human
gcttttttttttttacctta

SEQ ID NO: 329126 - DNA, 20 bp, human
gtaggcactcatgtaaattt

SEQ ID NO: 329127 - DNA, 20 bp, human
gtaacacactcaactcgtat

SEQ ID NO: 329128 - DNA, 20 bp, human
gccagtaactcaatcttcta

SEQ ID NO: 329129 - DNA, 20 bp, human
gataaatgttcactgatgta

SEQ ID NO: 329130 - DNA, 20 bp, human
gaggccaaagacgtgattga

SEQ ID NO: 329131 - DNA, 20 bp, human
gacactcaactcgtattgga

SEQ ID NO: 329132 - DNA, 20 bp, human
gaatccacaggaccaagaag

SEQ ID NO: 329133 - DNA, 20 bp, human
gtagctgcatgctaatccac

SEQ ID NO: 329134 - DNA, 20 bp, human
gtgttcactgatgtaaggtc

SEQ ID NO: 329135 - DNA, 20 bp, human
gccaaaaagtataacaattt

SEQ ID NO: 329136 - DNA, 20 bp, human
ggccaatcttgcctgaggga

SEQ ID NO: 329137 - DNA, 20 bp, human
gagaggccaatcttgcctga

SEQ ID NO: 329138 - DNA, 20 bp, human
gcttacctctctaatgacag

SEQ ID NO: 329139 - DNA, 20 bp, human
gttggcctctgtcattagag

SEQ ID NO: 329140 - DNA, 20 bp, human
gccctgtcagtgttgggtaa

SEQ ID NO: 329141 - DNA, 20 bp, human
gttgaatcatatcatcatgt

SEQ ID NO: 329142 - DNA, 20 bp, human
gacctttacccaacactgac

SEQ ID NO: 329143 - DNA, 20 bp, human
gcaaagcaaaatatttctta

SEQ ID NO: 329144 - DNA, 20 bp, human
gcgcacaaaaccgaaaaata

SEQ ID NO: 329145 - DNA, 20 bp, human
gagcaaattgaatagttcat

SEQ ID NO: 329146 - DNA, 20 bp, human
gcacaggtggtgataaaatt

SEQ ID NO: 329147 - DNA, 20 bp, human
gcacgccagggccggtcgga

SEQ ID NO: 329148 - DNA, 20 bp, human
gaagactgagtgctattcct

SEQ ID NO: 329149 - DNA, 20 bp, human
gttacagtaatgtatccact

SEQ ID NO: 329150 - DNA, 20 bp, human
gtagatggtagtacatttga

SEQ ID NO: 329151 - DNA, 20 bp, human
ggtcggagggtgggaggcta

SEQ ID NO: 329152 - DNA, 20 bp, human
gccagggccggtcggagggt

SEQ ID NO: 329153 - DNA, 20 bp, human
gaatacctaaggtaggtgtc

SEQ ID NO: 329154 - DNA, 20 bp, human
gtcaacccgacacctacctt

SEQ ID NO: 329155 - DNA, 20 bp, human
gatcacacgccagggccggt

SEQ ID NO: 329156 - DNA, 20 bp, human
gagtggcttaaacaatcttt

SEQ ID NO: 329157 - DNA, 20 bp, human
gtacacaagagactgtatca

SEQ ID NO: 329158 - DNA, 20 bp, human
ggtatcaggggacagagcat

SEQ ID NO: 329159 - DNA, 20 bp, human
gatacagtctcttgtgtatt

SEQ ID NO: 329160 - DNA, 20 bp, human
gctaaaatcatcaggtctac

SEQ ID NO: 329161 - DNA, 20 bp, human
gacagcttaatacaattcag

SEQ ID NO: 329162 - DNA, 20 bp, human
gaaaaatcataactgttcat

SEQ ID NO: 329163 - DNA, 20 bp, human
gaatagtttgttcacaagat

SEQ ID NO: 329164 - DNA, 20 bp, human
ggctacaagttctaaaattc

SEQ ID NO: 329165 - DNA, 20 bp, human
gtaaaacacacaaaaatgag

SEQ ID NO: 329166 - DNA, 20 bp, human
gtagacaatgatgaagtaat

SEQ ID NO: 329167 - DNA, 20 bp, human
ggtctattccattactatca

SEQ ID NO: 329168 - DNA, 20 bp, human
gtccaaatgactagaaaatg

SEQ ID NO: 329169 - DNA, 20 bp, human
gacagtgaaattcatctatt

SEQ ID NO: 329170 - DNA, 20 bp, human
gataatttccctgatagtaa

SEQ ID NO: 329171 - DNA, 20 bp, human
gctttaggacataatatgag

SEQ ID NO: 329172 - DNA, 20 bp, human
gaaaatcactttaattagca

SEQ ID NO: 329173 - DNA, 20 bp, human
gtccccattttctagtcatt

SEQ ID NO: 329174 - DNA, 20 bp, human
gatttcactgtataagtaaa

SEQ ID NO: 329175 - DNA, 20 bp, human
gaaaactaaatatgttatag

SEQ ID NO: 329176 - DNA, 20 bp, human
gtgccctcccatgtgataga

SEQ ID NO: 329177 - DNA, 20 bp, human
gaaaatggctcaggagtgga

SEQ ID NO: 329178 - DNA, 20 bp, human
ggggcaggaaattgccacaa

SEQ ID NO: 329179 - DNA, 20 bp, human
gtcccatgtgatagagggaa

SEQ ID NO: 329180 - DNA, 20 bp, human
gcaggagtggagggtaacaa

SEQ ID NO: 329181 - DNA, 20 bp, human
gggagagcatttgtccccaa

SEQ ID NO: 329182 - DNA, 20 bp, human
gagcctgagagctagaaaag

SEQ ID NO: 329183 - DNA, 20 bp, human
ggaaatgagcaagacatagc

SEQ ID NO: 329184 - DNA, 20 bp, human
ggaaattgccacaaagggag

SEQ ID NO: 329185 - DNA, 20 bp, human
ggggaaaggactgcgatgaa

SEQ ID NO: 329186 - DNA, 20 bp, human
ggcatggtaggtaggagcta

SEQ ID NO: 329187 - DNA, 20 bp, human
gtgatctgcaggtgaaacat

SEQ ID NO: 329188 - DNA, 20 bp, human
ggctcaccggcattttcttg

SEQ ID NO: 329189 - DNA, 20 bp, human
gtctgtgttgcatggtaggt

SEQ ID NO: 329190 - DNA, 20 bp, human
gtatatctgtgttgcatggt

SEQ ID NO: 329191 - DNA, 20 bp, human
gatggctgggtcatgctcac

SEQ ID NO: 329192 - DNA, 20 bp, human
gcagagaactctaggacata

SEQ ID NO: 329193 - DNA, 20 bp, human
gcacatccccaagaaaatgc

SEQ ID NO: 329194 - DNA, 20 bp, human
gcgatttctagaagaatctc

SEQ ID NO: 329195 - DNA, 20 bp, human
gttaaaaagatttgatctgc

SEQ ID NO: 329196 - DNA, 20 bp, human
gcacctgggatactttttga

SEQ ID NO: 329197 - DNA, 20 bp, human
gttgaaagtgacactcacct

SEQ ID NO: 329198 - DNA, 20 bp, human
ggcttctattgtacaatcta

SEQ ID NO: 329199 - DNA, 20 bp, human
gaaagttgatcaacttcctt

SEQ ID NO: 329200 - DNA, 20 bp, human
gtcctttggcagacactttt

SEQ ID NO: 329201 - DNA, 20 bp, human
gcacaagggccagaacatac

SEQ ID NO: 329202 - DNA, 20 bp, human
gaccatagttagagtcacaa

SEQ ID NO: 329203 - DNA, 20 bp, human
gctcatatatttgacaaaaa

SEQ ID NO: 329204 - DNA, 20 bp, human
ggcccttgtgactctaacta

SEQ ID NO: 329205 - DNA, 20 bp, human
gtgcttagtccggtatgttc

SEQ ID NO: 329206 - DNA, 20 bp, human
gcatgcattgagatgcactg

SEQ ID NO: 329207 - DNA, 20 bp, human
ggaggaaataagttacacaa

SEQ ID NO: 329208 - DNA, 20 bp, human
ggggttgcagaaatagcaag

SEQ ID NO: 329209 - DNA, 20 bp, human
gcgagactctttcaattttt

SEQ ID NO: 329210 - DNA, 20 bp, human
gacatcttggatgtacagct

SEQ ID NO: 329211 - DNA, 20 bp, human
gttgcagaaatagcaagagg

SEQ ID NO: 329212 - DNA, 20 bp, human
ggggactgtacaatacatct

SEQ ID NO: 329213 - DNA, 20 bp, human
ggaaataagttacacaatgg

SEQ ID NO: 329214 - DNA, 20 bp, human
gggttttgatctatgttctt

SEQ ID NO: 329215 - DNA, 20 bp, human
ggatttaagtgactaattct

SEQ ID NO: 329216 - DNA, 20 bp, human
gaagaaatcgtgtcttggag

SEQ ID NO: 329217 - DNA, 20 bp, human
gaccatgaactgggtacgtg

SEQ ID NO: 329218 - DNA, 20 bp, human
gtacaggtcagaccatgaac

SEQ ID NO: 329219 - DNA, 20 bp, human
gtaactgaccacgttgtcac

SEQ ID NO: 329220 - DNA, 20 bp, human
gcctgctaccagtgacaacg

SEQ ID NO: 329221 - DNA, 20 bp, human
ggtagctgtcatcacctatg

SEQ ID NO: 329222 - DNA, 20 bp, human
ggcctcacgtacccagttca

SEQ ID NO: 329223 - DNA, 20 bp, human
gagatgaagaaatcgtgtct

SEQ ID NO: 329224 - DNA, 20 bp, human
gttgtcactggtagcagggc

SEQ ID NO: 329225 - DNA, 20 bp, human
ggaaggataaaggagttgta

SEQ ID NO: 329226 - DNA, 20 bp, human
gtaaccatgaagtaggaatg

SEQ ID NO: 329227 - DNA, 20 bp, human
ggggacctggtccacaggtg

SEQ ID NO: 329228 - DNA, 20 bp, human
gcagcctcggcatgaggtga

SEQ ID NO: 329229 - DNA, 20 bp, human
gtaccagtccacacgtgcct

SEQ ID NO: 329230 - DNA, 20 bp, human
gagcccctcacctcatgccg

SEQ ID NO: 329231 - DNA, 20 bp, human
gcagctctcaagatccaagt

SEQ ID NO: 329232 - DNA, 20 bp, human
gatatgctgaggaacagagc

SEQ ID NO: 329233 - DNA, 20 bp, human
gtttggggttctgccctggt

SEQ ID NO: 329234 - DNA, 20 bp, human
gaacagagccgggcagctcc

SEQ ID NO: 329235 - DNA, 20 bp, human
gagatgccctgtggggcaag

SEQ ID NO: 329236 - DNA, 20 bp, human
ggctccccagagcaccagtg

SEQ ID NO: 329237 - DNA, 20 bp, human
ggcagtcagggctcatcccc

SEQ ID NO: 329238 - DNA, 20 bp, human
gtagtgcttaacatgtatct

SEQ ID NO: 329239 - DNA, 20 bp, human
gattccagacccagtgttac

SEQ ID NO: 329240 - DNA, 20 bp, human
ggctccccactggtgctctg

SEQ ID NO: 329241 - DNA, 20 bp, human
ggagggagactggtggtgac

SEQ ID NO: 329242 - DNA, 20 bp, human
ggactggtggtgacaggctc

SEQ ID NO: 329243 - DNA, 20 bp, human
gggtggtgacaggctcagga

SEQ ID NO: 329244 - DNA, 20 bp, human
ggggtgtccggtgtcctcca

SEQ ID NO: 329245 - DNA, 20 bp, human
ggatgcccttcatggttatt

SEQ ID NO: 329246 - DNA, 20 bp, human
gcaagtacggagctggagtt

SEQ ID NO: 329247 - DNA, 20 bp, human
gaaagataacaggtattatg

SEQ ID NO: 329248 - DNA, 20 bp, human
gaaggtggttctgattaggg

SEQ ID NO: 329249 - DNA, 20 bp, human
gacaggtattatgtggagtc

SEQ ID NO: 329250 - DNA, 20 bp, human
gtatcacagttggaagtggt

SEQ ID NO: 329251 - DNA, 20 bp, human
ggtaaaacagtggaaattaa

SEQ ID NO: 329252 - DNA, 20 bp, human
gaaaggaccactgttattat

SEQ ID NO: 329253 - DNA, 20 bp, human
gacgaaggtggttctgatta

SEQ ID NO: 329254 - DNA, 20 bp, human
ggatttgtgcaagaatacga

SEQ ID NO: 329255 - DNA, 20 bp, human
gttgtgcaagaatacgaagg

SEQ ID NO: 329256 - DNA, 20 bp, human
gaaaatcacggtttatgagg

SEQ ID NO: 329257 - DNA, 20 bp, human
gaaaccgtgatttttaaagg

SEQ ID NO: 329258 - DNA, 20 bp, human
gaaagaccggggaaaggctc

SEQ ID NO: 329259 - DNA, 20 bp, human
gcataaaccgtgatttttaa

SEQ ID NO: 329260 - DNA, 20 bp, human
ggaataaaaagaccggggaa

SEQ ID NO: 329261 - DNA, 20 bp, human
gcaggacaaactctgaatat

SEQ ID NO: 329262 - DNA, 20 bp, human
gagaaatgatgtcattttat

SEQ ID NO: 329263 - DNA, 20 bp, human
gatggaatggatttacaaat

SEQ ID NO: 329264 - DNA, 20 bp, human
gatatatgtgaaatttagaa

SEQ ID NO: 329265 - DNA, 20 bp, human
gctgaatataggatatatcc

SEQ ID NO: 329266 - DNA, 20 bp, human
gtagctgtttctcagtgatg

SEQ ID NO: 329267 - DNA, 20 bp, human
gagagaactagtaaataggc

SEQ ID NO: 329268 - DNA, 20 bp, human
gaattgtattgataattata

SEQ ID NO: 329269 - DNA, 20 bp, human
gttaccacctaaacataaaa

SEQ ID NO: 329270 - DNA, 20 bp, human
gtttaaatctaacagaaatt

SEQ ID NO: 329271 - DNA, 20 bp, human
gtaatgatattttgcattaa

SEQ ID NO: 329272 - DNA, 20 bp, human
ggagcacccattttatgttt

SEQ ID NO: 329273 - DNA, 20 bp, human
gttcatcatgtatacattaa

SEQ ID NO: 329274 - DNA, 20 bp, human
gagtaagagaactagtaaat

SEQ ID NO: 329275 - DNA, 20 bp, human
gcattaatgggacacaaagc

SEQ ID NO: 329276 - DNA, 20 bp, human
gcacttaaacaaaagatatg

SEQ ID NO: 329277 - DNA, 20 bp, human
ggagccaagtgcaccccaat

SEQ ID NO: 329278 - DNA, 20 bp, human
gccaaaccagtgtcccattg

SEQ ID NO: 329279 - DNA, 20 bp, human
gtgtcccattggggtgcact

SEQ ID NO: 329280 - DNA, 20 bp, human
gctcaagttgacctgttcct

SEQ ID NO: 329281 - DNA, 20 bp, human
gaaaagatatggggcttgca

SEQ ID NO: 329282 - DNA, 20 bp, human
ggacactggtttgggccata

SEQ ID NO: 329283 - DNA, 20 bp, human
gacattgctcaccatccata

SEQ ID NO: 329284 - DNA, 20 bp, human
gaacaaggatgtcagagatt

SEQ ID NO: 329285 - DNA, 20 bp, human
gttggacagtaatggagata

SEQ ID NO: 329286 - DNA, 20 bp, human
gacacataattacataccat

SEQ ID NO: 329287 - DNA, 20 bp, human
gatgtgtcatctacaatttc

SEQ ID NO: 329288 - DNA, 20 bp, human
gcaaattttgaattcaccta

SEQ ID NO: 329289 - DNA, 20 bp, human
gctgtactgatcaatgacta

SEQ ID NO: 329290 - DNA, 20 bp, human
ggtcatctacaatttcaggc

SEQ ID NO: 329291 - DNA, 20 bp, human
ggtttcaaaaccaggattta

SEQ ID NO: 329292 - DNA, 20 bp, human
gtctttttataacgagtatg

SEQ ID NO: 329293 - DNA, 20 bp, human
gtatcaaaactattgaaatg

SEQ ID NO: 329294 - DNA, 20 bp, human
gataatttaaccctaaatcc

SEQ ID NO: 329295 - DNA, 20 bp, human
gaaatttatccatgtgcaaa

SEQ ID NO: 329296 - DNA, 20 bp, human
gctgagttgtgcctttttat

SEQ ID NO: 329297 - DNA, 20 bp, human
gttcatttatccaacatcat

SEQ ID NO: 329298 - DNA, 20 bp, human
gattttgtataaatagatca

SEQ ID NO: 329299 - DNA, 20 bp, human
gctgatgtatgttttatttt

SEQ ID NO: 329300 - DNA, 20 bp, human
gcaagtaaaacctatgatgt

SEQ ID NO: 329301 - DNA, 20 bp, human
gataatgcaatccaataaaa

SEQ ID NO: 329302 - DNA, 20 bp, human
gggaattgaaatgttttgtt

SEQ ID NO: 329303 - DNA, 20 bp, human
gcatctctgttttaaaattt

SEQ ID NO: 329304 - DNA, 20 bp, human
gtgagttgcagaaaaacatt

SEQ ID NO: 329305 - DNA, 20 bp, human
gtttataaaataatcttatt

SEQ ID NO: 329306 - DNA, 20 bp, human
gcaagggttgagctaggtcc

SEQ ID NO: 329307 - DNA, 20 bp, human
gccaaactggggatcgcctg

SEQ ID NO: 329308 - DNA, 20 bp, human
gtaggtccaggaaaagatac

SEQ ID NO: 329309 - DNA, 20 bp, human
gtaagacctaagttaaggga

SEQ ID NO: 329310 - DNA, 20 bp, human
gtaggtaaagatcttggttc

SEQ ID NO: 329311 - DNA, 20 bp, human
gaacagaaattgtaaactag

SEQ ID NO: 329312 - DNA, 20 bp, human
ggaattaagacctaagttaa

SEQ ID NO: 329313 - DNA, 20 bp, human
gtaggaataaaaaggtgcaa

SEQ ID NO: 329314 - DNA, 20 bp, human
gggaattagttacaattaag

SEQ ID NO: 329315 - DNA, 20 bp, human
ggcttgaaaatcaactatta

SEQ ID NO: 329316 - DNA, 20 bp, human
gtataggctgctgttaaagg

SEQ ID NO: 329317 - DNA, 20 bp, human
gataaatgtaagcattgcga

SEQ ID NO: 329318 - DNA, 20 bp, human
gcaaagagtgaatcaccaga

SEQ ID NO: 329319 - DNA, 20 bp, human
ggggtattgaattcccactg

SEQ ID NO: 329320 - DNA, 20 bp, human
gatctcttggcttccacagt

SEQ ID NO: 329321 - DNA, 20 bp, human
ggtttgttctgttttctcaa

SEQ ID NO: 329322 - DNA, 20 bp, human
gttttataggctgctgttaa

SEQ ID NO: 329323 - DNA, 20 bp, human
gtggagagtttttagaagtt

SEQ ID NO: 329324 - DNA, 20 bp, human
gagtttttagaagtttggtg

SEQ ID NO: 329325 - DNA, 20 bp, human
ggggaaagcagagataaaaa

SEQ ID NO: 329326 - DNA, 20 bp, human
gagcggatagctagacacaa

SEQ ID NO: 329327 - DNA, 20 bp, human
gtatataagaaggtaactat

SEQ ID NO: 329328 - DNA, 20 bp, human
gaaatagatagatgcatcag

SEQ ID NO: 329329 - DNA, 20 bp, human
gaatgtcacaaatggcagtg

SEQ ID NO: 329330 - DNA, 20 bp, human
ggtgacattacggatgaacc

SEQ ID NO: 329331 - DNA, 20 bp, human
gtactggtgtcatagttttc

SEQ ID NO: 329332 - DNA, 20 bp, human
gagtaatgtattatataaga

SEQ ID NO: 329333 - DNA, 20 bp, human
gacacaatgaaactaactgt

SEQ ID NO: 329334 - DNA, 20 bp, human
gatagaataattttgcttgg

SEQ ID NO: 329335 - DNA, 20 bp, human
gtatattcaatatcttcaaa

SEQ ID NO: 329336 - DNA, 20 bp, human
gaattgtgacaagaagcact

SEQ ID NO: 329337 - DNA, 20 bp, human
gagtgatcaacccaattttt

SEQ ID NO: 329338 - DNA, 20 bp, human
gtatttagctaaaatgtagg

SEQ ID NO: 329339 - DNA, 20 bp, human
ggtaaaagataaattaacag

SEQ ID NO: 329340 - DNA, 20 bp, human
gtactatttagctaaaatgt

SEQ ID NO: 329341 - DNA, 20 bp, human
gtaattttcaccaaaaaatt

SEQ ID NO: 329342 - DNA, 20 bp, human
gccaaaataaatgtaaacta

SEQ ID NO: 329343 - DNA, 20 bp, human
gtgcttactgtatcttttat

SEQ ID NO: 329344 - DNA, 20 bp, human
gaaacaaaataataattcag

SEQ ID NO: 329345 - DNA, 20 bp, human
gaaatatttatacttgtctt

SEQ ID NO: 329346 - DNA, 20 bp, human
ggtggctcagagtgggatga

SEQ ID NO: 329347 - DNA, 20 bp, human
gcaaaaaacgtcagcaattc

SEQ ID NO: 329348 - DNA, 20 bp, human
gtctgggtttagatgtaatc

SEQ ID NO: 329349 - DNA, 20 bp, human
gaattcagtcagcgctttct

SEQ ID NO: 329350 - DNA, 20 bp, human
gtgttttctaaactgataat

SEQ ID NO: 329351 - DNA, 20 bp, human
gacgtatgtgactagaactt

SEQ ID NO: 329352 - DNA, 20 bp, human
gaaattacatgtttcagcca

SEQ ID NO: 329353 - DNA, 20 bp, human
gaatgttcaaaagtcaccaa

SEQ ID NO: 329354 - DNA, 20 bp, human
gctaattttaaagttacctt

SEQ ID NO: 329355 - DNA, 20 bp, human
gctggaatgtggctcagagt

SEQ ID NO: 329356 - DNA, 20 bp, human
gccctgtaatggggatagag

SEQ ID NO: 329357 - DNA, 20 bp, human
gtacgacttaagttgtagtg

SEQ ID NO: 329358 - DNA, 20 bp, human
gcgtaagcaactatagaata

SEQ ID NO: 329359 - DNA, 20 bp, human
ggtcctaatctgtagttctg

SEQ ID NO: 329360 - DNA, 20 bp, human
gcagggctctattcagacgc

SEQ ID NO: 329361 - DNA, 20 bp, human
gggtcctcatactgagagtt

SEQ ID NO: 329362 - DNA, 20 bp, human
gggaccgaactctcagtatg

SEQ ID NO: 329363 - DNA, 20 bp, human
gtacctcagaactacagatt

SEQ ID NO: 329364 - DNA, 20 bp, human
gacaatgtggggagattatt

SEQ ID NO: 329365 - DNA, 20 bp, human
gtgccaagaatccaataaac

SEQ ID NO: 329366 - DNA, 20 bp, human
gcatagtccagcacatgaga

SEQ ID NO: 329367 - DNA, 20 bp, human
gggcacaactgcagaaatag

SEQ ID NO: 329368 - DNA, 20 bp, human
gtgtacatgagtttaaagtc

SEQ ID NO: 329369 - DNA, 20 bp, human
gtctctaccctctcatgtgc

SEQ ID NO: 329370 - DNA, 20 bp, human
gagctgtacatcttatttat

SEQ ID NO: 329371 - DNA, 20 bp, human
gttttttttgtatcaaacat

SEQ ID NO: 329372 - DNA, 20 bp, human
gatacacatttactatatta

SEQ ID NO: 329373 - DNA, 20 bp, human
gttagcttaatctctaatat

SEQ ID NO: 329374 - DNA, 20 bp, human
ggtaagaagaactaccttga

SEQ ID NO: 329375 - DNA, 20 bp, human
gataagaagaactaccttga

SEQ ID NO: 329376 - DNA, 20 bp, human
ggcaccttaaactgtgagga

SEQ ID NO: 329377 - DNA, 20 bp, human
ggaaaggcagagcttccaag

SEQ ID NO: 329378 - DNA, 20 bp, human
gctaccttcctcacagttta

SEQ ID NO: 329379 - DNA, 20 bp, human
gccttgcaccttaaactgtg

SEQ ID NO: 329380 - DNA, 20 bp, human
gtttaacgtctgtctgtccc

SEQ ID NO: 329381 - DNA, 20 bp, human
gagtttaaggtgcaaggcag

SEQ ID NO: 329382 - DNA, 20 bp, human
ggcaacagtgcgccacagaa

SEQ ID NO: 329383 - DNA, 20 bp, human
gagctttctcacctcacacc

SEQ ID NO: 329384 - DNA, 20 bp, human
gaataaatgcatttcagact

SEQ ID NO: 329385 - DNA, 20 bp, human
gggggaaaagtgtaagatat

SEQ ID NO: 329386 - DNA, 20 bp, human
ggcggagagtggcttatatt

SEQ ID NO: 329387 - DNA, 20 bp, human
ggagaatgtattgcggagag

SEQ ID NO: 329388 - DNA, 20 bp, human
ggaaagtcaagatactattt

SEQ ID NO: 329389 - DNA, 20 bp, human
gatattgggagatgtagacc

SEQ ID NO: 329390 - DNA, 20 bp, human
gtaaaatgacggaataaggc

SEQ ID NO: 329391 - DNA, 20 bp, human
gcacagatctatacatgcta

SEQ ID NO: 329392 - DNA, 20 bp, human
gcctgtaaaatgacggaata

SEQ ID NO: 329393 - DNA, 20 bp, human
ggtaaaccagaataatagaa

SEQ ID NO: 329394 - DNA, 20 bp, human
gttaattattgtgccacact

SEQ ID NO: 329395 - DNA, 20 bp, human
gctggtttacagttcctgag

SEQ ID NO: 329396 - DNA, 20 bp, human
gaaggaggctgttgacagga

SEQ ID NO: 329397 - DNA, 20 bp, human
gtctgaaggaggctgttgac

SEQ ID NO: 329398 - DNA, 20 bp, human
ggagggcaatagtaatttga

SEQ ID NO: 329399 - DNA, 20 bp, human
gtctggaggtgagagaaggg

SEQ ID NO: 329400 - DNA, 20 bp, human
gcagggaagactaaacataa

SEQ ID NO: 329401 - DNA, 20 bp, human
gagaaagtcaactgggttac

SEQ ID NO: 329402 - DNA, 20 bp, human
gttctcataaaggaatagga

SEQ ID NO: 329403 - DNA, 20 bp, human
gataaaggtgaatagtctga

SEQ ID NO: 329404 - DNA, 20 bp, human
gagtcaactgggttacagga

SEQ ID NO: 329405 - DNA, 20 bp, human
gctatagggttctaacaaga

SEQ ID NO: 329406 - DNA, 20 bp, human
gtatagagctagaatgcttg

SEQ ID NO: 329407 - DNA, 20 bp, human
ggagctagaatgcttgagga

SEQ ID NO: 329408 - DNA, 20 bp, human
ggaaggaaaagctatgacct

SEQ ID NO: 329409 - DNA, 20 bp, human
ggacttaaagagtgaatttt

SEQ ID NO: 329410 - DNA, 20 bp, human
gtctgtgaaatagtatctat

SEQ ID NO: 329411 - DNA, 20 bp, human
gctctttaagtctttactga

SEQ ID NO: 329412 - DNA, 20 bp, human
ggtaatagtaatagtagtga

SEQ ID NO: 329413 - DNA, 20 bp, human
gtgcaaaataggcagaacaa

SEQ ID NO: 329414 - DNA, 20 bp, human
gagagagagaaatgaagttt

SEQ ID NO: 329415 - DNA, 20 bp, human
ggaagaggagttagaatgtt

SEQ ID NO: 329416 - DNA, 20 bp, human
gacctgtgagagtatgttgg

SEQ ID NO: 329417 - DNA, 20 bp, human
ggctaggtaattgagtactc

SEQ ID NO: 329418 - DNA, 20 bp, human
gatgccactaagctcttcag

SEQ ID NO: 329419 - DNA, 20 bp, human
gataacctgtgagagtatgt

SEQ ID NO: 329420 - DNA, 20 bp, human
gtctgttaacttttcctata

SEQ ID NO: 329421 - DNA, 20 bp, human
gtactgagtaaaggtgctgt

SEQ ID NO: 329422 - DNA, 20 bp, human
gtcaagggaaattgtactaa

SEQ ID NO: 329423 - DNA, 20 bp, human
gctagcaatcttaactacag

SEQ ID NO: 329424 - DNA, 20 bp, human
gttcaacagatactgagtaa

SEQ ID NO: 329425 - DNA, 20 bp, human
gccttgagaaataagcttgt

SEQ ID NO: 329426 - DNA, 20 bp, human
gtatagacagtcttccctcc

SEQ ID NO: 329427 - DNA, 20 bp, human
gactatgagcagaaatatca

SEQ ID NO: 329428 - DNA, 20 bp, human
gaatctaggtatgcttgctt

SEQ ID NO: 329429 - DNA, 20 bp, human
gtctatagctgaacctgaaa

SEQ ID NO: 329430 - DNA, 20 bp, human
gcagagaggagattgtgcat

SEQ ID NO: 329431 - DNA, 20 bp, human
gagagaacctgtgaggttgg

SEQ ID NO: 329432 - DNA, 20 bp, human
gttctcttttatttgaatct

SEQ ID NO: 329433 - DNA, 20 bp, human
gaagtagagacagtttacca

SEQ ID NO: 329434 - DNA, 20 bp, human
gatcaagctcttgaactcca

SEQ ID NO: 329435 - DNA, 20 bp, human
ggtttctcttctgaagtgaa

SEQ ID NO: 329436 - DNA, 20 bp, human
gccccagtttatccaattgc

SEQ ID NO: 329437 - DNA, 20 bp, human
gctaaagggtaacaaaactt

SEQ ID NO: 329438 - DNA, 20 bp, human
gcagaggacctgctcttacc

SEQ ID NO: 329439 - DNA, 20 bp, human
gaagtgcttcagatcttaac

SEQ ID NO: 329440 - DNA, 20 bp, human
gttacagcatttcacaactg

SEQ ID NO: 329441 - DNA, 20 bp, human
gtagagaagattttctctaa

SEQ ID NO: 329442 - DNA, 20 bp, human
ggatgcaggaatttaaaact

SEQ ID NO: 329443 - DNA, 20 bp, human
gacctgcaattggataaact

SEQ ID NO: 329444 - DNA, 20 bp, human
gaacttacttcatcatgata

SEQ ID NO: 329445 - DNA, 20 bp, human
gatcactgagcatctgagtt

SEQ ID NO: 329446 - DNA, 20 bp, human
ggactcttctatgatcaggt

SEQ ID NO: 329447 - DNA, 20 bp, human
gtgctgatactgttgagctc

SEQ ID NO: 329448 - DNA, 20 bp, human
gctatgatcaggtaggaaac

SEQ ID NO: 329449 - DNA, 20 bp, human
gaatatgttgatctatagtt

SEQ ID NO: 329450 - DNA, 20 bp, human
gcagaatgtaaggaagtgtt

SEQ ID NO: 329451 - DNA, 20 bp, human
ggataagaaaaggatgacga

SEQ ID NO: 329452 - DNA, 20 bp, human
ggacgagtccagaggagtag

SEQ ID NO: 329453 - DNA, 20 bp, human
gtaaagccacactactcaca

SEQ ID NO: 329454 - DNA, 20 bp, human
gcatagttttaagagtagct

SEQ ID NO: 329455 - DNA, 20 bp, human
gtggctttagacgagtccag

SEQ ID NO: 329456 - DNA, 20 bp, human
gtctcatgcctcagttttgc

SEQ ID NO: 329457 - DNA, 20 bp, human
gttttctgtttatcactcgc

SEQ ID NO: 329458 - DNA, 20 bp, human
ggattacagttgcctgcacc

SEQ ID NO: 329459 - DNA, 20 bp, human
gtcaaggagaaacagagtga

SEQ ID NO: 329460 - DNA, 20 bp, human
gaacttgaaacagaagaaac

SEQ ID NO: 329461 - DNA, 20 bp, human
gaacaggaatgggagagtca

SEQ ID NO: 329462 - DNA, 20 bp, human
gattaagaagagagaaggct

SEQ ID NO: 329463 - DNA, 20 bp, human
gtcttctgtttcaagttcaa

SEQ ID NO: 329464 - DNA, 20 bp, human
gtcagctacctgcaaaactg

SEQ ID NO: 329465 - DNA, 20 bp, human
gccttctctcttcttaataa

SEQ ID NO: 329466 - DNA, 20 bp, human
gcgtatttgtatgtgggtga

SEQ ID NO: 329467 - DNA, 20 bp, human
gcccacatacaaatacgcac

SEQ ID NO: 329468 - DNA, 20 bp, human
ggccagtgcgtatttgtatg

SEQ ID NO: 329469 - DNA, 20 bp, human
gcccttctttactgatgatt

SEQ ID NO: 329470 - DNA, 20 bp, human
gaaatagagtcaggtcccga

SEQ ID NO: 329471 - DNA, 20 bp, human
ggccaaatcatcagtaaaga

SEQ ID NO: 329472 - DNA, 20 bp, human
gctgactatgtaaggtcctt

SEQ ID NO: 329473 - DNA, 20 bp, human
gggaggattctgactatgta

SEQ ID NO: 329474 - DNA, 20 bp, human
gaggaagccattattgtgtg

SEQ ID NO: 329475 - DNA, 20 bp, human
gcacgtttacgtacataagt

SEQ ID NO: 329476 - DNA, 20 bp, human
gctagtgcttgtgtcatgga

SEQ ID NO: 329477 - DNA, 20 bp, human
ggtgcccaaaagtgatatat

SEQ ID NO: 329478 - DNA, 20 bp, human
gcatccccatctgctgaata

SEQ ID NO: 329479 - DNA, 20 bp, human
gtagactagtgcttgtgtca

SEQ ID NO: 329480 - DNA, 20 bp, human
gcattctctaggggcaattt

SEQ ID NO: 329481 - DNA, 20 bp, human
gctgtagtgaaagggtggtc

SEQ ID NO: 329482 - DNA, 20 bp, human
gcaaagcttttgagaaaaga

SEQ ID NO: 329483 - DNA, 20 bp, human
gcccctagagaatgggtagt

SEQ ID NO: 329484 - DNA, 20 bp, human
gtttgcctgtagtgaaaggg

SEQ ID NO: 329485 - DNA, 20 bp, human
ggtgataaatttgctggtgg

SEQ ID NO: 329486 - DNA, 20 bp, human
gaataaccatagtacgtaat

SEQ ID NO: 329487 - DNA, 20 bp, human
gaaaacaggtaacatgtcat

SEQ ID NO: 329488 - DNA, 20 bp, human
gtacgtactatggttattac

SEQ ID NO: 329489 - DNA, 20 bp, human
ggaacacctattacgtacta

SEQ ID NO: 329490 - DNA, 20 bp, human
gtcatgggggtttagtgtat

SEQ ID NO: 329491 - DNA, 20 bp, human
gatatgcaggtttgtaaaac

SEQ ID NO: 329492 - DNA, 20 bp, human
ggatactgggacctatttga

SEQ ID NO: 329493 - DNA, 20 bp, human
gcgcttgaacaaagagacag

SEQ ID NO: 329494 - DNA, 20 bp, human
gaaaacaagagaatagatac

SEQ ID NO: 329495 - DNA, 20 bp, human
gataacatttctgatagttt

SEQ ID NO: 329496 - DNA, 20 bp, human
gcaaccaagcctgggcacaa

SEQ ID NO: 329497 - DNA, 20 bp, human
gaaaagatgcaaccaagcct

SEQ ID NO: 329498 - DNA, 20 bp, human
gtctatggtgacagataaaa

SEQ ID NO: 329499 - DNA, 20 bp, human
gaaaaataagttcttgactc

SEQ ID NO: 329500 - DNA, 20 bp, human
ggccagggcaattggtatgg

SEQ ID NO: 329501 - DNA, 20 bp, human
ggaggccagggcaattggta

SEQ ID NO: 329502 - DNA, 20 bp, human
gcttgaggtgatgtcagtca

SEQ ID NO: 329503 - DNA, 20 bp, human
ggcctccataccaattgccc

SEQ ID NO: 329504 - DNA, 20 bp, human
gcaattggtatggaggcttg

SEQ ID NO: 329505 - DNA, 20 bp, human
gcatatagtcatcattcttg

SEQ ID NO: 329506 - DNA, 20 bp, human
gctggttcatccagtctctt

SEQ ID NO: 329507 - DNA, 20 bp, human
gttgtccctcaggcacccct

SEQ ID NO: 329508 - DNA, 20 bp, human
gcagggacataatgtactca

SEQ ID NO: 329509 - DNA, 20 bp, human
gttctctgttcccaagagac

SEQ ID NO: 329510 - DNA, 20 bp, human
ggtgaagaaaactttgtctc

SEQ ID NO: 329511 - DNA, 20 bp, human
gtaaggggagtaggcaagat

SEQ ID NO: 329512 - DNA, 20 bp, human
gtgtgcctattgagcagatg

SEQ ID NO: 329513 - DNA, 20 bp, human
gttggagatttaaggggagt

SEQ ID NO: 329514 - DNA, 20 bp, human
gtcgatgctttggagattta

SEQ ID NO: 329515 - DNA, 20 bp, human
ggatattccattcaacccag

SEQ ID NO: 329516 - DNA, 20 bp, human
gcagaggcggaggtttaata

SEQ ID NO: 329517 - DNA, 20 bp, human
gacacacacgaggagttcag

SEQ ID NO: 329518 - DNA, 20 bp, human
gtcggagacccttttctcta

SEQ ID NO: 329519 - DNA, 20 bp, human
gttaatagtcccctttgagg

SEQ ID NO: 329520 - DNA, 20 bp, human
gagtttaatagtcccctttg

SEQ ID NO: 329521 - DNA, 20 bp, human
ggacattttcatagtgctca

SEQ ID NO: 329522 - DNA, 20 bp, human
ggcgccatcttgtctgctcg

SEQ ID NO: 329523 - DNA, 20 bp, human
gccaattgcaaagtaagatt

SEQ ID NO: 329524 - DNA, 20 bp, human
gtgaggaatgagggaagaca

SEQ ID NO: 329525 - DNA, 20 bp, human
gcccttttctctatggagag

SEQ ID NO: 329526 - DNA, 20 bp, human
gttccaggaaccacagttta

SEQ ID NO: 329527 - DNA, 20 bp, human
gcggtcaggtgggcatgata

SEQ ID NO: 329528 - DNA, 20 bp, human
gcgactgaatctgatactct

SEQ ID NO: 329529 - DNA, 20 bp, human
ggatggtaactgtaacttgt

SEQ ID NO: 329530 - DNA, 20 bp, human
gatgtagagatgacttctcc

SEQ ID NO: 329531 - DNA, 20 bp, human
ggaagtcatctctacatcat

SEQ ID NO: 329532 - DNA, 20 bp, human
ggtatcagattcagtcggtc

SEQ ID NO: 329533 - DNA, 20 bp, human
gtacagttaccatcgctacc

SEQ ID NO: 329534 - DNA, 20 bp, human
gcatgatttcttgagttccc

SEQ ID NO: 329535 - DNA, 20 bp, human
gatgctgatggggctgttcc

SEQ ID NO: 329536 - DNA, 20 bp, human
gaaatcacaagtaaatagta

SEQ ID NO: 329537 - DNA, 20 bp, human
gttacatgaaggatgcccgt

SEQ ID NO: 329538 - DNA, 20 bp, human
gtactgatgtagcataaatc

SEQ ID NO: 329539 - DNA, 20 bp, human
gacatcagttaacatccaac

SEQ ID NO: 329540 - DNA, 20 bp, human
ggggtaactatgtaagacga

SEQ ID NO: 329541 - DNA, 20 bp, human
gctaatctttcatacgtaaa

SEQ ID NO: 329542 - DNA, 20 bp, human
gataattttcatgggtacac

SEQ ID NO: 329543 - DNA, 20 bp, human
gcaacatttctattacatga

SEQ ID NO: 329544 - DNA, 20 bp, human
gttcttgctataaagaaaat

SEQ ID NO: 329545 - DNA, 20 bp, human
gttattgactataattttca

SEQ ID NO: 329546 - DNA, 20 bp, human
gcaatgaatctctcaggaag

SEQ ID NO: 329547 - DNA, 20 bp, human
gtttgtaaggactccaggaa

SEQ ID NO: 329548 - DNA, 20 bp, human
gagaaatctctctctttggc

SEQ ID NO: 329549 - DNA, 20 bp, human
gcaaagacaatgaatctctc

SEQ ID NO: 329550 - DNA, 20 bp, human
gctaaaaattaaagaatggc

SEQ ID NO: 329551 - DNA, 20 bp, human
ggtgacaaatgtccatcaaa

SEQ ID NO: 329552 - DNA, 20 bp, human
gggacatttgtcacccttcc

SEQ ID NO: 329553 - DNA, 20 bp, human
ggagattcattgtctttgta

SEQ ID NO: 329554 - DNA, 20 bp, human
gttgtctttgtaaggactcc

SEQ ID NO: 329555 - DNA, 20 bp, human
gttacaatatcaccttttga

SEQ ID NO: 329556 - DNA, 20 bp, human
gcagtctattgaagaatgtt

SEQ ID NO: 329557 - DNA, 20 bp, human
gaaaactccaagtccaccta

SEQ ID NO: 329558 - DNA, 20 bp, human
gggtatgtaaagatgttttc

SEQ ID NO: 329559 - DNA, 20 bp, human
gaaagattaaatccattgaa

SEQ ID NO: 329560 - DNA, 20 bp, human
gctacaaattccattgattg

SEQ ID NO: 329561 - DNA, 20 bp, human
gtcagaaaacgtaagaatga

SEQ ID NO: 329562 - DNA, 20 bp, human
gagtactcactcaaatatgt

SEQ ID NO: 329563 - DNA, 20 bp, human
gaaatatagcctaatttatc

SEQ ID NO: 329564 - DNA, 20 bp, human
gtattttttcctgataaatt

SEQ ID NO: 329565 - DNA, 20 bp, human
gtccaagtccacctaaggca

SEQ ID NO: 329566 - DNA, 20 bp, human
gatcagcaagaagtctgggg

SEQ ID NO: 329567 - DNA, 20 bp, human
gtttatcagcaagaagtctg

SEQ ID NO: 329568 - DNA, 20 bp, human
gacttcttgctgataaactc

SEQ ID NO: 329569 - DNA, 20 bp, human
gaaaactccactcctgggcc

SEQ ID NO: 329570 - DNA, 20 bp, human
gttaagaaaactccactcct

SEQ ID NO: 329571 - DNA, 20 bp, human
gttgtgaaagaataaactgt

SEQ ID NO: 329572 - DNA, 20 bp, human
gcagttcaaaacatttactt

SEQ ID NO: 329573 - DNA, 20 bp, human
gtctatcaaaaacatctaca

SEQ ID NO: 329574 - DNA, 20 bp, human
gcaaaacatttacttaggaa

SEQ ID NO: 329575 - DNA, 20 bp, human
gagtagagacggcgggggtg

SEQ ID NO: 329576 - DNA, 20 bp, human
gaggaaagcaggccaaggtc

SEQ ID NO: 329577 - DNA, 20 bp, human
gacgcagtgtcagggtgata

SEQ ID NO: 329578 - DNA, 20 bp, human
gtttcagggatcatgaagat

SEQ ID NO: 329579 - DNA, 20 bp, human
gatgaagatgggaggaaagc

SEQ ID NO: 329580 - DNA, 20 bp, human
gcagggatcatgaagatggg

SEQ ID NO: 329581 - DNA, 20 bp, human
gatccctgaaacactcacgc

SEQ ID NO: 329582 - DNA, 20 bp, human
ggaccagcgtgagtgtttca

SEQ ID NO: 329583 - DNA, 20 bp, human
gtgcatctctaaaaaactcc

SEQ ID NO: 329584 - DNA, 20 bp, human
gctgaaatttacgcagtgtc

SEQ ID NO: 329585 - DNA, 20 bp, human
gatttgctggtcttctttgc

SEQ ID NO: 329586 - DNA, 20 bp, human
gtagaaaagggactgaccta

SEQ ID NO: 329587 - DNA, 20 bp, human
gaagatagacccacagtgag

SEQ ID NO: 329588 - DNA, 20 bp, human
ggctggatctgctgaagaaa

SEQ ID NO: 329589 - DNA, 20 bp, human
gcatctcaggattcccttca

SEQ ID NO: 329590 - DNA, 20 bp, human
ggagatagagactaagaatg

SEQ ID NO: 329591 - DNA, 20 bp, human
ggagagatttgaactttggt

SEQ ID NO: 329592 - DNA, 20 bp, human
ggagtctcatattacacttt

SEQ ID NO: 329593 - DNA, 20 bp, human
gatagagactaagaatgtgg

SEQ ID NO: 329594 - DNA, 20 bp, human
gggtttttaccactcactgt

SEQ ID NO: 329595 - DNA, 20 bp, human
ggatttgaactttggtagga

SEQ ID NO: 329596 - DNA, 20 bp, human
gaagggacagatggaagtga

SEQ ID NO: 329597 - DNA, 20 bp, human
gagtatggtctccgccctaa

SEQ ID NO: 329598 - DNA, 20 bp, human
gataaggcctcgactactaa

SEQ ID NO: 329599 - DNA, 20 bp, human
gagaagacccttagtagtcg

SEQ ID NO: 329600 - DNA, 20 bp, human
ggtaagggaggattccttta

SEQ ID NO: 329601 - DNA, 20 bp, human
gggaaacataagtagaaact

SEQ ID NO: 329602 - DNA, 20 bp, human
ggaagtgtctagtagaataa

SEQ ID NO: 329603 - DNA, 20 bp, human
gagggaggattcctttaggg

SEQ ID NO: 329604 - DNA, 20 bp, human
gtagacaggggtctcctata

SEQ ID NO: 329605 - DNA, 20 bp, human
gcttacctggtggtcatcac

SEQ ID NO: 329606 - DNA, 20 bp, human
gaagggccagatggaagcga

SEQ ID NO: 329607 - DNA, 20 bp, human
gcatctccctcgcttccatc

SEQ ID NO: 329608 - DNA, 20 bp, human
gagacagtgtttcatgatat

SEQ ID NO: 329609 - DNA, 20 bp, human
gttcatgatattggtctggc

SEQ ID NO: 329610 - DNA, 20 bp, human
gttactagaagacagagagg

SEQ ID NO: 329611 - DNA, 20 bp, human
gctgttgagcttgggttatg

SEQ ID NO: 329612 - DNA, 20 bp, human
ggacactgactgaaatgttg

SEQ ID NO: 329613 - DNA, 20 bp, human
ggactgaaatgttgaggagt

SEQ ID NO: 329614 - DNA, 20 bp, human
gtccttactagaagacagag

SEQ ID NO: 329615 - DNA, 20 bp, human
gcagagaggtggagtagctg

SEQ ID NO: 329616 - DNA, 20 bp, human
gacaggcacaagcatggcta

SEQ ID NO: 329617 - DNA, 20 bp, human
gagaaccaagagtacaacct

SEQ ID NO: 329618 - DNA, 20 bp, human
ggctagcttgaattcatgat

SEQ ID NO: 329619 - DNA, 20 bp, human
gacacgttgttaatacctca

SEQ ID NO: 329620 - DNA, 20 bp, human
gagagagggcatctgcacac

SEQ ID NO: 329621 - DNA, 20 bp, human
gagggcatctgcacactggc

SEQ ID NO: 329622 - DNA, 20 bp, human
gttaacaacgtgtctgtgag

SEQ ID NO: 329623 - DNA, 20 bp, human
gttgttaatacctcagggtg

SEQ ID NO: 329624 - DNA, 20 bp, human
gagctagcatctgttaccat

SEQ ID NO: 329625 - DNA, 20 bp, human
gtaagggaagaagactctag

SEQ ID NO: 329626 - DNA, 20 bp, human
ggaaactggggccagtctcc

SEQ ID NO: 329627 - DNA, 20 bp, human
gcatcctggacagagcagaa

SEQ ID NO: 329628 - DNA, 20 bp, human
gaagggatcaaagtaaagat

SEQ ID NO: 329629 - DNA, 20 bp, human
ggcctggagagttagggtta

SEQ ID NO: 329630 - DNA, 20 bp, human
gccgctaggccctatcccga

SEQ ID NO: 329631 - DNA, 20 bp, human
gaacaagtgaagataagagc

SEQ ID NO: 329632 - DNA, 20 bp, human
ggttgaaagggcgcaacaaa

SEQ ID NO: 329633 - DNA, 20 bp, human
gaggcggggcttgctccaga

SEQ ID NO: 329634 - DNA, 20 bp, human
gtgtaaacttaagtagaaac

SEQ ID NO: 329635 - DNA, 20 bp, human
gtggggactcgggaaaagtt

SEQ ID NO: 329636 - DNA, 20 bp, human
gcctttgagtaggagaaaac

SEQ ID NO: 329637 - DNA, 20 bp, human
gtggagtgatggtgggcatg

SEQ ID NO: 329638 - DNA, 20 bp, human
ggtaaaaatactgcagaagt

SEQ ID NO: 329639 - DNA, 20 bp, human
gtgtctccctaaagttccct

SEQ ID NO: 329640 - DNA, 20 bp, human
gaaatgttactgagtcagtc

SEQ ID NO: 329641 - DNA, 20 bp, human
gagacactttcaattctccg

SEQ ID NO: 329642 - DNA, 20 bp, human
ggagggccagaggtattatg

SEQ ID NO: 329643 - DNA, 20 bp, human
gttctggaccaacttggaga

SEQ ID NO: 329644 - DNA, 20 bp, human
gttccaactggagtgatggt

SEQ ID NO: 329645 - DNA, 20 bp, human
gtgcccaccatcactccagt

SEQ ID NO: 329646 - DNA, 20 bp, human
gggacctcttacaagatcaa

SEQ ID NO: 329647 - DNA, 20 bp, human
gaaaagaggagcattcaaca

SEQ ID NO: 329648 - DNA, 20 bp, human
gggaggactcttactaaaag

SEQ ID NO: 329649 - DNA, 20 bp, human
ggtaagcagtgttgttttaa

SEQ ID NO: 329650 - DNA, 20 bp, human
ggagcattcaacagggtttt

SEQ ID NO: 329651 - DNA, 20 bp, human
gccagcagtgaggtaattat

SEQ ID NO: 329652 - DNA, 20 bp, human
ggcatatgctcagataaaga

SEQ ID NO: 329653 - DNA, 20 bp, human
gccctgaaaagaggcaatca

SEQ ID NO: 329654 - DNA, 20 bp, human
gtatgttgattcatgttgat

SEQ ID NO: 329655 - DNA, 20 bp, human
gaacagaagtgagctaatga

SEQ ID NO: 329656 - DNA, 20 bp, human
ggagaatttgttccactgga

SEQ ID NO: 329657 - DNA, 20 bp, human
ggttcctaaaatctataggt

SEQ ID NO: 329658 - DNA, 20 bp, human
gaaccaggggatttctgttg

SEQ ID NO: 329659 - DNA, 20 bp, human
gctccacaacagaaatcccc

SEQ ID NO: 329660 - DNA, 20 bp, human
ggagtagctcgttgtctccc

SEQ ID NO: 329661 - DNA, 20 bp, human
gtctggttcctaaaatctat

SEQ ID NO: 329662 - DNA, 20 bp, human
gctaagagaatttgttccac

SEQ ID NO: 329663 - DNA, 20 bp, human
gtttgttccactggagggta

SEQ ID NO: 329664 - DNA, 20 bp, human
gcatctgagtgttcactttt

SEQ ID NO: 329665 - DNA, 20 bp, human
gacttttccataccctccag

SEQ ID NO: 329666 - DNA, 20 bp, human
gaaacttagtcacaaaagaa

SEQ ID NO: 329667 - DNA, 20 bp, human
ggactaagtttattctggtt

SEQ ID NO: 329668 - DNA, 20 bp, human
gtttgtgactaagtttattc

SEQ ID NO: 329669 - DNA, 20 bp, human
gatgatgatgctgtacagca

SEQ ID NO: 329670 - DNA, 20 bp, human
gttctttgatgagtttctgc

SEQ ID NO: 329671 - DNA, 20 bp, human
gattgttattctccttttgt

SEQ ID NO: 329672 - DNA, 20 bp, human
gtcccaggaagacgaggaag

SEQ ID NO: 329673 - DNA, 20 bp, human
gccctcttcctcgtcttcct

SEQ ID NO: 329674 - DNA, 20 bp, human
ggggatcactttcctacaaa

SEQ ID NO: 329675 - DNA, 20 bp, human
ggagaaaaaacatggtattt

SEQ ID NO: 329676 - DNA, 20 bp, human
gaaaaaccatggtgtttgta

SEQ ID NO: 329677 - DNA, 20 bp, human
gagcagacctgcattcagta

SEQ ID NO: 329678 - DNA, 20 bp, human
gtcaatccctacaaacacca

SEQ ID NO: 329679 - DNA, 20 bp, human
ggggtaacagaggtgcatta

SEQ ID NO: 329680 - DNA, 20 bp, human
gaaagttgacttgaaatctt

SEQ ID NO: 329681 - DNA, 20 bp, human
gaaatcatgaatcctcagca

SEQ ID NO: 329682 - DNA, 20 bp, human
gaggacaccgtactgaatgc

SEQ ID NO: 329683 - DNA, 20 bp, human
gtgagttgctattctacttt

SEQ ID NO: 329684 - DNA, 20 bp, human
gaatgataatcaggcaattt

SEQ ID NO: 329685 - DNA, 20 bp, human
gcttctctgctcgttaataa

SEQ ID NO: 329686 - DNA, 20 bp, human
gaatggctgagtgacaactt

SEQ ID NO: 329687 - DNA, 20 bp, human
ggaggttactgtctgtagac

SEQ ID NO: 329688 - DNA, 20 bp, human
gtatctctgacatcccttga

SEQ ID NO: 329689 - DNA, 20 bp, human
gctgaaactaatttctgtca

SEQ ID NO: 329690 - DNA, 20 bp, human
gactcattctgtttccctca

SEQ ID NO: 329691 - DNA, 20 bp, human
gattagtttcaggttattag

SEQ ID NO: 329692 - DNA, 20 bp, human
gttgtcatctctgagctaca

SEQ ID NO: 329693 - DNA, 20 bp, human
ggattactacatgctaaatt

SEQ ID NO: 329694 - DNA, 20 bp, human
ggaatatctatctgctgcag

SEQ ID NO: 329695 - DNA, 20 bp, human
gatgacaaactgtataatta

SEQ ID NO: 329696 - DNA, 20 bp, human
gaaggaaggcattcagaaca

SEQ ID NO: 329697 - DNA, 20 bp, human
gaggcattcagaacaaggtc

SEQ ID NO: 329698 - DNA, 20 bp, human
gctctgaagtcaacatatgt

SEQ ID NO: 329699 - DNA, 20 bp, human
gcatttaattgttctgactt

SEQ ID NO: 329700 - DNA, 20 bp, human
ggcaatataattccgtttta

SEQ ID NO: 329701 - DNA, 20 bp, human
gacatgtaataaacaatgag

SEQ ID NO: 329702 - DNA, 20 bp, human
ggagaaaaaaagagtatgga

SEQ ID NO: 329703 - DNA, 20 bp, human
gtatgttgacttcagagaga

SEQ ID NO: 329704 - DNA, 20 bp, human
gtaaatgtattaataaagga

SEQ ID NO: 329705 - DNA, 20 bp, human
gatggcatagtattttcttg

SEQ ID NO: 329706 - DNA, 20 bp, human
ggagtctggcacagtcgcca

SEQ ID NO: 329707 - DNA, 20 bp, human
gggtgaggaaaaaaagagta

SEQ ID NO: 329708 - DNA, 20 bp, human
gtttgtacttacatcaatat

SEQ ID NO: 329709 - DNA, 20 bp, human
gctggcacagtcgccagggc

SEQ ID NO: 329710 - DNA, 20 bp, human
gaggaaaaaaagagtatgga

SEQ ID NO: 329711 - DNA, 20 bp, human
gaaaaaagagtatggaaggt

SEQ ID NO: 329712 - DNA, 20 bp, human
gtttcctcacctaaactatg

SEQ ID NO: 329713 - DNA, 20 bp, human
gggagtaacttattcaaagt

SEQ ID NO: 329714 - DNA, 20 bp, human
gaactttctgtttatatgaa

SEQ ID NO: 329715 - DNA, 20 bp, human
gggattcaatgtgttaataa

SEQ ID NO: 329716 - DNA, 20 bp, human
ggagtctggcacagttgctg

SEQ ID NO: 329717 - DNA, 20 bp, human
gatccacatagtttaggtga

SEQ ID NO: 329718 - DNA, 20 bp, human
gtttgaacttatatctatat

SEQ ID NO: 329719 - DNA, 20 bp, human
ggtgagggaaaaaaagagta

SEQ ID NO: 329720 - DNA, 20 bp, human
ggggaaaaaaagagtatgga

SEQ ID NO: 329721 - DNA, 20 bp, human
gttccctcacctaaactatg

SEQ ID NO: 329722 - DNA, 20 bp, human
gaaaaaagagtatggaaggt

SEQ ID NO: 329723 - DNA, 20 bp, human
gaaactaattattaaatgct

SEQ ID NO: 329724 - DNA, 20 bp, human
gtctatggtataatattttc

SEQ ID NO: 329725 - DNA, 20 bp, human
gatggtataatattttcagg

SEQ ID NO: 329726 - DNA, 20 bp, human
ggccagacccaatgacagac

SEQ ID NO: 329727 - DNA, 20 bp, human
gtctacccctgtctgtcatt

SEQ ID NO: 329728 - DNA, 20 bp, human
gtaaactatgttatagatga

SEQ ID NO: 329729 - DNA, 20 bp, human
gtaaatctctagctaacttc

SEQ ID NO: 329730 - DNA, 20 bp, human
gccctgtctgtcattgggtc

SEQ ID NO: 329731 - DNA, 20 bp, human
ggtgagataagaccaaatga

SEQ ID NO: 329732 - DNA, 20 bp, human
gatagatgaaggccctcatt

SEQ ID NO: 329733 - DNA, 20 bp, human
gtttgtaaaactttcatgat

SEQ ID NO: 329734 - DNA, 20 bp, human
ggtagagaatggtacatctt

SEQ ID NO: 329735 - DNA, 20 bp, human
ggacagacaggggtagagaa

SEQ ID NO: 329736 - DNA, 20 bp, human
ggagacagaaagatcaagta

SEQ ID NO: 329737 - DNA, 20 bp, human
gttgcaggactgcccttata

SEQ ID NO: 329738 - DNA, 20 bp, human
gaattgtcctagccatataa

SEQ ID NO: 329739 - DNA, 20 bp, human
gggactgcccttatatggct

SEQ ID NO: 329740 - DNA, 20 bp, human
gtcaaaatgtttcatgatgc

SEQ ID NO: 329741 - DNA, 20 bp, human
gtttgcattaggcatgagaa

SEQ ID NO: 329742 - DNA, 20 bp, human
gaaaagcaaacagacatgga

SEQ ID NO: 329743 - DNA, 20 bp, human
gcttaggaatgggtgattct

SEQ ID NO: 329744 - DNA, 20 bp, human
gcttgctttttcttaggaat

SEQ ID NO: 329745 - DNA, 20 bp, human
gataattcaataagactgtg

SEQ ID NO: 329746 - DNA, 20 bp, human
ggcatcctgcaacactttga

SEQ ID NO: 329747 - DNA, 20 bp, human
gtaaaccctcaaagtgttgc

SEQ ID NO: 329748 - DNA, 20 bp, human
gaagtatggtaaatttagta

SEQ ID NO: 329749 - DNA, 20 bp, human
gagatggcaaggacaattcc

SEQ ID NO: 329750 - DNA, 20 bp, human
ggtacctagtcttgaggcaa

SEQ ID NO: 329751 - DNA, 20 bp, human
gatatcgccaaataatccaa

SEQ ID NO: 329752 - DNA, 20 bp, human
gaattgtccttgccatctag

SEQ ID NO: 329753 - DNA, 20 bp, human
gtttgcactgatcatgagaa

SEQ ID NO: 329754 - DNA, 20 bp, human
gtaagtggttatagacgtta

SEQ ID NO: 329755 - DNA, 20 bp, human
gagtatagtacctagtcttg

SEQ ID NO: 329756 - DNA, 20 bp, human
ggactctgggtccaaaaagt

SEQ ID NO: 329757 - DNA, 20 bp, human
gtatagatggagtaatgaat

SEQ ID NO: 329758 - DNA, 20 bp, human
gcagaaggatgtataattgg

SEQ ID NO: 329759 - DNA, 20 bp, human
ggtggtaaagtataattaaa

SEQ ID NO: 329760 - DNA, 20 bp, human
gctgcagaaggatgtataat

SEQ ID NO: 329761 - DNA, 20 bp, human
ggctactatgacctactttt

SEQ ID NO: 329762 - DNA, 20 bp, human
ggtcacattcattaaaactg

SEQ ID NO: 329763 - DNA, 20 bp, human
gtctgcttaccacaattttc

SEQ ID NO: 329764 - DNA, 20 bp, human
ggctgcttctagtgagcaat

SEQ ID NO: 329765 - DNA, 20 bp, human
ggcttctagtgagcaattgg

SEQ ID NO: 329766 - DNA, 20 bp, human
gtggggttgggtattgcgat

SEQ ID NO: 329767 - DNA, 20 bp, human
gggctgagtattgattatag

SEQ ID NO: 329768 - DNA, 20 bp, human
gggaatgtttagcagcttac

SEQ ID NO: 329769 - DNA, 20 bp, human
ggggccactgttgcatctaa

SEQ ID NO: 329770 - DNA, 20 bp, human
gactattgatatttggggtt

SEQ ID NO: 329771 - DNA, 20 bp, human
ggcatactaaaaaatttctc

SEQ ID NO: 329772 - DNA, 20 bp, human
gatgatagatagatagttaa

SEQ ID NO: 329773 - DNA, 20 bp, human
gatttctcaggtgatgatag

SEQ ID NO: 329774 - DNA, 20 bp, human
gtttatcacaatttggaggt

SEQ ID NO: 329775 - DNA, 20 bp, human
ggacattagaaaatgttttt

SEQ ID NO: 329776 - DNA, 20 bp, human
gttacatgaattcctctttt

SEQ ID NO: 329777 - DNA, 20 bp, human
ggaccctggaagtgcaaatg

SEQ ID NO: 329778 - DNA, 20 bp, human
ggatggcaataagataatga

SEQ ID NO: 329779 - DNA, 20 bp, human
ggcacttccagggtcttgtg

SEQ ID NO: 329780 - DNA, 20 bp, human
gtccctcatttgcacttcca

SEQ ID NO: 329781 - DNA, 20 bp, human
gttttgtaataatacctata

SEQ ID NO: 329782 - DNA, 20 bp, human
ggttaataacacagccatat

SEQ ID NO: 329783 - DNA, 20 bp, human
ggctcttttcatctgcacaa

SEQ ID NO: 329784 - DNA, 20 bp, human
gaaaagttttacaacaaaag

SEQ ID NO: 329785 - DNA, 20 bp, human
gttgatattctcaaagacag

SEQ ID NO: 329786 - DNA, 20 bp, human
gactggaactgctagaagca

SEQ ID NO: 329787 - DNA, 20 bp, human
gctgaagcatatggagataa

SEQ ID NO: 329788 - DNA, 20 bp, human
ggtgttccatagggcacaag

SEQ ID NO: 329789 - DNA, 20 bp, human
gcagagcttggtgttccata

SEQ ID NO: 329790 - DNA, 20 bp, human
gtaaaacctcttgtgcccta

SEQ ID NO: 329791 - DNA, 20 bp, human
gtgcaatcaatctatgtgac

SEQ ID NO: 329792 - DNA, 20 bp, human
gtaaaaccccccatggcctc

SEQ ID NO: 329793 - DNA, 20 bp, human
gcacaagaggttttaaactc

SEQ ID NO: 329794 - DNA, 20 bp, human
ggggaggctgtgcatgttta

SEQ ID NO: 329795 - DNA, 20 bp, human
gacattccagaggccatggg

SEQ ID NO: 329796 - DNA, 20 bp, human
gtggaattctggaaatgtga

SEQ ID NO: 329797 - DNA, 20 bp, human
gtacaggataagattatgtg

SEQ ID NO: 329798 - DNA, 20 bp, human
gatgaacttacatgaatgta

SEQ ID NO: 329799 - DNA, 20 bp, human
gtgttagcatactggaattc

SEQ ID NO: 329800 - DNA, 20 bp, human
gacacaacattaaatagagt

SEQ ID NO: 329801 - DNA, 20 bp, human
gatactgtaaatcctatatg

SEQ ID NO: 329802 - DNA, 20 bp, human
gcaattttactctaatttac

SEQ ID NO: 329803 - DNA, 20 bp, human
gatttgctttctaagagatt

SEQ ID NO: 329804 - DNA, 20 bp, human
gcatgatatttgatactatt

SEQ ID NO: 329805 - DNA, 20 bp, human
gataatgattgttagcatac

SEQ ID NO: 329806 - DNA, 20 bp, human
gtggaattctggaaatgtga

SEQ ID NO: 329807 - DNA, 20 bp, human
gtacaggataagattatgtg

SEQ ID NO: 329808 - DNA, 20 bp, human
gatgaacttacatgaatgta

SEQ ID NO: 329809 - DNA, 20 bp, human
gtgttagcatactggaattc

SEQ ID NO: 329810 - DNA, 20 bp, human
gacacaacattaaatagagt

SEQ ID NO: 329811 - DNA, 20 bp, human
gatactgtaaatcctatatg

SEQ ID NO: 329812 - DNA, 20 bp, human
gcaattttactctaatttac

SEQ ID NO: 329813 - DNA, 20 bp, human
gatttgctttctaagagatt

SEQ ID NO: 329814 - DNA, 20 bp, human
gcatgatatttgatactatt

SEQ ID NO: 329815 - DNA, 20 bp, human
gataatgattgttagcatac

SEQ ID NO: 329816 - DNA, 20 bp, human
ggtaaccagccccctagaat

SEQ ID NO: 329817 - DNA, 20 bp, human
gctagggggctggttacaca

SEQ ID NO: 329818 - DNA, 20 bp, human
ggagcctcacttgtagactt

SEQ ID NO: 329819 - DNA, 20 bp, human
gtcggcacatacatagcttg

SEQ ID NO: 329820 - DNA, 20 bp, human
gtgtcttcacccattctagg

SEQ ID NO: 329821 - DNA, 20 bp, human
gcatcccaagtctacaagtg

SEQ ID NO: 329822 - DNA, 20 bp, human
gatgtccctgctactgtggt

SEQ ID NO: 329823 - DNA, 20 bp, human
gaaagtaactccaggaccgg

SEQ ID NO: 329824 - DNA, 20 bp, human
gagcctctgcccccgagaga

SEQ ID NO: 329825 - DNA, 20 bp, human
gtgagtcaatcaggtccctc

SEQ ID NO: 329826 - DNA, 20 bp, human
gagtgcatactagggtgggt

SEQ ID NO: 329827 - DNA, 20 bp, human
gccggtgagagcagagttgg

SEQ ID NO: 329828 - DNA, 20 bp, human
gtgagaaagagtgcatacta

SEQ ID NO: 329829 - DNA, 20 bp, human
gccagcacctctatcatctt

SEQ ID NO: 329830 - DNA, 20 bp, human
gtggaagcagacagggtggc

SEQ ID NO: 329831 - DNA, 20 bp, human
ggtgatcatggaagcagaca

SEQ ID NO: 329832 - DNA, 20 bp, human
ggagtcaggttatggagttg

SEQ ID NO: 329833 - DNA, 20 bp, human
ggttccacccaagatgatag

SEQ ID NO: 329834 - DNA, 20 bp, human
gtccagttatgaataccaaa

SEQ ID NO: 329835 - DNA, 20 bp, human
gagtgaacacattgtgatca

SEQ ID NO: 329836 - DNA, 20 bp, human
gagaatagatacaatgtttt

SEQ ID NO: 329837 - DNA, 20 bp, human
gtcttcattttgcaacaatc

SEQ ID NO: 329838 - DNA, 20 bp, human
gcttgaacagtcattcctaa

SEQ ID NO: 329839 - DNA, 20 bp, human
gttcaatgcatagaaactag

SEQ ID NO: 329840 - DNA, 20 bp, human
gaaacaaacaattagattgt

SEQ ID NO: 329841 - DNA, 20 bp, human
gatactaagaaaagtataaa

SEQ ID NO: 329842 - DNA, 20 bp, human
gcttttcttagtattttctt

SEQ ID NO: 329843 - DNA, 20 bp, human
gttaaactatatttaaaaga

SEQ ID NO: 329844 - DNA, 20 bp, human
gtgtttgtctttaaaatact

SEQ ID NO: 329845 - DNA, 20 bp, human
ggaaaattgacaaaaggaag

SEQ ID NO: 329846 - DNA, 20 bp, human
gaggacttcagtccatgatt

SEQ ID NO: 329847 - DNA, 20 bp, human
gcctataattctagatagta

SEQ ID NO: 329848 - DNA, 20 bp, human
gcatgatttggaaaaattac

SEQ ID NO: 329849 - DNA, 20 bp, human
gttcatgtttgatgagaata

SEQ ID NO: 329850 - DNA, 20 bp, human
gttggaaaaattactggaat

SEQ ID NO: 329851 - DNA, 20 bp, human
gtttagtagagttggtgtgg

SEQ ID NO: 329852 - DNA, 20 bp, human
gcaaaaataatttgaaaatt

SEQ ID NO: 329853 - DNA, 20 bp, human
gtttattaactatttaatgc

SEQ ID NO: 329854 - DNA, 20 bp, human
gatttttagtagagttggtg

SEQ ID NO: 329855 - DNA, 20 bp, human
ggtagagttggtgtggtggt

SEQ ID NO: 329856 - DNA, 20 bp, human
gagaatagatacaatgtttt

SEQ ID NO: 329857 - DNA, 20 bp, human
gtcttcattttgcaacaatc

SEQ ID NO: 329858 - DNA, 20 bp, human
gcttgaacagtcattcctaa

SEQ ID NO: 329859 - DNA, 20 bp, human
gttcaatgcatagaaactag

SEQ ID NO: 329860 - DNA, 20 bp, human
gaaacaaacaattagattgt

SEQ ID NO: 329861 - DNA, 20 bp, human
gatactaagaaaagtataaa

SEQ ID NO: 329862 - DNA, 20 bp, human
gcttttcttagtattttctt

SEQ ID NO: 329863 - DNA, 20 bp, human
gttaaactatatttaaaaga

SEQ ID NO: 329864 - DNA, 20 bp, human
gtgtttgtctttaaaatact

SEQ ID NO: 329865 - DNA, 20 bp, human
ggaaaattgacaaaaggaag

SEQ ID NO: 329866 - DNA, 20 bp, human
gaaactggctgattttcctt

SEQ ID NO: 329867 - DNA, 20 bp, human
gaaaatgcaagagatgccca

SEQ ID NO: 329868 - DNA, 20 bp, human
gtgaccgtgtggtgggtata

SEQ ID NO: 329869 - DNA, 20 bp, human
gactaaggccagtgtgtgaa

SEQ ID NO: 329870 - DNA, 20 bp, human
gcggcaactgagtgaccgtg

SEQ ID NO: 329871 - DNA, 20 bp, human
gtctgttccagtcccatctg

SEQ ID NO: 329872 - DNA, 20 bp, human
ggtacagaaggagaaaccct

SEQ ID NO: 329873 - DNA, 20 bp, human
gttaccatatacccaccaca

SEQ ID NO: 329874 - DNA, 20 bp, human
gcaactgagtgaccgtgtgg

SEQ ID NO: 329875 - DNA, 20 bp, human
gggcatacaattcttaggtt

SEQ ID NO: 329876 - DNA, 20 bp, human
gaacatcatgaagcagtgac

SEQ ID NO: 329877 - DNA, 20 bp, human
gaagaaatgcaactaatctt

SEQ ID NO: 329878 - DNA, 20 bp, human
gggaaatgtgaaaggcattt

SEQ ID NO: 329879 - DNA, 20 bp, human
gggaagcacattagttagtt

SEQ ID NO: 329880 - DNA, 20 bp, human
ggtaattgcacttctcaagt

SEQ ID NO: 329881 - DNA, 20 bp, human
gcacattagttagtttgggt

SEQ ID NO: 329882 - DNA, 20 bp, human
gttctttaagtgttagagtt

SEQ ID NO: 329883 - DNA, 20 bp, human
gggcattgtattagatgcag

SEQ ID NO: 329884 - DNA, 20 bp, human
gtattgtgtgaatcatgagt

SEQ ID NO: 329885 - DNA, 20 bp, human
gagtgctttgatggcccatc

SEQ ID NO: 329886 - DNA, 20 bp, human
gaagagggtcagagagtgaa

SEQ ID NO: 329887 - DNA, 20 bp, human
gaggaactgcgttttcagat

SEQ ID NO: 329888 - DNA, 20 bp, human
gcatgctcctgattgtacgt

SEQ ID NO: 329889 - DNA, 20 bp, human
gaacaaaggcactatcttca

SEQ ID NO: 329890 - DNA, 20 bp, human
gacgctgccaacgtacaatc

SEQ ID NO: 329891 - DNA, 20 bp, human
ggactacatgtcagtgactt

SEQ ID NO: 329892 - DNA, 20 bp, human
gcagcctgctctcatggcct

SEQ ID NO: 329893 - DNA, 20 bp, human
gacagaaaagtcaatcaatt

SEQ ID NO: 329894 - DNA, 20 bp, human
gtccatgcaattactgtcaa

SEQ ID NO: 329895 - DNA, 20 bp, human
gtacaagacatcattcctgc

SEQ ID NO: 329896 - DNA, 20 bp, human
gagctgtttgatcttacaca

SEQ ID NO: 329897 - DNA, 20 bp, human
ggcactccacatatataagg

SEQ ID NO: 329898 - DNA, 20 bp, human
gtgagataagattaatgcgt

SEQ ID NO: 329899 - DNA, 20 bp, human
gaaagcactccacatatata

SEQ ID NO: 329900 - DNA, 20 bp, human
gaagcattatgatcctcttt

SEQ ID NO: 329901 - DNA, 20 bp, human
gaagatcaaacagctaattg

SEQ ID NO: 329902 - DNA, 20 bp, human
gaagcgctgacttgtaagtc

SEQ ID NO: 329903 - DNA, 20 bp, human
gaatgcgtaggttaaaacag

SEQ ID NO: 329904 - DNA, 20 bp, human
gtaatcttatctcataagca

SEQ ID NO: 329905 - DNA, 20 bp, human
gagcaatgggctctgcttgt

SEQ ID NO: 329906 - DNA, 20 bp, human
gacaacgcccacttcttggt

SEQ ID NO: 329907 - DNA, 20 bp, human
ggcgcgccagggaccgtggg

SEQ ID NO: 329908 - DNA, 20 bp, human
gaagaagtgggcgttgttgt

SEQ ID NO: 329909 - DNA, 20 bp, human
ggccccgcccaccaagaagt

SEQ ID NO: 329910 - DNA, 20 bp, human
ggcggcgcgccagggaccgt

SEQ ID NO: 329911 - DNA, 20 bp, human
ggcggcgcctcggatccccg

SEQ ID NO: 329912 - DNA, 20 bp, human
gcgggcgcttccaggaaaag

SEQ ID NO: 329913 - DNA, 20 bp, human
gggaccgtgggcggtgccgt

SEQ ID NO: 329914 - DNA, 20 bp, human
gtccaggccccggggatccg

SEQ ID NO: 329915 - DNA, 20 bp, human
ggctggcaaaagcccccggg

SEQ ID NO: 329916 - DNA, 20 bp, human
gccggcgggtgacgtggccg

SEQ ID NO: 329917 - DNA, 20 bp, human
gcccacccgcgggagagccg

SEQ ID NO: 329918 - DNA, 20 bp, human
ggccacgtcacccgccgggc

SEQ ID NO: 329919 - DNA, 20 bp, human
gccctcgcgcgatcccgggg

SEQ ID NO: 329920 - DNA, 20 bp, human
gcaacacgtgacccacccgc

SEQ ID NO: 329921 - DNA, 20 bp, human
gcgcctcctcggagagtggg

SEQ ID NO: 329922 - DNA, 20 bp, human
ggggcaggagggatgcgcgc

SEQ ID NO: 329923 - DNA, 20 bp, human
gccccccaccgccccatcgg

SEQ ID NO: 329924 - DNA, 20 bp, human
gggggctggcggcgcctcct

SEQ ID NO: 329925 - DNA, 20 bp, human
gtcgcgcgagggagaggagc

SEQ ID NO: 329926 - DNA, 20 bp, human
gactgcggggacttggtccc

SEQ ID NO: 329927 - DNA, 20 bp, human
gaccaagtccccgcagtccc

SEQ ID NO: 329928 - DNA, 20 bp, human
gcggggctagccacatgatg

SEQ ID NO: 329929 - DNA, 20 bp, human
gtccctacctacagatgagt

SEQ ID NO: 329930 - DNA, 20 bp, human
gggtcgcggggaatctctgc

SEQ ID NO: 329931 - DNA, 20 bp, human
ggggccggggcttaccatgt

SEQ ID NO: 329932 - DNA, 20 bp, human
ggggttggcgtgcacctcgg

SEQ ID NO: 329933 - DNA, 20 bp, human
gggaagaggcagcccggcga

SEQ ID NO: 329934 - DNA, 20 bp, human
gttggtgggtaggggtcgcg

SEQ ID NO: 329935 - DNA, 20 bp, human
ggtgtccagctgtaccttgg

SEQ ID NO: 329936 - DNA, 20 bp, human
ggcggggcttcagtcgaggc

SEQ ID NO: 329937 - DNA, 20 bp, human
gcatgcgcggctgcagcggt

SEQ ID NO: 329938 - DNA, 20 bp, human
ggcgaaaggaccccagggcg

SEQ ID NO: 329939 - DNA, 20 bp, human
gcagggcggggcttcagtcg

SEQ ID NO: 329940 - DNA, 20 bp, human
ggctcccagcgcggacagac

SEQ ID NO: 329941 - DNA, 20 bp, human
gcctgcccagctccagcaaa

SEQ ID NO: 329942 - DNA, 20 bp, human
ggcagggcgaaaggacccca

SEQ ID NO: 329943 - DNA, 20 bp, human
gccgcgcatgcgccatgtac

SEQ ID NO: 329944 - DNA, 20 bp, human
gagggcctgtctgtccgcgc

SEQ ID NO: 329945 - DNA, 20 bp, human
ggcccaaagcagcctgtaca

SEQ ID NO: 329946 - DNA, 20 bp, human
gccactccgtacacctaaga

SEQ ID NO: 329947 - DNA, 20 bp, human
gggaaacaccgtagtgtaaa

SEQ ID NO: 329948 - DNA, 20 bp, human
gtacgtcatgcgcccctctt

SEQ ID NO: 329949 - DNA, 20 bp, human
gtcgcctatcgaatcaatga

SEQ ID NO: 329950 - DNA, 20 bp, human
ggatggcggctgcatgttag

SEQ ID NO: 329951 - DNA, 20 bp, human
ggcaacgaagggacggtctg

SEQ ID NO: 329952 - DNA, 20 bp, human
gtgattcgataggcgacgcg

SEQ ID NO: 329953 - DNA, 20 bp, human
gccgccatcattgattcgat

SEQ ID NO: 329954 - DNA, 20 bp, human
gtaggtgtacggagtgggcg

SEQ ID NO: 329955 - DNA, 20 bp, human
gtggtgtcgcaacgaaggga

SEQ ID NO: 329956 - DNA, 20 bp, human
gaggagtcggccaagagcga

SEQ ID NO: 329957 - DNA, 20 bp, human
gctgaggaaaacggattctt

SEQ ID NO: 329958 - DNA, 20 bp, human
gccattcggccccgcccatc

SEQ ID NO: 329959 - DNA, 20 bp, human
gaaggtaaggcccacaactc

SEQ ID NO: 329960 - DNA, 20 bp, human
gcgaggaagccaataggaag

SEQ ID NO: 329961 - DNA, 20 bp, human
gaggaagtttgcacagtagc

SEQ ID NO: 329962 - DNA, 20 bp, human
gatggccggcgccgactgga

SEQ ID NO: 329963 - DNA, 20 bp, human
gggccgactcctcttcctat

SEQ ID NO: 329964 - DNA, 20 bp, human
ggggaaaaggaagtgttgtt

SEQ ID NO: 329965 - DNA, 20 bp, human
gttcttgggccctgagttgt

SEQ ID NO: 329966 - DNA, 20 bp, human
gcggggaggcgggtcgtata

SEQ ID NO: 329967 - DNA, 20 bp, human
ggcgggtcgtataaggaggt

SEQ ID NO: 329968 - DNA, 20 bp, human
gctgcggcgcacttccgtag

SEQ ID NO: 329969 - DNA, 20 bp, human
gtggctggcatcaccctccg

SEQ ID NO: 329970 - DNA, 20 bp, human
gggggcgaggccggaactgg

SEQ ID NO: 329971 - DNA, 20 bp, human
ggggtgatgccagccaatca

SEQ ID NO: 329972 - DNA, 20 bp, human
gaccctccggggcgggtttc

SEQ ID NO: 329973 - DNA, 20 bp, human
gctctgccctgcagccgcga

SEQ ID NO: 329974 - DNA, 20 bp, human
gagccacacggctccttgat

SEQ ID NO: 329975 - DNA, 20 bp, human
gggccggaactggcggactg

SEQ ID NO: 329976 - DNA, 20 bp, human
ggcgggaggtacaggagcgg

SEQ ID NO: 329977 - DNA, 20 bp, human
gaaagtggaggaacggaagt

SEQ ID NO: 329978 - DNA, 20 bp, human
gctaagggaaagtggaggaa

SEQ ID NO: 329979 - DNA, 20 bp, human
ggggcgtggacggagacgaa

SEQ ID NO: 329980 - DNA, 20 bp, human
ggaacggaagtgggcgtgga

SEQ ID NO: 329981 - DNA, 20 bp, human
gccttcctaagggaaagtgg

SEQ ID NO: 329982 - DNA, 20 bp, human
gacccggaagacattgtagc

SEQ ID NO: 329983 - DNA, 20 bp, human
gcgtcgaggcgctagcgacc

SEQ ID NO: 329984 - DNA, 20 bp, human
gcatgtccctctctgacggg

SEQ ID NO: 329985 - DNA, 20 bp, human
gcgaaaggaggtcacgtgtt

SEQ ID NO: 329986 - DNA, 20 bp, human
gtcgccgccgctctagtctc

SEQ ID NO: 329987 - DNA, 20 bp, human
gaaggagacgacatggagat

SEQ ID NO: 329988 - DNA, 20 bp, human
gcgaggttttgcccattctt

SEQ ID NO: 329989 - DNA, 20 bp, human
gaggaccagcgagaagagga

SEQ ID NO: 329990 - DNA, 20 bp, human
gtccggccctgagactagag

SEQ ID NO: 329991 - DNA, 20 bp, human
gtgggcttggtggggatttc

SEQ ID NO: 329992 - DNA, 20 bp, human
gggaaccatcctcttctcgc

SEQ ID NO: 329993 - DNA, 20 bp, human
gggccctgagactagagcgg

SEQ ID NO: 329994 - DNA, 20 bp, human
ggctccgggtccgtcttctt

SEQ ID NO: 329995 - DNA, 20 bp, human
ggagatgggcgaatagggaa

SEQ ID NO: 329996 - DNA, 20 bp, human
ggcggtgaacgtggacttgt

SEQ ID NO: 329997 - DNA, 20 bp, human
gacccccggcgcatctggat

SEQ ID NO: 329998 - DNA, 20 bp, human
ggcaaaaggaagaccctgat

SEQ ID NO: 329999 - DNA, 20 bp, human
gagagtgggcggagcagtgc

SEQ ID NO: 330000 - DNA, 20 bp, human
gaacgcagatgcggtgaacg

SEQ ID NO: 330001 - DNA, 20 bp, human
gcacagcgtgcgagagtggg

SEQ ID NO: 330002 - DNA, 20 bp, human
gggcagtggggatcgcccgg

SEQ ID NO: 330003 - DNA, 20 bp, human
gtcaccacagcgtgcgagag

SEQ ID NO: 330004 - DNA, 20 bp, human
gaagaccctgattggtttgt

SEQ ID NO: 330005 - DNA, 20 bp, human
gcatctagcgttaagtgaca

SEQ ID NO: 330006 - DNA, 20 bp, human
gaggtgggagctggtgatgg

SEQ ID NO: 330007 - DNA, 20 bp, human
ggaatctttgactgtcagct

SEQ ID NO: 330008 - DNA, 20 bp, human
gagtgatctggggagaaggt

SEQ ID NO: 330009 - DNA, 20 bp, human
gaaccacttgccagtgatct

SEQ ID NO: 330010 - DNA, 20 bp, human
gaacgaggagtacaataagt

SEQ ID NO: 330011 - DNA, 20 bp, human
gtctttgactgtcagctggg

SEQ ID NO: 330012 - DNA, 20 bp, human
ggagtacaataagtcggttc

SEQ ID NO: 330013 - DNA, 20 bp, human
ggcatcggcctttcgaaacg

SEQ ID NO: 330014 - DNA, 20 bp, human
gttgtactcctcgtttcgaa

SEQ ID NO: 330015 - DNA, 20 bp, human
gaagtggttttatatcgcat

SEQ ID NO: 330016 - DNA, 20 bp, human
gaatgatgaagcacctttga

SEQ ID NO: 330017 - DNA, 20 bp, human
gtgccgggtgaaggcaaaca

SEQ ID NO: 330018 - DNA, 20 bp, human
gatccatgtttgccttcacc

SEQ ID NO: 330019 - DNA, 20 bp, human
gtagctgttgccacactcag

SEQ ID NO: 330020 - DNA, 20 bp, human
gtcagagccaaagttcattg

SEQ ID NO: 330021 - DNA, 20 bp, human
gggtgaaggatgccgggtga

SEQ ID NO: 330022 - DNA, 20 bp, human
gaggaactcaaattagacct

SEQ ID NO: 330023 - DNA, 20 bp, human
gcaaggccaaggtgggtgcg

SEQ ID NO: 330024 - DNA, 20 bp, human
gccagcctggggaccctcaa

SEQ ID NO: 330025 - DNA, 20 bp, human
ggagcaccgcctccaaaccc

SEQ ID NO: 330026 - DNA, 20 bp, human
gcgcacgcgcgcggcagagc

SEQ ID NO: 330027 - DNA, 20 bp, human
gcgctggcagcgagtctgtc

SEQ ID NO: 330028 - DNA, 20 bp, human
gtgagtcccgcctcgcccgg

SEQ ID NO: 330029 - DNA, 20 bp, human
gcccgggggcaacgtgagat

SEQ ID NO: 330030 - DNA, 20 bp, human
gagactcgctgccagcggat

SEQ ID NO: 330031 - DNA, 20 bp, human
gtaagtgggcacgaacgcgg

SEQ ID NO: 330032 - DNA, 20 bp, human
gtgcgcatcgggtgagacgc

SEQ ID NO: 330033 - DNA, 20 bp, human
gcgctagcaggaaggtagtg

SEQ ID NO: 330034 - DNA, 20 bp, human
gaggaccagcccggctgcta

SEQ ID NO: 330035 - DNA, 20 bp, human
gagtggggcggcgggtaagt

SEQ ID NO: 330036 - DNA, 20 bp, human
gagagctgatggtatggcgt

SEQ ID NO: 330037 - DNA, 20 bp, human
gacgtcagctattgaccaat

SEQ ID NO: 330038 - DNA, 20 bp, human
gcaaaaggtggaactgggag

SEQ ID NO: 330039 - DNA, 20 bp, human
gccaccttttgaaagaggtg

SEQ ID NO: 330040 - DNA, 20 bp, human
gacgtcgctctcacttctct

SEQ ID NO: 330041 - DNA, 20 bp, human
gttgccccacctctttcaaa

SEQ ID NO: 330042 - DNA, 20 bp, human
gcagcgctgccaccacccat

SEQ ID NO: 330043 - DNA, 20 bp, human
gaaggagaggcgttacttcc

SEQ ID NO: 330044 - DNA, 20 bp, human
gaggcggaggccgcgggtgg

SEQ ID NO: 330045 - DNA, 20 bp, human
gtctttcaaaaggtggaact

SEQ ID NO: 330046 - DNA, 20 bp, human
gtccccgaagaggccgggaa

SEQ ID NO: 330047 - DNA, 20 bp, human
gcaaccgtgcgtccccgaag

SEQ ID NO: 330048 - DNA, 20 bp, human
gactcccaggaggcgtcggg

SEQ ID NO: 330049 - DNA, 20 bp, human
gggcgcggggcggtgacgta

SEQ ID NO: 330050 - DNA, 20 bp, human
ggaggccgggaacggagccc

SEQ ID NO: 330051 - DNA, 20 bp, human
gtcttccgctggctccgggc

SEQ ID NO: 330052 - DNA, 20 bp, human
gggcacgcccgacgccttct

SEQ ID NO: 330053 - DNA, 20 bp, human
gcgtgacgtgatggtcagat

SEQ ID NO: 330054 - DNA, 20 bp, human
gggcggtgacgtacggggac

SEQ ID NO: 330055 - DNA, 20 bp, human
gcgtgcgtccccgaagaggc

SEQ ID NO: 330056 - DNA, 20 bp, human
gtaggtagcgtgcgcagtgc

SEQ ID NO: 330057 - DNA, 20 bp, human
ggaggcgtggtctatgcgct

SEQ ID NO: 330058 - DNA, 20 bp, human
gacagctgggcgaagacaga

SEQ ID NO: 330059 - DNA, 20 bp, human
gtgaaattggggaacgagga

SEQ ID NO: 330060 - DNA, 20 bp, human
gagaccacgcctctgaaatt

SEQ ID NO: 330061 - DNA, 20 bp, human
ggcggagtattgaggcagat

SEQ ID NO: 330062 - DNA, 20 bp, human
gcctctgaaattggggaacg

SEQ ID NO: 330063 - DNA, 20 bp, human
gaccgccgggcggagtattg

SEQ ID NO: 330064 - DNA, 20 bp, human
gaggaatagggtacgtggga

SEQ ID NO: 330065 - DNA, 20 bp, human
gaacgtggctccaaggtcct

SEQ ID NO: 330066 - DNA, 20 bp, human
gcgggaagaaggacgtcgat

SEQ ID NO: 330067 - DNA, 20 bp, human
ggggcggggacgctgcgcgg

SEQ ID NO: 330068 - DNA, 20 bp, human
gtgccgctgagtgtcacttg

SEQ ID NO: 330069 - DNA, 20 bp, human
gtatctgaaccaatcaaagg

SEQ ID NO: 330070 - DNA, 20 bp, human
gcggcgacggcggctctcgt

SEQ ID NO: 330071 - DNA, 20 bp, human
gctgggcgctgtagaatgac

SEQ ID NO: 330072 - DNA, 20 bp, human
gagaaatgccaatatccgcg

SEQ ID NO: 330073 - DNA, 20 bp, human
gcgccagacccacctttgat

SEQ ID NO: 330074 - DNA, 20 bp, human
gaaccaatcaaaggtgggtc

SEQ ID NO: 330075 - DNA, 20 bp, human
gttccagcgctcagggagga

SEQ ID NO: 330076 - DNA, 20 bp, human
gggctctatggggaaagcgg

SEQ ID NO: 330077 - DNA, 20 bp, human
ggcgacccacagacaggtaa

SEQ ID NO: 330078 - DNA, 20 bp, human
gtgggccgaagcagagaccg

SEQ ID NO: 330079 - DNA, 20 bp, human
gctgcggccgccagaagcgg

SEQ ID NO: 330080 - DNA, 20 bp, human
gtgaagcgcgccatcccctt

SEQ ID NO: 330081 - DNA, 20 bp, human
gccacccaggaaagccgggt

SEQ ID NO: 330082 - DNA, 20 bp, human
ggcagccattacctgtctgt

SEQ ID NO: 330083 - DNA, 20 bp, human
gcccgtgggcagagctgcgc

SEQ ID NO: 330084 - DNA, 20 bp, human
gacagccggcgggcgctgac

SEQ ID NO: 330085 - DNA, 20 bp, human
gcgggtcggccggctctatg

SEQ ID NO: 330086 - DNA, 20 bp, human
gtggacccgcccggcctgac

SEQ ID NO: 330087 - DNA, 20 bp, human
ggccctcgggacactctagg

SEQ ID NO: 330088 - DNA, 20 bp, human
gaggtcccgaggtggataag

SEQ ID NO: 330089 - DNA, 20 bp, human
gcgggtggaccgggtgggtg

SEQ ID NO: 330090 - DNA, 20 bp, human
ggaaactagtgcggagggag

SEQ ID NO: 330091 - DNA, 20 bp, human
gaaggaatgcgtgggtgact

SEQ ID NO: 330092 - DNA, 20 bp, human
gggccctccgcgttgtctgg

SEQ ID NO: 330093 - DNA, 20 bp, human
gtgtgcggaagaccgagaga

SEQ ID NO: 330094 - DNA, 20 bp, human
gcacccggtccacccggata

SEQ ID NO: 330095 - DNA, 20 bp, human
gtcccgaggtggataagggg

SEQ ID NO: 330096 - DNA, 20 bp, human
gggcggcgggtccctgaagg

SEQ ID NO: 330097 - DNA, 20 bp, human
ggctctgggagctggtagct

SEQ ID NO: 330098 - DNA, 20 bp, human
gaagatggcgccagacgctt

SEQ ID NO: 330099 - DNA, 20 bp, human
gaagtgagctcacgctactc

SEQ ID NO: 330100 - DNA, 20 bp, human
gagagcctccgcctccttca

SEQ ID NO: 330101 - DNA, 20 bp, human
gagctcacgctactccggaa

SEQ ID NO: 330102 - DNA, 20 bp, human
ggggtggctgacccgctgtg

SEQ ID NO: 330103 - DNA, 20 bp, human
gggccctggcattcgcgctt

SEQ ID NO: 330104 - DNA, 20 bp, human
gcacgctactccggaaggga

SEQ ID NO: 330105 - DNA, 20 bp, human
gctcctgggaacccagtcga

SEQ ID NO: 330106 - DNA, 20 bp, human
gcggggagtgggcggggaac

SEQ ID NO: 330107 - DNA, 20 bp, human
gaacgggcgtgtccccgctg

SEQ ID NO: 330108 - DNA, 20 bp, human
gccccgctgcggtcacgtgt

SEQ ID NO: 330109 - DNA, 20 bp, human
ggcccgctcctgtcccgcct

SEQ ID NO: 330110 - DNA, 20 bp, human
gcctggaacgcgcatcctcc

SEQ ID NO: 330111 - DNA, 20 bp, human
gaggatgcgcgttccagggg

SEQ ID NO: 330112 - DNA, 20 bp, human
gggccaccggcgctggttcc

SEQ ID NO: 330113 - DNA, 20 bp, human
gtcccgacacgtgaccgcag

SEQ ID NO: 330114 - DNA, 20 bp, human
ggcgggacaggagcgggccg

SEQ ID NO: 330115 - DNA, 20 bp, human
gtgtggtgggaggagcgcga

SEQ ID NO: 330116 - DNA, 20 bp, human
gtgcgtgggcggggctctga

SEQ ID NO: 330117 - DNA, 20 bp, human
gggtagaggcccttcgcgaa

SEQ ID NO: 330118 - DNA, 20 bp, human
gctcgggccgggcgctgatt

SEQ ID NO: 330119 - DNA, 20 bp, human
gcggggctctgagggggcac

SEQ ID NO: 330120 - DNA, 20 bp, human
gcgcccacgcagcggagtga

SEQ ID NO: 330121 - DNA, 20 bp, human
gtcacagcaggagagaggcg

SEQ ID NO: 330122 - DNA, 20 bp, human
ggcccctgagccaaaagggg

SEQ ID NO: 330123 - DNA, 20 bp, human
gtatgctaatcccttcgcga

SEQ ID NO: 330124 - DNA, 20 bp, human
gaccccccggcgcgagcctc

SEQ ID NO: 330125 - DNA, 20 bp, human
gtgacaccgaggcggaagtg

SEQ ID NO: 330126 - DNA, 20 bp, human
ggggaccccggattccggat

SEQ ID NO: 330127 - DNA, 20 bp, human
gaatccgctggcttcttccg

SEQ ID NO: 330128 - DNA, 20 bp, human
ggccccacctccttcccgaa

SEQ ID NO: 330129 - DNA, 20 bp, human
gccaacccatccggaatccg

SEQ ID NO: 330130 - DNA, 20 bp, human
gagcccgaggagccgcgcaa

SEQ ID NO: 330131 - DNA, 20 bp, human
gcagaagtcgcctttcggga

SEQ ID NO: 330132 - DNA, 20 bp, human
gccacccagtgcctcgccgc

SEQ ID NO: 330133 - DNA, 20 bp, human
ggagtcctgcggcgaggcac

SEQ ID NO: 330134 - DNA, 20 bp, human
gaagtcgcctttcgggaagg

SEQ ID NO: 330135 - DNA, 20 bp, human
gccgcccggcgattagcccg

SEQ ID NO: 330136 - DNA, 20 bp, human
gccgcgcggcgattcggccc

SEQ ID NO: 330137 - DNA, 20 bp, human
gccgaatcgccgcgcggagc

SEQ ID NO: 330138 - DNA, 20 bp, human
gaggagaagcggcagccggt

SEQ ID NO: 330139 - DNA, 20 bp, human
gcgcgcggagcgggcgccca

SEQ ID NO: 330140 - DNA, 20 bp, human
gccggggctcacacccaccc

SEQ ID NO: 330141 - DNA, 20 bp, human
ggcgcggcggccgcaaaacc

SEQ ID NO: 330142 - DNA, 20 bp, human
gtgagtggggtcagcttcgt

SEQ ID NO: 330143 - DNA, 20 bp, human
ggcgcctcgcaccctggcta

SEQ ID NO: 330144 - DNA, 20 bp, human
gggagcgcgcgcggggggtt

SEQ ID NO: 330145 - DNA, 20 bp, human
gccctcgctccgcctcgcgc

SEQ ID NO: 330146 - DNA, 20 bp, human
gcagggaggggcgcccggta

SEQ ID NO: 330147 - DNA, 20 bp, human
ggtggagcggcaagcggctg

SEQ ID NO: 330148 - DNA, 20 bp, human
ggaggggcgcccggtagggc

SEQ ID NO: 330149 - DNA, 20 bp, human
gcctccctgcgccgccagat

SEQ ID NO: 330150 - DNA, 20 bp, human
ggggtccttagcccatctgg

SEQ ID NO: 330151 - DNA, 20 bp, human
gccccgcccgtgggagagga

SEQ ID NO: 330152 - DNA, 20 bp, human
gccactccagccgggcggac

SEQ ID NO: 330153 - DNA, 20 bp, human
gacgcggggtcccacagcca

SEQ ID NO: 330154 - DNA, 20 bp, human
gcgcgccccgcccgtgggag

SEQ ID NO: 330155 - DNA, 20 bp, human
ggtgggaccccgcgtgacca

SEQ ID NO: 330156 - DNA, 20 bp, human
gctgctccccggaggactca

SEQ ID NO: 330157 - DNA, 20 bp, human
gagtcctccggggagcaggg

SEQ ID NO: 330158 - DNA, 20 bp, human
gccaagccacatcgatgcta

SEQ ID NO: 330159 - DNA, 20 bp, human
ggactgccctagcatcgatg

SEQ ID NO: 330160 - DNA, 20 bp, human
gtggggagatccggctagag

SEQ ID NO: 330161 - DNA, 20 bp, human
gcatcgatgtggcttgggag

SEQ ID NO: 330162 - DNA, 20 bp, human
gcgatgtggcttgggagtgg

SEQ ID NO: 330163 - DNA, 20 bp, human
gctgcccggagcttggcggg

SEQ ID NO: 330164 - DNA, 20 bp, human
gggagatccggctagagggg

SEQ ID NO: 330165 - DNA, 20 bp, human
gccctcctcccgccaagctc

SEQ ID NO: 330166 - DNA, 20 bp, human
gacaccctggcgaagcaagg

SEQ ID NO: 330167 - DNA, 20 bp, human
gtgggcatgcggaaggggac

SEQ ID NO: 330168 - DNA, 20 bp, human
gctgctaggcgggctcgaac

SEQ ID NO: 330169 - DNA, 20 bp, human
gccgtcacgtgacgggaaga

SEQ ID NO: 330170 - DNA, 20 bp, human
ggaagcgagcccaccaccgt

SEQ ID NO: 330171 - DNA, 20 bp, human
gtaggcgggctcgaaccggg

SEQ ID NO: 330172 - DNA, 20 bp, human
gtccgcgcaccgtcacgtga

SEQ ID NO: 330173 - DNA, 20 bp, human
gataacaccctggcgaagca

SEQ ID NO: 330174 - DNA, 20 bp, human
gggagggcactagaatgtga

SEQ ID NO: 330175 - DNA, 20 bp, human
gtgcccttgggcatgcggaa

SEQ ID NO: 330176 - DNA, 20 bp, human
gaagtcaaacacgctttctt

SEQ ID NO: 330177 - DNA, 20 bp, human
gtagggcgcctattgtgtgt

SEQ ID NO: 330178 - DNA, 20 bp, human
gtgtgtaggactccatgcca

SEQ ID NO: 330179 - DNA, 20 bp, human
gatggagtcctacacacaat

SEQ ID NO: 330180 - DNA, 20 bp, human
gcgggtcctgggcgggtcct

SEQ ID NO: 330181 - DNA, 20 bp, human
gcgcatgctgaatgccatat

SEQ ID NO: 330182 - DNA, 20 bp, human
gcattctcgcatccgtggca

SEQ ID NO: 330183 - DNA, 20 bp, human
ggcatctgccggcaccgccc

SEQ ID NO: 330184 - DNA, 20 bp, human
gatggcattcagcatgcggg

SEQ ID NO: 330185 - DNA, 20 bp, human
ggcgtgtttgacttgatcgc

SEQ ID NO: 330186 - DNA, 20 bp, human
gtgactgtgtcatagcccta

SEQ ID NO: 330187 - DNA, 20 bp, human
gacggaagagagtatcgagg

SEQ ID NO: 330188 - DNA, 20 bp, human
gtatcgaggtgggggcctgt

SEQ ID NO: 330189 - DNA, 20 bp, human
gctatgacacagtcacccac

SEQ ID NO: 330190 - DNA, 20 bp, human
ggaagagagtatcgaggtgg

SEQ ID NO: 330191 - DNA, 20 bp, human
ggaaacaaatactagtcagg

SEQ ID NO: 330192 - DNA, 20 bp, human
ggcactgtggaaaaattagc

SEQ ID NO: 330193 - DNA, 20 bp, human
gggggttcagtcataacctg

SEQ ID NO: 330194 - DNA, 20 bp, human
gaatactagtcaggaggtgg

SEQ ID NO: 330195 - DNA, 20 bp, human
gtcatagccctatggcactg

SEQ ID NO: 330196 - DNA, 20 bp, human
ggccgccgcggagacaaaga

SEQ ID NO: 330197 - DNA, 20 bp, human
gcgaggacgcggagcaccct

SEQ ID NO: 330198 - DNA, 20 bp, human
gcgccctggagcacaagtag

SEQ ID NO: 330199 - DNA, 20 bp, human
ggcgcgagaacccgctccca

SEQ ID NO: 330200 - DNA, 20 bp, human
ggagcgggttctcgcgcata

SEQ ID NO: 330201 - DNA, 20 bp, human
gagaggcgaaagcaaggacg

SEQ ID NO: 330202 - DNA, 20 bp, human
gacggggctcgggtagttct

SEQ ID NO: 330203 - DNA, 20 bp, human
ggggcaggggtggaagcgat

SEQ ID NO: 330204 - DNA, 20 bp, human
ggcagccatctttgtctccg

SEQ ID NO: 330205 - DNA, 20 bp, human
gaagcgggccgtcgcacaga

SEQ ID NO: 330206 - DNA, 20 bp, human
gggtggtggaccgtcccggg

SEQ ID NO: 330207 - DNA, 20 bp, human
gtggctcggaccaatccccc

SEQ ID NO: 330208 - DNA, 20 bp, human
gctgggtggtggaccgtccc

SEQ ID NO: 330209 - DNA, 20 bp, human
ggagctgtgcttctgagagt

SEQ ID NO: 330210 - DNA, 20 bp, human
ggggagctaattggtctggg

SEQ ID NO: 330211 - DNA, 20 bp, human
gccggccctcgccctttcga

SEQ ID NO: 330212 - DNA, 20 bp, human
gagacgggagctaattggtc

SEQ ID NO: 330213 - DNA, 20 bp, human
gtgctggggcaacgccgtga

SEQ ID NO: 330214 - DNA, 20 bp, human
gcggaccaatccccccggga

SEQ ID NO: 330215 - DNA, 20 bp, human
gtgggaggtgccctgaagac

SEQ ID NO: 330216 - DNA, 20 bp, human
ggccgcgctgccgagtcact

SEQ ID NO: 330217 - DNA, 20 bp, human
gcctgcgtctgcgcagtcgt

SEQ ID NO: 330218 - DNA, 20 bp, human
gcgggtgcggggcgttggag

SEQ ID NO: 330219 - DNA, 20 bp, human
ggctgccgagtcactggggt

SEQ ID NO: 330220 - DNA, 20 bp, human
ggtgggaggagcataagcag

SEQ ID NO: 330221 - DNA, 20 bp, human
gtgctcccgacccgcttttg

SEQ ID NO: 330222 - DNA, 20 bp, human
gggcgcacgtgcttctgagg

SEQ ID NO: 330223 - DNA, 20 bp, human
gtaaggcgcacgtgcttctg

SEQ ID NO: 330224 - DNA, 20 bp, human
gcacgccccaaaagcgggtc

SEQ ID NO: 330225 - DNA, 20 bp, human
gcacgtgcttctgagggggg

SEQ ID NO: 330226 - DNA, 20 bp, human
gtaggaagacaggtccctgg

SEQ ID NO: 330227 - DNA, 20 bp, human
gtggaccacgggaaagagat

SEQ ID NO: 330228 - DNA, 20 bp, human
gaaacagcccgagggagggt

SEQ ID NO: 330229 - DNA, 20 bp, human
gaccaatcacgcgcattctt

SEQ ID NO: 330230 - DNA, 20 bp, human
gacaacgataaacagcccga

SEQ ID NO: 330231 - DNA, 20 bp, human
gcgcgagcggagacccgcca

SEQ ID NO: 330232 - DNA, 20 bp, human
gcgaatgtaaggcacagagt

SEQ ID NO: 330233 - DNA, 20 bp, human
gcccacgtgggtagcggacc

SEQ ID NO: 330234 - DNA, 20 bp, human
ggacctggtcacgtgatcag

SEQ ID NO: 330235 - DNA, 20 bp, human
ggccgaagaatgcgcgtgat

SEQ ID NO: 330236 - DNA, 20 bp, human
gcgcccggaagtgatgtcat

SEQ ID NO: 330237 - DNA, 20 bp, human
gctagtgactgatccagcgg

SEQ ID NO: 330238 - DNA, 20 bp, human
gtgcgcacagagagcgtttt

SEQ ID NO: 330239 - DNA, 20 bp, human
gaaagcccgaacctggcgcc

SEQ ID NO: 330240 - DNA, 20 bp, human
gctgctgttccgctagcgag

SEQ ID NO: 330241 - DNA, 20 bp, human
gtccagcggaggccgaatac

SEQ ID NO: 330242 - DNA, 20 bp, human
gctcatcacctgcaaatctg

SEQ ID NO: 330243 - DNA, 20 bp, human
ggcaaatctgggggaaatgc

SEQ ID NO: 330244 - DNA, 20 bp, human
gagagcgttttgggcaaaga

SEQ ID NO: 330245 - DNA, 20 bp, human
gatgtcatcggaactgtgca

SEQ ID NO: 330246 - DNA, 20 bp, human
gcctgctgggcggcctgcca

SEQ ID NO: 330247 - DNA, 20 bp, human
gaatgaacttgcacactggg

SEQ ID NO: 330248 - DNA, 20 bp, human
gcctcatggccagccttaaa

SEQ ID NO: 330249 - DNA, 20 bp, human
gtgtgcaagttcattcatca

SEQ ID NO: 330250 - DNA, 20 bp, human
gaggaggcggcgcaggcagt

SEQ ID NO: 330251 - DNA, 20 bp, human
gttaaagggcccctgctggg

SEQ ID NO: 330252 - DNA, 20 bp, human
gcggcctgccagggggccta

SEQ ID NO: 330253 - DNA, 20 bp, human
gagcgccaccctaggccccc

SEQ ID NO: 330254 - DNA, 20 bp, human
gtgggagggagcgccaccct

SEQ ID NO: 330255 - DNA, 20 bp, human
gcataagcgtgagtcagcag

SEQ ID NO: 330256 - DNA, 20 bp, human
ggggcgaagtctgcgattgg

SEQ ID NO: 330257 - DNA, 20 bp, human
gcagccgcacctgcgaggag

SEQ ID NO: 330258 - DNA, 20 bp, human
ggccggaggcgggtgatctc

SEQ ID NO: 330259 - DNA, 20 bp, human
gtctgcgattggtggagcca

SEQ ID NO: 330260 - DNA, 20 bp, human
gagcggaagccgctatctgg

SEQ ID NO: 330261 - DNA, 20 bp, human
gggagccacggcccgggcga

SEQ ID NO: 330262 - DNA, 20 bp, human
gtcccctgcccgcgcagcct

SEQ ID NO: 330263 - DNA, 20 bp, human
gggcgggcgaagtctgcgat

SEQ ID NO: 330264 - DNA, 20 bp, human
gattggtggagccacggccc

SEQ ID NO: 330265 - DNA, 20 bp, human
ggagagggccgagggacgag

SEQ ID NO: 330266 - DNA, 20 bp, human
gcgcagcctcagccttccta

SEQ ID NO: 330267 - DNA, 20 bp, human
gcgccccagcgggcataaag

SEQ ID NO: 330268 - DNA, 20 bp, human
ggaggtcagccctacgccca

SEQ ID NO: 330269 - DNA, 20 bp, human
gggcctgaaccacaatctcg

SEQ ID NO: 330270 - DNA, 20 bp, human
gtgggcacagagccagacgc

SEQ ID NO: 330271 - DNA, 20 bp, human
gtcagccttcctagggtgag

SEQ ID NO: 330272 - DNA, 20 bp, human
gctccccactcaccctagga

SEQ ID NO: 330273 - DNA, 20 bp, human
ggaacgaattcgaagaaaac

SEQ ID NO: 330274 - DNA, 20 bp, human
gcatgaggtgggtggggatg

SEQ ID NO: 330275 - DNA, 20 bp, human
gtggcccagttccctgaaga

SEQ ID NO: 330276 - DNA, 20 bp, human
ggggaggcggccgcgatcct

SEQ ID NO: 330277 - DNA, 20 bp, human
gtccccccgggactgaaggg

SEQ ID NO: 330278 - DNA, 20 bp, human
ggaagggagggaattcctgt

SEQ ID NO: 330279 - DNA, 20 bp, human
gtgcgcctcccccaggatcg

SEQ ID NO: 330280 - DNA, 20 bp, human
gcgcctccccccgggactga

SEQ ID NO: 330281 - DNA, 20 bp, human
gcccgcccgcccgcaaagtc

SEQ ID NO: 330282 - DNA, 20 bp, human
ggtaagccgagtgaccgatg

SEQ ID NO: 330283 - DNA, 20 bp, human
gggcccgtgcgtccttggcc

SEQ ID NO: 330284 - DNA, 20 bp, human
gccgcaaagtccgggttgtg

SEQ ID NO: 330285 - DNA, 20 bp, human
gtccctcccttcagtcccgg

SEQ ID NO: 330286 - DNA, 20 bp, human
ggtccctagcagatgagagc

SEQ ID NO: 330287 - DNA, 20 bp, human
gtgcgccaggcgtgccgctc

SEQ ID NO: 330288 - DNA, 20 bp, human
gcgcgcgggactgaagagga

SEQ ID NO: 330289 - DNA, 20 bp, human
gaatcctgaggcaaggggcg

SEQ ID NO: 330290 - DNA, 20 bp, human
ggcctctggaaagagattct

SEQ ID NO: 330291 - DNA, 20 bp, human
ggacacagcccgtgctcttt

SEQ ID NO: 330292 - DNA, 20 bp, human
gcacccccgccccttgcctc

SEQ ID NO: 330293 - DNA, 20 bp, human
gtcggagctcggcctctccc

SEQ ID NO: 330294 - DNA, 20 bp, human
gaaggcagcaggggtcgcgc

SEQ ID NO: 330295 - DNA, 20 bp, human
ggatccccacaccgcggctt

SEQ ID NO: 330296 - DNA, 20 bp, human
gcgctgagggccccgcgcgg

SEQ ID NO: 330297 - DNA, 20 bp, human
ggtggaccattagcagacgc

SEQ ID NO: 330298 - DNA, 20 bp, human
gcggctgcgtctctataaca

SEQ ID NO: 330299 - DNA, 20 bp, human
gcaaacagaagtaaacagag

SEQ ID NO: 330300 - DNA, 20 bp, human
gcgcgcccggcgtctgctaa

SEQ ID NO: 330301 - DNA, 20 bp, human
gaactgagtcttaaaggcac

SEQ ID NO: 330302 - DNA, 20 bp, human
gtctctgtggagtctttgag

SEQ ID NO: 330303 - DNA, 20 bp, human
gttttgaactgagtcaccta

SEQ ID NO: 330304 - DNA, 20 bp, human
gaaaggcacaggtttgctcg

SEQ ID NO: 330305 - DNA, 20 bp, human
ggcgggacgcccgcccgaag

SEQ ID NO: 330306 - DNA, 20 bp, human
ggtgggaggtccagccgtag

SEQ ID NO: 330307 - DNA, 20 bp, human
gagccccgccccacccccta

SEQ ID NO: 330308 - DNA, 20 bp, human
ggcgttgtagaatggggaca

SEQ ID NO: 330309 - DNA, 20 bp, human
gtctagccccgccgtctcgt

SEQ ID NO: 330310 - DNA, 20 bp, human
gtccggggaggcggccacca

SEQ ID NO: 330311 - DNA, 20 bp, human
ggggcccggcaccgcacagc

SEQ ID NO: 330312 - DNA, 20 bp, human
gccgcgcggagccgacgaga

SEQ ID NO: 330313 - DNA, 20 bp, human
gcgggcgcggctgcggtggg

SEQ ID NO: 330314 - DNA, 20 bp, human
ggcgcggcgcgttacggccg

SEQ ID NO: 330315 - DNA, 20 bp, human
gaggtccagccgtagggggt

SEQ ID NO: 330316 - DNA, 20 bp, human
gaagtcccgcaggtccttga

SEQ ID NO: 330317 - DNA, 20 bp, human
ggatccgtaaagctcggagg

SEQ ID NO: 330318 - DNA, 20 bp, human
gacctgcgggacttctaacg

SEQ ID NO: 330319 - DNA, 20 bp, human
gtgaaagctgattggacagg

SEQ ID NO: 330320 - DNA, 20 bp, human
gcccagagcgggagatgaat

SEQ ID NO: 330321 - DNA, 20 bp, human
gccctgcgtcagcgagtggg

SEQ ID NO: 330322 - DNA, 20 bp, human
gcatctcccgctctgggaac

SEQ ID NO: 330323 - DNA, 20 bp, human
gagcggaggccaaggaatct

SEQ ID NO: 330324 - DNA, 20 bp, human
gcgcgcacgcgcacttgtta

SEQ ID NO: 330325 - DNA, 20 bp, human
gcgcacttgttagggagggc

SEQ ID NO: 330326 - DNA, 20 bp, human
ggccgcgcgcgctcccgata

SEQ ID NO: 330327 - DNA, 20 bp, human
ggcggcccgcggcactgcac

SEQ ID NO: 330328 - DNA, 20 bp, human
gaccagccggagccgagcga

SEQ ID NO: 330329 - DNA, 20 bp, human
ggcgcgctcccgatagggaa

SEQ ID NO: 330330 - DNA, 20 bp, human
gaagggccggagctgcgcag

SEQ ID NO: 330331 - DNA, 20 bp, human
gagccgagcgagggcgaagc

SEQ ID NO: 330332 - DNA, 20 bp, human
ggcggggtccacttcctcgt

SEQ ID NO: 330333 - DNA, 20 bp, human
ggctcccgatagggaagggc

SEQ ID NO: 330334 - DNA, 20 bp, human
gcgcccgcttcgccctcgct

SEQ ID NO: 330335 - DNA, 20 bp, human
gagctccggcccttccctat

SEQ ID NO: 330336 - DNA, 20 bp, human
gaggcagccggcagccaatg

SEQ ID NO: 330337 - DNA, 20 bp, human
ggcggggcggagtggtgcat

SEQ ID NO: 330338 - DNA, 20 bp, human
gcgggagggcgcctaccctg

SEQ ID NO: 330339 - DNA, 20 bp, human
gcggccgcgcgctctccagc

SEQ ID NO: 330340 - DNA, 20 bp, human
gggccttcgcgcgtgcggga

SEQ ID NO: 330341 - DNA, 20 bp, human
ggagagccgggtcacgagga

SEQ ID NO: 330342 - DNA, 20 bp, human
gccgcacgcgcgaaggcctg

SEQ ID NO: 330343 - DNA, 20 bp, human
ggcgcggcgccccgccccat

SEQ ID NO: 330344 - DNA, 20 bp, human
gtggagagcgcgcggccgca

SEQ ID NO: 330345 - DNA, 20 bp, human
gggctggcgagcctcggcta

SEQ ID NO: 330346 - DNA, 20 bp, human
gagagaaagagatcgaagag

SEQ ID NO: 330347 - DNA, 20 bp, human
gaaggcagggattggagtaa

SEQ ID NO: 330348 - DNA, 20 bp, human
gagactaaatatggagggaa

SEQ ID NO: 330349 - DNA, 20 bp, human
gtaaataacgatggaagtat

SEQ ID NO: 330350 - DNA, 20 bp, human
gtgactaaaacctcaggaag

SEQ ID NO: 330351 - DNA, 20 bp, human
gaagagatcgaagagaggct

SEQ ID NO: 330352 - DNA, 20 bp, human
gatagatagactaaatatgg

SEQ ID NO: 330353 - DNA, 20 bp, human
gagtactttcagcctccgtc

SEQ ID NO: 330354 - DNA, 20 bp, human
gagcactgtgcacctgacgg

SEQ ID NO: 330355 - DNA, 20 bp, human
gcagacacaaacggatttat

SEQ ID NO: 330356 - DNA, 20 bp, human
gtaaccaggggactttgata

SEQ ID NO: 330357 - DNA, 20 bp, human
gaatggaaatagtactactc

SEQ ID NO: 330358 - DNA, 20 bp, human
gcaccgctgtgtattttttt

SEQ ID NO: 330359 - DNA, 20 bp, human
ggccaggcaataaaagagtc

SEQ ID NO: 330360 - DNA, 20 bp, human
gccctgcagtatctctaacc

SEQ ID NO: 330361 - DNA, 20 bp, human
gatgcaaggcactgcggtac

SEQ ID NO: 330362 - DNA, 20 bp, human
ggcggtaccggctgctgtga

SEQ ID NO: 330363 - DNA, 20 bp, human
gaattgacaagtactcattg

SEQ ID NO: 330364 - DNA, 20 bp, human
ggtgccctggaagctatttt

SEQ ID NO: 330365 - DNA, 20 bp, human
ggggtgcaagatgatagaga

SEQ ID NO: 330366 - DNA, 20 bp, human
gacaagaatgggggtttaga

SEQ ID NO: 330367 - DNA, 20 bp, human
gagaatgggggtttagatgg

SEQ ID NO: 330368 - DNA, 20 bp, human
gtgctggattgagaggagtt

SEQ ID NO: 330369 - DNA, 20 bp, human
gagtgtcttagacaagaatg

SEQ ID NO: 330370 - DNA, 20 bp, human
gcaggccattgtagtcacca

SEQ ID NO: 330371 - DNA, 20 bp, human
gaagggattctgggtgtact

SEQ ID NO: 330372 - DNA, 20 bp, human
ggggtagtggtaagataaac

SEQ ID NO: 330373 - DNA, 20 bp, human
gtcctctcaatccagcaaaa

SEQ ID NO: 330374 - DNA, 20 bp, human
gatagtcaaaagtagactct

SEQ ID NO: 330375 - DNA, 20 bp, human
gaaaagacttcaagggattc

SEQ ID NO: 330376 - DNA, 20 bp, human
gaagccctgccaccagtagt

SEQ ID NO: 330377 - DNA, 20 bp, human
ggctgggctgacaacttgga

SEQ ID NO: 330378 - DNA, 20 bp, human
gtgcacccaatgtgcagcct

SEQ ID NO: 330379 - DNA, 20 bp, human
gcctctgtgcccactactgg

SEQ ID NO: 330380 - DNA, 20 bp, human
gcagcccagcgtgtgtgtat

SEQ ID NO: 330381 - DNA, 20 bp, human
gagtgggcatgagcataggt

SEQ ID NO: 330382 - DNA, 20 bp, human
gtctctgtgggcagcatcgg

SEQ ID NO: 330383 - DNA, 20 bp, human
gcataggtagggtggatgtg

SEQ ID NO: 330384 - DNA, 20 bp, human
ggggcacactacaagaagaa

SEQ ID NO: 330385 - DNA, 20 bp, human
ggtagtgggcacagaggagt

SEQ ID NO: 330386 - DNA, 20 bp, human
gcagaggctaggctatggac

SEQ ID NO: 330387 - DNA, 20 bp, human
ggcctagcctctgcttttct

SEQ ID NO: 330388 - DNA, 20 bp, human
gtggggcatggtgagaacat

SEQ ID NO: 330389 - DNA, 20 bp, human
gactcagccctaaattgtct

SEQ ID NO: 330390 - DNA, 20 bp, human
gtgcttccctagacaattta

SEQ ID NO: 330391 - DNA, 20 bp, human
ggcttccaggacccaggtaa

SEQ ID NO: 330392 - DNA, 20 bp, human
gtactcctgtcactctagtt

SEQ ID NO: 330393 - DNA, 20 bp, human
gtggacaggcgcctaaatta

SEQ ID NO: 330394 - DNA, 20 bp, human
gatctgaatccagcctcccc

SEQ ID NO: 330395 - DNA, 20 bp, human
gtccctgagtggcatgtccc

SEQ ID NO: 330396 - DNA, 20 bp, human
ggctgtcttgagaaggtaaa

SEQ ID NO: 330397 - DNA, 20 bp, human
ggaaggtaaaaggttgatat

SEQ ID NO: 330398 - DNA, 20 bp, human
gacccacacctgcacatcat

SEQ ID NO: 330399 - DNA, 20 bp, human
gggtgtgggtgtaactaata

SEQ ID NO: 330400 - DNA, 20 bp, human
gaatgagagactcagccaaa

SEQ ID NO: 330401 - DNA, 20 bp, human
gaaaaaggcctatgatgtgc

SEQ ID NO: 330402 - DNA, 20 bp, human
gtaatgctgctgtcttgaga

SEQ ID NO: 330403 - DNA, 20 bp, human
gagataaccattattcctaa

SEQ ID NO: 330404 - DNA, 20 bp, human
gggcctatgatgtgcaggtg

SEQ ID NO: 330405 - DNA, 20 bp, human
gtttaacttgacatgttcat

SEQ ID NO: 330406 - DNA, 20 bp, human
gaatctgagtgaaatcagtg

SEQ ID NO: 330407 - DNA, 20 bp, human
gcaatagctcatataccctg

SEQ ID NO: 330408 - DNA, 20 bp, human
gcccaactattcaaactatc

SEQ ID NO: 330409 - DNA, 20 bp, human
gcaaatacatttgtattaga

SEQ ID NO: 330410 - DNA, 20 bp, human
ggccagatagtttgaatagt

SEQ ID NO: 330411 - DNA, 20 bp, human
gatacacatttatcttccac

SEQ ID NO: 330412 - DNA, 20 bp, human
gatgacttagtcttttcatt

SEQ ID NO: 330413 - DNA, 20 bp, human
gatagtccttaaatctacta

SEQ ID NO: 330414 - DNA, 20 bp, human
ggtagatcatgtttgctatt

SEQ ID NO: 330415 - DNA, 20 bp, human
gattatccttagtagattta

SEQ ID NO: 330416 - DNA, 20 bp, human
gggacagggtggtaccttga

SEQ ID NO: 330417 - DNA, 20 bp, human
gtcgggaggtgacaggagag

SEQ ID NO: 330418 - DNA, 20 bp, human
gcagggtggtaccttgacgg

SEQ ID NO: 330419 - DNA, 20 bp, human
ggccccttcgtcctccgtca

SEQ ID NO: 330420 - DNA, 20 bp, human
gatcccaggtcagcagggtg

SEQ ID NO: 330421 - DNA, 20 bp, human
gtctcccggagccagcccga

SEQ ID NO: 330422 - DNA, 20 bp, human
gtgggcgggcgtcggctcag

SEQ ID NO: 330423 - DNA, 20 bp, human
gcgtagaatcccaggtcagc

SEQ ID NO: 330424 - DNA, 20 bp, human
gttccggggcgcccggacag

SEQ ID NO: 330425 - DNA, 20 bp, human
gcgggcgccccggaaacgct

SEQ ID NO: 330426 - DNA, 20 bp, human
gcgcaccggggtgacggagt

SEQ ID NO: 330427 - DNA, 20 bp, human
gacagggtgatttacagctg

SEQ ID NO: 330428 - DNA, 20 bp, human
gagtggggtcgcctctcaaa

SEQ ID NO: 330429 - DNA, 20 bp, human
gagcccgctggagccagata

SEQ ID NO: 330430 - DNA, 20 bp, human
gcccgagcctggccgcaccg

SEQ ID NO: 330431 - DNA, 20 bp, human
gaatttagggaagagcccgc

SEQ ID NO: 330432 - DNA, 20 bp, human
gcctggccgcaccggggtga

SEQ ID NO: 330433 - DNA, 20 bp, human
gccgcactgcggcacctaga

SEQ ID NO: 330434 - DNA, 20 bp, human
ggaaagatggatcatgtgag

SEQ ID NO: 330435 - DNA, 20 bp, human
gcgcgctccgttggactccg

SEQ ID NO: 330436 - DNA, 20 bp, human
gaggcagctggacaagcggg

SEQ ID NO: 330437 - DNA, 20 bp, human
gcggctgcgcagtcccgctg

SEQ ID NO: 330438 - DNA, 20 bp, human
gcgcagcccgccctcggatg

SEQ ID NO: 330439 - DNA, 20 bp, human
gtgtccagctgcctcgcaat

SEQ ID NO: 330440 - DNA, 20 bp, human
gagcccgccctcggatgggg

SEQ ID NO: 330441 - DNA, 20 bp, human
gtcgttaattaccctcccgg

SEQ ID NO: 330442 - DNA, 20 bp, human
gccctctccaccccatccga

SEQ ID NO: 330443 - DNA, 20 bp, human
gtgggtccgagcccccggga

SEQ ID NO: 330444 - DNA, 20 bp, human
gccgagggcgggctgcgagt

SEQ ID NO: 330445 - DNA, 20 bp, human
gcctctgggtccgagccccc

SEQ ID NO: 330446 - DNA, 20 bp, human
gcagcctgttatgaaaacgg

SEQ ID NO: 330447 - DNA, 20 bp, human
ggagcagcctgttatgaaaa

SEQ ID NO: 330448 - DNA, 20 bp, human
gaaagcggctttaacaatag

SEQ ID NO: 330449 - DNA, 20 bp, human
gacccctccgttttcataac

SEQ ID NO: 330450 - DNA, 20 bp, human
gacaggctgctcggcttcag

SEQ ID NO: 330451 - DNA, 20 bp, human
ggttaaagccgctttagcag

SEQ ID NO: 330452 - DNA, 20 bp, human
gatgaaaacggaggggtggt

SEQ ID NO: 330453 - DNA, 20 bp, human
gataccctggccaattagaa

SEQ ID NO: 330454 - DNA, 20 bp, human
gtaagctgaaggaaaattag

SEQ ID NO: 330455 - DNA, 20 bp, human
gcacagagtttgactctgtt

SEQ ID NO: 330456 - DNA, 20 bp, human
gagcccacagtcctccggtg

SEQ ID NO: 330457 - DNA, 20 bp, human
gacaggagcccacagtcctc

SEQ ID NO: 330458 - DNA, 20 bp, human
gctacgtccaataccggggc

SEQ ID NO: 330459 - DNA, 20 bp, human
gtccttgcggagagtaaact

SEQ ID NO: 330460 - DNA, 20 bp, human
ggatcctacgtccaataccg

SEQ ID NO: 330461 - DNA, 20 bp, human
gcatccccaccggaggactg

SEQ ID NO: 330462 - DNA, 20 bp, human
gtatagaagggctgcagatg

SEQ ID NO: 330463 - DNA, 20 bp, human
gaggcaggtcccgctgacgg

SEQ ID NO: 330464 - DNA, 20 bp, human
gcaagagtcctctttataga

SEQ ID NO: 330465 - DNA, 20 bp, human
ggaccccacactttctgctg

SEQ ID NO: 330466 - DNA, 20 bp, human
ggcgaggggaccaatcagga

SEQ ID NO: 330467 - DNA, 20 bp, human
gtgcgcccgcctgaaggagg

SEQ ID NO: 330468 - DNA, 20 bp, human
gggagcctggagaaaatcgc

SEQ ID NO: 330469 - DNA, 20 bp, human
gccagcccagggcgcgacga

SEQ ID NO: 330470 - DNA, 20 bp, human
ggcagcgccggccaagggga

SEQ ID NO: 330471 - DNA, 20 bp, human
ggctgctttagctcctgctc

SEQ ID NO: 330472 - DNA, 20 bp, human
gggcggagtgggggactctc

SEQ ID NO: 330473 - DNA, 20 bp, human
ggcctgcgcccgcctgaagg

SEQ ID NO: 330474 - DNA, 20 bp, human
gcgggcgcaggcgagcgggc

SEQ ID NO: 330475 - DNA, 20 bp, human
ggctggcgggccaatatgag

SEQ ID NO: 330476 - DNA, 20 bp, human
gtaaggggatcccgttgcta

SEQ ID NO: 330477 - DNA, 20 bp, human
ggcgtgccagcacctgccac

SEQ ID NO: 330478 - DNA, 20 bp, human
gggcctctcctacaggtctc

SEQ ID NO: 330479 - DNA, 20 bp, human
ggtgcggcgctgtttaaaga

SEQ ID NO: 330480 - DNA, 20 bp, human
gccaaggcggggcaacgagg

SEQ ID NO: 330481 - DNA, 20 bp, human
gtccgtggggccacgatgtg

SEQ ID NO: 330482 - DNA, 20 bp, human
gggagccaaaccaatgtgtg

SEQ ID NO: 330483 - DNA, 20 bp, human
gaaaccaatgtgtggggtgg

SEQ ID NO: 330484 - DNA, 20 bp, human
gatccccttaggcgttgtca

SEQ ID NO: 330485 - DNA, 20 bp, human
gcaccaccgggaactttggg

SEQ ID NO: 330486 - DNA, 20 bp, human
ggccctgcgattgacgtctc

SEQ ID NO: 330487 - DNA, 20 bp, human
ggcgggacgtcatagaaagt

SEQ ID NO: 330488 - DNA, 20 bp, human
gcaaatggaccctaacgcat

SEQ ID NO: 330489 - DNA, 20 bp, human
gggacgtcatagaaagtggg

SEQ ID NO: 330490 - DNA, 20 bp, human
ggccttcagcctatgcgtta

SEQ ID NO: 330491 - DNA, 20 bp, human
gcaggcgggcaatcagaagc

SEQ ID NO: 330492 - DNA, 20 bp, human
ggcgttagggtccatttgat

SEQ ID NO: 330493 - DNA, 20 bp, human
ggcagggcgtgtgtcttgct

SEQ ID NO: 330494 - DNA, 20 bp, human
gcgcctgagacgtcaatcgc

SEQ ID NO: 330495 - DNA, 20 bp, human
ggcaatcagaagccgggacg

SEQ ID NO: 330496 - DNA, 20 bp, human
gccgcgtcacgtggactcac

SEQ ID NO: 330497 - DNA, 20 bp, human
gcgagcaggcgcgactgaat

SEQ ID NO: 330498 - DNA, 20 bp, human
gggcctgaggtaaacaaccg

SEQ ID NO: 330499 - DNA, 20 bp, human
ggggacgcgctccaacgggg

SEQ ID NO: 330500 - DNA, 20 bp, human
gcggcgggacgcgctccaac

SEQ ID NO: 330501 - DNA, 20 bp, human
ggccacgcccgtgacgtcgg

SEQ ID NO: 330502 - DNA, 20 bp, human
gaggaagccgcccgccccgt

SEQ ID NO: 330503 - DNA, 20 bp, human
ggggccgagcgcaccggcag

SEQ ID NO: 330504 - DNA, 20 bp, human
gagggccacgcccgtgacgt

SEQ ID NO: 330505 - DNA, 20 bp, human
gcgcggctgctgactcgcgg

SEQ ID NO: 330506 - DNA, 20 bp, human
gtggcaggagcgaccggaga

SEQ ID NO: 330507 - DNA, 20 bp, human
ggagccccgcaaaagaggcg

SEQ ID NO: 330508 - DNA, 20 bp, human
gggatggtactcaacgtgag

SEQ ID NO: 330509 - DNA, 20 bp, human
ggacgccatagagagctgga

SEQ ID NO: 330510 - DNA, 20 bp, human
gagcagacgccatagagagc

SEQ ID NO: 330511 - DNA, 20 bp, human
gagtaccatccaccactaga

SEQ ID NO: 330512 - DNA, 20 bp, human
ggtgcccctccagctctcta

SEQ ID NO: 330513 - DNA, 20 bp, human
gggtactcaacgtgagtggc

SEQ ID NO: 330514 - DNA, 20 bp, human
gcagcggcaaaagttaggac

SEQ ID NO: 330515 - DNA, 20 bp, human
gggaatagaacaaaccaaga

SEQ ID NO: 330516 - DNA, 20 bp, human
gcgccagtgcagcgcgaagc

SEQ ID NO: 330517 - DNA, 20 bp, human
gggctccgccggccgatgtg

SEQ ID NO: 330518 - DNA, 20 bp, human
gcgtccgcgagcaggccgag

SEQ ID NO: 330519 - DNA, 20 bp, human
ggcgctggccggcctacccg

SEQ ID NO: 330520 - DNA, 20 bp, human
ggcggcgcgcccgcgctgta

SEQ ID NO: 330521 - DNA, 20 bp, human
ggagcccctcggcctgctcg

SEQ ID NO: 330522 - DNA, 20 bp, human
ggggacggcccggcgggtct

SEQ ID NO: 330523 - DNA, 20 bp, human
gcgcgcaggtcgccccacat

SEQ ID NO: 330524 - DNA, 20 bp, human
gccggcgcgcgcgattcccg

SEQ ID NO: 330525 - DNA, 20 bp, human
ggcgcagcggcagggttggc

SEQ ID NO: 330526 - DNA, 20 bp, human
gacgcccacgggccaatcac

SEQ ID NO: 330527 - DNA, 20 bp, human
gtcccacgcagctgctcaat

SEQ ID NO: 330528 - DNA, 20 bp, human
ggtagtgcaagaacctgcga

SEQ ID NO: 330529 - DNA, 20 bp, human
gtgagacggagggcaccgga

SEQ ID NO: 330530 - DNA, 20 bp, human
gtacttccgagtaaggggcg

SEQ ID NO: 330531 - DNA, 20 bp, human
gacggaactgacggggagaa

SEQ ID NO: 330532 - DNA, 20 bp, human
ggggagagaacccggatgag

SEQ ID NO: 330533 - DNA, 20 bp, human
ggtagtgcgcgaggcacgac

SEQ ID NO: 330534 - DNA, 20 bp, human
gaaggggcggggctgtgccc

SEQ ID NO: 330535 - DNA, 20 bp, human
gggacctcgacgacgcccac

SEQ ID NO: 330536 - DNA, 20 bp, human
gccgccaaaaacctttgctg

SEQ ID NO: 330537 - DNA, 20 bp, human
gctagagcggcggttagagc

SEQ ID NO: 330538 - DNA, 20 bp, human
gcagagaagaatgcgaatgg

SEQ ID NO: 330539 - DNA, 20 bp, human
gagtggcctagcacttgcgg

SEQ ID NO: 330540 - DNA, 20 bp, human
gccacgcccccgcaagtgct

SEQ ID NO: 330541 - DNA, 20 bp, human
gaagtgctaggccacttgct

SEQ ID NO: 330542 - DNA, 20 bp, human
gcaactgccacacacattgc

SEQ ID NO: 330543 - DNA, 20 bp, human
gatggagacacagtgaccaa

SEQ ID NO: 330544 - DNA, 20 bp, human
gaaatgcccagtgctaggat

SEQ ID NO: 330545 - DNA, 20 bp, human
gcccgcaaatgcccagtgct

SEQ ID NO: 330546 - DNA, 20 bp, human
gccgccccgcccatcacggc

SEQ ID NO: 330547 - DNA, 20 bp, human
gtgaccctgccgtgatgggc

SEQ ID NO: 330548 - DNA, 20 bp, human
gcaaagacgagaaacttaaa

SEQ ID NO: 330549 - DNA, 20 bp, human
gaccgtgaccctgccgtgat

SEQ ID NO: 330550 - DNA, 20 bp, human
gcccggggctccattggcta

SEQ ID NO: 330551 - DNA, 20 bp, human
gccaatggagccccgggtga

SEQ ID NO: 330552 - DNA, 20 bp, human
gagcctagcgcgtagcttta

SEQ ID NO: 330553 - DNA, 20 bp, human
gggaggaaccagactgcgag

SEQ ID NO: 330554 - DNA, 20 bp, human
gggcgctctagccaattccg

SEQ ID NO: 330555 - DNA, 20 bp, human
gcagactgcgagcggagaag

SEQ ID NO: 330556 - DNA, 20 bp, human
gaatgtaagttcaggagtgc

SEQ ID NO: 330557 - DNA, 20 bp, human
ggggagggaacacaaacatt

SEQ ID NO: 330558 - DNA, 20 bp, human
gtacatgccatgtgagagaa

SEQ ID NO: 330559 - DNA, 20 bp, human
gtctcacatggcatgtacac

SEQ ID NO: 330560 - DNA, 20 bp, human
ggtattccacacagtactaa

SEQ ID NO: 330561 - DNA, 20 bp, human
gtagcagcccagatagacta

SEQ ID NO: 330562 - DNA, 20 bp, human
gcaaaatacaatagcttggg

SEQ ID NO: 330563 - DNA, 20 bp, human
gtgtcaaaatacaatagctt

SEQ ID NO: 330564 - DNA, 20 bp, human
gccacacagtactaaaggct

SEQ ID NO: 330565 - DNA, 20 bp, human
gcccttgccttagtctatct

SEQ ID NO: 330566 - DNA, 20 bp, human
ggggagcggcgctaaaggcg

SEQ ID NO: 330567 - DNA, 20 bp, human
gaaaacacggggtcacgcgc

SEQ ID NO: 330568 - DNA, 20 bp, human
ggcctggggagcggcgctaa

SEQ ID NO: 330569 - DNA, 20 bp, human
gccccaggctgcggccagtt

SEQ ID NO: 330570 - DNA, 20 bp, human
gctaaaggcggggctgcgac

SEQ ID NO: 330571 - DNA, 20 bp, human
ggactcgggtcgggaaaaca

SEQ ID NO: 330572 - DNA, 20 bp, human
gagctttagggactcgggtc

SEQ ID NO: 330573 - DNA, 20 bp, human
gcccgagtccctaaagctcc

SEQ ID NO: 330574 - DNA, 20 bp, human
ggggtggagtagttgtagaa

SEQ ID NO: 330575 - DNA, 20 bp, human
gcgcggggcaagcgccaaac

SEQ ID NO: 330576 - DNA, 20 bp, human
gcccgcgcggggcccccgat

SEQ ID NO: 330577 - DNA, 20 bp, human
gagttagcgcgcgaccgggg

SEQ ID NO: 330578 - DNA, 20 bp, human
ggggctaggccgccaatcgg

SEQ ID NO: 330579 - DNA, 20 bp, human
gcccgcgcgggctgagtgac

SEQ ID NO: 330580 - DNA, 20 bp, human
gggctcgcgcagccattgcc

SEQ ID NO: 330581 - DNA, 20 bp, human
gccggtcgcgcgctaactcc

SEQ ID NO: 330582 - DNA, 20 bp, human
ggcgcagagctaggcgagga

SEQ ID NO: 330583 - DNA, 20 bp, human
gacggggctaggccgccaat

SEQ ID NO: 330584 - DNA, 20 bp, human
gcccctccgcggccaggact

SEQ ID NO: 330585 - DNA, 20 bp, human
ggcgcgctaactccgggact

SEQ ID NO: 330586 - DNA, 20 bp, human
gaaccccagcaataagtgtg

SEQ ID NO: 330587 - DNA, 20 bp, human
gaaaacaggccgctgctgca

SEQ ID NO: 330588 - DNA, 20 bp, human
gttcggagtaaaggaagcag

SEQ ID NO: 330589 - DNA, 20 bp, human
gcaggccgctgctgcacggg

SEQ ID NO: 330590 - DNA, 20 bp, human
gaataaaaacacacaacagg

SEQ ID NO: 330591 - DNA, 20 bp, human
gaacattctggtaatgtcgg

SEQ ID NO: 330592 - DNA, 20 bp, human
gacgagcaggcaacaaatcc

SEQ ID NO: 330593 - DNA, 20 bp, human
gccactatgccgtctcagac

SEQ ID NO: 330594 - DNA, 20 bp, human
gacaattagttcacatgctc

SEQ ID NO: 330595 - DNA, 20 bp, human
gaaaggaaatttcggagtaa

SEQ ID NO: 330596 - DNA, 20 bp, human
gaggcggggcgcacccagag

SEQ ID NO: 330597 - DNA, 20 bp, human
gaacgtcagcaccgccccga

SEQ ID NO: 330598 - DNA, 20 bp, human
gggctccttgacgcgctccc

SEQ ID NO: 330599 - DNA, 20 bp, human
gggaagcacaatgcacgggg

SEQ ID NO: 330600 - DNA, 20 bp, human
gtgcagctgcagggacgaga

SEQ ID NO: 330601 - DNA, 20 bp, human
gaccgcgacgggaaacgcac

SEQ ID NO: 330602 - DNA, 20 bp, human
gaggtcgcagactttggtta

SEQ ID NO: 330603 - DNA, 20 bp, human
ggagcgcgtcaaggagccag

SEQ ID NO: 330604 - DNA, 20 bp, human
ggctgcgcggccattatgcc

SEQ ID NO: 330605 - DNA, 20 bp, human
gcgagcggaagcacaatgca

SEQ ID NO: 330606 - DNA, 20 bp, human
ggcaccgcaggaggggataa

SEQ ID NO: 330607 - DNA, 20 bp, human
gtctctaaggctgggtggcg

SEQ ID NO: 330608 - DNA, 20 bp, human
ggcggggcactgtgacacca

SEQ ID NO: 330609 - DNA, 20 bp, human
gctggcacgaggtggcccaa

SEQ ID NO: 330610 - DNA, 20 bp, human
gaaaactgtggtgaaggcgg

SEQ ID NO: 330611 - DNA, 20 bp, human
ggtgagctgccgccgctctc

SEQ ID NO: 330612 - DNA, 20 bp, human
ggatcaaatgatcgtgaaga

SEQ ID NO: 330613 - DNA, 20 bp, human
gcctgcgaattcccagactg

SEQ ID NO: 330614 - DNA, 20 bp, human
gaggggtgaccagagagcgg

SEQ ID NO: 330615 - DNA, 20 bp, human
ggcaacaagcttcttagaag

SEQ ID NO: 330616 - DNA, 20 bp, human
gttgctagccagatacactc

SEQ ID NO: 330617 - DNA, 20 bp, human
gtctggaggaatcaactaat

SEQ ID NO: 330618 - DNA, 20 bp, human
gggaatcaactaattggtgt

SEQ ID NO: 330619 - DNA, 20 bp, human
gctagccagatacactctgg

SEQ ID NO: 330620 - DNA, 20 bp, human
ggattcctccagagtgtatc

SEQ ID NO: 330621 - DNA, 20 bp, human
gaaagtggtaagctctacaa

SEQ ID NO: 330622 - DNA, 20 bp, human
gggtcgtttgcaaaaaagta

SEQ ID NO: 330623 - DNA, 20 bp, human
gtaattggtgtaggtgtaat

SEQ ID NO: 330624 - DNA, 20 bp, human
ggtgtatctggctagcaaag

SEQ ID NO: 330625 - DNA, 20 bp, human
ggtgtttcgcaaagatcttt

SEQ ID NO: 330626 - DNA, 20 bp, human
gcctggggggagtgtcatct

SEQ ID NO: 330627 - DNA, 20 bp, human
gacactgcctaagggagtgc

SEQ ID NO: 330628 - DNA, 20 bp, human
gtcagacagacactgcctaa

SEQ ID NO: 330629 - DNA, 20 bp, human
gacgaaggtgagttggacat

SEQ ID NO: 330630 - DNA, 20 bp, human
gtgcctgtctcatgagcctg

SEQ ID NO: 330631 - DNA, 20 bp, human
gtggacatgggccatgccac

SEQ ID NO: 330632 - DNA, 20 bp, human
gggagaagagcataagtcca

SEQ ID NO: 330633 - DNA, 20 bp, human
ggatttaatcaattgagggg

SEQ ID NO: 330634 - DNA, 20 bp, human
ggaggactggagcaagcccc

SEQ ID NO: 330635 - DNA, 20 bp, human
gaaggcatcccttaggctgg

SEQ ID NO: 330636 - DNA, 20 bp, human
gagggaggccaggtcgttct

SEQ ID NO: 330637 - DNA, 20 bp, human
gcacagggaagctcctataa

SEQ ID NO: 330638 - DNA, 20 bp, human
gtgtcccagcgctatccaca

SEQ ID NO: 330639 - DNA, 20 bp, human
ggcactgaataccaggaaga

SEQ ID NO: 330640 - DNA, 20 bp, human
gcccccatattcagtccctg

SEQ ID NO: 330641 - DNA, 20 bp, human
gctggtattcagtgccaacc

SEQ ID NO: 330642 - DNA, 20 bp, human
ggctgttgctttgttggaga

SEQ ID NO: 330643 - DNA, 20 bp, human
gaccacagggactgaatatg

SEQ ID NO: 330644 - DNA, 20 bp, human
ggcttccctgtggatagcgc

SEQ ID NO: 330645 - DNA, 20 bp, human
gcctggtgctgttgctttgt

SEQ ID NO: 330646 - DNA, 20 bp, human
ggaggccacctcacccgcag

SEQ ID NO: 330647 - DNA, 20 bp, human
gcgacaggtaacaaataggt

SEQ ID NO: 330648 - DNA, 20 bp, human
gggttcgacaggtaacaaat

SEQ ID NO: 330649 - DNA, 20 bp, human
gcgcatgcgttgggaaataa

SEQ ID NO: 330650 - DNA, 20 bp, human
gtggctaggaggtcccgcgg

SEQ ID NO: 330651 - DNA, 20 bp, human
gcacctcacccgcagcggaa

SEQ ID NO: 330652 - DNA, 20 bp, human
gggggtggcccggggagcga

SEQ ID NO: 330653 - DNA, 20 bp, human
gaattagcttggggtggccc

SEQ ID NO: 330654 - DNA, 20 bp, human
gttccattccgctgcgggtg

SEQ ID NO: 330655 - DNA, 20 bp, human
gcccgcagcggaatggaaac

SEQ ID NO: 330656 - DNA, 20 bp, human
gaggccccaactcaccggag

SEQ ID NO: 330657 - DNA, 20 bp, human
gggggaggggggcaactcgt

SEQ ID NO: 330658 - DNA, 20 bp, human
gctcaccggaggggtgccct

SEQ ID NO: 330659 - DNA, 20 bp, human
gccgccggaaccggtcggac

SEQ ID NO: 330660 - DNA, 20 bp, human
gggcacccctccggtgagtt

SEQ ID NO: 330661 - DNA, 20 bp, human
ggcctcgaggtgcaggtgat

SEQ ID NO: 330662 - DNA, 20 bp, human
gaggcggcgggagacttcca

SEQ ID NO: 330663 - DNA, 20 bp, human
gcgaagacaaatccaccggg

SEQ ID NO: 330664 - DNA, 20 bp, human
gcatgcgccctgcaacataa

SEQ ID NO: 330665 - DNA, 20 bp, human
gtcgtcgaagacaaatccac

SEQ ID NO: 330666 - DNA, 20 bp, human
gagaagatgggcaggtcccc

SEQ ID NO: 330667 - DNA, 20 bp, human
gggaaccatccagcctccag

SEQ ID NO: 330668 - DNA, 20 bp, human
gccctgggagtggactaagc

SEQ ID NO: 330669 - DNA, 20 bp, human
gctggggagcttttgaggat

SEQ ID NO: 330670 - DNA, 20 bp, human
gagtgcttgtccacccctgg

SEQ ID NO: 330671 - DNA, 20 bp, human
gtgactatccctggtgggaa

SEQ ID NO: 330672 - DNA, 20 bp, human
ggctcaggttacccctgcct

SEQ ID NO: 330673 - DNA, 20 bp, human
ggagtggactaagctggctc

SEQ ID NO: 330674 - DNA, 20 bp, human
ggccccaggatgactatccc

SEQ ID NO: 330675 - DNA, 20 bp, human
gccaccagggatagtcatcc

SEQ ID NO: 330676 - DNA, 20 bp, human
gcgagaggaagcacttttgg

SEQ ID NO: 330677 - DNA, 20 bp, human
gaggaagcacttttggaggc

SEQ ID NO: 330678 - DNA, 20 bp, human
gtgatctgcggctacaattc

SEQ ID NO: 330679 - DNA, 20 bp, human
gtggcgatgggactaatgtg

SEQ ID NO: 330680 - DNA, 20 bp, human
gaggacaatcgcgacattag

SEQ ID NO: 330681 - DNA, 20 bp, human
gacagtccgggcgtcgggta

SEQ ID NO: 330682 - DNA, 20 bp, human
gggactaatgtgcggacgcc

SEQ ID NO: 330683 - DNA, 20 bp, human
gtggcggccatatttgaagt

SEQ ID NO: 330684 - DNA, 20 bp, human
ggtcgggtaaggatgccccg

SEQ ID NO: 330685 - DNA, 20 bp, human
gggcctggttcactgggtca

SEQ ID NO: 330686 - DNA, 20 bp, human
gaagctaaagggctgacaga

SEQ ID NO: 330687 - DNA, 20 bp, human
gtgggcgtgtgcagctgtgt

SEQ ID NO: 330688 - DNA, 20 bp, human
ggcgccccatcgaagctaaa

SEQ ID NO: 330689 - DNA, 20 bp, human
gtgcagccggggcggatcgc

SEQ ID NO: 330690 - DNA, 20 bp, human
gtctcagcgcctcaggtgtc

SEQ ID NO: 330691 - DNA, 20 bp, human
gcggtggcgtgcggctcgaa

SEQ ID NO: 330692 - DNA, 20 bp, human
gaagttcctctcagcgcctc

SEQ ID NO: 330693 - DNA, 20 bp, human
gacttccccgcgatccgccc

SEQ ID NO: 330694 - DNA, 20 bp, human
ggctgcttttaaaagaagtg

SEQ ID NO: 330695 - DNA, 20 bp, human
ggactcatccacaacctagg

SEQ ID NO: 330696 - DNA, 20 bp, human
gtccccactgtcgcagtgag

SEQ ID NO: 330697 - DNA, 20 bp, human
ggctctgggaggctgtagtg

SEQ ID NO: 330698 - DNA, 20 bp, human
ggaggggtgaacctgagctc

SEQ ID NO: 330699 - DNA, 20 bp, human
ggagcagggacccttcctga

SEQ ID NO: 330700 - DNA, 20 bp, human
gcagggacccttcctgatgg

SEQ ID NO: 330701 - DNA, 20 bp, human
gacccctcactgcgacagtg

SEQ ID NO: 330702 - DNA, 20 bp, human
gaagggtccctgctctgaag

SEQ ID NO: 330703 - DNA, 20 bp, human
gcccttcctgatggaggtga

SEQ ID NO: 330704 - DNA, 20 bp, human
gtccctcacctccatcagga

SEQ ID NO: 330705 - DNA, 20 bp, human
gagtatccctcacctccatc

SEQ ID NO: 330706 - DNA, 20 bp, human
gaacacagggtgtttctcag

SEQ ID NO: 330707 - DNA, 20 bp, human
gactcagtaccccgaggcgg

SEQ ID NO: 330708 - DNA, 20 bp, human
gcctccttccctccgcctcg

SEQ ID NO: 330709 - DNA, 20 bp, human
ggtaccccgaggcggaggga

SEQ ID NO: 330710 - DNA, 20 bp, human
gctcagagacctcatgtggt

SEQ ID NO: 330711 - DNA, 20 bp, human
gtaccagcagcacaaccccc

SEQ ID NO: 330712 - DNA, 20 bp, human
gggcctgcaaacaggaacac

SEQ ID NO: 330713 - DNA, 20 bp, human
gtgggctcagagacctcatg

SEQ ID NO: 330714 - DNA, 20 bp, human
ggggtgaggtgggggctctc

SEQ ID NO: 330715 - DNA, 20 bp, human
gtgagtgatcccaccacatg

SEQ ID NO: 330716 - DNA, 20 bp, human
gcgggatggaggatgtccag

SEQ ID NO: 330717 - DNA, 20 bp, human
gtactgggaagtgggcgagg

SEQ ID NO: 330718 - DNA, 20 bp, human
gccgctgtccctgtgtctac

SEQ ID NO: 330719 - DNA, 20 bp, human
gaggcgggatgctgctggcc

SEQ ID NO: 330720 - DNA, 20 bp, human
gggacagcggcttccactcc

SEQ ID NO: 330721 - DNA, 20 bp, human
ggcactgggctgtaggagag

SEQ ID NO: 330722 - DNA, 20 bp, human
gggaggatgtccagaggtcc

SEQ ID NO: 330723 - DNA, 20 bp, human
gcctgtgtctactgggaagt

SEQ ID NO: 330724 - DNA, 20 bp, human
ggggcaacaaccctcccgcc

SEQ ID NO: 330725 - DNA, 20 bp, human
ggggcgaggcgggatgctgc

SEQ ID NO: 330726 - DNA, 20 bp, human
gaagcggaagtgccgatcgg

SEQ ID NO: 330727 - DNA, 20 bp, human
gcggtggggcggaaccatgc

SEQ ID NO: 330728 - DNA, 20 bp, human
gggggcggaaccatgcagga

SEQ ID NO: 330729 - DNA, 20 bp, human
ggaagtgccgatcggtgggg

SEQ ID NO: 330730 - DNA, 20 bp, human
gcctcccggcgtggagatgg

SEQ ID NO: 330731 - DNA, 20 bp, human
gggagctggtcgcggagcag

SEQ ID NO: 330732 - DNA, 20 bp, human
ggagcctcccggcgtggaga

SEQ ID NO: 330733 - DNA, 20 bp, human
gaggaagcggaagtgccgat

SEQ ID NO: 330734 - DNA, 20 bp, human
gcgcggagcagcggtgtcca

SEQ ID NO: 330735 - DNA, 20 bp, human
gcgccgctccagccagcgtg

SEQ ID NO: 330736 - DNA, 20 bp, human
ggagatggctgaactagggg

SEQ ID NO: 330737 - DNA, 20 bp, human
gaactaggggcggagacact

SEQ ID NO: 330738 - DNA, 20 bp, human
gatggagatggctgaactag

SEQ ID NO: 330739 - DNA, 20 bp, human
ggcgcggccaaatggataac

SEQ ID NO: 330740 - DNA, 20 bp, human
ggtaacgccccagcagtccg

SEQ ID NO: 330741 - DNA, 20 bp, human
ggggcaaggactagcccttc

SEQ ID NO: 330742 - DNA, 20 bp, human
gccaaatggataaccggtag

SEQ ID NO: 330743 - DNA, 20 bp, human
gcaccgctcctcctattggg

SEQ ID NO: 330744 - DNA, 20 bp, human
gtgccgcccaataggaggag

SEQ ID NO: 330745 - DNA, 20 bp, human
ggtcgctgccgcccaatagg

SEQ ID NO: 330746 - DNA, 20 bp, human
gtagtgcgtacacagcacaa

SEQ ID NO: 330747 - DNA, 20 bp, human
ggaactctgtaaacaagcca

SEQ ID NO: 330748 - DNA, 20 bp, human
gtcaaaaatcatctattcaa

SEQ ID NO: 330749 - DNA, 20 bp, human
gggtggcatcctgagaacta

SEQ ID NO: 330750 - DNA, 20 bp, human
ggcactctgggaagagctca

SEQ ID NO: 330751 - DNA, 20 bp, human
gacacagcacaagggacaaa

SEQ ID NO: 330752 - DNA, 20 bp, human
ggaggcccactcttgcttct

SEQ ID NO: 330753 - DNA, 20 bp, human
gttaaaatgtattcacatgg

SEQ ID NO: 330754 - DNA, 20 bp, human
gtcactttgcccagtgctga

SEQ ID NO: 330755 - DNA, 20 bp, human
gcccagtgcacagcacattg

SEQ ID NO: 330756 - DNA, 20 bp, human
gtcccgccaggtcagagcag

SEQ ID NO: 330757 - DNA, 20 bp, human
gtgcccggggacggaccatc

SEQ ID NO: 330758 - DNA, 20 bp, human
gcgggccaggccagctccat

SEQ ID NO: 330759 - DNA, 20 bp, human
ggctccgcgcgcctcacaag

SEQ ID NO: 330760 - DNA, 20 bp, human
gagacctgacccaggggagg

SEQ ID NO: 330761 - DNA, 20 bp, human
gcagaggctaaaaatggccc

SEQ ID NO: 330762 - DNA, 20 bp, human
gcaactccagcagtctcccc

SEQ ID NO: 330763 - DNA, 20 bp, human
gcgcctggcgccaatggagc

SEQ ID NO: 330764 - DNA, 20 bp, human
gcgcctcacaagaggcgggg

SEQ ID NO: 330765 - DNA, 20 bp, human
gccgacgcgtggtttcctga

SEQ ID NO: 330766 - DNA, 20 bp, human
gtcagaccgtgggaggcggc

SEQ ID NO: 330767 - DNA, 20 bp, human
gacctgccaataacgcgatg

SEQ ID NO: 330768 - DNA, 20 bp, human
gagtcactgaggttccgaga

SEQ ID NO: 330769 - DNA, 20 bp, human
gggcggaaagagagtcgaac

SEQ ID NO: 330770 - DNA, 20 bp, human
ggctgaggtcagaccgtggg

SEQ ID NO: 330771 - DNA, 20 bp, human
gttggctgaggtcagaccgt

SEQ ID NO: 330772 - DNA, 20 bp, human
ggattatcggcgagtcactg

SEQ ID NO: 330773 - DNA, 20 bp, human
gtcgaacgggacgcgtgcgt

SEQ ID NO: 330774 - DNA, 20 bp, human
ggctacccagccgcctccca

SEQ ID NO: 330775 - DNA, 20 bp, human
ggcggcttaaagtcaaccgg

SEQ ID NO: 330776 - DNA, 20 bp, human
gccggccgccatctccagtg

SEQ ID NO: 330777 - DNA, 20 bp, human
gggaagaagtgcttaggtag

SEQ ID NO: 330778 - DNA, 20 bp, human
gccgccatctccagtgtggc

SEQ ID NO: 330779 - DNA, 20 bp, human
gtggagatggcggccggagg

SEQ ID NO: 330780 - DNA, 20 bp, human
gcgctggtcacgccccacct

SEQ ID NO: 330781 - DNA, 20 bp, human
gccggaggcgggcccgaggt

SEQ ID NO: 330782 - DNA, 20 bp, human
gcatccagccacactggaga

SEQ ID NO: 330783 - DNA, 20 bp, human
gcggtaacggagctcttgaa

SEQ ID NO: 330784 - DNA, 20 bp, human
ggtaggagttcgcggtgaaa

SEQ ID NO: 330785 - DNA, 20 bp, human
gacgtgcgaaaggctctaca

SEQ ID NO: 330786 - DNA, 20 bp, human
gggaggctggataaagtctt

SEQ ID NO: 330787 - DNA, 20 bp, human
gggtcacagagggtcgccgt

SEQ ID NO: 330788 - DNA, 20 bp, human
gggggtcaaggtcaccgcgt

SEQ ID NO: 330789 - DNA, 20 bp, human
gtggcctgggccactagggt

SEQ ID NO: 330790 - DNA, 20 bp, human
gcctcccagtacctcgagga

SEQ ID NO: 330791 - DNA, 20 bp, human
gcgctgggacccctccaggt

SEQ ID NO: 330792 - DNA, 20 bp, human
gtgcgggtgcgctgggtcca

SEQ ID NO: 330793 - DNA, 20 bp, human
gggtcaggccgagtgcgtac

SEQ ID NO: 330794 - DNA, 20 bp, human
gcccccctcctcgaggtact

SEQ ID NO: 330795 - DNA, 20 bp, human
gcagaaggtgaggtgccttg

SEQ ID NO: 330796 - DNA, 20 bp, human
gaaccagctccgctccggag

SEQ ID NO: 330797 - DNA, 20 bp, human
gccagccgcgcagacccctc

SEQ ID NO: 330798 - DNA, 20 bp, human
gcgcgcagacccctccggag

SEQ ID NO: 330799 - DNA, 20 bp, human
gcgcggacagcgtctggatg

SEQ ID NO: 330800 - DNA, 20 bp, human
ggggcgaaccagctccgctc

SEQ ID NO: 330801 - DNA, 20 bp, human
gtacatcaagctggaggtgt

SEQ ID NO: 330802 - DNA, 20 bp, human
gtgcgcgcgcggacagcgtc

SEQ ID NO: 330803 - DNA, 20 bp, human
ggatgcggcgctgtgcgctg

SEQ ID NO: 330804 - DNA, 20 bp, human
gctatcgcacgggtccgcta

SEQ ID NO: 330805 - DNA, 20 bp, human
gggcctcgcccgccccctag

SEQ ID NO: 330806 - DNA, 20 bp, human
ggcccctcctggctctgcgt

SEQ ID NO: 330807 - DNA, 20 bp, human
gggcccacgcagagccagga

SEQ ID NO: 330808 - DNA, 20 bp, human
gcggggagtcccctaatctg

SEQ ID NO: 330809 - DNA, 20 bp, human
gcccaaagatagatggggcg

SEQ ID NO: 330810 - DNA, 20 bp, human
ggccagagctccatcttgcc

SEQ ID NO: 330811 - DNA, 20 bp, human
gaccacaggccacccgtcac

SEQ ID NO: 330812 - DNA, 20 bp, human
gctgccggggccaccatcag

SEQ ID NO: 330813 - DNA, 20 bp, human
gacctggcaagatggagctc

SEQ ID NO: 330814 - DNA, 20 bp, human
gcccccaaaacctggcaaga

SEQ ID NO: 330815 - DNA, 20 bp, human
gttgttgggcctccggaaac

SEQ ID NO: 330816 - DNA, 20 bp, human
ggtcccgggtgtcccaggtg

SEQ ID NO: 330817 - DNA, 20 bp, human
gcggcggtctcgaagttgga

SEQ ID NO: 330818 - DNA, 20 bp, human
gcccagctcttggtccaggt

SEQ ID NO: 330819 - DNA, 20 bp, human
gctcgcggggacagagccgg

SEQ ID NO: 330820 - DNA, 20 bp, human
ggaaccggcggtctcgaagt

SEQ ID NO: 330821 - DNA, 20 bp, human
ggctcgaggccgcaccccgg

SEQ ID NO: 330822 - DNA, 20 bp, human
ggactcccgggacacctgcg

SEQ ID NO: 330823 - DNA, 20 bp, human
gtgggacacccgggactccc

SEQ ID NO: 330824 - DNA, 20 bp, human
ggtctcgaagttggagggtc

SEQ ID NO: 330825 - DNA, 20 bp, human
gttggagggtcgggattccc

SEQ ID NO: 330826 - DNA, 20 bp, human
gtagctggctggagccctct

SEQ ID NO: 330827 - DNA, 20 bp, human
gcccaggcaatcaggagccc

SEQ ID NO: 330828 - DNA, 20 bp, human
gcaggctattaggtgactgg

SEQ ID NO: 330829 - DNA, 20 bp, human
ggggtggggtctccaatcct

SEQ ID NO: 330830 - DNA, 20 bp, human
gtgtgagcagctggtgagct

SEQ ID NO: 330831 - DNA, 20 bp, human
gggaaattgcaaggggcttt

SEQ ID NO: 330832 - DNA, 20 bp, human
gacatcacaggggagtggag

SEQ ID NO: 330833 - DNA, 20 bp, human
gtagggagagtgtgagcagc

SEQ ID NO: 330834 - DNA, 20 bp, human
ggggacggcgcagaactggg

SEQ ID NO: 330835 - DNA, 20 bp, human
ggagtggagacgaacaaaaa

SEQ ID NO: 330836 - DNA, 20 bp, human
gggaacgatgaccctctagg

SEQ ID NO: 330837 - DNA, 20 bp, human
ggggggcatggaactcgcgg

SEQ ID NO: 330838 - DNA, 20 bp, human
ggggagtggcctcgcccttg

SEQ ID NO: 330839 - DNA, 20 bp, human
gagagggtcatcgttcccga

SEQ ID NO: 330840 - DNA, 20 bp, human
ggcgccgtcatcgcggagga

SEQ ID NO: 330841 - DNA, 20 bp, human
ggagccccgcccagtccgcc

SEQ ID NO: 330842 - DNA, 20 bp, human
gaggaggcagcacgggcggt

SEQ ID NO: 330843 - DNA, 20 bp, human
ggggccctcctccgcgatga

SEQ ID NO: 330844 - DNA, 20 bp, human
gcctcgcccttgaggacgaa

SEQ ID NO: 330845 - DNA, 20 bp, human
gggcatggaactcgcggggg

SEQ ID NO: 330846 - DNA, 20 bp, human
gcagctgaaagcagcgatcg

SEQ ID NO: 330847 - DNA, 20 bp, human
gctgaaagcagcgatcgcgg

SEQ ID NO: 330848 - DNA, 20 bp, human
ggcaggggtgtcactgtgtc

SEQ ID NO: 330849 - DNA, 20 bp, human
gttcagctgggcaacagcac

SEQ ID NO: 330850 - DNA, 20 bp, human
ggcggtcctgcgcatccggg

SEQ ID NO: 330851 - DNA, 20 bp, human
gtggctggggagtaggttgc

SEQ ID NO: 330852 - DNA, 20 bp, human
gactccccagccaccggtct

SEQ ID NO: 330853 - DNA, 20 bp, human
gagcagcgatcgcggaggag

SEQ ID NO: 330854 - DNA, 20 bp, human
ggacgcggttgagaaagcct

SEQ ID NO: 330855 - DNA, 20 bp, human
ggtctgggagcgcagccccc

SEQ ID NO: 330856 - DNA, 20 bp, human
ggggtgttgaggaaagcttc

SEQ ID NO: 330857 - DNA, 20 bp, human
gttatcagtgctgtgagagg

SEQ ID NO: 330858 - DNA, 20 bp, human
gatgctggaaccccctagga

SEQ ID NO: 330859 - DNA, 20 bp, human
ggatggaggttcctggtgca

SEQ ID NO: 330860 - DNA, 20 bp, human
gcagcccagtgcatagcccg

SEQ ID NO: 330861 - DNA, 20 bp, human
gggaaccccctaggaaggca

SEQ ID NO: 330862 - DNA, 20 bp, human
gcgaacttcagaaatctgca

SEQ ID NO: 330863 - DNA, 20 bp, human
gtctgcaagggtcagcttag

SEQ ID NO: 330864 - DNA, 20 bp, human
gcgcgccacgggctatgcac

SEQ ID NO: 330865 - DNA, 20 bp, human
gcagctgggattaggggttg

SEQ ID NO: 330866 - DNA, 20 bp, human
gaagaagcgccaagtcctac

SEQ ID NO: 330867 - DNA, 20 bp, human
gccaactctgcagtcattgg

SEQ ID NO: 330868 - DNA, 20 bp, human
gcaagtcctacgggcctggc

SEQ ID NO: 330869 - DNA, 20 bp, human
gatctgccagccaggcccgt

SEQ ID NO: 330870 - DNA, 20 bp, human
ggcgccaagtcctacgggcc

SEQ ID NO: 330871 - DNA, 20 bp, human
ggcagagttggggcgggccc

SEQ ID NO: 330872 - DNA, 20 bp, human
gcacatgtggggccactgcc

SEQ ID NO: 330873 - DNA, 20 bp, human
ggtgaggtcatctgccagcc

SEQ ID NO: 330874 - DNA, 20 bp, human
gcagaccagagtattataag

SEQ ID NO: 330875 - DNA, 20 bp, human
gaccgccccttataatactc

SEQ ID NO: 330876 - DNA, 20 bp, human
gaagcaggaggcgtcttctg

SEQ ID NO: 330877 - DNA, 20 bp, human
gagaggggtgcgctccaagg

SEQ ID NO: 330878 - DNA, 20 bp, human
gacgctgctaccggagtcgg

SEQ ID NO: 330879 - DNA, 20 bp, human
gggcacgctgctaccggagt

SEQ ID NO: 330880 - DNA, 20 bp, human
gtgaacacactcggcctcgg

SEQ ID NO: 330881 - DNA, 20 bp, human
gggggagcaggtctccgccg

SEQ ID NO: 330882 - DNA, 20 bp, human
ggccctagaggctcctgcta

SEQ ID NO: 330883 - DNA, 20 bp, human
gaggctctaagcggtcggaa

SEQ ID NO: 330884 - DNA, 20 bp, human
gtccgtagcaggagcctcta

SEQ ID NO: 330885 - DNA, 20 bp, human
ggaggcgtcttctggggagc

SEQ ID NO: 330886 - DNA, 20 bp, human
ggttgtcaaggaaggagata

SEQ ID NO: 330887 - DNA, 20 bp, human
gagtgaaaatctagatatgt

SEQ ID NO: 330888 - DNA, 20 bp, human
ggctatgcatactcacacaa

SEQ ID NO: 330889 - DNA, 20 bp, human
gagaggggcactccagatgg

SEQ ID NO: 330890 - DNA, 20 bp, human
gtgtgagcctcaagatgaag

SEQ ID NO: 330891 - DNA, 20 bp, human
gctagatatgtcggttgtca

SEQ ID NO: 330892 - DNA, 20 bp, human
gcagtgtgcagtctagtaaa

SEQ ID NO: 330893 - DNA, 20 bp, human
ggcagagaaattcaaatagc

SEQ ID NO: 330894 - DNA, 20 bp, human
gtcctcagcctttgcccctc

SEQ ID NO: 330895 - DNA, 20 bp, human
gtagactgcacactgcttga

SEQ ID NO: 330896 - DNA, 20 bp, human
gccactaagccactggtgac

SEQ ID NO: 330897 - DNA, 20 bp, human
gctggctgggccagtaactg

SEQ ID NO: 330898 - DNA, 20 bp, human
gcggctctttggtgggactg

SEQ ID NO: 330899 - DNA, 20 bp, human
gttgaacctcaggagggttg

SEQ ID NO: 330900 - DNA, 20 bp, human
gtgcttgcacggctctttgg

SEQ ID NO: 330901 - DNA, 20 bp, human
gtgcacggggttggtttcat

SEQ ID NO: 330902 - DNA, 20 bp, human
gatgagcttgaacctcagga

SEQ ID NO: 330903 - DNA, 20 bp, human
gcccctaccctgcacggggt

SEQ ID NO: 330904 - DNA, 20 bp, human
gacggggttggtttcattgg

SEQ ID NO: 330905 - DNA, 20 bp, human
gcagccccatccccagttac

SEQ ID NO: 330906 - DNA, 20 bp, human
ggccttgtagaacatgttca

SEQ ID NO: 330907 - DNA, 20 bp, human
gaccctgaacatgttctaca

SEQ ID NO: 330908 - DNA, 20 bp, human
gaaaaagggaaatgtttcat

SEQ ID NO: 330909 - DNA, 20 bp, human
gtcataggggaacttccttc

SEQ ID NO: 330910 - DNA, 20 bp, human
ggaaaatagaacacatacaa

SEQ ID NO: 330911 - DNA, 20 bp, human
gtgtcaatcaaggaacccat

SEQ ID NO: 330912 - DNA, 20 bp, human
gtcatcacttgtgaacctat

SEQ ID NO: 330913 - DNA, 20 bp, human
gcacatgtctgtttcggcaa

SEQ ID NO: 330914 - DNA, 20 bp, human
gtgacatcacatgtctgttt

SEQ ID NO: 330915 - DNA, 20 bp, human
gtttccttttgtgtcaatca

SEQ ID NO: 330916 - DNA, 20 bp, human
ggagtgcctcttgtatatag

SEQ ID NO: 330917 - DNA, 20 bp, human
gcaaaggtctaaatatgaag

SEQ ID NO: 330918 - DNA, 20 bp, human
gaatatgaagaggttctaat

SEQ ID NO: 330919 - DNA, 20 bp, human
gtcccaaattacaatcaagt

SEQ ID NO: 330920 - DNA, 20 bp, human
ggtattagcaaatgtcccaa

SEQ ID NO: 330921 - DNA, 20 bp, human
gcttctgtatccttgtaaac

SEQ ID NO: 330922 - DNA, 20 bp, human
gctggaaaatccagtttaca

SEQ ID NO: 330923 - DNA, 20 bp, human
gtcctacttgattgtaattt

SEQ ID NO: 330924 - DNA, 20 bp, human
gtttccagtaatttgtgttc

SEQ ID NO: 330925 - DNA, 20 bp, human
gcattacataagtaaaaata

SEQ ID NO: 330926 - DNA, 20 bp, human
gctgggacgtggaaacaaag

SEQ ID NO: 330927 - DNA, 20 bp, human
gctgtgcatcagatgatgta

SEQ ID NO: 330928 - DNA, 20 bp, human
gcagatgatgtagggatgtg

SEQ ID NO: 330929 - DNA, 20 bp, human
gagagacgttttaatctctg

SEQ ID NO: 330930 - DNA, 20 bp, human
gactgtttttgcattactgg

SEQ ID NO: 330931 - DNA, 20 bp, human
gacagaaaccacaagatagt

SEQ ID NO: 330932 - DNA, 20 bp, human
gtatctgacaacagcagcag

SEQ ID NO: 330933 - DNA, 20 bp, human
gttgaatttgacaatggcaa

SEQ ID NO: 330934 - DNA, 20 bp, human
gagaactgatgtgtaagata

SEQ ID NO: 330935 - DNA, 20 bp, human
gacgtgcagagatgggtagt

SEQ ID NO: 330936 - DNA, 20 bp, human
ggggaggcctccttctggcc

SEQ ID NO: 330937 - DNA, 20 bp, human
gcggctccctcacgctagaa

SEQ ID NO: 330938 - DNA, 20 bp, human
gtggccaggaagggacctac

SEQ ID NO: 330939 - DNA, 20 bp, human
ggtgctgcaacgggagggtc

SEQ ID NO: 330940 - DNA, 20 bp, human
gaccccgcggccttgtcgct

SEQ ID NO: 330941 - DNA, 20 bp, human
gaaagtggggagcacgggag

SEQ ID NO: 330942 - DNA, 20 bp, human
ggcggcgacggcaccctgag

SEQ ID NO: 330943 - DNA, 20 bp, human
gtggcccggcttcggggttg

SEQ ID NO: 330944 - DNA, 20 bp, human
ggggcactggcacccgggag

SEQ ID NO: 330945 - DNA, 20 bp, human
ggcgctgcgcttctcctctc

SEQ ID NO: 330946 - DNA, 20 bp, human
gtggactaggtcatcgtaaa

SEQ ID NO: 330947 - DNA, 20 bp, human
gtgtaagtgagcagaaacat

SEQ ID NO: 330948 - DNA, 20 bp, human
ggggaaacgaattttcacat

SEQ ID NO: 330949 - DNA, 20 bp, human
gcccactcattgtacagatt

SEQ ID NO: 330950 - DNA, 20 bp, human
gcccctgtaatctatctcca

SEQ ID NO: 330951 - DNA, 20 bp, human
ggtccctggagatagattac

SEQ ID NO: 330952 - DNA, 20 bp, human
gtagctcatagagagcctat

SEQ ID NO: 330953 - DNA, 20 bp, human
gacagctttgaaatgactgc

SEQ ID NO: 330954 - DNA, 20 bp, human
gtgatgaagagccaggtccc

SEQ ID NO: 330955 - DNA, 20 bp, human
gtgttaaatagtaatctcgc

SEQ ID NO: 330956 - DNA, 20 bp, human
ggggtgaatgaagtgacttg

SEQ ID NO: 330957 - DNA, 20 bp, human
gaagtgacttgcgggcagct

SEQ ID NO: 330958 - DNA, 20 bp, human
gtgagtcagcattggtgtaa

SEQ ID NO: 330959 - DNA, 20 bp, human
gagagggctggggtgataat

SEQ ID NO: 330960 - DNA, 20 bp, human
gatcctcccaacagtccctt

SEQ ID NO: 330961 - DNA, 20 bp, human
gctggaaggtccgttaagag

SEQ ID NO: 330962 - DNA, 20 bp, human
gtctggagaggcagcagatg

SEQ ID NO: 330963 - DNA, 20 bp, human
gtgtttgagtgagcaaacag

SEQ ID NO: 330964 - DNA, 20 bp, human
gaggacaagggcctggcaca

SEQ ID NO: 330965 - DNA, 20 bp, human
gttctggcagaagtctggag

SEQ ID NO: 330966 - DNA, 20 bp, human
gcccctgcgagccagtgata

SEQ ID NO: 330967 - DNA, 20 bp, human
gctgcgagccagtgataggg

SEQ ID NO: 330968 - DNA, 20 bp, human
gccgcccacctccctatcac

SEQ ID NO: 330969 - DNA, 20 bp, human
gtaagagaaccctgagagtg

SEQ ID NO: 330970 - DNA, 20 bp, human
gggtgggccacccagcgaag

SEQ ID NO: 330971 - DNA, 20 bp, human
gtcagggttctcttaagagt

SEQ ID NO: 330972 - DNA, 20 bp, human
gtgtctgaacactcatgtgc

SEQ ID NO: 330973 - DNA, 20 bp, human
ggtaacgtcgctgtgtctct

SEQ ID NO: 330974 - DNA, 20 bp, human
gagtgttcagacagttacag

SEQ ID NO: 330975 - DNA, 20 bp, human
gacctcccagcgcaccacca

SEQ ID NO: 330976 - DNA, 20 bp, human
gagtctgaggccgagaggag

SEQ ID NO: 330977 - DNA, 20 bp, human
gcacgggccggccacgggtg

SEQ ID NO: 330978 - DNA, 20 bp, human
gcggtcccagccactcctct

SEQ ID NO: 330979 - DNA, 20 bp, human
gggaccggccgccgtggtgt

SEQ ID NO: 330980 - DNA, 20 bp, human
gctctcggcctcagactcca

SEQ ID NO: 330981 - DNA, 20 bp, human
gggcgcctgcgcagtcgccg

SEQ ID NO: 330982 - DNA, 20 bp, human
ggcaaactgaacaggagcgg

SEQ ID NO: 330983 - DNA, 20 bp, human
gccgcttacccacaccacgg

SEQ ID NO: 330984 - DNA, 20 bp, human
ggtaaccacggtaacggtgg

SEQ ID NO: 330985 - DNA, 20 bp, human
gagactccacgggccggcca

SEQ ID NO: 330986 - DNA, 20 bp, human
ggggctgcgggcggcatgaa

SEQ ID NO: 330987 - DNA, 20 bp, human
gacgtggcggcggctcaagt

SEQ ID NO: 330988 - DNA, 20 bp, human
gtggcggcggctcaagtggg

SEQ ID NO: 330989 - DNA, 20 bp, human
gggcaggcgtgtggagcgtg

SEQ ID NO: 330990 - DNA, 20 bp, human
ggagctggggaccaggacgc

SEQ ID NO: 330991 - DNA, 20 bp, human
gccgcctcgggccgctgccg

SEQ ID NO: 330992 - DNA, 20 bp, human
gcacacgcctgcctgcgtcc

SEQ ID NO: 330993 - DNA, 20 bp, human
ggggccaaggcccgcaggtg

SEQ ID NO: 330994 - DNA, 20 bp, human
gtcccaggggtcgcagagga

SEQ ID NO: 330995 - DNA, 20 bp, human
ggtagcctgggcgttcccag

SEQ ID NO: 330996 - DNA, 20 bp, human
gggcgtggagcgagactggg

SEQ ID NO: 330997 - DNA, 20 bp, human
gaaacaaggaaggagtcagg

SEQ ID NO: 330998 - DNA, 20 bp, human
ggtggagcgagactgggcgg

SEQ ID NO: 330999 - DNA, 20 bp, human
ggaagcccccacgcattccg

SEQ ID NO: 331000 - DNA, 20 bp, human
gacaggggcggggcaggcga

SEQ ID NO: 331001 - DNA, 20 bp, human
ggaggtgaggcgtcgaaaca

SEQ ID NO: 331002 - DNA, 20 bp, human
gagcgagactgggcggtgga

SEQ ID NO: 331003 - DNA, 20 bp, human
gagctcctcggaatgcgtgg

SEQ ID NO: 331004 - DNA, 20 bp, human
gcactgtgcccatcacacta

SEQ ID NO: 331005 - DNA, 20 bp, human
ggggtgagcgatgaattcac

SEQ ID NO: 331006 - DNA, 20 bp, human
gacagcgagcgcgaggtcct

SEQ ID NO: 331007 - DNA, 20 bp, human
gcttgtcgggagccaatgag

SEQ ID NO: 331008 - DNA, 20 bp, human
gcgaaggccagggagcactc

SEQ ID NO: 331009 - DNA, 20 bp, human
gcaatcccgaacgaaggcca

SEQ ID NO: 331010 - DNA, 20 bp, human
gtgagtgtccaatccgagag

SEQ ID NO: 331011 - DNA, 20 bp, human
gaagtccgccggccaatcga

SEQ ID NO: 331012 - DNA, 20 bp, human
ggctggggcccgccttcgat

SEQ ID NO: 331013 - DNA, 20 bp, human
gtgctccctggccttcgttc

SEQ ID NO: 331014 - DNA, 20 bp, human
gtccgccggccaatcgaagg

SEQ ID NO: 331015 - DNA, 20 bp, human
ggattggccggcggacttcg

SEQ ID NO: 331016 - DNA, 20 bp, human
gcccgacggcaacccagctt

SEQ ID NO: 331017 - DNA, 20 bp, human
gggaagagaagccccagcgt

SEQ ID NO: 331018 - DNA, 20 bp, human
gcaagagggcgtcttcacgc

SEQ ID NO: 331019 - DNA, 20 bp, human
gggactgcgtaagcggcgat

SEQ ID NO: 331020 - DNA, 20 bp, human
ggacaagagcggcaccatta

SEQ ID NO: 331021 - DNA, 20 bp, human
ggaggctgggactgcgtaag

SEQ ID NO: 331022 - DNA, 20 bp, human
ggaagccccagcgtgggctg

SEQ ID NO: 331023 - DNA, 20 bp, human
gcagacgatacttttcccgg

SEQ ID NO: 331024 - DNA, 20 bp, human
gaaggtcccaagcgtagacg

SEQ ID NO: 331025 - DNA, 20 bp, human
gcggtcggtccggatctccc

SEQ ID NO: 331026 - DNA, 20 bp, human
gagactctagccgctctcga

SEQ ID NO: 331027 - DNA, 20 bp, human
gggcgtgcgaggcccttgga

SEQ ID NO: 331028 - DNA, 20 bp, human
ggagagcggctagagtctgg

SEQ ID NO: 331029 - DNA, 20 bp, human
gagccgttggggagcttgag

SEQ ID NO: 331030 - DNA, 20 bp, human
ggctgggaattgtagttcga

SEQ ID NO: 331031 - DNA, 20 bp, human
gagcgcgcgggctgaggcgc

SEQ ID NO: 331032 - DNA, 20 bp, human
gagccagtaacagagagggg

SEQ ID NO: 331033 - DNA, 20 bp, human
ggcgctcctaagccaggccc

SEQ ID NO: 331034 - DNA, 20 bp, human
gcctggcttaggagcgcgag

SEQ ID NO: 331035 - DNA, 20 bp, human
gcggaatcgccgggcactct

SEQ ID NO: 331036 - DNA, 20 bp, human
ggggagcgtgcacacggaag

SEQ ID NO: 331037 - DNA, 20 bp, human
gtcaggaaccagcccctcgt

SEQ ID NO: 331038 - DNA, 20 bp, human
gagcgtgcacacggaagggg

SEQ ID NO: 331039 - DNA, 20 bp, human
gacaacggggctgcgatcag

SEQ ID NO: 331040 - DNA, 20 bp, human
gaggcgttgcgggcacaacg

SEQ ID NO: 331041 - DNA, 20 bp, human
gaacgcacgctcctacgcgg

SEQ ID NO: 331042 - DNA, 20 bp, human
gtgtgcacgctccccacgag

SEQ ID NO: 331043 - DNA, 20 bp, human
gaagcgtgcggcgaggacag

SEQ ID NO: 331044 - DNA, 20 bp, human
gtgggtttcgcaggcggttg

SEQ ID NO: 331045 - DNA, 20 bp, human
ggaaacccaagccgccgcgt

SEQ ID NO: 331046 - DNA, 20 bp, human
gcgagcgtcagcgccggagt

SEQ ID NO: 331047 - DNA, 20 bp, human
gcccccgcgcgtctgacgcc

SEQ ID NO: 331048 - DNA, 20 bp, human
ggccggagtaggaggagacg

SEQ ID NO: 331049 - DNA, 20 bp, human
gggcgcggggtataagtaga

SEQ ID NO: 331050 - DNA, 20 bp, human
gcctacgcgagcgtcagcgc

SEQ ID NO: 331051 - DNA, 20 bp, human
ggccctggcgtcagacgcgc

SEQ ID NO: 331052 - DNA, 20 bp, human
gtccgcgtctcctcctactc

SEQ ID NO: 331053 - DNA, 20 bp, human
gactaaccgccggggagaag

SEQ ID NO: 331054 - DNA, 20 bp, human
gctctcagcactaaccgccg

SEQ ID NO: 331055 - DNA, 20 bp, human
gtggggctcgggcgaagggg

SEQ ID NO: 331056 - DNA, 20 bp, human
ggtccctgcgcaccaatcgt

SEQ ID NO: 331057 - DNA, 20 bp, human
ggggacgcgggggcggtaaa

SEQ ID NO: 331058 - DNA, 20 bp, human
ggatctaaaagctacaggtg

SEQ ID NO: 331059 - DNA, 20 bp, human
gctcccccgggatccctcct

SEQ ID NO: 331060 - DNA, 20 bp, human
gccccacctgcgagcacttg

SEQ ID NO: 331061 - DNA, 20 bp, human
ggggcccaggagggatcccg

SEQ ID NO: 331062 - DNA, 20 bp, human
gcttccgcccgggtgagcgc

SEQ ID NO: 331063 - DNA, 20 bp, human
gagccccgcgctcacccggg

SEQ ID NO: 331064 - DNA, 20 bp, human
gaaagagccgaggactggga

SEQ ID NO: 331065 - DNA, 20 bp, human
ggattggtgcgcagggacgc

SEQ ID NO: 331066 - DNA, 20 bp, human
gaggctgcggggcccccctt

SEQ ID NO: 331067 - DNA, 20 bp, human
ggccgcccgggtggcaacgg

SEQ ID NO: 331068 - DNA, 20 bp, human
ggcggcgaccgtggcagagg

SEQ ID NO: 331069 - DNA, 20 bp, human
gacagcagcgacagtggcgg

SEQ ID NO: 331070 - DNA, 20 bp, human
ggaggccgcccgggtggcaa

SEQ ID NO: 331071 - DNA, 20 bp, human
ggccgaggcctcaatagagg

SEQ ID NO: 331072 - DNA, 20 bp, human
ggcccgggtggcaacggtgg

SEQ ID NO: 331073 - DNA, 20 bp, human
gggaagggaggtcgcggcag

SEQ ID NO: 331074 - DNA, 20 bp, human
ggtggcggaggcctccgtgg

SEQ ID NO: 331075 - DNA, 20 bp, human
ggcggaggcctccgtggcgg

SEQ ID NO: 331076 - DNA, 20 bp, human
ggatgcgaatgcgaaggtgg

SEQ ID NO: 331077 - DNA, 20 bp, human
ggccgcccgggtggcaacgg

SEQ ID NO: 331078 - DNA, 20 bp, human
gaggctgcggggcccccctt

SEQ ID NO: 331079 - DNA, 20 bp, human
ggaggccgcccgggtggcaa

SEQ ID NO: 331080 - DNA, 20 bp, human
ggccgaggcctcaatagagg

SEQ ID NO: 331081 - DNA, 20 bp, human
gcctccgcctcccccaaggg

SEQ ID NO: 331082 - DNA, 20 bp, human
ggcccgggtggcaacggtgg

SEQ ID NO: 331083 - DNA, 20 bp, human
gacagcagcgacagtggcgg

SEQ ID NO: 331084 - DNA, 20 bp, human
ggccaccaccgttgccaccc

SEQ ID NO: 331085 - DNA, 20 bp, human
ggcggcgaccgtggcagagg

SEQ ID NO: 331086 - DNA, 20 bp, human
gggacccgacaccgctaccc

SEQ ID NO: 331087 - DNA, 20 bp, human
gcggcggggagccagggtag

SEQ ID NO: 331088 - DNA, 20 bp, human
gggccgggggcgtagccgga

SEQ ID NO: 331089 - DNA, 20 bp, human
ggggggcgtagccggaggga

SEQ ID NO: 331090 - DNA, 20 bp, human
gaggagtagagcgcgtgccg

SEQ ID NO: 331091 - DNA, 20 bp, human
gaaaacatactaaaggagaa

SEQ ID NO: 331092 - DNA, 20 bp, human
gccaaggccttcctgctgcc

SEQ ID NO: 331093 - DNA, 20 bp, human
gagcccgagccgcccgccag

SEQ ID NO: 331094 - DNA, 20 bp, human
ggagcgggggcaagcgcaga

SEQ ID NO: 331095 - DNA, 20 bp, human
ggggccgctggcgggcggct

SEQ ID NO: 331096 - DNA, 20 bp, human
gcggccacgcgagagcgacc

SEQ ID NO: 331097 - DNA, 20 bp, human
ggggaggaccgcccagctcg

SEQ ID NO: 331098 - DNA, 20 bp, human
gcggggcgggcgggtataaa

SEQ ID NO: 331099 - DNA, 20 bp, human
gcccgggcgctgctggtcga

SEQ ID NO: 331100 - DNA, 20 bp, human
ggcgccgggtcgctctcgcg

SEQ ID NO: 331101 - DNA, 20 bp, human
gtctcccgcagccgcgagct

SEQ ID NO: 331102 - DNA, 20 bp, human
gcgggcgggtataaatggag

SEQ ID NO: 331103 - DNA, 20 bp, human
gtgcccgcccactcggcccg

SEQ ID NO: 331104 - DNA, 20 bp, human
gcactcggcccgggggcccg

SEQ ID NO: 331105 - DNA, 20 bp, human
gggcggtcctcccggcgcca

SEQ ID NO: 331106 - DNA, 20 bp, human
gcaaagccctgcgggcgggt

SEQ ID NO: 331107 - DNA, 20 bp, human
ggggtggagaaaggcagccg

SEQ ID NO: 331108 - DNA, 20 bp, human
gagacccatgcaaagccctg

SEQ ID NO: 331109 - DNA, 20 bp, human
gcaggaggcggtgactgggg

SEQ ID NO: 331110 - DNA, 20 bp, human
gccatgcaaagccctgcggg

SEQ ID NO: 331111 - DNA, 20 bp, human
ggggaactaagcagcagttg

SEQ ID NO: 331112 - DNA, 20 bp, human
ggggtgggaaacgtgtaata

SEQ ID NO: 331113 - DNA, 20 bp, human
gtgcgggcgggtgggtttat

SEQ ID NO: 331114 - DNA, 20 bp, human
gaaacgtgtaataggggcgg

SEQ ID NO: 331115 - DNA, 20 bp, human
ggggaaacgtgtaatagggg

SEQ ID NO: 331116 - DNA, 20 bp, human
gggtcccagcgcagaccgat

SEQ ID NO: 331117 - DNA, 20 bp, human
ggggcggagtcagcgaagaa

SEQ ID NO: 331118 - DNA, 20 bp, human
gtggctcttggtccctccgt

SEQ ID NO: 331119 - DNA, 20 bp, human
gccgcaggacagtccaacgg

SEQ ID NO: 331120 - DNA, 20 bp, human
gagcgcagaccgatgggctg

SEQ ID NO: 331121 - DNA, 20 bp, human
ggccagtagcagtgataggg

SEQ ID NO: 331122 - DNA, 20 bp, human
gaggcggggcgcgagaaacc

SEQ ID NO: 331123 - DNA, 20 bp, human
gtctccgcaggacagtccaa

SEQ ID NO: 331124 - DNA, 20 bp, human
gggtctggccagatgcgggg

SEQ ID NO: 331125 - DNA, 20 bp, human
gctctgacgcgaggcgggtc

SEQ ID NO: 331126 - DNA, 20 bp, human
ggggacgcgtgttgattgac

SEQ ID NO: 331127 - DNA, 20 bp, human
ggggcgggcccgcgaagtat

SEQ ID NO: 331128 - DNA, 20 bp, human
gtacctaaggactcgatagg

SEQ ID NO: 331129 - DNA, 20 bp, human
gggagcgtcccatacttcgc

SEQ ID NO: 331130 - DNA, 20 bp, human
ggcgcagtgccccgccttag

SEQ ID NO: 331131 - DNA, 20 bp, human
gagtactagctcatggtgac

SEQ ID NO: 331132 - DNA, 20 bp, human
ggtgccccgccttagaggtg

SEQ ID NO: 331133 - DNA, 20 bp, human
gcgggcccgcccgtaggccg

SEQ ID NO: 331134 - DNA, 20 bp, human
gtaaggccccacctctaagg

SEQ ID NO: 331135 - DNA, 20 bp, human
ggggcccgccgcccggcgat

SEQ ID NO: 331136 - DNA, 20 bp, human
gcccactagagcatttgcaa

SEQ ID NO: 331137 - DNA, 20 bp, human
gacctccaggacactctccc

SEQ ID NO: 331138 - DNA, 20 bp, human
gccttccctgtcactcggac

SEQ ID NO: 331139 - DNA, 20 bp, human
gagcagctggcctcagggga

SEQ ID NO: 331140 - DNA, 20 bp, human
gcactcggacaggtacctcc

SEQ ID NO: 331141 - DNA, 20 bp, human
gtgggcaggtgcggacgcga

SEQ ID NO: 331142 - DNA, 20 bp, human
ggagaggctgagttgagtgg

SEQ ID NO: 331143 - DNA, 20 bp, human
gggtacctgtccgagtgaca

SEQ ID NO: 331144 - DNA, 20 bp, human
ggggtcctgggcccagagga

SEQ ID NO: 331145 - DNA, 20 bp, human
gcttccgcctggccacgctg

SEQ ID NO: 331146 - DNA, 20 bp, human
gccgcgcgtgcgcattccta

SEQ ID NO: 331147 - DNA, 20 bp, human
ggctgggcctgaagccggaa

SEQ ID NO: 331148 - DNA, 20 bp, human
gacccaggagagccgctggt

SEQ ID NO: 331149 - DNA, 20 bp, human
gtcccaccagcggctctcct

SEQ ID NO: 331150 - DNA, 20 bp, human
gcaaccgggaggcttacctt

SEQ ID NO: 331151 - DNA, 20 bp, human
gagcgactggtcaacacggc

SEQ ID NO: 331152 - DNA, 20 bp, human
gcagagaggctgtacctggc

SEQ ID NO: 331153 - DNA, 20 bp, human
gctggcgccgctgcgcgcat

SEQ ID NO: 331154 - DNA, 20 bp, human
gggcgcagagaggctgtacc

SEQ ID NO: 331155 - DNA, 20 bp, human
gaacaggcccatgcgcgcag

SEQ ID NO: 331156 - DNA, 20 bp, human
gcctgggcaaccctcttctg

SEQ ID NO: 331157 - DNA, 20 bp, human
ggcactgcaggcgctgtctc

SEQ ID NO: 331158 - DNA, 20 bp, human
gcaggcgccaggagttcagg

SEQ ID NO: 331159 - DNA, 20 bp, human
ggcgctgtctctggcgacaa

SEQ ID NO: 331160 - DNA, 20 bp, human
gagagcagagggacgatgac

SEQ ID NO: 331161 - DNA, 20 bp, human
gcgcggaggcgccccagaag

SEQ ID NO: 331162 - DNA, 20 bp, human
gacaaaggggcacgtggtgg

SEQ ID NO: 331163 - DNA, 20 bp, human
gaaccaggcgccaggagttc

SEQ ID NO: 331164 - DNA, 20 bp, human
gcaatggtaagaggtcgcgg

SEQ ID NO: 331165 - DNA, 20 bp, human
gctggcgacaaaggggcacg

SEQ ID NO: 331166 - DNA, 20 bp, human
gcgctcccgcggagtagaag

SEQ ID NO: 331167 - DNA, 20 bp, human
gcggacacgcccacccgtgt

SEQ ID NO: 331168 - DNA, 20 bp, human
gcggcccctccgcgctgggt

SEQ ID NO: 331169 - DNA, 20 bp, human
gagcgggggcagactggcag

SEQ ID NO: 331170 - DNA, 20 bp, human
gtcccgcggagtagaagggg

SEQ ID NO: 331171 - DNA, 20 bp, human
gccccggcaaacagagaggt

SEQ ID NO: 331172 - DNA, 20 bp, human
ggagccgcaacaggcagcgg

SEQ ID NO: 331173 - DNA, 20 bp, human
gacgggtgggcgtgtccggg

SEQ ID NO: 331174 - DNA, 20 bp, human
ggaccaccccttctactccg

SEQ ID NO: 331175 - DNA, 20 bp, human
gccggccgcggccccgccag

SEQ ID NO: 331176 - DNA, 20 bp, human
ggcagcgcgcgccggaagtg

SEQ ID NO: 331177 - DNA, 20 bp, human
gccgcgccggcgccgccgat

SEQ ID NO: 331178 - DNA, 20 bp, human
gcgcgggcggcgacgagctg

SEQ ID NO: 331179 - DNA, 20 bp, human
gccggcggcgattggacccg

SEQ ID NO: 331180 - DNA, 20 bp, human
gcaagggccgggagagtcgt

SEQ ID NO: 331181 - DNA, 20 bp, human
gccccgggagccgcgggcaa

SEQ ID NO: 331182 - DNA, 20 bp, human
gcgcgcgcgcacctcacttc

SEQ ID NO: 331183 - DNA, 20 bp, human
gcgggcggggacgccccgtg

SEQ ID NO: 331184 - DNA, 20 bp, human
gacgggccgggccccggcgt

SEQ ID NO: 331185 - DNA, 20 bp, human
gccccgtgaggcgccgccgg

SEQ ID NO: 331186 - DNA, 20 bp, human
gggggaggcagcaaccagtt

SEQ ID NO: 331187 - DNA, 20 bp, human
ggccctgcccgcgctaccat

SEQ ID NO: 331188 - DNA, 20 bp, human
gaggcagggagcaacatccc

SEQ ID NO: 331189 - DNA, 20 bp, human
gcccccggcgcctgccaaac

SEQ ID NO: 331190 - DNA, 20 bp, human
gagcgagccaatggtagcgc

SEQ ID NO: 331191 - DNA, 20 bp, human
ggctgcctccccggcagccg

SEQ ID NO: 331192 - DNA, 20 bp, human
ggggaggagggcgcaccgga

SEQ ID NO: 331193 - DNA, 20 bp, human
ggtcagagctgaggcggaga

SEQ ID NO: 331194 - DNA, 20 bp, human
gcgcgggcagcccccagaag

SEQ ID NO: 331195 - DNA, 20 bp, human
gcaggggtcggctgaagcag

SEQ ID NO: 331196 - DNA, 20 bp, human
gcacggcgccgcatcaacat

SEQ ID NO: 331197 - DNA, 20 bp, human
gtccctcccatgtacagcag

SEQ ID NO: 331198 - DNA, 20 bp, human
gatcccctgctgtacatggg

SEQ ID NO: 331199 - DNA, 20 bp, human
ggtccccaccagcgtctctg

SEQ ID NO: 331200 - DNA, 20 bp, human
ggggatgcccgcctcccgca

SEQ ID NO: 331201 - DNA, 20 bp, human
ggagacgctggtggggacac

SEQ ID NO: 331202 - DNA, 20 bp, human
gggcatcccctgctgtacat

SEQ ID NO: 331203 - DNA, 20 bp, human
gcacgcatgcatacacttca

SEQ ID NO: 331204 - DNA, 20 bp, human
gcggccacagagacgctggt

SEQ ID NO: 331205 - DNA, 20 bp, human
ggaaggaggcgggtcgggat

SEQ ID NO: 331206 - DNA, 20 bp, human
gtcaccccgcgtgaggacga

SEQ ID NO: 331207 - DNA, 20 bp, human
gcctccccggcgcccccgat

SEQ ID NO: 331208 - DNA, 20 bp, human
gaggcggctcaccccgcgtg

SEQ ID NO: 331209 - DNA, 20 bp, human
gtactcatctggcccaatcg

SEQ ID NO: 331210 - DNA, 20 bp, human
gaaagccccaggacgcgcat

SEQ ID NO: 331211 - DNA, 20 bp, human
gttgggccagatgagtagag

SEQ ID NO: 331212 - DNA, 20 bp, human
gccctcgcagcccattaaat

SEQ ID NO: 331213 - DNA, 20 bp, human
ggtcaccaatgcgcgtcctg

SEQ ID NO: 331214 - DNA, 20 bp, human
gttctcctgtcaatcaaacg

SEQ ID NO: 331215 - DNA, 20 bp, human
gcaccaccagcgagcggctt

SEQ ID NO: 331216 - DNA, 20 bp, human
gtgcctgggcgggctcccca

SEQ ID NO: 331217 - DNA, 20 bp, human
ggccgcagggagccagattt

SEQ ID NO: 331218 - DNA, 20 bp, human
ggagaggcaaagccgaaatc

SEQ ID NO: 331219 - DNA, 20 bp, human
gcggcaccggggcgcaaccc

SEQ ID NO: 331220 - DNA, 20 bp, human
ggcctcaaccccacgcggcg

SEQ ID NO: 331221 - DNA, 20 bp, human
gcaggcatcgcggcgaccag

SEQ ID NO: 331222 - DNA, 20 bp, human
gcggcgaccagcggctcttg

SEQ ID NO: 331223 - DNA, 20 bp, human
gcgtgtgcggagtgcctggg

SEQ ID NO: 331224 - DNA, 20 bp, human
gaccagcggctcttgtggcg

SEQ ID NO: 331225 - DNA, 20 bp, human
gtctccaaggctgcccgtgc

SEQ ID NO: 331226 - DNA, 20 bp, human
ggaggtgcccaaggcctgtc

SEQ ID NO: 331227 - DNA, 20 bp, human
gcaatccaggaggtcagggg

SEQ ID NO: 331228 - DNA, 20 bp, human
gcactcagggctgtcaatcc

SEQ ID NO: 331229 - DNA, 20 bp, human
gggaaggggagcttcaactg

SEQ ID NO: 331230 - DNA, 20 bp, human
gtcagggctgtcaatccagg

SEQ ID NO: 331231 - DNA, 20 bp, human
gtgtcaatccaggaggtcag

SEQ ID NO: 331232 - DNA, 20 bp, human
gaaggatcacaggtggttat

SEQ ID NO: 331233 - DNA, 20 bp, human
gttcaggcaccaggagtctt

SEQ ID NO: 331234 - DNA, 20 bp, human
ggcaccaggagtctttggag

SEQ ID NO: 331235 - DNA, 20 bp, human
gtggagggtctcctgtcagc

SEQ ID NO: 331236 - DNA, 20 bp, human
gaggtcgtggcgaagtcatc

SEQ ID NO: 331237 - DNA, 20 bp, human
gagcggggcgggacgagtta

SEQ ID NO: 331238 - DNA, 20 bp, human
ggggcgggacgagttagggg

SEQ ID NO: 331239 - DNA, 20 bp, human
gacttcgccacgacctcagc

SEQ ID NO: 331240 - DNA, 20 bp, human
ggcccactgcgagaggactg

SEQ ID NO: 331241 - DNA, 20 bp, human
gtcccgccccgctgaggtcg

SEQ ID NO: 331242 - DNA, 20 bp, human
ggccacgacctcagcggggc

SEQ ID NO: 331243 - DNA, 20 bp, human
ggggaccacgcttgacggac

SEQ ID NO: 331244 - DNA, 20 bp, human
gcgccccagtcctctcgcag

SEQ ID NO: 331245 - DNA, 20 bp, human
gtgggctggggcgtccggag

SEQ ID NO: 331246 - DNA, 20 bp, human
gagagctgagagctcaggat

SEQ ID NO: 331247 - DNA, 20 bp, human
ggtgccggggtcgggacaac

SEQ ID NO: 331248 - DNA, 20 bp, human
gctgagagctcaggattggc

SEQ ID NO: 331249 - DNA, 20 bp, human
ggaacctgttgtcccgaccc

SEQ ID NO: 331250 - DNA, 20 bp, human
gagctcaggattggctggaa

SEQ ID NO: 331251 - DNA, 20 bp, human
gggggcaggtgctgttgagg

SEQ ID NO: 331252 - DNA, 20 bp, human
gaggcaccaggaactgttgg

SEQ ID NO: 331253 - DNA, 20 bp, human
gtgtcccgaccccggcaccc

SEQ ID NO: 331254 - DNA, 20 bp, human
gacttcctgggtgccggggt

SEQ ID NO: 331255 - DNA, 20 bp, human
gacctgcccccaacagttcc

SEQ ID NO: 331256 - DNA, 20 bp, human
ggcccctcggacctctagat

SEQ ID NO: 331257 - DNA, 20 bp, human
gacccctgacctgagtgggg

SEQ ID NO: 331258 - DNA, 20 bp, human
gcccctccccactcaggtca

SEQ ID NO: 331259 - DNA, 20 bp, human
gcacccatctagaggtccga

SEQ ID NO: 331260 - DNA, 20 bp, human
gcaaaatctcctctgccctg

SEQ ID NO: 331261 - DNA, 20 bp, human
gaatgctggtaccagtggca

SEQ ID NO: 331262 - DNA, 20 bp, human
gccacacccctgacctgagt

SEQ ID NO: 331263 - DNA, 20 bp, human
gtggctcagaaagcctgggg

SEQ ID NO: 331264 - DNA, 20 bp, human
gggtggctctgtcagtttct

SEQ ID NO: 331265 - DNA, 20 bp, human
ggaccgcaggtgctgactca

SEQ ID NO: 331266 - DNA, 20 bp, human
gcacgaggtgcctgataaat

SEQ ID NO: 331267 - DNA, 20 bp, human
gcctggtggctgatagtctg

SEQ ID NO: 331268 - DNA, 20 bp, human
gccacccccttgttaagaag

SEQ ID NO: 331269 - DNA, 20 bp, human
gcttcagctgggaagaggag

SEQ ID NO: 331270 - DNA, 20 bp, human
gcctccccttcttaacaagg

SEQ ID NO: 331271 - DNA, 20 bp, human
gccttcatcaccaatttatc

SEQ ID NO: 331272 - DNA, 20 bp, human
gagtctgaggccggttgctt

SEQ ID NO: 331273 - DNA, 20 bp, human
ggccaccaggaagctcttag

SEQ ID NO: 331274 - DNA, 20 bp, human
ggtggccttcagctgggaag

SEQ ID NO: 331275 - DNA, 20 bp, human
gctgcagctctgcaggcacg

SEQ ID NO: 331276 - DNA, 20 bp, human
gcacagaggaggttcccgcg

SEQ ID NO: 331277 - DNA, 20 bp, human
gaggggcctgggtcgggtcc

SEQ ID NO: 331278 - DNA, 20 bp, human
gcgaacctgtgactcatcct

SEQ ID NO: 331279 - DNA, 20 bp, human
gctgcccagcccggacacag

SEQ ID NO: 331280 - DNA, 20 bp, human
gtgtgtccagggcaggggta

SEQ ID NO: 331281 - DNA, 20 bp, human
gctcttccctgcgtccacgc

SEQ ID NO: 331282 - DNA, 20 bp, human
gggggctcctggacaatgtt

SEQ ID NO: 331283 - DNA, 20 bp, human
gctggacaatgttgggtcag

SEQ ID NO: 331284 - DNA, 20 bp, human
gacctcctctgtgtccgggc

SEQ ID NO: 331285 - DNA, 20 bp, human
ggaggttcccgcgtggacgc

SEQ ID NO: 331286 - DNA, 20 bp, human
gtggcgagcgtctgggtgaa

SEQ ID NO: 331287 - DNA, 20 bp, human
gagagaggtgcttctgtgat

SEQ ID NO: 331288 - DNA, 20 bp, human
gacgctcgccaatccgtgtg

SEQ ID NO: 331289 - DNA, 20 bp, human
gcaaacggggactagaaata

SEQ ID NO: 331290 - DNA, 20 bp, human
gcgagcgtctgggtgaaggg

SEQ ID NO: 331291 - DNA, 20 bp, human
gtgagagtgacgtaacgttg

SEQ ID NO: 331292 - DNA, 20 bp, human
gcggcctgaggagacccgtt

SEQ ID NO: 331293 - DNA, 20 bp, human
gtccggctcggaaccacaca

SEQ ID NO: 331294 - DNA, 20 bp, human
gaagacgctgaggacccaac

SEQ ID NO: 331295 - DNA, 20 bp, human
ggcgcaggcagcaccgggga

SEQ ID NO: 331296 - DNA, 20 bp, human
ggggccgcaagtcagacgag

SEQ ID NO: 331297 - DNA, 20 bp, human
gcagccgcccgcccgctaga

SEQ ID NO: 331298 - DNA, 20 bp, human
ggggccgcgctgccttctag

SEQ ID NO: 331299 - DNA, 20 bp, human
gcgcccgctagaaggcagcg

SEQ ID NO: 331300 - DNA, 20 bp, human
gagcggaggagcagcgacac

SEQ ID NO: 331301 - DNA, 20 bp, human
ggccgaccgcggcgtcccgt

SEQ ID NO: 331302 - DNA, 20 bp, human
gagcagcgacacgggagtct

SEQ ID NO: 331303 - DNA, 20 bp, human
gagcggtgccacccggccgg

SEQ ID NO: 331304 - DNA, 20 bp, human
gcctggcgggtctggggcgg

SEQ ID NO: 331305 - DNA, 20 bp, human
ggtcccgttggcaccgtgtg

SEQ ID NO: 331306 - DNA, 20 bp, human
ggtacccaacggggtgtggc

SEQ ID NO: 331307 - DNA, 20 bp, human
gtgtcccgccacaccccgtt

SEQ ID NO: 331308 - DNA, 20 bp, human
gacaaagcagggtacccaac

SEQ ID NO: 331309 - DNA, 20 bp, human
gcgcccgggagagcgaaggc

SEQ ID NO: 331310 - DNA, 20 bp, human
ggggacttccggaagccatt

SEQ ID NO: 331311 - DNA, 20 bp, human
gggagagaggaaccacgctg

SEQ ID NO: 331312 - DNA, 20 bp, human
gggggtgtggcgggacacct

SEQ ID NO: 331313 - DNA, 20 bp, human
gtaaccgcgagaacaaagca

SEQ ID NO: 331314 - DNA, 20 bp, human
gactgcggtggcacgaacgc

SEQ ID NO: 331315 - DNA, 20 bp, human
gggctgagtggcaggggaac

SEQ ID NO: 331316 - DNA, 20 bp, human
gcacccaccggtcacgggga

SEQ ID NO: 331317 - DNA, 20 bp, human
gtagccctctgtctagcaaa

SEQ ID NO: 331318 - DNA, 20 bp, human
gcgagaccatccagctcccg

SEQ ID NO: 331319 - DNA, 20 bp, human
gccccccccgcaacagtagg

SEQ ID NO: 331320 - DNA, 20 bp, human
ggaagagtcgagagtgggcg

SEQ ID NO: 331321 - DNA, 20 bp, human
gcgcgcacccggcacggggt

SEQ ID NO: 331322 - DNA, 20 bp, human
ggggaagcccacgagtagat

SEQ ID NO: 331323 - DNA, 20 bp, human
gaccacctactgttgcgggg

SEQ ID NO: 331324 - DNA, 20 bp, human
ggaaaccacccaccggtcac

SEQ ID NO: 331325 - DNA, 20 bp, human
gctccccccaccacgtgaat

SEQ ID NO: 331326 - DNA, 20 bp, human
gggacggtcgcgtagaactc

SEQ ID NO: 331327 - DNA, 20 bp, human
gacgaccacgcggggctgga

SEQ ID NO: 331328 - DNA, 20 bp, human
ggaggcggagggttacgcac

SEQ ID NO: 331329 - DNA, 20 bp, human
gggtcgcgtagaactctggg

SEQ ID NO: 331330 - DNA, 20 bp, human
gtcgcacgaccacgcggggc

SEQ ID NO: 331331 - DNA, 20 bp, human
gcgctcgagagcagaaatcg

SEQ ID NO: 331332 - DNA, 20 bp, human
gtcgagagcagaaatcgcgg

SEQ ID NO: 331333 - DNA, 20 bp, human
gcggtttcgcacgaccacgc

SEQ ID NO: 331334 - DNA, 20 bp, human
gaggaatcacaccgcatccc

SEQ ID NO: 331335 - DNA, 20 bp, human
gggtcgtgcgaaaccgccca

SEQ ID NO: 331336 - DNA, 20 bp, human
gcggggcctggcttgctcgc

SEQ ID NO: 331337 - DNA, 20 bp, human
gctgggggtgcacacgggtg

SEQ ID NO: 331338 - DNA, 20 bp, human
gggccgcagcggcacgtcac

SEQ ID NO: 331339 - DNA, 20 bp, human
ggcacgtcacgggggaggag

SEQ ID NO: 331340 - DNA, 20 bp, human
gcccccgtgacgtgccgctg

SEQ ID NO: 331341 - DNA, 20 bp, human
gcttgctcgcgggaggatgc

SEQ ID NO: 331342 - DNA, 20 bp, human
gcacgggtgaggaccggcgc

SEQ ID NO: 331343 - DNA, 20 bp, human
gggcctggcttgctcgcggg

SEQ ID NO: 331344 - DNA, 20 bp, human
ggcgcgagtgcgcatgatcc

SEQ ID NO: 331345 - DNA, 20 bp, human
gaccttaaggaccgcttaaa

SEQ ID NO: 331346 - DNA, 20 bp, human
gtagcacccaaaggtgggga

SEQ ID NO: 331347 - DNA, 20 bp, human
gaggggggctcagttgaaga

SEQ ID NO: 331348 - DNA, 20 bp, human
ggaggctagcacccaaaggt

SEQ ID NO: 331349 - DNA, 20 bp, human
gtcttcacggggatgaaaat

SEQ ID NO: 331350 - DNA, 20 bp, human
gcactgaggctagcacccaa

SEQ ID NO: 331351 - DNA, 20 bp, human
ggggatgaaaatcgggagtg

SEQ ID NO: 331352 - DNA, 20 bp, human
gtcactgggtgccttcccgt

SEQ ID NO: 331353 - DNA, 20 bp, human
gttgaggggagcactatttg

SEQ ID NO: 331354 - DNA, 20 bp, human
ggtcgtctacctcacttcac

SEQ ID NO: 331355 - DNA, 20 bp, human
gtgaggtatttgagtacccg

SEQ ID NO: 331356 - DNA, 20 bp, human
gacacgcatagcaacagaca

SEQ ID NO: 331357 - DNA, 20 bp, human
gaacagacatgggcaccaac

SEQ ID NO: 331358 - DNA, 20 bp, human
gctggtggtttactccacag

SEQ ID NO: 331359 - DNA, 20 bp, human
ggttagagaatatgagcctc

SEQ ID NO: 331360 - DNA, 20 bp, human
gtgcgtgtctgttgttgcgc

SEQ ID NO: 331361 - DNA, 20 bp, human
gatgtcttatgatattgcag

SEQ ID NO: 331362 - DNA, 20 bp, human
gatggaagcgtatataaaac

SEQ ID NO: 331363 - DNA, 20 bp, human
gcaaaacagtgggtgaaaca

SEQ ID NO: 331364 - DNA, 20 bp, human
gtggtttactccacagaggc

SEQ ID NO: 331365 - DNA, 20 bp, human
gtcatattctctaacgccac

SEQ ID NO: 331366 - DNA, 20 bp, human
ggctgtgtgtggacagaagg

SEQ ID NO: 331367 - DNA, 20 bp, human
gaacagacaagtgcagcaac

SEQ ID NO: 331368 - DNA, 20 bp, human
gtgatgttttcctgcgtctg

SEQ ID NO: 331369 - DNA, 20 bp, human
gtgcagcatgcacactgact

SEQ ID NO: 331370 - DNA, 20 bp, human
gtcaggagcgctggtggttt

SEQ ID NO: 331371 - DNA, 20 bp, human
gcaaaacagtgggtgcaaca

SEQ ID NO: 331372 - DNA, 20 bp, human
gacacattattagagtaacc

SEQ ID NO: 331373 - DNA, 20 bp, human
gtgaatgtcttatattggaa

SEQ ID NO: 331374 - DNA, 20 bp, human
gaactatgaatgtcttatat

SEQ ID NO: 331375 - DNA, 20 bp, human
gctccttgcagagctgtgtg

SEQ ID NO: 331376 - DNA, 20 bp, human
ggcacagagcctctaggagg

SEQ ID NO: 331377 - DNA, 20 bp, human
gcacccccgaggtttgggat

SEQ ID NO: 331378 - DNA, 20 bp, human
gagccaatcccaaacctcgg

SEQ ID NO: 331379 - DNA, 20 bp, human
ggcctgctcggtgctgagaa

SEQ ID NO: 331380 - DNA, 20 bp, human
ggtggcacagagcctctagg

SEQ ID NO: 331381 - DNA, 20 bp, human
gcctcgggggtgtgtcacgt

SEQ ID NO: 331382 - DNA, 20 bp, human
ggctgagaagggcttgtttc

SEQ ID NO: 331383 - DNA, 20 bp, human
gcaaggaggcagaagtaggt

SEQ ID NO: 331384 - DNA, 20 bp, human
gcaggtggcacagagcctct

SEQ ID NO: 331385 - DNA, 20 bp, human
gcagagatgcgtgaaagctt

SEQ ID NO: 331386 - DNA, 20 bp, human
gcaacgccattggaagtgaa

SEQ ID NO: 331387 - DNA, 20 bp, human
ggctctgcctagacagaagg

SEQ ID NO: 331388 - DNA, 20 bp, human
gaatggcgttggagaatatg

SEQ ID NO: 331389 - DNA, 20 bp, human
gagtgaaaggaaggttgggc

SEQ ID NO: 331390 - DNA, 20 bp, human
gtcagaagagcttgtggttt

SEQ ID NO: 331391 - DNA, 20 bp, human
gagagctctgcctagacaga

SEQ ID NO: 331392 - DNA, 20 bp, human
gcatgacagcagactcgcga

SEQ ID NO: 331393 - DNA, 20 bp, human
ggttggagaatatgaggccc

SEQ ID NO: 331394 - DNA, 20 bp, human
ggtatttgccacgtgactga

SEQ ID NO: 331395 - DNA, 20 bp, human
gttctgcccaccttctgtct

SEQ ID NO: 331396 - DNA, 20 bp, human
gctacgcaggcgcacagaaa

SEQ ID NO: 331397 - DNA, 20 bp, human
ggggagaaggcgccgtgtcc

SEQ ID NO: 331398 - DNA, 20 bp, human
gcaggcgcacagaaatggcg

SEQ ID NO: 331399 - DNA, 20 bp, human
gcgcacagaaatggcgcggg

SEQ ID NO: 331400 - DNA, 20 bp, human
gggaggctccgctctaggca

SEQ ID NO: 331401 - DNA, 20 bp, human
gagaccgcccgtccccggga

SEQ ID NO: 331402 - DNA, 20 bp, human
gcatgcgcgagtaagcgcac

SEQ ID NO: 331403 - DNA, 20 bp, human
gcggtggccatctttactgt

SEQ ID NO: 331404 - DNA, 20 bp, human
gcgctctaggcaaggctact

SEQ ID NO: 331405 - DNA, 20 bp, human
gtacttggaagaggaaagcg

SEQ ID NO: 331406 - DNA, 20 bp, human
ggcagcctgccggatgctcc

SEQ ID NO: 331407 - DNA, 20 bp, human
gtaaacctgtctaatcgacg

SEQ ID NO: 331408 - DNA, 20 bp, human
gctcccctccggcccgtcct

SEQ ID NO: 331409 - DNA, 20 bp, human
ggtgacctggagcatccggc

SEQ ID NO: 331410 - DNA, 20 bp, human
gcgctgcccgccctgggtaa

SEQ ID NO: 331411 - DNA, 20 bp, human
gctaatcgacggggcttggg

SEQ ID NO: 331412 - DNA, 20 bp, human
ggtcctgacgcaggaggcca

SEQ ID NO: 331413 - DNA, 20 bp, human
gcacgaggggcgttactgtg

SEQ ID NO: 331414 - DNA, 20 bp, human
gcaagccccgtcgattagac

SEQ ID NO: 331415 - DNA, 20 bp, human
gggcttcttccctttaccca

SEQ ID NO: 331416 - DNA, 20 bp, human
gctttccaggcagctcttag

SEQ ID NO: 331417 - DNA, 20 bp, human
gtaacccggaggggtatggg

SEQ ID NO: 331418 - DNA, 20 bp, human
gggacgaaacaacgccccac

SEQ ID NO: 331419 - DNA, 20 bp, human
ggagactgaaacgcggatat

SEQ ID NO: 331420 - DNA, 20 bp, human
gcatacccctccgggttagg

SEQ ID NO: 331421 - DNA, 20 bp, human
gtgcccggacaggcgaaaag

SEQ ID NO: 331422 - DNA, 20 bp, human
ggaaaagtggcgcgcactgg

SEQ ID NO: 331423 - DNA, 20 bp, human
ggcgcggcgggaagccagtg

SEQ ID NO: 331424 - DNA, 20 bp, human
gctacagccgcctaacccgg

SEQ ID NO: 331425 - DNA, 20 bp, human
gcggtcccgcggctgagggg

SEQ ID NO: 331426 - DNA, 20 bp, human
ggggcgcaggcgggtcacag

SEQ ID NO: 331427 - DNA, 20 bp, human
ggcgaactggaggatcctcg

SEQ ID NO: 331428 - DNA, 20 bp, human
gcctcactcgggcctcatgg

SEQ ID NO: 331429 - DNA, 20 bp, human
gcggccggccagccgcgaac

SEQ ID NO: 331430 - DNA, 20 bp, human
gccggccagccgcgaactgg

SEQ ID NO: 331431 - DNA, 20 bp, human
gcgcccgccgagtggcgtct

SEQ ID NO: 331432 - DNA, 20 bp, human
gtggccaagacgccactcgg

SEQ ID NO: 331433 - DNA, 20 bp, human
ggcggggagccgggttttgg

SEQ ID NO: 331434 - DNA, 20 bp, human
ggggtcacagcggccccctg

SEQ ID NO: 331435 - DNA, 20 bp, human
gaggcccgagtgaggcgcgg

SEQ ID NO: 331436 - DNA, 20 bp, human
gaccccgaagtctgtctcca

SEQ ID NO: 331437 - DNA, 20 bp, human
gccgtaggggcgcgctggaa

SEQ ID NO: 331438 - DNA, 20 bp, human
ggccttggagacagacttcg

SEQ ID NO: 331439 - DNA, 20 bp, human
gacccggcagccggccgtag

SEQ ID NO: 331440 - DNA, 20 bp, human
gagggcggggttggcggcga

SEQ ID NO: 331441 - DNA, 20 bp, human
ggccggctgccgggtgtagc

SEQ ID NO: 331442 - DNA, 20 bp, human
gtctcgcgcgcgctctctag

SEQ ID NO: 331443 - DNA, 20 bp, human
gccgggctggggtgtttgtt

SEQ ID NO: 331444 - DNA, 20 bp, human
gacagcgttcctgctacacc

SEQ ID NO: 331445 - DNA, 20 bp, human
gcagagctgacagaacaaga

SEQ ID NO: 331446 - DNA, 20 bp, human
ggcgcccggcccactcgtgg

SEQ ID NO: 331447 - DNA, 20 bp, human
gagagccggcatctccctca

SEQ ID NO: 331448 - DNA, 20 bp, human
ggggagatgccggctctgat

SEQ ID NO: 331449 - DNA, 20 bp, human
ggcccggcaaccaatggctt

SEQ ID NO: 331450 - DNA, 20 bp, human
ggatgcgcccggcccactcg

SEQ ID NO: 331451 - DNA, 20 bp, human
gacctccttgagggagatgc

SEQ ID NO: 331452 - DNA, 20 bp, human
ggaccgaacggcatcttctt

SEQ ID NO: 331453 - DNA, 20 bp, human
gtgggataggcattgggcca

SEQ ID NO: 331454 - DNA, 20 bp, human
gggcggtgcccggcaaccaa

SEQ ID NO: 331455 - DNA, 20 bp, human
gtcacctagaatggcatatg

SEQ ID NO: 331456 - DNA, 20 bp, human
gccgcctcccgcaggtgaga

SEQ ID NO: 331457 - DNA, 20 bp, human
gtctatgagctcgttgtcaa

SEQ ID NO: 331458 - DNA, 20 bp, human
gaacaacccgccacggacag

SEQ ID NO: 331459 - DNA, 20 bp, human
gtgggagcgaggccaaaccc

SEQ ID NO: 331460 - DNA, 20 bp, human
gtggcctcgctcccacgggt

SEQ ID NO: 331461 - DNA, 20 bp, human
gcatcggcgcgtgacgccag

SEQ ID NO: 331462 - DNA, 20 bp, human
gggagggcctgaccgacccg

SEQ ID NO: 331463 - DNA, 20 bp, human
ggcacggaaacaacccgcca

SEQ ID NO: 331464 - DNA, 20 bp, human
gcaaaccctggcccgcatga

SEQ ID NO: 331465 - DNA, 20 bp, human
ggtaggggagccagtgaact

SEQ ID NO: 331466 - DNA, 20 bp, human
gcggcagcgtgcattgttgt

SEQ ID NO: 331467 - DNA, 20 bp, human
gtacgcccgtctgaagggag

SEQ ID NO: 331468 - DNA, 20 bp, human
ggggcaagcaggcatatctc

SEQ ID NO: 331469 - DNA, 20 bp, human
gtaagcgcggggaggtcaca

SEQ ID NO: 331470 - DNA, 20 bp, human
gaggaggtggggccgacttc

SEQ ID NO: 331471 - DNA, 20 bp, human
ggaaatgaagggcttcgcag

SEQ ID NO: 331472 - DNA, 20 bp, human
gccagctacgcccgtctgaa

SEQ ID NO: 331473 - DNA, 20 bp, human
gccacctcctcctgatgtca

SEQ ID NO: 331474 - DNA, 20 bp, human
gccgcccgctcccttcagac

SEQ ID NO: 331475 - DNA, 20 bp, human
gacttccggccggttgctta

SEQ ID NO: 331476 - DNA, 20 bp, human
gaagccggagctccccgggg

SEQ ID NO: 331477 - DNA, 20 bp, human
gccgaagccggagctccccg

SEQ ID NO: 331478 - DNA, 20 bp, human
gcccgcgcgggcctgcccat

SEQ ID NO: 331479 - DNA, 20 bp, human
ggacgagcgccacctcccat

SEQ ID NO: 331480 - DNA, 20 bp, human
gtgcgcgtggccacaaccct

SEQ ID NO: 331481 - DNA, 20 bp, human
gtcggggcgggaggggttct

SEQ ID NO: 331482 - DNA, 20 bp, human
ggagccttcggcaatggcga

SEQ ID NO: 331483 - DNA, 20 bp, human
ggggccgtcgccattgccga

SEQ ID NO: 331484 - DNA, 20 bp, human
gtcccatgggcaggcccgcg

SEQ ID NO: 331485 - DNA, 20 bp, human
ggtctgtcagcgtcttccgt

SEQ ID NO: 331486 - DNA, 20 bp, human
ggggaaaaaactgaagggga

SEQ ID NO: 331487 - DNA, 20 bp, human
gctcctgaggggagcaatta

SEQ ID NO: 331488 - DNA, 20 bp, human
gaaaaagaggggcacctgac

SEQ ID NO: 331489 - DNA, 20 bp, human
gggtccccagtagcccactc

SEQ ID NO: 331490 - DNA, 20 bp, human
ggggttgtctagacagaggt

SEQ ID NO: 331491 - DNA, 20 bp, human
gtggaaacttctacactgtc

SEQ ID NO: 331492 - DNA, 20 bp, human
gtggggccatcaaaaaagag

SEQ ID NO: 331493 - DNA, 20 bp, human
gaactgaaggggagggaaca

SEQ ID NO: 331494 - DNA, 20 bp, human
ggagggggaaaaaactgaag

SEQ ID NO: 331495 - DNA, 20 bp, human
gtacacgggcacactttatt

SEQ ID NO: 331496 - DNA, 20 bp, human
ggggcagaaaatgccaagcg

SEQ ID NO: 331497 - DNA, 20 bp, human
gcgtccaatcggagaccttc

SEQ ID NO: 331498 - DNA, 20 bp, human
ggcccgctccagcctccgat

SEQ ID NO: 331499 - DNA, 20 bp, human
gctgcccgaaggtctccgat

SEQ ID NO: 331500 - DNA, 20 bp, human
ggacgctctgtaccaatcgg

SEQ ID NO: 331501 - DNA, 20 bp, human
gcccactgaggtccttaaag

SEQ ID NO: 331502 - DNA, 20 bp, human
gcccccccagaaggagttag

SEQ ID NO: 331503 - DNA, 20 bp, human
gtcccctttaaggacctcag

SEQ ID NO: 331504 - DNA, 20 bp, human
gcggagtcgggcgcctctca

SEQ ID NO: 331505 - DNA, 20 bp, human
gggcagggccagtgcggggg

SEQ ID NO: 331506 - DNA, 20 bp, human
gtgtggcctcaggtaggacg

SEQ ID NO: 331507 - DNA, 20 bp, human
gcggcggcgaacccagagcg

SEQ ID NO: 331508 - DNA, 20 bp, human
ggagcagcacggcgcccctc

SEQ ID NO: 331509 - DNA, 20 bp, human
gtcagggtgtggcctcaggt

SEQ ID NO: 331510 - DNA, 20 bp, human
gagccgcaggcaggtccccg

SEQ ID NO: 331511 - DNA, 20 bp, human
gaagttgccaagtgtcgctg

SEQ ID NO: 331512 - DNA, 20 bp, human
gacggcgcccctcgggcaga

SEQ ID NO: 331513 - DNA, 20 bp, human
gcgccgccgcgtcctacctg

SEQ ID NO: 331514 - DNA, 20 bp, human
gggcaacttctcccgcgctc

SEQ ID NO: 331515 - DNA, 20 bp, human
gtgtaagcgcggcccctcct

SEQ ID NO: 331516 - DNA, 20 bp, human
gggggtgagccaaggaggtc

SEQ ID NO: 331517 - DNA, 20 bp, human
gcgcagctccaagttctggg

SEQ ID NO: 331518 - DNA, 20 bp, human
gtcagctggttttgcttcga

SEQ ID NO: 331519 - DNA, 20 bp, human
ggggtgggggtgagccaagg

SEQ ID NO: 331520 - DNA, 20 bp, human
gacccccaccccccagaact

SEQ ID NO: 331521 - DNA, 20 bp, human
gaggaggtctggcttctcta

SEQ ID NO: 331522 - DNA, 20 bp, human
gggctcaccctgagcccggc

SEQ ID NO: 331523 - DNA, 20 bp, human
gtctggcttctctagggcaa

SEQ ID NO: 331524 - DNA, 20 bp, human
gggagctgcgcattcagatc

SEQ ID NO: 331525 - DNA, 20 bp, human
gaatgcgcagctccaagttc

SEQ ID NO: 331526 - DNA, 20 bp, human
ggggaggcaggctgtagcgg

SEQ ID NO: 331527 - DNA, 20 bp, human
gctcatggacagtcctccga

SEQ ID NO: 331528 - DNA, 20 bp, human
gggggggcgtgtctacactc

SEQ ID NO: 331529 - DNA, 20 bp, human
ggactgggagtaaacgtgat

SEQ ID NO: 331530 - DNA, 20 bp, human
gtggctgggtaggggcaagg

SEQ ID NO: 331531 - DNA, 20 bp, human
gggctgagaagcagaacagt

SEQ ID NO: 331532 - DNA, 20 bp, human
ggagcagctgcgtacgctca

SEQ ID NO: 331533 - DNA, 20 bp, human
gtgcccccgccggggacgac

SEQ ID NO: 331534 - DNA, 20 bp, human
gccagcctagcaatggtctc

SEQ ID NO: 331535 - DNA, 20 bp, human
ggcaggagctgcccccgccg

SEQ ID NO: 331536 - DNA, 20 bp, human
gcccagtgggccacctggag

SEQ ID NO: 331537 - DNA, 20 bp, human
gtccgctccaggtggcccac

SEQ ID NO: 331538 - DNA, 20 bp, human
ggctgtcgatgagtcccagt

SEQ ID NO: 331539 - DNA, 20 bp, human
gccacctggagcggaagtgg

SEQ ID NO: 331540 - DNA, 20 bp, human
gaggagcggccggaagtagc

SEQ ID NO: 331541 - DNA, 20 bp, human
ggggacgcagggttggaaag

SEQ ID NO: 331542 - DNA, 20 bp, human
gacggccgagcagtggagcg

SEQ ID NO: 331543 - DNA, 20 bp, human
gtccactgctcggccgtcta

SEQ ID NO: 331544 - DNA, 20 bp, human
ggtggagcgaggccgcctaa

SEQ ID NO: 331545 - DNA, 20 bp, human
ggacagcgcggctctccttt

SEQ ID NO: 331546 - DNA, 20 bp, human
gagtcccggccccaccgcga

SEQ ID NO: 331547 - DNA, 20 bp, human
gcccccgggcgggaggaacg

SEQ ID NO: 331548 - DNA, 20 bp, human
gccccgctacccaacgccga

SEQ ID NO: 331549 - DNA, 20 bp, human
gggagccgcactagcgacga

SEQ ID NO: 331550 - DNA, 20 bp, human
ggctacccaacgccgagggg

SEQ ID NO: 331551 - DNA, 20 bp, human
gcgggggcgggcgcggtgat

SEQ ID NO: 331552 - DNA, 20 bp, human
ggcgacgagggaagaggaac

SEQ ID NO: 331553 - DNA, 20 bp, human
ggtagccggcgtccgggacg

SEQ ID NO: 331554 - DNA, 20 bp, human
gacgcgggcgccacgttccc

SEQ ID NO: 331555 - DNA, 20 bp, human
gcccgcgttcctcccgcccg

SEQ ID NO: 331556 - DNA, 20 bp, human
ggaagcacccccaggaccga

SEQ ID NO: 331557 - DNA, 20 bp, human
gaacccagccctcggtcctg

SEQ ID NO: 331558 - DNA, 20 bp, human
gcacccccaggaccgagggc

SEQ ID NO: 331559 - DNA, 20 bp, human
gcaggcagtctctaatgaat

SEQ ID NO: 331560 - DNA, 20 bp, human
gagtaagaagagcttccatt

SEQ ID NO: 331561 - DNA, 20 bp, human
ggtagctggaaatcaccacc

SEQ ID NO: 331562 - DNA, 20 bp, human
gaacatgttaaaggtccagg

SEQ ID NO: 331563 - DNA, 20 bp, human
gctggtccgtggtcactttg

SEQ ID NO: 331564 - DNA, 20 bp, human
gttagagactgcctggtccg

SEQ ID NO: 331565 - DNA, 20 bp, human
gttatggatctgataaacgt

SEQ ID NO: 331566 - DNA, 20 bp, human
gcagacctaggcccttctca

SEQ ID NO: 331567 - DNA, 20 bp, human
gccttctcaggggtgccccg

SEQ ID NO: 331568 - DNA, 20 bp, human
ggcagcgcccgctcgcagcg

SEQ ID NO: 331569 - DNA, 20 bp, human
gtctcaggggtgccccgggg

SEQ ID NO: 331570 - DNA, 20 bp, human
gagggcgagcgaggggatag

SEQ ID NO: 331571 - DNA, 20 bp, human
gcagcaccgcgcccagacct

SEQ ID NO: 331572 - DNA, 20 bp, human
gtgccggagtatctggtgga

SEQ ID NO: 331573 - DNA, 20 bp, human
gcgccctccaccagatactc

SEQ ID NO: 331574 - DNA, 20 bp, human
gacctccccgcgctgcgagc

SEQ ID NO: 331575 - DNA, 20 bp, human
gggctaaggcctggcggccg

SEQ ID NO: 331576 - DNA, 20 bp, human
gccgaggccgcggtccaagg

SEQ ID NO: 331577 - DNA, 20 bp, human
ggacccgaggccgcggtcca

SEQ ID NO: 331578 - DNA, 20 bp, human
ggcgaggcaccgagacgtca

SEQ ID NO: 331579 - DNA, 20 bp, human
gtgccggcgtcccacgtcct

SEQ ID NO: 331580 - DNA, 20 bp, human
gtctccaaggcgcagacgga

SEQ ID NO: 331581 - DNA, 20 bp, human
gaggcaccgagacgtcaggg

SEQ ID NO: 331582 - DNA, 20 bp, human
gtcgccgccgcgggtctcca

SEQ ID NO: 331583 - DNA, 20 bp, human
gctcgggtccatcacactcc

SEQ ID NO: 331584 - DNA, 20 bp, human
gctccgcccctggagtgtga

SEQ ID NO: 331585 - DNA, 20 bp, human
gtccactggcatctgcccgg

SEQ ID NO: 331586 - DNA, 20 bp, human
gccgaggccgcggtccaagg

SEQ ID NO: 331587 - DNA, 20 bp, human
ggacccgaggccgcggtcca

SEQ ID NO: 331588 - DNA, 20 bp, human
ggcgaggcaccgagacgtca

SEQ ID NO: 331589 - DNA, 20 bp, human
gtgccggcgtcccacgtcct

SEQ ID NO: 331590 - DNA, 20 bp, human
gtctccaaggcgcagacgga

SEQ ID NO: 331591 - DNA, 20 bp, human
gaggcaccgagacgtcaggg

SEQ ID NO: 331592 - DNA, 20 bp, human
gtcgccgccgcgggtctcca

SEQ ID NO: 331593 - DNA, 20 bp, human
gctcgggtccatcacactcc

SEQ ID NO: 331594 - DNA, 20 bp, human
gctccgcccctggagtgtga

SEQ ID NO: 331595 - DNA, 20 bp, human
gtccactggcatctgcccgg

SEQ ID NO: 331596 - DNA, 20 bp, human
ggggggcgagggtcttggga

SEQ ID NO: 331597 - DNA, 20 bp, human
gcacctgggaagagtctggg

SEQ ID NO: 331598 - DNA, 20 bp, human
gctaaagccctccctaaatc

SEQ ID NO: 331599 - DNA, 20 bp, human
gctgggaagagtctgggcgg

SEQ ID NO: 331600 - DNA, 20 bp, human
gcaagcgtcctctgagatcg

SEQ ID NO: 331601 - DNA, 20 bp, human
gagaggggggcgttcaagat

SEQ ID NO: 331602 - DNA, 20 bp, human
ggcagtgaccacgactggtg

SEQ ID NO: 331603 - DNA, 20 bp, human
ggcaaggagctattcatgca

SEQ ID NO: 331604 - DNA, 20 bp, human
gactgagcagtgaccacgac

SEQ ID NO: 331605 - DNA, 20 bp, human
ggactcttcccaggtgcaaa

SEQ ID NO: 331606 - DNA, 20 bp, human
gtacctgcttgctagctcta

SEQ ID NO: 331607 - DNA, 20 bp, human
gagaccaacacatccgggga

SEQ ID NO: 331608 - DNA, 20 bp, human
gacacagaccaacacatccg

SEQ ID NO: 331609 - DNA, 20 bp, human
gctgtgtgttgctagagcag

SEQ ID NO: 331610 - DNA, 20 bp, human
gaagagctggcagctcctga

SEQ ID NO: 331611 - DNA, 20 bp, human
ggggggtggggtgtagacgg

SEQ ID NO: 331612 - DNA, 20 bp, human
ggagaaattcccgacttgtc

SEQ ID NO: 331613 - DNA, 20 bp, human
ggttgactgacaagtttgaa

SEQ ID NO: 331614 - DNA, 20 bp, human
gcagccatccccggatgtgt

SEQ ID NO: 331615 - DNA, 20 bp, human
gatgtaatgagggtgtgctg

SEQ ID NO: 331616 - DNA, 20 bp, human
gttctgaatgatgactgacg

SEQ ID NO: 331617 - DNA, 20 bp, human
gtacaggggctgcgccgtgg

SEQ ID NO: 331618 - DNA, 20 bp, human
gaaaacaggagtgggtccaa

SEQ ID NO: 331619 - DNA, 20 bp, human
ggtggctgtgagggataaag

SEQ ID NO: 331620 - DNA, 20 bp, human
ggataaaggggggaagaagt

SEQ ID NO: 331621 - DNA, 20 bp, human
gagccagcccccaagatttc

SEQ ID NO: 331622 - DNA, 20 bp, human
gtatgactccggaatgacag

SEQ ID NO: 331623 - DNA, 20 bp, human
ggcgctggggctagacgcgc

SEQ ID NO: 331624 - DNA, 20 bp, human
gacagaacaccggctctaca

SEQ ID NO: 331625 - DNA, 20 bp, human
gagagaaattcagactgggg

SEQ ID NO: 331626 - DNA, 20 bp, human
gtctacaggggctgcgccgt

SEQ ID NO: 331627 - DNA, 20 bp, human
ggtggctgtgagggataaag

SEQ ID NO: 331628 - DNA, 20 bp, human
ggataaaggggggaagaagt

SEQ ID NO: 331629 - DNA, 20 bp, human
gaaaacaggagtgggtccaa

SEQ ID NO: 331630 - DNA, 20 bp, human
gagagaaattcagactgggg

SEQ ID NO: 331631 - DNA, 20 bp, human
gtcagactggggtggctgtg

SEQ ID NO: 331632 - DNA, 20 bp, human
gcaaaacaaaaaacgaagag

SEQ ID NO: 331633 - DNA, 20 bp, human
gagccagcccccaagatttc

SEQ ID NO: 331634 - DNA, 20 bp, human
gacaggagtgggtccaaggg

SEQ ID NO: 331635 - DNA, 20 bp, human
gtaaagagaaattcagactg

SEQ ID NO: 331636 - DNA, 20 bp, human
gtcgggctctggataactgg

SEQ ID NO: 331637 - DNA, 20 bp, human
ggctctggataactgggggc

SEQ ID NO: 331638 - DNA, 20 bp, human
ggataactgggggcgggctt

SEQ ID NO: 331639 - DNA, 20 bp, human
ggccaccgggagcgtcttag

SEQ ID NO: 331640 - DNA, 20 bp, human
gaagcacatcggtcagacgt

SEQ ID NO: 331641 - DNA, 20 bp, human
gcgtcttagcggctcggggc

SEQ ID NO: 331642 - DNA, 20 bp, human
ggggagcgtcttagcggctc

SEQ ID NO: 331643 - DNA, 20 bp, human
ggcgcactggggtaagcacg

SEQ ID NO: 331644 - DNA, 20 bp, human
ggcgtcgggctctggataac

SEQ ID NO: 331645 - DNA, 20 bp, human
gggggatcaagcgtggtcgg

SEQ ID NO: 331646 - DNA, 20 bp, human
gacctcccggggccccgcaa

SEQ ID NO: 331647 - DNA, 20 bp, human
ggctgcggggcgctcaggtg

SEQ ID NO: 331648 - DNA, 20 bp, human
gaggaggggccataggaccc

SEQ ID NO: 331649 - DNA, 20 bp, human
gcggggccccgcaagggtta

SEQ ID NO: 331650 - DNA, 20 bp, human
ggcgggagcagaggtaccca

SEQ ID NO: 331651 - DNA, 20 bp, human
gctctcccatcctcatctga

SEQ ID NO: 331652 - DNA, 20 bp, human
gaggccgggagatcttccta

SEQ ID NO: 331653 - DNA, 20 bp, human
gcctcccagcacccaacact

SEQ ID NO: 331654 - DNA, 20 bp, human
gcgggagatcttcctacggg

SEQ ID NO: 331655 - DNA, 20 bp, human
gaggcgtggccacacctccc

SEQ ID NO: 331656 - DNA, 20 bp, human
ggtacctggctccttctgat

SEQ ID NO: 331657 - DNA, 20 bp, human
ggccccgagcccttcttgat

SEQ ID NO: 331658 - DNA, 20 bp, human
gcgccaaggaccggggtccg

SEQ ID NO: 331659 - DNA, 20 bp, human
ggcgtcacacgctctctcct

SEQ ID NO: 331660 - DNA, 20 bp, human
gccttggcgccgtagtggtt

SEQ ID NO: 331661 - DNA, 20 bp, human
gcgcttcttccaatcaagaa

SEQ ID NO: 331662 - DNA, 20 bp, human
gtaggcgtgggggagaactg

SEQ ID NO: 331663 - DNA, 20 bp, human
gctcctggggtcgccgtacc

SEQ ID NO: 331664 - DNA, 20 bp, human
ggggctcaacctaaccacta

SEQ ID NO: 331665 - DNA, 20 bp, human
gcgcctcggaccccggtcct

SEQ ID NO: 331666 - DNA, 20 bp, human
gcgtgcgcgctgagacgcga

SEQ ID NO: 331667 - DNA, 20 bp, human
gggcatccgcgagctatcgg

SEQ ID NO: 331668 - DNA, 20 bp, human
gtggaccggcggctctcggt

SEQ ID NO: 331669 - DNA, 20 bp, human
gagctcgcggatgcccccgg

SEQ ID NO: 331670 - DNA, 20 bp, human
gctgagacgcgagggcttat

SEQ ID NO: 331671 - DNA, 20 bp, human
gcagcggcgacggccgtctc

SEQ ID NO: 331672 - DNA, 20 bp, human
gctatcggcggttggaccgg

SEQ ID NO: 331673 - DNA, 20 bp, human
gcgacggccgtctcaggaag

SEQ ID NO: 331674 - DNA, 20 bp, human
gtggccggcgtcgggccccc

SEQ ID NO: 331675 - DNA, 20 bp, human
ggcccagacggggacttcga

SEQ ID NO: 331676 - DNA, 20 bp, human
gcacactcacaaagcgggga

SEQ ID NO: 331677 - DNA, 20 bp, human
gcagtggcggggaccagtct

SEQ ID NO: 331678 - DNA, 20 bp, human
gtggcggggaccagtctggg

SEQ ID NO: 331679 - DNA, 20 bp, human
gaacgtgaatgaccttgcaa

SEQ ID NO: 331680 - DNA, 20 bp, human
ggtttcaggaggaatacggg

SEQ ID NO: 331681 - DNA, 20 bp, human
gtccccatgttgaaactcgt

SEQ ID NO: 331682 - DNA, 20 bp, human
gtgaaactcgtcggtggcgg

SEQ ID NO: 331683 - DNA, 20 bp, human
gtaagcacacactcacaaag

SEQ ID NO: 331684 - DNA, 20 bp, human
ggtctgggagagacagcgaa

SEQ ID NO: 331685 - DNA, 20 bp, human
gcaaaggtatcttgctcact

SEQ ID NO: 331686 - DNA, 20 bp, human
gtgaagaaacagcttctaat

SEQ ID NO: 331687 - DNA, 20 bp, human
gctattggagagcgcaagtc

SEQ ID NO: 331688 - DNA, 20 bp, human
gtctaataggctgtgatttt

SEQ ID NO: 331689 - DNA, 20 bp, human
gaatgagagggttttttggg

SEQ ID NO: 331690 - DNA, 20 bp, human
gcgcgctcagagaagcgaga

SEQ ID NO: 331691 - DNA, 20 bp, human
gccggcccacatggtatcag

SEQ ID NO: 331692 - DNA, 20 bp, human
gaataggctgtgattttggg

SEQ ID NO: 331693 - DNA, 20 bp, human
gaatagacccgagacgctgc

SEQ ID NO: 331694 - DNA, 20 bp, human
gcatgtgggccggaactatg

SEQ ID NO: 331695 - DNA, 20 bp, human
gaaagtgggcggcacaccga

SEQ ID NO: 331696 - DNA, 20 bp, human
gtgggactcggggtcgcccc

SEQ ID NO: 331697 - DNA, 20 bp, human
gcaaaggcctcgcgtccagt

SEQ ID NO: 331698 - DNA, 20 bp, human
gcagtcggctccctaactcg

SEQ ID NO: 331699 - DNA, 20 bp, human
gatagcctctcattggacgg

SEQ ID NO: 331700 - DNA, 20 bp, human
gagaggctatcgtgacgggg

SEQ ID NO: 331701 - DNA, 20 bp, human
ggtccccagcctcgtcggat

SEQ ID NO: 331702 - DNA, 20 bp, human
gcaatgagaggctatcgtga

SEQ ID NO: 331703 - DNA, 20 bp, human
gggggatccgggttccgcgg

SEQ ID NO: 331704 - DNA, 20 bp, human
ggcaggaagccaatccgacg

SEQ ID NO: 331705 - DNA, 20 bp, human
gtcggctccctaactcgagg

SEQ ID NO: 331706 - DNA, 20 bp, human
gagagcggggcctcacgaac

SEQ ID NO: 331707 - DNA, 20 bp, human
gtgcggaagctgaggggcct

SEQ ID NO: 331708 - DNA, 20 bp, human
gtgggcgtgctggggaagtc

SEQ ID NO: 331709 - DNA, 20 bp, human
gccagcgaggaggcgaccaa

SEQ ID NO: 331710 - DNA, 20 bp, human
gtcacgtgggcgttcggcct

SEQ ID NO: 331711 - DNA, 20 bp, human
gccgggcggaagcggagcga

SEQ ID NO: 331712 - DNA, 20 bp, human
gaccactctgaggcgatctg

SEQ ID NO: 331713 - DNA, 20 bp, human
ggcgatctgcggaagctgag

SEQ ID NO: 331714 - DNA, 20 bp, human
gtctctggctgtagttgtgc

SEQ ID NO: 331715 - DNA, 20 bp, human
gtccgcagatcgcctcagag

SEQ ID NO: 331716 - DNA, 20 bp, human
ggccctagctcgccctgtag

SEQ ID NO: 331717 - DNA, 20 bp, human
ggggcggcgggaaggacgaa

SEQ ID NO: 331718 - DNA, 20 bp, human
ggccgctacagggcgagcta

SEQ ID NO: 331719 - DNA, 20 bp, human
ggtagcggccgagacctcag

SEQ ID NO: 331720 - DNA, 20 bp, human
gccgagacctcagaggccgg

SEQ ID NO: 331721 - DNA, 20 bp, human
gtgctgggcaggggtccgag

SEQ ID NO: 331722 - DNA, 20 bp, human
gtgtgctgatgcgcgatctc

SEQ ID NO: 331723 - DNA, 20 bp, human
gcggcgggaaggacgaaggg

SEQ ID NO: 331724 - DNA, 20 bp, human
gcggccgagacctcagaggc

SEQ ID NO: 331725 - DNA, 20 bp, human
gttgcggaagatctcgtcgg

SEQ ID NO: 331726 - DNA, 20 bp, human
gcggggaaaccaagtaccca

SEQ ID NO: 331727 - DNA, 20 bp, human
ggacgtgaggagaatccggc

SEQ ID NO: 331728 - DNA, 20 bp, human
gcgggccactctctgacaaa

SEQ ID NO: 331729 - DNA, 20 bp, human
ggtggagcttccggaagacg

SEQ ID NO: 331730 - DNA, 20 bp, human
gtgagagggtggcgcggaaa

SEQ ID NO: 331731 - DNA, 20 bp, human
gcggaagacgcggtgacgcg

SEQ ID NO: 331732 - DNA, 20 bp, human
gccaggacgtgaggagaatc

SEQ ID NO: 331733 - DNA, 20 bp, human
gtcaccgtgttggaaatgtt

SEQ ID NO: 331734 - DNA, 20 bp, human
ggggaccagcagcgctactc

SEQ ID NO: 331735 - DNA, 20 bp, human
gtccaaaggtgccgctcagt

SEQ ID NO: 331736 - DNA, 20 bp, human
gaacgcggggtggctggcgg

SEQ ID NO: 331737 - DNA, 20 bp, human
gaccccgcgttcccaggaag

SEQ ID NO: 331738 - DNA, 20 bp, human
ggggccctgcgatgcgacgg

SEQ ID NO: 331739 - DNA, 20 bp, human
gccagccaccccgcgttccc

SEQ ID NO: 331740 - DNA, 20 bp, human
gcgcccgcgccgcatctgcg

SEQ ID NO: 331741 - DNA, 20 bp, human
gtccctcttcctgggaacgc

SEQ ID NO: 331742 - DNA, 20 bp, human
gcggtggcgacgtgaggact

SEQ ID NO: 331743 - DNA, 20 bp, human
gatgaccggtccctcttcct

SEQ ID NO: 331744 - DNA, 20 bp, human
ggtggggcggagccacgccg

SEQ ID NO: 331745 - DNA, 20 bp, human
gtcctcacgtcgccaccgag

SEQ ID NO: 331746 - DNA, 20 bp, human
ggagtccccacgacccagct

SEQ ID NO: 331747 - DNA, 20 bp, human
ggggacaaagactactatgt

SEQ ID NO: 331748 - DNA, 20 bp, human
gctccagcaaggacccgcta

SEQ ID NO: 331749 - DNA, 20 bp, human
gagcaatcccagctgggtcg

SEQ ID NO: 331750 - DNA, 20 bp, human
gccacacaaattacatggag

SEQ ID NO: 331751 - DNA, 20 bp, human
gccaggccctgctaattaga

SEQ ID NO: 331752 - DNA, 20 bp, human
gcccagcagagatatccata

SEQ ID NO: 331753 - DNA, 20 bp, human
ggttctctaaataactgccc

SEQ ID NO: 331754 - DNA, 20 bp, human
gagccttagcgggtccttgc

SEQ ID NO: 331755 - DNA, 20 bp, human
gtggaaaaaagaccatagtc

SEQ ID NO: 331756 - DNA, 20 bp, human
ggaggccgaggcgcactgtg

SEQ ID NO: 331757 - DNA, 20 bp, human
gagacccgagcccagtccgg

SEQ ID NO: 331758 - DNA, 20 bp, human
gcctccgcgagcctccggac

SEQ ID NO: 331759 - DNA, 20 bp, human
gggacccgcgtcgagtgcga

SEQ ID NO: 331760 - DNA, 20 bp, human
gactgggctcgggtctcaga

SEQ ID NO: 331761 - DNA, 20 bp, human
gcccgcgaggacaggcgtca

SEQ ID NO: 331762 - DNA, 20 bp, human
gcgcgcgagcgtccccatgg

SEQ ID NO: 331763 - DNA, 20 bp, human
ggggccagtgtctcctccaa

SEQ ID NO: 331764 - DNA, 20 bp, human
gggtctggagctctcggagg

SEQ ID NO: 331765 - DNA, 20 bp, human
gcgagccccacagtgcgcct

SEQ ID NO: 331766 - DNA, 20 bp, human
ggccagcacaagttgggaaa

SEQ ID NO: 331767 - DNA, 20 bp, human
gcaagcaaagcgctcatagg

SEQ ID NO: 331768 - DNA, 20 bp, human
gtcgccggagggccacttct

SEQ ID NO: 331769 - DNA, 20 bp, human
gcgctcataggcggggtggg

SEQ ID NO: 331770 - DNA, 20 bp, human
gtgcgcaggcgcaagacagc

SEQ ID NO: 331771 - DNA, 20 bp, human
gaagcgctcataggcggggt

SEQ ID NO: 331772 - DNA, 20 bp, human
gggttaggactgcactaaga

SEQ ID NO: 331773 - DNA, 20 bp, human
gcggaagaccgacgtgaccc

SEQ ID NO: 331774 - DNA, 20 bp, human
gtggagcaggcagtcgccgg

SEQ ID NO: 331775 - DNA, 20 bp, human
gcaagacagccggatttgaa

SEQ ID NO: 331776 - DNA, 20 bp, human
gggctgcgcgagaccctgca

SEQ ID NO: 331777 - DNA, 20 bp, human
gagcccgcgtcaggaccccg

SEQ ID NO: 331778 - DNA, 20 bp, human
gacgtcaggaagggttgcga

SEQ ID NO: 331779 - DNA, 20 bp, human
ggggcacacgtagccgtgca

SEQ ID NO: 331780 - DNA, 20 bp, human
gtgccccggggtcctgacgc

SEQ ID NO: 331781 - DNA, 20 bp, human
gatccggcggccacagggat

SEQ ID NO: 331782 - DNA, 20 bp, human
gccaccagaaaaagtgttat

SEQ ID NO: 331783 - DNA, 20 bp, human
gtgggaggggcgaggagcga

SEQ ID NO: 331784 - DNA, 20 bp, human
gcctgtggccgccggatccc

SEQ ID NO: 331785 - DNA, 20 bp, human
ggcaacccttcctgacgtct

SEQ ID NO: 331786 - DNA, 20 bp, human
gctgccccccgcgctgctga

SEQ ID NO: 331787 - DNA, 20 bp, human
gcggccgccgtgtccagcgc

SEQ ID NO: 331788 - DNA, 20 bp, human
gtcggtgcccgactccgcgt

SEQ ID NO: 331789 - DNA, 20 bp, human
gcccgactccgcgttggacg

SEQ ID NO: 331790 - DNA, 20 bp, human
gggcgagttgaggcagaaat

SEQ ID NO: 331791 - DNA, 20 bp, human
gcgcgcacggacggacggac

SEQ ID NO: 331792 - DNA, 20 bp, human
gcccgcgctgctgacggcgc

SEQ ID NO: 331793 - DNA, 20 bp, human
gcagatctgggagacctcgc

SEQ ID NO: 331794 - DNA, 20 bp, human
gggacgacgacgagcagccg

SEQ ID NO: 331795 - DNA, 20 bp, human
gtcctcgtccaacgcggagt

SEQ ID NO: 331796 - DNA, 20 bp, human
gcccgcgccacgccctggtg

SEQ ID NO: 331797 - DNA, 20 bp, human
gcgggaagggggacccagga

SEQ ID NO: 331798 - DNA, 20 bp, human
ggtacccaggtgtgcaggac

SEQ ID NO: 331799 - DNA, 20 bp, human
ggggccctggctgtctaggg

SEQ ID NO: 331800 - DNA, 20 bp, human
gccagggcgtggcgcgggaa

SEQ ID NO: 331801 - DNA, 20 bp, human
ggcgcccaggcaggaccggc

SEQ ID NO: 331802 - DNA, 20 bp, human
gcagcgaggctggaaaggtt

SEQ ID NO: 331803 - DNA, 20 bp, human
gaggtccggccggtcctgcc

SEQ ID NO: 331804 - DNA, 20 bp, human
gctgatgagtgggcgcctga

SEQ ID NO: 331805 - DNA, 20 bp, human
gcttctgaggaggggtcagt

SEQ ID NO: 331806 - DNA, 20 bp, human
ggcaacaccggtcaccacga

SEQ ID NO: 331807 - DNA, 20 bp, human
gtggaggccccgggcaacac

SEQ ID NO: 331808 - DNA, 20 bp, human
gacccacctccaatccccgt

SEQ ID NO: 331809 - DNA, 20 bp, human
gaggacagagcccttcgtag

SEQ ID NO: 331810 - DNA, 20 bp, human
gccggggcctccacccgctt

SEQ ID NO: 331811 - DNA, 20 bp, human
gaccacgagggcctctacga

SEQ ID NO: 331812 - DNA, 20 bp, human
gcccttcgtagaggccctcg

SEQ ID NO: 331813 - DNA, 20 bp, human
gtctgtcctcccacggggat

SEQ ID NO: 331814 - DNA, 20 bp, human
gtggtgaccggtgttgcccg

SEQ ID NO: 331815 - DNA, 20 bp, human
ggtcctcccacggggattgg

SEQ ID NO: 331816 - DNA, 20 bp, human
ggtacagtgtagtgtgctca

SEQ ID NO: 331817 - DNA, 20 bp, human
gctcaacatgtgagcaagaa

SEQ ID NO: 331818 - DNA, 20 bp, human
ggtgcgccgtgcagtgtgcg

SEQ ID NO: 331819 - DNA, 20 bp, human
gaacttctgccagttgcgga

SEQ ID NO: 331820 - DNA, 20 bp, human
gaaaagtgagtctaattact

SEQ ID NO: 331821 - DNA, 20 bp, human
gggaatggcccatccgcaac

SEQ ID NO: 331822 - DNA, 20 bp, human
gcatgtgcagtgtgcggggc

SEQ ID NO: 331823 - DNA, 20 bp, human
gaaagtgcatgtgcagtgtg

SEQ ID NO: 331824 - DNA, 20 bp, human
gctgcactgcatacacacgt

SEQ ID NO: 331825 - DNA, 20 bp, human
gacttgtttcagagttccag

SEQ ID NO: 331826 - DNA, 20 bp, human
ggtccgccgcgaagcctcac

SEQ ID NO: 331827 - DNA, 20 bp, human
gacgggaagcggagttccta

SEQ ID NO: 331828 - DNA, 20 bp, human
gcggcccggcaattaccccc

SEQ ID NO: 331829 - DNA, 20 bp, human
ggacccagggggtaattgcc

SEQ ID NO: 331830 - DNA, 20 bp, human
gttcccgtgaggcttcgcgg

SEQ ID NO: 331831 - DNA, 20 bp, human
gaagcggtgcctcgtggctt

SEQ ID NO: 331832 - DNA, 20 bp, human
gatggtggaagggaacgctc

SEQ ID NO: 331833 - DNA, 20 bp, human
ggcggacggcgctggtgcgc

SEQ ID NO: 331834 - DNA, 20 bp, human
gtcctctcacacttagcagt

SEQ ID NO: 331835 - DNA, 20 bp, human
gacccactgctaagtgtgag

SEQ ID NO: 331836 - DNA, 20 bp, human
ggggggctatacatgggggt

SEQ ID NO: 331837 - DNA, 20 bp, human
gtgcgcggggggctatacat

SEQ ID NO: 331838 - DNA, 20 bp, human
gtgggagtggggtcggacca

SEQ ID NO: 331839 - DNA, 20 bp, human
ggcgcccgcgcgtgtacggt

SEQ ID NO: 331840 - DNA, 20 bp, human
gtggggaccgctagactgat

SEQ ID NO: 331841 - DNA, 20 bp, human
gtgcacatctgcgatgtcaa

SEQ ID NO: 331842 - DNA, 20 bp, human
gagacgccgtagcgattcgg

SEQ ID NO: 331843 - DNA, 20 bp, human
ggattcacgttgttgatgac

SEQ ID NO: 331844 - DNA, 20 bp, human
ggcacccgccgccagcgcga

SEQ ID NO: 331845 - DNA, 20 bp, human
gatggcgccagacccctcag

SEQ ID NO: 331846 - DNA, 20 bp, human
ggggccccgcccacaagctc

SEQ ID NO: 331847 - DNA, 20 bp, human
gagggctctcagtataccgt

SEQ ID NO: 331848 - DNA, 20 bp, human
gtcccgggacctaaaggcag

SEQ ID NO: 331849 - DNA, 20 bp, human
gggagcctcccgggacctaa

SEQ ID NO: 331850 - DNA, 20 bp, human
gcccctctgcctttaggtcc

SEQ ID NO: 331851 - DNA, 20 bp, human
gagccctgagcttgtgggcg

SEQ ID NO: 331852 - DNA, 20 bp, human
gctgggaagcggcgccatat

SEQ ID NO: 331853 - DNA, 20 bp, human
gtccgcggtactgtcaatgc

SEQ ID NO: 331854 - DNA, 20 bp, human
gccacgccccctctgccttt

SEQ ID NO: 331855 - DNA, 20 bp, human
ggggtggtccagacctccag

SEQ ID NO: 331856 - DNA, 20 bp, human
gagagctgggaggaccgtaa

SEQ ID NO: 331857 - DNA, 20 bp, human
gaattgggaaggtggagcgc

SEQ ID NO: 331858 - DNA, 20 bp, human
gaacagggactcattcaatt

SEQ ID NO: 331859 - DNA, 20 bp, human
ggatccccgcagttttaaca

SEQ ID NO: 331860 - DNA, 20 bp, human
gactcattcaattgggaagg

SEQ ID NO: 331861 - DNA, 20 bp, human
ggctgtggcttgtgttataa

SEQ ID NO: 331862 - DNA, 20 bp, human
gttgagcaggaatgagagct

SEQ ID NO: 331863 - DNA, 20 bp, human
gtgagtccctgttaaaactg

SEQ ID NO: 331864 - DNA, 20 bp, human
gctaatcaatcagtttggag

SEQ ID NO: 331865 - DNA, 20 bp, human
gagcaggaatgagagctggg

SEQ ID NO: 331866 - DNA, 20 bp, human
gcggactatcacggcactgg

SEQ ID NO: 331867 - DNA, 20 bp, human
gagtccgggaacacccaaat

SEQ ID NO: 331868 - DNA, 20 bp, human
ggggtgttcccggactatca

SEQ ID NO: 331869 - DNA, 20 bp, human
gtcccggactatcacggcac

SEQ ID NO: 331870 - DNA, 20 bp, human
gggtaatactgggtggtagc

SEQ ID NO: 331871 - DNA, 20 bp, human
ggatcctgaaaaccagatgt

SEQ ID NO: 331872 - DNA, 20 bp, human
gacaccaatttgggtgttcc

SEQ ID NO: 331873 - DNA, 20 bp, human
gaccaagtggtaatactggg

SEQ ID NO: 331874 - DNA, 20 bp, human
ggtcaaatccagcaccattt

SEQ ID NO: 331875 - DNA, 20 bp, human
gaggaccaagtggtaatact

SEQ ID NO: 331876 - DNA, 20 bp, human
gcgcatgcgccgcgcaaccc

SEQ ID NO: 331877 - DNA, 20 bp, human
gcgcgcctcggaaatgggtc

SEQ ID NO: 331878 - DNA, 20 bp, human
gggaaatgggtccggggcag

SEQ ID NO: 331879 - DNA, 20 bp, human
ggcaacccaggccacgagca

SEQ ID NO: 331880 - DNA, 20 bp, human
gtctacctccggttctatcc

SEQ ID NO: 331881 - DNA, 20 bp, human
gcgaaacgccgggatagaac

SEQ ID NO: 331882 - DNA, 20 bp, human
gaacgccgggatagaaccgg

SEQ ID NO: 331883 - DNA, 20 bp, human
ggtccggggcagaggtctgt

SEQ ID NO: 331884 - DNA, 20 bp, human
ggtggggaagggcgaaacgc

SEQ ID NO: 331885 - DNA, 20 bp, human
gtcagcgctcgcgccggcgc

SEQ ID NO: 331886 - DNA, 20 bp, human
ggctccgccagccccggtcc

SEQ ID NO: 331887 - DNA, 20 bp, human
gagcgcgcgcccgcgagtag

SEQ ID NO: 331888 - DNA, 20 bp, human
ggctgcttgcggaaccgacg

SEQ ID NO: 331889 - DNA, 20 bp, human
ggaccccgcctaggcggcgg

SEQ ID NO: 331890 - DNA, 20 bp, human
gcgggccggggaccccgcct

SEQ ID NO: 331891 - DNA, 20 bp, human
gccgctgcaaggtctcgccc

SEQ ID NO: 331892 - DNA, 20 bp, human
ggcgagaccttgcagcggag

SEQ ID NO: 331893 - DNA, 20 bp, human
gccggccgccgccgcctagg

SEQ ID NO: 331894 - DNA, 20 bp, human
gcgcgcccgcgagtaggggc

SEQ ID NO: 331895 - DNA, 20 bp, human
gtgaccccaggccgcgtgcc

SEQ ID NO: 331896 - DNA, 20 bp, human
ggtgctcgagcgtgcgctgg

SEQ ID NO: 331897 - DNA, 20 bp, human
ggcgcacgctcgagcacacc

SEQ ID NO: 331898 - DNA, 20 bp, human
gaccctgcccctcccagcta

SEQ ID NO: 331899 - DNA, 20 bp, human
gggcgcgctgacgtcagagg

SEQ ID NO: 331900 - DNA, 20 bp, human
gcccctcccagctagggctg

SEQ ID NO: 331901 - DNA, 20 bp, human
gcgcggcgcgctgacgtcag

SEQ ID NO: 331902 - DNA, 20 bp, human
gcacagcgtgagagacgccc

SEQ ID NO: 331903 - DNA, 20 bp, human
gctcgagcgtgcgctggcgg

SEQ ID NO: 331904 - DNA, 20 bp, human
gccgcccctcagccctagct

SEQ ID NO: 331905 - DNA, 20 bp, human
ggccgaaagcacagagctac

SEQ ID NO: 331906 - DNA, 20 bp, human
gggagcgcgcacactatgct

SEQ ID NO: 331907 - DNA, 20 bp, human
gcacactatgctaggaggcg

SEQ ID NO: 331908 - DNA, 20 bp, human
gcggcgcagcgagagccaat

SEQ ID NO: 331909 - DNA, 20 bp, human
gcgcgccgggctcctgacgt

SEQ ID NO: 331910 - DNA, 20 bp, human
gcccgcaggacccagaacgt

SEQ ID NO: 331911 - DNA, 20 bp, human
gcggcgggaactaggagcct

SEQ ID NO: 331912 - DNA, 20 bp, human
gccaatgggcgtggccggcg

SEQ ID NO: 331913 - DNA, 20 bp, human
gagcccggcgcgcgaaacgc

SEQ ID NO: 331914 - DNA, 20 bp, human
gggctgcgctagagtgaccc

SEQ ID NO: 331915 - DNA, 20 bp, human
gtagccctaccctgcagacg

SEQ ID NO: 331916 - DNA, 20 bp, human
ggaatggggtggcgagtctt

SEQ ID NO: 331917 - DNA, 20 bp, human
ggggaggagccgagggccgt

SEQ ID NO: 331918 - DNA, 20 bp, human
ggacgggcggggaccggcat

SEQ ID NO: 331919 - DNA, 20 bp, human
gatcacgtgccaccgaccct

SEQ ID NO: 331920 - DNA, 20 bp, human
gccgcgcgggaggggacggg

SEQ ID NO: 331921 - DNA, 20 bp, human
gcacctcaggctgtggaatg

SEQ ID NO: 331922 - DNA, 20 bp, human
gtacatgggccctaggagaa

SEQ ID NO: 331923 - DNA, 20 bp, human
gcaccccaggagccgaaggc

SEQ ID NO: 331924 - DNA, 20 bp, human
ggggtggtgcccacggccct

SEQ ID NO: 331925 - DNA, 20 bp, human
ggtaggcgcggcgacccgca

SEQ ID NO: 331926 - DNA, 20 bp, human
gccaaactccctgtgctgac

SEQ ID NO: 331927 - DNA, 20 bp, human
gagtgagctgcctgctaatg

SEQ ID NO: 331928 - DNA, 20 bp, human
gtgactggctagaacagggt

SEQ ID NO: 331929 - DNA, 20 bp, human
gcagggagtttgggtcgtgc

SEQ ID NO: 331930 - DNA, 20 bp, human
ggtggcccagccccattagc

SEQ ID NO: 331931 - DNA, 20 bp, human
gcggggagtggggagacaaa

SEQ ID NO: 331932 - DNA, 20 bp, human
gagaacagggtaggggccca

SEQ ID NO: 331933 - DNA, 20 bp, human
gtgctgggagaacctggaac

SEQ ID NO: 331934 - DNA, 20 bp, human
ggaacactgctctgagtcgc

SEQ ID NO: 331935 - DNA, 20 bp, human
gtgtgctgactggctagaac

SEQ ID NO: 331936 - DNA, 20 bp, human
gggtagcccgcatagatgta

SEQ ID NO: 331937 - DNA, 20 bp, human
gctggctgcagagatagctg

SEQ ID NO: 331938 - DNA, 20 bp, human
gggaagccgtacatctatgc

SEQ ID NO: 331939 - DNA, 20 bp, human
gccgcagactcggcaggagg

SEQ ID NO: 331940 - DNA, 20 bp, human
gccccccagctgctgctcgt

SEQ ID NO: 331941 - DNA, 20 bp, human
gagcgccaggtctgatgcag

SEQ ID NO: 331942 - DNA, 20 bp, human
gccagagcctgtcttcacgg

SEQ ID NO: 331943 - DNA, 20 bp, human
gaggtgggtccagacattca

SEQ ID NO: 331944 - DNA, 20 bp, human
gataaggctgtcggagagga

SEQ ID NO: 331945 - DNA, 20 bp, human
gagtctgcggcaggtcatcc

SEQ ID NO: 331946 - DNA, 20 bp, human
gccgcccccgggtcgggaag

SEQ ID NO: 331947 - DNA, 20 bp, human
gggtctgcgcatcccgcccc

SEQ ID NO: 331948 - DNA, 20 bp, human
gcagctaccagggactgcga

SEQ ID NO: 331949 - DNA, 20 bp, human
gactgcgagggtctgcgtcc

SEQ ID NO: 331950 - DNA, 20 bp, human
gccgccccttcccgacccgg

SEQ ID NO: 331951 - DNA, 20 bp, human
ggggaggaggagaccgccgg

SEQ ID NO: 331952 - DNA, 20 bp, human
gacgccgcttccttccaccc

SEQ ID NO: 331953 - DNA, 20 bp, human
gtcttgggcgggtgtatctt

SEQ ID NO: 331954 - DNA, 20 bp, human
gttccgaagtccctcgggaa

SEQ ID NO: 331955 - DNA, 20 bp, human
gcgcatcccgcccccgggtc

SEQ ID NO: 331956 - DNA, 20 bp, human
gggtacggaactcgagacag

SEQ ID NO: 331957 - DNA, 20 bp, human
gggacgggcgcaccgaggaa

SEQ ID NO: 331958 - DNA, 20 bp, human
gcggccgcgaaaccctagcc

SEQ ID NO: 331959 - DNA, 20 bp, human
gcccgaggagggggatggta

SEQ ID NO: 331960 - DNA, 20 bp, human
gccgccgcccccggagcggg

SEQ ID NO: 331961 - DNA, 20 bp, human
gggaggcccccgcccttcct

SEQ ID NO: 331962 - DNA, 20 bp, human
gcccccgcatcaatcattaa

SEQ ID NO: 331963 - DNA, 20 bp, human
gacaactctatcccccgaag

SEQ ID NO: 331964 - DNA, 20 bp, human
ggtgcgagccgaggcgcgga

SEQ ID NO: 331965 - DNA, 20 bp, human
gtagggtttcgcggccgctt

SEQ ID NO: 331966 - DNA, 20 bp, human
gcgtgctggcactggggcga

SEQ ID NO: 331967 - DNA, 20 bp, human
gtccccctgccgcatgtgcg

SEQ ID NO: 331968 - DNA, 20 bp, human
ggcgcggccggctacccgcg

SEQ ID NO: 331969 - DNA, 20 bp, human
gacaccgcgcacatgcggca

SEQ ID NO: 331970 - DNA, 20 bp, human
gaaggggcgtccccgaggag

SEQ ID NO: 331971 - DNA, 20 bp, human
gtccgccccgcgcgggtagc

SEQ ID NO: 331972 - DNA, 20 bp, human
gtgcaggctcgagtccccgc

SEQ ID NO: 331973 - DNA, 20 bp, human
gggcccccgagggcggtggc

SEQ ID NO: 331974 - DNA, 20 bp, human
gaggggcgacgcagccctgc

SEQ ID NO: 331975 - DNA, 20 bp, human
gggtcggcccccgagggcgg

SEQ ID NO: 331976 - DNA, 20 bp, human
ggtgacgagacgaggctccc

SEQ ID NO: 331977 - DNA, 20 bp, human
gagacccaggtgacgagacg

SEQ ID NO: 331978 - DNA, 20 bp, human
ggagctctggggagttgtaa

SEQ ID NO: 331979 - DNA, 20 bp, human
ggggccagtaactggagccc

SEQ ID NO: 331980 - DNA, 20 bp, human
ggagcctcgtctcgtcacct

SEQ ID NO: 331981 - DNA, 20 bp, human
gaacacccgagggaagagcg

SEQ ID NO: 331982 - DNA, 20 bp, human
ggctcccgggctccagttac

SEQ ID NO: 331983 - DNA, 20 bp, human
ggcagagctgcgcccttcac

SEQ ID NO: 331984 - DNA, 20 bp, human
gttactggcccgcagggccg

SEQ ID NO: 331985 - DNA, 20 bp, human
gtctcagaaagaacacccga

SEQ ID NO: 331986 - DNA, 20 bp, human
gcgtgatgacgcaagagcgg

SEQ ID NO: 331987 - DNA, 20 bp, human
gcgcgcgcccccggagtctg

SEQ ID NO: 331988 - DNA, 20 bp, human
gccggagcgtgacgtcaagg

SEQ ID NO: 331989 - DNA, 20 bp, human
gagggctccgccaatccgag

SEQ ID NO: 331990 - DNA, 20 bp, human
ggctccgccaatccgagggg

SEQ ID NO: 331991 - DNA, 20 bp, human
gccctgctccccagactccg

SEQ ID NO: 331992 - DNA, 20 bp, human
gaacggagccgtggatggag

SEQ ID NO: 331993 - DNA, 20 bp, human
ggggtcacacggtgctgaaa

SEQ ID NO: 331994 - DNA, 20 bp, human
gctcttgcgtcatcacgctg

SEQ ID NO: 331995 - DNA, 20 bp, human
gtaggaaacggagccgtgga

SEQ ID NO: 331996 - DNA, 20 bp, human
ggggtgtgggcggaacgcga

SEQ ID NO: 331997 - DNA, 20 bp, human
gagggattgcggcatcttcg

SEQ ID NO: 331998 - DNA, 20 bp, human
gcaggtgcgcgctttctatt

SEQ ID NO: 331999 - DNA, 20 bp, human
gccgcggctgtggtccgctc

SEQ ID NO: 332000 - DNA, 20 bp, human
gtgcgcgcgcgcgggctcgc

SEQ ID NO: 332001 - DNA, 20 bp, human
gcacgcctcgcgcggtgcgt

SEQ ID NO: 332002 - DNA, 20 bp, human
ggcgcgaggcgtgtatcgat

SEQ ID NO: 332003 - DNA, 20 bp, human
gggtcctgcgctacgaggga

SEQ ID NO: 332004 - DNA, 20 bp, human
ggcctcgcgcggtgcgtggg

SEQ ID NO: 332005 - DNA, 20 bp, human
gtagcgcaggaccaatcgtg

SEQ ID NO: 332006 - DNA, 20 bp, human
ggggctgtgggcggggatat

SEQ ID NO: 332007 - DNA, 20 bp, human
ggatatgggcgggtcctccg

SEQ ID NO: 332008 - DNA, 20 bp, human
gtgtgggcggggatatgggc

SEQ ID NO: 332009 - DNA, 20 bp, human
gacgcggagctgcagcgtgg

SEQ ID NO: 332010 - DNA, 20 bp, human
gacccactggcgatccgacg

SEQ ID NO: 332011 - DNA, 20 bp, human
gggcgcgggcgccgggaggt

SEQ ID NO: 332012 - DNA, 20 bp, human
gcgtgggggcgtggtgtggc

SEQ ID NO: 332013 - DNA, 20 bp, human
gcctggggaaaggagcatcg

SEQ ID NO: 332014 - DNA, 20 bp, human
gaaaacgagacgccttgggc

SEQ ID NO: 332015 - DNA, 20 bp, human
gcgtggtgtggcgggtcctc

SEQ ID NO: 332016 - DNA, 20 bp, human
ggaaggattcctaggggata

SEQ ID NO: 332017 - DNA, 20 bp, human
gttctagctccatatcccct

SEQ ID NO: 332018 - DNA, 20 bp, human
gcttggacctggttgaatgg

SEQ ID NO: 332019 - DNA, 20 bp, human
gatatctggtgacttggacc

SEQ ID NO: 332020 - DNA, 20 bp, human
gggcaaggaaggattcctag

SEQ ID NO: 332021 - DNA, 20 bp, human
gaggaatgggaagaactgaa

SEQ ID NO: 332022 - DNA, 20 bp, human
ggtaaaagctgaggcaagga

SEQ ID NO: 332023 - DNA, 20 bp, human
gacctggttgaatggaggtg

SEQ ID NO: 332024 - DNA, 20 bp, human
gacacttagaatcagagtat

SEQ ID NO: 332025 - DNA, 20 bp, human
gtcctcacctccattcaacc

SEQ ID NO: 332026 - DNA, 20 bp, human
gagcgactggtcaacacggc

SEQ ID NO: 332027 - DNA, 20 bp, human
ggctgggcctgaagccggaa

SEQ ID NO: 332028 - DNA, 20 bp, human
gcaaccgggaggcttacctt

SEQ ID NO: 332029 - DNA, 20 bp, human
ggaagggagctggaccctag

SEQ ID NO: 332030 - DNA, 20 bp, human
gggagctggaccctaggggc

SEQ ID NO: 332031 - DNA, 20 bp, human
gcccagcaatcttacgtcac

SEQ ID NO: 332032 - DNA, 20 bp, human
gcccggtgacgtaagattgc

SEQ ID NO: 332033 - DNA, 20 bp, human
gggcctgaagccggaaaggg

SEQ ID NO: 332034 - DNA, 20 bp, human
gtcaacctgggcactacgag

SEQ ID NO: 332035 - DNA, 20 bp, human
gtcaacccctcgtagtgccc

SEQ ID NO: 332036 - DNA, 20 bp, human
gccacccccgcctcagtccg

SEQ ID NO: 332037 - DNA, 20 bp, human
gggactgtgccattcgtggg

SEQ ID NO: 332038 - DNA, 20 bp, human
gctacctcggactgaggcgg

SEQ ID NO: 332039 - DNA, 20 bp, human
ggcaccggggagtttctagc

SEQ ID NO: 332040 - DNA, 20 bp, human
ggtgacgcagcgtgaggcca

SEQ ID NO: 332041 - DNA, 20 bp, human
gcgtgagtctgcgcagtgtg

SEQ ID NO: 332042 - DNA, 20 bp, human
gtggaactgccgagggactg

SEQ ID NO: 332043 - DNA, 20 bp, human
gggaccgagccgcctcaccc

SEQ ID NO: 332044 - DNA, 20 bp, human
gtgtccagctagaaactccc

SEQ ID NO: 332045 - DNA, 20 bp, human
gagtccgaggtagactcggc

SEQ ID NO: 332046 - DNA, 20 bp, human
ggggcgccagccagtcgtcc

SEQ ID NO: 332047 - DNA, 20 bp, human
gccgaaccagccacggtgcc

SEQ ID NO: 332048 - DNA, 20 bp, human
ggatggggccagagcgaaga

SEQ ID NO: 332049 - DNA, 20 bp, human
gagtctagagcgcccccgcg

SEQ ID NO: 332050 - DNA, 20 bp, human
ggccacggtgcccggacgac

SEQ ID NO: 332051 - DNA, 20 bp, human
gcactctcgcaggtcgctcc

SEQ ID NO: 332052 - DNA, 20 bp, human
gcagctggggttggtaaggt

SEQ ID NO: 332053 - DNA, 20 bp, human
gggaagtagttgcgcagctg

SEQ ID NO: 332054 - DNA, 20 bp, human
ggccagtcgtccgggcaccg

SEQ ID NO: 332055 - DNA, 20 bp, human
ggcgacctgcgagagtggcc

SEQ ID NO: 332056 - DNA, 20 bp, human
gccggggctctcgggacctg

SEQ ID NO: 332057 - DNA, 20 bp, human
gccgcggggcccgggtggga

SEQ ID NO: 332058 - DNA, 20 bp, human
gcaaacatttgctgaaccca

SEQ ID NO: 332059 - DNA, 20 bp, human
gcgggccccgcggcgatgac

SEQ ID NO: 332060 - DNA, 20 bp, human
gtgtcttgactgtccagcag

SEQ ID NO: 332061 - DNA, 20 bp, human
gggtggcccagtcatcgccg

SEQ ID NO: 332062 - DNA, 20 bp, human
gagtcaagacacgagaccct

SEQ ID NO: 332063 - DNA, 20 bp, human
ggtccagcagaggccgctct

SEQ ID NO: 332064 - DNA, 20 bp, human
gcgatgactgggccaccccc

SEQ ID NO: 332065 - DNA, 20 bp, human
gccgggtttaatgtggatga

SEQ ID NO: 332066 - DNA, 20 bp, human
gaaacccagtcagtatttcc

SEQ ID NO: 332067 - DNA, 20 bp, human
gtctcgacatccagtcgacc

SEQ ID NO: 332068 - DNA, 20 bp, human
ggtggctatcgaagtcccca

SEQ ID NO: 332069 - DNA, 20 bp, human
gtcccctgtccctataagga

SEQ ID NO: 332070 - DNA, 20 bp, human
gtgtccctataaggagggaa

SEQ ID NO: 332071 - DNA, 20 bp, human
gcgaccaggaaatactgact

SEQ ID NO: 332072 - DNA, 20 bp, human
ggcggccggcgtcaccgctg

SEQ ID NO: 332073 - DNA, 20 bp, human
ggtgaaagcccgcacaaatt

SEQ ID NO: 332074 - DNA, 20 bp, human
gatgctagccactcttacag

SEQ ID NO: 332075 - DNA, 20 bp, human
gcaaattaggccacgccttg

SEQ ID NO: 332076 - DNA, 20 bp, human
gaacccgcgtccacggggcg

SEQ ID NO: 332077 - DNA, 20 bp, human
gggccccgccccgtggacgc

SEQ ID NO: 332078 - DNA, 20 bp, human
gtgggacagaacaatcaaag

SEQ ID NO: 332079 - DNA, 20 bp, human
gcccacggaacccgcgtcca

SEQ ID NO: 332080 - DNA, 20 bp, human
gctgccgggtggagctctgc

SEQ ID NO: 332081 - DNA, 20 bp, human
gcggcccgcagagctccacc

SEQ ID NO: 332082 - DNA, 20 bp, human
ggctctgcgggccgctgccc

SEQ ID NO: 332083 - DNA, 20 bp, human
gtgagctagtagctctttgg

SEQ ID NO: 332084 - DNA, 20 bp, human
ggacagaacaatcaaagggg

SEQ ID NO: 332085 - DNA, 20 bp, human
gacaatcaaaggggtggcgc

SEQ ID NO: 332086 - DNA, 20 bp, human
ggaaactgaaagacggaagg

SEQ ID NO: 332087 - DNA, 20 bp, human
gtgaccaggaggtattggcc

SEQ ID NO: 332088 - DNA, 20 bp, human
ggccccttggtgggtttagt

SEQ ID NO: 332089 - DNA, 20 bp, human
gaatacctcctggtcagctg

SEQ ID NO: 332090 - DNA, 20 bp, human
gtgggccaggtagggccggt

SEQ ID NO: 332091 - DNA, 20 bp, human
gcagcctggccaatacctcc

SEQ ID NO: 332092 - DNA, 20 bp, human
gcatctgagccccagtaccc

SEQ ID NO: 332093 - DNA, 20 bp, human
gggtcctgaggggtccagcc

SEQ ID NO: 332094 - DNA, 20 bp, human
gctgtctaccctgccaacca

SEQ ID NO: 332095 - DNA, 20 bp, human
gccagcccaccggccctacc

SEQ ID NO: 332096 - DNA, 20 bp, human
ggggcgagcttgtaggagtg

SEQ ID NO: 332097 - DNA, 20 bp, human
gcgggcggtcgtcctgggcg

SEQ ID NO: 332098 - DNA, 20 bp, human
gcgtatggataagcgtgcag

SEQ ID NO: 332099 - DNA, 20 bp, human
ggcgcgcgggcggtcgtcct

SEQ ID NO: 332100 - DNA, 20 bp, human
gacgaccgcccgcgcgcgta

SEQ ID NO: 332101 - DNA, 20 bp, human
gcgagcttgtaggagtgggg

SEQ ID NO: 332102 - DNA, 20 bp, human
gtggataagcgtgcaggggc

SEQ ID NO: 332103 - DNA, 20 bp, human
gtaaacgctggcttgtgaca

SEQ ID NO: 332104 - DNA, 20 bp, human
ggcgagtctgtgtctgacga

SEQ ID NO: 332105 - DNA, 20 bp, human
gaggggcggggcgagcttgt

SEQ ID NO: 332106 - DNA, 20 bp, human
ggggcggcggcctcacagct

SEQ ID NO: 332107 - DNA, 20 bp, human
ggggcgtggcgagggcgcac

SEQ ID NO: 332108 - DNA, 20 bp, human
gctggcgggcggctctcgca

SEQ ID NO: 332109 - DNA, 20 bp, human
gtggcccaggccggcgtcgt

SEQ ID NO: 332110 - DNA, 20 bp, human
gcgccgcccgacggaagctc

SEQ ID NO: 332111 - DNA, 20 bp, human
gtggctgtggcggctcgcgg

SEQ ID NO: 332112 - DNA, 20 bp, human
gcacaggttctgtttttcgc

SEQ ID NO: 332113 - DNA, 20 bp, human
gctgggggccctgaggcgga

SEQ ID NO: 332114 - DNA, 20 bp, human
ggagctcccgagcttccgtc

SEQ ID NO: 332115 - DNA, 20 bp, human
gcggctgcgccttccgcctc

SEQ ID NO: 332116 - DNA, 20 bp, human
gcgccgctggccagccccaa

SEQ ID NO: 332117 - DNA, 20 bp, human
gagggggcccggagttagga

SEQ ID NO: 332118 - DNA, 20 bp, human
gtgtgggccgaatgcgaagg

SEQ ID NO: 332119 - DNA, 20 bp, human
gggctgtgggccgaatgcga

SEQ ID NO: 332120 - DNA, 20 bp, human
ggtgttaggctgaaggcaaa

SEQ ID NO: 332121 - DNA, 20 bp, human
gcagccccaaagggttactt

SEQ ID NO: 332122 - DNA, 20 bp, human
gtggggcgagcggcaggtag

SEQ ID NO: 332123 - DNA, 20 bp, human
gtgaactgaggccgccttcc

SEQ ID NO: 332124 - DNA, 20 bp, human
ggggctggccagcggcgccc

SEQ ID NO: 332125 - DNA, 20 bp, human
gaagctgccgacttgatctg

SEQ ID NO: 332126 - DNA, 20 bp, human
ggtacagatgctattgactg

SEQ ID NO: 332127 - DNA, 20 bp, human
ggcagtaacgtctgtcccaa

SEQ ID NO: 332128 - DNA, 20 bp, human
ggtgggatgcccaacagaaa

SEQ ID NO: 332129 - DNA, 20 bp, human
gtgggtgtgtagggagaatt

SEQ ID NO: 332130 - DNA, 20 bp, human
gtcgaggcctcaatctttga

SEQ ID NO: 332131 - DNA, 20 bp, human
gttactgccagacaaatcct

SEQ ID NO: 332132 - DNA, 20 bp, human
gatgcccaacagaaaaggaa

SEQ ID NO: 332133 - DNA, 20 bp, human
ggggaacctgactccagccc

SEQ ID NO: 332134 - DNA, 20 bp, human
gtcaggattgtgtcgccctt

SEQ ID NO: 332135 - DNA, 20 bp, human
gccgcttccgtcaaagattg

SEQ ID NO: 332136 - DNA, 20 bp, human
gcggaagacaggtggcgccg

SEQ ID NO: 332137 - DNA, 20 bp, human
gaggctcagtccgcagagct

SEQ ID NO: 332138 - DNA, 20 bp, human
gaaggggcgggccctcggct

SEQ ID NO: 332139 - DNA, 20 bp, human
gacaacccgtacggtggagc

SEQ ID NO: 332140 - DNA, 20 bp, human
gggggcgggcacaacccgta

SEQ ID NO: 332141 - DNA, 20 bp, human
gtggctggggcgcgaagggg

SEQ ID NO: 332142 - DNA, 20 bp, human
gccagccagctccaccgtac

SEQ ID NO: 332143 - DNA, 20 bp, human
gtgagctgcaggcggaagac

SEQ ID NO: 332144 - DNA, 20 bp, human
ggagctggctggggcgcgaa

SEQ ID NO: 332145 - DNA, 20 bp, human
ggatcggggtctgggagggg

SEQ ID NO: 332146 - DNA, 20 bp, human
gtaccctgcccacccgccat

SEQ ID NO: 332147 - DNA, 20 bp, human
gagggggcggcacttgtccg

SEQ ID NO: 332148 - DNA, 20 bp, human
gccagctgggttccggagtg

SEQ ID NO: 332149 - DNA, 20 bp, human
ggggcggcacttgtccgtgg

SEQ ID NO: 332150 - DNA, 20 bp, human
gctgggttccggagtgtggt

SEQ ID NO: 332151 - DNA, 20 bp, human
gagcccatggcgggtgggca

SEQ ID NO: 332152 - DNA, 20 bp, human
ggggtgggcagggtaggctc

SEQ ID NO: 332153 - DNA, 20 bp, human
ggtccagtggatcctccact

SEQ ID NO: 332154 - DNA, 20 bp, human
gcacttgtccgtggaggctc

SEQ ID NO: 332155 - DNA, 20 bp, human
gcgcagaagcccatggcggg

SEQ ID NO: 332156 - DNA, 20 bp, human
ggccagaggcggccctaaca

SEQ ID NO: 332157 - DNA, 20 bp, human
gcggagggaagctcatcagt

SEQ ID NO: 332158 - DNA, 20 bp, human
gggcccgcgattccttggag

SEQ ID NO: 332159 - DNA, 20 bp, human
gttcccaagggacatgggag

SEQ ID NO: 332160 - DNA, 20 bp, human
ggctccgcgcgaggtcagac

SEQ ID NO: 332161 - DNA, 20 bp, human
ggagcttccctccgccctat

SEQ ID NO: 332162 - DNA, 20 bp, human
ggaggtgaggtaccccgcag

SEQ ID NO: 332163 - DNA, 20 bp, human
gctagtctcagaccttccca

SEQ ID NO: 332164 - DNA, 20 bp, human
gagcgcgcgtgcgccctggc

SEQ ID NO: 332165 - DNA, 20 bp, human
gtggaccccgcccttcgggg

SEQ ID NO: 332166 - DNA, 20 bp, human
ggggctgcttggatccccgt

SEQ ID NO: 332167 - DNA, 20 bp, human
gcgaaagggcgccgcgtctc

SEQ ID NO: 332168 - DNA, 20 bp, human
gtgctggcccacttcgaagt

SEQ ID NO: 332169 - DNA, 20 bp, human
gggagcctaggaacttcagg

SEQ ID NO: 332170 - DNA, 20 bp, human
gcggcccggcaaccatgcca

SEQ ID NO: 332171 - DNA, 20 bp, human
gcggaagcgccgtggagatg

SEQ ID NO: 332172 - DNA, 20 bp, human
gtaggaagcccgcatctcca

SEQ ID NO: 332173 - DNA, 20 bp, human
gtggcgccccccagcggcca

SEQ ID NO: 332174 - DNA, 20 bp, human
gcttgctccgacttcgaagt

SEQ ID NO: 332175 - DNA, 20 bp, human
ggggccgagtcaccgagcta

SEQ ID NO: 332176 - DNA, 20 bp, human
ggggcgcagcgtcccaagca

SEQ ID NO: 332177 - DNA, 20 bp, human
ggccggaacgcgcccggaat

SEQ ID NO: 332178 - DNA, 20 bp, human
gcccaagcagggacgatagc

SEQ ID NO: 332179 - DNA, 20 bp, human
ggaatcgggtccgccaggtg

SEQ ID NO: 332180 - DNA, 20 bp, human
gctgaaagccctgaaccctc

SEQ ID NO: 332181 - DNA, 20 bp, human
gacgctgcgcccgcctggtg

SEQ ID NO: 332182 - DNA, 20 bp, human
ggcccggaatcgggtccgcc

SEQ ID NO: 332183 - DNA, 20 bp, human
gtgaaccctccggctgatct

SEQ ID NO: 332184 - DNA, 20 bp, human
gacgatagccggaacgcgcc

SEQ ID NO: 332185 - DNA, 20 bp, human
gtgggcgggcgccactgcgc

SEQ ID NO: 332186 - DNA, 20 bp, human
gtccatctctccagaggaaa

SEQ ID NO: 332187 - DNA, 20 bp, human
ggaaagggcattgagagtag

SEQ ID NO: 332188 - DNA, 20 bp, human
gggtgggttatggaattcac

SEQ ID NO: 332189 - DNA, 20 bp, human
gctctcaatgccctttcctc

SEQ ID NO: 332190 - DNA, 20 bp, human
gaggtcgaccaatttgctta

SEQ ID NO: 332191 - DNA, 20 bp, human
gttgaattaggccacgtttc

SEQ ID NO: 332192 - DNA, 20 bp, human
gggccctttcaaaagaagtt

SEQ ID NO: 332193 - DNA, 20 bp, human
gttaaggttaggagtacaga

SEQ ID NO: 332194 - DNA, 20 bp, human
gttaccggctttttcaaacc

SEQ ID NO: 332195 - DNA, 20 bp, human
gcagcctggtttgaaaaagc

SEQ ID NO: 332196 - DNA, 20 bp, human
gggccggcggggtgactagg

SEQ ID NO: 332197 - DNA, 20 bp, human
gcagctgggcggtcacatct

SEQ ID NO: 332198 - DNA, 20 bp, human
gaagcggctcccgcccggga

SEQ ID NO: 332199 - DNA, 20 bp, human
gcgcggccggcggggtgact

SEQ ID NO: 332200 - DNA, 20 bp, human
gggcggggtgactaggcggc

SEQ ID NO: 332201 - DNA, 20 bp, human
gagcggtcgtgaagactccc

SEQ ID NO: 332202 - DNA, 20 bp, human
ggagtattagccatcccggg

SEQ ID NO: 332203 - DNA, 20 bp, human
ggcagagtattagccatccc

SEQ ID NO: 332204 - DNA, 20 bp, human
gggccggcgtgcgagccgtg

SEQ ID NO: 332205 - DNA, 20 bp, human
gcacgtctggagtaatttta

SEQ ID NO: 332206 - DNA, 20 bp, human
gaggccatggctctgcgcgt

SEQ ID NO: 332207 - DNA, 20 bp, human
ggctctgccgggaacaggga

SEQ ID NO: 332208 - DNA, 20 bp, human
gggaggcagctgggcggtaa

SEQ ID NO: 332209 - DNA, 20 bp, human
ggaagccccgggcaccttcc

SEQ ID NO: 332210 - DNA, 20 bp, human
gatggctctgcgcgtcggga

SEQ ID NO: 332211 - DNA, 20 bp, human
gcatgtgcctggtgcgggtc

SEQ ID NO: 332212 - DNA, 20 bp, human
gcccggggcttcgtgttcct

SEQ ID NO: 332213 - DNA, 20 bp, human
gaaaggcgcggcccgccctg

SEQ ID NO: 332214 - DNA, 20 bp, human
gtgtacacccgcacgaggag

SEQ ID NO: 332215 - DNA, 20 bp, human
gcagctgggcggtaaaggcg

SEQ ID NO: 332216 - DNA, 20 bp, human
gagcgccaggaaccgaccag

SEQ ID NO: 332217 - DNA, 20 bp, human
gaaaagcatcccggcctctc

SEQ ID NO: 332218 - DNA, 20 bp, human
gctgcggtgcgtatcgagct

SEQ ID NO: 332219 - DNA, 20 bp, human
gatcgagctgggagcccgag

SEQ ID NO: 332220 - DNA, 20 bp, human
gcctgcctctggtcggttcc

SEQ ID NO: 332221 - DNA, 20 bp, human
ggggctgccgcgacgcgctg

SEQ ID NO: 332222 - DNA, 20 bp, human
gctggcccggggagaggtgt

SEQ ID NO: 332223 - DNA, 20 bp, human
gtgcccctgtaaaactacaa

SEQ ID NO: 332224 - DNA, 20 bp, human
gacctcccggggcccgaagt

SEQ ID NO: 332225 - DNA, 20 bp, human
gggccggcagaaaagcatcc

SEQ ID NO: 332226 - DNA, 20 bp, human
gcacgctaggcgcgcgtgag

SEQ ID NO: 332227 - DNA, 20 bp, human
gctcacggaggcggggccga

SEQ ID NO: 332228 - DNA, 20 bp, human
gcggaacggtgatttactca

SEQ ID NO: 332229 - DNA, 20 bp, human
gaagccgggtactcgctctt

SEQ ID NO: 332230 - DNA, 20 bp, human
gtagccaaagagcgagtacc

SEQ ID NO: 332231 - DNA, 20 bp, human
gggaggcggggcttaggagc

SEQ ID NO: 332232 - DNA, 20 bp, human
gcgctctttggctacacttc

SEQ ID NO: 332233 - DNA, 20 bp, human
ggcgcgcgtgagaggttttc

SEQ ID NO: 332234 - DNA, 20 bp, human
gtggccaatcaacgatcttg

SEQ ID NO: 332235 - DNA, 20 bp, human
gcgcgcgcctagcgtggggc

SEQ ID NO: 332236 - DNA, 20 bp, human
gcctgcaaggggcagttttg

SEQ ID NO: 332237 - DNA, 20 bp, human
gtccctgcttggggcaaccc

SEQ ID NO: 332238 - DNA, 20 bp, human
gcgggagcgcagctccttcc

SEQ ID NO: 332239 - DNA, 20 bp, human
gcaggaggacgtgtgtgccc

SEQ ID NO: 332240 - DNA, 20 bp, human
gagaccccgggagagtagca

SEQ ID NO: 332241 - DNA, 20 bp, human
gcccctgggttgccccaagc

SEQ ID NO: 332242 - DNA, 20 bp, human
ggccgccggctggaagaccc

SEQ ID NO: 332243 - DNA, 20 bp, human
gttggggcatcctccctgct

SEQ ID NO: 332244 - DNA, 20 bp, human
gggccgcgccttgcgcccct

SEQ ID NO: 332245 - DNA, 20 bp, human
gcccgggagagtagcagggt

SEQ ID NO: 332246 - DNA, 20 bp, human
gcgcgggacggggacggctc

SEQ ID NO: 332247 - DNA, 20 bp, human
gaagctcagagaaggggcgt

SEQ ID NO: 332248 - DNA, 20 bp, human
gaaggggcgtggggccaccc

SEQ ID NO: 332249 - DNA, 20 bp, human
gcccagggctccaacgcgta

SEQ ID NO: 332250 - DNA, 20 bp, human
gggacggggacggctctggc

SEQ ID NO: 332251 - DNA, 20 bp, human
ggctccaacgcgtagggaaa

SEQ ID NO: 332252 - DNA, 20 bp, human
gcgccgctcaagctcagaga

SEQ ID NO: 332253 - DNA, 20 bp, human
gaaaggctgcgccgctcccg

SEQ ID NO: 332254 - DNA, 20 bp, human
gaatgcggggcacaggtcat

SEQ ID NO: 332255 - DNA, 20 bp, human
gggggccgcgctccaggcca

SEQ ID NO: 332256 - DNA, 20 bp, human
gtgggcccccggggttctgc

SEQ ID NO: 332257 - DNA, 20 bp, human
gaagtgactcactcctccga

SEQ ID NO: 332258 - DNA, 20 bp, human
gtgctggtggtgggttgcgg

SEQ ID NO: 332259 - DNA, 20 bp, human
ggggctcagtgaataaatat

SEQ ID NO: 332260 - DNA, 20 bp, human
ggagtctcctgcgtggtccc

SEQ ID NO: 332261 - DNA, 20 bp, human
gcgtgccgcctgggcccccg

SEQ ID NO: 332262 - DNA, 20 bp, human
ggaaggggtgagaacgtggc

SEQ ID NO: 332263 - DNA, 20 bp, human
gtggaggtgaacagcctgcg

SEQ ID NO: 332264 - DNA, 20 bp, human
ggaacagcctgcggggaaac

SEQ ID NO: 332265 - DNA, 20 bp, human
gtgaggctcccacaagccct

SEQ ID NO: 332266 - DNA, 20 bp, human
gcccaacatcgcgaggtcta

SEQ ID NO: 332267 - DNA, 20 bp, human
gcgtggcagcggaagtaggg

SEQ ID NO: 332268 - DNA, 20 bp, human
gagtgcaaagcgcgtggtgg

SEQ ID NO: 332269 - DNA, 20 bp, human
gagggtggagagcctgtatt

SEQ ID NO: 332270 - DNA, 20 bp, human
gcagcgtggcagcggaagta

SEQ ID NO: 332271 - DNA, 20 bp, human
gggcagcggaagtagggggg

SEQ ID NO: 332272 - DNA, 20 bp, human
gtggagagcctgtattgggg

SEQ ID NO: 332273 - DNA, 20 bp, human
gtccctagacctcgcgatgt

SEQ ID NO: 332274 - DNA, 20 bp, human
ggctaagggctacgttgaag

SEQ ID NO: 332275 - DNA, 20 bp, human
gccgagataactactgtctc

SEQ ID NO: 332276 - DNA, 20 bp, human
gcccgcgctaagggttgcta

SEQ ID NO: 332277 - DNA, 20 bp, human
gcacccctacggcgcttcgg

SEQ ID NO: 332278 - DNA, 20 bp, human
ggacgcaccaaacaccccta

SEQ ID NO: 332279 - DNA, 20 bp, human
gagcgcgggcttctagactc

SEQ ID NO: 332280 - DNA, 20 bp, human
ggaggcgcccattattcctt

SEQ ID NO: 332281 - DNA, 20 bp, human
gcgcgcaagtggctggtccg

SEQ ID NO: 332282 - DNA, 20 bp, human
ggaggagccaaaggaataat

SEQ ID NO: 332283 - DNA, 20 bp, human
gcccccgggccgggcagatg

SEQ ID NO: 332284 - DNA, 20 bp, human
gggctcctccgaagcgccgt

SEQ ID NO: 332285 - DNA, 20 bp, human
ggaagcgccgtaggggtgtt

SEQ ID NO: 332286 - DNA, 20 bp, human
ggttaggggtggggactctg

SEQ ID NO: 332287 - DNA, 20 bp, human
gcagacagagggttcccatg

SEQ ID NO: 332288 - DNA, 20 bp, human
gaaggcataacctgctccta

SEQ ID NO: 332289 - DNA, 20 bp, human
gcccacccctaacccttcgc

SEQ ID NO: 332290 - DNA, 20 bp, human
gagaatgcaaggataaagct

SEQ ID NO: 332291 - DNA, 20 bp, human
gctcttccttgcaacttggt

SEQ ID NO: 332292 - DNA, 20 bp, human
ggtggggagaggtaatggcc

SEQ ID NO: 332293 - DNA, 20 bp, human
gacagaaaggttaggctcag

SEQ ID NO: 332294 - DNA, 20 bp, human
ggagagggcacagaaaggtt

SEQ ID NO: 332295 - DNA, 20 bp, human
gtggaaagaagcagacccta

SEQ ID NO: 332296 - DNA, 20 bp, human
gggagcaggtctggtgaatc

SEQ ID NO: 332297 - DNA, 20 bp, human
ggcaatcagatatggtggtt

SEQ ID NO: 332298 - DNA, 20 bp, human
gctgcacagcattctaaaga

SEQ ID NO: 332299 - DNA, 20 bp, human
ggcaatattgaagtaggagc

SEQ ID NO: 332300 - DNA, 20 bp, human
gattgaagtaggagcaggtc

SEQ ID NO: 332301 - DNA, 20 bp, human
gtgcacctgacagaagctcc

SEQ ID NO: 332302 - DNA, 20 bp, human
ggggttgttacaggggtata

SEQ ID NO: 332303 - DNA, 20 bp, human
gggcaggactgaataactgt

SEQ ID NO: 332304 - DNA, 20 bp, human
gaacaacttgctccttccac

SEQ ID NO: 332305 - DNA, 20 bp, human
gaactctgcaatattgaagt

SEQ ID NO: 332306 - DNA, 20 bp, human
gtcttggagctcaagttcat

SEQ ID NO: 332307 - DNA, 20 bp, human
gtcagagaggcattgaatca

SEQ ID NO: 332308 - DNA, 20 bp, human
gtgtgtgacaggctctccct

SEQ ID NO: 332309 - DNA, 20 bp, human
gagtaacagcactatctcac

SEQ ID NO: 332310 - DNA, 20 bp, human
ggaatcacggtggtgaaacg

SEQ ID NO: 332311 - DNA, 20 bp, human
ggtcacacaaggtttcctct

SEQ ID NO: 332312 - DNA, 20 bp, human
gggttccagaagcttacccc

SEQ ID NO: 332313 - DNA, 20 bp, human
gctagtgattattcatgcct

SEQ ID NO: 332314 - DNA, 20 bp, human
ggagaggcattgaatcacgg

SEQ ID NO: 332315 - DNA, 20 bp, human
gtaagaccaagcaatgaata

SEQ ID NO: 332316 - DNA, 20 bp, human
gtgaggagaagacagatatg

SEQ ID NO: 332317 - DNA, 20 bp, human
gagggaggagtccctgataa

SEQ ID NO: 332318 - DNA, 20 bp, human
ggagggaggatggagagtca

SEQ ID NO: 332319 - DNA, 20 bp, human
gtccttaagagaagggagtg

SEQ ID NO: 332320 - DNA, 20 bp, human
gcagtgtcagggaatgcttc

SEQ ID NO: 332321 - DNA, 20 bp, human
gttatggctccttaagagaa

SEQ ID NO: 332322 - DNA, 20 bp, human
gtccccactcccttctctta

SEQ ID NO: 332323 - DNA, 20 bp, human
gctccctcctttctatttac

SEQ ID NO: 332324 - DNA, 20 bp, human
ggtactaatgtggaaagtgc

SEQ ID NO: 332325 - DNA, 20 bp, human
gtcacagccagtaaatagaa

SEQ ID NO: 332326 - DNA, 20 bp, human
gcgcacgcgctgcccgtctt

SEQ ID NO: 332327 - DNA, 20 bp, human
gtccaagccgagcgcctaga

SEQ ID NO: 332328 - DNA, 20 bp, human
gtcaccaggcagccgaagac

SEQ ID NO: 332329 - DNA, 20 bp, human
ggtgacggagaactcgtgac

SEQ ID NO: 332330 - DNA, 20 bp, human
ggagttctccgtcacccgtg

SEQ ID NO: 332331 - DNA, 20 bp, human
gcgtgcgcagtctctcgcca

SEQ ID NO: 332332 - DNA, 20 bp, human
gttcggctgcctggtgatct

SEQ ID NO: 332333 - DNA, 20 bp, human
gcgcaggcgcgcctcaggca

SEQ ID NO: 332334 - DNA, 20 bp, human
ggctacaagcccagatcacc

SEQ ID NO: 332335 - DNA, 20 bp, human
gtccgcgccctctaggcgct

SEQ ID NO: 332336 - DNA, 20 bp, human
gcccctgctcacccattaaa

SEQ ID NO: 332337 - DNA, 20 bp, human
gtccatcaggccccaatgga

SEQ ID NO: 332338 - DNA, 20 bp, human
gtagcatcctccatccattg

SEQ ID NO: 332339 - DNA, 20 bp, human
gggacggtgactggtgatgt

SEQ ID NO: 332340 - DNA, 20 bp, human
gaaggacagcaacagtcagg

SEQ ID NO: 332341 - DNA, 20 bp, human
gagccctttaatgggtgagc

SEQ ID NO: 332342 - DNA, 20 bp, human
gggggcagatagttaaaaag

SEQ ID NO: 332343 - DNA, 20 bp, human
gaggatgctagccctttaat

SEQ ID NO: 332344 - DNA, 20 bp, human
gatcaggccccaatggatgg

SEQ ID NO: 332345 - DNA, 20 bp, human
gccctgaagcgccaggaatg

SEQ ID NO: 332346 - DNA, 20 bp, human
gccctagagccgagctggga

SEQ ID NO: 332347 - DNA, 20 bp, human
gctagggagctgtcccacaa

SEQ ID NO: 332348 - DNA, 20 bp, human
gagggacagaaatgaggcac

SEQ ID NO: 332349 - DNA, 20 bp, human
gggacggtgactggtgatgt

SEQ ID NO: 332350 - DNA, 20 bp, human
gtgaggcacaggctagaagc

SEQ ID NO: 332351 - DNA, 20 bp, human
gcagctccctagagccgagc

SEQ ID NO: 332352 - DNA, 20 bp, human
ggtctctctcctcaagacca

SEQ ID NO: 332353 - DNA, 20 bp, human
gcccctgctcacccattaaa

SEQ ID NO: 332354 - DNA, 20 bp, human
ggtgactggtgatgtcggtt

SEQ ID NO: 332355 - DNA, 20 bp, human
gaaggacagcaacagtcagg

SEQ ID NO: 332356 - DNA, 20 bp, human
gcggcccgggctaggcatcc

SEQ ID NO: 332357 - DNA, 20 bp, human
ggaaacggcgagctcagagt

SEQ ID NO: 332358 - DNA, 20 bp, human
ggggcgcgcacgtgcaaggc

SEQ ID NO: 332359 - DNA, 20 bp, human
ggggacgtgcatcctcgtct

SEQ ID NO: 332360 - DNA, 20 bp, human
gggggagcggactgcggggg

SEQ ID NO: 332361 - DNA, 20 bp, human
gcggggggagcggactgcgg

SEQ ID NO: 332362 - DNA, 20 bp, human
gcccccccctcaccaagacg

SEQ ID NO: 332363 - DNA, 20 bp, human
gcgcgcccggatgcctagcc

SEQ ID NO: 332364 - DNA, 20 bp, human
gttgcactttcacccctggg

SEQ ID NO: 332365 - DNA, 20 bp, human
gatgcctagcccgggccgcc

SEQ ID NO: 332366 - DNA, 20 bp, human
ggagccttaagtccccagct

SEQ ID NO: 332367 - DNA, 20 bp, human
gtcctggtcggggccctctg

SEQ ID NO: 332368 - DNA, 20 bp, human
gcagcccagctggggactta

SEQ ID NO: 332369 - DNA, 20 bp, human
ggctgcctgaccggtaagac

SEQ ID NO: 332370 - DNA, 20 bp, human
gggggacaggatctctatgt

SEQ ID NO: 332371 - DNA, 20 bp, human
ggaccaggaaccagtcttac

SEQ ID NO: 332372 - DNA, 20 bp, human
gaggacttgtctgggagcag

SEQ ID NO: 332373 - DNA, 20 bp, human
gccctcagagggccccgacc

SEQ ID NO: 332374 - DNA, 20 bp, human
gccaatgaatgccacccgga

SEQ ID NO: 332375 - DNA, 20 bp, human
ggggaactgaggacttgtct

SEQ ID NO: 332376 - DNA, 20 bp, human
gggcggcggtcgagatacta

SEQ ID NO: 332377 - DNA, 20 bp, human
gagggagccaggggcgggaa

SEQ ID NO: 332378 - DNA, 20 bp, human
ggcgcggcgcgcggtgggaa

SEQ ID NO: 332379 - DNA, 20 bp, human
gcgcgcctcgccttgggagt

SEQ ID NO: 332380 - DNA, 20 bp, human
gaagtgccgcggcaaactcg

SEQ ID NO: 332381 - DNA, 20 bp, human
gacgatcgccgcccctagaa

SEQ ID NO: 332382 - DNA, 20 bp, human
gacgacgagccgacaggtgg

SEQ ID NO: 332383 - DNA, 20 bp, human
gacgccgcgcacctgagcgc

SEQ ID NO: 332384 - DNA, 20 bp, human
gcggagctccaggcaatccc

SEQ ID NO: 332385 - DNA, 20 bp, human
gaccggcggtggctagagcg

SEQ ID NO: 332386 - DNA, 20 bp, human
gtagaggggtgggttccggg

SEQ ID NO: 332387 - DNA, 20 bp, human
ggcggtgcagggctcctgtc

SEQ ID NO: 332388 - DNA, 20 bp, human
gtagagtttcagggcgggga

SEQ ID NO: 332389 - DNA, 20 bp, human
gcagagcagtggaaggtccc

SEQ ID NO: 332390 - DNA, 20 bp, human
gcccaaagctagaggaggaa

SEQ ID NO: 332391 - DNA, 20 bp, human
gggtggtggaagagggccga

SEQ ID NO: 332392 - DNA, 20 bp, human
gtcaatctcggcagtcacgc

SEQ ID NO: 332393 - DNA, 20 bp, human
ggccgaggggggaggataga

SEQ ID NO: 332394 - DNA, 20 bp, human
gcggccgctgccccgggagt

SEQ ID NO: 332395 - DNA, 20 bp, human
gaggagggggtagagtttca

SEQ ID NO: 332396 - DNA, 20 bp, human
gcaacccggaggagccccag

SEQ ID NO: 332397 - DNA, 20 bp, human
gagcactgcgctccccgctg

SEQ ID NO: 332398 - DNA, 20 bp, human
gggccccgagcctgtcactc

SEQ ID NO: 332399 - DNA, 20 bp, human
ggagcctgtcactccggtgc

SEQ ID NO: 332400 - DNA, 20 bp, human
gccccgagcttcggcgagga

SEQ ID NO: 332401 - DNA, 20 bp, human
gtagccggcaccggagtgac

SEQ ID NO: 332402 - DNA, 20 bp, human
ggcgctggagccccgagctt

SEQ ID NO: 332403 - DNA, 20 bp, human
gcgcagccgcaacccacctg

SEQ ID NO: 332404 - DNA, 20 bp, human
gggagccccgagcttcggcg

SEQ ID NO: 332405 - DNA, 20 bp, human
gtccggtgccggctagggga

SEQ ID NO: 332406 - DNA, 20 bp, human
gcctcggcaccaccagagat

SEQ ID NO: 332407 - DNA, 20 bp, human
ggggagatggcagttgctga

SEQ ID NO: 332408 - DNA, 20 bp, human
gcgtcggccaatcgcagctc

SEQ ID NO: 332409 - DNA, 20 bp, human
gcgggccaaccttctctcct

SEQ ID NO: 332410 - DNA, 20 bp, human
gaggcctctgctggccccga

SEQ ID NO: 332411 - DNA, 20 bp, human
ggcggagacacgcgctgatt

SEQ ID NO: 332412 - DNA, 20 bp, human
gacgggtagaccgtcccggg

SEQ ID NO: 332413 - DNA, 20 bp, human
gcttgcccaggagagaaggt

SEQ ID NO: 332414 - DNA, 20 bp, human
gccgacgggtagaccgtccc

SEQ ID NO: 332415 - DNA, 20 bp, human
gggtagaccgtcccgggtgg

SEQ ID NO: 332416 - DNA, 20 bp, human
gaggacggtgaggagcctgg

SEQ ID NO: 332417 - DNA, 20 bp, human
gagcatgcatcaggacggtg

SEQ ID NO: 332418 - DNA, 20 bp, human
ggggaagggaagttccttct

SEQ ID NO: 332419 - DNA, 20 bp, human
gcctggagcatgcatcagga

SEQ ID NO: 332420 - DNA, 20 bp, human
gtggaaaaggagctcctaga

SEQ ID NO: 332421 - DNA, 20 bp, human
gagagacaggggaagacctc

SEQ ID NO: 332422 - DNA, 20 bp, human
ggctggctctgcaataatgg

SEQ ID NO: 332423 - DNA, 20 bp, human
ggagtctcatccttctgagg

SEQ ID NO: 332424 - DNA, 20 bp, human
gggggctggctctgcaataa

SEQ ID NO: 332425 - DNA, 20 bp, human
ggaaggatgagactccagct

SEQ ID NO: 332426 - DNA, 20 bp, human
ggccccgcgcacagcgcaga

SEQ ID NO: 332427 - DNA, 20 bp, human
gtcggtctgccccttcccgt

SEQ ID NO: 332428 - DNA, 20 bp, human
gccggcccggagcgaggaaa

SEQ ID NO: 332429 - DNA, 20 bp, human
gaggtgcggctggaagaccc

SEQ ID NO: 332430 - DNA, 20 bp, human
gcaggggcccagcaatagtc

SEQ ID NO: 332431 - DNA, 20 bp, human
gcaagcaggtgcttttgaaa

SEQ ID NO: 332432 - DNA, 20 bp, human
ggggccgggtccgccacgtc

SEQ ID NO: 332433 - DNA, 20 bp, human
gccgccccagacttttatag

SEQ ID NO: 332434 - DNA, 20 bp, human
ggggtcgggcgccgccctag

SEQ ID NO: 332435 - DNA, 20 bp, human
gggccctctgcgctgtgcgc

SEQ ID NO: 332436 - DNA, 20 bp, human
gtgaaccagagcgggaaatg

SEQ ID NO: 332437 - DNA, 20 bp, human
ggggagagggagcatccaat

SEQ ID NO: 332438 - DNA, 20 bp, human
ggggcctcgcgccagccgat

SEQ ID NO: 332439 - DNA, 20 bp, human
ggggaaatgaggccgagcca

SEQ ID NO: 332440 - DNA, 20 bp, human
gaggagccgggacccaccgg

SEQ ID NO: 332441 - DNA, 20 bp, human
gcccgctctggttcaggcgc

SEQ ID NO: 332442 - DNA, 20 bp, human
gggaccaattgcaccaggcg

SEQ ID NO: 332443 - DNA, 20 bp, human
gcaggcgagcgccagagccc

SEQ ID NO: 332444 - DNA, 20 bp, human
gtgattagtgggtttgaaaa

SEQ ID NO: 332445 - DNA, 20 bp, human
gtcctgcgcctgaaccagag

SEQ ID NO: 332446 - DNA, 20 bp, human
ggatccggcccattcatcaa

SEQ ID NO: 332447 - DNA, 20 bp, human
ggcagtgagcgcgatctgat

SEQ ID NO: 332448 - DNA, 20 bp, human
gccagggcgcaagggagcgg

SEQ ID NO: 332449 - DNA, 20 bp, human
gcggcctagggtgacttgaa

SEQ ID NO: 332450 - DNA, 20 bp, human
gagtgtggtccggagaaaga

SEQ ID NO: 332451 - DNA, 20 bp, human
ggggctggacggaggagaca

SEQ ID NO: 332452 - DNA, 20 bp, human
gcccggggacagacggaaga

SEQ ID NO: 332453 - DNA, 20 bp, human
gccaaaacgaggtcgagccg

SEQ ID NO: 332454 - DNA, 20 bp, human
gggggcgcgagtgatcagct

SEQ ID NO: 332455 - DNA, 20 bp, human
gagcagccgtgggcgacctg

SEQ ID NO: 332456 - DNA, 20 bp, human
ggaaggggaggattttgcaa

SEQ ID NO: 332457 - DNA, 20 bp, human
gtcagcaggcctggaaatat

SEQ ID NO: 332458 - DNA, 20 bp, human
gggcctcagcgggataaaac

SEQ ID NO: 332459 - DNA, 20 bp, human
gtcgccagacccatctccca

SEQ ID NO: 332460 - DNA, 20 bp, human
gaggctcgtaggccgcggat

SEQ ID NO: 332461 - DNA, 20 bp, human
gagaccatccctctcacttc

SEQ ID NO: 332462 - DNA, 20 bp, human
ggcctaggagcctgaggatg

SEQ ID NO: 332463 - DNA, 20 bp, human
gttccaggcctgctgagtta

SEQ ID NO: 332464 - DNA, 20 bp, human
gcaagggggacatggctgag

SEQ ID NO: 332465 - DNA, 20 bp, human
ggacatggctgagtggactc

SEQ ID NO: 332466 - DNA, 20 bp, human
gctaaaaggggcgggtccga

SEQ ID NO: 332467 - DNA, 20 bp, human
ggggcaagctgcatggtgat

SEQ ID NO: 332468 - DNA, 20 bp, human
gtggggacacgccctaaaag

SEQ ID NO: 332469 - DNA, 20 bp, human
gagctgcatggtgattggtg

SEQ ID NO: 332470 - DNA, 20 bp, human
gggacacgccctaaaagggg

SEQ ID NO: 332471 - DNA, 20 bp, human
gcatggtgattggtgcgggt

SEQ ID NO: 332472 - DNA, 20 bp, human
gtccttccgctgtctctttc

SEQ ID NO: 332473 - DNA, 20 bp, human
ggctccgtctatcactcact

SEQ ID NO: 332474 - DNA, 20 bp, human
gtcaatctaagcagcaacgt

SEQ ID NO: 332475 - DNA, 20 bp, human
ggtccccagtgagtgataga

SEQ ID NO: 332476 - DNA, 20 bp, human
gtcaacgcgtggggtaaggg

SEQ ID NO: 332477 - DNA, 20 bp, human
gactgagtgacgctaatatg

SEQ ID NO: 332478 - DNA, 20 bp, human
gccgctcgccttcaacgcgt

SEQ ID NO: 332479 - DNA, 20 bp, human
ggccttcaacgcgtggggta

SEQ ID NO: 332480 - DNA, 20 bp, human
gagcggcctaggggtaggga

SEQ ID NO: 332481 - DNA, 20 bp, human
gtgaaggcgagcgggattgc

SEQ ID NO: 332482 - DNA, 20 bp, human
gtgcaagagcgaacaaggat

SEQ ID NO: 332483 - DNA, 20 bp, human
gctaggggtagggaggggta

SEQ ID NO: 332484 - DNA, 20 bp, human
gagggtcacggcaatttctc

SEQ ID NO: 332485 - DNA, 20 bp, human
gggggagcggcctaggggta

SEQ ID NO: 332486 - DNA, 20 bp, human
gtgagagcgcgtgggagcat

SEQ ID NO: 332487 - DNA, 20 bp, human
gtacgcggagcggtaatgtg

SEQ ID NO: 332488 - DNA, 20 bp, human
gtctttgcatcgctctctgt

SEQ ID NO: 332489 - DNA, 20 bp, human
ggggtgcgcggtagcaacag

SEQ ID NO: 332490 - DNA, 20 bp, human
gcccacgcgctctcaatact

SEQ ID NO: 332491 - DNA, 20 bp, human
gacacctctcgcgagagcgt

SEQ ID NO: 332492 - DNA, 20 bp, human
gtaggcgcatgcgcgctcgt

SEQ ID NO: 332493 - DNA, 20 bp, human
gcccgccaaacagatgaggg

SEQ ID NO: 332494 - DNA, 20 bp, human
ggcatcgctctctgtcggag

SEQ ID NO: 332495 - DNA, 20 bp, human
gagagaagcggctttcggga

SEQ ID NO: 332496 - DNA, 20 bp, human
ggggccccctcgttgcagag

SEQ ID NO: 332497 - DNA, 20 bp, human
gcagaggcgcggggcgtcac

SEQ ID NO: 332498 - DNA, 20 bp, human
ggggcccggtcctgcgaatc

SEQ ID NO: 332499 - DNA, 20 bp, human
gcctcggcgctccccctcgg

SEQ ID NO: 332500 - DNA, 20 bp, human
ggaaccgcaagggccagagc

SEQ ID NO: 332501 - DNA, 20 bp, human
gctgccggcgccagctaccc

SEQ ID NO: 332502 - DNA, 20 bp, human
ggcgccgagcgcccgaagcg

SEQ ID NO: 332503 - DNA, 20 bp, human
gaggcgcggggcgtcactgg

SEQ ID NO: 332504 - DNA, 20 bp, human
gaccccggagccgtggctgg

SEQ ID NO: 332505 - DNA, 20 bp, human
gaaaccagctcccccctcgg

SEQ ID NO: 332506 - DNA, 20 bp, human
gaggtggagtactgttgcgt

SEQ ID NO: 332507 - DNA, 20 bp, human
gcgcctgtgcggggagggta

SEQ ID NO: 332508 - DNA, 20 bp, human
gggactgcttgagagatctg

SEQ ID NO: 332509 - DNA, 20 bp, human
ggtggagccgccagttgaga

SEQ ID NO: 332510 - DNA, 20 bp, human
gcggtggtgatcacgggaaa

SEQ ID NO: 332511 - DNA, 20 bp, human
ggcgcagtgaagacaagaaa

SEQ ID NO: 332512 - DNA, 20 bp, human
ggatcagagtccttctcaac

SEQ ID NO: 332513 - DNA, 20 bp, human
gacgaaaatgcatggtgcta

SEQ ID NO: 332514 - DNA, 20 bp, human
gactccctggtttggggtac

SEQ ID NO: 332515 - DNA, 20 bp, human
gaattttcggtggtgatcac

SEQ ID NO: 332516 - DNA, 20 bp, human
gcccgcaggcgccaaagacg

SEQ ID NO: 332517 - DNA, 20 bp, human
gtgcgggcaccgggagtcct

SEQ ID NO: 332518 - DNA, 20 bp, human
gaggcgccaaagacgaggga

SEQ ID NO: 332519 - DNA, 20 bp, human
gtcggccccgagctacgggg

SEQ ID NO: 332520 - DNA, 20 bp, human
gaggaggaacggcgaatcgg

SEQ ID NO: 332521 - DNA, 20 bp, human
ggggaggaggaacggcgaat

SEQ ID NO: 332522 - DNA, 20 bp, human
gcgggctgtgctcctcggaa

SEQ ID NO: 332523 - DNA, 20 bp, human
ggagctacggggcggcgtga

SEQ ID NO: 332524 - DNA, 20 bp, human
ggggaaggaaggaaaggcgc

SEQ ID NO: 332525 - DNA, 20 bp, human
gggggagcacaaacttttac

SEQ ID NO: 332526 - DNA, 20 bp, human
gtctagggcagctagataaa

SEQ ID NO: 332527 - DNA, 20 bp, human
gggcccttatattccagatt

SEQ ID NO: 332528 - DNA, 20 bp, human
gcctagagaccagaaagcta

SEQ ID NO: 332529 - DNA, 20 bp, human
ggataaacggaaagtctcct

SEQ ID NO: 332530 - DNA, 20 bp, human
gaggcttggctgctgacggg

SEQ ID NO: 332531 - DNA, 20 bp, human
gcgtactctccctagctttc

SEQ ID NO: 332532 - DNA, 20 bp, human
gaagggttttaagccaggct

SEQ ID NO: 332533 - DNA, 20 bp, human
gcacacacatctaccatcac

SEQ ID NO: 332534 - DNA, 20 bp, human
gaaatgggcatgtttcaagt

SEQ ID NO: 332535 - DNA, 20 bp, human
gaacgttaataaggacttcg

SEQ ID NO: 332536 - DNA, 20 bp, human
ggggaactgttctttgcgtc

SEQ ID NO: 332537 - DNA, 20 bp, human
gcaagaagaagacgtaaagc

SEQ ID NO: 332538 - DNA, 20 bp, human
gtagtagcgtcaggttttca

SEQ ID NO: 332539 - DNA, 20 bp, human
gattgcttgactttgtatct

SEQ ID NO: 332540 - DNA, 20 bp, human
gaaaaagttaatgttttact

SEQ ID NO: 332541 - DNA, 20 bp, human
gttttaaaaagttaggggat

SEQ ID NO: 332542 - DNA, 20 bp, human
gtacgtcttcttcttggaaa

SEQ ID NO: 332543 - DNA, 20 bp, human
gaaatgaaaaaagaagttag

SEQ ID NO: 332544 - DNA, 20 bp, human
gaaaagttaggggattggcc

SEQ ID NO: 332545 - DNA, 20 bp, human
gcgtcaggttttcacggtgt

SEQ ID NO: 332546 - DNA, 20 bp, human
gcaagcaagctcctcaagat

SEQ ID NO: 332547 - DNA, 20 bp, human
gaaggagtgagggtgttatc

SEQ ID NO: 332548 - DNA, 20 bp, human
gtaggatggaacagaaacat

SEQ ID NO: 332549 - DNA, 20 bp, human
gtcaagatagggttgttaaa

SEQ ID NO: 332550 - DNA, 20 bp, human
ggtttcagatgtagagaatc

SEQ ID NO: 332551 - DNA, 20 bp, human
gaaaagttctgtgtttgtat

SEQ ID NO: 332552 - DNA, 20 bp, human
gattctgcagagagtctgag

SEQ ID NO: 332553 - DNA, 20 bp, human
ggcagagacaatttgagatg

SEQ ID NO: 332554 - DNA, 20 bp, human
gaaaactctacctcgtagga

SEQ ID NO: 332555 - DNA, 20 bp, human
ggtttctgttccatcctacg

SEQ ID NO: 332556 - DNA, 20 bp, human
gagtgcgtgacgctcgtcag

SEQ ID NO: 332557 - DNA, 20 bp, human
gtgaaaaggcctagtaagtg

SEQ ID NO: 332558 - DNA, 20 bp, human
gagggccaaggcctacgcgt

SEQ ID NO: 332559 - DNA, 20 bp, human
ggtaagtggggtcgggaggc

SEQ ID NO: 332560 - DNA, 20 bp, human
gtcacacgtggcgccagcgg

SEQ ID NO: 332561 - DNA, 20 bp, human
ggcggtgacgcactttacgg

SEQ ID NO: 332562 - DNA, 20 bp, human
gacgtggcgccagcggaggc

SEQ ID NO: 332563 - DNA, 20 bp, human
gaggcctagtaagtggggtc

SEQ ID NO: 332564 - DNA, 20 bp, human
gagtggcttcagttcacacg

SEQ ID NO: 332565 - DNA, 20 bp, human
gcctagtaagtggggtcggg

SEQ ID NO: 332566 - DNA, 20 bp, human
gtggtggccaatcagggaag

SEQ ID NO: 332567 - DNA, 20 bp, human
ggaggcgccgtgaggaaagt

SEQ ID NO: 332568 - DNA, 20 bp, human
ggggccggtcctttatctgg

SEQ ID NO: 332569 - DNA, 20 bp, human
gagggggccggtcctttatc

SEQ ID NO: 332570 - DNA, 20 bp, human
gctctgaactctgattgaca

SEQ ID NO: 332571 - DNA, 20 bp, human
ggccaatcagggaagcgggg

SEQ ID NO: 332572 - DNA, 20 bp, human
gtcctccccgcttccctgat

SEQ ID NO: 332573 - DNA, 20 bp, human
gtcctcccctactttcctca

SEQ ID NO: 332574 - DNA, 20 bp, human
gagaaaaaccacagcctgag

SEQ ID NO: 332575 - DNA, 20 bp, human
ggcaagtctccagtccttaa

SEQ ID NO: 332576 - DNA, 20 bp, human
gaggaactgagacctagtgg

SEQ ID NO: 332577 - DNA, 20 bp, human
gctgagacctagtggaggag

SEQ ID NO: 332578 - DNA, 20 bp, human
gaggccgcggaagtccagcc

SEQ ID NO: 332579 - DNA, 20 bp, human
gcttccgcggcctaggagtg

SEQ ID NO: 332580 - DNA, 20 bp, human
gtccccggctggttaattac

SEQ ID NO: 332581 - DNA, 20 bp, human
gctttcccatatctttcaga

SEQ ID NO: 332582 - DNA, 20 bp, human
gcccaggcggggtgaaaggt

SEQ ID NO: 332583 - DNA, 20 bp, human
gtatgggaaagccccctggc

SEQ ID NO: 332584 - DNA, 20 bp, human
ggctgggggcgtctgtcacc

SEQ ID NO: 332585 - DNA, 20 bp, human
gggggctgtgttggcggctg

SEQ ID NO: 332586 - DNA, 20 bp, human
ggcccggccggcagggcccg

SEQ ID NO: 332587 - DNA, 20 bp, human
gggcgtcccggcaactcggc

SEQ ID NO: 332588 - DNA, 20 bp, human
gcgcttctcctcagcctcgg

SEQ ID NO: 332589 - DNA, 20 bp, human
ggctgaggagaagcggcggg

SEQ ID NO: 332590 - DNA, 20 bp, human
ggcggctgaggcgatgagga

SEQ ID NO: 332591 - DNA, 20 bp, human
gttctcctcagcctcggcgg

SEQ ID NO: 332592 - DNA, 20 bp, human
gcggcgcggcggccgcgtga

SEQ ID NO: 332593 - DNA, 20 bp, human
ggctgaggagcaagttgcgc

SEQ ID NO: 332594 - DNA, 20 bp, human
ggcagtgcgcaggctggcgc

SEQ ID NO: 332595 - DNA, 20 bp, human
gtcagcgcccgccgagttgc

SEQ ID NO: 332596 - DNA, 20 bp, human
gcccggagagggggaagttc

SEQ ID NO: 332597 - DNA, 20 bp, human
ggaagttcggggcgagtccc

SEQ ID NO: 332598 - DNA, 20 bp, human
gccagtccaagcccggagag

SEQ ID NO: 332599 - DNA, 20 bp, human
gaggaggagcaggaactctg

SEQ ID NO: 332600 - DNA, 20 bp, human
gcagcgctgccctctctcaa

SEQ ID NO: 332601 - DNA, 20 bp, human
gtgtaggcggtgcaatacac

SEQ ID NO: 332602 - DNA, 20 bp, human
ggaaggggcgtgtctgtagg

SEQ ID NO: 332603 - DNA, 20 bp, human
gcgtggcgccggttggctga

SEQ ID NO: 332604 - DNA, 20 bp, human
gggcggtgcaatacacgggt

SEQ ID NO: 332605 - DNA, 20 bp, human
ggttggctgacggagatgaa

SEQ ID NO: 332606 - DNA, 20 bp, human
ggcgacacggccctaaacct

SEQ ID NO: 332607 - DNA, 20 bp, human
ggggaccccggtcgcccacc

SEQ ID NO: 332608 - DNA, 20 bp, human
ggaagggaggtctagcgaca

SEQ ID NO: 332609 - DNA, 20 bp, human
ggggacaggtcgcaaatcca

SEQ ID NO: 332610 - DNA, 20 bp, human
gcccaccaggaggtaagccc

SEQ ID NO: 332611 - DNA, 20 bp, human
gaggaggtaagcccaggttt

SEQ ID NO: 332612 - DNA, 20 bp, human
gccaagggggcggaaacttt

SEQ ID NO: 332613 - DNA, 20 bp, human
ggaaaccagcaaaggtattt

SEQ ID NO: 332614 - DNA, 20 bp, human
gggggaagttgacttttcat

SEQ ID NO: 332615 - DNA, 20 bp, human
ggagcaggaattgagagcca

SEQ ID NO: 332616 - DNA, 20 bp, human
ggggaggagtccagagccta

SEQ ID NO: 332617 - DNA, 20 bp, human
gagcgcctggataagtggcg

SEQ ID NO: 332618 - DNA, 20 bp, human
ggcctaggggcgaggagtga

SEQ ID NO: 332619 - DNA, 20 bp, human
gcgctcgccggggacgggag

SEQ ID NO: 332620 - DNA, 20 bp, human
gcccaataacgggaggggtt

SEQ ID NO: 332621 - DNA, 20 bp, human
ggctccggagacaagggagt

SEQ ID NO: 332622 - DNA, 20 bp, human
gcgccaaggcttaaacgtga

SEQ ID NO: 332623 - DNA, 20 bp, human
gagtccagagcctaggggcg

SEQ ID NO: 332624 - DNA, 20 bp, human
ggggctgacgtggggcgcca

SEQ ID NO: 332625 - DNA, 20 bp, human
gcggcgagcgcctggataag

SEQ ID NO: 332626 - DNA, 20 bp, human
gcagctgtaagcggcggggt

SEQ ID NO: 332627 - DNA, 20 bp, human
gagcaggccgagcgcgtccc

SEQ ID NO: 332628 - DNA, 20 bp, human
gccacccagctgtaagcggc

SEQ ID NO: 332629 - DNA, 20 bp, human
ggaccccggcggctccgcag

SEQ ID NO: 332630 - DNA, 20 bp, human
gctccctgaaacaagcacgg

SEQ ID NO: 332631 - DNA, 20 bp, human
gagcaggtggccagcggaga

SEQ ID NO: 332632 - DNA, 20 bp, human
gctgaaacaagcacggagga

SEQ ID NO: 332633 - DNA, 20 bp, human
gccgagcgcgtccctggctg

SEQ ID NO: 332634 - DNA, 20 bp, human
gagccgccggggtccgaaag

SEQ ID NO: 332635 - DNA, 20 bp, human
ggaaagtgctggaagcaagc

SEQ ID NO: 332636 - DNA, 20 bp, human
ggcgaccgctgaagctcctg

SEQ ID NO: 332637 - DNA, 20 bp, human
gagccctggtagtctccctg

SEQ ID NO: 332638 - DNA, 20 bp, human
gtgcgcctgtgcccgcggga

SEQ ID NO: 332639 - DNA, 20 bp, human
gctagcgcagcgaggaccgg

SEQ ID NO: 332640 - DNA, 20 bp, human
gggggcgcgcagagtccacc

SEQ ID NO: 332641 - DNA, 20 bp, human
ggcgctgcgcgcagtccatg

SEQ ID NO: 332642 - DNA, 20 bp, human
gtcccgggcacagacgcgac

SEQ ID NO: 332643 - DNA, 20 bp, human
ggcgcgcagagtccacctgg

SEQ ID NO: 332644 - DNA, 20 bp, human
gaagcgcccagccttcccgc

SEQ ID NO: 332645 - DNA, 20 bp, human
gaagctcctgggggtgttcg

SEQ ID NO: 332646 - DNA, 20 bp, human
ggcccctcccccccggaaga

SEQ ID NO: 332647 - DNA, 20 bp, human
gctcgtgcgcggaacgacat

SEQ ID NO: 332648 - DNA, 20 bp, human
gagcgcgtgcgcgagggtgt

SEQ ID NO: 332649 - DNA, 20 bp, human
ggaccccttgaaaaaaaatg

SEQ ID NO: 332650 - DNA, 20 bp, human
gcaagcacttccggggtcag

SEQ ID NO: 332651 - DNA, 20 bp, human
ggattgcgccaacccttaca

SEQ ID NO: 332652 - DNA, 20 bp, human
gtgaaaatgaagcgcacgat

SEQ ID NO: 332653 - DNA, 20 bp, human
ggggcagcagccctcttccg

SEQ ID NO: 332654 - DNA, 20 bp, human
gtgcgcagcaagcacttccg

SEQ ID NO: 332655 - DNA, 20 bp, human
gaaatgaagcgcacgatggg

SEQ ID NO: 332656 - DNA, 20 bp, human
gtgcgatagagagggagcgt

SEQ ID NO: 332657 - DNA, 20 bp, human
gctggtgcctacgctgtcaa

SEQ ID NO: 332658 - DNA, 20 bp, human
gcgacgaattgcgatagaga

SEQ ID NO: 332659 - DNA, 20 bp, human
gctagcagccgttgtctcgc

SEQ ID NO: 332660 - DNA, 20 bp, human
gaggccgtctgcattgcgtg

SEQ ID NO: 332661 - DNA, 20 bp, human
ggaagcgctaaccaccccgg

SEQ ID NO: 332662 - DNA, 20 bp, human
ggcggctcctttgacagcgt

SEQ ID NO: 332663 - DNA, 20 bp, human
gtcagatgttagtgcggaga

SEQ ID NO: 332664 - DNA, 20 bp, human
gttagcgcttccggggtcga

SEQ ID NO: 332665 - DNA, 20 bp, human
gctgtcaaaggagccgctct

SEQ ID NO: 332666 - DNA, 20 bp, human
gaatcactctggtccgactg

SEQ ID NO: 332667 - DNA, 20 bp, human
gcccgcccccaggagatttc

SEQ ID NO: 332668 - DNA, 20 bp, human
ggaggaaacggttgctctag

SEQ ID NO: 332669 - DNA, 20 bp, human
ggaagccggaaatctcctgg

SEQ ID NO: 332670 - DNA, 20 bp, human
gggcggagcggagcccttta

SEQ ID NO: 332671 - DNA, 20 bp, human
ggtactggcctagccgtaaa

SEQ ID NO: 332672 - DNA, 20 bp, human
gggttgctctaggggcggag

SEQ ID NO: 332673 - DNA, 20 bp, human
gcactctggtccgactgagg

SEQ ID NO: 332674 - DNA, 20 bp, human
gcaaccgtttcctcctcagt

SEQ ID NO: 332675 - DNA, 20 bp, human
gaccaattaggcagtagcag

SEQ ID NO: 332676 - DNA, 20 bp, human
gacggaccacgcacatccag

SEQ ID NO: 332677 - DNA, 20 bp, human
gcgggaggccggagtgggag

SEQ ID NO: 332678 - DNA, 20 bp, human
gaggcctggtcagcacatgg

SEQ ID NO: 332679 - DNA, 20 bp, human
gagggtgcacgggagttcag

SEQ ID NO: 332680 - DNA, 20 bp, human
ggcacatccaggggtgtcct

SEQ ID NO: 332681 - DNA, 20 bp, human
gctgctagagaagagtctca

SEQ ID NO: 332682 - DNA, 20 bp, human
ggggcccagaaggcgtcacc

SEQ ID NO: 332683 - DNA, 20 bp, human
ggagcggcccaggacacccc

SEQ ID NO: 332684 - DNA, 20 bp, human
gagtcccctgaccagggtgt

SEQ ID NO: 332685 - DNA, 20 bp, human
ggaggtgcttccgtgaccct

SEQ ID NO: 332686 - DNA, 20 bp, human
ggctgtgagaacgagtttag

SEQ ID NO: 332687 - DNA, 20 bp, human
ggccgggccccatccagcgg

SEQ ID NO: 332688 - DNA, 20 bp, human
gtggggcatgtgagaccgag

SEQ ID NO: 332689 - DNA, 20 bp, human
ggtctcacatgccccaaacg

SEQ ID NO: 332690 - DNA, 20 bp, human
gtgaggaggaaagttccttc

SEQ ID NO: 332691 - DNA, 20 bp, human
gagttcaagctggggataag

SEQ ID NO: 332692 - DNA, 20 bp, human
gtggcaggaaacaggctcgg

SEQ ID NO: 332693 - DNA, 20 bp, human
gagcaaggatgcgatcccga

SEQ ID NO: 332694 - DNA, 20 bp, human
gatggacatggagcagtctg

SEQ ID NO: 332695 - DNA, 20 bp, human
gatgtgagaccgagaggctt

SEQ ID NO: 332696 - DNA, 20 bp, human
ggcggcggccgcttcctgga

SEQ ID NO: 332697 - DNA, 20 bp, human
ggggcccgccgctctgtaat

SEQ ID NO: 332698 - DNA, 20 bp, human
gcgccgcggtgcgccccgag

SEQ ID NO: 332699 - DNA, 20 bp, human
gcccgccaggccagtccttc

SEQ ID NO: 332700 - DNA, 20 bp, human
gctgtaatcggatccgggga

SEQ ID NO: 332701 - DNA, 20 bp, human
gcggcccgggccggaaggac

SEQ ID NO: 332702 - DNA, 20 bp, human
ggatccgattacagagcggc

SEQ ID NO: 332703 - DNA, 20 bp, human
gcccggatccgattacagag

SEQ ID NO: 332704 - DNA, 20 bp, human
gcgcggtgcgccccgagcgg

SEQ ID NO: 332705 - DNA, 20 bp, human
gccagagccccacgggttgg

SEQ ID NO: 332706 - DNA, 20 bp, human
gctaacttgcggaaagggga

SEQ ID NO: 332707 - DNA, 20 bp, human
gagtcgcgctaggacctgga

SEQ ID NO: 332708 - DNA, 20 bp, human
ggacctggagggctagtcgg

SEQ ID NO: 332709 - DNA, 20 bp, human
gtaggacctggagggctagt

SEQ ID NO: 332710 - DNA, 20 bp, human
gcgggagtcgcgctaggacc

SEQ ID NO: 332711 - DNA, 20 bp, human
gtcactcctggggtcggctc

SEQ ID NO: 332712 - DNA, 20 bp, human
gtgccccgccccctaacttg

SEQ ID NO: 332713 - DNA, 20 bp, human
gagtggtcggccagatccgc

SEQ ID NO: 332714 - DNA, 20 bp, human
gatcccggatccggcggatc

SEQ ID NO: 332715 - DNA, 20 bp, human
gcggccagatccgccggatc

SEQ ID NO: 332716 - DNA, 20 bp, human
gacccggtgctgcccgagga

SEQ ID NO: 332717 - DNA, 20 bp, human
gcgcgcagagaaaaagtaca

SEQ ID NO: 332718 - DNA, 20 bp, human
gtacgcatgtgctaaagcgt

SEQ ID NO: 332719 - DNA, 20 bp, human
gtctctgcgcgaccctcctc

SEQ ID NO: 332720 - DNA, 20 bp, human
gtacggcgcttgcgcagcat

SEQ ID NO: 332721 - DNA, 20 bp, human
gtggactacagaacctgctt

SEQ ID NO: 332722 - DNA, 20 bp, human
ggaccctcctcgggcagcac

SEQ ID NO: 332723 - DNA, 20 bp, human
gctgcctggctgcacaaaaa

SEQ ID NO: 332724 - DNA, 20 bp, human
gttctgtagtccagcccccg

SEQ ID NO: 332725 - DNA, 20 bp, human
gtcacgccttactcccaagc

SEQ ID NO: 332726 - DNA, 20 bp, human
gcaaagcaagggctgttcat

SEQ ID NO: 332727 - DNA, 20 bp, human
ggttcatgggagggcttgaa

SEQ ID NO: 332728 - DNA, 20 bp, human
ggcaagggctgttcatggga

SEQ ID NO: 332729 - DNA, 20 bp, human
gtagggaaagctaacagcca

SEQ ID NO: 332730 - DNA, 20 bp, human
ggataaggagaacctgaccc

SEQ ID NO: 332731 - DNA, 20 bp, human
gaggtggtggaaactaaagc

SEQ ID NO: 332732 - DNA, 20 bp, human
gtacttgcattgagatcaac

SEQ ID NO: 332733 - DNA, 20 bp, human
gacacctatctgccttgggc

SEQ ID NO: 332734 - DNA, 20 bp, human
gaggaaataggacgaggaaa

SEQ ID NO: 332735 - DNA, 20 bp, human
gaataacacctatctgcctt

SEQ ID NO: 332736 - DNA, 20 bp, human
gggtcccctcccagccggac

SEQ ID NO: 332737 - DNA, 20 bp, human
ggctcgggaccgctccggtc

SEQ ID NO: 332738 - DNA, 20 bp, human
gcaggagcggtcctagatgg

SEQ ID NO: 332739 - DNA, 20 bp, human
ggcctcgggcagtgaagaga

SEQ ID NO: 332740 - DNA, 20 bp, human
gcctcccagccggaccggag

SEQ ID NO: 332741 - DNA, 20 bp, human
ggcagtgaagagatggcaga

SEQ ID NO: 332742 - DNA, 20 bp, human
gcacctcccggccggagggg

SEQ ID NO: 332743 - DNA, 20 bp, human
gggaccgctccggtccggct

SEQ ID NO: 332744 - DNA, 20 bp, human
ggtggagctcgggaccgctc

SEQ ID NO: 332745 - DNA, 20 bp, human
ggctccacctcccggccgga

SEQ ID NO: 332746 - DNA, 20 bp, human
gaactctcgcccgagcggcc

SEQ ID NO: 332747 - DNA, 20 bp, human
ggccgcgtgacgtgtctgtt

SEQ ID NO: 332748 - DNA, 20 bp, human
gagagcgagaacagccccgc

SEQ ID NO: 332749 - DNA, 20 bp, human
gacgtcacgcggcagccggg

SEQ ID NO: 332750 - DNA, 20 bp, human
gccaccgagctgccgatgat

SEQ ID NO: 332751 - DNA, 20 bp, human
gaacagccccgcaggtcccg

SEQ ID NO: 332752 - DNA, 20 bp, human
gctggctggggacaatgccg

SEQ ID NO: 332753 - DNA, 20 bp, human
gtgtccccagccagcgcctc

SEQ ID NO: 332754 - DNA, 20 bp, human
gcagcgcctcgggacctgcg

SEQ ID NO: 332755 - DNA, 20 bp, human
gtgagggcgctgcgcaaaaa

SEQ ID NO: 332756 - DNA, 20 bp, human
gtgggggctgccagcgtccc

SEQ ID NO: 332757 - DNA, 20 bp, human
ggcgccagtccatgcgaaag

SEQ ID NO: 332758 - DNA, 20 bp, human
gcgcgggtgagcaggtaacc

SEQ ID NO: 332759 - DNA, 20 bp, human
gccgtcgtccgcgtccacgg

SEQ ID NO: 332760 - DNA, 20 bp, human
gtcacttacagcatcgtgcg

SEQ ID NO: 332761 - DNA, 20 bp, human
gcacgatgctgtaagtgagc

SEQ ID NO: 332762 - DNA, 20 bp, human
gagcgccaccgaccgggatg

SEQ ID NO: 332763 - DNA, 20 bp, human
gtggcactcgaggatagagt

SEQ ID NO: 332764 - DNA, 20 bp, human
gctggagtcccgttgcgccc

SEQ ID NO: 332765 - DNA, 20 bp, human
gccatcgtggcgcctctacc

SEQ ID NO: 332766 - DNA, 20 bp, human
ggctttcctgagcaaaaccc

SEQ ID NO: 332767 - DNA, 20 bp, human
ggggagggacttaaccgagg

SEQ ID NO: 332768 - DNA, 20 bp, human
gagggggagggacttaaccg

SEQ ID NO: 332769 - DNA, 20 bp, human
gagtcggcgaactgtcgggg

SEQ ID NO: 332770 - DNA, 20 bp, human
gtgcagtcggcgaactgtcg

SEQ ID NO: 332771 - DNA, 20 bp, human
gggagaacattgtatgccca

SEQ ID NO: 332772 - DNA, 20 bp, human
ggccgcccccggatcgatgg

SEQ ID NO: 332773 - DNA, 20 bp, human
ggtgaaccaggggaaggcgt

SEQ ID NO: 332774 - DNA, 20 bp, human
gggggccgcccccggatcga

SEQ ID NO: 332775 - DNA, 20 bp, human
gtccccctcgccattcaaaa

SEQ ID NO: 332776 - DNA, 20 bp, human
gggggagggacttaacagag

SEQ ID NO: 332777 - DNA, 20 bp, human
gggagaacattgtatgcaca

SEQ ID NO: 332778 - DNA, 20 bp, human
ggccgcccccggatcgatgg

SEQ ID NO: 332779 - DNA, 20 bp, human
ggtgaaccaggggaaggcgt

SEQ ID NO: 332780 - DNA, 20 bp, human
gggggccgcccccggatcga

SEQ ID NO: 332781 - DNA, 20 bp, human
gtccgggccgcctgctggga

SEQ ID NO: 332782 - DNA, 20 bp, human
ggatgtgaggtgcagggagt

SEQ ID NO: 332783 - DNA, 20 bp, human
gcagcaggcggcccggacac

SEQ ID NO: 332784 - DNA, 20 bp, human
gaaagctagcagcccgaaag

SEQ ID NO: 332785 - DNA, 20 bp, human
ggaaccagcaagaagggcgg

SEQ ID NO: 332786 - DNA, 20 bp, human
gaagtggcctgccgctgagg

SEQ ID NO: 332787 - DNA, 20 bp, human
ggggcagagtcaagacagag

SEQ ID NO: 332788 - DNA, 20 bp, human
gaatgagaggggaacaatgg

SEQ ID NO: 332789 - DNA, 20 bp, human
gctccggggacaggccagat

SEQ ID NO: 332790 - DNA, 20 bp, human
gaggcggctgctgagggaaa

SEQ ID NO: 332791 - DNA, 20 bp, human
ggctaagtggcctgccgctg

SEQ ID NO: 332792 - DNA, 20 bp, human
ggcaggccacttagcttcac

SEQ ID NO: 332793 - DNA, 20 bp, human
gggacctgacccagttgagc

SEQ ID NO: 332794 - DNA, 20 bp, human
gtcccacatcctgctcaact

SEQ ID NO: 332795 - DNA, 20 bp, human
gagacaaaaacgggtgatca

SEQ ID NO: 332796 - DNA, 20 bp, human
gtggagggcttcatataaga

SEQ ID NO: 332797 - DNA, 20 bp, human
ggctaatagcgacagataga

SEQ ID NO: 332798 - DNA, 20 bp, human
ggaacagagaatcatcagac

SEQ ID NO: 332799 - DNA, 20 bp, human
gagccagtaccgatgatcag

SEQ ID NO: 332800 - DNA, 20 bp, human
ggtccactgatcatcggtac

SEQ ID NO: 332801 - DNA, 20 bp, human
gtgtagcacctgctactaat

SEQ ID NO: 332802 - DNA, 20 bp, human
gtgcttctcgcagcacatac

SEQ ID NO: 332803 - DNA, 20 bp, human
ggcgctcaccagtcagtgcg

SEQ ID NO: 332804 - DNA, 20 bp, human
gctaacactaagctgctagc

SEQ ID NO: 332805 - DNA, 20 bp, human
gcgctaaaccacgcactgac

SEQ ID NO: 332806 - DNA, 20 bp, human
ggtagcggaggctactggct

SEQ ID NO: 332807 - DNA, 20 bp, human
gagtccttgctcgcggggag

SEQ ID NO: 332808 - DNA, 20 bp, human
gcgggggagagccttttccg

SEQ ID NO: 332809 - DNA, 20 bp, human
gcttgctcgcggggagagga

SEQ ID NO: 332810 - DNA, 20 bp, human
ggtggctttcttgatttcgg

SEQ ID NO: 332811 - DNA, 20 bp, human
gtccctctcttcctcggaaa

SEQ ID NO: 332812 - DNA, 20 bp, human
ggagtgtgttctacgaacag

SEQ ID NO: 332813 - DNA, 20 bp, human
gcacacagcaaatgctgatc

SEQ ID NO: 332814 - DNA, 20 bp, human
ggagagaagtccttgctcgc

SEQ ID NO: 332815 - DNA, 20 bp, human
ggtgtgtgcaaggactggga

SEQ ID NO: 332816 - DNA, 20 bp, human
ggggtgcgcgagggagagaa

SEQ ID NO: 332817 - DNA, 20 bp, human
gaaggggagatgggctggtg

SEQ ID NO: 332818 - DNA, 20 bp, human
gcactctcgccctccctcct

SEQ ID NO: 332819 - DNA, 20 bp, human
gtgatggagtcacccaagga

SEQ ID NO: 332820 - DNA, 20 bp, human
ggcagtagattgaaaggcgg

SEQ ID NO: 332821 - DNA, 20 bp, human
gggcgggggtgggtgcgcga

SEQ ID NO: 332822 - DNA, 20 bp, human
gtggaagcacgctgattggc

SEQ ID NO: 332823 - DNA, 20 bp, human
gtgaaaggcggagggggagt

SEQ ID NO: 332824 - DNA, 20 bp, human
gaatgcagtagattgaaagg

SEQ ID NO: 332825 - DNA, 20 bp, human
gtgagcgtgccatgacaaag

SEQ ID NO: 332826 - DNA, 20 bp, human
ggagccctggcgggattcat

SEQ ID NO: 332827 - DNA, 20 bp, human
gaatcccgccagggctccat

SEQ ID NO: 332828 - DNA, 20 bp, human
gcggaggcggggggtagcgg

SEQ ID NO: 332829 - DNA, 20 bp, human
ggccagcgggctccagtctt

SEQ ID NO: 332830 - DNA, 20 bp, human
gcaggccaggcaggagcaat

SEQ ID NO: 332831 - DNA, 20 bp, human
gttggggcggggccaagcgg

SEQ ID NO: 332832 - DNA, 20 bp, human
gtcacaccggcgggaccaag

SEQ ID NO: 332833 - DNA, 20 bp, human
gcaggcaggagcaatagggc

SEQ ID NO: 332834 - DNA, 20 bp, human
gccaagcggaaacttcacac

SEQ ID NO: 332835 - DNA, 20 bp, human
gcctcccatgaatcccgcca

SEQ ID NO: 332836 - DNA, 20 bp, human
ggggcagaagggcacattca

SEQ ID NO: 332837 - DNA, 20 bp, human
ggtcactggctcttcaatta

SEQ ID NO: 332838 - DNA, 20 bp, human
gaggacgggaactcaaagag

SEQ ID NO: 332839 - DNA, 20 bp, human
gtcagagcgctcttgaaggg

SEQ ID NO: 332840 - DNA, 20 bp, human
gcagtcagagcgctcttgaa

SEQ ID NO: 332841 - DNA, 20 bp, human
gtggctcttcaattaaggac

SEQ ID NO: 332842 - DNA, 20 bp, human
ggctcctgaagactgcgaag

SEQ ID NO: 332843 - DNA, 20 bp, human
gaacttcagccaatagtcac

SEQ ID NO: 332844 - DNA, 20 bp, human
gtaactccatactctgccag

SEQ ID NO: 332845 - DNA, 20 bp, human
gggcagaagacactccctct

SEQ ID NO: 332846 - DNA, 20 bp, human
gcaagagagcgagtgggaga

SEQ ID NO: 332847 - DNA, 20 bp, human
gagcgtgcaagagagcgagt

SEQ ID NO: 332848 - DNA, 20 bp, human
gcacggccgggcgtccccaa

SEQ ID NO: 332849 - DNA, 20 bp, human
gcccggccgtgcgctttcgc

SEQ ID NO: 332850 - DNA, 20 bp, human
gcaaaccaggctcggagcac

SEQ ID NO: 332851 - DNA, 20 bp, human
gaacgggagattcccactag

SEQ ID NO: 332852 - DNA, 20 bp, human
gactctcccagacgcgaaaa

SEQ ID NO: 332853 - DNA, 20 bp, human
ggtcgcctgtgctccgagcc

SEQ ID NO: 332854 - DNA, 20 bp, human
gaaaagggacgagacaactg

SEQ ID NO: 332855 - DNA, 20 bp, human
gccgtgccagggcacttccg

SEQ ID NO: 332856 - DNA, 20 bp, human
gcagggtgctgacaagaaaa

SEQ ID NO: 332857 - DNA, 20 bp, human
gcgggtgattagcatatcgg

SEQ ID NO: 332858 - DNA, 20 bp, human
gacccgagccgggtagccaa

SEQ ID NO: 332859 - DNA, 20 bp, human
gcatgtagaggagttggcac

SEQ ID NO: 332860 - DNA, 20 bp, human
gtgtgggtagggggctgcaa

SEQ ID NO: 332861 - DNA, 20 bp, human
gttagaggggaaaacaagaa

SEQ ID NO: 332862 - DNA, 20 bp, human
ggctccaggagtaaaaggag

SEQ ID NO: 332863 - DNA, 20 bp, human
gctagccgcggcacggaggg

SEQ ID NO: 332864 - DNA, 20 bp, human
gtctgacaatccctttaatg

SEQ ID NO: 332865 - DNA, 20 bp, human
gagttctagccgcggcacgg

SEQ ID NO: 332866 - DNA, 20 bp, human
gagggagggagcgcggaaca

SEQ ID NO: 332867 - DNA, 20 bp, human
gcggccgcagcccggcgcga

SEQ ID NO: 332868 - DNA, 20 bp, human
gcaggccaatcagagcccgg

SEQ ID NO: 332869 - DNA, 20 bp, human
ggcagtcacgccctccctct

SEQ ID NO: 332870 - DNA, 20 bp, human
gagggagggcgtgactgccc

SEQ ID NO: 332871 - DNA, 20 bp, human
gaggagagccgggttccatg

SEQ ID NO: 332872 - DNA, 20 bp, human
gcttgcccgccggaccaccc

SEQ ID NO: 332873 - DNA, 20 bp, human
gcagtgcacctcatggaacc

SEQ ID NO: 332874 - DNA, 20 bp, human
gggcctgcatcttgcggcgc

SEQ ID NO: 332875 - DNA, 20 bp, human
gggacgcgctggcgctcccc

SEQ ID NO: 332876 - DNA, 20 bp, human
gacaaagtcttgtcaataga

SEQ ID NO: 332877 - DNA, 20 bp, human
gagaacatttcaaatctcat

SEQ ID NO: 332878 - DNA, 20 bp, human
gaaatgttctgggtcttaaa

SEQ ID NO: 332879 - DNA, 20 bp, human
gcccaagctatcctagaata

SEQ ID NO: 332880 - DNA, 20 bp, human
gcattttgaaaatcaacgaa

SEQ ID NO: 332881 - DNA, 20 bp, human
gatatgattcaccttattct

SEQ ID NO: 332882 - DNA, 20 bp, human
gatgtaaaattcctttaatg

SEQ ID NO: 332883 - DNA, 20 bp, human
gaataaaatgatgtaaggag

SEQ ID NO: 332884 - DNA, 20 bp, human
gcattactaaaagaaaatac

SEQ ID NO: 332885 - DNA, 20 bp, human
ggcatttaacaaattgcaga

SEQ ID NO: 332886 - DNA, 20 bp, human
gtgtggacgacagcgacatc

SEQ ID NO: 332887 - DNA, 20 bp, human
gggacgacagcgacatccgg

SEQ ID NO: 332888 - DNA, 20 bp, human
gtacttacacctaaagccac

SEQ ID NO: 332889 - DNA, 20 bp, human
gtataaagagacgtaatgtg

SEQ ID NO: 332890 - DNA, 20 bp, human
gctagtgatgactagatctt

SEQ ID NO: 332891 - DNA, 20 bp, human
gagcgacatccggtggcttt

SEQ ID NO: 332892 - DNA, 20 bp, human
gggctagtgagtaggataat

SEQ ID NO: 332893 - DNA, 20 bp, human
gaggataataggaatctaaa

SEQ ID NO: 332894 - DNA, 20 bp, human
gcaagcatcaactatctgtg

SEQ ID NO: 332895 - DNA, 20 bp, human
gggcatcagccagtttctca

SEQ ID NO: 332896 - DNA, 20 bp, human
gaacacgtgaaattctgtgg

SEQ ID NO: 332897 - DNA, 20 bp, human
gcaaaacacgtgaaattctg

SEQ ID NO: 332898 - DNA, 20 bp, human
gttaaccctagtttttcatg

SEQ ID NO: 332899 - DNA, 20 bp, human
ggcacagtactcacagtttt

SEQ ID NO: 332900 - DNA, 20 bp, human
ggatctattctcatctctgt

SEQ ID NO: 332901 - DNA, 20 bp, human
ggagatgagaatagatcatg

SEQ ID NO: 332902 - DNA, 20 bp, human
gtggtggaaagttcatttaa

SEQ ID NO: 332903 - DNA, 20 bp, human
gtaagcacgttggaaatatt

SEQ ID NO: 332904 - DNA, 20 bp, human
gtttccaacgtgcttattta

SEQ ID NO: 332905 - DNA, 20 bp, human
gaaagagaattcagttgtta

SEQ ID NO: 332906 - DNA, 20 bp, human
ggtaagctatataaggggag

SEQ ID NO: 332907 - DNA, 20 bp, human
gaattctaatgtttcgactt

SEQ ID NO: 332908 - DNA, 20 bp, human
gttcggtttagccacttcct

SEQ ID NO: 332909 - DNA, 20 bp, human
gcggaattgtaagctatata

SEQ ID NO: 332910 - DNA, 20 bp, human
gaagatcctgaggttctttt

SEQ ID NO: 332911 - DNA, 20 bp, human
gatgtcgctctacactcaga

SEQ ID NO: 332912 - DNA, 20 bp, human
gcagaacctacactttatca

SEQ ID NO: 332913 - DNA, 20 bp, human
gctaaaccgaaaagaacctc

SEQ ID NO: 332914 - DNA, 20 bp, human
gaagtacaagaaagatcctg

SEQ ID NO: 332915 - DNA, 20 bp, human
gtacgatggagtgcttgtga

SEQ ID NO: 332916 - DNA, 20 bp, human
ggcagtgatttgctgtttct

SEQ ID NO: 332917 - DNA, 20 bp, human
gtagttctgcatagtcatgt

SEQ ID NO: 332918 - DNA, 20 bp, human
gaatattcgacactcgtttt

SEQ ID NO: 332919 - DNA, 20 bp, human
ggaaacggcggctttcttcg

SEQ ID NO: 332920 - DNA, 20 bp, human
gcggtgaaggtgaaaaatat

SEQ ID NO: 332921 - DNA, 20 bp, human
gaacagccattgactccaaa

SEQ ID NO: 332922 - DNA, 20 bp, human
gataagaataaaatcggtga

SEQ ID NO: 332923 - DNA, 20 bp, human
gtcgttttgggacaattgat

SEQ ID NO: 332924 - DNA, 20 bp, human
gtatttgcagtgaaaatgtc

SEQ ID NO: 332925 - DNA, 20 bp, human
gttttatattagctgacaat

SEQ ID NO: 332926 - DNA, 20 bp, human
ggaggaataagagaagcagc

SEQ ID NO: 332927 - DNA, 20 bp, human
gcttcctagagaacactcta

SEQ ID NO: 332928 - DNA, 20 bp, human
gtcaccgtcactccagtctc

SEQ ID NO: 332929 - DNA, 20 bp, human
gcctagagaacactctatgg

SEQ ID NO: 332930 - DNA, 20 bp, human
gcatcatgtggctaaaagga

SEQ ID NO: 332931 - DNA, 20 bp, human
gctggagtgacggtgaaaag

SEQ ID NO: 332932 - DNA, 20 bp, human
gttaaaactagtcgattttc

SEQ ID NO: 332933 - DNA, 20 bp, human
gttttaaccagagtaaaaaa

SEQ ID NO: 332934 - DNA, 20 bp, human
gtgttacaaatttttcatct

SEQ ID NO: 332935 - DNA, 20 bp, human
gcatttaatcatagttaata

SEQ ID NO: 332936 - DNA, 20 bp, human
ggtggagaaagaccttgtgg

SEQ ID NO: 332937 - DNA, 20 bp, human
gagaaaagtggctgtcacat

SEQ ID NO: 332938 - DNA, 20 bp, human
gaaagttcaaacgacataca

SEQ ID NO: 332939 - DNA, 20 bp, human
gtgggtggtaaagaggttaa

SEQ ID NO: 332940 - DNA, 20 bp, human
ggatgtcgctgtccaccaca

SEQ ID NO: 332941 - DNA, 20 bp, human
gaattagtataaaagttcta

SEQ ID NO: 332942 - DNA, 20 bp, human
gagatgtccactgttaaaac

SEQ ID NO: 332943 - DNA, 20 bp, human
ggtgattcctgttttaacag

SEQ ID NO: 332944 - DNA, 20 bp, human
gcaattgaaactagaaattt

SEQ ID NO: 332945 - DNA, 20 bp, human
gtttcaattgtaatatcctt

SEQ ID NO: 332946 - DNA, 20 bp, human
gaaattccttctattcttac

SEQ ID NO: 332947 - DNA, 20 bp, human
gaggaaccatatacactctt

SEQ ID NO: 332948 - DNA, 20 bp, human
gaccacactcaatcaatcag

SEQ ID NO: 332949 - DNA, 20 bp, human
gaaaccgtaagtagcaattg

SEQ ID NO: 332950 - DNA, 20 bp, human
gtttacagtagagtgtgtgg

SEQ ID NO: 332951 - DNA, 20 bp, human
gtgcccctatggcgaaacta

SEQ ID NO: 332952 - DNA, 20 bp, human
ggaagtaaaagttgccccta

SEQ ID NO: 332953 - DNA, 20 bp, human
gtagtttacagtagagtgtg

SEQ ID NO: 332954 - DNA, 20 bp, human
gttgaggggactggtctcta

SEQ ID NO: 332955 - DNA, 20 bp, human
gttcagtcgtttcggagaat

SEQ ID NO: 332956 - DNA, 20 bp, human
gcgacatcatgtggatgaaa

SEQ ID NO: 332957 - DNA, 20 bp, human
gtctcccttcccagcctcaa

SEQ ID NO: 332958 - DNA, 20 bp, human
gggaagggagaaaaaccttc

SEQ ID NO: 332959 - DNA, 20 bp, human
ggatgtcgctggacaccgga

SEQ ID NO: 332960 - DNA, 20 bp, human
ggtgctggtgtattttatat

SEQ ID NO: 332961 - DNA, 20 bp, human
gaatttctctagtaaggatt

SEQ ID NO: 332962 - DNA, 20 bp, human
gagcacaaatttctctagta

SEQ ID NO: 332963 - DNA, 20 bp, human
gtcttacctgagtttcttct

SEQ ID NO: 332964 - DNA, 20 bp, human
gatttgttttatgagtaaca

SEQ ID NO: 332965 - DNA, 20 bp, human
gtattcctttgaggctggga

SEQ ID NO: 332966 - DNA, 20 bp, human
gttggctagctataacttca

SEQ ID NO: 332967 - DNA, 20 bp, human
gcaaattacaaacgtgagga

SEQ ID NO: 332968 - DNA, 20 bp, human
gcgtgcaaattacaaacgtg

SEQ ID NO: 332969 - DNA, 20 bp, human
gtcctaggaaagacagatgt

SEQ ID NO: 332970 - DNA, 20 bp, human
ggacatcatgcggctccaaa

SEQ ID NO: 332971 - DNA, 20 bp, human
gtaaattaataaaagaagtc

SEQ ID NO: 332972 - DNA, 20 bp, human
gaggttcttctgtgtaatga

SEQ ID NO: 332973 - DNA, 20 bp, human
ggtaaactattctacactct

SEQ ID NO: 332974 - DNA, 20 bp, human
gtggacttcaataatctata

SEQ ID NO: 332975 - DNA, 20 bp, human
gcagcaaatttaagtgttaa

SEQ ID NO: 332976 - DNA, 20 bp, human
gagtagattcttgagatcct

SEQ ID NO: 332977 - DNA, 20 bp, human
ggattgttagaagcattctt

SEQ ID NO: 332978 - DNA, 20 bp, human
gttcctgggatctagatcaa

SEQ ID NO: 332979 - DNA, 20 bp, human
gtgtactcttttagggaccc

SEQ ID NO: 332980 - DNA, 20 bp, human
gctgattacgaaagaatttg

SEQ ID NO: 332981 - DNA, 20 bp, human
gagcattcttaggcgactga

SEQ ID NO: 332982 - DNA, 20 bp, human
gttctttcgtaatcagcaaa

SEQ ID NO: 332983 - DNA, 20 bp, human
gttcctttgatctagatccc

SEQ ID NO: 332984 - DNA, 20 bp, human
gactatccagacacttctct

SEQ ID NO: 332985 - DNA, 20 bp, human
gcatgaggaagctacagttc

SEQ ID NO: 332986 - DNA, 20 bp, human
gcagaggcattcatactgtc

SEQ ID NO: 332987 - DNA, 20 bp, human
gcctagctgaaactaatgta

SEQ ID NO: 332988 - DNA, 20 bp, human
gtctgcaattgataaagtta

SEQ ID NO: 332989 - DNA, 20 bp, human
gttgaccaaccagaacttct

SEQ ID NO: 332990 - DNA, 20 bp, human
gaattacttccgcaatatct

SEQ ID NO: 332991 - DNA, 20 bp, human
gtagggatttcttcttcata

SEQ ID NO: 332992 - DNA, 20 bp, human
ggacatcatgtggcttcaaa

SEQ ID NO: 332993 - DNA, 20 bp, human
gcttccacacgaaactatgg

SEQ ID NO: 332994 - DNA, 20 bp, human
gactggtatatattactctg

SEQ ID NO: 332995 - DNA, 20 bp, human
gtgtcctccatagtttcgtg

SEQ ID NO: 332996 - DNA, 20 bp, human
gaggctccagcaagagaaac

SEQ ID NO: 332997 - DNA, 20 bp, human
gggcaaagagtgacatcacg

SEQ ID NO: 332998 - DNA, 20 bp, human
gctcccatatggctcgaaat

SEQ ID NO: 332999 - DNA, 20 bp, human
gaatacagcccttttcccat

SEQ ID NO: 333000 - DNA, 20 bp, human
ggaaatatgtacttacactt

SEQ ID NO: 333001 - DNA, 20 bp, human
gggattcagagagaacatcg

SEQ ID NO: 333002 - DNA, 20 bp, human
gggcagtcagtctgctaaga

SEQ ID NO: 333003 - DNA, 20 bp, human
gaagatcccgtttctcttgc

SEQ ID NO: 333004 - DNA, 20 bp, human
gggtcatacaaaacttttag

SEQ ID NO: 333005 - DNA, 20 bp, human
ggaattcagaatctcccata

SEQ ID NO: 333006 - DNA, 20 bp, human
gtgaccccggcgcacctctc

SEQ ID NO: 333007 - DNA, 20 bp, human
gccccccgaaagaagtgctg

SEQ ID NO: 333008 - DNA, 20 bp, human
gccgacgcgcggctcccaaa

SEQ ID NO: 333009 - DNA, 20 bp, human
gtcaaactgcctccggactc

SEQ ID NO: 333010 - DNA, 20 bp, human
gtgcgccggggtcagagcgc

SEQ ID NO: 333011 - DNA, 20 bp, human
gcagctcctgggatacaaga

SEQ ID NO: 333012 - DNA, 20 bp, human
gaccacaccttctaggctta

SEQ ID NO: 333013 - DNA, 20 bp, human
ggatgtggaggttaagatct

SEQ ID NO: 333014 - DNA, 20 bp, human
gccccggcgcacctctccgg

SEQ ID NO: 333015 - DNA, 20 bp, human
ggtgagcgaccacaccttct

SEQ ID NO: 333016 - DNA, 20 bp, human
gcctgcggtccgctgggatc

SEQ ID NO: 333017 - DNA, 20 bp, human
gaagtggcggacagcgaacc

SEQ ID NO: 333018 - DNA, 20 bp, human
ggaactggacagtgggggta

SEQ ID NO: 333019 - DNA, 20 bp, human
gcggtggagactggatgaac

SEQ ID NO: 333020 - DNA, 20 bp, human
gcggtccgctgggatccggc

SEQ ID NO: 333021 - DNA, 20 bp, human
gactggatgaactggacagt

SEQ ID NO: 333022 - DNA, 20 bp, human
gctgggatccggcaggtcca

SEQ ID NO: 333023 - DNA, 20 bp, human
gttaagcaggggagagacgg

SEQ ID NO: 333024 - DNA, 20 bp, human
gtccggcaggtccagggtga

SEQ ID NO: 333025 - DNA, 20 bp, human
ggggaaagggagcggtagga

SEQ ID NO: 333026 - DNA, 20 bp, human
gattccggagagttaggtag

SEQ ID NO: 333027 - DNA, 20 bp, human
gcaacctctacctaactctc

SEQ ID NO: 333028 - DNA, 20 bp, human
gttcctgaaagggaattaac

SEQ ID NO: 333029 - DNA, 20 bp, human
gtaatacattcgctagactg

SEQ ID NO: 333030 - DNA, 20 bp, human
ggggcttcggaagactctgc

SEQ ID NO: 333031 - DNA, 20 bp, human
ggctacatctgcacactctg

SEQ ID NO: 333032 - DNA, 20 bp, human
gggaagtggtcagtaggaaa

SEQ ID NO: 333033 - DNA, 20 bp, human
ggctccctgcctcatatatt

SEQ ID NO: 333034 - DNA, 20 bp, human
gaatgggctcggctagcctt

SEQ ID NO: 333035 - DNA, 20 bp, human
gcacctgttaattccctttc

SEQ ID NO: 333036 - DNA, 20 bp, human
gcaggctaaagagacggttt

SEQ ID NO: 333037 - DNA, 20 bp, human
ggggtacaactactgaaatc

SEQ ID NO: 333038 - DNA, 20 bp, human
gtcagtagttgtacccattt

SEQ ID NO: 333039 - DNA, 20 bp, human
gctatgcaagtcactaataa

SEQ ID NO: 333040 - DNA, 20 bp, human
gcggtttgggaattgctctg

SEQ ID NO: 333041 - DNA, 20 bp, human
gtacaactactgaaatctgg

SEQ ID NO: 333042 - DNA, 20 bp, human
ggagttgtgtctgagatgaa

SEQ ID NO: 333043 - DNA, 20 bp, human
gagctaaatttagcacagtg

SEQ ID NO: 333044 - DNA, 20 bp, human
gacacaatgtcaagaatcaa

SEQ ID NO: 333045 - DNA, 20 bp, human
gggaaaatgttgctgacatc

SEQ ID NO: 333046 - DNA, 20 bp, human
gcaccacaactaagcacgtt

SEQ ID NO: 333047 - DNA, 20 bp, human
gcgtttggttgtatggagaa

SEQ ID NO: 333048 - DNA, 20 bp, human
gcggaggacatataagtgaa

SEQ ID NO: 333049 - DNA, 20 bp, human
gaatctatggagacacttgg

SEQ ID NO: 333050 - DNA, 20 bp, human
gaaccaaacgtgcttagttg

SEQ ID NO: 333051 - DNA, 20 bp, human
gcagaaagattacaaaccac

SEQ ID NO: 333052 - DNA, 20 bp, human
gaccaaactgtgaaaatcta

SEQ ID NO: 333053 - DNA, 20 bp, human
gaaatacaagatgtgattcc

SEQ ID NO: 333054 - DNA, 20 bp, human
gaactggattaaccatgaga

SEQ ID NO: 333055 - DNA, 20 bp, human
ggaaaaggcaaactatacat

SEQ ID NO: 333056 - DNA, 20 bp, human
gaatctgtggagacgcgtgg

SEQ ID NO: 333057 - DNA, 20 bp, human
gtaccacaactgaacacatt

SEQ ID NO: 333058 - DNA, 20 bp, human
ggggtctacaacatcctcca

SEQ ID NO: 333059 - DNA, 20 bp, human
gaagaaaaaaattaccctgg

SEQ ID NO: 333060 - DNA, 20 bp, human
ggaaaatctgtggagacgcg

SEQ ID NO: 333061 - DNA, 20 bp, human
gctggattaaccatgagatg

SEQ ID NO: 333062 - DNA, 20 bp, human
gcatgagatgaggcatatat

SEQ ID NO: 333063 - DNA, 20 bp, human
gatcaaactgtgaaaatctg

SEQ ID NO: 333064 - DNA, 20 bp, human
ggaatataaaacgattatta

SEQ ID NO: 333065 - DNA, 20 bp, human
gtccttacgtgataaggtaa

SEQ ID NO: 333066 - DNA, 20 bp, human
gtgcaccccgagactatgta

SEQ ID NO: 333067 - DNA, 20 bp, human
gtgtaaccttacatagtctc

SEQ ID NO: 333068 - DNA, 20 bp, human
gatagtctcggggtgcatac

SEQ ID NO: 333069 - DNA, 20 bp, human
gagtccggcgatattaacgg

SEQ ID NO: 333070 - DNA, 20 bp, human
gttgtctgctcactaaagtc

SEQ ID NO: 333071 - DNA, 20 bp, human
gacattttgtggaatgataa

SEQ ID NO: 333072 - DNA, 20 bp, human
gagattcctcatgtttaagg

SEQ ID NO: 333073 - DNA, 20 bp, human
gactaatgtgatttctcctt

SEQ ID NO: 333074 - DNA, 20 bp, human
gggtatataccttattttta

SEQ ID NO: 333075 - DNA, 20 bp, human
ggatattaaccttaaaaata

SEQ ID NO: 333076 - DNA, 20 bp, human
gagacacatggtggcgctac

SEQ ID NO: 333077 - DNA, 20 bp, human
gacggtgagcttcgctattc

SEQ ID NO: 333078 - DNA, 20 bp, human
gacgaaaacagtacataggc

SEQ ID NO: 333079 - DNA, 20 bp, human
gccaacagcaaaggacattt

SEQ ID NO: 333080 - DNA, 20 bp, human
gaacttgagcaataattcct

SEQ ID NO: 333081 - DNA, 20 bp, human
gaaaaaaacatggagacaca

SEQ ID NO: 333082 - DNA, 20 bp, human
gggatttgtttcgaatgttc

SEQ ID NO: 333083 - DNA, 20 bp, human
ggtgtaatttatactgcatt

SEQ ID NO: 333084 - DNA, 20 bp, human
gacttgttgtcagctatagt

SEQ ID NO: 333085 - DNA, 20 bp, human
gtttgaatgctcggcactaa

SEQ ID NO: 333086 - DNA, 20 bp, human
gactacaggctctggagggt

SEQ ID NO: 333087 - DNA, 20 bp, human
gacacccagactacaggctc

SEQ ID NO: 333088 - DNA, 20 bp, human
gaacactacacccagactac

SEQ ID NO: 333089 - DNA, 20 bp, human
gcctccagagcctgtagtct

SEQ ID NO: 333090 - DNA, 20 bp, human
ggtctgggtgtagtgttctg

SEQ ID NO: 333091 - DNA, 20 bp, human
gaagcaaagacaacgcatgg

SEQ ID NO: 333092 - DNA, 20 bp, human
gtaatcacaatatcacgcaa

SEQ ID NO: 333093 - DNA, 20 bp, human
gatctattctctattctatt

SEQ ID NO: 333094 - DNA, 20 bp, human
ggagcacaattctggtacat

SEQ ID NO: 333095 - DNA, 20 bp, human
gaccaatgggagcacaattc

SEQ ID NO: 333096 - DNA, 20 bp, human
ggcgctgcaggttaagatga

SEQ ID NO: 333097 - DNA, 20 bp, human
gagctctgtgatgttgtaca

SEQ ID NO: 333098 - DNA, 20 bp, human
gtactgtggttgaatattgg

SEQ ID NO: 333099 - DNA, 20 bp, human
gtgactttcgtgtatacaga

SEQ ID NO: 333100 - DNA, 20 bp, human
gcaactgcctacgcagctcc

SEQ ID NO: 333101 - DNA, 20 bp, human
gtctgtgatgttgtacaggg

SEQ ID NO: 333102 - DNA, 20 bp, human
gaagactcagtgagaacgcg

SEQ ID NO: 333103 - DNA, 20 bp, human
gctactcatagtgtctatat

SEQ ID NO: 333104 - DNA, 20 bp, human
gtaagtgtgtattctatgtc

SEQ ID NO: 333105 - DNA, 20 bp, human
ggaaacggtttgctggatcc

SEQ ID NO: 333106 - DNA, 20 bp, human
gcgaaacgccaataagactt

SEQ ID NO: 333107 - DNA, 20 bp, human
gtgggtaaggagcgtcggct

SEQ ID NO: 333108 - DNA, 20 bp, human
gaatactcggaagagacgcg

SEQ ID NO: 333109 - DNA, 20 bp, human
ggtatctgggtaaggagcgt

SEQ ID NO: 333110 - DNA, 20 bp, human
gcagcctgaaagaaagcact

SEQ ID NO: 333111 - DNA, 20 bp, human
gtcattgcacccatagagac

SEQ ID NO: 333112 - DNA, 20 bp, human
gactcggaagagacgcgggg

SEQ ID NO: 333113 - DNA, 20 bp, human
gctagcatgcttcggaaaga

SEQ ID NO: 333114 - DNA, 20 bp, human
gaaaaagcttggatttgtga

SEQ ID NO: 333115 - DNA, 20 bp, human
gttagctgagtatctgggta

SEQ ID NO: 333116 - DNA, 20 bp, human
gcctccagtagcgtcaacta

SEQ ID NO: 333117 - DNA, 20 bp, human
gcaaccctagttgacgctac

SEQ ID NO: 333118 - DNA, 20 bp, human
ggtaactgcaagcgaacgca

SEQ ID NO: 333119 - DNA, 20 bp, human
gactgcaagcgaacgcatgg

SEQ ID NO: 333120 - DNA, 20 bp, human
gtgtaaatgaggactctacc

SEQ ID NO: 333121 - DNA, 20 bp, human
gccgttaaatcgtgtaaatg

SEQ ID NO: 333122 - DNA, 20 bp, human
gtaattattacaaaagggga

SEQ ID NO: 333123 - DNA, 20 bp, human
ggcttgcagttacaaaatct

SEQ ID NO: 333124 - DNA, 20 bp, human
gggctcatttcacaaagttt

SEQ ID NO: 333125 - DNA, 20 bp, human
gttccagattatcatgctca

SEQ ID NO: 333126 - DNA, 20 bp, human
gaatacgcgcgagcttttta

SEQ ID NO: 333127 - DNA, 20 bp, human
gaacttcaagacaacgtatt

SEQ ID NO: 333128 - DNA, 20 bp, human
gtctcaatcaagacgcaggg

SEQ ID NO: 333129 - DNA, 20 bp, human
ggtaatacaggtgaatagac

SEQ ID NO: 333130 - DNA, 20 bp, human
gaatttctcaatcaagacgc

SEQ ID NO: 333131 - DNA, 20 bp, human
gaatgtgcaaatagtaatac

SEQ ID NO: 333132 - DNA, 20 bp, human
gtataaaaatttgtctcctg

SEQ ID NO: 333133 - DNA, 20 bp, human
gtttcactgataagcgtgtg

SEQ ID NO: 333134 - DNA, 20 bp, human
gcgactacctttgaaacgaa

SEQ ID NO: 333135 - DNA, 20 bp, human
gttaagatgttctctataca

SEQ ID NO: 333136 - DNA, 20 bp, human
gtaagagctggagataccat

SEQ ID NO: 333137 - DNA, 20 bp, human
gggagagcttatgtgacaaa

SEQ ID NO: 333138 - DNA, 20 bp, human
ggcgctgcaggctaagagtg

SEQ ID NO: 333139 - DNA, 20 bp, human
ggtcacataagctctcccga

SEQ ID NO: 333140 - DNA, 20 bp, human
gtacacgtcagttagaattt

SEQ ID NO: 333141 - DNA, 20 bp, human
gcttatgtgacaaaagggta

SEQ ID NO: 333142 - DNA, 20 bp, human
ggtgtggatagtgggctctg

SEQ ID NO: 333143 - DNA, 20 bp, human
gaggacagtgcttatctttt

SEQ ID NO: 333144 - DNA, 20 bp, human
ggtccccacctgctattgtc

SEQ ID NO: 333145 - DNA, 20 bp, human
gaaccagacaatagcaggtg

SEQ ID NO: 333146 - DNA, 20 bp, human
ggaaagctctgcagactcgg

SEQ ID NO: 333147 - DNA, 20 bp, human
gggggagtgaacccaggaat

SEQ ID NO: 333148 - DNA, 20 bp, human
gtctagaggggagtgaaccc

SEQ ID NO: 333149 - DNA, 20 bp, human
gtccctggtggtgctaatta

SEQ ID NO: 333150 - DNA, 20 bp, human
ggtttctcaaactgagtgcg

SEQ ID NO: 333151 - DNA, 20 bp, human
ggaacttgaatcaaattccc

SEQ ID NO: 333152 - DNA, 20 bp, human
gtagtttgaacgcgtggtgg

SEQ ID NO: 333153 - DNA, 20 bp, human
gtccttaattagcaccacca

SEQ ID NO: 333154 - DNA, 20 bp, human
gtttgattcaagttctagag

SEQ ID NO: 333155 - DNA, 20 bp, human
gaataattgcttgcgagcgt

SEQ ID NO: 333156 - DNA, 20 bp, human
gcaaaaagatggcggattga

SEQ ID NO: 333157 - DNA, 20 bp, human
gaatgaaacagcaaagatac

SEQ ID NO: 333158 - DNA, 20 bp, human
gataacatccacaaaacgca

SEQ ID NO: 333159 - DNA, 20 bp, human
gacatccacaaaacgcaagg

SEQ ID NO: 333160 - DNA, 20 bp, human
gagcgccaccttgcgttttg

SEQ ID NO: 333161 - DNA, 20 bp, human
gttgttctagtcttgataac

SEQ ID NO: 333162 - DNA, 20 bp, human
gcgaatccagattatcacag

SEQ ID NO: 333163 - DNA, 20 bp, human
ggtgttccaagaaatatcac

SEQ ID NO: 333164 - DNA, 20 bp, human
ggcattactgtgaccatttg

SEQ ID NO: 333165 - DNA, 20 bp, human
gttatagtcttcttaaatct

SEQ ID NO: 333166 - DNA, 20 bp, human
ggtaactttacatagtccca

SEQ ID NO: 333167 - DNA, 20 bp, human
gatagtcccagggtacatac

SEQ ID NO: 333168 - DNA, 20 bp, human
gactaacgcaatttctcctt

SEQ ID NO: 333169 - DNA, 20 bp, human
gactctgcctgtatgtaccc

SEQ ID NO: 333170 - DNA, 20 bp, human
gttgtctgctcagtaacgtc

SEQ ID NO: 333171 - DNA, 20 bp, human
gcgtccggcgatattaaccg

SEQ ID NO: 333172 - DNA, 20 bp, human
gaaactatgtacccggtata

SEQ ID NO: 333173 - DNA, 20 bp, human
gaatataatagtagttaaca

SEQ ID NO: 333174 - DNA, 20 bp, human
gcaatttgataccaccaggt

SEQ ID NO: 333175 - DNA, 20 bp, human
gtatcaaattgccatatacc

SEQ ID NO: 333176 - DNA, 20 bp, human
gcaggctaaagagacggttt

SEQ ID NO: 333177 - DNA, 20 bp, human
ggggtacaactactgaaatc

SEQ ID NO: 333178 - DNA, 20 bp, human
gtcagtagttgtacccattt

SEQ ID NO: 333179 - DNA, 20 bp, human
gtacaactactgaaatctgg

SEQ ID NO: 333180 - DNA, 20 bp, human
gcggtttgggaattgctctg

SEQ ID NO: 333181 - DNA, 20 bp, human
ggagttgtgtctgagatgaa

SEQ ID NO: 333182 - DNA, 20 bp, human
gagctaaatttagcacagtg

SEQ ID NO: 333183 - DNA, 20 bp, human
gacacaatgtcaagaatcaa

SEQ ID NO: 333184 - DNA, 20 bp, human
gggaaaatgttgctgacatc

SEQ ID NO: 333185 - DNA, 20 bp, human
gtttatgagagaatagagga

SEQ ID NO: 333186 - DNA, 20 bp, human
gaggaatgcagtaactggtt

SEQ ID NO: 333187 - DNA, 20 bp, human
ggcagtacacacaggtcagg

SEQ ID NO: 333188 - DNA, 20 bp, human
gcaggcagtacacacaggtc

SEQ ID NO: 333189 - DNA, 20 bp, human
gctaccagattagtgaacag

SEQ ID NO: 333190 - DNA, 20 bp, human
gttgctaggaatgcagtaac

SEQ ID NO: 333191 - DNA, 20 bp, human
ggtacacacaggtcaggagg

SEQ ID NO: 333192 - DNA, 20 bp, human
gagtaactggttaggactgt

SEQ ID NO: 333193 - DNA, 20 bp, human
gagatacaggcagtacacac

SEQ ID NO: 333194 - DNA, 20 bp, human
gaaggttttcagtatttgct

SEQ ID NO: 333195 - DNA, 20 bp, human
gtcactaatctggtagatac

SEQ ID NO: 333196 - DNA, 20 bp, human
gttgggtgcagtaacttctt

SEQ ID NO: 333197 - DNA, 20 bp, human
gacccaagtgatacatgcaa

SEQ ID NO: 333198 - DNA, 20 bp, human
gtaggggaggtgtgataaag

SEQ ID NO: 333199 - DNA, 20 bp, human
gggaaagtaaactattctgt

SEQ ID NO: 333200 - DNA, 20 bp, human
ggcgccgctgttcacctact

SEQ ID NO: 333201 - DNA, 20 bp, human
gctgcgttttctctcctagt

SEQ ID NO: 333202 - DNA, 20 bp, human
gtactatatgtaggtttctt

SEQ ID NO: 333203 - DNA, 20 bp, human
ggagaatccggattgagctc

SEQ ID NO: 333204 - DNA, 20 bp, human
gttaggtcatattagtgtct

SEQ ID NO: 333205 - DNA, 20 bp, human
gttccattgcatgtatcact

SEQ ID NO: 333206 - DNA, 20 bp, human
gcgccgctgctcaccaatca

SEQ ID NO: 333207 - DNA, 20 bp, human
gtgctcaccaatcagggaat

SEQ ID NO: 333208 - DNA, 20 bp, human
gtgagcgtaatcatttcttc

SEQ ID NO: 333209 - DNA, 20 bp, human
gcagcttcccattccctgat

SEQ ID NO: 333210 - DNA, 20 bp, human
gaaaacttgtaggttgtagt

SEQ ID NO: 333211 - DNA, 20 bp, human
gtcgttgcaataataagaat

SEQ ID NO: 333212 - DNA, 20 bp, human
gactggagctgaaaacttgt

SEQ ID NO: 333213 - DNA, 20 bp, human
gtaccaagaacacctgcgaa

SEQ ID NO: 333214 - DNA, 20 bp, human
gaaactacatgggtaatctc

SEQ ID NO: 333215 - DNA, 20 bp, human
gcggtcccgataaaatcatc

SEQ ID NO: 333216 - DNA, 20 bp, human
gctccccgattggtgaacag

SEQ ID NO: 333217 - DNA, 20 bp, human
gttcaagattgtgcagtaat

SEQ ID NO: 333218 - DNA, 20 bp, human
gcgccgctgttcaccaatcg

SEQ ID NO: 333219 - DNA, 20 bp, human
gccacctactgttcttcaaa

SEQ ID NO: 333220 - DNA, 20 bp, human
gtccataataggtgtgttgg

SEQ ID NO: 333221 - DNA, 20 bp, human
gaagcacaaagcagatagct

SEQ ID NO: 333222 - DNA, 20 bp, human
ggattgtgcagtaattggtt

SEQ ID NO: 333223 - DNA, 20 bp, human
gtgtgcttcaggcgcgtgca

SEQ ID NO: 333224 - DNA, 20 bp, human
gtccccttttgaagaacagt

SEQ ID NO: 333225 - DNA, 20 bp, human
gaggcgcgtgcaaggcgagc

SEQ ID NO: 333226 - DNA, 20 bp, human
gcggctcccacagcacaagg

SEQ ID NO: 333227 - DNA, 20 bp, human
ggggagccgtattgctggat

SEQ ID NO: 333228 - DNA, 20 bp, human
gctcccacagcacaaggggg

SEQ ID NO: 333229 - DNA, 20 bp, human
gtcgctgccttttactcctt

SEQ ID NO: 333230 - DNA, 20 bp, human
gcgtcgctgttgaccaccta

SEQ ID NO: 333231 - DNA, 20 bp, human
ggctgtgggagccgtattgc

SEQ ID NO: 333232 - DNA, 20 bp, human
ggcacaagggggtggaggtt

SEQ ID NO: 333233 - DNA, 20 bp, human
gctccacccccttgtgctgt

SEQ ID NO: 333234 - DNA, 20 bp, human
gctgccttttactccttagg

SEQ ID NO: 333235 - DNA, 20 bp, human
gataatttctgcacctgctc

SEQ ID NO: 333236 - DNA, 20 bp, human
gccttcttgtcagagataag

SEQ ID NO: 333237 - DNA, 20 bp, human
gtcaagaaggagaacgcagc

SEQ ID NO: 333238 - DNA, 20 bp, human
gggtcaacagcgacactaag

SEQ ID NO: 333239 - DNA, 20 bp, human
gtggcattaaggttagtgca

SEQ ID NO: 333240 - DNA, 20 bp, human
gcaagaaggatttcagatct

SEQ ID NO: 333241 - DNA, 20 bp, human
gcgctgttgaccactcaaga

SEQ ID NO: 333242 - DNA, 20 bp, human
ggaggatgcagtaaacggtt

SEQ ID NO: 333243 - DNA, 20 bp, human
gagcaatattggtggcatta

SEQ ID NO: 333244 - DNA, 20 bp, human
gacctcaagttatctttctt

SEQ ID NO: 333245 - DNA, 20 bp, human
gatgtttgaagcaatattgg

SEQ ID NO: 333246 - DNA, 20 bp, human
gtcgctgttcaccaatcagg

SEQ ID NO: 333247 - DNA, 20 bp, human
gaatacgctatactgagaat

SEQ ID NO: 333248 - DNA, 20 bp, human
gaatttgactttattatctt

SEQ ID NO: 333249 - DNA, 20 bp, human
gcagtaacaggttaagactc

SEQ ID NO: 333250 - DNA, 20 bp, human
gcagtatagcgtattgtgtg

SEQ ID NO: 333251 - DNA, 20 bp, human
gcattgccccaggttctaga

SEQ ID NO: 333252 - DNA, 20 bp, human
gaagaataaattgcagtaac

SEQ ID NO: 333253 - DNA, 20 bp, human
gtagagggtcaactcctgtg

SEQ ID NO: 333254 - DNA, 20 bp, human
ggagttgaccctctagaacc

SEQ ID NO: 333255 - DNA, 20 bp, human
gttcataaagtttattgtac

SEQ ID NO: 333256 - DNA, 20 bp, human
ggaaaatgggcgtggagcgt

SEQ ID NO: 333257 - DNA, 20 bp, human
ggaaaggtgcatggagaact

SEQ ID NO: 333258 - DNA, 20 bp, human
gcagagtcgggtcgcctctg

SEQ ID NO: 333259 - DNA, 20 bp, human
ggctacacagttaaacatta

SEQ ID NO: 333260 - DNA, 20 bp, human
gtggagcgttggcttttcgt

SEQ ID NO: 333261 - DNA, 20 bp, human
gtgtcgctgttgaccaaagt

SEQ ID NO: 333262 - DNA, 20 bp, human
gtccacgcccattttcgtca

SEQ ID NO: 333263 - DNA, 20 bp, human
gtccctgacgaaaatgggcg

SEQ ID NO: 333264 - DNA, 20 bp, human
gtcagggaatatgtacccat

SEQ ID NO: 333265 - DNA, 20 bp, human
gctggtctgtgtgtttagta

SEQ ID NO: 333266 - DNA, 20 bp, human
gctaaatgcttcattatctt

SEQ ID NO: 333267 - DNA, 20 bp, human
gcgtcgctgttgaccaacct

SEQ ID NO: 333268 - DNA, 20 bp, human
gaacgatgcagtattaagtt

SEQ ID NO: 333269 - DNA, 20 bp, human
gtgcttcattatcttgggga

SEQ ID NO: 333270 - DNA, 20 bp, human
gaaaatgggactagcataaa

SEQ ID NO: 333271 - DNA, 20 bp, human
gttgtgaaactatcacacag

SEQ ID NO: 333272 - DNA, 20 bp, human
gaacaacaaagcaaattaga

SEQ ID NO: 333273 - DNA, 20 bp, human
gacctgggcaagaaaatcaa

SEQ ID NO: 333274 - DNA, 20 bp, human
ggctagtcccattttcagta

SEQ ID NO: 333275 - DNA, 20 bp, human
gatgggactagcataaatgg

SEQ ID NO: 333276 - DNA, 20 bp, human
gcgccgctgttcaccaacca

SEQ ID NO: 333277 - DNA, 20 bp, human
gttcaccaaccagggaaaaa

SEQ ID NO: 333278 - DNA, 20 bp, human
gaaaactcggtggtttctgt

SEQ ID NO: 333279 - DNA, 20 bp, human
ggtggtgcagtaacttagta

SEQ ID NO: 333280 - DNA, 20 bp, human
gcgcaccatttttccctggt

SEQ ID NO: 333281 - DNA, 20 bp, human
gtgtattgtgtgcatcaatg

SEQ ID NO: 333282 - DNA, 20 bp, human
gtgcaacagtgttcatggac

SEQ ID NO: 333283 - DNA, 20 bp, human
gtgggaaaatcagttattga

SEQ ID NO: 333284 - DNA, 20 bp, human
gctcacacgttattgcacat

SEQ ID NO: 333285 - DNA, 20 bp, human
gattaatgcaacagtgttca

SEQ ID NO: 333286 - DNA, 20 bp, human
gctcagtgcagtaactattt

SEQ ID NO: 333287 - DNA, 20 bp, human
ggccaaagaatgtgagatga

SEQ ID NO: 333288 - DNA, 20 bp, human
gaccttcatctcacattctt

SEQ ID NO: 333289 - DNA, 20 bp, human
gaatgatcagattgtagcat

SEQ ID NO: 333290 - DNA, 20 bp, human
gataaagcttagagcacaat

SEQ ID NO: 333291 - DNA, 20 bp, human
gtgagtcagtcatctccagt

SEQ ID NO: 333292 - DNA, 20 bp, human
ggagactaaaatagacctac

SEQ ID NO: 333293 - DNA, 20 bp, human
ggctgtttcttttaaaatat

SEQ ID NO: 333294 - DNA, 20 bp, human
gcacatttctgcaatacatt

SEQ ID NO: 333295 - DNA, 20 bp, human
gcttttaaaatatgggttta

SEQ ID NO: 333296 - DNA, 20 bp, human
ggtgggtgtagtaacggctt

SEQ ID NO: 333297 - DNA, 20 bp, human
gacatcagtgggtgtagtaa

SEQ ID NO: 333298 - DNA, 20 bp, human
gtgtgtaacattatatcaga

SEQ ID NO: 333299 - DNA, 20 bp, human
ggcagaactggaaatccgga

SEQ ID NO: 333300 - DNA, 20 bp, human
gtcaactctaagcgaaaatc

SEQ ID NO: 333301 - DNA, 20 bp, human
gcgaaaatcaggactccatc

SEQ ID NO: 333302 - DNA, 20 bp, human
ggcttagagttgatcaacag

SEQ ID NO: 333303 - DNA, 20 bp, human
gatctgagttgtaaataaag

SEQ ID NO: 333304 - DNA, 20 bp, human
gccagaaaataatttcaaag

SEQ ID NO: 333305 - DNA, 20 bp, human
gttttatgtgcaatcttgtt

SEQ ID NO: 333306 - DNA, 20 bp, human
gggcgccgctgtcgaccaaa

SEQ ID NO: 333307 - DNA, 20 bp, human
gcggcgcccagaggttgtct

SEQ ID NO: 333308 - DNA, 20 bp, human
gcctccagcaaattaaagac

SEQ ID NO: 333309 - DNA, 20 bp, human
ggtcgaccaaaaggaagtga

SEQ ID NO: 333310 - DNA, 20 bp, human
gttgtcttggaaaactgcac

SEQ ID NO: 333311 - DNA, 20 bp, human
gtaccctgtctttaatttgc

SEQ ID NO: 333312 - DNA, 20 bp, human
gtctgcaggagcgtcaggca

SEQ ID NO: 333313 - DNA, 20 bp, human
gacttccttttggtcgacag

SEQ ID NO: 333314 - DNA, 20 bp, human
gggtgccttcctgctttgtc

SEQ ID NO: 333315 - DNA, 20 bp, human
ggctttgaggataaaaagct

SEQ ID NO: 333316 - DNA, 20 bp, human
ggacgctcagaggttttctc

SEQ ID NO: 333317 - DNA, 20 bp, human
gtctcaggaaactgcactaa

SEQ ID NO: 333318 - DNA, 20 bp, human
gcaaaagatgcattcagcat

SEQ ID NO: 333319 - DNA, 20 bp, human
gaacctctgagcgtcgctgt

SEQ ID NO: 333320 - DNA, 20 bp, human
gtatactggccttctctgtg

SEQ ID NO: 333321 - DNA, 20 bp, human
gctggccttctctgtgtggt

SEQ ID NO: 333322 - DNA, 20 bp, human
gcggagatatgtcttgtata

SEQ ID NO: 333323 - DNA, 20 bp, human
gagaacgaagagaagcgttt

SEQ ID NO: 333324 - DNA, 20 bp, human
ggagaaggccagtatagatt

SEQ ID NO: 333325 - DNA, 20 bp, human
gcaggaagttcccctctaag

SEQ ID NO: 333326 - DNA, 20 bp, human
gaggcgccgggtgccgctct

SEQ ID NO: 333327 - DNA, 20 bp, human
gactaaatcagctccaaata

SEQ ID NO: 333328 - DNA, 20 bp, human
ggtaccttttacttgtcaaa

SEQ ID NO: 333329 - DNA, 20 bp, human
gactagccaagagcggcacc

SEQ ID NO: 333330 - DNA, 20 bp, human
gagttctgcagcagaggcgc

SEQ ID NO: 333331 - DNA, 20 bp, human
gtcctaactagctccttatt

SEQ ID NO: 333332 - DNA, 20 bp, human
gtggaaactaaaaacgtgac

SEQ ID NO: 333333 - DNA, 20 bp, human
gaaaaggtacttgatttgga

SEQ ID NO: 333334 - DNA, 20 bp, human
gcttactctagtagaaatga

SEQ ID NO: 333335 - DNA, 20 bp, human
gcagaagacgtagtataaag

SEQ ID NO: 333336 - DNA, 20 bp, human
gcgtctaaaaatgtactctt

SEQ ID NO: 333337 - DNA, 20 bp, human
ggcgccgctgttggccaaag

SEQ ID NO: 333338 - DNA, 20 bp, human
gagtgcatgtttgaagattg

SEQ ID NO: 333339 - DNA, 20 bp, human
gcctaaaaatcctcaaagtt

SEQ ID NO: 333340 - DNA, 20 bp, human
gttaggccaagtctgtgtta

SEQ ID NO: 333341 - DNA, 20 bp, human
gctgtactctgagacggttt

SEQ ID NO: 333342 - DNA, 20 bp, human
gttactcattagaaatatac

SEQ ID NO: 333343 - DNA, 20 bp, human
ggatagccataacacagact

SEQ ID NO: 333344 - DNA, 20 bp, human
gtggtattactgatactctc

SEQ ID NO: 333345 - DNA, 20 bp, human
gtgccttcatcccaactttg

SEQ ID NO: 333346 - DNA, 20 bp, human
gacaaaaacaattactgcac

SEQ ID NO: 333347 - DNA, 20 bp, human
gagttctagctaagagttca

SEQ ID NO: 333348 - DNA, 20 bp, human
gttgcagaatggtgaaagaa

SEQ ID NO: 333349 - DNA, 20 bp, human
gagaatggaccaatgtatgc

SEQ ID NO: 333350 - DNA, 20 bp, human
gaaacttggcttgttaagtt

SEQ ID NO: 333351 - DNA, 20 bp, human
gtgaaatcagtatagtatga

SEQ ID NO: 333352 - DNA, 20 bp, human
ggtatatggacgtaaaaact

SEQ ID NO: 333353 - DNA, 20 bp, human
gttgttagaaatatcacgtt

SEQ ID NO: 333354 - DNA, 20 bp, human
gtatacaaacctgcatacat

SEQ ID NO: 333355 - DNA, 20 bp, human
gaattataacaacttcttta

SEQ ID NO: 333356 - DNA, 20 bp, human
ggcgcccagaggctccgtgc

SEQ ID NO: 333357 - DNA, 20 bp, human
gctgtcccgcacggagcctc

SEQ ID NO: 333358 - DNA, 20 bp, human
gtggtgagagcaaaatttga

SEQ ID NO: 333359 - DNA, 20 bp, human
gtggtgatcattgttgaagg

SEQ ID NO: 333360 - DNA, 20 bp, human
gcggtttttcattttgaatt

SEQ ID NO: 333361 - DNA, 20 bp, human
gaccgggctgctgtcccgca

SEQ ID NO: 333362 - DNA, 20 bp, human
gtaaacaaagattggctttg

SEQ ID NO: 333363 - DNA, 20 bp, human
ggtatatattaaacaaagat

SEQ ID NO: 333364 - DNA, 20 bp, human
gctccattcagtcatctgtc

SEQ ID NO: 333365 - DNA, 20 bp, human
gttcaaacttatacaacagt

SEQ ID NO: 333366 - DNA, 20 bp, human
ggcgcccagaggctctgtgt

SEQ ID NO: 333367 - DNA, 20 bp, human
gatccctcagcctctagcct

SEQ ID NO: 333368 - DNA, 20 bp, human
gagtcccacacagagcctct

SEQ ID NO: 333369 - DNA, 20 bp, human
ggatgtaaaaggaatcactg

SEQ ID NO: 333370 - DNA, 20 bp, human
gttggatagcaatgggccgt

SEQ ID NO: 333371 - DNA, 20 bp, human
gggaggaattggatagcaat

SEQ ID NO: 333372 - DNA, 20 bp, human
gtggatgatggtaatgacta

SEQ ID NO: 333373 - DNA, 20 bp, human
gatccaattcctccatccag

SEQ ID NO: 333374 - DNA, 20 bp, human
gaaagcaatacaggacaccc

SEQ ID NO: 333375 - DNA, 20 bp, human
gttactttctgggtgaatat

SEQ ID NO: 333376 - DNA, 20 bp, human
gcgaagaatgagctagcgcc

SEQ ID NO: 333377 - DNA, 20 bp, human
gtcttcgtgcagttattggc

SEQ ID NO: 333378 - DNA, 20 bp, human
gcgcagaaaggggacgggca

SEQ ID NO: 333379 - DNA, 20 bp, human
gccaaggctggctttcccta

SEQ ID NO: 333380 - DNA, 20 bp, human
gcgatctccagcgtcttcat

SEQ ID NO: 333381 - DNA, 20 bp, human
gtcattcttcgtgcagttat

SEQ ID NO: 333382 - DNA, 20 bp, human
gggactctgtgtgccgctgt

SEQ ID NO: 333383 - DNA, 20 bp, human
gtgtcggccaatgaagacgc

SEQ ID NO: 333384 - DNA, 20 bp, human
gtcatcccggggcgcagaaa

SEQ ID NO: 333385 - DNA, 20 bp, human
gcaaagcgccttgccagtat

SEQ ID NO: 333386 - DNA, 20 bp, human
ggaaaaggggcggggtcagt

SEQ ID NO: 333387 - DNA, 20 bp, human
gtgggggagcgtggaggata

SEQ ID NO: 333388 - DNA, 20 bp, human
ggagccgctgtctgccaatc

SEQ ID NO: 333389 - DNA, 20 bp, human
ggggaggaaggcgaaaagat

SEQ ID NO: 333390 - DNA, 20 bp, human
gcaacctgcggcccactgag

SEQ ID NO: 333391 - DNA, 20 bp, human
gaccccgccccttttcggcg

SEQ ID NO: 333392 - DNA, 20 bp, human
gttggcagacagcggctccc

SEQ ID NO: 333393 - DNA, 20 bp, human
gccgctgtctgccaatcggg

SEQ ID NO: 333394 - DNA, 20 bp, human
gagtgggccgcaggttgcta

SEQ ID NO: 333395 - DNA, 20 bp, human
gttccccgccgaaaaggggc

SEQ ID NO: 333396 - DNA, 20 bp, human
gtgagagcacacagactttt

SEQ ID NO: 333397 - DNA, 20 bp, human
gattgaggaaactccataat

SEQ ID NO: 333398 - DNA, 20 bp, human
gggagggtgggggaatacat

SEQ ID NO: 333399 - DNA, 20 bp, human
gagctgaatttgagtggagc

SEQ ID NO: 333400 - DNA, 20 bp, human
gtatggagtttcctcaatcc

SEQ ID NO: 333401 - DNA, 20 bp, human
gcctgcagcacgaagtgagt

SEQ ID NO: 333402 - DNA, 20 bp, human
gcttagtcaccgagtggcgg

SEQ ID NO: 333403 - DNA, 20 bp, human
gttgctgggacagaacgctg

SEQ ID NO: 333404 - DNA, 20 bp, human
gtagcagcattcagcaggat

SEQ ID NO: 333405 - DNA, 20 bp, human
ggtcaccgagtggcgggggt

SEQ ID NO: 333406 - DNA, 20 bp, human
ggatacgaatggattcccga

SEQ ID NO: 333407 - DNA, 20 bp, human
gacagcgcgacttatggcat

SEQ ID NO: 333408 - DNA, 20 bp, human
ggcgggagagaagacggacg

SEQ ID NO: 333409 - DNA, 20 bp, human
gcccgcgctccgctcttgaa

SEQ ID NO: 333410 - DNA, 20 bp, human
gcgaggggacatgagaaagt

SEQ ID NO: 333411 - DNA, 20 bp, human
gcggagccgcccgagccagt

SEQ ID NO: 333412 - DNA, 20 bp, human
gttatggcatgggatacgaa

SEQ ID NO: 333413 - DNA, 20 bp, human
gcacccgccgcctccggtcg

SEQ ID NO: 333414 - DNA, 20 bp, human
ggaggcggcgggtgattcct

SEQ ID NO: 333415 - DNA, 20 bp, human
ggacgcgctcccagggccgg

SEQ ID NO: 333416 - DNA, 20 bp, human
gctgccgtctgcaccagcca

SEQ ID NO: 333417 - DNA, 20 bp, human
gaggggacacccacctagag

SEQ ID NO: 333418 - DNA, 20 bp, human
gccagccatggactgctaca

SEQ ID NO: 333419 - DNA, 20 bp, human
gtgacccggacgggcggaag

SEQ ID NO: 333420 - DNA, 20 bp, human
gggggcagctcaccggtaaa

SEQ ID NO: 333421 - DNA, 20 bp, human
gaatcccggaacagcggaag

SEQ ID NO: 333422 - DNA, 20 bp, human
ggaggcccacaggattctat

SEQ ID NO: 333423 - DNA, 20 bp, human
gccccctcggagcgcccctg

SEQ ID NO: 333424 - DNA, 20 bp, human
gccagcgccagtagtgacag

SEQ ID NO: 333425 - DNA, 20 bp, human
gtccgcccgtccgggtcacg

SEQ ID NO: 333426 - DNA, 20 bp, human
gacacccagattactgagaa

SEQ ID NO: 333427 - DNA, 20 bp, human
ggcttgcaagccagcgtctg

SEQ ID NO: 333428 - DNA, 20 bp, human
gacagcatcttcctggaatt

SEQ ID NO: 333429 - DNA, 20 bp, human
gacatttccggtggcatctg

SEQ ID NO: 333430 - DNA, 20 bp, human
gcttgggctataggggaaat

SEQ ID NO: 333431 - DNA, 20 bp, human
gtgtcaaagtcttgaagctt

SEQ ID NO: 333432 - DNA, 20 bp, human
gcaagaacaataagagccaa

SEQ ID NO: 333433 - DNA, 20 bp, human
gaagctcaaaaccaaattcc

SEQ ID NO: 333434 - DNA, 20 bp, human
gctgaaaagatggtcagaag

SEQ ID NO: 333435 - DNA, 20 bp, human
gggggaaataggttagcctc

SEQ ID NO: 333436 - DNA, 20 bp, human
gactgcgtaggcagcctccc

SEQ ID NO: 333437 - DNA, 20 bp, human
gagcctcgtgggctccgggg

SEQ ID NO: 333438 - DNA, 20 bp, human
gccttcggaaggcactgcgt

SEQ ID NO: 333439 - DNA, 20 bp, human
gggtgcaagagtgacagaca

SEQ ID NO: 333440 - DNA, 20 bp, human
gcgccgggagccggagggaa

SEQ ID NO: 333441 - DNA, 20 bp, human
gggacgcgcagaccttcgga

SEQ ID NO: 333442 - DNA, 20 bp, human
gccgcccgccgggagccgga

SEQ ID NO: 333443 - DNA, 20 bp, human
gagacggacgcgcagacctt

SEQ ID NO: 333444 - DNA, 20 bp, human
gagcctccccggagcccacg

SEQ ID NO: 333445 - DNA, 20 bp, human
ggggagcctcgtgggctccg

SEQ ID NO: 333446 - DNA, 20 bp, human
gtagaggccggagaagaagg

SEQ ID NO: 333447 - DNA, 20 bp, human
gctggcaccgccttcttctc

SEQ ID NO: 333448 - DNA, 20 bp, human
gcgaaagtccgggtagaggc

SEQ ID NO: 333449 - DNA, 20 bp, human
ggccagggcgtcctgcggaa

SEQ ID NO: 333450 - DNA, 20 bp, human
gaaaagacggcccttctcat

SEQ ID NO: 333451 - DNA, 20 bp, human
gcagggaagccaataggcct

SEQ ID NO: 333452 - DNA, 20 bp, human
gctagagggagggacgaaga

SEQ ID NO: 333453 - DNA, 20 bp, human
gtggctgggaagctagaggg

SEQ ID NO: 333454 - DNA, 20 bp, human
gctactgctcggaggcgcac

SEQ ID NO: 333455 - DNA, 20 bp, human
ggcgtcctgcggaagggccg

SEQ ID NO: 333456 - DNA, 20 bp, human
gcccccccactccttaatta

SEQ ID NO: 333457 - DNA, 20 bp, human
gtgaggagacgccatcttaa

SEQ ID NO: 333458 - DNA, 20 bp, human
gcgtgggcggggccttacag

SEQ ID NO: 333459 - DNA, 20 bp, human
gtccgtaattaaggagtggg

SEQ ID NO: 333460 - DNA, 20 bp, human
gcacagggagaaagggacgt

SEQ ID NO: 333461 - DNA, 20 bp, human
gtacggattgagcaggggag

SEQ ID NO: 333462 - DNA, 20 bp, human
ggatcccagccggccacttc

SEQ ID NO: 333463 - DNA, 20 bp, human
ggcaccggaagtggccggct

SEQ ID NO: 333464 - DNA, 20 bp, human
gacggaacgaggtgcaaggg

SEQ ID NO: 333465 - DNA, 20 bp, human
gaagaccgacgaccctgagc

SEQ ID NO: 333466 - DNA, 20 bp, human
gtgaaggaatgaggtcacgt

SEQ ID NO: 333467 - DNA, 20 bp, human
gcggccgcatgggaagggag

SEQ ID NO: 333468 - DNA, 20 bp, human
ggggacctactcttgtctgg

SEQ ID NO: 333469 - DNA, 20 bp, human
ggaagggaggggtctcgtcc

SEQ ID NO: 333470 - DNA, 20 bp, human
ggaggggagggaccggagtg

SEQ ID NO: 333471 - DNA, 20 bp, human
gctagggacccggcagccgg

SEQ ID NO: 333472 - DNA, 20 bp, human
gatgaggtcacgtgggtgag

SEQ ID NO: 333473 - DNA, 20 bp, human
gcggggcggccgcatgggaa

SEQ ID NO: 333474 - DNA, 20 bp, human
gaaagcggcttggggtggga

SEQ ID NO: 333475 - DNA, 20 bp, human
gtcaggatgctggcagagac

SEQ ID NO: 333476 - DNA, 20 bp, human
gggagaggcgagtagttcac

SEQ ID NO: 333477 - DNA, 20 bp, human
gcacctgctccggagcctgc

SEQ ID NO: 333478 - DNA, 20 bp, human
gttgcctgggaacagtggga

SEQ ID NO: 333479 - DNA, 20 bp, human
gtcaccggccccggaggaaa

SEQ ID NO: 333480 - DNA, 20 bp, human
gaagatccggtcacctgctc

SEQ ID NO: 333481 - DNA, 20 bp, human
gggagtggtccgagaaccgg

SEQ ID NO: 333482 - DNA, 20 bp, human
gtactcgcctctccgcctgc

SEQ ID NO: 333483 - DNA, 20 bp, human
gccgagaaccggcgggagaa

SEQ ID NO: 333484 - DNA, 20 bp, human
ggcgagtagttcaccggccc

SEQ ID NO: 333485 - DNA, 20 bp, human
ggtcccctttcctccggggc

SEQ ID NO: 333486 - DNA, 20 bp, human
ggggccaggcggtaaggggt

SEQ ID NO: 333487 - DNA, 20 bp, human
gagggccaggggcgaggcat

SEQ ID NO: 333488 - DNA, 20 bp, human
ggggcggggccaggcggtaa

SEQ ID NO: 333489 - DNA, 20 bp, human
gcatagggcggggccatgag

SEQ ID NO: 333490 - DNA, 20 bp, human
gagggagccgcggggcgcga

SEQ ID NO: 333491 - DNA, 20 bp, human
gcggggaggggcgtgttcag

SEQ ID NO: 333492 - DNA, 20 bp, human
gctgtgctgagggacccgac

SEQ ID NO: 333493 - DNA, 20 bp, human
gaggggcgaggcatagggcg

SEQ ID NO: 333494 - DNA, 20 bp, human
gcgggcctggactcggcgga

SEQ ID NO: 333495 - DNA, 20 bp, human
gaccccgcggcaaggggcgt

SEQ ID NO: 333496 - DNA, 20 bp, human
gaccgaaggggtggacggtg

SEQ ID NO: 333497 - DNA, 20 bp, human
gggtgccgccggttggaagt

SEQ ID NO: 333498 - DNA, 20 bp, human
ggggcctcggggcccaggtc

SEQ ID NO: 333499 - DNA, 20 bp, human
gaaacaaccgaaggggtgga

SEQ ID NO: 333500 - DNA, 20 bp, human
gcgcaggtgggacagacttg

SEQ ID NO: 333501 - DNA, 20 bp, human
gatgatgtaaacaaccgaag

SEQ ID NO: 333502 - DNA, 20 bp, human
ggctgaagagacaaattctc

SEQ ID NO: 333503 - DNA, 20 bp, human
gccgagtggccccacagagc

SEQ ID NO: 333504 - DNA, 20 bp, human
ggttgcttttaaaccctcca

SEQ ID NO: 333505 - DNA, 20 bp, human
gggtccggtgccgcctccaa

SEQ ID NO: 333506 - DNA, 20 bp, human
gggaacgttgtggaggttga

SEQ ID NO: 333507 - DNA, 20 bp, human
ggcaaacgggaacgttgtgg

SEQ ID NO: 333508 - DNA, 20 bp, human
gtcttaagccatcactgctc

SEQ ID NO: 333509 - DNA, 20 bp, human
gacgttgtggaggttgaggg

SEQ ID NO: 333510 - DNA, 20 bp, human
gcagataaggtgcaaatcaa

SEQ ID NO: 333511 - DNA, 20 bp, human
gatgacaataatagagggta

SEQ ID NO: 333512 - DNA, 20 bp, human
gagtgtgggtccagagatca

SEQ ID NO: 333513 - DNA, 20 bp, human
gtgtatggctgctggactag

SEQ ID NO: 333514 - DNA, 20 bp, human
gaaacttgttactgtagtgt

SEQ ID NO: 333515 - DNA, 20 bp, human
gggatctttgaacacttgta

SEQ ID NO: 333516 - DNA, 20 bp, human
gttagcggccctcacctccg

SEQ ID NO: 333517 - DNA, 20 bp, human
gttgcgccccgcggaggtga

SEQ ID NO: 333518 - DNA, 20 bp, human
gcagctccggggcaggctgc

SEQ ID NO: 333519 - DNA, 20 bp, human
gcgcgcgggccgcactttaa

SEQ ID NO: 333520 - DNA, 20 bp, human
gaagagagcgtccccttcca

SEQ ID NO: 333521 - DNA, 20 bp, human
ggccgctaaaccacatttcc

SEQ ID NO: 333522 - DNA, 20 bp, human
ggccgggaaatgtggtttag

SEQ ID NO: 333523 - DNA, 20 bp, human
gtcggacgccaccactgcgc

SEQ ID NO: 333524 - DNA, 20 bp, human
gcccttccaaggagaaaatc

SEQ ID NO: 333525 - DNA, 20 bp, human
gcagggtttgcgccccgcgg

SEQ ID NO: 333526 - DNA, 20 bp, human
gcccgagcgcgtcgccgagc

SEQ ID NO: 333527 - DNA, 20 bp, human
gcgggtgcgcaggttggttc

SEQ ID NO: 333528 - DNA, 20 bp, human
gggcccggggtctttctgcc

SEQ ID NO: 333529 - DNA, 20 bp, human
gtgcgcaggttggttccgga

SEQ ID NO: 333530 - DNA, 20 bp, human
gaggcgcggagggtcctccg

SEQ ID NO: 333531 - DNA, 20 bp, human
gctctcagccgggacgccag

SEQ ID NO: 333532 - DNA, 20 bp, human
ggagaacctggggaccggct

SEQ ID NO: 333533 - DNA, 20 bp, human
gggccccggcagaaagaccc

SEQ ID NO: 333534 - DNA, 20 bp, human
ggggcgtgagaccacctcga

SEQ ID NO: 333535 - DNA, 20 bp, human
gggtccccaggttctccctc

SEQ ID NO: 333536 - DNA, 20 bp, human
gctgccaggccacacccagt

SEQ ID NO: 333537 - DNA, 20 bp, human
ggcggcgccagtgaggatgc

SEQ ID NO: 333538 - DNA, 20 bp, human
ggcctcgtacacatcgccag

SEQ ID NO: 333539 - DNA, 20 bp, human
gaagacgggcggcgccagtg

SEQ ID NO: 333540 - DNA, 20 bp, human
ggcagctgctgtgcggaaat

SEQ ID NO: 333541 - DNA, 20 bp, human
gggaaggcagttcctgaaag

SEQ ID NO: 333542 - DNA, 20 bp, human
gagaacctctgagagctgcc

SEQ ID NO: 333543 - DNA, 20 bp, human
gtcccctggcgatgtgtacg

SEQ ID NO: 333544 - DNA, 20 bp, human
gtcttctgagtgtcccctca

SEQ ID NO: 333545 - DNA, 20 bp, human
gctgtaatcagaaagacggg

SEQ ID NO: 333546 - DNA, 20 bp, human
gccgcggcgaggtccctcag

SEQ ID NO: 333547 - DNA, 20 bp, human
ggaaggggagacagctttgt

SEQ ID NO: 333548 - DNA, 20 bp, human
ggaccctgccacactcaaga

SEQ ID NO: 333549 - DNA, 20 bp, human
gtgagtgtggcagggtcggc

SEQ ID NO: 333550 - DNA, 20 bp, human
gggaggcatcgtggtgacgt

SEQ ID NO: 333551 - DNA, 20 bp, human
gtgctggggagaccggagat

SEQ ID NO: 333552 - DNA, 20 bp, human
gcggcccaggggaggcatcg

SEQ ID NO: 333553 - DNA, 20 bp, human
gcggcgaggtccctcagagg

SEQ ID NO: 333554 - DNA, 20 bp, human
gagggggccgaaagcaagct

SEQ ID NO: 333555 - DNA, 20 bp, human
gccgtccctgctgttccttg

SEQ ID NO: 333556 - DNA, 20 bp, human
gacgtcagggggcaggtctc

SEQ ID NO: 333557 - DNA, 20 bp, human
gaggctcgccactgacgtca

SEQ ID NO: 333558 - DNA, 20 bp, human
gggtctctggatcacggcca

SEQ ID NO: 333559 - DNA, 20 bp, human
gggggcaggtctctggatca

SEQ ID NO: 333560 - DNA, 20 bp, human
gtgttcaatgattatctccc

SEQ ID NO: 333561 - DNA, 20 bp, human
gactcactgcaacacgcccc

SEQ ID NO: 333562 - DNA, 20 bp, human
ggccagggtcagttatgctt

SEQ ID NO: 333563 - DNA, 20 bp, human
gcgtcagtggcgagcctccc

SEQ ID NO: 333564 - DNA, 20 bp, human
gactcactatggttggttga

SEQ ID NO: 333565 - DNA, 20 bp, human
ggccactgacgtcagggggc

SEQ ID NO: 333566 - DNA, 20 bp, human
gggcggggcctcgaagtcgg

SEQ ID NO: 333567 - DNA, 20 bp, human
gtcccgggagagacactagg

SEQ ID NO: 333568 - DNA, 20 bp, human
gcaggggcgggagactacag

SEQ ID NO: 333569 - DNA, 20 bp, human
ggtggacccagtcctccaat

SEQ ID NO: 333570 - DNA, 20 bp, human
gaacccatctctcccattgg

SEQ ID NO: 333571 - DNA, 20 bp, human
ggggggcggggcctcgaagt

SEQ ID NO: 333572 - DNA, 20 bp, human
gccaaacccatctctcccat

SEQ ID NO: 333573 - DNA, 20 bp, human
ggaggactgggtccactctt

SEQ ID NO: 333574 - DNA, 20 bp, human
gctcaaagttacatcatgtg

SEQ ID NO: 333575 - DNA, 20 bp, human
ggcaaacaagctaggaacga

SEQ ID NO: 333576 - DNA, 20 bp, human
gtgaacgcccggctaaaaac

SEQ ID NO: 333577 - DNA, 20 bp, human
gtcactgggctcctttaaat

SEQ ID NO: 333578 - DNA, 20 bp, human
gctgagagcgaggaaggatc

SEQ ID NO: 333579 - DNA, 20 bp, human
ggatccggagcgacgcagga

SEQ ID NO: 333580 - DNA, 20 bp, human
gcgcaggcgcctctcggaac

SEQ ID NO: 333581 - DNA, 20 bp, human
ggctctcagcaccgatttaa

SEQ ID NO: 333582 - DNA, 20 bp, human
gaaggagcccagtgaacgcc

SEQ ID NO: 333583 - DNA, 20 bp, human
gtcagtgcgcaggcgcctct

SEQ ID NO: 333584 - DNA, 20 bp, human
gtcggtgctgagagcgagga

SEQ ID NO: 333585 - DNA, 20 bp, human
gaccccatcctgcgtcgctc

SEQ ID NO: 333586 - DNA, 20 bp, human
ggcgacaccacagactccgg

SEQ ID NO: 333587 - DNA, 20 bp, human
gccagcatgccgtgcgcttc

SEQ ID NO: 333588 - DNA, 20 bp, human
ggatcagcgccggaagcgca

SEQ ID NO: 333589 - DNA, 20 bp, human
gcgggggcgagaactcgccc

SEQ ID NO: 333590 - DNA, 20 bp, human
ggggatacatagttcctggg

SEQ ID NO: 333591 - DNA, 20 bp, human
gcgttggtgtaatctctttt

SEQ ID NO: 333592 - DNA, 20 bp, human
ggccgcaatgcgagctagac

SEQ ID NO: 333593 - DNA, 20 bp, human
gcgggtgggggcggattcgt

SEQ ID NO: 333594 - DNA, 20 bp, human
gaacgcctgccggccacagg

SEQ ID NO: 333595 - DNA, 20 bp, human
ggagtctgtggtgtcgcttc

SEQ ID NO: 333596 - DNA, 20 bp, human
gggacacgcagcagcggaag

SEQ ID NO: 333597 - DNA, 20 bp, human
gtagcagccacaggggcggg

SEQ ID NO: 333598 - DNA, 20 bp, human
gtgcggccgggtggggccga

SEQ ID NO: 333599 - DNA, 20 bp, human
gcggtgaccggagacacagc

SEQ ID NO: 333600 - DNA, 20 bp, human
gtgtgtctccggtcaccgag

SEQ ID NO: 333601 - DNA, 20 bp, human
gtgccgggagcgcgcagtgg

SEQ ID NO: 333602 - DNA, 20 bp, human
ggagcgcatgcgtgccgcgg

SEQ ID NO: 333603 - DNA, 20 bp, human
gctgtgacgccgcgcggctt

SEQ ID NO: 333604 - DNA, 20 bp, human
gcgccgcgcggcttagggtg

SEQ ID NO: 333605 - DNA, 20 bp, human
gtgcgctctgtgacgccgcg

SEQ ID NO: 333606 - DNA, 20 bp, human
gagaacgtggagatggcggt

SEQ ID NO: 333607 - DNA, 20 bp, human
gtcaaggcctcgcgttgttt

SEQ ID NO: 333608 - DNA, 20 bp, human
gacaggccagaagacgatgg

SEQ ID NO: 333609 - DNA, 20 bp, human
gcctcgcgttgtttgggctt

SEQ ID NO: 333610 - DNA, 20 bp, human
gaggggggcggggccagatg

SEQ ID NO: 333611 - DNA, 20 bp, human
gggcggagcgagccctgagg

SEQ ID NO: 333612 - DNA, 20 bp, human
ggccgggagacgcccccatc

SEQ ID NO: 333613 - DNA, 20 bp, human
ggcggacgccaaagtcaaca

SEQ ID NO: 333614 - DNA, 20 bp, human
gcagaagacgatggcggtag

SEQ ID NO: 333615 - DNA, 20 bp, human
gttgacaggccagaagacga

SEQ ID NO: 333616 - DNA, 20 bp, human
ggagactcggacccggccta

SEQ ID NO: 333617 - DNA, 20 bp, human
gcgcgggcctggcacttaaa

SEQ ID NO: 333618 - DNA, 20 bp, human
gcgcccgcgagactcggacc

SEQ ID NO: 333619 - DNA, 20 bp, human
ggggtcagcaaaggcgtctc

SEQ ID NO: 333620 - DNA, 20 bp, human
gagcgagctctcagcggggc

SEQ ID NO: 333621 - DNA, 20 bp, human
ggcacttaaaggggtgatgg

SEQ ID NO: 333622 - DNA, 20 bp, human
gacggcgcgcccgcgagact

SEQ ID NO: 333623 - DNA, 20 bp, human
ggggcggacgcaggcagccc

SEQ ID NO: 333624 - DNA, 20 bp, human
gcagtcaggccgttgtgcgc

SEQ ID NO: 333625 - DNA, 20 bp, human
gaaaggggtgatggcggcgc

SEQ ID NO: 333626 - DNA, 20 bp, human
ggcaaatcaagcctaccggg

SEQ ID NO: 333627 - DNA, 20 bp, human
gcccctagagcatacattgg

SEQ ID NO: 333628 - DNA, 20 bp, human
gtcctccaatgtatgctcta

SEQ ID NO: 333629 - DNA, 20 bp, human
ggggcggggcagcgtcgcgc

SEQ ID NO: 333630 - DNA, 20 bp, human
gttcaggagtcaaagaggcg

SEQ ID NO: 333631 - DNA, 20 bp, human
gcgccccctagagcatacat

SEQ ID NO: 333632 - DNA, 20 bp, human
gccgggttcaggagtcaaag

SEQ ID NO: 333633 - DNA, 20 bp, human
gccttgcggggaagacttta

SEQ ID NO: 333634 - DNA, 20 bp, human
gtccgggcatatgtggagat

SEQ ID NO: 333635 - DNA, 20 bp, human
gcggggagcatggacacgat

SEQ ID NO: 333636 - DNA, 20 bp, human
gccgccttcggaagcggaag

SEQ ID NO: 333637 - DNA, 20 bp, human
gggtcccgaggaatgaaaag

SEQ ID NO: 333638 - DNA, 20 bp, human
gccagctcttccttccgagg

SEQ ID NO: 333639 - DNA, 20 bp, human
gaggaagagctgggaaggtt

SEQ ID NO: 333640 - DNA, 20 bp, human
gaagaggccgccttcggaag

SEQ ID NO: 333641 - DNA, 20 bp, human
ggcagcctagagcggtcccg

SEQ ID NO: 333642 - DNA, 20 bp, human
ggaaacgctgggatcttaga

SEQ ID NO: 333643 - DNA, 20 bp, human
gaatgaaaagaggccgcctt

SEQ ID NO: 333644 - DNA, 20 bp, human
gcattcctcgggaccgctct

SEQ ID NO: 333645 - DNA, 20 bp, human
ggacaggtccggagaagtga

SEQ ID NO: 333646 - DNA, 20 bp, human
gtgtggccggcgagcgtaaa

SEQ ID NO: 333647 - DNA, 20 bp, human
gaaagggcggggctccgccc

SEQ ID NO: 333648 - DNA, 20 bp, human
ggctctgggcggtgcagcct

SEQ ID NO: 333649 - DNA, 20 bp, human
ggcctggcgcccgctgtgat

SEQ ID NO: 333650 - DNA, 20 bp, human
gacgctcgccggccacagat

SEQ ID NO: 333651 - DNA, 20 bp, human
gacacgcgccgccaatcagg

SEQ ID NO: 333652 - DNA, 20 bp, human
ggctgcgtgacagttgtcgc

SEQ ID NO: 333653 - DNA, 20 bp, human
gaacgcagccccctgattgg

SEQ ID NO: 333654 - DNA, 20 bp, human
gccggcgagcgtaaagggcg

SEQ ID NO: 333655 - DNA, 20 bp, human
ggggccgcccggcggtgacg

SEQ ID NO: 333656 - DNA, 20 bp, human
gcccccggggccctgaaccc

SEQ ID NO: 333657 - DNA, 20 bp, human
gtcaacgcggccggggttca

SEQ ID NO: 333658 - DNA, 20 bp, human
gggcgcctcctgccgacgtc

SEQ ID NO: 333659 - DNA, 20 bp, human
gggcctaccaggggcagaat

SEQ ID NO: 333660 - DNA, 20 bp, human
gtgcggaggtggctgagacg

SEQ ID NO: 333661 - DNA, 20 bp, human
ggagacgcggctggctggtc

SEQ ID NO: 333662 - DNA, 20 bp, human
ggcaccgtagccggcccagg

SEQ ID NO: 333663 - DNA, 20 bp, human
ggcgcggcgcgcaccgtagc

SEQ ID NO: 333664 - DNA, 20 bp, human
ggaggcgcccgcggcggacc

SEQ ID NO: 333665 - DNA, 20 bp, human
gtctcccggacgtcggcagg

SEQ ID NO: 333666 - DNA, 20 bp, human
gccctccttagccttcgctg

SEQ ID NO: 333667 - DNA, 20 bp, human
gcgaaggctaaggagggact

SEQ ID NO: 333668 - DNA, 20 bp, human
gtggcccccagcgaaggcta

SEQ ID NO: 333669 - DNA, 20 bp, human
gtgctcagaggttgcttccg

SEQ ID NO: 333670 - DNA, 20 bp, human
gctcagaggcggctgctcag

SEQ ID NO: 333671 - DNA, 20 bp, human
gggactgggcgggcgttggg

SEQ ID NO: 333672 - DNA, 20 bp, human
gcccccagcgaaggctaagg

SEQ ID NO: 333673 - DNA, 20 bp, human
gcccttgcacgtcccctaac

SEQ ID NO: 333674 - DNA, 20 bp, human
ggcactcacagaaatccttc

SEQ ID NO: 333675 - DNA, 20 bp, human
gtccttctggcccccagcga

SEQ ID NO: 333676 - DNA, 20 bp, human
ggacgcgaggggtgcccttt

SEQ ID NO: 333677 - DNA, 20 bp, human
gcaacccagggtagacgact

SEQ ID NO: 333678 - DNA, 20 bp, human
gcccaggcgttgccaaccca

SEQ ID NO: 333679 - DNA, 20 bp, human
gtgggcgcatgcgtagaccc

SEQ ID NO: 333680 - DNA, 20 bp, human
gtgggtaacggcaaagtaat

SEQ ID NO: 333681 - DNA, 20 bp, human
gatggcgcggtaggacgcga

SEQ ID NO: 333682 - DNA, 20 bp, human
gacgccgctgggagcgaaat

SEQ ID NO: 333683 - DNA, 20 bp, human
gagaaaggtgatggcgcggt

SEQ ID NO: 333684 - DNA, 20 bp, human
ggagtctgcgcacgcccaaa

SEQ ID NO: 333685 - DNA, 20 bp, human
gccgcccagtcgtctaccct

SEQ ID NO: 333686 - DNA, 20 bp, human
gcggcccaagggaacgttca

SEQ ID NO: 333687 - DNA, 20 bp, human
gacgccctgaacgttccctt

SEQ ID NO: 333688 - DNA, 20 bp, human
ggaaggacgtcacgtcacca

SEQ ID NO: 333689 - DNA, 20 bp, human
gtgacgtgacgtccttcctc

SEQ ID NO: 333690 - DNA, 20 bp, human
gctgcctggccggggacgac

SEQ ID NO: 333691 - DNA, 20 bp, human
gtgtcttaacgcaggcagag

SEQ ID NO: 333692 - DNA, 20 bp, human
gcaacgacgctcttgcgtaa

SEQ ID NO: 333693 - DNA, 20 bp, human
gactcccgtcgtccccggcc

SEQ ID NO: 333694 - DNA, 20 bp, human
gcggcgcacaatcctgagga

SEQ ID NO: 333695 - DNA, 20 bp, human
ggacagcctgacccgacctc

SEQ ID NO: 333696 - DNA, 20 bp, human
gaggcctcaagtaacgtcat

SEQ ID NO: 333697 - DNA, 20 bp, human
ggctgaggaagcaggggcgg

SEQ ID NO: 333698 - DNA, 20 bp, human
gacacataaatgttgacctt

SEQ ID NO: 333699 - DNA, 20 bp, human
gcgggacagtggcgtgtcct

SEQ ID NO: 333700 - DNA, 20 bp, human
gaaccccactctgtccagtg

SEQ ID NO: 333701 - DNA, 20 bp, human
gggggcagaggccgtctccc

SEQ ID NO: 333702 - DNA, 20 bp, human
gaaatgttgaccttaggagg

SEQ ID NO: 333703 - DNA, 20 bp, human
gggcagggggtgagcaatga

SEQ ID NO: 333704 - DNA, 20 bp, human
gctagacctagagaggtccc

SEQ ID NO: 333705 - DNA, 20 bp, human
gtggggactggccagtgggg

SEQ ID NO: 333706 - DNA, 20 bp, human
gccagccctcagggaccccg

SEQ ID NO: 333707 - DNA, 20 bp, human
gcctccctgagaatcgtctc

SEQ ID NO: 333708 - DNA, 20 bp, human
gtggacgagagaggacccgt

SEQ ID NO: 333709 - DNA, 20 bp, human
gagagaggacccgtcggtcc

SEQ ID NO: 333710 - DNA, 20 bp, human
gacgcccagagacgattctc

SEQ ID NO: 333711 - DNA, 20 bp, human
ggggcggcccaggtagccgg

SEQ ID NO: 333712 - DNA, 20 bp, human
gcttctccccggggtccctg

SEQ ID NO: 333713 - DNA, 20 bp, human
gagagccgccccctctcgtg

SEQ ID NO: 333714 - DNA, 20 bp, human
gctggggtgccactccgcaa

SEQ ID NO: 333715 - DNA, 20 bp, human
gcctgagggctggacgagag

SEQ ID NO: 333716 - DNA, 20 bp, human
gtagggtggtagctggctta

SEQ ID NO: 333717 - DNA, 20 bp, human
gtggcttagggaggacttgc

SEQ ID NO: 333718 - DNA, 20 bp, human
gtccagggacagtgagttga

SEQ ID NO: 333719 - DNA, 20 bp, human
gcctagccccaggtgggaac

SEQ ID NO: 333720 - DNA, 20 bp, human
gcctcccttctccaactgtg

SEQ ID NO: 333721 - DNA, 20 bp, human
gtgccctttcaggagccagt

SEQ ID NO: 333722 - DNA, 20 bp, human
ggacagagctggagctaggg

SEQ ID NO: 333723 - DNA, 20 bp, human
gctgcagtcggtacagaaaa

SEQ ID NO: 333724 - DNA, 20 bp, human
gacaggaggcgagactccct

SEQ ID NO: 333725 - DNA, 20 bp, human
gtatcaccctagccccaggt

SEQ ID NO: 333726 - DNA, 20 bp, human
gagcaccaggggccacctag

SEQ ID NO: 333727 - DNA, 20 bp, human
ggtgctctcagatgtcggcc

SEQ ID NO: 333728 - DNA, 20 bp, human
gcaaaagagaacggcacgtt

SEQ ID NO: 333729 - DNA, 20 bp, human
gcgacatctgagagcaccag

SEQ ID NO: 333730 - DNA, 20 bp, human
ggctccaaattccgccagga

SEQ ID NO: 333731 - DNA, 20 bp, human
gcggtggcatcatgcctccc

SEQ ID NO: 333732 - DNA, 20 bp, human
gggaaggattgtttttctaa

SEQ ID NO: 333733 - DNA, 20 bp, human
gcgctgctccaaattccgcc

SEQ ID NO: 333734 - DNA, 20 bp, human
gtgcaccactaggtggcccc

SEQ ID NO: 333735 - DNA, 20 bp, human
gcaaattccgccaggatgga

SEQ ID NO: 333736 - DNA, 20 bp, human
gaaggagggggagaccatcg

SEQ ID NO: 333737 - DNA, 20 bp, human
ggggacggaaaatgaagtag

SEQ ID NO: 333738 - DNA, 20 bp, human
gaggaggagcttctattggt

SEQ ID NO: 333739 - DNA, 20 bp, human
gtacacgaagaaggcaaggt

SEQ ID NO: 333740 - DNA, 20 bp, human
gccaatgctggcaggtttag

SEQ ID NO: 333741 - DNA, 20 bp, human
gctagggtaagacagagagc

SEQ ID NO: 333742 - DNA, 20 bp, human
gggagaccatcgggggatgc

SEQ ID NO: 333743 - DNA, 20 bp, human
ggtaccgagctgagtataaa

SEQ ID NO: 333744 - DNA, 20 bp, human
gtgccagcattggatgcaag

SEQ ID NO: 333745 - DNA, 20 bp, human
ggagctgagtataaaaggtg

SEQ ID NO: 333746 - DNA, 20 bp, human
gatccgaatggtattcccgg

SEQ ID NO: 333747 - DNA, 20 bp, human
gccccgccgggaataccatt

SEQ ID NO: 333748 - DNA, 20 bp, human
gtagatctgacgtcaagaga

SEQ ID NO: 333749 - DNA, 20 bp, human
gctcacggtacagaatttat

SEQ ID NO: 333750 - DNA, 20 bp, human
gactcccagcctttgattct

SEQ ID NO: 333751 - DNA, 20 bp, human
gcataactaccaagaatcaa

SEQ ID NO: 333752 - DNA, 20 bp, human
gaagatccgaatggtattcc

SEQ ID NO: 333753 - DNA, 20 bp, human
gaccattcggatcttagtcc

SEQ ID NO: 333754 - DNA, 20 bp, human
gtaggagagtaaggagaaga

SEQ ID NO: 333755 - DNA, 20 bp, human
gtcttgacgtcagatctacc

SEQ ID NO: 333756 - DNA, 20 bp, human
gcggcccgcgccagggagat

SEQ ID NO: 333757 - DNA, 20 bp, human
gtgactcagtggagtggaat

SEQ ID NO: 333758 - DNA, 20 bp, human
gcgccatggagatgcccaaa

SEQ ID NO: 333759 - DNA, 20 bp, human
gtgcgtcggtcgggtgggtg

SEQ ID NO: 333760 - DNA, 20 bp, human
gccgacgcaggcgcagcctg

SEQ ID NO: 333761 - DNA, 20 bp, human
ggtaagaaaaattgactcag

SEQ ID NO: 333762 - DNA, 20 bp, human
gaggctctcagcggcgtaaa

SEQ ID NO: 333763 - DNA, 20 bp, human
gtggtccaacagaaccacta

SEQ ID NO: 333764 - DNA, 20 bp, human
gagtcggagggcagttgctg

SEQ ID NO: 333765 - DNA, 20 bp, human
ggctgcgcacgcccggaacc

SEQ ID NO: 333766 - DNA, 20 bp, human
gcccccgcccctttcagcac

SEQ ID NO: 333767 - DNA, 20 bp, human
ggcgctgcgcccccagaagg

SEQ ID NO: 333768 - DNA, 20 bp, human
gagtccgccagcggccaatg

SEQ ID NO: 333769 - DNA, 20 bp, human
gctgagatgggggagctctc

SEQ ID NO: 333770 - DNA, 20 bp, human
ggagctctccggtgctgaaa

SEQ ID NO: 333771 - DNA, 20 bp, human
gcctcagctccaattcccta

SEQ ID NO: 333772 - DNA, 20 bp, human
ggtaatcaggccagcggcgg

SEQ ID NO: 333773 - DNA, 20 bp, human
gctccggtgctgaaaggggc

SEQ ID NO: 333774 - DNA, 20 bp, human
gtgctctcccccagccccta

SEQ ID NO: 333775 - DNA, 20 bp, human
gggactcacgtcacccgagc

SEQ ID NO: 333776 - DNA, 20 bp, human
gagtagccgcaaggccccct

SEQ ID NO: 333777 - DNA, 20 bp, human
gaggccgggctgattctcga

SEQ ID NO: 333778 - DNA, 20 bp, human
gcagaaggcttcgactccca

SEQ ID NO: 333779 - DNA, 20 bp, human
ggaggcagggcggaatggta

SEQ ID NO: 333780 - DNA, 20 bp, human
gggcgccatagcaacgcaga

SEQ ID NO: 333781 - DNA, 20 bp, human
gggaacggggcgaggcttat

SEQ ID NO: 333782 - DNA, 20 bp, human
gggaaaactgaggctcccga

SEQ ID NO: 333783 - DNA, 20 bp, human
gtgcggctactcagccagga

SEQ ID NO: 333784 - DNA, 20 bp, human
ggcggggctgatcacaaagg

SEQ ID NO: 333785 - DNA, 20 bp, human
ggacgcctgggcccactcgg

SEQ ID NO: 333786 - DNA, 20 bp, human
gaaccctggaggttacagct

SEQ ID NO: 333787 - DNA, 20 bp, human
gtacagctgggcgaacccgg

SEQ ID NO: 333788 - DNA, 20 bp, human
gtcgcccagctgtaacctcc

SEQ ID NO: 333789 - DNA, 20 bp, human
ggaggagggcgatgtgggaa

SEQ ID NO: 333790 - DNA, 20 bp, human
gttactgcccggaaccctgg

SEQ ID NO: 333791 - DNA, 20 bp, human
gggaaaggaggggtgttaag

SEQ ID NO: 333792 - DNA, 20 bp, human
gctaggacctcgtcagcgcc

SEQ ID NO: 333793 - DNA, 20 bp, human
ggggcgaacccggaggcgct

SEQ ID NO: 333794 - DNA, 20 bp, human
gacgaggtcctagcgcctcc

SEQ ID NO: 333795 - DNA, 20 bp, human
gtcctccgccctcttgaaag

SEQ ID NO: 333796 - DNA, 20 bp, human
gctcctgcgaccgggctccg

SEQ ID NO: 333797 - DNA, 20 bp, human
gggcccgcgctcctgcgacc

SEQ ID NO: 333798 - DNA, 20 bp, human
gagcccggtcgcaggagcgc

SEQ ID NO: 333799 - DNA, 20 bp, human
gcgagagccccagaagtcgg

SEQ ID NO: 333800 - DNA, 20 bp, human
gggccccggagcccggtcgc

SEQ ID NO: 333801 - DNA, 20 bp, human
gccggggccgagagccgtcc

SEQ ID NO: 333802 - DNA, 20 bp, human
ggggccgagagccgtccggg

SEQ ID NO: 333803 - DNA, 20 bp, human
ggggaagttcccccggtggg

SEQ ID NO: 333804 - DNA, 20 bp, human
gcgggcgagccctccgtcta

SEQ ID NO: 333805 - DNA, 20 bp, human
gggcccgaaacgccccccac

SEQ ID NO: 333806 - DNA, 20 bp, human
ggcaaccggcgcccggggtc

SEQ ID NO: 333807 - DNA, 20 bp, human
gatgccccgaggactcgggg

SEQ ID NO: 333808 - DNA, 20 bp, human
gtcccgcgggcggcctacgc

SEQ ID NO: 333809 - DNA, 20 bp, human
gcgctcgtgccgccggaagt

SEQ ID NO: 333810 - DNA, 20 bp, human
gccggggcacggggatgctg

SEQ ID NO: 333811 - DNA, 20 bp, human
ggcgcccccgggaggaaagt

SEQ ID NO: 333812 - DNA, 20 bp, human
gcgctgggggctgaacccgc

SEQ ID NO: 333813 - DNA, 20 bp, human
gggacgggacgcacctgagc

SEQ ID NO: 333814 - DNA, 20 bp, human
gccccgggcgccggttgctg

SEQ ID NO: 333815 - DNA, 20 bp, human
ggctccggccgcgagaggag

SEQ ID NO: 333816 - DNA, 20 bp, human
gtcccacgcagggtgagagg

SEQ ID NO: 333817 - DNA, 20 bp, human
gtcgtccgatggggctctgg

SEQ ID NO: 333818 - DNA, 20 bp, human
gaggcaggccggcgccctag

SEQ ID NO: 333819 - DNA, 20 bp, human
gggactggaggatcaggttt

SEQ ID NO: 333820 - DNA, 20 bp, human
gaatctgacgctgtttgggg

SEQ ID NO: 333821 - DNA, 20 bp, human
gcagataggatcgtccgatg

SEQ ID NO: 333822 - DNA, 20 bp, human
gttccagcccagttaggatt

SEQ ID NO: 333823 - DNA, 20 bp, human
gcctgccttccagcccagtt

SEQ ID NO: 333824 - DNA, 20 bp, human
gcgtaatctgacgctgtttg

SEQ ID NO: 333825 - DNA, 20 bp, human
gtaaacattaacggaacccc

SEQ ID NO: 333826 - DNA, 20 bp, human
gccggctgccccagcgtcat

SEQ ID NO: 333827 - DNA, 20 bp, human
ggggcctagaaaagcgggcg

SEQ ID NO: 333828 - DNA, 20 bp, human
gaggggcgggcctagaaaag

SEQ ID NO: 333829 - DNA, 20 bp, human
gctgccccagcgtcattggc

SEQ ID NO: 333830 - DNA, 20 bp, human
gcccacactaagggtgtccg

SEQ ID NO: 333831 - DNA, 20 bp, human
gaagtaaggaggcttccaga

SEQ ID NO: 333832 - DNA, 20 bp, human
ggactggaggagcggcctga

SEQ ID NO: 333833 - DNA, 20 bp, human
gcgcccccaggcccacacta

SEQ ID NO: 333834 - DNA, 20 bp, human
gcggggtgaccgggctgccc

SEQ ID NO: 333835 - DNA, 20 bp, human
gcggcctgccctccaggcgg

SEQ ID NO: 333836 - DNA, 20 bp, human
gaggcggcaggatgtgctta

SEQ ID NO: 333837 - DNA, 20 bp, human
gatgtcttctgaaggagggt

SEQ ID NO: 333838 - DNA, 20 bp, human
gctgcaggagctccccactc

SEQ ID NO: 333839 - DNA, 20 bp, human
ggacctgggcggggctcgca

SEQ ID NO: 333840 - DNA, 20 bp, human
gccggtcctctcaaccctgc

SEQ ID NO: 333841 - DNA, 20 bp, human
gggcggggctcgcaggacct

SEQ ID NO: 333842 - DNA, 20 bp, human
gatgtgcttagggcactgag

SEQ ID NO: 333843 - DNA, 20 bp, human
gggggctcgcaggacctggg

SEQ ID NO: 333844 - DNA, 20 bp, human
gcagcggtgggaggactgcg

SEQ ID NO: 333845 - DNA, 20 bp, human
gcaggggctgggcggcctgg

SEQ ID NO: 333846 - DNA, 20 bp, human
ggctccatctctctcggggt

SEQ ID NO: 333847 - DNA, 20 bp, human
gccgcatgcgggctcctcat

SEQ ID NO: 333848 - DNA, 20 bp, human
gtcggggtaggctctctcat

SEQ ID NO: 333849 - DNA, 20 bp, human
ggagagagatggagctaatg

SEQ ID NO: 333850 - DNA, 20 bp, human
ggccagacccagctccgcat

SEQ ID NO: 333851 - DNA, 20 bp, human
ggaagcgggcacacctgcgc

SEQ ID NO: 333852 - DNA, 20 bp, human
ggaaggcgggactgccagtg

SEQ ID NO: 333853 - DNA, 20 bp, human
ggagcctaccccgagagaga

SEQ ID NO: 333854 - DNA, 20 bp, human
gtgggtctggcgcggcagga

SEQ ID NO: 333855 - DNA, 20 bp, human
gggagcccgcatgcgggggg

SEQ ID NO: 333856 - DNA, 20 bp, human
gaccggagacggaatggccc

SEQ ID NO: 333857 - DNA, 20 bp, human
gttcaaggagaagtcgtggt

SEQ ID NO: 333858 - DNA, 20 bp, human
gccagagaccggagacggaa

SEQ ID NO: 333859 - DNA, 20 bp, human
ggggaagtaggcggaacttc

SEQ ID NO: 333860 - DNA, 20 bp, human
gccctgggccattccgtctc

SEQ ID NO: 333861 - DNA, 20 bp, human
gactactgtgtcaggagtcg

SEQ ID NO: 333862 - DNA, 20 bp, human
gctgctgggtcacttcatcc

SEQ ID NO: 333863 - DNA, 20 bp, human
gcaggcgggcctgtgcgcgg

SEQ ID NO: 333864 - DNA, 20 bp, human
ggtcggattgacagaggtag

SEQ ID NO: 333865 - DNA, 20 bp, human
ggcagcgcgtcttgacggac

SEQ ID NO: 333866 - DNA, 20 bp, human
gggtacggagggctagccaa

SEQ ID NO: 333867 - DNA, 20 bp, human
gagggctagccaatggggcc

SEQ ID NO: 333868 - DNA, 20 bp, human
gggctagccctccgtaccca

SEQ ID NO: 333869 - DNA, 20 bp, human
gtcgggcccgtgggtacgga

SEQ ID NO: 333870 - DNA, 20 bp, human
ggcagcaagttcgggcccgt

SEQ ID NO: 333871 - DNA, 20 bp, human
ggtaccactccgccgggaag

SEQ ID NO: 333872 - DNA, 20 bp, human
gaagttcgggcccgtgggta

SEQ ID NO: 333873 - DNA, 20 bp, human
gatggggcccggccgcttcc

SEQ ID NO: 333874 - DNA, 20 bp, human
gcaaccagacgacactgaag

SEQ ID NO: 333875 - DNA, 20 bp, human
gcagccgcttcagtgtcgtc

SEQ ID NO: 333876 - DNA, 20 bp, human
gccgccaggcgcacgctcag

SEQ ID NO: 333877 - DNA, 20 bp, human
gaaagcgcggcacacgccat

SEQ ID NO: 333878 - DNA, 20 bp, human
gaggccaggtgtgggtcggg

SEQ ID NO: 333879 - DNA, 20 bp, human
ggggggcgggactctgtcag

SEQ ID NO: 333880 - DNA, 20 bp, human
gcgtgcgcggaggtgcggtg

SEQ ID NO: 333881 - DNA, 20 bp, human
gcacctccgcgcacggccaa

SEQ ID NO: 333882 - DNA, 20 bp, human
ggccgagcggcgcacgccat

SEQ ID NO: 333883 - DNA, 20 bp, human
gtggcggggcagtgcggcgt

SEQ ID NO: 333884 - DNA, 20 bp, human
gcggtggggcgcggccttcg

SEQ ID NO: 333885 - DNA, 20 bp, human
ggggcctcacccgctgcgca

SEQ ID NO: 333886 - DNA, 20 bp, human
ggggcaagcctggacttagg

SEQ ID NO: 333887 - DNA, 20 bp, human
gggaggcctccgcacgaagt

SEQ ID NO: 333888 - DNA, 20 bp, human
gaggacggtccgacttcgtg

SEQ ID NO: 333889 - DNA, 20 bp, human
ggacgggcaagcctggactt

SEQ ID NO: 333890 - DNA, 20 bp, human
gcgcaaggacccggacctca

SEQ ID NO: 333891 - DNA, 20 bp, human
ggcggagattgcgtcatctt

SEQ ID NO: 333892 - DNA, 20 bp, human
gcggaggcctccctgaggtc

SEQ ID NO: 333893 - DNA, 20 bp, human
gcggctctggaattctatac

SEQ ID NO: 333894 - DNA, 20 bp, human
gaaggacccggacctcaggg

SEQ ID NO: 333895 - DNA, 20 bp, human
gtgccacccaccggaagtga

SEQ ID NO: 333896 - DNA, 20 bp, human
gcctcacgatataggaaata

SEQ ID NO: 333897 - DNA, 20 bp, human
gaagcagtagctaggcacta

SEQ ID NO: 333898 - DNA, 20 bp, human
ggtgctcagtagatgattat

SEQ ID NO: 333899 - DNA, 20 bp, human
gtgcttgtttcacacaaagt

SEQ ID NO: 333900 - DNA, 20 bp, human
gttgaatagatgagagacag

SEQ ID NO: 333901 - DNA, 20 bp, human
gaggattgacagaattagca

SEQ ID NO: 333902 - DNA, 20 bp, human
gatagctctgaacaagtaat

SEQ ID NO: 333903 - DNA, 20 bp, human
gactgcaagcctcacgatat

SEQ ID NO: 333904 - DNA, 20 bp, human
gtgtgaaacaagcagtagct

SEQ ID NO: 333905 - DNA, 20 bp, human
gtgcaagggtcatcaatatc

SEQ ID NO: 333906 - DNA, 20 bp, human
ggggagacccccacggggta

SEQ ID NO: 333907 - DNA, 20 bp, human
gtgtcccaggtcaggttgaa

SEQ ID NO: 333908 - DNA, 20 bp, human
gacgtgggcgagagtgacag

SEQ ID NO: 333909 - DNA, 20 bp, human
gagggaaactgtcccaggtc

SEQ ID NO: 333910 - DNA, 20 bp, human
gaagagggggcgggagcaag

SEQ ID NO: 333911 - DNA, 20 bp, human
gcccccacgccctaccccgt

SEQ ID NO: 333912 - DNA, 20 bp, human
gcccccacggggtagggcgt

SEQ ID NO: 333913 - DNA, 20 bp, human
gtcttcctccacatccacgt

SEQ ID NO: 333914 - DNA, 20 bp, human
gctcgcccacgtggatgtgg

SEQ ID NO: 333915 - DNA, 20 bp, human
gcctcctgaggctgccgggt

SEQ ID NO: 333916 - DNA, 20 bp, human
gcgggggatcctgaggcgat

SEQ ID NO: 333917 - DNA, 20 bp, human
gtgtcaccacccatcgcctc

SEQ ID NO: 333918 - DNA, 20 bp, human
gcccagccggagtcgtgcag

SEQ ID NO: 333919 - DNA, 20 bp, human
gccctgattggcgcaggtga

SEQ ID NO: 333920 - DNA, 20 bp, human
gcgcctcaggatcccccgca

SEQ ID NO: 333921 - DNA, 20 bp, human
ggatcccccgcatggcctgc

SEQ ID NO: 333922 - DNA, 20 bp, human
ggagtcgtgcagaggcttat

SEQ ID NO: 333923 - DNA, 20 bp, human
gggcgcctcacccattgagg

SEQ ID NO: 333924 - DNA, 20 bp, human
gcccgccccctcaatgggtg

SEQ ID NO: 333925 - DNA, 20 bp, human
gcagggaattctcctactat

SEQ ID NO: 333926 - DNA, 20 bp, human
ggcattaggccgaatcgcgg

SEQ ID NO: 333927 - DNA, 20 bp, human
ggggccggctaaacgcgtgc

SEQ ID NO: 333928 - DNA, 20 bp, human
gaggtggttacattcgttga

SEQ ID NO: 333929 - DNA, 20 bp, human
gttagccggcccccgcgatt

SEQ ID NO: 333930 - DNA, 20 bp, human
gcaacacagcaacggaagta

SEQ ID NO: 333931 - DNA, 20 bp, human
ggtcgcattaggccgaatcg

SEQ ID NO: 333932 - DNA, 20 bp, human
gctagagacaggaatcggaa

SEQ ID NO: 333933 - DNA, 20 bp, human
gctaatgcgacgattggcta

SEQ ID NO: 333934 - DNA, 20 bp, human
gagacaggaatcggaagggc

SEQ ID NO: 333935 - DNA, 20 bp, human
gtaggccgaatcgcgggggc

SEQ ID NO: 333936 - DNA, 20 bp, human
gcaaaccagaactagttctg

SEQ ID NO: 333937 - DNA, 20 bp, human
ggatttttgtatgttcatgt

SEQ ID NO: 333938 - DNA, 20 bp, human
gagttcctcagaactagttc

SEQ ID NO: 333939 - DNA, 20 bp, human
ggccaggacttccaatagta

SEQ ID NO: 333940 - DNA, 20 bp, human
ggacgaaagcctggcttatt

SEQ ID NO: 333941 - DNA, 20 bp, human
gtgaggaactgacgaaagcc

SEQ ID NO: 333942 - DNA, 20 bp, human
gagggtattaaaaactctca

SEQ ID NO: 333943 - DNA, 20 bp, human
gtggcttatttggaaagttt

SEQ ID NO: 333944 - DNA, 20 bp, human
gaaagaaaaggcatccaaga

SEQ ID NO: 333945 - DNA, 20 bp, human
gtagcagtttgtctgtgaat

SEQ ID NO: 333946 - DNA, 20 bp, human
ggaaacgcgtctgacgggag

SEQ ID NO: 333947 - DNA, 20 bp, human
gcaccaggaaagcggctcgg

SEQ ID NO: 333948 - DNA, 20 bp, human
gcccggaggcaccaggaaag

SEQ ID NO: 333949 - DNA, 20 bp, human
gggcagaggcgccaggggcg

SEQ ID NO: 333950 - DNA, 20 bp, human
gggttgcaggaccaatgcga

SEQ ID NO: 333951 - DNA, 20 bp, human
gaggcggaaacgcgtctgac

SEQ ID NO: 333952 - DNA, 20 bp, human
gggaccaatgcgagggaacg

SEQ ID NO: 333953 - DNA, 20 bp, human
ggggtcggaaggcggaaatc

SEQ ID NO: 333954 - DNA, 20 bp, human
gcggggcagaggaaacctct

SEQ ID NO: 333955 - DNA, 20 bp, human
gcctgctggtgtccacctca

SEQ ID NO: 333956 - DNA, 20 bp, human
ggacgccagcggcgcctctg

SEQ ID NO: 333957 - DNA, 20 bp, human
ggaggcgccgctggcgtcag

SEQ ID NO: 333958 - DNA, 20 bp, human
gcccttactaggatccgatg

SEQ ID NO: 333959 - DNA, 20 bp, human
gataaccccgctcccttact

SEQ ID NO: 333960 - DNA, 20 bp, human
gtaaagccacgcctccgcat

SEQ ID NO: 333961 - DNA, 20 bp, human
gtaaggggcacataatgcct

SEQ ID NO: 333962 - DNA, 20 bp, human
gttcgagcccctgacgccag

SEQ ID NO: 333963 - DNA, 20 bp, human
gtcggatcctagtaagggag

SEQ ID NO: 333964 - DNA, 20 bp, human
gcgtcaggggctcgaaatcc

SEQ ID NO: 333965 - DNA, 20 bp, human
gtccgcatcggatcctagta

SEQ ID NO: 333966 - DNA, 20 bp, human
ggtcggctggccaatcgtgg

SEQ ID NO: 333967 - DNA, 20 bp, human
gaagggagaggagtgaaacg

SEQ ID NO: 333968 - DNA, 20 bp, human
ggagtgaaacgtggaaagtt

SEQ ID NO: 333969 - DNA, 20 bp, human
ggagcgggaagtcggggtgg

SEQ ID NO: 333970 - DNA, 20 bp, human
gggctggccaatcgtggcgg

SEQ ID NO: 333971 - DNA, 20 bp, human
gtaacacgggggcgagaggg

SEQ ID NO: 333972 - DNA, 20 bp, human
gttgggaggcgtggcgggat

SEQ ID NO: 333973 - DNA, 20 bp, human
gctctcgcccccgtgttact

SEQ ID NO: 333974 - DNA, 20 bp, human
gccggctccgccgccacgat

SEQ ID NO: 333975 - DNA, 20 bp, human
ggggagttgagcgggaagtc

SEQ ID NO: 333976 - DNA, 20 bp, human
gttgtaagcgaaggagatgg

SEQ ID NO: 333977 - DNA, 20 bp, human
gagcatgcctctaattcctt

SEQ ID NO: 333978 - DNA, 20 bp, human
ggttttgtaagcgaaggaga

SEQ ID NO: 333979 - DNA, 20 bp, human
gcttatattcagtagctctc

SEQ ID NO: 333980 - DNA, 20 bp, human
gttatgctaagatatatagt

SEQ ID NO: 333981 - DNA, 20 bp, human
gtatgttagtgtttcctatt

SEQ ID NO: 333982 - DNA, 20 bp, human
ggttacgtgttagcttttaa

SEQ ID NO: 333983 - DNA, 20 bp, human
gtttttaatgtgactctgtt

SEQ ID NO: 333984 - DNA, 20 bp, human
gagtagggagtcttttccaa

SEQ ID NO: 333985 - DNA, 20 bp, human
ggaaagcgttttgtaagcga

SEQ ID NO: 333986 - DNA, 20 bp, human
gcacgcagaggcgccgatca

SEQ ID NO: 333987 - DNA, 20 bp, human
gacgccccgcgccgctgcca

SEQ ID NO: 333988 - DNA, 20 bp, human
gcctctgcgtgcagggactt

SEQ ID NO: 333989 - DNA, 20 bp, human
gcagaggcgccgatcacggg

SEQ ID NO: 333990 - DNA, 20 bp, human
gccgcctgaaatcggggaat

SEQ ID NO: 333991 - DNA, 20 bp, human
gagcgcctgcgcagtggtca

SEQ ID NO: 333992 - DNA, 20 bp, human
gggcgccgatcacgggtggg

SEQ ID NO: 333993 - DNA, 20 bp, human
gggtgggaggtggatcccgg

SEQ ID NO: 333994 - DNA, 20 bp, human
gcgagcttgggcgcacggag

SEQ ID NO: 333995 - DNA, 20 bp, human
gacgggtgggaggtggatcc

SEQ ID NO: 333996 - DNA, 20 bp, human
gcggccccgcgacctgggac

SEQ ID NO: 333997 - DNA, 20 bp, human
gtgcggggagggcggggtct

SEQ ID NO: 333998 - DNA, 20 bp, human
ggcggcctgcgccaaagctc

SEQ ID NO: 333999 - DNA, 20 bp, human
gccctcgcagctaagttgcc

SEQ ID NO: 334000 - DNA, 20 bp, human
gaagttgccaggcaacgccc

SEQ ID NO: 334001 - DNA, 20 bp, human
gaacttagctgcgaggggat

SEQ ID NO: 334002 - DNA, 20 bp, human
gcaacgccctggcgcctgcg

SEQ ID NO: 334003 - DNA, 20 bp, human
ggcaggaaatgcgtggtctc

SEQ ID NO: 334004 - DNA, 20 bp, human
gcaaagctctggcttcctcc

SEQ ID NO: 334005 - DNA, 20 bp, human
gtggtctccgggatggtcac

SEQ ID NO: 334006 - DNA, 20 bp, human
gtcacgtgaaggtgtcgcgg

SEQ ID NO: 334007 - DNA, 20 bp, human
gcggtcacgtgaaggtgtcg

SEQ ID NO: 334008 - DNA, 20 bp, human
gcaccactgcggcaggaagg

SEQ ID NO: 334009 - DNA, 20 bp, human
gcgcaggcgcactggatgcg

SEQ ID NO: 334010 - DNA, 20 bp, human
gtacagggtaaactgggtcc

SEQ ID NO: 334011 - DNA, 20 bp, human
ggacaccagtacttctccgg

SEQ ID NO: 334012 - DNA, 20 bp, human
gggggtccttaagctgtccg

SEQ ID NO: 334013 - DNA, 20 bp, human
ggaagggaagaattccagat

SEQ ID NO: 334014 - DNA, 20 bp, human
gctccccaagaggcagtccc

SEQ ID NO: 334015 - DNA, 20 bp, human
gaccctgggactgcctcttg

SEQ ID NO: 334016 - DNA, 20 bp, human
ggtagactcgtccctccgga

SEQ ID NO: 334017 - DNA, 20 bp, human
ggaaggctcagtgcataagt

SEQ ID NO: 334018 - DNA, 20 bp, human
gcggagggacgagtctacag

SEQ ID NO: 334019 - DNA, 20 bp, human
gctaggatgctcaataagaa

SEQ ID NO: 334020 - DNA, 20 bp, human
gtatgcactgagccttccgg

SEQ ID NO: 334021 - DNA, 20 bp, human
ggaagtgacaggaatctgag

SEQ ID NO: 334022 - DNA, 20 bp, human
gtggccgaagaatggtggca

SEQ ID NO: 334023 - DNA, 20 bp, human
gtgcaaaggccctagtaaat

SEQ ID NO: 334024 - DNA, 20 bp, human
gggcagggccatgttcacga

SEQ ID NO: 334025 - DNA, 20 bp, human
gcggtgggcctgggcgaccc

SEQ ID NO: 334026 - DNA, 20 bp, human
ggggagtagcggcttctgat

SEQ ID NO: 334027 - DNA, 20 bp, human
gaggcggccttcctgcgtcg

SEQ ID NO: 334028 - DNA, 20 bp, human
gtactcccagctgaggggca

SEQ ID NO: 334029 - DNA, 20 bp, human
gcgtccgccacgacgcagga

SEQ ID NO: 334030 - DNA, 20 bp, human
gggtccgcgctgtcgggctt

SEQ ID NO: 334031 - DNA, 20 bp, human
gccgacagcgcggaccaatg

SEQ ID NO: 334032 - DNA, 20 bp, human
ggaagctacgggtcctacct

SEQ ID NO: 334033 - DNA, 20 bp, human
gccgcgctgtcgggcttcgg

SEQ ID NO: 334034 - DNA, 20 bp, human
gtaggagagcgttgttgtcg

SEQ ID NO: 334035 - DNA, 20 bp, human
gtgcgcgtccgccacgacgc

SEQ ID NO: 334036 - DNA, 20 bp, human
gaaacaatcggttgattcaa

SEQ ID NO: 334037 - DNA, 20 bp, human
gtggttgccaggcaatgcag

SEQ ID NO: 334038 - DNA, 20 bp, human
gccagcaccacaaagggaac

SEQ ID NO: 334039 - DNA, 20 bp, human
gggggtggagaacccttcag

SEQ ID NO: 334040 - DNA, 20 bp, human
ggagaaataacaaactcctg

SEQ ID NO: 334041 - DNA, 20 bp, human
ggtggagaacccttcagagg

SEQ ID NO: 334042 - DNA, 20 bp, human
gacaaggacttgttacgcat

SEQ ID NO: 334043 - DNA, 20 bp, human
gatgcagaggcccaacacag

SEQ ID NO: 334044 - DNA, 20 bp, human
gtaagaacgcctcctctgaa

SEQ ID NO: 334045 - DNA, 20 bp, human
gcacaaccatcccctgtgtt

SEQ ID NO: 334046 - DNA, 20 bp, human
ggcactccgagcaggacagt

SEQ ID NO: 334047 - DNA, 20 bp, human
gacagtaggcagatcctatc

SEQ ID NO: 334048 - DNA, 20 bp, human
ggacctggttctaattctgg

SEQ ID NO: 334049 - DNA, 20 bp, human
gtagggctggtcttcagcgg

SEQ ID NO: 334050 - DNA, 20 bp, human
gctgaagaccagccctaata

SEQ ID NO: 334051 - DNA, 20 bp, human
gtctggtggctgccttatta

SEQ ID NO: 334052 - DNA, 20 bp, human
gaagagcaggcgcagactca

SEQ ID NO: 334053 - DNA, 20 bp, human
ggagcggcggggagtaaggg

SEQ ID NO: 334054 - DNA, 20 bp, human
gcggggcgaaggctgggctg

SEQ ID NO: 334055 - DNA, 20 bp, human
gcgccccgcccagggacgag

SEQ ID NO: 334056 - DNA, 20 bp, human
gtggcaggggccaataggta

SEQ ID NO: 334057 - DNA, 20 bp, human
gcagcccagccgacccggac

SEQ ID NO: 334058 - DNA, 20 bp, human
gaacccgccggggccaaagc

SEQ ID NO: 334059 - DNA, 20 bp, human
gggcgcgcccgggagttcgc

SEQ ID NO: 334060 - DNA, 20 bp, human
gtacccggtccgggtcggct

SEQ ID NO: 334061 - DNA, 20 bp, human
ggagcctggcaggggccaat

SEQ ID NO: 334062 - DNA, 20 bp, human
gggaccgggtacgaacgcgc

SEQ ID NO: 334063 - DNA, 20 bp, human
ggtcgcgcctgctttggccc

SEQ ID NO: 334064 - DNA, 20 bp, human
gccgagccatggcgtccgag

SEQ ID NO: 334065 - DNA, 20 bp, human
ggggtcgcgagggtcctccc

SEQ ID NO: 334066 - DNA, 20 bp, human
gccgcagcccggctcgtccc

SEQ ID NO: 334067 - DNA, 20 bp, human
gccgctggcaggggaccctg

SEQ ID NO: 334068 - DNA, 20 bp, human
gacgagccgggctgcggccc

SEQ ID NO: 334069 - DNA, 20 bp, human
gcaaactccgcccggaaccc

SEQ ID NO: 334070 - DNA, 20 bp, human
ggcggcccggggaggaacca

SEQ ID NO: 334071 - DNA, 20 bp, human
gccacggccaggccactcgg

SEQ ID NO: 334072 - DNA, 20 bp, human
ggggagcaagaggctcctcg

SEQ ID NO: 334073 - DNA, 20 bp, human
gtcctcccgggccggggcta

SEQ ID NO: 334074 - DNA, 20 bp, human
gcggcgggccggggctcggt

SEQ ID NO: 334075 - DNA, 20 bp, human
gacggcgcctggctaccctc

SEQ ID NO: 334076 - DNA, 20 bp, human
gcagcctgggccgtggactt

SEQ ID NO: 334077 - DNA, 20 bp, human
gccagaccagccaaagtcca

SEQ ID NO: 334078 - DNA, 20 bp, human
gtgagtggaccgctgtgaca

SEQ ID NO: 334079 - DNA, 20 bp, human
gcaggacacgcccctgagtg

SEQ ID NO: 334080 - DNA, 20 bp, human
ggactcttccaggaaccgcc

SEQ ID NO: 334081 - DNA, 20 bp, human
gccgctgtgacagggaggta

SEQ ID NO: 334082 - DNA, 20 bp, human
gtgggtacaggactcctgat

SEQ ID NO: 334083 - DNA, 20 bp, human
gcacgcccctgagtgaggca

SEQ ID NO: 334084 - DNA, 20 bp, human
gcaggctccgtgcctcactc

SEQ ID NO: 334085 - DNA, 20 bp, human
gaacacagaagcggactccg

SEQ ID NO: 334086 - DNA, 20 bp, human
gaagacccgcggccgatcag

SEQ ID NO: 334087 - DNA, 20 bp, human
gctactgtcaggtggagctg

SEQ ID NO: 334088 - DNA, 20 bp, human
gaggagggagacaatgacga

SEQ ID NO: 334089 - DNA, 20 bp, human
gacaccaccctatccacttc

SEQ ID NO: 334090 - DNA, 20 bp, human
gtagcggtcgacaagacccg

SEQ ID NO: 334091 - DNA, 20 bp, human
gacgaggggacaccgacctc

SEQ ID NO: 334092 - DNA, 20 bp, human
gcttccggctagcgaagaga

SEQ ID NO: 334093 - DNA, 20 bp, human
gacgataggtcagaattata

SEQ ID NO: 334094 - DNA, 20 bp, human
gctccaagccggaagtggat

SEQ ID NO: 334095 - DNA, 20 bp, human
gggcctggtgggttcacccc

SEQ ID NO: 334096 - DNA, 20 bp, human
gaatagagctcgtaaactgt

SEQ ID NO: 334097 - DNA, 20 bp, human
ggagagcttgagtactcagt

SEQ ID NO: 334098 - DNA, 20 bp, human
gcggtcagtagtacagtagc

SEQ ID NO: 334099 - DNA, 20 bp, human
gtactgctgtctgcttaggg

SEQ ID NO: 334100 - DNA, 20 bp, human
gcatcctgcccttgttctgt

SEQ ID NO: 334101 - DNA, 20 bp, human
gacaagggcaggatgtaata

SEQ ID NO: 334102 - DNA, 20 bp, human
gcctctctaccaacagaaca

SEQ ID NO: 334103 - DNA, 20 bp, human
gagtagcaggctcacatgta

SEQ ID NO: 334104 - DNA, 20 bp, human
gtaacagatgagctgctttt

SEQ ID NO: 334105 - DNA, 20 bp, human
gcagaagaacacagctccac

SEQ ID NO: 334106 - DNA, 20 bp, human
gcagaagaacacagctccac

SEQ ID NO: 334107 - DNA, 20 bp, human
gaatagagctcgtaaactgt

SEQ ID NO: 334108 - DNA, 20 bp, human
gggagctgtgttcttctgta

SEQ ID NO: 334109 - DNA, 20 bp, human
ggagagcttgagtactcagt

SEQ ID NO: 334110 - DNA, 20 bp, human
gacaagggcaggatgtaata

SEQ ID NO: 334111 - DNA, 20 bp, human
gcatcctgcccttgttctgt

SEQ ID NO: 334112 - DNA, 20 bp, human
gcggtcagtagtacagtagc

SEQ ID NO: 334113 - DNA, 20 bp, human
gcctctctaccaacagaaca

SEQ ID NO: 334114 - DNA, 20 bp, human
gaaaaccttggcatttaaac

SEQ ID NO: 334115 - DNA, 20 bp, human
gcctagcaactccacacagt

SEQ ID NO: 334116 - DNA, 20 bp, human
gcacaggcgccggggacgag

SEQ ID NO: 334117 - DNA, 20 bp, human
gcgcacgcacacaggcgccg

SEQ ID NO: 334118 - DNA, 20 bp, human
ggctgtgaggagtgagagac

SEQ ID NO: 334119 - DNA, 20 bp, human
ggagtgagagactggcgggc

SEQ ID NO: 334120 - DNA, 20 bp, human
gccactcctccccctcccaa

SEQ ID NO: 334121 - DNA, 20 bp, human
gaggaacgattggaagccgg

SEQ ID NO: 334122 - DNA, 20 bp, human
gtccaatcgttcctttggga

SEQ ID NO: 334123 - DNA, 20 bp, human
ggaggcggcgggctggactt

SEQ ID NO: 334124 - DNA, 20 bp, human
gcccctcccaaaggaacgat

SEQ ID NO: 334125 - DNA, 20 bp, human
gactcacatccgccagtaca

SEQ ID NO: 334126 - DNA, 20 bp, human
gagacccagcctaccggaac

SEQ ID NO: 334127 - DNA, 20 bp, human
gctaccggaactgggtgaga

SEQ ID NO: 334128 - DNA, 20 bp, human
gagaggaggtctgtagcggg

SEQ ID NO: 334129 - DNA, 20 bp, human
gacagagaggaggtctgtag

SEQ ID NO: 334130 - DNA, 20 bp, human
gggtctgtagcgggagggga

SEQ ID NO: 334131 - DNA, 20 bp, human
gagaccgggctcaacaggga

SEQ ID NO: 334132 - DNA, 20 bp, human
gctctgtgacagattcagga

SEQ ID NO: 334133 - DNA, 20 bp, human
gggcttaagagtgcagggac

SEQ ID NO: 334134 - DNA, 20 bp, human
gaggcagagacccagcctac

SEQ ID NO: 334135 - DNA, 20 bp, human
gtctcagaagaagcccagaa

SEQ ID NO: 334136 - DNA, 20 bp, human
ggctccgcgcgcaagtagga

SEQ ID NO: 334137 - DNA, 20 bp, human
gctgtcaccgcgggcgcgga

SEQ ID NO: 334138 - DNA, 20 bp, human
gagaaaacagaggggcgcga

SEQ ID NO: 334139 - DNA, 20 bp, human
ggaagcccacgcagctccgc

SEQ ID NO: 334140 - DNA, 20 bp, human
gcgtctgccgggcacacgct

SEQ ID NO: 334141 - DNA, 20 bp, human
gcgtctgtcagcgcccgggc

SEQ ID NO: 334142 - DNA, 20 bp, human
gaagtcgtctgtcagcgccc

SEQ ID NO: 334143 - DNA, 20 bp, human
gcccacgcagctccgcaggt

SEQ ID NO: 334144 - DNA, 20 bp, human
gcggagccgagctcttgttg

SEQ ID NO: 334145 - DNA, 20 bp, human
gccgagctcttgttgaggtg

SEQ ID NO: 334146 - DNA, 20 bp, human
gggtagagagagagtctgac

SEQ ID NO: 334147 - DNA, 20 bp, human
gggacagtaacacatgaaga

SEQ ID NO: 334148 - DNA, 20 bp, human
gggtctgataatgcagaagg

SEQ ID NO: 334149 - DNA, 20 bp, human
gagccttagcgagatcaaga

SEQ ID NO: 334150 - DNA, 20 bp, human
gagggatttacaatcctcat

SEQ ID NO: 334151 - DNA, 20 bp, human
gtctgcgatggggcagcaga

SEQ ID NO: 334152 - DNA, 20 bp, human
gaaaggggagtggctgacag

SEQ ID NO: 334153 - DNA, 20 bp, human
gcagaagccttcaggatgag

SEQ ID NO: 334154 - DNA, 20 bp, human
gaatcctcatgggctaggat

SEQ ID NO: 334155 - DNA, 20 bp, human
gttccatcttgatctcgcta

SEQ ID NO: 334156 - DNA, 20 bp, human
ggagcagtgtaaggaggcgg

SEQ ID NO: 334157 - DNA, 20 bp, human
gggggaggtcggctgtgacc

SEQ ID NO: 334158 - DNA, 20 bp, human
gtcttcccggggcctcgggg

SEQ ID NO: 334159 - DNA, 20 bp, human
ggtgaggctggtccgcgggg

SEQ ID NO: 334160 - DNA, 20 bp, human
gggctccctgtcctttctgc

SEQ ID NO: 334161 - DNA, 20 bp, human
ggggagaagaaggattccga

SEQ ID NO: 334162 - DNA, 20 bp, human
gcaggtctccccagcagcca

SEQ ID NO: 334163 - DNA, 20 bp, human
gagcagccccgggagcagaa

SEQ ID NO: 334164 - DNA, 20 bp, human
gtttcctccgcgctgtgcgc

SEQ ID NO: 334165 - DNA, 20 bp, human
gagcacctccccgaggcccc

SEQ ID NO: 334166 - DNA, 20 bp, human
ggcgccgcggccgcccaaca

SEQ ID NO: 334167 - DNA, 20 bp, human
gccggccggggcagtcgcgg

SEQ ID NO: 334168 - DNA, 20 bp, human
gctcgcgcgcccaacggacc

SEQ ID NO: 334169 - DNA, 20 bp, human
gggctcgcgtccctgttggg

SEQ ID NO: 334170 - DNA, 20 bp, human
gcgcccggccggggcagtcg

SEQ ID NO: 334171 - DNA, 20 bp, human
gcccggctcgcgtccctgtt

SEQ ID NO: 334172 - DNA, 20 bp, human
gagaaggacgaggtcatctt

SEQ ID NO: 334173 - DNA, 20 bp, human
gcgtccctgttgggcggccg

SEQ ID NO: 334174 - DNA, 20 bp, human
gcggcagtccgaagacccac

SEQ ID NO: 334175 - DNA, 20 bp, human
ggccgaggaaagcgcggcgg

SEQ ID NO: 334176 - DNA, 20 bp, human
gtccctggaaggtgtgtctc

SEQ ID NO: 334177 - DNA, 20 bp, human
ggaggggatgggtcctgatg

SEQ ID NO: 334178 - DNA, 20 bp, human
gcctcagccagaacctaggt

SEQ ID NO: 334179 - DNA, 20 bp, human
gggtgtgtccatggagggga

SEQ ID NO: 334180 - DNA, 20 bp, human
gtacatctgtgagtgtaaag

SEQ ID NO: 334181 - DNA, 20 bp, human
gggacagcccacctaggttc

SEQ ID NO: 334182 - DNA, 20 bp, human
gggggtgggggggtattaaa

SEQ ID NO: 334183 - DNA, 20 bp, human
gtgggcctcagccagaacct

SEQ ID NO: 334184 - DNA, 20 bp, human
gggtgtctgtctataggtgt

SEQ ID NO: 334185 - DNA, 20 bp, human
ggcaggctgcatgggatgtc

SEQ ID NO: 334186 - DNA, 20 bp, human
gcgcccgcacggctctggtg

SEQ ID NO: 334187 - DNA, 20 bp, human
gtggggcgcccgcacggctc

SEQ ID NO: 334188 - DNA, 20 bp, human
gctccagcgcgaagccggaa

SEQ ID NO: 334189 - DNA, 20 bp, human
gcggaagggccgaggcgaca

SEQ ID NO: 334190 - DNA, 20 bp, human
gcgggtctggggcgcccgca

SEQ ID NO: 334191 - DNA, 20 bp, human
gtggagccgcccccagggcg

SEQ ID NO: 334192 - DNA, 20 bp, human
gccaccccgccctgtcgcct

SEQ ID NO: 334193 - DNA, 20 bp, human
gggagtgtccccacagattt

SEQ ID NO: 334194 - DNA, 20 bp, human
gggcccttccggcttcgcgc

SEQ ID NO: 334195 - DNA, 20 bp, human
gggcggctccagcgcgaagc

SEQ ID NO: 334196 - DNA, 20 bp, human
ggatgaagggtgttgttaag

SEQ ID NO: 334197 - DNA, 20 bp, human
gtgggccaatagcatttggt

SEQ ID NO: 334198 - DNA, 20 bp, human
gtcagcgaacaggaaaacat

SEQ ID NO: 334199 - DNA, 20 bp, human
gtggaaatctaaagcgatga

SEQ ID NO: 334200 - DNA, 20 bp, human
gtccacctaccaaatgctat

SEQ ID NO: 334201 - DNA, 20 bp, human
gtgggcattaaattccttgg

SEQ ID NO: 334202 - DNA, 20 bp, human
gagcttaaacagaagaatga

SEQ ID NO: 334203 - DNA, 20 bp, human
gacacatgctggacggattc

SEQ ID NO: 334204 - DNA, 20 bp, human
gaacaagctgcattcactaa

SEQ ID NO: 334205 - DNA, 20 bp, human
gataaaaaatgtcagcgaac

SEQ ID NO: 334206 - DNA, 20 bp, human
ggggtcgtcgtgtttagaag

SEQ ID NO: 334207 - DNA, 20 bp, human
gaggggcagggtgtctttag

SEQ ID NO: 334208 - DNA, 20 bp, human
gtttagaaggggtggagtcc

SEQ ID NO: 334209 - DNA, 20 bp, human
gagggcgagaaccgcacccg

SEQ ID NO: 334210 - DNA, 20 bp, human
ggcagggtgtgggacctccc

SEQ ID NO: 334211 - DNA, 20 bp, human
gtccccaaaaggccccagtc

SEQ ID NO: 334212 - DNA, 20 bp, human
gaaagaggacggcaggggca

SEQ ID NO: 334213 - DNA, 20 bp, human
gtcgtcgtgtttagaagggg

SEQ ID NO: 334214 - DNA, 20 bp, human
ggctcccagaggggacaacc

SEQ ID NO: 334215 - DNA, 20 bp, human
gggagtgacagcaggggttt

SEQ ID NO: 334216 - DNA, 20 bp, human
gacgacccccgggacaaacg

SEQ ID NO: 334217 - DNA, 20 bp, human
gggccccgcctcgaggccgg

SEQ ID NO: 334218 - DNA, 20 bp, human
gggagccgccggcctcgagg

SEQ ID NO: 334219 - DNA, 20 bp, human
gcccgggctaatgtattttc

SEQ ID NO: 334220 - DNA, 20 bp, human
gcggctccctgacgaccccc

SEQ ID NO: 334221 - DNA, 20 bp, human
ggagggggcaaagggcgcat

SEQ ID NO: 334222 - DNA, 20 bp, human
gatcggccccgcctcgaggc

SEQ ID NO: 334223 - DNA, 20 bp, human
gcagggagccgccggcctcg

SEQ ID NO: 334224 - DNA, 20 bp, human
gccaactgtacttctttaga

SEQ ID NO: 334225 - DNA, 20 bp, human
gactaaccagggacgtgccg

SEQ ID NO: 334226 - DNA, 20 bp, human
ggaagtcactcgcgcagctg

SEQ ID NO: 334227 - DNA, 20 bp, human
gggaaagcaccgcgctcgca

SEQ ID NO: 334228 - DNA, 20 bp, human
ggtacataaaaagtcctggg

SEQ ID NO: 334229 - DNA, 20 bp, human
gggacaaagccgtgcgagcg

SEQ ID NO: 334230 - DNA, 20 bp, human
gaagcagcctgttaaactat

SEQ ID NO: 334231 - DNA, 20 bp, human
gtatgtacataaaaagtcct

SEQ ID NO: 334232 - DNA, 20 bp, human
gaacaggctgctttgtagca

SEQ ID NO: 334233 - DNA, 20 bp, human
ggcatagcaaatgaacaagg

SEQ ID NO: 334234 - DNA, 20 bp, human
gatggttaagccctcccccc

SEQ ID NO: 334235 - DNA, 20 bp, human
gagggagataaatagccctg

SEQ ID NO: 334236 - DNA, 20 bp, human
gggggagggttagtacccgt

SEQ ID NO: 334237 - DNA, 20 bp, human
gaagaagggcaagtcaccca

SEQ ID NO: 334238 - DNA, 20 bp, human
ggcgagggaaggcttggtaa

SEQ ID NO: 334239 - DNA, 20 bp, human
gggcgcgcagcggtacctag

SEQ ID NO: 334240 - DNA, 20 bp, human
gagtgtttctcccttgatgt

SEQ ID NO: 334241 - DNA, 20 bp, human
gcggacagtgccacgtcctc

SEQ ID NO: 334242 - DNA, 20 bp, human
gagggaaggcttggtaacgg

SEQ ID NO: 334243 - DNA, 20 bp, human
gtgtccgagaatgcagggag

SEQ ID NO: 334244 - DNA, 20 bp, human
gtgagggaaagggacttcaa

SEQ ID NO: 334245 - DNA, 20 bp, human
gcgccccgcctgggttctaa

SEQ ID NO: 334246 - DNA, 20 bp, human
gacactgccggaccccgggt

SEQ ID NO: 334247 - DNA, 20 bp, human
gggcgcccaggtgtggtggg

SEQ ID NO: 334248 - DNA, 20 bp, human
gccgccccgcgcggttctac

SEQ ID NO: 334249 - DNA, 20 bp, human
gtccggaagccaagtggcgg

SEQ ID NO: 334250 - DNA, 20 bp, human
ggccgcctcctgggaaccag

SEQ ID NO: 334251 - DNA, 20 bp, human
gactgaagagcctgcgagag

SEQ ID NO: 334252 - DNA, 20 bp, human
gggcgcccgtagaaccgcgc

SEQ ID NO: 334253 - DNA, 20 bp, human
gtgtgccaagccgacttctg

SEQ ID NO: 334254 - DNA, 20 bp, human
gcagtcccctggttcccagg

SEQ ID NO: 334255 - DNA, 20 bp, human
gacgggcgcccaggtgtggt

SEQ ID NO: 334256 - DNA, 20 bp, human
gtgtggggccagatgggaga

SEQ ID NO: 334257 - DNA, 20 bp, human
gagtgtgttccagatgctgt

SEQ ID NO: 334258 - DNA, 20 bp, human
gcaaagcaggggttgcaaaa

SEQ ID NO: 334259 - DNA, 20 bp, human
gcatctggccccacagcatc

SEQ ID NO: 334260 - DNA, 20 bp, human
gacaggagagggagcaagct

SEQ ID NO: 334261 - DNA, 20 bp, human
ggggacagtctacttgctgt

SEQ ID NO: 334262 - DNA, 20 bp, human
gcttgagcactgccaaagca

SEQ ID NO: 334263 - DNA, 20 bp, human
gggttgcaaaaaggcagcac

SEQ ID NO: 334264 - DNA, 20 bp, human
gagtgcaaagattgtgacat

SEQ ID NO: 334265 - DNA, 20 bp, human
ggagatggcctgcacaggag

SEQ ID NO: 334266 - DNA, 20 bp, human
gcacccgtgacgcctgcaac

SEQ ID NO: 334267 - DNA, 20 bp, human
ggaaggctgggagtaactgt

SEQ ID NO: 334268 - DNA, 20 bp, human
gagcgcaggcccccatttgt

SEQ ID NO: 334269 - DNA, 20 bp, human
gccaggaaaaccagaccctg

SEQ ID NO: 334270 - DNA, 20 bp, human
gctgactcactcctacaaat

SEQ ID NO: 334271 - DNA, 20 bp, human
gaaagcgtcatgctgtgtgt

SEQ ID NO: 334272 - DNA, 20 bp, human
gaccctgtggaatgaaggct

SEQ ID NO: 334273 - DNA, 20 bp, human
gttagtgagattaggaaccc

SEQ ID NO: 334274 - DNA, 20 bp, human
ggggaccaacccaaaccctc

SEQ ID NO: 334275 - DNA, 20 bp, human
gtgcctgttgcaggcgtcac

SEQ ID NO: 334276 - DNA, 20 bp, human
gcagaaaaataactgaatgt

SEQ ID NO: 334277 - DNA, 20 bp, human
gcctcagcttgctacttgct

SEQ ID NO: 334278 - DNA, 20 bp, human
gatactctgaagattcgcta

SEQ ID NO: 334279 - DNA, 20 bp, human
gtccatgaatgacacgacat

SEQ ID NO: 334280 - DNA, 20 bp, human
gagaaggccctggcttaggg

SEQ ID NO: 334281 - DNA, 20 bp, human
gacacgacattggcaacaat

SEQ ID NO: 334282 - DNA, 20 bp, human
gaatgaacatctgggagata

SEQ ID NO: 334283 - DNA, 20 bp, human
gtgaatcccaccctaagcca

SEQ ID NO: 334284 - DNA, 20 bp, human
gtgaagtgacagggattgag

SEQ ID NO: 334285 - DNA, 20 bp, human
gttgcatcactgcaacataa

SEQ ID NO: 334286 - DNA, 20 bp, human
gcctccccgggaagtcccat

SEQ ID NO: 334287 - DNA, 20 bp, human
ggtgtcctatgggacttccc

SEQ ID NO: 334288 - DNA, 20 bp, human
gcgcgcagcggcttcgcagg

SEQ ID NO: 334289 - DNA, 20 bp, human
ggggggactgttaacgtcaa

SEQ ID NO: 334290 - DNA, 20 bp, human
gctccgctgggacaaactct

SEQ ID NO: 334291 - DNA, 20 bp, human
ggccaaggctggctttccat

SEQ ID NO: 334292 - DNA, 20 bp, human
gactgttaacgtcaatggga

SEQ ID NO: 334293 - DNA, 20 bp, human
gagggcactgcgaggctagg

SEQ ID NO: 334294 - DNA, 20 bp, human
gtagcctcgcagtgccctcc

SEQ ID NO: 334295 - DNA, 20 bp, human
gggtcccccgagtgcgccgc

SEQ ID NO: 334296 - DNA, 20 bp, human
gaggggctcaggtgctgtca

SEQ ID NO: 334297 - DNA, 20 bp, human
gcagcagatggggccgggac

SEQ ID NO: 334298 - DNA, 20 bp, human
gaccctgcctgatctctgaa

SEQ ID NO: 334299 - DNA, 20 bp, human
ggcacaaccaccaaggttca

SEQ ID NO: 334300 - DNA, 20 bp, human
gaccaccaaggttcagggga

SEQ ID NO: 334301 - DNA, 20 bp, human
gagattgttgggccccgagg

SEQ ID NO: 334302 - DNA, 20 bp, human
ggacacccagcagatggggc

SEQ ID NO: 334303 - DNA, 20 bp, human
gtccatcccctgaaccttgg

SEQ ID NO: 334304 - DNA, 20 bp, human
gagcagcgagataaaggccg

SEQ ID NO: 334305 - DNA, 20 bp, human
ggtcaggaaaggcagtaggg

SEQ ID NO: 334306 - DNA, 20 bp, human
ggagaacatgggttgatgct

SEQ ID NO: 334307 - DNA, 20 bp, human
gaagctcagaacagcaaccc

SEQ ID NO: 334308 - DNA, 20 bp, human
gacagtgcctcctgctatac

SEQ ID NO: 334309 - DNA, 20 bp, human
gtgaaagggcctctaattat

SEQ ID NO: 334310 - DNA, 20 bp, human
gacccaagtcagttttgaaa

SEQ ID NO: 334311 - DNA, 20 bp, human
gaacatgcgggcagtgacat

SEQ ID NO: 334312 - DNA, 20 bp, human
gagcttatgacggtgagatt

SEQ ID NO: 334313 - DNA, 20 bp, human
gacaatacctatttattgac

SEQ ID NO: 334314 - DNA, 20 bp, human
gcatgggttgatgctgggac

SEQ ID NO: 334315 - DNA, 20 bp, human
gtgggggtattgaaatctaa

SEQ ID NO: 334316 - DNA, 20 bp, human
gggggaaaacgtttgtcggg

SEQ ID NO: 334317 - DNA, 20 bp, human
ggcccagggagactggcaag

SEQ ID NO: 334318 - DNA, 20 bp, human
gcggggcgcgaagggaactg

SEQ ID NO: 334319 - DNA, 20 bp, human
ggggatgccccgaaacggtg

SEQ ID NO: 334320 - DNA, 20 bp, human
ggagactggcaagcggccga

SEQ ID NO: 334321 - DNA, 20 bp, human
gccgcagcgcccagggagac

SEQ ID NO: 334322 - DNA, 20 bp, human
ggccgcttgccagtctccct

SEQ ID NO: 334323 - DNA, 20 bp, human
gagggtgcagaacacaagga

SEQ ID NO: 334324 - DNA, 20 bp, human
gctagggaagggagtcacgg

SEQ ID NO: 334325 - DNA, 20 bp, human
gagtcacggcggggcgcgaa

SEQ ID NO: 334326 - DNA, 20 bp, human
gtcccagcctagcaggccgg

SEQ ID NO: 334327 - DNA, 20 bp, human
gagaaagagagactctccct

SEQ ID NO: 334328 - DNA, 20 bp, human
gaggaaaagcagagaccaat

SEQ ID NO: 334329 - DNA, 20 bp, human
gagtgcccagaccaactgac

SEQ ID NO: 334330 - DNA, 20 bp, human
gttcaactctggcagcttac

SEQ ID NO: 334331 - DNA, 20 bp, human
ggccgccggcctgctaggct

SEQ ID NO: 334332 - DNA, 20 bp, human
ggaccaatcggcttcaactc

SEQ ID NO: 334333 - DNA, 20 bp, human
gttggtctgggcactgcagc

SEQ ID NO: 334334 - DNA, 20 bp, human
ggagcagccgccggcctgct

SEQ ID NO: 334335 - DNA, 20 bp, human
gctctgtcccagcacttgtc

SEQ ID NO: 334336 - DNA, 20 bp, human
gtcgtgccgcagctcggcga

SEQ ID NO: 334337 - DNA, 20 bp, human
gcggccagcgggagcgtcta

SEQ ID NO: 334338 - DNA, 20 bp, human
ggagctgcggcacgaccccc

SEQ ID NO: 334339 - DNA, 20 bp, human
gggaccccgcgcctaaaccc

SEQ ID NO: 334340 - DNA, 20 bp, human
ggggtccgagggaaacccct

SEQ ID NO: 334341 - DNA, 20 bp, human
gcgggagctcgcctcccccg

SEQ ID NO: 334342 - DNA, 20 bp, human
gctcgcggaaaagccccccc

SEQ ID NO: 334343 - DNA, 20 bp, human
gccccagcggtgacctccag

SEQ ID NO: 334344 - DNA, 20 bp, human
gccgtcgagaagcgcagaaa

SEQ ID NO: 334345 - DNA, 20 bp, human
gtgccgcgccgagcccccag

SEQ ID NO: 334346 - DNA, 20 bp, human
gtccccggagcctcgatctc

SEQ ID NO: 334347 - DNA, 20 bp, human
gaagacccggaggcgtgctg

SEQ ID NO: 334348 - DNA, 20 bp, human
ggggccagagatcgaggctc

SEQ ID NO: 334349 - DNA, 20 bp, human
gctgctcgggccagagatcg

SEQ ID NO: 334350 - DNA, 20 bp, human
gcgggagcggctgcctctca

SEQ ID NO: 334351 - DNA, 20 bp, human
gtcgccagtaacgtgctctc

SEQ ID NO: 334352 - DNA, 20 bp, human
gtaacccgagagcacgttac

SEQ ID NO: 334353 - DNA, 20 bp, human
ggccctggagcgaccctgag

SEQ ID NO: 334354 - DNA, 20 bp, human
gccagcccgcagcacgcctc

SEQ ID NO: 334355 - DNA, 20 bp, human
ggcctctcagggtcgctcca

SEQ ID NO: 334356 - DNA, 20 bp, human
gcacccgcggccctgggcca

SEQ ID NO: 334357 - DNA, 20 bp, human
gagcccggcgaggtcgagct

SEQ ID NO: 334358 - DNA, 20 bp, human
ggagaggcaagcaaatgcgg

SEQ ID NO: 334359 - DNA, 20 bp, human
gccgcccagctcgacctcgc

SEQ ID NO: 334360 - DNA, 20 bp, human
ggccccaccgcctactccga

SEQ ID NO: 334361 - DNA, 20 bp, human
gggcccctgccatttcggga

SEQ ID NO: 334362 - DNA, 20 bp, human
gcgcggagccggggcacctg

SEQ ID NO: 334363 - DNA, 20 bp, human
gacgggcgcagaccgaaagt

SEQ ID NO: 334364 - DNA, 20 bp, human
gacagcccttcaggggaaga

SEQ ID NO: 334365 - DNA, 20 bp, human
ggaggcttacacagcccttc

SEQ ID NO: 334366 - DNA, 20 bp, human
ggaccgggggctggagtcaa

SEQ ID NO: 334367 - DNA, 20 bp, human
ggagataggcagccgaccgg

SEQ ID NO: 334368 - DNA, 20 bp, human
gacgccccctagttagggga

SEQ ID NO: 334369 - DNA, 20 bp, human
gagcccgagcgcgagccgag

SEQ ID NO: 334370 - DNA, 20 bp, human
gaggagggacgggctgcgtg

SEQ ID NO: 334371 - DNA, 20 bp, human
ggggccgaaggggtcgctca

SEQ ID NO: 334372 - DNA, 20 bp, human
gggctctgcacagctgtcca

SEQ ID NO: 334373 - DNA, 20 bp, human
ggagccctgagcgacccctt

SEQ ID NO: 334374 - DNA, 20 bp, human
gccgcagggtctcctccgct

SEQ ID NO: 334375 - DNA, 20 bp, human
gggagcgcgcgagccggagt

SEQ ID NO: 334376 - DNA, 20 bp, human
gaacccgccccggaccttcc

SEQ ID NO: 334377 - DNA, 20 bp, human
ggaggcgggaaggcgctccc

SEQ ID NO: 334378 - DNA, 20 bp, human
ggcctcgccctggaaggtcc

SEQ ID NO: 334379 - DNA, 20 bp, human
gcccgccttcctgcttagac

SEQ ID NO: 334380 - DNA, 20 bp, human
ggccctggaaggtccggggc

SEQ ID NO: 334381 - DNA, 20 bp, human
gtcccgggaggagagcggaa

SEQ ID NO: 334382 - DNA, 20 bp, human
ggctcactgccagtctaagc

SEQ ID NO: 334383 - DNA, 20 bp, human
gtgaggttcccggcgcgggg

SEQ ID NO: 334384 - DNA, 20 bp, human
gggccaggactgcctcgccc

SEQ ID NO: 334385 - DNA, 20 bp, human
gaggccgaaccgcccagcgt

SEQ ID NO: 334386 - DNA, 20 bp, human
gtccctccggagttcttctt

SEQ ID NO: 334387 - DNA, 20 bp, human
gcaggtgatcggtgtggcgg

SEQ ID NO: 334388 - DNA, 20 bp, human
gcgaaccccgagcgcttccg

SEQ ID NO: 334389 - DNA, 20 bp, human
gggagggtgggcaagctcga

SEQ ID NO: 334390 - DNA, 20 bp, human
ggggccgccgggtagggggt

SEQ ID NO: 334391 - DNA, 20 bp, human
ggaagcgctcggggttcgtg

SEQ ID NO: 334392 - DNA, 20 bp, human
gcctcctgggccgccgggta

SEQ ID NO: 334393 - DNA, 20 bp, human
gaggcgtccaggcaggtgat

SEQ ID NO: 334394 - DNA, 20 bp, human
gcgcggcggcggccagcacc

SEQ ID NO: 334395 - DNA, 20 bp, human
ggccccaagaagaactccgg

SEQ ID NO: 334396 - DNA, 20 bp, human
gtgctgaggggcgggacggt

SEQ ID NO: 334397 - DNA, 20 bp, human
gaagggagagtgcgagaggt

SEQ ID NO: 334398 - DNA, 20 bp, human
gtgggctcctaacctgtcca

SEQ ID NO: 334399 - DNA, 20 bp, human
gccctcctggcgctgactcc

SEQ ID NO: 334400 - DNA, 20 bp, human
gggagcccacgtggtctagg

SEQ ID NO: 334401 - DNA, 20 bp, human
gactgtgctgaggggcggga

SEQ ID NO: 334402 - DNA, 20 bp, human
ggacaggttaggagcccacg

SEQ ID NO: 334403 - DNA, 20 bp, human
gttccccagggccagattca

SEQ ID NO: 334404 - DNA, 20 bp, human
gacatccccctagaccacgt

SEQ ID NO: 334405 - DNA, 20 bp, human
gcatggactgaagggttgct

SEQ ID NO: 334406 - DNA, 20 bp, human
ggggccatgcgggtgagccg

SEQ ID NO: 334407 - DNA, 20 bp, human
gccccccagcgacggagccg

SEQ ID NO: 334408 - DNA, 20 bp, human
gctcccctgccccccagcga

SEQ ID NO: 334409 - DNA, 20 bp, human
gcccacacggctagacgcct

SEQ ID NO: 334410 - DNA, 20 bp, human
gccggccccggctccgtcgc

SEQ ID NO: 334411 - DNA, 20 bp, human
ggggtccgaggccgctacct

SEQ ID NO: 334412 - DNA, 20 bp, human
ggccccggctccgtcgctgg

SEQ ID NO: 334413 - DNA, 20 bp, human
gtacgcgtccggggccccgc

SEQ ID NO: 334414 - DNA, 20 bp, human
gcggccgtggatgctcactc

SEQ ID NO: 334415 - DNA, 20 bp, human
gcagccgcggctcacccgca

SEQ ID NO: 334416 - DNA, 20 bp, human
gtctccgcacggggtgaaga

SEQ ID NO: 334417 - DNA, 20 bp, human
gtgacccccgcccgccccat

SEQ ID NO: 334418 - DNA, 20 bp, human
gctcccgcaggcggccgatg

SEQ ID NO: 334419 - DNA, 20 bp, human
gcgcacggggtgaagaggga

SEQ ID NO: 334420 - DNA, 20 bp, human
gctcgcgcggacgcgtccca

SEQ ID NO: 334421 - DNA, 20 bp, human
gaacaggtgctgcgcagaca

SEQ ID NO: 334422 - DNA, 20 bp, human
gggagcgcgcgcctggcgag

SEQ ID NO: 334423 - DNA, 20 bp, human
ggggctccgcgctaacctcg

SEQ ID NO: 334424 - DNA, 20 bp, human
gccgcccactggctgtcaac

SEQ ID NO: 334425 - DNA, 20 bp, human
gggtgctgcgggactcgctg

SEQ ID NO: 334426 - DNA, 20 bp, human
gcccggccgcggcccctgag

SEQ ID NO: 334427 - DNA, 20 bp, human
ggggcagcgccgaatctagc

SEQ ID NO: 334428 - DNA, 20 bp, human
gcccgagtgcgcgcctctca

SEQ ID NO: 334429 - DNA, 20 bp, human
gcagctgccggccaccggag

SEQ ID NO: 334430 - DNA, 20 bp, human
ggcgccgaatctagcggggc

SEQ ID NO: 334431 - DNA, 20 bp, human
gtgggtgccgcacttccttg

SEQ ID NO: 334432 - DNA, 20 bp, human
gcgttctccagccccggccg

SEQ ID NO: 334433 - DNA, 20 bp, human
gtcgcctgccccgctagatt

SEQ ID NO: 334434 - DNA, 20 bp, human
gcgcgcactcgggctcagag

SEQ ID NO: 334435 - DNA, 20 bp, human
gcccggccggcgattaaact

SEQ ID NO: 334436 - DNA, 20 bp, human
gcggggagaagcagaccaga

SEQ ID NO: 334437 - DNA, 20 bp, human
ggaagcagaccagatgggat

SEQ ID NO: 334438 - DNA, 20 bp, human
ggacttcgacaacaactggg

SEQ ID NO: 334439 - DNA, 20 bp, human
gagttgttgtcgaagtctgg

SEQ ID NO: 334440 - DNA, 20 bp, human
ggaaggcgcaatctggacac

SEQ ID NO: 334441 - DNA, 20 bp, human
ggaagtctgggggttgggac

SEQ ID NO: 334442 - DNA, 20 bp, human
ggcagaccagatgggatggg

SEQ ID NO: 334443 - DNA, 20 bp, human
ggcgtaagagcaaaaagcga

SEQ ID NO: 334444 - DNA, 20 bp, human
gttcgacaacaactgggggg

SEQ ID NO: 334445 - DNA, 20 bp, human
gaaaaagcgaaggcgcaatc

SEQ ID NO: 334446 - DNA, 20 bp, human
gggaggccgccacccgacat

SEQ ID NO: 334447 - DNA, 20 bp, human
gccctcacatcctgagcgaa

SEQ ID NO: 334448 - DNA, 20 bp, human
gtgagcgaacgggcgatggg

SEQ ID NO: 334449 - DNA, 20 bp, human
gatcctgagcgaacgggcga

SEQ ID NO: 334450 - DNA, 20 bp, human
gcatgggcatcgggaaagtg

SEQ ID NO: 334451 - DNA, 20 bp, human
gcgccacccgacatgggcat

SEQ ID NO: 334452 - DNA, 20 bp, human
gcccgttcgctcaggatgtg

SEQ ID NO: 334453 - DNA, 20 bp, human
gtggcggcctccccttgcca

SEQ ID NO: 334454 - DNA, 20 bp, human
gccaaagtggcgggggaagt

SEQ ID NO: 334455 - DNA, 20 bp, human
gcatcgggaaagtggggccg

SEQ ID NO: 334456 - DNA, 20 bp, human
gttcccagcgcggggaggaa

SEQ ID NO: 334457 - DNA, 20 bp, human
gctgccccctggcggagccg

SEQ ID NO: 334458 - DNA, 20 bp, human
gacgccgaagcgggaggatt

SEQ ID NO: 334459 - DNA, 20 bp, human
ggaagaagtgctgcgcaccg

SEQ ID NO: 334460 - DNA, 20 bp, human
gtcaggaggaacaaggtttg

SEQ ID NO: 334461 - DNA, 20 bp, human
ggctcctgggacgccgaagc

SEQ ID NO: 334462 - DNA, 20 bp, human
gacttcttcccagcgcgggg

SEQ ID NO: 334463 - DNA, 20 bp, human
gaggatcagcgggtgctgat

SEQ ID NO: 334464 - DNA, 20 bp, human
gcagccctgtaactgctggt

SEQ ID NO: 334465 - DNA, 20 bp, human
ggggaggattcggtttcttc

SEQ ID NO: 334466 - DNA, 20 bp, human
gtatcagcgccagagaggga

SEQ ID NO: 334467 - DNA, 20 bp, human
gggccgcgggccaaccagaa

SEQ ID NO: 334468 - DNA, 20 bp, human
gcccgcccgcggcgtggcgt

SEQ ID NO: 334469 - DNA, 20 bp, human
gtgggtatcagcgccagaga

SEQ ID NO: 334470 - DNA, 20 bp, human
gggtgccccgcccccgctaa

SEQ ID NO: 334471 - DNA, 20 bp, human
gaaccagaacggcgtccagg

SEQ ID NO: 334472 - DNA, 20 bp, human
gagtcagcagagcggaatct

SEQ ID NO: 334473 - DNA, 20 bp, human
gagcgcctgcgtgggaaggt

SEQ ID NO: 334474 - DNA, 20 bp, human
gcaccccctggacgccgttc

SEQ ID NO: 334475 - DNA, 20 bp, human
gtccgacgccacgccgcggg

SEQ ID NO: 334476 - DNA, 20 bp, human
gtgtacaaatcagtcagctc

SEQ ID NO: 334477 - DNA, 20 bp, human
gctgcacagcactgggacat

SEQ ID NO: 334478 - DNA, 20 bp, human
gaggacttgggcaaactaca

SEQ ID NO: 334479 - DNA, 20 bp, human
gcagtgcacacgggtgatag

SEQ ID NO: 334480 - DNA, 20 bp, human
ggcacacgggtgatagaggc

SEQ ID NO: 334481 - DNA, 20 bp, human
gggaacaaactcagtcccta

SEQ ID NO: 334482 - DNA, 20 bp, human
gaccatccgggcagtgcaca

SEQ ID NO: 334483 - DNA, 20 bp, human
gcccgtgtgcactgcccgga

SEQ ID NO: 334484 - DNA, 20 bp, human
gtcagtcagctcaggctgcg

SEQ ID NO: 334485 - DNA, 20 bp, human
gagaactctcatgtgcctta

SEQ ID NO: 334486 - DNA, 20 bp, human
gccgcggcccctcacccggt

SEQ ID NO: 334487 - DNA, 20 bp, human
gcggcccctcacccggtggg

SEQ ID NO: 334488 - DNA, 20 bp, human
gggccaatggcaaggcgcgc

SEQ ID NO: 334489 - DNA, 20 bp, human
gccgggctgaggtggcgtgt

SEQ ID NO: 334490 - DNA, 20 bp, human
gacagtaggcggtgaccgac

SEQ ID NO: 334491 - DNA, 20 bp, human
gcacccgcccaccgggtgag

SEQ ID NO: 334492 - DNA, 20 bp, human
gggtgggcgggtcacgcagc

SEQ ID NO: 334493 - DNA, 20 bp, human
gctgctgcctacctcccgaa

SEQ ID NO: 334494 - DNA, 20 bp, human
ggacaggcggggtgcacgct

SEQ ID NO: 334495 - DNA, 20 bp, human
ggaggacacgaccaagatgg

SEQ ID NO: 334496 - DNA, 20 bp, human
ggggtctggtaaggccccgc

SEQ ID NO: 334497 - DNA, 20 bp, human
gggcggggcgaacggggcgg

SEQ ID NO: 334498 - DNA, 20 bp, human
ggcaaggccaacgtggttgg

SEQ ID NO: 334499 - DNA, 20 bp, human
ggccccgcctccaaccacgt

SEQ ID NO: 334500 - DNA, 20 bp, human
gcgggggccggggtctggta

SEQ ID NO: 334501 - DNA, 20 bp, human
gcgccggctgagatatccag

SEQ ID NO: 334502 - DNA, 20 bp, human
ggcggcgcacctgacttccc

SEQ ID NO: 334503 - DNA, 20 bp, human
gaggccaacgtggttggagg

SEQ ID NO: 334504 - DNA, 20 bp, human
gggggcgtggccaaccatgc

SEQ ID NO: 334505 - DNA, 20 bp, human
gccgggaggcaaggccaacg

SEQ ID NO: 334506 - DNA, 20 bp, human
gggtcctggcacgccggcgg

SEQ ID NO: 334507 - DNA, 20 bp, human
gcggggtcctggcacgccgg

SEQ ID NO: 334508 - DNA, 20 bp, human
gacgcggacgcacgcagccg

SEQ ID NO: 334509 - DNA, 20 bp, human
ggcgtccgggcgcttctgtg

SEQ ID NO: 334510 - DNA, 20 bp, human
gtcgcccccgccggcgtgcc

SEQ ID NO: 334511 - DNA, 20 bp, human
gacccgggtgccggcccgtg

SEQ ID NO: 334512 - DNA, 20 bp, human
gtgcccggctctggccagca

SEQ ID NO: 334513 - DNA, 20 bp, human
gggcgacacgcgcgtctctg

SEQ ID NO: 334514 - DNA, 20 bp, human
gagagagcccccagccgctc

SEQ ID NO: 334515 - DNA, 20 bp, human
gggctcccgccgcgccgtgg

SEQ ID NO: 334516 - DNA, 20 bp, human
gccgcgctccggccactcgg

SEQ ID NO: 334517 - DNA, 20 bp, human
gggccgaggcggcgagtgtc

SEQ ID NO: 334518 - DNA, 20 bp, human
gccactcggcggtaacgagt

SEQ ID NO: 334519 - DNA, 20 bp, human
gagcccggctacccctacgc

SEQ ID NO: 334520 - DNA, 20 bp, human
gagcgcaagcagcgggttag

SEQ ID NO: 334521 - DNA, 20 bp, human
gtcgggcggggcgggaaatg

SEQ ID NO: 334522 - DNA, 20 bp, human
ggcgagtgtctgggcgagcg

SEQ ID NO: 334523 - DNA, 20 bp, human
gtccggctgcaggtccgcct

SEQ ID NO: 334524 - DNA, 20 bp, human
gtgtctgggcgagcgtggct

SEQ ID NO: 334525 - DNA, 20 bp, human
gacgcgcgagcgcaagcagc

SEQ ID NO: 334526 - DNA, 20 bp, human
gtggggagcagtggcgagca

SEQ ID NO: 334527 - DNA, 20 bp, human
gcgcctcggccgcgacgagt

SEQ ID NO: 334528 - DNA, 20 bp, human
gagggccgcgcgcaggagta

SEQ ID NO: 334529 - DNA, 20 bp, human
ggtggcgcagccaatcagaa

SEQ ID NO: 334530 - DNA, 20 bp, human
gaggccaagagggagagcgg

SEQ ID NO: 334531 - DNA, 20 bp, human
gcggcggagccgactcgtcg

SEQ ID NO: 334532 - DNA, 20 bp, human
gccgcgcgcaggagtaggga

SEQ ID NO: 334533 - DNA, 20 bp, human
gtagggagggcctagggcgg

SEQ ID NO: 334534 - DNA, 20 bp, human
gtccgtgccggcgtcagtct

SEQ ID NO: 334535 - DNA, 20 bp, human
gaagggggcacctcacgtta

SEQ ID NO: 334536 - DNA, 20 bp, human
gaaagcatgcgcagcagctg

SEQ ID NO: 334537 - DNA, 20 bp, human
gggggctgcgggtgcggact

SEQ ID NO: 334538 - DNA, 20 bp, human
gcccagcgagcacttcttcc

SEQ ID NO: 334539 - DNA, 20 bp, human
ggaaggcaattaatgagcgg

SEQ ID NO: 334540 - DNA, 20 bp, human
gcgtggcaccgggaactcgg

SEQ ID NO: 334541 - DNA, 20 bp, human
ggggaagtggccgtggtggt

SEQ ID NO: 334542 - DNA, 20 bp, human
ggtgcgaaaaggcaaggtca

SEQ ID NO: 334543 - DNA, 20 bp, human
gggcaccgggaactcggagg

SEQ ID NO: 334544 - DNA, 20 bp, human
gagtgaagtgcgaaaaggca

SEQ ID NO: 334545 - DNA, 20 bp, human
gcagcgagtgaagtgcgaaa

SEQ ID NO: 334546 - DNA, 20 bp, human
gggctgcggctcattggtcc

SEQ ID NO: 334547 - DNA, 20 bp, human
gcaaaccggtaacctctacc

SEQ ID NO: 334548 - DNA, 20 bp, human
gcggccgcccctcggaccac

SEQ ID NO: 334549 - DNA, 20 bp, human
gtgagtgagcgatgtccgcc

SEQ ID NO: 334550 - DNA, 20 bp, human
ggctcactcacatatccaat

SEQ ID NO: 334551 - DNA, 20 bp, human
ggtggcgagcagcggaaggc

SEQ ID NO: 334552 - DNA, 20 bp, human
gcactcacatatccaatggg

SEQ ID NO: 334553 - DNA, 20 bp, human
ggccctctcggggtgctgct

SEQ ID NO: 334554 - DNA, 20 bp, human
ggaaggcgctcgccaagccg

SEQ ID NO: 334555 - DNA, 20 bp, human
ggcccctcggaccaccggac

SEQ ID NO: 334556 - DNA, 20 bp, human
gcggccgcgcgcctcgtcgg

SEQ ID NO: 334557 - DNA, 20 bp, human
gcagagccgggagtcgtcgg

SEQ ID NO: 334558 - DNA, 20 bp, human
gttgcagagccgggagtcgt

SEQ ID NO: 334559 - DNA, 20 bp, human
ggcaaatcctcgagagaggg

SEQ ID NO: 334560 - DNA, 20 bp, human
gtctgcaaatcctcgagaga

SEQ ID NO: 334561 - DNA, 20 bp, human
gtcctcggcgtggggagtga

SEQ ID NO: 334562 - DNA, 20 bp, human
gacgttccgcgccaccgacg

SEQ ID NO: 334563 - DNA, 20 bp, human
gaacgtcccggctcgcgcta

SEQ ID NO: 334564 - DNA, 20 bp, human
gtcggtggcgcggaacgtcc

SEQ ID NO: 334565 - DNA, 20 bp, human
ggggctgggtgcgatcatct

SEQ ID NO: 334566 - DNA, 20 bp, human
gtgctgggtatggcccagga

SEQ ID NO: 334567 - DNA, 20 bp, human
ggagttagatgccatgtaac

SEQ ID NO: 334568 - DNA, 20 bp, human
ggaactcagtgcctatagat

SEQ ID NO: 334569 - DNA, 20 bp, human
ggggccattgttgagtaaga

SEQ ID NO: 334570 - DNA, 20 bp, human
ggagcagctcagtacctaga

SEQ ID NO: 334571 - DNA, 20 bp, human
gtacatggcatctaactcat

SEQ ID NO: 334572 - DNA, 20 bp, human
gggggtgctgggtatggccc

SEQ ID NO: 334573 - DNA, 20 bp, human
gccagggtggtgatgcgtga

SEQ ID NO: 334574 - DNA, 20 bp, human
ggccccctcttactcaacaa

SEQ ID NO: 334575 - DNA, 20 bp, human
gggggatgggataaaataag

SEQ ID NO: 334576 - DNA, 20 bp, human
gcacccgacgtgtacgggga

SEQ ID NO: 334577 - DNA, 20 bp, human
gtcccgcccagcggcgcagg

SEQ ID NO: 334578 - DNA, 20 bp, human
ggggacactaagaggcgagg

SEQ ID NO: 334579 - DNA, 20 bp, human
ggccccctgcgccgctgggc

SEQ ID NO: 334580 - DNA, 20 bp, human
ggggcgggactccggcgagg

SEQ ID NO: 334581 - DNA, 20 bp, human
gaggtgtggggtgagcgtgt

SEQ ID NO: 334582 - DNA, 20 bp, human
gccccagccggcgaggtgtg

SEQ ID NO: 334583 - DNA, 20 bp, human
gcccgtacacgtcgggtgat

SEQ ID NO: 334584 - DNA, 20 bp, human
gggcggggatcggctgtcac

SEQ ID NO: 334585 - DNA, 20 bp, human
ggggaggctgggcgggactc

SEQ ID NO: 334586 - DNA, 20 bp, human
gaaagcgtgggttaaggggg

SEQ ID NO: 334587 - DNA, 20 bp, human
gagatgcgagggggtagcaa

SEQ ID NO: 334588 - DNA, 20 bp, human
gcttcgccccgcggaggaaa

SEQ ID NO: 334589 - DNA, 20 bp, human
gccggcaaagcgtgggttaa

SEQ ID NO: 334590 - DNA, 20 bp, human
gggaaggaaggggttaaccc

SEQ ID NO: 334591 - DNA, 20 bp, human
gaaccaatagccttccgccc

SEQ ID NO: 334592 - DNA, 20 bp, human
gcccgggggaagccacgtgc

SEQ ID NO: 334593 - DNA, 20 bp, human
gggccgccccggcaaagcgt

SEQ ID NO: 334594 - DNA, 20 bp, human
gggaatgcccgccagggcaa

SEQ ID NO: 334595 - DNA, 20 bp, human
gccagccaatcggctcgtca

SEQ ID NO: 334596 - DNA, 20 bp, human
gtgggttctccgctgccgaa

SEQ ID NO: 334597 - DNA, 20 bp, human
gagcggcggccaatcagtgg

SEQ ID NO: 334598 - DNA, 20 bp, human
gcacgtacgcggcgcgcgag

SEQ ID NO: 334599 - DNA, 20 bp, human
ggcgcgcgccctccactgat

SEQ ID NO: 334600 - DNA, 20 bp, human
ggaaagcggctgcacttgct

SEQ ID NO: 334601 - DNA, 20 bp, human
gcaaaacacaaacgtcacag

SEQ ID NO: 334602 - DNA, 20 bp, human
ggtgcccgcggaccgggaag

SEQ ID NO: 334603 - DNA, 20 bp, human
ggggctgagtcccatgagcc

SEQ ID NO: 334604 - DNA, 20 bp, human
gctcccggaaaaggcgcctg

SEQ ID NO: 334605 - DNA, 20 bp, human
ggggtctctggcgccgcgcc

SEQ ID NO: 334606 - DNA, 20 bp, human
gaagcagaaacaggtatctg

SEQ ID NO: 334607 - DNA, 20 bp, human
ggctgtgacggaaaaagggt

SEQ ID NO: 334608 - DNA, 20 bp, human
gctccccccgagtcccaaac

SEQ ID NO: 334609 - DNA, 20 bp, human
gacggggctccgagtcgcgt

SEQ ID NO: 334610 - DNA, 20 bp, human
gcgcggctgtgacggaaaaa

SEQ ID NO: 334611 - DNA, 20 bp, human
gaagctgcgttcaaaagtat

SEQ ID NO: 334612 - DNA, 20 bp, human
ggaccccagcccacgcgact

SEQ ID NO: 334613 - DNA, 20 bp, human
gcaggtatctggggcaacgt

SEQ ID NO: 334614 - DNA, 20 bp, human
gcccccgagtcccaaacagg

SEQ ID NO: 334615 - DNA, 20 bp, human
gccggtgccagggcactccg

SEQ ID NO: 334616 - DNA, 20 bp, human
ggggggcagggcaaccgcga

SEQ ID NO: 334617 - DNA, 20 bp, human
gctgactcgcgctctctcgg

SEQ ID NO: 334618 - DNA, 20 bp, human
ggccgtgcgtacaggaggga

SEQ ID NO: 334619 - DNA, 20 bp, human
gtcggcgggactccgggcca

SEQ ID NO: 334620 - DNA, 20 bp, human
gagagagcgcgagtcagatg

SEQ ID NO: 334621 - DNA, 20 bp, human
gtgcggccgtgcgtacagga

SEQ ID NO: 334622 - DNA, 20 bp, human
ggggcccgagagccgcggtg

SEQ ID NO: 334623 - DNA, 20 bp, human
gagtcggagccgacctcaga

SEQ ID NO: 334624 - DNA, 20 bp, human
gcgagtcagatgcggggccg

SEQ ID NO: 334625 - DNA, 20 bp, human
ggggcgggtgctaggtgaga

SEQ ID NO: 334626 - DNA, 20 bp, human
gcgccctggctccgagggaa

SEQ ID NO: 334627 - DNA, 20 bp, human
gcggccgaggccggcctgtt

SEQ ID NO: 334628 - DNA, 20 bp, human
ggccccctggtgtcgggcct

SEQ ID NO: 334629 - DNA, 20 bp, human
gttcccaggcccgacaccag

SEQ ID NO: 334630 - DNA, 20 bp, human
gagccgggctaggccctcct

SEQ ID NO: 334631 - DNA, 20 bp, human
gacaccttggctccaaggga

SEQ ID NO: 334632 - DNA, 20 bp, human
gcagggcgcagagactgcca

SEQ ID NO: 334633 - DNA, 20 bp, human
gctggccggccctgactccc

SEQ ID NO: 334634 - DNA, 20 bp, human
ggcctagcccggctgttccc

SEQ ID NO: 334635 - DNA, 20 bp, human
gaggcatgcgggttctgccg

SEQ ID NO: 334636 - DNA, 20 bp, human
ggcacagcagagccggtcca

SEQ ID NO: 334637 - DNA, 20 bp, human
gcccgccggggggatgaggc

SEQ ID NO: 334638 - DNA, 20 bp, human
gctggcccgagcccgccggg

SEQ ID NO: 334639 - DNA, 20 bp, human
gcgcggggcagtccctggac

SEQ ID NO: 334640 - DNA, 20 bp, human
ggaccggctctgctgtgctc

SEQ ID NO: 334641 - DNA, 20 bp, human
ggggaggatgcgggcaccac

SEQ ID NO: 334642 - DNA, 20 bp, human
gtcatccccccggcgggctc

SEQ ID NO: 334643 - DNA, 20 bp, human
gggccccgggatcacatggg

SEQ ID NO: 334644 - DNA, 20 bp, human
gcctccgcccatgtgatccc

SEQ ID NO: 334645 - DNA, 20 bp, human
ggcggcggcttctcgggcta

SEQ ID NO: 334646 - DNA, 20 bp, human
gccgggctgcgcactcccgc

SEQ ID NO: 334647 - DNA, 20 bp, human
gcggctctcgcttccaaagt

SEQ ID NO: 334648 - DNA, 20 bp, human
gccccggagagctccaactt

SEQ ID NO: 334649 - DNA, 20 bp, human
ggtgcgcagcccggccggct

SEQ ID NO: 334650 - DNA, 20 bp, human
gctccaagcagaagataaac

SEQ ID NO: 334651 - DNA, 20 bp, human
gtgtgacttcaagagagcga

SEQ ID NO: 334652 - DNA, 20 bp, human
gtcctggccccgacccgggc

SEQ ID NO: 334653 - DNA, 20 bp, human
ggggcgctttatccccgctg

SEQ ID NO: 334654 - DNA, 20 bp, human
gcggcgtcctggccccgacc

SEQ ID NO: 334655 - DNA, 20 bp, human
ggcgcagcagtgcactttgt

SEQ ID NO: 334656 - DNA, 20 bp, human
gccgaccctcccacttcggg

SEQ ID NO: 334657 - DNA, 20 bp, human
gcctcagagccccccgaagt

SEQ ID NO: 334658 - DNA, 20 bp, human
ggggccaatccaggcgcaca

SEQ ID NO: 334659 - DNA, 20 bp, human
ggatctctgagagctgagtg

SEQ ID NO: 334660 - DNA, 20 bp, human
gcagcccgaccctcccactt

SEQ ID NO: 334661 - DNA, 20 bp, human
gctggccgcggggccaatcc

SEQ ID NO: 334662 - DNA, 20 bp, human
ggctccctgtgcgcctggat

SEQ ID NO: 334663 - DNA, 20 bp, human
gccaggcgcacagggagcgg

SEQ ID NO: 334664 - DNA, 20 bp, human
gcagagccccccgaagtggg

SEQ ID NO: 334665 - DNA, 20 bp, human
gcggtgctccagcccgagga

SEQ ID NO: 334666 - DNA, 20 bp, human
gcgctcccggccacgcctct

SEQ ID NO: 334667 - DNA, 20 bp, human
gcagccgcgccgcgcagggg

SEQ ID NO: 334668 - DNA, 20 bp, human
ggaggggcgtgtcctgggtc

SEQ ID NO: 334669 - DNA, 20 bp, human
ggagcggaggggcgtgtcct

SEQ ID NO: 334670 - DNA, 20 bp, human
gccgggcgctcgggcttgct

SEQ ID NO: 334671 - DNA, 20 bp, human
gcgctcgggcttgctggggc

SEQ ID NO: 334672 - DNA, 20 bp, human
gaggaggcggaagttcccgc

SEQ ID NO: 334673 - DNA, 20 bp, human
gaggcggaagttcccgcggg

SEQ ID NO: 334674 - DNA, 20 bp, human
gtcggtgggagtagtcttag

SEQ ID NO: 334675 - DNA, 20 bp, human
ggctctgcctaaaaatagaa

SEQ ID NO: 334676 - DNA, 20 bp, human
gcccgacgggacttggtgat

SEQ ID NO: 334677 - DNA, 20 bp, human
gccctgcaacggggcggagt

SEQ ID NO: 334678 - DNA, 20 bp, human
ggctgcgggtcgcctcctta

SEQ ID NO: 334679 - DNA, 20 bp, human
gccgacccgggccctgcaac

SEQ ID NO: 334680 - DNA, 20 bp, human
gtccgcgcgctcaaagtgga

SEQ ID NO: 334681 - DNA, 20 bp, human
gagcgggcggtgcgagggac

SEQ ID NO: 334682 - DNA, 20 bp, human
gaacggggcggagtcgggag

SEQ ID NO: 334683 - DNA, 20 bp, human
gaggaggcgacccgcagccc

SEQ ID NO: 334684 - DNA, 20 bp, human
gcccgggccctgcaacgggg

SEQ ID NO: 334685 - DNA, 20 bp, human
gtctcagctctaagcccgac

SEQ ID NO: 334686 - DNA, 20 bp, human
gccacctgagggagagggtc

SEQ ID NO: 334687 - DNA, 20 bp, human
ggacactaaagcaacccagg

SEQ ID NO: 334688 - DNA, 20 bp, human
ggaccctgcagacccaagcc

SEQ ID NO: 334689 - DNA, 20 bp, human
gactaaagcaacccaggagg

SEQ ID NO: 334690 - DNA, 20 bp, human
gtccacaaacagccacgctc

SEQ ID NO: 334691 - DNA, 20 bp, human
gaataaataagcagtgtgac

SEQ ID NO: 334692 - DNA, 20 bp, human
gacccaagccaggctgacgg

SEQ ID NO: 334693 - DNA, 20 bp, human
gtctggaagtgggacagctt

SEQ ID NO: 334694 - DNA, 20 bp, human
gctcaggtgagcaccacctg

SEQ ID NO: 334695 - DNA, 20 bp, human
gaagtgggacagctttgggt

SEQ ID NO: 334696 - DNA, 20 bp, human
gtggctgcgcagtgacgagt

SEQ ID NO: 334697 - DNA, 20 bp, human
gtggcggccccgcacggtag

SEQ ID NO: 334698 - DNA, 20 bp, human
gcggctcgcgccgaatggaa

SEQ ID NO: 334699 - DNA, 20 bp, human
gtgcgcagtgacgagtggga

SEQ ID NO: 334700 - DNA, 20 bp, human
ggcgggcccggggaaccaat

SEQ ID NO: 334701 - DNA, 20 bp, human
ggctgcgcggcgctagggag

SEQ ID NO: 334702 - DNA, 20 bp, human
gcggcccgaacgtgcgggcg

SEQ ID NO: 334703 - DNA, 20 bp, human
gtcgtcactgcgcagccaat

SEQ ID NO: 334704 - DNA, 20 bp, human
ggctagggagcggtggtctg

SEQ ID NO: 334705 - DNA, 20 bp, human
gcccgcccccagcgagtgga

SEQ ID NO: 334706 - DNA, 20 bp, human
gagcacccaggcagggggta

SEQ ID NO: 334707 - DNA, 20 bp, human
ggggcagaaaggcgggaccc

SEQ ID NO: 334708 - DNA, 20 bp, human
gagaaaggcgggacccggga

SEQ ID NO: 334709 - DNA, 20 bp, human
gagggtgtggcgctcaagag

SEQ ID NO: 334710 - DNA, 20 bp, human
gtccgcaattgagccaacca

SEQ ID NO: 334711 - DNA, 20 bp, human
gccaaccagggctggcggga

SEQ ID NO: 334712 - DNA, 20 bp, human
ggccctggttggctcaattg

SEQ ID NO: 334713 - DNA, 20 bp, human
gtggagctgggtcctgacta

SEQ ID NO: 334714 - DNA, 20 bp, human
gtgcggaggcgggcccttga

SEQ ID NO: 334715 - DNA, 20 bp, human
gggacagaggtattgcccaa

SEQ ID NO: 334716 - DNA, 20 bp, human
gagggggcgagctgtcattc

SEQ ID NO: 334717 - DNA, 20 bp, human
ggtcacgcccgaggtagcgg

SEQ ID NO: 334718 - DNA, 20 bp, human
gaatgcagctggagcggagg

SEQ ID NO: 334719 - DNA, 20 bp, human
ggagcccactaaggccgcgg

SEQ ID NO: 334720 - DNA, 20 bp, human
ggctccgccgcggccttagt

SEQ ID NO: 334721 - DNA, 20 bp, human
gcccggaaatgcagctggag

SEQ ID NO: 334722 - DNA, 20 bp, human
ggccgcggcggagcgacgat

SEQ ID NO: 334723 - DNA, 20 bp, human
ggcggaggcggagcccacta

SEQ ID NO: 334724 - DNA, 20 bp, human
gtgggcgcgggcgtcggctg

SEQ ID NO: 334725 - DNA, 20 bp, human
gccccctccccaggcggggt

SEQ ID NO: 334726 - DNA, 20 bp, human
gttgccagggcccgcagtcc

SEQ ID NO: 334727 - DNA, 20 bp, human
gtacagggccgcagctgcgg

SEQ ID NO: 334728 - DNA, 20 bp, human
ggcgccaaaacgatgatctc

SEQ ID NO: 334729 - DNA, 20 bp, human
gccggccaaacagagcccga

SEQ ID NO: 334730 - DNA, 20 bp, human
ggcgcccttgtcccggggac

SEQ ID NO: 334731 - DNA, 20 bp, human
ggaggagcgcgacggtgggg

SEQ ID NO: 334732 - DNA, 20 bp, human
gccagcctggaggagcgcga

SEQ ID NO: 334733 - DNA, 20 bp, human
gcgacggtgggggggccgga

SEQ ID NO: 334734 - DNA, 20 bp, human
gcgctccggtccccgggaca

SEQ ID NO: 334735 - DNA, 20 bp, human
gctgcgggccctggcaaaat

SEQ ID NO: 334736 - DNA, 20 bp, human
ggccggcagtacccttgccc

SEQ ID NO: 334737 - DNA, 20 bp, human
gccccgggcaagggtactgc

SEQ ID NO: 334738 - DNA, 20 bp, human
ggcgcgctcgtgcgctgctg

SEQ ID NO: 334739 - DNA, 20 bp, human
gaagctgagaagagtaagat

SEQ ID NO: 334740 - DNA, 20 bp, human
gagaagagtaagatagggcc

SEQ ID NO: 334741 - DNA, 20 bp, human
gactaacggacctgagttcc

SEQ ID NO: 334742 - DNA, 20 bp, human
gtcttctcagcttctcagct

SEQ ID NO: 334743 - DNA, 20 bp, human
ggcgcgccgtgacgccttcg

SEQ ID NO: 334744 - DNA, 20 bp, human
gctttacggcccccgggcaa

SEQ ID NO: 334745 - DNA, 20 bp, human
gtagggccgttttagaaccg

SEQ ID NO: 334746 - DNA, 20 bp, human
gaggcggggcctagctttgg

SEQ ID NO: 334747 - DNA, 20 bp, human
gtaaaagaacggtggtgcgc

SEQ ID NO: 334748 - DNA, 20 bp, human
ggagaggcggggcctagctt

SEQ ID NO: 334749 - DNA, 20 bp, human
gcgagggagtaacgggtcag

SEQ ID NO: 334750 - DNA, 20 bp, human
gctcagagagctcagtcctc

SEQ ID NO: 334751 - DNA, 20 bp, human
gctaacactagtgcgccagc

SEQ ID NO: 334752 - DNA, 20 bp, human
gtgcgcagttaaaagaacgg

SEQ ID NO: 334753 - DNA, 20 bp, human
gagtcgaagcggagatcccg

SEQ ID NO: 334754 - DNA, 20 bp, human
ggccggaagcacctagagag

SEQ ID NO: 334755 - DNA, 20 bp, human
gtgcgcacgcgccgctctct

SEQ ID NO: 334756 - DNA, 20 bp, human
gggtattggcgccaaccggg

SEQ ID NO: 334757 - DNA, 20 bp, human
gacttttgggggtcatcctg

SEQ ID NO: 334758 - DNA, 20 bp, human
gcctctccggtcgggtcctc

SEQ ID NO: 334759 - DNA, 20 bp, human
ggcctcccggaggacccgac

SEQ ID NO: 334760 - DNA, 20 bp, human
gcgccccgcgcggcaggtat

SEQ ID NO: 334761 - DNA, 20 bp, human
ggaggcggatgcacggccgg

SEQ ID NO: 334762 - DNA, 20 bp, human
gtccggtcgggtcctccggg

SEQ ID NO: 334763 - DNA, 20 bp, human
ggacagcgccgccacccggt

SEQ ID NO: 334764 - DNA, 20 bp, human
gggttcccgcggccttgcga

SEQ ID NO: 334765 - DNA, 20 bp, human
gtcctctcgccctctccggt

SEQ ID NO: 334766 - DNA, 20 bp, human
ggacgtgcgcgcgcgcggac

SEQ ID NO: 334767 - DNA, 20 bp, human
gcgccgcggggcccgcgaga

SEQ ID NO: 334768 - DNA, 20 bp, human
gccgcggcggcgtgcccgtg

SEQ ID NO: 334769 - DNA, 20 bp, human
gggcaggcagagcgcggcat

SEQ ID NO: 334770 - DNA, 20 bp, human
gtgcccccgggtgctgtccg

SEQ ID NO: 334771 - DNA, 20 bp, human
gccgcgctctgcctgccccc

SEQ ID NO: 334772 - DNA, 20 bp, human
gggcgccaagcgctcttcgg

SEQ ID NO: 334773 - DNA, 20 bp, human
ggcgccccctgccgaccaga

SEQ ID NO: 334774 - DNA, 20 bp, human
gtgctccaatcgaaccgccg

SEQ ID NO: 334775 - DNA, 20 bp, human
ggcgctcggggccgtctggt

SEQ ID NO: 334776 - DNA, 20 bp, human
gtgcccgtctgcagccaacg

SEQ ID NO: 334777 - DNA, 20 bp, human
gcccggggaaggttacgctc

SEQ ID NO: 334778 - DNA, 20 bp, human
gacacccgaagtgtccgcgc

SEQ ID NO: 334779 - DNA, 20 bp, human
ggagcggctgcagtccccgt

SEQ ID NO: 334780 - DNA, 20 bp, human
ggtccccgttggctgcagac

SEQ ID NO: 334781 - DNA, 20 bp, human
gctgccggcgcggacacttc

SEQ ID NO: 334782 - DNA, 20 bp, human
gtcttcccggaagctgtgca

SEQ ID NO: 334783 - DNA, 20 bp, human
gaagagcgaaccgcgctccc

SEQ ID NO: 334784 - DNA, 20 bp, human
gggcagccggaccgcaagcg

SEQ ID NO: 334785 - DNA, 20 bp, human
gacagcttccgggaagaggt

SEQ ID NO: 334786 - DNA, 20 bp, human
gcggcctgccgtaaagacag

SEQ ID NO: 334787 - DNA, 20 bp, human
gtacccgagaacgcccccgc

SEQ ID NO: 334788 - DNA, 20 bp, human
ggagctgaacctcccaaccc

SEQ ID NO: 334789 - DNA, 20 bp, human
ggtggaggacgccatattgg

SEQ ID NO: 334790 - DNA, 20 bp, human
gcccctgcgggggcgttctc

SEQ ID NO: 334791 - DNA, 20 bp, human
gccccgcaggggcggtgctt

SEQ ID NO: 334792 - DNA, 20 bp, human
gcccagataccgtgtgcaga

SEQ ID NO: 334793 - DNA, 20 bp, human
gcgcaggggcggtgctttgg

SEQ ID NO: 334794 - DNA, 20 bp, human
gagcaaaggtcgtcagtgac

SEQ ID NO: 334795 - DNA, 20 bp, human
gtgcccgcaaggaagggcgt

SEQ ID NO: 334796 - DNA, 20 bp, human
ggggccggccgccgcaccat

SEQ ID NO: 334797 - DNA, 20 bp, human
gaacaaaagcaggtgctcgc

SEQ ID NO: 334798 - DNA, 20 bp, human
gtggcggtgctccccaaaat

SEQ ID NO: 334799 - DNA, 20 bp, human
ggggccccacgtggttcagc

SEQ ID NO: 334800 - DNA, 20 bp, human
gcccccggctgaaccacgtg

SEQ ID NO: 334801 - DNA, 20 bp, human
gcaggtgctcgcgggtacct

SEQ ID NO: 334802 - DNA, 20 bp, human
gcctggctggccgcactaag

SEQ ID NO: 334803 - DNA, 20 bp, human
gtgggcctagcctcttagtg

SEQ ID NO: 334804 - DNA, 20 bp, human
gtgaaccacgtggggccccg

SEQ ID NO: 334805 - DNA, 20 bp, human
gcggccagccaggccaatca

SEQ ID NO: 334806 - DNA, 20 bp, human
ggggcggggccccgtagcgc

SEQ ID NO: 334807 - DNA, 20 bp, human
ggggctccgcccagcgctac

SEQ ID NO: 334808 - DNA, 20 bp, human
gcaaggaggcggtgagcgag

SEQ ID NO: 334809 - DNA, 20 bp, human
gggggccccgtagcgctggg

SEQ ID NO: 334810 - DNA, 20 bp, human
ggacatgaaagaggctggac

SEQ ID NO: 334811 - DNA, 20 bp, human
gttatcacttgtcaggtaat

SEQ ID NO: 334812 - DNA, 20 bp, human
ggtcacaattatcacttgtc

SEQ ID NO: 334813 - DNA, 20 bp, human
gattgtgacatgaaagaggc

SEQ ID NO: 334814 - DNA, 20 bp, human
ggcgctgggcggagccctct

SEQ ID NO: 334815 - DNA, 20 bp, human
gcccgcgcccgcggccggcg

SEQ ID NO: 334816 - DNA, 20 bp, human
ggcacgcaggggagactcgg

SEQ ID NO: 334817 - DNA, 20 bp, human
ggggctgaggcggagcacaa

SEQ ID NO: 334818 - DNA, 20 bp, human
gggctgggaggaagcgaaac

SEQ ID NO: 334819 - DNA, 20 bp, human
gaggaagcgaaaccggaccc

SEQ ID NO: 334820 - DNA, 20 bp, human
gtgtcgcgcccggaggtcag

SEQ ID NO: 334821 - DNA, 20 bp, human
gaaaccggaccctggccgcg

SEQ ID NO: 334822 - DNA, 20 bp, human
gcccgcgcggcccctgggaa

SEQ ID NO: 334823 - DNA, 20 bp, human
gggggcggggacagccacgc

SEQ ID NO: 334824 - DNA, 20 bp, human
gcgcgggcgtgggaatagtg

SEQ ID NO: 334825 - DNA, 20 bp, human
ggtttcgggcggcagagtgg

SEQ ID NO: 334826 - DNA, 20 bp, human
gtggccaacaccgaggggaa

SEQ ID NO: 334827 - DNA, 20 bp, human
ggattcgtggccaacaccga

SEQ ID NO: 334828 - DNA, 20 bp, human
gggtcccttcccctcggtgt

SEQ ID NO: 334829 - DNA, 20 bp, human
gccaatgggggcgagagtct

SEQ ID NO: 334830 - DNA, 20 bp, human
gggagagaggggcggattcg

SEQ ID NO: 334831 - DNA, 20 bp, human
ggatcaagctagctcttcat

SEQ ID NO: 334832 - DNA, 20 bp, human
gtaacggaacttggagagag

SEQ ID NO: 334833 - DNA, 20 bp, human
gtgtagtcggcgttgaaact

SEQ ID NO: 334834 - DNA, 20 bp, human
ggagcgaagccgcgagctaa

SEQ ID NO: 334835 - DNA, 20 bp, human
gggtccagcagaaccaggga

SEQ ID NO: 334836 - DNA, 20 bp, human
gaaggcagccgtgttgggga

SEQ ID NO: 334837 - DNA, 20 bp, human
gccagggagttcgagttgaa

SEQ ID NO: 334838 - DNA, 20 bp, human
ggaggaaggcagccgtgttg

SEQ ID NO: 334839 - DNA, 20 bp, human
ggagttcgagttgaagggcc

SEQ ID NO: 334840 - DNA, 20 bp, human
gaagagaagcctattgtgtc

SEQ ID NO: 334841 - DNA, 20 bp, human
gctagggagtgatacaaagg

SEQ ID NO: 334842 - DNA, 20 bp, human
gctctcagccacttccccat

SEQ ID NO: 334843 - DNA, 20 bp, human
gttcgagttgaagggcctgg

SEQ ID NO: 334844 - DNA, 20 bp, human
ggaggctctcgtccataaaa

SEQ ID NO: 334845 - DNA, 20 bp, human
ggctctcgtccataaaaggg

SEQ ID NO: 334846 - DNA, 20 bp, human
gggcccagggagaacgggga

SEQ ID NO: 334847 - DNA, 20 bp, human
ggggcagtccgcactgcaat

SEQ ID NO: 334848 - DNA, 20 bp, human
gtgcagtgcggactgcccga

SEQ ID NO: 334849 - DNA, 20 bp, human
ggctccgcagggtcgaaaag

SEQ ID NO: 334850 - DNA, 20 bp, human
gagtgcggactgcccgaggg

SEQ ID NO: 334851 - DNA, 20 bp, human
gaggagggtcggaaccgggg

SEQ ID NO: 334852 - DNA, 20 bp, human
gtcgaaaagaggccgggcca

SEQ ID NO: 334853 - DNA, 20 bp, human
gcgctgaggagggtcggaac

SEQ ID NO: 334854 - DNA, 20 bp, human
gcggaagcggatgctccgca

SEQ ID NO: 334855 - DNA, 20 bp, human
ggcgcgcaggccggcgcggt

SEQ ID NO: 334856 - DNA, 20 bp, human
gcgcgggcaaggcgtctctc

SEQ ID NO: 334857 - DNA, 20 bp, human
gtcagaaacctggggatcgt

SEQ ID NO: 334858 - DNA, 20 bp, human
ggaaacctggggatcgtggg

SEQ ID NO: 334859 - DNA, 20 bp, human
gcccgagtgacagggacggg

SEQ ID NO: 334860 - DNA, 20 bp, human
gcgcccgcttcagaaacctg

SEQ ID NO: 334861 - DNA, 20 bp, human
gagacgccttgcccgcggcg

SEQ ID NO: 334862 - DNA, 20 bp, human
gaggtggaacagagcgagct

SEQ ID NO: 334863 - DNA, 20 bp, human
gcctccccctggttgattcg

SEQ ID NO: 334864 - DNA, 20 bp, human
ggcttagggcgccatctagg

SEQ ID NO: 334865 - DNA, 20 bp, human
gtccgccgagcctccaggat

SEQ ID NO: 334866 - DNA, 20 bp, human
gcagtggggtaatggttaac

SEQ ID NO: 334867 - DNA, 20 bp, human
gcaaggaggcgggacctggg

SEQ ID NO: 334868 - DNA, 20 bp, human
gtcttcaaggaggcgggacc

SEQ ID NO: 334869 - DNA, 20 bp, human
gacagcgtcttcaaggaggc

SEQ ID NO: 334870 - DNA, 20 bp, human
gcctgggccccaactttttc

SEQ ID NO: 334871 - DNA, 20 bp, human
gggggcccagggatagattc

SEQ ID NO: 334872 - DNA, 20 bp, human
gggcaactgggtcagattca

SEQ ID NO: 334873 - DNA, 20 bp, human
gtgcttccacagcgtcttca

SEQ ID NO: 334874 - DNA, 20 bp, human
gttccacagcgtcttcaagg

SEQ ID NO: 334875 - DNA, 20 bp, human
gtctgcacagaggggcaact

SEQ ID NO: 334876 - DNA, 20 bp, human
gggcccggcccgcgacaggg

SEQ ID NO: 334877 - DNA, 20 bp, human
gggcgggcgctcgacggaag

SEQ ID NO: 334878 - DNA, 20 bp, human
gaccggacgccgggtgtcgt

SEQ ID NO: 334879 - DNA, 20 bp, human
gcgtccaagaccggggagag

SEQ ID NO: 334880 - DNA, 20 bp, human
gtggggagggggtgggtcgt

SEQ ID NO: 334881 - DNA, 20 bp, human
gtgtctgcgcgatgccgctc

SEQ ID NO: 334882 - DNA, 20 bp, human
gggcgctcgacggaagcggg

SEQ ID NO: 334883 - DNA, 20 bp, human
gcgcctggtgcccgcccctc

SEQ ID NO: 334884 - DNA, 20 bp, human
gtgaaatcgcggactctctc

SEQ ID NO: 334885 - DNA, 20 bp, human
gatgccgctctgggagagag

SEQ ID NO: 334886 - DNA, 20 bp, human
gcggctgtccctggcgccta

SEQ ID NO: 334887 - DNA, 20 bp, human
gcctccgcgcagcgtgggtg

SEQ ID NO: 334888 - DNA, 20 bp, human
gccgagcgttacctggtccc

SEQ ID NO: 334889 - DNA, 20 bp, human
gggcgtcagaaccagaactg

SEQ ID NO: 334890 - DNA, 20 bp, human
gccctccacggaggcctcaa

SEQ ID NO: 334891 - DNA, 20 bp, human
ggccgccagtcattctattc

SEQ ID NO: 334892 - DNA, 20 bp, human
ggaggcctcaagggtgccca

SEQ ID NO: 334893 - DNA, 20 bp, human
ggaggctgcgggaattgggc

SEQ ID NO: 334894 - DNA, 20 bp, human
gctattccggcacctccctt

SEQ ID NO: 334895 - DNA, 20 bp, human
gggtgccggaatagaatgac

SEQ ID NO: 334896 - DNA, 20 bp, human
gtgcccgggcgccgactgct

SEQ ID NO: 334897 - DNA, 20 bp, human
ggagcagcgcgtgacgtcag

SEQ ID NO: 334898 - DNA, 20 bp, human
ggacccgcgtccgcgtgccc

SEQ ID NO: 334899 - DNA, 20 bp, human
gggactgcggccagagacgg

SEQ ID NO: 334900 - DNA, 20 bp, human
gaagggccgcagagaagtaa

SEQ ID NO: 334901 - DNA, 20 bp, human
gtcgcccagcagtcggcgcc

SEQ ID NO: 334902 - DNA, 20 bp, human
ggggattggaatgttggcgt

SEQ ID NO: 334903 - DNA, 20 bp, human
ggggcgcagccgaggataac

SEQ ID NO: 334904 - DNA, 20 bp, human
gccggccatcccgttatcct

SEQ ID NO: 334905 - DNA, 20 bp, human
ggactgctgggcgacgccgc

SEQ ID NO: 334906 - DNA, 20 bp, human
gccactgcccagaaattggg

SEQ ID NO: 334907 - DNA, 20 bp, human
gccccctggcggccatcccg

SEQ ID NO: 334908 - DNA, 20 bp, human
gaccctgcaaaacgtggcgt

SEQ ID NO: 334909 - DNA, 20 bp, human
ggtcgccgcaaggcttcccg

SEQ ID NO: 334910 - DNA, 20 bp, human
ggccctcgggatggccgcca

SEQ ID NO: 334911 - DNA, 20 bp, human
ggggtccacgggaagccttg

SEQ ID NO: 334912 - DNA, 20 bp, human
ggcccacgccacgttttgca

SEQ ID NO: 334913 - DNA, 20 bp, human
gcggcagtgaggtcgccgca

SEQ ID NO: 334914 - DNA, 20 bp, human
gtcactgccgcccaatttct

SEQ ID NO: 334915 - DNA, 20 bp, human
gcaccgtgcctgacccacgg

SEQ ID NO: 334916 - DNA, 20 bp, human
ggggagtggctggcgagcag

SEQ ID NO: 334917 - DNA, 20 bp, human
ggggactggaggatcctaac

SEQ ID NO: 334918 - DNA, 20 bp, human
ggagcagcggcctccccgca

SEQ ID NO: 334919 - DNA, 20 bp, human
gagagtaccaaggaaagcgg

SEQ ID NO: 334920 - DNA, 20 bp, human
gcagccagctggcaggaagc

SEQ ID NO: 334921 - DNA, 20 bp, human
gttccttggtactctccctt

SEQ ID NO: 334922 - DNA, 20 bp, human
gtgccaaagggagagtacca

SEQ ID NO: 334923 - DNA, 20 bp, human
ggaggatcctaacaggattg

SEQ ID NO: 334924 - DNA, 20 bp, human
ggtcccccatcctggggtca

SEQ ID NO: 334925 - DNA, 20 bp, human
gggttggttgggtgtaacca

SEQ ID NO: 334926 - DNA, 20 bp, human
ggggctggattctagggaaa

SEQ ID NO: 334927 - DNA, 20 bp, human
gttccaggggccagctaagg

SEQ ID NO: 334928 - DNA, 20 bp, human
gaatgccagcccaagtgagc

SEQ ID NO: 334929 - DNA, 20 bp, human
gcattcgaggtcatcttcca

SEQ ID NO: 334930 - DNA, 20 bp, human
ggctggtgcccagctcactt

SEQ ID NO: 334931 - DNA, 20 bp, human
ggaaaagggagctcagggca

SEQ ID NO: 334932 - DNA, 20 bp, human
gtatgaggaacaagcagatg

SEQ ID NO: 334933 - DNA, 20 bp, human
gtgactgagcccagtgggcg

SEQ ID NO: 334934 - DNA, 20 bp, human
gtctggcagctcattaccat

SEQ ID NO: 334935 - DNA, 20 bp, human
gagctaaggaggtgggtatg

SEQ ID NO: 334936 - DNA, 20 bp, human
gctggaaggcagaagcgcgt

SEQ ID NO: 334937 - DNA, 20 bp, human
ggaggctcgccagaagggac

SEQ ID NO: 334938 - DNA, 20 bp, human
gacactgaggctcgccagaa

SEQ ID NO: 334939 - DNA, 20 bp, human
gtgggctggcccgtcccttc

SEQ ID NO: 334940 - DNA, 20 bp, human
gagcgcgtgggaggacactg

SEQ ID NO: 334941 - DNA, 20 bp, human
ggaaggcagaagcgcgtggg

SEQ ID NO: 334942 - DNA, 20 bp, human
gggctggcgggaggcatcca

SEQ ID NO: 334943 - DNA, 20 bp, human
ggggctcgaagagaaccctt

SEQ ID NO: 334944 - DNA, 20 bp, human
ggagaaaagctcgctgagtt

SEQ ID NO: 334945 - DNA, 20 bp, human
ggcaatcagccactagagga

SEQ ID NO: 334946 - DNA, 20 bp, human
gcggctgcggccactcggtc

SEQ ID NO: 334947 - DNA, 20 bp, human
ggcaaagcccatgttaggga

SEQ ID NO: 334948 - DNA, 20 bp, human
gacagctcgccgggcgccaa

SEQ ID NO: 334949 - DNA, 20 bp, human
ggggtggcccggggaaggca

SEQ ID NO: 334950 - DNA, 20 bp, human
gggcgcctccgcaccgccca

SEQ ID NO: 334951 - DNA, 20 bp, human
gccagggcaaagcccatgtt

SEQ ID NO: 334952 - DNA, 20 bp, human
ggcgcccggcgagctgtacc

SEQ ID NO: 334953 - DNA, 20 bp, human
ggcttctgcgaagcgctcca

SEQ ID NO: 334954 - DNA, 20 bp, human
gcactccagagccgggtcca

SEQ ID NO: 334955 - DNA, 20 bp, human
gccgcaccgcccagggcaac

SEQ ID NO: 334956 - DNA, 20 bp, human
gggggaggagggtgccctac

SEQ ID NO: 334957 - DNA, 20 bp, human
gcccctgggaggcacagagt

SEQ ID NO: 334958 - DNA, 20 bp, human
ggggggacagaattgggcgg

SEQ ID NO: 334959 - DNA, 20 bp, human
ggatgggggacagaattggg

SEQ ID NO: 334960 - DNA, 20 bp, human
ggggaggcacagagtaggtt

SEQ ID NO: 334961 - DNA, 20 bp, human
ggtcatccaaaggtcaaaag

SEQ ID NO: 334962 - DNA, 20 bp, human
gaggcaccgtggtcatccaa

SEQ ID NO: 334963 - DNA, 20 bp, human
gcaattctgtcccccatcct

SEQ ID NO: 334964 - DNA, 20 bp, human
gtccccggctctgacatcac

SEQ ID NO: 334965 - DNA, 20 bp, human
gaattgtttcgcagttcagg

SEQ ID NO: 334966 - DNA, 20 bp, human
ggagacctgggagacgaccg

SEQ ID NO: 334967 - DNA, 20 bp, human
gcgcgcgtgctcacggctcc

SEQ ID NO: 334968 - DNA, 20 bp, human
gcgggccccggtcgtctccc

SEQ ID NO: 334969 - DNA, 20 bp, human
gagggcggggctaagacaag

SEQ ID NO: 334970 - DNA, 20 bp, human
gtggcggtgactcctcccgc

SEQ ID NO: 334971 - DNA, 20 bp, human
ggacctaaagggtgcctgat

SEQ ID NO: 334972 - DNA, 20 bp, human
gtccagaggacgagacctaa

SEQ ID NO: 334973 - DNA, 20 bp, human
gggtctcgtcctctggaggt

SEQ ID NO: 334974 - DNA, 20 bp, human
gagaccttgggcccgcgtga

SEQ ID NO: 334975 - DNA, 20 bp, human
gtgattggctgcggagggcg

SEQ ID NO: 334976 - DNA, 20 bp, human
ggggagggaaaactgtattc

SEQ ID NO: 334977 - DNA, 20 bp, human
gaacccaggccgcacaacga

SEQ ID NO: 334978 - DNA, 20 bp, human
gaggggagatccaggcgccc

SEQ ID NO: 334979 - DNA, 20 bp, human
gagcagagggggataagaag

SEQ ID NO: 334980 - DNA, 20 bp, human
ggcacaacgaggggaagcta

SEQ ID NO: 334981 - DNA, 20 bp, human
gcatcccactagtctcggag

SEQ ID NO: 334982 - DNA, 20 bp, human
gggcccaggccgcgcagagt

SEQ ID NO: 334983 - DNA, 20 bp, human
gcacagaggccgactctgcg

SEQ ID NO: 334984 - DNA, 20 bp, human
gaggtcagcgcaggggccca

SEQ ID NO: 334985 - DNA, 20 bp, human
gattctgggtgggatcacag

SEQ ID NO: 334986 - DNA, 20 bp, human
gggagcggtgggcgtgacgt

SEQ ID NO: 334987 - DNA, 20 bp, human
ggagcaggttgcatggaccc

SEQ ID NO: 334988 - DNA, 20 bp, human
gttcggccaatcagaggcca

SEQ ID NO: 334989 - DNA, 20 bp, human
gctgtggctgccgagttctc

SEQ ID NO: 334990 - DNA, 20 bp, human
ggcctctgattggccgaagc

SEQ ID NO: 334991 - DNA, 20 bp, human
gcagggcctctcgcgctcct

SEQ ID NO: 334992 - DNA, 20 bp, human
ggccgagttctcgggaacag

SEQ ID NO: 334993 - DNA, 20 bp, human
gcgtgctctcgcgtggtcgc

SEQ ID NO: 334994 - DNA, 20 bp, human
gcttcggcgaacctattcca

SEQ ID NO: 334995 - DNA, 20 bp, human
ggccgctgttcccgagaact

SEQ ID NO: 334996 - DNA, 20 bp, human
gtggccagctgaccatccct

SEQ ID NO: 334997 - DNA, 20 bp, human
gccaccttggggaagctcac

SEQ ID NO: 334998 - DNA, 20 bp, human
ggggccagctgaggacagaa

SEQ ID NO: 334999 - DNA, 20 bp, human
gtggacaaggagctgcaccg

SEQ ID NO: 335000 - DNA, 20 bp, human
gtggggtcaccagcttccca

SEQ ID NO: 335001 - DNA, 20 bp, human
gaggacagaagggtgcgtct

SEQ ID NO: 335002 - DNA, 20 bp, human
gccgaagggccagctccgaa

SEQ ID NO: 335003 - DNA, 20 bp, human
gtgggctgtgcccctcagac

SEQ ID NO: 335004 - DNA, 20 bp, human
gcaaggagcaggctggcctt

SEQ ID NO: 335005 - DNA, 20 bp, human
gtggactcaatgtacgttcc

SEQ ID NO: 335006 - DNA, 20 bp, human
gtgtcgctacagagaacgga

SEQ ID NO: 335007 - DNA, 20 bp, human
gggaacatggatgtccttcc

SEQ ID NO: 335008 - DNA, 20 bp, human
gtctgtagcgacaagaaaca

SEQ ID NO: 335009 - DNA, 20 bp, human
gaagcagggctgtcacacac

SEQ ID NO: 335010 - DNA, 20 bp, human
ggaacggaaggctcccttga

SEQ ID NO: 335011 - DNA, 20 bp, human
gaaggccagatgcacatccc

SEQ ID NO: 335012 - DNA, 20 bp, human
gagggattatctgttcttct

SEQ ID NO: 335013 - DNA, 20 bp, human
ggaggaattgctgtgttctg

SEQ ID NO: 335014 - DNA, 20 bp, human
gccagatgcacatccctgga

SEQ ID NO: 335015 - DNA, 20 bp, human
gtcaagattgaagattgccc

SEQ ID NO: 335016 - DNA, 20 bp, human
gtccgccagcgtcggtccct

SEQ ID NO: 335017 - DNA, 20 bp, human
ggttctgctccgggaggatg

SEQ ID NO: 335018 - DNA, 20 bp, human
gggcggaggttgcggacagc

SEQ ID NO: 335019 - DNA, 20 bp, human
gcggggagggtgcggggttc

SEQ ID NO: 335020 - DNA, 20 bp, human
gcggcaggcgggcgcagcga

SEQ ID NO: 335021 - DNA, 20 bp, human
gcggggttctggtggtcacg

SEQ ID NO: 335022 - DNA, 20 bp, human
gccgacgctggcggaggttg

SEQ ID NO: 335023 - DNA, 20 bp, human
gtgcgcccgcctgccggggt

SEQ ID NO: 335024 - DNA, 20 bp, human
gtctcagggacattcgaggc

SEQ ID NO: 335025 - DNA, 20 bp, human
gagggacattcgaggcgggc

SEQ ID NO: 335026 - DNA, 20 bp, human
gccgacggaagtgacgatgg

SEQ ID NO: 335027 - DNA, 20 bp, human
gctcccctggtctctcgggt

SEQ ID NO: 335028 - DNA, 20 bp, human
gttagctcccctggtctctc

SEQ ID NO: 335029 - DNA, 20 bp, human
ggacagcacccaagattgac

SEQ ID NO: 335030 - DNA, 20 bp, human
ggtacagccgccaagacttc

SEQ ID NO: 335031 - DNA, 20 bp, human
gcggccgacggaagtgacga

SEQ ID NO: 335032 - DNA, 20 bp, human
gcgaggggcgggtttgagag

SEQ ID NO: 335033 - DNA, 20 bp, human
gacacactcacctgccggta

SEQ ID NO: 335034 - DNA, 20 bp, human
gccgcccctcgtctcggctt

SEQ ID NO: 335035 - DNA, 20 bp, human
gcgtccgcgcctgtcaatct

SEQ ID NO: 335036 - DNA, 20 bp, human
ggcagtggcccgccgctaga

SEQ ID NO: 335037 - DNA, 20 bp, human
gagggagtacgggattaccg

SEQ ID NO: 335038 - DNA, 20 bp, human
ggatgctgaactggccaagc

SEQ ID NO: 335039 - DNA, 20 bp, human
ggggaggggagaatcgagga

SEQ ID NO: 335040 - DNA, 20 bp, human
gccgccgctagagggagtac

SEQ ID NO: 335041 - DNA, 20 bp, human
gggaggggaggggagaatcg

SEQ ID NO: 335042 - DNA, 20 bp, human
ggagtacgggattaccgagg

SEQ ID NO: 335043 - DNA, 20 bp, human
gcaggcgcccggaacccgag

SEQ ID NO: 335044 - DNA, 20 bp, human
gtgctccgcgggctaggggg

SEQ ID NO: 335045 - DNA, 20 bp, human
gtgcttggacgggacagggt

SEQ ID NO: 335046 - DNA, 20 bp, human
gggacccagggtgacggttg

SEQ ID NO: 335047 - DNA, 20 bp, human
gaagtgaagctacagctggg

SEQ ID NO: 335048 - DNA, 20 bp, human
gccaccccaaccgtcaccct

SEQ ID NO: 335049 - DNA, 20 bp, human
gaatgtaagcacgtagagca

SEQ ID NO: 335050 - DNA, 20 bp, human
ggcagcaaaagcagacacaa

SEQ ID NO: 335051 - DNA, 20 bp, human
ggtggcctttgaggaagaca

SEQ ID NO: 335052 - DNA, 20 bp, human
gacagaagtgaagctacagc

SEQ ID NO: 335053 - DNA, 20 bp, human
gttgttgaatcataatgaac

SEQ ID NO: 335054 - DNA, 20 bp, human
gttgaatcataatgaacagg

SEQ ID NO: 335055 - DNA, 20 bp, human
gtacaaaactacttgtttag

SEQ ID NO: 335056 - DNA, 20 bp, human
gtggtgagggggcccggaga

SEQ ID NO: 335057 - DNA, 20 bp, human
gcggagaagccctgacaagg

SEQ ID NO: 335058 - DNA, 20 bp, human
ggccctgtgacgtgccaatc

SEQ ID NO: 335059 - DNA, 20 bp, human
gcaaagccaggtctggaaaa

SEQ ID NO: 335060 - DNA, 20 bp, human
gtgacgtgccaatcaggctg

SEQ ID NO: 335061 - DNA, 20 bp, human
gtgagggggcccggagaggg

SEQ ID NO: 335062 - DNA, 20 bp, human
gaaagaaatgggggtcgaaa

SEQ ID NO: 335063 - DNA, 20 bp, human
ggcctgattggcacgtcaca

SEQ ID NO: 335064 - DNA, 20 bp, human
gagtttggcgcgaaggctgg

SEQ ID NO: 335065 - DNA, 20 bp, human
gctgcggagaagccctgaca

SEQ ID NO: 335066 - DNA, 20 bp, human
gctgcactgagcatgctcga

SEQ ID NO: 335067 - DNA, 20 bp, human
gaccatggtaacggtgggag

SEQ ID NO: 335068 - DNA, 20 bp, human
gagtgcagagcgagcctggt

SEQ ID NO: 335069 - DNA, 20 bp, human
ggtgtcggtgaccatggtaa

SEQ ID NO: 335070 - DNA, 20 bp, human
gaggggaggggtctagccgg

SEQ ID NO: 335071 - DNA, 20 bp, human
gtcggtgaccatggtaacgg

SEQ ID NO: 335072 - DNA, 20 bp, human
gcatgctcgagggcgaggtt

SEQ ID NO: 335073 - DNA, 20 bp, human
gcggtgtcgccgcaccgaga

SEQ ID NO: 335074 - DNA, 20 bp, human
gaggaggggaggggtctagc

SEQ ID NO: 335075 - DNA, 20 bp, human
gtgttgtccagcaccctacc

SEQ ID NO: 335076 - DNA, 20 bp, human
gcgggcgcctggctctgcgt

SEQ ID NO: 335077 - DNA, 20 bp, human
gccccctcccccggcgcgtg

SEQ ID NO: 335078 - DNA, 20 bp, human
ggaaggggaggcacccaagt

SEQ ID NO: 335079 - DNA, 20 bp, human
gctgaagaaccaggcggcga

SEQ ID NO: 335080 - DNA, 20 bp, human
gaccccgcgctctaagtttg

SEQ ID NO: 335081 - DNA, 20 bp, human
ggagggagcgggcgcacgag

SEQ ID NO: 335082 - DNA, 20 bp, human
gggcggggagtgggcgcgga

SEQ ID NO: 335083 - DNA, 20 bp, human
gccctcccgcggggcttcgg

SEQ ID NO: 335084 - DNA, 20 bp, human
gcaggggccgagcctccgcc

SEQ ID NO: 335085 - DNA, 20 bp, human
gcgagcctccgccgggccga

SEQ ID NO: 335086 - DNA, 20 bp, human
ggcgaggcggagctctccta

SEQ ID NO: 335087 - DNA, 20 bp, human
gagaggcggagtctggagcg

SEQ ID NO: 335088 - DNA, 20 bp, human
gggcgtggtctcctgcgaag

SEQ ID NO: 335089 - DNA, 20 bp, human
ggcggggcttccctggtcag

SEQ ID NO: 335090 - DNA, 20 bp, human
gggcggagctccgcctacga

SEQ ID NO: 335091 - DNA, 20 bp, human
ggagggcggtaccaggggaa

SEQ ID NO: 335092 - DNA, 20 bp, human
gcggtaccaggggaagggcg

SEQ ID NO: 335093 - DNA, 20 bp, human
gtcctaggggcggggaaaat

SEQ ID NO: 335094 - DNA, 20 bp, human
gaggggcggggaaaatgggg

SEQ ID NO: 335095 - DNA, 20 bp, human
ggtggtctcctgcgaagggg

SEQ ID NO: 335096 - DNA, 20 bp, human
gcgaatgaactccctcaaga

SEQ ID NO: 335097 - DNA, 20 bp, human
gcctgcgcacgcgcgaactg

SEQ ID NO: 335098 - DNA, 20 bp, human
gactctgtgcaccttcttga

SEQ ID NO: 335099 - DNA, 20 bp, human
ggattcttcacagacaggga

SEQ ID NO: 335100 - DNA, 20 bp, human
gcctgtctgtgaagaatccg

SEQ ID NO: 335101 - DNA, 20 bp, human
gactaagctgtgaggcgctc

SEQ ID NO: 335102 - DNA, 20 bp, human
gggggacgggagacgtgcgt

SEQ ID NO: 335103 - DNA, 20 bp, human
ggcgtcgggtcgcgggacgg

SEQ ID NO: 335104 - DNA, 20 bp, human
gcgtccccaaaggagaggcg

SEQ ID NO: 335105 - DNA, 20 bp, human
gccactgcaacgcttccctc

SEQ ID NO: 335106 - DNA, 20 bp, human
gcccgggccgggagaagtaa

SEQ ID NO: 335107 - DNA, 20 bp, human
ggaaagctgcctcccgttaa

SEQ ID NO: 335108 - DNA, 20 bp, human
gcctgggcgcccttaacggg

SEQ ID NO: 335109 - DNA, 20 bp, human
gccctctgcgcaatggaccc

SEQ ID NO: 335110 - DNA, 20 bp, human
gggagaagtaaggggtgtga

SEQ ID NO: 335111 - DNA, 20 bp, human
gcgggtaagggctggacctt

SEQ ID NO: 335112 - DNA, 20 bp, human
ggtgtccgcaggggatggaa

SEQ ID NO: 335113 - DNA, 20 bp, human
gacttctcccggcccgggca

SEQ ID NO: 335114 - DNA, 20 bp, human
gaagggctggaccttcggga

SEQ ID NO: 335115 - DNA, 20 bp, human
gagggcgctttgacagtgcc

SEQ ID NO: 335116 - DNA, 20 bp, human
gggcggtcctgtgatgttaa

SEQ ID NO: 335117 - DNA, 20 bp, human
ggtgatgttaaaggtacacg

SEQ ID NO: 335118 - DNA, 20 bp, human
gggacaaaaggcgccaaagt

SEQ ID NO: 335119 - DNA, 20 bp, human
ggttaaaggtacacgtggtc

SEQ ID NO: 335120 - DNA, 20 bp, human
gtacacgtggtccggacaaa

SEQ ID NO: 335121 - DNA, 20 bp, human
gcttgggacatcttcgctgt

SEQ ID NO: 335122 - DNA, 20 bp, human
gcaagactccgtccgctaaa

SEQ ID NO: 335123 - DNA, 20 bp, human
gcggaacgatttccatttag

SEQ ID NO: 335124 - DNA, 20 bp, human
gacacacgttactgattcct

SEQ ID NO: 335125 - DNA, 20 bp, human
gacgatttccatttagcgga

SEQ ID NO: 335126 - DNA, 20 bp, human
gggctcgcgacagcgtctag

SEQ ID NO: 335127 - DNA, 20 bp, human
ggctctgcggcgaaacacac

SEQ ID NO: 335128 - DNA, 20 bp, human
gggcgggaggccggatccaa

SEQ ID NO: 335129 - DNA, 20 bp, human
ggggacgccaggtcagttac

SEQ ID NO: 335130 - DNA, 20 bp, human
gcgaagtgcctctttatctg

SEQ ID NO: 335131 - DNA, 20 bp, human
gaagaggcacttcgcggtga

SEQ ID NO: 335132 - DNA, 20 bp, human
gtacgtagctgcagcggaac

SEQ ID NO: 335133 - DNA, 20 bp, human
gctacgtagcagtatcccct

SEQ ID NO: 335134 - DNA, 20 bp, human
gagccggcgaccaaaggcac

SEQ ID NO: 335135 - DNA, 20 bp, human
gaccaaaggcactgggcggg

SEQ ID NO: 335136 - DNA, 20 bp, human
gtcggcgcggggctggcgta

SEQ ID NO: 335137 - DNA, 20 bp, human
gcgctccccccgccgagctc

SEQ ID NO: 335138 - DNA, 20 bp, human
gtccccccgccgagctcggg

SEQ ID NO: 335139 - DNA, 20 bp, human
gaactcggagtcaagtgtgg

SEQ ID NO: 335140 - DNA, 20 bp, human
gggaccgacccctcccgcga

SEQ ID NO: 335141 - DNA, 20 bp, human
gaagaaggcaagtgtgagga

SEQ ID NO: 335142 - DNA, 20 bp, human
gtcgccgtcccggggcttaa

SEQ ID NO: 335143 - DNA, 20 bp, human
gagccaccgagcgccccctg

SEQ ID NO: 335144 - DNA, 20 bp, human
gcgcgcgccccaatcgccgg

SEQ ID NO: 335145 - DNA, 20 bp, human
gggggcgcgcgcgcctcctt

SEQ ID NO: 335146 - DNA, 20 bp, human
ggaagggcggagccccgatg

SEQ ID NO: 335147 - DNA, 20 bp, human
gtccgggagccccgccccat

SEQ ID NO: 335148 - DNA, 20 bp, human
gctcttgggcccccaatctc

SEQ ID NO: 335149 - DNA, 20 bp, human
gcggggctcccggagattgg

SEQ ID NO: 335150 - DNA, 20 bp, human
gacgggaaggggcggtacct

SEQ ID NO: 335151 - DNA, 20 bp, human
gcctccagagccaaattcca

SEQ ID NO: 335152 - DNA, 20 bp, human
ggtcccgtggaatttggctc

SEQ ID NO: 335153 - DNA, 20 bp, human
gcggctgcagacagtaggtc

SEQ ID NO: 335154 - DNA, 20 bp, human
gttatcctggccgagctctt

SEQ ID NO: 335155 - DNA, 20 bp, human
gaaattccacgggacgggaa

SEQ ID NO: 335156 - DNA, 20 bp, human
gagaacctcagaagtgtcga

SEQ ID NO: 335157 - DNA, 20 bp, human
ggtcagcaggccaacggggg

SEQ ID NO: 335158 - DNA, 20 bp, human
gcccctaagccaataagcgt

SEQ ID NO: 335159 - DNA, 20 bp, human
gtgcacgcggcacggggcat

SEQ ID NO: 335160 - DNA, 20 bp, human
gcggccggaggtgccaatgg

SEQ ID NO: 335161 - DNA, 20 bp, human
ggccgccatcgtcttctcat

SEQ ID NO: 335162 - DNA, 20 bp, human
gctgaccaatgagaagacga

SEQ ID NO: 335163 - DNA, 20 bp, human
ggctctccaagctttctcat

SEQ ID NO: 335164 - DNA, 20 bp, human
gcagcctccattggcacctc

SEQ ID NO: 335165 - DNA, 20 bp, human
ggccgccccaacgcggggat

SEQ ID NO: 335166 - DNA, 20 bp, human
ggtggtctccactaaggtca

SEQ ID NO: 335167 - DNA, 20 bp, human
gtggctagtggtctccacta

SEQ ID NO: 335168 - DNA, 20 bp, human
gaaaaagcccggcccggggt

SEQ ID NO: 335169 - DNA, 20 bp, human
gacacgggcgcacgtggacc

SEQ ID NO: 335170 - DNA, 20 bp, human
gcgcacgtggacctgggtgc

SEQ ID NO: 335171 - DNA, 20 bp, human
gtgcacattgaataatggaa

SEQ ID NO: 335172 - DNA, 20 bp, human
gccgggcactgccccctcat

SEQ ID NO: 335173 - DNA, 20 bp, human
ggccccgcccccgattggct

SEQ ID NO: 335174 - DNA, 20 bp, human
gccactagccaatcaggcgc

SEQ ID NO: 335175 - DNA, 20 bp, human
gcggcaagaggccaatgagg

SEQ ID NO: 335176 - DNA, 20 bp, human
ggaagtggatgagaccacta

SEQ ID NO: 335177 - DNA, 20 bp, human
gaacgccgcgcgcccattgg

SEQ ID NO: 335178 - DNA, 20 bp, human
ggacgggcgcggccaccaat

SEQ ID NO: 335179 - DNA, 20 bp, human
ggtaaaaagagcgacgggcg

SEQ ID NO: 335180 - DNA, 20 bp, human
gcacctcgtcggttcctcaa

SEQ ID NO: 335181 - DNA, 20 bp, human
gacgcgccgcgtctccattg

SEQ ID NO: 335182 - DNA, 20 bp, human
gcatctgcatacatgagggg

SEQ ID NO: 335183 - DNA, 20 bp, human
gaactccatgttcacctcgt

SEQ ID NO: 335184 - DNA, 20 bp, human
gctccattgaggaaccgacg

SEQ ID NO: 335185 - DNA, 20 bp, human
gtgagggcgtagtgaatgga

SEQ ID NO: 335186 - DNA, 20 bp, human
ggggccgtgcgattggtcgt

SEQ ID NO: 335187 - DNA, 20 bp, human
ggggacggggtggccctcag

SEQ ID NO: 335188 - DNA, 20 bp, human
gcggccccctggcacggcgc

SEQ ID NO: 335189 - DNA, 20 bp, human
gcactccagtcgcgcggcac

SEQ ID NO: 335190 - DNA, 20 bp, human
gcgccccggcgccgtgccag

SEQ ID NO: 335191 - DNA, 20 bp, human
gcgccctggcttatataacc

SEQ ID NO: 335192 - DNA, 20 bp, human
ggccgcgcgactggagtgtc

SEQ ID NO: 335193 - DNA, 20 bp, human
gcgcccgggttatataagcc

SEQ ID NO: 335194 - DNA, 20 bp, human
gcacaggcctgaggccgctg

SEQ ID NO: 335195 - DNA, 20 bp, human
gccccctgccgccgcgtgac

SEQ ID NO: 335196 - DNA, 20 bp, human
gcgggcgcgctctgagtcac

SEQ ID NO: 335197 - DNA, 20 bp, human
ggggccgctggtaaacaggc

SEQ ID NO: 335198 - DNA, 20 bp, human
ggggttctggtgacaccggg

SEQ ID NO: 335199 - DNA, 20 bp, human
ggacctgccctgccgggccg

SEQ ID NO: 335200 - DNA, 20 bp, human
gacatcaggggtcagatatt

SEQ ID NO: 335201 - DNA, 20 bp, human
ggctcccgaggacgccgctc

SEQ ID NO: 335202 - DNA, 20 bp, human
gtggtaaacaggctgggttc

SEQ ID NO: 335203 - DNA, 20 bp, human
gcgcccggagcggcgtcctc

SEQ ID NO: 335204 - DNA, 20 bp, human
gtgggacgcgcgggaccctc

SEQ ID NO: 335205 - DNA, 20 bp, human
ggccaggagagcgggactgg

SEQ ID NO: 335206 - DNA, 20 bp, human
gtccgtcccaacatgcaacg

SEQ ID NO: 335207 - DNA, 20 bp, human
gctgagaagcggttcccgag

SEQ ID NO: 335208 - DNA, 20 bp, human
gcaaacagacagcgtggggt

SEQ ID NO: 335209 - DNA, 20 bp, human
ggagaggggcggaaggctta

SEQ ID NO: 335210 - DNA, 20 bp, human
gtgcatgttgggacggagag

SEQ ID NO: 335211 - DNA, 20 bp, human
gcgcacaaacagacagcgtg

SEQ ID NO: 335212 - DNA, 20 bp, human
ggagatgcctgtacaagtcc

SEQ ID NO: 335213 - DNA, 20 bp, human
ggtcctcggggtccttggca

SEQ ID NO: 335214 - DNA, 20 bp, human
ggcactccatggtgcgcgat

SEQ ID NO: 335215 - DNA, 20 bp, human
gggaaggcttagggacagcg

SEQ ID NO: 335216 - DNA, 20 bp, human
gcggaggggcgggccgtcag

SEQ ID NO: 335217 - DNA, 20 bp, human
ggaaaagaagtcaataacgt

SEQ ID NO: 335218 - DNA, 20 bp, human
ggaaaacgggtctggctcgg

SEQ ID NO: 335219 - DNA, 20 bp, human
gaaccaatagaaaacgggtc

SEQ ID NO: 335220 - DNA, 20 bp, human
gtttctggatgcccaggtac

SEQ ID NO: 335221 - DNA, 20 bp, human
gagccagacccgttttctat

SEQ ID NO: 335222 - DNA, 20 bp, human
gggccaatcagcttcagcaa

SEQ ID NO: 335223 - DNA, 20 bp, human
gtggacgccgcaggggatcg

SEQ ID NO: 335224 - DNA, 20 bp, human
gcagcaagacagaagctcac

SEQ ID NO: 335225 - DNA, 20 bp, human
ggcgactctctcctgtacct

SEQ ID NO: 335226 - DNA, 20 bp, human
gtgccggaaccccgcggaga

SEQ ID NO: 335227 - DNA, 20 bp, human
ggaagcctgccggaaccccg

SEQ ID NO: 335228 - DNA, 20 bp, human
gggagcctcgcggcatagtg

SEQ ID NO: 335229 - DNA, 20 bp, human
gaccggaagactactattcc

SEQ ID NO: 335230 - DNA, 20 bp, human
gtcccctctccgcggggttc

SEQ ID NO: 335231 - DNA, 20 bp, human
gagagggtgggagggtttct

SEQ ID NO: 335232 - DNA, 20 bp, human
gaaacgccataggctcggac

SEQ ID NO: 335233 - DNA, 20 bp, human
ggaggtgtgactcctcctag

SEQ ID NO: 335234 - DNA, 20 bp, human
gaatgcattaaaaacgccat

SEQ ID NO: 335235 - DNA, 20 bp, human
gactcctcctagcggggagt

SEQ ID NO: 335236 - DNA, 20 bp, human
gaccccgcccggggtgaggt

SEQ ID NO: 335237 - DNA, 20 bp, human
gtggccccggcaccttacca

SEQ ID NO: 335238 - DNA, 20 bp, human
ggcggcgcacgcgacggctg

SEQ ID NO: 335239 - DNA, 20 bp, human
ggaactcttggcttcactag

SEQ ID NO: 335240 - DNA, 20 bp, human
gaaggtgccggggccagttt

SEQ ID NO: 335241 - DNA, 20 bp, human
gcgcctgcggggtgtgcagg

SEQ ID NO: 335242 - DNA, 20 bp, human
gcccaggctctacgaactct

SEQ ID NO: 335243 - DNA, 20 bp, human
gcgagcatagagcggcgccc

SEQ ID NO: 335244 - DNA, 20 bp, human
ggactcctagaatttgaatc

SEQ ID NO: 335245 - DNA, 20 bp, human
ggctggggctctgcgctcga

SEQ ID NO: 335246 - DNA, 20 bp, human
gtctccgccgagccgctcgg

SEQ ID NO: 335247 - DNA, 20 bp, human
ggtgccgcccccgagcggct

SEQ ID NO: 335248 - DNA, 20 bp, human
gaggccgaggacgtcggagc

SEQ ID NO: 335249 - DNA, 20 bp, human
gcctgccgtaagcctgtagt

SEQ ID NO: 335250 - DNA, 20 bp, human
gccgtaagcctgtagtgggt

SEQ ID NO: 335251 - DNA, 20 bp, human
gggagccggaggagatcgat

SEQ ID NO: 335252 - DNA, 20 bp, human
gggggccgatcgatctcctc

SEQ ID NO: 335253 - DNA, 20 bp, human
ggataaaagggagctcagta

SEQ ID NO: 335254 - DNA, 20 bp, human
gaagagagcgggatgagtta

SEQ ID NO: 335255 - DNA, 20 bp, human
gtccctgcgaggatcaaagt

SEQ ID NO: 335256 - DNA, 20 bp, human
ggcagcgggaaggtagtcgg

SEQ ID NO: 335257 - DNA, 20 bp, human
gccagggcccgggcggaagc

SEQ ID NO: 335258 - DNA, 20 bp, human
ggccccgcgctgcgctggtt

SEQ ID NO: 335259 - DNA, 20 bp, human
ggctggcgaggcagcgggat

SEQ ID NO: 335260 - DNA, 20 bp, human
gggcccgcgagccgaggtgg

SEQ ID NO: 335261 - DNA, 20 bp, human
gaggcagcgggatgggctcg

SEQ ID NO: 335262 - DNA, 20 bp, human
gggggcagcgggaaggtagt

SEQ ID NO: 335263 - DNA, 20 bp, human
gcctctgcgtcaaggtgctg

SEQ ID NO: 335264 - DNA, 20 bp, human
gggaaggtagtcggaggcgc

SEQ ID NO: 335265 - DNA, 20 bp, human
gaactgatgacggcacgacg

SEQ ID NO: 335266 - DNA, 20 bp, human
ggggctgaacccctcatccg

SEQ ID NO: 335267 - DNA, 20 bp, human
gagacacgggtgcacccgcg

SEQ ID NO: 335268 - DNA, 20 bp, human
gttgcctggtccacggatga

SEQ ID NO: 335269 - DNA, 20 bp, human
gcgcggggtcagaactccaa

SEQ ID NO: 335270 - DNA, 20 bp, human
gcgggtgcacccgtgtctcc

SEQ ID NO: 335271 - DNA, 20 bp, human
gtgattgggttgagcacctt

SEQ ID NO: 335272 - DNA, 20 bp, human
gggtgctcaacccaatcaga

SEQ ID NO: 335273 - DNA, 20 bp, human
gcaacccggcatcgcccacg

SEQ ID NO: 335274 - DNA, 20 bp, human
gcacctcagcggctccacgt

SEQ ID NO: 335275 - DNA, 20 bp, human
gcagaggctgccctctgatt

SEQ ID NO: 335276 - DNA, 20 bp, human
ggggagtcctgggactcgag

SEQ ID NO: 335277 - DNA, 20 bp, human
gacaggtaaaggggagtcct

SEQ ID NO: 335278 - DNA, 20 bp, human
gtacctgtagagtctcctag

SEQ ID NO: 335279 - DNA, 20 bp, human
gtgggactcgaggggagccc

SEQ ID NO: 335280 - DNA, 20 bp, human
gagtctctccgccccagagg

SEQ ID NO: 335281 - DNA, 20 bp, human
gtctcctagaggaaagtctg

SEQ ID NO: 335282 - DNA, 20 bp, human
gccttggtaaccacaacttc

SEQ ID NO: 335283 - DNA, 20 bp, human
ggtgcccgccccctctgggg

SEQ ID NO: 335284 - DNA, 20 bp, human
gaggagactctacaggtaaa

SEQ ID NO: 335285 - DNA, 20 bp, human
gcggttcaagccggaagttg

SEQ ID NO: 335286 - DNA, 20 bp, human
gagtaggggtcgtctgataa

SEQ ID NO: 335287 - DNA, 20 bp, human
gtgactaggggcgggaagtg

SEQ ID NO: 335288 - DNA, 20 bp, human
ggaggcgtgctagggagtag

SEQ ID NO: 335289 - DNA, 20 bp, human
gacccaacggtgcctcgcga

SEQ ID NO: 335290 - DNA, 20 bp, human
gcgcgcagtaggcgtgacta

SEQ ID NO: 335291 - DNA, 20 bp, human
gcacagtaatacacagatgg

SEQ ID NO: 335292 - DNA, 20 bp, human
gtgccgctggaggcgtgcta

SEQ ID NO: 335293 - DNA, 20 bp, human
ggtgcggcccgaataggaat

SEQ ID NO: 335294 - DNA, 20 bp, human
gcagtaggcgtgactagggg

SEQ ID NO: 335295 - DNA, 20 bp, human
gacagaggaagactctagtg

SEQ ID NO: 335296 - DNA, 20 bp, human
gggtaccgggagcgccccaa

SEQ ID NO: 335297 - DNA, 20 bp, human
gcggacaaaaagccggtcag

SEQ ID NO: 335298 - DNA, 20 bp, human
gaaactccgaggatgatcca

SEQ ID NO: 335299 - DNA, 20 bp, human
gcagaatgcagcaaactccg

SEQ ID NO: 335300 - DNA, 20 bp, human
gacgtcggcgcgccgcgcca

SEQ ID NO: 335301 - DNA, 20 bp, human
gaagccggtcagggggacaa

SEQ ID NO: 335302 - DNA, 20 bp, human
gaggcctttgtccccctgac

SEQ ID NO: 335303 - DNA, 20 bp, human
gcgacacgtgtgtgctctcc

SEQ ID NO: 335304 - DNA, 20 bp, human
ggccccaaaggcttgcgcgc

SEQ ID NO: 335305 - DNA, 20 bp, human
gcggctttttgtccgctgta

SEQ ID NO: 335306 - DNA, 20 bp, human
ggcgggagcggaagctcagg

SEQ ID NO: 335307 - DNA, 20 bp, human
gggcgctctagttccgaatg

SEQ ID NO: 335308 - DNA, 20 bp, human
gtctagttccgaatgcggtc

SEQ ID NO: 335309 - DNA, 20 bp, human
gcgccccgctgaaacagaag

SEQ ID NO: 335310 - DNA, 20 bp, human
gggcccttgtgggctggttt

SEQ ID NO: 335311 - DNA, 20 bp, human
ggccctcttctgtttcagcg

SEQ ID NO: 335312 - DNA, 20 bp, human
gtgcggcttctgtcataaag

SEQ ID NO: 335313 - DNA, 20 bp, human
gagagcgcctctcttccgcc

SEQ ID NO: 335314 - DNA, 20 bp, human
ggaagagggcccttgtgggc

SEQ ID NO: 335315 - DNA, 20 bp, human
ggggctggttttggctagtt

SEQ ID NO: 335316 - DNA, 20 bp, human
gggtgggactccgacgtcta

SEQ ID NO: 335317 - DNA, 20 bp, human
ggtcccaccgaggcttttct

SEQ ID NO: 335318 - DNA, 20 bp, human
ggctacaactccctagacgt

SEQ ID NO: 335319 - DNA, 20 bp, human
gttctgggagtggaccagtc

SEQ ID NO: 335320 - DNA, 20 bp, human
ggcgggtaggtaagaggtga

SEQ ID NO: 335321 - DNA, 20 bp, human
gccggaaggggttaaatctc

SEQ ID NO: 335322 - DNA, 20 bp, human
gctacctcccccacgagcga

SEQ ID NO: 335323 - DNA, 20 bp, human
gtcgatgagcctttaccctg

SEQ ID NO: 335324 - DNA, 20 bp, human
ggctttactcccagcccgac

SEQ ID NO: 335325 - DNA, 20 bp, human
gaaccccttccggccctcga

SEQ ID NO: 335326 - DNA, 20 bp, human
ggggtggagcccgggtgtcc

SEQ ID NO: 335327 - DNA, 20 bp, human
gacagagcctgtcgatgtag

SEQ ID NO: 335328 - DNA, 20 bp, human
gcaaggtgacccggacaccc

SEQ ID NO: 335329 - DNA, 20 bp, human
gccgcccagactaaggtagc

SEQ ID NO: 335330 - DNA, 20 bp, human
gacatcgacaggctctgttc

SEQ ID NO: 335331 - DNA, 20 bp, human
gcgccctcccgcccagacta

SEQ ID NO: 335332 - DNA, 20 bp, human
ggagaaacctcgcccagcgg

SEQ ID NO: 335333 - DNA, 20 bp, human
gcctgtcgatgtaggggact

SEQ ID NO: 335334 - DNA, 20 bp, human
ggcaaagaagatatagactt

SEQ ID NO: 335335 - DNA, 20 bp, human
gtgggagaaacctcgcccag

SEQ ID NO: 335336 - DNA, 20 bp, human
ggggaagcggttcaagagat

SEQ ID NO: 335337 - DNA, 20 bp, human
gacggcgctgggcgggtcag

SEQ ID NO: 335338 - DNA, 20 bp, human
gggcagggccggattttaaa

SEQ ID NO: 335339 - DNA, 20 bp, human
gaatgacttgagggagtagg

SEQ ID NO: 335340 - DNA, 20 bp, human
ggggcagccaacccggtaaa

SEQ ID NO: 335341 - DNA, 20 bp, human
gttgctaagggctacccgag

SEQ ID NO: 335342 - DNA, 20 bp, human
ggggtagcccttagcaactg

SEQ ID NO: 335343 - DNA, 20 bp, human
ggcaactgagggcccaaacc

SEQ ID NO: 335344 - DNA, 20 bp, human
gtttgggccctcagttgcta

SEQ ID NO: 335345 - DNA, 20 bp, human
gggtgctgacggcgctgggc

SEQ ID NO: 335346 - DNA, 20 bp, human
gcggaaccgccatttttaaa

SEQ ID NO: 335347 - DNA, 20 bp, human
gaaaaatggcggttccgcac

SEQ ID NO: 335348 - DNA, 20 bp, human
gctcctgtgaaacagaatta

SEQ ID NO: 335349 - DNA, 20 bp, human
gggttacccgaggcagaaga

SEQ ID NO: 335350 - DNA, 20 bp, human
ggaaggggtggagggcgtgt

SEQ ID NO: 335351 - DNA, 20 bp, human
gcactggtcaacaataccat

SEQ ID NO: 335352 - DNA, 20 bp, human
gagaagagggcgggagcgaa

SEQ ID NO: 335353 - DNA, 20 bp, human
gttctgcctcgggtaaccaa

SEQ ID NO: 335354 - DNA, 20 bp, human
ggggcgtgtcggcaccgagg

SEQ ID NO: 335355 - DNA, 20 bp, human
gggagggcgtgtcggcaccg

SEQ ID NO: 335356 - DNA, 20 bp, human
ggacacccgcgcgcggtgat

SEQ ID NO: 335357 - DNA, 20 bp, human
gcgcgcgcgggtgtccgctt

SEQ ID NO: 335358 - DNA, 20 bp, human
gcccgcgcgcggtgattggc

SEQ ID NO: 335359 - DNA, 20 bp, human
ggacaagccgaagagccgaa

SEQ ID NO: 335360 - DNA, 20 bp, human
gtggcaggagagtcacgaac

SEQ ID NO: 335361 - DNA, 20 bp, human
gaggacactacaagtgtcga

SEQ ID NO: 335362 - DNA, 20 bp, human
ggggtcaggggccgcaagtg

SEQ ID NO: 335363 - DNA, 20 bp, human
gcaagtgtcgaggggcctag

SEQ ID NO: 335364 - DNA, 20 bp, human
gtttcggcccttcggctctt

SEQ ID NO: 335365 - DNA, 20 bp, human
gggtgtccgcttcggctttt

SEQ ID NO: 335366 - DNA, 20 bp, human
gggcacaggggcggcttccg

SEQ ID NO: 335367 - DNA, 20 bp, human
gtccggggcgcggcgtgctg

SEQ ID NO: 335368 - DNA, 20 bp, human
gcaaactggtgctacagctt

SEQ ID NO: 335369 - DNA, 20 bp, human
gttttctcacggcacagggg

SEQ ID NO: 335370 - DNA, 20 bp, human
gggcccatcgccttctgtaa

SEQ ID NO: 335371 - DNA, 20 bp, human
gcttctgtaatggaagtagg

SEQ ID NO: 335372 - DNA, 20 bp, human
ggcaccagtttgttttctca

SEQ ID NO: 335373 - DNA, 20 bp, human
gttccattacagaaggcgat

SEQ ID NO: 335374 - DNA, 20 bp, human
gcgccttctgtaatggaagt

SEQ ID NO: 335375 - DNA, 20 bp, human
gcctcactaaccagttccag

SEQ ID NO: 335376 - DNA, 20 bp, human
gcactcagctacagagcccg

SEQ ID NO: 335377 - DNA, 20 bp, human
ggggcccgggaccccgtttc

SEQ ID NO: 335378 - DNA, 20 bp, human
gcgcgggcagcggaacgcgg

SEQ ID NO: 335379 - DNA, 20 bp, human
gtggctgggtatggaggcga

SEQ ID NO: 335380 - DNA, 20 bp, human
ggagcgcgggcagcggaacg

SEQ ID NO: 335381 - DNA, 20 bp, human
ggagaccgaaaagtggatgg

SEQ ID NO: 335382 - DNA, 20 bp, human
gctgggtatggaggcgaagg

SEQ ID NO: 335383 - DNA, 20 bp, human
gagcacgcgccgcttgcagc

SEQ ID NO: 335384 - DNA, 20 bp, human
gcccgggaccccgtttccgg

SEQ ID NO: 335385 - DNA, 20 bp, human
gccggggtcgggttgagggc

SEQ ID NO: 335386 - DNA, 20 bp, human
gactcacggctcttcccgtc

SEQ ID NO: 335387 - DNA, 20 bp, human
ggaagagccgtgagtcttaa

SEQ ID NO: 335388 - DNA, 20 bp, human
gctccaagacccgctctcta

SEQ ID NO: 335389 - DNA, 20 bp, human
gcggaagctgtctgaaaagg

SEQ ID NO: 335390 - DNA, 20 bp, human
gggaagagcaccttagagag

SEQ ID NO: 335391 - DNA, 20 bp, human
gggcggggctcaggcttaaa

SEQ ID NO: 335392 - DNA, 20 bp, human
ggactgcgacgcagcctgac

SEQ ID NO: 335393 - DNA, 20 bp, human
gaggctgcgtcgcagtctta

SEQ ID NO: 335394 - DNA, 20 bp, human
gggagcgctcgaaaaggcca

SEQ ID NO: 335395 - DNA, 20 bp, human
gcagcggaagctgtctgaaa

SEQ ID NO: 335396 - DNA, 20 bp, human
gctgctgcaagtgaatcttg

SEQ ID NO: 335397 - DNA, 20 bp, human
gcaatccaacataaatgaag

SEQ ID NO: 335398 - DNA, 20 bp, human
ggtaatatgtcagctgtaaa

SEQ ID NO: 335399 - DNA, 20 bp, human
gatcttgaggcttttggctg

SEQ ID NO: 335400 - DNA, 20 bp, human
gaagtgaatcttgaggcttt

SEQ ID NO: 335401 - DNA, 20 bp, human
gtcccacagagggcttttgc

SEQ ID NO: 335402 - DNA, 20 bp, human
gtgttgatttcactgttata

SEQ ID NO: 335403 - DNA, 20 bp, human
gacccagcaaaagccctctg

SEQ ID NO: 335404 - DNA, 20 bp, human
gaggatccaactcccacaga

SEQ ID NO: 335405 - DNA, 20 bp, human
gatcccaatccactcaaaaa

SEQ ID NO: 335406 - DNA, 20 bp, human
ggcagcgcggcgttcaggtg

SEQ ID NO: 335407 - DNA, 20 bp, human
gcacgcgcgcgcgttcccag

SEQ ID NO: 335408 - DNA, 20 bp, human
gcggcggcaaggcgaggtgc

SEQ ID NO: 335409 - DNA, 20 bp, human
gggtgtaggcgctcacgtca

SEQ ID NO: 335410 - DNA, 20 bp, human
gcgcgcgcggcggcaaggcg

SEQ ID NO: 335411 - DNA, 20 bp, human
ggctccccgagcgcgtcctc

SEQ ID NO: 335412 - DNA, 20 bp, human
gcggcgttcaggtgcggcgt

SEQ ID NO: 335413 - DNA, 20 bp, human
gaatgctcggcgatgaactg

SEQ ID NO: 335414 - DNA, 20 bp, human
gcctgaacgccgcgctgctg

SEQ ID NO: 335415 - DNA, 20 bp, human
ggcgggcagggcgattctag

SEQ ID NO: 335416 - DNA, 20 bp, human
gtgaaggttactgcctatcg

SEQ ID NO: 335417 - DNA, 20 bp, human
ggatgactgggcccagtact

SEQ ID NO: 335418 - DNA, 20 bp, human
ggtgccgcgaacttgctctg

SEQ ID NO: 335419 - DNA, 20 bp, human
gcacgacgcagatcaatccg

SEQ ID NO: 335420 - DNA, 20 bp, human
gctcgcgcacactagtcgtc

SEQ ID NO: 335421 - DNA, 20 bp, human
gccgcgaacttgctctgagg

SEQ ID NO: 335422 - DNA, 20 bp, human
gccgcttccgcttccgtcag

SEQ ID NO: 335423 - DNA, 20 bp, human
gtggcctcccctgacggaag

SEQ ID NO: 335424 - DNA, 20 bp, human
gtacgcaaccgcagcgatga

SEQ ID NO: 335425 - DNA, 20 bp, human
ggcagtaaccttcatcgctg

SEQ ID NO: 335426 - DNA, 20 bp, human
gctatcaggggagtgatcca

SEQ ID NO: 335427 - DNA, 20 bp, human
ggaaagggcgttgactccga

SEQ ID NO: 335428 - DNA, 20 bp, human
gcaaagatacagatctatca

SEQ ID NO: 335429 - DNA, 20 bp, human
gcggggcccacacttccgtc

SEQ ID NO: 335430 - DNA, 20 bp, human
ggcagaccggacggaagtgt

SEQ ID NO: 335431 - DNA, 20 bp, human
gtccgcggccggggcagcga

SEQ ID NO: 335432 - DNA, 20 bp, human
gtggcgcggttagagagacc

SEQ ID NO: 335433 - DNA, 20 bp, human
gacggagaccatttttgttt

SEQ ID NO: 335434 - DNA, 20 bp, human
gggaagccgttccgagtcgg

SEQ ID NO: 335435 - DNA, 20 bp, human
ggattggtccgcacaggaaa

SEQ ID NO: 335436 - DNA, 20 bp, human
gcggaaactaagatagtact

SEQ ID NO: 335437 - DNA, 20 bp, human
gacaccgaggaactgcggtg

SEQ ID NO: 335438 - DNA, 20 bp, human
gaagcctgaagtggacaccg

SEQ ID NO: 335439 - DNA, 20 bp, human
gaactcgggctgggtctctg

SEQ ID NO: 335440 - DNA, 20 bp, human
gaaggaaacaggaactgtca

SEQ ID NO: 335441 - DNA, 20 bp, human
ggatagtactgggaagactt

SEQ ID NO: 335442 - DNA, 20 bp, human
gccagtccggaagcctgaag

SEQ ID NO: 335443 - DNA, 20 bp, human
gaaacgtgccggcgaggctc

SEQ ID NO: 335444 - DNA, 20 bp, human
gcttgtatgtaagttgaggt

SEQ ID NO: 335445 - DNA, 20 bp, human
gaatgactcctgagcctcgc

SEQ ID NO: 335446 - DNA, 20 bp, human
ggctgtccaccccaggcttc

SEQ ID NO: 335447 - DNA, 20 bp, human
gtccttccagtccggaagcc

SEQ ID NO: 335448 - DNA, 20 bp, human
gcagcgaggaactgtggtgc

SEQ ID NO: 335449 - DNA, 20 bp, human
ggctatgaagactcagactc

SEQ ID NO: 335450 - DNA, 20 bp, human
gggcagttcttgagttgaga

SEQ ID NO: 335451 - DNA, 20 bp, human
gaggacagtgggacagtgac

SEQ ID NO: 335452 - DNA, 20 bp, human
gggcagctgccttggctagg

SEQ ID NO: 335453 - DNA, 20 bp, human
ggttcctcgctgtccacccc

SEQ ID NO: 335454 - DNA, 20 bp, human
gttctgcaggcagtgactcc

SEQ ID NO: 335455 - DNA, 20 bp, human
gacgggggataaaagaagcc

SEQ ID NO: 335456 - DNA, 20 bp, human
gcggccgaattctaggttct

SEQ ID NO: 335457 - DNA, 20 bp, human
gcgaattctaggttcttggt

SEQ ID NO: 335458 - DNA, 20 bp, human
gtcacttaggagggagacgg

SEQ ID NO: 335459 - DNA, 20 bp, human
gaacctagaattcggccggg

SEQ ID NO: 335460 - DNA, 20 bp, human
ggggcggggcgtagtcgccc

SEQ ID NO: 335461 - DNA, 20 bp, human
gtctctgcccgcggcgcacg

SEQ ID NO: 335462 - DNA, 20 bp, human
gactggacctgccagcgccg

SEQ ID NO: 335463 - DNA, 20 bp, human
gggacaggatgtcacttagg

SEQ ID NO: 335464 - DNA, 20 bp, human
gcagttcaagacagatttgt

SEQ ID NO: 335465 - DNA, 20 bp, human
ggaattcggccgggtggctg

SEQ ID NO: 335466 - DNA, 20 bp, human
gctacctgaccggtcaggtc

SEQ ID NO: 335467 - DNA, 20 bp, human
gaagccagacctgaccggtc

SEQ ID NO: 335468 - DNA, 20 bp, human
ggggctatgtctggaagata

SEQ ID NO: 335469 - DNA, 20 bp, human
gcggtcaggtagtgaagaca

SEQ ID NO: 335470 - DNA, 20 bp, human
gctgcgcgttgggctatgtc

SEQ ID NO: 335471 - DNA, 20 bp, human
gactgaaatagggtggggaa

SEQ ID NO: 335472 - DNA, 20 bp, human
gaggactgatcgactgatga

SEQ ID NO: 335473 - DNA, 20 bp, human
gcgcatgagttggactaacc

SEQ ID NO: 335474 - DNA, 20 bp, human
gaaactgcttaaagccacat

SEQ ID NO: 335475 - DNA, 20 bp, human
gacatgggaaatctgcgcgt

SEQ ID NO: 335476 - DNA, 20 bp, human
gcggacgtgacgcaaggcgg

SEQ ID NO: 335477 - DNA, 20 bp, human
ggacctactccctatcccgt

SEQ ID NO: 335478 - DNA, 20 bp, human
gcaccgcggccgacgggata

SEQ ID NO: 335479 - DNA, 20 bp, human
gtcgcagggtccgatccgga

SEQ ID NO: 335480 - DNA, 20 bp, human
gagttaccgcccactcgctg

SEQ ID NO: 335481 - DNA, 20 bp, human
gctggctccagaccgccctc

SEQ ID NO: 335482 - DNA, 20 bp, human
gcgagtgggcggtaactcgc

SEQ ID NO: 335483 - DNA, 20 bp, human
ggggacgggccaactggagc

SEQ ID NO: 335484 - DNA, 20 bp, human
gcctggtgggcaaggggcaa

SEQ ID NO: 335485 - DNA, 20 bp, human
gccgcggtgaatcccacctg

SEQ ID NO: 335486 - DNA, 20 bp, human
gccagctggggcaggatcaa

SEQ ID NO: 335487 - DNA, 20 bp, human
gtggaccgacataaacacgg

SEQ ID NO: 335488 - DNA, 20 bp, human
gggggtgtggcgaacggctc

SEQ ID NO: 335489 - DNA, 20 bp, human
gaacacgggggtgtggcgaa

SEQ ID NO: 335490 - DNA, 20 bp, human
gtgtttatgtcggtccacgg

SEQ ID NO: 335491 - DNA, 20 bp, human
ggtagggaggaaatgtgacc

SEQ ID NO: 335492 - DNA, 20 bp, human
gggttgcctgtccctttaat

SEQ ID NO: 335493 - DNA, 20 bp, human
gcacacccccgtgtttatgt

SEQ ID NO: 335494 - DNA, 20 bp, human
ggggagcgagagaacgctcg

SEQ ID NO: 335495 - DNA, 20 bp, human
gtggcgaacggctccggccg

SEQ ID NO: 335496 - DNA, 20 bp, human
gccctccttcccttccggga

SEQ ID NO: 335497 - DNA, 20 bp, human
gcgtcctctgcgcgtctcgg

SEQ ID NO: 335498 - DNA, 20 bp, human
gtcacacaacagtctctgag

SEQ ID NO: 335499 - DNA, 20 bp, human
ggcagcaatagcaagcgggg

SEQ ID NO: 335500 - DNA, 20 bp, human
ggcgccaccgagacgcgcag

SEQ ID NO: 335501 - DNA, 20 bp, human
gcaggcagcaatagcaagcg

SEQ ID NO: 335502 - DNA, 20 bp, human
gtatgatcctccgtcccgga

SEQ ID NO: 335503 - DNA, 20 bp, human
ggctctatgatcctccgtcc

SEQ ID NO: 335504 - DNA, 20 bp, human
gtgccatggcgacggctcgg

SEQ ID NO: 335505 - DNA, 20 bp, human
gggctggattgccatggcga

SEQ ID NO: 335506 - DNA, 20 bp, human
gcacgctctccttagagggg

SEQ ID NO: 335507 - DNA, 20 bp, human
gggagccaggggctaagtag

SEQ ID NO: 335508 - DNA, 20 bp, human
gagggcacgctctccttaga

SEQ ID NO: 335509 - DNA, 20 bp, human
gcaggggctaagtagcggtg

SEQ ID NO: 335510 - DNA, 20 bp, human
gaaactgttccgcccctcta

SEQ ID NO: 335511 - DNA, 20 bp, human
ggaactacacttcccatcaa

SEQ ID NO: 335512 - DNA, 20 bp, human
gataaacccggaagtaaaca

SEQ ID NO: 335513 - DNA, 20 bp, human
gtacgctgctgattggatga

SEQ ID NO: 335514 - DNA, 20 bp, human
gcgactgtgtggcagctgag

SEQ ID NO: 335515 - DNA, 20 bp, human
ggcggtgcggtttctttttc

SEQ ID NO: 335516 - DNA, 20 bp, human
gtcctcctggaggacttaaa

SEQ ID NO: 335517 - DNA, 20 bp, human
gagtgcgataactaggacaa

SEQ ID NO: 335518 - DNA, 20 bp, human
ggtaaccttttaagtcctcc

SEQ ID NO: 335519 - DNA, 20 bp, human
gttagagccatcatcctcaa

SEQ ID NO: 335520 - DNA, 20 bp, human
gtggatatgcccaatgtcca

SEQ ID NO: 335521 - DNA, 20 bp, human
gctgtaaccattgaggatga

SEQ ID NO: 335522 - DNA, 20 bp, human
ggctctaagacttaaattct

SEQ ID NO: 335523 - DNA, 20 bp, human
gtatgctgcaattctgggtg

SEQ ID NO: 335524 - DNA, 20 bp, human
gtcccatgagtgcgataact

SEQ ID NO: 335525 - DNA, 20 bp, human
gaagagcatcgacaggttca

SEQ ID NO: 335526 - DNA, 20 bp, human
gcgggaaggcggctggaagt

SEQ ID NO: 335527 - DNA, 20 bp, human
gcctaactggctcgggaagg

SEQ ID NO: 335528 - DNA, 20 bp, human
gccaccaggctcctcggcgc

SEQ ID NO: 335529 - DNA, 20 bp, human
gagggtcgcaatcgcctaac

SEQ ID NO: 335530 - DNA, 20 bp, human
gacagtgccaccaggctcct

SEQ ID NO: 335531 - DNA, 20 bp, human
gtcgcctaactggctcggga

SEQ ID NO: 335532 - DNA, 20 bp, human
gcgcaatcgcctaactggct

SEQ ID NO: 335533 - DNA, 20 bp, human
gtgttgcttggtaactaata

SEQ ID NO: 335534 - DNA, 20 bp, human
gcgagagtagactattcggt

SEQ ID NO: 335535 - DNA, 20 bp, human
gcggtaggcgtcttgagagc

SEQ ID NO: 335536 - DNA, 20 bp, human
gagcctgcgagctccccctg

SEQ ID NO: 335537 - DNA, 20 bp, human
gcctcctccccacgtggaag

SEQ ID NO: 335538 - DNA, 20 bp, human
gtcccagcccccttccacgt

SEQ ID NO: 335539 - DNA, 20 bp, human
gggggcgggccgcattcctt

SEQ ID NO: 335540 - DNA, 20 bp, human
gccctgcgggccggcgacgg

SEQ ID NO: 335541 - DNA, 20 bp, human
gaggctgacgtacgcgtctg

SEQ ID NO: 335542 - DNA, 20 bp, human
gcagccaggacccttcagca

SEQ ID NO: 335543 - DNA, 20 bp, human
ggacgcgtacgtcagcctcg

SEQ ID NO: 335544 - DNA, 20 bp, human
ggcgtacgtcagcctcgggg

SEQ ID NO: 335545 - DNA, 20 bp, human
gagacgtcccgaggggacaa

SEQ ID NO: 335546 - DNA, 20 bp, human
ggggcgggaccagtacaatc

SEQ ID NO: 335547 - DNA, 20 bp, human
gcctgcgggaagatagacat

SEQ ID NO: 335548 - DNA, 20 bp, human
gggctccgccccagctgaaa

SEQ ID NO: 335549 - DNA, 20 bp, human
gcaatccgggccttgaactg

SEQ ID NO: 335550 - DNA, 20 bp, human
gtgttccaaaacgggcgggt

SEQ ID NO: 335551 - DNA, 20 bp, human
gggcccacttgttccaaaac

SEQ ID NO: 335552 - DNA, 20 bp, human
gaggccgggcccctttcagc

SEQ ID NO: 335553 - DNA, 20 bp, human
gggctgtcgcggcttgagga

SEQ ID NO: 335554 - DNA, 20 bp, human
gccagggcggagcccgtagg

SEQ ID NO: 335555 - DNA, 20 bp, human
ggcggagcctactcactctg

SEQ ID NO: 335556 - DNA, 20 bp, human
gggcccgcgtgacattgcac

SEQ ID NO: 335557 - DNA, 20 bp, human
gtcgcaggacggaccctgga

SEQ ID NO: 335558 - DNA, 20 bp, human
ggacggaccctggacggagc

SEQ ID NO: 335559 - DNA, 20 bp, human
gaggcctgaaggcgccctga

SEQ ID NO: 335560 - DNA, 20 bp, human
gcgggccagacgtgccaccg

SEQ ID NO: 335561 - DNA, 20 bp, human
gaggatccctgctccgtcca

SEQ ID NO: 335562 - DNA, 20 bp, human
ggaaacgcacagcgggaagg

SEQ ID NO: 335563 - DNA, 20 bp, human
gaacctgtgcaatgtcacgc

SEQ ID NO: 335564 - DNA, 20 bp, human
gccggcgcctcctcgcagga

SEQ ID NO: 335565 - DNA, 20 bp, human
ggccgacagcaaggaacctc

SEQ ID NO: 335566 - DNA, 20 bp, human
gagccaggggatccaacagg

SEQ ID NO: 335567 - DNA, 20 bp, human
gccggcagccatccagaaga

SEQ ID NO: 335568 - DNA, 20 bp, human
ggcccccctgttggatcccc

SEQ ID NO: 335569 - DNA, 20 bp, human
gagcagccaggggatccaac

SEQ ID NO: 335570 - DNA, 20 bp, human
gacccaccctcaggttcagt

SEQ ID NO: 335571 - DNA, 20 bp, human
gcatctatgtggggatgtga

SEQ ID NO: 335572 - DNA, 20 bp, human
gcaccctcaggttcagtagg

SEQ ID NO: 335573 - DNA, 20 bp, human
ggccgtgctcccatctatgt

SEQ ID NO: 335574 - DNA, 20 bp, human
ggtggagaagctgccagtgt

SEQ ID NO: 335575 - DNA, 20 bp, human
ggggctcggctgtctttctg

SEQ ID NO: 335576 - DNA, 20 bp, human
gtctgagctgagtacttagg

SEQ ID NO: 335577 - DNA, 20 bp, human
ggagctgagtacttaggggg

SEQ ID NO: 335578 - DNA, 20 bp, human
gtgtcagcatctgttagtgg

SEQ ID NO: 335579 - DNA, 20 bp, human
gaggggtgatggacgaacat

SEQ ID NO: 335580 - DNA, 20 bp, human
gggctctcgagatagatatg

SEQ ID NO: 335581 - DNA, 20 bp, human
gttggaatgcaaggtgtctc

SEQ ID NO: 335582 - DNA, 20 bp, human
gtaagtactcagctcagata

SEQ ID NO: 335583 - DNA, 20 bp, human
gctgagtacttagggggagg

SEQ ID NO: 335584 - DNA, 20 bp, human
gacgaacatggggaggagcc

SEQ ID NO: 335585 - DNA, 20 bp, human
gtatgaggaccccaggactc

SEQ ID NO: 335586 - DNA, 20 bp, human
ggaaaagggagggatcgttg

SEQ ID NO: 335587 - DNA, 20 bp, human
gtggggaataaactaaggtc

SEQ ID NO: 335588 - DNA, 20 bp, human
gtcagcttgtcagtctacaa

SEQ ID NO: 335589 - DNA, 20 bp, human
gcccaattggaacctatttg

SEQ ID NO: 335590 - DNA, 20 bp, human
gattggggtgggagggatca

SEQ ID NO: 335591 - DNA, 20 bp, human
gtagaagagcaagggtaggt

SEQ ID NO: 335592 - DNA, 20 bp, human
gtggaatcagatgaggttta

SEQ ID NO: 335593 - DNA, 20 bp, human
gaataggttccaattggggt

SEQ ID NO: 335594 - DNA, 20 bp, human
gaggttccaattggggtggg

SEQ ID NO: 335595 - DNA, 20 bp, human
gttaggaccttagtagtctt

SEQ ID NO: 335596 - DNA, 20 bp, human
ggggcccgagcgtatgggag

SEQ ID NO: 335597 - DNA, 20 bp, human
gggcaggagcatctacgcgg

SEQ ID NO: 335598 - DNA, 20 bp, human
ggggcggggcccgagcgtat

SEQ ID NO: 335599 - DNA, 20 bp, human
gccaatgggcggtgacgggc

SEQ ID NO: 335600 - DNA, 20 bp, human
gcggccccagcgccaatggg

SEQ ID NO: 335601 - DNA, 20 bp, human
gtctacgcgggggtcgtcgt

SEQ ID NO: 335602 - DNA, 20 bp, human
gtgggcgggtccctgctagt

SEQ ID NO: 335603 - DNA, 20 bp, human
gcagcccctcccatacgctc

SEQ ID NO: 335604 - DNA, 20 bp, human
ggtgggcaggagcatctacg

SEQ ID NO: 335605 - DNA, 20 bp, human
gtcaccgcccattggcgctg

SEQ ID NO: 335606 - DNA, 20 bp, human
ggggagagaggtgaagggta

SEQ ID NO: 335607 - DNA, 20 bp, human
ggaaagcaatgcagaaggat

SEQ ID NO: 335608 - DNA, 20 bp, human
ggtgtctgggctggcgagtg

SEQ ID NO: 335609 - DNA, 20 bp, human
gcaaaatttgcagagttcga

SEQ ID NO: 335610 - DNA, 20 bp, human
gcgccggtccttcccttcgg

SEQ ID NO: 335611 - DNA, 20 bp, human
gcggtccttcccttcggcgg

SEQ ID NO: 335612 - DNA, 20 bp, human
gcgacccgtgtggaccctgc

SEQ ID NO: 335613 - DNA, 20 bp, human
ggcgcccggcccgacccgtg

SEQ ID NO: 335614 - DNA, 20 bp, human
gccggggccgggagtgcatg

SEQ ID NO: 335615 - DNA, 20 bp, human
gcgtgtggaccctgcgggaa

SEQ ID NO: 335616 - DNA, 20 bp, human
ggacgcgggttcagcgatga

SEQ ID NO: 335617 - DNA, 20 bp, human
gggggctgacaaaccagcgg

SEQ ID NO: 335618 - DNA, 20 bp, human
gcccgggcacggagggtccc

SEQ ID NO: 335619 - DNA, 20 bp, human
gctgacaaaccagcggcggg

SEQ ID NO: 335620 - DNA, 20 bp, human
gccgccgcagctcctcgggg

SEQ ID NO: 335621 - DNA, 20 bp, human
gcgtgtccgcggaaaacgga

SEQ ID NO: 335622 - DNA, 20 bp, human
gagctgcggcgggaggacgc

SEQ ID NO: 335623 - DNA, 20 bp, human
gggcacggagggtcccggga

SEQ ID NO: 335624 - DNA, 20 bp, human
gcgtgcgtgcgatccttccg

SEQ ID NO: 335625 - DNA, 20 bp, human
ggctcaagattccgcatccc

SEQ ID NO: 335626 - DNA, 20 bp, human
gccagcctgggtggtcgctc

SEQ ID NO: 335627 - DNA, 20 bp, human
gcgtcccggagcgaccaccc

SEQ ID NO: 335628 - DNA, 20 bp, human
gcacccaggctggggcacgt

SEQ ID NO: 335629 - DNA, 20 bp, human
ggctggggcacgtggggcgt

SEQ ID NO: 335630 - DNA, 20 bp, human
gtctgccaaacccatcctac

SEQ ID NO: 335631 - DNA, 20 bp, human
gagttctaaggttatcctgt

SEQ ID NO: 335632 - DNA, 20 bp, human
gtgggtttggcagagcgcag

SEQ ID NO: 335633 - DNA, 20 bp, human
gtaaggttatcctgtaggat

SEQ ID NO: 335634 - DNA, 20 bp, human
gtagtgctgtcgcagttcta

SEQ ID NO: 335635 - DNA, 20 bp, human
ggtcacacaaggcgccgtcc

SEQ ID NO: 335636 - DNA, 20 bp, human
gaggcccaaaggggattggg

SEQ ID NO: 335637 - DNA, 20 bp, human
ggacggcttcaggcccaaag

SEQ ID NO: 335638 - DNA, 20 bp, human
ggggcggcggctctaggtgg

SEQ ID NO: 335639 - DNA, 20 bp, human
gcccaaaggggattgggcgg

SEQ ID NO: 335640 - DNA, 20 bp, human
gttcaggcccaaaggggatt

SEQ ID NO: 335641 - DNA, 20 bp, human
gcactccgccccctgcgccg

SEQ ID NO: 335642 - DNA, 20 bp, human
gagtccgcgcgggcggtgcc

SEQ ID NO: 335643 - DNA, 20 bp, human
gaagccgtcctccgccgccc

SEQ ID NO: 335644 - DNA, 20 bp, human
ggccgccgcccaatcccctt

SEQ ID NO: 335645 - DNA, 20 bp, human
gggactcgctgtggaacccg

SEQ ID NO: 335646 - DNA, 20 bp, human
gccatggtgcaaagttatag

SEQ ID NO: 335647 - DNA, 20 bp, human
ggatctcagaatgtggctta

SEQ ID NO: 335648 - DNA, 20 bp, human
gaaactccgtcaggaaagta

SEQ ID NO: 335649 - DNA, 20 bp, human
gaagaaagaaaaaagcctcc

SEQ ID NO: 335650 - DNA, 20 bp, human
gctctgcgggtccatcccca

SEQ ID NO: 335651 - DNA, 20 bp, human
gagaaaacaaataagcttcc

SEQ ID NO: 335652 - DNA, 20 bp, human
gcaggaaagtaaggaaagaa

SEQ ID NO: 335653 - DNA, 20 bp, human
ggctggtaaagttttaacgt

SEQ ID NO: 335654 - DNA, 20 bp, human
gggaggggggagggtgccat

SEQ ID NO: 335655 - DNA, 20 bp, human
gtggacccgcagagagagag

SEQ ID NO: 335656 - DNA, 20 bp, human
ggggacaaatcaggccacct

SEQ ID NO: 335657 - DNA, 20 bp, human
gcagcattggagagatgtga

SEQ ID NO: 335658 - DNA, 20 bp, human
gagtgcgtttaacacagcat

SEQ ID NO: 335659 - DNA, 20 bp, human
gaaactccctcaggaaagaa

SEQ ID NO: 335660 - DNA, 20 bp, human
gaaaggaaagaaatggagaa

SEQ ID NO: 335661 - DNA, 20 bp, human
gagagatgtgaaggagcccc

SEQ ID NO: 335662 - DNA, 20 bp, human
ggctggtaaagttttaacgt

SEQ ID NO: 335663 - DNA, 20 bp, human
gagaaaagaaaatagcctcc

SEQ ID NO: 335664 - DNA, 20 bp, human
gttctttcctttctttcctg

SEQ ID NO: 335665 - DNA, 20 bp, human
gtggacccgcagagagagag

SEQ ID NO: 335666 - DNA, 20 bp, human
gagacaggggaggccccgaa

SEQ ID NO: 335667 - DNA, 20 bp, human
gcgtagaaatgaagctgcca

SEQ ID NO: 335668 - DNA, 20 bp, human
gtgaagctgccagggagaca

SEQ ID NO: 335669 - DNA, 20 bp, human
gctccaccacctctcaccct

SEQ ID NO: 335670 - DNA, 20 bp, human
gggaacaaaaacagggccca

SEQ ID NO: 335671 - DNA, 20 bp, human
gaggggaggccccgaagggg

SEQ ID NO: 335672 - DNA, 20 bp, human
gcattccaccctccccttcg

SEQ ID NO: 335673 - DNA, 20 bp, human
gttatcttgccagctaggcc

SEQ ID NO: 335674 - DNA, 20 bp, human
ggctgccagggagacagggg

SEQ ID NO: 335675 - DNA, 20 bp, human
gggcccagggtgagaggtgg

SEQ ID NO: 335676 - DNA, 20 bp, human
gaccgacgcgggactggaga

SEQ ID NO: 335677 - DNA, 20 bp, human
gctgcggcccccgacaggag

SEQ ID NO: 335678 - DNA, 20 bp, human
gtgactgcggcgaccgacgc

SEQ ID NO: 335679 - DNA, 20 bp, human
gagcgcacgtaagcacgcgg

SEQ ID NO: 335680 - DNA, 20 bp, human
gtacgtgcgctccgtgactg

SEQ ID NO: 335681 - DNA, 20 bp, human
ggcgcatgcgcacacctgga

SEQ ID NO: 335682 - DNA, 20 bp, human
ggcgcgccccctcctgtcgg

SEQ ID NO: 335683 - DNA, 20 bp, human
gtccctctccagtcccgcgt

SEQ ID NO: 335684 - DNA, 20 bp, human
ggagggggcgcgcttcggca

SEQ ID NO: 335685 - DNA, 20 bp, human
gcacgtaagcacgcggaggg

SEQ ID NO: 335686 - DNA, 20 bp, human
gccccactcagtctgggctc

SEQ ID NO: 335687 - DNA, 20 bp, human
gtggaatgctgattggcagt

SEQ ID NO: 335688 - DNA, 20 bp, human
gcccagagcccagactgagt

SEQ ID NO: 335689 - DNA, 20 bp, human
gggggagtgtgcaggccaag

SEQ ID NO: 335690 - DNA, 20 bp, human
gggtcagggatgggcgtgaa

SEQ ID NO: 335691 - DNA, 20 bp, human
gctgagtggggctgctggtc

SEQ ID NO: 335692 - DNA, 20 bp, human
ggcgtgaagggcagaagtct

SEQ ID NO: 335693 - DNA, 20 bp, human
gctaggaggcggccctcagc

SEQ ID NO: 335694 - DNA, 20 bp, human
gagacatgccacctgaaccc

SEQ ID NO: 335695 - DNA, 20 bp, human
gtagcctggctgccaatcac

SEQ ID NO: 335696 - DNA, 20 bp, human
gagaggaaccactgtttcca

SEQ ID NO: 335697 - DNA, 20 bp, human
gctgttttttcactgatatt

SEQ ID NO: 335698 - DNA, 20 bp, human
gcagtggttcctctggtgag

SEQ ID NO: 335699 - DNA, 20 bp, human
gtggggatgtagtagtttaa

SEQ ID NO: 335700 - DNA, 20 bp, human
gactcatttcccctcaccag

SEQ ID NO: 335701 - DNA, 20 bp, human
gatatatcccatggaaacag

SEQ ID NO: 335702 - DNA, 20 bp, human
gtgactatgatgatttcatg

SEQ ID NO: 335703 - DNA, 20 bp, human
ggtagtcaatatggtgtctg

SEQ ID NO: 335704 - DNA, 20 bp, human
gtcccaaattattgagtcat

SEQ ID NO: 335705 - DNA, 20 bp, human
gaggcctcccgccaatagcc

SEQ ID NO: 335706 - DNA, 20 bp, human
ggctcgcgagcacaagtgac

SEQ ID NO: 335707 - DNA, 20 bp, human
gcgagcacaagtgacgggac

SEQ ID NO: 335708 - DNA, 20 bp, human
gtggggcgcggcaggacgcg

SEQ ID NO: 335709 - DNA, 20 bp, human
ggactggagcgtggcgcggc

SEQ ID NO: 335710 - DNA, 20 bp, human
gaggtgcgggcggggttgtg

SEQ ID NO: 335711 - DNA, 20 bp, human
gcggggcagccttgcgcgaa

SEQ ID NO: 335712 - DNA, 20 bp, human
gggcggaagtcccgcctcct

SEQ ID NO: 335713 - DNA, 20 bp, human
ggcgcgaaggggcgttttcg

SEQ ID NO: 335714 - DNA, 20 bp, human
gcacttgtgctcgcgagcgc

SEQ ID NO: 335715 - DNA, 20 bp, human
gcggcctcggcaggcgcttc

SEQ ID NO: 335716 - DNA, 20 bp, human
gcctgcgcgcaccaggtccg

SEQ ID NO: 335717 - DNA, 20 bp, human
gcaggaggcgggtgtcagat

SEQ ID NO: 335718 - DNA, 20 bp, human
gcagcgcgagcgcggatcta

SEQ ID NO: 335719 - DNA, 20 bp, human
gagccctggagacgagccgg

SEQ ID NO: 335720 - DNA, 20 bp, human
gcgactcccagagccgaggg

SEQ ID NO: 335721 - DNA, 20 bp, human
gtgtcagatgggtgaatctg

SEQ ID NO: 335722 - DNA, 20 bp, human
gccagagccgagggaggagt

SEQ ID NO: 335723 - DNA, 20 bp, human
ggcactgcgcggctggcgaa

SEQ ID NO: 335724 - DNA, 20 bp, human
ggaagcatccagagggggat

SEQ ID NO: 335725 - DNA, 20 bp, human
gatcccccggctcgtctcca

SEQ ID NO: 335726 - DNA, 20 bp, human
gacgctcccgccaaccgcgg

SEQ ID NO: 335727 - DNA, 20 bp, human
gacacagggcctctcgaagt

SEQ ID NO: 335728 - DNA, 20 bp, human
ggacacgctcccgccaaccg

SEQ ID NO: 335729 - DNA, 20 bp, human
gggaggggcagaaggagttc

SEQ ID NO: 335730 - DNA, 20 bp, human
gcaccggcggggtgtcggga

SEQ ID NO: 335731 - DNA, 20 bp, human
gaattcgcggacggcgaggg

SEQ ID NO: 335732 - DNA, 20 bp, human
gacacgccgcccggcgtcag

SEQ ID NO: 335733 - DNA, 20 bp, human
gcctcgccgccgcggttggc

SEQ ID NO: 335734 - DNA, 20 bp, human
gacagggtaggagcggtgag

SEQ ID NO: 335735 - DNA, 20 bp, human
gtggacgcggccgccactct

SEQ ID NO: 335736 - DNA, 20 bp, human
ggggtcggggtctccagaag

SEQ ID NO: 335737 - DNA, 20 bp, human
gagggcagccggaagagctc

SEQ ID NO: 335738 - DNA, 20 bp, human
gggaacgcagctgagaggta

SEQ ID NO: 335739 - DNA, 20 bp, human
gggtctgcccccactaattt

SEQ ID NO: 335740 - DNA, 20 bp, human
gttgaggacacgccagattg

SEQ ID NO: 335741 - DNA, 20 bp, human
gaggagccagcggaggatct

SEQ ID NO: 335742 - DNA, 20 bp, human
gacgcagccgaaattagtgg

SEQ ID NO: 335743 - DNA, 20 bp, human
gaggacacgccagattgagg

SEQ ID NO: 335744 - DNA, 20 bp, human
gagattgaggaggagagcca

SEQ ID NO: 335745 - DNA, 20 bp, human
gctcggggcggaacttagag

SEQ ID NO: 335746 - DNA, 20 bp, human
gtatcgaggcgatagggtta

SEQ ID NO: 335747 - DNA, 20 bp, human
gaggcgatagggttaaggga

SEQ ID NO: 335748 - DNA, 20 bp, human
gcaggcgcccacaaaaatcc

SEQ ID NO: 335749 - DNA, 20 bp, human
ggagagaagtggatagttac

SEQ ID NO: 335750 - DNA, 20 bp, human
gggacacagcagggggacga

SEQ ID NO: 335751 - DNA, 20 bp, human
gaaagttcccggatttttgt

SEQ ID NO: 335752 - DNA, 20 bp, human
gtccatatatcgaggcgata

SEQ ID NO: 335753 - DNA, 20 bp, human
ggggaaggcggacgcctgat

SEQ ID NO: 335754 - DNA, 20 bp, human
gaccctatcgcctcgatata

SEQ ID NO: 335755 - DNA, 20 bp, human
gctgctgtgtccatatatcg

SEQ ID NO: 335756 - DNA, 20 bp, human
gcggcggcggagagtgacct

SEQ ID NO: 335757 - DNA, 20 bp, human
ggccggaccccaggcccatt

SEQ ID NO: 335758 - DNA, 20 bp, human
gctgtcttcggggtcatcac

SEQ ID NO: 335759 - DNA, 20 bp, human
ggcacggccgctcgtctctc

SEQ ID NO: 335760 - DNA, 20 bp, human
ggcggagtggcggagtctgg

SEQ ID NO: 335761 - DNA, 20 bp, human
gcgcgcccgcagcggagtgg

SEQ ID NO: 335762 - DNA, 20 bp, human
gggctcaccagagagacgag

SEQ ID NO: 335763 - DNA, 20 bp, human
ggtgcttgcaccgtccgaat

SEQ ID NO: 335764 - DNA, 20 bp, human
gcaccgtccgaatgggcctg

SEQ ID NO: 335765 - DNA, 20 bp, human
ggccgtgctcctagagaggc

SEQ ID NO: 335766 - DNA, 20 bp, human
ggacctccgcggcgcctaga

SEQ ID NO: 335767 - DNA, 20 bp, human
gaacgcctgcgaggccagaa

SEQ ID NO: 335768 - DNA, 20 bp, human
gggaggtcctggagtctcga

SEQ ID NO: 335769 - DNA, 20 bp, human
gttccaaagtaggacagggg

SEQ ID NO: 335770 - DNA, 20 bp, human
gtggcctcgcaggcgttttc

SEQ ID NO: 335771 - DNA, 20 bp, human
gaagagctggcccgctgggg

SEQ ID NO: 335772 - DNA, 20 bp, human
gccgctggggtgggttattt

SEQ ID NO: 335773 - DNA, 20 bp, human
ggaagctgctgttagattgg

SEQ ID NO: 335774 - DNA, 20 bp, human
gatccctctaggcgccgcgg

SEQ ID NO: 335775 - DNA, 20 bp, human
gggagagtggcgggaagagc

SEQ ID NO: 335776 - DNA, 20 bp, human
gtgctcgcacgcaagtagaa

SEQ ID NO: 335777 - DNA, 20 bp, human
gccacccagctgaccggcag

SEQ ID NO: 335778 - DNA, 20 bp, human
gcgggcaagaccacgtggtt

SEQ ID NO: 335779 - DNA, 20 bp, human
gaagcacgggcaagaccacg

SEQ ID NO: 335780 - DNA, 20 bp, human
gtcagctgggtggcttgcga

SEQ ID NO: 335781 - DNA, 20 bp, human
ggagccaggcgcatgcgcca

SEQ ID NO: 335782 - DNA, 20 bp, human
gcccgtccctccaaaccacg

SEQ ID NO: 335783 - DNA, 20 bp, human
gagaaagctgtctccgctgc

SEQ ID NO: 335784 - DNA, 20 bp, human
gcaggtgcgcgcgtggcgga

SEQ ID NO: 335785 - DNA, 20 bp, human
ggtctccgctgccggtcagc

SEQ ID NO: 335786 - DNA, 20 bp, human
ggctgtgggatccaaccaga

SEQ ID NO: 335787 - DNA, 20 bp, human
gccagagtgccgggagttaa

SEQ ID NO: 335788 - DNA, 20 bp, human
gaactcccggcactctggat

SEQ ID NO: 335789 - DNA, 20 bp, human
ggagactgggagggcttccg

SEQ ID NO: 335790 - DNA, 20 bp, human
ggactagcgaggcggaagta

SEQ ID NO: 335791 - DNA, 20 bp, human
gggcactctggattggaaga

SEQ ID NO: 335792 - DNA, 20 bp, human
gcgtttctgtcataagctgt

SEQ ID NO: 335793 - DNA, 20 bp, human
gctgctgctgctgctatcgg

SEQ ID NO: 335794 - DNA, 20 bp, human
gatcaagccgccagcggcgg

SEQ ID NO: 335795 - DNA, 20 bp, human
ggcggtggcggccgggagac

SEQ ID NO: 335796 - DNA, 20 bp, human
ggcccagggcccggcgtgtg

SEQ ID NO: 335797 - DNA, 20 bp, human
ggggcccgaggcggccaaga

SEQ ID NO: 335798 - DNA, 20 bp, human
gcggctgggaggcactgtgg

SEQ ID NO: 335799 - DNA, 20 bp, human
gcccgaggcggccaagacgg

SEQ ID NO: 335800 - DNA, 20 bp, human
gtgcggcgcccgagctccga

SEQ ID NO: 335801 - DNA, 20 bp, human
gaaggtcggcagccgagcgc

SEQ ID NO: 335802 - DNA, 20 bp, human
gggctcgcgcccgggaaggt

SEQ ID NO: 335803 - DNA, 20 bp, human
gtgcgggctgcgctggtggg

SEQ ID NO: 335804 - DNA, 20 bp, human
gcccggccggcccgccgtct

SEQ ID NO: 335805 - DNA, 20 bp, human
gcctcccagccgcacacgcc

SEQ ID NO: 335806 - DNA, 20 bp, human
ggcagagtgctgggatagat

SEQ ID NO: 335807 - DNA, 20 bp, human
ggaagcacagggtacaccct

SEQ ID NO: 335808 - DNA, 20 bp, human
gagagaaagttgccgtaaga

SEQ ID NO: 335809 - DNA, 20 bp, human
gaagttgccgtaagatggag

SEQ ID NO: 335810 - DNA, 20 bp, human
gaatgcacacattatgcctc

SEQ ID NO: 335811 - DNA, 20 bp, human
gacaccctgggttgaggtca

SEQ ID NO: 335812 - DNA, 20 bp, human
gtttttggttcaagcatcgg

SEQ ID NO: 335813 - DNA, 20 bp, human
gagggacgagggccagaaaa

SEQ ID NO: 335814 - DNA, 20 bp, human
ggcagccatgacctcaaccc

SEQ ID NO: 335815 - DNA, 20 bp, human
gtcaagcatcggaggccagg

SEQ ID NO: 335816 - DNA, 20 bp, human
gaggacacctgacctaggat

SEQ ID NO: 335817 - DNA, 20 bp, human
gtctctgattggcccatcct

SEQ ID NO: 335818 - DNA, 20 bp, human
gctcctgaatcagtcaacta

SEQ ID NO: 335819 - DNA, 20 bp, human
gggagttcccagaagaagta

SEQ ID NO: 335820 - DNA, 20 bp, human
gagaagtaagggatgtttct

SEQ ID NO: 335821 - DNA, 20 bp, human
ggattggcccatcctaggtc

SEQ ID NO: 335822 - DNA, 20 bp, human
ggggtcaaagcattcacagg

SEQ ID NO: 335823 - DNA, 20 bp, human
gaacatcccttacttcttct

SEQ ID NO: 335824 - DNA, 20 bp, human
gaggagaggacacctgacct

SEQ ID NO: 335825 - DNA, 20 bp, human
gtcaaagcattcacaggtgg

SEQ ID NO: 335826 - DNA, 20 bp, human
ggacgcgcggaggacgagtg

SEQ ID NO: 335827 - DNA, 20 bp, human
gagcggaaagctctgcgcgt

SEQ ID NO: 335828 - DNA, 20 bp, human
gcgggcggggaactctttgg

SEQ ID NO: 335829 - DNA, 20 bp, human
gcgccggggcaatgtcatct

SEQ ID NO: 335830 - DNA, 20 bp, human
gcacctagatgacattgccc

SEQ ID NO: 335831 - DNA, 20 bp, human
ggctcggcgctccactgatc

SEQ ID NO: 335832 - DNA, 20 bp, human
gtgggcgggcacgtttgcct

SEQ ID NO: 335833 - DNA, 20 bp, human
gacgcctgttagaccatccg

SEQ ID NO: 335834 - DNA, 20 bp, human
gccactgatccggcccccgg

SEQ ID NO: 335835 - DNA, 20 bp, human
gggaaagctctgcgcgtggg

SEQ ID NO: 335836 - DNA, 20 bp, human
gcgctccgggaactcggctc

SEQ ID NO: 335837 - DNA, 20 bp, human
gcgtgcgaggggctctcggc

SEQ ID NO: 335838 - DNA, 20 bp, human
gagcccgcagtgcgtgcgag

SEQ ID NO: 335839 - DNA, 20 bp, human
gggctcgggaacctcgtctg

SEQ ID NO: 335840 - DNA, 20 bp, human
gcgccctgagagccgaagca

SEQ ID NO: 335841 - DNA, 20 bp, human
gcgggctgaccgggcgctcc

SEQ ID NO: 335842 - DNA, 20 bp, human
gtctgcaggaagggccgtcc

SEQ ID NO: 335843 - DNA, 20 bp, human
gcgggaacctcgtctgcggt

SEQ ID NO: 335844 - DNA, 20 bp, human
gaccgggcgctccgggaact

SEQ ID NO: 335845 - DNA, 20 bp, human
gagtgcgtgcgaggggctct

SEQ ID NO: 335846 - DNA, 20 bp, human
ggcgctagctagggagatat

SEQ ID NO: 335847 - DNA, 20 bp, human
gaggtgtttacaagcctcga

SEQ ID NO: 335848 - DNA, 20 bp, human
ggagagaggaagtgctgcac

SEQ ID NO: 335849 - DNA, 20 bp, human
gctagggagatatcggagag

SEQ ID NO: 335850 - DNA, 20 bp, human
gtctccgcgggcactgattc

SEQ ID NO: 335851 - DNA, 20 bp, human
ggtagggtcatgcgctagct

SEQ ID NO: 335852 - DNA, 20 bp, human
gaggcttgtaaacacctcgc

SEQ ID NO: 335853 - DNA, 20 bp, human
ggctttgagtagaaaaggta

SEQ ID NO: 335854 - DNA, 20 bp, human
ggcaccctgtggttcagcac

SEQ ID NO: 335855 - DNA, 20 bp, human
gccctcctgtgctgaaccac

SEQ ID NO: 335856 - DNA, 20 bp, human
ggcagcgcgccgaccgcgat

SEQ ID NO: 335857 - DNA, 20 bp, human
gggggggcccacaagggtag

SEQ ID NO: 335858 - DNA, 20 bp, human
gggccacagcccatcgcggt

SEQ ID NO: 335859 - DNA, 20 bp, human
gcgccgaccgcgatgggctg

SEQ ID NO: 335860 - DNA, 20 bp, human
gtggcgctgtccgtctgcga

SEQ ID NO: 335861 - DNA, 20 bp, human
gggacagcgccagggagcaa

SEQ ID NO: 335862 - DNA, 20 bp, human
gaagtcgggaaggttccttg

SEQ ID NO: 335863 - DNA, 20 bp, human
ggcgtgccggacgtgacaaa

SEQ ID NO: 335864 - DNA, 20 bp, human
ggcgcgctgccattgctccc

SEQ ID NO: 335865 - DNA, 20 bp, human
gaaccttcccgacttagggg

SEQ ID NO: 335866 - DNA, 20 bp, human
gtgggcagagggtcatgtag

SEQ ID NO: 335867 - DNA, 20 bp, human
gacaacggccactgttagac

SEQ ID NO: 335868 - DNA, 20 bp, human
ggtgaagattccaacttcct

SEQ ID NO: 335869 - DNA, 20 bp, human
gctggcttcaggcgagactt

SEQ ID NO: 335870 - DNA, 20 bp, human
gttaaccgagctgtggggtg

SEQ ID NO: 335871 - DNA, 20 bp, human
gagaaggcggcgcacacctc

SEQ ID NO: 335872 - DNA, 20 bp, human
gcgttgtgctggagacagtg

SEQ ID NO: 335873 - DNA, 20 bp, human
gcttcaggcgagacttgggt

SEQ ID NO: 335874 - DNA, 20 bp, human
gagttcagatcgagattgac

SEQ ID NO: 335875 - DNA, 20 bp, human
gggcaaaaagagccagaagg

SEQ ID NO: 335876 - DNA, 20 bp, human
gacagcaggcaaagattcaa

SEQ ID NO: 335877 - DNA, 20 bp, human
gggcaaagattcaatgggta

SEQ ID NO: 335878 - DNA, 20 bp, human
ggaaggtcgggcagtcggtc

SEQ ID NO: 335879 - DNA, 20 bp, human
gcctgagtcgaagtgagttc

SEQ ID NO: 335880 - DNA, 20 bp, human
ggtgaagcaccgcgaaggtc

SEQ ID NO: 335881 - DNA, 20 bp, human
gaccgcgaaggtcgggcagt

SEQ ID NO: 335882 - DNA, 20 bp, human
gggcaagtgaagcaccgcga

SEQ ID NO: 335883 - DNA, 20 bp, human
gagaggacgtcctatcgagg

SEQ ID NO: 335884 - DNA, 20 bp, human
gaggttgagcattcgggcac

SEQ ID NO: 335885 - DNA, 20 bp, human
gcaaccttgctgtatcaggg

SEQ ID NO: 335886 - DNA, 20 bp, human
ggagccccgcgtctagagcc

SEQ ID NO: 335887 - DNA, 20 bp, human
gtcacgcccacggcaatgac

SEQ ID NO: 335888 - DNA, 20 bp, human
gtccttctctggctgggcca

SEQ ID NO: 335889 - DNA, 20 bp, human
gtcagcagggagggacgcac

SEQ ID NO: 335890 - DNA, 20 bp, human
gtcgcagaggcccggggcat

SEQ ID NO: 335891 - DNA, 20 bp, human
gggcgggatgcactgtggtt

SEQ ID NO: 335892 - DNA, 20 bp, human
gagggggcctgtcattgccg

SEQ ID NO: 335893 - DNA, 20 bp, human
gcttctccccgcaaggactg

SEQ ID NO: 335894 - DNA, 20 bp, human
gtgcactgtggttggggtct

SEQ ID NO: 335895 - DNA, 20 bp, human
ggctgagacaccggaggcac

SEQ ID NO: 335896 - DNA, 20 bp, human
ggggagggacaggacttgag

SEQ ID NO: 335897 - DNA, 20 bp, human
gtaggagggacagaagagac

SEQ ID NO: 335898 - DNA, 20 bp, human
ggctacagagccgtcactat

SEQ ID NO: 335899 - DNA, 20 bp, human
gcccagatgaccttgaccca

SEQ ID NO: 335900 - DNA, 20 bp, human
gttgcctcggtccacctcac

SEQ ID NO: 335901 - DNA, 20 bp, human
gacatggggcagcgtaccct

SEQ ID NO: 335902 - DNA, 20 bp, human
gcgtcactatggggagggac

SEQ ID NO: 335903 - DNA, 20 bp, human
ggtaagaccggctgtgttga

SEQ ID NO: 335904 - DNA, 20 bp, human
gagagccgtcactatgggga

SEQ ID NO: 335905 - DNA, 20 bp, human
gccagaggggcctggagacc

SEQ ID NO: 335906 - DNA, 20 bp, human
ggcccagggcaacaggaggt

SEQ ID NO: 335907 - DNA, 20 bp, human
gaggaaccaggagttgccca

SEQ ID NO: 335908 - DNA, 20 bp, human
gagccacaggatggtagggg

SEQ ID NO: 335909 - DNA, 20 bp, human
gagttgcccagggcaacagg

SEQ ID NO: 335910 - DNA, 20 bp, human
ggacagtggtgccacatagt

SEQ ID NO: 335911 - DNA, 20 bp, human
gacctggctcaggcttctcg

SEQ ID NO: 335912 - DNA, 20 bp, human
gggaacctgatgtgtttaag

SEQ ID NO: 335913 - DNA, 20 bp, human
gcaggcactgcgcttctatg

SEQ ID NO: 335914 - DNA, 20 bp, human
gggagcacccacctactatg

SEQ ID NO: 335915 - DNA, 20 bp, human
gcacccacctcctgttgccc

SEQ ID NO: 335916 - DNA, 20 bp, human
gtccaggagcctgaagactg

SEQ ID NO: 335917 - DNA, 20 bp, human
ggggctgaggacgagctctc

SEQ ID NO: 335918 - DNA, 20 bp, human
gccaacctgggaaagcctgc

SEQ ID NO: 335919 - DNA, 20 bp, human
gacttcaatccacagtcttc

SEQ ID NO: 335920 - DNA, 20 bp, human
gtgcaagtgggaccagactc

SEQ ID NO: 335921 - DNA, 20 bp, human
gtggacagagagaaactggg

SEQ ID NO: 335922 - DNA, 20 bp, human
ggacgagctctcgggagtgt

SEQ ID NO: 335923 - DNA, 20 bp, human
ggtcatgagcagggtcagga

SEQ ID NO: 335924 - DNA, 20 bp, human
gtgttgcagacacaaccctc

SEQ ID NO: 335925 - DNA, 20 bp, human
gaagctattggggcagaatt

SEQ ID NO: 335926 - DNA, 20 bp, human
ggggtaggaacccggtcata

SEQ ID NO: 335927 - DNA, 20 bp, human
gaggtccggcgggaggggaa

SEQ ID NO: 335928 - DNA, 20 bp, human
gcacctcctggcaggtccgg

SEQ ID NO: 335929 - DNA, 20 bp, human
gtctaggcctcctgtgaaat

SEQ ID NO: 335930 - DNA, 20 bp, human
gggaacccggtcatagggca

SEQ ID NO: 335931 - DNA, 20 bp, human
gaaggctccacccatttcac

SEQ ID NO: 335932 - DNA, 20 bp, human
gagggcaaggacgtgaggca

SEQ ID NO: 335933 - DNA, 20 bp, human
gcctctgccccaacacttag

SEQ ID NO: 335934 - DNA, 20 bp, human
gtgcgggcctctttttacag

SEQ ID NO: 335935 - DNA, 20 bp, human
gtcccgccggacctgccagg

SEQ ID NO: 335936 - DNA, 20 bp, human
gaggaggaattgcggggcta

SEQ ID NO: 335937 - DNA, 20 bp, human
gaggaattgcggggctaggg

SEQ ID NO: 335938 - DNA, 20 bp, human
gtgagcgaggaggaattgcg

SEQ ID NO: 335939 - DNA, 20 bp, human
ggcggcggagccagtcggtc

SEQ ID NO: 335940 - DNA, 20 bp, human
ggcggagccagtcggtccgg

SEQ ID NO: 335941 - DNA, 20 bp, human
gcaaggaggcgtgcccgccg

SEQ ID NO: 335942 - DNA, 20 bp, human
gcggccccaagacgtggagg

SEQ ID NO: 335943 - DNA, 20 bp, human
gcctgcagcgcacccgcaaa

SEQ ID NO: 335944 - DNA, 20 bp, human
gaaagtgacgcgcgccgcgg

SEQ ID NO: 335945 - DNA, 20 bp, human
ggcacccgcaaacggcaagg

SEQ ID NO: 335946 - DNA, 20 bp, human
ggctccagtctagaacttcg

SEQ ID NO: 335947 - DNA, 20 bp, human
gtaaacccccactacttcgg

SEQ ID NO: 335948 - DNA, 20 bp, human
gcacgcctccgaagtagtgg

SEQ ID NO: 335949 - DNA, 20 bp, human
gcaggcccccagtttctctt

SEQ ID NO: 335950 - DNA, 20 bp, human
gattgcctcaccacccggac

SEQ ID NO: 335951 - DNA, 20 bp, human
ggtggtgaggcaatagtgca

SEQ ID NO: 335952 - DNA, 20 bp, human
gccgccgcccgccccgccta

SEQ ID NO: 335953 - DNA, 20 bp, human
gccccacgcctccgaagtag

SEQ ID NO: 335954 - DNA, 20 bp, human
gaatcagcaagggcgggaag

SEQ ID NO: 335955 - DNA, 20 bp, human
ggtgagagcagatcgaggaa

SEQ ID NO: 335956 - DNA, 20 bp, human
ggggacccaggataagggta

SEQ ID NO: 335957 - DNA, 20 bp, human
ggcctgaggaactgcggctg

SEQ ID NO: 335958 - DNA, 20 bp, human
gccctggccaatcacggcag

SEQ ID NO: 335959 - DNA, 20 bp, human
ggccagctgcgcgcgacctg

SEQ ID NO: 335960 - DNA, 20 bp, human
gaccgcagccgcagttcctc

SEQ ID NO: 335961 - DNA, 20 bp, human
gcgcggccgcagtgctctga

SEQ ID NO: 335962 - DNA, 20 bp, human
gggttggggccgagggtcgc

SEQ ID NO: 335963 - DNA, 20 bp, human
gtgtccgaggcccagcgacg

SEQ ID NO: 335964 - DNA, 20 bp, human
gggccacgtctgcggttctg

SEQ ID NO: 335965 - DNA, 20 bp, human
gggctcgtcgccacgccccc

SEQ ID NO: 335966 - DNA, 20 bp, human
ggtaggaaagcctatttcta

SEQ ID NO: 335967 - DNA, 20 bp, human
ggaaagcctatttctaaggc

SEQ ID NO: 335968 - DNA, 20 bp, human
ggaggctgggcgctgcgtgt

SEQ ID NO: 335969 - DNA, 20 bp, human
gacaaatggtcggggtggga

SEQ ID NO: 335970 - DNA, 20 bp, human
gaggctggggaaagtgtgga

SEQ ID NO: 335971 - DNA, 20 bp, human
gcaccccgaccatttgttga

SEQ ID NO: 335972 - DNA, 20 bp, human
gaaagtgtggatggctcgag

SEQ ID NO: 335973 - DNA, 20 bp, human
gtgggtagggagggtgagaa

SEQ ID NO: 335974 - DNA, 20 bp, human
gtggctcgagtgggtcctgt

SEQ ID NO: 335975 - DNA, 20 bp, human
gttcccttcaacaaatggtc

SEQ ID NO: 335976 - DNA, 20 bp, human
gcggggagaggggcgatcat

SEQ ID NO: 335977 - DNA, 20 bp, human
gcgcgccgggcctcaccgat

SEQ ID NO: 335978 - DNA, 20 bp, human
ggcgcaaggccgctgttccc

SEQ ID NO: 335979 - DNA, 20 bp, human
gagctcccgcagcccgcggg

SEQ ID NO: 335980 - DNA, 20 bp, human
gcttgggacgccccggtgat

SEQ ID NO: 335981 - DNA, 20 bp, human
gagcgccaatcggtgaggcc

SEQ ID NO: 335982 - DNA, 20 bp, human
ggggccaatgagcgccccgg

SEQ ID NO: 335983 - DNA, 20 bp, human
gggacgccccggtgattggc

SEQ ID NO: 335984 - DNA, 20 bp, human
gagcgcttcactccgaatgc

SEQ ID NO: 335985 - DNA, 20 bp, human
gctgaccactcgcttccaat

SEQ ID NO: 335986 - DNA, 20 bp, human
gggcgcgcacgctgcgtctc

SEQ ID NO: 335987 - DNA, 20 bp, human
gacgccgagcggctgaccgg

SEQ ID NO: 335988 - DNA, 20 bp, human
gcgccccgcccccgtcggct

SEQ ID NO: 335989 - DNA, 20 bp, human
gtgcaagcggctacacacta

SEQ ID NO: 335990 - DNA, 20 bp, human
ggaggccgggggcttgacag

SEQ ID NO: 335991 - DNA, 20 bp, human
gaataccgggcctagccgac

SEQ ID NO: 335992 - DNA, 20 bp, human
gaacggaggctggggaatac

SEQ ID NO: 335993 - DNA, 20 bp, human
gtagcctcctaggaccatgg

SEQ ID NO: 335994 - DNA, 20 bp, human
gcacgctgcgtctcgggccc

SEQ ID NO: 335995 - DNA, 20 bp, human
gcacgcccctgtcaagcccc

SEQ ID NO: 335996 - DNA, 20 bp, human
gtgggcttctgagtctggaa

SEQ ID NO: 335997 - DNA, 20 bp, human
ggcgtttacaatcctggagc

SEQ ID NO: 335998 - DNA, 20 bp, human
ggaacctttatgtttaacta

SEQ ID NO: 335999 - DNA, 20 bp, human
gtctgagtctggaagggact

SEQ ID NO: 336000 - DNA, 20 bp, human
gcagggggcggcactcgtgg

SEQ ID NO: 336001 - DNA, 20 bp, human
gcaggcgcactgcacaggac

SEQ ID NO: 336002 - DNA, 20 bp, human
ggtgccgccccctgctccac

SEQ ID NO: 336003 - DNA, 20 bp, human
gtcgatgggactgggtcctg

SEQ ID NO: 336004 - DNA, 20 bp, human
gatcccttagttaaacataa

SEQ ID NO: 336005 - DNA, 20 bp, human
gaacttttgtgtccagctcc

SEQ ID NO: 336006 - DNA, 20 bp, human
gccaacccgctgtcctgagc

SEQ ID NO: 336007 - DNA, 20 bp, human
gacgatccagctcaggacag

SEQ ID NO: 336008 - DNA, 20 bp, human
gcgggcggccaggaggggtt

SEQ ID NO: 336009 - DNA, 20 bp, human
gcaaaggtgagctaagggtt

SEQ ID NO: 336010 - DNA, 20 bp, human
gccggcgtccgtagcgttct

SEQ ID NO: 336011 - DNA, 20 bp, human
gtttctggacatttgagtct

SEQ ID NO: 336012 - DNA, 20 bp, human
ggtactgtcctaggaactgt

SEQ ID NO: 336013 - DNA, 20 bp, human
gaagcagaacgatccagctc

SEQ ID NO: 336014 - DNA, 20 bp, human
gcctgggacagaaggatgtc

SEQ ID NO: 336015 - DNA, 20 bp, human
gctcaaagaggtactgtcct

SEQ ID NO: 336016 - DNA, 20 bp, human
ggcctccatcctgtcgtcag

SEQ ID NO: 336017 - DNA, 20 bp, human
gcctaccggtaattggggta

SEQ ID NO: 336018 - DNA, 20 bp, human
gctctcaatagcaggttctt

SEQ ID NO: 336019 - DNA, 20 bp, human
gtcccctgacgacaggatgg

SEQ ID NO: 336020 - DNA, 20 bp, human
gggcggggcctccctagagg

SEQ ID NO: 336021 - DNA, 20 bp, human
gtccctcctcctggagacgg

SEQ ID NO: 336022 - DNA, 20 bp, human
gtactgggatctgagatctt

SEQ ID NO: 336023 - DNA, 20 bp, human
gctagtgctcccgcactact

SEQ ID NO: 336024 - DNA, 20 bp, human
gccacagctgtcactaatcg

SEQ ID NO: 336025 - DNA, 20 bp, human
gccacagttcccctgacgac

SEQ ID NO: 336026 - DNA, 20 bp, human
gcgccactcgctcgctcaga

SEQ ID NO: 336027 - DNA, 20 bp, human
ggagcggcgccggactctag

SEQ ID NO: 336028 - DNA, 20 bp, human
gtcccaggtagaactgaggg

SEQ ID NO: 336029 - DNA, 20 bp, human
gggcctcccaggtagaactg

SEQ ID NO: 336030 - DNA, 20 bp, human
gcggactctagaggctttgg

SEQ ID NO: 336031 - DNA, 20 bp, human
gatggcgcgaggatggcgtg

SEQ ID NO: 336032 - DNA, 20 bp, human
gtctgcgaggagcaaaaaag

SEQ ID NO: 336033 - DNA, 20 bp, human
gctcctccccggctagtctt

SEQ ID NO: 336034 - DNA, 20 bp, human
ggcccccctcagttctacct

SEQ ID NO: 336035 - DNA, 20 bp, human
gggcggccaaagactagccg

SEQ ID NO: 336036 - DNA, 20 bp, human
gtgcgcggccagcgaaagaa

SEQ ID NO: 336037 - DNA, 20 bp, human
gcggccagcgaaagaaggga

SEQ ID NO: 336038 - DNA, 20 bp, human
gcgtctacttaacctagcgg

SEQ ID NO: 336039 - DNA, 20 bp, human
gccccctcttctcacgttat

SEQ ID NO: 336040 - DNA, 20 bp, human
ggtcaggccggctcctgatt

SEQ ID NO: 336041 - DNA, 20 bp, human
gaccccgtcaacacccaatc

SEQ ID NO: 336042 - DNA, 20 bp, human
gtcctgattgggtgttgacg

SEQ ID NO: 336043 - DNA, 20 bp, human
gcggggcgtgcctcccgcag

SEQ ID NO: 336044 - DNA, 20 bp, human
gcgctggcgggcagtgatgg

SEQ ID NO: 336045 - DNA, 20 bp, human
gtcaacacccaatcaggagc

SEQ ID NO: 336046 - DNA, 20 bp, human
gggaacccctggctcgggga

SEQ ID NO: 336047 - DNA, 20 bp, human
gggacacaggcgaggaacag

SEQ ID NO: 336048 - DNA, 20 bp, human
ggtcacaggtcgcggaggaa

SEQ ID NO: 336049 - DNA, 20 bp, human
gacctgtgacgagtgactgc

SEQ ID NO: 336050 - DNA, 20 bp, human
ggcgagcgcggacacggctc

SEQ ID NO: 336051 - DNA, 20 bp, human
gcgcgcaggcgcggaacccc

SEQ ID NO: 336052 - DNA, 20 bp, human
gcactcgtcacaggtcgcgg

SEQ ID NO: 336053 - DNA, 20 bp, human
ggcgcggaacccctggctcg

SEQ ID NO: 336054 - DNA, 20 bp, human
gagtggtcgcgccgcaggag

SEQ ID NO: 336055 - DNA, 20 bp, human
gaggaaaggatgcggcgcag

SEQ ID NO: 336056 - DNA, 20 bp, human
gaagtggactgcaactcaga

SEQ ID NO: 336057 - DNA, 20 bp, human
gagacaggctttagcctcaa

SEQ ID NO: 336058 - DNA, 20 bp, human
gaggccacagtccccaagtt

SEQ ID NO: 336059 - DNA, 20 bp, human
gcccaagttaggaggccaca

SEQ ID NO: 336060 - DNA, 20 bp, human
gccacagtccccaagttagg

SEQ ID NO: 336061 - DNA, 20 bp, human
gagttgcagtccacttgcct

SEQ ID NO: 336062 - DNA, 20 bp, human
gcatctcctccagtggcccc

SEQ ID NO: 336063 - DNA, 20 bp, human
gtgacgcacgtgcctctcct

SEQ ID NO: 336064 - DNA, 20 bp, human
gcaggctttagcctcaaggg

SEQ ID NO: 336065 - DNA, 20 bp, human
ggggtctgcacagaagaggc

SEQ ID NO: 336066 - DNA, 20 bp, human
ggaccagctcccacgtggga

SEQ ID NO: 336067 - DNA, 20 bp, human
gagggtgtcaaccaaagtcg

SEQ ID NO: 336068 - DNA, 20 bp, human
gccacgtgggagctggtcag

SEQ ID NO: 336069 - DNA, 20 bp, human
gtgaatccatcccccgactt

SEQ ID NO: 336070 - DNA, 20 bp, human
gtctccattccatcccacgt

SEQ ID NO: 336071 - DNA, 20 bp, human
gtggacccttcatgccagat

SEQ ID NO: 336072 - DNA, 20 bp, human
gtgggtggccacctagtcca

SEQ ID NO: 336073 - DNA, 20 bp, human
gtggcaccgagaggctgcat

SEQ ID NO: 336074 - DNA, 20 bp, human
ggactcccagagattgggga

SEQ ID NO: 336075 - DNA, 20 bp, human
gtactcagacgtctctaaag

SEQ ID NO: 336076 - DNA, 20 bp, human
gaaggggggtgagggcgata

SEQ ID NO: 336077 - DNA, 20 bp, human
gtgagggcgatagggagggg

SEQ ID NO: 336078 - DNA, 20 bp, human
ggggggtgagggcgataggg

SEQ ID NO: 336079 - DNA, 20 bp, human
gaggggtcacgggggaagaa

SEQ ID NO: 336080 - DNA, 20 bp, human
gccgcacccgcaccccctca

SEQ ID NO: 336081 - DNA, 20 bp, human
ggcaccccctcagggtggta

SEQ ID NO: 336082 - DNA, 20 bp, human
ggaactccctaccaccctga

SEQ ID NO: 336083 - DNA, 20 bp, human
gcgcggcggatcctgcccag

SEQ ID NO: 336084 - DNA, 20 bp, human
gtgcagattagctggggtca

SEQ ID NO: 336085 - DNA, 20 bp, human
gggtgggggaagcccccagc

SEQ ID NO: 336086 - DNA, 20 bp, human
ggggaggggtcgcacatacc

SEQ ID NO: 336087 - DNA, 20 bp, human
ggagaggagcatgacgtcac

SEQ ID NO: 336088 - DNA, 20 bp, human
gaggggctggaccccgggtt

SEQ ID NO: 336089 - DNA, 20 bp, human
gaaggcgcgtggccactggg

SEQ ID NO: 336090 - DNA, 20 bp, human
gtcctctcgcgcggcatgat

SEQ ID NO: 336091 - DNA, 20 bp, human
ggggtgggcggctcctaacc

SEQ ID NO: 336092 - DNA, 20 bp, human
gacgggagaggggcgtgaga

SEQ ID NO: 336093 - DNA, 20 bp, human
gagcatgacgtcacgggaga

SEQ ID NO: 336094 - DNA, 20 bp, human
ggagaaggcgcgtggccact

SEQ ID NO: 336095 - DNA, 20 bp, human
gggtcccgacgcgcccaccc

SEQ ID NO: 336096 - DNA, 20 bp, human
gcatgcccagagaggtcgta

SEQ ID NO: 336097 - DNA, 20 bp, human
ggcccagagaggtcgtaagg

SEQ ID NO: 336098 - DNA, 20 bp, human
ggacgaccgcccggagagaa

SEQ ID NO: 336099 - DNA, 20 bp, human
gagcgtgcgtcctttctctc

SEQ ID NO: 336100 - DNA, 20 bp, human
gggccagcgcatgcccagag

SEQ ID NO: 336101 - DNA, 20 bp, human
ggagccggctggacagtgta

SEQ ID NO: 336102 - DNA, 20 bp, human
ggtaggacgtgccgccgcgg

SEQ ID NO: 336103 - DNA, 20 bp, human
ggacttgtagtccccagcag

SEQ ID NO: 336104 - DNA, 20 bp, human
gcccggcaagctgaacaaaa

SEQ ID NO: 336105 - DNA, 20 bp, human
gtcctccttacgacctctct

SEQ ID NO: 336106 - DNA, 20 bp, human
ggggaaggatgtacggccaa

SEQ ID NO: 336107 - DNA, 20 bp, human
ggggcagccggaaggcccgg

SEQ ID NO: 336108 - DNA, 20 bp, human
gggaggccagcctgtcccag

SEQ ID NO: 336109 - DNA, 20 bp, human
gacaagggattcattttccc

SEQ ID NO: 336110 - DNA, 20 bp, human
gcatacaggggaaggatgta

SEQ ID NO: 336111 - DNA, 20 bp, human
ggaatgcaatgggacgcctc

SEQ ID NO: 336112 - DNA, 20 bp, human
ggtcaggagagcacttccgg

SEQ ID NO: 336113 - DNA, 20 bp, human
ggacccgcggatacctaggg

SEQ ID NO: 336114 - DNA, 20 bp, human
gcggggtagttggaatgcaa

SEQ ID NO: 336115 - DNA, 20 bp, human
gggacaggctggcctccgcg

SEQ ID NO: 336116 - DNA, 20 bp, human
gagaaaagtaggaacttgat

SEQ ID NO: 336117 - DNA, 20 bp, human
gtaaattggcaaattccatg

SEQ ID NO: 336118 - DNA, 20 bp, human
gttgaagatcagttccattt

SEQ ID NO: 336119 - DNA, 20 bp, human
gaaaaatacatgcccagcct

SEQ ID NO: 336120 - DNA, 20 bp, human
gcaactttgccattccaaaa

SEQ ID NO: 336121 - DNA, 20 bp, human
ggctttggtaatatagtaga

SEQ ID NO: 336122 - DNA, 20 bp, human
ggatcagttccattttggaa

SEQ ID NO: 336123 - DNA, 20 bp, human
gtcatggctcaccacctctc

SEQ ID NO: 336124 - DNA, 20 bp, human
gatgtggaacttagaaaagt

SEQ ID NO: 336125 - DNA, 20 bp, human
gaagttttgttctgtggccg

SEQ ID NO: 336126 - DNA, 20 bp, human
ggagaaaagcgttttctctt

SEQ ID NO: 336127 - DNA, 20 bp, human
ggaagagcgctgtgagttct

SEQ ID NO: 336128 - DNA, 20 bp, human
gttgccgcaaagccttttgg

SEQ ID NO: 336129 - DNA, 20 bp, human
gagcgctgtgagttctggga

SEQ ID NO: 336130 - DNA, 20 bp, human
ggctaagagccgcagaacca

SEQ ID NO: 336131 - DNA, 20 bp, human
ggaacctcaccctggttctg

SEQ ID NO: 336132 - DNA, 20 bp, human
gccaaaaggctatgcagcgg

SEQ ID NO: 336133 - DNA, 20 bp, human
gagaaaacgcttttctccgc

SEQ ID NO: 336134 - DNA, 20 bp, human
ggtggcttagaacctcaccc

SEQ ID NO: 336135 - DNA, 20 bp, human
gagcgctcttccacaccaat

SEQ ID NO: 336136 - DNA, 20 bp, human
gcggaagtcccgcccctttc

SEQ ID NO: 336137 - DNA, 20 bp, human
gagggcagccttccagaaag

SEQ ID NO: 336138 - DNA, 20 bp, human
gcgaagttcgggtccgtagt

SEQ ID NO: 336139 - DNA, 20 bp, human
gagtcccgcccctttctgga

SEQ ID NO: 336140 - DNA, 20 bp, human
gttgaaagtgggccaggaaa

SEQ ID NO: 336141 - DNA, 20 bp, human
gacccaagcggccccgacta

SEQ ID NO: 336142 - DNA, 20 bp, human
gctaagggggagggtttcaa

SEQ ID NO: 336143 - DNA, 20 bp, human
ggtaaggctggcgaaagaaa

SEQ ID NO: 336144 - DNA, 20 bp, human
gcgggtccgtagtgggctaa

SEQ ID NO: 336145 - DNA, 20 bp, human
gtcaagcctcgtgaacgaag

SEQ ID NO: 336146 - DNA, 20 bp, human
gtctggagctgctgggaata

SEQ ID NO: 336147 - DNA, 20 bp, human
ggggaacgcacctctcggag

SEQ ID NO: 336148 - DNA, 20 bp, human
ggcacctctcggagaggaga

SEQ ID NO: 336149 - DNA, 20 bp, human
gaagagaggaaaaaacccct

SEQ ID NO: 336150 - DNA, 20 bp, human
gccaaccggcgagcagaact

SEQ ID NO: 336151 - DNA, 20 bp, human
ggggcgccggcaggaaacga

SEQ ID NO: 336152 - DNA, 20 bp, human
gcccgggagctgcgtcgcca

SEQ ID NO: 336153 - DNA, 20 bp, human
gtagtggggaacgcacctct

SEQ ID NO: 336154 - DNA, 20 bp, human
gagggaagtgacgtgagacg

SEQ ID NO: 336155 - DNA, 20 bp, human
gcagaactcggagagaaaga

SEQ ID NO: 336156 - DNA, 20 bp, human
gcgggcgccacgccacgagg

SEQ ID NO: 336157 - DNA, 20 bp, human
gtccctaacccgccttccgg

SEQ ID NO: 336158 - DNA, 20 bp, human
gccctccggaaggcgggtta

SEQ ID NO: 336159 - DNA, 20 bp, human
ggccgcgcgcttcctttgtg

SEQ ID NO: 336160 - DNA, 20 bp, human
gtatcagggcagcctcctcg

SEQ ID NO: 336161 - DNA, 20 bp, human
ggcgtccctaacccgccttc

SEQ ID NO: 336162 - DNA, 20 bp, human
gactcgccgcattgtctccg

SEQ ID NO: 336163 - DNA, 20 bp, human
gagccgccgcggagacaatg

SEQ ID NO: 336164 - DNA, 20 bp, human
gagcacttgcaccggctatc

SEQ ID NO: 336165 - DNA, 20 bp, human
gcgccaaggagcacttgcac

SEQ ID NO: 336166 - DNA, 20 bp, human
gctccccaagaggaagatcc

SEQ ID NO: 336167 - DNA, 20 bp, human
gacgtgacctctggctccgg

SEQ ID NO: 336168 - DNA, 20 bp, human
gagacactggttatcttagt

SEQ ID NO: 336169 - DNA, 20 bp, human
gcccaagaggaagatcctgg

SEQ ID NO: 336170 - DNA, 20 bp, human
gaaagagcaattcctatggt

SEQ ID NO: 336171 - DNA, 20 bp, human
gaatcgcccccgcccaccat

SEQ ID NO: 336172 - DNA, 20 bp, human
ggccacgtgacctctggctc

SEQ ID NO: 336173 - DNA, 20 bp, human
ggagcaattcctatggtggg

SEQ ID NO: 336174 - DNA, 20 bp, human
gtcctccaggatcttcctct

SEQ ID NO: 336175 - DNA, 20 bp, human
gcaattcctatggtgggcgg

SEQ ID NO: 336176 - DNA, 20 bp, human
gatggctgcctcagtaggag

SEQ ID NO: 336177 - DNA, 20 bp, human
gttgtctgccactcctactg

SEQ ID NO: 336178 - DNA, 20 bp, human
gttccccaggatgaattcaa

SEQ ID NO: 336179 - DNA, 20 bp, human
gcctggggaatctgctgaag

SEQ ID NO: 336180 - DNA, 20 bp, human
gaatgaatggctgcctcagt

SEQ ID NO: 336181 - DNA, 20 bp, human
gaaggcaattggtttcaggc

SEQ ID NO: 336182 - DNA, 20 bp, human
gttcaaaggcaattggtttc

SEQ ID NO: 336183 - DNA, 20 bp, human
gacaaaaacatcctaatgaa

SEQ ID NO: 336184 - DNA, 20 bp, human
gaactggaactttttcttaa

SEQ ID NO: 336185 - DNA, 20 bp, human
gggaactttttcttaaagga

SEQ ID NO: 336186 - DNA, 20 bp, human
gcctgcgcgcggcacctggg

SEQ ID NO: 336187 - DNA, 20 bp, human
ggccgccgcccggtgaagga

SEQ ID NO: 336188 - DNA, 20 bp, human
ggcgcgactcgtcacgggga

SEQ ID NO: 336189 - DNA, 20 bp, human
ggggacacgcgtgcgcaaaa

SEQ ID NO: 336190 - DNA, 20 bp, human
ggtcccgccccgtgcttcca

SEQ ID NO: 336191 - DNA, 20 bp, human
gccctcgcgccaaccgccga

SEQ ID NO: 336192 - DNA, 20 bp, human
ggtggggcgcgactcgtcac

SEQ ID NO: 336193 - DNA, 20 bp, human
ggccccgcctctggactctg

SEQ ID NO: 336194 - DNA, 20 bp, human
ggggagggacggaccggttg

SEQ ID NO: 336195 - DNA, 20 bp, human
ggtggggcagctaacggatg

SEQ ID NO: 336196 - DNA, 20 bp, human
ggcgacccccggcagagagg

SEQ ID NO: 336197 - DNA, 20 bp, human
gaggggcgacccgagaacaa

SEQ ID NO: 336198 - DNA, 20 bp, human
gagggaacgagggtgacgcg

SEQ ID NO: 336199 - DNA, 20 bp, human
gctccgggcagggcgacccc

SEQ ID NO: 336200 - DNA, 20 bp, human
gaacgagggtgacgcgcgga

SEQ ID NO: 336201 - DNA, 20 bp, human
gcatccgcagctgcacccgg

SEQ ID NO: 336202 - DNA, 20 bp, human
ggggctgcgggccggaatgg

SEQ ID NO: 336203 - DNA, 20 bp, human
gggcgacccgagaacaaagg

SEQ ID NO: 336204 - DNA, 20 bp, human
gggagcgccaccagcgagag

SEQ ID NO: 336205 - DNA, 20 bp, human
gcgcgagcgcgtagaggcgg

SEQ ID NO: 336206 - DNA, 20 bp, human
gtagccggcccggggaaagt

SEQ ID NO: 336207 - DNA, 20 bp, human
gtgagtcactagccggcccg

SEQ ID NO: 336208 - DNA, 20 bp, human
ggtcgctttgagtcactagc

SEQ ID NO: 336209 - DNA, 20 bp, human
gcacccaactttccccgggc

SEQ ID NO: 336210 - DNA, 20 bp, human
gcggccggatagcgagatcc

SEQ ID NO: 336211 - DNA, 20 bp, human
gacccaaacgccgggagcag

SEQ ID NO: 336212 - DNA, 20 bp, human
gctgcacacccaactttccc

SEQ ID NO: 336213 - DNA, 20 bp, human
ggaaacaatcactctcctga

SEQ ID NO: 336214 - DNA, 20 bp, human
gagccactgctcccggcgtt

SEQ ID NO: 336215 - DNA, 20 bp, human
gtttctcccgctgtgttgtg

SEQ ID NO: 336216 - DNA, 20 bp, human
gaggccgccggctgtcactg

SEQ ID NO: 336217 - DNA, 20 bp, human
gcaaccgcagtgacagccgg

SEQ ID NO: 336218 - DNA, 20 bp, human
gctcccgcgcagccgcggtg

SEQ ID NO: 336219 - DNA, 20 bp, human
ggcgcagccgcaggaagcta

SEQ ID NO: 336220 - DNA, 20 bp, human
gccagcgcactgagacaaaa

SEQ ID NO: 336221 - DNA, 20 bp, human
gagccgcgctggcattcgtc

SEQ ID NO: 336222 - DNA, 20 bp, human
gcgcgctggcattcgtctgg

SEQ ID NO: 336223 - DNA, 20 bp, human
ggcgctggcgcagggcagaa

SEQ ID NO: 336224 - DNA, 20 bp, human
gcgcactgagacaaaagggc

SEQ ID NO: 336225 - DNA, 20 bp, human
ggggacctgaggtctcgcgc

SEQ ID NO: 336226 - DNA, 20 bp, human
gagcggtagcgccttggtct

SEQ ID NO: 336227 - DNA, 20 bp, human
ggcgcacaaaggaaaccttg

SEQ ID NO: 336228 - DNA, 20 bp, human
gcgccgccgcggagcctcat

SEQ ID NO: 336229 - DNA, 20 bp, human
ggactggaagccagcggcga

SEQ ID NO: 336230 - DNA, 20 bp, human
gcggcggcggccccggtgtg

SEQ ID NO: 336231 - DNA, 20 bp, human
gttgtgggagtggtagtcca

SEQ ID NO: 336232 - DNA, 20 bp, human
gagacccgcctccacacacc

SEQ ID NO: 336233 - DNA, 20 bp, human
gggccccggtgtgtggaggc

SEQ ID NO: 336234 - DNA, 20 bp, human
gcccccatgaggctccgcgg

SEQ ID NO: 336235 - DNA, 20 bp, human
gtcgggaaatgtagtctggg

SEQ ID NO: 336236 - DNA, 20 bp, human
ggagccgagtagtgccaagg

SEQ ID NO: 336237 - DNA, 20 bp, human
ggcggagccgagtagtgcca

SEQ ID NO: 336238 - DNA, 20 bp, human
gttcggctcctgctcgggaa

SEQ ID NO: 336239 - DNA, 20 bp, human
gctcctgagtccaaatccct

SEQ ID NO: 336240 - DNA, 20 bp, human
gtgagagcagcaggaattga

SEQ ID NO: 336241 - DNA, 20 bp, human
gggtgaattaggcgcggaga

SEQ ID NO: 336242 - DNA, 20 bp, human
gcagagccgagtgaaagccc

SEQ ID NO: 336243 - DNA, 20 bp, human
gaaaaggaagtgaaaacacg

SEQ ID NO: 336244 - DNA, 20 bp, human
gcggagcctttggggtttat

SEQ ID NO: 336245 - DNA, 20 bp, human
gaattgcacagggtttggcg

SEQ ID NO: 336246 - DNA, 20 bp, human
gcgggtctggggcgcgtagg

SEQ ID NO: 336247 - DNA, 20 bp, human
gaaccccccgcccagttgtt

SEQ ID NO: 336248 - DNA, 20 bp, human
gggggcggcgacgggggtgt

SEQ ID NO: 336249 - DNA, 20 bp, human
gggagtccaggtagcgttgc

SEQ ID NO: 336250 - DNA, 20 bp, human
gcgcccgtgcaagtcccatc

SEQ ID NO: 336251 - DNA, 20 bp, human
gtgcgggccccgtgggggaa

SEQ ID NO: 336252 - DNA, 20 bp, human
gtagcgttgcgggccccgtg

SEQ ID NO: 336253 - DNA, 20 bp, human
gcccgccggagccaaacaac

SEQ ID NO: 336254 - DNA, 20 bp, human
gtgccagcaggcgtggtggt

SEQ ID NO: 336255 - DNA, 20 bp, human
gagggcacccttcccccacg

SEQ ID NO: 336256 - DNA, 20 bp, human
gggtcaagctccaacctcct

SEQ ID NO: 336257 - DNA, 20 bp, human
gtggcctcgggaggaggttg

SEQ ID NO: 336258 - DNA, 20 bp, human
ggaggggcagccgaccatga

SEQ ID NO: 336259 - DNA, 20 bp, human
gctggttggggaggaatcgg

SEQ ID NO: 336260 - DNA, 20 bp, human
gtcggcgggcgcagcgggtt

SEQ ID NO: 336261 - DNA, 20 bp, human
gggaatgcctctagctgggg

SEQ ID NO: 336262 - DNA, 20 bp, human
gggctccgggaacagaccca

SEQ ID NO: 336263 - DNA, 20 bp, human
gaggactggcctcctggttg

SEQ ID NO: 336264 - DNA, 20 bp, human
gcacgtgggtgagttgtgaa

SEQ ID NO: 336265 - DNA, 20 bp, human
gcacgtgccttcaaagccaa

SEQ ID NO: 336266 - DNA, 20 bp, human
gcgcgctcgccctaccggag

SEQ ID NO: 336267 - DNA, 20 bp, human
gagaacgcgcggcgggcaga

SEQ ID NO: 336268 - DNA, 20 bp, human
gtgcccgccgcgcgttcttc

SEQ ID NO: 336269 - DNA, 20 bp, human
ggcggcgccgcgttccaggt

SEQ ID NO: 336270 - DNA, 20 bp, human
gcgccgcgcgttcttctggc

SEQ ID NO: 336271 - DNA, 20 bp, human
ggtggcgcacccagctggac

SEQ ID NO: 336272 - DNA, 20 bp, human
gcgtgggagcgcacagtgtc

SEQ ID NO: 336273 - DNA, 20 bp, human
gagcgcggccggcggtgggt

SEQ ID NO: 336274 - DNA, 20 bp, human
gccgagcgctagagaggacg

SEQ ID NO: 336275 - DNA, 20 bp, human
ggccccgccgagcgctagag

SEQ ID NO: 336276 - DNA, 20 bp, human
ggggctgcgaagagttaacg

SEQ ID NO: 336277 - DNA, 20 bp, human
gcgagagggtggggacggga

SEQ ID NO: 336278 - DNA, 20 bp, human
gttgccaaaacgagagggtg

SEQ ID NO: 336279 - DNA, 20 bp, human
gggaccgagccccagcgccg

SEQ ID NO: 336280 - DNA, 20 bp, human
gatcccttgccaaaacgaga

SEQ ID NO: 336281 - DNA, 20 bp, human
gggcgggcccctgctctcgc

SEQ ID NO: 336282 - DNA, 20 bp, human
gtgcgcgccggcgagagcag

SEQ ID NO: 336283 - DNA, 20 bp, human
gtcacaaggtgggtgaagta

SEQ ID NO: 336284 - DNA, 20 bp, human
gcgtccccaccctctcgttt

SEQ ID NO: 336285 - DNA, 20 bp, human
ggcactctcggtctggcgtt

SEQ ID NO: 336286 - DNA, 20 bp, human
gcgcgggcgcgcatcctccg

SEQ ID NO: 336287 - DNA, 20 bp, human
gcccccgctaattacataag

SEQ ID NO: 336288 - DNA, 20 bp, human
gcggcggccgcgggctccaa

SEQ ID NO: 336289 - DNA, 20 bp, human
gcgggacgtcaataattcgc

SEQ ID NO: 336290 - DNA, 20 bp, human
gccgaggagcggccacaccg

SEQ ID NO: 336291 - DNA, 20 bp, human
ggccgcgggctccaatggcg

SEQ ID NO: 336292 - DNA, 20 bp, human
ggtcccgcttatgtaattag

SEQ ID NO: 336293 - DNA, 20 bp, human
gtgtggccgctcctcggcgg

SEQ ID NO: 336294 - DNA, 20 bp, human
gtcctggctagtggccgcgg

SEQ ID NO: 336295 - DNA, 20 bp, human
ggggtcctggctagtggccg

SEQ ID NO: 336296 - DNA, 20 bp, human
ggagccgcggccccaccgaa

SEQ ID NO: 336297 - DNA, 20 bp, human
gccgcgcgcgggacacaaaa

SEQ ID NO: 336298 - DNA, 20 bp, human
gacccggggcgctgacgtag

SEQ ID NO: 336299 - DNA, 20 bp, human
gggtcccttcggtggggccg

SEQ ID NO: 336300 - DNA, 20 bp, human
gcggccgggggtcccttcgg

SEQ ID NO: 336301 - DNA, 20 bp, human
gagggcgctagtgtgcgcgg

SEQ ID NO: 336302 - DNA, 20 bp, human
ggggaccccggggagaaggt

SEQ ID NO: 336303 - DNA, 20 bp, human
ggagccttgagactgaaagt

SEQ ID NO: 336304 - DNA, 20 bp, human
gaccctgcgggggagaaggt

SEQ ID NO: 336305 - DNA, 20 bp, human
ggccccaccgaagggacccc

SEQ ID NO: 336306 - DNA, 20 bp, human
ggggaccttacgtcactcgg

SEQ ID NO: 336307 - DNA, 20 bp, human
gtcccgcgcgtcagggtagt

SEQ ID NO: 336308 - DNA, 20 bp, human
gtgcccgatcactgtggcaa

SEQ ID NO: 336309 - DNA, 20 bp, human
gaggccgttgccacagtgat

SEQ ID NO: 336310 - DNA, 20 bp, human
gcccgtctgcccgatcactg

SEQ ID NO: 336311 - DNA, 20 bp, human
gaccctgacgcgcgggaaac

SEQ ID NO: 336312 - DNA, 20 bp, human
gggcctgtttcccgcgcgtc

SEQ ID NO: 336313 - DNA, 20 bp, human
gtacgctgggcgcgtcccgg

SEQ ID NO: 336314 - DNA, 20 bp, human
ggccaccaccgagtgacgta

SEQ ID NO: 336315 - DNA, 20 bp, human
ggcccactaccctgacgcgc

SEQ ID NO: 336316 - DNA, 20 bp, human
gcgggcggggctctggttac

SEQ ID NO: 336317 - DNA, 20 bp, human
gggcgggccgccgtaggagg

SEQ ID NO: 336318 - DNA, 20 bp, human
gcctacggcggcccgccaat

SEQ ID NO: 336319 - DNA, 20 bp, human
gcccgcttccggcacgtcgc

SEQ ID NO: 336320 - DNA, 20 bp, human
gggggcccggcgtcgcgtca

SEQ ID NO: 336321 - DNA, 20 bp, human
ggcggggctctggttactgg

SEQ ID NO: 336322 - DNA, 20 bp, human
gcgtaggaggcggggctttg

SEQ ID NO: 336323 - DNA, 20 bp, human
gttgacggaccgctagcggg

SEQ ID NO: 336324 - DNA, 20 bp, human
gggggctttgcggtcgttga

SEQ ID NO: 336325 - DNA, 20 bp, human
ggcccgcgacgtgccggaag

SEQ ID NO: 336326 - DNA, 20 bp, human
gagccgggcgagagggactg

SEQ ID NO: 336327 - DNA, 20 bp, human
gcctgggcggagggatcccc

SEQ ID NO: 336328 - DNA, 20 bp, human
gaaagcggggacgagggcga

SEQ ID NO: 336329 - DNA, 20 bp, human
ggctgggaaagcggggacga

SEQ ID NO: 336330 - DNA, 20 bp, human
gccggggccgggtggtgaat

SEQ ID NO: 336331 - DNA, 20 bp, human
gtcccgagagccgggcgaga

SEQ ID NO: 336332 - DNA, 20 bp, human
gccccgggccggaatcggga

SEQ ID NO: 336333 - DNA, 20 bp, human
gccccgccgctcccgagagc

SEQ ID NO: 336334 - DNA, 20 bp, human
ggactggggctgggaaagcg

SEQ ID NO: 336335 - DNA, 20 bp, human
gccccaccgcccccggtggg

SEQ ID NO: 336336 - DNA, 20 bp, human
gcccgagcggagaacaaaag

SEQ ID NO: 336337 - DNA, 20 bp, human
gcggagaacaaaagtggcgg

SEQ ID NO: 336338 - DNA, 20 bp, human
ggacggggacgcacggtcgc

SEQ ID NO: 336339 - DNA, 20 bp, human
gaacaaaagtggcggtggac

SEQ ID NO: 336340 - DNA, 20 bp, human
ggcggggcgcggcgggctga

SEQ ID NO: 336341 - DNA, 20 bp, human
gcccctgcgccgtgtaacgc

SEQ ID NO: 336342 - DNA, 20 bp, human
gggcgccgcgttccccgggt

SEQ ID NO: 336343 - DNA, 20 bp, human
gttacacggcgcagggggtg

SEQ ID NO: 336344 - DNA, 20 bp, human
gcgggccaacccggggaacg

SEQ ID NO: 336345 - DNA, 20 bp, human
ggagtcatcctctccgtccc

SEQ ID NO: 336346 - DNA, 20 bp, human
gcgccccgggcgaacctgcc

SEQ ID NO: 336347 - DNA, 20 bp, human
gtcacgaaggggccccctcc

SEQ ID NO: 336348 - DNA, 20 bp, human
ggcccgaggggaggccggaa

SEQ ID NO: 336349 - DNA, 20 bp, human
gcacgcgcggacccccttct

SEQ ID NO: 336350 - DNA, 20 bp, human
gtagggtctgcatgactggg

SEQ ID NO: 336351 - DNA, 20 bp, human
gggcggccggagcctgagcg

SEQ ID NO: 336352 - DNA, 20 bp, human
gcggggaggggagtgcgaat

SEQ ID NO: 336353 - DNA, 20 bp, human
ggatgtagggtctgcatgac

SEQ ID NO: 336354 - DNA, 20 bp, human
gggcgatcgctgctggcgag

SEQ ID NO: 336355 - DNA, 20 bp, human
ggatcgctgctggcgagcgg

SEQ ID NO: 336356 - DNA, 20 bp, human
ggtccgggaacagcggaaaa

SEQ ID NO: 336357 - DNA, 20 bp, human
ggcccctgggagatgtaggc

SEQ ID NO: 336358 - DNA, 20 bp, human
ggccgaggcgcagtgcacca

SEQ ID NO: 336359 - DNA, 20 bp, human
ggctcccctcccccggggag

SEQ ID NO: 336360 - DNA, 20 bp, human
ggcaggcccctgggagatgt

SEQ ID NO: 336361 - DNA, 20 bp, human
ggcacttccgctctcccctc

SEQ ID NO: 336362 - DNA, 20 bp, human
ggcccagcctacatctccca

SEQ ID NO: 336363 - DNA, 20 bp, human
ggcagaacgaggcagtatgg

SEQ ID NO: 336364 - DNA, 20 bp, human
gggacggactacaaaaccct

SEQ ID NO: 336365 - DNA, 20 bp, human
ggaagtggggcggtcctcct

SEQ ID NO: 336366 - DNA, 20 bp, human
ggtgtgagctagaagcccgc

SEQ ID NO: 336367 - DNA, 20 bp, human
gtgccgcgtcctccgaagac

SEQ ID NO: 336368 - DNA, 20 bp, human
ggcaacgaggattaggaggg

SEQ ID NO: 336369 - DNA, 20 bp, human
ggaagccttagtgcttacta

SEQ ID NO: 336370 - DNA, 20 bp, human
gcaggccgcggcccccggaa

SEQ ID NO: 336371 - DNA, 20 bp, human
gcccggaacggtaaacagtg

SEQ ID NO: 336372 - DNA, 20 bp, human
ggccgggaggggcgaatcag

SEQ ID NO: 336373 - DNA, 20 bp, human
gggcggctgcaacgaggatt

SEQ ID NO: 336374 - DNA, 20 bp, human
ggccgccgccctgagcccga

SEQ ID NO: 336375 - DNA, 20 bp, human
gtgagctagaagcccgcagg

SEQ ID NO: 336376 - DNA, 20 bp, human
gactcgcgcgagagcaagac

SEQ ID NO: 336377 - DNA, 20 bp, human
ggcaagacgggcctggtgca

SEQ ID NO: 336378 - DNA, 20 bp, human
gtgcaaggattgtaaactga

SEQ ID NO: 336379 - DNA, 20 bp, human
gctgctgggcggccaggtcc

SEQ ID NO: 336380 - DNA, 20 bp, human
gtgggcggccaggtcctggc

SEQ ID NO: 336381 - DNA, 20 bp, human
gcgcgagagcaagacgggcc

SEQ ID NO: 336382 - DNA, 20 bp, human
gcgtggaggcaggaacaatg

SEQ ID NO: 336383 - DNA, 20 bp, human
ggggacctctgggttcacgg

SEQ ID NO: 336384 - DNA, 20 bp, human
gagaaccctgtgaacgcaat

SEQ ID NO: 336385 - DNA, 20 bp, human
gagtttttgtcgctgctggg

SEQ ID NO: 336386 - DNA, 20 bp, human
gtgcgaggggggcgacgtaa

SEQ ID NO: 336387 - DNA, 20 bp, human
ggggacgtatcaacgctctg

SEQ ID NO: 336388 - DNA, 20 bp, human
gtgccgccttcagtcgtaca

SEQ ID NO: 336389 - DNA, 20 bp, human
gcctgattggccgcagagag

SEQ ID NO: 336390 - DNA, 20 bp, human
gtccgcgcgcgaacaggagg

SEQ ID NO: 336391 - DNA, 20 bp, human
gggtttctgcacatgcgctg

SEQ ID NO: 336392 - DNA, 20 bp, human
gcgaacaagtgcaagggata

SEQ ID NO: 336393 - DNA, 20 bp, human
gcaaacactcggcggagcgg

SEQ ID NO: 336394 - DNA, 20 bp, human
gccaccccctgtacgactga

SEQ ID NO: 336395 - DNA, 20 bp, human
gcctgcccccaaacactcgg

SEQ ID NO: 336396 - DNA, 20 bp, human
ggcggggcggcgaacggaag

SEQ ID NO: 336397 - DNA, 20 bp, human
gaggcgcgagaggaggggat

SEQ ID NO: 336398 - DNA, 20 bp, human
gcgcaggtggggcgagagga

SEQ ID NO: 336399 - DNA, 20 bp, human
gggaggggcggggcaggcta

SEQ ID NO: 336400 - DNA, 20 bp, human
ggacggggcggggcggcgaa

SEQ ID NO: 336401 - DNA, 20 bp, human
gcgcacgcgcggagggacgg

SEQ ID NO: 336402 - DNA, 20 bp, human
gctaggcccgggtgctgcga

SEQ ID NO: 336403 - DNA, 20 bp, human
gttgggcgctgaggcgcgag

SEQ ID NO: 336404 - DNA, 20 bp, human
ggggcgggacgggcagtact

SEQ ID NO: 336405 - DNA, 20 bp, human
ggacgggcagtactaggccc

SEQ ID NO: 336406 - DNA, 20 bp, human
gagacgagcgggtccaaagg

SEQ ID NO: 336407 - DNA, 20 bp, human
gtcccgggtgacgtcatcgg

SEQ ID NO: 336408 - DNA, 20 bp, human
gggacccgctcgtctcttta

SEQ ID NO: 336409 - DNA, 20 bp, human
gtccagccctcataagatgg

SEQ ID NO: 336410 - DNA, 20 bp, human
gtctgcctcgcctaagatgg

SEQ ID NO: 336411 - DNA, 20 bp, human
ggggaaggctaggaagtttc

SEQ ID NO: 336412 - DNA, 20 bp, human
gggcgctacccagacaacca

SEQ ID NO: 336413 - DNA, 20 bp, human
gggcgaccgccatcttatga

SEQ ID NO: 336414 - DNA, 20 bp, human
gtatgagggctggactcgcg

SEQ ID NO: 336415 - DNA, 20 bp, human
gaggaggagtgtgcgagtcg

SEQ ID NO: 336416 - DNA, 20 bp, human
gaaaaggagactgtaagagg

SEQ ID NO: 336417 - DNA, 20 bp, human
gagatggagaaattcatcgc

SEQ ID NO: 336418 - DNA, 20 bp, human
gcgcgggaggataataaagc

SEQ ID NO: 336419 - DNA, 20 bp, human
ggaggataataaagcgggca

SEQ ID NO: 336420 - DNA, 20 bp, human
gtggagaaattcatcgcggg

SEQ ID NO: 336421 - DNA, 20 bp, human
gcaacctcagagccgcgagg

SEQ ID NO: 336422 - DNA, 20 bp, human
gatcaaaaggagactgtaag

SEQ ID NO: 336423 - DNA, 20 bp, human
ggcactgtgctagacgttga

SEQ ID NO: 336424 - DNA, 20 bp, human
gttatatgctcaccaggtgt

SEQ ID NO: 336425 - DNA, 20 bp, human
ggatgcatatctgaaatgaa

SEQ ID NO: 336426 - DNA, 20 bp, human
ggcaaaggacagttgaaagc

SEQ ID NO: 336427 - DNA, 20 bp, human
gcgagggaatgaagagggat

SEQ ID NO: 336428 - DNA, 20 bp, human
gccagatgcagaaggctcga

SEQ ID NO: 336429 - DNA, 20 bp, human
ggatgggctaatccttatct

SEQ ID NO: 336430 - DNA, 20 bp, human
ggaacaagccgttaccagat

SEQ ID NO: 336431 - DNA, 20 bp, human
gggaggggctgggattgaac

SEQ ID NO: 336432 - DNA, 20 bp, human
ggcctggcctggcattcagt

SEQ ID NO: 336433 - DNA, 20 bp, human
gggcaaggctgtttacacca

SEQ ID NO: 336434 - DNA, 20 bp, human
gaaacagccttgccagtgtt

SEQ ID NO: 336435 - DNA, 20 bp, human
gtaccacaccaatctggtaa

SEQ ID NO: 336436 - DNA, 20 bp, human
ggcggcccagggctcggccc

SEQ ID NO: 336437 - DNA, 20 bp, human
ggagccctgggccgcgaagg

SEQ ID NO: 336438 - DNA, 20 bp, human
ggctggggacgaggggtcgg

SEQ ID NO: 336439 - DNA, 20 bp, human
gagcgctggggacgaggggt

SEQ ID NO: 336440 - DNA, 20 bp, human
gccctccgcggaaccgtccc

SEQ ID NO: 336441 - DNA, 20 bp, human
gtctctgtggaggccgatag

SEQ ID NO: 336442 - DNA, 20 bp, human
ggcgccttccagccaaccgg

SEQ ID NO: 336443 - DNA, 20 bp, human
ggtccccagcgctccgcacg

SEQ ID NO: 336444 - DNA, 20 bp, human
gcgccccccggcgctaaaaa

SEQ ID NO: 336445 - DNA, 20 bp, human
gtgccgcgtgcggagcgctg

SEQ ID NO: 336446 - DNA, 20 bp, human
ggctgcgcgctgcgaccccg

SEQ ID NO: 336447 - DNA, 20 bp, human
ggccgagaatgtgtcaccgt

SEQ ID NO: 336448 - DNA, 20 bp, human
gtgcacacaggatgttgggg

SEQ ID NO: 336449 - DNA, 20 bp, human
ggggcgggcgcgactggttc

SEQ ID NO: 336450 - DNA, 20 bp, human
ggtctcccgcaaggtggagg

SEQ ID NO: 336451 - DNA, 20 bp, human
gcccgctcgcgtctcccgca

SEQ ID NO: 336452 - DNA, 20 bp, human
gcacgtaggtcacaaggctg

SEQ ID NO: 336453 - DNA, 20 bp, human
gaggctctccttcgttctac

SEQ ID NO: 336454 - DNA, 20 bp, human
gctgcgccgcctccaccttg

SEQ ID NO: 336455 - DNA, 20 bp, human
gaccttgcgggagacgcgag

SEQ ID NO: 336456 - DNA, 20 bp, human
ggggccgtgaggtcgttcca

SEQ ID NO: 336457 - DNA, 20 bp, human
ggcctgggcgatctccccgg

SEQ ID NO: 336458 - DNA, 20 bp, human
ggggacctcctcgcgaccgc

SEQ ID NO: 336459 - DNA, 20 bp, human
gcgaccgccgggacgtaaaa

SEQ ID NO: 336460 - DNA, 20 bp, human
ggaaaccaggttccgggagt

SEQ ID NO: 336461 - DNA, 20 bp, human
ggccgccggggagatcgccc

SEQ ID NO: 336462 - DNA, 20 bp, human
gagtccggagggcgggtcca

SEQ ID NO: 336463 - DNA, 20 bp, human
ggcagccggccggggagaga

SEQ ID NO: 336464 - DNA, 20 bp, human
ggggcgggggcgagtccgga

SEQ ID NO: 336465 - DNA, 20 bp, human
gctgaggggcacaggtaagg

SEQ ID NO: 336466 - DNA, 20 bp, human
ggggctgcgcgccactctct

SEQ ID NO: 336467 - DNA, 20 bp, human
ggtcggaagggcagccctag

SEQ ID NO: 336468 - DNA, 20 bp, human
ggaagagggcccaggagctc

SEQ ID NO: 336469 - DNA, 20 bp, human
gtaaaaaagcagtggagcta

SEQ ID NO: 336470 - DNA, 20 bp, human
ggacgcgtaagagccgctgc

SEQ ID NO: 336471 - DNA, 20 bp, human
gctgccggaagtgagcgtga

SEQ ID NO: 336472 - DNA, 20 bp, human
gccggaagtgagcgtgaggg

SEQ ID NO: 336473 - DNA, 20 bp, human
gcctcccgacagtgtcgtgc

SEQ ID NO: 336474 - DNA, 20 bp, human
gccccccgcacgacactgtc

SEQ ID NO: 336475 - DNA, 20 bp, human
gtgaggggctgccatggcgg

SEQ ID NO: 336476 - DNA, 20 bp, human
gccaaggctccgcagggaca

SEQ ID NO: 336477 - DNA, 20 bp, human
gaggcaggccaaggctccgc

SEQ ID NO: 336478 - DNA, 20 bp, human
gaggccaagggagctccaga

SEQ ID NO: 336479 - DNA, 20 bp, human
gcagtctccgggcggaaggt

SEQ ID NO: 336480 - DNA, 20 bp, human
ggtgggggacctctggtgga

SEQ ID NO: 336481 - DNA, 20 bp, human
gatggagcccagtctccggg

SEQ ID NO: 336482 - DNA, 20 bp, human
gagcccagtctccgggcgga

SEQ ID NO: 336483 - DNA, 20 bp, human
gatcactcttacatcctgtc

SEQ ID NO: 336484 - DNA, 20 bp, human
gtaaatccagccttgtgcgg

SEQ ID NO: 336485 - DNA, 20 bp, human
gtatgctgagagcactgccc

SEQ ID NO: 336486 - DNA, 20 bp, human
gcagcgccgcccgaagactg

SEQ ID NO: 336487 - DNA, 20 bp, human
ggaaaccggccgcccaattg

SEQ ID NO: 336488 - DNA, 20 bp, human
gcggccgcccaattggggct

SEQ ID NO: 336489 - DNA, 20 bp, human
ggcggagcttgttgtcacgt

SEQ ID NO: 336490 - DNA, 20 bp, human
gtcacgccccagccccaatt

SEQ ID NO: 336491 - DNA, 20 bp, human
gtgggcggccggtttccaat

SEQ ID NO: 336492 - DNA, 20 bp, human
gcggcgctcggctggaccta

SEQ ID NO: 336493 - DNA, 20 bp, human
gcggggcgcggcttcagacg

SEQ ID NO: 336494 - DNA, 20 bp, human
ggggaaacgtgatctctggg

SEQ ID NO: 336495 - DNA, 20 bp, human
gaggctgcaacgcgacgccg

SEQ ID NO: 336496 - DNA, 20 bp, human
gaacgagcgcggaagcaagt

SEQ ID NO: 336497 - DNA, 20 bp, human
ggcggagcaagagacgctgg

SEQ ID NO: 336498 - DNA, 20 bp, human
gtagaggagaggagtttccg

SEQ ID NO: 336499 - DNA, 20 bp, human
ggacgcagcgggctttggaa

SEQ ID NO: 336500 - DNA, 20 bp, human
gccttccaggggaacgagcg

SEQ ID NO: 336501 - DNA, 20 bp, human
gtccgctgggtgtcactcgg

SEQ ID NO: 336502 - DNA, 20 bp, human
gggtccgggtcgccttccag

SEQ ID NO: 336503 - DNA, 20 bp, human
ggctcctggcgcccgcaccg

SEQ ID NO: 336504 - DNA, 20 bp, human
gggcgcacgcctcattaact

SEQ ID NO: 336505 - DNA, 20 bp, human
ggaggcggagcaagagacgc

SEQ ID NO: 336506 - DNA, 20 bp, human
gggcccggacggctgggctt

SEQ ID NO: 336507 - DNA, 20 bp, human
gggacctcgagtcaccccac

SEQ ID NO: 336508 - DNA, 20 bp, human
gcggggaggggcagctataa

SEQ ID NO: 336509 - DNA, 20 bp, human
ggagcgcgggcttctgagat

SEQ ID NO: 336510 - DNA, 20 bp, human
gccccggcgtgagtcatcgc

SEQ ID NO: 336511 - DNA, 20 bp, human
gccgcgctctggtcggtccc

SEQ ID NO: 336512 - DNA, 20 bp, human
gccggcctgcgagacggtgc

SEQ ID NO: 336513 - DNA, 20 bp, human
ggaccagagcgcggacgcga

SEQ ID NO: 336514 - DNA, 20 bp, human
gctcgcccgcaccgtctcgc

SEQ ID NO: 336515 - DNA, 20 bp, human
gggccccgtggggtgactcg

SEQ ID NO: 336516 - DNA, 20 bp, human
gcccccaggccttgaatgaa

SEQ ID NO: 336517 - DNA, 20 bp, human
ggagctgcggttccgagaag

SEQ ID NO: 336518 - DNA, 20 bp, human
ggcgctgctagcaagggggt

SEQ ID NO: 336519 - DNA, 20 bp, human
gccgcgcaccagctccggca

SEQ ID NO: 336520 - DNA, 20 bp, human
gcccccttcattcaaggcct

SEQ ID NO: 336521 - DNA, 20 bp, human
gcctccccgcgcaatgcatg

SEQ ID NO: 336522 - DNA, 20 bp, human
gaatgaagggggagatggcg

SEQ ID NO: 336523 - DNA, 20 bp, human
gcgagcggcggaacatgtaa

SEQ ID NO: 336524 - DNA, 20 bp, human
gagagcgcgctgctagcaag

SEQ ID NO: 336525 - DNA, 20 bp, human
gagtcactcactggaggcgc

SEQ ID NO: 336526 - DNA, 20 bp, human
gcccacaagggcgtcttctt

SEQ ID NO: 336527 - DNA, 20 bp, human
gcggacgggacgggggacgg

SEQ ID NO: 336528 - DNA, 20 bp, human
gaacaaagcgggcgctgtgc

SEQ ID NO: 336529 - DNA, 20 bp, human
gagctcccggggaaaagcaa

SEQ ID NO: 336530 - DNA, 20 bp, human
ggctgtgggaaagggtgggt

SEQ ID NO: 336531 - DNA, 20 bp, human
gttgggctccagccccacaa

SEQ ID NO: 336532 - DNA, 20 bp, human
gccccgggagctcgctaagt

SEQ ID NO: 336533 - DNA, 20 bp, human
ggaagacgcccttgtggggc

SEQ ID NO: 336534 - DNA, 20 bp, human
gcgggcgctgtgcaggctgg

SEQ ID NO: 336535 - DNA, 20 bp, human
gtggccaggcggacgggacg

SEQ ID NO: 336536 - DNA, 20 bp, human
gggaaggaaaggttcaaggg

SEQ ID NO: 336537 - DNA, 20 bp, human
ggcgggaaggaaaggttcaa

SEQ ID NO: 336538 - DNA, 20 bp, human
ggaggagacgagtggagagc

SEQ ID NO: 336539 - DNA, 20 bp, human
gcagccgccaatgcccgggg

SEQ ID NO: 336540 - DNA, 20 bp, human
ggcgggccggccaccagcgg

SEQ ID NO: 336541 - DNA, 20 bp, human
ggcttgggatcctgcatcga

SEQ ID NO: 336542 - DNA, 20 bp, human
ggcagaaagggagccggctt

SEQ ID NO: 336543 - DNA, 20 bp, human
ggcctcctggctcttcactc

SEQ ID NO: 336544 - DNA, 20 bp, human
gcccagccccctgtggtaag

SEQ ID NO: 336545 - DNA, 20 bp, human
gtaaggaagccgaggccaga

SEQ ID NO: 336546 - DNA, 20 bp, human
ggaactgtcggaaggaggtg

SEQ ID NO: 336547 - DNA, 20 bp, human
gaagctggcgcccagtgatg

SEQ ID NO: 336548 - DNA, 20 bp, human
gtgagctaaggactggggtc

SEQ ID NO: 336549 - DNA, 20 bp, human
gttgccccggggcgaactgt

SEQ ID NO: 336550 - DNA, 20 bp, human
gagacagcgaagtatctatt

SEQ ID NO: 336551 - DNA, 20 bp, human
gcggcctgagctaaggactg

SEQ ID NO: 336552 - DNA, 20 bp, human
ggggctcacggagggagaca

SEQ ID NO: 336553 - DNA, 20 bp, human
gggggcgaactgtcggaagg

SEQ ID NO: 336554 - DNA, 20 bp, human
gggagttcgagcaacgaagt

SEQ ID NO: 336555 - DNA, 20 bp, human
gcccggggcgaactgtcgga

SEQ ID NO: 336556 - DNA, 20 bp, human
ggggctcgagggagactggg

SEQ ID NO: 336557 - DNA, 20 bp, human
gccagcagcccggaagtgga

SEQ ID NO: 336558 - DNA, 20 bp, human
ggcaggaatgaggggctcga

SEQ ID NO: 336559 - DNA, 20 bp, human
gcggtcagggcccttctgaa

SEQ ID NO: 336560 - DNA, 20 bp, human
gcaggtccaacagctcccga

SEQ ID NO: 336561 - DNA, 20 bp, human
gtggccaagactcctccagg

SEQ ID NO: 336562 - DNA, 20 bp, human
gcaacagctcccgagggagg

SEQ ID NO: 336563 - DNA, 20 bp, human
gaggtggccaagactcctcc

SEQ ID NO: 336564 - DNA, 20 bp, human
ggcgatgctgagttccacga

SEQ ID NO: 336565 - DNA, 20 bp, human
gtggccggatgccgaggcca

SEQ ID NO: 336566 - DNA, 20 bp, human
gcggggagggcgtgtgtcgg

SEQ ID NO: 336567 - DNA, 20 bp, human
ggccggctcaggaacctccc

SEQ ID NO: 336568 - DNA, 20 bp, human
ggctggggagcccgcgaccc

SEQ ID NO: 336569 - DNA, 20 bp, human
ggcgaaccagccgcggatct

SEQ ID NO: 336570 - DNA, 20 bp, human
gggttcgccgggttgaggcg

SEQ ID NO: 336571 - DNA, 20 bp, human
gggccggaggcggagcttca

SEQ ID NO: 336572 - DNA, 20 bp, human
gcaacccggcgaaccagccg

SEQ ID NO: 336573 - DNA, 20 bp, human
gccggcatgacggcattcca

SEQ ID NO: 336574 - DNA, 20 bp, human
gaggggatcggcaatcccga

SEQ ID NO: 336575 - DNA, 20 bp, human
gacgtgacgcgtgcgtacga

SEQ ID NO: 336576 - DNA, 20 bp, human
gacggcgtgcggagcctcgg

SEQ ID NO: 336577 - DNA, 20 bp, human
gcagctgcttaggtccagcg

SEQ ID NO: 336578 - DNA, 20 bp, human
ggcgccaccgagccgcattc

SEQ ID NO: 336579 - DNA, 20 bp, human
gatgcggctcggtggcgccc

SEQ ID NO: 336580 - DNA, 20 bp, human
gaagacgctgccctccgcca

SEQ ID NO: 336581 - DNA, 20 bp, human
gcccgccgccctaggcttgg

SEQ ID NO: 336582 - DNA, 20 bp, human
gggcgcgcgcgagcaaccgg

SEQ ID NO: 336583 - DNA, 20 bp, human
gaggggaagccctaaaaatc

SEQ ID NO: 336584 - DNA, 20 bp, human
gcgcccgggccactcggcgc

SEQ ID NO: 336585 - DNA, 20 bp, human
gctcccgcgggtttcttaga

SEQ ID NO: 336586 - DNA, 20 bp, human
ggtgccggcgcacatcaaag

SEQ ID NO: 336587 - DNA, 20 bp, human
gcgggagcgccagctaaggt

SEQ ID NO: 336588 - DNA, 20 bp, human
ggctccgggagcgccagcta

SEQ ID NO: 336589 - DNA, 20 bp, human
gcgccagctaaggtgggatt

SEQ ID NO: 336590 - DNA, 20 bp, human
gccggcgcacatcaaagggg

SEQ ID NO: 336591 - DNA, 20 bp, human
gaaggtgggattaggctctc

SEQ ID NO: 336592 - DNA, 20 bp, human
ggtgacgttggggactgcgg

SEQ ID NO: 336593 - DNA, 20 bp, human
gctggggaaaagggtcccga

SEQ ID NO: 336594 - DNA, 20 bp, human
gggacagtcgcttgtgacgt

SEQ ID NO: 336595 - DNA, 20 bp, human
gtgtccaatcgcagcggtgc

SEQ ID NO: 336596 - DNA, 20 bp, human
ggtacgagtaacaactccac

SEQ ID NO: 336597 - DNA, 20 bp, human
gcgtaccagcatctctgacg

SEQ ID NO: 336598 - DNA, 20 bp, human
ggaacccgcaggagcgtcac

SEQ ID NO: 336599 - DNA, 20 bp, human
ggacacctcgtcagagatgc

SEQ ID NO: 336600 - DNA, 20 bp, human
ggggtccgatgcctaccctc

SEQ ID NO: 336601 - DNA, 20 bp, human
gctcccttgttcctcggcta

SEQ ID NO: 336602 - DNA, 20 bp, human
ggcgagctgggcttgtgagt

SEQ ID NO: 336603 - DNA, 20 bp, human
gagccgtagccgaggaacaa

SEQ ID NO: 336604 - DNA, 20 bp, human
gactgtggcgccaagcgccg

SEQ ID NO: 336605 - DNA, 20 bp, human
gtccatgatgctcctagatc

SEQ ID NO: 336606 - DNA, 20 bp, human
ggtacgagtaacaactccac

SEQ ID NO: 336607 - DNA, 20 bp, human
gcgtaccagcatctctgacg

SEQ ID NO: 336608 - DNA, 20 bp, human
ggaacccgcaggagcgtcac

SEQ ID NO: 336609 - DNA, 20 bp, human
ggacacctcgtcagagatgc

SEQ ID NO: 336610 - DNA, 20 bp, human
ggggtccgatgcctaccctc

SEQ ID NO: 336611 - DNA, 20 bp, human
gctcccttgttcctcggcta

SEQ ID NO: 336612 - DNA, 20 bp, human
ggcgagctgggcttgtgagt

SEQ ID NO: 336613 - DNA, 20 bp, human
gagccgtagccgaggaacaa

SEQ ID NO: 336614 - DNA, 20 bp, human
gactgtggcgccaagcgccg

SEQ ID NO: 336615 - DNA, 20 bp, human
gtccatgatgctcctagatc

SEQ ID NO: 336616 - DNA, 20 bp, human
gggtccccgccgccgtctta

SEQ ID NO: 336617 - DNA, 20 bp, human
gacggcggcggggacccttc

SEQ ID NO: 336618 - DNA, 20 bp, human
ggggcaggatagggactccg

SEQ ID NO: 336619 - DNA, 20 bp, human
ggacgctgtgtagagaccga

SEQ ID NO: 336620 - DNA, 20 bp, human
ggatagggactccggggata

SEQ ID NO: 336621 - DNA, 20 bp, human
gggcggggacccttcggggt

SEQ ID NO: 336622 - DNA, 20 bp, human
gcacctgcggccccgcggaa

SEQ ID NO: 336623 - DNA, 20 bp, human
ggggccagatcggaataact

SEQ ID NO: 336624 - DNA, 20 bp, human
ggaaaagggtcgggaccctc

SEQ ID NO: 336625 - DNA, 20 bp, human
ggtgtggagctgggatgcgc

SEQ ID NO: 336626 - DNA, 20 bp, human
gggttagaagggaggatcag

SEQ ID NO: 336627 - DNA, 20 bp, human
gccagtgccagcccaataga

SEQ ID NO: 336628 - DNA, 20 bp, human
gtcaggggctcggtgcgtaa

SEQ ID NO: 336629 - DNA, 20 bp, human
ggatgcaggaatcaatgata

SEQ ID NO: 336630 - DNA, 20 bp, human
ggctcggggaaattggatca

SEQ ID NO: 336631 - DNA, 20 bp, human
gggctcggtgcgtaatggtg

SEQ ID NO: 336632 - DNA, 20 bp, human
gcacttggacaatagcaaag

SEQ ID NO: 336633 - DNA, 20 bp, human
ggcaggaatcaatgataggg

SEQ ID NO: 336634 - DNA, 20 bp, human
gactcatccgtctattgggc

SEQ ID NO: 336635 - DNA, 20 bp, human
gctatgagatgccttgtctg

SEQ ID NO: 336636 - DNA, 20 bp, human
ggaaacgtggaatcgggaat

SEQ ID NO: 336637 - DNA, 20 bp, human
gcctcggtcggcggtacaat

SEQ ID NO: 336638 - DNA, 20 bp, human
ggtacaagcggcccccgggt

SEQ ID NO: 336639 - DNA, 20 bp, human
gaggaggaacatggcggtgg

SEQ ID NO: 336640 - DNA, 20 bp, human
ggaggctggggcaacgaggg

SEQ ID NO: 336641 - DNA, 20 bp, human
gtcggcggtacaattggctg

SEQ ID NO: 336642 - DNA, 20 bp, human
gccgcaaggcggcaaggaac

SEQ ID NO: 336643 - DNA, 20 bp, human
gcgcgaggctggggcaacga

SEQ ID NO: 336644 - DNA, 20 bp, human
gggctggcggagccgcaagg

SEQ ID NO: 336645 - DNA, 20 bp, human
gttaaaggaaacgtggaatc

SEQ ID NO: 336646 - DNA, 20 bp, human
ggtaccagctgtcccggccg

SEQ ID NO: 336647 - DNA, 20 bp, human
gaagcagctcccattcgctc

SEQ ID NO: 336648 - DNA, 20 bp, human
gtgggcggtgggcggagatc

SEQ ID NO: 336649 - DNA, 20 bp, human
ggggtctcgaggcgttcaaa

SEQ ID NO: 336650 - DNA, 20 bp, human
gtgcgggcccgaggagggac

SEQ ID NO: 336651 - DNA, 20 bp, human
gtggaccagcccatggtcgc

SEQ ID NO: 336652 - DNA, 20 bp, human
ggagcagcgggcgtgaggcg

SEQ ID NO: 336653 - DNA, 20 bp, human
gagggcggggctgcagacgt

SEQ ID NO: 336654 - DNA, 20 bp, human
gcagtcagcgagcaggacag

SEQ ID NO: 336655 - DNA, 20 bp, human
gggcggggctacgtgcgtgg

SEQ ID NO: 336656 - DNA, 20 bp, human
ggagtcgcgcggcatatcga

SEQ ID NO: 336657 - DNA, 20 bp, human
gaggcctgaagggtgatctg

SEQ ID NO: 336658 - DNA, 20 bp, human
gccagccttggtccaggctc

SEQ ID NO: 336659 - DNA, 20 bp, human
ggtccaggctccgggtccga

SEQ ID NO: 336660 - DNA, 20 bp, human
gaaggctgctgcccggtggt

SEQ ID NO: 336661 - DNA, 20 bp, human
gctctagcccagatctcaga

SEQ ID NO: 336662 - DNA, 20 bp, human
gccacctcggcggcgaaagc

SEQ ID NO: 336663 - DNA, 20 bp, human
gctcccatccagcggtctaa

SEQ ID NO: 336664 - DNA, 20 bp, human
gactcagccgtctgagatct

SEQ ID NO: 336665 - DNA, 20 bp, human
gccagcggtctaaaggaggt

SEQ ID NO: 336666 - DNA, 20 bp, human
ggcccctgagcctaccctat

SEQ ID NO: 336667 - DNA, 20 bp, human
gtgtgggcccaatgggagca

SEQ ID NO: 336668 - DNA, 20 bp, human
gctactgtcacgggttagta

SEQ ID NO: 336669 - DNA, 20 bp, human
gcccgcctctctactgtcac

SEQ ID NO: 336670 - DNA, 20 bp, human
gctaacccgtgacagtagag

SEQ ID NO: 336671 - DNA, 20 bp, human
ggggacctctgaatccagat

SEQ ID NO: 336672 - DNA, 20 bp, human
gcgggcgcgctgcctccaga

SEQ ID NO: 336673 - DNA, 20 bp, human
gaaagtaaggaaaggtcggt

SEQ ID NO: 336674 - DNA, 20 bp, human
ggacgccaatctggattcag

SEQ ID NO: 336675 - DNA, 20 bp, human
gcagtcactgcgcgcgggca

SEQ ID NO: 336676 - DNA, 20 bp, human
gacggaaggatcatggtgtg

SEQ ID NO: 336677 - DNA, 20 bp, human
gccgcccgctgggctaaatg

SEQ ID NO: 336678 - DNA, 20 bp, human
gccgcctccaggcgccgccc

SEQ ID NO: 336679 - DNA, 20 bp, human
ggccccggactggacgtaag

SEQ ID NO: 336680 - DNA, 20 bp, human
gcggtgccagctcgcgggcc

SEQ ID NO: 336681 - DNA, 20 bp, human
gccgggcggtgccagctcgc

SEQ ID NO: 336682 - DNA, 20 bp, human
gggaggacttcagccccggg

SEQ ID NO: 336683 - DNA, 20 bp, human
ggcgcgccgggcaaccgccc

SEQ ID NO: 336684 - DNA, 20 bp, human
gtggacgtaagcgggattcc

SEQ ID NO: 336685 - DNA, 20 bp, human
ggggcccccgagcttcggtg

SEQ ID NO: 336686 - DNA, 20 bp, human
gtgtctagggaaggagggtt

SEQ ID NO: 336687 - DNA, 20 bp, human
gcaaatcctggattagttgt

SEQ ID NO: 336688 - DNA, 20 bp, human
gaggaagcagataaaatcct

SEQ ID NO: 336689 - DNA, 20 bp, human
gggaagggttaagtcctccc

SEQ ID NO: 336690 - DNA, 20 bp, human
ggggatgcagggttggtctg

SEQ ID NO: 336691 - DNA, 20 bp, human
gacctggtaagcagtggtgg

SEQ ID NO: 336692 - DNA, 20 bp, human
gggaatggcggcgcctggac

SEQ ID NO: 336693 - DNA, 20 bp, human
ggtgggaccgggttttctcc

SEQ ID NO: 336694 - DNA, 20 bp, human
ggatgggaaagggcaaatcc

SEQ ID NO: 336695 - DNA, 20 bp, human
ggggaaattatgctgtgaga

SEQ ID NO: 336696 - DNA, 20 bp, human
gccgctgatcccattggtgg

SEQ ID NO: 336697 - DNA, 20 bp, human
ggcgcagccgctgatcccat

SEQ ID NO: 336698 - DNA, 20 bp, human
gaggcttggtccctgctcgc

SEQ ID NO: 336699 - DNA, 20 bp, human
ggtgttggagggacttctga

SEQ ID NO: 336700 - DNA, 20 bp, human
gtgggggtccacaggaaaag

SEQ ID NO: 336701 - DNA, 20 bp, human
ggcgtcaggtgataataagc

SEQ ID NO: 336702 - DNA, 20 bp, human
gtggtccctgctcgccgggc

SEQ ID NO: 336703 - DNA, 20 bp, human
gcgaatctgcctccaccaat

SEQ ID NO: 336704 - DNA, 20 bp, human
ggagctacacagatgtcctc

SEQ ID NO: 336705 - DNA, 20 bp, human
gcagccgctgatcccattgg

SEQ ID NO: 336706 - DNA, 20 bp, human
gcgtgcgcgcagaagggcgg

SEQ ID NO: 336707 - DNA, 20 bp, human
gtcggggaacgtgatgtata

SEQ ID NO: 336708 - DNA, 20 bp, human
gtccccgtgcagacgcctca

SEQ ID NO: 336709 - DNA, 20 bp, human
gcgtctgcacggggaggcga

SEQ ID NO: 336710 - DNA, 20 bp, human
gcccacctgctggcgcgcgg

SEQ ID NO: 336711 - DNA, 20 bp, human
gaacctcgcgcgtgaggcgt

SEQ ID NO: 336712 - DNA, 20 bp, human
gttgccttggcagtggctgg

SEQ ID NO: 336713 - DNA, 20 bp, human
gggggcgcgtgcgcgcagaa

SEQ ID NO: 336714 - DNA, 20 bp, human
gcaggacccggcgcgaggat

SEQ ID NO: 336715 - DNA, 20 bp, human
ggcgaccgagcgcgcgggaa

SEQ ID NO: 336716 - DNA, 20 bp, human
gtgctcccggcgcccaggcg

SEQ ID NO: 336717 - DNA, 20 bp, human
gagcaggggcggggtcgtcc

SEQ ID NO: 336718 - DNA, 20 bp, human
gcggcctcccttccgggaaa

SEQ ID NO: 336719 - DNA, 20 bp, human
gggagctccgagccccgcct

SEQ ID NO: 336720 - DNA, 20 bp, human
ggcgactcaaagactgagtc

SEQ ID NO: 336721 - DNA, 20 bp, human
gcgtcccggaaccagagacg

SEQ ID NO: 336722 - DNA, 20 bp, human
ggtacacagtaggggcctca

SEQ ID NO: 336723 - DNA, 20 bp, human
ggtcgtccgggaccctttcc

SEQ ID NO: 336724 - DNA, 20 bp, human
gcaacgcgggcgcttcgggg

SEQ ID NO: 336725 - DNA, 20 bp, human
gtcgagcgctgccccgtctc

SEQ ID NO: 336726 - DNA, 20 bp, human
ggggtggcaacctttttatg

SEQ ID NO: 336727 - DNA, 20 bp, human
gagccaaaatcaaaggggag

SEQ ID NO: 336728 - DNA, 20 bp, human
gcctcaccacccacataaaa

SEQ ID NO: 336729 - DNA, 20 bp, human
ggaaaaaaacagtgattggg

SEQ ID NO: 336730 - DNA, 20 bp, human
gctctcttagccaaaatcaa

SEQ ID NO: 336731 - DNA, 20 bp, human
gaaaaggggtttgtctttta

SEQ ID NO: 336732 - DNA, 20 bp, human
ggagaaattactcacagaaa

SEQ ID NO: 336733 - DNA, 20 bp, human
gcttgtactttgtaagctgt

SEQ ID NO: 336734 - DNA, 20 bp, human
gagtttgcaacgtccagaaa

SEQ ID NO: 336735 - DNA, 20 bp, human
gggcaacctttttatgtggg

SEQ ID NO: 336736 - DNA, 20 bp, human
gtcacacaatgtctcaggga

SEQ ID NO: 336737 - DNA, 20 bp, human
gccgactcacacaatgtctc

SEQ ID NO: 336738 - DNA, 20 bp, human
gagaaaggaggtttttgcca

SEQ ID NO: 336739 - DNA, 20 bp, human
gaggggagtgcacttgatgc

SEQ ID NO: 336740 - DNA, 20 bp, human
gaaggatctgtccacaactt

SEQ ID NO: 336741 - DNA, 20 bp, human
gaccctacccacagaggagt

SEQ ID NO: 336742 - DNA, 20 bp, human
gagggagggctgggcgcttt

SEQ ID NO: 336743 - DNA, 20 bp, human
gagtgcacttgatgctggtc

SEQ ID NO: 336744 - DNA, 20 bp, human
gacacacagtgggtgtgacc

SEQ ID NO: 336745 - DNA, 20 bp, human
ggcccccgttaccaagagaa

SEQ ID NO: 336746 - DNA, 20 bp, human
gcagcgcctggcacaatgag

SEQ ID NO: 336747 - DNA, 20 bp, human
gagtgtggggcttaccggct

SEQ ID NO: 336748 - DNA, 20 bp, human
ggcaaccacaggcagtgttg

SEQ ID NO: 336749 - DNA, 20 bp, human
gatgagagtgtggggcttac

SEQ ID NO: 336750 - DNA, 20 bp, human
gtagggcctgtgatcatccc

SEQ ID NO: 336751 - DNA, 20 bp, human
gtccgtagatgcaggacaat

SEQ ID NO: 336752 - DNA, 20 bp, human
gtcatccacaacactgcctg

SEQ ID NO: 336753 - DNA, 20 bp, human
gaaaacagctccgtagatgc

SEQ ID NO: 336754 - DNA, 20 bp, human
gtgttgtggatgagagtgtg

SEQ ID NO: 336755 - DNA, 20 bp, human
gacctgctgtatgtgaatac

SEQ ID NO: 336756 - DNA, 20 bp, human
ggacctgggggctttccctc

SEQ ID NO: 336757 - DNA, 20 bp, human
gatcctgagggaaagccccc

SEQ ID NO: 336758 - DNA, 20 bp, human
gtatccaccccattctggga

SEQ ID NO: 336759 - DNA, 20 bp, human
ggggtctgtggtatttacaa

SEQ ID NO: 336760 - DNA, 20 bp, human
gaagtgctggctcacttatt

SEQ ID NO: 336761 - DNA, 20 bp, human
gttcctgtgaataatcctga

SEQ ID NO: 336762 - DNA, 20 bp, human
ggaaatatccaccccattct

SEQ ID NO: 336763 - DNA, 20 bp, human
ggagaaagtaggaaaactct

SEQ ID NO: 336764 - DNA, 20 bp, human
gaagagaaaggaatcaccga

SEQ ID NO: 336765 - DNA, 20 bp, human
ggataattccttagctgtat

SEQ ID NO: 336766 - DNA, 20 bp, human
gtggccctggagatgtgaga

SEQ ID NO: 336767 - DNA, 20 bp, human
ggggatggacagcctgtcac

SEQ ID NO: 336768 - DNA, 20 bp, human
ggccaggcttggcccctgca

SEQ ID NO: 336769 - DNA, 20 bp, human
gggctgtgagtggctagcac

SEQ ID NO: 336770 - DNA, 20 bp, human
gaccaagtcaatccatgcag

SEQ ID NO: 336771 - DNA, 20 bp, human
ggcaagaagctgcctgtgac

SEQ ID NO: 336772 - DNA, 20 bp, human
ggaaaagttgagtggcaggg

SEQ ID NO: 336773 - DNA, 20 bp, human
gtgagcaggtcctgccctgt

SEQ ID NO: 336774 - DNA, 20 bp, human
gaggggctgggtagctggct

SEQ ID NO: 336775 - DNA, 20 bp, human
gccacagtaaagaagctgca

SEQ ID NO: 336776 - DNA, 20 bp, human
gtcgctttactcccagtgga

SEQ ID NO: 336777 - DNA, 20 bp, human
gggcttttgaggggtcaggt

SEQ ID NO: 336778 - DNA, 20 bp, human
gcggcggcagcggggcacgt

SEQ ID NO: 336779 - DNA, 20 bp, human
gggcacgtgggagtgaacag

SEQ ID NO: 336780 - DNA, 20 bp, human
gcgcctgcgcagaagggtcg

SEQ ID NO: 336781 - DNA, 20 bp, human
gtccccgcgctcacggaagc

SEQ ID NO: 336782 - DNA, 20 bp, human
gcgctcacggaagcaggtgg

SEQ ID NO: 336783 - DNA, 20 bp, human
gctgcgcagaagggtcgtgg

SEQ ID NO: 336784 - DNA, 20 bp, human
gcgtgagcgcggggagaagc

SEQ ID NO: 336785 - DNA, 20 bp, human
ggcggggcttttgaggggtc

SEQ ID NO: 336786 - DNA, 20 bp, human
ggggcgggcccaccgctgca

SEQ ID NO: 336787 - DNA, 20 bp, human
gccggcgcggctctcggtct

SEQ ID NO: 336788 - DNA, 20 bp, human
gagccgacctgcgcgatggt

SEQ ID NO: 336789 - DNA, 20 bp, human
gcaactgagaggtcacgtgg

SEQ ID NO: 336790 - DNA, 20 bp, human
gggggatggacagtaggctg

SEQ ID NO: 336791 - DNA, 20 bp, human
gcagttgctgacactagata

SEQ ID NO: 336792 - DNA, 20 bp, human
gtcggagccgaccatcgcgc

SEQ ID NO: 336793 - DNA, 20 bp, human
ggctgacactagatagggcg

SEQ ID NO: 336794 - DNA, 20 bp, human
gccccagccgacctgcgcga

SEQ ID NO: 336795 - DNA, 20 bp, human
ggccccgcccgccgaccccg

SEQ ID NO: 336796 - DNA, 20 bp, human
gaagggaggagcttacgggt

SEQ ID NO: 336797 - DNA, 20 bp, human
gaagcaggaaagcgtatcct

SEQ ID NO: 336798 - DNA, 20 bp, human
gggggcggggaaaagatgtt

SEQ ID NO: 336799 - DNA, 20 bp, human
ggggcgaagggaggagctta

SEQ ID NO: 336800 - DNA, 20 bp, human
ggattactatggaatcggta

SEQ ID NO: 336801 - DNA, 20 bp, human
gaaaggcttggcttggactc

SEQ ID NO: 336802 - DNA, 20 bp, human
gggtagggtcctgaccgctg

SEQ ID NO: 336803 - DNA, 20 bp, human
gccatagtaatctaaggagt

SEQ ID NO: 336804 - DNA, 20 bp, human
gaggctgccacaagttcgac

SEQ ID NO: 336805 - DNA, 20 bp, human
gtcgatgtagtattcttctc

SEQ ID NO: 336806 - DNA, 20 bp, human
gtcaagccaggctatgtccc

SEQ ID NO: 336807 - DNA, 20 bp, human
gcagggaagcggacggtcgc

SEQ ID NO: 336808 - DNA, 20 bp, human
gagactgccatcagaaccca

SEQ ID NO: 336809 - DNA, 20 bp, human
gcagaacccagggaagcgga

SEQ ID NO: 336810 - DNA, 20 bp, human
gacagcgggcaaaaccaagt

SEQ ID NO: 336811 - DNA, 20 bp, human
gaaactgactgaggcgacca

SEQ ID NO: 336812 - DNA, 20 bp, human
gatgggtgtccctggagttg

SEQ ID NO: 336813 - DNA, 20 bp, human
gaaggaccttgcaccatctt

SEQ ID NO: 336814 - DNA, 20 bp, human
gaggagggttaaaccgtgcg

SEQ ID NO: 336815 - DNA, 20 bp, human
gagcagggccagagtgaaat

SEQ ID NO: 336816 - DNA, 20 bp, human
ggggcttcgagcgccctgag

SEQ ID NO: 336817 - DNA, 20 bp, human
gcaagcgcagtgaacttcgc

SEQ ID NO: 336818 - DNA, 20 bp, human
gagctggccgagctaggatg

SEQ ID NO: 336819 - DNA, 20 bp, human
gtctcgcagctgtacgtgcc

SEQ ID NO: 336820 - DNA, 20 bp, human
gtgagcggggcggaggctag

SEQ ID NO: 336821 - DNA, 20 bp, human
gagaggggcgggtctagcgg

SEQ ID NO: 336822 - DNA, 20 bp, human
gtgcgctgacagacgcaaga

SEQ ID NO: 336823 - DNA, 20 bp, human
ggccaggccggctagagggg

SEQ ID NO: 336824 - DNA, 20 bp, human
ggcggacagtgcggaactaa

SEQ ID NO: 336825 - DNA, 20 bp, human
gggggccaggccggctagag

SEQ ID NO: 336826 - DNA, 20 bp, human
gggagggaaggcacgacctg

SEQ ID NO: 336827 - DNA, 20 bp, human
gtgggcagggggcaccgcta

SEQ ID NO: 336828 - DNA, 20 bp, human
gggaaggcggtcgcgcgggt

SEQ ID NO: 336829 - DNA, 20 bp, human
gctgtcgccgcgcggactga

SEQ ID NO: 336830 - DNA, 20 bp, human
ggccgggcccgtcacgtgaa

SEQ ID NO: 336831 - DNA, 20 bp, human
gccgagcggggccaagccgc

SEQ ID NO: 336832 - DNA, 20 bp, human
ggactgaaggcgcgggcgga

SEQ ID NO: 336833 - DNA, 20 bp, human
gtagagctgggtcgcaactg

SEQ ID NO: 336834 - DNA, 20 bp, human
gcgggcggaaggcggtcgcg

SEQ ID NO: 336835 - DNA, 20 bp, human
gtatccgcgggcctggcctc

SEQ ID NO: 336836 - DNA, 20 bp, human
gctaaggtaggctaatcaga

SEQ ID NO: 336837 - DNA, 20 bp, human
gtggacccgtgccctaaggt

SEQ ID NO: 336838 - DNA, 20 bp, human
gacaagaagggttggttctc

SEQ ID NO: 336839 - DNA, 20 bp, human
gagtgtggacccgtgcccta

SEQ ID NO: 336840 - DNA, 20 bp, human
gttgccaagtagatcaagtg

SEQ ID NO: 336841 - DNA, 20 bp, human
gttagcctaccttagggcac

SEQ ID NO: 336842 - DNA, 20 bp, human
gggtccacacttgatctact

SEQ ID NO: 336843 - DNA, 20 bp, human
gggaatggctgagtggtaaa

SEQ ID NO: 336844 - DNA, 20 bp, human
gatcactgaataaatgtcct

SEQ ID NO: 336845 - DNA, 20 bp, human
gagactggcctgagtcatta

SEQ ID NO: 336846 - DNA, 20 bp, human
gcccgccaggaccgccaaga

SEQ ID NO: 336847 - DNA, 20 bp, human
ggcggagctcgggcgagaga

SEQ ID NO: 336848 - DNA, 20 bp, human
gccgcctagcgctcgggctg

SEQ ID NO: 336849 - DNA, 20 bp, human
gaagcgttgaggggtcacag

SEQ ID NO: 336850 - DNA, 20 bp, human
gtagccccggagggagtgta

SEQ ID NO: 336851 - DNA, 20 bp, human
gggaccgccaagagggaagg

SEQ ID NO: 336852 - DNA, 20 bp, human
ggccgggaaggggaggtata

SEQ ID NO: 336853 - DNA, 20 bp, human
gcccagcagctacacgtctg

SEQ ID NO: 336854 - DNA, 20 bp, human
gtgggtaggcagttcagaga

SEQ ID NO: 336855 - DNA, 20 bp, human
gctgctgggtcggctgtgga

SEQ ID NO: 336856 - DNA, 20 bp, human
gggggggcgctggtgtagga

SEQ ID NO: 336857 - DNA, 20 bp, human
ggcgaccacgcctaccccgg

SEQ ID NO: 336858 - DNA, 20 bp, human
gtggtcgccgcgagcggggg

SEQ ID NO: 336859 - DNA, 20 bp, human
gggtgtaggacggacctgat

SEQ ID NO: 336860 - DNA, 20 bp, human
gcccgcccgcgagtggtgag

SEQ ID NO: 336861 - DNA, 20 bp, human
gcccgggcctccggccaatc

SEQ ID NO: 336862 - DNA, 20 bp, human
gagcgcgcgcgggtgctaat

SEQ ID NO: 336863 - DNA, 20 bp, human
ggccctgcgcaggtggggac

SEQ ID NO: 336864 - DNA, 20 bp, human
ggggtgctcggtttcctcta

SEQ ID NO: 336865 - DNA, 20 bp, human
gagtcaggcgccgccggggt

SEQ ID NO: 336866 - DNA, 20 bp, human
gcactctcgcccaatccccg

SEQ ID NO: 336867 - DNA, 20 bp, human
gggaaagggaagaacctccg

SEQ ID NO: 336868 - DNA, 20 bp, human
gtccgcccgtggcctaggcg

SEQ ID NO: 336869 - DNA, 20 bp, human
gcctaggccacgggcggaaa

SEQ ID NO: 336870 - DNA, 20 bp, human
gaaaatgccgagataaacat

SEQ ID NO: 336871 - DNA, 20 bp, human
gcgggagagttgacttccgg

SEQ ID NO: 336872 - DNA, 20 bp, human
gtgccgagataaacattggt

SEQ ID NO: 336873 - DNA, 20 bp, human
gagaagtgttactaatatcc

SEQ ID NO: 336874 - DNA, 20 bp, human
gccagaaggaagccccgcct

SEQ ID NO: 336875 - DNA, 20 bp, human
gaactctcccggatgttccg

SEQ ID NO: 336876 - DNA, 20 bp, human
gggcgggcgtcgaagaggaa

SEQ ID NO: 336877 - DNA, 20 bp, human
ggcgcccgcgcgttacgtga

SEQ ID NO: 336878 - DNA, 20 bp, human
gaacaggaggcccgcccgag

SEQ ID NO: 336879 - DNA, 20 bp, human
ggggagggcgggcgtcgaag

SEQ ID NO: 336880 - DNA, 20 bp, human
gaccccgcgggccgagcctc

SEQ ID NO: 336881 - DNA, 20 bp, human
gggcgggagaggaatggcga

SEQ ID NO: 336882 - DNA, 20 bp, human
gcccgcggggtcacagacgc

SEQ ID NO: 336883 - DNA, 20 bp, human
gcctgccaacaggtcgcctg

SEQ ID NO: 336884 - DNA, 20 bp, human
gagcccggaaagctccgagg

SEQ ID NO: 336885 - DNA, 20 bp, human
gggcagcccggaaagctccg

SEQ ID NO: 336886 - DNA, 20 bp, human
gcctgagccggggttacctc

SEQ ID NO: 336887 - DNA, 20 bp, human
gacagaggaacggtctggac

SEQ ID NO: 336888 - DNA, 20 bp, human
gaagggaaggattgtctgca

SEQ ID NO: 336889 - DNA, 20 bp, human
gggcggcggcggcagggcaa

SEQ ID NO: 336890 - DNA, 20 bp, human
gcgaaaacagaggaacggtc

SEQ ID NO: 336891 - DNA, 20 bp, human
gtacctccggcgaggctcag

SEQ ID NO: 336892 - DNA, 20 bp, human
gggagcaaatatccagtggg

SEQ ID NO: 336893 - DNA, 20 bp, human
ggcctcgccggaggtaaccc

SEQ ID NO: 336894 - DNA, 20 bp, human
gtgaaagggcatgatgtctt

SEQ ID NO: 336895 - DNA, 20 bp, human
gaagttggcgaaactgggat

SEQ ID NO: 336896 - DNA, 20 bp, human
gcgcgctctgagcatgcccg

SEQ ID NO: 336897 - DNA, 20 bp, human
gaggaagcccccattgggtt

SEQ ID NO: 336898 - DNA, 20 bp, human
ggctctgagcatgcccgggg

SEQ ID NO: 336899 - DNA, 20 bp, human
gcagagcgcgcaggtccggg

SEQ ID NO: 336900 - DNA, 20 bp, human
ggactctaaatcctagtgag

SEQ ID NO: 336901 - DNA, 20 bp, human
gagactggctgaggggggaa

SEQ ID NO: 336902 - DNA, 20 bp, human
ggctcagagcgcgcaggtcc

SEQ ID NO: 336903 - DNA, 20 bp, human
ggggggcagcggggatgtcg

SEQ ID NO: 336904 - DNA, 20 bp, human
gttcccagaccccaacccaa

SEQ ID NO: 336905 - DNA, 20 bp, human
gcctggagccgggggtggtg

SEQ ID NO: 336906 - DNA, 20 bp, human
gactccctccccgtcgtcat

SEQ ID NO: 336907 - DNA, 20 bp, human
gaagggccaccgaaactcgt

SEQ ID NO: 336908 - DNA, 20 bp, human
gcagccaatgacgacgggga

SEQ ID NO: 336909 - DNA, 20 bp, human
gtgggggtgctaggtaccga

SEQ ID NO: 336910 - DNA, 20 bp, human
gtggcggccgcgctccatgt

SEQ ID NO: 336911 - DNA, 20 bp, human
gtggacgaagcgagtccaaa

SEQ ID NO: 336912 - DNA, 20 bp, human
gcgcgaaaagtgcctgacgg

SEQ ID NO: 336913 - DNA, 20 bp, human
gccaacgcccccacgagttt

SEQ ID NO: 336914 - DNA, 20 bp, human
gggtgcaccgctgccggaag

SEQ ID NO: 336915 - DNA, 20 bp, human
gaaggcagatgccgtccctt

SEQ ID NO: 336916 - DNA, 20 bp, human
gagccgggagacctcccccg

SEQ ID NO: 336917 - DNA, 20 bp, human
gcgacaggcggagggaaggc

SEQ ID NO: 336918 - DNA, 20 bp, human
gtctccggggctgcgacagg

SEQ ID NO: 336919 - DNA, 20 bp, human
ggggcggctcggcagatgga

SEQ ID NO: 336920 - DNA, 20 bp, human
gggtcgcgtccgcgtctccg

SEQ ID NO: 336921 - DNA, 20 bp, human
gcggggctgcgacaggcgga

SEQ ID NO: 336922 - DNA, 20 bp, human
ggccccgagaacctcggaaa

SEQ ID NO: 336923 - DNA, 20 bp, human
gaagccgagcgctgctgcgc

SEQ ID NO: 336924 - DNA, 20 bp, human
gggggcgcgtcccgaggggg

SEQ ID NO: 336925 - DNA, 20 bp, human
ggcgcgggcggctcggcaga

SEQ ID NO: 336926 - DNA, 20 bp, human
gccgggccagcgccagtcgg

SEQ ID NO: 336927 - DNA, 20 bp, human
gggcccgccctggtgcgttg

SEQ ID NO: 336928 - DNA, 20 bp, human
ggggcccgggcgctacataa

SEQ ID NO: 336929 - DNA, 20 bp, human
gagccgcggggccaagactg

SEQ ID NO: 336930 - DNA, 20 bp, human
gggaactccgagcctcccca

SEQ ID NO: 336931 - DNA, 20 bp, human
ggggcctggagacccccgac

SEQ ID NO: 336932 - DNA, 20 bp, human
gaggccccaacgcaccaggg

SEQ ID NO: 336933 - DNA, 20 bp, human
ggcgccccctggggaccgtg

SEQ ID NO: 336934 - DNA, 20 bp, human
gggggccaagactgcgggag

SEQ ID NO: 336935 - DNA, 20 bp, human
ggccgcgcgggacagcggag

SEQ ID NO: 336936 - DNA, 20 bp, human
gcgagcaaagggggcaagaa

SEQ ID NO: 336937 - DNA, 20 bp, human
gtaaatgggccggccgcagg

SEQ ID NO: 336938 - DNA, 20 bp, human
gagccccgggagcgtgccct

SEQ ID NO: 336939 - DNA, 20 bp, human
gagcggcggcggcttcttca

SEQ ID NO: 336940 - DNA, 20 bp, human
gcccgcgccgaggcgatgct

SEQ ID NO: 336941 - DNA, 20 bp, human
gtggccgcccctcgcccacc

SEQ ID NO: 336942 - DNA, 20 bp, human
ggcggcgcggcgagcaaagg

SEQ ID NO: 336943 - DNA, 20 bp, human
ggcgacgctctccgccccga

SEQ ID NO: 336944 - DNA, 20 bp, human
gctctgggtagcccctcacc

SEQ ID NO: 336945 - DNA, 20 bp, human
gttagtgtgaatcctggatc

SEQ ID NO: 336946 - DNA, 20 bp, human
gcccagccgtccactggatt

SEQ ID NO: 336947 - DNA, 20 bp, human
ggaggtaggggcgtaacaat

SEQ ID NO: 336948 - DNA, 20 bp, human
gacccggcggcgcgtggtgt

SEQ ID NO: 336949 - DNA, 20 bp, human
gagaggaaggaggtttatgg

SEQ ID NO: 336950 - DNA, 20 bp, human
gctccagccactcagaggta

SEQ ID NO: 336951 - DNA, 20 bp, human
ggtctctactccaggagctt

SEQ ID NO: 336952 - DNA, 20 bp, human
gtaaagatccagtcggtgat

SEQ ID NO: 336953 - DNA, 20 bp, human
gaccacgcccagccgtccac

SEQ ID NO: 336954 - DNA, 20 bp, human
gttacgcccctacctctgag

SEQ ID NO: 336955 - DNA, 20 bp, human
gttggtacagcccaagctcc

SEQ ID NO: 336956 - DNA, 20 bp, human
gccggccccgggggtgtcgt

SEQ ID NO: 336957 - DNA, 20 bp, human
gctctcgggcatagaggcgg

SEQ ID NO: 336958 - DNA, 20 bp, human
gggtgctataggggacgtaa

SEQ ID NO: 336959 - DNA, 20 bp, human
gccttcgcggctgcccgccc

SEQ ID NO: 336960 - DNA, 20 bp, human
gctcggcgaaacgcgtgaag

SEQ ID NO: 336961 - DNA, 20 bp, human
gccggagcacaggggtcatg

SEQ ID NO: 336962 - DNA, 20 bp, human
ggcgccgcgagttgatgctg

SEQ ID NO: 336963 - DNA, 20 bp, human
gaggcggtgacgatgctctc

SEQ ID NO: 336964 - DNA, 20 bp, human
ggcaggggaatatgaggact

SEQ ID NO: 336965 - DNA, 20 bp, human
gaaacgcgtgaagaggcgcg

SEQ ID NO: 336966 - DNA, 20 bp, human
gcgtccaccgagccactact

SEQ ID NO: 336967 - DNA, 20 bp, human
gccgctgcagcgtaccgggg

SEQ ID NO: 336968 - DNA, 20 bp, human
gtgccccagtagtggctcgg

SEQ ID NO: 336969 - DNA, 20 bp, human
gcgggttcctgccccagtag

SEQ ID NO: 336970 - DNA, 20 bp, human
gcgcgcctgcgcggcaagtt

SEQ ID NO: 336971 - DNA, 20 bp, human
gacgccccagcagaggagta

SEQ ID NO: 336972 - DNA, 20 bp, human
gatagaatgggcaacctgat

SEQ ID NO: 336973 - DNA, 20 bp, human
ggtaccggggtggactccct

SEQ ID NO: 336974 - DNA, 20 bp, human
gtctgggccaccagcaagta

SEQ ID NO: 336975 - DNA, 20 bp, human
gacagccgctgcagcgtacc

SEQ ID NO: 336976 - DNA, 20 bp, human
gaagcggccgacggtagggt

SEQ ID NO: 336977 - DNA, 20 bp, human
gtgcgcccgtctcctagaag

SEQ ID NO: 336978 - DNA, 20 bp, human
gtgagcacccaccctaccgt

SEQ ID NO: 336979 - DNA, 20 bp, human
ggacgacagagcgtctctct

SEQ ID NO: 336980 - DNA, 20 bp, human
ggaggcagccaatcacaaag

SEQ ID NO: 336981 - DNA, 20 bp, human
gctagaagcggccgacggta

SEQ ID NO: 336982 - DNA, 20 bp, human
gcgcgcagagaactggcgtc

SEQ ID NO: 336983 - DNA, 20 bp, human
gtacatctcgcgcttaaggg

SEQ ID NO: 336984 - DNA, 20 bp, human
gacgctgtaaccaggaaacc

SEQ ID NO: 336985 - DNA, 20 bp, human
ggttccgcagcaccaatcta

SEQ ID NO: 336986 - DNA, 20 bp, human
gaggaggccaccacgtcggg

SEQ ID NO: 336987 - DNA, 20 bp, human
gcgcaaggaggccaccacgt

SEQ ID NO: 336988 - DNA, 20 bp, human
gcaacgaggtaggcagggta

SEQ ID NO: 336989 - DNA, 20 bp, human
gcgcaagcccggaagtaacc

SEQ ID NO: 336990 - DNA, 20 bp, human
gtcgtagctcccacccgacg

SEQ ID NO: 336991 - DNA, 20 bp, human
gtagctcccacccgacgtgg

SEQ ID NO: 336992 - DNA, 20 bp, human
ggggtccgaaaactgctgga

SEQ ID NO: 336993 - DNA, 20 bp, human
ggcgaaaggaaaccgcaagg

SEQ ID NO: 336994 - DNA, 20 bp, human
gggagcaggcgcagaacagt

SEQ ID NO: 336995 - DNA, 20 bp, human
gacagtcggaggtacctgag

SEQ ID NO: 336996 - DNA, 20 bp, human
gtggctgctcgaaggacctc

SEQ ID NO: 336997 - DNA, 20 bp, human
gccccctcctggctgctcga

SEQ ID NO: 336998 - DNA, 20 bp, human
ggctggggatttgccttcct

SEQ ID NO: 336999 - DNA, 20 bp, human
gggcagcagtcacgtcgcga

SEQ ID NO: 337000 - DNA, 20 bp, human
ggctcagagcattcgggttt

SEQ ID NO: 337001 - DNA, 20 bp, human
ggggaagggtgccctcgcta

SEQ ID NO: 337002 - DNA, 20 bp, human
gtgagggcctgacttaataa

SEQ ID NO: 337003 - DNA, 20 bp, human
gggtccttcgagcagccagg

SEQ ID NO: 337004 - DNA, 20 bp, human
ggatggttccagccggggaa

SEQ ID NO: 337005 - DNA, 20 bp, human
gctcgctaaggagattgcgg

SEQ ID NO: 337006 - DNA, 20 bp, human
gttggggtaggcgggagtat

SEQ ID NO: 337007 - DNA, 20 bp, human
gggagtatgggcttagaagc

SEQ ID NO: 337008 - DNA, 20 bp, human
gggttgacgtagcccggaag

SEQ ID NO: 337009 - DNA, 20 bp, human
gcggctaggggaaccgtcgt

SEQ ID NO: 337010 - DNA, 20 bp, human
gggctacgtcaacccacttc

SEQ ID NO: 337011 - DNA, 20 bp, human
gtgggcttagaagccggaag

SEQ ID NO: 337012 - DNA, 20 bp, human
gcagccctgcgcctgcgcgt

SEQ ID NO: 337013 - DNA, 20 bp, human
ggaaccgtcgtggggaagga

SEQ ID NO: 337014 - DNA, 20 bp, human
gagggaggggcgggcaaaag

SEQ ID NO: 337015 - DNA, 20 bp, human
gaaaggggcagcggctttcc

SEQ ID NO: 337016 - DNA, 20 bp, human
gaagacggccccacggagcc

SEQ ID NO: 337017 - DNA, 20 bp, human
gcccgctgttcgtatgtccg

SEQ ID NO: 337018 - DNA, 20 bp, human
ggcggtgttcccggctccgt

SEQ ID NO: 337019 - DNA, 20 bp, human
gacctcggacatacgaacag

SEQ ID NO: 337020 - DNA, 20 bp, human
gccgaggtgacgccccgctg

SEQ ID NO: 337021 - DNA, 20 bp, human
gcttcccggcgagtccgcga

SEQ ID NO: 337022 - DNA, 20 bp, human
gctccgtggggccgtcttcc

SEQ ID NO: 337023 - DNA, 20 bp, human
gcgccgggaagacggcccca

SEQ ID NO: 337024 - DNA, 20 bp, human
ggcgaccgtcgcggactcgc

SEQ ID NO: 337025 - DNA, 20 bp, human
gacggtcgccgcccacggcg

SEQ ID NO: 337026 - DNA, 20 bp, human
ggctgcgcaggcttagggcg

SEQ ID NO: 337027 - DNA, 20 bp, human
gcgtcggggcaatagttaag

SEQ ID NO: 337028 - DNA, 20 bp, human
gagaccgggcgcgttgactc

SEQ ID NO: 337029 - DNA, 20 bp, human
gcgcgccgagagctctgctg

SEQ ID NO: 337030 - DNA, 20 bp, human
gagctctcggcgcgcaactg

SEQ ID NO: 337031 - DNA, 20 bp, human
ggttgtgcgttcttccgggc

SEQ ID NO: 337032 - DNA, 20 bp, human
ggatggttgtgcgttcttcc

SEQ ID NO: 337033 - DNA, 20 bp, human
gcggctgccggaagcgggtc

SEQ ID NO: 337034 - DNA, 20 bp, human
gagacggaatggcgcgacgt

SEQ ID NO: 337035 - DNA, 20 bp, human
gtcttcgaaaaaacctcgtc

SEQ ID NO: 337036 - DNA, 20 bp, human
gccagagggccacctcgaag

SEQ ID NO: 337037 - DNA, 20 bp, human
gtcgaggtggccctctggtc

SEQ ID NO: 337038 - DNA, 20 bp, human
gcatccgcgcctcttcgagg

SEQ ID NO: 337039 - DNA, 20 bp, human
ggggccacctcgaagaggcg

SEQ ID NO: 337040 - DNA, 20 bp, human
gagctcgagagtccgggaca

SEQ ID NO: 337041 - DNA, 20 bp, human
gtccgggacaaggtagacgc

SEQ ID NO: 337042 - DNA, 20 bp, human
ggtccggctttagaactctg

SEQ ID NO: 337043 - DNA, 20 bp, human
gttgtggagctcgagagtcc

SEQ ID NO: 337044 - DNA, 20 bp, human
gtcctgcgtctaccttgtcc

SEQ ID NO: 337045 - DNA, 20 bp, human
ggtgccgtaaagtagcgctg

SEQ ID NO: 337046 - DNA, 20 bp, human
ggtacagtgtggtaggacta

SEQ ID NO: 337047 - DNA, 20 bp, human
gccctcccgccgacatgctc

SEQ ID NO: 337048 - DNA, 20 bp, human
gtgagcctgcgcagtaggaa

SEQ ID NO: 337049 - DNA, 20 bp, human
gcggctggaaaacttcaccg

SEQ ID NO: 337050 - DNA, 20 bp, human
gagcttccggagcatgtcgg

SEQ ID NO: 337051 - DNA, 20 bp, human
gtaggactagggtaggaaac

SEQ ID NO: 337052 - DNA, 20 bp, human
gtggctcctgtgtgtggcgt

SEQ ID NO: 337053 - DNA, 20 bp, human
ggacatgctccggaagcttg

SEQ ID NO: 337054 - DNA, 20 bp, human
gggtaggaaactggacggca

SEQ ID NO: 337055 - DNA, 20 bp, human
gaacttcaccggggaatgtt

SEQ ID NO: 337056 - DNA, 20 bp, human
gaggactggaaatggggcgc

SEQ ID NO: 337057 - DNA, 20 bp, human
gcccgcagctcgctgctcgt

SEQ ID NO: 337058 - DNA, 20 bp, human
ggcggctgagaagaccgcgc

SEQ ID NO: 337059 - DNA, 20 bp, human
gcctccgctggaagaagaag

SEQ ID NO: 337060 - DNA, 20 bp, human
ggagacaggtagcagtacgg

SEQ ID NO: 337061 - DNA, 20 bp, human
gagaccgtccatccagagga

SEQ ID NO: 337062 - DNA, 20 bp, human
ggaaatggggcgcgggaaga

SEQ ID NO: 337063 - DNA, 20 bp, human
gaggggagacgtccgcttgc

SEQ ID NO: 337064 - DNA, 20 bp, human
gccagcggaggcgggatttc

SEQ ID NO: 337065 - DNA, 20 bp, human
gttgccgggaaatccggcac

SEQ ID NO: 337066 - DNA, 20 bp, human
gaaggcgtggagcggactga

SEQ ID NO: 337067 - DNA, 20 bp, human
gggaatgggcggagctgaag

SEQ ID NO: 337068 - DNA, 20 bp, human
gccaatcatggaggagtcgt

SEQ ID NO: 337069 - DNA, 20 bp, human
gcggggctagatcggggaga

SEQ ID NO: 337070 - DNA, 20 bp, human
ggccagatagcaaagattga

SEQ ID NO: 337071 - DNA, 20 bp, human
ggctggggcggggctagatc

SEQ ID NO: 337072 - DNA, 20 bp, human
gtctcgcgagactggagacc

SEQ ID NO: 337073 - DNA, 20 bp, human
gaggaagacgcctgcagagc

SEQ ID NO: 337074 - DNA, 20 bp, human
gaggcgcccacactcctgac

SEQ ID NO: 337075 - DNA, 20 bp, human
gctccatgattggtcagaga

SEQ ID NO: 337076 - DNA, 20 bp, human
gagacagagtggcccgtcgg

SEQ ID NO: 337077 - DNA, 20 bp, human
gggacaggggaccaagctgg

SEQ ID NO: 337078 - DNA, 20 bp, human
ggaccctggctcacctgcaa

SEQ ID NO: 337079 - DNA, 20 bp, human
ggggctggccccagtttgat

SEQ ID NO: 337080 - DNA, 20 bp, human
gagggtgaggggaataccgg

SEQ ID NO: 337081 - DNA, 20 bp, human
gccatctgccggcacctcgg

SEQ ID NO: 337082 - DNA, 20 bp, human
gcgggaggctgggtagttac

SEQ ID NO: 337083 - DNA, 20 bp, human
gcctggccaaacttccaccg

SEQ ID NO: 337084 - DNA, 20 bp, human
gcggcacctcggtggaagtt

SEQ ID NO: 337085 - DNA, 20 bp, human
gaccggggggtgaggttctc

SEQ ID NO: 337086 - DNA, 20 bp, human
ggaagcgaggtgcgtcacgt

SEQ ID NO: 337087 - DNA, 20 bp, human
ggctcgcgacggcgaaggag

SEQ ID NO: 337088 - DNA, 20 bp, human
gcctccacgtcagccgacgg

SEQ ID NO: 337089 - DNA, 20 bp, human
gacccgctccctcccgccgt

SEQ ID NO: 337090 - DNA, 20 bp, human
gccgcggctcgcgacggcga

SEQ ID NO: 337091 - DNA, 20 bp, human
gcgcccgcgagcctcggacg

SEQ ID NO: 337092 - DNA, 20 bp, human
ggggtggcggcgttgaagcg

SEQ ID NO: 337093 - DNA, 20 bp, human
ggggggcgggcgtgatcccg

SEQ ID NO: 337094 - DNA, 20 bp, human
ggcaacccccaccctggcgc

SEQ ID NO: 337095 - DNA, 20 bp, human
gggcgcacaacgaccctccc

SEQ ID NO: 337096 - DNA, 20 bp, human
gaggcaggctcgggaggtcc

SEQ ID NO: 337097 - DNA, 20 bp, human
gacctcccgagcctgcctcc

SEQ ID NO: 337098 - DNA, 20 bp, human
gcggggtccgggttccacga

SEQ ID NO: 337099 - DNA, 20 bp, human
gaggaaaccgagctgacgcg

SEQ ID NO: 337100 - DNA, 20 bp, human
ggcagacaacagagtgacgg

SEQ ID NO: 337101 - DNA, 20 bp, human
ggctgcgccgcggaacgctc

SEQ ID NO: 337102 - DNA, 20 bp, human
ggcgtgcccgcccagtcccc

SEQ ID NO: 337103 - DNA, 20 bp, human
gcaggtccagtcagtttctc

SEQ ID NO: 337104 - DNA, 20 bp, human
ggccttcctggaatcccgca

SEQ ID NO: 337105 - DNA, 20 bp, human
gaaccgagctgacgcggggc

SEQ ID NO: 337106 - DNA, 20 bp, human
gccacacctgggctcttaaa

SEQ ID NO: 337107 - DNA, 20 bp, human
gagagtctccccaaggtcaa

SEQ ID NO: 337108 - DNA, 20 bp, human
gagtggccctttaagagccc

SEQ ID NO: 337109 - DNA, 20 bp, human
gtggggagactctgttactt

SEQ ID NO: 337110 - DNA, 20 bp, human
gcctgaagctgcaacgatgg

SEQ ID NO: 337111 - DNA, 20 bp, human
gcagtgtttgacccacacct

SEQ ID NO: 337112 - DNA, 20 bp, human
gcatcctgaagctgcaacga

SEQ ID NO: 337113 - DNA, 20 bp, human
gcactctcccacaggcaccg

SEQ ID NO: 337114 - DNA, 20 bp, human
ggtaacctagggagtcggag

SEQ ID NO: 337115 - DNA, 20 bp, human
ggctaagtaacctagggagt

SEQ ID NO: 337116 - DNA, 20 bp, human
gtccgctgggagcttcgctg

SEQ ID NO: 337117 - DNA, 20 bp, human
ggcttcgctggggatctgaa

SEQ ID NO: 337118 - DNA, 20 bp, human
gcccgcagacgggagcaagc

SEQ ID NO: 337119 - DNA, 20 bp, human
ggaagtcacccgggcgcgga

SEQ ID NO: 337120 - DNA, 20 bp, human
gctactccagacccgcagac

SEQ ID NO: 337121 - DNA, 20 bp, human
ggcgcggagggacagcctag

SEQ ID NO: 337122 - DNA, 20 bp, human
gacgggagcaagcgggcgag

SEQ ID NO: 337123 - DNA, 20 bp, human
gatctgaaaggaagtcaccc

SEQ ID NO: 337124 - DNA, 20 bp, human
gaggaccgcggcggtgatcg

SEQ ID NO: 337125 - DNA, 20 bp, human
gggacagcctaggggccgtg

SEQ ID NO: 337126 - DNA, 20 bp, human
gcatataagagacaaaatca

SEQ ID NO: 337127 - DNA, 20 bp, human
gaagaaaatagcaaagccaa

SEQ ID NO: 337128 - DNA, 20 bp, human
gaaaagacacaatcaggaca

SEQ ID NO: 337129 - DNA, 20 bp, human
gtctctttgtgtagactgtt

SEQ ID NO: 337130 - DNA, 20 bp, human
gccttgtagggaaaacacgt

SEQ ID NO: 337131 - DNA, 20 bp, human
gagtttattcagtttaccct

SEQ ID NO: 337132 - DNA, 20 bp, human
gtttatcaggtcttcctagt

SEQ ID NO: 337133 - DNA, 20 bp, human
gcgtgggagaaatttttatc

SEQ ID NO: 337134 - DNA, 20 bp, human
gaagaatctgtagagcaaac

SEQ ID NO: 337135 - DNA, 20 bp, human
ggtaattgcttctgaataac

SEQ ID NO: 337136 - DNA, 20 bp, human
gagagctggtgggtctaagg

SEQ ID NO: 337137 - DNA, 20 bp, human
ggtactgggaggacacgaga

SEQ ID NO: 337138 - DNA, 20 bp, human
gacacgagagggagtaggca

SEQ ID NO: 337139 - DNA, 20 bp, human
gttagacccaccagctctga

SEQ ID NO: 337140 - DNA, 20 bp, human
gtcagagcgaccgcctgcgc

SEQ ID NO: 337141 - DNA, 20 bp, human
gccgctgtcgtcccggaaac

SEQ ID NO: 337142 - DNA, 20 bp, human
gcgctctgataaccgcatcc

SEQ ID NO: 337143 - DNA, 20 bp, human
gagggcgagtaaccagcttg

SEQ ID NO: 337144 - DNA, 20 bp, human
gtaaccgcatcccggtttcc

SEQ ID NO: 337145 - DNA, 20 bp, human
gcgtcccggaaaccgggatg

SEQ ID NO: 337146 - DNA, 20 bp, human
gaggccagacgtggggacta

SEQ ID NO: 337147 - DNA, 20 bp, human
ggggccggagcgacggaaag

SEQ ID NO: 337148 - DNA, 20 bp, human
gaagctgcgtatgcagaagg

SEQ ID NO: 337149 - DNA, 20 bp, human
gcgccggagaggccagacgt

SEQ ID NO: 337150 - DNA, 20 bp, human
gagaaagccttgcggcgagg

SEQ ID NO: 337151 - DNA, 20 bp, human
gctcaagctgcgtatgcaga

SEQ ID NO: 337152 - DNA, 20 bp, human
gcggaagtagtcgccttcct

SEQ ID NO: 337153 - DNA, 20 bp, human
gcccagaaagccttgcggcg

SEQ ID NO: 337154 - DNA, 20 bp, human
gtccggcccgcctcgccgca

SEQ ID NO: 337155 - DNA, 20 bp, human
gaagccgcgccgctatagcg

SEQ ID NO: 337156 - DNA, 20 bp, human
ggggccgcgtgggccccgga

SEQ ID NO: 337157 - DNA, 20 bp, human
gagcggggcggggacgccgt

SEQ ID NO: 337158 - DNA, 20 bp, human
ggcgcccgaggctgctatgg

SEQ ID NO: 337159 - DNA, 20 bp, human
ggccccggatggaggagctg

SEQ ID NO: 337160 - DNA, 20 bp, human
gccgcgtgggccccggatgg

SEQ ID NO: 337161 - DNA, 20 bp, human
gcggcggccatgttgactcc

SEQ ID NO: 337162 - DNA, 20 bp, human
gcgctcgcccggagtcaaca

SEQ ID NO: 337163 - DNA, 20 bp, human
gggggaggtcgggacgggca

SEQ ID NO: 337164 - DNA, 20 bp, human
gtgcgcgctggctccgccga

SEQ ID NO: 337165 - DNA, 20 bp, human
gcccgaggctgctatggcgg

SEQ ID NO: 337166 - DNA, 20 bp, human
gtcaggcggcgggaagaaca

SEQ ID NO: 337167 - DNA, 20 bp, human
gccgcccggccagactggaa

SEQ ID NO: 337168 - DNA, 20 bp, human
gagcagtgccgcagccgacg

SEQ ID NO: 337169 - DNA, 20 bp, human
gtcggccggctcctccctag

SEQ ID NO: 337170 - DNA, 20 bp, human
gcggctgcggcactgctaag

SEQ ID NO: 337171 - DNA, 20 bp, human
gaaccgcaccccgtcggctg

SEQ ID NO: 337172 - DNA, 20 bp, human
gggcagcttcccacgttctg

SEQ ID NO: 337173 - DNA, 20 bp, human
gccggccagactggaaaggc

SEQ ID NO: 337174 - DNA, 20 bp, human
gtgccgcagccgacggggtg

SEQ ID NO: 337175 - DNA, 20 bp, human
ggcacgagcgccatgatggg

SEQ ID NO: 337176 - DNA, 20 bp, human
gcgcgcccggcctgtcgctg

SEQ ID NO: 337177 - DNA, 20 bp, human
gaatccctgtacgccgaggt

SEQ ID NO: 337178 - DNA, 20 bp, human
ggctcccacctcggcgtaca

SEQ ID NO: 337179 - DNA, 20 bp, human
ggccgcgcgggaacccttgg

SEQ ID NO: 337180 - DNA, 20 bp, human
gccggcgagcgctggcctag

SEQ ID NO: 337181 - DNA, 20 bp, human
gcgaggagctgcgcacgcgc

SEQ ID NO: 337182 - DNA, 20 bp, human
ggcccccaagggttcccgcg

SEQ ID NO: 337183 - DNA, 20 bp, human
ggcccgaggggtgaactccc

SEQ ID NO: 337184 - DNA, 20 bp, human
gcccctcgggctcgtcagta

SEQ ID NO: 337185 - DNA, 20 bp, human
gaacaccgggaagcggaggt

SEQ ID NO: 337186 - DNA, 20 bp, human
gctgccctggggctgtcctc

SEQ ID NO: 337187 - DNA, 20 bp, human
gcgcccgtgggaaaagcagt

SEQ ID NO: 337188 - DNA, 20 bp, human
gggcgtcatctatagtccgg

SEQ ID NO: 337189 - DNA, 20 bp, human
gaacgctgccgaggagtagg

SEQ ID NO: 337190 - DNA, 20 bp, human
gggactatagatgacgcccg

SEQ ID NO: 337191 - DNA, 20 bp, human
gaagccgggagctcggccac

SEQ ID NO: 337192 - DNA, 20 bp, human
gttgtagtctggtaaggcgg

SEQ ID NO: 337193 - DNA, 20 bp, human
ggcccgccccgcctactcct

SEQ ID NO: 337194 - DNA, 20 bp, human
gggaaacgctgccgaggagt

SEQ ID NO: 337195 - DNA, 20 bp, human
gctaactccctacaactctg

SEQ ID NO: 337196 - DNA, 20 bp, human
gagcgcggggacgtacacgg

SEQ ID NO: 337197 - DNA, 20 bp, human
gaacgagaggagtgtggcct

SEQ ID NO: 337198 - DNA, 20 bp, human
ggggagcgcggggacgtaca

SEQ ID NO: 337199 - DNA, 20 bp, human
gcctcgggccgggcaacgcc

SEQ ID NO: 337200 - DNA, 20 bp, human
gcggggagggagcccgagcg

SEQ ID NO: 337201 - DNA, 20 bp, human
gccagctcgctccgggaccg

SEQ ID NO: 337202 - DNA, 20 bp, human
gccgacctcccgcgcgtgga

SEQ ID NO: 337203 - DNA, 20 bp, human
gaacagcctttcggcgcggg

SEQ ID NO: 337204 - DNA, 20 bp, human
gggccacgaagcaggaccgg

SEQ ID NO: 337205 - DNA, 20 bp, human
gacctcccgcgcgtggaagg

SEQ ID NO: 337206 - DNA, 20 bp, human
gacaggaagtgtggcactca

SEQ ID NO: 337207 - DNA, 20 bp, human
gttcatagatacaggaagtg

SEQ ID NO: 337208 - DNA, 20 bp, human
ggtgtggctttcatagatac

SEQ ID NO: 337209 - DNA, 20 bp, human
gtgggcgctgtggctcctac

SEQ ID NO: 337210 - DNA, 20 bp, human
gccggtctatcggtaaacac

SEQ ID NO: 337211 - DNA, 20 bp, human
gcactcagggatccgccttg

SEQ ID NO: 337212 - DNA, 20 bp, human
ggaaagccacacttccggct

SEQ ID NO: 337213 - DNA, 20 bp, human
gtaccgatagaccggaagtg

SEQ ID NO: 337214 - DNA, 20 bp, human
gctatcggtaaacacaggac

SEQ ID NO: 337215 - DNA, 20 bp, human
gtctatgaaagccacacttc

SEQ ID NO: 337216 - DNA, 20 bp, human
gagcccagagactcccacaa

SEQ ID NO: 337217 - DNA, 20 bp, human
gccgaggccgctggggaaca

SEQ ID NO: 337218 - DNA, 20 bp, human
gccgcagcctcgcgtggcgg

SEQ ID NO: 337219 - DNA, 20 bp, human
ggaggctgcggcgcacggta

SEQ ID NO: 337220 - DNA, 20 bp, human
gtaggggggaagaagtggtt

SEQ ID NO: 337221 - DNA, 20 bp, human
ggggccccagaaagtatcta

SEQ ID NO: 337222 - DNA, 20 bp, human
gtgtggggagggcgtttgga

SEQ ID NO: 337223 - DNA, 20 bp, human
gctcccttgtgggagtctct

SEQ ID NO: 337224 - DNA, 20 bp, human
gaggaaggcgggcgctttcc

SEQ ID NO: 337225 - DNA, 20 bp, human
gcaagcctggcaccagaagg

SEQ ID NO: 337226 - DNA, 20 bp, human
ggcgaccagtgaccctgacc

SEQ ID NO: 337227 - DNA, 20 bp, human
gtcgacctggttaactagaa

SEQ ID NO: 337228 - DNA, 20 bp, human
ggggaacctgcccactaagg

SEQ ID NO: 337229 - DNA, 20 bp, human
gtccgagcgcgtccaggtca

SEQ ID NO: 337230 - DNA, 20 bp, human
gaacccggaggttggcaggt

SEQ ID NO: 337231 - DNA, 20 bp, human
gaagtcaagcgggaacccgg

SEQ ID NO: 337232 - DNA, 20 bp, human
gaggcctgcccgtatagttc

SEQ ID NO: 337233 - DNA, 20 bp, human
gaccctgacctggacgcgct

SEQ ID NO: 337234 - DNA, 20 bp, human
ggtctcatctgagactgcac

SEQ ID NO: 337235 - DNA, 20 bp, human
ggtccggccctgaactatac

SEQ ID NO: 337236 - DNA, 20 bp, human
gccgagtcccgcaggcgggg

SEQ ID NO: 337237 - DNA, 20 bp, human
gacccgcggccgttggggag

SEQ ID NO: 337238 - DNA, 20 bp, human
gcagcccggcctcgccacga

SEQ ID NO: 337239 - DNA, 20 bp, human
gcccacggccccctgctcag

SEQ ID NO: 337240 - DNA, 20 bp, human
gctcaggggcagcgagaagg

SEQ ID NO: 337241 - DNA, 20 bp, human
gaggcggagggggagagtgt

SEQ ID NO: 337242 - DNA, 20 bp, human
gaagggcagcccgaggtgga

SEQ ID NO: 337243 - DNA, 20 bp, human
gttctcgctgcccctgagca

SEQ ID NO: 337244 - DNA, 20 bp, human
gcccgcggcacctgcacccg

SEQ ID NO: 337245 - DNA, 20 bp, human
ggcctctgggagacagggcg

SEQ ID NO: 337246 - DNA, 20 bp, human
gaggccctgtggtctgttat

SEQ ID NO: 337247 - DNA, 20 bp, human
gcacagggcctgagctaccg

SEQ ID NO: 337248 - DNA, 20 bp, human
gtgggcacagtagtcccaag

SEQ ID NO: 337249 - DNA, 20 bp, human
gatagcctataacagaccac

SEQ ID NO: 337250 - DNA, 20 bp, human
gaaccgaaagacaagacacc

SEQ ID NO: 337251 - DNA, 20 bp, human
ggactcccttctcttctctc

SEQ ID NO: 337252 - DNA, 20 bp, human
gcctggccttggcgcgtcac

SEQ ID NO: 337253 - DNA, 20 bp, human
gaatctctagaggtttgtcc

SEQ ID NO: 337254 - DNA, 20 bp, human
gtgtcttgtctttcggtttt

SEQ ID NO: 337255 - DNA, 20 bp, human
gggtctgttataggctatta

SEQ ID NO: 337256 - DNA, 20 bp, human
gtgtaacccaacagtgtata

SEQ ID NO: 337257 - DNA, 20 bp, human
gtaaagtccaaagtcatatg

SEQ ID NO: 337258 - DNA, 20 bp, human
ggtccaaagtcatatggggt

SEQ ID NO: 337259 - DNA, 20 bp, human
gtccagttgtgtcaggaaat

SEQ ID NO: 337260 - DNA, 20 bp, human
gcagaagtaccactggttaa

SEQ ID NO: 337261 - DNA, 20 bp, human
gattctgccagaagtaccac

SEQ ID NO: 337262 - DNA, 20 bp, human
gccccatttcctgacacaac

SEQ ID NO: 337263 - DNA, 20 bp, human
gattttcaacagttcagaca

SEQ ID NO: 337264 - DNA, 20 bp, human
gtgtagcttccaaaatagca

SEQ ID NO: 337265 - DNA, 20 bp, human
gacttgctatttctgcatat

SEQ ID NO: 337266 - DNA, 20 bp, human
gcccccacgcaatggcaagt

SEQ ID NO: 337267 - DNA, 20 bp, human
ggccccacttgccattgcgt

SEQ ID NO: 337268 - DNA, 20 bp, human
gaaaaaccctcacccaagtg

SEQ ID NO: 337269 - DNA, 20 bp, human
gagccaaggggttccagcag

SEQ ID NO: 337270 - DNA, 20 bp, human
gtgggggaagagaaacgcgc

SEQ ID NO: 337271 - DNA, 20 bp, human
gtaccccaacctaaccctca

SEQ ID NO: 337272 - DNA, 20 bp, human
gccactccccacttgggtga

SEQ ID NO: 337273 - DNA, 20 bp, human
gtaccttgagggttaggttg

SEQ ID NO: 337274 - DNA, 20 bp, human
gcagctcggaagatccacct

SEQ ID NO: 337275 - DNA, 20 bp, human
gcggggcggctgctggaacc

SEQ ID NO: 337276 - DNA, 20 bp, human
gcacgcccaacctgccaaac

SEQ ID NO: 337277 - DNA, 20 bp, human
ggcacagagaagctcattta

SEQ ID NO: 337278 - DNA, 20 bp, human
gtctgtgctaaacagaattc

SEQ ID NO: 337279 - DNA, 20 bp, human
gtcccctcaaattacagcta

SEQ ID NO: 337280 - DNA, 20 bp, human
gataacccttcagggtttga

SEQ ID NO: 337281 - DNA, 20 bp, human
gttggcaggttgggcgtgtt

SEQ ID NO: 337282 - DNA, 20 bp, human
ggagaagctcatttatggtt

SEQ ID NO: 337283 - DNA, 20 bp, human
gggaagcttttattcctgtt

SEQ ID NO: 337284 - DNA, 20 bp, human
gaaccttagctgtaatttga

SEQ ID NO: 337285 - DNA, 20 bp, human
gtattgctgatcagtatctt

SEQ ID NO: 337286 - DNA, 20 bp, human
gtgcccttaagcaagatggt

SEQ ID NO: 337287 - DNA, 20 bp, human
gcccggagcgagttccgacg

SEQ ID NO: 337288 - DNA, 20 bp, human
gcgctccgggcgtggattgg

SEQ ID NO: 337289 - DNA, 20 bp, human
gcgcggaagggttgtttcgg

SEQ ID NO: 337290 - DNA, 20 bp, human
gggcaaatgtatacgggaaa

SEQ ID NO: 337291 - DNA, 20 bp, human
gcgcccaccatcttgcttaa

SEQ ID NO: 337292 - DNA, 20 bp, human
gggagcgagttccgacgcgg

SEQ ID NO: 337293 - DNA, 20 bp, human
gtcggaactcgctccgggcg

SEQ ID NO: 337294 - DNA, 20 bp, human
gcttaagggcaaatgtatac

SEQ ID NO: 337295 - DNA, 20 bp, human
gatgcgcggaagggttgttt

SEQ ID NO: 337296 - DNA, 20 bp, human
gcggaagcgaaattgaggcg

SEQ ID NO: 337297 - DNA, 20 bp, human
gaagcagatgcgcaaagaag

SEQ ID NO: 337298 - DNA, 20 bp, human
ggggcggaaaagcaagacgc

SEQ ID NO: 337299 - DNA, 20 bp, human
gcagaagagggtaagagctg

SEQ ID NO: 337300 - DNA, 20 bp, human
gagcagggagtgggcaaata

SEQ ID NO: 337301 - DNA, 20 bp, human
gaagagggtaagagctgagg

SEQ ID NO: 337302 - DNA, 20 bp, human
gtcttctgccggaggagggg

SEQ ID NO: 337303 - DNA, 20 bp, human
gcgacggagaaaggagtcgg

SEQ ID NO: 337304 - DNA, 20 bp, human
gaggaaacgagattagttcg

SEQ ID NO: 337305 - DNA, 20 bp, human
gtctgcttccgggggattgt

SEQ ID NO: 337306 - DNA, 20 bp, human
gccgccctcgggccaatccc

SEQ ID NO: 337307 - DNA, 20 bp, human
ggggcccgggattggcccga

SEQ ID NO: 337308 - DNA, 20 bp, human
ggccgggctggcaacggtag

SEQ ID NO: 337309 - DNA, 20 bp, human
gcacacgggcgcgggttcgg

SEQ ID NO: 337310 - DNA, 20 bp, human
ggggagtcgcaaagagagtt

SEQ ID NO: 337311 - DNA, 20 bp, human
gaggaagagcggaatctctc

SEQ ID NO: 337312 - DNA, 20 bp, human
gggcggcagttgggctggca

SEQ ID NO: 337313 - DNA, 20 bp, human
gtcctctaccgttgccagcc

SEQ ID NO: 337314 - DNA, 20 bp, human
gaagagcggaatctctcggg

SEQ ID NO: 337315 - DNA, 20 bp, human
ggtcgcagccgggctggcaa

SEQ ID NO: 337316 - DNA, 20 bp, human
gtaggcgaactggggagtgt

SEQ ID NO: 337317 - DNA, 20 bp, human
ggcgaactggggagtgtggg

SEQ ID NO: 337318 - DNA, 20 bp, human
ggctagaggggcatcatccc

SEQ ID NO: 337319 - DNA, 20 bp, human
gatgatgcccctctagcggt

SEQ ID NO: 337320 - DNA, 20 bp, human
gaaaaacaacaggtcctcca

SEQ ID NO: 337321 - DNA, 20 bp, human
gcctctagcggtaggcgaac

SEQ ID NO: 337322 - DNA, 20 bp, human
ggcgagtgagcctcgaggga

SEQ ID NO: 337323 - DNA, 20 bp, human
gtgggcgcgagtgagcctcg

SEQ ID NO: 337324 - DNA, 20 bp, human
ggaccccaagcgccattgcg

SEQ ID NO: 337325 - DNA, 20 bp, human
gcaatggcgcttggggtccc

SEQ ID NO: 337326 - DNA, 20 bp, human
gcctctgcatctggatatga

SEQ ID NO: 337327 - DNA, 20 bp, human
gcatgctaactgaggggtgg

SEQ ID NO: 337328 - DNA, 20 bp, human
ggcggaggcgatgatgctga

SEQ ID NO: 337329 - DNA, 20 bp, human
gtcctgttttagcatagaga

SEQ ID NO: 337330 - DNA, 20 bp, human
gaggaagtgttgcagttacc

SEQ ID NO: 337331 - DNA, 20 bp, human
ggaagaatttagacgcacac

SEQ ID NO: 337332 - DNA, 20 bp, human
gaaattcttccgcttttctg

SEQ ID NO: 337333 - DNA, 20 bp, human
gaccctctctatgctaaaac

SEQ ID NO: 337334 - DNA, 20 bp, human
gttggggcctaaaatatcac

SEQ ID NO: 337335 - DNA, 20 bp, human
ggcacatgctaactgagggg

SEQ ID NO: 337336 - DNA, 20 bp, human
gtcgcaggtctcaaactgat

SEQ ID NO: 337337 - DNA, 20 bp, human
ggcacaacctgcatatctct

SEQ ID NO: 337338 - DNA, 20 bp, human
gaaggggcatcatgggatgt

SEQ ID NO: 337339 - DNA, 20 bp, human
gctaggaggcttaggaccca

SEQ ID NO: 337340 - DNA, 20 bp, human
gaatctaactgagccaagaa

SEQ ID NO: 337341 - DNA, 20 bp, human
ggaagagatgaaaaaccctg

SEQ ID NO: 337342 - DNA, 20 bp, human
gctgcgaggccgcatcccca

SEQ ID NO: 337343 - DNA, 20 bp, human
gagggagctatgcacccagg

SEQ ID NO: 337344 - DNA, 20 bp, human
ggcgctgcagcaagctagct

SEQ ID NO: 337345 - DNA, 20 bp, human
gtcagctgaaaggcgccccc

SEQ ID NO: 337346 - DNA, 20 bp, human
gacagccctggccaatcgga

SEQ ID NO: 337347 - DNA, 20 bp, human
gcgcgccgtccgattggcca

SEQ ID NO: 337348 - DNA, 20 bp, human
ggagctcatacgagtggcgg

SEQ ID NO: 337349 - DNA, 20 bp, human
gccaggagcggggattcccg

SEQ ID NO: 337350 - DNA, 20 bp, human
gggccctggtgctacgtcag

SEQ ID NO: 337351 - DNA, 20 bp, human
ggatgagctcatacgagtgg

SEQ ID NO: 337352 - DNA, 20 bp, human
gcgcctccgcgccgtccgat

SEQ ID NO: 337353 - DNA, 20 bp, human
gggccggcgtccctgagaaa

SEQ ID NO: 337354 - DNA, 20 bp, human
gcccgcgcgggtcctcgtcc

SEQ ID NO: 337355 - DNA, 20 bp, human
ggcggatgagctcatacgag

SEQ ID NO: 337356 - DNA, 20 bp, human
gccgtgcggacggaaagggg

SEQ ID NO: 337357 - DNA, 20 bp, human
ggagccgtgcggacggaaag

SEQ ID NO: 337358 - DNA, 20 bp, human
ggctggggggcggaaggcga

SEQ ID NO: 337359 - DNA, 20 bp, human
gctcccccactgccagccgc

SEQ ID NO: 337360 - DNA, 20 bp, human
ggccgcccggggcatccccg

SEQ ID NO: 337361 - DNA, 20 bp, human
ggagccggcggctggcagtg

SEQ ID NO: 337362 - DNA, 20 bp, human
gaacccctccgcctctgcgc

SEQ ID NO: 337363 - DNA, 20 bp, human
gccacaccaaccagagcccg

SEQ ID NO: 337364 - DNA, 20 bp, human
gacggctcgggcctccgagc

SEQ ID NO: 337365 - DNA, 20 bp, human
ggtggcaggaagggtccgcc

SEQ ID NO: 337366 - DNA, 20 bp, human
gagtgcaatcgggtcggcga

SEQ ID NO: 337367 - DNA, 20 bp, human
gagtcccgcgggattacgtt

SEQ ID NO: 337368 - DNA, 20 bp, human
gtagccgagtgcaatcgggt

SEQ ID NO: 337369 - DNA, 20 bp, human
ggagccgggcggatgaaccg

SEQ ID NO: 337370 - DNA, 20 bp, human
ggaggcggagcctgaggtaa

SEQ ID NO: 337371 - DNA, 20 bp, human
gagggatccgagactgggct

SEQ ID NO: 337372 - DNA, 20 bp, human
gcggcgagggatccgagact

SEQ ID NO: 337373 - DNA, 20 bp, human
gaggccgctcggaaccgtgg

SEQ ID NO: 337374 - DNA, 20 bp, human
gaaacgctcggctgtctcgg

SEQ ID NO: 337375 - DNA, 20 bp, human
gtcgggtgcccccttacctc

SEQ ID NO: 337376 - DNA, 20 bp, human
gtgggcccatctccgtgttg

SEQ ID NO: 337377 - DNA, 20 bp, human
gctactcccagcagctccaa

SEQ ID NO: 337378 - DNA, 20 bp, human
ggacgccgacctagggagac

SEQ ID NO: 337379 - DNA, 20 bp, human
gcagctgaggacgccgacct

SEQ ID NO: 337380 - DNA, 20 bp, human
gtcacccccaacacggagat

SEQ ID NO: 337381 - DNA, 20 bp, human
gacaagggagccaagggtgc

SEQ ID NO: 337382 - DNA, 20 bp, human
gtatccctgtctccctaggt

SEQ ID NO: 337383 - DNA, 20 bp, human
gcttggggccggtccctctc

SEQ ID NO: 337384 - DNA, 20 bp, human
gatacctggggcaggttctt

SEQ ID NO: 337385 - DNA, 20 bp, human
gtggaattccctgaatcact

SEQ ID NO: 337386 - DNA, 20 bp, human
ggcacgcgagccaggcgagg

SEQ ID NO: 337387 - DNA, 20 bp, human
gctcctctccttactcgtcc

SEQ ID NO: 337388 - DNA, 20 bp, human
gccggtacatcgaggcggga

SEQ ID NO: 337389 - DNA, 20 bp, human
gccacccaaccgcgccggga

SEQ ID NO: 337390 - DNA, 20 bp, human
ggaggcgggacggcgtggaa

SEQ ID NO: 337391 - DNA, 20 bp, human
gtgctcccggcactgactcc

SEQ ID NO: 337392 - DNA, 20 bp, human
gagagcgcggatggctgatt

SEQ ID NO: 337393 - DNA, 20 bp, human
gaggcgccacccaaccgcgc

SEQ ID NO: 337394 - DNA, 20 bp, human
gaatcccggtacatcgaggc

SEQ ID NO: 337395 - DNA, 20 bp, human
ggggtggcgcctcagcgggt

SEQ ID NO: 337396 - DNA, 20 bp, human
gctaccctggcaattcctca

SEQ ID NO: 337397 - DNA, 20 bp, human
ggaaggcgtggtcttacttt

SEQ ID NO: 337398 - DNA, 20 bp, human
gcgtgtctgagcagattcta

SEQ ID NO: 337399 - DNA, 20 bp, human
ggttgctaggaaactaggga

SEQ ID NO: 337400 - DNA, 20 bp, human
gaccggttgctaggaaacta

SEQ ID NO: 337401 - DNA, 20 bp, human
ggaactcccgggaaagcaac

SEQ ID NO: 337402 - DNA, 20 bp, human
gtactttgggcgagtctaca

SEQ ID NO: 337403 - DNA, 20 bp, human
ggggtaggaaaccggttgct

SEQ ID NO: 337404 - DNA, 20 bp, human
gctcacttcctgtcgccgag

SEQ ID NO: 337405 - DNA, 20 bp, human
gtaggaaactagggaaggcg

SEQ ID NO: 337406 - DNA, 20 bp, human
gcgcccggccccacatcctc

SEQ ID NO: 337407 - DNA, 20 bp, human
gacgctgccgggccgccagg

SEQ ID NO: 337408 - DNA, 20 bp, human
gcggcccggcagcgtcagcc

SEQ ID NO: 337409 - DNA, 20 bp, human
gcctctgggtcacgcccccg

SEQ ID NO: 337410 - DNA, 20 bp, human
gagacgccttgcggcctcgg

SEQ ID NO: 337411 - DNA, 20 bp, human
gcggggcggagcctgtcagg

SEQ ID NO: 337412 - DNA, 20 bp, human
gcactgccatggaccggcca

SEQ ID NO: 337413 - DNA, 20 bp, human
gctcagacgccttgcggcct

SEQ ID NO: 337414 - DNA, 20 bp, human
gtaacctccccttactcctt

SEQ ID NO: 337415 - DNA, 20 bp, human
gagagaaggaagcagctcgt

SEQ ID NO: 337416 - DNA, 20 bp, human
gcctcccaagagactccctc

SEQ ID NO: 337417 - DNA, 20 bp, human
gactccctctggtgttgacg

SEQ ID NO: 337418 - DNA, 20 bp, human
gtggccatgtccaggggtgg

SEQ ID NO: 337419 - DNA, 20 bp, human
gaagcatgacccacggtcac

SEQ ID NO: 337420 - DNA, 20 bp, human
gaaggacctccagtgaccgt

SEQ ID NO: 337421 - DNA, 20 bp, human
gaacaccagagggagtctct

SEQ ID NO: 337422 - DNA, 20 bp, human
ggaggtgcttgagggacatc

SEQ ID NO: 337423 - DNA, 20 bp, human
gtctaaagaagcatgaccca

SEQ ID NO: 337424 - DNA, 20 bp, human
gccctcctgccccataaaat

SEQ ID NO: 337425 - DNA, 20 bp, human
gctcccccgtcaacaccaga

SEQ ID NO: 337426 - DNA, 20 bp, human
gacgctcggatcagatgctc

SEQ ID NO: 337427 - DNA, 20 bp, human
ggatcaggacgactcgatct

SEQ ID NO: 337428 - DNA, 20 bp, human
ggtcacgcatgcggggtcaa

SEQ ID NO: 337429 - DNA, 20 bp, human
gagtccccctggcttcttcc

SEQ ID NO: 337430 - DNA, 20 bp, human
gctcacgcgcgcagtccccc

SEQ ID NO: 337431 - DNA, 20 bp, human
gaggacgactcgatctgggc

SEQ ID NO: 337432 - DNA, 20 bp, human
gtcccagcccggccgacgct

SEQ ID NO: 337433 - DNA, 20 bp, human
gcggcccccgggaaagattt

SEQ ID NO: 337434 - DNA, 20 bp, human
ggcatgcggggtcaacggat

SEQ ID NO: 337435 - DNA, 20 bp, human
gcgcgtgagcgtcacgcatg

SEQ ID NO: 337436 - DNA, 20 bp, human
ggtccccgtcctcctgccga

SEQ ID NO: 337437 - DNA, 20 bp, human
gcagccctgcccaaaggccg

SEQ ID NO: 337438 - DNA, 20 bp, human
gggaccgcggcctttgggca

SEQ ID NO: 337439 - DNA, 20 bp, human
gcagcccctcggcaggagga

SEQ ID NO: 337440 - DNA, 20 bp, human
gggggctgggcctgaccttg

SEQ ID NO: 337441 - DNA, 20 bp, human
gggcccagccccccaaggtc

SEQ ID NO: 337442 - DNA, 20 bp, human
gcgcagaaggacagagattc

SEQ ID NO: 337443 - DNA, 20 bp, human
ggcaccacgaccttgctcaa

SEQ ID NO: 337444 - DNA, 20 bp, human
ggacggggaccgcggccttt

SEQ ID NO: 337445 - DNA, 20 bp, human
gggaggcccttttgcaatag

SEQ ID NO: 337446 - DNA, 20 bp, human
gaacgtcgaaagcagccgtt

SEQ ID NO: 337447 - DNA, 20 bp, human
gaagcagccgttgggagccc

SEQ ID NO: 337448 - DNA, 20 bp, human
ggttcggaaaaaacgcagtc

SEQ ID NO: 337449 - DNA, 20 bp, human
ggacgccgtggttcttaaag

SEQ ID NO: 337450 - DNA, 20 bp, human
ggcgtggcgaggccgcctcg

SEQ ID NO: 337451 - DNA, 20 bp, human
gtgaccctgctgctggcgtt

SEQ ID NO: 337452 - DNA, 20 bp, human
gtggcgaggccgcctcgtgg

SEQ ID NO: 337453 - DNA, 20 bp, human
gttttccgaacgccagcagc

SEQ ID NO: 337454 - DNA, 20 bp, human
gccagggaggttggacgccg

SEQ ID NO: 337455 - DNA, 20 bp, human
gactgggaaagttccctcca

SEQ ID NO: 337456 - DNA, 20 bp, human
ggccccgcagccaggagtaa

SEQ ID NO: 337457 - DNA, 20 bp, human
ggaggggcgcggggcgtgag

SEQ ID NO: 337458 - DNA, 20 bp, human
ggaggcgggagctgggtgta

SEQ ID NO: 337459 - DNA, 20 bp, human
ggccgcgagggaggaaggat

SEQ ID NO: 337460 - DNA, 20 bp, human
gccgccccgcccagctctcg

SEQ ID NO: 337461 - DNA, 20 bp, human
gccttcccgccacgtcgtgg

SEQ ID NO: 337462 - DNA, 20 bp, human
ggaaaaggcgccaaaatgga

SEQ ID NO: 337463 - DNA, 20 bp, human
gccgagttatgcagatcaat

SEQ ID NO: 337464 - DNA, 20 bp, human
gccagctctcgcggtcagaa

SEQ ID NO: 337465 - DNA, 20 bp, human
ggcgcggccacagagcgcgc

SEQ ID NO: 337466 - DNA, 20 bp, human
gtgttgcgcggggttgttgt

SEQ ID NO: 337467 - DNA, 20 bp, human
ggcggggttgttgttggtag

SEQ ID NO: 337468 - DNA, 20 bp, human
gggcctgcatgtaaatgagg

SEQ ID NO: 337469 - DNA, 20 bp, human
gggggcccttgaaacgatga

SEQ ID NO: 337470 - DNA, 20 bp, human
gcggggcctgcatgtaaatg

SEQ ID NO: 337471 - DNA, 20 bp, human
ggtggtatgcaaataagaac

SEQ ID NO: 337472 - DNA, 20 bp, human
gaatgagggggcttgaggtg

SEQ ID NO: 337473 - DNA, 20 bp, human
ggcccttgaaacgatgaggg

SEQ ID NO: 337474 - DNA, 20 bp, human
gtacacgctcggttcttccg

SEQ ID NO: 337475 - DNA, 20 bp, human
gtgggcggggctgtcgccca

SEQ ID NO: 337476 - DNA, 20 bp, human
ggcctcgggcagaacgagga

SEQ ID NO: 337477 - DNA, 20 bp, human
ggccccgagcagggttcctg

SEQ ID NO: 337478 - DNA, 20 bp, human
ggaaccctgctcggggccgg

SEQ ID NO: 337479 - DNA, 20 bp, human
ggcagcttggcgcctgtctt

SEQ ID NO: 337480 - DNA, 20 bp, human
gacccccaggaaccctgctc

SEQ ID NO: 337481 - DNA, 20 bp, human
ggcgacctgcgcttgtcccg

SEQ ID NO: 337482 - DNA, 20 bp, human
gacgggatgcgcagacagcc

SEQ ID NO: 337483 - DNA, 20 bp, human
gccctcgcccgcccgaagac

SEQ ID NO: 337484 - DNA, 20 bp, human
gcgctagctggggagacggc

SEQ ID NO: 337485 - DNA, 20 bp, human
gcggagtgagagcgtgagcg

SEQ ID NO: 337486 - DNA, 20 bp, human
gcggggcgcagggataacgt

SEQ ID NO: 337487 - DNA, 20 bp, human
gggcgcagggataacgtggg

SEQ ID NO: 337488 - DNA, 20 bp, human
gaagccaatccggaccgtta

SEQ ID NO: 337489 - DNA, 20 bp, human
gcctggcggcgacgcccatt

SEQ ID NO: 337490 - DNA, 20 bp, human
ggggtagaagaaaggctggg

SEQ ID NO: 337491 - DNA, 20 bp, human
ggccgaggagagcgagtggg

SEQ ID NO: 337492 - DNA, 20 bp, human
gcccgcccactcgctctcct

SEQ ID NO: 337493 - DNA, 20 bp, human
ggctccctaacggtccggat

SEQ ID NO: 337494 - DNA, 20 bp, human
gcttctattgggtagaagaa

SEQ ID NO: 337495 - DNA, 20 bp, human
gggagccgaggagagcgagt

SEQ ID NO: 337496 - DNA, 20 bp, human
gggtccaagagccaaaggac

SEQ ID NO: 337497 - DNA, 20 bp, human
gagaacggtcaattgagatg

SEQ ID NO: 337498 - DNA, 20 bp, human
gcatggcggggcttctaaag

SEQ ID NO: 337499 - DNA, 20 bp, human
gtccggagccgcaataagaa

SEQ ID NO: 337500 - DNA, 20 bp, human
gggccgaaacaaaggcagag

SEQ ID NO: 337501 - DNA, 20 bp, human
gggaagcaggagtactgtgg

SEQ ID NO: 337502 - DNA, 20 bp, human
ggggggatctggtgcaaatt

SEQ ID NO: 337503 - DNA, 20 bp, human
gacaaaggccggattagggc

SEQ ID NO: 337504 - DNA, 20 bp, human
gccgcggggccgccagacaa

SEQ ID NO: 337505 - DNA, 20 bp, human
gccggaagcaggcacagctt

SEQ ID NO: 337506 - DNA, 20 bp, human
gagggcttgccggttcaggc

SEQ ID NO: 337507 - DNA, 20 bp, human
gcactttggacccacgtgga

SEQ ID NO: 337508 - DNA, 20 bp, human
gaaccggcaagccctccacg

SEQ ID NO: 337509 - DNA, 20 bp, human
gccgagtcggggaactgccg

SEQ ID NO: 337510 - DNA, 20 bp, human
gagtcggggaactgccgcgg

SEQ ID NO: 337511 - DNA, 20 bp, human
gacgtgggtccaaagtgcaa

SEQ ID NO: 337512 - DNA, 20 bp, human
gaaaaccgaggcatagtaag

SEQ ID NO: 337513 - DNA, 20 bp, human
gcgcaggcgcaggcgctggt

SEQ ID NO: 337514 - DNA, 20 bp, human
gaagggaaagtcactgctag

SEQ ID NO: 337515 - DNA, 20 bp, human
gggtcacaacaaacttgggg

SEQ ID NO: 337516 - DNA, 20 bp, human
gcctctgtggcctccgggtt

SEQ ID NO: 337517 - DNA, 20 bp, human
gaggccacagaggactgccc

SEQ ID NO: 337518 - DNA, 20 bp, human
gctccccgtagggtgaatgt

SEQ ID NO: 337519 - DNA, 20 bp, human
gggctgggcacaagatgccc

SEQ ID NO: 337520 - DNA, 20 bp, human
gaagaggcccaactccgtct

SEQ ID NO: 337521 - DNA, 20 bp, human
ggacccacattcaccctacg

SEQ ID NO: 337522 - DNA, 20 bp, human
gccacactgggtgcttcctt

SEQ ID NO: 337523 - DNA, 20 bp, human
gtgaagaccaagacggagtt

SEQ ID NO: 337524 - DNA, 20 bp, human
ggaagcacccagtgtgggta

SEQ ID NO: 337525 - DNA, 20 bp, human
gaagatgcccaggtcacttt

SEQ ID NO: 337526 - DNA, 20 bp, human
gcgcctgggcgtgtctgccg

SEQ ID NO: 337527 - DNA, 20 bp, human
gagcagggcggggcaacctg

SEQ ID NO: 337528 - DNA, 20 bp, human
gctccgcggcagacacgccc

SEQ ID NO: 337529 - DNA, 20 bp, human
gtattcgctcattggctaga

SEQ ID NO: 337530 - DNA, 20 bp, human
gagggcggggcaacctgggg

SEQ ID NO: 337531 - DNA, 20 bp, human
gcacgtgagcttatgctccg

SEQ ID NO: 337532 - DNA, 20 bp, human
gctcacgtggattacctgta

SEQ ID NO: 337533 - DNA, 20 bp, human
gcctcgccggcggactgcag

SEQ ID NO: 337534 - DNA, 20 bp, human
ggatgtgagtaaagcccgcc

SEQ ID NO: 337535 - DNA, 20 bp, human
gggagtacgtattcgctcat

SEQ ID NO: 337536 - DNA, 20 bp, human
ggaaagatcacgagtgggga

SEQ ID NO: 337537 - DNA, 20 bp, human
gacaaggaaagatcacgagt

SEQ ID NO: 337538 - DNA, 20 bp, human
ggctgccagggagatccatg

SEQ ID NO: 337539 - DNA, 20 bp, human
gaaagcagagaacacagctg

SEQ ID NO: 337540 - DNA, 20 bp, human
gaaaactggtgtatcttttg

SEQ ID NO: 337541 - DNA, 20 bp, human
ggaatgtcagcgtttgagag

SEQ ID NO: 337542 - DNA, 20 bp, human
gtgatgggtagtgactgcta

SEQ ID NO: 337543 - DNA, 20 bp, human
gtacacatagcacttcagac

SEQ ID NO: 337544 - DNA, 20 bp, human
ggaatgggtgattcacctca

SEQ ID NO: 337545 - DNA, 20 bp, human
gctctgatgctgaaaaaata

SEQ ID NO: 337546 - DNA, 20 bp, human
ggcgggaaggcgcagcctaa

SEQ ID NO: 337547 - DNA, 20 bp, human
ggcgcggcagctggaccgtt

SEQ ID NO: 337548 - DNA, 20 bp, human
gcgggccgccccctgtgcgc

SEQ ID NO: 337549 - DNA, 20 bp, human
gtgcccgcggaggaggccgt

SEQ ID NO: 337550 - DNA, 20 bp, human
ggtcgcccgcgcacaggggg

SEQ ID NO: 337551 - DNA, 20 bp, human
gaacccacggcctcctccgc

SEQ ID NO: 337552 - DNA, 20 bp, human
ggcagggagcgaacgcccgg

SEQ ID NO: 337553 - DNA, 20 bp, human
ggaggtcgcccgcgcacagg

SEQ ID NO: 337554 - DNA, 20 bp, human
gcgccggcgtcatgacgcag

SEQ ID NO: 337555 - DNA, 20 bp, human
gtgggcagagtgaggaggtt

SEQ ID NO: 337556 - DNA, 20 bp, human
gcccaccccgggggagagga

SEQ ID NO: 337557 - DNA, 20 bp, human
gcgtaccatgcccaccccgg

SEQ ID NO: 337558 - DNA, 20 bp, human
gggacgtaccatgcccaccc

SEQ ID NO: 337559 - DNA, 20 bp, human
gggggcggacggaaccaccg

SEQ ID NO: 337560 - DNA, 20 bp, human
gacgggccgtaccacgcgga

SEQ ID NO: 337561 - DNA, 20 bp, human
gcggacggaaccaccggggc

SEQ ID NO: 337562 - DNA, 20 bp, human
gggaaccaccggggcggggt

SEQ ID NO: 337563 - DNA, 20 bp, human
gcggctgcaccgcccggggg

SEQ ID NO: 337564 - DNA, 20 bp, human
ggggtgggaggtaacgggac

SEQ ID NO: 337565 - DNA, 20 bp, human
ggccccccaacgccagggtt

SEQ ID NO: 337566 - DNA, 20 bp, human
gctggcctgattgactccca

SEQ ID NO: 337567 - DNA, 20 bp, human
gactgagcggacattggggc

SEQ ID NO: 337568 - DNA, 20 bp, human
gtacagggatcccgcacgcc

SEQ ID NO: 337569 - DNA, 20 bp, human
gcgaacagggcgaggcagga

SEQ ID NO: 337570 - DNA, 20 bp, human
gcggacgcgcgaacagggcg

SEQ ID NO: 337571 - DNA, 20 bp, human
gccaatgtccgctcagtgtg

SEQ ID NO: 337572 - DNA, 20 bp, human
gggacagcggacgcgcgaac

SEQ ID NO: 337573 - DNA, 20 bp, human
ggcccctcgaactgtcaact

SEQ ID NO: 337574 - DNA, 20 bp, human
ggattgactcccaaggtcta

SEQ ID NO: 337575 - DNA, 20 bp, human
gaggcgcccgaccccggaag

SEQ ID NO: 337576 - DNA, 20 bp, human
gtccacccgtggactcgtca

SEQ ID NO: 337577 - DNA, 20 bp, human
ggctaatggtcacgtgaggt

SEQ ID NO: 337578 - DNA, 20 bp, human
ggacctgccgagccaccgta

SEQ ID NO: 337579 - DNA, 20 bp, human
ggccctgacgagtccacggg

SEQ ID NO: 337580 - DNA, 20 bp, human
gggttggccgacagtcccta

SEQ ID NO: 337581 - DNA, 20 bp, human
gcacgccctgacgagtccac

SEQ ID NO: 337582 - DNA, 20 bp, human
gcgcgcacatcttccacccg

SEQ ID NO: 337583 - DNA, 20 bp, human
gcatgcgcccgaccttctcg

SEQ ID NO: 337584 - DNA, 20 bp, human
gggtggaagatgtgcgcgcg

SEQ ID NO: 337585 - DNA, 20 bp, human
gtggccgacagtccctacgg

SEQ ID NO: 337586 - DNA, 20 bp, human
gcccgcaagccctgcagcga

SEQ ID NO: 337587 - DNA, 20 bp, human
gcccactgcggctgaagctc

SEQ ID NO: 337588 - DNA, 20 bp, human
gccctgcagcgaaggcagac

SEQ ID NO: 337589 - DNA, 20 bp, human
gtcagccggtgtgtggggac

SEQ ID NO: 337590 - DNA, 20 bp, human
gaggcacccgccaattccag

SEQ ID NO: 337591 - DNA, 20 bp, human
ggtgggctgggcgtctcagc

SEQ ID NO: 337592 - DNA, 20 bp, human
ggggcgtctcagccggtgtg

SEQ ID NO: 337593 - DNA, 20 bp, human
gccaaccccgctctcagtct

SEQ ID NO: 337594 - DNA, 20 bp, human
gcccacagccctgtttcgca

SEQ ID NO: 337595 - DNA, 20 bp, human
ggctggcccagactgagagc

SEQ ID NO: 337596 - DNA, 20 bp, human
ggcggccaatcggggctcgg

SEQ ID NO: 337597 - DNA, 20 bp, human
ggagtgccccctcgcgccca

SEQ ID NO: 337598 - DNA, 20 bp, human
gctcgccattccatcgtatt

SEQ ID NO: 337599 - DNA, 20 bp, human
gcccacccctgggcgcgagg

SEQ ID NO: 337600 - DNA, 20 bp, human
gggggcactcgaggcgctcc

SEQ ID NO: 337601 - DNA, 20 bp, human
gtacgatggaatggcgagcc

SEQ ID NO: 337602 - DNA, 20 bp, human
gcccgcccccgagccccgat

SEQ ID NO: 337603 - DNA, 20 bp, human
gctggctgcgggtcgcaagc

SEQ ID NO: 337604 - DNA, 20 bp, human
gcgcgcggccaatcggggct

SEQ ID NO: 337605 - DNA, 20 bp, human
gctgacctaatacgatggaa

SEQ ID NO: 337606 - DNA, 20 bp, human
gcactggtggctgccggcaa

SEQ ID NO: 337607 - DNA, 20 bp, human
ggagggatggagtgtgaaca

SEQ ID NO: 337608 - DNA, 20 bp, human
ggacctgcctgatgcaacct

SEQ ID NO: 337609 - DNA, 20 bp, human
gaatctaaagggtagtggag

SEQ ID NO: 337610 - DNA, 20 bp, human
gggaaagtgtagagactcga

SEQ ID NO: 337611 - DNA, 20 bp, human
gtggcctagcccatcctctc

SEQ ID NO: 337612 - DNA, 20 bp, human
gctgcctgatgcaacctggg

SEQ ID NO: 337613 - DNA, 20 bp, human
ggcaccagtagaaacagcac

SEQ ID NO: 337614 - DNA, 20 bp, human
gaaacagcactggtggctgc

SEQ ID NO: 337615 - DNA, 20 bp, human
gggggtggccctgaagccaa

SEQ ID NO: 337616 - DNA, 20 bp, human
ggaaagccacagggatgcaa

SEQ ID NO: 337617 - DNA, 20 bp, human
gacccagctctgctccgcag

SEQ ID NO: 337618 - DNA, 20 bp, human
gtgaagaggggaaaaccagc

SEQ ID NO: 337619 - DNA, 20 bp, human
ggggaggtgggtcttattct

SEQ ID NO: 337620 - DNA, 20 bp, human
gccacagggatgcaagggtg

SEQ ID NO: 337621 - DNA, 20 bp, human
gaggcaggggccaattggga

SEQ ID NO: 337622 - DNA, 20 bp, human
gacagaaagggcagagtgag

SEQ ID NO: 337623 - DNA, 20 bp, human
gagctctgctccgcagggga

SEQ ID NO: 337624 - DNA, 20 bp, human
gccggtgcccagtatggtct

SEQ ID NO: 337625 - DNA, 20 bp, human
gtcccggctaaaggacgagg

SEQ ID NO: 337626 - DNA, 20 bp, human
gagtggagtgacattcccga

SEQ ID NO: 337627 - DNA, 20 bp, human
gctggcctgggagaggcgta

SEQ ID NO: 337628 - DNA, 20 bp, human
gtccgccctacgcctctccc

SEQ ID NO: 337629 - DNA, 20 bp, human
gtcccgagggcggagcccca

SEQ ID NO: 337630 - DNA, 20 bp, human
ggggagtctacgggtctcgg

SEQ ID NO: 337631 - DNA, 20 bp, human
gggcgggaggcgggagtcta

SEQ ID NO: 337632 - DNA, 20 bp, human
ggcctgggagaggcgtaggg

SEQ ID NO: 337633 - DNA, 20 bp, human
gagactgagccacctgtccc

SEQ ID NO: 337634 - DNA, 20 bp, human
ggcggccggcggcctagagg

SEQ ID NO: 337635 - DNA, 20 bp, human
gctccgccggctgggtgaca

SEQ ID NO: 337636 - DNA, 20 bp, human
ggtagcctgagtcagccgga

SEQ ID NO: 337637 - DNA, 20 bp, human
ggggatgagttgccaaagag

SEQ ID NO: 337638 - DNA, 20 bp, human
gtgccctgcccaggcaccaa

SEQ ID NO: 337639 - DNA, 20 bp, human
gctgagaaagccacagtccg

SEQ ID NO: 337640 - DNA, 20 bp, human
gggcatgggtcctcggactg

SEQ ID NO: 337641 - DNA, 20 bp, human
gcagaccctccggctgactc

SEQ ID NO: 337642 - DNA, 20 bp, human
gagggtgcccacccgtgcat

SEQ ID NO: 337643 - DNA, 20 bp, human
gacccaggctcagaaatcag

SEQ ID NO: 337644 - DNA, 20 bp, human
gtggaggtaagtcgtgttgt

SEQ ID NO: 337645 - DNA, 20 bp, human
ggtgtagtggccatggtggt

SEQ ID NO: 337646 - DNA, 20 bp, human
gttaaaggggccctcgggtt

SEQ ID NO: 337647 - DNA, 20 bp, human
gtgggcccggctgctcccaa

SEQ ID NO: 337648 - DNA, 20 bp, human
gagggcccctttaagaggaa

SEQ ID NO: 337649 - DNA, 20 bp, human
gaagccttggggcgagtggg

SEQ ID NO: 337650 - DNA, 20 bp, human
gcccggagccgggaagcctt

SEQ ID NO: 337651 - DNA, 20 bp, human
gggggcggcagctttaaggg

SEQ ID NO: 337652 - DNA, 20 bp, human
ggcagctttaagggtggctg

SEQ ID NO: 337653 - DNA, 20 bp, human
gcccactcaaccagcaaggt

SEQ ID NO: 337654 - DNA, 20 bp, human
gggctccgggagcgccccta

SEQ ID NO: 337655 - DNA, 20 bp, human
ggggaagccttggggcgagt

SEQ ID NO: 337656 - DNA, 20 bp, human
ggatgaggagcttgcaagaa

SEQ ID NO: 337657 - DNA, 20 bp, human
gccaaagatttcatcctctc

SEQ ID NO: 337658 - DNA, 20 bp, human
gaggatgaaatctttggctt

SEQ ID NO: 337659 - DNA, 20 bp, human
ggggcttccagggctgtcat

SEQ ID NO: 337660 - DNA, 20 bp, human
ggtcttgaggtgacacgagg

SEQ ID NO: 337661 - DNA, 20 bp, human
gcacctcaagacagccagag

SEQ ID NO: 337662 - DNA, 20 bp, human
ggctgtcttgaggtgacacg

SEQ ID NO: 337663 - DNA, 20 bp, human
gttctgtggagaggagttta

SEQ ID NO: 337664 - DNA, 20 bp, human
gccagggctgtcataggcag

SEQ ID NO: 337665 - DNA, 20 bp, human
gcaaggccaagccacttcct

SEQ ID NO: 337666 - DNA, 20 bp, human
gaaggctccatcctcgtcgg

SEQ ID NO: 337667 - DNA, 20 bp, human
ggctgctgttccagcttcct

SEQ ID NO: 337668 - DNA, 20 bp, human
ggtgtgctgagtaaactcac

SEQ ID NO: 337669 - DNA, 20 bp, human
gcatgcgcgtggggagaagg

SEQ ID NO: 337670 - DNA, 20 bp, human
ggcgaaggctccatcctcgt

SEQ ID NO: 337671 - DNA, 20 bp, human
gtggagtcatatacgaactc

SEQ ID NO: 337672 - DNA, 20 bp, human
gcaaagaaacgtggcgatca

SEQ ID NO: 337673 - DNA, 20 bp, human
ggcgcatgcgcgtggggaga

SEQ ID NO: 337674 - DNA, 20 bp, human
gggtcgagcggaactgacgt

SEQ ID NO: 337675 - DNA, 20 bp, human
gcagcatccagcgccaggac

SEQ ID NO: 337676 - DNA, 20 bp, human
gcagccgcggggccccacct

SEQ ID NO: 337677 - DNA, 20 bp, human
gcgccgccgcggcccactta

SEQ ID NO: 337678 - DNA, 20 bp, human
gcagaaggcggagcagacta

SEQ ID NO: 337679 - DNA, 20 bp, human
gggcccacttaaggacggga

SEQ ID NO: 337680 - DNA, 20 bp, human
ggccgcggcccacttaagga

SEQ ID NO: 337681 - DNA, 20 bp, human
gggaaccgacagcgccgccg

SEQ ID NO: 337682 - DNA, 20 bp, human
ggcgctgtcggttccgaggt

SEQ ID NO: 337683 - DNA, 20 bp, human
gcgccctcccgtccttaagt

SEQ ID NO: 337684 - DNA, 20 bp, human
gggtgcgcgctgacgtcacg

SEQ ID NO: 337685 - DNA, 20 bp, human
gtgggccgcggcggcgctgt

SEQ ID NO: 337686 - DNA, 20 bp, human
ggcaggctgcgcaaccgcag

SEQ ID NO: 337687 - DNA, 20 bp, human
ggagcgtgcggcttctactg

SEQ ID NO: 337688 - DNA, 20 bp, human
gggtggggcacgaaactggg

SEQ ID NO: 337689 - DNA, 20 bp, human
gcggggtggggcacgaaact

SEQ ID NO: 337690 - DNA, 20 bp, human
ggggctcctcccttcagctt

SEQ ID NO: 337691 - DNA, 20 bp, human
gcagcctgccgaagagcgtg

SEQ ID NO: 337692 - DNA, 20 bp, human
gtggaggcctcgtgtgcccg

SEQ ID NO: 337693 - DNA, 20 bp, human
gctgacgcgactggtcgcgg

SEQ ID NO: 337694 - DNA, 20 bp, human
ggtagaagccgcacgctctt

SEQ ID NO: 337695 - DNA, 20 bp, human
gggcctcgtgtgcccggggt

SEQ ID NO: 337696 - DNA, 20 bp, human
gccagacggcggggctgctc

SEQ ID NO: 337697 - DNA, 20 bp, human
gggccccaggcacactgcat

SEQ ID NO: 337698 - DNA, 20 bp, human
gtagccccatccggccaatg

SEQ ID NO: 337699 - DNA, 20 bp, human
gcgccggccgggctccgctc

SEQ ID NO: 337700 - DNA, 20 bp, human
ggcgaggctgacatcagcag

SEQ ID NO: 337701 - DNA, 20 bp, human
gcggggagggtagccccatc

SEQ ID NO: 337702 - DNA, 20 bp, human
gggaccagaaacttcccaga

SEQ ID NO: 337703 - DNA, 20 bp, human
gcatgtctctgccagacggc

SEQ ID NO: 337704 - DNA, 20 bp, human
gtggagcacggcagcactca

SEQ ID NO: 337705 - DNA, 20 bp, human
gccgggccaggcgaggtaac

SEQ ID NO: 337706 - DNA, 20 bp, human
ggccccgcctgcagcggagg

SEQ ID NO: 337707 - DNA, 20 bp, human
ggcagccccgcctgcagcgg

SEQ ID NO: 337708 - DNA, 20 bp, human
gggcgggcggatcgagagga

SEQ ID NO: 337709 - DNA, 20 bp, human
gcccccgggcagtgggaaaa

SEQ ID NO: 337710 - DNA, 20 bp, human
gaccccgccgactccgggaa

SEQ ID NO: 337711 - DNA, 20 bp, human
gtacacgcccaggcagaaac

SEQ ID NO: 337712 - DNA, 20 bp, human
ggtcacccagctacacgccc

SEQ ID NO: 337713 - DNA, 20 bp, human
gggcggatcgagaggaaggt

SEQ ID NO: 337714 - DNA, 20 bp, human
gtgtagctgggtgaccatag

SEQ ID NO: 337715 - DNA, 20 bp, human
gcccccggagcgccaggctc

SEQ ID NO: 337716 - DNA, 20 bp, human
gggaccaagaggattgaaca

SEQ ID NO: 337717 - DNA, 20 bp, human
ggtgggtctcccagttggat

SEQ ID NO: 337718 - DNA, 20 bp, human
ggggagacccacaatgccga

SEQ ID NO: 337719 - DNA, 20 bp, human
ggtcccctgttcaatcctct

SEQ ID NO: 337720 - DNA, 20 bp, human
ggggagaagcacaatgggag

SEQ ID NO: 337721 - DNA, 20 bp, human
gggagaggaggtgagacacc

SEQ ID NO: 337722 - DNA, 20 bp, human
gacaggggacatctgactaa

SEQ ID NO: 337723 - DNA, 20 bp, human
gacccagcccaggacgattc

SEQ ID NO: 337724 - DNA, 20 bp, human
gacaatgccgatggaccaag

SEQ ID NO: 337725 - DNA, 20 bp, human
gtctcccagttggattggtg

SEQ ID NO: 337726 - DNA, 20 bp, human
gaaggcccggtctacacctg

SEQ ID NO: 337727 - DNA, 20 bp, human
gcaacggtgcaactttgagc

SEQ ID NO: 337728 - DNA, 20 bp, human
gccagcctcaggtgtagacc

SEQ ID NO: 337729 - DNA, 20 bp, human
ggggcctttcctctgtgcta

SEQ ID NO: 337730 - DNA, 20 bp, human
gggtgaataccatagcacag

SEQ ID NO: 337731 - DNA, 20 bp, human
gcactcagagtctccccctt

SEQ ID NO: 337732 - DNA, 20 bp, human
gagcctctcacttgtccttt

SEQ ID NO: 337733 - DNA, 20 bp, human
ggacatcactacatcccaag

SEQ ID NO: 337734 - DNA, 20 bp, human
ggtctgagccatgccattag

SEQ ID NO: 337735 - DNA, 20 bp, human
gtactcactgtgtcagtacc

SEQ ID NO: 337736 - DNA, 20 bp, human
gcggccaccgcagcgcgcga

SEQ ID NO: 337737 - DNA, 20 bp, human
ggggagggactgacgaagga

SEQ ID NO: 337738 - DNA, 20 bp, human
ggccggggagggactgacga

SEQ ID NO: 337739 - DNA, 20 bp, human
gctctggcccgcagtgtctc

SEQ ID NO: 337740 - DNA, 20 bp, human
gtccgcgtctctgagcccct

SEQ ID NO: 337741 - DNA, 20 bp, human
gacactgcgggccagagacg

SEQ ID NO: 337742 - DNA, 20 bp, human
gggccagaacgccgaggtgg

SEQ ID NO: 337743 - DNA, 20 bp, human
gcgcccctcgcgcgctgcgg

SEQ ID NO: 337744 - DNA, 20 bp, human
ggagacagcccgagacactg

SEQ ID NO: 337745 - DNA, 20 bp, human
gcagagacggggccctggac

SEQ ID NO: 337746 - DNA, 20 bp, human
gagggcggtgcggacggaga

SEQ ID NO: 337747 - DNA, 20 bp, human
gcggacggagatgggcggga

SEQ ID NO: 337748 - DNA, 20 bp, human
gggtgcggacggagatgggc

SEQ ID NO: 337749 - DNA, 20 bp, human
gggggccgacgtgccgaagg

SEQ ID NO: 337750 - DNA, 20 bp, human
ggcgtggtacgggtagaaag

SEQ ID NO: 337751 - DNA, 20 bp, human
gcccgcctccttcggcacgt

SEQ ID NO: 337752 - DNA, 20 bp, human
gcctgcgtcgggttaagagg

SEQ ID NO: 337753 - DNA, 20 bp, human
ggataggctgtaggtgaaaa

SEQ ID NO: 337754 - DNA, 20 bp, human
gggtacgggtagaaaggggc

SEQ ID NO: 337755 - DNA, 20 bp, human
ggatgtggacagatgatagg

SEQ ID NO: 337756 - DNA, 20 bp, human
ggacacaccgagttctccct

SEQ ID NO: 337757 - DNA, 20 bp, human
gggagaactcggtgtgtcac

SEQ ID NO: 337758 - DNA, 20 bp, human
gcggcggcgcgggcggcttg

SEQ ID NO: 337759 - DNA, 20 bp, human
gctggcctgcgagtcccggg

SEQ ID NO: 337760 - DNA, 20 bp, human
gcatctggcctgcgagtccc

SEQ ID NO: 337761 - DNA, 20 bp, human
gcgcagggactgctggaacc

SEQ ID NO: 337762 - DNA, 20 bp, human
gcgccccggcgctggctcga

SEQ ID NO: 337763 - DNA, 20 bp, human
gacttcgaggcggccgagac

SEQ ID NO: 337764 - DNA, 20 bp, human
gcgagacgggagttgattct

SEQ ID NO: 337765 - DNA, 20 bp, human
gcagatgcgtttcttttgtg

SEQ ID NO: 337766 - DNA, 20 bp, human
gcaggacagtccctccaccg

SEQ ID NO: 337767 - DNA, 20 bp, human
gcgccccgagccgcggtgga

SEQ ID NO: 337768 - DNA, 20 bp, human
gcgcacccggagaagggtct

SEQ ID NO: 337769 - DNA, 20 bp, human
gcggctcggggcgtcctgat

SEQ ID NO: 337770 - DNA, 20 bp, human
gccggccccgcactgctgat

SEQ ID NO: 337771 - DNA, 20 bp, human
gacgtggctccgcaccaatc

SEQ ID NO: 337772 - DNA, 20 bp, human
ggtcagtcgcacccggagaa

SEQ ID NO: 337773 - DNA, 20 bp, human
gctcctcccagacccttctc

SEQ ID NO: 337774 - DNA, 20 bp, human
gtctacacaggcaagctccc

SEQ ID NO: 337775 - DNA, 20 bp, human
ggagccacgtcagtcgcacc

SEQ ID NO: 337776 - DNA, 20 bp, human
gcgccggggggagcgagcag

SEQ ID NO: 337777 - DNA, 20 bp, human
ggggccgaagagtcgggagc

SEQ ID NO: 337778 - DNA, 20 bp, human
ggaaaggaggaccagaaggg

SEQ ID NO: 337779 - DNA, 20 bp, human
gactgtgcagtggagtttgg

SEQ ID NO: 337780 - DNA, 20 bp, human
ggctccggctcccgactctt

SEQ ID NO: 337781 - DNA, 20 bp, human
ggccagcgggccgaagagtc

SEQ ID NO: 337782 - DNA, 20 bp, human
gcgggcgctgtgctcgctcc

SEQ ID NO: 337783 - DNA, 20 bp, human
gggcgacgagaaacgaggca

SEQ ID NO: 337784 - DNA, 20 bp, human
gacgagaaacgaggcagggg

SEQ ID NO: 337785 - DNA, 20 bp, human
gccggagccgggagagcgaa

SEQ ID NO: 337786 - DNA, 20 bp, human
gggccagagggcggggttct

SEQ ID NO: 337787 - DNA, 20 bp, human
ggacccctccctcaaaggcg

SEQ ID NO: 337788 - DNA, 20 bp, human
gagccacgggtaaaagggat

SEQ ID NO: 337789 - DNA, 20 bp, human
gggtctctgccacgtgggga

SEQ ID NO: 337790 - DNA, 20 bp, human
gctccaggccccgcctttga

SEQ ID NO: 337791 - DNA, 20 bp, human
gcaggccccgcctttgaggg

SEQ ID NO: 337792 - DNA, 20 bp, human
ggctgaagagcgcttctgat

SEQ ID NO: 337793 - DNA, 20 bp, human
gagcgcttctgattggccag

SEQ ID NO: 337794 - DNA, 20 bp, human
gcgccaagaaccccgccctc

SEQ ID NO: 337795 - DNA, 20 bp, human
gggagatccacagctggaaa

SEQ ID NO: 337796 - DNA, 20 bp, human
gaggcggtgttcatccgccc

SEQ ID NO: 337797 - DNA, 20 bp, human
gcaacaggcgctcttttccc

SEQ ID NO: 337798 - DNA, 20 bp, human
ggcgcgcgccacgccctcat

SEQ ID NO: 337799 - DNA, 20 bp, human
gcggatgaacaccgcctccc

SEQ ID NO: 337800 - DNA, 20 bp, human
gtgtccgggaggggccagac

SEQ ID NO: 337801 - DNA, 20 bp, human
gccagcgccgaaggcgaggt

SEQ ID NO: 337802 - DNA, 20 bp, human
gtgggttcccgagagagcca

SEQ ID NO: 337803 - DNA, 20 bp, human
gcatgtgcggggtgtctgtc

SEQ ID NO: 337804 - DNA, 20 bp, human
ggacctcccaggacctcctt

SEQ ID NO: 337805 - DNA, 20 bp, human
gcacgcgggcagcgagcaac

SEQ ID NO: 337806 - DNA, 20 bp, human
gcatgtgggccccggggcgt

SEQ ID NO: 337807 - DNA, 20 bp, human
gtggccaatgggctcatccc

SEQ ID NO: 337808 - DNA, 20 bp, human
gtgtgcaggggcggttcgtg

SEQ ID NO: 337809 - DNA, 20 bp, human
gccaatgggctcatccccgg

SEQ ID NO: 337810 - DNA, 20 bp, human
ggaggctcgtcctttccagc

SEQ ID NO: 337811 - DNA, 20 bp, human
gcaggggcggttcgtgcgga

SEQ ID NO: 337812 - DNA, 20 bp, human
gggcctcgaagagcggaaat

SEQ ID NO: 337813 - DNA, 20 bp, human
gtccagcaggttccctgtgc

SEQ ID NO: 337814 - DNA, 20 bp, human
gtccgctcttcgaggcctcc

SEQ ID NO: 337815 - DNA, 20 bp, human
gcaggttccctgtgcagggg

SEQ ID NO: 337816 - DNA, 20 bp, human
gggagagcgtccagttgaag

SEQ ID NO: 337817 - DNA, 20 bp, human
gacgtccgagtccgcccggt

SEQ ID NO: 337818 - DNA, 20 bp, human
ggtcgccctcgcactccccg

SEQ ID NO: 337819 - DNA, 20 bp, human
gtccccggggctgcgaagcc

SEQ ID NO: 337820 - DNA, 20 bp, human
gcaactggacgctctcctac

SEQ ID NO: 337821 - DNA, 20 bp, human
ggccaggcttcgcagccccg

SEQ ID NO: 337822 - DNA, 20 bp, human
gtggacgctctcctaccggg

SEQ ID NO: 337823 - DNA, 20 bp, human
gcgcagccccggggagtgcg

SEQ ID NO: 337824 - DNA, 20 bp, human
gctctcctaccgggcggact

SEQ ID NO: 337825 - DNA, 20 bp, human
gtggggtagaggtagccata

SEQ ID NO: 337826 - DNA, 20 bp, human
gggagcccgcctccttgatg

SEQ ID NO: 337827 - DNA, 20 bp, human
gcagctgctctccacaaatc

SEQ ID NO: 337828 - DNA, 20 bp, human
gtcgggcccaccctgatttg

SEQ ID NO: 337829 - DNA, 20 bp, human
ggctctccacaaatcagggt

SEQ ID NO: 337830 - DNA, 20 bp, human
gccccgccacatcaaggagg

SEQ ID NO: 337831 - DNA, 20 bp, human
gcgcccgccccgctgctgtc

SEQ ID NO: 337832 - DNA, 20 bp, human
gcccgcctccttgatgtggc

SEQ ID NO: 337833 - DNA, 20 bp, human
gtgccgcccccgccacatca

SEQ ID NO: 337834 - DNA, 20 bp, human
gcaaccataacacgtaacat

SEQ ID NO: 337835 - DNA, 20 bp, human
gtctctgtccaagagatcat

SEQ ID NO: 337836 - DNA, 20 bp, human
gaggagtgggctcacgtcaa

SEQ ID NO: 337837 - DNA, 20 bp, human
gcactcctcaggttctgatt

SEQ ID NO: 337838 - DNA, 20 bp, human
gcacgtcaatggttgggacg

SEQ ID NO: 337839 - DNA, 20 bp, human
gtgcgccgcggtggaggcga

SEQ ID NO: 337840 - DNA, 20 bp, human
gtgactggtcatctctgcta

SEQ ID NO: 337841 - DNA, 20 bp, human
gagtcccgccccttgcgccg

SEQ ID NO: 337842 - DNA, 20 bp, human
ggtactgcgacgtttgggga

SEQ ID NO: 337843 - DNA, 20 bp, human
gtgggctcacgtcaatggtt

SEQ ID NO: 337844 - DNA, 20 bp, human
gtacgcccaatcagaacctg

SEQ ID NO: 337845 - DNA, 20 bp, human
gaattggtgaactccccctg

SEQ ID NO: 337846 - DNA, 20 bp, human
gacaccgcggaagaaggatc

SEQ ID NO: 337847 - DNA, 20 bp, human
gggatccacaccgcggaaga

SEQ ID NO: 337848 - DNA, 20 bp, human
gctcccgcaatctccgtgcg

SEQ ID NO: 337849 - DNA, 20 bp, human
gtactgactcgggccgcgca

SEQ ID NO: 337850 - DNA, 20 bp, human
ggcccgtcgcactgcagagt

SEQ ID NO: 337851 - DNA, 20 bp, human
gcaccctgatccttcttccg

SEQ ID NO: 337852 - DNA, 20 bp, human
ggggagaaggatccacaccg

SEQ ID NO: 337853 - DNA, 20 bp, human
gactttagcctgcagcgggg

SEQ ID NO: 337854 - DNA, 20 bp, human
gaggctgcgggtactgactc

SEQ ID NO: 337855 - DNA, 20 bp, human
gcgcactttagcctgcagcg

SEQ ID NO: 337856 - DNA, 20 bp, human
gtgtcaaaagcacacttctt

SEQ ID NO: 337857 - DNA, 20 bp, human
gaaaagcacacttcttagga

SEQ ID NO: 337858 - DNA, 20 bp, human
gagcttcttcctacatcctc

SEQ ID NO: 337859 - DNA, 20 bp, human
ggtgcttttgacagacgtgg

SEQ ID NO: 337860 - DNA, 20 bp, human
ggaaacagatcactactcaa

SEQ ID NO: 337861 - DNA, 20 bp, human
gacaaaagctgtttctgctt

SEQ ID NO: 337862 - DNA, 20 bp, human
gagtgtgcttttgacagacg

SEQ ID NO: 337863 - DNA, 20 bp, human
ggaatttgtctgacagtgtt

SEQ ID NO: 337864 - DNA, 20 bp, human
gtcaagggagagactgtaca

SEQ ID NO: 337865 - DNA, 20 bp, human
ggtacttgtgacctcttatc

SEQ ID NO: 337866 - DNA, 20 bp, human
gagggaagatggatgacggg

SEQ ID NO: 337867 - DNA, 20 bp, human
ggactgaaagataagcagac

SEQ ID NO: 337868 - DNA, 20 bp, human
gctgtctttgcatcacataa

SEQ ID NO: 337869 - DNA, 20 bp, human
gtggatgacgggtggatgtg

SEQ ID NO: 337870 - DNA, 20 bp, human
gaattaataggctttggagc

SEQ ID NO: 337871 - DNA, 20 bp, human
ggaccatctgacaaattaat

SEQ ID NO: 337872 - DNA, 20 bp, human
gagctgccgctcggcacaat

SEQ ID NO: 337873 - DNA, 20 bp, human
gctgacaaattaataggctt

SEQ ID NO: 337874 - DNA, 20 bp, human
ggagagaatgggtatcattt

SEQ ID NO: 337875 - DNA, 20 bp, human
gacgaaacatacagccctca

SEQ ID NO: 337876 - DNA, 20 bp, human
gaaacagcccagcaccacat

SEQ ID NO: 337877 - DNA, 20 bp, human
gtgctaaaggcatattcggt

SEQ ID NO: 337878 - DNA, 20 bp, human
gggtaggtagacacagatgg

SEQ ID NO: 337879 - DNA, 20 bp, human
ggcagagatcaataaaacaa

SEQ ID NO: 337880 - DNA, 20 bp, human
gaattgggaacaatttacca

SEQ ID NO: 337881 - DNA, 20 bp, human
gttcggtaggtagacacaga

SEQ ID NO: 337882 - DNA, 20 bp, human
gtcagaacaagtattattct

SEQ ID NO: 337883 - DNA, 20 bp, human
ggcttgtaggacctgcacct

SEQ ID NO: 337884 - DNA, 20 bp, human
ggctgagtctaagctgcact

SEQ ID NO: 337885 - DNA, 20 bp, human
gaacaatggccctttttatc

SEQ ID NO: 337886 - DNA, 20 bp, human
gccgcctcgcccatccgccg

SEQ ID NO: 337887 - DNA, 20 bp, human
gtcagcgcgccgcggcggat

SEQ ID NO: 337888 - DNA, 20 bp, human
ggcgagcgcgcagaccgcgg

SEQ ID NO: 337889 - DNA, 20 bp, human
gcccgggctccggttccact

SEQ ID NO: 337890 - DNA, 20 bp, human
gcgggcgagcgcgcagaccg

SEQ ID NO: 337891 - DNA, 20 bp, human
ggaggcggggcgaggccaga

SEQ ID NO: 337892 - DNA, 20 bp, human
gcccgagtccgcgttccaag

SEQ ID NO: 337893 - DNA, 20 bp, human
gagagggaggcgggccaaag

SEQ ID NO: 337894 - DNA, 20 bp, human
gtccacttggaacgcggact

SEQ ID NO: 337895 - DNA, 20 bp, human
gccttcccgggaatggaacg

SEQ ID NO: 337896 - DNA, 20 bp, human
gcagccgaaaggggaggtga

SEQ ID NO: 337897 - DNA, 20 bp, human
gccaggggaccagccgaaag

SEQ ID NO: 337898 - DNA, 20 bp, human
gaaaggggaggtgagggaac

SEQ ID NO: 337899 - DNA, 20 bp, human
gggaggaaaaggcgatgctg

SEQ ID NO: 337900 - DNA, 20 bp, human
gccctggggcttgcagcaag

SEQ ID NO: 337901 - DNA, 20 bp, human
ggggagcggatgagaggaca

SEQ ID NO: 337902 - DNA, 20 bp, human
gaaggaccatcaatcctgtc

SEQ ID NO: 337903 - DNA, 20 bp, human
gaaagggccgacatggattg

SEQ ID NO: 337904 - DNA, 20 bp, human
gggacagctgaaggtgagac

SEQ ID NO: 337905 - DNA, 20 bp, human
gtgctcgcagatgtgcctgg

SEQ ID NO: 337906 - DNA, 20 bp, human
gcggctgcgccgcaggagcc

SEQ ID NO: 337907 - DNA, 20 bp, human
gctgctggggtctggtgcgg

SEQ ID NO: 337908 - DNA, 20 bp, human
ggaggcctttcgcccgaggc

SEQ ID NO: 337909 - DNA, 20 bp, human
gccgggaggcctttcgcccg

SEQ ID NO: 337910 - DNA, 20 bp, human
gctcgcgcaggcgtcagagc

SEQ ID NO: 337911 - DNA, 20 bp, human
gaggagctgggggctcgcgc

SEQ ID NO: 337912 - DNA, 20 bp, human
gactcgacaagtcgtcagcg

SEQ ID NO: 337913 - DNA, 20 bp, human
gccaacttctgggaataacc

SEQ ID NO: 337914 - DNA, 20 bp, human
ggcagcccgcctcgggcgaa

SEQ ID NO: 337915 - DNA, 20 bp, human
gtctgggaataacctggctg

SEQ ID NO: 337916 - DNA, 20 bp, human
gcccggcccgagcccgtcct

SEQ ID NO: 337917 - DNA, 20 bp, human
gtcagtcagcggggaaggcc

SEQ ID NO: 337918 - DNA, 20 bp, human
gtcccaggcccggacggccg

SEQ ID NO: 337919 - DNA, 20 bp, human
gggtcccccgagctccgtct

SEQ ID NO: 337920 - DNA, 20 bp, human
ggggacgagcagctaagtcc

SEQ ID NO: 337921 - DNA, 20 bp, human
gggctccgcgcccaacgcga

SEQ ID NO: 337922 - DNA, 20 bp, human
gacagcgggacctcctcccg

SEQ ID NO: 337923 - DNA, 20 bp, human
ggtcccgctgtcagtcagcg

SEQ ID NO: 337924 - DNA, 20 bp, human
gttccccgctgactgacagc

SEQ ID NO: 337925 - DNA, 20 bp, human
gcggctctgggccttataag

SEQ ID NO: 337926 - DNA, 20 bp, human
gacacacttggggacggaga

SEQ ID NO: 337927 - DNA, 20 bp, human
gcagctctgtggtctgcacg

SEQ ID NO: 337928 - DNA, 20 bp, human
gcggggatagtgagggtctt

SEQ ID NO: 337929 - DNA, 20 bp, human
gagggtcaggatggctcagg

SEQ ID NO: 337930 - DNA, 20 bp, human
gagggaaccgtgagatccct

SEQ ID NO: 337931 - DNA, 20 bp, human
gtgggcgcccagggatctca

SEQ ID NO: 337932 - DNA, 20 bp, human
ggcttggggtcagtcggcac

SEQ ID NO: 337933 - DNA, 20 bp, human
gcccaggaaggtctgactct

SEQ ID NO: 337934 - DNA, 20 bp, human
gagctgggacctcggagctt

SEQ ID NO: 337935 - DNA, 20 bp, human
gcgactgaccccaagctccg

SEQ ID NO: 337936 - DNA, 20 bp, human
gtccacccagtgagacaaac

SEQ ID NO: 337937 - DNA, 20 bp, human
gcactcaggctttttcctca

SEQ ID NO: 337938 - DNA, 20 bp, human
gcaaatcagcgattgaacag

SEQ ID NO: 337939 - DNA, 20 bp, human
gctggggcacatgcagtaag

SEQ ID NO: 337940 - DNA, 20 bp, human
gcaagagaaaggaccactag

SEQ ID NO: 337941 - DNA, 20 bp, human
gaatgcctgtttgtctcact

SEQ ID NO: 337942 - DNA, 20 bp, human
gggtctaaagaagtacagaa

SEQ ID NO: 337943 - DNA, 20 bp, human
gtacttaaaattcttatctg

SEQ ID NO: 337944 - DNA, 20 bp, human
ggctgggacacaaacgagtt

SEQ ID NO: 337945 - DNA, 20 bp, human
ggagagactgttcatgaatg

SEQ ID NO: 337946 - DNA, 20 bp, human
gtatggggacagccttggga

SEQ ID NO: 337947 - DNA, 20 bp, human
gttctcccgcgaaggttcca

SEQ ID NO: 337948 - DNA, 20 bp, human
gacacaccctggaaccttcg

SEQ ID NO: 337949 - DNA, 20 bp, human
gtgaaggggtaaacacgcgt

SEQ ID NO: 337950 - DNA, 20 bp, human
gtagggcgaaggcttactgt

SEQ ID NO: 337951 - DNA, 20 bp, human
gaggagcagcccgacagcag

SEQ ID NO: 337952 - DNA, 20 bp, human
gggcgggcccgcttcgtccc

SEQ ID NO: 337953 - DNA, 20 bp, human
gtggggaggattaatgacca

SEQ ID NO: 337954 - DNA, 20 bp, human
gaaaatagagaaggagacct

SEQ ID NO: 337955 - DNA, 20 bp, human
ggactggctcggggccggct

SEQ ID NO: 337956 - DNA, 20 bp, human
gcatgcagccggggtgacgg

SEQ ID NO: 337957 - DNA, 20 bp, human
gggggccgctcccgacccca

SEQ ID NO: 337958 - DNA, 20 bp, human
gtcgctgccccgcgaggttg

SEQ ID NO: 337959 - DNA, 20 bp, human
ggtgacgggggagcgctcgg

SEQ ID NO: 337960 - DNA, 20 bp, human
gaatgtggtgatccgtcccg

SEQ ID NO: 337961 - DNA, 20 bp, human
ggccccgctccccccgtggc

SEQ ID NO: 337962 - DNA, 20 bp, human
gctgcagcatcgctggatta

SEQ ID NO: 337963 - DNA, 20 bp, human
ggagcgctcccccgtcaccc

SEQ ID NO: 337964 - DNA, 20 bp, human
gaagagggtgggaaacccac

SEQ ID NO: 337965 - DNA, 20 bp, human
gatcgtcgagcgccgtttcc

SEQ ID NO: 337966 - DNA, 20 bp, human
ggggccaccgcatcactccc

SEQ ID NO: 337967 - DNA, 20 bp, human
ggagccgcgctcgtagcctg

SEQ ID NO: 337968 - DNA, 20 bp, human
gcgtgccccggggagtgatg

SEQ ID NO: 337969 - DNA, 20 bp, human
ggctacgagcgcggctcccc

SEQ ID NO: 337970 - DNA, 20 bp, human
gctccccggggcacgtgcca

SEQ ID NO: 337971 - DNA, 20 bp, human
gtaccgtggcacgtgccccg

SEQ ID NO: 337972 - DNA, 20 bp, human
gcaggcggtggcagctactc

SEQ ID NO: 337973 - DNA, 20 bp, human
gcgacgtcggaaagcaggaa

SEQ ID NO: 337974 - DNA, 20 bp, human
ggaactgggagtggcgggcg

SEQ ID NO: 337975 - DNA, 20 bp, human
gcgccactcccagttccctt

SEQ ID NO: 337976 - DNA, 20 bp, human
gggatggatcagccaaacta

SEQ ID NO: 337977 - DNA, 20 bp, human
gagccaaactagggcttgga

SEQ ID NO: 337978 - DNA, 20 bp, human
gtggcagaaagagtctctac

SEQ ID NO: 337979 - DNA, 20 bp, human
ggcacccttaagcatccaag

SEQ ID NO: 337980 - DNA, 20 bp, human
gttccttccaagccctagtt

SEQ ID NO: 337981 - DNA, 20 bp, human
gcaagtggctcattcggctc

SEQ ID NO: 337982 - DNA, 20 bp, human
ggaaagagtctctacaggag

SEQ ID NO: 337983 - DNA, 20 bp, human
ggcaatctggctcacactga

SEQ ID NO: 337984 - DNA, 20 bp, human
gaggaaaagagtgttttgtt

SEQ ID NO: 337985 - DNA, 20 bp, human
gaaaatatttagtgctctct

SEQ ID NO: 337986 - DNA, 20 bp, human
gggcagaggagggacgaagt

SEQ ID NO: 337987 - DNA, 20 bp, human
ggaggccaaggggaggtctt

SEQ ID NO: 337988 - DNA, 20 bp, human
ggcccggggaagatacggaa

SEQ ID NO: 337989 - DNA, 20 bp, human
gcccctccgcggctgcggaa

SEQ ID NO: 337990 - DNA, 20 bp, human
ggcgctacggcggctcggat

SEQ ID NO: 337991 - DNA, 20 bp, human
gctcaaatggggaccgtgcg

SEQ ID NO: 337992 - DNA, 20 bp, human
gaaggggacgcgaaccgtcc

SEQ ID NO: 337993 - DNA, 20 bp, human
gtcccgcggcactcgcgcta

SEQ ID NO: 337994 - DNA, 20 bp, human
gcactcgcgctacggcggct

SEQ ID NO: 337995 - DNA, 20 bp, human
ggcgaaggagggatccgggt

SEQ ID NO: 337996 - DNA, 20 bp, human
gtggctctggcctgcctata

SEQ ID NO: 337997 - DNA, 20 bp, human
gcagagagcaggccgttctg

SEQ ID NO: 337998 - DNA, 20 bp, human
ggggctccaggaggtaagaa

SEQ ID NO: 337999 - DNA, 20 bp, human
ggaaaaggggcacacccagt

SEQ ID NO: 338000 - DNA, 20 bp, human
gggccagagtccaggaacca

SEQ ID NO: 338001 - DNA, 20 bp, human
ggaaccacgggagtgccccg

SEQ ID NO: 338002 - DNA, 20 bp, human
gaaactgctggtcttatcta

SEQ ID NO: 338003 - DNA, 20 bp, human
gaagccacggggcactcccg

SEQ ID NO: 338004 - DNA, 20 bp, human
gccccgtggcttacatgctg

SEQ ID NO: 338005 - DNA, 20 bp, human
gacctcctggagccccaatc

SEQ ID NO: 338006 - DNA, 20 bp, human
gcggcggcggcggaacgcgc

SEQ ID NO: 338007 - DNA, 20 bp, human
ggggcgcagtcaccttcagg

SEQ ID NO: 338008 - DNA, 20 bp, human
gtcggtgggactaaattctg

SEQ ID NO: 338009 - DNA, 20 bp, human
gggcaggttgccctttcggt

SEQ ID NO: 338010 - DNA, 20 bp, human
ggtcgcccggagccgggatt

SEQ ID NO: 338011 - DNA, 20 bp, human
gtctgggaggaaagtcgctc

SEQ ID NO: 338012 - DNA, 20 bp, human
gcgcgggcaggttgcccttt

SEQ ID NO: 338013 - DNA, 20 bp, human
gcggggcggcggagggattg

SEQ ID NO: 338014 - DNA, 20 bp, human
gccgcagcgggataaccttg

SEQ ID NO: 338015 - DNA, 20 bp, human
gtgccccgccgcgtccccat

SEQ ID NO: 338016 - DNA, 20 bp, human
gcacgagggcacaggtcaac

SEQ ID NO: 338017 - DNA, 20 bp, human
gctgggaagtggtgcattat

SEQ ID NO: 338018 - DNA, 20 bp, human
gtaggggaggcagagcacga

SEQ ID NO: 338019 - DNA, 20 bp, human
gaggcagagcacgagggcac

SEQ ID NO: 338020 - DNA, 20 bp, human
gcaggattacacagtgtagt

SEQ ID NO: 338021 - DNA, 20 bp, human
gcccgcaaggacagtgagct

SEQ ID NO: 338022 - DNA, 20 bp, human
gtcggcacctgtatgaaaaa

SEQ ID NO: 338023 - DNA, 20 bp, human
gtgtagtaggttttcaactc

SEQ ID NO: 338024 - DNA, 20 bp, human
gagcaggcacctttcccgca

SEQ ID NO: 338025 - DNA, 20 bp, human
ggaaaaagggtaagtagggg

SEQ ID NO: 338026 - DNA, 20 bp, human
gggcgcgcacgcagcacgag

SEQ ID NO: 338027 - DNA, 20 bp, human
ggagcggcggggcggctcgg

SEQ ID NO: 338028 - DNA, 20 bp, human
gtgcgcagtgagcggcgggg

SEQ ID NO: 338029 - DNA, 20 bp, human
gcagcccgtcaggggtgccc

SEQ ID NO: 338030 - DNA, 20 bp, human
gtacgccagcccagcgaggg

SEQ ID NO: 338031 - DNA, 20 bp, human
gccccagtgcagcccgtcag

SEQ ID NO: 338032 - DNA, 20 bp, human
gcctacccggagtaaccctg

SEQ ID NO: 338033 - DNA, 20 bp, human
ggagcccgggcacccctgac

SEQ ID NO: 338034 - DNA, 20 bp, human
gcacccctgacgggctgcac

SEQ ID NO: 338035 - DNA, 20 bp, human
ggattctccgcgctggcccg

SEQ ID NO: 338036 - DNA, 20 bp, human
ggctcgggagaccgaggggg

SEQ ID NO: 338037 - DNA, 20 bp, human
gtccgggctcgggagaccga

SEQ ID NO: 338038 - DNA, 20 bp, human
ggggacccctcggcagcgtg

SEQ ID NO: 338039 - DNA, 20 bp, human
ggaaaggtggggagccgatg

SEQ ID NO: 338040 - DNA, 20 bp, human
gcgtctcgggacccggaaag

SEQ ID NO: 338041 - DNA, 20 bp, human
ggagcccggagcatccccat

SEQ ID NO: 338042 - DNA, 20 bp, human
gctgccgaggggtcccccat

SEQ ID NO: 338043 - DNA, 20 bp, human
gttcccgcgcgctccaatgg

SEQ ID NO: 338044 - DNA, 20 bp, human
gacccggaaagaggaaaggt

SEQ ID NO: 338045 - DNA, 20 bp, human
gaatgcaccggggtagggtg

SEQ ID NO: 338046 - DNA, 20 bp, human
gtcgcgcggggccaactcca

SEQ ID NO: 338047 - DNA, 20 bp, human
gagggagcaaggactgtccc

SEQ ID NO: 338048 - DNA, 20 bp, human
ggccaactccagggcatcta

SEQ ID NO: 338049 - DNA, 20 bp, human
gtgtccctagagaatgtcca

SEQ ID NO: 338050 - DNA, 20 bp, human
gtgtatccatgaggggacgc

SEQ ID NO: 338051 - DNA, 20 bp, human
ggcagccgagaggccctggt

SEQ ID NO: 338052 - DNA, 20 bp, human
gttcctctagatgaaaccca

SEQ ID NO: 338053 - DNA, 20 bp, human
gcccttagatgccctggagt

SEQ ID NO: 338054 - DNA, 20 bp, human
gcggagcctgcgtcccctca

SEQ ID NO: 338055 - DNA, 20 bp, human
ggcacactcaagtcagccct

SEQ ID NO: 338056 - DNA, 20 bp, human
gggggcggaggggttcccta

SEQ ID NO: 338057 - DNA, 20 bp, human
gctcggctggggtgaaaatg

SEQ ID NO: 338058 - DNA, 20 bp, human
ggggttccctagggcgaacg

SEQ ID NO: 338059 - DNA, 20 bp, human
ggactgggctcgagtctctg

SEQ ID NO: 338060 - DNA, 20 bp, human
gtcaccccagccgagtccaa

SEQ ID NO: 338061 - DNA, 20 bp, human
gcgagggcagccattggact

SEQ ID NO: 338062 - DNA, 20 bp, human
gcgacccgactccgcggcga

SEQ ID NO: 338063 - DNA, 20 bp, human
gcctagggcgaacgcggcga

SEQ ID NO: 338064 - DNA, 20 bp, human
gccactgcccctcatcgggc

SEQ ID NO: 338065 - DNA, 20 bp, human
gtgggctcgagtctctgggg

SEQ ID NO: 338066 - DNA, 20 bp, human
gaggaggcggccagctccac

SEQ ID NO: 338067 - DNA, 20 bp, human
gaggcccagcgcgttagagg

SEQ ID NO: 338068 - DNA, 20 bp, human
gtagaggggctcaaagttag

SEQ ID NO: 338069 - DNA, 20 bp, human
gaggggctcaaagttagagg

SEQ ID NO: 338070 - DNA, 20 bp, human
gcgacccggcaaccttcagg

SEQ ID NO: 338071 - DNA, 20 bp, human
gccaccggctgcacccggct

SEQ ID NO: 338072 - DNA, 20 bp, human
gctcccgcctctaacgcgct

SEQ ID NO: 338073 - DNA, 20 bp, human
gtcgcccagccgggtgcagc

SEQ ID NO: 338074 - DNA, 20 bp, human
gggctcaaagttagaggagg

SEQ ID NO: 338075 - DNA, 20 bp, human
gaggaggcccagcgcgttag

SEQ ID NO: 338076 - DNA, 20 bp, human
gcccgccgccgcgcagggag

SEQ ID NO: 338077 - DNA, 20 bp, human
gcggggcggggcctgatcgc

SEQ ID NO: 338078 - DNA, 20 bp, human
gggcggggcctgatcgctgg

SEQ ID NO: 338079 - DNA, 20 bp, human
gacgcccggcggtggggtta

SEQ ID NO: 338080 - DNA, 20 bp, human
gtgggggcacggcctagctc

SEQ ID NO: 338081 - DNA, 20 bp, human
gctcgggcgcggccggttgg

SEQ ID NO: 338082 - DNA, 20 bp, human
gcccgcccgcacccggagct

SEQ ID NO: 338083 - DNA, 20 bp, human
gcgacacagcctcgctcaat

SEQ ID NO: 338084 - DNA, 20 bp, human
ggggcggggcctgccggaga

SEQ ID NO: 338085 - DNA, 20 bp, human
ggcaaccgagggcgcggagg

SEQ ID NO: 338086 - DNA, 20 bp, human
ggcccgagagcctccggtag

SEQ ID NO: 338087 - DNA, 20 bp, human
gccggccgctgccaagtcgg

SEQ ID NO: 338088 - DNA, 20 bp, human
gggcccggccgctgccaagt

SEQ ID NO: 338089 - DNA, 20 bp, human
gcagcggccgggccgggagt

SEQ ID NO: 338090 - DNA, 20 bp, human
gggccgggccgggagtgggt

SEQ ID NO: 338091 - DNA, 20 bp, human
ggagaggggaggtgtgtgaa

SEQ ID NO: 338092 - DNA, 20 bp, human
ggagtgtctccctctaccgg

SEQ ID NO: 338093 - DNA, 20 bp, human
gcgggcctgctcctgcggca

SEQ ID NO: 338094 - DNA, 20 bp, human
gccctctaccggaggctctc

SEQ ID NO: 338095 - DNA, 20 bp, human
gaccggaggctctcgggcgg

SEQ ID NO: 338096 - DNA, 20 bp, human
ggggctgcgagtcccctgtg

SEQ ID NO: 338097 - DNA, 20 bp, human
ggcgcccagcgtcccacaca

SEQ ID NO: 338098 - DNA, 20 bp, human
ggacagaggggcgtctccct

SEQ ID NO: 338099 - DNA, 20 bp, human
gagtcccctgtgtgggacgc

SEQ ID NO: 338100 - DNA, 20 bp, human
gctgcagggcactgctgctg

SEQ ID NO: 338101 - DNA, 20 bp, human
gcgcggcccggtggagtggg

SEQ ID NO: 338102 - DNA, 20 bp, human
gaaaaaaagagcgagcagga

SEQ ID NO: 338103 - DNA, 20 bp, human
ggtaacccagtctactctaa

SEQ ID NO: 338104 - DNA, 20 bp, human
gtgcgacgtttcttgctcat

SEQ ID NO: 338105 - DNA, 20 bp, human
gcagagaccaaccccggcgg

SEQ ID NO: 338106 - DNA, 20 bp, human
gcacgcgcagtcgggcccgg

SEQ ID NO: 338107 - DNA, 20 bp, human
gggacgcccggccttccctg

SEQ ID NO: 338108 - DNA, 20 bp, human
gcgggcgggtacaagtctcc

SEQ ID NO: 338109 - DNA, 20 bp, human
gcggccgggcacgcgcagtc

SEQ ID NO: 338110 - DNA, 20 bp, human
ggggcccgactgcgcgtgcc

SEQ ID NO: 338111 - DNA, 20 bp, human
gccccctcctcagggaaggc

SEQ ID NO: 338112 - DNA, 20 bp, human
ggccgggcgtccggcccacg

SEQ ID NO: 338113 - DNA, 20 bp, human
ggaggggcgcggttcgcctg

SEQ ID NO: 338114 - DNA, 20 bp, human
gcccggcaggcggtatccgc

SEQ ID NO: 338115 - DNA, 20 bp, human
gcccgagcgagtagtatgtc

SEQ ID NO: 338116 - DNA, 20 bp, human
gcagccctgagcgcagctgg

SEQ ID NO: 338117 - DNA, 20 bp, human
ggtccccgtggccctgttgt

SEQ ID NO: 338118 - DNA, 20 bp, human
gaggggccgccgcctgctta

SEQ ID NO: 338119 - DNA, 20 bp, human
gcggggacacctggccaggt

SEQ ID NO: 338120 - DNA, 20 bp, human
gagaccgggccctttgtcgt

SEQ ID NO: 338121 - DNA, 20 bp, human
gcctgcttaaggtggaattt

SEQ ID NO: 338122 - DNA, 20 bp, human
gggcccggtctggcctttac

SEQ ID NO: 338123 - DNA, 20 bp, human
gtgggacctggggccatgca

SEQ ID NO: 338124 - DNA, 20 bp, human
gccgtggccctgttgtggga

SEQ ID NO: 338125 - DNA, 20 bp, human
gtgtcccagccccacgacaa

SEQ ID NO: 338126 - DNA, 20 bp, human
gaacgcccagctcatcggac

SEQ ID NO: 338127 - DNA, 20 bp, human
ggcagcccagtcaggccgaa

SEQ ID NO: 338128 - DNA, 20 bp, human
ggggcctggaggtatgtgcc

SEQ ID NO: 338129 - DNA, 20 bp, human
gagggggaagccagcctgga

SEQ ID NO: 338130 - DNA, 20 bp, human
ggtgggaacgcccagctcat

SEQ ID NO: 338131 - DNA, 20 bp, human
gcaggctgggcggcatgagg

SEQ ID NO: 338132 - DNA, 20 bp, human
gcctgggagacaagtttgtg

SEQ ID NO: 338133 - DNA, 20 bp, human
gatgccaggcacatacctcc

SEQ ID NO: 338134 - DNA, 20 bp, human
gcagtgaaggggcttccgtg

SEQ ID NO: 338135 - DNA, 20 bp, human
ggcccacctggggccctgca

SEQ ID NO: 338136 - DNA, 20 bp, human
gagggccgggccaatgggga

SEQ ID NO: 338137 - DNA, 20 bp, human
gctctcgcgctgaacagcat

SEQ ID NO: 338138 - DNA, 20 bp, human
gtgaacagcatcggtctcta

SEQ ID NO: 338139 - DNA, 20 bp, human
gccagctcccgccaccccat

SEQ ID NO: 338140 - DNA, 20 bp, human
gcccattggcgggaaggaga

SEQ ID NO: 338141 - DNA, 20 bp, human
ggcggcgtgctgacgttccc

SEQ ID NO: 338142 - DNA, 20 bp, human
gtcagcacgccgccgtcccc

SEQ ID NO: 338143 - DNA, 20 bp, human
gcccggccctcatattgaac

SEQ ID NO: 338144 - DNA, 20 bp, human
ggagggctggccctccccat

SEQ ID NO: 338145 - DNA, 20 bp, human
gtatgagggccgggccaatg

SEQ ID NO: 338146 - DNA, 20 bp, human
gctatcacgggaagtgggag

SEQ ID NO: 338147 - DNA, 20 bp, human
gcacgtgggtgttttctgag

SEQ ID NO: 338148 - DNA, 20 bp, human
ggcagaagtcctgcatctct

SEQ ID NO: 338149 - DNA, 20 bp, human
gaagaagaaaccgaaaactc

SEQ ID NO: 338150 - DNA, 20 bp, human
gctgggttatatgatctctt

SEQ ID NO: 338151 - DNA, 20 bp, human
ggataattccaacacaatga

SEQ ID NO: 338152 - DNA, 20 bp, human
gagtgtgtttcaatgcactc

SEQ ID NO: 338153 - DNA, 20 bp, human
gaggatgttagtaataacca

SEQ ID NO: 338154 - DNA, 20 bp, human
gacatcctatcacgggaagt

SEQ ID NO: 338155 - DNA, 20 bp, human
ggggaagaaaaagtttcctc

SEQ ID NO: 338156 - DNA, 20 bp, human
gggtgccgcggagaccacgt

SEQ ID NO: 338157 - DNA, 20 bp, human
gcgcgcggggcgggaaacgg

SEQ ID NO: 338158 - DNA, 20 bp, human
gaggaccaagggtcttggga

SEQ ID NO: 338159 - DNA, 20 bp, human
gcgtcagcggcgcacgggag

SEQ ID NO: 338160 - DNA, 20 bp, human
gccggagcacggcgcgtcag

SEQ ID NO: 338161 - DNA, 20 bp, human
gcatgcccacgtggtctccg

SEQ ID NO: 338162 - DNA, 20 bp, human
gaaccaggaccaagggtctt

SEQ ID NO: 338163 - DNA, 20 bp, human
gggcctgagccccttttcta

SEQ ID NO: 338164 - DNA, 20 bp, human
gcggggcctccatgcccacg

SEQ ID NO: 338165 - DNA, 20 bp, human
gccagcgcgcccgctcacct

SEQ ID NO: 338166 - DNA, 20 bp, human
gagaaagagggcaaaggtta

SEQ ID NO: 338167 - DNA, 20 bp, human
gcactcagatggctacatct

SEQ ID NO: 338168 - DNA, 20 bp, human
ggatagaagagcttgaccga

SEQ ID NO: 338169 - DNA, 20 bp, human
gtggattctaccaccctgga

SEQ ID NO: 338170 - DNA, 20 bp, human
gtggagactatgtaggtagc

SEQ ID NO: 338171 - DNA, 20 bp, human
gagtcaggaggatgtgtaca

SEQ ID NO: 338172 - DNA, 20 bp, human
gtgagacgcaggaacggtga

SEQ ID NO: 338173 - DNA, 20 bp, human
gttctgctgtggaacccacc

SEQ ID NO: 338174 - DNA, 20 bp, human
ggagggcaaaggttagggag

SEQ ID NO: 338175 - DNA, 20 bp, human
gctggctgaggggtgtggct

SEQ ID NO: 338176 - DNA, 20 bp, human
gcgactgggaggggcgtata

SEQ ID NO: 338177 - DNA, 20 bp, human
gagcgtggtccaggaagcag

SEQ ID NO: 338178 - DNA, 20 bp, human
gcggcgacctccgactggga

SEQ ID NO: 338179 - DNA, 20 bp, human
gctgggaggggcgtatatgg

SEQ ID NO: 338180 - DNA, 20 bp, human
gcggggcggcgacctccgac

SEQ ID NO: 338181 - DNA, 20 bp, human
ggtccaggaagcagggggtt

SEQ ID NO: 338182 - DNA, 20 bp, human
gtgagcgccgagcgcatcga

SEQ ID NO: 338183 - DNA, 20 bp, human
gcgcaaatggctggccaata

SEQ ID NO: 338184 - DNA, 20 bp, human
gcgagcgcatcgatggatcg

SEQ ID NO: 338185 - DNA, 20 bp, human
gcccgcctcccgcaaatggc

SEQ ID NO: 338186 - DNA, 20 bp, human
gccaccgcggccattagacc

SEQ ID NO: 338187 - DNA, 20 bp, human
ggcgcagggcatgggtgagg

SEQ ID NO: 338188 - DNA, 20 bp, human
gccctgcgcgcccagcatcc

SEQ ID NO: 338189 - DNA, 20 bp, human
gtgctgggcgcgcagggcat

SEQ ID NO: 338190 - DNA, 20 bp, human
ggtcgagtgtgtgcgactcc

SEQ ID NO: 338191 - DNA, 20 bp, human
gtgcacacacatcacactgc

SEQ ID NO: 338192 - DNA, 20 bp, human
gctgcgaggctctcattagc

SEQ ID NO: 338193 - DNA, 20 bp, human
ggcgggcgtcctgcagtcgc

SEQ ID NO: 338194 - DNA, 20 bp, human
gttcgccttcactcaagaat

SEQ ID NO: 338195 - DNA, 20 bp, human
ggtcgccgggctcgggaccg

SEQ ID NO: 338196 - DNA, 20 bp, human
ggggctgagtacaaagtggt

SEQ ID NO: 338197 - DNA, 20 bp, human
gcagtcggacgctgggataa

SEQ ID NO: 338198 - DNA, 20 bp, human
ggtactcagcccagcttcac

SEQ ID NO: 338199 - DNA, 20 bp, human
gtacaaagtggtgggtatga

SEQ ID NO: 338200 - DNA, 20 bp, human
gcccatgctggcaaatcgtc

SEQ ID NO: 338201 - DNA, 20 bp, human
gccaaccagcccgtgaagct

SEQ ID NO: 338202 - DNA, 20 bp, human
gaaccctgcccagataaggc

SEQ ID NO: 338203 - DNA, 20 bp, human
gaaacactccagccttatct

SEQ ID NO: 338204 - DNA, 20 bp, human
gtttgccagcatgggatcac

SEQ ID NO: 338205 - DNA, 20 bp, human
gactccagaaaccatccctt

SEQ ID NO: 338206 - DNA, 20 bp, human
gaatcctagctgaggcggta

SEQ ID NO: 338207 - DNA, 20 bp, human
gaaaaactatcaggcctagc

SEQ ID NO: 338208 - DNA, 20 bp, human
gaaaactatctgacctaggg

SEQ ID NO: 338209 - DNA, 20 bp, human
gtttaaaactatctgaccta

SEQ ID NO: 338210 - DNA, 20 bp, human
gataataatctctaacctca

SEQ ID NO: 338211 - DNA, 20 bp, human
gatctgacctagggaggctg

SEQ ID NO: 338212 - DNA, 20 bp, human
gtagctcctaggacagagcc

SEQ ID NO: 338213 - DNA, 20 bp, human
gcatggagcttacaacctag

SEQ ID NO: 338214 - DNA, 20 bp, human
gataataaatgtgataaggc

SEQ ID NO: 338215 - DNA, 20 bp, human
gataaataataaatgtgata

SEQ ID NO: 338216 - DNA, 20 bp, human
gctgtcctgccagctgatga

SEQ ID NO: 338217 - DNA, 20 bp, human
gaaggaaagggattacctag

SEQ ID NO: 338218 - DNA, 20 bp, human
ggcaggacagagttgaggat

SEQ ID NO: 338219 - DNA, 20 bp, human
ggatgggcgtggtcagttgg

SEQ ID NO: 338220 - DNA, 20 bp, human
ggtggtcagttggtggactc

SEQ ID NO: 338221 - DNA, 20 bp, human
gctccctgcaatcgcctcta

SEQ ID NO: 338222 - DNA, 20 bp, human
gaatagctgctccctctggg

SEQ ID NO: 338223 - DNA, 20 bp, human
gcagttggtggactcaggat

SEQ ID NO: 338224 - DNA, 20 bp, human
gcacacccagagctggttat

SEQ ID NO: 338225 - DNA, 20 bp, human
gcatcagctactgacacgta

SEQ ID NO: 338226 - DNA, 20 bp, human
gcagcactctagtaagggga

SEQ ID NO: 338227 - DNA, 20 bp, human
gccccaaagcgaagtgcaag

SEQ ID NO: 338228 - DNA, 20 bp, human
ggggtctgatgcaacatgaa

SEQ ID NO: 338229 - DNA, 20 bp, human
ggaagtgcaaggggcatggc

SEQ ID NO: 338230 - DNA, 20 bp, human
ggccccttgcacttcgcttt

SEQ ID NO: 338231 - DNA, 20 bp, human
gaggcctgatgacatctgga

SEQ ID NO: 338232 - DNA, 20 bp, human
gaaaaactagctgtgttaca

SEQ ID NO: 338233 - DNA, 20 bp, human
gcatgttgcatcagacccga

SEQ ID NO: 338234 - DNA, 20 bp, human
gttctaggcagaacaccctc

SEQ ID NO: 338235 - DNA, 20 bp, human
ggcacttcgctttggggatc

SEQ ID NO: 338236 - DNA, 20 bp, human
ggtgttgcctccatgagagt

SEQ ID NO: 338237 - DNA, 20 bp, human
gggggtgcatctgatataag

SEQ ID NO: 338238 - DNA, 20 bp, human
gacactcagtgtagaagatt

SEQ ID NO: 338239 - DNA, 20 bp, human
gttatcaaaaagggcatggt

SEQ ID NO: 338240 - DNA, 20 bp, human
gtcttttatcaaaaagggca

SEQ ID NO: 338241 - DNA, 20 bp, human
gtatgtttcttttatcaaaa

SEQ ID NO: 338242 - DNA, 20 bp, human
ggggctgggcaaggctgggt

SEQ ID NO: 338243 - DNA, 20 bp, human
gctccccagtgccagaaaag

SEQ ID NO: 338244 - DNA, 20 bp, human
ggggagggctgggcaaggct

SEQ ID NO: 338245 - DNA, 20 bp, human
gctcccagcccccactctca

SEQ ID NO: 338246 - DNA, 20 bp, human
gcactcacgggttaatgaca

SEQ ID NO: 338247 - DNA, 20 bp, human
gcgcctcacagcgtggtcaa

SEQ ID NO: 338248 - DNA, 20 bp, human
gctgcttccaggcagtgtgg

SEQ ID NO: 338249 - DNA, 20 bp, human
ggggatggcgggcaatctcg

SEQ ID NO: 338250 - DNA, 20 bp, human
gtggcccctccccggggact

SEQ ID NO: 338251 - DNA, 20 bp, human
gcagagcaggagggtcgggg

SEQ ID NO: 338252 - DNA, 20 bp, human
gaggccctgaacggtgacgg

SEQ ID NO: 338253 - DNA, 20 bp, human
gacactttggccaagtcccc

SEQ ID NO: 338254 - DNA, 20 bp, human
gacagggagtggacaggacc

SEQ ID NO: 338255 - DNA, 20 bp, human
ggaccagagcaggagggtcg

SEQ ID NO: 338256 - DNA, 20 bp, human
ggtggagcctcctttttcta

SEQ ID NO: 338257 - DNA, 20 bp, human
gaccagagcacccagcggtg

SEQ ID NO: 338258 - DNA, 20 bp, human
gaaagactgactctcctatc

SEQ ID NO: 338259 - DNA, 20 bp, human
gcggtggggactgtaccagc

SEQ ID NO: 338260 - DNA, 20 bp, human
gtcgcacactggcaggggag

SEQ ID NO: 338261 - DNA, 20 bp, human
gaaacatcaggggtcatggg

SEQ ID NO: 338262 - DNA, 20 bp, human
gtgaaaggaaattagcccaa

SEQ ID NO: 338263 - DNA, 20 bp, human
gggcagtggcttccgcagtg

SEQ ID NO: 338264 - DNA, 20 bp, human
gcaacccacctgccttcagc

SEQ ID NO: 338265 - DNA, 20 bp, human
gtctggtctgcctgacttgg

SEQ ID NO: 338266 - DNA, 20 bp, human
gtggagtatggggtgatctt

SEQ ID NO: 338267 - DNA, 20 bp, human
gaggaaagaggctggagtat

SEQ ID NO: 338268 - DNA, 20 bp, human
gaatcagcgtcctgcccggc

SEQ ID NO: 338269 - DNA, 20 bp, human
gaaagccctaagctgtggga

SEQ ID NO: 338270 - DNA, 20 bp, human
gagccaaagccctaagctgt

SEQ ID NO: 338271 - DNA, 20 bp, human
ggctcccatagtcccaatct

SEQ ID NO: 338272 - DNA, 20 bp, human
ggtgcggcgggaccaatgaa

SEQ ID NO: 338273 - DNA, 20 bp, human
gggaccaatgaatggagctg

SEQ ID NO: 338274 - DNA, 20 bp, human
gtgccagccctgcctagatt

SEQ ID NO: 338275 - DNA, 20 bp, human
gcctgcctagattgggacta

SEQ ID NO: 338276 - DNA, 20 bp, human
ggtaggaggggctaaaatgt

SEQ ID NO: 338277 - DNA, 20 bp, human
gcgcttttgcagatgtttta

SEQ ID NO: 338278 - DNA, 20 bp, human
gaggaagtagttactactta

SEQ ID NO: 338279 - DNA, 20 bp, human
gaacacaggtgttctgagtc

SEQ ID NO: 338280 - DNA, 20 bp, human
ggaggggctaaaatgtgggc

SEQ ID NO: 338281 - DNA, 20 bp, human
gagaaagtcttatcctgagt

SEQ ID NO: 338282 - DNA, 20 bp, human
gataagactttctctaagtc

SEQ ID NO: 338283 - DNA, 20 bp, human
gggtggaattaaaggggaag

SEQ ID NO: 338284 - DNA, 20 bp, human
gaaatccacaacagcactca

SEQ ID NO: 338285 - DNA, 20 bp, human
gaaacatctgcaaaagcgca

SEQ ID NO: 338286 - DNA, 20 bp, human
gcccactggccggcatccca

SEQ ID NO: 338287 - DNA, 20 bp, human
gagggcggggcgagggtctg

SEQ ID NO: 338288 - DNA, 20 bp, human
ggcggggcgtcggggaaagg

SEQ ID NO: 338289 - DNA, 20 bp, human
gctgcccctggacacacacc

SEQ ID NO: 338290 - DNA, 20 bp, human
gagggcggggcgagtgcttg

SEQ ID NO: 338291 - DNA, 20 bp, human
ggccagtcgctccaccgctt

SEQ ID NO: 338292 - DNA, 20 bp, human
gcgactggcagcgcccgctt

SEQ ID NO: 338293 - DNA, 20 bp, human
gagtcgctccaccgcttcgg

SEQ ID NO: 338294 - DNA, 20 bp, human
gtggcctgcggcggggactc

SEQ ID NO: 338295 - DNA, 20 bp, human
ggggtgcctctggaagggcg

SEQ ID NO: 338296 - DNA, 20 bp, human
ggtcccagaacagcagccaa

SEQ ID NO: 338297 - DNA, 20 bp, human
gaggctggcgagtgccacag

SEQ ID NO: 338298 - DNA, 20 bp, human
ggccccctcacgacaggcag

SEQ ID NO: 338299 - DNA, 20 bp, human
gtggagcttaggtggagcag

SEQ ID NO: 338300 - DNA, 20 bp, human
ggccacctgtccaggaaatg

SEQ ID NO: 338301 - DNA, 20 bp, human
gactcccctgcctgtcgtga

SEQ ID NO: 338302 - DNA, 20 bp, human
gcgagtgccacagaggtatc

SEQ ID NO: 338303 - DNA, 20 bp, human
ggtatcaggagctctagtat

SEQ ID NO: 338304 - DNA, 20 bp, human
gcaggtggctggttcaggag

SEQ ID NO: 338305 - DNA, 20 bp, human
gcggcgggtaggagggactt

SEQ ID NO: 338306 - DNA, 20 bp, human
gagacagccagatgcatagg

SEQ ID NO: 338307 - DNA, 20 bp, human
gcagaagggtgacatcacta

SEQ ID NO: 338308 - DNA, 20 bp, human
gcgggtgcctaatgacagaa

SEQ ID NO: 338309 - DNA, 20 bp, human
gattagacagccagatgcat

SEQ ID NO: 338310 - DNA, 20 bp, human
gatccgtgggatcacgtgga

SEQ ID NO: 338311 - DNA, 20 bp, human
ggctaatcctcctatgcatc

SEQ ID NO: 338312 - DNA, 20 bp, human
ggcagtgagccagatcctta

SEQ ID NO: 338313 - DNA, 20 bp, human
gagccctccacgtgatccca

SEQ ID NO: 338314 - DNA, 20 bp, human
gatgtcacccttctgtcatt

SEQ ID NO: 338315 - DNA, 20 bp, human
gtgtcgttatataactatat

SEQ ID NO: 338316 - DNA, 20 bp, human
ggccagcctctagaggagga

SEQ ID NO: 338317 - DNA, 20 bp, human
gcaggaagctggttcccctg

SEQ ID NO: 338318 - DNA, 20 bp, human
gggggaggcagacgagtccc

SEQ ID NO: 338319 - DNA, 20 bp, human
gaggacagaagatgcagcca

SEQ ID NO: 338320 - DNA, 20 bp, human
gagaagatgcagccaggggg

SEQ ID NO: 338321 - DNA, 20 bp, human
ggagccctgccagaggtttc

SEQ ID NO: 338322 - DNA, 20 bp, human
gaggaaacccccagctccac

SEQ ID NO: 338323 - DNA, 20 bp, human
gcctggctccagtggagctg

SEQ ID NO: 338324 - DNA, 20 bp, human
ggaggaggatacactagccc

SEQ ID NO: 338325 - DNA, 20 bp, human
gagggctgaaggagcgacct

SEQ ID NO: 338326 - DNA, 20 bp, human
ggtgttcagagctgatggtg

SEQ ID NO: 338327 - DNA, 20 bp, human
gccatatctggcagcttaac

SEQ ID NO: 338328 - DNA, 20 bp, human
ggggatactcccaactagag

SEQ ID NO: 338329 - DNA, 20 bp, human
ggggttaaaatagagatctg

SEQ ID NO: 338330 - DNA, 20 bp, human
gtgaggctgtggttttccag

SEQ ID NO: 338331 - DNA, 20 bp, human
gcccagcatcctctctagtt

SEQ ID NO: 338332 - DNA, 20 bp, human
gaggctaggtatttattttc

SEQ ID NO: 338333 - DNA, 20 bp, human
gaaatgattaaattctattc

SEQ ID NO: 338334 - DNA, 20 bp, human
gctgttgcttcatttctgat

SEQ ID NO: 338335 - DNA, 20 bp, human
gatagagatctgggggtgtc

SEQ ID NO: 338336 - DNA, 20 bp, human
gccctctccaagagactctt

SEQ ID NO: 338337 - DNA, 20 bp, human
ggtgacaggcagcactgagt

SEQ ID NO: 338338 - DNA, 20 bp, human
ggtcttgttggaaatagctc

SEQ ID NO: 338339 - DNA, 20 bp, human
gacatgctccaggaagtgac

SEQ ID NO: 338340 - DNA, 20 bp, human
gaagagactcttggggtctc

SEQ ID NO: 338341 - DNA, 20 bp, human
gagggaaggtgggacttgaa

SEQ ID NO: 338342 - DNA, 20 bp, human
gccccaagagtctcttggag

SEQ ID NO: 338343 - DNA, 20 bp, human
gagctggcccagagaccagc

SEQ ID NO: 338344 - DNA, 20 bp, human
gcagtgataaccagggcgct

SEQ ID NO: 338345 - DNA, 20 bp, human
gtctcctccagctgtggaaa

SEQ ID NO: 338346 - DNA, 20 bp, human
gtaacccctacctcagtcct

SEQ ID NO: 338347 - DNA, 20 bp, human
ggggctgaggggattagcaa

SEQ ID NO: 338348 - DNA, 20 bp, human
gactgaggtaggggttactt

SEQ ID NO: 338349 - DNA, 20 bp, human
gcacccgcattggaattctc

SEQ ID NO: 338350 - DNA, 20 bp, human
ggggctcatcagtcttggcg

SEQ ID NO: 338351 - DNA, 20 bp, human
gtgggctcagaaccttgtta

SEQ ID NO: 338352 - DNA, 20 bp, human
gttagcaaaggcttgtgaag

SEQ ID NO: 338353 - DNA, 20 bp, human
gaggggttacttcgggctga

SEQ ID NO: 338354 - DNA, 20 bp, human
gcctgggggctcatcagtct

SEQ ID NO: 338355 - DNA, 20 bp, human
gcacccagagaattccaatg

SEQ ID NO: 338356 - DNA, 20 bp, human
gcccgcctcccgccgtcctc

SEQ ID NO: 338357 - DNA, 20 bp, human
gtcccgccgtcctcgggcgc

SEQ ID NO: 338358 - DNA, 20 bp, human
gctagaggaggcctgggaca

SEQ ID NO: 338359 - DNA, 20 bp, human
gggacagggccaccagtgat

SEQ ID NO: 338360 - DNA, 20 bp, human
ggctctccgccaatcactgg

SEQ ID NO: 338361 - DNA, 20 bp, human
gctaagggagccccttccat

SEQ ID NO: 338362 - DNA, 20 bp, human
gggcgggagccaatcctcgg

SEQ ID NO: 338363 - DNA, 20 bp, human
gggaaggggctcccttagcc

SEQ ID NO: 338364 - DNA, 20 bp, human
ggggcagttaaaaaaaatgg

SEQ ID NO: 338365 - DNA, 20 bp, human
ggcgcctcgccgccgaggat

SEQ ID NO: 338366 - DNA, 20 bp, human
gaggtgcgggccatggtctt

SEQ ID NO: 338367 - DNA, 20 bp, human
gttaaccgcgggtccaggtg

SEQ ID NO: 338368 - DNA, 20 bp, human
gagagagccaggcaatgcct

SEQ ID NO: 338369 - DNA, 20 bp, human
gagccgccgctgctagtgag

SEQ ID NO: 338370 - DNA, 20 bp, human
gcccggcctctcactagcag

SEQ ID NO: 338371 - DNA, 20 bp, human
gtaccggggaggagcgtgtg

SEQ ID NO: 338372 - DNA, 20 bp, human
gggtgagcacgacaccaccc

SEQ ID NO: 338373 - DNA, 20 bp, human
ggatgctggaggaggtaccg

SEQ ID NO: 338374 - DNA, 20 bp, human
gcagagaacacggtgaaaca

SEQ ID NO: 338375 - DNA, 20 bp, human
ggtgctgggtgcgctcgagc

SEQ ID NO: 338376 - DNA, 20 bp, human
gctcacccacaactcctctt

SEQ ID NO: 338377 - DNA, 20 bp, human
gccccaagccgcagtgggtg

SEQ ID NO: 338378 - DNA, 20 bp, human
gttcactgtggagacagcgg

SEQ ID NO: 338379 - DNA, 20 bp, human
gggtggggacaggcggagtg

SEQ ID NO: 338380 - DNA, 20 bp, human
gaggcggagtgaggctgctc

SEQ ID NO: 338381 - DNA, 20 bp, human
gaggcaggaatttctgggat

SEQ ID NO: 338382 - DNA, 20 bp, human
ggccccacccactgcggctt

SEQ ID NO: 338383 - DNA, 20 bp, human
ggagcagctgggttcactct

SEQ ID NO: 338384 - DNA, 20 bp, human
ggagacagcggtggcggagt

SEQ ID NO: 338385 - DNA, 20 bp, human
ggctgcccgctgcaaatccg

SEQ ID NO: 338386 - DNA, 20 bp, human
gccaaccgccgacgccgatg

SEQ ID NO: 338387 - DNA, 20 bp, human
gacacactctgcgtcatgga

SEQ ID NO: 338388 - DNA, 20 bp, human
ggtcaggcgtcctggtggaa

SEQ ID NO: 338389 - DNA, 20 bp, human
gaagagacccgggtttggga

SEQ ID NO: 338390 - DNA, 20 bp, human
gagctccgcatcggcgtcgg

SEQ ID NO: 338391 - DNA, 20 bp, human
ggcactccggaattcatcat

SEQ ID NO: 338392 - DNA, 20 bp, human
gcaccaggacgcctgaccct

SEQ ID NO: 338393 - DNA, 20 bp, human
gcccgagagccggtacggaa

SEQ ID NO: 338394 - DNA, 20 bp, human
ggggaaggggcgcgccgagc

SEQ ID NO: 338395 - DNA, 20 bp, human
gccggagtcggaagagaccc

SEQ ID NO: 338396 - DNA, 20 bp, human
gaactcattcacaggaagaa

SEQ ID NO: 338397 - DNA, 20 bp, human
ggcttctaacacatgacagt

SEQ ID NO: 338398 - DNA, 20 bp, human
gcaatcactgatgatctcaa

SEQ ID NO: 338399 - DNA, 20 bp, human
ggagttctgtcaaggtgaca

SEQ ID NO: 338400 - DNA, 20 bp, human
gcaacagcaagcactacaag

SEQ ID NO: 338401 - DNA, 20 bp, human
gggggaggagggttacaaca

SEQ ID NO: 338402 - DNA, 20 bp, human
ggggacaaaggctggattcc

SEQ ID NO: 338403 - DNA, 20 bp, human
gctgtgaatgagttctgtca

SEQ ID NO: 338404 - DNA, 20 bp, human
ggggctccttgagagaactg

SEQ ID NO: 338405 - DNA, 20 bp, human
ggtagtgcttgctgttgcca

SEQ ID NO: 338406 - DNA, 20 bp, human
gaggctgttctcatattaga

SEQ ID NO: 338407 - DNA, 20 bp, human
gcacagtgtcagctacctaa

SEQ ID NO: 338408 - DNA, 20 bp, human
gggaggggacaggcacccaa

SEQ ID NO: 338409 - DNA, 20 bp, human
gtaaatctctaggaggggac

SEQ ID NO: 338410 - DNA, 20 bp, human
gaaacatcaggaggatggca

SEQ ID NO: 338411 - DNA, 20 bp, human
gtcctgttacaaacatcagg

SEQ ID NO: 338412 - DNA, 20 bp, human
gaggaacataaatctctagg

SEQ ID NO: 338413 - DNA, 20 bp, human
ggttacaaacatcaggagga

SEQ ID NO: 338414 - DNA, 20 bp, human
gcaagagagtctcagccttt

SEQ ID NO: 338415 - DNA, 20 bp, human
ggtgaactacccaaataagg

SEQ ID NO: 338416 - DNA, 20 bp, human
gaaaccctggggtacccagt

SEQ ID NO: 338417 - DNA, 20 bp, human
gaccaagagcagcttaggca

SEQ ID NO: 338418 - DNA, 20 bp, human
ggagttataagacagtacac

SEQ ID NO: 338419 - DNA, 20 bp, human
gaatactcctaacttcaggg

SEQ ID NO: 338420 - DNA, 20 bp, human
gttggcgagggcatccttgt

SEQ ID NO: 338421 - DNA, 20 bp, human
ggagcttgcaattggctatt

SEQ ID NO: 338422 - DNA, 20 bp, human
gccgcccactgggtacccca

SEQ ID NO: 338423 - DNA, 20 bp, human
gaacctggtcttgggttcac

SEQ ID NO: 338424 - DNA, 20 bp, human
gacaggaaggagcttgcaat

SEQ ID NO: 338425 - DNA, 20 bp, human
gctttgaccaagagcagctt

SEQ ID NO: 338426 - DNA, 20 bp, human
gagtgtacctaacacaatat

SEQ ID NO: 338427 - DNA, 20 bp, human
gcacttctgctggattactc

SEQ ID NO: 338428 - DNA, 20 bp, human
gaaaagaaacacaccttatt

SEQ ID NO: 338429 - DNA, 20 bp, human
gctgatacgtctttttaatg

SEQ ID NO: 338430 - DNA, 20 bp, human
gtgacatgagctaaaatcct

SEQ ID NO: 338431 - DNA, 20 bp, human
ggtaactgtgtttctatcgc

SEQ ID NO: 338432 - DNA, 20 bp, human
gcagtttcagacgctcttat

SEQ ID NO: 338433 - DNA, 20 bp, human
gttcttgagctgactttcag

SEQ ID NO: 338434 - DNA, 20 bp, human
gagatactgaacattaaaat

SEQ ID NO: 338435 - DNA, 20 bp, human
gcatctcaagcatcctttaa

SEQ ID NO: 338436 - DNA, 20 bp, human
gcagccttctgaatcttcca

SEQ ID NO: 338437 - DNA, 20 bp, human
gtctcctcaagtttgagcta

SEQ ID NO: 338438 - DNA, 20 bp, human
ggttccttggaagattcaga

SEQ ID NO: 338439 - DNA, 20 bp, human
ggaattggaccagcagttca

SEQ ID NO: 338440 - DNA, 20 bp, human
gcttccaaggaacggtcaag

SEQ ID NO: 338441 - DNA, 20 bp, human
ggtgccacttgaccgttcct

SEQ ID NO: 338442 - DNA, 20 bp, human
ggatgaatgtgtccacagtt

SEQ ID NO: 338443 - DNA, 20 bp, human
gctgctgcttctcagtcaca

SEQ ID NO: 338444 - DNA, 20 bp, human
gacaggtatacacctaactg

SEQ ID NO: 338445 - DNA, 20 bp, human
gctaccatagctcaaacttg

SEQ ID NO: 338446 - DNA, 20 bp, human
gctgcccacggggtgccgag

SEQ ID NO: 338447 - DNA, 20 bp, human
gcctcagctcccggggtctc

SEQ ID NO: 338448 - DNA, 20 bp, human
gaggcgcccaggtggcacgt

SEQ ID NO: 338449 - DNA, 20 bp, human
gaggcaccgacgtgccacct

SEQ ID NO: 338450 - DNA, 20 bp, human
gctgggcgcctcccgaggaa

SEQ ID NO: 338451 - DNA, 20 bp, human
gacctcctgggagcccggga

SEQ ID NO: 338452 - DNA, 20 bp, human
ggggcagactaagactcgga

SEQ ID NO: 338453 - DNA, 20 bp, human
ggggttcagatcctgtgcta

SEQ ID NO: 338454 - DNA, 20 bp, human
gtgggctccgcgctgcccac

SEQ ID NO: 338455 - DNA, 20 bp, human
ggcgaccgagcctggggtca

SEQ ID NO: 338456 - DNA, 20 bp, human
ggcggtggccgaacaggcag

SEQ ID NO: 338457 - DNA, 20 bp, human
gtaagagacgggccgcggct

SEQ ID NO: 338458 - DNA, 20 bp, human
gcccccgcctggcgaaagga

SEQ ID NO: 338459 - DNA, 20 bp, human
gaacacttcggcttgacggg

SEQ ID NO: 338460 - DNA, 20 bp, human
gcgagtggccagctctcggg

SEQ ID NO: 338461 - DNA, 20 bp, human
ggcgggggcggtggccgaac

SEQ ID NO: 338462 - DNA, 20 bp, human
ggggagttggcccgcccatt

SEQ ID NO: 338463 - DNA, 20 bp, human
ggcgcgctccgcccgagagc

SEQ ID NO: 338464 - DNA, 20 bp, human
gggcccgtctcttaacactt

SEQ ID NO: 338465 - DNA, 20 bp, human
ggcgtcgcggcccaatgggc

SEQ ID NO: 338466 - DNA, 20 bp, human
gctcgggagccggaacggcg

SEQ ID NO: 338467 - DNA, 20 bp, human
gaggagggcgctggggcccc

SEQ ID NO: 338468 - DNA, 20 bp, human
gccacgtgacgcccccgcca

SEQ ID NO: 338469 - DNA, 20 bp, human
gggctcggggcggtaccgac

SEQ ID NO: 338470 - DNA, 20 bp, human
gtctaaatcaaggctcgggg

SEQ ID NO: 338471 - DNA, 20 bp, human
gctcggcgcagccatcctct

SEQ ID NO: 338472 - DNA, 20 bp, human
gggcgcaggtagacccgagc

SEQ ID NO: 338473 - DNA, 20 bp, human
gcgacgggctgaatgacaaa

SEQ ID NO: 338474 - DNA, 20 bp, human
ggtcctgcgggccgggtcac

SEQ ID NO: 338475 - DNA, 20 bp, human
gcgggccgggtcaccggtgg

SEQ ID NO: 338476 - DNA, 20 bp, human
gagccccaactcttaaccgc

SEQ ID NO: 338477 - DNA, 20 bp, human
gggcgatgacaagagtctcg

SEQ ID NO: 338478 - DNA, 20 bp, human
ggccgcccgcggttaagagt

SEQ ID NO: 338479 - DNA, 20 bp, human
gggcaaagtccccaacgcgg

SEQ ID NO: 338480 - DNA, 20 bp, human
ggaactgaggcagcccgacc

SEQ ID NO: 338481 - DNA, 20 bp, human
gaggagcaagatctgaactg

SEQ ID NO: 338482 - DNA, 20 bp, human
gggcccgcggtagccgcctt

SEQ ID NO: 338483 - DNA, 20 bp, human
gcaagagtctcgcggaagag

SEQ ID NO: 338484 - DNA, 20 bp, human
gggcgaatccacgtgttgtg

SEQ ID NO: 338485 - DNA, 20 bp, human
gagaggcaaagtccccaacg

SEQ ID NO: 338486 - DNA, 20 bp, human
gccagccgcggcgcacagtc

SEQ ID NO: 338487 - DNA, 20 bp, human
gccgcggcgcacagtcgggg

SEQ ID NO: 338488 - DNA, 20 bp, human
gcgggcgctcgggtcgtgga

SEQ ID NO: 338489 - DNA, 20 bp, human
gcgcagggaccgctgggagc

SEQ ID NO: 338490 - DNA, 20 bp, human
ggcggcgcgcagggaccgct

SEQ ID NO: 338491 - DNA, 20 bp, human
gagcggccgtgcccacgcgg

SEQ ID NO: 338492 - DNA, 20 bp, human
ggggcagtagagcaggtaac

SEQ ID NO: 338493 - DNA, 20 bp, human
gcgggttcccgggccgacat

SEQ ID NO: 338494 - DNA, 20 bp, human
gcggtgccgcgggatctcta

SEQ ID NO: 338495 - DNA, 20 bp, human
gcgggaccatagagatcccg

SEQ ID NO: 338496 - DNA, 20 bp, human
gaatcgcaggaatttggaag

SEQ ID NO: 338497 - DNA, 20 bp, human
ggcacagcccatcctggctt

SEQ ID NO: 338498 - DNA, 20 bp, human
gtgggacactaggactctaa

SEQ ID NO: 338499 - DNA, 20 bp, human
gcctggcccgaagccaggat

SEQ ID NO: 338500 - DNA, 20 bp, human
gagggggaggaagttcacgg

SEQ ID NO: 338501 - DNA, 20 bp, human
gctgcgattcaatgacatca

SEQ ID NO: 338502 - DNA, 20 bp, human
gtgggcgggtttctgtgtgg

SEQ ID NO: 338503 - DNA, 20 bp, human
gggcctgtttttataaagca

SEQ ID NO: 338504 - DNA, 20 bp, human
ggcctgcctcagctccctca

SEQ ID NO: 338505 - DNA, 20 bp, human
gaggaatttggaagtgggat

SEQ ID NO: 338506 - DNA, 20 bp, human
gtctggactgaggaatcgag

SEQ ID NO: 338507 - DNA, 20 bp, human
gcccaacagcgtctggactg

SEQ ID NO: 338508 - DNA, 20 bp, human
ggaggggacccaacagcgtc

SEQ ID NO: 338509 - DNA, 20 bp, human
gaagcgcgatctccagcgga

SEQ ID NO: 338510 - DNA, 20 bp, human
ggagcgctgcaagacagggg

SEQ ID NO: 338511 - DNA, 20 bp, human
gtcggggactccttgcactg

SEQ ID NO: 338512 - DNA, 20 bp, human
gggactccttgcactggggc

SEQ ID NO: 338513 - DNA, 20 bp, human
ggagtccccgaattgcagag

SEQ ID NO: 338514 - DNA, 20 bp, human
ggcgggccctgatatagagc

SEQ ID NO: 338515 - DNA, 20 bp, human
gtcctcagtccagacgctgt

SEQ ID NO: 338516 - DNA, 20 bp, human
gccccgggaagggaagtttg

SEQ ID NO: 338517 - DNA, 20 bp, human
gctggctcggccctgactca

SEQ ID NO: 338518 - DNA, 20 bp, human
ggcggccggctggtggtgaa

SEQ ID NO: 338519 - DNA, 20 bp, human
gaggaggttcgtacgggagg

SEQ ID NO: 338520 - DNA, 20 bp, human
gtggcggaggaggttcgtac

SEQ ID NO: 338521 - DNA, 20 bp, human
gcgggaagggaagtttgtgg

SEQ ID NO: 338522 - DNA, 20 bp, human
gatcacaactccatgagtca

SEQ ID NO: 338523 - DNA, 20 bp, human
ggagtcagccccagatgcgt

SEQ ID NO: 338524 - DNA, 20 bp, human
gggggaggcgcccacgcatc

SEQ ID NO: 338525 - DNA, 20 bp, human
gtcccttcccggggcgcggc

SEQ ID NO: 338526 - DNA, 20 bp, human
gaggcagatgagtcaatgat

SEQ ID NO: 338527 - DNA, 20 bp, human
gttaggcggaagagttctta

SEQ ID NO: 338528 - DNA, 20 bp, human
gataaatattaacacttagg

SEQ ID NO: 338529 - DNA, 20 bp, human
gaaagctgaggccacgttaa

SEQ ID NO: 338530 - DNA, 20 bp, human
gcgccactaccccctttcaa

SEQ ID NO: 338531 - DNA, 20 bp, human
gtacagccttccatgatggt

SEQ ID NO: 338532 - DNA, 20 bp, human
ggtgctctatcagaacacag

SEQ ID NO: 338533 - DNA, 20 bp, human
gccgaacaccggcaatttct

SEQ ID NO: 338534 - DNA, 20 bp, human
gggaggcagctatgcggccc

SEQ ID NO: 338535 - DNA, 20 bp, human
gcatagacactgacagacca

SEQ ID NO: 338536 - DNA, 20 bp, human
gcggcccaggggttgctaga

SEQ ID NO: 338537 - DNA, 20 bp, human
gggcccaccccgcctaggaa

SEQ ID NO: 338538 - DNA, 20 bp, human
gccggagggagaggctagta

SEQ ID NO: 338539 - DNA, 20 bp, human
gataaatggtcgaccccgga

SEQ ID NO: 338540 - DNA, 20 bp, human
gccaccccgcctaggaaagg

SEQ ID NO: 338541 - DNA, 20 bp, human
gaggggtacgctaatcgctg

SEQ ID NO: 338542 - DNA, 20 bp, human
ggcaacccctgggccggtct

SEQ ID NO: 338543 - DNA, 20 bp, human
ggcaaaactgcgaaagaaag

SEQ ID NO: 338544 - DNA, 20 bp, human
gtgaccctctagcaacccct

SEQ ID NO: 338545 - DNA, 20 bp, human
ggcgccgcctctccgaggtg

SEQ ID NO: 338546 - DNA, 20 bp, human
gtggggaagtgtgctaaacc

SEQ ID NO: 338547 - DNA, 20 bp, human
gcgaggggaggcctacgggg

SEQ ID NO: 338548 - DNA, 20 bp, human
gcggccgggctctttaaggt

SEQ ID NO: 338549 - DNA, 20 bp, human
gagcccctcccatcccggaa

SEQ ID NO: 338550 - DNA, 20 bp, human
gcgggtttgcgtaggtggaa

SEQ ID NO: 338551 - DNA, 20 bp, human
ggcgcgaggggaggcctacg

SEQ ID NO: 338552 - DNA, 20 bp, human
gtaaaccgggtttgcgtagg

SEQ ID NO: 338553 - DNA, 20 bp, human
gtttgcgtaggtggaagggg

SEQ ID NO: 338554 - DNA, 20 bp, human
gaaggtgggtcccgccccgt

SEQ ID NO: 338555 - DNA, 20 bp, human
gagcctttccgggatgggag

SEQ ID NO: 338556 - DNA, 20 bp, human
gggcatgctcagagcgaatg

SEQ ID NO: 338557 - DNA, 20 bp, human
ggcaggcgttggctgcaatg

SEQ ID NO: 338558 - DNA, 20 bp, human
gtgacccagcgtgcaaagtt

SEQ ID NO: 338559 - DNA, 20 bp, human
ggggtcaggcgccaggaagc

SEQ ID NO: 338560 - DNA, 20 bp, human
gccaggaagcggggacgcag

SEQ ID NO: 338561 - DNA, 20 bp, human
ggggtccttccttccccccg

SEQ ID NO: 338562 - DNA, 20 bp, human
gagcgagggtggcggggaag

SEQ ID NO: 338563 - DNA, 20 bp, human
gtgctcagagcgaatgcggg

SEQ ID NO: 338564 - DNA, 20 bp, human
gcctctgcaaccagggcacg

SEQ ID NO: 338565 - DNA, 20 bp, human
gacccagcgagcgagggtgg

SEQ ID NO: 338566 - DNA, 20 bp, human
ggagacgtggtcatgaggcc

SEQ ID NO: 338567 - DNA, 20 bp, human
gctgaccagagaccaccaca

SEQ ID NO: 338568 - DNA, 20 bp, human
gccctggctccaaggcgacc

SEQ ID NO: 338569 - DNA, 20 bp, human
ggctgctcacagcggagacg

SEQ ID NO: 338570 - DNA, 20 bp, human
gcatgggcatctgaccccaa

SEQ ID NO: 338571 - DNA, 20 bp, human
ggggaggagggtgatttaca

SEQ ID NO: 338572 - DNA, 20 bp, human
gcagtccctgtggtggtctc

SEQ ID NO: 338573 - DNA, 20 bp, human
gcgggggcctccagaagagg

SEQ ID NO: 338574 - DNA, 20 bp, human
gagggagctcactaggagaa

SEQ ID NO: 338575 - DNA, 20 bp, human
gtacaaggcagatgggcctc

SEQ ID NO: 338576 - DNA, 20 bp, human
ggcagccggagcggggattg

SEQ ID NO: 338577 - DNA, 20 bp, human
gcctgccccaatccccgctc

SEQ ID NO: 338578 - DNA, 20 bp, human
gagccggctaagtgctccca

SEQ ID NO: 338579 - DNA, 20 bp, human
gtggggcaggggcacgcgga

SEQ ID NO: 338580 - DNA, 20 bp, human
gtgctccccaacagccactt

SEQ ID NO: 338581 - DNA, 20 bp, human
gccaccgcgtcggctccccc

SEQ ID NO: 338582 - DNA, 20 bp, human
ggggctgcagtaccagcgga

SEQ ID NO: 338583 - DNA, 20 bp, human
ggggagccgacgcggtggga

SEQ ID NO: 338584 - DNA, 20 bp, human
gggaccgcgcggcataagag

SEQ ID NO: 338585 - DNA, 20 bp, human
gtggagggactgggtgtaga

SEQ ID NO: 338586 - DNA, 20 bp, human
gtgggcgccgactgggtcgg

SEQ ID NO: 338587 - DNA, 20 bp, human
ggctgcgcccccgacccagt

SEQ ID NO: 338588 - DNA, 20 bp, human
gaacgaggagggaggctcgg

SEQ ID NO: 338589 - DNA, 20 bp, human
gcgggaggcgagaacgagga

SEQ ID NO: 338590 - DNA, 20 bp, human
ggcgctgggcgcagaaccca

SEQ ID NO: 338591 - DNA, 20 bp, human
gcagttgccgcgagcccgca

SEQ ID NO: 338592 - DNA, 20 bp, human
ggggcgcagcctcgcgagcc

SEQ ID NO: 338593 - DNA, 20 bp, human
gcgggtcggcgctgccccgt

SEQ ID NO: 338594 - DNA, 20 bp, human
gatgccgcggggagccgcca

SEQ ID NO: 338595 - DNA, 20 bp, human
gggcccgcggcgcgctcctc

SEQ ID NO: 338596 - DNA, 20 bp, human
gcccttctggggacgcgaga

SEQ ID NO: 338597 - DNA, 20 bp, human
gtctggggacgcgagaggga

SEQ ID NO: 338598 - DNA, 20 bp, human
ggggccccacgccctgttgt

SEQ ID NO: 338599 - DNA, 20 bp, human
gggcggggagagacgagggt

SEQ ID NO: 338600 - DNA, 20 bp, human
gccggggaagggatcgtgta

SEQ ID NO: 338601 - DNA, 20 bp, human
ggggagagacgagggttggc

SEQ ID NO: 338602 - DNA, 20 bp, human
ggccgcccgcggtaatgaca

SEQ ID NO: 338603 - DNA, 20 bp, human
gaatctggctatttctggtc

SEQ ID NO: 338604 - DNA, 20 bp, human
gagggcccgcggcccgtggg

SEQ ID NO: 338605 - DNA, 20 bp, human
gccagcgaggcgcccacaac

SEQ ID NO: 338606 - DNA, 20 bp, human
ggagacggactcacgagcag

SEQ ID NO: 338607 - DNA, 20 bp, human
gagaggctcgcccggactaa

SEQ ID NO: 338608 - DNA, 20 bp, human
gagtccgtctccccttagtc

SEQ ID NO: 338609 - DNA, 20 bp, human
gcccttgcggccaagatcag

SEQ ID NO: 338610 - DNA, 20 bp, human
gaacccgaagggatgggcat

SEQ ID NO: 338611 - DNA, 20 bp, human
gggggcgagcgctgaggctc

SEQ ID NO: 338612 - DNA, 20 bp, human
gggggacgagggccatcctc

SEQ ID NO: 338613 - DNA, 20 bp, human
gtcccgggggccctgactcg

SEQ ID NO: 338614 - DNA, 20 bp, human
gtggccctcgtccccggtgc

SEQ ID NO: 338615 - DNA, 20 bp, human
gagagccgggacaggacgca

SEQ ID NO: 338616 - DNA, 20 bp, human
gtgcgggattggggtcaatg

SEQ ID NO: 338617 - DNA, 20 bp, human
ggggcctttaagagttggat

SEQ ID NO: 338618 - DNA, 20 bp, human
ggggcagcacatctccaggg

SEQ ID NO: 338619 - DNA, 20 bp, human
ggtcaatgtgagggagtagt

SEQ ID NO: 338620 - DNA, 20 bp, human
gtgagagctactgcgggatt

SEQ ID NO: 338621 - DNA, 20 bp, human
ggaagcagtaagaaggggag

SEQ ID NO: 338622 - DNA, 20 bp, human
gcagcccatccaactcttaa

SEQ ID NO: 338623 - DNA, 20 bp, human
gacatctccagggaggagcc

SEQ ID NO: 338624 - DNA, 20 bp, human
gcaggacactggtcaatgtg

SEQ ID NO: 338625 - DNA, 20 bp, human
gtcactttgagagctactgc

SEQ ID NO: 338626 - DNA, 20 bp, human
gcgctagcggcctctcaccc

SEQ ID NO: 338627 - DNA, 20 bp, human
gcgccagcagccagctccgg

SEQ ID NO: 338628 - DNA, 20 bp, human
gtaccccagggaaccacccc

SEQ ID NO: 338629 - DNA, 20 bp, human
gaggccgctagcgccaccgc

SEQ ID NO: 338630 - DNA, 20 bp, human
ggccccaggagcgctctctc

SEQ ID NO: 338631 - DNA, 20 bp, human
gtggctcccgccagaaagga

SEQ ID NO: 338632 - DNA, 20 bp, human
gggctcctgccgcgcgggga

SEQ ID NO: 338633 - DNA, 20 bp, human
gaaccaggggtggttccctg

SEQ ID NO: 338634 - DNA, 20 bp, human
gagcggcctctcacccgggg

SEQ ID NO: 338635 - DNA, 20 bp, human
gccgcccgcggtggcgctag

SEQ ID NO: 338636 - DNA, 20 bp, human
gcccgcctgcggcctgtctg

SEQ ID NO: 338637 - DNA, 20 bp, human
ggccgcgtgagaaagctctg

SEQ ID NO: 338638 - DNA, 20 bp, human
gcgcccgcgcacccgtgggg

SEQ ID NO: 338639 - DNA, 20 bp, human
gaggcgcccgcgcacccgtg

SEQ ID NO: 338640 - DNA, 20 bp, human
ggcgcctccgtccccgcctg

SEQ ID NO: 338641 - DNA, 20 bp, human
gctgaggccccaccccgctt

SEQ ID NO: 338642 - DNA, 20 bp, human
ggcgcgggcgcctttgttcc

SEQ ID NO: 338643 - DNA, 20 bp, human
gctgcctgcggattggtcgc

SEQ ID NO: 338644 - DNA, 20 bp, human
gggggaggacccccgcccgt

SEQ ID NO: 338645 - DNA, 20 bp, human
ggacctaacgcccctgtaag

SEQ ID NO: 338646 - DNA, 20 bp, human
gcgccctccccgccatggag

SEQ ID NO: 338647 - DNA, 20 bp, human
gccccgccatggagcggccc

SEQ ID NO: 338648 - DNA, 20 bp, human
gcgcggggacgctgcactcg

SEQ ID NO: 338649 - DNA, 20 bp, human
gcccagccgggtccgcctct

SEQ ID NO: 338650 - DNA, 20 bp, human
ggggcaggtagcctcccctc

SEQ ID NO: 338651 - DNA, 20 bp, human
gccaggcctgggccgctcca

SEQ ID NO: 338652 - DNA, 20 bp, human
ggaaactgaggcaacccgag

SEQ ID NO: 338653 - DNA, 20 bp, human
gcggctgggcgcgcctgggg

SEQ ID NO: 338654 - DNA, 20 bp, human
gactgaggcaacccgagggg

SEQ ID NO: 338655 - DNA, 20 bp, human
gggcctgggccgctccatgg

SEQ ID NO: 338656 - DNA, 20 bp, human
ggaactggagttgcggagag

SEQ ID NO: 338657 - DNA, 20 bp, human
gatgggtgtacggaacccta

SEQ ID NO: 338658 - DNA, 20 bp, human
gcccgggcgggatgggtgta

SEQ ID NO: 338659 - DNA, 20 bp, human
gagaaagcaggttgtggcgg

SEQ ID NO: 338660 - DNA, 20 bp, human
gtggcaagggccagaagcac

SEQ ID NO: 338661 - DNA, 20 bp, human
gatcccgcccgggccagagg

SEQ ID NO: 338662 - DNA, 20 bp, human
gggaagctgcggggccgaga

SEQ ID NO: 338663 - DNA, 20 bp, human
gcctctggctacagccccga

SEQ ID NO: 338664 - DNA, 20 bp, human
gtccgtacacccatcccgcc

SEQ ID NO: 338665 - DNA, 20 bp, human
gaaacccagggtaacccctc

SEQ ID NO: 338666 - DNA, 20 bp, human
ggagaaacactgattaccgt

SEQ ID NO: 338667 - DNA, 20 bp, human
gaaaccctcctcaccttcag

SEQ ID NO: 338668 - DNA, 20 bp, human
gtgacctctgaaggtgagga

SEQ ID NO: 338669 - DNA, 20 bp, human
ggtgaggagggtttctttga

SEQ ID NO: 338670 - DNA, 20 bp, human
gtcagtctgcgtcactccca

SEQ ID NO: 338671 - DNA, 20 bp, human
ggcaaacatcactccatcgg

SEQ ID NO: 338672 - DNA, 20 bp, human
ggaagcaaacatcactccat

SEQ ID NO: 338673 - DNA, 20 bp, human
gtgcacaaaagtagcctata

SEQ ID NO: 338674 - DNA, 20 bp, human
gtaagctacgactgccctat

SEQ ID NO: 338675 - DNA, 20 bp, human
ggtttctcaatgacctctga

SEQ ID NO: 338676 - DNA, 20 bp, human
gaggctgctgggcccgggct

SEQ ID NO: 338677 - DNA, 20 bp, human
ggcagggctcctcctactga

SEQ ID NO: 338678 - DNA, 20 bp, human
gggtgcagccacccctcagt

SEQ ID NO: 338679 - DNA, 20 bp, human
ggtgggaagggaggacacct

SEQ ID NO: 338680 - DNA, 20 bp, human
gggcggggctcccacgggag

SEQ ID NO: 338681 - DNA, 20 bp, human
gtgggcagccaagggttaag

SEQ ID NO: 338682 - DNA, 20 bp, human
gtggtcgctcaagctgctat

SEQ ID NO: 338683 - DNA, 20 bp, human
ggcagccacccctcagtagg

SEQ ID NO: 338684 - DNA, 20 bp, human
ggccccgcccacttaaccct

SEQ ID NO: 338685 - DNA, 20 bp, human
ggaagggaggacacctgggc

SEQ ID NO: 338686 - DNA, 20 bp, human
gccaccccacacagggtcct

SEQ ID NO: 338687 - DNA, 20 bp, human
gaccaacgggagggccctcc

SEQ ID NO: 338688 - DNA, 20 bp, human
gtcctccgaggaccctgtgt

SEQ ID NO: 338689 - DNA, 20 bp, human
ggggacccagagaacgcaac

SEQ ID NO: 338690 - DNA, 20 bp, human
ggctcagggacccacatcct

SEQ ID NO: 338691 - DNA, 20 bp, human
gaagagcaggaccaacggga

SEQ ID NO: 338692 - DNA, 20 bp, human
gagcacagggattgggcctg

SEQ ID NO: 338693 - DNA, 20 bp, human
gcagcctcggcatctgtggt

SEQ ID NO: 338694 - DNA, 20 bp, human
gtggagctgggattagcaca

SEQ ID NO: 338695 - DNA, 20 bp, human
gcccagagaacgcaaccgga

SEQ ID NO: 338696 - DNA, 20 bp, human
gtgtgcccgagcgcgaagaa

SEQ ID NO: 338697 - DNA, 20 bp, human
ggacgcctgccaatccccaa

SEQ ID NO: 338698 - DNA, 20 bp, human
ggcccgaccaatcctcactg

SEQ ID NO: 338699 - DNA, 20 bp, human
gcgaccaatcctcactgcgg

SEQ ID NO: 338700 - DNA, 20 bp, human
ggcgaggcgaggctcctaag

SEQ ID NO: 338701 - DNA, 20 bp, human
gcgcgcgtgtgcaaacccgg

SEQ ID NO: 338702 - DNA, 20 bp, human
ggagcctcgcctcgccgagg

SEQ ID NO: 338703 - DNA, 20 bp, human
gacccctccgcagtgaggat

SEQ ID NO: 338704 - DNA, 20 bp, human
gtaggagcctcgcctcgccg

SEQ ID NO: 338705 - DNA, 20 bp, human
gactgggagccggcccagcg

SEQ ID NO: 338706 - DNA, 20 bp, human
gcgcacggttaaagtcgcgg

SEQ ID NO: 338707 - DNA, 20 bp, human
ggtcgcggcggcagaattat

SEQ ID NO: 338708 - DNA, 20 bp, human
ggcaacccgcgcccacctca

SEQ ID NO: 338709 - DNA, 20 bp, human
gcgcagaggcgcgtgtgttg

SEQ ID NO: 338710 - DNA, 20 bp, human
gccccggctctcggcacctg

SEQ ID NO: 338711 - DNA, 20 bp, human
gtgggcgccccgttacctcg

SEQ ID NO: 338712 - DNA, 20 bp, human
ggacgagtcagctccggcgc

SEQ ID NO: 338713 - DNA, 20 bp, human
ggagtcagctccggcgccgg

SEQ ID NO: 338714 - DNA, 20 bp, human
gcgggcggggggcgacgcgt

SEQ ID NO: 338715 - DNA, 20 bp, human
ggtaacggggcgcccacgtc

SEQ ID NO: 338716 - DNA, 20 bp, human
gggacccggagccgcggtac

SEQ ID NO: 338717 - DNA, 20 bp, human
gcggagccgcggtacaggtg

SEQ ID NO: 338718 - DNA, 20 bp, human
gccccgggctgataaagaat

SEQ ID NO: 338719 - DNA, 20 bp, human
ggaaggggccagctccctcc

SEQ ID NO: 338720 - DNA, 20 bp, human
gagcaaccacacctgtaccg

SEQ ID NO: 338721 - DNA, 20 bp, human
gcggagcggggggcgtgcag

SEQ ID NO: 338722 - DNA, 20 bp, human
gggggaggggaagccgtcct

SEQ ID NO: 338723 - DNA, 20 bp, human
gcggctccgggtccccagga

SEQ ID NO: 338724 - DNA, 20 bp, human
gccagctggctgcagagaag

SEQ ID NO: 338725 - DNA, 20 bp, human
gagggtcccgggagcctgct

SEQ ID NO: 338726 - DNA, 20 bp, human
ggggtccccgtgggagttca

SEQ ID NO: 338727 - DNA, 20 bp, human
gaccccacagaccaggactg

SEQ ID NO: 338728 - DNA, 20 bp, human
gccggtcccgctcctgcggt

SEQ ID NO: 338729 - DNA, 20 bp, human
gaccccggggacaccttgtt

SEQ ID NO: 338730 - DNA, 20 bp, human
gggacagcccgcccccgcca

SEQ ID NO: 338731 - DNA, 20 bp, human
gtggtctgtggggtccccgt

SEQ ID NO: 338732 - DNA, 20 bp, human
gacacccagtccgctgcgat

SEQ ID NO: 338733 - DNA, 20 bp, human
gcccggggtcccccggtcag

SEQ ID NO: 338734 - DNA, 20 bp, human
gagtccgctgcgattggctg

SEQ ID NO: 338735 - DNA, 20 bp, human
gtgcggtggggacagatccg

SEQ ID NO: 338736 - DNA, 20 bp, human
gggaaggcaagagtaacgga

SEQ ID NO: 338737 - DNA, 20 bp, human
gagcagggaaggcgtgggag

SEQ ID NO: 338738 - DNA, 20 bp, human
gcgtctgtctacacacacac

SEQ ID NO: 338739 - DNA, 20 bp, human
gggcgtgggagcgggacaga

SEQ ID NO: 338740 - DNA, 20 bp, human
gtgagtgctgactgtgtgag

SEQ ID NO: 338741 - DNA, 20 bp, human
gtggcggagcgcgctccgat

SEQ ID NO: 338742 - DNA, 20 bp, human
gccggagagcgctggccaat

SEQ ID NO: 338743 - DNA, 20 bp, human
ggggctaggcggcccgtgat

SEQ ID NO: 338744 - DNA, 20 bp, human
gtgcgcgcgtgtctgaaaga

SEQ ID NO: 338745 - DNA, 20 bp, human
gaggaaagaggacctatctg

SEQ ID NO: 338746 - DNA, 20 bp, human
gacgcctaggaaggataaga

SEQ ID NO: 338747 - DNA, 20 bp, human
gctaggaaggataagacggg

SEQ ID NO: 338748 - DNA, 20 bp, human
gagtctggcggaggcactaa

SEQ ID NO: 338749 - DNA, 20 bp, human
gaggaaaggcagagacgcct

SEQ ID NO: 338750 - DNA, 20 bp, human
gaccagggaaagctgcagaa

SEQ ID NO: 338751 - DNA, 20 bp, human
gcggaggcactaagggagca

SEQ ID NO: 338752 - DNA, 20 bp, human
ggacgagaaagtcacagcaa

SEQ ID NO: 338753 - DNA, 20 bp, human
ggctgcagaatggcgaggaa

SEQ ID NO: 338754 - DNA, 20 bp, human
gctctctgcgccacacccac

SEQ ID NO: 338755 - DNA, 20 bp, human
gtgcctccgccagactccgc

SEQ ID NO: 338756 - DNA, 20 bp, human
gtgaaatgaggagtgttcaa

SEQ ID NO: 338757 - DNA, 20 bp, human
gtgaatgttaacaccttgat

SEQ ID NO: 338758 - DNA, 20 bp, human
ggaaagcaggcagtctggca

SEQ ID NO: 338759 - DNA, 20 bp, human
gtatgtctatccatgaaagc

SEQ ID NO: 338760 - DNA, 20 bp, human
gttcttatgacctcatcagg

SEQ ID NO: 338761 - DNA, 20 bp, human
gagcagacagagatcatcaa

SEQ ID NO: 338762 - DNA, 20 bp, human
ggcacgctaagtgtcatgtt

SEQ ID NO: 338763 - DNA, 20 bp, human
gtttacaaattcccctggag

SEQ ID NO: 338764 - DNA, 20 bp, human
gtccatgaaagcaggcagtc

SEQ ID NO: 338765 - DNA, 20 bp, human
gaagctttccttgtgaagtg

SEQ ID NO: 338766 - DNA, 20 bp, human
gtcccggggcgtcgcggtgc

SEQ ID NO: 338767 - DNA, 20 bp, human
gaatccggggcgaatccggg

SEQ ID NO: 338768 - DNA, 20 bp, human
gcgcgagacctgccccgctg

SEQ ID NO: 338769 - DNA, 20 bp, human
ggaggcggtgccaggtcccg

SEQ ID NO: 338770 - DNA, 20 bp, human
gccggctggaggccccagcg

SEQ ID NO: 338771 - DNA, 20 bp, human
gcggggcaggtctcgcgact

SEQ ID NO: 338772 - DNA, 20 bp, human
ggcgaatccggggcgaatcc

SEQ ID NO: 338773 - DNA, 20 bp, human
ggattcgcaggggtggagcg

SEQ ID NO: 338774 - DNA, 20 bp, human
gaaggaacgcgggcgatcag

SEQ ID NO: 338775 - DNA, 20 bp, human
ggcgtcgcggtgccggctgg

SEQ ID NO: 338776 - DNA, 20 bp, human
gccctgcccggggctctcgg

SEQ ID NO: 338777 - DNA, 20 bp, human
gaggacagacgagaatcccg

SEQ ID NO: 338778 - DNA, 20 bp, human
gacagacgagaatcccgcgg

SEQ ID NO: 338779 - DNA, 20 bp, human
gaatcccgcggaggtgaggc

SEQ ID NO: 338780 - DNA, 20 bp, human
gtcggtggcgcactgggcgg

SEQ ID NO: 338781 - DNA, 20 bp, human
ggggctctcggtggcgcact

SEQ ID NO: 338782 - DNA, 20 bp, human
ggcagccggagcccacgccc

SEQ ID NO: 338783 - DNA, 20 bp, human
gagggcgtaaaaggcctgag

SEQ ID NO: 338784 - DNA, 20 bp, human
ggctccgtctgccagggtga

SEQ ID NO: 338785 - DNA, 20 bp, human
gcgagaatcccgcggaggtg

SEQ ID NO: 338786 - DNA, 20 bp, human
gctacacggggactctaggg

SEQ ID NO: 338787 - DNA, 20 bp, human
ggggctcggctccccagaca

SEQ ID NO: 338788 - DNA, 20 bp, human
ggctggagcgaccgtgtctg

SEQ ID NO: 338789 - DNA, 20 bp, human
ggccctacacggggactcta

SEQ ID NO: 338790 - DNA, 20 bp, human
gttggggggtagtacatggc

SEQ ID NO: 338791 - DNA, 20 bp, human
gggagctccgcccactgcag

SEQ ID NO: 338792 - DNA, 20 bp, human
gctccagcctggccgggttg

SEQ ID NO: 338793 - DNA, 20 bp, human
gcgggttggggggtagtaca

SEQ ID NO: 338794 - DNA, 20 bp, human
gcgagccccgcttctcgctg

SEQ ID NO: 338795 - DNA, 20 bp, human
gggctcaccgcagcgagaag

SEQ ID NO: 338796 - DNA, 20 bp, human
gggagcgccgggccgacggt

SEQ ID NO: 338797 - DNA, 20 bp, human
gcactctcgctggtgtcggt

SEQ ID NO: 338798 - DNA, 20 bp, human
ggccgcactctcgctggtgg

SEQ ID NO: 338799 - DNA, 20 bp, human
ggggaggagtgtctgacagt

SEQ ID NO: 338800 - DNA, 20 bp, human
gggcggtcacgtgatggtta

SEQ ID NO: 338801 - DNA, 20 bp, human
gtcacgtgaccgcccaccgt

SEQ ID NO: 338802 - DNA, 20 bp, human
ggcgccgggccgacggtggg

SEQ ID NO: 338803 - DNA, 20 bp, human
ggttacgactgcactctcgc

SEQ ID NO: 338804 - DNA, 20 bp, human
gtgttggggtagagcggccg

SEQ ID NO: 338805 - DNA, 20 bp, human
ggcggcgcggccaatgagaa

SEQ ID NO: 338806 - DNA, 20 bp, human
gtggagggcctctacctcga

SEQ ID NO: 338807 - DNA, 20 bp, human
ggtgggcgggctagagggta

SEQ ID NO: 338808 - DNA, 20 bp, human
gtcgtaggcccgcaactgga

SEQ ID NO: 338809 - DNA, 20 bp, human
gcagttgcgggcctacgaat

SEQ ID NO: 338810 - DNA, 20 bp, human
gcctctacctcgagggagtg

SEQ ID NO: 338811 - DNA, 20 bp, human
ggaacttgactccgattcgt

SEQ ID NO: 338812 - DNA, 20 bp, human
ggctgggtgggcgggctaga

SEQ ID NO: 338813 - DNA, 20 bp, human
gggtagaggccctccagttg

SEQ ID NO: 338814 - DNA, 20 bp, human
ggaacactaagcaggtccag

SEQ ID NO: 338815 - DNA, 20 bp, human
gtctacaccccactccctcg

SEQ ID NO: 338816 - DNA, 20 bp, human
ggctccggagggagacactc

SEQ ID NO: 338817 - DNA, 20 bp, human
ggtagcctgctcgggaaagg

SEQ ID NO: 338818 - DNA, 20 bp, human
gggcgccgctggatagagat

SEQ ID NO: 338819 - DNA, 20 bp, human
gagcaggctacacctctccc

SEQ ID NO: 338820 - DNA, 20 bp, human
gggtgtagcctgctcgggaa

SEQ ID NO: 338821 - DNA, 20 bp, human
gttccagtaaagatgcgcca

SEQ ID NO: 338822 - DNA, 20 bp, human
gcctcactgcaccaacctgc

SEQ ID NO: 338823 - DNA, 20 bp, human
gctccctggcgcatctttac

SEQ ID NO: 338824 - DNA, 20 bp, human
gcctctgctctaagtccctt

SEQ ID NO: 338825 - DNA, 20 bp, human
gcgcagcccaagcgagccgg

SEQ ID NO: 338826 - DNA, 20 bp, human
gcctagcgcgtggccctcgg

SEQ ID NO: 338827 - DNA, 20 bp, human
gccccgtcacgcagcgccaa

SEQ ID NO: 338828 - DNA, 20 bp, human
gctggtgcgtggcaattggc

SEQ ID NO: 338829 - DNA, 20 bp, human
ggcaattggcaggacgtgat

SEQ ID NO: 338830 - DNA, 20 bp, human
gggcaggacgtgatagggcg

SEQ ID NO: 338831 - DNA, 20 bp, human
gtggcctggtgcgtggcaat

SEQ ID NO: 338832 - DNA, 20 bp, human
gggccgttggcgctgcgtga

SEQ ID NO: 338833 - DNA, 20 bp, human
gggcgtggcctggcggtcta

SEQ ID NO: 338834 - DNA, 20 bp, human
gccgccagcggccatgtgcc

SEQ ID NO: 338835 - DNA, 20 bp, human
gcgctggcggcgcgtgacgg

SEQ ID NO: 338836 - DNA, 20 bp, human
ggggctgcagtggtcggggt

SEQ ID NO: 338837 - DNA, 20 bp, human
ggggccgagggcgtgtctgt

SEQ ID NO: 338838 - DNA, 20 bp, human
gccaggccgccgccagggag

SEQ ID NO: 338839 - DNA, 20 bp, human
gccctcggcccgccagaaac

SEQ ID NO: 338840 - DNA, 20 bp, human
gtcagagcccctcccgtcgg

SEQ ID NO: 338841 - DNA, 20 bp, human
gccgaccactgcagccccct

SEQ ID NO: 338842 - DNA, 20 bp, human
gtgtccccaggtccccctag

SEQ ID NO: 338843 - DNA, 20 bp, human
gggagtggccgcaccgactg

SEQ ID NO: 338844 - DNA, 20 bp, human
gccggggagtacagcaggca

SEQ ID NO: 338845 - DNA, 20 bp, human
gcgccagaaacaggaaaccg

SEQ ID NO: 338846 - DNA, 20 bp, human
gtggagccgtggggcctggt

SEQ ID NO: 338847 - DNA, 20 bp, human
gggcccggcgtcctggagga

SEQ ID NO: 338848 - DNA, 20 bp, human
gggccccgtcggctgtgggt

SEQ ID NO: 338849 - DNA, 20 bp, human
gccctcccacccacagccga

SEQ ID NO: 338850 - DNA, 20 bp, human
gacggggcccttgtagagtg

SEQ ID NO: 338851 - DNA, 20 bp, human
gtctaaagaagagggtggca

SEQ ID NO: 338852 - DNA, 20 bp, human
gaccaagagtctaaagaaga

SEQ ID NO: 338853 - DNA, 20 bp, human
gacagtcttagggaccttga

SEQ ID NO: 338854 - DNA, 20 bp, human
gggtgccccccactctacaa

SEQ ID NO: 338855 - DNA, 20 bp, human
gttgccccagcacagtctta

SEQ ID NO: 338856 - DNA, 20 bp, human
gcgacctgctgtagaaaagg

SEQ ID NO: 338857 - DNA, 20 bp, human
gtccagcattagcaaggaat

SEQ ID NO: 338858 - DNA, 20 bp, human
gagcattagcaaggaatggg

SEQ ID NO: 338859 - DNA, 20 bp, human
ggggttgaatatttacctaa

SEQ ID NO: 338860 - DNA, 20 bp, human
gaaacacttgatacagggct

SEQ ID NO: 338861 - DNA, 20 bp, human
gtcaagaataatccttactc

SEQ ID NO: 338862 - DNA, 20 bp, human
ggatcttccaacccagtgag

SEQ ID NO: 338863 - DNA, 20 bp, human
ggcttggcatagagagaagt

SEQ ID NO: 338864 - DNA, 20 bp, human
ggagaaaaagaagtgatgaa

SEQ ID NO: 338865 - DNA, 20 bp, human
gcatgcgaccgccagcagaa

SEQ ID NO: 338866 - DNA, 20 bp, human
ggcgcggggcgcacctggat

SEQ ID NO: 338867 - DNA, 20 bp, human
gaaaggtgctccagggtcgg

SEQ ID NO: 338868 - DNA, 20 bp, human
gaccctggagcacctttggg

SEQ ID NO: 338869 - DNA, 20 bp, human
ggaggaccaaccaccgaccc

SEQ ID NO: 338870 - DNA, 20 bp, human
gtggtcctccaggtacagag

SEQ ID NO: 338871 - DNA, 20 bp, human
ggggttggccgctctgtacc

SEQ ID NO: 338872 - DNA, 20 bp, human
ggtgctccagggtcggtggt

SEQ ID NO: 338873 - DNA, 20 bp, human
gtggaacagtgaggggcgcg

SEQ ID NO: 338874 - DNA, 20 bp, human
gttccacccaaaggtgctcc

SEQ ID NO: 338875 - DNA, 20 bp, human
gttatcctggcctctgatgg

SEQ ID NO: 338876 - DNA, 20 bp, human
gtgcctcagccctcagacgg

SEQ ID NO: 338877 - DNA, 20 bp, human
gtggctcggaggtagaactc

SEQ ID NO: 338878 - DNA, 20 bp, human
gaatctcagccgccgtctga

SEQ ID NO: 338879 - DNA, 20 bp, human
gccgggactcgtagtctctg

SEQ ID NO: 338880 - DNA, 20 bp, human
gggcccagagctccgcgcgc

SEQ ID NO: 338881 - DNA, 20 bp, human
gtccgagccaagcccagtgg

SEQ ID NO: 338882 - DNA, 20 bp, human
gggcggctgagattccggag

SEQ ID NO: 338883 - DNA, 20 bp, human
gaggaagcaccgcggcgcgg

SEQ ID NO: 338884 - DNA, 20 bp, human
ggcgtggcgggccgagtttc

SEQ ID NO: 338885 - DNA, 20 bp, human
gcgccggggaggcctgcgcg

SEQ ID NO: 338886 - DNA, 20 bp, human
gggaggaggggctgccctcg

SEQ ID NO: 338887 - DNA, 20 bp, human
gaggtggccgcagaccctgg

SEQ ID NO: 338888 - DNA, 20 bp, human
gcagctgaggtcgctgggtg

SEQ ID NO: 338889 - DNA, 20 bp, human
gcggggctctcccagagggt

SEQ ID NO: 338890 - DNA, 20 bp, human
gcgcgcagggctgaatacgc

SEQ ID NO: 338891 - DNA, 20 bp, human
gtgaagaagccactcttctt

SEQ ID NO: 338892 - DNA, 20 bp, human
gcgagccccggcccctgcac

SEQ ID NO: 338893 - DNA, 20 bp, human
gtggggccgcggagagggtg

SEQ ID NO: 338894 - DNA, 20 bp, human
gctgaatacgccggtcctag

SEQ ID NO: 338895 - DNA, 20 bp, human
gtacccccccgtgcaggggc

SEQ ID NO: 338896 - DNA, 20 bp, human
gcagccccggtgcctaccta

SEQ ID NO: 338897 - DNA, 20 bp, human
gcggcccgtgggaggagtaa

SEQ ID NO: 338898 - DNA, 20 bp, human
gggcggccaaggggaaactt

SEQ ID NO: 338899 - DNA, 20 bp, human
gggaggagtaaaggcggccc

SEQ ID NO: 338900 - DNA, 20 bp, human
gcgcgcgcagcggagctcga

SEQ ID NO: 338901 - DNA, 20 bp, human
gctgttggccaccggcccgt

SEQ ID NO: 338902 - DNA, 20 bp, human
gggcctcgccgcctagccgg

SEQ ID NO: 338903 - DNA, 20 bp, human
gttggccaccggcccgtggg

SEQ ID NO: 338904 - DNA, 20 bp, human
gaggctcccaagtttcccct

SEQ ID NO: 338905 - DNA, 20 bp, human
gaccctcggcctgccagcca

SEQ ID NO: 338906 - DNA, 20 bp, human
gcagaggtcaggctgtagtg

SEQ ID NO: 338907 - DNA, 20 bp, human
gtgcactccagggcccccgt

SEQ ID NO: 338908 - DNA, 20 bp, human
gaggtcaggctgtagtgggg

SEQ ID NO: 338909 - DNA, 20 bp, human
ggcccccatagctgaaggga

SEQ ID NO: 338910 - DNA, 20 bp, human
gtcccctaaggaccaaggtt

SEQ ID NO: 338911 - DNA, 20 bp, human
gcagctgcccccatagctga

SEQ ID NO: 338912 - DNA, 20 bp, human
gcccctcccttcagctatgg

SEQ ID NO: 338913 - DNA, 20 bp, human
gcacagcagcaaacccacgg

SEQ ID NO: 338914 - DNA, 20 bp, human
gaaaggggatggtcccagta

SEQ ID NO: 338915 - DNA, 20 bp, human
gttaggggacctgggaattg

SEQ ID NO: 338916 - DNA, 20 bp, human
gcggccgccgggatgcggag

SEQ ID NO: 338917 - DNA, 20 bp, human
gccgccgccccggcagggtc

SEQ ID NO: 338918 - DNA, 20 bp, human
ggcgcgccgcaggggcccga

SEQ ID NO: 338919 - DNA, 20 bp, human
gccgcccctccgcatcccgg

SEQ ID NO: 338920 - DNA, 20 bp, human
gcgcgccctaccccctcggg

SEQ ID NO: 338921 - DNA, 20 bp, human
gtcgccgcccctccgcatcc

SEQ ID NO: 338922 - DNA, 20 bp, human
gcgcgcgcgccctaccccct

SEQ ID NO: 338923 - DNA, 20 bp, human
gggcaccgcccgagggggta

SEQ ID NO: 338924 - DNA, 20 bp, human
gaaaacgcgtcctgccccca

SEQ ID NO: 338925 - DNA, 20 bp, human
gcaggggcttgggcattatt

SEQ ID NO: 338926 - DNA, 20 bp, human
ggggagcagggccaccgtct

SEQ ID NO: 338927 - DNA, 20 bp, human
gcctccccaagctgtcactt

SEQ ID NO: 338928 - DNA, 20 bp, human
gggctcccccggggatttca

SEQ ID NO: 338929 - DNA, 20 bp, human
gggcaggcaggctgcgtgga

SEQ ID NO: 338930 - DNA, 20 bp, human
gcatcctctcccgggcaggc

SEQ ID NO: 338931 - DNA, 20 bp, human
gtccctgcagtctcttgtgg

SEQ ID NO: 338932 - DNA, 20 bp, human
ggtggccctgaaatccccgg

SEQ ID NO: 338933 - DNA, 20 bp, human
gcggtggccctgctcccctt

SEQ ID NO: 338934 - DNA, 20 bp, human
ggcagctgggcatgctccat

SEQ ID NO: 338935 - DNA, 20 bp, human
gtgatcctaagtgacagctt

SEQ ID NO: 338936 - DNA, 20 bp, human
ggccgggcggtcgctccctc

SEQ ID NO: 338937 - DNA, 20 bp, human
gtgcgctgggttggccggag

SEQ ID NO: 338938 - DNA, 20 bp, human
gccggagcggctgcgaactc

SEQ ID NO: 338939 - DNA, 20 bp, human
gggcactgcgctgggttggc

SEQ ID NO: 338940 - DNA, 20 bp, human
gtccaggcgcgggctcctga

SEQ ID NO: 338941 - DNA, 20 bp, human
gggggaaggctcggggacaa

SEQ ID NO: 338942 - DNA, 20 bp, human
ggactcgattaaccttacag

SEQ ID NO: 338943 - DNA, 20 bp, human
gtcctgagggagcgaccgcc

SEQ ID NO: 338944 - DNA, 20 bp, human
gccgggtctcccggcctcgg

SEQ ID NO: 338945 - DNA, 20 bp, human
ggctcggggacaaaggccgc

SEQ ID NO: 338946 - DNA, 20 bp, human
gggactgcggactaggcgac

SEQ ID NO: 338947 - DNA, 20 bp, human
gagtccgcagtccgcgtctc

SEQ ID NO: 338948 - DNA, 20 bp, human
ggcggcggggcggagtttgc

SEQ ID NO: 338949 - DNA, 20 bp, human
gagtcccgagacgcggactg

SEQ ID NO: 338950 - DNA, 20 bp, human
gcccgggcccggcgagtcga

SEQ ID NO: 338951 - DNA, 20 bp, human
gcggactaggcgacgggagg

SEQ ID NO: 338952 - DNA, 20 bp, human
gtgcgctccacacttgtctc

SEQ ID NO: 338953 - DNA, 20 bp, human
gttgggaaggggcgcgcgag

SEQ ID NO: 338954 - DNA, 20 bp, human
gcgccgctgccgcgaaatcc

SEQ ID NO: 338955 - DNA, 20 bp, human
gacgcgctcgcgcatgccca

SEQ ID NO: 338956 - DNA, 20 bp, human
ggtgaagagatgctgacccg

SEQ ID NO: 338957 - DNA, 20 bp, human
gacaagtcccagtacgcctc

SEQ ID NO: 338958 - DNA, 20 bp, human
gtggggtgggcaggtccgga

SEQ ID NO: 338959 - DNA, 20 bp, human
gtgcttctgcccagctctac

SEQ ID NO: 338960 - DNA, 20 bp, human
gggtgggcaggtccggaggg

SEQ ID NO: 338961 - DNA, 20 bp, human
gatgctgacccgaggcgtac

SEQ ID NO: 338962 - DNA, 20 bp, human
gctgggctctcaggcgctgc

SEQ ID NO: 338963 - DNA, 20 bp, human
gacgtcactccccctccctg

SEQ ID NO: 338964 - DNA, 20 bp, human
gaaaagtaaaattgcaggcg

SEQ ID NO: 338965 - DNA, 20 bp, human
gtagtctacccctgtagagc

SEQ ID NO: 338966 - DNA, 20 bp, human
gccgaggcgtgacgtcagaa

SEQ ID NO: 338967 - DNA, 20 bp, human
gaggcgtgacgtcagaacgg

SEQ ID NO: 338968 - DNA, 20 bp, human
gggtcggcgcttccactaaa

SEQ ID NO: 338969 - DNA, 20 bp, human
ggggtggttttctgagaaac

SEQ ID NO: 338970 - DNA, 20 bp, human
ggcggcccccggaagctctc

SEQ ID NO: 338971 - DNA, 20 bp, human
gagtggaagcgccgacctcc

SEQ ID NO: 338972 - DNA, 20 bp, human
gtgaaggaccgggcgtccaa

SEQ ID NO: 338973 - DNA, 20 bp, human
gctggcctacaaaacgctcc

SEQ ID NO: 338974 - DNA, 20 bp, human
gtgagccgggagcgttttgt

SEQ ID NO: 338975 - DNA, 20 bp, human
gatgggcgactctaggaccc

SEQ ID NO: 338976 - DNA, 20 bp, human
ggcgctgcggccaagtcccc

SEQ ID NO: 338977 - DNA, 20 bp, human
gagggaccccggggtggtgt

SEQ ID NO: 338978 - DNA, 20 bp, human
gctcgccgagagggaccccg

SEQ ID NO: 338979 - DNA, 20 bp, human
gcggcctcgggcgccaatca

SEQ ID NO: 338980 - DNA, 20 bp, human
gagccggcgcccgccctgat

SEQ ID NO: 338981 - DNA, 20 bp, human
gcctcgggcgccaatcaggg

SEQ ID NO: 338982 - DNA, 20 bp, human
gacacctgctcgcctcgggg

SEQ ID NO: 338983 - DNA, 20 bp, human
ggcgacccgcagggaccttc

SEQ ID NO: 338984 - DNA, 20 bp, human
gcgggctccgtgcgtccaga

SEQ ID NO: 338985 - DNA, 20 bp, human
gtgccactcccagccaatcg

SEQ ID NO: 338986 - DNA, 20 bp, human
gtgtgcgcgctgcaggtccg

SEQ ID NO: 338987 - DNA, 20 bp, human
gggggccagggggtcaaaca

SEQ ID NO: 338988 - DNA, 20 bp, human
gctgcagcgcgcacaagctc

SEQ ID NO: 338989 - DNA, 20 bp, human
gcttgggcgcggcgctcgga

SEQ ID NO: 338990 - DNA, 20 bp, human
ggcggggacccgggctactg

SEQ ID NO: 338991 - DNA, 20 bp, human
gccaatcggagcccgggaag

SEQ ID NO: 338992 - DNA, 20 bp, human
ggcgactgccgtcacccggt

SEQ ID NO: 338993 - DNA, 20 bp, human
ggccagggtcgcagtcccac

SEQ ID NO: 338994 - DNA, 20 bp, human
gctactgcggtgtggactcg

SEQ ID NO: 338995 - DNA, 20 bp, human
gtccgccggacacgcccccg

SEQ ID NO: 338996 - DNA, 20 bp, human
gcccctagagcgcgtcgcga

SEQ ID NO: 338997 - DNA, 20 bp, human
gaggggcggggcgagggaac

SEQ ID NO: 338998 - DNA, 20 bp, human
gggcggggagcgaggggtgt

SEQ ID NO: 338999 - DNA, 20 bp, human
gggaactggcaagaaagggc

SEQ ID NO: 339000 - DNA, 20 bp, human
gcccctcgcgacgcgctcta

SEQ ID NO: 339001 - DNA, 20 bp, human
ggcgacgcgctctaggggcg

SEQ ID NO: 339002 - DNA, 20 bp, human
gctcgcgcccggagtgtgga

SEQ ID NO: 339003 - DNA, 20 bp, human
ggcgagggaactggcaagaa

SEQ ID NO: 339004 - DNA, 20 bp, human
gcggagcttgtccatgtgtg

SEQ ID NO: 339005 - DNA, 20 bp, human
gctaggggcggggcctttgg

SEQ ID NO: 339006 - DNA, 20 bp, human
gtctgccctgagggtgaaaa

SEQ ID NO: 339007 - DNA, 20 bp, human
ggaagctggcgtctgggcgc

SEQ ID NO: 339008 - DNA, 20 bp, human
ggacgagcgatccactgctc

SEQ ID NO: 339009 - DNA, 20 bp, human
gggggcgcggccgagcagtg

SEQ ID NO: 339010 - DNA, 20 bp, human
gtccacctttttcaccctca

SEQ ID NO: 339011 - DNA, 20 bp, human
ggggaagcccggtgttcttc

SEQ ID NO: 339012 - DNA, 20 bp, human
gtggcaaggctccagagaca

SEQ ID NO: 339013 - DNA, 20 bp, human
gagcagtggggccgagcccg

SEQ ID NO: 339014 - DNA, 20 bp, human
gaaagtaaaagtggaaacgg

SEQ ID NO: 339015 - DNA, 20 bp, human
gccggtaatcaagtgaaaag

SEQ ID NO: 339016 - DNA, 20 bp, human
gaggtgaaacccagcagctt

SEQ ID NO: 339017 - DNA, 20 bp, human
gctgtggtctgcacactagg

SEQ ID NO: 339018 - DNA, 20 bp, human
gaggacaatagacaccactg

SEQ ID NO: 339019 - DNA, 20 bp, human
ggcgctgcacagactagcaa

SEQ ID NO: 339020 - DNA, 20 bp, human
ggactcatgcaatatttcta

SEQ ID NO: 339021 - DNA, 20 bp, human
gcacactcgcccaaagctgc

SEQ ID NO: 339022 - DNA, 20 bp, human
gctgctgggtttcaccttcc

SEQ ID NO: 339023 - DNA, 20 bp, human
gtcccaaacccaacacacaa

SEQ ID NO: 339024 - DNA, 20 bp, human
gttaaaatgcaggttggggt

SEQ ID NO: 339025 - DNA, 20 bp, human
gtgatgtcatgtttcattta

SEQ ID NO: 339026 - DNA, 20 bp, human
ggccgcgaggcgtgagaatc

SEQ ID NO: 339027 - DNA, 20 bp, human
gtggggtcttaacccttcgc

SEQ ID NO: 339028 - DNA, 20 bp, human
gccctcccccgctgtcgccg

SEQ ID NO: 339029 - DNA, 20 bp, human
gcccgcctgcggggggggga

SEQ ID NO: 339030 - DNA, 20 bp, human
ggcgccggggtcttcttcag

SEQ ID NO: 339031 - DNA, 20 bp, human
gcgcggcccttgctgtaaaa

SEQ ID NO: 339032 - DNA, 20 bp, human
ggcgaggcgtttggaatgta

SEQ ID NO: 339033 - DNA, 20 bp, human
gaaggcggggccctccggtg

SEQ ID NO: 339034 - DNA, 20 bp, human
gaggcgtgagaatccggaac

SEQ ID NO: 339035 - DNA, 20 bp, human
gaggggtgtcgcctaccaga

SEQ ID NO: 339036 - DNA, 20 bp, human
gggggccggggcaaccttcg

SEQ ID NO: 339037 - DNA, 20 bp, human
gagccggggtaaggctgcgg

SEQ ID NO: 339038 - DNA, 20 bp, human
gcagagccggggtaaggctg

SEQ ID NO: 339039 - DNA, 20 bp, human
gagctggagtctccacccac

SEQ ID NO: 339040 - DNA, 20 bp, human
ggctgcagtccagcaattgg

SEQ ID NO: 339041 - DNA, 20 bp, human
gggccaggaatttttcctgt

SEQ ID NO: 339042 - DNA, 20 bp, human
gacaccgggccctgcgaagg

SEQ ID NO: 339043 - DNA, 20 bp, human
gcgcgccgcgaaggttgccc

SEQ ID NO: 339044 - DNA, 20 bp, human
gccgcagagccgccaattgc

SEQ ID NO: 339045 - DNA, 20 bp, human
ggggtggagactccagctcg

SEQ ID NO: 339046 - DNA, 20 bp, human
ggggcacagccctgccggcg

SEQ ID NO: 339047 - DNA, 20 bp, human
gcagcccgagcaggtctcga

SEQ ID NO: 339048 - DNA, 20 bp, human
gccgccgccgtcctctccgt

SEQ ID NO: 339049 - DNA, 20 bp, human
ggccccgtcgagacctgctc

SEQ ID NO: 339050 - DNA, 20 bp, human
gcctgccggcgcggaagaca

SEQ ID NO: 339051 - DNA, 20 bp, human
ggcgggcgggggttgctgca

SEQ ID NO: 339052 - DNA, 20 bp, human
gcggcgcggaagacaaggtg

SEQ ID NO: 339053 - DNA, 20 bp, human
gccgcggcgtcgcagtgcgt

SEQ ID NO: 339054 - DNA, 20 bp, human
gaggccgcgtgggtgagcga

SEQ ID NO: 339055 - DNA, 20 bp, human
gccgtcctccggcctccagg

SEQ ID NO: 339056 - DNA, 20 bp, human
gaggtcccccccggctctta

SEQ ID NO: 339057 - DNA, 20 bp, human
gccaggagccctaagagccg

SEQ ID NO: 339058 - DNA, 20 bp, human
gggcacagcaggcagattca

SEQ ID NO: 339059 - DNA, 20 bp, human
ggatgctgaaagtacggaag

SEQ ID NO: 339060 - DNA, 20 bp, human
gccacaggctatagctgacc

SEQ ID NO: 339061 - DNA, 20 bp, human
gggtggccctgggacagaac

SEQ ID NO: 339062 - DNA, 20 bp, human
gtacagccatactgagatag

SEQ ID NO: 339063 - DNA, 20 bp, human
gcagcaggcagattcagggg

SEQ ID NO: 339064 - DNA, 20 bp, human
gggtatgtgtgcccgccagc

SEQ ID NO: 339065 - DNA, 20 bp, human
gccctgggacagaactgggg

SEQ ID NO: 339066 - DNA, 20 bp, human
gcccctgggcagctctgagg

SEQ ID NO: 339067 - DNA, 20 bp, human
gtctaggctgcacacaagtg

SEQ ID NO: 339068 - DNA, 20 bp, human
ggagaactgtggggggtcgg

SEQ ID NO: 339069 - DNA, 20 bp, human
gaggccggaccccatggacc

SEQ ID NO: 339070 - DNA, 20 bp, human
gcagcctagacgctggttca

SEQ ID NO: 339071 - DNA, 20 bp, human
gggactggggcagtagccag

SEQ ID NO: 339072 - DNA, 20 bp, human
gaccccccacagttctcagg

SEQ ID NO: 339073 - DNA, 20 bp, human
gactccctgaaccagcgtct

SEQ ID NO: 339074 - DNA, 20 bp, human
gtggttcagggagtcgtaca

SEQ ID NO: 339075 - DNA, 20 bp, human
gaggggcatggggttccgca

SEQ ID NO: 339076 - DNA, 20 bp, human
gcctgcgcgctgcggtccgg

SEQ ID NO: 339077 - DNA, 20 bp, human
ggcccctgcgcgctgcggtc

SEQ ID NO: 339078 - DNA, 20 bp, human
ggctgccccgcgcagggtga

SEQ ID NO: 339079 - DNA, 20 bp, human
gagggtgccatccacgcgga

SEQ ID NO: 339080 - DNA, 20 bp, human
gcgcgtggatggcaccctcc

SEQ ID NO: 339081 - DNA, 20 bp, human
gacctcggagacagcgattc

SEQ ID NO: 339082 - DNA, 20 bp, human
gggagacagcgattccgggc

SEQ ID NO: 339083 - DNA, 20 bp, human
gtgacagccctcaccctgcg

SEQ ID NO: 339084 - DNA, 20 bp, human
gggcctgcattcctgcggac

SEQ ID NO: 339085 - DNA, 20 bp, human
ggtggcaggcgagtctctcc

SEQ ID NO: 339086 - DNA, 20 bp, human
gccccggggctgggtggcga

SEQ ID NO: 339087 - DNA, 20 bp, human
gaggtgtccgccttcctggg

SEQ ID NO: 339088 - DNA, 20 bp, human
gtaggggttcccgggcgggg

SEQ ID NO: 339089 - DNA, 20 bp, human
gaggcggaggcgggggtgta

SEQ ID NO: 339090 - DNA, 20 bp, human
gaggcggggatccccggggc

SEQ ID NO: 339091 - DNA, 20 bp, human
gcggggatcgagtcacccag

SEQ ID NO: 339092 - DNA, 20 bp, human
ggtgtggagtccccgggtct

SEQ ID NO: 339093 - DNA, 20 bp, human
gcgcacaatggcaggaagcg

SEQ ID NO: 339094 - DNA, 20 bp, human
gaggggctccacagtctcca

SEQ ID NO: 339095 - DNA, 20 bp, human
gccgcctctgcccagacccg

SEQ ID NO: 339096 - DNA, 20 bp, human
gacgtgagctgtcctctccg

SEQ ID NO: 339097 - DNA, 20 bp, human
gggtggctgcgtgagggcgg

SEQ ID NO: 339098 - DNA, 20 bp, human
gcggcgagggtgacaacctg

SEQ ID NO: 339099 - DNA, 20 bp, human
gttcaggtgcgaccgaaaag

SEQ ID NO: 339100 - DNA, 20 bp, human
ggagaggacagctcacgtgg

SEQ ID NO: 339101 - DNA, 20 bp, human
ggccaccgccttccccggag

SEQ ID NO: 339102 - DNA, 20 bp, human
gctaccgccagcaccgctcg

SEQ ID NO: 339103 - DNA, 20 bp, human
gcggtgctggcggtagggag

SEQ ID NO: 339104 - DNA, 20 bp, human
ggcgaggcgctgcagtaatg

SEQ ID NO: 339105 - DNA, 20 bp, human
ggagccgggcagcgcgggtc

SEQ ID NO: 339106 - DNA, 20 bp, human
gaaggctatgtcaccccaat

SEQ ID NO: 339107 - DNA, 20 bp, human
gtagagctcagaaatggctt

SEQ ID NO: 339108 - DNA, 20 bp, human
gctatgtcaccccaatgggt

SEQ ID NO: 339109 - DNA, 20 bp, human
gttggacaaggtagtctcac

SEQ ID NO: 339110 - DNA, 20 bp, human
gctcgaagatggttagaaac

SEQ ID NO: 339111 - DNA, 20 bp, human
gatggctttggaactgttag

SEQ ID NO: 339112 - DNA, 20 bp, human
ggaatgaacgaaagatgcca

SEQ ID NO: 339113 - DNA, 20 bp, human
gaaaatgagaggtttggaca

SEQ ID NO: 339114 - DNA, 20 bp, human
gtctttgccctgctcgaaga

SEQ ID NO: 339115 - DNA, 20 bp, human
gatctcttatcatgaatgtt

SEQ ID NO: 339116 - DNA, 20 bp, human
ggcccggcggagcgttgaat

SEQ ID NO: 339117 - DNA, 20 bp, human
ggcagctcgcggagaggcac

SEQ ID NO: 339118 - DNA, 20 bp, human
ggctgggctcgtccctgggg

SEQ ID NO: 339119 - DNA, 20 bp, human
gctccccgcccgctccttaa

SEQ ID NO: 339120 - DNA, 20 bp, human
gcaccgctgggctcgtccct

SEQ ID NO: 339121 - DNA, 20 bp, human
ggagcgggaggggtgcccgc

SEQ ID NO: 339122 - DNA, 20 bp, human
ggccggcccggagctctccg

SEQ ID NO: 339123 - DNA, 20 bp, human
gtgcctttaaggagcgggcg

SEQ ID NO: 339124 - DNA, 20 bp, human
ggcccagcgctctgccttta

SEQ ID NO: 339125 - DNA, 20 bp, human
gagcggtgcggagaagtggg

SEQ ID NO: 339126 - DNA, 20 bp, human
ggaccaccgggcgtcaccgg

SEQ ID NO: 339127 - DNA, 20 bp, human
ggccgaccaccgggcgtcac

SEQ ID NO: 339128 - DNA, 20 bp, human
gctcaagccgagctcggaga

SEQ ID NO: 339129 - DNA, 20 bp, human
ggggggtgtggctataactt

SEQ ID NO: 339130 - DNA, 20 bp, human
ggacgcccggtggtcggctg

SEQ ID NO: 339131 - DNA, 20 bp, human
gcagagctccctcctggggc

SEQ ID NO: 339132 - DNA, 20 bp, human
ggtcggctgtggtctcccat

SEQ ID NO: 339133 - DNA, 20 bp, human
gaagggcaccgcctcctcca

SEQ ID NO: 339134 - DNA, 20 bp, human
gggcagccggtgtagccaat

SEQ ID NO: 339135 - DNA, 20 bp, human
gctcgcagttgggacgttag

SEQ ID NO: 339136 - DNA, 20 bp, human
gggcgcggctaccaatcaga

SEQ ID NO: 339137 - DNA, 20 bp, human
gcagacggctgaaaccgcgt

SEQ ID NO: 339138 - DNA, 20 bp, human
gcccgctgtcaccaagccag

SEQ ID NO: 339139 - DNA, 20 bp, human
gcggcgccaggcacagggat

SEQ ID NO: 339140 - DNA, 20 bp, human
ggggttgcatcatgtgcccc

SEQ ID NO: 339141 - DNA, 20 bp, human
gcgtccgacctcagagactg

SEQ ID NO: 339142 - DNA, 20 bp, human
gggaccctgcctagtaaaga

SEQ ID NO: 339143 - DNA, 20 bp, human
gcggggtgctagtgacgtca

SEQ ID NO: 339144 - DNA, 20 bp, human
gggaccctgagacgagacag

SEQ ID NO: 339145 - DNA, 20 bp, human
ggacctcagagactggggcg

SEQ ID NO: 339146 - DNA, 20 bp, human
ggacccgtggctgctggcgt

SEQ ID NO: 339147 - DNA, 20 bp, human
gtaccggttggtaggagaga

SEQ ID NO: 339148 - DNA, 20 bp, human
ggcgtggcgctggcgacccg

SEQ ID NO: 339149 - DNA, 20 bp, human
ggctggcgtgggcggggtac

SEQ ID NO: 339150 - DNA, 20 bp, human
gggtcgccagcgccacgcag

SEQ ID NO: 339151 - DNA, 20 bp, human
ggggcggggtaccggttggt

SEQ ID NO: 339152 - DNA, 20 bp, human
ggcgtgggcggggtaccggt

SEQ ID NO: 339153 - DNA, 20 bp, human
gcgccagcgccacgcagcgg

SEQ ID NO: 339154 - DNA, 20 bp, human
gtgcggccgcagcggaccga

SEQ ID NO: 339155 - DNA, 20 bp, human
gcgcctggccgctctagaaa

SEQ ID NO: 339156 - DNA, 20 bp, human
gctaatgggcgagttacaca

SEQ ID NO: 339157 - DNA, 20 bp, human
gacacgggagagtgcccaag

SEQ ID NO: 339158 - DNA, 20 bp, human
gaacgccttgaggtcccctt

SEQ ID NO: 339159 - DNA, 20 bp, human
gcaagccaggcggtgctaat

SEQ ID NO: 339160 - DNA, 20 bp, human
gagtgcccaaggggacctca

SEQ ID NO: 339161 - DNA, 20 bp, human
ggacctcaaggcgttccctt

SEQ ID NO: 339162 - DNA, 20 bp, human
gtgaccacactttatcccaa

SEQ ID NO: 339163 - DNA, 20 bp, human
ggttcccttgggataaagtg

SEQ ID NO: 339164 - DNA, 20 bp, human
gatcccaagggaacgccttg

SEQ ID NO: 339165 - DNA, 20 bp, human
gctcgcccattagcaccgcc

SEQ ID NO: 339166 - DNA, 20 bp, human
gcccgcctgccggggacctc

SEQ ID NO: 339167 - DNA, 20 bp, human
gggggagagtctgtgacttg

SEQ ID NO: 339168 - DNA, 20 bp, human
ggagccccgaggtccccggc

SEQ ID NO: 339169 - DNA, 20 bp, human
gccgggccgcggtggagcga

SEQ ID NO: 339170 - DNA, 20 bp, human
ggaactgatgtcaggcgggg

SEQ ID NO: 339171 - DNA, 20 bp, human
ggagagtctgtgacttgagg

SEQ ID NO: 339172 - DNA, 20 bp, human
gagggtctgtgcgggtctcc

SEQ ID NO: 339173 - DNA, 20 bp, human
ggagggcccaggcgaggcga

SEQ ID NO: 339174 - DNA, 20 bp, human
gccgcacagacccttggccg

SEQ ID NO: 339175 - DNA, 20 bp, human
gtcgaggtctctggcgtccc

SEQ ID NO: 339176 - DNA, 20 bp, human
ggggacccggcagctaggca

SEQ ID NO: 339177 - DNA, 20 bp, human
gaggcctggcgggtgcggtc

SEQ ID NO: 339178 - DNA, 20 bp, human
gaggcctgaccgcacccgcc

SEQ ID NO: 339179 - DNA, 20 bp, human
gcaggaaagactcgtcctcg

SEQ ID NO: 339180 - DNA, 20 bp, human
gaaagcaatggcgtgtgtcg

SEQ ID NO: 339181 - DNA, 20 bp, human
ggcctggaaccttgtgtgtc

SEQ ID NO: 339182 - DNA, 20 bp, human
gacgagtctttcctgcccga

SEQ ID NO: 339183 - DNA, 20 bp, human
gtcaggccttgcctagctgc

SEQ ID NO: 339184 - DNA, 20 bp, human
gctttcctgcccgagggacc

SEQ ID NO: 339185 - DNA, 20 bp, human
ggtacacattgtgaaagcaa

SEQ ID NO: 339186 - DNA, 20 bp, human
ggacctgcacggctcaggta

SEQ ID NO: 339187 - DNA, 20 bp, human
gggcaccagggcctgggcga

SEQ ID NO: 339188 - DNA, 20 bp, human
gaccccacctgcttgtgctc

SEQ ID NO: 339189 - DNA, 20 bp, human
gtgtgggcacgttgtcccgg

SEQ ID NO: 339190 - DNA, 20 bp, human
gggggcctggaaggtcgccc

SEQ ID NO: 339191 - DNA, 20 bp, human
gcgccccgggttcaccaagc

SEQ ID NO: 339192 - DNA, 20 bp, human
gccaaggctggcctctcgag

SEQ ID NO: 339193 - DNA, 20 bp, human
ggcagagacctgcacggctc

SEQ ID NO: 339194 - DNA, 20 bp, human
gggcgagggtggagcctttc

SEQ ID NO: 339195 - DNA, 20 bp, human
gccgcccggcaccagggcct

SEQ ID NO: 339196 - DNA, 20 bp, human
ggaagaaggcggcttcgaag

SEQ ID NO: 339197 - DNA, 20 bp, human
ggggaccctcgctccggcgg

SEQ ID NO: 339198 - DNA, 20 bp, human
gcgagccgccgccggagcga

SEQ ID NO: 339199 - DNA, 20 bp, human
gcggcccgcggatggagctg

SEQ ID NO: 339200 - DNA, 20 bp, human
ggggccgcccacagcgcacc

SEQ ID NO: 339201 - DNA, 20 bp, human
gagtcagaaacaaaggcggg

SEQ ID NO: 339202 - DNA, 20 bp, human
ggggcgggcgcggtggataa

SEQ ID NO: 339203 - DNA, 20 bp, human
gaatcgcggagccgcagctc

SEQ ID NO: 339204 - DNA, 20 bp, human
gccccggcccggtgcgctgt

SEQ ID NO: 339205 - DNA, 20 bp, human
ggttgcgagttcagaataaa

SEQ ID NO: 339206 - DNA, 20 bp, human
gccggcccagggcgggaaat

SEQ ID NO: 339207 - DNA, 20 bp, human
gcgggcggagatgcaactgg

SEQ ID NO: 339208 - DNA, 20 bp, human
ggccccgcccagaggttcca

SEQ ID NO: 339209 - DNA, 20 bp, human
ggcctgggttggagactgga

SEQ ID NO: 339210 - DNA, 20 bp, human
gggcccagagactgaggcga

SEQ ID NO: 339211 - DNA, 20 bp, human
gaccgcccactgcccggcgt

SEQ ID NO: 339212 - DNA, 20 bp, human
gcctgggcggccagagatgt

SEQ ID NO: 339213 - DNA, 20 bp, human
gggcccaagaaacttcgggg

SEQ ID NO: 339214 - DNA, 20 bp, human
gcggagggagagggactagg

SEQ ID NO: 339215 - DNA, 20 bp, human
gccggcgtcggggaggaaag

SEQ ID NO: 339216 - DNA, 20 bp, human
gtggcaagccacaagtatga

SEQ ID NO: 339217 - DNA, 20 bp, human
gagtcaccacagacggttga

SEQ ID NO: 339218 - DNA, 20 bp, human
gatggaagctatgccctcag

SEQ ID NO: 339219 - DNA, 20 bp, human
ggaagacattggttaagata

SEQ ID NO: 339220 - DNA, 20 bp, human
gaggcccagaacttcccctg

SEQ ID NO: 339221 - DNA, 20 bp, human
gttctgggccttcatacttg

SEQ ID NO: 339222 - DNA, 20 bp, human
gcagacggttgagggtaaat

SEQ ID NO: 339223 - DNA, 20 bp, human
gccagccaccaaagggtctt

SEQ ID NO: 339224 - DNA, 20 bp, human
gctaggcagctgggacacca

SEQ ID NO: 339225 - DNA, 20 bp, human
gttcctgggaagggtagaaa

SEQ ID NO: 339226 - DNA, 20 bp, human
ggaacacacagtcgggcatt

SEQ ID NO: 339227 - DNA, 20 bp, human
ggactatgtgaatacccagg

SEQ ID NO: 339228 - DNA, 20 bp, human
gtagttaagaacacacagtc

SEQ ID NO: 339229 - DNA, 20 bp, human
gattaactggattgacaaac

SEQ ID NO: 339230 - DNA, 20 bp, human
ggacaaacaggttagaacta

SEQ ID NO: 339231 - DNA, 20 bp, human
ggatgactatgtgaataccc

SEQ ID NO: 339232 - DNA, 20 bp, human
gtaatatggtaacatagtag

SEQ ID NO: 339233 - DNA, 20 bp, human
gtagaggtgggagatccaag

SEQ ID NO: 339234 - DNA, 20 bp, human
ggctaaccaaatagattaaa

SEQ ID NO: 339235 - DNA, 20 bp, human
ggtaaacagaaagttttatt

SEQ ID NO: 339236 - DNA, 20 bp, human
gaatgcacagatggatgtta

SEQ ID NO: 339237 - DNA, 20 bp, human
ggtggaggtgttgcttgaat

SEQ ID NO: 339238 - DNA, 20 bp, human
ggaaaactatcgcgggaatg

SEQ ID NO: 339239 - DNA, 20 bp, human
gaacaggtgaaaactatcgc

SEQ ID NO: 339240 - DNA, 20 bp, human
ggttcccttcagacactggt

SEQ ID NO: 339241 - DNA, 20 bp, human
gatgtggctgttaccgtgtc

SEQ ID NO: 339242 - DNA, 20 bp, human
gacctgttcccttcagacac

SEQ ID NO: 339243 - DNA, 20 bp, human
gagatggatgttaaggagga

SEQ ID NO: 339244 - DNA, 20 bp, human
gtgttaaggaggatggctgc

SEQ ID NO: 339245 - DNA, 20 bp, human
gaggtgggaccagaagatgg

SEQ ID NO: 339246 - DNA, 20 bp, human
gtggcccggaaggacacacc

SEQ ID NO: 339247 - DNA, 20 bp, human
ggctcagtgttaccagaggt

SEQ ID NO: 339248 - DNA, 20 bp, human
gccaggctcagtgttaccag

SEQ ID NO: 339249 - DNA, 20 bp, human
gggcacttccgccagaagcc

SEQ ID NO: 339250 - DNA, 20 bp, human
gctccgcccagcgtcgggat

SEQ ID NO: 339251 - DNA, 20 bp, human
gagctgagggctgcgcgaat

SEQ ID NO: 339252 - DNA, 20 bp, human
gcagtgttaccagaggtggg

SEQ ID NO: 339253 - DNA, 20 bp, human
gtctggcagctgagtcgccg

SEQ ID NO: 339254 - DNA, 20 bp, human
gcgccaatcccgacgctggg

SEQ ID NO: 339255 - DNA, 20 bp, human
gcggctctttaaagaagctg

SEQ ID NO: 339256 - DNA, 20 bp, human
ggagaagttaggatatgcct

SEQ ID NO: 339257 - DNA, 20 bp, human
ggaaggagatccaggctcag

SEQ ID NO: 339258 - DNA, 20 bp, human
ggtcatataaccatgacaac

SEQ ID NO: 339259 - DNA, 20 bp, human
gaattcctgtcactcctggg

SEQ ID NO: 339260 - DNA, 20 bp, human
ggatatgcctggggaaccct

SEQ ID NO: 339261 - DNA, 20 bp, human
gaactgatgcttcatggctc

SEQ ID NO: 339262 - DNA, 20 bp, human
gcagggtcagccagttgtca

SEQ ID NO: 339263 - DNA, 20 bp, human
ggtcatggttatatgaccca

SEQ ID NO: 339264 - DNA, 20 bp, human
gctgccctcctctagctggg

SEQ ID NO: 339265 - DNA, 20 bp, human
gctttccagaaagaaggtat

SEQ ID NO: 339266 - DNA, 20 bp, human
ggggcccggtcgggttgaga

SEQ ID NO: 339267 - DNA, 20 bp, human
gggcccccaccactctagga

SEQ ID NO: 339268 - DNA, 20 bp, human
ggtgcccgagggtgacactc

SEQ ID NO: 339269 - DNA, 20 bp, human
ggacactcgggcttgggaca

SEQ ID NO: 339270 - DNA, 20 bp, human
gactctaggagggccggcgt

SEQ ID NO: 339271 - DNA, 20 bp, human
gggcgccgggacgtgcccga

SEQ ID NO: 339272 - DNA, 20 bp, human
gaagcccgagtgtcaccctc

SEQ ID NO: 339273 - DNA, 20 bp, human
gcggccctcctagagtggtg

SEQ ID NO: 339274 - DNA, 20 bp, human
gctaggagggccggcgttgg

SEQ ID NO: 339275 - DNA, 20 bp, human
gcaggctcctctccccgtgg

SEQ ID NO: 339276 - DNA, 20 bp, human
gacccacacatgctggtcaa

SEQ ID NO: 339277 - DNA, 20 bp, human
gcacacatgctggtcaaagg

SEQ ID NO: 339278 - DNA, 20 bp, human
gcctcccaccctatgtcaaa

SEQ ID NO: 339279 - DNA, 20 bp, human
gcaaacaactattgccaatc

SEQ ID NO: 339280 - DNA, 20 bp, human
ggcacgacaccatttgacat

SEQ ID NO: 339281 - DNA, 20 bp, human
gcttttgaaatggtgtcatc

SEQ ID NO: 339282 - DNA, 20 bp, human
gtggctggcagcaacctgat

SEQ ID NO: 339283 - DNA, 20 bp, human
gaatggtgtcatcaggagaa

SEQ ID NO: 339284 - DNA, 20 bp, human
gacgttccttgccaagccac

SEQ ID NO: 339285 - DNA, 20 bp, human
gtctagactgttcttggagt

SEQ ID NO: 339286 - DNA, 20 bp, human
gagtcggagcccatggtgga

SEQ ID NO: 339287 - DNA, 20 bp, human
ggggccacgccctccaccat

SEQ ID NO: 339288 - DNA, 20 bp, human
gaggggaccaatcaggttga

SEQ ID NO: 339289 - DNA, 20 bp, human
gtccacgccctgcccctgaa

SEQ ID NO: 339290 - DNA, 20 bp, human
gttactgcgtggtaggttgg

SEQ ID NO: 339291 - DNA, 20 bp, human
gcaagtcatgaagtccggga

SEQ ID NO: 339292 - DNA, 20 bp, human
ggcccctgacgcgctggcga

SEQ ID NO: 339293 - DNA, 20 bp, human
gctcgccaagtcatgaagtc

SEQ ID NO: 339294 - DNA, 20 bp, human
ggctggggaccctgtgaagt

SEQ ID NO: 339295 - DNA, 20 bp, human
gcatgacttggcgaggggcg

SEQ ID NO: 339296 - DNA, 20 bp, human
ggggctgggctggcagacat

SEQ ID NO: 339297 - DNA, 20 bp, human
ggggctggcagacatcgggg

SEQ ID NO: 339298 - DNA, 20 bp, human
gctaagggagtggtccaggg

SEQ ID NO: 339299 - DNA, 20 bp, human
gtgccccaaagcacactagg

SEQ ID NO: 339300 - DNA, 20 bp, human
gctaagggggccgtccaagg

SEQ ID NO: 339301 - DNA, 20 bp, human
gggggccgtccaagggggtc

SEQ ID NO: 339302 - DNA, 20 bp, human
ggcgtggtggacgtggctaa

SEQ ID NO: 339303 - DNA, 20 bp, human
ggtgtccagcggggtcacag

SEQ ID NO: 339304 - DNA, 20 bp, human
ggtgtgttccaagatgtcca

SEQ ID NO: 339305 - DNA, 20 bp, human
gcccgtaagtgcagaccgag

SEQ ID NO: 339306 - DNA, 20 bp, human
gcagctcaaggagagggcga

SEQ ID NO: 339307 - DNA, 20 bp, human
gtagcgctcccgaattacta

SEQ ID NO: 339308 - DNA, 20 bp, human
gaggtggccaaacttggtcc

SEQ ID NO: 339309 - DNA, 20 bp, human
gtatggcaaccgtagggcac

SEQ ID NO: 339310 - DNA, 20 bp, human
gaattactatggcaaccgta

SEQ ID NO: 339311 - DNA, 20 bp, human
gggcctccggaactgaccaa

SEQ ID NO: 339312 - DNA, 20 bp, human
gtacgttcccggaccaagtt

SEQ ID NO: 339313 - DNA, 20 bp, human
ggtcactcagcagggctatg

SEQ ID NO: 339314 - DNA, 20 bp, human
gccaatggggagaggccgtg

SEQ ID NO: 339315 - DNA, 20 bp, human
gtatgggggctgtgatcgca

SEQ ID NO: 339316 - DNA, 20 bp, human
ggagaggaggaattccttcg

SEQ ID NO: 339317 - DNA, 20 bp, human
gtttcccggacgcccgagaa

SEQ ID NO: 339318 - DNA, 20 bp, human
gcgaacacgtgggatagcct

SEQ ID NO: 339319 - DNA, 20 bp, human
ggctgcgcagggcgctccca

SEQ ID NO: 339320 - DNA, 20 bp, human
gtagcctgggaaaccaaacc

SEQ ID NO: 339321 - DNA, 20 bp, human
ggtgtcaatcaggttttccc

SEQ ID NO: 339322 - DNA, 20 bp, human
gcacggacgcccgaacacgt

SEQ ID NO: 339323 - DNA, 20 bp, human
gaatccccgcggccaatcag

SEQ ID NO: 339324 - DNA, 20 bp, human
gttaaaggctgctgctgcgc

SEQ ID NO: 339325 - DNA, 20 bp, human
ggggtctccgcatccacgcc

SEQ ID NO: 339326 - DNA, 20 bp, human
gaggccggggcggaccacgt

SEQ ID NO: 339327 - DNA, 20 bp, human
ggcggggcgccgctgaggga

SEQ ID NO: 339328 - DNA, 20 bp, human
gccggggcggaccacgtcgg

SEQ ID NO: 339329 - DNA, 20 bp, human
ggcggggcgtcgtgaggccg

SEQ ID NO: 339330 - DNA, 20 bp, human
ggcgggacgaagacctgcat

SEQ ID NO: 339331 - DNA, 20 bp, human
gcgaagacctgcatggggcg

SEQ ID NO: 339332 - DNA, 20 bp, human
gcggaagccggctttgtggg

SEQ ID NO: 339333 - DNA, 20 bp, human
gaggcggggcaagacgccgt

SEQ ID NO: 339334 - DNA, 20 bp, human
gcggggaagaggcgtggcag

SEQ ID NO: 339335 - DNA, 20 bp, human
gacaccgcgtcaagggagag

SEQ ID NO: 339336 - DNA, 20 bp, human
gccgctgtcccgttcttcga

SEQ ID NO: 339337 - DNA, 20 bp, human
gcggccgccgagatctcttg

SEQ ID NO: 339338 - DNA, 20 bp, human
gcggccgcaagagatctcgg

SEQ ID NO: 339339 - DNA, 20 bp, human
gccgcggccgcaagagatct

SEQ ID NO: 339340 - DNA, 20 bp, human
gtccgctgggaagcgagacc

SEQ ID NO: 339341 - DNA, 20 bp, human
gcaccctgataccttgacac

SEQ ID NO: 339342 - DNA, 20 bp, human
gccggccgagcgcgcgtggc

SEQ ID NO: 339343 - DNA, 20 bp, human
ggatacgcgacatcacgtca

SEQ ID NO: 339344 - DNA, 20 bp, human
ggaagcgagacccgggtggc

SEQ ID NO: 339345 - DNA, 20 bp, human
ggtacaaaacagaatcgcga

SEQ ID NO: 339346 - DNA, 20 bp, human
gcaaagccgagacggaattg

SEQ ID NO: 339347 - DNA, 20 bp, human
gcgggagacacacagttctg

SEQ ID NO: 339348 - DNA, 20 bp, human
ggccgagacggaattgagga

SEQ ID NO: 339349 - DNA, 20 bp, human
gtatggagggagttggaacg

SEQ ID NO: 339350 - DNA, 20 bp, human
gaatgcatttctcttcatga

SEQ ID NO: 339351 - DNA, 20 bp, human
ggagaaatgcatcttgagtc

SEQ ID NO: 339352 - DNA, 20 bp, human
gataaaggggagctttatgg

SEQ ID NO: 339353 - DNA, 20 bp, human
gtttgcaaagccaccctgaa

SEQ ID NO: 339354 - DNA, 20 bp, human
gatcttgagtctggaagcga

SEQ ID NO: 339355 - DNA, 20 bp, human
gttccctgggagcagataga

SEQ ID NO: 339356 - DNA, 20 bp, human
gggagcttctgggtgatgta

SEQ ID NO: 339357 - DNA, 20 bp, human
gctggcagtgcgttgggtgg

SEQ ID NO: 339358 - DNA, 20 bp, human
ggaggggtgagaggcggaca

SEQ ID NO: 339359 - DNA, 20 bp, human
gggtctggcagtgcgttggg

SEQ ID NO: 339360 - DNA, 20 bp, human
gctagcagcgagtcgaggag

SEQ ID NO: 339361 - DNA, 20 bp, human
gcggggtctggcagtgcgtt

SEQ ID NO: 339362 - DNA, 20 bp, human
gcaggtgcaaccaggccgca

SEQ ID NO: 339363 - DNA, 20 bp, human
gactcgcagtggccaaggag

SEQ ID NO: 339364 - DNA, 20 bp, human
gtgggtgggggaggagcttc

SEQ ID NO: 339365 - DNA, 20 bp, human
gtgaccagacgccggggagg

SEQ ID NO: 339366 - DNA, 20 bp, human
gttctagacttcggggccaa

SEQ ID NO: 339367 - DNA, 20 bp, human
ggctgcggagagtttagttc

SEQ ID NO: 339368 - DNA, 20 bp, human
gccaagggccggaagcgctg

SEQ ID NO: 339369 - DNA, 20 bp, human
gaaccctgggccggccgcaa

SEQ ID NO: 339370 - DNA, 20 bp, human
gtggtggtgacgtaacgaga

SEQ ID NO: 339371 - DNA, 20 bp, human
ggctgtctcgggcccactct

SEQ ID NO: 339372 - DNA, 20 bp, human
gcgcggcagaccttcctttg

SEQ ID NO: 339373 - DNA, 20 bp, human
gcgccccggcgcagcctatc

SEQ ID NO: 339374 - DNA, 20 bp, human
gggcccagggttctagactt

SEQ ID NO: 339375 - DNA, 20 bp, human
ggccccgaagtctagaaccc

SEQ ID NO: 339376 - DNA, 20 bp, human
gcgcggctggggaagttcca

SEQ ID NO: 339377 - DNA, 20 bp, human
gcgaccctgcacacccgggc

SEQ ID NO: 339378 - DNA, 20 bp, human
ggcggcccctggcgcccggt

SEQ ID NO: 339379 - DNA, 20 bp, human
gcagggtcggaggagctcgc

SEQ ID NO: 339380 - DNA, 20 bp, human
gtgcccggccgtggagtggg

SEQ ID NO: 339381 - DNA, 20 bp, human
gaggtgcccggccgtggagt

SEQ ID NO: 339382 - DNA, 20 bp, human
gcgagtcccgcacgccaacc

SEQ ID NO: 339383 - DNA, 20 bp, human
gccgggctggacctgcgccc

SEQ ID NO: 339384 - DNA, 20 bp, human
gggtaaagcgggcgtatcag

SEQ ID NO: 339385 - DNA, 20 bp, human
gaggctctctcgcgcgtggg

SEQ ID NO: 339386 - DNA, 20 bp, human
ggctgcccacgaaccggtcg

SEQ ID NO: 339387 - DNA, 20 bp, human
gagagccgggaaattcccag

SEQ ID NO: 339388 - DNA, 20 bp, human
gcggacccggggttgtttac

SEQ ID NO: 339389 - DNA, 20 bp, human
gggcagccgcgtccactccc

SEQ ID NO: 339390 - DNA, 20 bp, human
gcaaccccgggtccgtgaat

SEQ ID NO: 339391 - DNA, 20 bp, human
ggaggccggcgaagcggtct

SEQ ID NO: 339392 - DNA, 20 bp, human
gcacgaaccggtcgcggctg

SEQ ID NO: 339393 - DNA, 20 bp, human
gccgcccgctgggaatttcc

SEQ ID NO: 339394 - DNA, 20 bp, human
gcccagcgggcggcttgccc

SEQ ID NO: 339395 - DNA, 20 bp, human
gcggcgagcaaagggttaag

SEQ ID NO: 339396 - DNA, 20 bp, human
gaggtcttatgatgtcacat

SEQ ID NO: 339397 - DNA, 20 bp, human
ggagaaaaagtgttctaggg

SEQ ID NO: 339398 - DNA, 20 bp, human
gtgggaacagttgcagtagg

SEQ ID NO: 339399 - DNA, 20 bp, human
gttatgggaacagttgcagt

SEQ ID NO: 339400 - DNA, 20 bp, human
ggaacagttgcagtaggtgg

SEQ ID NO: 339401 - DNA, 20 bp, human
gtgcaactgttcccataaac

SEQ ID NO: 339402 - DNA, 20 bp, human
gagtaagaagttctaaagtt

SEQ ID NO: 339403 - DNA, 20 bp, human
gataagtaaacttgaggtgg

SEQ ID NO: 339404 - DNA, 20 bp, human
gaaaataagtaaacttgagg

SEQ ID NO: 339405 - DNA, 20 bp, human
gtaaagattcatgcatcttc

SEQ ID NO: 339406 - DNA, 20 bp, human
gggagggagctgccctaata

SEQ ID NO: 339407 - DNA, 20 bp, human
gtccgggcctctccttatta

SEQ ID NO: 339408 - DNA, 20 bp, human
gtaaggagaggcccggactt

SEQ ID NO: 339409 - DNA, 20 bp, human
gtgaaccccccagagaaggg

SEQ ID NO: 339410 - DNA, 20 bp, human
ggcgcctgcctagtggggaa

SEQ ID NO: 339411 - DNA, 20 bp, human
gagctcccggggcttccgtc

SEQ ID NO: 339412 - DNA, 20 bp, human
gctcccccgcgcctgcctag

SEQ ID NO: 339413 - DNA, 20 bp, human
ggggagacggcagggcctga

SEQ ID NO: 339414 - DNA, 20 bp, human
ggggctggaaacttcgcgac

SEQ ID NO: 339415 - DNA, 20 bp, human
gcagggcctgacggaagccc

SEQ ID NO: 339416 - DNA, 20 bp, human
ggctgctgtggaagctaccg

SEQ ID NO: 339417 - DNA, 20 bp, human
gagcgcttctggctggaacg

SEQ ID NO: 339418 - DNA, 20 bp, human
gcgccgctgcgcgcccggtg

SEQ ID NO: 339419 - DNA, 20 bp, human
ggcttccacagcagcctcga

SEQ ID NO: 339420 - DNA, 20 bp, human
gggagggcggtgttcccgtc

SEQ ID NO: 339421 - DNA, 20 bp, human
ggagctgaggcgaccgcacc

SEQ ID NO: 339422 - DNA, 20 bp, human
gtgggagtgggtttgggaga

SEQ ID NO: 339423 - DNA, 20 bp, human
ggaggctcacgcagcgcttc

SEQ ID NO: 339424 - DNA, 20 bp, human
gtgagcaaacagtccagacg

SEQ ID NO: 339425 - DNA, 20 bp, human
gtcccctcggggagcctata

SEQ ID NO: 339426 - DNA, 20 bp, human
gagagtgcgggcggaagacg

SEQ ID NO: 339427 - DNA, 20 bp, human
gcccccaggcctccgtcccg

SEQ ID NO: 339428 - DNA, 20 bp, human
gcctgcccagagagtgcggg

SEQ ID NO: 339429 - DNA, 20 bp, human
ggcagcccctggagcttctc

SEQ ID NO: 339430 - DNA, 20 bp, human
gacaaggcgaggattgtccc

SEQ ID NO: 339431 - DNA, 20 bp, human
gaagcctaggagtccgccgc

SEQ ID NO: 339432 - DNA, 20 bp, human
gtctgcccggagaagctcca

SEQ ID NO: 339433 - DNA, 20 bp, human
gcgccgcgggacggaggcct

SEQ ID NO: 339434 - DNA, 20 bp, human
gggccggcgggcgggagaca

SEQ ID NO: 339435 - DNA, 20 bp, human
gacggaggcctgggggaact

SEQ ID NO: 339436 - DNA, 20 bp, human
gccctgagtaggtggggaaa

SEQ ID NO: 339437 - DNA, 20 bp, human
ggagtatccctgagtaggtg

SEQ ID NO: 339438 - DNA, 20 bp, human
ggacagccaacccccttaaa

SEQ ID NO: 339439 - DNA, 20 bp, human
gaaattccaggcaagcctta

SEQ ID NO: 339440 - DNA, 20 bp, human
gaagatggagcccttagaga

SEQ ID NO: 339441 - DNA, 20 bp, human
gcctgtccctttaagggggt

SEQ ID NO: 339442 - DNA, 20 bp, human
gcccacaccaattagaccca

SEQ ID NO: 339443 - DNA, 20 bp, human
ggggcagctaggagtgatgt

SEQ ID NO: 339444 - DNA, 20 bp, human
gtgaaacaattggcagtgaa

SEQ ID NO: 339445 - DNA, 20 bp, human
gaaacttccaactgatcctt

SEQ ID NO: 339446 - DNA, 20 bp, human
gccccggggcgccccatcgc

SEQ ID NO: 339447 - DNA, 20 bp, human
gaggctgggagtatccttgg

SEQ ID NO: 339448 - DNA, 20 bp, human
ggccaagcacccctgcgatg

SEQ ID NO: 339449 - DNA, 20 bp, human
gggggccccggggcgaagga

SEQ ID NO: 339450 - DNA, 20 bp, human
gccctgcgatggggcgcccc

SEQ ID NO: 339451 - DNA, 20 bp, human
ggtaccaggagcagtaatag

SEQ ID NO: 339452 - DNA, 20 bp, human
gtgggagtatccttgggggg

SEQ ID NO: 339453 - DNA, 20 bp, human
gggcccccttcccggccaga

SEQ ID NO: 339454 - DNA, 20 bp, human
gccccttcccggccagacgg

SEQ ID NO: 339455 - DNA, 20 bp, human
gtaactgaataaaacggccg

SEQ ID NO: 339456 - DNA, 20 bp, human
gcctctagggcggagtctcg

SEQ ID NO: 339457 - DNA, 20 bp, human
gaagccggagactcctggaa

SEQ ID NO: 339458 - DNA, 20 bp, human
gcctagaggcggtcccgagg

SEQ ID NO: 339459 - DNA, 20 bp, human
gcacgcgcgctagtctccct

SEQ ID NO: 339460 - DNA, 20 bp, human
ggctgaaagccggagactcc

SEQ ID NO: 339461 - DNA, 20 bp, human
gctggagagcaaactcccgt

SEQ ID NO: 339462 - DNA, 20 bp, human
gcgagtgaaaccctccaccc

SEQ ID NO: 339463 - DNA, 20 bp, human
gggagactcctggaagggcc

SEQ ID NO: 339464 - DNA, 20 bp, human
gccctcggccatctaggatc

SEQ ID NO: 339465 - DNA, 20 bp, human
gcccgcctcctgatcctaga

SEQ ID NO: 339466 - DNA, 20 bp, human
gaggcgctgggagcgtggat

SEQ ID NO: 339467 - DNA, 20 bp, human
ggagaggtggacgggcgctg

SEQ ID NO: 339468 - DNA, 20 bp, human
gagaacctgggtttaggcta

SEQ ID NO: 339469 - DNA, 20 bp, human
gaagcccagaacctgggttt

SEQ ID NO: 339470 - DNA, 20 bp, human
gaaagaggagttgcaggcgc

SEQ ID NO: 339471 - DNA, 20 bp, human
ggggagccgcaggcaaaacg

SEQ ID NO: 339472 - DNA, 20 bp, human
gtcacccttagcctaaaccc

SEQ ID NO: 339473 - DNA, 20 bp, human
gcgcagtggcgcgagcgcag

SEQ ID NO: 339474 - DNA, 20 bp, human
gaaaactggtgctactagtc

SEQ ID NO: 339475 - DNA, 20 bp, human
gacttgccgcgttttgcctg

SEQ ID NO: 339476 - DNA, 20 bp, human
gccaatctgcaacatgggtg

SEQ ID NO: 339477 - DNA, 20 bp, human
ggggtaaaatctaaggggta

SEQ ID NO: 339478 - DNA, 20 bp, human
gtgcttgggtaaaatctaag

SEQ ID NO: 339479 - DNA, 20 bp, human
ggaaaggccaatctgcaaca

SEQ ID NO: 339480 - DNA, 20 bp, human
gtagggtagtcccattccat

SEQ ID NO: 339481 - DNA, 20 bp, human
ggggagcttaaaatacattg

SEQ ID NO: 339482 - DNA, 20 bp, human
gaagaatatggaagctcata

SEQ ID NO: 339483 - DNA, 20 bp, human
ggaaccataaaaaaatcaag

SEQ ID NO: 339484 - DNA, 20 bp, human
gaggttttcttcctatggaa

SEQ ID NO: 339485 - DNA, 20 bp, human
gtaaaatggcaatgttgagc

SEQ ID NO: 339486 - DNA, 20 bp, human
gggtggggatccaggaaaat

SEQ ID NO: 339487 - DNA, 20 bp, human
gtgggcacccaggagggata

SEQ ID NO: 339488 - DNA, 20 bp, human
ggatccaggaaaataggcac

SEQ ID NO: 339489 - DNA, 20 bp, human
gcccacccagttgatgtgac

SEQ ID NO: 339490 - DNA, 20 bp, human
gggaaaataggcacggggat

SEQ ID NO: 339491 - DNA, 20 bp, human
gcggccgccgccattggctc

SEQ ID NO: 339492 - DNA, 20 bp, human
gggactgcaactctgctgca

SEQ ID NO: 339493 - DNA, 20 bp, human
gcgagcctgtcacatcaact

SEQ ID NO: 339494 - DNA, 20 bp, human
gaggggagactcaggcgctg

SEQ ID NO: 339495 - DNA, 20 bp, human
gtgcagtccctatccctcct

SEQ ID NO: 339496 - DNA, 20 bp, human
ggagcaagaaagcaagtcgg

SEQ ID NO: 339497 - DNA, 20 bp, human
ggacccacgagactactgga

SEQ ID NO: 339498 - DNA, 20 bp, human
gcaccctccagtagtctcgt

SEQ ID NO: 339499 - DNA, 20 bp, human
gaccaccggacaaacgtctc

SEQ ID NO: 339500 - DNA, 20 bp, human
ggggcctcacaccagggggt

SEQ ID NO: 339501 - DNA, 20 bp, human
gaggggaggggcctcacacc

SEQ ID NO: 339502 - DNA, 20 bp, human
gactggaaagtcatcagctg

SEQ ID NO: 339503 - DNA, 20 bp, human
gaatgagcaagaaagcaagt

SEQ ID NO: 339504 - DNA, 20 bp, human
gcgagcgccagcgcgggaac

SEQ ID NO: 339505 - DNA, 20 bp, human
gcagcgcgggaaccgggaaa

SEQ ID NO: 339506 - DNA, 20 bp, human
gtggcagtcacggggcagac

SEQ ID NO: 339507 - DNA, 20 bp, human
gcagtcacggggcagacggg

SEQ ID NO: 339508 - DNA, 20 bp, human
ggagcccgcgcagggaccag

SEQ ID NO: 339509 - DNA, 20 bp, human
gcagctgcagccacgggtaa

SEQ ID NO: 339510 - DNA, 20 bp, human
gtgcgcgggctcagaggatc

SEQ ID NO: 339511 - DNA, 20 bp, human
gggaccccaagggtacaaca

SEQ ID NO: 339512 - DNA, 20 bp, human
gccggaagtcggcggaaaag

SEQ ID NO: 339513 - DNA, 20 bp, human
gacaccccagtcccataggg

SEQ ID NO: 339514 - DNA, 20 bp, human
gctggagcgcggccgagctg

SEQ ID NO: 339515 - DNA, 20 bp, human
ggcacacggcgtgggggggt

SEQ ID NO: 339516 - DNA, 20 bp, human
ggcagagtggcgaagacgtc

SEQ ID NO: 339517 - DNA, 20 bp, human
gagtggcgaagacgtctggc

SEQ ID NO: 339518 - DNA, 20 bp, human
gccgaccgcccatgcaaata

SEQ ID NO: 339519 - DNA, 20 bp, human
gggagaaaccagcaccaatt

SEQ ID NO: 339520 - DNA, 20 bp, human
gcgggattggctggcctctt

SEQ ID NO: 339521 - DNA, 20 bp, human
gggcgaagacgtctggcggg

SEQ ID NO: 339522 - DNA, 20 bp, human
gactagggggatttgcgtca

SEQ ID NO: 339523 - DNA, 20 bp, human
ggggttgagggcgggactag

SEQ ID NO: 339524 - DNA, 20 bp, human
gtgcagcggttttacaaagg

SEQ ID NO: 339525 - DNA, 20 bp, human
gctctgcagcggttttacaa

SEQ ID NO: 339526 - DNA, 20 bp, human
ggccccgggaagccgatcgt

SEQ ID NO: 339527 - DNA, 20 bp, human
ggaggagcaaagcccacgat

SEQ ID NO: 339528 - DNA, 20 bp, human
gaggcccgactgcccttggg

SEQ ID NO: 339529 - DNA, 20 bp, human
gtgggcatctgcagtccgag

SEQ ID NO: 339530 - DNA, 20 bp, human
ggcggaaggggcgggaacgt

SEQ ID NO: 339531 - DNA, 20 bp, human
gcaaacgcaccgcccaggag

SEQ ID NO: 339532 - DNA, 20 bp, human
gcgccctgggtgggaggcga

SEQ ID NO: 339533 - DNA, 20 bp, human
gggcttcccggggcagcgga

SEQ ID NO: 339534 - DNA, 20 bp, human
gcccgactgcccttgggagg

SEQ ID NO: 339535 - DNA, 20 bp, human
gcatctgcagtccgagcgga

SEQ ID NO: 339536 - DNA, 20 bp, human
ggggagagccgccagcccgg

SEQ ID NO: 339537 - DNA, 20 bp, human
gtgaaacctaaaagccgagg

SEQ ID NO: 339538 - DNA, 20 bp, human
gggaagggagggctaggcgc

SEQ ID NO: 339539 - DNA, 20 bp, human
gttccaggaagacgctcccc

SEQ ID NO: 339540 - DNA, 20 bp, human
gtggcggctctcccagcgcg

SEQ ID NO: 339541 - DNA, 20 bp, human
gcggctctcccagcgcgggg

SEQ ID NO: 339542 - DNA, 20 bp, human
gagacggggaagccgcgcgc

SEQ ID NO: 339543 - DNA, 20 bp, human
gcgctgaaacctaaaagccg

SEQ ID NO: 339544 - DNA, 20 bp, human
gtctgattggaagtgaccgt

SEQ ID NO: 339545 - DNA, 20 bp, human
ggctgggagagccgccagcc

SEQ ID NO: 339546 - DNA, 20 bp, human
gagccaccaaagttatatga

SEQ ID NO: 339547 - DNA, 20 bp, human
ggtcagcttacatataacag

SEQ ID NO: 339548 - DNA, 20 bp, human
gaaccatcatataactttgg

SEQ ID NO: 339549 - DNA, 20 bp, human
gttatatgtaagctgacaag

SEQ ID NO: 339550 - DNA, 20 bp, human
gatataactttggtggctga

SEQ ID NO: 339551 - DNA, 20 bp, human
gcttgctgtttctagacttc

SEQ ID NO: 339552 - DNA, 20 bp, human
ggcttacatataacagagga

SEQ ID NO: 339553 - DNA, 20 bp, human
gtatcaaaaatttatacaat

SEQ ID NO: 339554 - DNA, 20 bp, human
gagaaaccatcatataactt

SEQ ID NO: 339555 - DNA, 20 bp, human
gcttctggactttatcagtt

SEQ ID NO: 339556 - DNA, 20 bp, human
ggacaagcccggccgctgtc

SEQ ID NO: 339557 - DNA, 20 bp, human
gcagcggccgggcttgtcac

SEQ ID NO: 339558 - DNA, 20 bp, human
gcggccgctgtctggacaag

SEQ ID NO: 339559 - DNA, 20 bp, human
gctcccacttgtccagacag

SEQ ID NO: 339560 - DNA, 20 bp, human
gcagagccccgtgacaagcc

SEQ ID NO: 339561 - DNA, 20 bp, human
ggggattgttggggctgagt

SEQ ID NO: 339562 - DNA, 20 bp, human
ggaggtcccgagatgattgt

SEQ ID NO: 339563 - DNA, 20 bp, human
gatgataggaactacctctt

SEQ ID NO: 339564 - DNA, 20 bp, human
gggggaggccggctttataa

SEQ ID NO: 339565 - DNA, 20 bp, human
ggcgaaatgtgcacgatgat

SEQ ID NO: 339566 - DNA, 20 bp, human
gcggggcccgagaaatctca

SEQ ID NO: 339567 - DNA, 20 bp, human
gtggtcccgcctatgatgac

SEQ ID NO: 339568 - DNA, 20 bp, human
gggggcctcgcgatccgggg

SEQ ID NO: 339569 - DNA, 20 bp, human
gccgagaaatctcagggtct

SEQ ID NO: 339570 - DNA, 20 bp, human
gtaggcgggaccaggcagat

SEQ ID NO: 339571 - DNA, 20 bp, human
ggggcggggcctcgcgatcc

SEQ ID NO: 339572 - DNA, 20 bp, human
ggggcacgggagctaagtaa

SEQ ID NO: 339573 - DNA, 20 bp, human
gggccccgccccggatcgcg

SEQ ID NO: 339574 - DNA, 20 bp, human
gacaacatctctgagtaagt

SEQ ID NO: 339575 - DNA, 20 bp, human
gtctctgagtaagtgggggg

SEQ ID NO: 339576 - DNA, 20 bp, human
gcccacccagcattaatcag

SEQ ID NO: 339577 - DNA, 20 bp, human
gaggggtccagccggtgccc

SEQ ID NO: 339578 - DNA, 20 bp, human
gggacccctctgattaatgc

SEQ ID NO: 339579 - DNA, 20 bp, human
gtcccactctggctgtgaga

SEQ ID NO: 339580 - DNA, 20 bp, human
gaggcagaggaagtattaag

SEQ ID NO: 339581 - DNA, 20 bp, human
gccagccggtgccctggctc

SEQ ID NO: 339582 - DNA, 20 bp, human
gcgcgaggctcgaagaggcc

SEQ ID NO: 339583 - DNA, 20 bp, human
ggccttctcacagccagagt

SEQ ID NO: 339584 - DNA, 20 bp, human
gccctctgattaatgctggg

SEQ ID NO: 339585 - DNA, 20 bp, human
gctggctggtcaggcattcc

SEQ ID NO: 339586 - DNA, 20 bp, human
gtcagccactagggcaggaa

SEQ ID NO: 339587 - DNA, 20 bp, human
gaaacctcgccgggccctgg

SEQ ID NO: 339588 - DNA, 20 bp, human
gagggaagggcaaacctcgc

SEQ ID NO: 339589 - DNA, 20 bp, human
gcctcctcagccactagggc

SEQ ID NO: 339590 - DNA, 20 bp, human
gcgctgaggacgagcctcca

SEQ ID NO: 339591 - DNA, 20 bp, human
gggttctgaggaagaagtag

SEQ ID NO: 339592 - DNA, 20 bp, human
gtgaacccgaaggagccctg

SEQ ID NO: 339593 - DNA, 20 bp, human
gaagggatggcccgactcgg

SEQ ID NO: 339594 - DNA, 20 bp, human
ggggccatcccttggtcctc

SEQ ID NO: 339595 - DNA, 20 bp, human
gcaacagagtgtcagacaga

SEQ ID NO: 339596 - DNA, 20 bp, human
gctaggggagcgctccgtta

SEQ ID NO: 339597 - DNA, 20 bp, human
gagcggctgcagagctctag

SEQ ID NO: 339598 - DNA, 20 bp, human
ggggcccgtgacccagggat

SEQ ID NO: 339599 - DNA, 20 bp, human
ggcaccccttgccttgggag

SEQ ID NO: 339600 - DNA, 20 bp, human
gactctgcaccccttgcctt

SEQ ID NO: 339601 - DNA, 20 bp, human
gggggcggctgatgcttcta

SEQ ID NO: 339602 - DNA, 20 bp, human
gagcgctccgttagggctga

SEQ ID NO: 339603 - DNA, 20 bp, human
ggggggcgcggcgtcgttgg

SEQ ID NO: 339604 - DNA, 20 bp, human
gggggttctctcagcccgag

SEQ ID NO: 339605 - DNA, 20 bp, human
gttcccggcggaacggagga

SEQ ID NO: 339606 - DNA, 20 bp, human
gaaggcaggaggtcggagac

SEQ ID NO: 339607 - DNA, 20 bp, human
ggcaggaggtcggagacagg

SEQ ID NO: 339608 - DNA, 20 bp, human
gggaaacccgcaggacaaga

SEQ ID NO: 339609 - DNA, 20 bp, human
gtgacctcgaggaaggcagg

SEQ ID NO: 339610 - DNA, 20 bp, human
gacttctcaccttgacctcg

SEQ ID NO: 339611 - DNA, 20 bp, human
gcacgaggtaccccagatgg

SEQ ID NO: 339612 - DNA, 20 bp, human
gtcgtcacgtggccacttga

SEQ ID NO: 339613 - DNA, 20 bp, human
gggaatgtgcaaagacgccg

SEQ ID NO: 339614 - DNA, 20 bp, human
gcacaaccctcttgtcctgc

SEQ ID NO: 339615 - DNA, 20 bp, human
gagggttgtggctcgtcacg

SEQ ID NO: 339616 - DNA, 20 bp, human
gaactcctggggctccgcgg

SEQ ID NO: 339617 - DNA, 20 bp, human
gcctccgccaccaaactcct

SEQ ID NO: 339618 - DNA, 20 bp, human
gcctggaggagcgaagggga

SEQ ID NO: 339619 - DNA, 20 bp, human
gcgggctgccggtttcaggg

SEQ ID NO: 339620 - DNA, 20 bp, human
ggagtgggagggagtcacgc

SEQ ID NO: 339621 - DNA, 20 bp, human
ggagtcacgctggaacctat

SEQ ID NO: 339622 - DNA, 20 bp, human
gagaagcctggaggagcgaa

SEQ ID NO: 339623 - DNA, 20 bp, human
gctcccccggcttaatctgt

SEQ ID NO: 339624 - DNA, 20 bp, human
gcgctggaacctatcgggag

SEQ ID NO: 339625 - DNA, 20 bp, human
gttcctccgggctcaggagg

SEQ ID NO: 339626 - DNA, 20 bp, human
gctgctgctgccgggcatgt

SEQ ID NO: 339627 - DNA, 20 bp, human
gtgggagatcataatatcat

SEQ ID NO: 339628 - DNA, 20 bp, human
gcctgaggccctataagctg

SEQ ID NO: 339629 - DNA, 20 bp, human
gtggcaagaggtcactccgt

SEQ ID NO: 339630 - DNA, 20 bp, human
gtgggcacctccctggcctg

SEQ ID NO: 339631 - DNA, 20 bp, human
ggaagagggcatgtgaatgc

SEQ ID NO: 339632 - DNA, 20 bp, human
gaggcagaacctgacccacc

SEQ ID NO: 339633 - DNA, 20 bp, human
gcctgctggggtgagcatca

SEQ ID NO: 339634 - DNA, 20 bp, human
ggccttgggcctcggtgctc

SEQ ID NO: 339635 - DNA, 20 bp, human
ggaggtgcccagtttgcccc

SEQ ID NO: 339636 - DNA, 20 bp, human
ggtgacaggtgatgcgaatg

SEQ ID NO: 339637 - DNA, 20 bp, human
gtaaggtggccgatgggtcc

SEQ ID NO: 339638 - DNA, 20 bp, human
gaggaagtccgcgcgggcgg

SEQ ID NO: 339639 - DNA, 20 bp, human
gcccccttggctacttaagg

SEQ ID NO: 339640 - DNA, 20 bp, human
gcggaggaggaagtccgcgc

SEQ ID NO: 339641 - DNA, 20 bp, human
ggggcccgggaattcgagtc

SEQ ID NO: 339642 - DNA, 20 bp, human
ggggagggggttaacgcgcg

SEQ ID NO: 339643 - DNA, 20 bp, human
gaggtctagcgttggggtta

SEQ ID NO: 339644 - DNA, 20 bp, human
gaggaggaagtccgcgcggg

SEQ ID NO: 339645 - DNA, 20 bp, human
gcagctggcttggcccccgg

SEQ ID NO: 339646 - DNA, 20 bp, human
gctgacccccgcgacctgaa

SEQ ID NO: 339647 - DNA, 20 bp, human
gcgggtcccccttcaggtcg

SEQ ID NO: 339648 - DNA, 20 bp, human
ggacgcggccatcgagcgaa

SEQ ID NO: 339649 - DNA, 20 bp, human
ggccgggcgggtcccccttc

SEQ ID NO: 339650 - DNA, 20 bp, human
gacctgaagggggacccgcc

SEQ ID NO: 339651 - DNA, 20 bp, human
gtccggggacgcccggccga

SEQ ID NO: 339652 - DNA, 20 bp, human
gacgcgcgccccaggcccga

SEQ ID NO: 339653 - DNA, 20 bp, human
ggtcccccttcaggtcgcgg

SEQ ID NO: 339654 - DNA, 20 bp, human
gcggcggcaggggacgcagg

SEQ ID NO: 339655 - DNA, 20 bp, human
gcgcgcgaggtccctggccc

SEQ ID NO: 339656 - DNA, 20 bp, human
ggggcccgtggagctgtgtg

SEQ ID NO: 339657 - DNA, 20 bp, human
ggcacccgggtcaccatcgt

SEQ ID NO: 339658 - DNA, 20 bp, human
gtgggtgcccgggccgtatg

SEQ ID NO: 339659 - DNA, 20 bp, human
gtccgactgcgtgcggaagt

SEQ ID NO: 339660 - DNA, 20 bp, human
ggacctgctccgactgcgtg

SEQ ID NO: 339661 - DNA, 20 bp, human
gccacgagagggtggatctg

SEQ ID NO: 339662 - DNA, 20 bp, human
gtgtgagatggaggagtcgc

SEQ ID NO: 339663 - DNA, 20 bp, human
ggctcagagagcgtcagggc

SEQ ID NO: 339664 - DNA, 20 bp, human
gctagggctcagagagcgtc

SEQ ID NO: 339665 - DNA, 20 bp, human
gacagctccacgggccccgg

SEQ ID NO: 339666 - DNA, 20 bp, human
gcaagcgcacactgactctg

SEQ ID NO: 339667 - DNA, 20 bp, human
gcgggtgggagcatgtaggg

SEQ ID NO: 339668 - DNA, 20 bp, human
gctcgctggctcggagctcg

SEQ ID NO: 339669 - DNA, 20 bp, human
gcggagagaggggcatacat

SEQ ID NO: 339670 - DNA, 20 bp, human
gagaagctgtcaagccccgc

SEQ ID NO: 339671 - DNA, 20 bp, human
gagcccgggagctccggcgg

SEQ ID NO: 339672 - DNA, 20 bp, human
gcggctgacatctagagcga

SEQ ID NO: 339673 - DNA, 20 bp, human
ggggctgcctgctgccgccg

SEQ ID NO: 339674 - DNA, 20 bp, human
ggtgtcggcaaacgttggtg

SEQ ID NO: 339675 - DNA, 20 bp, human
gccctggcggtggcgatgtg

SEQ ID NO: 339676 - DNA, 20 bp, human
ggcttccggcctggcccggg

SEQ ID NO: 339677 - DNA, 20 bp, human
gagacaaagccgcgtcggcc

SEQ ID NO: 339678 - DNA, 20 bp, human
gggggcgggctgcaccgcgg

SEQ ID NO: 339679 - DNA, 20 bp, human
gcggctctccgggctgcttc

SEQ ID NO: 339680 - DNA, 20 bp, human
gcgctggcagaagaacgggt

SEQ ID NO: 339681 - DNA, 20 bp, human
gcgggctccgcatcggccga

SEQ ID NO: 339682 - DNA, 20 bp, human
ggggctggaatgcggggtcc

SEQ ID NO: 339683 - DNA, 20 bp, human
gcaacgcgggtcgcccggag

SEQ ID NO: 339684 - DNA, 20 bp, human
ggccctcccccgtgcgggag

SEQ ID NO: 339685 - DNA, 20 bp, human
gcggggtcccgggcggttcg

SEQ ID NO: 339686 - DNA, 20 bp, human
ggcggggagaacaggagaag

SEQ ID NO: 339687 - DNA, 20 bp, human
gcccgcccccgacgagggag

SEQ ID NO: 339688 - DNA, 20 bp, human
gccctcctctccctcgtcgg

SEQ ID NO: 339689 - DNA, 20 bp, human
ggggcagaagagaaccggag

SEQ ID NO: 339690 - DNA, 20 bp, human
gcccctcctcggccacacaa

SEQ ID NO: 339691 - DNA, 20 bp, human
ggacctgcggggttcctgtg

SEQ ID NO: 339692 - DNA, 20 bp, human
gaggaaccccgcaggtctga

SEQ ID NO: 339693 - DNA, 20 bp, human
gtgaacctgggtctgaactg

SEQ ID NO: 339694 - DNA, 20 bp, human
ggcctcccctcagacctgcg

SEQ ID NO: 339695 - DNA, 20 bp, human
gggccacagcattgtctggt

SEQ ID NO: 339696 - DNA, 20 bp, human
gctgcctggccgggcttgtt

SEQ ID NO: 339697 - DNA, 20 bp, human
gacggcagcgccctcctatt

SEQ ID NO: 339698 - DNA, 20 bp, human
gctggccgcagcgggcatga

SEQ ID NO: 339699 - DNA, 20 bp, human
gctcacctgccaggtgccca

SEQ ID NO: 339700 - DNA, 20 bp, human
gcccctttgcccaatggcac

SEQ ID NO: 339701 - DNA, 20 bp, human
gtagcctgacggttaagtga

SEQ ID NO: 339702 - DNA, 20 bp, human
gcatgatggagtactgaccg

SEQ ID NO: 339703 - DNA, 20 bp, human
gcgcccgcccctttgcccaa

SEQ ID NO: 339704 - DNA, 20 bp, human
ggccctctgctggccgcagc

SEQ ID NO: 339705 - DNA, 20 bp, human
gcgggcttgttgggatgagt

SEQ ID NO: 339706 - DNA, 20 bp, human
gtcaccgaatcaagagggga

SEQ ID NO: 339707 - DNA, 20 bp, human
gagccccaggcgagccaagg

SEQ ID NO: 339708 - DNA, 20 bp, human
gcgcgcggagcgaggatcca

SEQ ID NO: 339709 - DNA, 20 bp, human
gctcttgattcggtgagata

SEQ ID NO: 339710 - DNA, 20 bp, human
gtgtgaaagtgggatgcaac

SEQ ID NO: 339711 - DNA, 20 bp, human
gcgagccaagggggcgatgg

SEQ ID NO: 339712 - DNA, 20 bp, human
ggagggaggtctcgtaattt

SEQ ID NO: 339713 - DNA, 20 bp, human
ggggagccccaggcgagcca

SEQ ID NO: 339714 - DNA, 20 bp, human
gcgcccccttggctcgcctg

SEQ ID NO: 339715 - DNA, 20 bp, human
gcgaggatccagggtgcgaa

SEQ ID NO: 339716 - DNA, 20 bp, human
ggacggcggggcgtggccca

SEQ ID NO: 339717 - DNA, 20 bp, human
gagtgagggcgtgtccgcag

SEQ ID NO: 339718 - DNA, 20 bp, human
gcggcgggacccgcggacgg

SEQ ID NO: 339719 - DNA, 20 bp, human
ggcaggccaagcggccaagt

SEQ ID NO: 339720 - DNA, 20 bp, human
gcacgcgcggagtttggggt

SEQ ID NO: 339721 - DNA, 20 bp, human
ggagagcgaagcggagtcgg

SEQ ID NO: 339722 - DNA, 20 bp, human
gggccaagcggccaagtggg

SEQ ID NO: 339723 - DNA, 20 bp, human
gagagagggagcgagcgtca

SEQ ID NO: 339724 - DNA, 20 bp, human
ggccacacgcgcggagtttg

SEQ ID NO: 339725 - DNA, 20 bp, human
gcgcgcgtgtggcgcttctc

SEQ ID NO: 339726 - DNA, 20 bp, human
gaccccgcccaggatcctta

SEQ ID NO: 339727 - DNA, 20 bp, human
ggatccttaaggcctttcga

SEQ ID NO: 339728 - DNA, 20 bp, human
gcagatctggatatggggtg

SEQ ID NO: 339729 - DNA, 20 bp, human
gcatcgcttcgctaggacag

SEQ ID NO: 339730 - DNA, 20 bp, human
gattggtcagatctggatat

SEQ ID NO: 339731 - DNA, 20 bp, human
ggtcctagcgaagcgatgat

SEQ ID NO: 339732 - DNA, 20 bp, human
gaggccttaaggatcctggg

SEQ ID NO: 339733 - DNA, 20 bp, human
gaaaacccacaaccctcgaa

SEQ ID NO: 339734 - DNA, 20 bp, human
ggaaaggccttaaggatcct

SEQ ID NO: 339735 - DNA, 20 bp, human
ggcagagcagaggtgaggtc

SEQ ID NO: 339736 - DNA, 20 bp, human
ggccgcgcgggaaacgctgg

SEQ ID NO: 339737 - DNA, 20 bp, human
gcggccgctcgtaccctacc

SEQ ID NO: 339738 - DNA, 20 bp, human
gcgcggccacacagctccca

SEQ ID NO: 339739 - DNA, 20 bp, human
gtgccccgccgtggggtttt

SEQ ID NO: 339740 - DNA, 20 bp, human
ggcgcctggtagggtacgag

SEQ ID NO: 339741 - DNA, 20 bp, human
ggccgccagcgtttcccgcg

SEQ ID NO: 339742 - DNA, 20 bp, human
gggcgccgcgcgggaaacgc

SEQ ID NO: 339743 - DNA, 20 bp, human
gaggcgctctgccccgccgt

SEQ ID NO: 339744 - DNA, 20 bp, human
gaggcctctgggcgcgtgcg

SEQ ID NO: 339745 - DNA, 20 bp, human
gagggcaccacccccagtcc

SEQ ID NO: 339746 - DNA, 20 bp, human
gggggaagggtttaaccagg

SEQ ID NO: 339747 - DNA, 20 bp, human
gggcgttatgggagcggacg

SEQ ID NO: 339748 - DNA, 20 bp, human
gcgcgggtcgggagcgtgtc

SEQ ID NO: 339749 - DNA, 20 bp, human
ggccccgcagacggcgttat

SEQ ID NO: 339750 - DNA, 20 bp, human
ggtcgggagcgtgtccgggc

SEQ ID NO: 339751 - DNA, 20 bp, human
ggcagacggcgttatgggag

SEQ ID NO: 339752 - DNA, 20 bp, human
gtaaccaggaggaacgttgt

SEQ ID NO: 339753 - DNA, 20 bp, human
gagaacttccctggtgacgt

SEQ ID NO: 339754 - DNA, 20 bp, human
gtggacgtcgtcagcggcag

SEQ ID NO: 339755 - DNA, 20 bp, human
gcggcggcgccgacccgcgg

SEQ ID NO: 339756 - DNA, 20 bp, human
ggaaatgactcattagattg

SEQ ID NO: 339757 - DNA, 20 bp, human
gaggaagaccacaggacatc

SEQ ID NO: 339758 - DNA, 20 bp, human
gggtattagcagctgcataa

SEQ ID NO: 339759 - DNA, 20 bp, human
gtgttattaaggaagaccac

SEQ ID NO: 339760 - DNA, 20 bp, human
gactaaaaccaaaacaatgt

SEQ ID NO: 339761 - DNA, 20 bp, human
gtaatcagaaaatacacaaa

SEQ ID NO: 339762 - DNA, 20 bp, human
gacagaatcgtttaccaagc

SEQ ID NO: 339763 - DNA, 20 bp, human
ggattatagtctcttgaaaa

SEQ ID NO: 339764 - DNA, 20 bp, human
ggagataaaatacacctgac

SEQ ID NO: 339765 - DNA, 20 bp, human
ggctttttgttcacactgac

SEQ ID NO: 339766 - DNA, 20 bp, human
ggatgggaaagcaatgtcta

SEQ ID NO: 339767 - DNA, 20 bp, human
gcgggcaagagctaactgaa

SEQ ID NO: 339768 - DNA, 20 bp, human
gaaaactgacaaagggatcc

SEQ ID NO: 339769 - DNA, 20 bp, human
ggaaactgtcattgagtagc

SEQ ID NO: 339770 - DNA, 20 bp, human
gcaaaacagagacagtgtcg

SEQ ID NO: 339771 - DNA, 20 bp, human
gaaagcaatgtctagggacc

SEQ ID NO: 339772 - DNA, 20 bp, human
gagtgtcggggtatgctatg

SEQ ID NO: 339773 - DNA, 20 bp, human
gtgacagtttctggtttcac

SEQ ID NO: 339774 - DNA, 20 bp, human
gtctcatcttgatgcactcc

SEQ ID NO: 339775 - DNA, 20 bp, human
gaacgactcctctgaggccc

SEQ ID NO: 339776 - DNA, 20 bp, human
gcacccgcgcaacggaggag

SEQ ID NO: 339777 - DNA, 20 bp, human
gaaacggggcgggctcttaa

SEQ ID NO: 339778 - DNA, 20 bp, human
gagacccggcacccgcgcaa

SEQ ID NO: 339779 - DNA, 20 bp, human
gccagcaacccgcccgggtg

SEQ ID NO: 339780 - DNA, 20 bp, human
gggggcggggtgacgggaaa

SEQ ID NO: 339781 - DNA, 20 bp, human
gctgaccgccgttggggaga

SEQ ID NO: 339782 - DNA, 20 bp, human
ggcgggtgccgggtctacgt

SEQ ID NO: 339783 - DNA, 20 bp, human
gttaaagggccagagctagg

SEQ ID NO: 339784 - DNA, 20 bp, human
gtaggcggcccacgtagacc

SEQ ID NO: 339785 - DNA, 20 bp, human
gtcaaggaccccagggacgg

SEQ ID NO: 339786 - DNA, 20 bp, human
ggaggctgagggcagcgggg

SEQ ID NO: 339787 - DNA, 20 bp, human
ggggaagtcatcggaggctg

SEQ ID NO: 339788 - DNA, 20 bp, human
ggcgggggcggggaagtcat

SEQ ID NO: 339789 - DNA, 20 bp, human
gaggcgaggctctgcgcggt

SEQ ID NO: 339790 - DNA, 20 bp, human
gctgtcaccgagcagggcgg

SEQ ID NO: 339791 - DNA, 20 bp, human
gcgcgcaagccaaagctcgg

SEQ ID NO: 339792 - DNA, 20 bp, human
gaatcggaggcacccttcgc

SEQ ID NO: 339793 - DNA, 20 bp, human
ggccaatcgggagctccggc

SEQ ID NO: 339794 - DNA, 20 bp, human
gagaacgtctgtcaccgagc

SEQ ID NO: 339795 - DNA, 20 bp, human
ggcctgccggagctcccgat

SEQ ID NO: 339796 - DNA, 20 bp, human
ggaggctgagggcagcgggg

SEQ ID NO: 339797 - DNA, 20 bp, human
ggggaagtcatcggaggctg

SEQ ID NO: 339798 - DNA, 20 bp, human
ggcgggggcggggaagtcat

SEQ ID NO: 339799 - DNA, 20 bp, human
gaggcgaggctctgcgcggt

SEQ ID NO: 339800 - DNA, 20 bp, human
gctgtcaccgagcagggcgg

SEQ ID NO: 339801 - DNA, 20 bp, human
gcgcgcaagccaaagctcgg

SEQ ID NO: 339802 - DNA, 20 bp, human
gaatcggaggcacccttcgc

SEQ ID NO: 339803 - DNA, 20 bp, human
ggccaatcgggagctccggc

SEQ ID NO: 339804 - DNA, 20 bp, human
gagaacgtctgtcaccgagc

SEQ ID NO: 339805 - DNA, 20 bp, human
ggcctgccggagctcccgat

SEQ ID NO: 339806 - DNA, 20 bp, human
gcacctactggttcttaaag

SEQ ID NO: 339807 - DNA, 20 bp, human
gagccccagctgactcataa

SEQ ID NO: 339808 - DNA, 20 bp, human
gaatagaagttcaccagctg

SEQ ID NO: 339809 - DNA, 20 bp, human
ggaggactacgaggatattg

SEQ ID NO: 339810 - DNA, 20 bp, human
gaacttggtgaatcacctac

SEQ ID NO: 339811 - DNA, 20 bp, human
gcagtggcttacgaccgtga

SEQ ID NO: 339812 - DNA, 20 bp, human
gtatcctcgtagtcctcagc

SEQ ID NO: 339813 - DNA, 20 bp, human
gttccgctttaagaaccagt

SEQ ID NO: 339814 - DNA, 20 bp, human
gcacagtatagtgtaatcat

SEQ ID NO: 339815 - DNA, 20 bp, human
gtatttctttgaggaggtaa

SEQ ID NO: 339816 - DNA, 20 bp, human
gtcaccaagtagtggttttc

SEQ ID NO: 339817 - DNA, 20 bp, human
ggatctatgccctcagcaag

SEQ ID NO: 339818 - DNA, 20 bp, human
gtgagggcatagatccagct

SEQ ID NO: 339819 - DNA, 20 bp, human
gaggtcatgcacatcatgtc

SEQ ID NO: 339820 - DNA, 20 bp, human
gaaaccatggtcctgccatc

SEQ ID NO: 339821 - DNA, 20 bp, human
gtgggtattgctaacagttc

SEQ ID NO: 339822 - DNA, 20 bp, human
gccatggtcctgccatctgg

SEQ ID NO: 339823 - DNA, 20 bp, human
ggggtgttaaaacctccaga

SEQ ID NO: 339824 - DNA, 20 bp, human
ggctctcttactactctatg

SEQ ID NO: 339825 - DNA, 20 bp, human
gggtaaattcagaaactgtt

SEQ ID NO: 339826 - DNA, 20 bp, human
gtcagggcccgcctctggag

SEQ ID NO: 339827 - DNA, 20 bp, human
ggggcagagaggccgactgt

SEQ ID NO: 339828 - DNA, 20 bp, human
ggaagctgggggcggttcta

SEQ ID NO: 339829 - DNA, 20 bp, human
gccggctcagggcccgcctc

SEQ ID NO: 339830 - DNA, 20 bp, human
gcagacctaccgctgactta

SEQ ID NO: 339831 - DNA, 20 bp, human
ggaagcagtgccagtgtgaa

SEQ ID NO: 339832 - DNA, 20 bp, human
gaggggaggcgtgagccagt

SEQ ID NO: 339833 - DNA, 20 bp, human
gtgcgtgaagagaagctgaa

SEQ ID NO: 339834 - DNA, 20 bp, human
gagacacgcccagagcgggg

SEQ ID NO: 339835 - DNA, 20 bp, human
gtcccttgagctgtccgaaa

SEQ ID NO: 339836 - DNA, 20 bp, human
gtctaggcgggcggaagcgg

SEQ ID NO: 339837 - DNA, 20 bp, human
gaggaggggagcgcggcata

SEQ ID NO: 339838 - DNA, 20 bp, human
gaacccggaagacaggggcg

SEQ ID NO: 339839 - DNA, 20 bp, human
gagaaggggcgtggtctagg

SEQ ID NO: 339840 - DNA, 20 bp, human
ggggcggggccagaattggc

SEQ ID NO: 339841 - DNA, 20 bp, human
gagggtgaacccggaagaca

SEQ ID NO: 339842 - DNA, 20 bp, human
gggagccctccaggttcgat

SEQ ID NO: 339843 - DNA, 20 bp, human
gggccagtggactgcctgat

SEQ ID NO: 339844 - DNA, 20 bp, human
ggacggggcggggcattagg

SEQ ID NO: 339845 - DNA, 20 bp, human
gagcgcggcatagggcggag

SEQ ID NO: 339846 - DNA, 20 bp, human
gcatgctcgaatgtacaagg

SEQ ID NO: 339847 - DNA, 20 bp, human
gagttgcggtccaggaatcg

SEQ ID NO: 339848 - DNA, 20 bp, human
gtcctggaccgcaactccca

SEQ ID NO: 339849 - DNA, 20 bp, human
gtgcgctcttaggggttccg

SEQ ID NO: 339850 - DNA, 20 bp, human
gtagcggcagccacgattcc

SEQ ID NO: 339851 - DNA, 20 bp, human
gtggtggggccatggtaagg

SEQ ID NO: 339852 - DNA, 20 bp, human
gcgcagggcacgtcgggaag

SEQ ID NO: 339853 - DNA, 20 bp, human
ggggcacgtcgggaagagga

SEQ ID NO: 339854 - DNA, 20 bp, human
gggccggtgggatttacttc

SEQ ID NO: 339855 - DNA, 20 bp, human
gaccctgggagttgcggtcc

SEQ ID NO: 339856 - DNA, 20 bp, human
gcaaagggaagtattatgtg

SEQ ID NO: 339857 - DNA, 20 bp, human
gcaatggggaaaggcagtgt

SEQ ID NO: 339858 - DNA, 20 bp, human
ggcaatgaatggctcttcaa

SEQ ID NO: 339859 - DNA, 20 bp, human
gttgtgggagagaaacgtag

SEQ ID NO: 339860 - DNA, 20 bp, human
gagtgtgaggaagtattcat

SEQ ID NO: 339861 - DNA, 20 bp, human
gggccagctgcccgcccaat

SEQ ID NO: 339862 - DNA, 20 bp, human
ggactcttacagagacccaa

SEQ ID NO: 339863 - DNA, 20 bp, human
ggtcgggactaagcaatgaa

SEQ ID NO: 339864 - DNA, 20 bp, human
gtgtaagagtcacacgcttt

SEQ ID NO: 339865 - DNA, 20 bp, human
gaacgtaggggagcagtgtg

SEQ ID NO: 339866 - DNA, 20 bp, human
ggggagggcgggactcaggg

SEQ ID NO: 339867 - DNA, 20 bp, human
gtgggtcagcgtgtgcggga

SEQ ID NO: 339868 - DNA, 20 bp, human
gtgcagtagggtgtgtccct

SEQ ID NO: 339869 - DNA, 20 bp, human
gtcagcgtgtgcgggagggc

SEQ ID NO: 339870 - DNA, 20 bp, human
ggtgcgggagggcgggactc

SEQ ID NO: 339871 - DNA, 20 bp, human
gtccctgggtcagcgtgtgc

SEQ ID NO: 339872 - DNA, 20 bp, human
gcgggcgcggtcggcgtcgg

SEQ ID NO: 339873 - DNA, 20 bp, human
gtcaacactaggtctccacg

SEQ ID NO: 339874 - DNA, 20 bp, human
gtactgcagcgacgcaaaca

SEQ ID NO: 339875 - DNA, 20 bp, human
gagggcgttgttcccgttaa

SEQ ID NO: 339876 - DNA, 20 bp, human
ggggaagccgtgggcggaag

SEQ ID NO: 339877 - DNA, 20 bp, human
ggcgagaggctcggaggcgc

SEQ ID NO: 339878 - DNA, 20 bp, human
ggtgctcggagcggaagcag

SEQ ID NO: 339879 - DNA, 20 bp, human
gccgacggcccaaggcgttc

SEQ ID NO: 339880 - DNA, 20 bp, human
gcgccttgggccgtcggcga

SEQ ID NO: 339881 - DNA, 20 bp, human
ggcgttcaggcacgcgcttt

SEQ ID NO: 339882 - DNA, 20 bp, human
ggggcaggggccgagtccag

SEQ ID NO: 339883 - DNA, 20 bp, human
gtagctgggggagacaagac

SEQ ID NO: 339884 - DNA, 20 bp, human
gccccgctcaccgtcgggaa

SEQ ID NO: 339885 - DNA, 20 bp, human
gccccctcgccgacggccca

SEQ ID NO: 339886 - DNA, 20 bp, human
gggaatgacactcctcgaag

SEQ ID NO: 339887 - DNA, 20 bp, human
gtaagtgcaaggcacaaatg

SEQ ID NO: 339888 - DNA, 20 bp, human
ggcagactccccaattcatt

SEQ ID NO: 339889 - DNA, 20 bp, human
ggggagagacagatgccgtg

SEQ ID NO: 339890 - DNA, 20 bp, human
gagacagatgccgtgagggg

SEQ ID NO: 339891 - DNA, 20 bp, human
gggaggtgggctccaccttg

SEQ ID NO: 339892 - DNA, 20 bp, human
gctgatgcaatatatctcac

SEQ ID NO: 339893 - DNA, 20 bp, human
gggacctcaggtcgcgaccc

SEQ ID NO: 339894 - DNA, 20 bp, human
gcttccggggtcgcgacctg

SEQ ID NO: 339895 - DNA, 20 bp, human
gtccaccttgtggccgtgat

SEQ ID NO: 339896 - DNA, 20 bp, human
gtacatcaggtatggtacga

SEQ ID NO: 339897 - DNA, 20 bp, human
gctactccagaagtaaatgt

SEQ ID NO: 339898 - DNA, 20 bp, human
gctacttcagataatgaata

SEQ ID NO: 339899 - DNA, 20 bp, human
gtcaagttccagatctaact

SEQ ID NO: 339900 - DNA, 20 bp, human
gtctaactgggatctcttct

SEQ ID NO: 339901 - DNA, 20 bp, human
gagaatagatgaagtataaa

SEQ ID NO: 339902 - DNA, 20 bp, human
gttggtttctaaagtacatc

SEQ ID NO: 339903 - DNA, 20 bp, human
gaagagatcccagttagatc

SEQ ID NO: 339904 - DNA, 20 bp, human
gtttcatgcagggtcaaatt

SEQ ID NO: 339905 - DNA, 20 bp, human
gatcctcccacatttacttc

SEQ ID NO: 339906 - DNA, 20 bp, human
gcgctggcagcgagtctgtc

SEQ ID NO: 339907 - DNA, 20 bp, human
gagactcgctgccagcggat

SEQ ID NO: 339908 - DNA, 20 bp, human
gaggaccagcccggctgcta

SEQ ID NO: 339909 - DNA, 20 bp, human
gcccgggggcaacgtgagat

SEQ ID NO: 339910 - DNA, 20 bp, human
gtaagtgggcacgaacgcgg

SEQ ID NO: 339911 - DNA, 20 bp, human
gtgagtcccgcctcgcccgg

SEQ ID NO: 339912 - DNA, 20 bp, human
ggccgcggatacacgccctc

SEQ ID NO: 339913 - DNA, 20 bp, human
gagcccggctgctacggccg

SEQ ID NO: 339914 - DNA, 20 bp, human
gcgcacgcgcgcggcagagc

SEQ ID NO: 339915 - DNA, 20 bp, human
gagtggggcggcgggtaagt

SEQ ID NO: 339916 - DNA, 20 bp, human
gaaaccgtcagaggtcacga

SEQ ID NO: 339917 - DNA, 20 bp, human
ggggtcagaagggaggtggc

SEQ ID NO: 339918 - DNA, 20 bp, human
gtcgtgacgtcaaagagcct

SEQ ID NO: 339919 - DNA, 20 bp, human
gcgttcgggaaaacgcagtc

SEQ ID NO: 339920 - DNA, 20 bp, human
gccgcctcctgaactcccat

SEQ ID NO: 339921 - DNA, 20 bp, human
gccggggtggggccgtgaac

SEQ ID NO: 339922 - DNA, 20 bp, human
gcagccaatgggagttcagg

SEQ ID NO: 339923 - DNA, 20 bp, human
gcagaggtcacgacggagac

SEQ ID NO: 339924 - DNA, 20 bp, human
ggtggggccgtgaaccggtt

SEQ ID NO: 339925 - DNA, 20 bp, human
gaagcagccaatgggagttc

SEQ ID NO: 339926 - DNA, 20 bp, human
ggtgagcgaaggttctgggc

SEQ ID NO: 339927 - DNA, 20 bp, human
gacaccgcgcggaatggacg

SEQ ID NO: 339928 - DNA, 20 bp, human
gctcgccgtagctgcgaaca

SEQ ID NO: 339929 - DNA, 20 bp, human
gaggctgtgagcgaaggttc

SEQ ID NO: 339930 - DNA, 20 bp, human
gcagacgtcacccccctcgg

SEQ ID NO: 339931 - DNA, 20 bp, human
gggaggaaggtagtcgcgtc

SEQ ID NO: 339932 - DNA, 20 bp, human
ggagctgagggcacggtcgc

SEQ ID NO: 339933 - DNA, 20 bp, human
gcctgcttaactgacacccg

SEQ ID NO: 339934 - DNA, 20 bp, human
ggtgagacacgcggagagaa

SEQ ID NO: 339935 - DNA, 20 bp, human
ggggggagcttcacgagggg

SEQ ID NO: 339936 - DNA, 20 bp, human
gtggcggccggcacccgagc

SEQ ID NO: 339937 - DNA, 20 bp, human
gcgcgagcgagcagtgggct

SEQ ID NO: 339938 - DNA, 20 bp, human
gcgccgcagggcaccttgta

SEQ ID NO: 339939 - DNA, 20 bp, human
gggcggcgcgagcgagcagt

SEQ ID NO: 339940 - DNA, 20 bp, human
ggggccactgcgtgcttggg

SEQ ID NO: 339941 - DNA, 20 bp, human
gtaaggcaatcgccgggatc

SEQ ID NO: 339942 - DNA, 20 bp, human
gacagccaccggtggtgcaa

SEQ ID NO: 339943 - DNA, 20 bp, human
gggggcgcgccaggcgtgac

SEQ ID NO: 339944 - DNA, 20 bp, human
gtcaccgcctctccgaggac

SEQ ID NO: 339945 - DNA, 20 bp, human
gcagccgcccaagcacgcag

SEQ ID NO: 339946 - DNA, 20 bp, human
gaaaaagtaacgtgcaggaa

SEQ ID NO: 339947 - DNA, 20 bp, human
gacgttaaaaagtaacgtgc

SEQ ID NO: 339948 - DNA, 20 bp, human
ggtgttgaccagagtagaga

SEQ ID NO: 339949 - DNA, 20 bp, human
gtgtgcggattgacatgttt

SEQ ID NO: 339950 - DNA, 20 bp, human
ggcgcccgatttgtctcacc

SEQ ID NO: 339951 - DNA, 20 bp, human
gacctggatgagagatggta

SEQ ID NO: 339952 - DNA, 20 bp, human
gtatggcttcagatgacaaa

SEQ ID NO: 339953 - DNA, 20 bp, human
gcaggaatggttcagttgcc

SEQ ID NO: 339954 - DNA, 20 bp, human
gcactcccgccttggagaag

SEQ ID NO: 339955 - DNA, 20 bp, human
gtataaagatgggtcgggaa

SEQ ID NO: 339956 - DNA, 20 bp, human
gaatcaaagctagacgtagc

SEQ ID NO: 339957 - DNA, 20 bp, human
gggtcgggaagttctagtag

SEQ ID NO: 339958 - DNA, 20 bp, human
gagaagtagaagtcgctcaa

SEQ ID NO: 339959 - DNA, 20 bp, human
gaattaaaatagagagcaat

SEQ ID NO: 339960 - DNA, 20 bp, human
gaacaaggaaggagtaggtc

SEQ ID NO: 339961 - DNA, 20 bp, human
gagagaagcagacggtgatg

SEQ ID NO: 339962 - DNA, 20 bp, human
gaagagaaagacgacgaaat

SEQ ID NO: 339963 - DNA, 20 bp, human
gggtaaagattagagataga

SEQ ID NO: 339964 - DNA, 20 bp, human
gctacttctacgtctctctc

SEQ ID NO: 339965 - DNA, 20 bp, human
gtagtagtcgtacttcttct

SEQ ID NO: 339966 - DNA, 20 bp, human
gaggaggatgcaagggtcaa

SEQ ID NO: 339967 - DNA, 20 bp, human
gccgcccgcctccccgtcca

SEQ ID NO: 339968 - DNA, 20 bp, human
gggtccaaaggagaggtcaa

SEQ ID NO: 339969 - DNA, 20 bp, human
gctgaccccgatgatctctc

SEQ ID NO: 339970 - DNA, 20 bp, human
gggctctgaggaggatgcaa

SEQ ID NO: 339971 - DNA, 20 bp, human
gccggcaggcaggttccccg

SEQ ID NO: 339972 - DNA, 20 bp, human
gagccgggcaagcaccccga

SEQ ID NO: 339973 - DNA, 20 bp, human
gcggctggcggccaggaggc

SEQ ID NO: 339974 - DNA, 20 bp, human
gccccaagccgggtggcctt

SEQ ID NO: 339975 - DNA, 20 bp, human
gtgtagcagtgccctggacg

SEQ ID NO: 339976 - DNA, 20 bp, human
ggccccgcctgcaacccggc

SEQ ID NO: 339977 - DNA, 20 bp, human
gccccgccccccacccacga

SEQ ID NO: 339978 - DNA, 20 bp, human
ggaggaaactagaacatcga

SEQ ID NO: 339979 - DNA, 20 bp, human
ggaggctcaggccggtagcg

SEQ ID NO: 339980 - DNA, 20 bp, human
gccggcggcggtcggttcct

SEQ ID NO: 339981 - DNA, 20 bp, human
ggaaggggcgtggctgctgt

SEQ ID NO: 339982 - DNA, 20 bp, human
gggacctccctggtcggaag

SEQ ID NO: 339983 - DNA, 20 bp, human
gtcgtcccctcgtgggtggg

SEQ ID NO: 339984 - DNA, 20 bp, human
ggcgcccctaagtccttctt

SEQ ID NO: 339985 - DNA, 20 bp, human
ggcggcggtcggttcctcgg

SEQ ID NO: 339986 - DNA, 20 bp, human
gggaagctgggcacgtgggg

SEQ ID NO: 339987 - DNA, 20 bp, human
ggctgaggagccaggtaaac

SEQ ID NO: 339988 - DNA, 20 bp, human
ggcgacgccagcagcacacg

SEQ ID NO: 339989 - DNA, 20 bp, human
gcagcagcacacggggaagc

SEQ ID NO: 339990 - DNA, 20 bp, human
gcgcgccgccgggtcttaaa

SEQ ID NO: 339991 - DNA, 20 bp, human
ggggcagcacgtgatagcgc

SEQ ID NO: 339992 - DNA, 20 bp, human
gggaatggggacagacatac

SEQ ID NO: 339993 - DNA, 20 bp, human
gcggcgcgacggaagcgcgt

SEQ ID NO: 339994 - DNA, 20 bp, human
gaaacacccgcaggcaggtg

SEQ ID NO: 339995 - DNA, 20 bp, human
gaagcgcgtgggcagcacgt

SEQ ID NO: 339996 - DNA, 20 bp, human
gcatcatcccacaactacta

SEQ ID NO: 339997 - DNA, 20 bp, human
ggcatgcaaagaaaggccca

SEQ ID NO: 339998 - DNA, 20 bp, human
gtcaccgtggcagttccgtc

SEQ ID NO: 339999 - DNA, 20 bp, human
gaaggtatgagctctcttga

SEQ ID NO: 340000 - DNA, 20 bp, human
gaaaaatggcaagagctggt

SEQ ID NO: 340001 - DNA, 20 bp, human
gattctctgtgcctgtctgt

SEQ ID NO: 340002 - DNA, 20 bp, human
gtactataatgaaattaaag

SEQ ID NO: 340003 - DNA, 20 bp, human
ggcaagagctggtaggctgc

SEQ ID NO: 340004 - DNA, 20 bp, human
gagttcatttagacctctgg

SEQ ID NO: 340005 - DNA, 20 bp, human
gcattctgatcaattaggcc

SEQ ID NO: 340006 - DNA, 20 bp, human
ggacactcgatccggtggga

SEQ ID NO: 340007 - DNA, 20 bp, human
gtcaagtcttcccacaagtc

SEQ ID NO: 340008 - DNA, 20 bp, human
ggtcatatttccagacttgt

SEQ ID NO: 340009 - DNA, 20 bp, human
ggtggtcagaagctactgtg

SEQ ID NO: 340010 - DNA, 20 bp, human
gtccggtgggagggaacatc

SEQ ID NO: 340011 - DNA, 20 bp, human
gagaatgcttggttaaagca

SEQ ID NO: 340012 - DNA, 20 bp, human
gagtacatgcatagttacat

SEQ ID NO: 340013 - DNA, 20 bp, human
gtagtcttcgaaagagagag

SEQ ID NO: 340014 - DNA, 20 bp, human
gcatgtacttgtgagctgaa

SEQ ID NO: 340015 - DNA, 20 bp, human
gagtgtccaaatgataaggc

SEQ ID NO: 340016 - DNA, 20 bp, human
gtgccccggcctttcctcta

SEQ ID NO: 340017 - DNA, 20 bp, human
gtagataaggcactgcacgt

SEQ ID NO: 340018 - DNA, 20 bp, human
gggccggggcaggatagata

SEQ ID NO: 340019 - DNA, 20 bp, human
gagcaacaggacgacacgat

SEQ ID NO: 340020 - DNA, 20 bp, human
ggacgacacgatgggtttgg

SEQ ID NO: 340021 - DNA, 20 bp, human
gtatcctttggactccttag

SEQ ID NO: 340022 - DNA, 20 bp, human
gatgccgcgcatagcatctc

SEQ ID NO: 340023 - DNA, 20 bp, human
gtgttcccaaagtggtaaca

SEQ ID NO: 340024 - DNA, 20 bp, human
gtgtgcgggcctaggaagtc

SEQ ID NO: 340025 - DNA, 20 bp, human
gaggaaaaccaactttggga

SEQ ID NO: 340026 - DNA, 20 bp, human
gatactgccacacagataag

SEQ ID NO: 340027 - DNA, 20 bp, human
ggtgccttacatcttatgat

SEQ ID NO: 340028 - DNA, 20 bp, human
gaaagtgcctaatcctggtt

SEQ ID NO: 340029 - DNA, 20 bp, human
ggggtctgtttgtattaatt

SEQ ID NO: 340030 - DNA, 20 bp, human
gctgtgtggcagtataatat

SEQ ID NO: 340031 - DNA, 20 bp, human
gggtaaggaaaggaatagtg

SEQ ID NO: 340032 - DNA, 20 bp, human
gttgccaatcataagatgta

SEQ ID NO: 340033 - DNA, 20 bp, human
gactcttgaaagttacttta

SEQ ID NO: 340034 - DNA, 20 bp, human
gctcggaacatcttatagca

SEQ ID NO: 340035 - DNA, 20 bp, human
ggaatttggacccagcattc

SEQ ID NO: 340036 - DNA, 20 bp, human
gcgaggcacgcctgctccgg

SEQ ID NO: 340037 - DNA, 20 bp, human
gctgctccggcggctcgcgg

SEQ ID NO: 340038 - DNA, 20 bp, human
ggagcaggcgtgcctcgcgc

SEQ ID NO: 340039 - DNA, 20 bp, human
ggcggctcgcgggggtcgag

SEQ ID NO: 340040 - DNA, 20 bp, human
gttgccgtggagccagcgag

SEQ ID NO: 340041 - DNA, 20 bp, human
gagctgctcgggcgtctcca

SEQ ID NO: 340042 - DNA, 20 bp, human
gtactgctgcagtggaggat

SEQ ID NO: 340043 - DNA, 20 bp, human
gcggggcggacgccgctcgc

SEQ ID NO: 340044 - DNA, 20 bp, human
gaaatgcccgagcccctcgc

SEQ ID NO: 340045 - DNA, 20 bp, human
gcccccgcggcggagctgct

SEQ ID NO: 340046 - DNA, 20 bp, human
gaagcggcaaagttggatct

SEQ ID NO: 340047 - DNA, 20 bp, human
gggcaaagttggatctggga

SEQ ID NO: 340048 - DNA, 20 bp, human
gtcagaggggcgtagcagat

SEQ ID NO: 340049 - DNA, 20 bp, human
gccgaaaggctgccagttcc

SEQ ID NO: 340050 - DNA, 20 bp, human
gtctgggagggcgtccgctg

SEQ ID NO: 340051 - DNA, 20 bp, human
ggtggcgcagacacggtcca

SEQ ID NO: 340052 - DNA, 20 bp, human
gctcggggaagcggcaaagt

SEQ ID NO: 340053 - DNA, 20 bp, human
ggggcagggcacgcggagtg

SEQ ID NO: 340054 - DNA, 20 bp, human
gactgcgccaagaagggcgc

SEQ ID NO: 340055 - DNA, 20 bp, human
gctgtagccgcggggggcgt

SEQ ID NO: 340056 - DNA, 20 bp, human
ggcgtcgtccgggagaccgc

SEQ ID NO: 340057 - DNA, 20 bp, human
gcggacccctccgcgtcgtc

SEQ ID NO: 340058 - DNA, 20 bp, human
gctctcgccgccgcccctgg

SEQ ID NO: 340059 - DNA, 20 bp, human
ggtctcccggacgacgcgga

SEQ ID NO: 340060 - DNA, 20 bp, human
ggctctctgcagtgcggaca

SEQ ID NO: 340061 - DNA, 20 bp, human
ggaccgcagggccattggcg

SEQ ID NO: 340062 - DNA, 20 bp, human
gcaatggccctgcggtctcc

SEQ ID NO: 340063 - DNA, 20 bp, human
gcagggccattggcgcggac

SEQ ID NO: 340064 - DNA, 20 bp, human
gcgggcgcttgtgtgcccgg

SEQ ID NO: 340065 - DNA, 20 bp, human
gcctagcccccccgccacgg

SEQ ID NO: 340066 - DNA, 20 bp, human
gacccccgtgccgacgacgg

SEQ ID NO: 340067 - DNA, 20 bp, human
gctgccaccgtcgtcggcac

SEQ ID NO: 340068 - DNA, 20 bp, human
gcccacccccgtgccgacga

SEQ ID NO: 340069 - DNA, 20 bp, human
ggcctggctgccaccgtcgt

SEQ ID NO: 340070 - DNA, 20 bp, human
ggggtgaggaaccaccttgc

SEQ ID NO: 340071 - DNA, 20 bp, human
gcccgctcacggttgcgcac

SEQ ID NO: 340072 - DNA, 20 bp, human
gcacccggcccttcacccat

SEQ ID NO: 340073 - DNA, 20 bp, human
gcagttccgctcatggggta

SEQ ID NO: 340074 - DNA, 20 bp, human
gtggctcttcctcattggag

SEQ ID NO: 340075 - DNA, 20 bp, human
ggccgacgacggtggcagcc

SEQ ID NO: 340076 - DNA, 20 bp, human
gaaccgggcgtgggttgcta

SEQ ID NO: 340077 - DNA, 20 bp, human
gaacccacgcccggttgcca

SEQ ID NO: 340078 - DNA, 20 bp, human
gggcgctgcaattggaccta

SEQ ID NO: 340079 - DNA, 20 bp, human
gctccatggcaaccgggcgt

SEQ ID NO: 340080 - DNA, 20 bp, human
gaccgccgctcgggggtctt

SEQ ID NO: 340081 - DNA, 20 bp, human
ggggtctggatacactccgg

SEQ ID NO: 340082 - DNA, 20 bp, human
gccggcccaggcgggtcacg

SEQ ID NO: 340083 - DNA, 20 bp, human
gcgcgctgcgacgccaacct

SEQ ID NO: 340084 - DNA, 20 bp, human
ggcccaagacccccgagcgg

SEQ ID NO: 340085 - DNA, 20 bp, human
gccggttgccatggagacgt

SEQ ID NO: 340086 - DNA, 20 bp, human
gggccccaagtccttgtcat

SEQ ID NO: 340087 - DNA, 20 bp, human
gtcccgatgacaaggacttg

SEQ ID NO: 340088 - DNA, 20 bp, human
ggatgccggtaccctctgga

SEQ ID NO: 340089 - DNA, 20 bp, human
ggctggggtctgcgtcgctg

SEQ ID NO: 340090 - DNA, 20 bp, human
gtgtgcggctccctctgcgc

SEQ ID NO: 340091 - DNA, 20 bp, human
ggatacccgacctcattcag

SEQ ID NO: 340092 - DNA, 20 bp, human
gccccgcccaaccgtctcca

SEQ ID NO: 340093 - DNA, 20 bp, human
gagggtaccggcatcactgg

SEQ ID NO: 340094 - DNA, 20 bp, human
gtgccatggagacggttggg

SEQ ID NO: 340095 - DNA, 20 bp, human
gcaaggctgcaccgttgcca

SEQ ID NO: 340096 - DNA, 20 bp, human
ggggcccggtggcatagcaa

SEQ ID NO: 340097 - DNA, 20 bp, human
ggcatagcaacggacgagag

SEQ ID NO: 340098 - DNA, 20 bp, human
ggggagggggtgtcgctgga

SEQ ID NO: 340099 - DNA, 20 bp, human
ggcccccggagcgaccacag

SEQ ID NO: 340100 - DNA, 20 bp, human
gagttgtgtggcagttctaa

SEQ ID NO: 340101 - DNA, 20 bp, human
ggcactgcccgtccgatggc

SEQ ID NO: 340102 - DNA, 20 bp, human
ggcaacggacgagagaggcc

SEQ ID NO: 340103 - DNA, 20 bp, human
gcccggagcgaccacagcgg

SEQ ID NO: 340104 - DNA, 20 bp, human
gggtggggagggggtgtcgc

SEQ ID NO: 340105 - DNA, 20 bp, human
gccgatggcaggcgcgatag

SEQ ID NO: 340106 - DNA, 20 bp, human
gcaggcacccgcagctaact

SEQ ID NO: 340107 - DNA, 20 bp, human
gagacaacgctcatcgtcat

SEQ ID NO: 340108 - DNA, 20 bp, human
gacccgcagctaactgggga

SEQ ID NO: 340109 - DNA, 20 bp, human
gtgctagcgcagagtcgggg

SEQ ID NO: 340110 - DNA, 20 bp, human
gtccctccccagttagctgc

SEQ ID NO: 340111 - DNA, 20 bp, human
gggggagggagatgactgcc

SEQ ID NO: 340112 - DNA, 20 bp, human
gaaccactcagcgaccggaa

SEQ ID NO: 340113 - DNA, 20 bp, human
gcccccttccggtcgctgag

SEQ ID NO: 340114 - DNA, 20 bp, human
gtgcgctagcagcgggatcc

SEQ ID NO: 340115 - DNA, 20 bp, human
gcattggctcagagtcacaa

SEQ ID NO: 340116 - DNA, 20 bp, human
gtggggcagaatacggaaag

SEQ ID NO: 340117 - DNA, 20 bp, human
gtcacaggccggggacctgc

SEQ ID NO: 340118 - DNA, 20 bp, human
gggccggtgggggggaaaac

SEQ ID NO: 340119 - DNA, 20 bp, human
gccccggcctgtgacgtttt

SEQ ID NO: 340120 - DNA, 20 bp, human
ggggctgggagttgcgcggc

SEQ ID NO: 340121 - DNA, 20 bp, human
gagaccatcaggcatatctt

SEQ ID NO: 340122 - DNA, 20 bp, human
gggaaaggggcggagctgca

SEQ ID NO: 340123 - DNA, 20 bp, human
ggcctgtgacgttttaggaa

SEQ ID NO: 340124 - DNA, 20 bp, human
gtgcgaaaggcagtgggtaa

SEQ ID NO: 340125 - DNA, 20 bp, human
gtgtcctaagatatgcctga

SEQ ID NO: 340126 - DNA, 20 bp, human
ggaaggggagggctgtgcgt

SEQ ID NO: 340127 - DNA, 20 bp, human
gggggagaggatatatatgc

SEQ ID NO: 340128 - DNA, 20 bp, human
gggggaggtggggatgtcac

SEQ ID NO: 340129 - DNA, 20 bp, human
ggccttccctgtgcttccag

SEQ ID NO: 340130 - DNA, 20 bp, human
gggtctgatggcagagccgg

SEQ ID NO: 340131 - DNA, 20 bp, human
gaggctctgtgaggactgat

SEQ ID NO: 340132 - DNA, 20 bp, human
gtgagaatggattgatgggg

SEQ ID NO: 340133 - DNA, 20 bp, human
gaggcttgagaatggattga

SEQ ID NO: 340134 - DNA, 20 bp, human
gcctcctggtgacagtgacg

SEQ ID NO: 340135 - DNA, 20 bp, human
gaaggagactccaggatttg

SEQ ID NO: 340136 - DNA, 20 bp, human
ggggtcaagaccctgtgggg

SEQ ID NO: 340137 - DNA, 20 bp, human
gaccctgtggggtggtaggc

SEQ ID NO: 340138 - DNA, 20 bp, human
gaatggggtcaagaccctgt

SEQ ID NO: 340139 - DNA, 20 bp, human
gagagcccagcagacccgct

SEQ ID NO: 340140 - DNA, 20 bp, human
gagtgacgactgctgtacgc

SEQ ID NO: 340141 - DNA, 20 bp, human
gtaggccggctggacgtgcg

SEQ ID NO: 340142 - DNA, 20 bp, human
gaggggctggagaaacatcg

SEQ ID NO: 340143 - DNA, 20 bp, human
gcagctggtggctagaagtc

SEQ ID NO: 340144 - DNA, 20 bp, human
gggagccgagcgggtctgct

SEQ ID NO: 340145 - DNA, 20 bp, human
gggcttgtgggaggtcacat

SEQ ID NO: 340146 - DNA, 20 bp, human
gccccggggcagaaggttta

SEQ ID NO: 340147 - DNA, 20 bp, human
gcgcacccagcatttcatct

SEQ ID NO: 340148 - DNA, 20 bp, human
gggtaccgagatgaaatgct

SEQ ID NO: 340149 - DNA, 20 bp, human
ggctgggaagaactctgatt

SEQ ID NO: 340150 - DNA, 20 bp, human
gctgccctgcggactggaat

SEQ ID NO: 340151 - DNA, 20 bp, human
gtgaaatgctgggtgcgctc

SEQ ID NO: 340152 - DNA, 20 bp, human
gcggaaatagggctagaagt

SEQ ID NO: 340153 - DNA, 20 bp, human
ggaattagggtgtgtcacca

SEQ ID NO: 340154 - DNA, 20 bp, human
ggctcgcttgccattggctg

SEQ ID NO: 340155 - DNA, 20 bp, human
gtgacacaccctaattcaat

SEQ ID NO: 340156 - DNA, 20 bp, human
gggcacagcacataggggat

SEQ ID NO: 340157 - DNA, 20 bp, human
gccctcagttaatactaact

SEQ ID NO: 340158 - DNA, 20 bp, human
gtaaacagtctctagagtgg

SEQ ID NO: 340159 - DNA, 20 bp, human
gctaacttggattctcgaga

SEQ ID NO: 340160 - DNA, 20 bp, human
ggactaaacagtctctagag

SEQ ID NO: 340161 - DNA, 20 bp, human
gaagatgtctggcagtgact

SEQ ID NO: 340162 - DNA, 20 bp, human
gactgtttagtctcaaaagt

SEQ ID NO: 340163 - DNA, 20 bp, human
ggcagtcctagctatttggc

SEQ ID NO: 340164 - DNA, 20 bp, human
gcagcacataggggatgggt

SEQ ID NO: 340165 - DNA, 20 bp, human
gtgtcaataagaaagatgtc

SEQ ID NO: 340166 - DNA, 20 bp, human
gggggccgggtcaaggacgg

SEQ ID NO: 340167 - DNA, 20 bp, human
gggcacacgaagaccaatcg

SEQ ID NO: 340168 - DNA, 20 bp, human
gcggggggccgggtcaagga

SEQ ID NO: 340169 - DNA, 20 bp, human
gcgtgcccagcaggggcgga

SEQ ID NO: 340170 - DNA, 20 bp, human
gaacagggccagaacaggat

SEQ ID NO: 340171 - DNA, 20 bp, human
ggacccacgcgacctgacgt

SEQ ID NO: 340172 - DNA, 20 bp, human
gacaggatggggccatctag

SEQ ID NO: 340173 - DNA, 20 bp, human
ggccccacgtcaggtcgcgt

SEQ ID NO: 340174 - DNA, 20 bp, human
gcccctgctgggcacggctg

SEQ ID NO: 340175 - DNA, 20 bp, human
gggcacacgcctaggggtgt

SEQ ID NO: 340176 - DNA, 20 bp, human
ggggtggggacgacgtctgg

SEQ ID NO: 340177 - DNA, 20 bp, human
gtggggacgacgtctggcgg

SEQ ID NO: 340178 - DNA, 20 bp, human
gcggcgggaggcccaatgag

SEQ ID NO: 340179 - DNA, 20 bp, human
gacgacgtctggcgggggat

SEQ ID NO: 340180 - DNA, 20 bp, human
gggtctgggagggggattgg

SEQ ID NO: 340181 - DNA, 20 bp, human
gaggctggacccccccgcac

SEQ ID NO: 340182 - DNA, 20 bp, human
gtgggggtggggacgacgtc

SEQ ID NO: 340183 - DNA, 20 bp, human
gtggcggaggacctgtgcgg

SEQ ID NO: 340184 - DNA, 20 bp, human
ggtcgctgcggggagctccc

SEQ ID NO: 340185 - DNA, 20 bp, human
ggggggcggggaccgggtct

SEQ ID NO: 340186 - DNA, 20 bp, human
ggcgggcgaaagggtggaga

SEQ ID NO: 340187 - DNA, 20 bp, human
gaccgcccaggcgggcgaaa

SEQ ID NO: 340188 - DNA, 20 bp, human
gaacagacgcgaagagggta

SEQ ID NO: 340189 - DNA, 20 bp, human
gacaacgcctctctagggtg

SEQ ID NO: 340190 - DNA, 20 bp, human
ggcctagcgggcgccttcgt

SEQ ID NO: 340191 - DNA, 20 bp, human
ggaagagggtaaggcacttc

SEQ ID NO: 340192 - DNA, 20 bp, human
gccgggaaacagacgcgaag

SEQ ID NO: 340193 - DNA, 20 bp, human
gttccggggcacagaaaatg

SEQ ID NO: 340194 - DNA, 20 bp, human
gccctaggggccaactccag

SEQ ID NO: 340195 - DNA, 20 bp, human
gggaggacgctccggtctag

SEQ ID NO: 340196 - DNA, 20 bp, human
gctggcgcacaactggagtg

SEQ ID NO: 340197 - DNA, 20 bp, human
gcagcgcgcgggcacttctg

SEQ ID NO: 340198 - DNA, 20 bp, human
ggcccgccccggatccgcat

SEQ ID NO: 340199 - DNA, 20 bp, human
gcgcgacccggggacttcat

SEQ ID NO: 340200 - DNA, 20 bp, human
gggcacttctggggcacacc

SEQ ID NO: 340201 - DNA, 20 bp, human
gccccagccaatgaagtccc

SEQ ID NO: 340202 - DNA, 20 bp, human
ggatccggggcgggcgcgtg

SEQ ID NO: 340203 - DNA, 20 bp, human
gcaggctgtagtggtaggtg

SEQ ID NO: 340204 - DNA, 20 bp, human
gccagcgtatacacagcgcg

SEQ ID NO: 340205 - DNA, 20 bp, human
gctatgacccgatgcggatc

SEQ ID NO: 340206 - DNA, 20 bp, human
gcagagacgctgggattagt

SEQ ID NO: 340207 - DNA, 20 bp, human
gcgggcggaactacgtttcc

SEQ ID NO: 340208 - DNA, 20 bp, human
ggaaagttactgagattctg

SEQ ID NO: 340209 - DNA, 20 bp, human
gctgcaaactggaatggtaa

SEQ ID NO: 340210 - DNA, 20 bp, human
gacgctgggattagtgggtg

SEQ ID NO: 340211 - DNA, 20 bp, human
gggtggggcggagaccgggt

SEQ ID NO: 340212 - DNA, 20 bp, human
ggggatgcttggggtggcgt

SEQ ID NO: 340213 - DNA, 20 bp, human
gtaaggggtggggcggagac

SEQ ID NO: 340214 - DNA, 20 bp, human
gaggccctacgcgtaggcga

SEQ ID NO: 340215 - DNA, 20 bp, human
gaccgggtaggtgccggcgt

SEQ ID NO: 340216 - DNA, 20 bp, human
gctggcggggcgtggatccg

SEQ ID NO: 340217 - DNA, 20 bp, human
gtggagaagcacggctggag

SEQ ID NO: 340218 - DNA, 20 bp, human
gagatggggcgtatccaagc

SEQ ID NO: 340219 - DNA, 20 bp, human
gaggggaggtgacgctggcg

SEQ ID NO: 340220 - DNA, 20 bp, human
ggctggaggggaggtgacgc

SEQ ID NO: 340221 - DNA, 20 bp, human
gcgtatccaagcaggtcaag

SEQ ID NO: 340222 - DNA, 20 bp, human
gccagaacagcagccagatg

SEQ ID NO: 340223 - DNA, 20 bp, human
gttccgggacagccacgtga

SEQ ID NO: 340224 - DNA, 20 bp, human
gtctgtaaacagccctcacg

SEQ ID NO: 340225 - DNA, 20 bp, human
ggctgtttacagagggaagg

SEQ ID NO: 340226 - DNA, 20 bp, human
gggaacggagattgacaagg

SEQ ID NO: 340227 - DNA, 20 bp, human
ggagcggggcggggctgagt

SEQ ID NO: 340228 - DNA, 20 bp, human
gtgcgcatatctcggggcgg

SEQ ID NO: 340229 - DNA, 20 bp, human
ggaggcgtggcttgctggtg

SEQ ID NO: 340230 - DNA, 20 bp, human
gcacgcacacacgtctgtcg

SEQ ID NO: 340231 - DNA, 20 bp, human
gggaggaacggagattgaca

SEQ ID NO: 340232 - DNA, 20 bp, human
gaggcggaaaatcctcaccc

SEQ ID NO: 340233 - DNA, 20 bp, human
ggctctattgcgcatatctc

SEQ ID NO: 340234 - DNA, 20 bp, human
gaagtgacgcgctagaagtt

SEQ ID NO: 340235 - DNA, 20 bp, human
gtgggtctacccgcgggccg

SEQ ID NO: 340236 - DNA, 20 bp, human
gtccgatcctggaaactcat

SEQ ID NO: 340237 - DNA, 20 bp, human
gagtttccaggatcggagga

SEQ ID NO: 340238 - DNA, 20 bp, human
gctaacaggtcctaagtcct

SEQ ID NO: 340239 - DNA, 20 bp, human
gacagacacggagaggtcat

SEQ ID NO: 340240 - DNA, 20 bp, human
gccccaaaggcgctacccat

SEQ ID NO: 340241 - DNA, 20 bp, human
gggaggttggttaaaggtat

SEQ ID NO: 340242 - DNA, 20 bp, human
gtcttgcagctcaggcgggg

SEQ ID NO: 340243 - DNA, 20 bp, human
gttaacacgcacgtggaggt

SEQ ID NO: 340244 - DNA, 20 bp, human
gtccccggggtagaagtcca

SEQ ID NO: 340245 - DNA, 20 bp, human
gagggcaggaagtaccccct

SEQ ID NO: 340246 - DNA, 20 bp, human
gggctccgccccacggtctg

SEQ ID NO: 340247 - DNA, 20 bp, human
gcctctctagtcttcgtaga

SEQ ID NO: 340248 - DNA, 20 bp, human
gccgagggacgccggggtaa

SEQ ID NO: 340249 - DNA, 20 bp, human
ggctcactccgcagaccgtg

SEQ ID NO: 340250 - DNA, 20 bp, human
ggcggaaacgaaactccatc

SEQ ID NO: 340251 - DNA, 20 bp, human
gtctgcggagtgagccaatc

SEQ ID NO: 340252 - DNA, 20 bp, human
gaccgtggggcggagcctga

SEQ ID NO: 340253 - DNA, 20 bp, human
ggcggtgcccgagggacgcc

SEQ ID NO: 340254 - DNA, 20 bp, human
gtcgtttccgcggtgcccga

SEQ ID NO: 340255 - DNA, 20 bp, human
gaacataatcgcgttctgat

SEQ ID NO: 340256 - DNA, 20 bp, human
gtgggctttcgcaggaaagt

SEQ ID NO: 340257 - DNA, 20 bp, human
gtgtctacccgaagctgcgg

SEQ ID NO: 340258 - DNA, 20 bp, human
ggggaggagtaaagagggtg

SEQ ID NO: 340259 - DNA, 20 bp, human
gagggcggcaggaagaacgg

SEQ ID NO: 340260 - DNA, 20 bp, human
gagctgcggaggcggagcga

SEQ ID NO: 340261 - DNA, 20 bp, human
gctacccgaagctgcggagg

SEQ ID NO: 340262 - DNA, 20 bp, human
gcaaagagggcgcactgcgc

SEQ ID NO: 340263 - DNA, 20 bp, human
ggtcccgcgaacaatgaaat

SEQ ID NO: 340264 - DNA, 20 bp, human
gctagcccggcgaagcgcag

SEQ ID NO: 340265 - DNA, 20 bp, human
ggccttgtcgcactctaatt

SEQ ID NO: 340266 - DNA, 20 bp, human
ggggccgccgcctgttgctg

SEQ ID NO: 340267 - DNA, 20 bp, human
gggagaaaggactaagacac

SEQ ID NO: 340268 - DNA, 20 bp, human
gcccacccacacaccctcga

SEQ ID NO: 340269 - DNA, 20 bp, human
gcgcacgagagccgagcggt

SEQ ID NO: 340270 - DNA, 20 bp, human
gtggaccgagcagttactcc

SEQ ID NO: 340271 - DNA, 20 bp, human
ggcggcggcccgcttctcat

SEQ ID NO: 340272 - DNA, 20 bp, human
gcatgccgggagtaactgct

SEQ ID NO: 340273 - DNA, 20 bp, human
gcggagaggccgccggagaa

SEQ ID NO: 340274 - DNA, 20 bp, human
gggcctggccaatgagaagc

SEQ ID NO: 340275 - DNA, 20 bp, human
ggtggccctcgagggtgtgt

SEQ ID NO: 340276 - DNA, 20 bp, human
gccggaagcggaggacacgt

SEQ ID NO: 340277 - DNA, 20 bp, human
ggccttaaggatcccggaag

SEQ ID NO: 340278 - DNA, 20 bp, human
gggaagcagagctgtatgac

SEQ ID NO: 340279 - DNA, 20 bp, human
gggttcctgcggggaaaatc

SEQ ID NO: 340280 - DNA, 20 bp, human
gtctcaggcggaacgagtgg

SEQ ID NO: 340281 - DNA, 20 bp, human
gcctccagacataggggcgt

SEQ ID NO: 340282 - DNA, 20 bp, human
ggaactgggcacggagaccg

SEQ ID NO: 340283 - DNA, 20 bp, human
gttaaggatcccggaagcgg

SEQ ID NO: 340284 - DNA, 20 bp, human
gaaccactgagagttcccga

SEQ ID NO: 340285 - DNA, 20 bp, human
gagcagagctgtatgaccgg

SEQ ID NO: 340286 - DNA, 20 bp, human
gaggaagtggggtagtaacc

SEQ ID NO: 340287 - DNA, 20 bp, human
gtgtgtggccacagctgacc

SEQ ID NO: 340288 - DNA, 20 bp, human
gagccctgtaaagagaggac

SEQ ID NO: 340289 - DNA, 20 bp, human
gcctgtaaagagaggacggg

SEQ ID NO: 340290 - DNA, 20 bp, human
ggaggacgggaggtatgcgc

SEQ ID NO: 340291 - DNA, 20 bp, human
gctctgatcgcatcgatcac

SEQ ID NO: 340292 - DNA, 20 bp, human
gccgccagccctgtaaagag

SEQ ID NO: 340293 - DNA, 20 bp, human
gcagggctggcggtgtctcg

SEQ ID NO: 340294 - DNA, 20 bp, human
gtggccatgcctggagcgcg

SEQ ID NO: 340295 - DNA, 20 bp, human
gtggagcgcggggtttgact

SEQ ID NO: 340296 - DNA, 20 bp, human
gctctgatcgcatcgatcac

SEQ ID NO: 340297 - DNA, 20 bp, human
gacagcacccgtgacgttta

SEQ ID NO: 340298 - DNA, 20 bp, human
gtcaacaaaataagcggtag

SEQ ID NO: 340299 - DNA, 20 bp, human
gtaaagctttgacatgaaga

SEQ ID NO: 340300 - DNA, 20 bp, human
gggatcaccttaaacgtcac

SEQ ID NO: 340301 - DNA, 20 bp, human
gggcactgtgtggaaaacag

SEQ ID NO: 340302 - DNA, 20 bp, human
gaataagagcgatgaatgga

SEQ ID NO: 340303 - DNA, 20 bp, human
gaaaggaactaaatcccctg

SEQ ID NO: 340304 - DNA, 20 bp, human
gaattcaaatctgccctcag

SEQ ID NO: 340305 - DNA, 20 bp, human
gtttacgtcaacaaaataag

SEQ ID NO: 340306 - DNA, 20 bp, human
gtggctccgcaggttggtag

SEQ ID NO: 340307 - DNA, 20 bp, human
gagctctcggaccaatcaaa

SEQ ID NO: 340308 - DNA, 20 bp, human
gcgggagctgatttggatag

SEQ ID NO: 340309 - DNA, 20 bp, human
gggagaagccggaattactt

SEQ ID NO: 340310 - DNA, 20 bp, human
ggccccctggctccgcaggt

SEQ ID NO: 340311 - DNA, 20 bp, human
gtgattggtccgagagctgg

SEQ ID NO: 340312 - DNA, 20 bp, human
gggtagggggcggggtccta

SEQ ID NO: 340313 - DNA, 20 bp, human
gcgtgctcagttctgttcag

SEQ ID NO: 340314 - DNA, 20 bp, human
ggcggctgcaggctgctaag

SEQ ID NO: 340315 - DNA, 20 bp, human
gagccccacccagcgcccgt

SEQ ID NO: 340316 - DNA, 20 bp, human
gctccccgggaagtgggaac

SEQ ID NO: 340317 - DNA, 20 bp, human
gtggccggttcccacttccc

SEQ ID NO: 340318 - DNA, 20 bp, human
gaaccggccaagtcccgagc

SEQ ID NO: 340319 - DNA, 20 bp, human
ggccaagtcccgagcgggga

SEQ ID NO: 340320 - DNA, 20 bp, human
gaccctacgcctgtgtccga

SEQ ID NO: 340321 - DNA, 20 bp, human
gtctcctgcccgcgcctggg

SEQ ID NO: 340322 - DNA, 20 bp, human
gctgagaggggtcggtgcgg

SEQ ID NO: 340323 - DNA, 20 bp, human
gcccacccgggagaccggga

SEQ ID NO: 340324 - DNA, 20 bp, human
gcccctccccgctcgggact

SEQ ID NO: 340325 - DNA, 20 bp, human
gctccttcggacacaggcgt

SEQ ID NO: 340326 - DNA, 20 bp, human
gtgtgtgagcacggcagagt

SEQ ID NO: 340327 - DNA, 20 bp, human
ggaacatgtaagagagtcag

SEQ ID NO: 340328 - DNA, 20 bp, human
gaggctactatgagtaggga

SEQ ID NO: 340329 - DNA, 20 bp, human
gactctcttacatgttccac

SEQ ID NO: 340330 - DNA, 20 bp, human
gacacgccgtgggaaggggt

SEQ ID NO: 340331 - DNA, 20 bp, human
gaggccttctggcaccccgc

SEQ ID NO: 340332 - DNA, 20 bp, human
ggctgcagaaaagagtccgg

SEQ ID NO: 340333 - DNA, 20 bp, human
gccacaggacgatggaccgc

SEQ ID NO: 340334 - DNA, 20 bp, human
gccagggcccgggagtatga

SEQ ID NO: 340335 - DNA, 20 bp, human
gaggccaggctactatgagt

SEQ ID NO: 340336 - DNA, 20 bp, human
ggggacgaccgcaggagtag

SEQ ID NO: 340337 - DNA, 20 bp, human
ggggcagcagcgagggatta

SEQ ID NO: 340338 - DNA, 20 bp, human
gcgaccgcaggagtaggggt

SEQ ID NO: 340339 - DNA, 20 bp, human
gggagagttccgagaagcag

SEQ ID NO: 340340 - DNA, 20 bp, human
ggagggatggggggagcttc

SEQ ID NO: 340341 - DNA, 20 bp, human
gtgttcttgtggcccggccc

SEQ ID NO: 340342 - DNA, 20 bp, human
gtacgaaagcagagatgggg

SEQ ID NO: 340343 - DNA, 20 bp, human
ggtcgtcccaaataccagac

SEQ ID NO: 340344 - DNA, 20 bp, human
ggagcaagaccagccagcag

SEQ ID NO: 340345 - DNA, 20 bp, human
gccaaccattaccccagaaa

SEQ ID NO: 340346 - DNA, 20 bp, human
gggccgtgaacaatgagcag

SEQ ID NO: 340347 - DNA, 20 bp, human
gcgcccgtcgcgctccaggg

SEQ ID NO: 340348 - DNA, 20 bp, human
gtcccccaggagcccgccag

SEQ ID NO: 340349 - DNA, 20 bp, human
ggccgctggcgggctcctgg

SEQ ID NO: 340350 - DNA, 20 bp, human
gactccgccctggagcgcga

SEQ ID NO: 340351 - DNA, 20 bp, human
gcgtgaacaatgagcagagg

SEQ ID NO: 340352 - DNA, 20 bp, human
gtcccgcccgtcgcgctcca

SEQ ID NO: 340353 - DNA, 20 bp, human
gagaggaggaaactccgccc

SEQ ID NO: 340354 - DNA, 20 bp, human
ggcggcctccgcgccttggg

SEQ ID NO: 340355 - DNA, 20 bp, human
gggcccacttagaagcactc

SEQ ID NO: 340356 - DNA, 20 bp, human
gcgcccccgcggagacgaag

SEQ ID NO: 340357 - DNA, 20 bp, human
gcagcaccgccgaggctcgg

SEQ ID NO: 340358 - DNA, 20 bp, human
gggggcgcgcccgcggcacg

SEQ ID NO: 340359 - DNA, 20 bp, human
gcgtccgcttcgtctccgcg

SEQ ID NO: 340360 - DNA, 20 bp, human
gggagacgaagcggacgcgc

SEQ ID NO: 340361 - DNA, 20 bp, human
gcgcgtggaaatgactgtga

SEQ ID NO: 340362 - DNA, 20 bp, human
gaatcagcaccgccgaggct

SEQ ID NO: 340363 - DNA, 20 bp, human
gcggggagagagcggcatcc

SEQ ID NO: 340364 - DNA, 20 bp, human
gagggaacgggtgaccgcgc

SEQ ID NO: 340365 - DNA, 20 bp, human
gacggccatgcggaccaatg

SEQ ID NO: 340366 - DNA, 20 bp, human
gggtactgacacgcccttag

SEQ ID NO: 340367 - DNA, 20 bp, human
gaggggcggattcacttagc

SEQ ID NO: 340368 - DNA, 20 bp, human
gactgacacgcccttagggg

SEQ ID NO: 340369 - DNA, 20 bp, human
gtaagtgaatccgcccctaa

SEQ ID NO: 340370 - DNA, 20 bp, human
gccagagtttccaagcacat

SEQ ID NO: 340371 - DNA, 20 bp, human
gtgccacggagatagctaca

SEQ ID NO: 340372 - DNA, 20 bp, human
gagccttgtagctatctccg

SEQ ID NO: 340373 - DNA, 20 bp, human
gacagactcctttacctgct

SEQ ID NO: 340374 - DNA, 20 bp, human
gtttcctggagcaatgtcac

SEQ ID NO: 340375 - DNA, 20 bp, human
gcaccctgtgacattgctcc

SEQ ID NO: 340376 - DNA, 20 bp, human
gcgggcgctcgggtcgtgga

SEQ ID NO: 340377 - DNA, 20 bp, human
gcgggaccatagagatcccg

SEQ ID NO: 340378 - DNA, 20 bp, human
gccccctcaggccccggtag

SEQ ID NO: 340379 - DNA, 20 bp, human
gccattgtgcggtgcattgt

SEQ ID NO: 340380 - DNA, 20 bp, human
gcggcggtcgggccattgtg

SEQ ID NO: 340381 - DNA, 20 bp, human
gacccgagcgcccgctcgcg

SEQ ID NO: 340382 - DNA, 20 bp, human
gcggtgccgcgggatctcta

SEQ ID NO: 340383 - DNA, 20 bp, human
ggcccgaccgccgccactac

SEQ ID NO: 340384 - DNA, 20 bp, human
gcgccctgtacccggagcgg

SEQ ID NO: 340385 - DNA, 20 bp, human
ggccgcgcgagcgggcgctc

SEQ ID NO: 340386 - DNA, 20 bp, human
gacggcctccgggtctgcaa

SEQ ID NO: 340387 - DNA, 20 bp, human
gaggccgtggctgtggttcg

SEQ ID NO: 340388 - DNA, 20 bp, human
gcatcaccggcaagcagggg

SEQ ID NO: 340389 - DNA, 20 bp, human
gatggaacctctagccgctg

SEQ ID NO: 340390 - DNA, 20 bp, human
ggcgccatcaccggcaagca

SEQ ID NO: 340391 - DNA, 20 bp, human
gtccgccctcctgaccgcag

SEQ ID NO: 340392 - DNA, 20 bp, human
ggcggggcgtggttccgggg

SEQ ID NO: 340393 - DNA, 20 bp, human
gacctctagccgctgcggtc

SEQ ID NO: 340394 - DNA, 20 bp, human
gccctggcgcagcccacgca

SEQ ID NO: 340395 - DNA, 20 bp, human
gggttccattgcagacccgg

SEQ ID NO: 340396 - DNA, 20 bp, human
gggaagccgcgcctagagga

SEQ ID NO: 340397 - DNA, 20 bp, human
gggtccgggcagtccctggc

SEQ ID NO: 340398 - DNA, 20 bp, human
gagggactgcccggaccggc

SEQ ID NO: 340399 - DNA, 20 bp, human
gagcggggaggacacgtggt

SEQ ID NO: 340400 - DNA, 20 bp, human
gggcgcccgcgcgagctccg

SEQ ID NO: 340401 - DNA, 20 bp, human
gcggggccctcctctaggcg

SEQ ID NO: 340402 - DNA, 20 bp, human
gcggctacccaggcccgcca

SEQ ID NO: 340403 - DNA, 20 bp, human
gtcacacgcagcactggaag

SEQ ID NO: 340404 - DNA, 20 bp, human
gaagcggcctgcatcgggcg

SEQ ID NO: 340405 - DNA, 20 bp, human
gtctaggcgcggcttccggc

SEQ ID NO: 340406 - DNA, 20 bp, human
gaggctgcgccgggaaggtg

SEQ ID NO: 340407 - DNA, 20 bp, human
gtcccggcgcagccttctca

SEQ ID NO: 340408 - DNA, 20 bp, human
ggggagccgcagcacgtggg

SEQ ID NO: 340409 - DNA, 20 bp, human
gaagggtggtggggccacgg

SEQ ID NO: 340410 - DNA, 20 bp, human
gcccgggagccgcagcacgt

SEQ ID NO: 340411 - DNA, 20 bp, human
gtcagggaaactccgcctca

SEQ ID NO: 340412 - DNA, 20 bp, human
gggaaactccgcctcaaggc

SEQ ID NO: 340413 - DNA, 20 bp, human
gctggcacccctgggaaaat

SEQ ID NO: 340414 - DNA, 20 bp, human
gggtggggaggataaacgaa

SEQ ID NO: 340415 - DNA, 20 bp, human
gctgccggcgatggagtggt

SEQ ID NO: 340416 - DNA, 20 bp, human
gggagcgcgctgcacgtcat

SEQ ID NO: 340417 - DNA, 20 bp, human
gcgcgctccgaccaattggg

SEQ ID NO: 340418 - DNA, 20 bp, human
gcggggcgagagggtcggtg

SEQ ID NO: 340419 - DNA, 20 bp, human
ggtgggggggccaaggaatg

SEQ ID NO: 340420 - DNA, 20 bp, human
gacgagccgtatccctccgc

SEQ ID NO: 340421 - DNA, 20 bp, human
gagaagcccgggcaggggtt

SEQ ID NO: 340422 - DNA, 20 bp, human
ggggggcgggggggccccga

SEQ ID NO: 340423 - DNA, 20 bp, human
gcagcgcgctccgaccaatt

SEQ ID NO: 340424 - DNA, 20 bp, human
ggaccctctcgccccgcgga

SEQ ID NO: 340425 - DNA, 20 bp, human
gttgactagaaaagaagccc

SEQ ID NO: 340426 - DNA, 20 bp, human
gcaagcgcacgcatgctgat

SEQ ID NO: 340427 - DNA, 20 bp, human
gttccctaaggggtcatcac

SEQ ID NO: 340428 - DNA, 20 bp, human
ggcgcggcgcggcacgtcag

SEQ ID NO: 340429 - DNA, 20 bp, human
gcaaacgcgcgtccgcggga

SEQ ID NO: 340430 - DNA, 20 bp, human
gcgcttgcgcagtctccagg

SEQ ID NO: 340431 - DNA, 20 bp, human
gagctctagcttttccctaa

SEQ ID NO: 340432 - DNA, 20 bp, human
ggccctgtgatgacccctta

SEQ ID NO: 340433 - DNA, 20 bp, human
gaagcggtcgggcgctggaa

SEQ ID NO: 340434 - DNA, 20 bp, human
ggaaagaagcggtcgggcgc

SEQ ID NO: 340435 - DNA, 20 bp, human
gcgtgggagaaagggcgctc

SEQ ID NO: 340436 - DNA, 20 bp, human
gaatgagccggggaaagcaa

SEQ ID NO: 340437 - DNA, 20 bp, human
gcagggcgcgtgcgcatcag

SEQ ID NO: 340438 - DNA, 20 bp, human
ggaactgcgcagctgctgac

SEQ ID NO: 340439 - DNA, 20 bp, human
gtgcgcatcagcgggcgtgt

SEQ ID NO: 340440 - DNA, 20 bp, human
ggggccgcgcgtgcgcgcgt

SEQ ID NO: 340441 - DNA, 20 bp, human
ggaaagcaaggggaaggttt

SEQ ID NO: 340442 - DNA, 20 bp, human
ggcgtgcgcgcgtggggttc

SEQ ID NO: 340443 - DNA, 20 bp, human
ggggcgttgcgagtcacaac

SEQ ID NO: 340444 - DNA, 20 bp, human
gcagccgatgcccagaaaac

SEQ ID NO: 340445 - DNA, 20 bp, human
gtggggttccggaatgagcc

SEQ ID NO: 340446 - DNA, 20 bp, human
gtgaggagagagaactcgga

SEQ ID NO: 340447 - DNA, 20 bp, human
gagcccaggggccttcctat

SEQ ID NO: 340448 - DNA, 20 bp, human
gagagaactcggagggttcg

SEQ ID NO: 340449 - DNA, 20 bp, human
gcggagggttcgtggactcg

SEQ ID NO: 340450 - DNA, 20 bp, human
ggacacggcgcgggggaaat

SEQ ID NO: 340451 - DNA, 20 bp, human
gtggacgtggacacggcgcg

SEQ ID NO: 340452 - DNA, 20 bp, human
gcagcgccctagtacgtaag

SEQ ID NO: 340453 - DNA, 20 bp, human
gggactcgtggacgtggaca

SEQ ID NO: 340454 - DNA, 20 bp, human
gagtacgtaaggggctgcac

SEQ ID NO: 340455 - DNA, 20 bp, human
gaaggggctgcactggagtg

SEQ ID NO: 340456 - DNA, 20 bp, human
ggatgcgcgcgcaacacccg

SEQ ID NO: 340457 - DNA, 20 bp, human
gtctcgcccggggccgtgta

SEQ ID NO: 340458 - DNA, 20 bp, human
gcatggggaggcggagttaa

SEQ ID NO: 340459 - DNA, 20 bp, human
gttcgggcagacaggtcatg

SEQ ID NO: 340460 - DNA, 20 bp, human
gcgcgcgcaacacccgaggg

SEQ ID NO: 340461 - DNA, 20 bp, human
gagaccgcacgaggtcgtga

SEQ ID NO: 340462 - DNA, 20 bp, human
gtgaaggtagccgcgcggag

SEQ ID NO: 340463 - DNA, 20 bp, human
gagccgcggcgctcagagac

SEQ ID NO: 340464 - DNA, 20 bp, human
gggcgcgcccagaccgcacg

SEQ ID NO: 340465 - DNA, 20 bp, human
gctaccttcacgacctcgtg

SEQ ID NO: 340466 - DNA, 20 bp, human
gggactgggcgcacagtggt

SEQ ID NO: 340467 - DNA, 20 bp, human
gtgggcgcacagtggtcggc

SEQ ID NO: 340468 - DNA, 20 bp, human
gaggcgcctggtgacggacg

SEQ ID NO: 340469 - DNA, 20 bp, human
gggtgtggctccgcgttctc

SEQ ID NO: 340470 - DNA, 20 bp, human
ggggatgaggcgcctggtga

SEQ ID NO: 340471 - DNA, 20 bp, human
gggccgcgcgtgcaggggtt

SEQ ID NO: 340472 - DNA, 20 bp, human
gcacagtggtcggcgggatg

SEQ ID NO: 340473 - DNA, 20 bp, human
ggccgccaaccaaagacccg

SEQ ID NO: 340474 - DNA, 20 bp, human
gaaccaaagacccgcggcgc

SEQ ID NO: 340475 - DNA, 20 bp, human
gctgggacgcccagagaacg

SEQ ID NO: 340476 - DNA, 20 bp, human
gagacggcgcagacggaggt

SEQ ID NO: 340477 - DNA, 20 bp, human
gcactacggcggccctcgaa

SEQ ID NO: 340478 - DNA, 20 bp, human
gcggaggcgacgcactacgg

SEQ ID NO: 340479 - DNA, 20 bp, human
gtcgaagggtcaaactagtc

SEQ ID NO: 340480 - DNA, 20 bp, human
gcaacggaggcgacgcacta

SEQ ID NO: 340481 - DNA, 20 bp, human
gaggtcccgggtcgtttccc

SEQ ID NO: 340482 - DNA, 20 bp, human
ggttgccggggaaacgaccc

SEQ ID NO: 340483 - DNA, 20 bp, human
gtgcgtcgcctccgttgccg

SEQ ID NO: 340484 - DNA, 20 bp, human
ggtcgtttccccggcaacgg

SEQ ID NO: 340485 - DNA, 20 bp, human
gagtagaaaacaccgaagtg

SEQ ID NO: 340486 - DNA, 20 bp, human
ggccaatggtaggcagtgta

SEQ ID NO: 340487 - DNA, 20 bp, human
gaccctacactgcctaccat

SEQ ID NO: 340488 - DNA, 20 bp, human
gaggaagtcgccggggtcca

SEQ ID NO: 340489 - DNA, 20 bp, human
ggaagtcggggcatcccgac

SEQ ID NO: 340490 - DNA, 20 bp, human
gctggggcgggggacctgtc

SEQ ID NO: 340491 - DNA, 20 bp, human
gtgcctcagctgtgggccgc

SEQ ID NO: 340492 - DNA, 20 bp, human
ggacccacagcagaccaatg

SEQ ID NO: 340493 - DNA, 20 bp, human
gggggaaggtggtgaagtcg

SEQ ID NO: 340494 - DNA, 20 bp, human
ggcccccattggtctgctgt

SEQ ID NO: 340495 - DNA, 20 bp, human
gcctggcgctagccaatggt

SEQ ID NO: 340496 - DNA, 20 bp, human
gcgggcggaagtccgggttg

SEQ ID NO: 340497 - DNA, 20 bp, human
ggcgcggcgggcggaagtcc

SEQ ID NO: 340498 - DNA, 20 bp, human
gtctagccggctctccggtc

SEQ ID NO: 340499 - DNA, 20 bp, human
gcggtcaggtgaccccaacc

SEQ ID NO: 340500 - DNA, 20 bp, human
gcgctggggaagaagcacaa

SEQ ID NO: 340501 - DNA, 20 bp, human
gcgctcgcccgcaagcaaag

SEQ ID NO: 340502 - DNA, 20 bp, human
gccggagagccggctagata

SEQ ID NO: 340503 - DNA, 20 bp, human
gcggaagttgctctgagctc

SEQ ID NO: 340504 - DNA, 20 bp, human
gctccggggtgggaccaggc

SEQ ID NO: 340505 - DNA, 20 bp, human
gaaccgcccggccgcgggtc

SEQ ID NO: 340506 - DNA, 20 bp, human
gcagcaccgcgaaggctcac

SEQ ID NO: 340507 - DNA, 20 bp, human
gtgagcagccagcaccgcga

SEQ ID NO: 340508 - DNA, 20 bp, human
gaagcaggcaagaaccggaa

SEQ ID NO: 340509 - DNA, 20 bp, human
gggcaagaaccggaaggggc

SEQ ID NO: 340510 - DNA, 20 bp, human
gcgttccccgtgagccttcg

SEQ ID NO: 340511 - DNA, 20 bp, human
ggggagcgacgaactacttc

SEQ ID NO: 340512 - DNA, 20 bp, human
gctggctgctcatctgcata

SEQ ID NO: 340513 - DNA, 20 bp, human
gagtaggcgggtcaccttga

SEQ ID NO: 340514 - DNA, 20 bp, human
ggcgacagccagctcaaagc

SEQ ID NO: 340515 - DNA, 20 bp, human
gtgtcgcgagagttggtccg

SEQ ID NO: 340516 - DNA, 20 bp, human
ggagcccgaggcgccgagag

SEQ ID NO: 340517 - DNA, 20 bp, human
ggggaccggggaaaagtgtg

SEQ ID NO: 340518 - DNA, 20 bp, human
gcgcccggccagcctgaggt

SEQ ID NO: 340519 - DNA, 20 bp, human
gccccccgaggcgctccaat

SEQ ID NO: 340520 - DNA, 20 bp, human
gccggggaaaagtgtgtggt

SEQ ID NO: 340521 - DNA, 20 bp, human
gcgcaccgtggggttgggac

SEQ ID NO: 340522 - DNA, 20 bp, human
ggccaattggagcgcctcgg

SEQ ID NO: 340523 - DNA, 20 bp, human
ggaggcgctccaattggcgc

SEQ ID NO: 340524 - DNA, 20 bp, human
ggaggcgccgagagcggagt

SEQ ID NO: 340525 - DNA, 20 bp, human
gcgcggcgcaccgtggggtt

SEQ ID NO: 340526 - DNA, 20 bp, human
gcgcagtcctgcaatgtcta

SEQ ID NO: 340527 - DNA, 20 bp, human
gtcgcaaccccggaccgagt

SEQ ID NO: 340528 - DNA, 20 bp, human
gggaccgagtaggctgaaag

SEQ ID NO: 340529 - DNA, 20 bp, human
gtccggggttgcgaactgta

SEQ ID NO: 340530 - DNA, 20 bp, human
gcaggcagcggagaccaagc

SEQ ID NO: 340531 - DNA, 20 bp, human
gccaagcagggatcttaaca

SEQ ID NO: 340532 - DNA, 20 bp, human
ggacaccagggaagacgctc

SEQ ID NO: 340533 - DNA, 20 bp, human
ggctctggccctcagtttcc

SEQ ID NO: 340534 - DNA, 20 bp, human
gtggcgccaaatcgcaaata

SEQ ID NO: 340535 - DNA, 20 bp, human
gctctcatggcctcgaaaga

SEQ ID NO: 340536 - DNA, 20 bp, human
ggggcgtgcggggtgcggta

SEQ ID NO: 340537 - DNA, 20 bp, human
gccgcctccgcctcaaatac

SEQ ID NO: 340538 - DNA, 20 bp, human
ggggcaccatgggaaacgga

SEQ ID NO: 340539 - DNA, 20 bp, human
gcgcagcgcgtgggagacga

SEQ ID NO: 340540 - DNA, 20 bp, human
gacctggggaggggcgtgcg

SEQ ID NO: 340541 - DNA, 20 bp, human
gccactgcggcttcaaaatc

SEQ ID NO: 340542 - DNA, 20 bp, human
ggggtcagaccgtagcgacg

SEQ ID NO: 340543 - DNA, 20 bp, human
gcgcgtgggagacgaaggcg

SEQ ID NO: 340544 - DNA, 20 bp, human
gggacactgtaggccacgtg

SEQ ID NO: 340545 - DNA, 20 bp, human
gcgtagcgacgcgggaagtc

SEQ ID NO: 340546 - DNA, 20 bp, human
gcacgcgcctagccacccgt

SEQ ID NO: 340547 - DNA, 20 bp, human
ggccgcgcgcagcacgctca

SEQ ID NO: 340548 - DNA, 20 bp, human
gcatgcgcgcgcacagtcgg

SEQ ID NO: 340549 - DNA, 20 bp, human
gcgcgcgcctacacagggtg

SEQ ID NO: 340550 - DNA, 20 bp, human
gcgctgccaggaaaccgggt

SEQ ID NO: 340551 - DNA, 20 bp, human
ggagccccaggcacactcgt

SEQ ID NO: 340552 - DNA, 20 bp, human
gtggcagcgcactgccgcgt

SEQ ID NO: 340553 - DNA, 20 bp, human
ggggacgccccgagaggagg

SEQ ID NO: 340554 - DNA, 20 bp, human
gctccagcccgcgcgggaaa

SEQ ID NO: 340555 - DNA, 20 bp, human
ggccaggaaaccgggtgggc

SEQ ID NO: 340556 - DNA, 20 bp, human
gtctcaaggagcaggtggat

SEQ ID NO: 340557 - DNA, 20 bp, human
gagaagggggacttctgggt

SEQ ID NO: 340558 - DNA, 20 bp, human
gtggtcccgagctagctggt

SEQ ID NO: 340559 - DNA, 20 bp, human
gaatggagcggtccgcccgc

SEQ ID NO: 340560 - DNA, 20 bp, human
gaggagggccgccaatggag

SEQ ID NO: 340561 - DNA, 20 bp, human
gcccagcgcgaccaatagga

SEQ ID NO: 340562 - DNA, 20 bp, human
ggaagtgcggtgggaatcgg

SEQ ID NO: 340563 - DNA, 20 bp, human
gtgcggaacgcgcgaaccaa

SEQ ID NO: 340564 - DNA, 20 bp, human
gtgcacccagctaggtcccg

SEQ ID NO: 340565 - DNA, 20 bp, human
gtcctgccgcggtcgaaggg

SEQ ID NO: 340566 - DNA, 20 bp, human
gcgtcccccgcccaccatgg

SEQ ID NO: 340567 - DNA, 20 bp, human
ggaagcgcatgtctgcgttc

SEQ ID NO: 340568 - DNA, 20 bp, human
gcggcgtccgccatggtggg

SEQ ID NO: 340569 - DNA, 20 bp, human
gagcagagaaccatccgagc

SEQ ID NO: 340570 - DNA, 20 bp, human
ggggaggggcgcgacgcgaa

SEQ ID NO: 340571 - DNA, 20 bp, human
ggacatgcgcttccggggtg

SEQ ID NO: 340572 - DNA, 20 bp, human
gggccacggcgcaggcgcaa

SEQ ID NO: 340573 - DNA, 20 bp, human
ggagccggcgtccgccatgg

SEQ ID NO: 340574 - DNA, 20 bp, human
gcacggcgcaggcgcaacgg

SEQ ID NO: 340575 - DNA, 20 bp, human
gaaaaagtcaatctgaaggg

SEQ ID NO: 340576 - DNA, 20 bp, human
gcacgcgcccgcggaagtgg

SEQ ID NO: 340577 - DNA, 20 bp, human
gcgcgtgcgcagtggcgggc

SEQ ID NO: 340578 - DNA, 20 bp, human
gggcggggcgggaggcggaa

SEQ ID NO: 340579 - DNA, 20 bp, human
ggcggcccggtaccaacggg

SEQ ID NO: 340580 - DNA, 20 bp, human
gacgggagccgccacttccg

SEQ ID NO: 340581 - DNA, 20 bp, human
ggccgcggcccggtaccaac

SEQ ID NO: 340582 - DNA, 20 bp, human
gtgcgagcagctggtgaaag

SEQ ID NO: 340583 - DNA, 20 bp, human
ggtgcaggttgagcctaggt

SEQ ID NO: 340584 - DNA, 20 bp, human
gagtggcggctcccgtgtgc

SEQ ID NO: 340585 - DNA, 20 bp, human
gcctcggcgagaccacccgt

SEQ ID NO: 340586 - DNA, 20 bp, human
gtggtctccagggaaaccgg

SEQ ID NO: 340587 - DNA, 20 bp, human
gccacgactgcgcaggcgag

SEQ ID NO: 340588 - DNA, 20 bp, human
gtggtcggccacgactgcgc

SEQ ID NO: 340589 - DNA, 20 bp, human
gggaaaaaactcccgcacgt

SEQ ID NO: 340590 - DNA, 20 bp, human
gactggagactgtagtcccc

SEQ ID NO: 340591 - DNA, 20 bp, human
ggcgtgtcactctgggcaac

SEQ ID NO: 340592 - DNA, 20 bp, human
gctctgggcaacaggctggt

SEQ ID NO: 340593 - DNA, 20 bp, human
gggcaacagtgacgcaatac

SEQ ID NO: 340594 - DNA, 20 bp, human
gccaaccgcagcgctacttc

SEQ ID NO: 340595 - DNA, 20 bp, human
ggcggccggaagtagcgctg

SEQ ID NO: 340596 - DNA, 20 bp, human
gagagccggaggtagggttc

SEQ ID NO: 340597 - DNA, 20 bp, human
gttcgggaggaggatcccga

SEQ ID NO: 340598 - DNA, 20 bp, human
ggggagtagtgggggagaat

SEQ ID NO: 340599 - DNA, 20 bp, human
ggaggaggatcccgaaggct

SEQ ID NO: 340600 - DNA, 20 bp, human
ggacggggcggggagtagtg

SEQ ID NO: 340601 - DNA, 20 bp, human
gcccgggagagccggaggta

SEQ ID NO: 340602 - DNA, 20 bp, human
gcgtcacccgggagagccgg

SEQ ID NO: 340603 - DNA, 20 bp, human
gtgacgacgggtagaaaagc

SEQ ID NO: 340604 - DNA, 20 bp, human
gtcctcccgaaccctacctc

SEQ ID NO: 340605 - DNA, 20 bp, human
gggaggggagggtaaatagt

SEQ ID NO: 340606 - DNA, 20 bp, human
gtcagccggaagtgaccctc

SEQ ID NO: 340607 - DNA, 20 bp, human
gctgcaggacggtaactcga

SEQ ID NO: 340608 - DNA, 20 bp, human
gcggaagtgaccctctggaa

SEQ ID NO: 340609 - DNA, 20 bp, human
gaggggaaagatggcggtga

SEQ ID NO: 340610 - DNA, 20 bp, human
gagagcggacgaagggggga

SEQ ID NO: 340611 - DNA, 20 bp, human
gaaagatggcggtgacgggc

SEQ ID NO: 340612 - DNA, 20 bp, human
gccggagggccggaccctga

SEQ ID NO: 340613 - DNA, 20 bp, human
gtgcagcagcgcagtcttct

SEQ ID NO: 340614 - DNA, 20 bp, human
gcaatgagagcggacgaagg

SEQ ID NO: 340615 - DNA, 20 bp, human
gccatggcaaccgttccaga

SEQ ID NO: 340616 - DNA, 20 bp, human
gccgggacacccaatcctgt

SEQ ID NO: 340617 - DNA, 20 bp, human
gtgggccagtcggagcgctg

SEQ ID NO: 340618 - DNA, 20 bp, human
gcaaatgaggcctctccgtg

SEQ ID NO: 340619 - DNA, 20 bp, human
gccagtcggagcgctgggga

SEQ ID NO: 340620 - DNA, 20 bp, human
ggggcgtccccggctaggga

SEQ ID NO: 340621 - DNA, 20 bp, human
ggccccgccctatgcaaatg

SEQ ID NO: 340622 - DNA, 20 bp, human
gtccatgcaaataacggcag

SEQ ID NO: 340623 - DNA, 20 bp, human
gggagggtccgggctcctac

SEQ ID NO: 340624 - DNA, 20 bp, human
gggaggcgggtcttccggag

SEQ ID NO: 340625 - DNA, 20 bp, human
gcccgcctccatgcaaataa

SEQ ID NO: 340626 - DNA, 20 bp, human
gaaggcccgacgtgcccctc

SEQ ID NO: 340627 - DNA, 20 bp, human
gtcagtctgactctgactca

SEQ ID NO: 340628 - DNA, 20 bp, human
gtcagactgacgccctcagg

SEQ ID NO: 340629 - DNA, 20 bp, human
gaggtcccttcactggggag

SEQ ID NO: 340630 - DNA, 20 bp, human
gccaccgtcacgctgaccgg

SEQ ID NO: 340631 - DNA, 20 bp, human
ggactcaggtcccttcactg

SEQ ID NO: 340632 - DNA, 20 bp, human
gctgaagcgggcccactcgt

SEQ ID NO: 340633 - DNA, 20 bp, human
gctcctgaccctccttgggg

SEQ ID NO: 340634 - DNA, 20 bp, human
gggtctgaagccaagccaga

SEQ ID NO: 340635 - DNA, 20 bp, human
gccctcagggggaagttgca

SEQ ID NO: 340636 - DNA, 20 bp, human
gagtcggcgaggctggacta

SEQ ID NO: 340637 - DNA, 20 bp, human
ggcgaggctggactatgggg

SEQ ID NO: 340638 - DNA, 20 bp, human
ggcgcctcgcactgcctcac

SEQ ID NO: 340639 - DNA, 20 bp, human
gcaatgaatggggtgcagag

SEQ ID NO: 340640 - DNA, 20 bp, human
gtgcggtggggcgccctctg

SEQ ID NO: 340641 - DNA, 20 bp, human
ggcggagcctgggcaatgaa

SEQ ID NO: 340642 - DNA, 20 bp, human
ggcgtccaggcgctcccgtg

SEQ ID NO: 340643 - DNA, 20 bp, human
ggcatcctgcctcctgggcg

SEQ ID NO: 340644 - DNA, 20 bp, human
gaaaagaggcggagtcggcg

SEQ ID NO: 340645 - DNA, 20 bp, human
ggtgtcaaaagaggcggagt

SEQ ID NO: 340646 - DNA, 20 bp, human
ggggaaggagcggctctcgc

SEQ ID NO: 340647 - DNA, 20 bp, human
gcgctggcgtctaagacttc

SEQ ID NO: 340648 - DNA, 20 bp, human
gccgaaagccatagactcgt

SEQ ID NO: 340649 - DNA, 20 bp, human
gtaagccacggagaactcta

SEQ ID NO: 340650 - DNA, 20 bp, human
gaactctatggttccggggc

SEQ ID NO: 340651 - DNA, 20 bp, human
gggaaccatagagttctccg

SEQ ID NO: 340652 - DNA, 20 bp, human
gaaaatgggctgcccataat

SEQ ID NO: 340653 - DNA, 20 bp, human
gtatgaacgccgcgaggaag

SEQ ID NO: 340654 - DNA, 20 bp, human
ggcccataataggtagatca

SEQ ID NO: 340655 - DNA, 20 bp, human
gctccttccccacgagtcta

SEQ ID NO: 340656 - DNA, 20 bp, human
gccgcccgccgacccgtcag

SEQ ID NO: 340657 - DNA, 20 bp, human
gcgtgcctcgaccttcagga

SEQ ID NO: 340658 - DNA, 20 bp, human
gcagggaacagctccgctat

SEQ ID NO: 340659 - DNA, 20 bp, human
gcccaccttcctgaaggtcg

SEQ ID NO: 340660 - DNA, 20 bp, human
gagatcacttctacatgggg

SEQ ID NO: 340661 - DNA, 20 bp, human
gaaagcgtgcctcgaccttc

SEQ ID NO: 340662 - DNA, 20 bp, human
ggatgagatcacttctacat

SEQ ID NO: 340663 - DNA, 20 bp, human
ggctccgctattggctgaag

SEQ ID NO: 340664 - DNA, 20 bp, human
gcgcaggaacgacatttacg

SEQ ID NO: 340665 - DNA, 20 bp, human
gacgaaagcaatcataaaat

SEQ ID NO: 340666 - DNA, 20 bp, human
gtggctcagtcaattaggat

SEQ ID NO: 340667 - DNA, 20 bp, human
gggaggagagcggtcttctc

SEQ ID NO: 340668 - DNA, 20 bp, human
gtcgcgagcggggagatgag

SEQ ID NO: 340669 - DNA, 20 bp, human
gtgggactgggaacaggtga

SEQ ID NO: 340670 - DNA, 20 bp, human
gggactgcggccactacttc

SEQ ID NO: 340671 - DNA, 20 bp, human
gctagggcgggtggaacgag

SEQ ID NO: 340672 - DNA, 20 bp, human
gctcccccaggcctccagtc

SEQ ID NO: 340673 - DNA, 20 bp, human
gtcccagcaggctgcggaaa

SEQ ID NO: 340674 - DNA, 20 bp, human
ggccctaggccctgcggttt

SEQ ID NO: 340675 - DNA, 20 bp, human
gtgacctctttggctctcat

SEQ ID NO: 340676 - DNA, 20 bp, human
gtccggaaggtagacgtcca

SEQ ID NO: 340677 - DNA, 20 bp, human
gtccagggtcgaggagaggt

SEQ ID NO: 340678 - DNA, 20 bp, human
gcgcggagtgggcaagatgt

SEQ ID NO: 340679 - DNA, 20 bp, human
gctagccccgcgcgcggagt

SEQ ID NO: 340680 - DNA, 20 bp, human
gaccctggacgtctaccttc

SEQ ID NO: 340681 - DNA, 20 bp, human
gtagccctgctccgtctccg

SEQ ID NO: 340682 - DNA, 20 bp, human
gaggtagacgtccagggtcg

SEQ ID NO: 340683 - DNA, 20 bp, human
gaacacaaaaaggagaagcc

SEQ ID NO: 340684 - DNA, 20 bp, human
ggacgtccagggtcgaggag

SEQ ID NO: 340685 - DNA, 20 bp, human
ggaggagaggtgggatcggc

SEQ ID NO: 340686 - DNA, 20 bp, human
gagggggcgcactcacaaga

SEQ ID NO: 340687 - DNA, 20 bp, human
ggcccgggacccccttgcga

SEQ ID NO: 340688 - DNA, 20 bp, human
ggccaggggagtgtatggaa

SEQ ID NO: 340689 - DNA, 20 bp, human
gtgcttggagggtgctgtga

SEQ ID NO: 340690 - DNA, 20 bp, human
gtgagtgcgccccctcgcaa

SEQ ID NO: 340691 - DNA, 20 bp, human
gcccagccgcatcaagcagc

SEQ ID NO: 340692 - DNA, 20 bp, human
gggacacgacgcccaggtta

SEQ ID NO: 340693 - DNA, 20 bp, human
gggtactggaaggagtgtgg

SEQ ID NO: 340694 - DNA, 20 bp, human
gactcacaagagggactgga

SEQ ID NO: 340695 - DNA, 20 bp, human
gagggactggatggagcggt

SEQ ID NO: 340696 - DNA, 20 bp, human
gtggcctcgcgtggtcgccc

SEQ ID NO: 340697 - DNA, 20 bp, human
gaggccactcgcggcgggag

SEQ ID NO: 340698 - DNA, 20 bp, human
gcacgcgaggccactcgcgg

SEQ ID NO: 340699 - DNA, 20 bp, human
gggaaggcgcggaggacgga

SEQ ID NO: 340700 - DNA, 20 bp, human
gccagcgccgccttaccccg

SEQ ID NO: 340701 - DNA, 20 bp, human
gggcgcccgcaggcctgtct

SEQ ID NO: 340702 - DNA, 20 bp, human
gtcaccccgcgtcggggcgg

SEQ ID NO: 340703 - DNA, 20 bp, human
gtctgggcctcggggtaagg

SEQ ID NO: 340704 - DNA, 20 bp, human
gctgtctgggcctcggggta

SEQ ID NO: 340705 - DNA, 20 bp, human
ggccaccgctcaccccgcgt

SEQ ID NO: 340706 - DNA, 20 bp, human
gggaggtagcacagggcggg

SEQ ID NO: 340707 - DNA, 20 bp, human
gccgcacccgggccaatcgg

SEQ ID NO: 340708 - DNA, 20 bp, human
ggggaggtgggcggaccaga

SEQ ID NO: 340709 - DNA, 20 bp, human
gaacccgcacccgggccaat

SEQ ID NO: 340710 - DNA, 20 bp, human
gaggtgggcggaccagaggg

SEQ ID NO: 340711 - DNA, 20 bp, human
gtatccgagagctcgggagg

SEQ ID NO: 340712 - DNA, 20 bp, human
ggccaatcggaggtagcaca

SEQ ID NO: 340713 - DNA, 20 bp, human
gagcggcccaacccgcaccc

SEQ ID NO: 340714 - DNA, 20 bp, human
ggccctgtgctacctccgat

SEQ ID NO: 340715 - DNA, 20 bp, human
ggataggtggagccgccctc

SEQ ID NO: 340716 - DNA, 20 bp, human
gcgggtgtgtggcaccttgt

SEQ ID NO: 340717 - DNA, 20 bp, human
ggcgcctcggccagtcaagc

SEQ ID NO: 340718 - DNA, 20 bp, human
gaccacgcctctctacgcgg

SEQ ID NO: 340719 - DNA, 20 bp, human
gggccagtcaagcgggtgtg

SEQ ID NO: 340720 - DNA, 20 bp, human
gccccccgcgtagagaggcg

SEQ ID NO: 340721 - DNA, 20 bp, human
gccgcgctgcgggccggaaa

SEQ ID NO: 340722 - DNA, 20 bp, human
gccagagcccgaggcgccaa

SEQ ID NO: 340723 - DNA, 20 bp, human
ggagaccacgcctctctacg

SEQ ID NO: 340724 - DNA, 20 bp, human
gccaatcaggtgctgcgcct

SEQ ID NO: 340725 - DNA, 20 bp, human
gtcagcgctcgcgtgcactc

SEQ ID NO: 340726 - DNA, 20 bp, human
ggggtgcgagccagagtcgt

SEQ ID NO: 340727 - DNA, 20 bp, human
gcgcctgcgcaggcccgcaa

SEQ ID NO: 340728 - DNA, 20 bp, human
gcggccccgtagcgcaaggg

SEQ ID NO: 340729 - DNA, 20 bp, human
gaaccccccgctcgctggtt

SEQ ID NO: 340730 - DNA, 20 bp, human
gcgcccaaccagcgagcggg

SEQ ID NO: 340731 - DNA, 20 bp, human
ggggggtttacccacgactc

SEQ ID NO: 340732 - DNA, 20 bp, human
gaggcggccccgtagcgcaa

SEQ ID NO: 340733 - DNA, 20 bp, human
gccgtagcgcaagggagggc

SEQ ID NO: 340734 - DNA, 20 bp, human
gagcagcgaggagaggcggt

SEQ ID NO: 340735 - DNA, 20 bp, human
ggggtcctcccggggaaggg

SEQ ID NO: 340736 - DNA, 20 bp, human
gcgctgccgggctgattgag

SEQ ID NO: 340737 - DNA, 20 bp, human
ggtaggtcaagcttgggccg

SEQ ID NO: 340738 - DNA, 20 bp, human
gctaactttggcgtccctgt

SEQ ID NO: 340739 - DNA, 20 bp, human
gtcaagcttgggccggggtt

SEQ ID NO: 340740 - DNA, 20 bp, human
gttgcacacgcgtaaattgt

SEQ ID NO: 340741 - DNA, 20 bp, human
gacaccaaaggccgcccaca

SEQ ID NO: 340742 - DNA, 20 bp, human
ggctgtcctctcaatcagcc

SEQ ID NO: 340743 - DNA, 20 bp, human
gaccacgcgtctcacaccaa

SEQ ID NO: 340744 - DNA, 20 bp, human
gcaggcgcagatcctaactt

SEQ ID NO: 340745 - DNA, 20 bp, human
gcaaattgtaggtcaagctt

SEQ ID NO: 340746 - DNA, 20 bp, human
gaactgccgagcgtcttctg

SEQ ID NO: 340747 - DNA, 20 bp, human
ggtaccagattcagctatct

SEQ ID NO: 340748 - DNA, 20 bp, human
gggaggccgcagaagacgct

SEQ ID NO: 340749 - DNA, 20 bp, human
gtggcgccgcgcagtcaccg

SEQ ID NO: 340750 - DNA, 20 bp, human
gccaccaggtctcttatcaa

SEQ ID NO: 340751 - DNA, 20 bp, human
ggcgctgtgagtcgtctttg

SEQ ID NO: 340752 - DNA, 20 bp, human
gcctccgagatagctgaatc

SEQ ID NO: 340753 - DNA, 20 bp, human
gggcctcgctgactgacttc

SEQ ID NO: 340754 - DNA, 20 bp, human
ggactgacttccggtgttgg

SEQ ID NO: 340755 - DNA, 20 bp, human
gctgctccgcggtgactgcg

SEQ ID NO: 340756 - DNA, 20 bp, human
gagtgcagggcgcccctcgg

SEQ ID NO: 340757 - DNA, 20 bp, human
ggaggctccccgccaccgag

SEQ ID NO: 340758 - DNA, 20 bp, human
gctgccccaggacgtctgcg

SEQ ID NO: 340759 - DNA, 20 bp, human
gcctccgtccagaaaggcgt

SEQ ID NO: 340760 - DNA, 20 bp, human
gtcgccgcgcagacgtcctg

SEQ ID NO: 340761 - DNA, 20 bp, human
gaaggggcgtggtctcggga

SEQ ID NO: 340762 - DNA, 20 bp, human
gtgacctcctccgtccagaa

SEQ ID NO: 340763 - DNA, 20 bp, human
ggcagggcgcccctcggtgg

SEQ ID NO: 340764 - DNA, 20 bp, human
ggtccctacgcctttctgga

SEQ ID NO: 340765 - DNA, 20 bp, human
ggcggaaggggcgtggtctc

SEQ ID NO: 340766 - DNA, 20 bp, human
gtctgcgaagtgtgagatga

SEQ ID NO: 340767 - DNA, 20 bp, human
gaccaccttcccactgtctg

SEQ ID NO: 340768 - DNA, 20 bp, human
gtcagccccagacagtggga

SEQ ID NO: 340769 - DNA, 20 bp, human
ggatgtggaggccaaaaacc

SEQ ID NO: 340770 - DNA, 20 bp, human
gcccagcttggcgtggggtt

SEQ ID NO: 340771 - DNA, 20 bp, human
gaaacagcccagcttggcgt

SEQ ID NO: 340772 - DNA, 20 bp, human
gacttcgcagaggcacgttc

SEQ ID NO: 340773 - DNA, 20 bp, human
gctgttgactacctcattcc

SEQ ID NO: 340774 - DNA, 20 bp, human
gccaagattccatgtcacct

SEQ ID NO: 340775 - DNA, 20 bp, human
gacctaaccccacgccaagc

SEQ ID NO: 340776 - DNA, 20 bp, human
gcaaagacacacgagaacta

SEQ ID NO: 340777 - DNA, 20 bp, human
gtgccgctctcgtaaggctc

SEQ ID NO: 340778 - DNA, 20 bp, human
gccccgcgctggtctgtcgt

SEQ ID NO: 340779 - DNA, 20 bp, human
ggccaactgccgctctcgta

SEQ ID NO: 340780 - DNA, 20 bp, human
gagtgtgagcggggaaactg

SEQ ID NO: 340781 - DNA, 20 bp, human
gcctgaatgcagcaacgtct

SEQ ID NO: 340782 - DNA, 20 bp, human
gctcggatcggcagcgccaa

SEQ ID NO: 340783 - DNA, 20 bp, human
gatgcagcaacgtctcggat

SEQ ID NO: 340784 - DNA, 20 bp, human
ggtaaggctcgggctgccct

SEQ ID NO: 340785 - DNA, 20 bp, human
gcctgcgccgaatccgaatc

SEQ ID NO: 340786 - DNA, 20 bp, human
ggggaacgcggaagtctcga

SEQ ID NO: 340787 - DNA, 20 bp, human
ggggctggaaaggatactat

SEQ ID NO: 340788 - DNA, 20 bp, human
gaagtctcgagggacaggga

SEQ ID NO: 340789 - DNA, 20 bp, human
gccagacagggccgttgggg

SEQ ID NO: 340790 - DNA, 20 bp, human
gagggccgttgggggggcag

SEQ ID NO: 340791 - DNA, 20 bp, human
ggggaccctagtgctgggac

SEQ ID NO: 340792 - DNA, 20 bp, human
gagtgccggggatcggggtg

SEQ ID NO: 340793 - DNA, 20 bp, human
gtcccccgcctgtggagcca

SEQ ID NO: 340794 - DNA, 20 bp, human
gcacacccctgcccccccaa

SEQ ID NO: 340795 - DNA, 20 bp, human
ggcggaagtctcgagggaca

SEQ ID NO: 340796 - DNA, 20 bp, human
gcccctctccacatagaagt

SEQ ID NO: 340797 - DNA, 20 bp, human
gaaagtgcgcatgcgctgac

SEQ ID NO: 340798 - DNA, 20 bp, human
gagcccacttctatgtggag

SEQ ID NO: 340799 - DNA, 20 bp, human
gcagaaatactgcgcgatct

SEQ ID NO: 340800 - DNA, 20 bp, human
gagaagtgggctcccggagg

SEQ ID NO: 340801 - DNA, 20 bp, human
gcgcctgcgccgtaacccag

SEQ ID NO: 340802 - DNA, 20 bp, human
gtttctgcgtggcaccggtg

SEQ ID NO: 340803 - DNA, 20 bp, human
ggcacccagagagggtctta

SEQ ID NO: 340804 - DNA, 20 bp, human
gcgtggcaccggtgcggatg

SEQ ID NO: 340805 - DNA, 20 bp, human
gacccagaggaaatcacttc

SEQ ID NO: 340806 - DNA, 20 bp, human
gcagctccgcgggtctgatt

SEQ ID NO: 340807 - DNA, 20 bp, human
gaacaccacctcctccgcga

SEQ ID NO: 340808 - DNA, 20 bp, human
gtgattgggcctcgccgtcg

SEQ ID NO: 340809 - DNA, 20 bp, human
gtggagttccgccctcgcgg

SEQ ID NO: 340810 - DNA, 20 bp, human
gtagtggttctcgcccacga

SEQ ID NO: 340811 - DNA, 20 bp, human
gcgaggcccaatcagacccg

SEQ ID NO: 340812 - DNA, 20 bp, human
gtggtggagttccgccctcg

SEQ ID NO: 340813 - DNA, 20 bp, human
gcttgctgcgactaggaggg

SEQ ID NO: 340814 - DNA, 20 bp, human
gaccacctcctccgcgaggg

SEQ ID NO: 340815 - DNA, 20 bp, human
gaagcgcggaactggggttg

SEQ ID NO: 340816 - DNA, 20 bp, human
gcccagggcggggaagcaat

SEQ ID NO: 340817 - DNA, 20 bp, human
gggaacccggcctctgaaga

SEQ ID NO: 340818 - DNA, 20 bp, human
gcctctcggaagcaatcttt

SEQ ID NO: 340819 - DNA, 20 bp, human
gcgagaggcttcggcattga

SEQ ID NO: 340820 - DNA, 20 bp, human
gggcgggtctcatgtccagg

SEQ ID NO: 340821 - DNA, 20 bp, human
ggggttctcgcgctccgctg

SEQ ID NO: 340822 - DNA, 20 bp, human
gcctactgcgccctcttcag

SEQ ID NO: 340823 - DNA, 20 bp, human
gcggaagcaatctttcggga

SEQ ID NO: 340824 - DNA, 20 bp, human
ggaggcttcggcattgaggg

SEQ ID NO: 340825 - DNA, 20 bp, human
gaagttaagtagccccgagc

SEQ ID NO: 340826 - DNA, 20 bp, human
gagctcgcccagtccgcgaa

SEQ ID NO: 340827 - DNA, 20 bp, human
gaagactgaagcccggaggt

SEQ ID NO: 340828 - DNA, 20 bp, human
ggagagagccgagcccgagg

SEQ ID NO: 340829 - DNA, 20 bp, human
gcggagctgcgcacacgtgc

SEQ ID NO: 340830 - DNA, 20 bp, human
gtccaatagcggcccgggaa

SEQ ID NO: 340831 - DNA, 20 bp, human
gcccgggaaaggaccagaac

SEQ ID NO: 340832 - DNA, 20 bp, human
gatggaaggcccctctggat

SEQ ID NO: 340833 - DNA, 20 bp, human
gaggggccttccatagttca

SEQ ID NO: 340834 - DNA, 20 bp, human
gctgcggagcgggtgtgagg

SEQ ID NO: 340835 - DNA, 20 bp, human
gagccctcttcctggcggtg

SEQ ID NO: 340836 - DNA, 20 bp, human
gggcggggtgcggggtggcg

SEQ ID NO: 340837 - DNA, 20 bp, human
gggaaagccatgccgggggg

SEQ ID NO: 340838 - DNA, 20 bp, human
gacggggaaagccatgccgg

SEQ ID NO: 340839 - DNA, 20 bp, human
ggatgagccgatccttgagc

SEQ ID NO: 340840 - DNA, 20 bp, human
gggcggggcaaacccgctca

SEQ ID NO: 340841 - DNA, 20 bp, human
gttagccgggagggacaatt

SEQ ID NO: 340842 - DNA, 20 bp, human
ggtgcagctggcttgttagc

SEQ ID NO: 340843 - DNA, 20 bp, human
gcaagccagctgcacccccc

SEQ ID NO: 340844 - DNA, 20 bp, human
gtctgcctggggggtgcagc

SEQ ID NO: 340845 - DNA, 20 bp, human
ggctggcttgttagccggga

SEQ ID NO: 340846 - DNA, 20 bp, human
gggggcgatgagccgatcct

SEQ ID NO: 340847 - DNA, 20 bp, human
gagtgagaggggagcccgta

SEQ ID NO: 340848 - DNA, 20 bp, human
gggtgtatacagcagtgaga

SEQ ID NO: 340849 - DNA, 20 bp, human
gaagatatacgtaaccctac

SEQ ID NO: 340850 - DNA, 20 bp, human
gagatcctccagcccaacgg

SEQ ID NO: 340851 - DNA, 20 bp, human
gcggctcatcgccccccgtt

SEQ ID NO: 340852 - DNA, 20 bp, human
ggatgagccgatccttgggc

SEQ ID NO: 340853 - DNA, 20 bp, human
gggcggggcaaacccgccca

SEQ ID NO: 340854 - DNA, 20 bp, human
ggcatgctcagagcgccagc

SEQ ID NO: 340855 - DNA, 20 bp, human
ggggagggacaattgggtga

SEQ ID NO: 340856 - DNA, 20 bp, human
gactaccccccccacccacc

SEQ ID NO: 340857 - DNA, 20 bp, human
gtacagttgcaagacaagcc

SEQ ID NO: 340858 - DNA, 20 bp, human
gacagacaggggagcctctg

SEQ ID NO: 340859 - DNA, 20 bp, human
gcaggagcgcctgaccaggg

SEQ ID NO: 340860 - DNA, 20 bp, human
gctggtcaggcgctcctggt

SEQ ID NO: 340861 - DNA, 20 bp, human
gaatctggcatcgccaggga

SEQ ID NO: 340862 - DNA, 20 bp, human
gtctgccagcccagtgaatc

SEQ ID NO: 340863 - DNA, 20 bp, human
gctggcgatgccagattcac

SEQ ID NO: 340864 - DNA, 20 bp, human
gcggggcagcctcaggatcc

SEQ ID NO: 340865 - DNA, 20 bp, human
gtggggcagcctggatcctg

SEQ ID NO: 340866 - DNA, 20 bp, human
ggccacgcctggggcggaag

SEQ ID NO: 340867 - DNA, 20 bp, human
gcgcaaaggcggtaaagcag

SEQ ID NO: 340868 - DNA, 20 bp, human
gaacccggatggcgcaaagg

SEQ ID NO: 340869 - DNA, 20 bp, human
gcgtggccagacaacccgga

SEQ ID NO: 340870 - DNA, 20 bp, human
gtaagcgaattggcgggttg

SEQ ID NO: 340871 - DNA, 20 bp, human
ggacaacccggatggcgcaa

SEQ ID NO: 340872 - DNA, 20 bp, human
gggactagccgggttgtatt

SEQ ID NO: 340873 - DNA, 20 bp, human
gttaccgcctttgcgccatc

SEQ ID NO: 340874 - DNA, 20 bp, human
gacagtagcctatcagagaa

SEQ ID NO: 340875 - DNA, 20 bp, human
gatgtaccagcgccggaagt

SEQ ID NO: 340876 - DNA, 20 bp, human
gggggcttcccgtgcgtccc

SEQ ID NO: 340877 - DNA, 20 bp, human
gcagggccgtaaagctgcgg

SEQ ID NO: 340878 - DNA, 20 bp, human
gcggaacagcggagaacgag

SEQ ID NO: 340879 - DNA, 20 bp, human
gcgggcgcgtccactgttgc

SEQ ID NO: 340880 - DNA, 20 bp, human
gcctgggcctgtgcgtcccg

SEQ ID NO: 340881 - DNA, 20 bp, human
gcgggaagcccctatcgcgg

SEQ ID NO: 340882 - DNA, 20 bp, human
gccgggatgcaccaagacgg

SEQ ID NO: 340883 - DNA, 20 bp, human
ggttccggccgtccctccac

SEQ ID NO: 340884 - DNA, 20 bp, human
ggggccggtggagggacggc

SEQ ID NO: 340885 - DNA, 20 bp, human
gaaccgccgccgcagcttta

SEQ ID NO: 340886 - DNA, 20 bp, human
gtaaagggcggaagttacgt

SEQ ID NO: 340887 - DNA, 20 bp, human
ggcggtcatcagctgttcgt

SEQ ID NO: 340888 - DNA, 20 bp, human
gaagttacgtcggatgacgc

SEQ ID NO: 340889 - DNA, 20 bp, human
gcgtccgcaggagcgttaaa

SEQ ID NO: 340890 - DNA, 20 bp, human
gccgcaggagcgttaaaggg

SEQ ID NO: 340891 - DNA, 20 bp, human
gtcggatgacgccggctcct

SEQ ID NO: 340892 - DNA, 20 bp, human
gcgcatgaatgctcacacaa

SEQ ID NO: 340893 - DNA, 20 bp, human
ggtgcttggtgaggtcacgc

SEQ ID NO: 340894 - DNA, 20 bp, human
gccggaaacaaacacggact

SEQ ID NO: 340895 - DNA, 20 bp, human
gatgctcacacaaggggaaa

SEQ ID NO: 340896 - DNA, 20 bp, human
gaggtgacggtgcggggaaa

SEQ ID NO: 340897 - DNA, 20 bp, human
gcttactggaagccgcaccg

SEQ ID NO: 340898 - DNA, 20 bp, human
gcagacgcgcgggcgagtag

SEQ ID NO: 340899 - DNA, 20 bp, human
ggccaccaggtgacggtgcg

SEQ ID NO: 340900 - DNA, 20 bp, human
ggaagaggaagcggacacgt

SEQ ID NO: 340901 - DNA, 20 bp, human
ggtcacctggtggcgcttac

SEQ ID NO: 340902 - DNA, 20 bp, human
gcgcgggcgagtagcggaag

SEQ ID NO: 340903 - DNA, 20 bp, human
gcacgtgggacactctacgg

SEQ ID NO: 340904 - DNA, 20 bp, human
ggcttccagtaagcgccacc

SEQ ID NO: 340905 - DNA, 20 bp, human
gtacagcacacgcctcggtg

SEQ ID NO: 340906 - DNA, 20 bp, human
ggccctctggtgtagctcgg

SEQ ID NO: 340907 - DNA, 20 bp, human
gtccctgcccgaatctgcgg

SEQ ID NO: 340908 - DNA, 20 bp, human
gcgctccctgcccgaatctg

SEQ ID NO: 340909 - DNA, 20 bp, human
gatgtggccgaggccgagta

SEQ ID NO: 340910 - DNA, 20 bp, human
gacctccgagctacaccaga

SEQ ID NO: 340911 - DNA, 20 bp, human
gtggaacccggatgtggccg

SEQ ID NO: 340912 - DNA, 20 bp, human
gtacgccctctggtgtagct

SEQ ID NO: 340913 - DNA, 20 bp, human
gtacgcaacttgaaccactg

SEQ ID NO: 340914 - DNA, 20 bp, human
ggtaaggaaagtacgccctc

SEQ ID NO: 340915 - DNA, 20 bp, human
gagctcggaggtctggcgca

SEQ ID NO: 340916 - DNA, 20 bp, human
gccgcctcccagcaccaaag

SEQ ID NO: 340917 - DNA, 20 bp, human
gtccacaaacagcccctcgc

SEQ ID NO: 340918 - DNA, 20 bp, human
gggcggcgacgactgcagct

SEQ ID NO: 340919 - DNA, 20 bp, human
ggccaggcccagaaacgcgg

SEQ ID NO: 340920 - DNA, 20 bp, human
gcaactcacgtgaccgacgc

SEQ ID NO: 340921 - DNA, 20 bp, human
gctgccctctcggacggccg

SEQ ID NO: 340922 - DNA, 20 bp, human
gtagcggcctggcgagggac

SEQ ID NO: 340923 - DNA, 20 bp, human
gaagactggaggaccagcga

SEQ ID NO: 340924 - DNA, 20 bp, human
gcggagggcaaaaatggcgg

SEQ ID NO: 340925 - DNA, 20 bp, human
gttggcgccgccgcgtttct

SEQ ID NO: 340926 - DNA, 20 bp, human
ggggcggaagtgacgttagg

SEQ ID NO: 340927 - DNA, 20 bp, human
gagggcgtgtcgcgagccaa

SEQ ID NO: 340928 - DNA, 20 bp, human
ggcccgggtgcgtccctgtc

SEQ ID NO: 340929 - DNA, 20 bp, human
ggagtctcgccacgtgggag

SEQ ID NO: 340930 - DNA, 20 bp, human
gcccgggagtctcgccacgt

SEQ ID NO: 340931 - DNA, 20 bp, human
gcgcccggcgcggagaccga

SEQ ID NO: 340932 - DNA, 20 bp, human
gtccctgtctggttcctggg

SEQ ID NO: 340933 - DNA, 20 bp, human
ggaggcgaatcctcacattg

SEQ ID NO: 340934 - DNA, 20 bp, human
gccacccaggtgagagcctt

SEQ ID NO: 340935 - DNA, 20 bp, human
ggcggggcggaagtgacgtt

SEQ ID NO: 340936 - DNA, 20 bp, human
ggagccaggagtgtatgcag

SEQ ID NO: 340937 - DNA, 20 bp, human
ggcacgcgcaaaactgagcc

SEQ ID NO: 340938 - DNA, 20 bp, human
gctgcagcagggggcgctga

SEQ ID NO: 340939 - DNA, 20 bp, human
gacggcctgcatgaatggcg

SEQ ID NO: 340940 - DNA, 20 bp, human
gtccgccgcgccattcatgc

SEQ ID NO: 340941 - DNA, 20 bp, human
gtccccgctgcatacactcc

SEQ ID NO: 340942 - DNA, 20 bp, human
ggcggggcattgtgggtaag

SEQ ID NO: 340943 - DNA, 20 bp, human
gacagcaaccctggcagcgg

SEQ ID NO: 340944 - DNA, 20 bp, human
gcaccggggcggggcattgt

SEQ ID NO: 340945 - DNA, 20 bp, human
gtgggtaagaggaaacgctg

SEQ ID NO: 340946 - DNA, 20 bp, human
gcatctgcccagcacccagt

SEQ ID NO: 340947 - DNA, 20 bp, human
ggcgtctgtggtaacccggg

SEQ ID NO: 340948 - DNA, 20 bp, human
gcccatcggacgcacaagcc

SEQ ID NO: 340949 - DNA, 20 bp, human
gtaccaggctccctgcggag

SEQ ID NO: 340950 - DNA, 20 bp, human
ggtgctgggcagatgattgg

SEQ ID NO: 340951 - DNA, 20 bp, human
gtctgtggtaacccgggcgg

SEQ ID NO: 340952 - DNA, 20 bp, human
gccggcccctgccgctccgc

SEQ ID NO: 340953 - DNA, 20 bp, human
ggccgcgtctgtggtaaccc

SEQ ID NO: 340954 - DNA, 20 bp, human
gcctgctccggcccacttac

SEQ ID NO: 340955 - DNA, 20 bp, human
gccgaaaggcaaggaaggac

SEQ ID NO: 340956 - DNA, 20 bp, human
gagaaagtgtggggcctcgc

SEQ ID NO: 340957 - DNA, 20 bp, human
gacagcagaggcccgcagtg

SEQ ID NO: 340958 - DNA, 20 bp, human
gccagctggcgcagaaagtg

SEQ ID NO: 340959 - DNA, 20 bp, human
gccctgcagagccagtgggt

SEQ ID NO: 340960 - DNA, 20 bp, human
gcagaggcccgcagtgaggg

SEQ ID NO: 340961 - DNA, 20 bp, human
gcagggcgcgcactcccagc

SEQ ID NO: 340962 - DNA, 20 bp, human
gcccgggcgtgtgacagcag

SEQ ID NO: 340963 - DNA, 20 bp, human
gcgactacggcgcctgccaa

SEQ ID NO: 340964 - DNA, 20 bp, human
gcgcgccctgcagagccagt

SEQ ID NO: 340965 - DNA, 20 bp, human
gtgcagcagaatggagactc

SEQ ID NO: 340966 - DNA, 20 bp, human
ggccggcgagagttcaccga

SEQ ID NO: 340967 - DNA, 20 bp, human
gtccctcggtgaactctcgc

SEQ ID NO: 340968 - DNA, 20 bp, human
gggaaccgaagcttgcgaag

SEQ ID NO: 340969 - DNA, 20 bp, human
ggggcgttgcagaatcagct

SEQ ID NO: 340970 - DNA, 20 bp, human
ggacactcatatctcatcga

SEQ ID NO: 340971 - DNA, 20 bp, human
ggggagggagcgagtacgcc

SEQ ID NO: 340972 - DNA, 20 bp, human
gcgacccgcttcgcaagctt

SEQ ID NO: 340973 - DNA, 20 bp, human
gctcttcctaggcttcaaga

SEQ ID NO: 340974 - DNA, 20 bp, human
ggcgggtcgcagagagagat

SEQ ID NO: 340975 - DNA, 20 bp, human
gaatgcaggagaagccgagg

SEQ ID NO: 340976 - DNA, 20 bp, human
gtgtgctcgcgcacagcgtg

SEQ ID NO: 340977 - DNA, 20 bp, human
gcggggcctcctcctttcac

SEQ ID NO: 340978 - DNA, 20 bp, human
gaggcgagggataatcaggc

SEQ ID NO: 340979 - DNA, 20 bp, human
gcaacagaaagcgctgtcgg

SEQ ID NO: 340980 - DNA, 20 bp, human
ggctctgctcctgtgaaagg

SEQ ID NO: 340981 - DNA, 20 bp, human
ggtggacagaggtttcttat

SEQ ID NO: 340982 - DNA, 20 bp, human
gggccaggcgagggataatc

SEQ ID NO: 340983 - DNA, 20 bp, human
gatcaggcgggattgcacgg

SEQ ID NO: 340984 - DNA, 20 bp, human
gcactctggctgccgagcag

SEQ ID NO: 340985 - DNA, 20 bp, human
ggcagtcgcgcaagcgcgag

SEQ ID NO: 340986 - DNA, 20 bp, human
ggcactgccagcccgcacta

SEQ ID NO: 340987 - DNA, 20 bp, human
gcagccactggcgcgccggg

SEQ ID NO: 340988 - DNA, 20 bp, human
gaggccaagcgcgcacgcgc

SEQ ID NO: 340989 - DNA, 20 bp, human
gctgccagcccgcactaggg

SEQ ID NO: 340990 - DNA, 20 bp, human
ggcggccctggaggagacgg

SEQ ID NO: 340991 - DNA, 20 bp, human
ggcggcctccgtctcctcca

SEQ ID NO: 340992 - DNA, 20 bp, human
gtggcgcgccggggggggtg

SEQ ID NO: 340993 - DNA, 20 bp, human
gaatcgccctgtctattggt

SEQ ID NO: 340994 - DNA, 20 bp, human
gccctcctggaacacgtcca

SEQ ID NO: 340995 - DNA, 20 bp, human
gctcgagctcacattggtcc

SEQ ID NO: 340996 - DNA, 20 bp, human
ggaggcgcgaaggcatgcgc

SEQ ID NO: 340997 - DNA, 20 bp, human
ggcaactgggaggcactctc

SEQ ID NO: 340998 - DNA, 20 bp, human
gcgccggtggacgctctgat

SEQ ID NO: 340999 - DNA, 20 bp, human
gcgggacagagctgttgccg

SEQ ID NO: 341000 - DNA, 20 bp, human
gcgcgcctccgctgcatcct

SEQ ID NO: 341001 - DNA, 20 bp, human
gcatcctgggagtctacttc

SEQ ID NO: 341002 - DNA, 20 bp, human
ggcgcgaaggcatgcgccgg

SEQ ID NO: 341003 - DNA, 20 bp, human
gaaccaatcagagcgtccac

SEQ ID NO: 341004 - DNA, 20 bp, human
gtgttgccgtggcaactggg

SEQ ID NO: 341005 - DNA, 20 bp, human
gggtcgacggaggctgcgaa

SEQ ID NO: 341006 - DNA, 20 bp, human
ggacacccaccgccgttccc

SEQ ID NO: 341007 - DNA, 20 bp, human
gcggcggtgggtgtcccagg

SEQ ID NO: 341008 - DNA, 20 bp, human
gcttgtcctgggaacggcgg

SEQ ID NO: 341009 - DNA, 20 bp, human
gttacttgtcctgggaacgg

SEQ ID NO: 341010 - DNA, 20 bp, human
gccgttacttgtcctgggaa

SEQ ID NO: 341011 - DNA, 20 bp, human
gaaaggtgaagttcagtctg

SEQ ID NO: 341012 - DNA, 20 bp, human
gcggtgggtgtcccaggagg

SEQ ID NO: 341013 - DNA, 20 bp, human
ggaacggcggtgggtgtccc

SEQ ID NO: 341014 - DNA, 20 bp, human
gaagtccagggctgcgttac

SEQ ID NO: 341015 - DNA, 20 bp, human
ggaaaatagaatttgtagct

SEQ ID NO: 341016 - DNA, 20 bp, human
gtacgcgctcccccagtttt

SEQ ID NO: 341017 - DNA, 20 bp, human
gttgtcctgggacccgcggt

SEQ ID NO: 341018 - DNA, 20 bp, human
ggggctccaggacccagtaa

SEQ ID NO: 341019 - DNA, 20 bp, human
ggggggagcgcgtaggctcc

SEQ ID NO: 341020 - DNA, 20 bp, human
gtttaagacggccccaaaac

SEQ ID NO: 341021 - DNA, 20 bp, human
gaaatccagggctccgttac

SEQ ID NO: 341022 - DNA, 20 bp, human
ggacacccaccgcgggtccc

SEQ ID NO: 341023 - DNA, 20 bp, human
ggggagaggtgcacaagcgc

SEQ ID NO: 341024 - DNA, 20 bp, human
gaagacggccccaaaactgg

SEQ ID NO: 341025 - DNA, 20 bp, human
gttacttgtcctgggacccg

SEQ ID NO: 341026 - DNA, 20 bp, human
gaaggggagcagacgagggg

SEQ ID NO: 341027 - DNA, 20 bp, human
gaggggcctaggagctacca

SEQ ID NO: 341028 - DNA, 20 bp, human
ggaggaaggggagcagacga

SEQ ID NO: 341029 - DNA, 20 bp, human
ggaggcacaagcctccttcc

SEQ ID NO: 341030 - DNA, 20 bp, human
gggagaccatggtagctcct

SEQ ID NO: 341031 - DNA, 20 bp, human
ggcccagaaacccagactgc

SEQ ID NO: 341032 - DNA, 20 bp, human
gcctgcgcgtggcgccattg

SEQ ID NO: 341033 - DNA, 20 bp, human
gtctccagaggcaaacttgc

SEQ ID NO: 341034 - DNA, 20 bp, human
gggcgcgggacactccacaa

SEQ ID NO: 341035 - DNA, 20 bp, human
gtgaacgacatcacaagagg

SEQ ID NO: 341036 - DNA, 20 bp, human
ggcggggagaggaactcgag

SEQ ID NO: 341037 - DNA, 20 bp, human
gtcgcccctggcgtcggcag

SEQ ID NO: 341038 - DNA, 20 bp, human
gaacagcaaagcaagttact

SEQ ID NO: 341039 - DNA, 20 bp, human
gacagccgctgccgacgcca

SEQ ID NO: 341040 - DNA, 20 bp, human
gctaggaaagcgcgagtctc

SEQ ID NO: 341041 - DNA, 20 bp, human
gcagactccggggatcccgc

SEQ ID NO: 341042 - DNA, 20 bp, human
gggccccggcgcagatctgt

SEQ ID NO: 341043 - DNA, 20 bp, human
gcgggccgacagatctgcgc

SEQ ID NO: 341044 - DNA, 20 bp, human
gtcaccaagtggcgcagagc

SEQ ID NO: 341045 - DNA, 20 bp, human
gtgtcggcccgcgggatccc

SEQ ID NO: 341046 - DNA, 20 bp, human
gcggggagacgcgctggaaa

SEQ ID NO: 341047 - DNA, 20 bp, human
gcccgcgctcgtcccccgtc

SEQ ID NO: 341048 - DNA, 20 bp, human
gagacgcgctggaaaggggc

SEQ ID NO: 341049 - DNA, 20 bp, human
ggaggggggcttccagacgg

SEQ ID NO: 341050 - DNA, 20 bp, human
gagagctcggcaagtatata

SEQ ID NO: 341051 - DNA, 20 bp, human
ggcccggcctgccccacacg

SEQ ID NO: 341052 - DNA, 20 bp, human
gtctgaggtcgttgaggcga

SEQ ID NO: 341053 - DNA, 20 bp, human
gtccagacgggggacgagcg

SEQ ID NO: 341054 - DNA, 20 bp, human
gccaggggaaggggggccgc

SEQ ID NO: 341055 - DNA, 20 bp, human
gctcaggaagaacttaatta

SEQ ID NO: 341056 - DNA, 20 bp, human
gtgtaagcagccagcgagta

SEQ ID NO: 341057 - DNA, 20 bp, human
gagggcacgccagggtcaga

SEQ ID NO: 341058 - DNA, 20 bp, human
ggggcgacgggcggtgctta

SEQ ID NO: 341059 - DNA, 20 bp, human
ggagcattcgccttactcgc

SEQ ID NO: 341060 - DNA, 20 bp, human
ggagtcgggcttgccatcgg

SEQ ID NO: 341061 - DNA, 20 bp, human
gcgacgggcggtgcttaggg

SEQ ID NO: 341062 - DNA, 20 bp, human
gcccaggacgggtatggggc

SEQ ID NO: 341063 - DNA, 20 bp, human
gcaagcccgactccagtcag

SEQ ID NO: 341064 - DNA, 20 bp, human
gcgaatgctcagaccgtgct

SEQ ID NO: 341065 - DNA, 20 bp, human
gcgctccccagcaccgccga

SEQ ID NO: 341066 - DNA, 20 bp, human
gcaccagcctgcggaatgtt

SEQ ID NO: 341067 - DNA, 20 bp, human
gatcactcccaacattccgc

SEQ ID NO: 341068 - DNA, 20 bp, human
gacagccaggactggacggt

SEQ ID NO: 341069 - DNA, 20 bp, human
ggccagggcaaccgaactcg

SEQ ID NO: 341070 - DNA, 20 bp, human
gtggctcgcggaatcctggg

SEQ ID NO: 341071 - DNA, 20 bp, human
gtaatggaatggtgccgcag

SEQ ID NO: 341072 - DNA, 20 bp, human
gtaaggtgacagctggttaa

SEQ ID NO: 341073 - DNA, 20 bp, human
gctgcgcagagccgcgagtt

SEQ ID NO: 341074 - DNA, 20 bp, human
gccttggctcgcggaatcct

SEQ ID NO: 341075 - DNA, 20 bp, human
gaggcgcacaggctccgcgc

SEQ ID NO: 341076 - DNA, 20 bp, human
gccaagggacccagggccaa

SEQ ID NO: 341077 - DNA, 20 bp, human
gcaagggcgcagtaagggtg

SEQ ID NO: 341078 - DNA, 20 bp, human
gagggccaagggcgcagtaa

SEQ ID NO: 341079 - DNA, 20 bp, human
gacgccggagggagctgcgc

SEQ ID NO: 341080 - DNA, 20 bp, human
gaggacggacgcacttccgg

SEQ ID NO: 341081 - DNA, 20 bp, human
gccgtcctggcgaggaagga

SEQ ID NO: 341082 - DNA, 20 bp, human
gggccccgcgcagctccctc

SEQ ID NO: 341083 - DNA, 20 bp, human
gtgcaatcccaagggaccca

SEQ ID NO: 341084 - DNA, 20 bp, human
ggcgcagtaagggtgtgggc

SEQ ID NO: 341085 - DNA, 20 bp, human
gcgggacgagacgtgcctga

SEQ ID NO: 341086 - DNA, 20 bp, human
ggagaggcaggtgtgaaacg

SEQ ID NO: 341087 - DNA, 20 bp, human
gggcgccggtcccggaggag

SEQ ID NO: 341088 - DNA, 20 bp, human
ggcgcgtgcgcactgggaga

SEQ ID NO: 341089 - DNA, 20 bp, human
gaacagtagcacccgagaga

SEQ ID NO: 341090 - DNA, 20 bp, human
ggctgcccgtctggccccgc

SEQ ID NO: 341091 - DNA, 20 bp, human
gggtgacgcgcgtgcgcagc

SEQ ID NO: 341092 - DNA, 20 bp, human
gcagatggagtgaaaaagca

SEQ ID NO: 341093 - DNA, 20 bp, human
ggaacgttgagcagggcggt

SEQ ID NO: 341094 - DNA, 20 bp, human
gttagagtacacagaaatcc

SEQ ID NO: 341095 - DNA, 20 bp, human
gaatcgaacgttgagcaggg

SEQ ID NO: 341096 - DNA, 20 bp, human
gttacccggacgaaagacac

SEQ ID NO: 341097 - DNA, 20 bp, human
gcccaggtacggggcgtggc

SEQ ID NO: 341098 - DNA, 20 bp, human
gggggctcgaagttccggga

SEQ ID NO: 341099 - DNA, 20 bp, human
gggagagctgggcgagccag

SEQ ID NO: 341100 - DNA, 20 bp, human
gccagcagcccccaggtacg

SEQ ID NO: 341101 - DNA, 20 bp, human
gcgagccagaggcgaccgga

SEQ ID NO: 341102 - DNA, 20 bp, human
gtgggacctgccgacgacta

SEQ ID NO: 341103 - DNA, 20 bp, human
gctcactgagccttagtcgt

SEQ ID NO: 341104 - DNA, 20 bp, human
gaggcccgtgtctttcgtcc

SEQ ID NO: 341105 - DNA, 20 bp, human
gttcgtccgggtaaagcgag

SEQ ID NO: 341106 - DNA, 20 bp, human
gagaccgataactttagcat

SEQ ID NO: 341107 - DNA, 20 bp, human
gatacctatgctaaagttat

SEQ ID NO: 341108 - DNA, 20 bp, human
ggatcgcgtccaaaataaaa

SEQ ID NO: 341109 - DNA, 20 bp, human
gactcttgcggtttcccgca

SEQ ID NO: 341110 - DNA, 20 bp, human
gtcaaaatccacccgatgtc

SEQ ID NO: 341111 - DNA, 20 bp, human
gacatcatggcccagacatc

SEQ ID NO: 341112 - DNA, 20 bp, human
gtcatggcccagacatcggg

SEQ ID NO: 341113 - DNA, 20 bp, human
gcgcgcgcgcatgacgtggc

SEQ ID NO: 341114 - DNA, 20 bp, human
gtcccgagacacagctgttt

SEQ ID NO: 341115 - DNA, 20 bp, human
gatcccatccggctcccatc

SEQ ID NO: 341116 - DNA, 20 bp, human
gcggcccgggtgccgcagca

SEQ ID NO: 341117 - DNA, 20 bp, human
gccgggccgctcaggtaagt

SEQ ID NO: 341118 - DNA, 20 bp, human
gcggccttgaacccgggcgg

SEQ ID NO: 341119 - DNA, 20 bp, human
gggccgctcaggtaagtagg

SEQ ID NO: 341120 - DNA, 20 bp, human
gactcgtcagcgccctgctg

SEQ ID NO: 341121 - DNA, 20 bp, human
gcccaccacaactcggtccc

SEQ ID NO: 341122 - DNA, 20 bp, human
gggtcaaggctcaacggaga

SEQ ID NO: 341123 - DNA, 20 bp, human
gccaaaaaacaaggaatcgt

SEQ ID NO: 341124 - DNA, 20 bp, human
gttctccctcaggccatctg

SEQ ID NO: 341125 - DNA, 20 bp, human
gcctgcctcgcgtacggatt

SEQ ID NO: 341126 - DNA, 20 bp, human
gtccccagataccttcggga

SEQ ID NO: 341127 - DNA, 20 bp, human
gcgtgtccgggccgtcccga

SEQ ID NO: 341128 - DNA, 20 bp, human
gaagactagggaaacgagaa

SEQ ID NO: 341129 - DNA, 20 bp, human
gcctccgcggccccgacgca

SEQ ID NO: 341130 - DNA, 20 bp, human
ggggccgtcccgaaggtatc

SEQ ID NO: 341131 - DNA, 20 bp, human
gcccggacacgccttacatt

SEQ ID NO: 341132 - DNA, 20 bp, human
ggccgcggaggctccgccct

SEQ ID NO: 341133 - DNA, 20 bp, human
gaggccgagtccctgcgtcg

SEQ ID NO: 341134 - DNA, 20 bp, human
gcggccccgacgcagggact

SEQ ID NO: 341135 - DNA, 20 bp, human
gactcggcctaggcggagga

SEQ ID NO: 341136 - DNA, 20 bp, human
gcggcccgggtgccgcagca

SEQ ID NO: 341137 - DNA, 20 bp, human
gccgggccgctcaggtaagt

SEQ ID NO: 341138 - DNA, 20 bp, human
gcggccttgaacccgggcgg

SEQ ID NO: 341139 - DNA, 20 bp, human
gggccgctcaggtaagtagg

SEQ ID NO: 341140 - DNA, 20 bp, human
gactcgtcagcgccctgctg

SEQ ID NO: 341141 - DNA, 20 bp, human
gcccaccacaactcggtccc

SEQ ID NO: 341142 - DNA, 20 bp, human
gggtcaaggctcaacggaga

SEQ ID NO: 341143 - DNA, 20 bp, human
gccaaaaaacaaggaatcgt

SEQ ID NO: 341144 - DNA, 20 bp, human
gttctccctcaggccatctg

SEQ ID NO: 341145 - DNA, 20 bp, human
gcctgcctcgcgtacggatt

SEQ ID NO: 341146 - DNA, 20 bp, human
gagccctgctggcttcttac

SEQ ID NO: 341147 - DNA, 20 bp, human
ggcccccagcgggagctgtg

SEQ ID NO: 341148 - DNA, 20 bp, human
gaccgggcgcttcctccacg

SEQ ID NO: 341149 - DNA, 20 bp, human
gtcctgaaggggctgcaaga

SEQ ID NO: 341150 - DNA, 20 bp, human
gtgccccacagctcccgctg

SEQ ID NO: 341151 - DNA, 20 bp, human
gcgggctcgtgcggcattct

SEQ ID NO: 341152 - DNA, 20 bp, human
gtggggcttcttctcctgaa

SEQ ID NO: 341153 - DNA, 20 bp, human
ggcgcgctctccaggagctt

SEQ ID NO: 341154 - DNA, 20 bp, human
gggaagctgtgtcggaccca

SEQ ID NO: 341155 - DNA, 20 bp, human
ggacgctccaggccacgtgg

SEQ ID NO: 341156 - DNA, 20 bp, human
gcggctactgagaacgtcgt

SEQ ID NO: 341157 - DNA, 20 bp, human
ggggcgcatgcgcctggaaa

SEQ ID NO: 341158 - DNA, 20 bp, human
ggcgctatgcgtgacatcac

SEQ ID NO: 341159 - DNA, 20 bp, human
gctactgagaacgtcgtagg

SEQ ID NO: 341160 - DNA, 20 bp, human
ggaaatgggacggggacggt

SEQ ID NO: 341161 - DNA, 20 bp, human
ggactctcggagctcggaga

SEQ ID NO: 341162 - DNA, 20 bp, human
gtgcaggcggaaaagacccc

SEQ ID NO: 341163 - DNA, 20 bp, human
gcgaaggaggttggggatct

SEQ ID NO: 341164 - DNA, 20 bp, human
gcctgtcccccaaaagatgc

SEQ ID NO: 341165 - DNA, 20 bp, human
ggatctgggagggcggaaat

SEQ ID NO: 341166 - DNA, 20 bp, human
gcgcgcatgcgtcctgcgga

SEQ ID NO: 341167 - DNA, 20 bp, human
gcgcgcttacaaacgcagtt

SEQ ID NO: 341168 - DNA, 20 bp, human
ggggtcactgactagtttga

SEQ ID NO: 341169 - DNA, 20 bp, human
ggcggagctagaaagttgag

SEQ ID NO: 341170 - DNA, 20 bp, human
ggcctccgcgctctccggtc

SEQ ID NO: 341171 - DNA, 20 bp, human
ggagcgccttgcagctgtaa

SEQ ID NO: 341172 - DNA, 20 bp, human
gtgagggctgaaccccggga

SEQ ID NO: 341173 - DNA, 20 bp, human
gcttacaaacgcagttgggc

SEQ ID NO: 341174 - DNA, 20 bp, human
gagcggacagaattcacatc

SEQ ID NO: 341175 - DNA, 20 bp, human
gctgcaaggcgctccatccc

SEQ ID NO: 341176 - DNA, 20 bp, human
gccggcggaggggtagcgta

SEQ ID NO: 341177 - DNA, 20 bp, human
ggggaaccaggtccgagccg

SEQ ID NO: 341178 - DNA, 20 bp, human
gaaccaggtccgagccgggg

SEQ ID NO: 341179 - DNA, 20 bp, human
gcgcccttgcgctcagggaa

SEQ ID NO: 341180 - DNA, 20 bp, human
ggatctacacgtgtacgcct

SEQ ID NO: 341181 - DNA, 20 bp, human
gtgtacgcctcgggaactgg

SEQ ID NO: 341182 - DNA, 20 bp, human
ggtagcgtagggaagacacc

SEQ ID NO: 341183 - DNA, 20 bp, human
ggccggggaggagctagaaa

SEQ ID NO: 341184 - DNA, 20 bp, human
ggtagggaagacacctggag

SEQ ID NO: 341185 - DNA, 20 bp, human
gttgagaaacgcgagacttc

SEQ ID NO: 341186 - DNA, 20 bp, human
gctgaaaagtccagcagcgt

SEQ ID NO: 341187 - DNA, 20 bp, human
gagccttgctgagacagcgg

SEQ ID NO: 341188 - DNA, 20 bp, human
gcccaagaaacatggaacca

SEQ ID NO: 341189 - DNA, 20 bp, human
gcaagggaaagtagcactac

SEQ ID NO: 341190 - DNA, 20 bp, human
gagtgaggacacatcagagt

SEQ ID NO: 341191 - DNA, 20 bp, human
gctcttggcaccggaagaaa

SEQ ID NO: 341192 - DNA, 20 bp, human
gactgtctggctctccccaa

SEQ ID NO: 341193 - DNA, 20 bp, human
gccaaacatggtatccatct

SEQ ID NO: 341194 - DNA, 20 bp, human
gtcttgggagtcttcaaatt

SEQ ID NO: 341195 - DNA, 20 bp, human
gcagagccttgctgagacag

SEQ ID NO: 341196 - DNA, 20 bp, human
ggggctgcggagaatcctag

SEQ ID NO: 341197 - DNA, 20 bp, human
gcccgagtgtacaccgctcc

SEQ ID NO: 341198 - DNA, 20 bp, human
ggggcgcagcgtgaccgcag

SEQ ID NO: 341199 - DNA, 20 bp, human
gtgggctggctgctgaacca

SEQ ID NO: 341200 - DNA, 20 bp, human
gagtggggacgggaatatta

SEQ ID NO: 341201 - DNA, 20 bp, human
ggtggccgaaccgcctgccc

SEQ ID NO: 341202 - DNA, 20 bp, human
gctaggtgtatgttacaacc

SEQ ID NO: 341203 - DNA, 20 bp, human
gctaggcaggagcgatgggc

SEQ ID NO: 341204 - DNA, 20 bp, human
gaccgggagcggtgtacact

SEQ ID NO: 341205 - DNA, 20 bp, human
gtgtatgttacaaccgggag

SEQ ID NO: 341206 - DNA, 20 bp, human
gtgagctggccgcctgtgat

SEQ ID NO: 341207 - DNA, 20 bp, human
gaaagtagggagaaagactc

SEQ ID NO: 341208 - DNA, 20 bp, human
gaaaaccaaaatcactcgat

SEQ ID NO: 341209 - DNA, 20 bp, human
ggtagccaatcgagtgattt

SEQ ID NO: 341210 - DNA, 20 bp, human
gcctgtgattggctgaaacc

SEQ ID NO: 341211 - DNA, 20 bp, human
gtgggcataatgtgatgagc

SEQ ID NO: 341212 - DNA, 20 bp, human
gtcacacagggactcaaagt

SEQ ID NO: 341213 - DNA, 20 bp, human
gctctgcatctgctttattt

SEQ ID NO: 341214 - DNA, 20 bp, human
gcaaagttagtttttcacac

SEQ ID NO: 341215 - DNA, 20 bp, human
ggaattgttaaataagcagg

SEQ ID NO: 341216 - DNA, 20 bp, human
gacccagccgagccgcgagg

SEQ ID NO: 341217 - DNA, 20 bp, human
gaatgcacgcgcggctcgag

SEQ ID NO: 341218 - DNA, 20 bp, human
gcacgcgcggctcgagtggg

SEQ ID NO: 341219 - DNA, 20 bp, human
gcgagccgcgcgtgcattcc

SEQ ID NO: 341220 - DNA, 20 bp, human
ggccacgccccctcgcggct

SEQ ID NO: 341221 - DNA, 20 bp, human
gaccaagagcgcaaatttgc

SEQ ID NO: 341222 - DNA, 20 bp, human
gggctccgggaatgcacgcg

SEQ ID NO: 341223 - DNA, 20 bp, human
gccggctgcccaccttcccg

SEQ ID NO: 341224 - DNA, 20 bp, human
ggcggctcggctgggtcgcc

SEQ ID NO: 341225 - DNA, 20 bp, human
gaatttgcagggggaagcgc

SEQ ID NO: 341226 - DNA, 20 bp, human
gtccggaggcagacggtctg

SEQ ID NO: 341227 - DNA, 20 bp, human
ggccacaggccggaaaggtg

SEQ ID NO: 341228 - DNA, 20 bp, human
gaaaccgccacaggccggaa

SEQ ID NO: 341229 - DNA, 20 bp, human
gtgaggggagaccggcgcgg

SEQ ID NO: 341230 - DNA, 20 bp, human
gcgtgcgcgggtgactattt

SEQ ID NO: 341231 - DNA, 20 bp, human
gcggccaatgggagagcagg

SEQ ID NO: 341232 - DNA, 20 bp, human
gccccctcctgctctcccat

SEQ ID NO: 341233 - DNA, 20 bp, human
ggattgaggggagaccggcg

SEQ ID NO: 341234 - DNA, 20 bp, human
ggggccgccccgggatttaa

SEQ ID NO: 341235 - DNA, 20 bp, human
ggctcggccaatgggagagc

SEQ ID NO: 341236 - DNA, 20 bp, human
gttggtgggctagtaggaag

SEQ ID NO: 341237 - DNA, 20 bp, human
gagaaggttggtgggctagt

SEQ ID NO: 341238 - DNA, 20 bp, human
gggctggaatgtagtgggat

SEQ ID NO: 341239 - DNA, 20 bp, human
gtgggtagagggcgtagcca

SEQ ID NO: 341240 - DNA, 20 bp, human
ggattggaggggcccaaagc

SEQ ID NO: 341241 - DNA, 20 bp, human
gaggggcccaaagcaggtgt

SEQ ID NO: 341242 - DNA, 20 bp, human
gggcaaccctttgggtgaaa

SEQ ID NO: 341243 - DNA, 20 bp, human
gaggtaggatggcaaccctt

SEQ ID NO: 341244 - DNA, 20 bp, human
gagctccccaacacctgctt

SEQ ID NO: 341245 - DNA, 20 bp, human
gtcaatgtcttgtggggtga

SEQ ID NO: 341246 - DNA, 20 bp, human
gcgagtctgacaatcacaag

SEQ ID NO: 341247 - DNA, 20 bp, human
gtatacattctactctggaa

SEQ ID NO: 341248 - DNA, 20 bp, human
gttttggttagttatattta

SEQ ID NO: 341249 - DNA, 20 bp, human
gacttgctgaagaaccatgt

SEQ ID NO: 341250 - DNA, 20 bp, human
ggacattatacattctactc

SEQ ID NO: 341251 - DNA, 20 bp, human
gtattcctttgtatcttaga

SEQ ID NO: 341252 - DNA, 20 bp, human
ggagagtctgaactctttcc

SEQ ID NO: 341253 - DNA, 20 bp, human
gatatacatgtcagagttgt

SEQ ID NO: 341254 - DNA, 20 bp, human
gcgcatctacctttgttttc

SEQ ID NO: 341255 - DNA, 20 bp, human
gtgaagttgccgatgcttcc

SEQ ID NO: 341256 - DNA, 20 bp, human
gaccaggcaacctctcagaa

SEQ ID NO: 341257 - DNA, 20 bp, human
gccggatcggcccttctgag

SEQ ID NO: 341258 - DNA, 20 bp, human
gttggccaacactatctgta

SEQ ID NO: 341259 - DNA, 20 bp, human
gaggaaagaagctgttcccg

SEQ ID NO: 341260 - DNA, 20 bp, human
ggatagtgttggccaaaaga

SEQ ID NO: 341261 - DNA, 20 bp, human
gtcaagctaccttatggatc

SEQ ID NO: 341262 - DNA, 20 bp, human
gaatgcagacagcctaggaa

SEQ ID NO: 341263 - DNA, 20 bp, human
gcataattaagtttccggat

SEQ ID NO: 341264 - DNA, 20 bp, human
ggaaaccttacagatagtgt

SEQ ID NO: 341265 - DNA, 20 bp, human
gattacctgcctgatccata

SEQ ID NO: 341266 - DNA, 20 bp, human
gggagctgcgagaattccgg

SEQ ID NO: 341267 - DNA, 20 bp, human
gtgacaggatgcgacgtcaa

SEQ ID NO: 341268 - DNA, 20 bp, human
gtacgcagctggtccaccgc

SEQ ID NO: 341269 - DNA, 20 bp, human
ggagcgcagggccaaggtac

SEQ ID NO: 341270 - DNA, 20 bp, human
gaggggagctgcgagaattc

SEQ ID NO: 341271 - DNA, 20 bp, human
gggtttggcgaaatactgac

SEQ ID NO: 341272 - DNA, 20 bp, human
gtggcgggaggcaagcttag

SEQ ID NO: 341273 - DNA, 20 bp, human
gcgacgtcaacgggagcgca

SEQ ID NO: 341274 - DNA, 20 bp, human
gtcactgggggcggagctaa

SEQ ID NO: 341275 - DNA, 20 bp, human
gccagtccggtcacatcccc

SEQ ID NO: 341276 - DNA, 20 bp, human
gagccgttatgcgcgtgcgg

SEQ ID NO: 341277 - DNA, 20 bp, human
ggcacacatcggccacttcc

SEQ ID NO: 341278 - DNA, 20 bp, human
ggtgtcattgcacgtggtcc

SEQ ID NO: 341279 - DNA, 20 bp, human
gcgcccccgcacgcgcataa

SEQ ID NO: 341280 - DNA, 20 bp, human
ggtgcgggggcgcgcgtgcg

SEQ ID NO: 341281 - DNA, 20 bp, human
gctaacagccaagccaagct

SEQ ID NO: 341282 - DNA, 20 bp, human
gggctgttagtagctttgcc

SEQ ID NO: 341283 - DNA, 20 bp, human
gcagcaaaggaatgcgaggg

SEQ ID NO: 341284 - DNA, 20 bp, human
ggtgcgcgtgtcattgcacg

SEQ ID NO: 341285 - DNA, 20 bp, human
ggttatgcggcgtgtgcgtg

SEQ ID NO: 341286 - DNA, 20 bp, human
ggcacacatcggccacttcc

SEQ ID NO: 341287 - DNA, 20 bp, human
ggtgtcattgcacgtggtcc

SEQ ID NO: 341288 - DNA, 20 bp, human
gctaacagccaagccaagct

SEQ ID NO: 341289 - DNA, 20 bp, human
gggctgttagtagctttgcc

SEQ ID NO: 341290 - DNA, 20 bp, human
gcagcaaaggaatgcgaggg

SEQ ID NO: 341291 - DNA, 20 bp, human
ggtgcgcgtgtcattgcacg

SEQ ID NO: 341292 - DNA, 20 bp, human
gttgcacgtggtccaggaag

SEQ ID NO: 341293 - DNA, 20 bp, human
gagcgaagcgtacccgttac

SEQ ID NO: 341294 - DNA, 20 bp, human
ggttatgcggcgtgtgcgtg

SEQ ID NO: 341295 - DNA, 20 bp, human
ggcacgcggattgcacacat

SEQ ID NO: 341296 - DNA, 20 bp, human
gcactcggggccacagaatc

SEQ ID NO: 341297 - DNA, 20 bp, human
ggggccacagaatcggggct

SEQ ID NO: 341298 - DNA, 20 bp, human
gtggtccgcacccagaacac

SEQ ID NO: 341299 - DNA, 20 bp, human
gcatcagcaacggggcactc

SEQ ID NO: 341300 - DNA, 20 bp, human
gtgaccctgtgttctgggtg

SEQ ID NO: 341301 - DNA, 20 bp, human
ggcgccaagacttgcgcacc

SEQ ID NO: 341302 - DNA, 20 bp, human
ggtggccgatgtgtgcaatc

SEQ ID NO: 341303 - DNA, 20 bp, human
ggcgcgcctcagacgttacg

SEQ ID NO: 341304 - DNA, 20 bp, human
gtcctcagtggcccgaaagc

SEQ ID NO: 341305 - DNA, 20 bp, human
ggccactgaggagaagcctg

SEQ ID NO: 341306 - DNA, 20 bp, human
gttctgggcacggaccaagg

SEQ ID NO: 341307 - DNA, 20 bp, human
ggtgttctgggcacggacca

SEQ ID NO: 341308 - DNA, 20 bp, human
gcactcggggccacagaatc

SEQ ID NO: 341309 - DNA, 20 bp, human
gcagcccagccccgattctg

SEQ ID NO: 341310 - DNA, 20 bp, human
ggggctgctagctcctgctg

SEQ ID NO: 341311 - DNA, 20 bp, human
ggggccacagaatcggggct

SEQ ID NO: 341312 - DNA, 20 bp, human
gcatcagcaacggggcactc

SEQ ID NO: 341313 - DNA, 20 bp, human
gtggccctgtgttctgggca

SEQ ID NO: 341314 - DNA, 20 bp, human
gtgaggcgggcgcgcgtgcg

SEQ ID NO: 341315 - DNA, 20 bp, human
gtgtggaaggcgcctcacgc

SEQ ID NO: 341316 - DNA, 20 bp, human
ggaaagggccaaccccagaa

SEQ ID NO: 341317 - DNA, 20 bp, human
ggcagcttgctggcttgtaa

SEQ ID NO: 341318 - DNA, 20 bp, human
gaagccagcaagctgctgcc

SEQ ID NO: 341319 - DNA, 20 bp, human
gacgcccggcagcagcttgc

SEQ ID NO: 341320 - DNA, 20 bp, human
gtgggcgtggggtcgcccag

SEQ ID NO: 341321 - DNA, 20 bp, human
ggaaagcccacgccccccct

SEQ ID NO: 341322 - DNA, 20 bp, human
ggcgtggggtcgcccagggg

SEQ ID NO: 341323 - DNA, 20 bp, human
gggggggcgtgggctttcct

SEQ ID NO: 341324 - DNA, 20 bp, human
gggtcgcccagggggggcgt

SEQ ID NO: 341325 - DNA, 20 bp, human
gagaaaacgtcaatccaagc

SEQ ID NO: 341326 - DNA, 20 bp, human
gtaccgagattatatacagg

SEQ ID NO: 341327 - DNA, 20 bp, human
gatcctcctgtatataatct

SEQ ID NO: 341328 - DNA, 20 bp, human
gatataccgagattatatac

SEQ ID NO: 341329 - DNA, 20 bp, human
gggtatatgactgctgctga

SEQ ID NO: 341330 - DNA, 20 bp, human
ggggcactgagcagctccac

SEQ ID NO: 341331 - DNA, 20 bp, human
gcggcggaagcggtaagagg

SEQ ID NO: 341332 - DNA, 20 bp, human
gagagcgcgttgcaaaaagg

SEQ ID NO: 341333 - DNA, 20 bp, human
gctgctgctgaagggaagtc

SEQ ID NO: 341334 - DNA, 20 bp, human
gcagctccacaggaaaatac

SEQ ID NO: 341335 - DNA, 20 bp, human
gtaggtaaagcatgcggagg

SEQ ID NO: 341336 - DNA, 20 bp, human
ggcacaccggacgcgtataa

SEQ ID NO: 341337 - DNA, 20 bp, human
gccaaaccgttatacgcgtc

SEQ ID NO: 341338 - DNA, 20 bp, human
ggcacactgcacgtgcgtga

SEQ ID NO: 341339 - DNA, 20 bp, human
gctgcacgtgcgtgacggct

SEQ ID NO: 341340 - DNA, 20 bp, human
gttggctggtctgtaacagt

SEQ ID NO: 341341 - DNA, 20 bp, human
gtggattgacatttcttcct

SEQ ID NO: 341342 - DNA, 20 bp, human
gaagccaagccaagcgctac

SEQ ID NO: 341343 - DNA, 20 bp, human
gttggctggcctgtagcgct

SEQ ID NO: 341344 - DNA, 20 bp, human
gttctgtcacgttactttgc

SEQ ID NO: 341345 - DNA, 20 bp, human
gtggcctgtagcgcttggct

SEQ ID NO: 341346 - DNA, 20 bp, human
ggcacgccggacgcgtataa

SEQ ID NO: 341347 - DNA, 20 bp, human
gccaaaccgttatacgcgtc

SEQ ID NO: 341348 - DNA, 20 bp, human
gttggctggtctgtaacagt

SEQ ID NO: 341349 - DNA, 20 bp, human
gaagccaagccaagcgctac

SEQ ID NO: 341350 - DNA, 20 bp, human
gtggattgacatttcttcct

SEQ ID NO: 341351 - DNA, 20 bp, human
gttggctggcctgtagcgct

SEQ ID NO: 341352 - DNA, 20 bp, human
gttctgtcacgttactttgc

SEQ ID NO: 341353 - DNA, 20 bp, human
gtggcctgtagcgcttggct

SEQ ID NO: 341354 - DNA, 20 bp, human
gtggcttggcatttgtcgct

SEQ ID NO: 341355 - DNA, 20 bp, human
gggaaagcccacacccacgc

SEQ ID NO: 341356 - DNA, 20 bp, human
gcgtgcagcgtgtgcatctc

SEQ ID NO: 341357 - DNA, 20 bp, human
gccgctgccgcgtgcgcgtg

SEQ ID NO: 341358 - DNA, 20 bp, human
ggcagcgtgtgcatctcagg

SEQ ID NO: 341359 - DNA, 20 bp, human
gcgtctgcagctcggagctg

SEQ ID NO: 341360 - DNA, 20 bp, human
gcaggtggcgtcagtgcatg

SEQ ID NO: 341361 - DNA, 20 bp, human
ggaagtttgccaggaacata

SEQ ID NO: 341362 - DNA, 20 bp, human
ggtgcatgtggcacagacag

SEQ ID NO: 341363 - DNA, 20 bp, human
ggagtcccatgaagtttgcc

SEQ ID NO: 341364 - DNA, 20 bp, human
gaagcaggactggggctaag

SEQ ID NO: 341365 - DNA, 20 bp, human
gtgttcctggcaaacttcat

SEQ ID NO: 341366 - DNA, 20 bp, human
gccgctgccgcgtgcgcgtg

SEQ ID NO: 341367 - DNA, 20 bp, human
gttggcctggtgttcctcct

SEQ ID NO: 341368 - DNA, 20 bp, human
ggggttgggcttacctgctg

SEQ ID NO: 341369 - DNA, 20 bp, human
gcacgcggcagcggcttggc

SEQ ID NO: 341370 - DNA, 20 bp, human
ggcccacgcccacccgagga

SEQ ID NO: 341371 - DNA, 20 bp, human
gcaatccaaggaggaacacc

SEQ ID NO: 341372 - DNA, 20 bp, human
ggaaaaggtcaagcctagca

SEQ ID NO: 341373 - DNA, 20 bp, human
gccacacgcgcatagcggtt

SEQ ID NO: 341374 - DNA, 20 bp, human
ggcacgccacacgcgcatag

SEQ ID NO: 341375 - DNA, 20 bp, human
gtctctcgcgttcccttgct

SEQ ID NO: 341376 - DNA, 20 bp, human
ggggatagacattccttcct

SEQ ID NO: 341377 - DNA, 20 bp, human
gggcctgtagcagctagact

SEQ ID NO: 341378 - DNA, 20 bp, human
gacgctgccaagccaagcaa

SEQ ID NO: 341379 - DNA, 20 bp, human
gaaaaacgtcagtccaagga

SEQ ID NO: 341380 - DNA, 20 bp, human
gtggctctgcgacctttgct

SEQ ID NO: 341381 - DNA, 20 bp, human
gttggctggcctgtaacact

SEQ ID NO: 341382 - DNA, 20 bp, human
gtgcgcatgccgagtgttac

SEQ ID NO: 341383 - DNA, 20 bp, human
ggcttggcagcgtgactgct

SEQ ID NO: 341384 - DNA, 20 bp, human
gagccaagtctagctgctac

SEQ ID NO: 341385 - DNA, 20 bp, human
gttctgtcacgttactccgc

SEQ ID NO: 341386 - DNA, 20 bp, human
gaggctctgaggcaccagga

SEQ ID NO: 341387 - DNA, 20 bp, human
ggctgattctggggtataga

SEQ ID NO: 341388 - DNA, 20 bp, human
gttaccccaaacataatcca

SEQ ID NO: 341389 - DNA, 20 bp, human
gaggaaggctctgaggcacc

SEQ ID NO: 341390 - DNA, 20 bp, human
gtctgccatggattatgttt

SEQ ID NO: 341391 - DNA, 20 bp, human
gctactgaagttgtcaaata

SEQ ID NO: 341392 - DNA, 20 bp, human
gcaggtagtgagaattgaat

SEQ ID NO: 341393 - DNA, 20 bp, human
gatactagcgcgcaccctcc

SEQ ID NO: 341394 - DNA, 20 bp, human
gtgtggcattatttttttga

SEQ ID NO: 341395 - DNA, 20 bp, human
gcttcctgatgtatatatgc

SEQ ID NO: 341396 - DNA, 20 bp, human
ggcccagagcgctccacact

SEQ ID NO: 341397 - DNA, 20 bp, human
ggtggtgtggggcaagctgt

SEQ ID NO: 341398 - DNA, 20 bp, human
ggtggcctggaagcctgcat

SEQ ID NO: 341399 - DNA, 20 bp, human
gcccactgtgcgcgccccag

SEQ ID NO: 341400 - DNA, 20 bp, human
ggccgctggggcgcgcacag

SEQ ID NO: 341401 - DNA, 20 bp, human
gcagagcaacagcgcagcgc

SEQ ID NO: 341402 - DNA, 20 bp, human
gtccgagtgtggagcgctct

SEQ ID NO: 341403 - DNA, 20 bp, human
ggcctgggttcccgctgcgt

SEQ ID NO: 341404 - DNA, 20 bp, human
gagctggctagctccgagtg

SEQ ID NO: 341405 - DNA, 20 bp, human
gatgacgcggcccacgcagc

SEQ ID NO: 341406 - DNA, 20 bp, human
gcgtgcgcagagcgcgggaa

SEQ ID NO: 341407 - DNA, 20 bp, human
ggggtggagctcttctgagg

SEQ ID NO: 341408 - DNA, 20 bp, human
gaggccggctctgttcgccc

SEQ ID NO: 341409 - DNA, 20 bp, human
gagggtgcctggctgattga

SEQ ID NO: 341410 - DNA, 20 bp, human
gagggggtggagctcttctg

SEQ ID NO: 341411 - DNA, 20 bp, human
ggcagcgccctcaatcagcc

SEQ ID NO: 341412 - DNA, 20 bp, human
gcatgcgccggcgacacttc

SEQ ID NO: 341413 - DNA, 20 bp, human
gctctgcgcacgcgccttcg

SEQ ID NO: 341414 - DNA, 20 bp, human
gacttctggcggcaggagaa

SEQ ID NO: 341415 - DNA, 20 bp, human
gtctccccgggcgcgcgcca

SEQ ID NO: 341416 - DNA, 20 bp, human
ggctggctgctgtgctaacg

SEQ ID NO: 341417 - DNA, 20 bp, human
gtgacaatgtcagtcctagc

SEQ ID NO: 341418 - DNA, 20 bp, human
gaatcagtatgcgcgtgatt

SEQ ID NO: 341419 - DNA, 20 bp, human
gaatgtcagtcctagctggt

SEQ ID NO: 341420 - DNA, 20 bp, human
gtactgattaagcttcatta

SEQ ID NO: 341421 - DNA, 20 bp, human
gacgaggagagatttgcata

SEQ ID NO: 341422 - DNA, 20 bp, human
gtgccagcataataattagg

SEQ ID NO: 341423 - DNA, 20 bp, human
gtaactggagatagtaccaa

SEQ ID NO: 341424 - DNA, 20 bp, human
ggagtgccagcataataatt

SEQ ID NO: 341425 - DNA, 20 bp, human
gtaaaggtgcttaagtctgt

SEQ ID NO: 341426 - DNA, 20 bp, human
gctggaagagccgactccta

SEQ ID NO: 341427 - DNA, 20 bp, human
gggatcgcagccgtaggagt

SEQ ID NO: 341428 - DNA, 20 bp, human
ggggcagaggataagcaggc

SEQ ID NO: 341429 - DNA, 20 bp, human
gagtggggcagaggataagc

SEQ ID NO: 341430 - DNA, 20 bp, human
gagtctggaacagggaatgg

SEQ ID NO: 341431 - DNA, 20 bp, human
gcacacacatgatttggggt

SEQ ID NO: 341432 - DNA, 20 bp, human
gtgggggcgacagaagtcgg

SEQ ID NO: 341433 - DNA, 20 bp, human
gaactgttgcaggcacctct

SEQ ID NO: 341434 - DNA, 20 bp, human
gcctacggctgcgatccaag

SEQ ID NO: 341435 - DNA, 20 bp, human
gccctgccggaagtcactca

SEQ ID NO: 341436 - DNA, 20 bp, human
gaacagggacagggagtatc

SEQ ID NO: 341437 - DNA, 20 bp, human
gacagggagtatcaggctca

SEQ ID NO: 341438 - DNA, 20 bp, human
gccagctgttgagagaggtg

SEQ ID NO: 341439 - DNA, 20 bp, human
gtccctgtttagcttaggag

SEQ ID NO: 341440 - DNA, 20 bp, human
gcctaagctaaacagggaca

SEQ ID NO: 341441 - DNA, 20 bp, human
gagagagataggggtttgcc

SEQ ID NO: 341442 - DNA, 20 bp, human
gccccttggctgcacctcta

SEQ ID NO: 341443 - DNA, 20 bp, human
gccacccactgtgtctggaa

SEQ ID NO: 341444 - DNA, 20 bp, human
gccctggagagggtactgcg

SEQ ID NO: 341445 - DNA, 20 bp, human
gtcctctcctaagctaaaca

SEQ ID NO: 341446 - DNA, 20 bp, human
gcaggctggagaacccgcca

SEQ ID NO: 341447 - DNA, 20 bp, human
gcgccagggcttcctaaaaa

SEQ ID NO: 341448 - DNA, 20 bp, human
ggggagtgtggcaatcctgg

SEQ ID NO: 341449 - DNA, 20 bp, human
gccgcgccgcgtgctcacct

SEQ ID NO: 341450 - DNA, 20 bp, human
gaggcgcggggctcctgcca

SEQ ID NO: 341451 - DNA, 20 bp, human
gggggcgggtctcgatcccg

SEQ ID NO: 341452 - DNA, 20 bp, human
gggtcctgctcgcccttttt

SEQ ID NO: 341453 - DNA, 20 bp, human
ggcggtgaggaggtgctgcc

SEQ ID NO: 341454 - DNA, 20 bp, human
gcactccgggcgcggtgagg

SEQ ID NO: 341455 - DNA, 20 bp, human
ggcaaatcactgctttgcat

SEQ ID NO: 341456 - DNA, 20 bp, human
gacgcccaatggagagctct

SEQ ID NO: 341457 - DNA, 20 bp, human
gccgcccagagctctccatt

SEQ ID NO: 341458 - DNA, 20 bp, human
gagtgtgtacgcggacggta

SEQ ID NO: 341459 - DNA, 20 bp, human
gccccgggagcgacgcccaa

SEQ ID NO: 341460 - DNA, 20 bp, human
gcacgtggggagtggcgcgg

SEQ ID NO: 341461 - DNA, 20 bp, human
gaggcgggaggcagctccgc

SEQ ID NO: 341462 - DNA, 20 bp, human
ggcgtgagtgtgtacgcgga

SEQ ID NO: 341463 - DNA, 20 bp, human
gcacacagccaggacgagag

SEQ ID NO: 341464 - DNA, 20 bp, human
ggccgctggggcttcattca

SEQ ID NO: 341465 - DNA, 20 bp, human
ggtgtacgcggacggtaggg

SEQ ID NO: 341466 - DNA, 20 bp, human
gccccgggtgaggaagaagc

SEQ ID NO: 341467 - DNA, 20 bp, human
ggaactgagagaatctgaat

SEQ ID NO: 341468 - DNA, 20 bp, human
ggccggcgctgccaagagag

SEQ ID NO: 341469 - DNA, 20 bp, human
ggggcccatccgagagaggg

SEQ ID NO: 341470 - DNA, 20 bp, human
ggcggggcccatccgagaga

SEQ ID NO: 341471 - DNA, 20 bp, human
gataccgctagcaacctccc

SEQ ID NO: 341472 - DNA, 20 bp, human
gaggactccgagcccggggg

SEQ ID NO: 341473 - DNA, 20 bp, human
gcggcctgggaggttgctag

SEQ ID NO: 341474 - DNA, 20 bp, human
gaggaggactccgagcccgg

SEQ ID NO: 341475 - DNA, 20 bp, human
gaggcagagaagaccggcag

SEQ ID NO: 341476 - DNA, 20 bp, human
gtccgagtgcacaatagagc

SEQ ID NO: 341477 - DNA, 20 bp, human
gggctgttccccggcaggta

SEQ ID NO: 341478 - DNA, 20 bp, human
gccggggaacagcctgctcg

SEQ ID NO: 341479 - DNA, 20 bp, human
gggccacgaccccccctgaa

SEQ ID NO: 341480 - DNA, 20 bp, human
gccgtggccacccccttcag

SEQ ID NO: 341481 - DNA, 20 bp, human
gtggccacccccttcagggg

SEQ ID NO: 341482 - DNA, 20 bp, human
ggcttctaacccctacctgc

SEQ ID NO: 341483 - DNA, 20 bp, human
ggcagcgccgccgtgacctc

SEQ ID NO: 341484 - DNA, 20 bp, human
gggaacagcctgctcgcggc

SEQ ID NO: 341485 - DNA, 20 bp, human
gaatagagccggccgcgagc

SEQ ID NO: 341486 - DNA, 20 bp, human
gaatagcggtgcgggaggtc

SEQ ID NO: 341487 - DNA, 20 bp, human
gcggccaatagcggtgcggg

SEQ ID NO: 341488 - DNA, 20 bp, human
gtaacccgtgctagcgtctt

SEQ ID NO: 341489 - DNA, 20 bp, human
gagcccggccaatagcggtg

SEQ ID NO: 341490 - DNA, 20 bp, human
gcgggctcgctttccaaatt

SEQ ID NO: 341491 - DNA, 20 bp, human
ggagtaagcccggccaatag

SEQ ID NO: 341492 - DNA, 20 bp, human
ggcctggccaggagtaagcc

SEQ ID NO: 341493 - DNA, 20 bp, human
ggagccaaagacgctagcac

SEQ ID NO: 341494 - DNA, 20 bp, human
gcgctgcgattggccgtggt

SEQ ID NO: 341495 - DNA, 20 bp, human
ggacgcgctgcgattggccg

SEQ ID NO: 341496 - DNA, 20 bp, human
gacgcacggggccgccgaga

SEQ ID NO: 341497 - DNA, 20 bp, human
gcccacgcgctggtcgcggc

SEQ ID NO: 341498 - DNA, 20 bp, human
gctggtggtcactataagag

SEQ ID NO: 341499 - DNA, 20 bp, human
ggatgcctgtcagcgcggtg

SEQ ID NO: 341500 - DNA, 20 bp, human
ggggacggccgcgagaagtg

SEQ ID NO: 341501 - DNA, 20 bp, human
gtgacgcgcgctctccttct

SEQ ID NO: 341502 - DNA, 20 bp, human
gtcgcgagagctccccggga

SEQ ID NO: 341503 - DNA, 20 bp, human
ggcgcgcgcgcagacgcacg

SEQ ID NO: 341504 - DNA, 20 bp, human
ggatgcacctgtagctaccc

SEQ ID NO: 341505 - DNA, 20 bp, human
gcgcatgcccgggtagctac

SEQ ID NO: 341506 - DNA, 20 bp, human
gaagcctgaggggagtagag

SEQ ID NO: 341507 - DNA, 20 bp, human
gctcccttgccaggaaacgc

SEQ ID NO: 341508 - DNA, 20 bp, human
gggcaacagagcacgggcgg

SEQ ID NO: 341509 - DNA, 20 bp, human
ggaaaggactcaagcctgag

SEQ ID NO: 341510 - DNA, 20 bp, human
gggcggcggcaacagagcac

SEQ ID NO: 341511 - DNA, 20 bp, human
ggcagaaaagaggcggcgga

SEQ ID NO: 341512 - DNA, 20 bp, human
ggcaacgcgagaaaccgaac

SEQ ID NO: 341513 - DNA, 20 bp, human
gcggacctggccatttgggt

SEQ ID NO: 341514 - DNA, 20 bp, human
gagaggggagtataactcgc

SEQ ID NO: 341515 - DNA, 20 bp, human
gtggcccggcacttctcgga

SEQ ID NO: 341516 - DNA, 20 bp, human
gaggccaggcccgggtataa

SEQ ID NO: 341517 - DNA, 20 bp, human
gtatccaggcagttcgagct

SEQ ID NO: 341518 - DNA, 20 bp, human
gtggataaaagggtagccct

SEQ ID NO: 341519 - DNA, 20 bp, human
gcacgcgccggggactcgca

SEQ ID NO: 341520 - DNA, 20 bp, human
ggagaggggaagttggagta

SEQ ID NO: 341521 - DNA, 20 bp, human
ggcgccgcgggaccggactc

SEQ ID NO: 341522 - DNA, 20 bp, human
gcgggtataaaggctgtgga

SEQ ID NO: 341523 - DNA, 20 bp, human
gggcccgggtataaaggctg

SEQ ID NO: 341524 - DNA, 20 bp, human
gtcgaactgcctggataaaa

SEQ ID NO: 341525 - DNA, 20 bp, human
gcagcggggcggggcggact

SEQ ID NO: 341526 - DNA, 20 bp, human
ggatgtttgcctaatggtgg

SEQ ID NO: 341527 - DNA, 20 bp, human
ggccccgccccctggatggg

SEQ ID NO: 341528 - DNA, 20 bp, human
gtctgtggaaggggaaaacc

SEQ ID NO: 341529 - DNA, 20 bp, human
gaaggctagtgggtgggact

SEQ ID NO: 341530 - DNA, 20 bp, human
ggaaaaccgggagacacaac

SEQ ID NO: 341531 - DNA, 20 bp, human
gctggccccgccccctggat

SEQ ID NO: 341532 - DNA, 20 bp, human
gacacaactggcgcccctcc

SEQ ID NO: 341533 - DNA, 20 bp, human
ggccagaggtcaaggctagt

SEQ ID NO: 341534 - DNA, 20 bp, human
ggaggtcaaggctagtgggt

SEQ ID NO: 341535 - DNA, 20 bp, human
gtccacccatccagggggcg

SEQ ID NO: 341536 - DNA, 20 bp, human
gcgtaccgggaggctcccat

SEQ ID NO: 341537 - DNA, 20 bp, human
gtggactggagctgctacgg

SEQ ID NO: 341538 - DNA, 20 bp, human
gcaatggggttcaagaaaaa

SEQ ID NO: 341539 - DNA, 20 bp, human
gagcagtgggaggggtgatt

SEQ ID NO: 341540 - DNA, 20 bp, human
gaagatgggcgggactacgc

SEQ ID NO: 341541 - DNA, 20 bp, human
ggtagcagctccagtccaat

SEQ ID NO: 341542 - DNA, 20 bp, human
gtgaggagagacgcttgtct

SEQ ID NO: 341543 - DNA, 20 bp, human
gggactggacttaacccaat

SEQ ID NO: 341544 - DNA, 20 bp, human
gagagacgcttgtctcggac

SEQ ID NO: 341545 - DNA, 20 bp, human
gaaccccaaattcctaagta

SEQ ID NO: 341546 - DNA, 20 bp, human
ggacaagtgtgctgtagtga

SEQ ID NO: 341547 - DNA, 20 bp, human
gagaatggactcaggaatca

SEQ ID NO: 341548 - DNA, 20 bp, human
ggcagaagcagaatggactc

SEQ ID NO: 341549 - DNA, 20 bp, human
gtgaaagctctgtgaccgta

SEQ ID NO: 341550 - DNA, 20 bp, human
gctacactggaatttcagat

SEQ ID NO: 341551 - DNA, 20 bp, human
gcatgatgctagattcttca

SEQ ID NO: 341552 - DNA, 20 bp, human
gagcacagaacacaagtaga

SEQ ID NO: 341553 - DNA, 20 bp, human
gagaatctagcatcatggta

SEQ ID NO: 341554 - DNA, 20 bp, human
gtatgacacacacagccata

SEQ ID NO: 341555 - DNA, 20 bp, human
gagatcggccactgacacaa

SEQ ID NO: 341556 - DNA, 20 bp, human
gtcaagccccgccccccagt

SEQ ID NO: 341557 - DNA, 20 bp, human
gggaaatctggtagatccat

SEQ ID NO: 341558 - DNA, 20 bp, human
ggtgcgtaggcggggaaatc

SEQ ID NO: 341559 - DNA, 20 bp, human
ggccaagggtgcctgtgcgt

SEQ ID NO: 341560 - DNA, 20 bp, human
gggctcactcccttaaccct

SEQ ID NO: 341561 - DNA, 20 bp, human
gtagatccataggaactcct

SEQ ID NO: 341562 - DNA, 20 bp, human
gggagttggaagcaaaggtc

SEQ ID NO: 341563 - DNA, 20 bp, human
gggactggggatgtgcaaag

SEQ ID NO: 341564 - DNA, 20 bp, human
gtaggaactcctgggtccta

SEQ ID NO: 341565 - DNA, 20 bp, human
gctcctgggtcctagggtta

SEQ ID NO: 341566 - DNA, 20 bp, human
ggccgagcgggaggtcccgg

SEQ ID NO: 341567 - DNA, 20 bp, human
ggggacctcccgctcggcca

SEQ ID NO: 341568 - DNA, 20 bp, human
ggcacgggagccaggagcga

SEQ ID NO: 341569 - DNA, 20 bp, human
ggtcccggaggctctctccc

SEQ ID NO: 341570 - DNA, 20 bp, human
ggaaggccatgtggcatgga

SEQ ID NO: 341571 - DNA, 20 bp, human
ggacagggatggacggtcag

SEQ ID NO: 341572 - DNA, 20 bp, human
gcacctccgcggcacctcgg

SEQ ID NO: 341573 - DNA, 20 bp, human
gccctctggccctggccgag

SEQ ID NO: 341574 - DNA, 20 bp, human
gtggttactcagcccctccg

SEQ ID NO: 341575 - DNA, 20 bp, human
gtgtcccgggagagagcctc

SEQ ID NO: 341576 - DNA, 20 bp, human
gtagctccacggaagatctg

SEQ ID NO: 341577 - DNA, 20 bp, human
gatcttccgtggagctacat

SEQ ID NO: 341578 - DNA, 20 bp, human
gaagtcagagagctgacatt

SEQ ID NO: 341579 - DNA, 20 bp, human
ggacagaacactaaacaact

SEQ ID NO: 341580 - DNA, 20 bp, human
gtgacacacatgctttttac

SEQ ID NO: 341581 - DNA, 20 bp, human
gattttcccatgtagctcca

SEQ ID NO: 341582 - DNA, 20 bp, human
gtctaggcatgaactctctt

SEQ ID NO: 341583 - DNA, 20 bp, human
gacatgctttttacaggact

SEQ ID NO: 341584 - DNA, 20 bp, human
gagaagtaattttgaaggtg

SEQ ID NO: 341585 - DNA, 20 bp, human
gcatcatttaaataaaatgt

SEQ ID NO: 341586 - DNA, 20 bp, human
ggagttctgactgaggttcc

SEQ ID NO: 341587 - DNA, 20 bp, human
gttaccactatctggacaat

SEQ ID NO: 341588 - DNA, 20 bp, human
ggtgctatgaaggcactggt

SEQ ID NO: 341589 - DNA, 20 bp, human
ggtgtgtgctatgaaggcac

SEQ ID NO: 341590 - DNA, 20 bp, human
gactcactttatgattcaga

SEQ ID NO: 341591 - DNA, 20 bp, human
gagttgtatgaagtaaactt

SEQ ID NO: 341592 - DNA, 20 bp, human
gaaatcagtagaacttcaaa

SEQ ID NO: 341593 - DNA, 20 bp, human
gctttggaatttctgaaaga

SEQ ID NO: 341594 - DNA, 20 bp, human
gacaattggacatgtttcac

SEQ ID NO: 341595 - DNA, 20 bp, human
gacatatttatgttgtgtga

SEQ ID NO: 341596 - DNA, 20 bp, human
ggcctccgcgatggcagcta

SEQ ID NO: 341597 - DNA, 20 bp, human
gctggggagtgcggacaccc

SEQ ID NO: 341598 - DNA, 20 bp, human
ggatggcagctagggctcag

SEQ ID NO: 341599 - DNA, 20 bp, human
gtcgggcccagcctccgcga

SEQ ID NO: 341600 - DNA, 20 bp, human
gcacggggttggcccggcgg

SEQ ID NO: 341601 - DNA, 20 bp, human
gggaacagaaccagcgccgg

SEQ ID NO: 341602 - DNA, 20 bp, human
ggcggggagcgcctttaacg

SEQ ID NO: 341603 - DNA, 20 bp, human
gtccctgtgtgcgtggtcgg

SEQ ID NO: 341604 - DNA, 20 bp, human
ggagtgcggacacccgggcc

SEQ ID NO: 341605 - DNA, 20 bp, human
gcgcactgcgagcactggac

SEQ ID NO: 341606 - DNA, 20 bp, human
gtgcgcgcggagctacctgg

SEQ ID NO: 341607 - DNA, 20 bp, human
gagggcatagtgcgcacaac

SEQ ID NO: 341608 - DNA, 20 bp, human
gcgcagcccgagcgccgggg

SEQ ID NO: 341609 - DNA, 20 bp, human
gcgggagggatgactccgga

SEQ ID NO: 341610 - DNA, 20 bp, human
ggggatgactccggacggta

SEQ ID NO: 341611 - DNA, 20 bp, human
gtgagctgcggcctcgctga

SEQ ID NO: 341612 - DNA, 20 bp, human
gctcactcgtctttgagctg

SEQ ID NO: 341613 - DNA, 20 bp, human
gtgagctcttcaggggtggt

SEQ ID NO: 341614 - DNA, 20 bp, human
gggtccctgccagtggaatc

SEQ ID NO: 341615 - DNA, 20 bp, human
gctggtgttccagattccac

SEQ ID NO: 341616 - DNA, 20 bp, human
gctgagagccggcacggcgt

SEQ ID NO: 341617 - DNA, 20 bp, human
gacacgggtgcctgtttcta

SEQ ID NO: 341618 - DNA, 20 bp, human
gagcggttgctatggagaca

SEQ ID NO: 341619 - DNA, 20 bp, human
gcggaagcggcggacgcagg

SEQ ID NO: 341620 - DNA, 20 bp, human
gcacggcgtgggacgacatc

SEQ ID NO: 341621 - DNA, 20 bp, human
ggcgctgcgcagctcacttc

SEQ ID NO: 341622 - DNA, 20 bp, human
gtcccccgggcccacgaatt

SEQ ID NO: 341623 - DNA, 20 bp, human
ggcgtgggacgacatcaggc

SEQ ID NO: 341624 - DNA, 20 bp, human
gtagcccagctggaggaaat

SEQ ID NO: 341625 - DNA, 20 bp, human
gcagcagcatgggacagtca

SEQ ID NO: 341626 - DNA, 20 bp, human
gctgagagccggcacggcgt

SEQ ID NO: 341627 - DNA, 20 bp, human
gacacgggtgcctgtttcta

SEQ ID NO: 341628 - DNA, 20 bp, human
gagcggttgctatggagaca

SEQ ID NO: 341629 - DNA, 20 bp, human
gcggaagcggcggacgcagg

SEQ ID NO: 341630 - DNA, 20 bp, human
gcacggcgtgggacgacatc

SEQ ID NO: 341631 - DNA, 20 bp, human
ggcgctgcgcagctcacttc

SEQ ID NO: 341632 - DNA, 20 bp, human
gtcccccgggcccacgaatt

SEQ ID NO: 341633 - DNA, 20 bp, human
ggcgtgggacgacatcaggc

SEQ ID NO: 341634 - DNA, 20 bp, human
gtagcccagctggaggaaat

SEQ ID NO: 341635 - DNA, 20 bp, human
gcagcagcatgggacagtca

SEQ ID NO: 341636 - DNA, 20 bp, human
gggggtaccgaggccgagtt

SEQ ID NO: 341637 - DNA, 20 bp, human
gtcgggagggatgaggccga

SEQ ID NO: 341638 - DNA, 20 bp, human
gcggatgccgcaggtcggga

SEQ ID NO: 341639 - DNA, 20 bp, human
gccgcaggtcgggagggatg

SEQ ID NO: 341640 - DNA, 20 bp, human
gcggcatccgcccagaagtg

SEQ ID NO: 341641 - DNA, 20 bp, human
gtgggcggatgccgcaggtc

SEQ ID NO: 341642 - DNA, 20 bp, human
gttaccactgagtttaaggg

SEQ ID NO: 341643 - DNA, 20 bp, human
gtgaggccgacggcgctgat

SEQ ID NO: 341644 - DNA, 20 bp, human
gtgccgagagccgcacttct

SEQ ID NO: 341645 - DNA, 20 bp, human
ggtcagccaatcagcgccgt

SEQ ID NO: 341646 - DNA, 20 bp, human
gaggaggcaaagttagagtt

SEQ ID NO: 341647 - DNA, 20 bp, human
ggctgctgctgtgatcgcct

SEQ ID NO: 341648 - DNA, 20 bp, human
ggtcttaggcagcttaagga

SEQ ID NO: 341649 - DNA, 20 bp, human
ggcaaagttagagttggggc

SEQ ID NO: 341650 - DNA, 20 bp, human
gagagagggacctccttact

SEQ ID NO: 341651 - DNA, 20 bp, human
gcttaagctgcctaagacgt

SEQ ID NO: 341652 - DNA, 20 bp, human
gtaggggctcccggtttctc

SEQ ID NO: 341653 - DNA, 20 bp, human
ggggacctccttacttggct

SEQ ID NO: 341654 - DNA, 20 bp, human
gttaaaaagagaagacgtgg

SEQ ID NO: 341655 - DNA, 20 bp, human
gtggtgtttctgaacgctag

SEQ ID NO: 341656 - DNA, 20 bp, human
gaggggcggggagggcacga

SEQ ID NO: 341657 - DNA, 20 bp, human
ggaggagggagggttagggg

SEQ ID NO: 341658 - DNA, 20 bp, human
gtccgcgccacgtgactccg

SEQ ID NO: 341659 - DNA, 20 bp, human
gtcagggccgggactccggg

SEQ ID NO: 341660 - DNA, 20 bp, human
gcggagtcccggccctgacc

SEQ ID NO: 341661 - DNA, 20 bp, human
gccgcggcgcccaaaagagc

SEQ ID NO: 341662 - DNA, 20 bp, human
ggcgcggctgccactccctg

SEQ ID NO: 341663 - DNA, 20 bp, human
gggcgcccaaaagagcgggt

SEQ ID NO: 341664 - DNA, 20 bp, human
gagcgggtggggcgagcgtg

SEQ ID NO: 341665 - DNA, 20 bp, human
gccctcctctccgcgcgggg

SEQ ID NO: 341666 - DNA, 20 bp, human
gagcccgaggcgcgaggttt

SEQ ID NO: 341667 - DNA, 20 bp, human
gcggaccccgcctcctagtg

SEQ ID NO: 341668 - DNA, 20 bp, human
gctcctggggagagggatcc

SEQ ID NO: 341669 - DNA, 20 bp, human
ggagcccaggggccgcccac

SEQ ID NO: 341670 - DNA, 20 bp, human
ggggcacccgcggaccgggg

SEQ ID NO: 341671 - DNA, 20 bp, human
gcgagcgcgctgccctggcg

SEQ ID NO: 341672 - DNA, 20 bp, human
gaccggggaggggaagcccg

SEQ ID NO: 341673 - DNA, 20 bp, human
gccggccgctggcgatactg

SEQ ID NO: 341674 - DNA, 20 bp, human
gaggggccgcccactggcgg

SEQ ID NO: 341675 - DNA, 20 bp, human
gcccaggggccgcccactgg

SEQ ID NO: 341676 - DNA, 20 bp, human
gcggcggctccccaggaaga

SEQ ID NO: 341677 - DNA, 20 bp, human
gtcggctggaactggggcgc

SEQ ID NO: 341678 - DNA, 20 bp, human
ggagggcatcgtctggcaaa

SEQ ID NO: 341679 - DNA, 20 bp, human
gagaaggctgctccccgcgg

SEQ ID NO: 341680 - DNA, 20 bp, human
gtccctgctgaacgcaccag

SEQ ID NO: 341681 - DNA, 20 bp, human
gctgacgtggccacctccgc

SEQ ID NO: 341682 - DNA, 20 bp, human
ggacctactcggctggaact

SEQ ID NO: 341683 - DNA, 20 bp, human
ggccccagttccagccgagt

SEQ ID NO: 341684 - DNA, 20 bp, human
ggccgccaggccgtcttcct

SEQ ID NO: 341685 - DNA, 20 bp, human
ggaccgtacgccgacctact

SEQ ID NO: 341686 - DNA, 20 bp, human
gagagcgcgattgtgacacc

SEQ ID NO: 341687 - DNA, 20 bp, human
gtccaatgtgaggagagcag

SEQ ID NO: 341688 - DNA, 20 bp, human
ggaggggaggatgttggcgt

SEQ ID NO: 341689 - DNA, 20 bp, human
gcgggatggtagtgcggaag

SEQ ID NO: 341690 - DNA, 20 bp, human
gtgacacctggtggagacgt

SEQ ID NO: 341691 - DNA, 20 bp, human
gtccgcactaccatcccgga

SEQ ID NO: 341692 - DNA, 20 bp, human
gcccctccgggatggtagtg

SEQ ID NO: 341693 - DNA, 20 bp, human
ggtcacaatcgcgctctcgc

SEQ ID NO: 341694 - DNA, 20 bp, human
gacctggtggagacgtggga

SEQ ID NO: 341695 - DNA, 20 bp, human
ggggccgggaagcctctgtt

SEQ ID NO: 341696 - DNA, 20 bp, human
gtggactcctcacctcccgg

SEQ ID NO: 341697 - DNA, 20 bp, human
gtgacttgcaggggtctgga

SEQ ID NO: 341698 - DNA, 20 bp, human
gcaccagcagagcctccggg

SEQ ID NO: 341699 - DNA, 20 bp, human
ggtggccttggcctctgaag

SEQ ID NO: 341700 - DNA, 20 bp, human
gcggccaatggctcatccct

SEQ ID NO: 341701 - DNA, 20 bp, human
gggtgcaggccccgcattgg

SEQ ID NO: 341702 - DNA, 20 bp, human
gcccacctctgccccttcag

SEQ ID NO: 341703 - DNA, 20 bp, human
gctgccgggcagcttggacc

SEQ ID NO: 341704 - DNA, 20 bp, human
ggggcctgggctatttaaat

SEQ ID NO: 341705 - DNA, 20 bp, human
gggagggaggggtcatgagt

SEQ ID NO: 341706 - DNA, 20 bp, human
gggccccgggacacaccccc

SEQ ID NO: 341707 - DNA, 20 bp, human
gatcgggcgccgccctccgg

SEQ ID NO: 341708 - DNA, 20 bp, human
gctccggggggtgtgtcccg

SEQ ID NO: 341709 - DNA, 20 bp, human
gcggccgcggggcgctaggt

SEQ ID NO: 341710 - DNA, 20 bp, human
gcgggcggggcttccgggtc

SEQ ID NO: 341711 - DNA, 20 bp, human
ggaggggcggtgcgtgtcgc

SEQ ID NO: 341712 - DNA, 20 bp, human
ggtcccggggccgaggcccg

SEQ ID NO: 341713 - DNA, 20 bp, human
gagtgtcccgaggcccgacc

SEQ ID NO: 341714 - DNA, 20 bp, human
ggaggtggagggaccgtcca

SEQ ID NO: 341715 - DNA, 20 bp, human
ggacactggctcgcgcggac

SEQ ID NO: 341716 - DNA, 20 bp, human
gcctgtggcgccctctggtg

SEQ ID NO: 341717 - DNA, 20 bp, human
gaattaggggagtctccagg

SEQ ID NO: 341718 - DNA, 20 bp, human
gcggacgtagcagctaaggg

SEQ ID NO: 341719 - DNA, 20 bp, human
ggatgcggacgtagcagcta

SEQ ID NO: 341720 - DNA, 20 bp, human
ggctgccccgggccagcctg

SEQ ID NO: 341721 - DNA, 20 bp, human
gcgtccgcatcccgcaccag

SEQ ID NO: 341722 - DNA, 20 bp, human
gcagaattaggggagtctcc

SEQ ID NO: 341723 - DNA, 20 bp, human
ggccagcctgtggcgccctc

SEQ ID NO: 341724 - DNA, 20 bp, human
gcagcgcggtgacgtctcgc

SEQ ID NO: 341725 - DNA, 20 bp, human
gctccaggaggcgtggtgat

SEQ ID NO: 341726 - DNA, 20 bp, human
gcctcctgggagcctaactg

SEQ ID NO: 341727 - DNA, 20 bp, human
gaggtcccttggtggaaggt

SEQ ID NO: 341728 - DNA, 20 bp, human
ggcctctacccccctcagtt

SEQ ID NO: 341729 - DNA, 20 bp, human
gcctgggagcctaactgagg

SEQ ID NO: 341730 - DNA, 20 bp, human
ggcaccccggggggctggaa

SEQ ID NO: 341731 - DNA, 20 bp, human
gtacgcctcggtgtttaggg

SEQ ID NO: 341732 - DNA, 20 bp, human
gggcgctgaccactcctcct

SEQ ID NO: 341733 - DNA, 20 bp, human
ggaaatctcaggtcccttgg

SEQ ID NO: 341734 - DNA, 20 bp, human
gggctcctccctaaacaccg

SEQ ID NO: 341735 - DNA, 20 bp, human
gacggggagtaaccgagctg

SEQ ID NO: 341736 - DNA, 20 bp, human
gcggcggcgcgcgactggga

SEQ ID NO: 341737 - DNA, 20 bp, human
gccgccgcccgcgcacagta

SEQ ID NO: 341738 - DNA, 20 bp, human
ggcggggcagagagtggacg

SEQ ID NO: 341739 - DNA, 20 bp, human
ggagggatccgaagtttagg

SEQ ID NO: 341740 - DNA, 20 bp, human
gcccccggccagggccggtc

SEQ ID NO: 341741 - DNA, 20 bp, human
gcgtgggccctactgtgcgc

SEQ ID NO: 341742 - DNA, 20 bp, human
ggggccctactgtgcgcggg

SEQ ID NO: 341743 - DNA, 20 bp, human
gggcccacggcgggagccac

SEQ ID NO: 341744 - DNA, 20 bp, human
gagggtcccatttccgagga

SEQ ID NO: 341745 - DNA, 20 bp, human
gagagtggacgcgggaaagc

SEQ ID NO: 341746 - DNA, 20 bp, human
gaactcgtgacgtcactcaa

SEQ ID NO: 341747 - DNA, 20 bp, human
gagcaagctgcacaggggaa

SEQ ID NO: 341748 - DNA, 20 bp, human
ggaaacacttagacttttgg

SEQ ID NO: 341749 - DNA, 20 bp, human
ggttacttcactgaagcaga

SEQ ID NO: 341750 - DNA, 20 bp, human
gttagagcagcaagctgcac

SEQ ID NO: 341751 - DNA, 20 bp, human
gctggggactgtagtaagac

SEQ ID NO: 341752 - DNA, 20 bp, human
gagtctgtggcattcaaagc

SEQ ID NO: 341753 - DNA, 20 bp, human
ggccacttgcttgttttgga

SEQ ID NO: 341754 - DNA, 20 bp, human
ggggctccgtttagagtctg

SEQ ID NO: 341755 - DNA, 20 bp, human
gggggattttggttattata

SEQ ID NO: 341756 - DNA, 20 bp, human
gcacaagggcatggtgacgt

SEQ ID NO: 341757 - DNA, 20 bp, human
gcgggataaagtgtcatcat

SEQ ID NO: 341758 - DNA, 20 bp, human
gagagctccctcgagacaca

SEQ ID NO: 341759 - DNA, 20 bp, human
gttgctcttacgttcgtatc

SEQ ID NO: 341760 - DNA, 20 bp, human
gacttagtgcctctgaacta

SEQ ID NO: 341761 - DNA, 20 bp, human
gtggctgctcaaaactttac

SEQ ID NO: 341762 - DNA, 20 bp, human
gagggcatggtgacgtggga

SEQ ID NO: 341763 - DNA, 20 bp, human
ggccccagttggtagagcta

SEQ ID NO: 341764 - DNA, 20 bp, human
gtgacatcagcaattgagac

SEQ ID NO: 341765 - DNA, 20 bp, human
gagtcagttatgggcatgga

SEQ ID NO: 341766 - DNA, 20 bp, human
gagacacggcgcaggaaagt

SEQ ID NO: 341767 - DNA, 20 bp, human
gcccgcagctagcggccctg

SEQ ID NO: 341768 - DNA, 20 bp, human
gcagcaatgcgggcagcccc

SEQ ID NO: 341769 - DNA, 20 bp, human
gtcagcaaggggtaaagcgc

SEQ ID NO: 341770 - DNA, 20 bp, human
gcgagcccccggctgccgca

SEQ ID NO: 341771 - DNA, 20 bp, human
gtcaacgccgagccggcccg

SEQ ID NO: 341772 - DNA, 20 bp, human
gaagaagcaggttgtctcgc

SEQ ID NO: 341773 - DNA, 20 bp, human
ggctgcccgcattgctgcgc

SEQ ID NO: 341774 - DNA, 20 bp, human
gtgcgcccggccttcgaacg

SEQ ID NO: 341775 - DNA, 20 bp, human
ggggctgcgtgagctggtcg

SEQ ID NO: 341776 - DNA, 20 bp, human
gcggtcccgcggctgagggg

SEQ ID NO: 341777 - DNA, 20 bp, human
gcggggtcacggatgctgta

SEQ ID NO: 341778 - DNA, 20 bp, human
gccaggcagctcttagggga

SEQ ID NO: 341779 - DNA, 20 bp, human
gcgcgccgccgcagtagctg

SEQ ID NO: 341780 - DNA, 20 bp, human
ggggcggtcccgcggctgag

SEQ ID NO: 341781 - DNA, 20 bp, human
gggcgcgcgctgtccctagg

SEQ ID NO: 341782 - DNA, 20 bp, human
gcgagtccaccaacgagcga

SEQ ID NO: 341783 - DNA, 20 bp, human
gacaggctcttccttcccga

SEQ ID NO: 341784 - DNA, 20 bp, human
gcccctccgccctcgctcgt

SEQ ID NO: 341785 - DNA, 20 bp, human
gtaacccggaggggtatggg

SEQ ID NO: 341786 - DNA, 20 bp, human
gacccagagaaagaccagac

SEQ ID NO: 341787 - DNA, 20 bp, human
gcctacctcttccttcttac

SEQ ID NO: 341788 - DNA, 20 bp, human
ggagttcttacacaggtgta

SEQ ID NO: 341789 - DNA, 20 bp, human
gctgaacggagttcttacac

SEQ ID NO: 341790 - DNA, 20 bp, human
ggcacattaagcaagttagt

SEQ ID NO: 341791 - DNA, 20 bp, human
gagtaggaatttgacctgtc

SEQ ID NO: 341792 - DNA, 20 bp, human
gacctgtctggtctttctct

SEQ ID NO: 341793 - DNA, 20 bp, human
ggtaagaactccgttcagga

SEQ ID NO: 341794 - DNA, 20 bp, human
gtagttcttaccttcctgaa

SEQ ID NO: 341795 - DNA, 20 bp, human
gctgcagtatagaaaaggca

SEQ ID NO: 341796 - DNA, 20 bp, human
ggtggactacaactcccgga

SEQ ID NO: 341797 - DNA, 20 bp, human
gccagcccggtgctctcgtg

SEQ ID NO: 341798 - DNA, 20 bp, human
gtgggactctcgataggggc

SEQ ID NO: 341799 - DNA, 20 bp, human
gtagtccactggggaaatcc

SEQ ID NO: 341800 - DNA, 20 bp, human
gttgctgggactctcgatag

SEQ ID NO: 341801 - DNA, 20 bp, human
gctctcccgcggaatctgac

SEQ ID NO: 341802 - DNA, 20 bp, human
ggcacgcctcacgagagcac

SEQ ID NO: 341803 - DNA, 20 bp, human
ggaaatcctggagcaaaccc

SEQ ID NO: 341804 - DNA, 20 bp, human
ggtatgtcgcgcagccttct

SEQ ID NO: 341805 - DNA, 20 bp, human
gagcaacaagcagtgtgtgt

SEQ ID NO: 341806 - DNA, 20 bp, human
gcaggaggggccacccaagg

SEQ ID NO: 341807 - DNA, 20 bp, human
gcgggcagaggtaggcccag

SEQ ID NO: 341808 - DNA, 20 bp, human
ggcagaggcacgcaagtgac

SEQ ID NO: 341809 - DNA, 20 bp, human
ggccacccaaggaggctcat

SEQ ID NO: 341810 - DNA, 20 bp, human
ggggcctacctctgcccgag

SEQ ID NO: 341811 - DNA, 20 bp, human
gggtcaggccctatcaggtg

SEQ ID NO: 341812 - DNA, 20 bp, human
gctgcaagctcctgccactc

SEQ ID NO: 341813 - DNA, 20 bp, human
ggctgtgtggcacagaactc

SEQ ID NO: 341814 - DNA, 20 bp, human
gccaaaggtcaggccctatc

SEQ ID NO: 341815 - DNA, 20 bp, human
gctacctctgcccgagtggc

SEQ ID NO: 341816 - DNA, 20 bp, human
gggacctagtgtcaaaagaa

SEQ ID NO: 341817 - DNA, 20 bp, human
gccgcgccgtactgagtggg

SEQ ID NO: 341818 - DNA, 20 bp, human
ggctgggtgggcatctggta

SEQ ID NO: 341819 - DNA, 20 bp, human
ggcgccgcgccgtactgagt

SEQ ID NO: 341820 - DNA, 20 bp, human
ggggcgcagactctgctgtg

SEQ ID NO: 341821 - DNA, 20 bp, human
gacaccaggtaggcgagaag

SEQ ID NO: 341822 - DNA, 20 bp, human
gggccgagaaacgactccca

SEQ ID NO: 341823 - DNA, 20 bp, human
gtccagaaaggcccgtacag

SEQ ID NO: 341824 - DNA, 20 bp, human
gacccactggcagtccccaa

SEQ ID NO: 341825 - DNA, 20 bp, human
gcgaaagtgacactgcaacg

SEQ ID NO: 341826 - DNA, 20 bp, human
gggcgagagtcgcaccgagg

SEQ ID NO: 341827 - DNA, 20 bp, human
ggactctcgccgtctggctt

SEQ ID NO: 341828 - DNA, 20 bp, human
gggcccccgcgcatataagt

SEQ ID NO: 341829 - DNA, 20 bp, human
gggccgcggcgcgtcacgga

SEQ ID NO: 341830 - DNA, 20 bp, human
ggggcggcccggccggtcct

SEQ ID NO: 341831 - DNA, 20 bp, human
gtgggggcgcggcctcgccg

SEQ ID NO: 341832 - DNA, 20 bp, human
ggcccccgtcgcctccacaa

SEQ ID NO: 341833 - DNA, 20 bp, human
ggccctgcggcgttcgtctt

SEQ ID NO: 341834 - DNA, 20 bp, human
ggtcgcaccgaggtggaagc

SEQ ID NO: 341835 - DNA, 20 bp, human
ggacggcgagagtcgcaccg

SEQ ID NO: 341836 - DNA, 20 bp, human
ggcagctacagagcagctat

SEQ ID NO: 341837 - DNA, 20 bp, human
gtaaccacatggtagctgag

SEQ ID NO: 341838 - DNA, 20 bp, human
ggctggatgtgacctagaca

SEQ ID NO: 341839 - DNA, 20 bp, human
gatcagacataatctaatcc

SEQ ID NO: 341840 - DNA, 20 bp, human
gaggaggcagccggtcgcag

SEQ ID NO: 341841 - DNA, 20 bp, human
gaatgagtttctccatgtct

SEQ ID NO: 341842 - DNA, 20 bp, human
gaaaccgccagttaaccaca

SEQ ID NO: 341843 - DNA, 20 bp, human
gcgctgttcatcatgtgatg

SEQ ID NO: 341844 - DNA, 20 bp, human
ggctctattttatacagagc

SEQ ID NO: 341845 - DNA, 20 bp, human
gctgacataattaactgttt

SEQ ID NO: 341846 - DNA, 20 bp, human
gaagggggcgactgcatagt

SEQ ID NO: 341847 - DNA, 20 bp, human
ggcccccaaggaagatttga

SEQ ID NO: 341848 - DNA, 20 bp, human
gcccatatacccaaggagat

SEQ ID NO: 341849 - DNA, 20 bp, human
gcccaaggaagatttgaagg

SEQ ID NO: 341850 - DNA, 20 bp, human
gaaacacagtcttctaatcc

SEQ ID NO: 341851 - DNA, 20 bp, human
gcagagtgctgacaagacac

SEQ ID NO: 341852 - DNA, 20 bp, human
gtcagcagaagacacatagg

SEQ ID NO: 341853 - DNA, 20 bp, human
ggacaagacacaggggccta

SEQ ID NO: 341854 - DNA, 20 bp, human
gcagtcagatcaggccccca

SEQ ID NO: 341855 - DNA, 20 bp, human
gctaaatcttcttactctcc

SEQ ID NO: 341856 - DNA, 20 bp, human
ggcggccccggggcactgat

SEQ ID NO: 341857 - DNA, 20 bp, human
gtcagccaatcagtgccccg

SEQ ID NO: 341858 - DNA, 20 bp, human
gcaagcgctgtctcctcagg

SEQ ID NO: 341859 - DNA, 20 bp, human
gccctcccccgcgacccggg

SEQ ID NO: 341860 - DNA, 20 bp, human
gaggcccagggagaccgtag

SEQ ID NO: 341861 - DNA, 20 bp, human
gggaaactggggacgcccgg

SEQ ID NO: 341862 - DNA, 20 bp, human
gagacagcgcttgcgtactc

SEQ ID NO: 341863 - DNA, 20 bp, human
gggcgtccctgcagccgtgg

SEQ ID NO: 341864 - DNA, 20 bp, human
ggccccctcccccgcgaccc

SEQ ID NO: 341865 - DNA, 20 bp, human
gcgcttgcgtactcgggcca

SEQ ID NO: 341866 - DNA, 20 bp, human
gaaaaggcgtgagaagtatc

SEQ ID NO: 341867 - DNA, 20 bp, human
gcggttcagaccattgtcaa

SEQ ID NO: 341868 - DNA, 20 bp, human
gttagccttaaactccagag

SEQ ID NO: 341869 - DNA, 20 bp, human
ggggatgcaaaaagcaggac

SEQ ID NO: 341870 - DNA, 20 bp, human
gggagcccctctggagttta

SEQ ID NO: 341871 - DNA, 20 bp, human
gagaccggagaccggggact

SEQ ID NO: 341872 - DNA, 20 bp, human
gaaaggaaaacgagtcccta

SEQ ID NO: 341873 - DNA, 20 bp, human
ggggacgccccacacacccc

SEQ ID NO: 341874 - DNA, 20 bp, human
ggcgcgcggaaacaggctgg

SEQ ID NO: 341875 - DNA, 20 bp, human
gggagcgcgcggaaacaggc

SEQ ID NO: 341876 - DNA, 20 bp, human
gcgggcgcgtgtgcgtgagg

SEQ ID NO: 341877 - DNA, 20 bp, human
gcgcaggctgacacaagcga

SEQ ID NO: 341878 - DNA, 20 bp, human
gagaagaccggggagccaaa

SEQ ID NO: 341879 - DNA, 20 bp, human
gtgggcttctttcacacaat

SEQ ID NO: 341880 - DNA, 20 bp, human
gtgtgtgaaagaagcccagg

SEQ ID NO: 341881 - DNA, 20 bp, human
gggggagacgagtgtatccg

SEQ ID NO: 341882 - DNA, 20 bp, human
gtggggatgggaacggactt

SEQ ID NO: 341883 - DNA, 20 bp, human
gttcccatccccaccagcgc

SEQ ID NO: 341884 - DNA, 20 bp, human
gagcccgggagcggctctgg

SEQ ID NO: 341885 - DNA, 20 bp, human
ggggaggtggagatataagg

SEQ ID NO: 341886 - DNA, 20 bp, human
ggggcctcgtggtgttgaag

SEQ ID NO: 341887 - DNA, 20 bp, human
gggaacaacacgcgggtgag

SEQ ID NO: 341888 - DNA, 20 bp, human
ggcggaacggaacaacacgc

SEQ ID NO: 341889 - DNA, 20 bp, human
ggggacagcgggacttagca

SEQ ID NO: 341890 - DNA, 20 bp, human
gaaggagctgaacttatgtc

SEQ ID NO: 341891 - DNA, 20 bp, human
ggagggcggggcctaagtgg

SEQ ID NO: 341892 - DNA, 20 bp, human
ggaggcttgccgttaatggg

SEQ ID NO: 341893 - DNA, 20 bp, human
gcctgagtggcaagggacag

SEQ ID NO: 341894 - DNA, 20 bp, human
gggaagaaggcggtccggaa

SEQ ID NO: 341895 - DNA, 20 bp, human
gacagcgggacttagcaggg

SEQ ID NO: 341896 - DNA, 20 bp, human
gaccgcccgggagccgtggg

SEQ ID NO: 341897 - DNA, 20 bp, human
gcccccccacggctcccggg

SEQ ID NO: 341898 - DNA, 20 bp, human
gccgcagccgccagatccag

SEQ ID NO: 341899 - DNA, 20 bp, human
gacgaccgcccgggagccgt

SEQ ID NO: 341900 - DNA, 20 bp, human
gagggaggaggaattttttt

SEQ ID NO: 341901 - DNA, 20 bp, human
gttaacaggagactgacaga

SEQ ID NO: 341902 - DNA, 20 bp, human
ggggagccgtggggggggag

SEQ ID NO: 341903 - DNA, 20 bp, human
gaaaggggccacgaccgccc

SEQ ID NO: 341904 - DNA, 20 bp, human
gtgtcagtctcctgttaaag

SEQ ID NO: 341905 - DNA, 20 bp, human
gggccaatgggagagagcgt

SEQ ID NO: 341906 - DNA, 20 bp, human
gatggcgcgcggcctcaaag

SEQ ID NO: 341907 - DNA, 20 bp, human
gcagcccagccccgcctagg

SEQ ID NO: 341908 - DNA, 20 bp, human
gctcccgcccccaagcgcct

SEQ ID NO: 341909 - DNA, 20 bp, human
ggacccgaggcgcttggggg

SEQ ID NO: 341910 - DNA, 20 bp, human
gccgccccctaggcggggct

SEQ ID NO: 341911 - DNA, 20 bp, human
gggcgctctcgtcacgtgcc

SEQ ID NO: 341912 - DNA, 20 bp, human
gtggcacttcgccacctcct

SEQ ID NO: 341913 - DNA, 20 bp, human
gcggctccgccccctaggcg

SEQ ID NO: 341914 - DNA, 20 bp, human
gcggccgcgcgcttgggcgg

SEQ ID NO: 341915 - DNA, 20 bp, human
gttgaggccgcgcgccatct

SEQ ID NO: 341916 - DNA, 20 bp, human
gccccactgctgactctctt

SEQ ID NO: 341917 - DNA, 20 bp, human
ggccggggaacgtcactcag

SEQ ID NO: 341918 - DNA, 20 bp, human
gcgcccgctgattggagccg

SEQ ID NO: 341919 - DNA, 20 bp, human
gtcctctgagtgacgttccc

SEQ ID NO: 341920 - DNA, 20 bp, human
gcgatggggaagaacctggc

SEQ ID NO: 341921 - DNA, 20 bp, human
gcccacttccagccctagtc

SEQ ID NO: 341922 - DNA, 20 bp, human
ggcccttcctgctatctcta

SEQ ID NO: 341923 - DNA, 20 bp, human
gaggagagaagggcggcagt

SEQ ID NO: 341924 - DNA, 20 bp, human
gagagaagggcggcagtggg

SEQ ID NO: 341925 - DNA, 20 bp, human
gaatccgatggggaagaacc

SEQ ID NO: 341926 - DNA, 20 bp, human
ggggacgaggcaggttcgaa

SEQ ID NO: 341927 - DNA, 20 bp, human
gctgaccaggccggtccccc

SEQ ID NO: 341928 - DNA, 20 bp, human
ggaacaggaaccctggtgga

SEQ ID NO: 341929 - DNA, 20 bp, human
gaggccggtcccccgggaac

SEQ ID NO: 341930 - DNA, 20 bp, human
gcaccccgggacctgccaca

SEQ ID NO: 341931 - DNA, 20 bp, human
gccacagggaccaccccctt

SEQ ID NO: 341932 - DNA, 20 bp, human
gtgctgggacccgtccacca

SEQ ID NO: 341933 - DNA, 20 bp, human
gccagccccgcctctctcgg

SEQ ID NO: 341934 - DNA, 20 bp, human
gcggtccgccgagagaggcg

SEQ ID NO: 341935 - DNA, 20 bp, human
gggggccggcgcccacgtga

SEQ ID NO: 341936 - DNA, 20 bp, human
gagatccgggccccgaaggc

SEQ ID NO: 341937 - DNA, 20 bp, human
gcagtcgggaagaagcaccg

SEQ ID NO: 341938 - DNA, 20 bp, human
ggcctctgggcccgccttcg

SEQ ID NO: 341939 - DNA, 20 bp, human
gcgcgccggaagtacctacc

SEQ ID NO: 341940 - DNA, 20 bp, human
gggcatcacgagtcctggga

SEQ ID NO: 341941 - DNA, 20 bp, human
ggcccggatctcaaacagtc

SEQ ID NO: 341942 - DNA, 20 bp, human
gtgggcccgccttcggggcc

SEQ ID NO: 341943 - DNA, 20 bp, human
ggagcagataatagcagcca

SEQ ID NO: 341944 - DNA, 20 bp, human
ggaggcgtttaccttcaggt

SEQ ID NO: 341945 - DNA, 20 bp, human
ggtaaacgcctcctcagctg

SEQ ID NO: 341946 - DNA, 20 bp, human
gggcggcagtacgggacgcg

SEQ ID NO: 341947 - DNA, 20 bp, human
gtggctgcggcatgggactc

SEQ ID NO: 341948 - DNA, 20 bp, human
ggcgaagtcgcagacccgat

SEQ ID NO: 341949 - DNA, 20 bp, human
gacggaagccggcgctgatg

SEQ ID NO: 341950 - DNA, 20 bp, human
gctgatggggacgacacatg

SEQ ID NO: 341951 - DNA, 20 bp, human
ggggccgaacgtggtataaa

SEQ ID NO: 341952 - DNA, 20 bp, human
gagcgccggcttccgtctat

SEQ ID NO: 341953 - DNA, 20 bp, human
ggtgtcgtccccatcagcgc

SEQ ID NO: 341954 - DNA, 20 bp, human
gcctgcgggctccgtcgcgg

SEQ ID NO: 341955 - DNA, 20 bp, human
gctggcctatagacggaagc

SEQ ID NO: 341956 - DNA, 20 bp, human
ggcggccgggagcccaatga

SEQ ID NO: 341957 - DNA, 20 bp, human
ggggcgccgtttcccccctc

SEQ ID NO: 341958 - DNA, 20 bp, human
gcctcgcagagcacgggccc

SEQ ID NO: 341959 - DNA, 20 bp, human
gcgggccgcggagcatgccg

SEQ ID NO: 341960 - DNA, 20 bp, human
gcggctcggcgccggatagt

SEQ ID NO: 341961 - DNA, 20 bp, human
gaccacccacgagcccgcgt

SEQ ID NO: 341962 - DNA, 20 bp, human
gcaatgagggagcaataacg

SEQ ID NO: 341963 - DNA, 20 bp, human
gaggcggcctcgcagagcac

SEQ ID NO: 341964 - DNA, 20 bp, human
ggcgccgccacgcgcgggtg

SEQ ID NO: 341965 - DNA, 20 bp, human
gaccgacgcgggctcgtggg

SEQ ID NO: 341966 - DNA, 20 bp, human
ggggtcgcgagtctgaactt

SEQ ID NO: 341967 - DNA, 20 bp, human
ggggcagtccgggaagggcg

SEQ ID NO: 341968 - DNA, 20 bp, human
ggcgacccgaacttgggatt

SEQ ID NO: 341969 - DNA, 20 bp, human
gggatcgggcagtccgggaa

SEQ ID NO: 341970 - DNA, 20 bp, human
gtgcgcgctcccggttgcgg

SEQ ID NO: 341971 - DNA, 20 bp, human
ggagccgggcgcagcgggct

SEQ ID NO: 341972 - DNA, 20 bp, human
gcgcccacagggcgcagcca

SEQ ID NO: 341973 - DNA, 20 bp, human
gaggcgcggcggtcgagccc

SEQ ID NO: 341974 - DNA, 20 bp, human
gacccgaacttgggattcgg

SEQ ID NO: 341975 - DNA, 20 bp, human
gcgaccgccgcgccttaggc

SEQ ID NO: 341976 - DNA, 20 bp, human
gtcgctgcacggagtcgctc

SEQ ID NO: 341977 - DNA, 20 bp, human
gggtgccggaagtcaggcca

SEQ ID NO: 341978 - DNA, 20 bp, human
gcagcgtcgctgccggtctc

SEQ ID NO: 341979 - DNA, 20 bp, human
gtcagctctgccaccaagtt

SEQ ID NO: 341980 - DNA, 20 bp, human
gagccaggaacaggtggcgg

SEQ ID NO: 341981 - DNA, 20 bp, human
ggggcacgcggttcgctgca

SEQ ID NO: 341982 - DNA, 20 bp, human
ggaccggcagcgacgctgac

SEQ ID NO: 341983 - DNA, 20 bp, human
gcagagctgacgctggcatg

SEQ ID NO: 341984 - DNA, 20 bp, human
gaaacaccgcgcgggggagc

SEQ ID NO: 341985 - DNA, 20 bp, human
ggagacggactctggagttt

SEQ ID NO: 341986 - DNA, 20 bp, human
ggtgcgcagtggtaaaccaa

SEQ ID NO: 341987 - DNA, 20 bp, human
gggacagtggggaagaggac

SEQ ID NO: 341988 - DNA, 20 bp, human
gtcccagtgcgcaccgtgtt

SEQ ID NO: 341989 - DNA, 20 bp, human
gaccccgcccaccctcgcgt

SEQ ID NO: 341990 - DNA, 20 bp, human
gatgcactgggcgccttgtg

SEQ ID NO: 341991 - DNA, 20 bp, human
gtaccactgcgcacctcaca

SEQ ID NO: 341992 - DNA, 20 bp, human
ggccggttggaccaacgcga

SEQ ID NO: 341993 - DNA, 20 bp, human
ggcccagtgcatccgggtag

SEQ ID NO: 341994 - DNA, 20 bp, human
gcgggtagcgggatgccggt

SEQ ID NO: 341995 - DNA, 20 bp, human
gagtggtaaaccaagggacg

SEQ ID NO: 341996 - DNA, 20 bp, human
gaacctgggcaagccaataa

SEQ ID NO: 341997 - DNA, 20 bp, human
gtcacgctccgcggccccac

SEQ ID NO: 341998 - DNA, 20 bp, human
ggcaggggtagtccacggac

SEQ ID NO: 341999 - DNA, 20 bp, human
gctggctgcgctgcccgctg

SEQ ID NO: 342000 - DNA, 20 bp, human
gaggaggcgggacgggggca

SEQ ID NO: 342001 - DNA, 20 bp, human
ggtctgttctccgggtctct

SEQ ID NO: 342002 - DNA, 20 bp, human
gcgcgcgccgcagcctttat

SEQ ID NO: 342003 - DNA, 20 bp, human
gagaacagacacctggcaaa

SEQ ID NO: 342004 - DNA, 20 bp, human
ggcgcgggactcggccttct

SEQ ID NO: 342005 - DNA, 20 bp, human
ggacgtcgcgcgcgcccaga

SEQ ID NO: 342006 - DNA, 20 bp, human
ggacgcaagcaggtgaacgc

SEQ ID NO: 342007 - DNA, 20 bp, human
gccggaagcgcgtcaggagt

SEQ ID NO: 342008 - DNA, 20 bp, human
gaatcctagaagtcctagga

SEQ ID NO: 342009 - DNA, 20 bp, human
gggtgcaggtaagtggtatg

SEQ ID NO: 342010 - DNA, 20 bp, human
gctcccccacaactcagtcc

SEQ ID NO: 342011 - DNA, 20 bp, human
gaggagtgggttgtcagcat

SEQ ID NO: 342012 - DNA, 20 bp, human
gccaacccggtcagccgcgc

SEQ ID NO: 342013 - DNA, 20 bp, human
gtggagagacagcgtcgcac

SEQ ID NO: 342014 - DNA, 20 bp, human
gtgcgtcaccacgccctcct

SEQ ID NO: 342015 - DNA, 20 bp, human
gaaaggaaggcctaccttca

SEQ ID NO: 342016 - DNA, 20 bp, human
gccgacccggaagcagaagt

SEQ ID NO: 342017 - DNA, 20 bp, human
gaagcagaagtcgggagcgt

SEQ ID NO: 342018 - DNA, 20 bp, human
gtgcctggcactggggacgc

SEQ ID NO: 342019 - DNA, 20 bp, human
ggtagacgtggagcgagacc

SEQ ID NO: 342020 - DNA, 20 bp, human
gcgcacggggcgacagcttc

SEQ ID NO: 342021 - DNA, 20 bp, human
gggagcaggcgcggtagacg

SEQ ID NO: 342022 - DNA, 20 bp, human
gggtccgcggatttcgtccg

SEQ ID NO: 342023 - DNA, 20 bp, human
ggaacctaaagcccggtccg

SEQ ID NO: 342024 - DNA, 20 bp, human
ggtctcagcacacaccgcac

SEQ ID NO: 342025 - DNA, 20 bp, human
gttcgtccggggagcaggcg

SEQ ID NO: 342026 - DNA, 20 bp, human
gccactctgggcgatctgat

SEQ ID NO: 342027 - DNA, 20 bp, human
gaagctgggctcaagaacag

SEQ ID NO: 342028 - DNA, 20 bp, human
gcgatctgattggttcgttt

SEQ ID NO: 342029 - DNA, 20 bp, human
gaaaatgcaaacttcattcg

SEQ ID NO: 342030 - DNA, 20 bp, human
gccaaatcctggtatcgaaa

SEQ ID NO: 342031 - DNA, 20 bp, human
gaaccagaaaagctgcgctc

SEQ ID NO: 342032 - DNA, 20 bp, human
ggtgggagacgagaagaagc

SEQ ID NO: 342033 - DNA, 20 bp, human
gcagatcgcccagagtggcg

SEQ ID NO: 342034 - DNA, 20 bp, human
gcggaagtgtgcagcagcga

SEQ ID NO: 342035 - DNA, 20 bp, human
gagaaaagctgcgctctggt

SEQ ID NO: 342036 - DNA, 20 bp, human
gggccccgaaaagacgcctg

SEQ ID NO: 342037 - DNA, 20 bp, human
gtcccgcaggcgtcttttcg

SEQ ID NO: 342038 - DNA, 20 bp, human
gaaaagacgcctgcgggaga

SEQ ID NO: 342039 - DNA, 20 bp, human
gcagacccctcaagaagatg

SEQ ID NO: 342040 - DNA, 20 bp, human
gggagatggcacacctagct

SEQ ID NO: 342041 - DNA, 20 bp, human
gtaggtgtgccatctcccgc

SEQ ID NO: 342042 - DNA, 20 bp, human
gaaggatcgcctgcccagta

SEQ ID NO: 342043 - DNA, 20 bp, human
gccgcggcgcgccccggaaa

SEQ ID NO: 342044 - DNA, 20 bp, human
gcggaagtggtcacggaact

SEQ ID NO: 342045 - DNA, 20 bp, human
gtggtcacggaactcggctg

SEQ ID NO: 342046 - DNA, 20 bp, human
gttccgggactggtgagtag

SEQ ID NO: 342047 - DNA, 20 bp, human
gcggagcgccgacgcgggac

SEQ ID NO: 342048 - DNA, 20 bp, human
gcaaccggcacctaccgcga

SEQ ID NO: 342049 - DNA, 20 bp, human
gtgaccttcgcggtaggtgc

SEQ ID NO: 342050 - DNA, 20 bp, human
ggcccactactcaccagtcc

SEQ ID NO: 342051 - DNA, 20 bp, human
ggtcacttccggtcccgcgt

SEQ ID NO: 342052 - DNA, 20 bp, human
gaaggtcacaactacactcg

SEQ ID NO: 342053 - DNA, 20 bp, human
gccgcccagctctcccgcta

SEQ ID NO: 342054 - DNA, 20 bp, human
gtagttgtgaccttcgcggt

SEQ ID NO: 342055 - DNA, 20 bp, human
gtccccgtagcgggagagct

SEQ ID NO: 342056 - DNA, 20 bp, human
ggggctgcccagctgactta

SEQ ID NO: 342057 - DNA, 20 bp, human
gcgcccgcacgccgaccgga

SEQ ID NO: 342058 - DNA, 20 bp, human
ggcccagctgacttacggat

SEQ ID NO: 342059 - DNA, 20 bp, human
gggaaggaactgctcggaac

SEQ ID NO: 342060 - DNA, 20 bp, human
gcggcgagatgacgcaaaag

SEQ ID NO: 342061 - DNA, 20 bp, human
gccgaccggaaggaactgct

SEQ ID NO: 342062 - DNA, 20 bp, human
gcggaggagtccgcccaaat

SEQ ID NO: 342063 - DNA, 20 bp, human
ggcaaaaggggtcgcgccga

SEQ ID NO: 342064 - DNA, 20 bp, human
gaactgctcggaaccggggg

SEQ ID NO: 342065 - DNA, 20 bp, human
gcggaccaggattttcaaaa

SEQ ID NO: 342066 - DNA, 20 bp, human
gccgcgcgctaggaccctgg

SEQ ID NO: 342067 - DNA, 20 bp, human
gcgaccgccggggacgagct

SEQ ID NO: 342068 - DNA, 20 bp, human
gcctccaagctcgtccccgg

SEQ ID NO: 342069 - DNA, 20 bp, human
gggcgctctccggaccccca

SEQ ID NO: 342070 - DNA, 20 bp, human
gcggctgttcccaatcaggc

SEQ ID NO: 342071 - DNA, 20 bp, human
ggcgccggcggcccagcaac

SEQ ID NO: 342072 - DNA, 20 bp, human
gcgggcgcccaggctcggta

SEQ ID NO: 342073 - DNA, 20 bp, human
gcgctaggaccctgggggtc

SEQ ID NO: 342074 - DNA, 20 bp, human
ggaaccgggagccgcccacc

SEQ ID NO: 342075 - DNA, 20 bp, human
gggtcgagggcggcccgtgg

SEQ ID NO: 342076 - DNA, 20 bp, human
gacccctagtggctctggga

SEQ ID NO: 342077 - DNA, 20 bp, human
gggaggagcgtgacccctag

SEQ ID NO: 342078 - DNA, 20 bp, human
gtccctcccagagccactag

SEQ ID NO: 342079 - DNA, 20 bp, human
gctcctccgcgcagaagcgc

SEQ ID NO: 342080 - DNA, 20 bp, human
gtaacagagtcaggctgcgt

SEQ ID NO: 342081 - DNA, 20 bp, human
ggcgtgacccctagtggctc

SEQ ID NO: 342082 - DNA, 20 bp, human
gcgacacactaagaaatcaa

SEQ ID NO: 342083 - DNA, 20 bp, human
gggccggcgcttctgcgcgg

SEQ ID NO: 342084 - DNA, 20 bp, human
gaagcctcatgctgagaaag

SEQ ID NO: 342085 - DNA, 20 bp, human
gtttcatgagacgacggggt

SEQ ID NO: 342086 - DNA, 20 bp, human
gagaagaggtttaaggggaa

SEQ ID NO: 342087 - DNA, 20 bp, human
gtaatttaattcaaaggcag

SEQ ID NO: 342088 - DNA, 20 bp, human
gattcagtaatttaattcaa

SEQ ID NO: 342089 - DNA, 20 bp, human
ggggtgagcagggaggaaaa

SEQ ID NO: 342090 - DNA, 20 bp, human
gggacatgccggcattgtaa

SEQ ID NO: 342091 - DNA, 20 bp, human
gaacaagaaaggaggcatat

SEQ ID NO: 342092 - DNA, 20 bp, human
gggaaacaaaacaaagctat

SEQ ID NO: 342093 - DNA, 20 bp, human
gcataagagggaactataag

SEQ ID NO: 342094 - DNA, 20 bp, human
ggaagaaggatcaacaagaa

SEQ ID NO: 342095 - DNA, 20 bp, human
gaaaggcaggtcctcgagga

SEQ ID NO: 342096 - DNA, 20 bp, human
gagaagaggtttaaggggaa

SEQ ID NO: 342097 - DNA, 20 bp, human
gattttttgagttaatcttt

SEQ ID NO: 342098 - DNA, 20 bp, human
ggatataatgcttagaatgt

SEQ ID NO: 342099 - DNA, 20 bp, human
gacattaaggccaggcacac

SEQ ID NO: 342100 - DNA, 20 bp, human
gcccaaagcgccgagattat

SEQ ID NO: 342101 - DNA, 20 bp, human
gtaatttaattcaaaggcag

SEQ ID NO: 342102 - DNA, 20 bp, human
gattcagtaatttaattcaa

SEQ ID NO: 342103 - DNA, 20 bp, human
gacaaaaacattcaaaaatt

SEQ ID NO: 342104 - DNA, 20 bp, human
ggcattatatcagaacatta

SEQ ID NO: 342105 - DNA, 20 bp, human
gtaaatttttggtttgagag

SEQ ID NO: 342106 - DNA, 20 bp, human
gtcggcgtgagacccgagga

SEQ ID NO: 342107 - DNA, 20 bp, human
gtggttccaaggttccccaa

SEQ ID NO: 342108 - DNA, 20 bp, human
ggttccgcccggtgaggttt

SEQ ID NO: 342109 - DNA, 20 bp, human
ggccggaagcggaactaccc

SEQ ID NO: 342110 - DNA, 20 bp, human
gactacccgggtcctttaga

SEQ ID NO: 342111 - DNA, 20 bp, human
gtctcacgccgaaacctcac

SEQ ID NO: 342112 - DNA, 20 bp, human
gcctcggtgagtggtcgttc

SEQ ID NO: 342113 - DNA, 20 bp, human
ggcctcttccccgccctcct

SEQ ID NO: 342114 - DNA, 20 bp, human
gggccacataagggaacctc

SEQ ID NO: 342115 - DNA, 20 bp, human
gtatctcgcgctgccggaag

SEQ ID NO: 342116 - DNA, 20 bp, human
gcggtggcccctcctcggga

SEQ ID NO: 342117 - DNA, 20 bp, human
gcgggcggggcttggacgcg

SEQ ID NO: 342118 - DNA, 20 bp, human
gaggggccaccgcgcgggcg

SEQ ID NO: 342119 - DNA, 20 bp, human
gccgcgcggtggcccctcct

SEQ ID NO: 342120 - DNA, 20 bp, human
gcccagccgggggactccgg

SEQ ID NO: 342121 - DNA, 20 bp, human
ggggctgcgagcgctcgccc

SEQ ID NO: 342122 - DNA, 20 bp, human
gggcccgcagagccagtggc

SEQ ID NO: 342123 - DNA, 20 bp, human
ggctccgggtccctactcgc

SEQ ID NO: 342124 - DNA, 20 bp, human
gtgcgggccgctccccgaga

SEQ ID NO: 342125 - DNA, 20 bp, human
gacccccagccgggggactc

SEQ ID NO: 342126 - DNA, 20 bp, human
gcagtcttatgctaccactg

SEQ ID NO: 342127 - DNA, 20 bp, human
gcctggacagtctttagggt

SEQ ID NO: 342128 - DNA, 20 bp, human
gtgggcaggaactgcggtga

SEQ ID NO: 342129 - DNA, 20 bp, human
ggcgcgcagctacagagacc

SEQ ID NO: 342130 - DNA, 20 bp, human
gcgccgcgccgcagctgtag

SEQ ID NO: 342131 - DNA, 20 bp, human
gacagagacccggatgtcgt

SEQ ID NO: 342132 - DNA, 20 bp, human
gcgcgccgcagctgtagcgg

SEQ ID NO: 342133 - DNA, 20 bp, human
ggctccaggccgtaaggcaa

SEQ ID NO: 342134 - DNA, 20 bp, human
gaaggcagtgacgtcatctg

SEQ ID NO: 342135 - DNA, 20 bp, human
ggttcctgcccaacgacatc

SEQ ID NO: 342136 - DNA, 20 bp, human
gcaaaccgggggccgtgaga

SEQ ID NO: 342137 - DNA, 20 bp, human
ggggcggggtaaacgaagta

SEQ ID NO: 342138 - DNA, 20 bp, human
gcggggtaaacgaagtacgg

SEQ ID NO: 342139 - DNA, 20 bp, human
gtggaggcggggcaccctga

SEQ ID NO: 342140 - DNA, 20 bp, human
gcgagggagcagcacgggga

SEQ ID NO: 342141 - DNA, 20 bp, human
gaactcccccgcaactgcta

SEQ ID NO: 342142 - DNA, 20 bp, human
ggggcgcgcggcatcccagt

SEQ ID NO: 342143 - DNA, 20 bp, human
gtcacggcccccggtttgct

SEQ ID NO: 342144 - DNA, 20 bp, human
gcgcgccctctcacggcccc

SEQ ID NO: 342145 - DNA, 20 bp, human
ggtgccgagggagcagcacg

SEQ ID NO: 342146 - DNA, 20 bp, human
gccgtcgcaggcgggagcga

SEQ ID NO: 342147 - DNA, 20 bp, human
gcgaaaacgcccgcggcgta

SEQ ID NO: 342148 - DNA, 20 bp, human
ggagcgaaggcggggacgga

SEQ ID NO: 342149 - DNA, 20 bp, human
gggctcgctccactcgactc

SEQ ID NO: 342150 - DNA, 20 bp, human
ggagagccgagtgacgtcag

SEQ ID NO: 342151 - DNA, 20 bp, human
ggcagcgcggccgtcgcagg

SEQ ID NO: 342152 - DNA, 20 bp, human
gtcgcaggcgggagcgaagg

SEQ ID NO: 342153 - DNA, 20 bp, human
gtctctaagctcgaccaatc

SEQ ID NO: 342154 - DNA, 20 bp, human
gcgaccaatccggagtcgag

SEQ ID NO: 342155 - DNA, 20 bp, human
ggaggcagcgcggccgtcgc

SEQ ID NO: 342156 - DNA, 20 bp, human
gcgcccctctcggatctgga

SEQ ID NO: 342157 - DNA, 20 bp, human
gcgcgcgcagggtccagcgg

SEQ ID NO: 342158 - DNA, 20 bp, human
gggaagcccaggaagggtaa

SEQ ID NO: 342159 - DNA, 20 bp, human
ggcgccgcccctctcggatc

SEQ ID NO: 342160 - DNA, 20 bp, human
gggcccaccctttattccta

SEQ ID NO: 342161 - DNA, 20 bp, human
gtgccatggcgacagtctct

SEQ ID NO: 342162 - DNA, 20 bp, human
ggtccctcccgtcgagtccg

SEQ ID NO: 342163 - DNA, 20 bp, human
ggagctctccgtaggaataa

SEQ ID NO: 342164 - DNA, 20 bp, human
gactccgcggactcgacggg

SEQ ID NO: 342165 - DNA, 20 bp, human
ggcactaggttgcctggaga

SEQ ID NO: 342166 - DNA, 20 bp, human
ggctacgtggacggtgactg

SEQ ID NO: 342167 - DNA, 20 bp, human
ggcgaactgcggctccacct

SEQ ID NO: 342168 - DNA, 20 bp, human
gcccctggcggctacgtgga

SEQ ID NO: 342169 - DNA, 20 bp, human
ggcggccagggacgggaagt

SEQ ID NO: 342170 - DNA, 20 bp, human
gggtgactgcggccctttag

SEQ ID NO: 342171 - DNA, 20 bp, human
gaccgtccacgtagccgcca

SEQ ID NO: 342172 - DNA, 20 bp, human
ggcagttcgcctaccactaa

SEQ ID NO: 342173 - DNA, 20 bp, human
gcaggcaggctcatccgtcc

SEQ ID NO: 342174 - DNA, 20 bp, human
gttctgggcgctgtgaccta

SEQ ID NO: 342175 - DNA, 20 bp, human
ggatggggaaagcaatccct

SEQ ID NO: 342176 - DNA, 20 bp, human
gcgggcggggcgagttgcta

SEQ ID NO: 342177 - DNA, 20 bp, human
gaggaagcggagtaggacgg

SEQ ID NO: 342178 - DNA, 20 bp, human
ggggacaacggcccgcccaa

SEQ ID NO: 342179 - DNA, 20 bp, human
gtaggacggcggccgttggt

SEQ ID NO: 342180 - DNA, 20 bp, human
ggcaactcgccccgcccgca

SEQ ID NO: 342181 - DNA, 20 bp, human
ggggcgggccgttgtccctg

SEQ ID NO: 342182 - DNA, 20 bp, human
gggctggggactgggaacga

SEQ ID NO: 342183 - DNA, 20 bp, human
gcgtggtcgcgctagtctcg

SEQ ID NO: 342184 - DNA, 20 bp, human
gcaggaggcggtaacgggac

SEQ ID NO: 342185 - DNA, 20 bp, human
ggcgaggaagcggagtagga

SEQ ID NO: 342186 - DNA, 20 bp, human
gggacctgaggactcaacta

SEQ ID NO: 342187 - DNA, 20 bp, human
ggccctccccacagcaaatc

SEQ ID NO: 342188 - DNA, 20 bp, human
gcccatgccagactcctcat

SEQ ID NO: 342189 - DNA, 20 bp, human
ggcgaggaaccagggtccca

SEQ ID NO: 342190 - DNA, 20 bp, human
ggggaagttagaggctgcaa

SEQ ID NO: 342191 - DNA, 20 bp, human
ggcaaatctggaggtgggac

SEQ ID NO: 342192 - DNA, 20 bp, human
gaagagctgctgacacgcta

SEQ ID NO: 342193 - DNA, 20 bp, human
ggaaaatggccccacagcca

SEQ ID NO: 342194 - DNA, 20 bp, human
ggggtcccagggcctcaatg

SEQ ID NO: 342195 - DNA, 20 bp, human
ggctgcactgctgcatgaag

SEQ ID NO: 342196 - DNA, 20 bp, human
gtacctggcggaggggatgg

SEQ ID NO: 342197 - DNA, 20 bp, human
gcggctgagtcggtacctgg

SEQ ID NO: 342198 - DNA, 20 bp, human
gtgagtcggtacctggcgga

SEQ ID NO: 342199 - DNA, 20 bp, human
gcgggatcgtgacctcctgg

SEQ ID NO: 342200 - DNA, 20 bp, human
ggcccaagcgagactcgcac

SEQ ID NO: 342201 - DNA, 20 bp, human
gcaccgggatcgtgacctcc

SEQ ID NO: 342202 - DNA, 20 bp, human
gagggggagaccggctgagt

SEQ ID NO: 342203 - DNA, 20 bp, human
gcccggtgcgagtctcgctt

SEQ ID NO: 342204 - DNA, 20 bp, human
gaatcaggctgcaagggctc

SEQ ID NO: 342205 - DNA, 20 bp, human
gggtgaaggcagcattcctc

SEQ ID NO: 342206 - DNA, 20 bp, human
ggggccaagccggaatgggg

SEQ ID NO: 342207 - DNA, 20 bp, human
ggacccgtgggccggttcct

SEQ ID NO: 342208 - DNA, 20 bp, human
gctagcgcacggctgaaata

SEQ ID NO: 342209 - DNA, 20 bp, human
gtggccgggagccagtagca

SEQ ID NO: 342210 - DNA, 20 bp, human
ggcggggccaagccggaatg

SEQ ID NO: 342211 - DNA, 20 bp, human
ggaaccggcccacgggtccc

SEQ ID NO: 342212 - DNA, 20 bp, human
gcgcccccatggctccgcgt

SEQ ID NO: 342213 - DNA, 20 bp, human
ggcgaaacttgcccttgctc

SEQ ID NO: 342214 - DNA, 20 bp, human
gcgtgggccggttcctgggg

SEQ ID NO: 342215 - DNA, 20 bp, human
gcgggagccagtagcaggga

SEQ ID NO: 342216 - DNA, 20 bp, human
gtcccatcggcatctgtgac

SEQ ID NO: 342217 - DNA, 20 bp, human
gtcaaatagcagccgcgggg

SEQ ID NO: 342218 - DNA, 20 bp, human
gcgcaagcgcgccccctctt

SEQ ID NO: 342219 - DNA, 20 bp, human
gcgcgagccaccactggcac

SEQ ID NO: 342220 - DNA, 20 bp, human
gtggctggggagctaacctc

SEQ ID NO: 342221 - DNA, 20 bp, human
gtgtgactggctgcgatcga

SEQ ID NO: 342222 - DNA, 20 bp, human
gtggggagctaacctcggga

SEQ ID NO: 342223 - DNA, 20 bp, human
gcggggaggctcgttcccat

SEQ ID NO: 342224 - DNA, 20 bp, human
gtgggtggggccgcgagact

SEQ ID NO: 342225 - DNA, 20 bp, human
gaagtcaaatagcagccgcg

SEQ ID NO: 342226 - DNA, 20 bp, human
gcggtccaggacagccaagg

SEQ ID NO: 342227 - DNA, 20 bp, human
ggtgtcgagtcccgactcaa

SEQ ID NO: 342228 - DNA, 20 bp, human
gggctgcgagcccgcaccgg

SEQ ID NO: 342229 - DNA, 20 bp, human
gtggggctgcgagcccgcac

SEQ ID NO: 342230 - DNA, 20 bp, human
gcagctgggtgggaacacct

SEQ ID NO: 342231 - DNA, 20 bp, human
gtcgcagccccatgcggtcc

SEQ ID NO: 342232 - DNA, 20 bp, human
gagaagggacgcacttctcc

SEQ ID NO: 342233 - DNA, 20 bp, human
gcccgtcccgccccttgagt

SEQ ID NO: 342234 - DNA, 20 bp, human
ggagtcccgactcaaggggc

SEQ ID NO: 342235 - DNA, 20 bp, human
gatgcggtccaggacagcca

SEQ ID NO: 342236 - DNA, 20 bp, human
gcacgcttgcggggcactgg

SEQ ID NO: 342237 - DNA, 20 bp, human
ggggccgtcggtagggcacg

SEQ ID NO: 342238 - DNA, 20 bp, human
gcggctggttcgctgactcc

SEQ ID NO: 342239 - DNA, 20 bp, human
ggccgccgcgccatgtccgc

SEQ ID NO: 342240 - DNA, 20 bp, human
gcagcgtcccacagtagcca

SEQ ID NO: 342241 - DNA, 20 bp, human
gaagcggcgccggaaccagc

SEQ ID NO: 342242 - DNA, 20 bp, human
gccgcccgggagtgcgtgcg

SEQ ID NO: 342243 - DNA, 20 bp, human
gaggaagcggggccgtcggt

SEQ ID NO: 342244 - DNA, 20 bp, human
gcgcggagcgcggggcgcta

SEQ ID NO: 342245 - DNA, 20 bp, human
ggggtggggacctgacgcaa

SEQ ID NO: 342246 - DNA, 20 bp, human
gcggggcggtaccagaggga

SEQ ID NO: 342247 - DNA, 20 bp, human
gtaaaggggcggaaccaaga

SEQ ID NO: 342248 - DNA, 20 bp, human
gacgggcggggcggtaccag

SEQ ID NO: 342249 - DNA, 20 bp, human
gcggggaaacgccgaggatc

SEQ ID NO: 342250 - DNA, 20 bp, human
gctggtgctcggctcggcgg

SEQ ID NO: 342251 - DNA, 20 bp, human
gggggcggaaccaagagggt

SEQ ID NO: 342252 - DNA, 20 bp, human
ggccgagccgagcaccaggg

SEQ ID NO: 342253 - DNA, 20 bp, human
gggaaacgccgaggatcagg

SEQ ID NO: 342254 - DNA, 20 bp, human
ggctacggagccaggaagga

SEQ ID NO: 342255 - DNA, 20 bp, human
ggcggggcctagatcgcaga

SEQ ID NO: 342256 - DNA, 20 bp, human
gggaacccgacgactttcac

SEQ ID NO: 342257 - DNA, 20 bp, human
gtgctgttgcgcacttccgg

SEQ ID NO: 342258 - DNA, 20 bp, human
gcgcaacagcactcatacaa

SEQ ID NO: 342259 - DNA, 20 bp, human
gggaaggaggagcgctcttc

SEQ ID NO: 342260 - DNA, 20 bp, human
gtgggcggtaggcggtgcta

SEQ ID NO: 342261 - DNA, 20 bp, human
gtaggggagcgagtcgtgac

SEQ ID NO: 342262 - DNA, 20 bp, human
gccttccggtgaaagtcgtc

SEQ ID NO: 342263 - DNA, 20 bp, human
gtgagaactccgcagactcc

SEQ ID NO: 342264 - DNA, 20 bp, human
gtccagctgcgcaagcgcat

SEQ ID NO: 342265 - DNA, 20 bp, human
gcctctccggggttggctgg

SEQ ID NO: 342266 - DNA, 20 bp, human
ggccgcgagaacagagtgga

SEQ ID NO: 342267 - DNA, 20 bp, human
gcgacggcagctgtaagagc

SEQ ID NO: 342268 - DNA, 20 bp, human
ggccgcctcggtcctgagga

SEQ ID NO: 342269 - DNA, 20 bp, human
gcgccgcccgagccctgcga

SEQ ID NO: 342270 - DNA, 20 bp, human
gagcgtaggagagaccgaaa

SEQ ID NO: 342271 - DNA, 20 bp, human
gtggattggcgggacttgga

SEQ ID NO: 342272 - DNA, 20 bp, human
gggccctcgcagggctcggg

SEQ ID NO: 342273 - DNA, 20 bp, human
gtcccagctcggcgctaaca

SEQ ID NO: 342274 - DNA, 20 bp, human
gactgccctcctcaggaccg

SEQ ID NO: 342275 - DNA, 20 bp, human
gggagagaccgaaaaggctg

SEQ ID NO: 342276 - DNA, 20 bp, human
gtgggggcggggtctgtcgg

SEQ ID NO: 342277 - DNA, 20 bp, human
gagcgcccccgctggacgtg

SEQ ID NO: 342278 - DNA, 20 bp, human
ggccccacatcctctgaaca

SEQ ID NO: 342279 - DNA, 20 bp, human
gcgcgcctcacgtccagcgg

SEQ ID NO: 342280 - DNA, 20 bp, human
gcagcgggggcgctagaggg

SEQ ID NO: 342281 - DNA, 20 bp, human
ggtccagcgggggcgctaga

SEQ ID NO: 342282 - DNA, 20 bp, human
gcgccgcgcctcacgtccag

SEQ ID NO: 342283 - DNA, 20 bp, human
gaggggtgggaaagtctgtt

SEQ ID NO: 342284 - DNA, 20 bp, human
gctctggggcgtaaccagct

SEQ ID NO: 342285 - DNA, 20 bp, human
gtgtggggccggaaggactg

SEQ ID NO: 342286 - DNA, 20 bp, human
gggactccgcccttactcct

SEQ ID NO: 342287 - DNA, 20 bp, human
gcaagtaagcccaggagtaa

SEQ ID NO: 342288 - DNA, 20 bp, human
gccaagcaccgcctctagcg

SEQ ID NO: 342289 - DNA, 20 bp, human
gtggagcaaaggggcgtcct

SEQ ID NO: 342290 - DNA, 20 bp, human
gggaccagccgcgctagagg

SEQ ID NO: 342291 - DNA, 20 bp, human
ggtaagcccaggagtaaggg

SEQ ID NO: 342292 - DNA, 20 bp, human
gccgccgcccggtgagggtg

SEQ ID NO: 342293 - DNA, 20 bp, human
gcaaaggggcgtccttgggg

SEQ ID NO: 342294 - DNA, 20 bp, human
gtcccctcaccctcaccggg

SEQ ID NO: 342295 - DNA, 20 bp, human
ggccaggtacaagtaagccc

SEQ ID NO: 342296 - DNA, 20 bp, human
ggcggcgcgcaagggacgtg

SEQ ID NO: 342297 - DNA, 20 bp, human
gctgacgcggccctgttcga

SEQ ID NO: 342298 - DNA, 20 bp, human
gcaaagccggggaacctccc

SEQ ID NO: 342299 - DNA, 20 bp, human
gggagagctgcgtgacgcgg

SEQ ID NO: 342300 - DNA, 20 bp, human
ggagctgggcggtgccgagg

SEQ ID NO: 342301 - DNA, 20 bp, human
ggcgccgagtctcgccacgg

SEQ ID NO: 342302 - DNA, 20 bp, human
gcggcggcccaggcgtcgag

SEQ ID NO: 342303 - DNA, 20 bp, human
gcaggcgtcgaggggagcct

SEQ ID NO: 342304 - DNA, 20 bp, human
gagtgagtggcgctgcgggt

SEQ ID NO: 342305 - DNA, 20 bp, human
gccagcgcgctctgcgtaac

SEQ ID NO: 342306 - DNA, 20 bp, human
gcgcaaccgcgtccccgcat

SEQ ID NO: 342307 - DNA, 20 bp, human
gttggcggaaggatcccatg

SEQ ID NO: 342308 - DNA, 20 bp, human
gccccctcccgcgcccccta

SEQ ID NO: 342309 - DNA, 20 bp, human
gaggatcccatgcggggacg

SEQ ID NO: 342310 - DNA, 20 bp, human
gcgccgcccgaggctgtcta

SEQ ID NO: 342311 - DNA, 20 bp, human
gtgggatccttccgccaaac

SEQ ID NO: 342312 - DNA, 20 bp, human
gccgaggctgtctaaggagt

SEQ ID NO: 342313 - DNA, 20 bp, human
gccaaacgggccgagtaaat

SEQ ID NO: 342314 - DNA, 20 bp, human
gcggcgatggccgcaaccgg

SEQ ID NO: 342315 - DNA, 20 bp, human
gatgcgcgcggggagtgcag

SEQ ID NO: 342316 - DNA, 20 bp, human
gagggaaaggggcggagcaa

SEQ ID NO: 342317 - DNA, 20 bp, human
gtggtcacgcgcacgcgaca

SEQ ID NO: 342318 - DNA, 20 bp, human
ggggtgagaaatgttctcca

SEQ ID NO: 342319 - DNA, 20 bp, human
gacgcgaggcgtgaactcat

SEQ ID NO: 342320 - DNA, 20 bp, human
gtcacgcgcacgcgacaggg

SEQ ID NO: 342321 - DNA, 20 bp, human
gtgacaactcgccaactgat

SEQ ID NO: 342322 - DNA, 20 bp, human
gagttggcgagttgtcattt

SEQ ID NO: 342323 - DNA, 20 bp, human
ggcggaagtggcggaagcag

SEQ ID NO: 342324 - DNA, 20 bp, human
ggcgcacgcgacagggaggc

SEQ ID NO: 342325 - DNA, 20 bp, human
ggacaagcccgcagtgcgga

SEQ ID NO: 342326 - DNA, 20 bp, human
gcctgcgcgctgtcacgtta

SEQ ID NO: 342327 - DNA, 20 bp, human
ggggccagacgctgcagagt

SEQ ID NO: 342328 - DNA, 20 bp, human
gttagccaggttatccccag

SEQ ID NO: 342329 - DNA, 20 bp, human
gggggtgtcactgcgggtgt

SEQ ID NO: 342330 - DNA, 20 bp, human
ggtcaaagcgcaggcgtcgc

SEQ ID NO: 342331 - DNA, 20 bp, human
gggcccggcaatacccatct

SEQ ID NO: 342332 - DNA, 20 bp, human
gagaaacaaatttggcggaa

SEQ ID NO: 342333 - DNA, 20 bp, human
gggtgccgtggaagggaaaa

SEQ ID NO: 342334 - DNA, 20 bp, human
gtccacccctggggataacc

SEQ ID NO: 342335 - DNA, 20 bp, human
ggcgcccagatgggtattgc

SEQ ID NO: 342336 - DNA, 20 bp, human
gcgcatgcgcactggtcgaa

SEQ ID NO: 342337 - DNA, 20 bp, human
gagggcttctgtggtaggaa

SEQ ID NO: 342338 - DNA, 20 bp, human
gcacggccacccgtcaccgg

SEQ ID NO: 342339 - DNA, 20 bp, human
gcagcacggccacccgtcac

SEQ ID NO: 342340 - DNA, 20 bp, human
gcgcgggagcgctcttcctg

SEQ ID NO: 342341 - DNA, 20 bp, human
gcgaagggcgcctcccagtc

SEQ ID NO: 342342 - DNA, 20 bp, human
gtcgcgagatccggactggg

SEQ ID NO: 342343 - DNA, 20 bp, human
gaacttcgcgagatccggac

SEQ ID NO: 342344 - DNA, 20 bp, human
gagagcgctcccgcgaactg

SEQ ID NO: 342345 - DNA, 20 bp, human
gcaccaccgccgcagttcgc

SEQ ID NO: 342346 - DNA, 20 bp, human
gcctggatgcatcagaaaaa

SEQ ID NO: 342347 - DNA, 20 bp, human
ggaaaaaaggcgaggaccgg

SEQ ID NO: 342348 - DNA, 20 bp, human
gccaaaatgcccagaggaag

SEQ ID NO: 342349 - DNA, 20 bp, human
gagggcaaaggtgaccccac

SEQ ID NO: 342350 - DNA, 20 bp, human
gtcagaaaaaaggcgaggac

SEQ ID NO: 342351 - DNA, 20 bp, human
gtgcgggcggtactactggc

SEQ ID NO: 342352 - DNA, 20 bp, human
ggggatttgtagttccctta

SEQ ID NO: 342353 - DNA, 20 bp, human
gaagaggctgacgccagtcc

SEQ ID NO: 342354 - DNA, 20 bp, human
ggtgaccccactgggtcccg

SEQ ID NO: 342355 - DNA, 20 bp, human
gttcgccacgggacccagtg

SEQ ID NO: 342356 - DNA, 20 bp, human
gatgccgtggggcacccctc

SEQ ID NO: 342357 - DNA, 20 bp, human
gcagatgagggcctcctccg

SEQ ID NO: 342358 - DNA, 20 bp, human
ggacttcccagtgtgcatcg

SEQ ID NO: 342359 - DNA, 20 bp, human
ggctgtgccccgatgcacac

SEQ ID NO: 342360 - DNA, 20 bp, human
gggtgtgctgggcaggtcgc

SEQ ID NO: 342361 - DNA, 20 bp, human
gcggggaccgggagatcctt

SEQ ID NO: 342362 - DNA, 20 bp, human
gggcctcctccggggaatgc

SEQ ID NO: 342363 - DNA, 20 bp, human
gagtggaaatcgccagatga

SEQ ID NO: 342364 - DNA, 20 bp, human
gcgactcctggaagtggcca

SEQ ID NO: 342365 - DNA, 20 bp, human
gaggccggaggggtgcccca

SEQ ID NO: 342366 - DNA, 20 bp, human
gtggccgccgctgagagcga

SEQ ID NO: 342367 - DNA, 20 bp, human
gctaccctcgctctcagcgg

SEQ ID NO: 342368 - DNA, 20 bp, human
gctcccaccgggccaatcag

SEQ ID NO: 342369 - DNA, 20 bp, human
gtgagagcgagggtagcggg

SEQ ID NO: 342370 - DNA, 20 bp, human
gctagtcggggctcacgcaa

SEQ ID NO: 342371 - DNA, 20 bp, human
gggggctcacgcaagggcgg

SEQ ID NO: 342372 - DNA, 20 bp, human
gattggcccggtgggagcgg

SEQ ID NO: 342373 - DNA, 20 bp, human
gtcccgtagccccctctgat

SEQ ID NO: 342374 - DNA, 20 bp, human
gactgaggcccgacagggaa

SEQ ID NO: 342375 - DNA, 20 bp, human
gagggaagaccgcggacggt

SEQ ID NO: 342376 - DNA, 20 bp, human
gactctgggtgaatccaaat

SEQ ID NO: 342377 - DNA, 20 bp, human
gaccctgggggatactgatc

SEQ ID NO: 342378 - DNA, 20 bp, human
gatagtgcgcctgaaggggt

SEQ ID NO: 342379 - DNA, 20 bp, human
gtgggacttgtagtcccgga

SEQ ID NO: 342380 - DNA, 20 bp, human
gtccctggcctggtcgctct

SEQ ID NO: 342381 - DNA, 20 bp, human
gagcccaagacgatcccatt

SEQ ID NO: 342382 - DNA, 20 bp, human
ggggatactgatcaggaaag

SEQ ID NO: 342383 - DNA, 20 bp, human
gcacagcgaggcaggcgtct

SEQ ID NO: 342384 - DNA, 20 bp, human
gaggtcgcctcgagcacctt

SEQ ID NO: 342385 - DNA, 20 bp, human
gagggaggcgggtcccggtg

SEQ ID NO: 342386 - DNA, 20 bp, human
gcgggagcgcccaactggtg

SEQ ID NO: 342387 - DNA, 20 bp, human
ggcgacccatcgggacccga

SEQ ID NO: 342388 - DNA, 20 bp, human
gaggcccgtcgggtcccgat

SEQ ID NO: 342389 - DNA, 20 bp, human
gccccatcgtctgtccaata

SEQ ID NO: 342390 - DNA, 20 bp, human
gccaactggtgcgggagcgc

SEQ ID NO: 342391 - DNA, 20 bp, human
gtcaggcaaccctgtagccc

SEQ ID NO: 342392 - DNA, 20 bp, human
ggctggagtcagaggcccgt

SEQ ID NO: 342393 - DNA, 20 bp, human
gaaggggtagggcatcatcc

SEQ ID NO: 342394 - DNA, 20 bp, human
gatcctgggacccacacctc

SEQ ID NO: 342395 - DNA, 20 bp, human
gacgatgggggcgacccatc

SEQ ID NO: 342396 - DNA, 20 bp, human
gccctctggcggtggcgggg

SEQ ID NO: 342397 - DNA, 20 bp, human
gcccgggcgggtccctgcat

SEQ ID NO: 342398 - DNA, 20 bp, human
ggggcgggtccctgcatcgg

SEQ ID NO: 342399 - DNA, 20 bp, human
gtcgtgcgaagttgaggtat

SEQ ID NO: 342400 - DNA, 20 bp, human
ggggacccgcccgggactct

SEQ ID NO: 342401 - DNA, 20 bp, human
gtcccgggccgggatcctgt

SEQ ID NO: 342402 - DNA, 20 bp, human
gcgaccttctacagcgacag

SEQ ID NO: 342403 - DNA, 20 bp, human
ggggacagacactcgggacc

SEQ ID NO: 342404 - DNA, 20 bp, human
gcgagagtaggccgctgcgt

SEQ ID NO: 342405 - DNA, 20 bp, human
gaccgccagagggcgcagac

SEQ ID NO: 342406 - DNA, 20 bp, human
ggggagggtctattcggcag

SEQ ID NO: 342407 - DNA, 20 bp, human
gccgcccccgggcaggggta

SEQ ID NO: 342408 - DNA, 20 bp, human
ggggtaggggagggtctatt

SEQ ID NO: 342409 - DNA, 20 bp, human
gctactccgcccccgggcag

SEQ ID NO: 342410 - DNA, 20 bp, human
gctcccctacccctgcccgg

SEQ ID NO: 342411 - DNA, 20 bp, human
gggactggaaggttgcgttt

SEQ ID NO: 342412 - DNA, 20 bp, human
gaaagggccagcccctctac

SEQ ID NO: 342413 - DNA, 20 bp, human
gaggggagaggggcctgtag

SEQ ID NO: 342414 - DNA, 20 bp, human
gctgctactcggagagtcta

SEQ ID NO: 342415 - DNA, 20 bp, human
gaagggtccaatgaagacta

SEQ ID NO: 342416 - DNA, 20 bp, human
ggcgccagatcccgcctctg

SEQ ID NO: 342417 - DNA, 20 bp, human
gaagccgccgaggaccctct

SEQ ID NO: 342418 - DNA, 20 bp, human
gggaccgagagggtcctcgg

SEQ ID NO: 342419 - DNA, 20 bp, human
gcagagagggcccggggcgt

SEQ ID NO: 342420 - DNA, 20 bp, human
gccttccggagtctacacat

SEQ ID NO: 342421 - DNA, 20 bp, human
ggcgtggggcggggtgccag

SEQ ID NO: 342422 - DNA, 20 bp, human
gccggggccgcgccaggtgg

SEQ ID NO: 342423 - DNA, 20 bp, human
gtctgggggctggaccgaga

SEQ ID NO: 342424 - DNA, 20 bp, human
gagcccccagaggcgggatc

SEQ ID NO: 342425 - DNA, 20 bp, human
gtcggtccagcccccagagg

SEQ ID NO: 342426 - DNA, 20 bp, human
gtccctttctgcagcttcta

SEQ ID NO: 342427 - DNA, 20 bp, human
gtgggatacagagggatctc

SEQ ID NO: 342428 - DNA, 20 bp, human
gctatggccagctctggaat

SEQ ID NO: 342429 - DNA, 20 bp, human
gtggctggcagtgaggagcc

SEQ ID NO: 342430 - DNA, 20 bp, human
ggcaaagatcaataggactt

SEQ ID NO: 342431 - DNA, 20 bp, human
gggctccaatcgctgctcta

SEQ ID NO: 342432 - DNA, 20 bp, human
gtggggtcctgaagggtaca

SEQ ID NO: 342433 - DNA, 20 bp, human
gctggccatagagcagcgat

SEQ ID NO: 342434 - DNA, 20 bp, human
gcagatgagcaaaggtcaag

SEQ ID NO: 342435 - DNA, 20 bp, human
ggaccagtgcccccagtgtc

SEQ ID NO: 342436 - DNA, 20 bp, human
gagaccgcaacccgaagggt

SEQ ID NO: 342437 - DNA, 20 bp, human
ggtgctgacgtcacgaagag

SEQ ID NO: 342438 - DNA, 20 bp, human
ggacagttcgtttgttggag

SEQ ID NO: 342439 - DNA, 20 bp, human
gggatctaaggcagaactag

SEQ ID NO: 342440 - DNA, 20 bp, human
gtccagcttttgcaacgtca

SEQ ID NO: 342441 - DNA, 20 bp, human
gtaagatcaacaactgggat

SEQ ID NO: 342442 - DNA, 20 bp, human
gggcgtggccgagatcagaa

SEQ ID NO: 342443 - DNA, 20 bp, human
gtgactatgagtcatagcaa

SEQ ID NO: 342444 - DNA, 20 bp, human
gccggatgccatcctctaaa

SEQ ID NO: 342445 - DNA, 20 bp, human
ggagtaactcagagtatctc

SEQ ID NO: 342446 - DNA, 20 bp, human
ggcaacctcacgctgccgtg

SEQ ID NO: 342447 - DNA, 20 bp, human
ggaaatctggcaaaaccaat

SEQ ID NO: 342448 - DNA, 20 bp, human
gcacacggaagtgggcggaa

SEQ ID NO: 342449 - DNA, 20 bp, human
gtgcggctctacctcgagta

SEQ ID NO: 342450 - DNA, 20 bp, human
gtcggcggccacacggaagt

SEQ ID NO: 342451 - DNA, 20 bp, human
gaggacacccccctagacgc

SEQ ID NO: 342452 - DNA, 20 bp, human
gtcgagtaaggaagccgaca

SEQ ID NO: 342453 - DNA, 20 bp, human
gaggttgcatcagccggggc

SEQ ID NO: 342454 - DNA, 20 bp, human
ggcggccacacggaagtggg

SEQ ID NO: 342455 - DNA, 20 bp, human
gtagacgccggaagagacgc

SEQ ID NO: 342456 - DNA, 20 bp, human
gcggccgggcgagtcctccg

SEQ ID NO: 342457 - DNA, 20 bp, human
gcctggggagggacggtcgg

SEQ ID NO: 342458 - DNA, 20 bp, human
ggggcctggggagggacggt

SEQ ID NO: 342459 - DNA, 20 bp, human
gcgcccgcagctgtccgcgt

SEQ ID NO: 342460 - DNA, 20 bp, human
gggaagccgcggtgccccgt

SEQ ID NO: 342461 - DNA, 20 bp, human
gacctccttggggcgtgggt

SEQ ID NO: 342462 - DNA, 20 bp, human
gtcatcgcgggcaacgggac

SEQ ID NO: 342463 - DNA, 20 bp, human
ggctccgcccccggctccca

SEQ ID NO: 342464 - DNA, 20 bp, human
ggggccaacgcggacagctg

SEQ ID NO: 342465 - DNA, 20 bp, human
gcgcggggcccactgacccg

SEQ ID NO: 342466 - DNA, 20 bp, human
gacagggtcccggcgctctc

SEQ ID NO: 342467 - DNA, 20 bp, human
ggggcgcgctcaaccccatc

SEQ ID NO: 342468 - DNA, 20 bp, human
gggtcccggcgctctcgggt

SEQ ID NO: 342469 - DNA, 20 bp, human
gcaaccccatccggcttggg

SEQ ID NO: 342470 - DNA, 20 bp, human
ggctgcctcccaagccggat

SEQ ID NO: 342471 - DNA, 20 bp, human
gggtccccacccgagagcgc

SEQ ID NO: 342472 - DNA, 20 bp, human
ggcagcgcgggacagggtcc

SEQ ID NO: 342473 - DNA, 20 bp, human
ggagctcaggccccgccttg

SEQ ID NO: 342474 - DNA, 20 bp, human
ggctcaaccccatccggctt

SEQ ID NO: 342475 - DNA, 20 bp, human
gttgggaggcagcgcgggac

SEQ ID NO: 342476 - DNA, 20 bp, human
ggagtcgtgctttgagtttc

SEQ ID NO: 342477 - DNA, 20 bp, human
gcagctggtccctagataag

SEQ ID NO: 342478 - DNA, 20 bp, human
ggggaattcaatgatgtagc

SEQ ID NO: 342479 - DNA, 20 bp, human
gctccagctcctcttatcta

SEQ ID NO: 342480 - DNA, 20 bp, human
gtctccatcgctgctctcca

SEQ ID NO: 342481 - DNA, 20 bp, human
gttgccgtggagagcagcga

SEQ ID NO: 342482 - DNA, 20 bp, human
ggtccctagataagaggagc

SEQ ID NO: 342483 - DNA, 20 bp, human
gtgagagtcgaaattagctg

SEQ ID NO: 342484 - DNA, 20 bp, human
gtaatgtacaatgattgccg

SEQ ID NO: 342485 - DNA, 20 bp, human
gtactgctaacatttatgta

SEQ ID NO: 342486 - DNA, 20 bp, human
gcccgggttccgaaagtctc

SEQ ID NO: 342487 - DNA, 20 bp, human
ggggcggagtgcggggcaga

SEQ ID NO: 342488 - DNA, 20 bp, human
gagtctgtgcggctacagcg

SEQ ID NO: 342489 - DNA, 20 bp, human
gggcctgtgagttgactgag

SEQ ID NO: 342490 - DNA, 20 bp, human
gttcccccgacccgcctcgg

SEQ ID NO: 342491 - DNA, 20 bp, human
gcgcgtggggcagtcggtgg

SEQ ID NO: 342492 - DNA, 20 bp, human
ggagacggccggctctgtca

SEQ ID NO: 342493 - DNA, 20 bp, human
ggggagatccggagactgga

SEQ ID NO: 342494 - DNA, 20 bp, human
ggctggcagccctgacgccc

SEQ ID NO: 342495 - DNA, 20 bp, human
gtggcactctggggtcgcgt

SEQ ID NO: 342496 - DNA, 20 bp, human
gagtcccagcgtcctctggt

SEQ ID NO: 342497 - DNA, 20 bp, human
gcctgtggaagatggcgaga

SEQ ID NO: 342498 - DNA, 20 bp, human
gcccaaggcaacagttccgc

SEQ ID NO: 342499 - DNA, 20 bp, human
gctggaatctcccggtgtgg

SEQ ID NO: 342500 - DNA, 20 bp, human
gtggaccctgaactccggga

SEQ ID NO: 342501 - DNA, 20 bp, human
gagaagcttctggaatctcc

SEQ ID NO: 342502 - DNA, 20 bp, human
gcctcccaccagaggacgct

SEQ ID NO: 342503 - DNA, 20 bp, human
gctccgggaaggctcgagaa

SEQ ID NO: 342504 - DNA, 20 bp, human
gctgtccgagaccctgacaa

SEQ ID NO: 342505 - DNA, 20 bp, human
gcgagccttcccggagttca

SEQ ID NO: 342506 - DNA, 20 bp, human
ggggccacgcccggactcgg

SEQ ID NO: 342507 - DNA, 20 bp, human
gcctgagctgtccactacga

SEQ ID NO: 342508 - DNA, 20 bp, human
gccccgcgggccgccgagtc

SEQ ID NO: 342509 - DNA, 20 bp, human
gggcccgggagccgtcgtag

SEQ ID NO: 342510 - DNA, 20 bp, human
gcggaaccttaaccccgtcg

SEQ ID NO: 342511 - DNA, 20 bp, human
gcccgtcgtggctgcaccgg

SEQ ID NO: 342512 - DNA, 20 bp, human
gcaaaactccgaggacactg

SEQ ID NO: 342513 - DNA, 20 bp, human
gcgccctgcccaaaactccg

SEQ ID NO: 342514 - DNA, 20 bp, human
ggtccactacgacggctccc

SEQ ID NO: 342515 - DNA, 20 bp, human
gtagccggagcaggttgttg

SEQ ID NO: 342516 - DNA, 20 bp, human
gtgctcggagggagggttta

SEQ ID NO: 342517 - DNA, 20 bp, human
gagggtgggagttagagcca

SEQ ID NO: 342518 - DNA, 20 bp, human
gggagaatcgtgttctcctg

SEQ ID NO: 342519 - DNA, 20 bp, human
gagttctggggagaccgcag

SEQ ID NO: 342520 - DNA, 20 bp, human
gcagtcccaggcggagggga

SEQ ID NO: 342521 - DNA, 20 bp, human
ggcgccagtcccaggcggag

SEQ ID NO: 342522 - DNA, 20 bp, human
gggaaactggccaatgagca

SEQ ID NO: 342523 - DNA, 20 bp, human
gcccgggcgccagtcccagg

SEQ ID NO: 342524 - DNA, 20 bp, human
gtggcgcccgggtgctcgga

SEQ ID NO: 342525 - DNA, 20 bp, human
gagaggcctgcgaggtcgtg

SEQ ID NO: 342526 - DNA, 20 bp, human
gcagggcagtgggtccttca

SEQ ID NO: 342527 - DNA, 20 bp, human
gcatccctgcaatactcaga

SEQ ID NO: 342528 - DNA, 20 bp, human
gtgggggcagggtttaggta

SEQ ID NO: 342529 - DNA, 20 bp, human
gtgagggcagcattactgca

SEQ ID NO: 342530 - DNA, 20 bp, human
gggcatgtgtattagtgaag

SEQ ID NO: 342531 - DNA, 20 bp, human
gttgtgctgagaggatccaa

SEQ ID NO: 342532 - DNA, 20 bp, human
gtattacgaagcactctgtg

SEQ ID NO: 342533 - DNA, 20 bp, human
gtccactgtacattactaac

SEQ ID NO: 342534 - DNA, 20 bp, human
gaccgtggatgttgaagaag

SEQ ID NO: 342535 - DNA, 20 bp, human
gggcaagccaggcatcaccg

SEQ ID NO: 342536 - DNA, 20 bp, human
gtcacaaggtggtgggacga

SEQ ID NO: 342537 - DNA, 20 bp, human
gcgccctctcgcgatatcta

SEQ ID NO: 342538 - DNA, 20 bp, human
ggtccgggaagcagcaagcc

SEQ ID NO: 342539 - DNA, 20 bp, human
gtacggcctcacaaggtggt

SEQ ID NO: 342540 - DNA, 20 bp, human
ggggtgctcgagagacgcgc

SEQ ID NO: 342541 - DNA, 20 bp, human
gagctgtctctgagaacctg

SEQ ID NO: 342542 - DNA, 20 bp, human
gcctctcgcgatatctaggg

SEQ ID NO: 342543 - DNA, 20 bp, human
gctcgagagacgcgcgggtc

SEQ ID NO: 342544 - DNA, 20 bp, human
gacactacggcctcacaagg

SEQ ID NO: 342545 - DNA, 20 bp, human
ggtgacgtcactccgcagag

SEQ ID NO: 342546 - DNA, 20 bp, human
gtggcgccccctggtcccag

SEQ ID NO: 342547 - DNA, 20 bp, human
gtattcgggcgcgaagggtg

SEQ ID NO: 342548 - DNA, 20 bp, human
gtagcctcgctagcgtgcct

SEQ ID NO: 342549 - DNA, 20 bp, human
ggctacgcacgcacgtattc

SEQ ID NO: 342550 - DNA, 20 bp, human
gggggcggagcgaccacaga

SEQ ID NO: 342551 - DNA, 20 bp, human
gcagcccaggcacgctagcg

SEQ ID NO: 342552 - DNA, 20 bp, human
gagagcctatagaatgggcg

SEQ ID NO: 342553 - DNA, 20 bp, human
gcaccccgggaacccggaag

SEQ ID NO: 342554 - DNA, 20 bp, human
gtcaaaatacaggacactga

SEQ ID NO: 342555 - DNA, 20 bp, human
gggtcccccgcccattctat

SEQ ID NO: 342556 - DNA, 20 bp, human
ggggccgcgtccgaaccggg

SEQ ID NO: 342557 - DNA, 20 bp, human
gtcggacgcggccccctccg

SEQ ID NO: 342558 - DNA, 20 bp, human
ggccccgcccggttcggacg

SEQ ID NO: 342559 - DNA, 20 bp, human
gcgcgggcgcggcggcaggt

SEQ ID NO: 342560 - DNA, 20 bp, human
gccaccgtccggtaggtcgc

SEQ ID NO: 342561 - DNA, 20 bp, human
ggtgcggggcgaaggcgctt

SEQ ID NO: 342562 - DNA, 20 bp, human
ggggcgaaggcgcttgggcc

SEQ ID NO: 342563 - DNA, 20 bp, human
gagggggccgcgtccgaacc

SEQ ID NO: 342564 - DNA, 20 bp, human
gacctaccggacggtggcgg

SEQ ID NO: 342565 - DNA, 20 bp, human
ggtaccgcggccacctccgg

SEQ ID NO: 342566 - DNA, 20 bp, human
ggccgggcacggtgacagat

SEQ ID NO: 342567 - DNA, 20 bp, human
gctgtggggcagggagcgac

SEQ ID NO: 342568 - DNA, 20 bp, human
gaggaatgatctgacccctt

SEQ ID NO: 342569 - DNA, 20 bp, human
ggctaggaacgcgagatcaa

SEQ ID NO: 342570 - DNA, 20 bp, human
gtcatcctccccggcgcgag

SEQ ID NO: 342571 - DNA, 20 bp, human
gcctcggtaaggcaccttct

SEQ ID NO: 342572 - DNA, 20 bp, human
ggagtcactaaacatgatct

SEQ ID NO: 342573 - DNA, 20 bp, human
gcctcctcctgccctcggta

SEQ ID NO: 342574 - DNA, 20 bp, human
gccttctaggtccagctgtg

SEQ ID NO: 342575 - DNA, 20 bp, human
gtaaacatgatctggggtgc

SEQ ID NO: 342576 - DNA, 20 bp, human
ggcccactgaggggctgacc

SEQ ID NO: 342577 - DNA, 20 bp, human
gccgagaagtgggtacttta

SEQ ID NO: 342578 - DNA, 20 bp, human
gagtgggccctggccctaga

SEQ ID NO: 342579 - DNA, 20 bp, human
gctgagaccttctagggcca

SEQ ID NO: 342580 - DNA, 20 bp, human
ggcctagcaacagcgtcccc

SEQ ID NO: 342581 - DNA, 20 bp, human
ggtggaggaggccggaggtt

SEQ ID NO: 342582 - DNA, 20 bp, human
gaggcttctgagaccttcta

SEQ ID NO: 342583 - DNA, 20 bp, human
ggctcagaggatggagatag

SEQ ID NO: 342584 - DNA, 20 bp, human
gtaaagtatctgccgagaag

SEQ ID NO: 342585 - DNA, 20 bp, human
ggtcagaagctgcccgagca

SEQ ID NO: 342586 - DNA, 20 bp, human
gaaacctggggacggagcga

SEQ ID NO: 342587 - DNA, 20 bp, human
gggtgccaaggctgtgagtg

SEQ ID NO: 342588 - DNA, 20 bp, human
gacgcctgggagcgacaaca

SEQ ID NO: 342589 - DNA, 20 bp, human
ggcttccaacacttcggctt

SEQ ID NO: 342590 - DNA, 20 bp, human
ggagcgacaacagggtgggt

SEQ ID NO: 342591 - DNA, 20 bp, human
gccgtccccaggtttccggc

SEQ ID NO: 342592 - DNA, 20 bp, human
gctcaaaaacacttcggctt

SEQ ID NO: 342593 - DNA, 20 bp, human
gactccgcccccgaaggaaa

SEQ ID NO: 342594 - DNA, 20 bp, human
ggagcgagggaaatgacgcc

SEQ ID NO: 342595 - DNA, 20 bp, human
gccccagctcaaaaacactt

SEQ ID NO: 342596 - DNA, 20 bp, human
ggccctgggcggctttacaa

SEQ ID NO: 342597 - DNA, 20 bp, human
gaaaagccgtggcgacgtat

SEQ ID NO: 342598 - DNA, 20 bp, human
gtcgccacggcttttaagac

SEQ ID NO: 342599 - DNA, 20 bp, human
ggggcggctttacaatggat

SEQ ID NO: 342600 - DNA, 20 bp, human
gttcccagtcttaaaagccg

SEQ ID NO: 342601 - DNA, 20 bp, human
ggggaagcagggtagcctcg

SEQ ID NO: 342602 - DNA, 20 bp, human
gcagcccgcgcggcctagga

SEQ ID NO: 342603 - DNA, 20 bp, human
gctgctctccccatcaacct

SEQ ID NO: 342604 - DNA, 20 bp, human
ggcctcgtggaagagaacat

SEQ ID NO: 342605 - DNA, 20 bp, human
gggggcgtcgcttccgtcct

SEQ ID NO: 342606 - DNA, 20 bp, human
gcggaactgcagactatgag

SEQ ID NO: 342607 - DNA, 20 bp, human
gtgcacgtagagttgtcccg

SEQ ID NO: 342608 - DNA, 20 bp, human
gctgcagactatgaggggcg

SEQ ID NO: 342609 - DNA, 20 bp, human
ggaagagagaaacaaagggc

SEQ ID NO: 342610 - DNA, 20 bp, human
ggggctcttgacgaatgtgc

SEQ ID NO: 342611 - DNA, 20 bp, human
gggcgcgcttgggctcccgg

SEQ ID NO: 342612 - DNA, 20 bp, human
ggagctgaatattcgttatt

SEQ ID NO: 342613 - DNA, 20 bp, human
gcgcgcttgcgcgctgctct

SEQ ID NO: 342614 - DNA, 20 bp, human
gagaactgaaaacacctggc

SEQ ID NO: 342615 - DNA, 20 bp, human
gggactccggcaggaaggcg

SEQ ID NO: 342616 - DNA, 20 bp, human
ggggaggctagcagggttgc

SEQ ID NO: 342617 - DNA, 20 bp, human
gcctgctagcctccccctaa

SEQ ID NO: 342618 - DNA, 20 bp, human
gaaatctgaaacatactggt

SEQ ID NO: 342619 - DNA, 20 bp, human
gcatatgcaaggcctttagg

SEQ ID NO: 342620 - DNA, 20 bp, human
gcatactggtgggagtagca

SEQ ID NO: 342621 - DNA, 20 bp, human
ggagcaggtaagtgcaaaca

SEQ ID NO: 342622 - DNA, 20 bp, human
gatgcaaggcctttaggggg

SEQ ID NO: 342623 - DNA, 20 bp, human
ggatagctgtcattattagt

SEQ ID NO: 342624 - DNA, 20 bp, human
gagaactcagctctataaat

SEQ ID NO: 342625 - DNA, 20 bp, human
gttacaaaagggttaaatag

SEQ ID NO: 342626 - DNA, 20 bp, human
gcccgcagccggatcactcc

SEQ ID NO: 342627 - DNA, 20 bp, human
gcagcgcgcccggagtgatc

SEQ ID NO: 342628 - DNA, 20 bp, human
gcccgcccgggtgcgataac

SEQ ID NO: 342629 - DNA, 20 bp, human
gctagcacgatccccgtccc

SEQ ID NO: 342630 - DNA, 20 bp, human
gtaggctctcaggccaccga

SEQ ID NO: 342631 - DNA, 20 bp, human
ggatccccgtcccgggctgg

SEQ ID NO: 342632 - DNA, 20 bp, human
ggccggcaaaggggcaaccc

SEQ ID NO: 342633 - DNA, 20 bp, human
ggcaaaggggcaaccccggc

SEQ ID NO: 342634 - DNA, 20 bp, human
gcccgggcggggccggcaaa

SEQ ID NO: 342635 - DNA, 20 bp, human
ggggttcccggagatgtcgg

SEQ ID NO: 342636 - DNA, 20 bp, human
gcccggggcgatcacgttgc

SEQ ID NO: 342637 - DNA, 20 bp, human
gaccaaccagcgcccagctg

SEQ ID NO: 342638 - DNA, 20 bp, human
ggatcacgttgccggggcga

SEQ ID NO: 342639 - DNA, 20 bp, human
gtaacgggaaccctgggcta

SEQ ID NO: 342640 - DNA, 20 bp, human
ggacgtgcagagagctatct

SEQ ID NO: 342641 - DNA, 20 bp, human
gtctctgcacgtctcgcccc

SEQ ID NO: 342642 - DNA, 20 bp, human
gcccggcaacgtgatcgccc

SEQ ID NO: 342643 - DNA, 20 bp, human
gaggcccggcgattggtccc

SEQ ID NO: 342644 - DNA, 20 bp, human
gacgttgccggggcgagggc

SEQ ID NO: 342645 - DNA, 20 bp, human
gtggcgccccagctgggcgc

SEQ ID NO: 342646 - DNA, 20 bp, human
gcaggcggcgtcacgagggg

SEQ ID NO: 342647 - DNA, 20 bp, human
gcggaccgggaaagtgggag

SEQ ID NO: 342648 - DNA, 20 bp, human
ggcgcggggacgcccggctg

SEQ ID NO: 342649 - DNA, 20 bp, human
gctgcaggcggcgtcacgag

SEQ ID NO: 342650 - DNA, 20 bp, human
ggctccctcggtctgaccaa

SEQ ID NO: 342651 - DNA, 20 bp, human
gcggtgcggcaaagcattct

SEQ ID NO: 342652 - DNA, 20 bp, human
gatcgataggcgcgcaatcc

SEQ ID NO: 342653 - DNA, 20 bp, human
gtacaaggctgcaacttgac

SEQ ID NO: 342654 - DNA, 20 bp, human
gtggacccttggtcagaccg

SEQ ID NO: 342655 - DNA, 20 bp, human
gcttgccaggagctggtctc

SEQ ID NO: 342656 - DNA, 20 bp, human
gtgcccgcgccgccgattgg

SEQ ID NO: 342657 - DNA, 20 bp, human
gagcgcgcgcgtggtggacc

SEQ ID NO: 342658 - DNA, 20 bp, human
gggcggggccggaccggcgt

SEQ ID NO: 342659 - DNA, 20 bp, human
ggcagggcgcccccaatcgg

SEQ ID NO: 342660 - DNA, 20 bp, human
gacgctcacgcgcttctcgt

SEQ ID NO: 342661 - DNA, 20 bp, human
gggggccggaccggcgtagg

SEQ ID NO: 342662 - DNA, 20 bp, human
gctggagcgccgacggctgg

SEQ ID NO: 342663 - DNA, 20 bp, human
gacgcccagcgggcccgcct

SEQ ID NO: 342664 - DNA, 20 bp, human
gcgctcccggccacgcccag

SEQ ID NO: 342665 - DNA, 20 bp, human
gtgcctggaacgcgccgagg

SEQ ID NO: 342666 - DNA, 20 bp, human
gggcggggactccacctttg

SEQ ID NO: 342667 - DNA, 20 bp, human
gaaaaaaaacatccacggac

SEQ ID NO: 342668 - DNA, 20 bp, human
gagccatcgcgtcccgtccg

SEQ ID NO: 342669 - DNA, 20 bp, human
gtcactcgggaccgcaaagg

SEQ ID NO: 342670 - DNA, 20 bp, human
gatccacggacgggacgcga

SEQ ID NO: 342671 - DNA, 20 bp, human
ggtgcagcagcgaagacaag

SEQ ID NO: 342672 - DNA, 20 bp, human
gaagcggagccacctgtcag

SEQ ID NO: 342673 - DNA, 20 bp, human
ggcttcactcgggaccgcaa

SEQ ID NO: 342674 - DNA, 20 bp, human
ggccgtgagggccttggaac

SEQ ID NO: 342675 - DNA, 20 bp, human
gctcaactgcactcaccctc

SEQ ID NO: 342676 - DNA, 20 bp, human
gaatggggatgcccgggagt

SEQ ID NO: 342677 - DNA, 20 bp, human
gagtgggcggtgtagggggc

SEQ ID NO: 342678 - DNA, 20 bp, human
gcccgggagtgggcggtgta

SEQ ID NO: 342679 - DNA, 20 bp, human
ggagaagcacgcagccaatg

SEQ ID NO: 342680 - DNA, 20 bp, human
ggggatgatcgaggaatcaa

SEQ ID NO: 342681 - DNA, 20 bp, human
ggtagggggcgggatgatcg

SEQ ID NO: 342682 - DNA, 20 bp, human
gtcaatggagaggccggaat

SEQ ID NO: 342683 - DNA, 20 bp, human
ggatcgaggaatcaatggag

SEQ ID NO: 342684 - DNA, 20 bp, human
gaccaagaggcgggtgtgta

SEQ ID NO: 342685 - DNA, 20 bp, human
gaacgcagaggcccaaaaag

SEQ ID NO: 342686 - DNA, 20 bp, human
gcggctgcccagggcgaagt

SEQ ID NO: 342687 - DNA, 20 bp, human
gcgagtgctccggtggaatg

SEQ ID NO: 342688 - DNA, 20 bp, human
gtgctccggtggaatgcggg

SEQ ID NO: 342689 - DNA, 20 bp, human
gccctcacccgcacccccgg

SEQ ID NO: 342690 - DNA, 20 bp, human
gttcttgagtgcctcgaagt

SEQ ID NO: 342691 - DNA, 20 bp, human
ggtgttcccgagtgctccgg

SEQ ID NO: 342692 - DNA, 20 bp, human
ggaacagacgcgagccccgc

SEQ ID NO: 342693 - DNA, 20 bp, human
ggcgactttctgtcgttcgc

SEQ ID NO: 342694 - DNA, 20 bp, human
ggctctgcacccccacttcg

SEQ ID NO: 342695 - DNA, 20 bp, human
gtcactgagcgctctcctct

SEQ ID NO: 342696 - DNA, 20 bp, human
gtcacaggggaaggacccac

SEQ ID NO: 342697 - DNA, 20 bp, human
gtgaagaggccgtgaggcat

SEQ ID NO: 342698 - DNA, 20 bp, human
gtccctacgcagaccagcgg

SEQ ID NO: 342699 - DNA, 20 bp, human
gagaaatctcgcgacatcgc

SEQ ID NO: 342700 - DNA, 20 bp, human
gaggctgctccctccccggt

SEQ ID NO: 342701 - DNA, 20 bp, human
gtccttcccctgtgaggcgg

SEQ ID NO: 342702 - DNA, 20 bp, human
gaagctaacaggactctagt

SEQ ID NO: 342703 - DNA, 20 bp, human
gtggcaggataatccggtag

SEQ ID NO: 342704 - DNA, 20 bp, human
gacaggactctagtcggagt

SEQ ID NO: 342705 - DNA, 20 bp, human
gttagcttgaagaggccgtg

SEQ ID NO: 342706 - DNA, 20 bp, human
ggcggcgcgcggcctcatga

SEQ ID NO: 342707 - DNA, 20 bp, human
gcgcgcaagtggctggtccg

SEQ ID NO: 342708 - DNA, 20 bp, human
gctgaggcgggagccctgat

SEQ ID NO: 342709 - DNA, 20 bp, human
gtcgctgtgcgattggtcgg

SEQ ID NO: 342710 - DNA, 20 bp, human
gtagctgcaggcagacggag

SEQ ID NO: 342711 - DNA, 20 bp, human
gcccgcgctaagggttgcta

SEQ ID NO: 342712 - DNA, 20 bp, human
gagcgcgggcttctagactc

SEQ ID NO: 342713 - DNA, 20 bp, human
ggggctcggcggtgcgcgaa

SEQ ID NO: 342714 - DNA, 20 bp, human
gagcaggtaatttcaggcgg

SEQ ID NO: 342715 - DNA, 20 bp, human
gcagagtggagagacgccct

SEQ ID NO: 342716 - DNA, 20 bp, human
gggggggcggtgcttctagt

SEQ ID NO: 342717 - DNA, 20 bp, human
gctcacgcacgcccgtacgg

SEQ ID NO: 342718 - DNA, 20 bp, human
ggaaactggaagaccgagaa

SEQ ID NO: 342719 - DNA, 20 bp, human
ggaagcaccgccccccgtac

SEQ ID NO: 342720 - DNA, 20 bp, human
gcgtgagcgtgcgtacgcac

SEQ ID NO: 342721 - DNA, 20 bp, human
gcaaggaaaaccctaaccac

SEQ ID NO: 342722 - DNA, 20 bp, human
gtgtgcgagttggccgtctc

SEQ ID NO: 342723 - DNA, 20 bp, human
ggggactaagccgtgcgcga

SEQ ID NO: 342724 - DNA, 20 bp, human
gcgcacgcccgtacgggggg

SEQ ID NO: 342725 - DNA, 20 bp, human
gtgcgtacgcacaggctgct

SEQ ID NO: 342726 - DNA, 20 bp, human
ggcgcctgcgaggagggggt

SEQ ID NO: 342727 - DNA, 20 bp, human
gcgtgggcgaggggcctctc

SEQ ID NO: 342728 - DNA, 20 bp, human
gccccctcggccgtgggcga

SEQ ID NO: 342729 - DNA, 20 bp, human
ggctccggaacttggttctg

SEQ ID NO: 342730 - DNA, 20 bp, human
ggcccctcgcccacggccga

SEQ ID NO: 342731 - DNA, 20 bp, human
gcgaggccgccccaccccct

SEQ ID NO: 342732 - DNA, 20 bp, human
gccaacacccgaacaggaag

SEQ ID NO: 342733 - DNA, 20 bp, human
ggaaaagggcggggttcggg

SEQ ID NO: 342734 - DNA, 20 bp, human
gccggagccaacacccgaac

SEQ ID NO: 342735 - DNA, 20 bp, human
gcagccccagaaccaagttc

SEQ ID NO: 342736 - DNA, 20 bp, human
ggaggggaggggatccgttc

SEQ ID NO: 342737 - DNA, 20 bp, human
gagcggaaggctctccgcga

SEQ ID NO: 342738 - DNA, 20 bp, human
gagtgctggccaacgtccgg

SEQ ID NO: 342739 - DNA, 20 bp, human
gggcacctctgggtcctaaa

SEQ ID NO: 342740 - DNA, 20 bp, human
ggggaggggatccgttcggg

SEQ ID NO: 342741 - DNA, 20 bp, human
gaggctctccgcgagggctg

SEQ ID NO: 342742 - DNA, 20 bp, human
gaggggatccgttcgggtgg

SEQ ID NO: 342743 - DNA, 20 bp, human
ggcggctgccggagaccgag

SEQ ID NO: 342744 - DNA, 20 bp, human
gcatggaggtgcggttctgt

SEQ ID NO: 342745 - DNA, 20 bp, human
gaacgtccgggggcagcgga

SEQ ID NO: 342746 - DNA, 20 bp, human
gagcgcaggcgcgacgtagc

SEQ ID NO: 342747 - DNA, 20 bp, human
gcggccgcacgaccggagtt

SEQ ID NO: 342748 - DNA, 20 bp, human
gcggagttggggcgcaaact

SEQ ID NO: 342749 - DNA, 20 bp, human
gcaggcgcgacgtagccggc

SEQ ID NO: 342750 - DNA, 20 bp, human
gtctcctggaatagtgctca

SEQ ID NO: 342751 - DNA, 20 bp, human
ggggcctggcagtccgatca

SEQ ID NO: 342752 - DNA, 20 bp, human
gaaactgggggtcaaagcgc

SEQ ID NO: 342753 - DNA, 20 bp, human
gtgaagcgccttgacttttt

SEQ ID NO: 342754 - DNA, 20 bp, human
gcgccccaactccggtcgtg

SEQ ID NO: 342755 - DNA, 20 bp, human
ggtgacgtcaccacgcccgg

SEQ ID NO: 342756 - DNA, 20 bp, human
gtctccgccaagccacgcga

SEQ ID NO: 342757 - DNA, 20 bp, human
gctagggcgccgtgtcccgg

SEQ ID NO: 342758 - DNA, 20 bp, human
gttggcggagaaacggtccg

SEQ ID NO: 342759 - DNA, 20 bp, human
ggggcgctgttctgctccta

SEQ ID NO: 342760 - DNA, 20 bp, human
gcagagcttggtctggggca

SEQ ID NO: 342761 - DNA, 20 bp, human
ggcggagaaacggtccgagg

SEQ ID NO: 342762 - DNA, 20 bp, human
gaaccagcagagcttggtct

SEQ ID NO: 342763 - DNA, 20 bp, human
gctcctagggcgccgtgtcc

SEQ ID NO: 342764 - DNA, 20 bp, human
ggcgtggcttggcggagaaa

SEQ ID NO: 342765 - DNA, 20 bp, human
ggcgccctcgcgtggcttgg

SEQ ID NO: 342766 - DNA, 20 bp, human
gaccagggcgggtacaatct

SEQ ID NO: 342767 - DNA, 20 bp, human
ggggcgggacttcacaagtc

SEQ ID NO: 342768 - DNA, 20 bp, human
gcgcccgagccagtttacag

SEQ ID NO: 342769 - DNA, 20 bp, human
gtcgttgttagcagcgacca

SEQ ID NO: 342770 - DNA, 20 bp, human
gcccacttccgatttgccat

SEQ ID NO: 342771 - DNA, 20 bp, human
ggtagcgcggccaatggccg

SEQ ID NO: 342772 - DNA, 20 bp, human
gaatgaggggcgacatgggg

SEQ ID NO: 342773 - DNA, 20 bp, human
gcacgcgcagaagccttccc

SEQ ID NO: 342774 - DNA, 20 bp, human
gaccaatggcaaatcggaag

SEQ ID NO: 342775 - DNA, 20 bp, human
gccattggccgcgctaccca

SEQ ID NO: 342776 - DNA, 20 bp, human
gcctgaggcagcaggcagta

SEQ ID NO: 342777 - DNA, 20 bp, human
gtacctgggagtcggggacg

SEQ ID NO: 342778 - DNA, 20 bp, human
gtcttcccagccctatgaaa

SEQ ID NO: 342779 - DNA, 20 bp, human
gagctccgtttcatagggct

SEQ ID NO: 342780 - DNA, 20 bp, human
gacagactctgcagttgtgt

SEQ ID NO: 342781 - DNA, 20 bp, human
gctgcggcccgccgcaccat

SEQ ID NO: 342782 - DNA, 20 bp, human
gtaccccacaggtccgcatg

SEQ ID NO: 342783 - DNA, 20 bp, human
gaaacctcatgcggacctgt

SEQ ID NO: 342784 - DNA, 20 bp, human
gctatcagctccgtttcata

SEQ ID NO: 342785 - DNA, 20 bp, human
gatccccgtccccgactccc

SEQ ID NO: 342786 - DNA, 20 bp, human
gtgaactcaagaagacgggt

SEQ ID NO: 342787 - DNA, 20 bp, human
gggaccaaagagagtgcccg

SEQ ID NO: 342788 - DNA, 20 bp, human
ggcccaggcagtagggacga

SEQ ID NO: 342789 - DNA, 20 bp, human
gagaagggagccttaatcat

SEQ ID NO: 342790 - DNA, 20 bp, human
gagtctgagcggagaaatta

SEQ ID NO: 342791 - DNA, 20 bp, human
gaggtctgaactcaagaaga

SEQ ID NO: 342792 - DNA, 20 bp, human
gtccctgtttctttcggctg

SEQ ID NO: 342793 - DNA, 20 bp, human
ggccccgcgcccaggcagta

SEQ ID NO: 342794 - DNA, 20 bp, human
gtggcctcgggcactctctt

SEQ ID NO: 342795 - DNA, 20 bp, human
gcggctggggaaaggacgca

SEQ ID NO: 342796 - DNA, 20 bp, human
gctgccggccgggacacgga

SEQ ID NO: 342797 - DNA, 20 bp, human
ggggcacaggcgcagcagga

SEQ ID NO: 342798 - DNA, 20 bp, human
gccgcgccagcgtctcgcca

SEQ ID NO: 342799 - DNA, 20 bp, human
gtggccagtgacgtcaccta

SEQ ID NO: 342800 - DNA, 20 bp, human
gcgcaggcggtgcggacaga

SEQ ID NO: 342801 - DNA, 20 bp, human
ggccccggcgctagtgctcg

SEQ ID NO: 342802 - DNA, 20 bp, human
gcactagcgccggggctctg

SEQ ID NO: 342803 - DNA, 20 bp, human
ggtatgccatggcgagacgc

SEQ ID NO: 342804 - DNA, 20 bp, human
ggctggggcggagagcggag

SEQ ID NO: 342805 - DNA, 20 bp, human
ggcggacagagggtatgcca

SEQ ID NO: 342806 - DNA, 20 bp, human
ggctgctgggaaagagtcgt

SEQ ID NO: 342807 - DNA, 20 bp, human
gcagccgcgaatcggcacct

SEQ ID NO: 342808 - DNA, 20 bp, human
gctgcccaggtgccgattcg

SEQ ID NO: 342809 - DNA, 20 bp, human
gggcgcatgcagccgcgaat

SEQ ID NO: 342810 - DNA, 20 bp, human
gctactagagggcttaagat

SEQ ID NO: 342811 - DNA, 20 bp, human
gcggctgctctttgctgcag

SEQ ID NO: 342812 - DNA, 20 bp, human
gagctagtcgcttgctgccc

SEQ ID NO: 342813 - DNA, 20 bp, human
gagtcgtggggctgctgacg

SEQ ID NO: 342814 - DNA, 20 bp, human
gctctcgcgccactcagcta

SEQ ID NO: 342815 - DNA, 20 bp, human
ggaccacatgcatcatataa

SEQ ID NO: 342816 - DNA, 20 bp, human
gtggttgagcggccagtaag

SEQ ID NO: 342817 - DNA, 20 bp, human
gtcttccccaccatcacaga

SEQ ID NO: 342818 - DNA, 20 bp, human
ggaatgaggcagttcgttaa

SEQ ID NO: 342819 - DNA, 20 bp, human
gtgtgactggcccttttcac

SEQ ID NO: 342820 - DNA, 20 bp, human
gacgctgccagggcctgaga

SEQ ID NO: 342821 - DNA, 20 bp, human
gcagttcgttaaggggtgag

SEQ ID NO: 342822 - DNA, 20 bp, human
ggggtggctcacacagagtt

SEQ ID NO: 342823 - DNA, 20 bp, human
gaagagagatggaagtgctc

SEQ ID NO: 342824 - DNA, 20 bp, human
gtggtcctggcctggtcaaa

SEQ ID NO: 342825 - DNA, 20 bp, human
gtgggtatctgaccccttac

SEQ ID NO: 342826 - DNA, 20 bp, human
gaggctgcaccgccgtgctc

SEQ ID NO: 342827 - DNA, 20 bp, human
ggtgctcgggccctcgcggt

SEQ ID NO: 342828 - DNA, 20 bp, human
gggagccggcgcccaagccg

SEQ ID NO: 342829 - DNA, 20 bp, human
gaccaaggtgcccaccgcga

SEQ ID NO: 342830 - DNA, 20 bp, human
gagggaggggcctgcgacag

SEQ ID NO: 342831 - DNA, 20 bp, human
gagggcgcacctggagaatg

SEQ ID NO: 342832 - DNA, 20 bp, human
gaaggcagaaaggactagga

SEQ ID NO: 342833 - DNA, 20 bp, human
ggaggggcctgcgacagcgg

SEQ ID NO: 342834 - DNA, 20 bp, human
gtgcccaggtgctccagtta

SEQ ID NO: 342835 - DNA, 20 bp, human
gccctctccccgcaagctgg

SEQ ID NO: 342836 - DNA, 20 bp, human
ggggcggcttttattctgca

SEQ ID NO: 342837 - DNA, 20 bp, human
gtccggttcatgactttgaa

SEQ ID NO: 342838 - DNA, 20 bp, human
gagaagtggagtcgaagagt

SEQ ID NO: 342839 - DNA, 20 bp, human
gccagatgcatacctagaag

SEQ ID NO: 342840 - DNA, 20 bp, human
gacggcaggctgcattcggc

SEQ ID NO: 342841 - DNA, 20 bp, human
gacagcaggctacattcgac

SEQ ID NO: 342842 - DNA, 20 bp, human
ggcagccttgctgtattttc

SEQ ID NO: 342843 - DNA, 20 bp, human
gtgctccagaaaatacagca

SEQ ID NO: 342844 - DNA, 20 bp, human
ggaacacggcaggctgcgtt

SEQ ID NO: 342845 - DNA, 20 bp, human
gacctttcaaagtcatgaac

SEQ ID NO: 342846 - DNA, 20 bp, human
gcgggccggccgccgagggt

SEQ ID NO: 342847 - DNA, 20 bp, human
gggcgccgcgagagccgctg

SEQ ID NO: 342848 - DNA, 20 bp, human
ggccctcgccgaggccacag

SEQ ID NO: 342849 - DNA, 20 bp, human
ggccgctgtggcctcggcga

SEQ ID NO: 342850 - DNA, 20 bp, human
ggaggccacagcggctctcg

SEQ ID NO: 342851 - DNA, 20 bp, human
gagggcagtctcctgtatgg

SEQ ID NO: 342852 - DNA, 20 bp, human
ggcgagggcagtctcctgta

SEQ ID NO: 342853 - DNA, 20 bp, human
gccccgcggcgccgccatac

SEQ ID NO: 342854 - DNA, 20 bp, human
ggaggggcggggcgtaggct

SEQ ID NO: 342855 - DNA, 20 bp, human
ggcggggatgcgattcgtgg

SEQ ID NO: 342856 - DNA, 20 bp, human
gcccgcggggcgcaagccag

SEQ ID NO: 342857 - DNA, 20 bp, human
ggctgcggtgaggacgaggg

SEQ ID NO: 342858 - DNA, 20 bp, human
ggcgccgtgcatagcggtgg

SEQ ID NO: 342859 - DNA, 20 bp, human
gcatgcgccgtgcatagcgg

SEQ ID NO: 342860 - DNA, 20 bp, human
ggggccgagcggctgcggtg

SEQ ID NO: 342861 - DNA, 20 bp, human
ggagcatgcgccgtgcatag

SEQ ID NO: 342862 - DNA, 20 bp, human
gtggaggagcggagttcggg

SEQ ID NO: 342863 - DNA, 20 bp, human
gccggtgcctcccactgcgc

SEQ ID NO: 342864 - DNA, 20 bp, human
gagcggctgcggtgaggacg

SEQ ID NO: 342865 - DNA, 20 bp, human
gagagggtggaacctccgca

SEQ ID NO: 342866 - DNA, 20 bp, human
gcaaccaccatcttgatcga

SEQ ID NO: 342867 - DNA, 20 bp, human
gggctggcgcggtgcatcgt

SEQ ID NO: 342868 - DNA, 20 bp, human
ggcaccgccaggccccgtaa

SEQ ID NO: 342869 - DNA, 20 bp, human
gccgctaccacgctgactgg

SEQ ID NO: 342870 - DNA, 20 bp, human
ggccaggccccgtaaaggtt

SEQ ID NO: 342871 - DNA, 20 bp, human
gtcaccaagccggattttaa

SEQ ID NO: 342872 - DNA, 20 bp, human
gccggaactaatgaactcct

SEQ ID NO: 342873 - DNA, 20 bp, human
gctcgtccgtcggtcggggc

SEQ ID NO: 342874 - DNA, 20 bp, human
gtcagtctcgtccgtcggtc

SEQ ID NO: 342875 - DNA, 20 bp, human
gcgccaaaggcacacgataa

SEQ ID NO: 342876 - DNA, 20 bp, human
gtgtgcggggcgtcaagttt

SEQ ID NO: 342877 - DNA, 20 bp, human
ggcggcgcccgacgttcggg

SEQ ID NO: 342878 - DNA, 20 bp, human
gttgacgccccgcacaatcg

SEQ ID NO: 342879 - DNA, 20 bp, human
gagactgtcccggaaaaaca

SEQ ID NO: 342880 - DNA, 20 bp, human
gcggggacggggcatcgatg

SEQ ID NO: 342881 - DNA, 20 bp, human
gacaggtggtactccgggac

SEQ ID NO: 342882 - DNA, 20 bp, human
gtaggctggctgcgagtcgg

SEQ ID NO: 342883 - DNA, 20 bp, human
gccgcgcgccggccgttaat

SEQ ID NO: 342884 - DNA, 20 bp, human
gtagaagacatgtggggaca

SEQ ID NO: 342885 - DNA, 20 bp, human
gcaagcgctaggaccgctca

SEQ ID NO: 342886 - DNA, 20 bp, human
gctcgcctggggttctccgt

SEQ ID NO: 342887 - DNA, 20 bp, human
gcgaccgctacaacttgaga

SEQ ID NO: 342888 - DNA, 20 bp, human
gtggttggtacaggcgactg

SEQ ID NO: 342889 - DNA, 20 bp, human
gccggggaggggcctcgcaa

SEQ ID NO: 342890 - DNA, 20 bp, human
gccgcctcttggtgcggcgg

SEQ ID NO: 342891 - DNA, 20 bp, human
ggaggggcctcgcaaggggt

SEQ ID NO: 342892 - DNA, 20 bp, human
ggcagcgacggcgtgaggtg

SEQ ID NO: 342893 - DNA, 20 bp, human
gtcccgcccgcctcttggtg

SEQ ID NO: 342894 - DNA, 20 bp, human
gcgcccgcctcttggtgcgg

SEQ ID NO: 342895 - DNA, 20 bp, human
ggccgtgtgattggctaaga

SEQ ID NO: 342896 - DNA, 20 bp, human
gccaaaggggacacccctga

SEQ ID NO: 342897 - DNA, 20 bp, human
gcccctgagggcagactcgg

SEQ ID NO: 342898 - DNA, 20 bp, human
gcacccccgagtctgccctc

SEQ ID NO: 342899 - DNA, 20 bp, human
gggaagcctggattctagaa

SEQ ID NO: 342900 - DNA, 20 bp, human
gtccccgcgggctgaaaggg

SEQ ID NO: 342901 - DNA, 20 bp, human
gtcagcccgcggggaggtgc

SEQ ID NO: 342902 - DNA, 20 bp, human
gacctccccgcgggctgaaa

SEQ ID NO: 342903 - DNA, 20 bp, human
gtagacagcaagggacggga

SEQ ID NO: 342904 - DNA, 20 bp, human
gtctagaagggaggctgcat

SEQ ID NO: 342905 - DNA, 20 bp, human
ggctgcgtcaggaaggcccg

SEQ ID NO: 342906 - DNA, 20 bp, human
ggggctctctgcatgatata

SEQ ID NO: 342907 - DNA, 20 bp, human
gcgggcgcgaaaaagggact

SEQ ID NO: 342908 - DNA, 20 bp, human
gcctgtagaggggaggttaa

SEQ ID NO: 342909 - DNA, 20 bp, human
gcccctacgctcactgtcat

SEQ ID NO: 342910 - DNA, 20 bp, human
ggagccttcgggcgcgaaaa

SEQ ID NO: 342911 - DNA, 20 bp, human
gacagtgagcgtagggggcg

SEQ ID NO: 342912 - DNA, 20 bp, human
gctggcgcctagagaagcgg

SEQ ID NO: 342913 - DNA, 20 bp, human
gccaggtgccggcccctcaa

SEQ ID NO: 342914 - DNA, 20 bp, human
gaagggcgaggcctactgat

SEQ ID NO: 342915 - DNA, 20 bp, human
gggcctggcgcctagagaag

SEQ ID NO: 342916 - DNA, 20 bp, human
gacggaaagagcgttctgtt

SEQ ID NO: 342917 - DNA, 20 bp, human
gaacgaaggctgcaaaaagc

SEQ ID NO: 342918 - DNA, 20 bp, human
gaggcatgaagctcgctgat

SEQ ID NO: 342919 - DNA, 20 bp, human
gcatctcttagggggaatac

SEQ ID NO: 342920 - DNA, 20 bp, human
gacactaaaaaaactgcaaa

SEQ ID NO: 342921 - DNA, 20 bp, human
gctcttagggggaatactgg

SEQ ID NO: 342922 - DNA, 20 bp, human
gatgaagctcgctgattggc

SEQ ID NO: 342923 - DNA, 20 bp, human
gtcagtgtgccttaaaagct

SEQ ID NO: 342924 - DNA, 20 bp, human
ggctggttcgtgatgtcagc

SEQ ID NO: 342925 - DNA, 20 bp, human
gtgtaaacaaatgatttcga

SEQ ID NO: 342926 - DNA, 20 bp, human
gaacccaagcttggctagga

SEQ ID NO: 342927 - DNA, 20 bp, human
gataaggggaaacccaagct

SEQ ID NO: 342928 - DNA, 20 bp, human
ggccgacgcacagcagacgc

SEQ ID NO: 342929 - DNA, 20 bp, human
gtctggaagccgaaccctgg

SEQ ID NO: 342930 - DNA, 20 bp, human
gagtacaaaccgccagggtt

SEQ ID NO: 342931 - DNA, 20 bp, human
gcacccacttcagccaattc

SEQ ID NO: 342932 - DNA, 20 bp, human
gtctaagctcgacccacttt

SEQ ID NO: 342933 - DNA, 20 bp, human
gggtggtcccgccctaaagt

SEQ ID NO: 342934 - DNA, 20 bp, human
gagtgggtcgagcttagaga

SEQ ID NO: 342935 - DNA, 20 bp, human
gaattctggaagccgaaccc

SEQ ID NO: 342936 - DNA, 20 bp, human
gatgcagccgcgatctcggg

SEQ ID NO: 342937 - DNA, 20 bp, human
ggtgggaagagagaaggtcg

SEQ ID NO: 342938 - DNA, 20 bp, human
gaagagagaaggtcgaggat

SEQ ID NO: 342939 - DNA, 20 bp, human
gactcccctgacagcatgtt

SEQ ID NO: 342940 - DNA, 20 bp, human
gggccgaagcttgaggaacc

SEQ ID NO: 342941 - DNA, 20 bp, human
gttcggctgagacctgatca

SEQ ID NO: 342942 - DNA, 20 bp, human
gcagccgaacatgctgtcag

SEQ ID NO: 342943 - DNA, 20 bp, human
gagacctgatcagggattgg

SEQ ID NO: 342944 - DNA, 20 bp, human
gctgccgccaatccctgatc

SEQ ID NO: 342945 - DNA, 20 bp, human
gggcaggagggcggagaaac

SEQ ID NO: 342946 - DNA, 20 bp, human
gaggaactccggcgtcgggg

SEQ ID NO: 342947 - DNA, 20 bp, human
ggtcgggggcgggctcagtg

SEQ ID NO: 342948 - DNA, 20 bp, human
gctgcaggcgcgcaagaggc

SEQ ID NO: 342949 - DNA, 20 bp, human
ggaggctgcaggcgcgcaag

SEQ ID NO: 342950 - DNA, 20 bp, human
gtgtgtgcgtggcccacaag

SEQ ID NO: 342951 - DNA, 20 bp, human
ggaggcgggcgcggtgttgg

SEQ ID NO: 342952 - DNA, 20 bp, human
gcaatgaacgcgaggaactc

SEQ ID NO: 342953 - DNA, 20 bp, human
gaagcggggaggccgccacc

SEQ ID NO: 342954 - DNA, 20 bp, human
gctggaagaaaacagagcaa

SEQ ID NO: 342955 - DNA, 20 bp, human
gcaagtgcagagggtgtctc

SEQ ID NO: 342956 - DNA, 20 bp, human
gaatactgaagggttggtag

SEQ ID NO: 342957 - DNA, 20 bp, human
ggggtaggctctagggactt

SEQ ID NO: 342958 - DNA, 20 bp, human
gctaggagagaaacaggacg

SEQ ID NO: 342959 - DNA, 20 bp, human
gcctacagaggggctaagac

SEQ ID NO: 342960 - DNA, 20 bp, human
ggcggcgccgccggggaaca

SEQ ID NO: 342961 - DNA, 20 bp, human
gggtccgccatgttccccgg

SEQ ID NO: 342962 - DNA, 20 bp, human
ggcactgcgcgtgcgggggt

SEQ ID NO: 342963 - DNA, 20 bp, human
gaccctctttccctacagag

SEQ ID NO: 342964 - DNA, 20 bp, human
ggggggcggggtaggctcta

SEQ ID NO: 342965 - DNA, 20 bp, human
ggggcaaaattactgaagct

SEQ ID NO: 342966 - DNA, 20 bp, human
ggcctcgcgggaaggcggaa

SEQ ID NO: 342967 - DNA, 20 bp, human
gccgagctctactgcctcgc

SEQ ID NO: 342968 - DNA, 20 bp, human
gctactgcctcgcgggaagg

SEQ ID NO: 342969 - DNA, 20 bp, human
gtcggcgcacgcgctgctct

SEQ ID NO: 342970 - DNA, 20 bp, human
gaaaatgggcggttagcagc

SEQ ID NO: 342971 - DNA, 20 bp, human
gaggcccggccgggtccgct

SEQ ID NO: 342972 - DNA, 20 bp, human
gtgtcctagcggacccggcc

SEQ ID NO: 342973 - DNA, 20 bp, human
ggagaagaagcgaaaatggg

SEQ ID NO: 342974 - DNA, 20 bp, human
gatgttccgggcccgggtag

SEQ ID NO: 342975 - DNA, 20 bp, human
gggcgcgcttgcgtgcacga

SEQ ID NO: 342976 - DNA, 20 bp, human
gctctggcgagctctggttg

SEQ ID NO: 342977 - DNA, 20 bp, human
ggccggctgaggggcgaacg

SEQ ID NO: 342978 - DNA, 20 bp, human
gccaccctgcacgcaagggg

SEQ ID NO: 342979 - DNA, 20 bp, human
ggcaaggggcggccggctga

SEQ ID NO: 342980 - DNA, 20 bp, human
gtccagccacatgaccggaa

SEQ ID NO: 342981 - DNA, 20 bp, human
gcggccgccccttgcgtgca

SEQ ID NO: 342982 - DNA, 20 bp, human
ggcggcgctctggcgagctc

SEQ ID NO: 342983 - DNA, 20 bp, human
gggaacctgcgcgccccgct

SEQ ID NO: 342984 - DNA, 20 bp, human
gtccgcgagcgccgcacatc

SEQ ID NO: 342985 - DNA, 20 bp, human
gtcgcgtggcggagcccttc

SEQ ID NO: 342986 - DNA, 20 bp, human
ggggccctggtcgagcaaaa

SEQ ID NO: 342987 - DNA, 20 bp, human
gctgtctgggcaggagtata

SEQ ID NO: 342988 - DNA, 20 bp, human
gtggtcgagcaaaagggcag

SEQ ID NO: 342989 - DNA, 20 bp, human
gaggggaggtgggtgctgtc

SEQ ID NO: 342990 - DNA, 20 bp, human
gtgcccggacggttgggcca

SEQ ID NO: 342991 - DNA, 20 bp, human
gaccccatggcccaaccgtc

SEQ ID NO: 342992 - DNA, 20 bp, human
gggctcaaagggtcggagag

SEQ ID NO: 342993 - DNA, 20 bp, human
gggcggggctcgtgcccgga

SEQ ID NO: 342994 - DNA, 20 bp, human
gttgctcgaccagggccccc

SEQ ID NO: 342995 - DNA, 20 bp, human
gatactgcagcgaataacac

SEQ ID NO: 342996 - DNA, 20 bp, human
gaggaggtggaggaacccgg

SEQ ID NO: 342997 - DNA, 20 bp, human
gcggcggcggcggtcgaaag

SEQ ID NO: 342998 - DNA, 20 bp, human
gcagcctgagatcgggaagg

SEQ ID NO: 342999 - DNA, 20 bp, human
ggcggggccggaagtaggag

SEQ ID NO: 343000 - DNA, 20 bp, human
gatgggaggggactggtcta

SEQ ID NO: 343001 - DNA, 20 bp, human
gctccagcctgagatcggga

SEQ ID NO: 343002 - DNA, 20 bp, human
gcacttctccagcctgagat

SEQ ID NO: 343003 - DNA, 20 bp, human
ggctaaggacggtgacttag

SEQ ID NO: 343004 - DNA, 20 bp, human
ggtcgaaagcggagtgaaag

SEQ ID NO: 343005 - DNA, 20 bp, human
gccacctccttcccgatctc

SEQ ID NO: 343006 - DNA, 20 bp, human
ggctcggcgtgagggcggct

SEQ ID NO: 343007 - DNA, 20 bp, human
ggggaccctgcggcgagtgc

SEQ ID NO: 343008 - DNA, 20 bp, human
ggcgcccgccgagatggctg

SEQ ID NO: 343009 - DNA, 20 bp, human
ggcccggggccctcgccaag

SEQ ID NO: 343010 - DNA, 20 bp, human
gccagccgcagccatctcgg

SEQ ID NO: 343011 - DNA, 20 bp, human
gtacgtgcaggcctggggat

SEQ ID NO: 343012 - DNA, 20 bp, human
gaccccggccccgacgacct

SEQ ID NO: 343013 - DNA, 20 bp, human
gtggctgctaacaaagccca

SEQ ID NO: 343014 - DNA, 20 bp, human
gctgccagccgcagccatct

SEQ ID NO: 343015 - DNA, 20 bp, human
ggtgagggcggctcgggagg

SEQ ID NO: 343016 - DNA, 20 bp, human
gcggccgaggtgtgacgctg

SEQ ID NO: 343017 - DNA, 20 bp, human
ggggccccagcgtcacacct

SEQ ID NO: 343018 - DNA, 20 bp, human
ggctccgcggagctgaagac

SEQ ID NO: 343019 - DNA, 20 bp, human
gcccagtggcgtctgcgtcc

SEQ ID NO: 343020 - DNA, 20 bp, human
ggaacccgagagcgcgtgcg

SEQ ID NO: 343021 - DNA, 20 bp, human
gcggccgcgcacgcgctctc

SEQ ID NO: 343022 - DNA, 20 bp, human
gagtggcgtctgcgtcccgg

SEQ ID NO: 343023 - DNA, 20 bp, human
gcgtgcgcgcggtgacgtac

SEQ ID NO: 343024 - DNA, 20 bp, human
gactggacggtcaggcgaga

SEQ ID NO: 343025 - DNA, 20 bp, human
ggggttgcaggcggactcct

SEQ ID NO: 343026 - DNA, 20 bp, human
gtgcgcgcggcgcccgggaa

SEQ ID NO: 343027 - DNA, 20 bp, human
ggggtggggcacacttggtt

SEQ ID NO: 343028 - DNA, 20 bp, human
gaggagcgggcgcagaaggg

SEQ ID NO: 343029 - DNA, 20 bp, human
gcccgggcgccgcgcgcaag

SEQ ID NO: 343030 - DNA, 20 bp, human
ggggccgccgggtcgttgcg

SEQ ID NO: 343031 - DNA, 20 bp, human
gctgccgcgcaacgacccgg

SEQ ID NO: 343032 - DNA, 20 bp, human
gcaactgccgcgcaacgacc

SEQ ID NO: 343033 - DNA, 20 bp, human
gtgcgcacgcgctgtggggt

SEQ ID NO: 343034 - DNA, 20 bp, human
gcaagagcacggcccggcga

SEQ ID NO: 343035 - DNA, 20 bp, human
ggcgaggagcgggcgcagaa

SEQ ID NO: 343036 - DNA, 20 bp, human
gtctaccaggggtaccgtct

SEQ ID NO: 343037 - DNA, 20 bp, human
ggtaccgtctggggaacctc

SEQ ID NO: 343038 - DNA, 20 bp, human
gacctgcgcaggcgcgtgaa

SEQ ID NO: 343039 - DNA, 20 bp, human
gtggcgaaagggacctgcgc

SEQ ID NO: 343040 - DNA, 20 bp, human
gcgcgcgctctgtggcgaaa

SEQ ID NO: 343041 - DNA, 20 bp, human
gctggtagagagagccaata

SEQ ID NO: 343042 - DNA, 20 bp, human
gtgaccagaggttccccaga

SEQ ID NO: 343043 - DNA, 20 bp, human
gcccttctctcattccctat

SEQ ID NO: 343044 - DNA, 20 bp, human
ggttccccagacggtacccc

SEQ ID NO: 343045 - DNA, 20 bp, human
gacccggcgctccttcgcga

SEQ ID NO: 343046 - DNA, 20 bp, human
gggccgttgagggaccgttg

SEQ ID NO: 343047 - DNA, 20 bp, human
gggggcgcggagggatccgt

SEQ ID NO: 343048 - DNA, 20 bp, human
gagggaaagtagtccggcga

SEQ ID NO: 343049 - DNA, 20 bp, human
gatccgtgggagccgcagtg

SEQ ID NO: 343050 - DNA, 20 bp, human
ggggcccacttcactttctt

SEQ ID NO: 343051 - DNA, 20 bp, human
ggccaggcccaatagtgacg

SEQ ID NO: 343052 - DNA, 20 bp, human
ggtggggacgagagattcgc

SEQ ID NO: 343053 - DNA, 20 bp, human
gccccaccctgcacaggaat

SEQ ID NO: 343054 - DNA, 20 bp, human
ggcggaggggcacagctcgg

SEQ ID NO: 343055 - DNA, 20 bp, human
ggcgcgctcgctcccgtcgc

SEQ ID NO: 343056 - DNA, 20 bp, human
gcccccgcggcagacgacta

SEQ ID NO: 343057 - DNA, 20 bp, human
gggtcccagcaggtttcgcg

SEQ ID NO: 343058 - DNA, 20 bp, human
gttcgcggggtggaccgaag

SEQ ID NO: 343059 - DNA, 20 bp, human
ggccccaagagagcccgctt

SEQ ID NO: 343060 - DNA, 20 bp, human
gctcttggggcctgcagtcg

SEQ ID NO: 343061 - DNA, 20 bp, human
gaccgaagcgggctctcttg

SEQ ID NO: 343062 - DNA, 20 bp, human
ggtacgcccggcgccccctc

SEQ ID NO: 343063 - DNA, 20 bp, human
gccgggcgtaccgacgtagc

SEQ ID NO: 343064 - DNA, 20 bp, human
gcgacgtagcggggagaaac

SEQ ID NO: 343065 - DNA, 20 bp, human
gctgcgcaggcgccactcac

SEQ ID NO: 343066 - DNA, 20 bp, human
ggggaagggaaatcctggag

SEQ ID NO: 343067 - DNA, 20 bp, human
gcggcggcggggttcaagag

SEQ ID NO: 343068 - DNA, 20 bp, human
gcacgcgcactgcaccgccc

SEQ ID NO: 343069 - DNA, 20 bp, human
gggcgcaagcgcgtctgcgg

SEQ ID NO: 343070 - DNA, 20 bp, human
gggcggggttcaagagtggg

SEQ ID NO: 343071 - DNA, 20 bp, human
gcaaacggagcgagtgggaa

SEQ ID NO: 343072 - DNA, 20 bp, human
ggcgcaccggctccgttcca

SEQ ID NO: 343073 - DNA, 20 bp, human
gaaacgactgagggcctctg

SEQ ID NO: 343074 - DNA, 20 bp, human
ggagctgtctgggtttattc

SEQ ID NO: 343075 - DNA, 20 bp, human
gtgttggtgcgcaggtgcgg

SEQ ID NO: 343076 - DNA, 20 bp, human
gaacccgcgtgggagcacga

SEQ ID NO: 343077 - DNA, 20 bp, human
gaccgagtgccccactccag

SEQ ID NO: 343078 - DNA, 20 bp, human
gtctccgggccccctggagt

SEQ ID NO: 343079 - DNA, 20 bp, human
gcactcggtgaaacccgcgt

SEQ ID NO: 343080 - DNA, 20 bp, human
gcgtgggagcacgagggctt

SEQ ID NO: 343081 - DNA, 20 bp, human
gcctcaaagggaaacgtaaa

SEQ ID NO: 343082 - DNA, 20 bp, human
gcgagcgtgcgcgccccaag

SEQ ID NO: 343083 - DNA, 20 bp, human
gtcccccgtggcccaggaaa

SEQ ID NO: 343084 - DNA, 20 bp, human
gacgccccgcggcctctggg

SEQ ID NO: 343085 - DNA, 20 bp, human
gtccaggcaggacgcgggac

SEQ ID NO: 343086 - DNA, 20 bp, human
gccctcgcgcttgactgacg

SEQ ID NO: 343087 - DNA, 20 bp, human
gccaatcggaatgtagtcaa

SEQ ID NO: 343088 - DNA, 20 bp, human
gacgaggcttgcgggccaat

SEQ ID NO: 343089 - DNA, 20 bp, human
gcgatccaataggtagtagg

SEQ ID NO: 343090 - DNA, 20 bp, human
gaggcgatccaataggtagt

SEQ ID NO: 343091 - DNA, 20 bp, human
gagccgctaggcgatccaat

SEQ ID NO: 343092 - DNA, 20 bp, human
gccggatccgtcaagtccat

SEQ ID NO: 343093 - DNA, 20 bp, human
gcccgccccctactacctat

SEQ ID NO: 343094 - DNA, 20 bp, human
ggccaatgagcctggagctg

SEQ ID NO: 343095 - DNA, 20 bp, human
gtacctattggatcgcctag

SEQ ID NO: 343096 - DNA, 20 bp, human
ggcctcgcgcgaaggttcct

SEQ ID NO: 343097 - DNA, 20 bp, human
ggcaccctggaagaaggccc

SEQ ID NO: 343098 - DNA, 20 bp, human
gccaaacggtccccacttaa

SEQ ID NO: 343099 - DNA, 20 bp, human
ggaaccttcgcgcgaggcca

SEQ ID NO: 343100 - DNA, 20 bp, human
gtaaagggactactactccc

SEQ ID NO: 343101 - DNA, 20 bp, human
gtctcgccgcacggctctct

SEQ ID NO: 343102 - DNA, 20 bp, human
gggagcgcaagtgcccacta

SEQ ID NO: 343103 - DNA, 20 bp, human
gtcccaggaaccttcgcgcg

SEQ ID NO: 343104 - DNA, 20 bp, human
ggtagtagtccctttaagtg

SEQ ID NO: 343105 - DNA, 20 bp, human
gccttcttccagggtgcaag

SEQ ID NO: 343106 - DNA, 20 bp, human
gggccagcggggtctggcgg

SEQ ID NO: 343107 - DNA, 20 bp, human
ggcaacctgcgcatcccgaa

SEQ ID NO: 343108 - DNA, 20 bp, human
gaacggatgcccagcctgat

SEQ ID NO: 343109 - DNA, 20 bp, human
gaaccgcgctccgcccgcct

SEQ ID NO: 343110 - DNA, 20 bp, human
gcagaccccgctggccgagt

SEQ ID NO: 343111 - DNA, 20 bp, human
gcgctgaaagctccagggta

SEQ ID NO: 343112 - DNA, 20 bp, human
gtctcgtagaccgccctctg

SEQ ID NO: 343113 - DNA, 20 bp, human
ggagccccactcggccagcg

SEQ ID NO: 343114 - DNA, 20 bp, human
gacactgaggcactgcgaat

SEQ ID NO: 343115 - DNA, 20 bp, human
gtgtcgcgctgaaagctcca

SEQ ID NO: 343116 - DNA, 20 bp, human
gacacagacccaggacagga

SEQ ID NO: 343117 - DNA, 20 bp, human
gtaggtgctggggaggaaac

SEQ ID NO: 343118 - DNA, 20 bp, human
gagagagcgcaggggaatga

SEQ ID NO: 343119 - DNA, 20 bp, human
gtgagggtgggtcgcttata

SEQ ID NO: 343120 - DNA, 20 bp, human
gggtcacaggcggagaggtg

SEQ ID NO: 343121 - DNA, 20 bp, human
gagcgcaggggaatgacgga

SEQ ID NO: 343122 - DNA, 20 bp, human
gttaggggtcacaggcggag

SEQ ID NO: 343123 - DNA, 20 bp, human
gggcactagggtgtcggtta

SEQ ID NO: 343124 - DNA, 20 bp, human
gtgacctggggcggactgga

SEQ ID NO: 343125 - DNA, 20 bp, human
gcgcaaatccgtcacgtccg

SEQ ID NO: 343126 - DNA, 20 bp, human
gaccgcccggaacacgctag

SEQ ID NO: 343127 - DNA, 20 bp, human
gtgaacatgcgcagagggtg

SEQ ID NO: 343128 - DNA, 20 bp, human
gtgcggacgcagtgtctctt

SEQ ID NO: 343129 - DNA, 20 bp, human
ggggcctgagcggtgaatcg

SEQ ID NO: 343130 - DNA, 20 bp, human
gcaaaagtgactacgactcc

SEQ ID NO: 343131 - DNA, 20 bp, human
gctgccttatgcagtcacca

SEQ ID NO: 343132 - DNA, 20 bp, human
gcccctaggtcctaaatctt

SEQ ID NO: 343133 - DNA, 20 bp, human
gaaggttgaacatgcgcaga

SEQ ID NO: 343134 - DNA, 20 bp, human
gccggaacacgctagtggag

SEQ ID NO: 343135 - DNA, 20 bp, human
gcataaggcagcgagcccaa

SEQ ID NO: 343136 - DNA, 20 bp, human
gcagcgcgcgcagaagtccg

SEQ ID NO: 343137 - DNA, 20 bp, human
ggggaatgagcacatccaat

SEQ ID NO: 343138 - DNA, 20 bp, human
gtccgagcgagtttcgggat

SEQ ID NO: 343139 - DNA, 20 bp, human
gcgagtttcgggattggctg

SEQ ID NO: 343140 - DNA, 20 bp, human
ggcgcgcgctgcatgcccat

SEQ ID NO: 343141 - DNA, 20 bp, human
ggggaagtcaggtatctagt

SEQ ID NO: 343142 - DNA, 20 bp, human
gaggaagcgcttgccagccc

SEQ ID NO: 343143 - DNA, 20 bp, human
ggccggggaggttgatataa

SEQ ID NO: 343144 - DNA, 20 bp, human
gaagaacgggactcaaagcc

SEQ ID NO: 343145 - DNA, 20 bp, human
ggatgcgaacaacatggcgg

SEQ ID NO: 343146 - DNA, 20 bp, human
gacaggaggcggggactctg

SEQ ID NO: 343147 - DNA, 20 bp, human
ggggaaggggtgtcagtgat

SEQ ID NO: 343148 - DNA, 20 bp, human
gactgaggccagagacggga

SEQ ID NO: 343149 - DNA, 20 bp, human
ggagggcttcggagtgagag

SEQ ID NO: 343150 - DNA, 20 bp, human
gggggacagggcagttctgt

SEQ ID NO: 343151 - DNA, 20 bp, human
gccgtctctggcctcagtac

SEQ ID NO: 343152 - DNA, 20 bp, human
gccacaggagacttttactg

SEQ ID NO: 343153 - DNA, 20 bp, human
ggctctggtgcccaaaggga

SEQ ID NO: 343154 - DNA, 20 bp, human
gactggcaacgccagtactg

SEQ ID NO: 343155 - DNA, 20 bp, human
gtcaagaaagatggggttct

SEQ ID NO: 343156 - DNA, 20 bp, human
ggggagccctggtacggcaa

SEQ ID NO: 343157 - DNA, 20 bp, human
gccggtgtgcgtctacgctg

SEQ ID NO: 343158 - DNA, 20 bp, human
gcgtagacgcacaccggcgt

SEQ ID NO: 343159 - DNA, 20 bp, human
gctggtacggcaatgggcac

SEQ ID NO: 343160 - DNA, 20 bp, human
ggtcccccgagtctggtaca

SEQ ID NO: 343161 - DNA, 20 bp, human
ggccaaggacgcactctcat

SEQ ID NO: 343162 - DNA, 20 bp, human
gacgctcgggagccctggta

SEQ ID NO: 343163 - DNA, 20 bp, human
gccaatcgctgcccggtaat

SEQ ID NO: 343164 - DNA, 20 bp, human
gggcgtctggccgcgcagtc

SEQ ID NO: 343165 - DNA, 20 bp, human
gagccatgtaccagactcgg

SEQ ID NO: 343166 - DNA, 20 bp, human
gccggctggtatttcccgac

SEQ ID NO: 343167 - DNA, 20 bp, human
gtctcggcgtcagtccgctc

SEQ ID NO: 343168 - DNA, 20 bp, human
gcctccgcgcagctccggcg

SEQ ID NO: 343169 - DNA, 20 bp, human
gggcgccaggcctgagggac

SEQ ID NO: 343170 - DNA, 20 bp, human
gccccggcgcatctgctcgt

SEQ ID NO: 343171 - DNA, 20 bp, human
gcgggaaataccagccgggc

SEQ ID NO: 343172 - DNA, 20 bp, human
gcgcgcggccatccaagcgg

SEQ ID NO: 343173 - DNA, 20 bp, human
gcgagacgcgcgcgggtcag

SEQ ID NO: 343174 - DNA, 20 bp, human
gtggtatttcccgaccgggc

SEQ ID NO: 343175 - DNA, 20 bp, human
gcaggcgggcgctgcgatgg

SEQ ID NO: 343176 - DNA, 20 bp, human
gcgggagactacgcgagacg

SEQ ID NO: 343177 - DNA, 20 bp, human
gggccccgcccatgccgggg

SEQ ID NO: 343178 - DNA, 20 bp, human
gggagcgcggaggcagttgg

SEQ ID NO: 343179 - DNA, 20 bp, human
ggccgcgcgctgggctgacc

SEQ ID NO: 343180 - DNA, 20 bp, human
ggcgcctgcgcgttgggagc

SEQ ID NO: 343181 - DNA, 20 bp, human
gcgaagcgcgcagtggacgg

SEQ ID NO: 343182 - DNA, 20 bp, human
gcccccggctcccaacgcgc

SEQ ID NO: 343183 - DNA, 20 bp, human
ggcggcactcagcatagcag

SEQ ID NO: 343184 - DNA, 20 bp, human
ggcagcggcgcctgcgcgtt

SEQ ID NO: 343185 - DNA, 20 bp, human
ggagcgaagcgcgcagtgga

SEQ ID NO: 343186 - DNA, 20 bp, human
gtgggggcggggcgagatga

SEQ ID NO: 343187 - DNA, 20 bp, human
gagggggcgaatctgggggc

SEQ ID NO: 343188 - DNA, 20 bp, human
ggcggggtgcgtccagggga

SEQ ID NO: 343189 - DNA, 20 bp, human
gaggcgaggcgagatgaggc

SEQ ID NO: 343190 - DNA, 20 bp, human
ggcgagatgagggtagtccg

SEQ ID NO: 343191 - DNA, 20 bp, human
gccgggaaggcggaaggctt

SEQ ID NO: 343192 - DNA, 20 bp, human
gcgaggttggccacgggatt

SEQ ID NO: 343193 - DNA, 20 bp, human
gccgtaggcgaggcgagatg

SEQ ID NO: 343194 - DNA, 20 bp, human
gcgagcccgggcgggcccgt

SEQ ID NO: 343195 - DNA, 20 bp, human
ggcgagatgaggctggccag

SEQ ID NO: 343196 - DNA, 20 bp, human
ggaggtccagggagattcgg

SEQ ID NO: 343197 - DNA, 20 bp, human
gacagcaaccaggaggtcca

SEQ ID NO: 343198 - DNA, 20 bp, human
ggggcgccagcattattcta

SEQ ID NO: 343199 - DNA, 20 bp, human
gtggcccttcctcccctgat

SEQ ID NO: 343200 - DNA, 20 bp, human
gcaggaggtccagggagatt

SEQ ID NO: 343201 - DNA, 20 bp, human
gtacacagaactaactggta

SEQ ID NO: 343202 - DNA, 20 bp, human
gccccgccccagactctaca

SEQ ID NO: 343203 - DNA, 20 bp, human
gtaagaaggcctgcggttgg

SEQ ID NO: 343204 - DNA, 20 bp, human
gtgcaagtaggggcgaaagc

SEQ ID NO: 343205 - DNA, 20 bp, human
gggggcggggctcagtaaga

SEQ ID NO: 343206 - DNA, 20 bp, human
gaggacccggagagtatgct

SEQ ID NO: 343207 - DNA, 20 bp, human
gaccaataggaagtaggcta

SEQ ID NO: 343208 - DNA, 20 bp, human
gggccagggaggacaagcac

SEQ ID NO: 343209 - DNA, 20 bp, human
gctcgccgcgggctggacga

SEQ ID NO: 343210 - DNA, 20 bp, human
gaacgaggctcaaggctgat

SEQ ID NO: 343211 - DNA, 20 bp, human
gacgacgggaacgaggctca

SEQ ID NO: 343212 - DNA, 20 bp, human
gccgccccagcatactctcc

SEQ ID NO: 343213 - DNA, 20 bp, human
gtggtcgagagaagtggagc

SEQ ID NO: 343214 - DNA, 20 bp, human
ggaagtaggctaaggcgcag

SEQ ID NO: 343215 - DNA, 20 bp, human
gatactctccgggtcctcgc

SEQ ID NO: 343216 - DNA, 20 bp, human
ggggtggatggcagttttaa

SEQ ID NO: 343217 - DNA, 20 bp, human
gcctgcgcaatccacctagg

SEQ ID NO: 343218 - DNA, 20 bp, human
ggggcggcgatgcacgtgac

SEQ ID NO: 343219 - DNA, 20 bp, human
gcacaccgggaaatggagtc

SEQ ID NO: 343220 - DNA, 20 bp, human
ggcccctgcgcaatccacct

SEQ ID NO: 343221 - DNA, 20 bp, human
gctgctccgggcggtgccag

SEQ ID NO: 343222 - DNA, 20 bp, human
ggatggcagttttaagggtt

SEQ ID NO: 343223 - DNA, 20 bp, human
ggcatctcgcttcgtggcaa

SEQ ID NO: 343224 - DNA, 20 bp, human
gggcgtgttagttgcttttc

SEQ ID NO: 343225 - DNA, 20 bp, human
gtggcaaaggcttgatttcc

SEQ ID NO: 343226 - DNA, 20 bp, human
ggagcatcgcgagtgacagt

SEQ ID NO: 343227 - DNA, 20 bp, human
gagtgacagtggggttctcc

SEQ ID NO: 343228 - DNA, 20 bp, human
gaggcgaagggggttcctca

SEQ ID NO: 343229 - DNA, 20 bp, human
ggccccttggtcacccacaa

SEQ ID NO: 343230 - DNA, 20 bp, human
gacagtggggttctccgggg

SEQ ID NO: 343231 - DNA, 20 bp, human
gtgagggaacccggaagggt

SEQ ID NO: 343232 - DNA, 20 bp, human
gctccgaagacccgggaact

SEQ ID NO: 343233 - DNA, 20 bp, human
gaagacgcggacctccgcgg

SEQ ID NO: 343234 - DNA, 20 bp, human
gaactaggcgaggaaggcgg

SEQ ID NO: 343235 - DNA, 20 bp, human
gtcaaggccgagactgtctg

SEQ ID NO: 343236 - DNA, 20 bp, human
ggcaggatctggagacggac

SEQ ID NO: 343237 - DNA, 20 bp, human
gacggtcagcacacagggtg

SEQ ID NO: 343238 - DNA, 20 bp, human
gggtgggggctgctagaggt

SEQ ID NO: 343239 - DNA, 20 bp, human
ggctccacggtcagcacaca

SEQ ID NO: 343240 - DNA, 20 bp, human
gagaagtggctggcaggatc

SEQ ID NO: 343241 - DNA, 20 bp, human
gacagggtgggggctgctag

SEQ ID NO: 343242 - DNA, 20 bp, human
gcaaccagtgccccaagctt

SEQ ID NO: 343243 - DNA, 20 bp, human
ggaccatgttaggaacatgc

SEQ ID NO: 343244 - DNA, 20 bp, human
gccaagcttgggacagtagc

SEQ ID NO: 343245 - DNA, 20 bp, human
ggcttgggacagtagcaggc

SEQ ID NO: 343246 - DNA, 20 bp, human
gtcaaggcccttcaagggac

SEQ ID NO: 343247 - DNA, 20 bp, human
gcctctccccttaccaggaa

SEQ ID NO: 343248 - DNA, 20 bp, human
gaacacggggtccttccgct

SEQ ID NO: 343249 - DNA, 20 bp, human
gtggaggcggagtacttccc

SEQ ID NO: 343250 - DNA, 20 bp, human
ggggctaggagccaagcgga

SEQ ID NO: 343251 - DNA, 20 bp, human
gcgtgttcaaggcccttcaa

SEQ ID NO: 343252 - DNA, 20 bp, human
ggggggcactagagtcaaca

SEQ ID NO: 343253 - DNA, 20 bp, human
gtcgccggaactcgcgtctg

SEQ ID NO: 343254 - DNA, 20 bp, human
gggacgggctaggagccaag

SEQ ID NO: 343255 - DNA, 20 bp, human
ggcccttcaagggacgggac

SEQ ID NO: 343256 - DNA, 20 bp, human
gacagtgttagggatagggt

SEQ ID NO: 343257 - DNA, 20 bp, human
gttgggaggacaagttgggt

SEQ ID NO: 343258 - DNA, 20 bp, human
gtggatacgtggaggggtgt

SEQ ID NO: 343259 - DNA, 20 bp, human
gcattcaagaccgggcaagg

SEQ ID NO: 343260 - DNA, 20 bp, human
gacccagttaatcctgattg

SEQ ID NO: 343261 - DNA, 20 bp, human
ggtcttgaatgtctgaactc

SEQ ID NO: 343262 - DNA, 20 bp, human
gaaaatacaagaattagaca

SEQ ID NO: 343263 - DNA, 20 bp, human
gaagaattagacagggacga

SEQ ID NO: 343264 - DNA, 20 bp, human
gtcagatatcacttgttgat

SEQ ID NO: 343265 - DNA, 20 bp, human
gttgattcatgaacttaata

SEQ ID NO: 343266 - DNA, 20 bp, human
gaaacaatgaggagagggca

SEQ ID NO: 343267 - DNA, 20 bp, human
ggagagggcaaggtaaccac

SEQ ID NO: 343268 - DNA, 20 bp, human
gtcttccaaacaatgaggag

SEQ ID NO: 343269 - DNA, 20 bp, human
ggcaatggttgaaaatgaat

SEQ ID NO: 343270 - DNA, 20 bp, human
gctgagatttagtgcagcaa

SEQ ID NO: 343271 - DNA, 20 bp, human
gctagagcctgtgaaagtta

SEQ ID NO: 343272 - DNA, 20 bp, human
gtctcgttcccattgtttta

SEQ ID NO: 343273 - DNA, 20 bp, human
gcatgcttgcagaagactaa

SEQ ID NO: 343274 - DNA, 20 bp, human
gctgcaagcatgtcaattgt

SEQ ID NO: 343275 - DNA, 20 bp, human
ggaagactaaagggactcct

SEQ ID NO: 343276 - DNA, 20 bp, human
gcctggccagggtggagcaa

SEQ ID NO: 343277 - DNA, 20 bp, human
gtctcccaacctccaaggag

SEQ ID NO: 343278 - DNA, 20 bp, human
gttgcccgctccttggaggt

SEQ ID NO: 343279 - DNA, 20 bp, human
gcaaaagtcactactctgtc

SEQ ID NO: 343280 - DNA, 20 bp, human
gagtgatcttgcccgctcct

SEQ ID NO: 343281 - DNA, 20 bp, human
gttcatccattgctccaccc

SEQ ID NO: 343282 - DNA, 20 bp, human
gctgcaggctctgctccctg

SEQ ID NO: 343283 - DNA, 20 bp, human
ggctctgggaagtgttacca

SEQ ID NO: 343284 - DNA, 20 bp, human
ggctccaccctggccaggcg

SEQ ID NO: 343285 - DNA, 20 bp, human
gcacccaactctattagctc

SEQ ID NO: 343286 - DNA, 20 bp, human
gttattttgagacagagaca

SEQ ID NO: 343287 - DNA, 20 bp, human
gcaagaaagtgacagtatta

SEQ ID NO: 343288 - DNA, 20 bp, human
gtcattcattcaaggctcgg

SEQ ID NO: 343289 - DNA, 20 bp, human
gtgaaatgaatatggatatc

SEQ ID NO: 343290 - DNA, 20 bp, human
gttgattcatgaaatgaata

SEQ ID NO: 343291 - DNA, 20 bp, human
gtcagataccactttttgat

SEQ ID NO: 343292 - DNA, 20 bp, human
gaattcattcattcaaggct

SEQ ID NO: 343293 - DNA, 20 bp, human
ggacagtattagggatagag

SEQ ID NO: 343294 - DNA, 20 bp, human
gtatggatatctggtatgaa

SEQ ID NO: 343295 - DNA, 20 bp, human
gctagcttccaatcaaaaag

SEQ ID NO: 343296 - DNA, 20 bp, human
ggggagggatgagggaaaga

SEQ ID NO: 343297 - DNA, 20 bp, human
gatccagtgagtagtaaata

SEQ ID NO: 343298 - DNA, 20 bp, human
ggccctgcctcctcactgct

SEQ ID NO: 343299 - DNA, 20 bp, human
gctgggagatgagattgcat

SEQ ID NO: 343300 - DNA, 20 bp, human
gtgcagcagaggcagaagcc

SEQ ID NO: 343301 - DNA, 20 bp, human
gtcccaagcagtgaggaggc

SEQ ID NO: 343302 - DNA, 20 bp, human
gcagtgagtagtaaatatgg

SEQ ID NO: 343303 - DNA, 20 bp, human
gctaatccctcccacctttg

SEQ ID NO: 343304 - DNA, 20 bp, human
gaagcatctcccaagcagtg

SEQ ID NO: 343305 - DNA, 20 bp, human
gctactcactggatgagcac

SEQ ID NO: 343306 - DNA, 20 bp, human
ggggccaaaagtcactactc

SEQ ID NO: 343307 - DNA, 20 bp, human
gtcccagagctaatagagtt

SEQ ID NO: 343308 - DNA, 20 bp, human
gaaacaatggtcatgtggct

SEQ ID NO: 343309 - DNA, 20 bp, human
gcagagctaatagagttggg

SEQ ID NO: 343310 - DNA, 20 bp, human
gctcctaacctccaaggaac

SEQ ID NO: 343311 - DNA, 20 bp, human
gatctaaaacaatggtcatg

SEQ ID NO: 343312 - DNA, 20 bp, human
gaaaatgtcttctcaattta

SEQ ID NO: 343313 - DNA, 20 bp, human
gagacattttttctcaaaaa

SEQ ID NO: 343314 - DNA, 20 bp, human
gatggtcatgtggctgggct

SEQ ID NO: 343315 - DNA, 20 bp, human
gatttaaggatctaaaacaa

SEQ ID NO: 343316 - DNA, 20 bp, human
ggggccaaaagtcactactc

SEQ ID NO: 343317 - DNA, 20 bp, human
gaaacaatggtcatgtggct

SEQ ID NO: 343318 - DNA, 20 bp, human
gtcccagagctaatagagtt

SEQ ID NO: 343319 - DNA, 20 bp, human
gcacccaactctattagctc

SEQ ID NO: 343320 - DNA, 20 bp, human
gctcctaacctccaaggaac

SEQ ID NO: 343321 - DNA, 20 bp, human
gatctaaaacaatggtcatg

SEQ ID NO: 343322 - DNA, 20 bp, human
gaaaatgtcttctcaattta

SEQ ID NO: 343323 - DNA, 20 bp, human
gagacattttttctcaaaaa

SEQ ID NO: 343324 - DNA, 20 bp, human
gatggtcatgtggctgggct

SEQ ID NO: 343325 - DNA, 20 bp, human
gatttaaggatctaaaacaa

SEQ ID NO: 343326 - DNA, 20 bp, human
gaggcagaatgctggcttaa

SEQ ID NO: 343327 - DNA, 20 bp, human
gggagaagataagattgcat

SEQ ID NO: 343328 - DNA, 20 bp, human
ggtaggaggggttcactttc

SEQ ID NO: 343329 - DNA, 20 bp, human
gactgagtacagggcagaat

SEQ ID NO: 343330 - DNA, 20 bp, human
gttaatggccactgagtaca

SEQ ID NO: 343331 - DNA, 20 bp, human
gcagtgactagtgagtgtgg

SEQ ID NO: 343332 - DNA, 20 bp, human
gtgaacccctcctaccattg

SEQ ID NO: 343333 - DNA, 20 bp, human
gtagtcactggatggagcac

SEQ ID NO: 343334 - DNA, 20 bp, human
gccgaagcagtgaggaagca

SEQ ID NO: 343335 - DNA, 20 bp, human
gacactcactagtcactgga

SEQ ID NO: 343336 - DNA, 20 bp, human
gctagagcacttggaaggtg

SEQ ID NO: 343337 - DNA, 20 bp, human
gagcacttggaaggtgcggg

SEQ ID NO: 343338 - DNA, 20 bp, human
ggtattctagagcacttgga

SEQ ID NO: 343339 - DNA, 20 bp, human
gagaaactataaaagcagtg

SEQ ID NO: 343340 - DNA, 20 bp, human
gggcagtattctagagcact

SEQ ID NO: 343341 - DNA, 20 bp, human
gtcgtcccctccttggtgtt

SEQ ID NO: 343342 - DNA, 20 bp, human
ggggcacagatacagatttg

SEQ ID NO: 343343 - DNA, 20 bp, human
gcaagtgcagaatggaactg

SEQ ID NO: 343344 - DNA, 20 bp, human
gtcttccaaacaccaaggag

SEQ ID NO: 343345 - DNA, 20 bp, human
gaatctcattgctctggtgg

SEQ ID NO: 343346 - DNA, 20 bp, human
gtgtgggttcaggttgaaaa

SEQ ID NO: 343347 - DNA, 20 bp, human
gaacagggcaggtcatatgt

SEQ ID NO: 343348 - DNA, 20 bp, human
ggcaggtcatatgtgggttc

SEQ ID NO: 343349 - DNA, 20 bp, human
ggggttttatgttttataac

SEQ ID NO: 343350 - DNA, 20 bp, human
gttatgttttataacagggc

SEQ ID NO: 343351 - DNA, 20 bp, human
gtcaatcaggactaactagg

SEQ ID NO: 343352 - DNA, 20 bp, human
ggaagctggtgattgagaag

SEQ ID NO: 343353 - DNA, 20 bp, human
ggactaactaggtggaactt

SEQ ID NO: 343354 - DNA, 20 bp, human
gggaacttcggaatctaatc

SEQ ID NO: 343355 - DNA, 20 bp, human
gaaagctcctgagtttgcaa

SEQ ID NO: 343356 - DNA, 20 bp, human
gtgtgggttcaggttgaaaa

SEQ ID NO: 343357 - DNA, 20 bp, human
gaacagggcaggtcatatgt

SEQ ID NO: 343358 - DNA, 20 bp, human
ggcaggtcatatgtgggttc

SEQ ID NO: 343359 - DNA, 20 bp, human
ggggttttatgttttataac

SEQ ID NO: 343360 - DNA, 20 bp, human
gttatgttttataacagggc

SEQ ID NO: 343361 - DNA, 20 bp, human
gtcaatcaggactaactagg

SEQ ID NO: 343362 - DNA, 20 bp, human
ggaagctggtgattgagaag

SEQ ID NO: 343363 - DNA, 20 bp, human
ggactaactaggtggaactt

SEQ ID NO: 343364 - DNA, 20 bp, human
gggaacttcggaatctaatc

SEQ ID NO: 343365 - DNA, 20 bp, human
gaaagctcctgagtttgcaa

SEQ ID NO: 343366 - DNA, 20 bp, human
gcacctgagctacccagggt

SEQ ID NO: 343367 - DNA, 20 bp, human
gctacccagggtgggatccc

SEQ ID NO: 343368 - DNA, 20 bp, human
gatcccaccctgggtagctc

SEQ ID NO: 343369 - DNA, 20 bp, human
gccagtcacctgagctaccc

SEQ ID NO: 343370 - DNA, 20 bp, human
gcgtgtcaggacagaggtcg

SEQ ID NO: 343371 - DNA, 20 bp, human
gttggggcgtgtcaggacag

SEQ ID NO: 343372 - DNA, 20 bp, human
ggggccgggtgccagatact

SEQ ID NO: 343373 - DNA, 20 bp, human
gggtgtccccgctcagatcc

SEQ ID NO: 343374 - DNA, 20 bp, human
gctcagatccaggcccgagt

SEQ ID NO: 343375 - DNA, 20 bp, human
gctgccgcttggggcgtgtc

SEQ ID NO: 343376 - DNA, 20 bp, human
ggctatctatgagatgtgtg

SEQ ID NO: 343377 - DNA, 20 bp, human
gctatccaactcatctctct

SEQ ID NO: 343378 - DNA, 20 bp, human
gctacaaccagcagtgaaga

SEQ ID NO: 343379 - DNA, 20 bp, human
gacttgaacaatggttttga

SEQ ID NO: 343380 - DNA, 20 bp, human
ggagtctcaaagaaaaataa

SEQ ID NO: 343381 - DNA, 20 bp, human
gtaaatagcacagtggaaag

SEQ ID NO: 343382 - DNA, 20 bp, human
gatcacaagagatggaaata

SEQ ID NO: 343383 - DNA, 20 bp, human
gcttctgctttgctcactgc

SEQ ID NO: 343384 - DNA, 20 bp, human
gttagtgtcttatttccaaa

SEQ ID NO: 343385 - DNA, 20 bp, human
gacagaaataaatagcacag

SEQ ID NO: 343386 - DNA, 20 bp, human
gtagcccagaggaacaggtt

SEQ ID NO: 343387 - DNA, 20 bp, human
gcaacccaacctgttcctct

SEQ ID NO: 343388 - DNA, 20 bp, human
gagagtcccagacagaaata

SEQ ID NO: 343389 - DNA, 20 bp, human
ggaaagcagaacccagtctc

SEQ ID NO: 343390 - DNA, 20 bp, human
ggtatcccttatttctgtct

SEQ ID NO: 343391 - DNA, 20 bp, human
gtgggcacacagatgacaga

SEQ ID NO: 343392 - DNA, 20 bp, human
ggctatctgggagatgtttg

SEQ ID NO: 343393 - DNA, 20 bp, human
ggagatagtttctgctatct

SEQ ID NO: 343394 - DNA, 20 bp, human
gtattgatcatcatcaccgc

SEQ ID NO: 343395 - DNA, 20 bp, human
gataaagaggagcagaacag

SEQ ID NO: 343396 - DNA, 20 bp, human
gaggcccacccagggctcaa

SEQ ID NO: 343397 - DNA, 20 bp, human
gacttgaataaaggttctaa

SEQ ID NO: 343398 - DNA, 20 bp, human
gacgactatgacttgaataa

SEQ ID NO: 343399 - DNA, 20 bp, human
gcaatggcacctttgagccc

SEQ ID NO: 343400 - DNA, 20 bp, human
gctgtcatctatgtgtgccc

SEQ ID NO: 343401 - DNA, 20 bp, human
ggtttctgttacctgtgtga

SEQ ID NO: 343402 - DNA, 20 bp, human
gttctgtgtaatatttgtgg

SEQ ID NO: 343403 - DNA, 20 bp, human
ggactctagcccagagggat

SEQ ID NO: 343404 - DNA, 20 bp, human
gagagtcccaaagagaaata

SEQ ID NO: 343405 - DNA, 20 bp, human
ggtatcccttatttctcttt

SEQ ID NO: 343406 - DNA, 20 bp, human
gcgcgggtgcgcaatcgggg

SEQ ID NO: 343407 - DNA, 20 bp, human
gcccctcgggctgaagtcgc

SEQ ID NO: 343408 - DNA, 20 bp, human
gaagtcgcgggtgcgcaatc

SEQ ID NO: 343409 - DNA, 20 bp, human
ggggtggggactcgcgagca

SEQ ID NO: 343410 - DNA, 20 bp, human
gggcctgggaagcgccggag

SEQ ID NO: 343411 - DNA, 20 bp, human
gggcgctccgatgaggtagc

SEQ ID NO: 343412 - DNA, 20 bp, human
gcgccactccggcgcttccc

SEQ ID NO: 343413 - DNA, 20 bp, human
ggcggggcggcgctccgatg

SEQ ID NO: 343414 - DNA, 20 bp, human
gccgatgaggtagctggctt

SEQ ID NO: 343415 - DNA, 20 bp, human
gggactcgcgagcagggcct

SEQ ID NO: 343416 - DNA, 20 bp, human
gactgccgtggtgaccggtg

SEQ ID NO: 343417 - DNA, 20 bp, human
ggaaacccgcctctgacgca

SEQ ID NO: 343418 - DNA, 20 bp, human
gccaggtgtccctgcgtcag

SEQ ID NO: 343419 - DNA, 20 bp, human
gaccacggcagtcactgaga

SEQ ID NO: 343420 - DNA, 20 bp, human
ggtgtccctgcgtcagaggc

SEQ ID NO: 343421 - DNA, 20 bp, human
gtagtcacctcggaattgtt

SEQ ID NO: 343422 - DNA, 20 bp, human
gcggcgggagttggagtccg

SEQ ID NO: 343423 - DNA, 20 bp, human
gcaagccccaccggtcacca

SEQ ID NO: 343424 - DNA, 20 bp, human
gccttgcgctgagatccctg

SEQ ID NO: 343425 - DNA, 20 bp, human
gtcgtcgcctaacaattccg

SEQ ID NO: 343426 - DNA, 20 bp, human
gagggtctgctcctggatct

SEQ ID NO: 343427 - DNA, 20 bp, human
gtgctgatgctcagtcccgg

SEQ ID NO: 343428 - DNA, 20 bp, human
gcgcgtgtgcacagaggcac

SEQ ID NO: 343429 - DNA, 20 bp, human
ggagagacgcgtgtgcacag

SEQ ID NO: 343430 - DNA, 20 bp, human
gagaaatggcagagcagctg

SEQ ID NO: 343431 - DNA, 20 bp, human
gccaaacgggcagtagcgtg

SEQ ID NO: 343432 - DNA, 20 bp, human
gaggcagagacatcgccgct

SEQ ID NO: 343433 - DNA, 20 bp, human
gtctctgctcaggatcatgc

SEQ ID NO: 343434 - DNA, 20 bp, human
ggtgtgcacagaggcacggg

SEQ ID NO: 343435 - DNA, 20 bp, human
gccagagctcatcctgtcac

SEQ ID NO: 343436 - DNA, 20 bp, human
gccgctggaggggagaacct

SEQ ID NO: 343437 - DNA, 20 bp, human
gccctccagcggtagggtca

SEQ ID NO: 343438 - DNA, 20 bp, human
gagactgggccttgcttgca

SEQ ID NO: 343439 - DNA, 20 bp, human
ggactgcagtagagtgaccc

SEQ ID NO: 343440 - DNA, 20 bp, human
gcatgccttgaccctaccgc

SEQ ID NO: 343441 - DNA, 20 bp, human
ggaggctcaagctgattagt

SEQ ID NO: 343442 - DNA, 20 bp, human
ggtggcattgagcacgtatt

SEQ ID NO: 343443 - DNA, 20 bp, human
gaactctgaaagtgccctgt

SEQ ID NO: 343444 - DNA, 20 bp, human
gggcgccttgaataactcct

SEQ ID NO: 343445 - DNA, 20 bp, human
gcagcggccccgaccttgtg

SEQ ID NO: 343446 - DNA, 20 bp, human
gaggcggtgtcctcggggat

SEQ ID NO: 343447 - DNA, 20 bp, human
ggatgggggcggagtggctg

SEQ ID NO: 343448 - DNA, 20 bp, human
gaaggagcagatggcacgag

SEQ ID NO: 343449 - DNA, 20 bp, human
ggagtggaggcggtgtcctc

SEQ ID NO: 343450 - DNA, 20 bp, human
ggcaatgaaggtgagtgcta

SEQ ID NO: 343451 - DNA, 20 bp, human
gagaggccctagcatgataa

SEQ ID NO: 343452 - DNA, 20 bp, human
ggaggccagcagaagcgcac

SEQ ID NO: 343453 - DNA, 20 bp, human
ggggaggagctgttttgcgg

SEQ ID NO: 343454 - DNA, 20 bp, human
gctcggggatgggggcggag

SEQ ID NO: 343455 - DNA, 20 bp, human
gtggggtgtgaccgcaatga

SEQ ID NO: 343456 - DNA, 20 bp, human
gaggacgcgggagattcgat

SEQ ID NO: 343457 - DNA, 20 bp, human
ggacgcacagtgactcggac

SEQ ID NO: 343458 - DNA, 20 bp, human
gtcacctgggggagaagacc

SEQ ID NO: 343459 - DNA, 20 bp, human
ggagccggagactcctaagg

SEQ ID NO: 343460 - DNA, 20 bp, human
gcgtcgcctgggcccgttcc

SEQ ID NO: 343461 - DNA, 20 bp, human
ggaagagccggagactccta

SEQ ID NO: 343462 - DNA, 20 bp, human
gtgcggcgccttcttctgat

SEQ ID NO: 343463 - DNA, 20 bp, human
gcgcgggagattcgattgga

SEQ ID NO: 343464 - DNA, 20 bp, human
gcccaggtgagctgggtaaa

SEQ ID NO: 343465 - DNA, 20 bp, human
ggattcgattggaaggctgc

SEQ ID NO: 343466 - DNA, 20 bp, human
gcggctgtgctagcaatctg

SEQ ID NO: 343467 - DNA, 20 bp, human
ggaaagccctgggctcggcc

SEQ ID NO: 343468 - DNA, 20 bp, human
ggggctcggccaggtggtgt

SEQ ID NO: 343469 - DNA, 20 bp, human
gctggcgcggcagaattagg

SEQ ID NO: 343470 - DNA, 20 bp, human
gtctgccgcgccaggaagga

SEQ ID NO: 343471 - DNA, 20 bp, human
gactcggctgcgcgaagtgg

SEQ ID NO: 343472 - DNA, 20 bp, human
gcaatctgggggaaagccct

SEQ ID NO: 343473 - DNA, 20 bp, human
gagagcccaagtaagcgttg

SEQ ID NO: 343474 - DNA, 20 bp, human
ggctaaggaaatcttaagca

SEQ ID NO: 343475 - DNA, 20 bp, human
gtcgcgcagccgagtggcta

SEQ ID NO: 343476 - DNA, 20 bp, human
gaacgctggggcgaactgac

SEQ ID NO: 343477 - DNA, 20 bp, human
gctagagacgagaaacgctg

SEQ ID NO: 343478 - DNA, 20 bp, human
gaagagtcgggttttctgat

SEQ ID NO: 343479 - DNA, 20 bp, human
gagcacgcgggccgcagcgg

SEQ ID NO: 343480 - DNA, 20 bp, human
gcagactgaataagcgtctc

SEQ ID NO: 343481 - DNA, 20 bp, human
gtggctgagagtagaaacgc

SEQ ID NO: 343482 - DNA, 20 bp, human
ggaccccaatgcgaagagtc

SEQ ID NO: 343483 - DNA, 20 bp, human
gaagacgcgcgggggtgagg

SEQ ID NO: 343484 - DNA, 20 bp, human
gcgtctctaggcacggcatg

SEQ ID NO: 343485 - DNA, 20 bp, human
ggggagcagcataaaaggcg

SEQ ID NO: 343486 - DNA, 20 bp, human
gcaaacaagcatgggatcaa

SEQ ID NO: 343487 - DNA, 20 bp, human
gaagttggctgcaaagatct

SEQ ID NO: 343488 - DNA, 20 bp, human
gaggctatttagagagtttc

SEQ ID NO: 343489 - DNA, 20 bp, human
gcccacagaagcggcggtgt

SEQ ID NO: 343490 - DNA, 20 bp, human
gctcacacccacagaagcgg

SEQ ID NO: 343491 - DNA, 20 bp, human
gcactgaggaaccaagaagt

SEQ ID NO: 343492 - DNA, 20 bp, human
gaaagagagactgggaccgc

SEQ ID NO: 343493 - DNA, 20 bp, human
gtgagtgaccaaacaagcat

SEQ ID NO: 343494 - DNA, 20 bp, human
gtcccacaccgccgcttctg

SEQ ID NO: 343495 - DNA, 20 bp, human
gggaacagctagagcacatg

SEQ ID NO: 343496 - DNA, 20 bp, human
gcccaagaggacatgtccca

SEQ ID NO: 343497 - DNA, 20 bp, human
gtgtaattgcagaggagtct

SEQ ID NO: 343498 - DNA, 20 bp, human
gtgggtgtggaggggttcca

SEQ ID NO: 343499 - DNA, 20 bp, human
gggagcaaggccaaatgtca

SEQ ID NO: 343500 - DNA, 20 bp, human
ggctatctgctcatcatgtt

SEQ ID NO: 343501 - DNA, 20 bp, human
gggtgcgttcatcaggaaga

SEQ ID NO: 343502 - DNA, 20 bp, human
gcccctgggacatgtcctct

SEQ ID NO: 343503 - DNA, 20 bp, human
gtagtgacatgtaattgcag

SEQ ID NO: 343504 - DNA, 20 bp, human
gcctggggagatcaggctga

SEQ ID NO: 343505 - DNA, 20 bp, human
ggcaatagaactgcaacccc

SEQ ID NO: 343506 - DNA, 20 bp, human
ggggaccaggctagacaaga

SEQ ID NO: 343507 - DNA, 20 bp, human
gcctgccctgcgcttcccac

SEQ ID NO: 343508 - DNA, 20 bp, human
ggccaaggggaagacggccc

SEQ ID NO: 343509 - DNA, 20 bp, human
gaatgaccccctgacgtcgg

SEQ ID NO: 343510 - DNA, 20 bp, human
gaggcctgatctatgttcac

SEQ ID NO: 343511 - DNA, 20 bp, human
gagccggggcagcaaagtaa

SEQ ID NO: 343512 - DNA, 20 bp, human
gcctctcgcacactcggccg

SEQ ID NO: 343513 - DNA, 20 bp, human
ggtcactgcggctcctataa

SEQ ID NO: 343514 - DNA, 20 bp, human
ggggatccgcgtggcaacta

SEQ ID NO: 343515 - DNA, 20 bp, human
gaggccggtgaacatagatc

SEQ ID NO: 343516 - DNA, 20 bp, human
gagcggggagaactcggcgg

SEQ ID NO: 343517 - DNA, 20 bp, human
gccccagcgagcaggcactt

SEQ ID NO: 343518 - DNA, 20 bp, human
ggctcacggcgacccctacc

SEQ ID NO: 343519 - DNA, 20 bp, human
gcaggcacttgggatggtgg

SEQ ID NO: 343520 - DNA, 20 bp, human
ggggagaactcggcggcggg

SEQ ID NO: 343521 - DNA, 20 bp, human
gagcgagcaggcacttggga

SEQ ID NO: 343522 - DNA, 20 bp, human
gcacgccggggtagaaagcc

SEQ ID NO: 343523 - DNA, 20 bp, human
gcacggcgacccctaccggg

SEQ ID NO: 343524 - DNA, 20 bp, human
gagcctgcccaaagcgaggc

SEQ ID NO: 343525 - DNA, 20 bp, human
gaagcccgccggcctagcga

SEQ ID NO: 343526 - DNA, 20 bp, human
gcggggcatcgacaggtcga

SEQ ID NO: 343527 - DNA, 20 bp, human
gactcgccgctggccttcta

SEQ ID NO: 343528 - DNA, 20 bp, human
gtgctcgccactagggtccc

SEQ ID NO: 343529 - DNA, 20 bp, human
gccaatggctgcggtgggcg

SEQ ID NO: 343530 - DNA, 20 bp, human
gcgagtcgagagtcggccaa

SEQ ID NO: 343531 - DNA, 20 bp, human
gcgaacacgtgtgctaccca

SEQ ID NO: 343532 - DNA, 20 bp, human
gcagagggcgagtcgagagt

SEQ ID NO: 343533 - DNA, 20 bp, human
ggagagtcggccaatggctg

SEQ ID NO: 343534 - DNA, 20 bp, human
ggggcggggagaagacgacg

SEQ ID NO: 343535 - DNA, 20 bp, human
gagttaagtgagcgacccca

SEQ ID NO: 343536 - DNA, 20 bp, human
gagggccgtgccacgtggga

SEQ ID NO: 343537 - DNA, 20 bp, human
gcggcagggccgtgccacgt

SEQ ID NO: 343538 - DNA, 20 bp, human
gaagaaacgcgtccgaggag

SEQ ID NO: 343539 - DNA, 20 bp, human
ggcccccctcccacgtggca

SEQ ID NO: 343540 - DNA, 20 bp, human
gcgagaccctggcgcggccg

SEQ ID NO: 343541 - DNA, 20 bp, human
gccgcgcgcggaattccctc

SEQ ID NO: 343542 - DNA, 20 bp, human
gccctgccgcccacgcgcgc

SEQ ID NO: 343543 - DNA, 20 bp, human
gaaacgcgtccgaggagagg

SEQ ID NO: 343544 - DNA, 20 bp, human
ggggacttgtagtccgcggg

SEQ ID NO: 343545 - DNA, 20 bp, human
gagggagctgcccgcgcgcg

SEQ ID NO: 343546 - DNA, 20 bp, human
gcggcggcggcgcgacgatg

SEQ ID NO: 343547 - DNA, 20 bp, human
gctgcgctgaaaaggggggg

SEQ ID NO: 343548 - DNA, 20 bp, human
ggagctgcgctgaaaagggg

SEQ ID NO: 343549 - DNA, 20 bp, human
gtccgagctgcgctgaaaag

SEQ ID NO: 343550 - DNA, 20 bp, human
gaatctgacacccctcgccg

SEQ ID NO: 343551 - DNA, 20 bp, human
gagtgagacgaagaccgaga

SEQ ID NO: 343552 - DNA, 20 bp, human
ggccgcctcggcgcgggatt

SEQ ID NO: 343553 - DNA, 20 bp, human
gccccaatcccgcgccgagg

SEQ ID NO: 343554 - DNA, 20 bp, human
gacgaagaccgagaaggccg

SEQ ID NO: 343555 - DNA, 20 bp, human
gccagccggggccgaagatg

SEQ ID NO: 343556 - DNA, 20 bp, human
gacctatgttaaactctggt

SEQ ID NO: 343557 - DNA, 20 bp, human
gaaggtcttgggcaatgtac

SEQ ID NO: 343558 - DNA, 20 bp, human
gctctggtgggataattccg

SEQ ID NO: 343559 - DNA, 20 bp, human
gcaagtgttagtttgattat

SEQ ID NO: 343560 - DNA, 20 bp, human
gaagcacatataaaatgtgt

SEQ ID NO: 343561 - DNA, 20 bp, human
ggggtttagtgactcttaca

SEQ ID NO: 343562 - DNA, 20 bp, human
gtaagacctatgttaaactc

SEQ ID NO: 343563 - DNA, 20 bp, human
gaaagagctgaattacttct

SEQ ID NO: 343564 - DNA, 20 bp, human
ggtgttagtttgattatagg

SEQ ID NO: 343565 - DNA, 20 bp, human
gttatagggggcagtctgtc

SEQ ID NO: 343566 - DNA, 20 bp, human
gcgcacgcgcggaggggcct

SEQ ID NO: 343567 - DNA, 20 bp, human
gagggcgcacgcacgagggg

SEQ ID NO: 343568 - DNA, 20 bp, human
gacccggccggatggagacg

SEQ ID NO: 343569 - DNA, 20 bp, human
ggcactggccgcgagaggct

SEQ ID NO: 343570 - DNA, 20 bp, human
gtggccgcgagaggctcggc

SEQ ID NO: 343571 - DNA, 20 bp, human
ggggagggcgcacgcacgag

SEQ ID NO: 343572 - DNA, 20 bp, human
ggagcggcgggcgctgagag

SEQ ID NO: 343573 - DNA, 20 bp, human
gccgcgcgtgcgcacggcag

SEQ ID NO: 343574 - DNA, 20 bp, human
ggatggagacgcggaactcc

SEQ ID NO: 343575 - DNA, 20 bp, human
gctcccggccgagcctctcg

SEQ ID NO: 343576 - DNA, 20 bp, human
gcccgacccgggacgaggag

SEQ ID NO: 343577 - DNA, 20 bp, human
gcccccgcagcaggaatggc

SEQ ID NO: 343578 - DNA, 20 bp, human
gggtcagagccgccaacttc

SEQ ID NO: 343579 - DNA, 20 bp, human
gcgccgccgcgccggggcta

SEQ ID NO: 343580 - DNA, 20 bp, human
gagcacccctagccccggcg

SEQ ID NO: 343581 - DNA, 20 bp, human
gcccagggcctcaaacccgg

SEQ ID NO: 343582 - DNA, 20 bp, human
gtcccgggtcgggctcggcc

SEQ ID NO: 343583 - DNA, 20 bp, human
gggaacgcacgccgccgcgc

SEQ ID NO: 343584 - DNA, 20 bp, human
gctgctccgggcttcgcgcc

SEQ ID NO: 343585 - DNA, 20 bp, human
gggaatggcaggaacggatc

SEQ ID NO: 343586 - DNA, 20 bp, human
gttgtgcgggaaaggcgctc

SEQ ID NO: 343587 - DNA, 20 bp, human
gggaggagtttgtgcgggaa

SEQ ID NO: 343588 - DNA, 20 bp, human
gcgctctggcgatgtgggtc

SEQ ID NO: 343589 - DNA, 20 bp, human
gaaaggcgctctggcgatgt

SEQ ID NO: 343590 - DNA, 20 bp, human
ggctctggcagcttcccggc

SEQ ID NO: 343591 - DNA, 20 bp, human
gcccagaaaagacatatcat

SEQ ID NO: 343592 - DNA, 20 bp, human
gtatgttagaggttgcgtgg

SEQ ID NO: 343593 - DNA, 20 bp, human
gacgtcacgccaaaaaaaca

SEQ ID NO: 343594 - DNA, 20 bp, human
gctgccagagcgtggaacca

SEQ ID NO: 343595 - DNA, 20 bp, human
gagcgtggaaccaaggagcc

SEQ ID NO: 343596 - DNA, 20 bp, human
gagtacccccagacctccct

SEQ ID NO: 343597 - DNA, 20 bp, human
ggtgttcagagcaggaagac

SEQ ID NO: 343598 - DNA, 20 bp, human
gagcaggaagactgggttcc

SEQ ID NO: 343599 - DNA, 20 bp, human
gtctgaacaccccagccaga

SEQ ID NO: 343600 - DNA, 20 bp, human
ggaagacagagccttgttct

SEQ ID NO: 343601 - DNA, 20 bp, human
gtaggagctgggagactcag

SEQ ID NO: 343602 - DNA, 20 bp, human
gtccaaatgagccaagctgc

SEQ ID NO: 343603 - DNA, 20 bp, human
ggagagccagaggagtctca

SEQ ID NO: 343604 - DNA, 20 bp, human
ggcagggttctgttttagcg

SEQ ID NO: 343605 - DNA, 20 bp, human
gcccctgactgctgggactt

SEQ ID NO: 343606 - DNA, 20 bp, human
gggtaggcgctcaggatctg

SEQ ID NO: 343607 - DNA, 20 bp, human
gaggaggggaaaatcgtttc

SEQ ID NO: 343608 - DNA, 20 bp, human
gaggcgttgccacccggggt

SEQ ID NO: 343609 - DNA, 20 bp, human
gccacccggggtaggcgctc

SEQ ID NO: 343610 - DNA, 20 bp, human
ggggcccgagctttaggagg

SEQ ID NO: 343611 - DNA, 20 bp, human
gggccgggacgctctctgag

SEQ ID NO: 343612 - DNA, 20 bp, human
gtggcccagcaaagagttaa

SEQ ID NO: 343613 - DNA, 20 bp, human
ggatcctgagcgcctacccc

SEQ ID NO: 343614 - DNA, 20 bp, human
gagttaaagggaggggacgt

SEQ ID NO: 343615 - DNA, 20 bp, human
gcctctgggactgctaggag

SEQ ID NO: 343616 - DNA, 20 bp, human
gaaaagagaggggatcctcc

SEQ ID NO: 343617 - DNA, 20 bp, human
gcccagctctccatccccgg

SEQ ID NO: 343618 - DNA, 20 bp, human
gggagtgggatggacaaggt

SEQ ID NO: 343619 - DNA, 20 bp, human
ggggctgccctgtaatcggc

SEQ ID NO: 343620 - DNA, 20 bp, human
gtgagcgtgtaggagtgctt

SEQ ID NO: 343621 - DNA, 20 bp, human
gtaccgggctgccctgtaat

SEQ ID NO: 343622 - DNA, 20 bp, human
gctcaagtcccgccgattac

SEQ ID NO: 343623 - DNA, 20 bp, human
gagcgggtgtgtgagcgtgt

SEQ ID NO: 343624 - DNA, 20 bp, human
ggcaggtttagcaaaagaga

SEQ ID NO: 343625 - DNA, 20 bp, human
gacccgctgtccgtcagaag

SEQ ID NO: 343626 - DNA, 20 bp, human
gcagtcaggaggcgctaaat

SEQ ID NO: 343627 - DNA, 20 bp, human
gtcaggaggcgctaaatggg

SEQ ID NO: 343628 - DNA, 20 bp, human
ggagggaccttcctcagggg

SEQ ID NO: 343629 - DNA, 20 bp, human
gaatcccctctgggagggga

SEQ ID NO: 343630 - DNA, 20 bp, human
gacgggcacaacccggtttg

SEQ ID NO: 343631 - DNA, 20 bp, human
gcgcgcaggcgcagtttcga

SEQ ID NO: 343632 - DNA, 20 bp, human
gacaacccggtttggggctc

SEQ ID NO: 343633 - DNA, 20 bp, human
ggaggggagggaccttcctc

SEQ ID NO: 343634 - DNA, 20 bp, human
gcacctcctgagccccaaac

SEQ ID NO: 343635 - DNA, 20 bp, human
gcacgcaatcccctctggga

SEQ ID NO: 343636 - DNA, 20 bp, human
ggcgccccgccggaatgact

SEQ ID NO: 343637 - DNA, 20 bp, human
gtccgcacccgccccaacga

SEQ ID NO: 343638 - DNA, 20 bp, human
gactcggcgctttccctcgt

SEQ ID NO: 343639 - DNA, 20 bp, human
gagggaaagttcatcttggg

SEQ ID NO: 343640 - DNA, 20 bp, human
gcgctttccctcgttggggc

SEQ ID NO: 343641 - DNA, 20 bp, human
gtcagccatccgcaacaggg

SEQ ID NO: 343642 - DNA, 20 bp, human
ggaggaagaaaacaattatg

SEQ ID NO: 343643 - DNA, 20 bp, human
gcagagggaaagttcatctt

SEQ ID NO: 343644 - DNA, 20 bp, human
gtaagccatgagggttactg

SEQ ID NO: 343645 - DNA, 20 bp, human
gctcccgaacccgaacgctt

SEQ ID NO: 343646 - DNA, 20 bp, human
ggggggagacgcgttgcctt

SEQ ID NO: 343647 - DNA, 20 bp, human
gtccactgcgcccgcaggtg

SEQ ID NO: 343648 - DNA, 20 bp, human
ggcgggcgcattacccacgc

SEQ ID NO: 343649 - DNA, 20 bp, human
gaccactgcacctgcccgcg

SEQ ID NO: 343650 - DNA, 20 bp, human
ggccgggtccatgcgcctgc

SEQ ID NO: 343651 - DNA, 20 bp, human
gactgcgcccgcaggtgcgg

SEQ ID NO: 343652 - DNA, 20 bp, human
ggtgcagtggtcccggccga

SEQ ID NO: 343653 - DNA, 20 bp, human
ggcagccagcaggagaagta

SEQ ID NO: 343654 - DNA, 20 bp, human
ggcgcattacccacgcgggc

SEQ ID NO: 343655 - DNA, 20 bp, human
gagacgcgttgccttcggcc

SEQ ID NO: 343656 - DNA, 20 bp, human
gggcccgctcaccaccccgt

SEQ ID NO: 343657 - DNA, 20 bp, human
gtcagggtctccaggaggcg

SEQ ID NO: 343658 - DNA, 20 bp, human
ggggcctacggggtggtgag

SEQ ID NO: 343659 - DNA, 20 bp, human
gcgcaggggcggggcctacg

SEQ ID NO: 343660 - DNA, 20 bp, human
ggagggagaaattcccttta

SEQ ID NO: 343661 - DNA, 20 bp, human
gagcgggccctctgctggtg

SEQ ID NO: 343662 - DNA, 20 bp, human
gtgcttgggcaagtgacacg

SEQ ID NO: 343663 - DNA, 20 bp, human
gcctttaaggctgaatgctt

SEQ ID NO: 343664 - DNA, 20 bp, human
gttaaggttggggcgacagt

SEQ ID NO: 343665 - DNA, 20 bp, human
gtggtgagcgggccctctgc

SEQ ID NO: 343666 - DNA, 20 bp, human
ggggacgcaggcgcaaatgc

SEQ ID NO: 343667 - DNA, 20 bp, human
gtcccgcggctgaccaggac

SEQ ID NO: 343668 - DNA, 20 bp, human
ggcaaatgcaggcttgggat

SEQ ID NO: 343669 - DNA, 20 bp, human
ggggcggggagcagataggg

SEQ ID NO: 343670 - DNA, 20 bp, human
ggcggggcggggagcagata

SEQ ID NO: 343671 - DNA, 20 bp, human
gtcccggtcctggtcagccg

SEQ ID NO: 343672 - DNA, 20 bp, human
gcggccggcgcccacgtggc

SEQ ID NO: 343673 - DNA, 20 bp, human
gtgggcaacgctcccggtcc

SEQ ID NO: 343674 - DNA, 20 bp, human
ggccgcgccccggttcgcgc

SEQ ID NO: 343675 - DNA, 20 bp, human
gcacacaagcccctcacaag

SEQ ID NO: 343676 - DNA, 20 bp, human
gcgcgcctgcgcagtggagg

SEQ ID NO: 343677 - DNA, 20 bp, human
ggcacagcggcgacaccctg

SEQ ID NO: 343678 - DNA, 20 bp, human
ggcgacaccctgcggaaggc

SEQ ID NO: 343679 - DNA, 20 bp, human
ggcaaacgaggcgtgggtcc

SEQ ID NO: 343680 - DNA, 20 bp, human
gccagcacccagtgcaaacg

SEQ ID NO: 343681 - DNA, 20 bp, human
gacccagtgcaaacgaggcg

SEQ ID NO: 343682 - DNA, 20 bp, human
gtccactgcgcaggcgcgag

SEQ ID NO: 343683 - DNA, 20 bp, human
ggacgcaactacaaatgggg

SEQ ID NO: 343684 - DNA, 20 bp, human
gggcaccgctagcggcacag

SEQ ID NO: 343685 - DNA, 20 bp, human
ggcaggcggggcaccgctag

SEQ ID NO: 343686 - DNA, 20 bp, human
gcgcgcggaggaataaacga

SEQ ID NO: 343687 - DNA, 20 bp, human
gggcgcgagctggactaccg

SEQ ID NO: 343688 - DNA, 20 bp, human
ggcgccaccaacagcgaccg

SEQ ID NO: 343689 - DNA, 20 bp, human
gaaggatgccacctagtcgc

SEQ ID NO: 343690 - DNA, 20 bp, human
gctaccgcggtcgctgttgg

SEQ ID NO: 343691 - DNA, 20 bp, human
gcacctagtcgcaggcccgg

SEQ ID NO: 343692 - DNA, 20 bp, human
gggactaccgcggtcgctgt

SEQ ID NO: 343693 - DNA, 20 bp, human
gtctctgcacacgtgatgcg

SEQ ID NO: 343694 - DNA, 20 bp, human
gcggacccgtgcagcgccca

SEQ ID NO: 343695 - DNA, 20 bp, human
gaggaaggcgagccccaagg

SEQ ID NO: 343696 - DNA, 20 bp, human
gtctgcctccgcgccagggg

SEQ ID NO: 343697 - DNA, 20 bp, human
ggaggaggtggagccaatgg

SEQ ID NO: 343698 - DNA, 20 bp, human
gcgcggggccgcgtttcccg

SEQ ID NO: 343699 - DNA, 20 bp, human
ggactctgcctccgcgccag

SEQ ID NO: 343700 - DNA, 20 bp, human
gttctccacccctggcgcgg

SEQ ID NO: 343701 - DNA, 20 bp, human
gaaatggcgaagtcggtgct

SEQ ID NO: 343702 - DNA, 20 bp, human
gtctgcgagaccgacttgga

SEQ ID NO: 343703 - DNA, 20 bp, human
ggacacgcgtcagcactagc

SEQ ID NO: 343704 - DNA, 20 bp, human
gcgcatgcgcacctgtctcg

SEQ ID NO: 343705 - DNA, 20 bp, human
ggggccgcgtttcccggggc

SEQ ID NO: 343706 - DNA, 20 bp, human
ggcttaagctccgttctggc

SEQ ID NO: 343707 - DNA, 20 bp, human
gtcgagcccgacgcgctgtc

SEQ ID NO: 343708 - DNA, 20 bp, human
gttgcgggagaccccaggtt

SEQ ID NO: 343709 - DNA, 20 bp, human
gggaagcggtggctactgtg

SEQ ID NO: 343710 - DNA, 20 bp, human
gcccggcttaagctccgttc

SEQ ID NO: 343711 - DNA, 20 bp, human
gcccgcgccacgtgaccttg

SEQ ID NO: 343712 - DNA, 20 bp, human
gggagaccccaggttcggtt

SEQ ID NO: 343713 - DNA, 20 bp, human
ggggaatcccaaccgaacct

SEQ ID NO: 343714 - DNA, 20 bp, human
gcctggggtctcccgcaacc

SEQ ID NO: 343715 - DNA, 20 bp, human
gccctcgggcagtctcttag

SEQ ID NO: 343716 - DNA, 20 bp, human
gactctggcagtaggggcgt

SEQ ID NO: 343717 - DNA, 20 bp, human
gcccctactgccagagtccg

SEQ ID NO: 343718 - DNA, 20 bp, human
ggcctggggttacagagcgc

SEQ ID NO: 343719 - DNA, 20 bp, human
gggccccgcggtctccacgc

SEQ ID NO: 343720 - DNA, 20 bp, human
ggccgccagcgtggagaccg

SEQ ID NO: 343721 - DNA, 20 bp, human
gcggccgcgggagggcacca

SEQ ID NO: 343722 - DNA, 20 bp, human
gggagcgctcccagagcacc

SEQ ID NO: 343723 - DNA, 20 bp, human
ggcggggccccgggtgctct

SEQ ID NO: 343724 - DNA, 20 bp, human
gtggggttacagagcgcggg

SEQ ID NO: 343725 - DNA, 20 bp, human
gcacactcggacagccacat

SEQ ID NO: 343726 - DNA, 20 bp, human
ggaggggcagatcataggga

SEQ ID NO: 343727 - DNA, 20 bp, human
ggggcagatcatagggaggg

SEQ ID NO: 343728 - DNA, 20 bp, human
gggacccagccatccagtcc

SEQ ID NO: 343729 - DNA, 20 bp, human
gggggtggggaggttagctt

SEQ ID NO: 343730 - DNA, 20 bp, human
gctaacctccccaccccaat

SEQ ID NO: 343731 - DNA, 20 bp, human
gggtgtgtggatgaagtctt

SEQ ID NO: 343732 - DNA, 20 bp, human
gtccccaccccaataggatc

SEQ ID NO: 343733 - DNA, 20 bp, human
gctgctgccgcttctggaga

SEQ ID NO: 343734 - DNA, 20 bp, human
ggcaaagggagtggagtctc

SEQ ID NO: 343735 - DNA, 20 bp, human
gagaaggcaaggcgattgtt

SEQ ID NO: 343736 - DNA, 20 bp, human
ggcgcggccaaagagaggca

SEQ ID NO: 343737 - DNA, 20 bp, human
gcggccggcgatcctgcaga

SEQ ID NO: 343738 - DNA, 20 bp, human
gcggcggcggcaagagggag

SEQ ID NO: 343739 - DNA, 20 bp, human
ggctccctctgcaggatcgc

SEQ ID NO: 343740 - DNA, 20 bp, human
ggggacccggcctcggtgga

SEQ ID NO: 343741 - DNA, 20 bp, human
ggcgtgggcgagcgcgtagc

SEQ ID NO: 343742 - DNA, 20 bp, human
gaccgagcgtgcgctaaggc

SEQ ID NO: 343743 - DNA, 20 bp, human
gcccgcgccgcccgggcgca

SEQ ID NO: 343744 - DNA, 20 bp, human
gctcccggcctcgcagacag

SEQ ID NO: 343745 - DNA, 20 bp, human
gcatcagcaaggaaaccctg

SEQ ID NO: 343746 - DNA, 20 bp, human
gttgagtgagggcggaccag

SEQ ID NO: 343747 - DNA, 20 bp, human
gggatgagagagctgtggca

SEQ ID NO: 343748 - DNA, 20 bp, human
gagagcgcgcatgcctggtc

SEQ ID NO: 343749 - DNA, 20 bp, human
gggagggtgccgggcgtcac

SEQ ID NO: 343750 - DNA, 20 bp, human
gaccctccctccaccggacc

SEQ ID NO: 343751 - DNA, 20 bp, human
gacccagagccgcctagagc

SEQ ID NO: 343752 - DNA, 20 bp, human
ggtggtcaaggagtcttctt

SEQ ID NO: 343753 - DNA, 20 bp, human
ggctgcaaaccagctctagg

SEQ ID NO: 343754 - DNA, 20 bp, human
gactcgcgactccatctcac

SEQ ID NO: 343755 - DNA, 20 bp, human
gcgcatgcctggtccggtgg

SEQ ID NO: 343756 - DNA, 20 bp, human
gcacgcgcagagcgcctctg

SEQ ID NO: 343757 - DNA, 20 bp, human
gcgcgtgcacggggcccctg

SEQ ID NO: 343758 - DNA, 20 bp, human
gctccgcggggcccttccgg

SEQ ID NO: 343759 - DNA, 20 bp, human
gacgccgcgctcggccgcag

SEQ ID NO: 343760 - DNA, 20 bp, human
gacccccgagcttccgacgg

SEQ ID NO: 343761 - DNA, 20 bp, human
gcgggagggggcggccctcg

SEQ ID NO: 343762 - DNA, 20 bp, human
gccgacccccgagcttccga

SEQ ID NO: 343763 - DNA, 20 bp, human
gaggcgctctgcgcgtgcac

SEQ ID NO: 343764 - DNA, 20 bp, human
gctcggggctcccagacggc

SEQ ID NO: 343765 - DNA, 20 bp, human
ggcctccgtcggaagctcgg

SEQ ID NO: 343766 - DNA, 20 bp, human
gactccaaggcgcagctcga

SEQ ID NO: 343767 - DNA, 20 bp, human
gctctgcagaggaaactcct

SEQ ID NO: 343768 - DNA, 20 bp, human
gaaaaaggaaacacaaccct

SEQ ID NO: 343769 - DNA, 20 bp, human
gctggggaagtactgcgtac

SEQ ID NO: 343770 - DNA, 20 bp, human
gcaactgagaatagttcaca

SEQ ID NO: 343771 - DNA, 20 bp, human
gtaaagttaaacaatagcgg

SEQ ID NO: 343772 - DNA, 20 bp, human
gtaaccctcgagctgcgcct

SEQ ID NO: 343773 - DNA, 20 bp, human
gttgatatggaactcacagg

SEQ ID NO: 343774 - DNA, 20 bp, human
ggggctgaaatcccggcgcg

SEQ ID NO: 343775 - DNA, 20 bp, human
gcacttgatatggaactcac

SEQ ID NO: 343776 - DNA, 20 bp, human
gtcagtggggagccggatga

SEQ ID NO: 343777 - DNA, 20 bp, human
gcctgctgctcgcttcctga

SEQ ID NO: 343778 - DNA, 20 bp, human
gctgccgagtagagctgctg

SEQ ID NO: 343779 - DNA, 20 bp, human
gactcagggcacacaggcgg

SEQ ID NO: 343780 - DNA, 20 bp, human
gctccccactgacagccctc

SEQ ID NO: 343781 - DNA, 20 bp, human
gaagaggcaagcagaggcgg

SEQ ID NO: 343782 - DNA, 20 bp, human
gttcctgagggctgtcagtg

SEQ ID NO: 343783 - DNA, 20 bp, human
gggcctgttcatcaacacca

SEQ ID NO: 343784 - DNA, 20 bp, human
gagggtgggtgcttgtggga

SEQ ID NO: 343785 - DNA, 20 bp, human
gggccctggtgttgatgaac

SEQ ID NO: 343786 - DNA, 20 bp, human
gggagatagcaaggctgata

SEQ ID NO: 343787 - DNA, 20 bp, human
ggcccctgggttcctgaagt

SEQ ID NO: 343788 - DNA, 20 bp, human
ggggttcctgaagtgggtat

SEQ ID NO: 343789 - DNA, 20 bp, human
ggggccatctggaacagctc

SEQ ID NO: 343790 - DNA, 20 bp, human
gagaacgcagcaaaccctga

SEQ ID NO: 343791 - DNA, 20 bp, human
gctgtcagagggagatagca

SEQ ID NO: 343792 - DNA, 20 bp, human
gccttggaggaacttccccc

SEQ ID NO: 343793 - DNA, 20 bp, human
gacccacttcaggaacccag

SEQ ID NO: 343794 - DNA, 20 bp, human
gcaggaacccaggggccatc

SEQ ID NO: 343795 - DNA, 20 bp, human
gaaagacccaggaaggtctc

SEQ ID NO: 343796 - DNA, 20 bp, human
gggtgtggggtacccaaaca

SEQ ID NO: 343797 - DNA, 20 bp, human
gcaaggcagtaggccccagg

SEQ ID NO: 343798 - DNA, 20 bp, human
gggtacccaaacaaggcagt

SEQ ID NO: 343799 - DNA, 20 bp, human
ggggccttctgaagcaaacc

SEQ ID NO: 343800 - DNA, 20 bp, human
gaggacagagtgggggacaa

SEQ ID NO: 343801 - DNA, 20 bp, human
gctgaagcaaaccagggtgt

SEQ ID NO: 343802 - DNA, 20 bp, human
ggcacactatgcccctagga

SEQ ID NO: 343803 - DNA, 20 bp, human
gtgtcctggagcaatcattc

SEQ ID NO: 343804 - DNA, 20 bp, human
gagagtgaagtggagatccc

SEQ ID NO: 343805 - DNA, 20 bp, human
gtggggcctactgccttgtt

SEQ ID NO: 343806 - DNA, 20 bp, human
gttcatctcaccactaactt

SEQ ID NO: 343807 - DNA, 20 bp, human
gactgtcaataacgtggctg

SEQ ID NO: 343808 - DNA, 20 bp, human
gtaaaactctagccaaagta

SEQ ID NO: 343809 - DNA, 20 bp, human
gctgagatggtaaatagctc

SEQ ID NO: 343810 - DNA, 20 bp, human
gggcccagacgactagactt

SEQ ID NO: 343811 - DNA, 20 bp, human
gggcccttttccaataaatg

SEQ ID NO: 343812 - DNA, 20 bp, human
gtaaagtcttgtttcaagaa

SEQ ID NO: 343813 - DNA, 20 bp, human
ggaggaaagtttgatttcat

SEQ ID NO: 343814 - DNA, 20 bp, human
gtataagactcccaggacgt

SEQ ID NO: 343815 - DNA, 20 bp, human
gtaatgcaagcctaagttag

SEQ ID NO: 343816 - DNA, 20 bp, human
gtcagcaggaagggttgggt

SEQ ID NO: 343817 - DNA, 20 bp, human
gggaactgtgtccaagcagt

SEQ ID NO: 343818 - DNA, 20 bp, human
gagtcatagttgtgcctttt

SEQ ID NO: 343819 - DNA, 20 bp, human
gtttgtgtctaattcctaaa

SEQ ID NO: 343820 - DNA, 20 bp, human
gttgaactttagacatcttt

SEQ ID NO: 343821 - DNA, 20 bp, human
ggtgaggacagcacactccc

SEQ ID NO: 343822 - DNA, 20 bp, human
gtgacactgtgccgactgct

SEQ ID NO: 343823 - DNA, 20 bp, human
gcttatctgtgagatgtgtg

SEQ ID NO: 343824 - DNA, 20 bp, human
gatttttcatgtaacagaga

SEQ ID NO: 343825 - DNA, 20 bp, human
gagtttgtgtgggtgtgtcg

SEQ ID NO: 343826 - DNA, 20 bp, human
gagcctagcaggaagggttg

SEQ ID NO: 343827 - DNA, 20 bp, human
ggactctagcctagcaggaa

SEQ ID NO: 343828 - DNA, 20 bp, human
gcctcctcgcctcagagact

SEQ ID NO: 343829 - DNA, 20 bp, human
gtgtgaggacagcacactgc

SEQ ID NO: 343830 - DNA, 20 bp, human
ggctgtcctcacacaactca

SEQ ID NO: 343831 - DNA, 20 bp, human
gcttatccgtgagttgtgtg

SEQ ID NO: 343832 - DNA, 20 bp, human
gctagcaggaagggttgggg

SEQ ID NO: 343833 - DNA, 20 bp, human
gttggggaggatgttgtttg

SEQ ID NO: 343834 - DNA, 20 bp, human
gtctgggactctagcctagc

SEQ ID NO: 343835 - DNA, 20 bp, human
ggtgggtgtgtcagggggtt

SEQ ID NO: 343836 - DNA, 20 bp, human
ggggcccgacctcgctttca

SEQ ID NO: 343837 - DNA, 20 bp, human
gcggccctgaaagcgaggtc

SEQ ID NO: 343838 - DNA, 20 bp, human
ggccgagccggggtacgcgt

SEQ ID NO: 343839 - DNA, 20 bp, human
gcgcgcgcccacgcgtaccc

SEQ ID NO: 343840 - DNA, 20 bp, human
gcccagcggcctcgatcccg

SEQ ID NO: 343841 - DNA, 20 bp, human
gctgcgagcaggcctgggac

SEQ ID NO: 343842 - DNA, 20 bp, human
gcccggcgcgagcgaaaacg

SEQ ID NO: 343843 - DNA, 20 bp, human
gcggctcggccctgaaagcg

SEQ ID NO: 343844 - DNA, 20 bp, human
ggctccacgcgcagccagtg

SEQ ID NO: 343845 - DNA, 20 bp, human
gcggtccagagtcgcaagtg

SEQ ID NO: 343846 - DNA, 20 bp, human
gggtccctgcccctaggctg

SEQ ID NO: 343847 - DNA, 20 bp, human
gaggctggggacaagggtga

SEQ ID NO: 343848 - DNA, 20 bp, human
gggttcgccccgcggtccac

SEQ ID NO: 343849 - DNA, 20 bp, human
gcccagccgggtgcggggga

SEQ ID NO: 343850 - DNA, 20 bp, human
ggggaagagccggtggaccg

SEQ ID NO: 343851 - DNA, 20 bp, human
gccgcggggcgaacccggga

SEQ ID NO: 343852 - DNA, 20 bp, human
ggccgggagttgtgcccagt

SEQ ID NO: 343853 - DNA, 20 bp, human
gggtgagggacgagccttca

SEQ ID NO: 343854 - DNA, 20 bp, human
gtacctggtcccgcccctga

SEQ ID NO: 343855 - DNA, 20 bp, human
gtgcgctccggagcgagccg

SEQ ID NO: 343856 - DNA, 20 bp, human
gctttcccgcggggcactcc

SEQ ID NO: 343857 - DNA, 20 bp, human
ggtagcccggagtgccccgc

SEQ ID NO: 343858 - DNA, 20 bp, human
ggtaaacctgacaccctcgt

SEQ ID NO: 343859 - DNA, 20 bp, human
gaggtgaactgcacgtagcc

SEQ ID NO: 343860 - DNA, 20 bp, human
gaagccccaggtcccgtgag

SEQ ID NO: 343861 - DNA, 20 bp, human
ggggcttgaaggttctgtag

SEQ ID NO: 343862 - DNA, 20 bp, human
gggagagaccacatgcccgg

SEQ ID NO: 343863 - DNA, 20 bp, human
gtggcacgccgggattctgg

SEQ ID NO: 343864 - DNA, 20 bp, human
gggggcgcgctcctcccacg

SEQ ID NO: 343865 - DNA, 20 bp, human
gctcctcccacgagggtgtc

SEQ ID NO: 343866 - DNA, 20 bp, human
gctggggcgtgggagaggaa

SEQ ID NO: 343867 - DNA, 20 bp, human
ggagaggggcggctcaggga

SEQ ID NO: 343868 - DNA, 20 bp, human
gaggaagggccgcgctatta

SEQ ID NO: 343869 - DNA, 20 bp, human
gtggtggagaggggcggctc

SEQ ID NO: 343870 - DNA, 20 bp, human
gggcctggagctgcagattg

SEQ ID NO: 343871 - DNA, 20 bp, human
gcctctccaccagccgggga

SEQ ID NO: 343872 - DNA, 20 bp, human
gcccgcccgccctaatagcg

SEQ ID NO: 343873 - DNA, 20 bp, human
gctctgccatgcaggtgcaa

SEQ ID NO: 343874 - DNA, 20 bp, human
gggcgctgaagccttggggt

SEQ ID NO: 343875 - DNA, 20 bp, human
gggagctgcagattgggggg

SEQ ID NO: 343876 - DNA, 20 bp, human
gccctagtgcccgaacgcgt

SEQ ID NO: 343877 - DNA, 20 bp, human
ggggaattgtagttcccact

SEQ ID NO: 343878 - DNA, 20 bp, human
ggcccccgcgcgcaccaagt

SEQ ID NO: 343879 - DNA, 20 bp, human
gctagggccaccgctcttgt

SEQ ID NO: 343880 - DNA, 20 bp, human
gccggcggcccgcagtccgc

SEQ ID NO: 343881 - DNA, 20 bp, human
gcttctgcccacaagagcgg

SEQ ID NO: 343882 - DNA, 20 bp, human
gggcggccccgcgactgcgc

SEQ ID NO: 343883 - DNA, 20 bp, human
gagaaggccgcgtccattcc

SEQ ID NO: 343884 - DNA, 20 bp, human
ggcgatctgcccacgcgttc

SEQ ID NO: 343885 - DNA, 20 bp, human
gaggcgcttatggccgaggt

SEQ ID NO: 343886 - DNA, 20 bp, human
gtacccgccaaggggaggtg

SEQ ID NO: 343887 - DNA, 20 bp, human
gaggaagtgactagcacaga

SEQ ID NO: 343888 - DNA, 20 bp, human
ggagcgcgtctgggaattca

SEQ ID NO: 343889 - DNA, 20 bp, human
gtccccttggcgggtaggag

SEQ ID NO: 343890 - DNA, 20 bp, human
gtaggagggggtttggcctg

SEQ ID NO: 343891 - DNA, 20 bp, human
gccccctcctacccgccaag

SEQ ID NO: 343892 - DNA, 20 bp, human
gtgctcagtggagcgcgtct

SEQ ID NO: 343893 - DNA, 20 bp, human
ggtggagtcggtagctttaa

SEQ ID NO: 343894 - DNA, 20 bp, human
ggctttaacggttgaaactg

SEQ ID NO: 343895 - DNA, 20 bp, human
gaccaatgtaacttcgtctg

SEQ ID NO: 343896 - DNA, 20 bp, human
gcgcgcggcgccaccaggaa

SEQ ID NO: 343897 - DNA, 20 bp, human
gcaccccgctcccagggcca

SEQ ID NO: 343898 - DNA, 20 bp, human
gaaaggcggggagccaacgc

SEQ ID NO: 343899 - DNA, 20 bp, human
ggggcggcaccccgctccca

SEQ ID NO: 343900 - DNA, 20 bp, human
ggccctccccgggcccgcgt

SEQ ID NO: 343901 - DNA, 20 bp, human
ggcgcggctgcccggggcac

SEQ ID NO: 343902 - DNA, 20 bp, human
gtgagggtagtagagagctc

SEQ ID NO: 343903 - DNA, 20 bp, human
ggcagccgccaaggtgagga

SEQ ID NO: 343904 - DNA, 20 bp, human
gtcccgaggctgcggaaagg

SEQ ID NO: 343905 - DNA, 20 bp, human
gcctctcgcgggccagcgtg

SEQ ID NO: 343906 - DNA, 20 bp, human
gcgcggaagcagtgcagacg

SEQ ID NO: 343907 - DNA, 20 bp, human
gagggcgggaccagggcgtg

SEQ ID NO: 343908 - DNA, 20 bp, human
gctggggctgggttctcggg

SEQ ID NO: 343909 - DNA, 20 bp, human
gcctcagggcgggaccaaag

SEQ ID NO: 343910 - DNA, 20 bp, human
gctcgggcgggcgggagcta

SEQ ID NO: 343911 - DNA, 20 bp, human
ggcggcgcgaggggccgaca

SEQ ID NO: 343912 - DNA, 20 bp, human
gggactggcgcgggacgcga

SEQ ID NO: 343913 - DNA, 20 bp, human
gaaagcgggaggactggcgc

SEQ ID NO: 343914 - DNA, 20 bp, human
gaccagggcgtgaggacgcg

SEQ ID NO: 343915 - DNA, 20 bp, human
gctggcgcgggacgcgaggg

SEQ ID NO: 343916 - DNA, 20 bp, human
gaggccccgcagcctacgtc

SEQ ID NO: 343917 - DNA, 20 bp, human
ggcggcgcagggcggtgact

SEQ ID NO: 343918 - DNA, 20 bp, human
ggcagacgctccccctggcg

SEQ ID NO: 343919 - DNA, 20 bp, human
ggggcggtgactcggctcgg

SEQ ID NO: 343920 - DNA, 20 bp, human
gcgctcaggcccgaggatgc

SEQ ID NO: 343921 - DNA, 20 bp, human
gctgcgcccgacgtaggctg

SEQ ID NO: 343922 - DNA, 20 bp, human
gagctcgggttggtgcgggg

SEQ ID NO: 343923 - DNA, 20 bp, human
gctcctcgccccgcatcctc

SEQ ID NO: 343924 - DNA, 20 bp, human
gagcccctccgcgtgccggt

SEQ ID NO: 343925 - DNA, 20 bp, human
ggaccgcagagtggtagtta

SEQ ID NO: 343926 - DNA, 20 bp, human
ggcccccgctgtcgctgctt

SEQ ID NO: 343927 - DNA, 20 bp, human
gagcgcgaggcgcccgctcc

SEQ ID NO: 343928 - DNA, 20 bp, human
gagactggggcccgatccta

SEQ ID NO: 343929 - DNA, 20 bp, human
ggtgggaagcaacgggcgag

SEQ ID NO: 343930 - DNA, 20 bp, human
ggatgcgcggggtccgagtg

SEQ ID NO: 343931 - DNA, 20 bp, human
gagcctctcactcccgggag

SEQ ID NO: 343932 - DNA, 20 bp, human
gggcggaccccgagccgcga

SEQ ID NO: 343933 - DNA, 20 bp, human
ggggcgcttcgggcccaggt

SEQ ID NO: 343934 - DNA, 20 bp, human
gtaaaagggaagaatcggga

SEQ ID NO: 343935 - DNA, 20 bp, human
ggcgacaggtgctgcgaggg

SEQ ID NO: 343936 - DNA, 20 bp, human
gtcgctgaggggtggtgaag

SEQ ID NO: 343937 - DNA, 20 bp, human
gttaccgcaccgctcaagac

SEQ ID NO: 343938 - DNA, 20 bp, human
gctcggcagcgcctcgtcct

SEQ ID NO: 343939 - DNA, 20 bp, human
gccggcctagggcgtggagg

SEQ ID NO: 343940 - DNA, 20 bp, human
gcgtaagtcggcccggccta

SEQ ID NO: 343941 - DNA, 20 bp, human
gcggaagcggaagtcgctga

SEQ ID NO: 343942 - DNA, 20 bp, human
gtcaagaccggaagcggaaa

SEQ ID NO: 343943 - DNA, 20 bp, human
gactgcgactgcgcgctccg

SEQ ID NO: 343944 - DNA, 20 bp, human
ggcggccagctaaacgcgcg

SEQ ID NO: 343945 - DNA, 20 bp, human
gggcctgcagagacggcccg

SEQ ID NO: 343946 - DNA, 20 bp, human
gagagaggccggcgggtccc

SEQ ID NO: 343947 - DNA, 20 bp, human
gcgactgcccaccatcgagg

SEQ ID NO: 343948 - DNA, 20 bp, human
gagactgcgcccgggataat

SEQ ID NO: 343949 - DNA, 20 bp, human
ggcccagtgcgcgttccctg

SEQ ID NO: 343950 - DNA, 20 bp, human
gccgccgccgcctcgatggt

SEQ ID NO: 343951 - DNA, 20 bp, human
ggccgcagggaacgcgcact

SEQ ID NO: 343952 - DNA, 20 bp, human
gccaagggccactgatgtga

SEQ ID NO: 343953 - DNA, 20 bp, human
gcgcccctggcagtgagcgc

SEQ ID NO: 343954 - DNA, 20 bp, human
ggcagggcctgtcccgcctg

SEQ ID NO: 343955 - DNA, 20 bp, human
gtggtcgccagcgaggggtg

SEQ ID NO: 343956 - DNA, 20 bp, human
gggcctcgcgagcgagtgaa

SEQ ID NO: 343957 - DNA, 20 bp, human
ggaccttcccgcgccactat

SEQ ID NO: 343958 - DNA, 20 bp, human
ggcctcgcagggcggacccc

SEQ ID NO: 343959 - DNA, 20 bp, human
gagacagcggcagagatctt

SEQ ID NO: 343960 - DNA, 20 bp, human
ggcgcgggaaggtcgcggga

SEQ ID NO: 343961 - DNA, 20 bp, human
gtgagagcctatagtggcgc

SEQ ID NO: 343962 - DNA, 20 bp, human
gagcctcgggacacgcaccg

SEQ ID NO: 343963 - DNA, 20 bp, human
ggcgggggcgtcacagacag

SEQ ID NO: 343964 - DNA, 20 bp, human
gagaacgctcagtgtcaatc

SEQ ID NO: 343965 - DNA, 20 bp, human
ggcgggcagacgcgtccgat

SEQ ID NO: 343966 - DNA, 20 bp, human
gcccaaacataaagcctttt

SEQ ID NO: 343967 - DNA, 20 bp, human
ggcctaaaaggctttatgtt

SEQ ID NO: 343968 - DNA, 20 bp, human
gcacttttcagctagagttg

SEQ ID NO: 343969 - DNA, 20 bp, human
ggtttgaataccctgcaaac

SEQ ID NO: 343970 - DNA, 20 bp, human
ggtcaaacttcctgtttgca

SEQ ID NO: 343971 - DNA, 20 bp, human
gttgtgtttggaggacagct

SEQ ID NO: 343972 - DNA, 20 bp, human
gcttgcaatatctgcctaaa

SEQ ID NO: 343973 - DNA, 20 bp, human
ggaaaagttagctgcttata

SEQ ID NO: 343974 - DNA, 20 bp, human
gtgtgctgttttatattaac

SEQ ID NO: 343975 - DNA, 20 bp, human
ggtctttagcatgttgtgtt

SEQ ID NO: 343976 - DNA, 20 bp, human
gtagctgggaatataagcgg

SEQ ID NO: 343977 - DNA, 20 bp, human
ggcggagatggcgccccctg

SEQ ID NO: 343978 - DNA, 20 bp, human
gtgccagggcttggggttag

SEQ ID NO: 343979 - DNA, 20 bp, human
gaatataagcggaggccggg

SEQ ID NO: 343980 - DNA, 20 bp, human
gtgagagaagccaactctaa

SEQ ID NO: 343981 - DNA, 20 bp, human
gagtaagtctcctttagagt

SEQ ID NO: 343982 - DNA, 20 bp, human
ggggaatataagcggaggcc

SEQ ID NO: 343983 - DNA, 20 bp, human
gatgtagctgggaatataag

SEQ ID NO: 343984 - DNA, 20 bp, human
gcttggggttaggggacggt

SEQ ID NO: 343985 - DNA, 20 bp, human
ggccgctgcactcaacaata

SEQ ID NO: 343986 - DNA, 20 bp, human
gctcgcggaccgcacggatc

SEQ ID NO: 343987 - DNA, 20 bp, human
gcggatccggctgacggcga

SEQ ID NO: 343988 - DNA, 20 bp, human
ggccgtcagccggatccgtg

SEQ ID NO: 343989 - DNA, 20 bp, human
gaggcccgccaccgccggaa

SEQ ID NO: 343990 - DNA, 20 bp, human
ggccctcccccgggtcctcg

SEQ ID NO: 343991 - DNA, 20 bp, human
gcggctgacggcgagggtca

SEQ ID NO: 343992 - DNA, 20 bp, human
gaaggaacccacccttccgg

SEQ ID NO: 343993 - DNA, 20 bp, human
ggcgactgccatgacgtggg

SEQ ID NO: 343994 - DNA, 20 bp, human
gcatggcagtcgccagactg

SEQ ID NO: 343995 - DNA, 20 bp, human
gaccgcacggatccggctga

SEQ ID NO: 343996 - DNA, 20 bp, human
gctgggcgcggcgacgaggg

SEQ ID NO: 343997 - DNA, 20 bp, human
gcggccgctggcagaagttc

SEQ ID NO: 343998 - DNA, 20 bp, human
gctggcagaagttctggcgg

SEQ ID NO: 343999 - DNA, 20 bp, human
gaccgcaaggggacagtgag

SEQ ID NO: 344000 - DNA, 20 bp, human
gcggccctgcgcgccggagg

SEQ ID NO: 344001 - DNA, 20 bp, human
gggactccgggcgccccctc

SEQ ID NO: 344002 - DNA, 20 bp, human
gtgtgcccaagtggggaatc

SEQ ID NO: 344003 - DNA, 20 bp, human
gtccctctcgcccagaaagg

SEQ ID NO: 344004 - DNA, 20 bp, human
gcctctgcgcaattaggcta

SEQ ID NO: 344005 - DNA, 20 bp, human
gaggaagcccacagtctccg

SEQ ID NO: 344006 - DNA, 20 bp, human
gtgggtgtcaggcaatgaga

SEQ ID NO: 344007 - DNA, 20 bp, human
gtcagctgctacagccctga

SEQ ID NO: 344008 - DNA, 20 bp, human
gagggaggctcttggaatag

SEQ ID NO: 344009 - DNA, 20 bp, human
ggaccctttttgaggggatg

SEQ ID NO: 344010 - DNA, 20 bp, human
gtgggagggaaggggcgcac

SEQ ID NO: 344011 - DNA, 20 bp, human
gggggcgcaccggataatct

SEQ ID NO: 344012 - DNA, 20 bp, human
gaccaagtacccagattatc

SEQ ID NO: 344013 - DNA, 20 bp, human
gtcactgaggacaagctaga

SEQ ID NO: 344014 - DNA, 20 bp, human
gctagagggaccctttttga

SEQ ID NO: 344015 - DNA, 20 bp, human
ggatgtggcttggagcatgt

SEQ ID NO: 344016 - DNA, 20 bp, human
gcacgtgggtcggccaggga

SEQ ID NO: 344017 - DNA, 20 bp, human
gaaccgggctagggagactg

SEQ ID NO: 344018 - DNA, 20 bp, human
gcgaccaggggggaggaact

SEQ ID NO: 344019 - DNA, 20 bp, human
gccggggccctcccttgcag

SEQ ID NO: 344020 - DNA, 20 bp, human
gacgtcaatgcgcctcgctc

SEQ ID NO: 344021 - DNA, 20 bp, human
gccccctggtcgctcttgga

SEQ ID NO: 344022 - DNA, 20 bp, human
ggtcgccttagcaaccttaa

SEQ ID NO: 344023 - DNA, 20 bp, human
gtggggctgttgcgccctta

SEQ ID NO: 344024 - DNA, 20 bp, human
gtccttccaagagcgaccag

SEQ ID NO: 344025 - DNA, 20 bp, human
ggtggggcgtctcagatgac

SEQ ID NO: 344026 - DNA, 20 bp, human
ggccccgcggggaggcggtc

SEQ ID NO: 344027 - DNA, 20 bp, human
ggggccgcctctgatggcct

SEQ ID NO: 344028 - DNA, 20 bp, human
ggaggcggtcggggggagac

SEQ ID NO: 344029 - DNA, 20 bp, human
ggcctgaacctgcgccggtg

SEQ ID NO: 344030 - DNA, 20 bp, human
gccccatcccccaccggcgc

SEQ ID NO: 344031 - DNA, 20 bp, human
gcccccaccggcgcaggttc

SEQ ID NO: 344032 - DNA, 20 bp, human
gggcctgcaccggctggagt

SEQ ID NO: 344033 - DNA, 20 bp, human
gacctgcgccggtgggggat

SEQ ID NO: 344034 - DNA, 20 bp, human
ggcggtggtcgtgaacgggg

SEQ ID NO: 344035 - DNA, 20 bp, human
gagccgcggtggtcgtgaac

SEQ ID NO: 344036 - DNA, 20 bp, human
ggcccctctcacaacccccg

SEQ ID NO: 344037 - DNA, 20 bp, human
ggggggtccgggatgttggg

SEQ ID NO: 344038 - DNA, 20 bp, human
ggggggaagcggcgcatggg

SEQ ID NO: 344039 - DNA, 20 bp, human
gaagcaggaacaggggtcac

SEQ ID NO: 344040 - DNA, 20 bp, human
ggagccgcgggggttgtgag

SEQ ID NO: 344041 - DNA, 20 bp, human
gcatggggggtccgggatgt

SEQ ID NO: 344042 - DNA, 20 bp, human
gtgccccaaagcaccccgcc

SEQ ID NO: 344043 - DNA, 20 bp, human
ggggccgggcggggtgcttt

SEQ ID NO: 344044 - DNA, 20 bp, human
gcccgcaccccccaacatcc

SEQ ID NO: 344045 - DNA, 20 bp, human
gaggggagtgaggtgagtga

SEQ ID NO: 344046 - DNA, 20 bp, human
ggccccctcgggctgtcggg

SEQ ID NO: 344047 - DNA, 20 bp, human
gagtggcgcaagcgcactga

SEQ ID NO: 344048 - DNA, 20 bp, human
ggggacgcgcacgcccgcgg

SEQ ID NO: 344049 - DNA, 20 bp, human
ggaccccccgacagcccgag

SEQ ID NO: 344050 - DNA, 20 bp, human
gccctccgtgagctggcatc

SEQ ID NO: 344051 - DNA, 20 bp, human
gactgagggccggtgctaag

SEQ ID NO: 344052 - DNA, 20 bp, human
gtgcccgtcggtccccgcgg

SEQ ID NO: 344053 - DNA, 20 bp, human
gacccgccccctcgggctgt

SEQ ID NO: 344054 - DNA, 20 bp, human
gggagggaatccagggaatt

SEQ ID NO: 344055 - DNA, 20 bp, human
gactagatgacccgccccct

SEQ ID NO: 344056 - DNA, 20 bp, human
gaaaccatggcaacctccgc

SEQ ID NO: 344057 - DNA, 20 bp, human
gagccctgcggtggtctgac

SEQ ID NO: 344058 - DNA, 20 bp, human
gaggttgccatggtttccgg

SEQ ID NO: 344059 - DNA, 20 bp, human
gctgcggtggtctgacaggc

SEQ ID NO: 344060 - DNA, 20 bp, human
gcgcggacaggtggacacga

SEQ ID NO: 344061 - DNA, 20 bp, human
gggacaggtggacacgaagg

SEQ ID NO: 344062 - DNA, 20 bp, human
gtcccaggcgtcattcgcca

SEQ ID NO: 344063 - DNA, 20 bp, human
gcagccagcggaggttgcca

SEQ ID NO: 344064 - DNA, 20 bp, human
gcaccgcagggctgcgcgcc

SEQ ID NO: 344065 - DNA, 20 bp, human
gcgaatgacgcctgggaagc

SEQ ID NO: 344066 - DNA, 20 bp, human
gaggccgcgaggacgagcgg

SEQ ID NO: 344067 - DNA, 20 bp, human
ggagcggaccggaccgagtg

SEQ ID NO: 344068 - DNA, 20 bp, human
gcggaccggaccgagtgcgg

SEQ ID NO: 344069 - DNA, 20 bp, human
ggcctcctccgcactcggtc

SEQ ID NO: 344070 - DNA, 20 bp, human
ggcgaggccgcgaggacgag

SEQ ID NO: 344071 - DNA, 20 bp, human
gcccccgccgctcgtcctcg

SEQ ID NO: 344072 - DNA, 20 bp, human
gggaggcagcgagtgccttg

SEQ ID NO: 344073 - DNA, 20 bp, human
gtcggggcatgcgcggtggg

SEQ ID NO: 344074 - DNA, 20 bp, human
gccggcccgagtggggatgc

SEQ ID NO: 344075 - DNA, 20 bp, human
gcgctcggggcatgcgcggt

SEQ ID NO: 344076 - DNA, 20 bp, human
ggaccgcagcccggggtcgt

SEQ ID NO: 344077 - DNA, 20 bp, human
ggcgaggcccgcggtagccc

SEQ ID NO: 344078 - DNA, 20 bp, human
gggcgcgatgcaaatgagga

SEQ ID NO: 344079 - DNA, 20 bp, human
gcgaaggggagcgggtggaa

SEQ ID NO: 344080 - DNA, 20 bp, human
gcctgggcgcgatgcaaatg

SEQ ID NO: 344081 - DNA, 20 bp, human
gaattccaccccggcctctg

SEQ ID NO: 344082 - DNA, 20 bp, human
gtctgcacgcgtctcctgga

SEQ ID NO: 344083 - DNA, 20 bp, human
ggctcgggtccgacgacccc

SEQ ID NO: 344084 - DNA, 20 bp, human
gcctacggggcgaaggggag

SEQ ID NO: 344085 - DNA, 20 bp, human
gacgcgtgcagaatgaccaa

SEQ ID NO: 344086 - DNA, 20 bp, human
ggccccgccagctgcaatcg

SEQ ID NO: 344087 - DNA, 20 bp, human
ggcggcacacggaagtgcga

SEQ ID NO: 344088 - DNA, 20 bp, human
ggagactcggtgtcccgcgc

SEQ ID NO: 344089 - DNA, 20 bp, human
ggtaaaatgggccccttctg

SEQ ID NO: 344090 - DNA, 20 bp, human
ggctgcgcgctaatggcggg

SEQ ID NO: 344091 - DNA, 20 bp, human
gtccccgattgcagctggcg

SEQ ID NO: 344092 - DNA, 20 bp, human
gtggcgggaggatgcgaaga

SEQ ID NO: 344093 - DNA, 20 bp, human
gcggtgtcccgcgcaggcag

SEQ ID NO: 344094 - DNA, 20 bp, human
ggaaggggcccattttacag

SEQ ID NO: 344095 - DNA, 20 bp, human
gagggctggctgcgcgctaa

SEQ ID NO: 344096 - DNA, 20 bp, human
gggcgtggggatgttggcag

SEQ ID NO: 344097 - DNA, 20 bp, human
gcgggagggcgcgagggcgt

SEQ ID NO: 344098 - DNA, 20 bp, human
gttccgctgtcccgcgccgg

SEQ ID NO: 344099 - DNA, 20 bp, human
gcagggaattggagcggagg

SEQ ID NO: 344100 - DNA, 20 bp, human
gcagagtgagagggtttgca

SEQ ID NO: 344101 - DNA, 20 bp, human
gaggctggatgcaggcgaca

SEQ ID NO: 344102 - DNA, 20 bp, human
gcccgcgccgggggcctgct

SEQ ID NO: 344103 - DNA, 20 bp, human
gcgaaagtggacggcgacgg

SEQ ID NO: 344104 - DNA, 20 bp, human
gtgactcaggcaggcggagt

SEQ ID NO: 344105 - DNA, 20 bp, human
ggtgggaggccgaaagtgga

SEQ ID NO: 344106 - DNA, 20 bp, human
gctccccgcgtccccgctct

SEQ ID NO: 344107 - DNA, 20 bp, human
gtcgctcgcacaccgacaga

SEQ ID NO: 344108 - DNA, 20 bp, human
gcgcgcgcacggcagtgttt

SEQ ID NO: 344109 - DNA, 20 bp, human
gcgcacaccgacagagggag

SEQ ID NO: 344110 - DNA, 20 bp, human
gtgagccgaggagacaacgg

SEQ ID NO: 344111 - DNA, 20 bp, human
gagagggagaggagaccgcg

SEQ ID NO: 344112 - DNA, 20 bp, human
gcgagcggcagccgagagcg

SEQ ID NO: 344113 - DNA, 20 bp, human
gtgcgcatttcctgcattag

SEQ ID NO: 344114 - DNA, 20 bp, human
gctgcccggggtcgcagcgg

SEQ ID NO: 344115 - DNA, 20 bp, human
gaagtgagccgaggagacaa

SEQ ID NO: 344116 - DNA, 20 bp, human
ggtgcacacacccactccgg

SEQ ID NO: 344117 - DNA, 20 bp, human
ggggcaggatgacagattgc

SEQ ID NO: 344118 - DNA, 20 bp, human
gaggggcagggtcagacaca

SEQ ID NO: 344119 - DNA, 20 bp, human
gtccagccagcccccggagt

SEQ ID NO: 344120 - DNA, 20 bp, human
gcacgtgcacacacccactc

SEQ ID NO: 344121 - DNA, 20 bp, human
ggacacacgaggcaccctag

SEQ ID NO: 344122 - DNA, 20 bp, human
gtgtcccgtgtctccgggag

SEQ ID NO: 344123 - DNA, 20 bp, human
gcagccggaggcacgggcgg

SEQ ID NO: 344124 - DNA, 20 bp, human
ggttgccaggacgaccgaga

SEQ ID NO: 344125 - DNA, 20 bp, human
gatgacagattgcagggtgg

SEQ ID NO: 344126 - DNA, 20 bp, human
gggtccggaaggcgcgggag

SEQ ID NO: 344127 - DNA, 20 bp, human
gcccgcgccttccggacccc

SEQ ID NO: 344128 - DNA, 20 bp, human
ggatccccgcgcaagccccc

SEQ ID NO: 344129 - DNA, 20 bp, human
gagacccagcgctacaagga

SEQ ID NO: 344130 - DNA, 20 bp, human
ggttctcgccggggatgcgg

SEQ ID NO: 344131 - DNA, 20 bp, human
ggggcggcgcaagcgggcac

SEQ ID NO: 344132 - DNA, 20 bp, human
ggcctcccgggggcttgcgc

SEQ ID NO: 344133 - DNA, 20 bp, human
gccctggggtccggaaggcg

SEQ ID NO: 344134 - DNA, 20 bp, human
gggagagcgtgagccttcgg

SEQ ID NO: 344135 - DNA, 20 bp, human
ggcgggcactggcctcccgg

SEQ ID NO: 344136 - DNA, 20 bp, human
gtccaaaggcccacattccg

SEQ ID NO: 344137 - DNA, 20 bp, human
gggctgaaccatccttacgg

SEQ ID NO: 344138 - DNA, 20 bp, human
gtgaccaagttgcgaggcta

SEQ ID NO: 344139 - DNA, 20 bp, human
gaagtgggagggaccgacgc

SEQ ID NO: 344140 - DNA, 20 bp, human
gccgggctgaaccatcctta

SEQ ID NO: 344141 - DNA, 20 bp, human
gaagttgcgaggctagggtg

SEQ ID NO: 344142 - DNA, 20 bp, human
gcgcgtgaaagcacccctct

SEQ ID NO: 344143 - DNA, 20 bp, human
gaggcccacattccggggta

SEQ ID NO: 344144 - DNA, 20 bp, human
gccttacgggggcagagaaa

SEQ ID NO: 344145 - DNA, 20 bp, human
ggccgcctctacagccgccc

SEQ ID NO: 344146 - DNA, 20 bp, human
ggggaccgagcgcgcgtccc

SEQ ID NO: 344147 - DNA, 20 bp, human
gcgtccctggctagaggtgc

SEQ ID NO: 344148 - DNA, 20 bp, human
ggacccggcacctctagcca

SEQ ID NO: 344149 - DNA, 20 bp, human
gagcgcgcgtccctggctag

SEQ ID NO: 344150 - DNA, 20 bp, human
ggggcgacaagtggctggta

SEQ ID NO: 344151 - DNA, 20 bp, human
ggccctcccggggctgtcct

SEQ ID NO: 344152 - DNA, 20 bp, human
gttcgcagctgggcgacaag

SEQ ID NO: 344153 - DNA, 20 bp, human
gtagaaggcggtgcccgcca

SEQ ID NO: 344154 - DNA, 20 bp, human
ggtggctggtaaggaggcca

SEQ ID NO: 344155 - DNA, 20 bp, human
gtgcgggtgcgcctagaagg

SEQ ID NO: 344156 - DNA, 20 bp, human
gaacccccaggggcgggata

SEQ ID NO: 344157 - DNA, 20 bp, human
gctgcccaagatggccgtct

SEQ ID NO: 344158 - DNA, 20 bp, human
gcttagagaggatagttctg

SEQ ID NO: 344159 - DNA, 20 bp, human
ggaggggcggtcccaacagt

SEQ ID NO: 344160 - DNA, 20 bp, human
gagccgcgccgcaggacgga

SEQ ID NO: 344161 - DNA, 20 bp, human
gtcgccatgttgggagaggc

SEQ ID NO: 344162 - DNA, 20 bp, human
gcccaggggcgggataaggt

SEQ ID NO: 344163 - DNA, 20 bp, human
ggaaacagtggagagagacg

SEQ ID NO: 344164 - DNA, 20 bp, human
ggcgcagcgtacctccatct

SEQ ID NO: 344165 - DNA, 20 bp, human
gggaacgcgggtgatctcca

SEQ ID NO: 344166 - DNA, 20 bp, human
ggagctgacgctgacgtcac

SEQ ID NO: 344167 - DNA, 20 bp, human
gagcccaggaacggagcggg

SEQ ID NO: 344168 - DNA, 20 bp, human
gacctctgacctgcgtccag

SEQ ID NO: 344169 - DNA, 20 bp, human
gggctcgacaccaatggcca

SEQ ID NO: 344170 - DNA, 20 bp, human
gtgcgtccagaggctgtgaa

SEQ ID NO: 344171 - DNA, 20 bp, human
gtggggacggtgggcactgg

SEQ ID NO: 344172 - DNA, 20 bp, human
gggtcagaggtcactcgcca

SEQ ID NO: 344173 - DNA, 20 bp, human
gcacacactggtggggtttg

SEQ ID NO: 344174 - DNA, 20 bp, human
gtgaatgggctcgacaccaa

SEQ ID NO: 344175 - DNA, 20 bp, human
ggcacagtccagagagcggg

SEQ ID NO: 344176 - DNA, 20 bp, human
gcacctgggccaatcctcgg

SEQ ID NO: 344177 - DNA, 20 bp, human
gggagccagcggccaatccg

SEQ ID NO: 344178 - DNA, 20 bp, human
ggtcccccgaggattggccc

SEQ ID NO: 344179 - DNA, 20 bp, human
gcgccccgcggattggccgc

SEQ ID NO: 344180 - DNA, 20 bp, human
gcgcggccgggtgtcccccg

SEQ ID NO: 344181 - DNA, 20 bp, human
gtggcacctgcggccaatga

SEQ ID NO: 344182 - DNA, 20 bp, human
gccgggtgtcccccgaggat

SEQ ID NO: 344183 - DNA, 20 bp, human
gtcgggcggggctacctgtt

SEQ ID NO: 344184 - DNA, 20 bp, human
ggctctgcccggcaaccgga

SEQ ID NO: 344185 - DNA, 20 bp, human
gcccgcccgcgcctcgccat

SEQ ID NO: 344186 - DNA, 20 bp, human
gcggcgggcgcgggagtcgc

SEQ ID NO: 344187 - DNA, 20 bp, human
ggcgggagtcgcaggagcag

SEQ ID NO: 344188 - DNA, 20 bp, human
gtggcgcgctcggaaggacg

SEQ ID NO: 344189 - DNA, 20 bp, human
gccctccgcccgcagttccc

SEQ ID NO: 344190 - DNA, 20 bp, human
gccaggcggcagattcttgg

SEQ ID NO: 344191 - DNA, 20 bp, human
ggaaggacggggcgacgggt

SEQ ID NO: 344192 - DNA, 20 bp, human
ggccccgccccgactgcgga

SEQ ID NO: 344193 - DNA, 20 bp, human
gtggggagccaccacccggc

SEQ ID NO: 344194 - DNA, 20 bp, human
ggactcccgcgcccgccggg

SEQ ID NO: 344195 - DNA, 20 bp, human
gtcccgcgcccgccgggtgg

SEQ ID NO: 344196 - DNA, 20 bp, human
gcccggggcctccgagttgg

SEQ ID NO: 344197 - DNA, 20 bp, human
gggcctcggcgacgtcagag

SEQ ID NO: 344198 - DNA, 20 bp, human
gaggggcggagcctgccgag

SEQ ID NO: 344199 - DNA, 20 bp, human
gcctccagggtccgggacaa

SEQ ID NO: 344200 - DNA, 20 bp, human
gcgacgcctgcgaccggcgg

SEQ ID NO: 344201 - DNA, 20 bp, human
gcgtccggcgcccatggcag

SEQ ID NO: 344202 - DNA, 20 bp, human
gagagggctcccctccttaa

SEQ ID NO: 344203 - DNA, 20 bp, human
gggtccagcccccaactcgg

SEQ ID NO: 344204 - DNA, 20 bp, human
gcctccagatgggtaggaag

SEQ ID NO: 344205 - DNA, 20 bp, human
gccctcggctggacagggag

SEQ ID NO: 344206 - DNA, 20 bp, human
gggcctggagccaggtaact

SEQ ID NO: 344207 - DNA, 20 bp, human
gctggaaggaggacttttcg

SEQ ID NO: 344208 - DNA, 20 bp, human
gagggcgctggagataagga

SEQ ID NO: 344209 - DNA, 20 bp, human
gccgggggacttggactcga

SEQ ID NO: 344210 - DNA, 20 bp, human
gggtggggcgagctggaagg

SEQ ID NO: 344211 - DNA, 20 bp, human
gaggacttttcggggctcct

SEQ ID NO: 344212 - DNA, 20 bp, human
gacaatagacagatccagga

SEQ ID NO: 344213 - DNA, 20 bp, human
gcctgccacccaatgctcaa

SEQ ID NO: 344214 - DNA, 20 bp, human
gccaactcagcccacttcat

SEQ ID NO: 344215 - DNA, 20 bp, human
gccttcccgaggccccaccg

SEQ ID NO: 344216 - DNA, 20 bp, human
ggaagacgcccggaactcga

SEQ ID NO: 344217 - DNA, 20 bp, human
ggggagcgccgggtacagtc

SEQ ID NO: 344218 - DNA, 20 bp, human
gctcccggcgccccttcgcg

SEQ ID NO: 344219 - DNA, 20 bp, human
ggtggccgcggcgggaggtc

SEQ ID NO: 344220 - DNA, 20 bp, human
ggacacgctcgcgactcccg

SEQ ID NO: 344221 - DNA, 20 bp, human
ggagccagcccgactgtacc

SEQ ID NO: 344222 - DNA, 20 bp, human
gcagggaggagcatgcggga

SEQ ID NO: 344223 - DNA, 20 bp, human
gcaaccccgacctcccgccg

SEQ ID NO: 344224 - DNA, 20 bp, human
ggccgggagctgtagttcct

SEQ ID NO: 344225 - DNA, 20 bp, human
gtcggcccgcgcccgccggg

SEQ ID NO: 344226 - DNA, 20 bp, human
gtggccaggccttcccgcag

SEQ ID NO: 344227 - DNA, 20 bp, human
gaaaaacgtctgacctgcgg

SEQ ID NO: 344228 - DNA, 20 bp, human
gcccggggacccctgcggga

SEQ ID NO: 344229 - DNA, 20 bp, human
gcggcggcaggaactttccc

SEQ ID NO: 344230 - DNA, 20 bp, human
gctgacctgcggaggtagtt

SEQ ID NO: 344231 - DNA, 20 bp, human
ggccttcccgcaggggtccc

SEQ ID NO: 344232 - DNA, 20 bp, human
ggccagtaagcgcgcctctt

SEQ ID NO: 344233 - DNA, 20 bp, human
gtctttggcccgaatcaaca

SEQ ID NO: 344234 - DNA, 20 bp, human
gaggtcagacgtttttcctt

SEQ ID NO: 344235 - DNA, 20 bp, human
gcctgcggaggtagtttggg

SEQ ID NO: 344236 - DNA, 20 bp, human
gtcacggagtgactaggaga

SEQ ID NO: 344237 - DNA, 20 bp, human
gatgacgcagcgcttgtaac

SEQ ID NO: 344238 - DNA, 20 bp, human
gcaaccctctgctagcaact

SEQ ID NO: 344239 - DNA, 20 bp, human
gagcaactcggctgtcggtg

SEQ ID NO: 344240 - DNA, 20 bp, human
gacagccgagttgctagcag

SEQ ID NO: 344241 - DNA, 20 bp, human
gtaggagagggggacgaggg

SEQ ID NO: 344242 - DNA, 20 bp, human
ggactaaaagcaccgagggg

SEQ ID NO: 344243 - DNA, 20 bp, human
gccacgctgtatggtaccaa

SEQ ID NO: 344244 - DNA, 20 bp, human
gcgtcatccgccagatcaca

SEQ ID NO: 344245 - DNA, 20 bp, human
gaactcggctgtcggtgggg

SEQ ID NO: 344246 - DNA, 20 bp, human
ggtgtcgggagtaaaggttc

SEQ ID NO: 344247 - DNA, 20 bp, human
gtgggcgccggcttccctaa

SEQ ID NO: 344248 - DNA, 20 bp, human
ggcggctgtgtcgggagtaa

SEQ ID NO: 344249 - DNA, 20 bp, human
gatagtgaggcaacttaagt

SEQ ID NO: 344250 - DNA, 20 bp, human
gcgccggcttccctaaaggt

SEQ ID NO: 344251 - DNA, 20 bp, human
gcctcactatggagggtatg

SEQ ID NO: 344252 - DNA, 20 bp, human
gagccggcgcccaactatcc

SEQ ID NO: 344253 - DNA, 20 bp, human
gcgcgggtgaccccaccttt

SEQ ID NO: 344254 - DNA, 20 bp, human
gtaagttgcctcactatgga

SEQ ID NO: 344255 - DNA, 20 bp, human
gttcaagtgtgtgggacgag

SEQ ID NO: 344256 - DNA, 20 bp, human
gaagggacaggggcggagtt

SEQ ID NO: 344257 - DNA, 20 bp, human
ggacaggggcggagttgggc

SEQ ID NO: 344258 - DNA, 20 bp, human
gaagggggcggaccctggaa

SEQ ID NO: 344259 - DNA, 20 bp, human
gctgaccagcctgtagtaac

SEQ ID NO: 344260 - DNA, 20 bp, human
gcctaggggccagttactac

SEQ ID NO: 344261 - DNA, 20 bp, human
ggcgggcgcggagaaccccc

SEQ ID NO: 344262 - DNA, 20 bp, human
ggcctgtgcccacgcgggag

SEQ ID NO: 344263 - DNA, 20 bp, human
gtgtcctcgcgctccagcgg

SEQ ID NO: 344264 - DNA, 20 bp, human
gccgggacggaggcccgcag

SEQ ID NO: 344265 - DNA, 20 bp, human
gcccgcagaggagcagcgag

SEQ ID NO: 344266 - DNA, 20 bp, human
gggactggagaggtcggcta

SEQ ID NO: 344267 - DNA, 20 bp, human
gacgcccgcggggactggag

SEQ ID NO: 344268 - DNA, 20 bp, human
ggaggtgccgagagcatcag

SEQ ID NO: 344269 - DNA, 20 bp, human
ggagggccacctccccttca

SEQ ID NO: 344270 - DNA, 20 bp, human
gccgcagaggggaacggagg

SEQ ID NO: 344271 - DNA, 20 bp, human
gaataacccacgccagcctc

SEQ ID NO: 344272 - DNA, 20 bp, human
gaggctcatgaatattcagc

SEQ ID NO: 344273 - DNA, 20 bp, human
ggagactgcgtatgcgtcgc

SEQ ID NO: 344274 - DNA, 20 bp, human
gcagtctccgcagaggggaa

SEQ ID NO: 344275 - DNA, 20 bp, human
gcatcagcggggctgctcgg

SEQ ID NO: 344276 - DNA, 20 bp, human
ggacacccaccaccggtccc

SEQ ID NO: 344277 - DNA, 20 bp, human
ggagggcgcgtaaagctcat

SEQ ID NO: 344278 - DNA, 20 bp, human
gttgtcctgggaccggtggt

SEQ ID NO: 344279 - DNA, 20 bp, human
ggcgcgtaaagctcataggc

SEQ ID NO: 344280 - DNA, 20 bp, human
gaatggcccctaaacttgga

SEQ ID NO: 344281 - DNA, 20 bp, human
gctaaacttggggagcgcat

SEQ ID NO: 344282 - DNA, 20 bp, human
gctcccgggacacccaccac

SEQ ID NO: 344283 - DNA, 20 bp, human
gctggagcttcttcaccttt

SEQ ID NO: 344284 - DNA, 20 bp, human
gttacgcgccctccaagttt

SEQ ID NO: 344285 - DNA, 20 bp, human
ggcttcttcacctttaggcg

SEQ ID NO: 344286 - DNA, 20 bp, human
gtgcccgcctgctgagaagg

SEQ ID NO: 344287 - DNA, 20 bp, human
gcaaggaagcgcgcctgccg

SEQ ID NO: 344288 - DNA, 20 bp, human
gcgcctgccggggtgtggcg

SEQ ID NO: 344289 - DNA, 20 bp, human
gctgccggggtgtggcgagg

SEQ ID NO: 344290 - DNA, 20 bp, human
gcctccgcctcgccacaccc

SEQ ID NO: 344291 - DNA, 20 bp, human
gtgcgcacagtctaatccgc

SEQ ID NO: 344292 - DNA, 20 bp, human
gtgctgagaaggcggaaagg

SEQ ID NO: 344293 - DNA, 20 bp, human
gactgtgcgcagtcgcactg

SEQ ID NO: 344294 - DNA, 20 bp, human
ggcgtgcccgcctgctgaga

SEQ ID NO: 344295 - DNA, 20 bp, human
gcagcaggcgggcacgcgca

SEQ ID NO: 344296 - DNA, 20 bp, human
gagacccgggcgtgcggcgc

SEQ ID NO: 344297 - DNA, 20 bp, human
gcagccccgcggccgggtta

SEQ ID NO: 344298 - DNA, 20 bp, human
ggagaggcgcggtcacgccc

SEQ ID NO: 344299 - DNA, 20 bp, human
gctcctgggctgggtcgggg

SEQ ID NO: 344300 - DNA, 20 bp, human
gccgcgcccggggcacccct

SEQ ID NO: 344301 - DNA, 20 bp, human
gtccccagcgccgcacgccc

SEQ ID NO: 344302 - DNA, 20 bp, human
gccgcggccgggttagggcg

SEQ ID NO: 344303 - DNA, 20 bp, human
gcccaggctgacttctcctc

SEQ ID NO: 344304 - DNA, 20 bp, human
ggcgagacccggaatgcgca

SEQ ID NO: 344305 - DNA, 20 bp, human
ggcccgccagtgcgtccccg

SEQ ID NO: 344306 - DNA, 20 bp, human
ggaaatagatgaccaggaaa

SEQ ID NO: 344307 - DNA, 20 bp, human
gatctgagactagattggtt

SEQ ID NO: 344308 - DNA, 20 bp, human
gttgatgtttgaaattatgg

SEQ ID NO: 344309 - DNA, 20 bp, human
gtaccaagagatatagaata

SEQ ID NO: 344310 - DNA, 20 bp, human
ggcattcgtttcccttttcc

SEQ ID NO: 344311 - DNA, 20 bp, human
gttcatgaatataatgaatc

SEQ ID NO: 344312 - DNA, 20 bp, human
gaatttaatgacagtgtaac

SEQ ID NO: 344313 - DNA, 20 bp, human
gtctttacctagcaatcttg

SEQ ID NO: 344314 - DNA, 20 bp, human
gtaaagtttgttgaatatat

SEQ ID NO: 344315 - DNA, 20 bp, human
ggaataaggattgagaaatc

SEQ ID NO: 344316 - DNA, 20 bp, human
gagggcagtggggagcaata

SEQ ID NO: 344317 - DNA, 20 bp, human
ggcctgatttgctactgtaa

SEQ ID NO: 344318 - DNA, 20 bp, human
gtggcatcgggcagccccgc

SEQ ID NO: 344319 - DNA, 20 bp, human
gctactgtaatggctgggat

SEQ ID NO: 344320 - DNA, 20 bp, human
gcagccccgccgggacagat

SEQ ID NO: 344321 - DNA, 20 bp, human
ggtagcaaatcaggcagctg

SEQ ID NO: 344322 - DNA, 20 bp, human
gttcagaagtaatcctgccg

SEQ ID NO: 344323 - DNA, 20 bp, human
gctgctcctgtgccagagcg

SEQ ID NO: 344324 - DNA, 20 bp, human
gggagcaataaggctttcct

SEQ ID NO: 344325 - DNA, 20 bp, human
gccgccgggacagatgggca

SEQ ID NO: 344326 - DNA, 20 bp, human
gtgcacggagctgggacctt

SEQ ID NO: 344327 - DNA, 20 bp, human
gtatgtatatgtgtacaaga

SEQ ID NO: 344328 - DNA, 20 bp, human
gacagtgctcactctaccca

SEQ ID NO: 344329 - DNA, 20 bp, human
ggcagcgtcacacaggcatc

SEQ ID NO: 344330 - DNA, 20 bp, human
ggggtgcgtgtgcacggagc

SEQ ID NO: 344331 - DNA, 20 bp, human
gatgaggaggacacggcctg

SEQ ID NO: 344332 - DNA, 20 bp, human
gagggtgtggtgtgtgcaca

SEQ ID NO: 344333 - DNA, 20 bp, human
gggcaggagcagcgtcacac

SEQ ID NO: 344334 - DNA, 20 bp, human
ggacacggcctgggggagaa

SEQ ID NO: 344335 - DNA, 20 bp, human
ggcatcagggtgcgtgtgca

SEQ ID NO: 344336 - DNA, 20 bp, human
ggaatccgaaacgggaggag

SEQ ID NO: 344337 - DNA, 20 bp, human
gggaggatggaatccgaaac

SEQ ID NO: 344338 - DNA, 20 bp, human
gagccggtgcagtcttagga

SEQ ID NO: 344339 - DNA, 20 bp, human
gccggcccctcctcccgttt

SEQ ID NO: 344340 - DNA, 20 bp, human
ggaagcgtcaggctatcggg

SEQ ID NO: 344341 - DNA, 20 bp, human
gggtccggaggagcgcacag

SEQ ID NO: 344342 - DNA, 20 bp, human
ggaggaggggccggcaaacc

SEQ ID NO: 344343 - DNA, 20 bp, human
gccggaggagcgcacagtgg

SEQ ID NO: 344344 - DNA, 20 bp, human
gggatggaatccgaaacggg

SEQ ID NO: 344345 - DNA, 20 bp, human
gctgcctagcggccaggttg

SEQ ID NO: 344346 - DNA, 20 bp, human
gagaaggcgacggaggtagt

SEQ ID NO: 344347 - DNA, 20 bp, human
gagagcctgccagttttaga

SEQ ID NO: 344348 - DNA, 20 bp, human
ggtcgccttctaaaactggc

SEQ ID NO: 344349 - DNA, 20 bp, human
gtgtttcttcaggtcttcgc

SEQ ID NO: 344350 - DNA, 20 bp, human
gcaactgattccccccagat

SEQ ID NO: 344351 - DNA, 20 bp, human
gatcatgcaaaaccgatctg

SEQ ID NO: 344352 - DNA, 20 bp, human
gagtctcaatgaaagatatg

SEQ ID NO: 344353 - DNA, 20 bp, human
gctccgtcgccttctaaaac

SEQ ID NO: 344354 - DNA, 20 bp, human
ggggaatcagttgtttcttc

SEQ ID NO: 344355 - DNA, 20 bp, human
ggatcggttttgcatgatta

SEQ ID NO: 344356 - DNA, 20 bp, human
gaggcagcccctacactcgg

SEQ ID NO: 344357 - DNA, 20 bp, human
ggggccgttggtcattgtga

SEQ ID NO: 344358 - DNA, 20 bp, human
gcgggcaggcccccgagtgt

SEQ ID NO: 344359 - DNA, 20 bp, human
gtacaagatgactcctccgt

SEQ ID NO: 344360 - DNA, 20 bp, human
gggctgcctatgtcacagct

SEQ ID NO: 344361 - DNA, 20 bp, human
gcggcctgttatagatgcca

SEQ ID NO: 344362 - DNA, 20 bp, human
ggccccctggcatctataac

SEQ ID NO: 344363 - DNA, 20 bp, human
gtagatgattgctcccacgg

SEQ ID NO: 344364 - DNA, 20 bp, human
ggatgcaggccacctggcca

SEQ ID NO: 344365 - DNA, 20 bp, human
gatcgccccagctgtgacat

SEQ ID NO: 344366 - DNA, 20 bp, human
gcaccggcttggggagatga

SEQ ID NO: 344367 - DNA, 20 bp, human
gtgtgcgcacccaccggctt

SEQ ID NO: 344368 - DNA, 20 bp, human
gcggggccgcagagtcatag

SEQ ID NO: 344369 - DNA, 20 bp, human
gtggcacataggagctatta

SEQ ID NO: 344370 - DNA, 20 bp, human
gtgacaatgtgcgcacccac

SEQ ID NO: 344371 - DNA, 20 bp, human
gaaaacacctgccatctgta

SEQ ID NO: 344372 - DNA, 20 bp, human
gccaggggtcacaactagca

SEQ ID NO: 344373 - DNA, 20 bp, human
gctgtggcacagcagtgagt

SEQ ID NO: 344374 - DNA, 20 bp, human
gggagatgagggcttggatt

SEQ ID NO: 344375 - DNA, 20 bp, human
gagtaggtgaaccatacaga

SEQ ID NO: 344376 - DNA, 20 bp, human
gcccacaggggaggtctgca

SEQ ID NO: 344377 - DNA, 20 bp, human
gtgaggtgtgagttaactgt

SEQ ID NO: 344378 - DNA, 20 bp, human
ggccttgcagacctcccctg

SEQ ID NO: 344379 - DNA, 20 bp, human
gcaacagagacagctctctc

SEQ ID NO: 344380 - DNA, 20 bp, human
gccagggcaaatgaggacta

SEQ ID NO: 344381 - DNA, 20 bp, human
gaggatgctgacatcacaaa

SEQ ID NO: 344382 - DNA, 20 bp, human
gtaactcacacctcagccac

SEQ ID NO: 344383 - DNA, 20 bp, human
gcagacccaggttcccaagt

SEQ ID NO: 344384 - DNA, 20 bp, human
ggggtgaaggggctgcgagt

SEQ ID NO: 344385 - DNA, 20 bp, human
gccatccccacttgggaacc

SEQ ID NO: 344386 - DNA, 20 bp, human
gccgccccctcaagtcgacc

SEQ ID NO: 344387 - DNA, 20 bp, human
ggggcagttttccccatccc

SEQ ID NO: 344388 - DNA, 20 bp, human
gaggcggtgctgggtgtaaa

SEQ ID NO: 344389 - DNA, 20 bp, human
gtagagaatacgtccatcat

SEQ ID NO: 344390 - DNA, 20 bp, human
gaagaagcgcgactggtgat

SEQ ID NO: 344391 - DNA, 20 bp, human
gtacgtccatcataggtcag

SEQ ID NO: 344392 - DNA, 20 bp, human
gaaatcttccagcggggtcg

SEQ ID NO: 344393 - DNA, 20 bp, human
ggagaataccgtctagtaat

SEQ ID NO: 344394 - DNA, 20 bp, human
gccccgctggaagatttcat

SEQ ID NO: 344395 - DNA, 20 bp, human
gccctcaagtcgacccggga

SEQ ID NO: 344396 - DNA, 20 bp, human
gggccaggtgcgcaatagtg

SEQ ID NO: 344397 - DNA, 20 bp, human
gtggtcgctcctgcgggaat

SEQ ID NO: 344398 - DNA, 20 bp, human
gcactgctgcccattcccgc

SEQ ID NO: 344399 - DNA, 20 bp, human
ggggttggcgagttcacccg

SEQ ID NO: 344400 - DNA, 20 bp, human
gacgtcagcgcgcccgacgt

SEQ ID NO: 344401 - DNA, 20 bp, human
ggagcataggagaacgtctg

SEQ ID NO: 344402 - DNA, 20 bp, human
ggaccactgtgcgtgagcat

SEQ ID NO: 344403 - DNA, 20 bp, human
ggcagtgacgtgcccacgtc

SEQ ID NO: 344404 - DNA, 20 bp, human
ggcacagtggtcgctcctgc

SEQ ID NO: 344405 - DNA, 20 bp, human
gaatagtggggtatgcgtca

SEQ ID NO: 344406 - DNA, 20 bp, human
gacgcgccggcgcaagtcga

SEQ ID NO: 344407 - DNA, 20 bp, human
gcgccggcgcaagtcgaggg

SEQ ID NO: 344408 - DNA, 20 bp, human
gcaccgccctcgacttgcgc

SEQ ID NO: 344409 - DNA, 20 bp, human
gcacagatcgtctgcagctg

SEQ ID NO: 344410 - DNA, 20 bp, human
ggcctcgcctcgcaagaccg

SEQ ID NO: 344411 - DNA, 20 bp, human
gctggaatgggggacgtctt

SEQ ID NO: 344412 - DNA, 20 bp, human
gcggctgggctgggcgattg

SEQ ID NO: 344413 - DNA, 20 bp, human
ggggttggggggctcggctt

SEQ ID NO: 344414 - DNA, 20 bp, human
gcgcaggccgtcagccggga

SEQ ID NO: 344415 - DNA, 20 bp, human
gcgcttgcgcgggttgaggg

SEQ ID NO: 344416 - DNA, 20 bp, human
gcgcgcttcggcgttcccgg

SEQ ID NO: 344417 - DNA, 20 bp, human
gaacgccgaagcgcgcgcgc

SEQ ID NO: 344418 - DNA, 20 bp, human
gtgaagaggcgcgctgatga

SEQ ID NO: 344419 - DNA, 20 bp, human
gcacaagcgcgaacccgcgg

SEQ ID NO: 344420 - DNA, 20 bp, human
gtgcgggtcacgtgaggtgg

SEQ ID NO: 344421 - DNA, 20 bp, human
gccgcacggcgcctcgaggc

SEQ ID NO: 344422 - DNA, 20 bp, human
gccgtgcgggtcacgtgagg

SEQ ID NO: 344423 - DNA, 20 bp, human
ggctggctcgcaatcgcttc

SEQ ID NO: 344424 - DNA, 20 bp, human
gtaacgcctgccgcaaccca

SEQ ID NO: 344425 - DNA, 20 bp, human
ggcgcactgcgccaaccctg

SEQ ID NO: 344426 - DNA, 20 bp, human
gcgggctgcacagtggcgta

SEQ ID NO: 344427 - DNA, 20 bp, human
gccacagctcccgaacagga

SEQ ID NO: 344428 - DNA, 20 bp, human
gaaccagaccctgagattgg

SEQ ID NO: 344429 - DNA, 20 bp, human
gcatggatccaccaatctca

SEQ ID NO: 344430 - DNA, 20 bp, human
ggggcggtgtagtctctcaa

SEQ ID NO: 344431 - DNA, 20 bp, human
gagctcccgaacaggaggga

SEQ ID NO: 344432 - DNA, 20 bp, human
gtctgccacagctcccgaac

SEQ ID NO: 344433 - DNA, 20 bp, human
gtgcacagtggcgtacggca

SEQ ID NO: 344434 - DNA, 20 bp, human
gggagctgtggcagacgctc

SEQ ID NO: 344435 - DNA, 20 bp, human
gcaatccgcgggctgcacag

SEQ ID NO: 344436 - DNA, 20 bp, human
gtaccagggtgcaagggata

SEQ ID NO: 344437 - DNA, 20 bp, human
gctcaaggagacctccctac

SEQ ID NO: 344438 - DNA, 20 bp, human
gcaccctggtacagcagcaa

SEQ ID NO: 344439 - DNA, 20 bp, human
gcagggtgcaacctgtaggg

SEQ ID NO: 344440 - DNA, 20 bp, human
gctgctgtaccagggtgcaa

SEQ ID NO: 344441 - DNA, 20 bp, human
gcacacagaggagtacagtg

SEQ ID NO: 344442 - DNA, 20 bp, human
gatagggtgaggggaagtac

SEQ ID NO: 344443 - DNA, 20 bp, human
ggtacagggtgcaacctgta

SEQ ID NO: 344444 - DNA, 20 bp, human
gtatagtaagaggattgcag

SEQ ID NO: 344445 - DNA, 20 bp, human
ggcaccaactacacacacag

SEQ ID NO: 344446 - DNA, 20 bp, human
ggggcgaccccgcaggaagt

SEQ ID NO: 344447 - DNA, 20 bp, human
gaaaagaaagcttgagtcgg

SEQ ID NO: 344448 - DNA, 20 bp, human
gagaatgtgggcgtcgtggg

SEQ ID NO: 344449 - DNA, 20 bp, human
gcaaaacagctcccgtgagc

SEQ ID NO: 344450 - DNA, 20 bp, human
ggcgcgggctccaggaaacg

SEQ ID NO: 344451 - DNA, 20 bp, human
ggggtgggaaaagggatgcc

SEQ ID NO: 344452 - DNA, 20 bp, human
gtctcagaatgtgggcgtcg

SEQ ID NO: 344453 - DNA, 20 bp, human
gtgcgtgcctacttcaggaa

SEQ ID NO: 344454 - DNA, 20 bp, human
ggtgccgcgctacgcccgcc

SEQ ID NO: 344455 - DNA, 20 bp, human
ggctcccggcgggcgtagcg

SEQ ID NO: 344456 - DNA, 20 bp, human
gggagctcgcggggtgtgat

SEQ ID NO: 344457 - DNA, 20 bp, human
ggagcactgtgggagctcgc

SEQ ID NO: 344458 - DNA, 20 bp, human
ggtcctggcggcctccatag

SEQ ID NO: 344459 - DNA, 20 bp, human
gcggaagcgcagtgcggagc

SEQ ID NO: 344460 - DNA, 20 bp, human
gagcgacgcggtcgagtcag

SEQ ID NO: 344461 - DNA, 20 bp, human
gcgccaggaccgctgtactc

SEQ ID NO: 344462 - DNA, 20 bp, human
gacccggagtacagcggtcc

SEQ ID NO: 344463 - DNA, 20 bp, human
gtcagcggcacagaagacgt

SEQ ID NO: 344464 - DNA, 20 bp, human
ggtgaagcggaagcgcagtg

SEQ ID NO: 344465 - DNA, 20 bp, human
gtcagcggcagccactatgg

SEQ ID NO: 344466 - DNA, 20 bp, human
ggcggctgggcgcagaccga

SEQ ID NO: 344467 - DNA, 20 bp, human
gtggaggcggccgagaccct

SEQ ID NO: 344468 - DNA, 20 bp, human
ggcgctgcacacaacttacg

SEQ ID NO: 344469 - DNA, 20 bp, human
gcccctcccctagtctccga

SEQ ID NO: 344470 - DNA, 20 bp, human
gcgagaccctcggagactag

SEQ ID NO: 344471 - DNA, 20 bp, human
gtgtgtgcagcgccagggag

SEQ ID NO: 344472 - DNA, 20 bp, human
gggcggggtaggaggttcgc

SEQ ID NO: 344473 - DNA, 20 bp, human
gtaggtgggagcacgcgcac

SEQ ID NO: 344474 - DNA, 20 bp, human
ggtgcagcgccagggagtgg

SEQ ID NO: 344475 - DNA, 20 bp, human
gtcctgcgcgtctctcctag

SEQ ID NO: 344476 - DNA, 20 bp, human
gctccccggcagaccaatca

SEQ ID NO: 344477 - DNA, 20 bp, human
gaagccctgattggtctgcc

SEQ ID NO: 344478 - DNA, 20 bp, human
ggagaaggtccatccttctc

SEQ ID NO: 344479 - DNA, 20 bp, human
gagggaagggctgccttatt

SEQ ID NO: 344480 - DNA, 20 bp, human
gcagaccaatcagggcttcc

SEQ ID NO: 344481 - DNA, 20 bp, human
gacactatgcatgtccagcg

SEQ ID NO: 344482 - DNA, 20 bp, human
gcagaggtgccttttagaat

SEQ ID NO: 344483 - DNA, 20 bp, human
gcaggatgaaggagtggtcc

SEQ ID NO: 344484 - DNA, 20 bp, human
gtggaatgagatgtgttaga

SEQ ID NO: 344485 - DNA, 20 bp, human
gaaaacagaactggtaggta

SEQ ID NO: 344486 - DNA, 20 bp, human
gggtgcagcgctgccaagca

SEQ ID NO: 344487 - DNA, 20 bp, human
ggtgccatcgctccctgacg

SEQ ID NO: 344488 - DNA, 20 bp, human
gggccgaggtttaagttaaa

SEQ ID NO: 344489 - DNA, 20 bp, human
gactctgtgcccccggcggg

SEQ ID NO: 344490 - DNA, 20 bp, human
gtaacggggagctggagctt

SEQ ID NO: 344491 - DNA, 20 bp, human
ggagcgatggcacccgcagg

SEQ ID NO: 344492 - DNA, 20 bp, human
gccagctccccgttacataa

SEQ ID NO: 344493 - DNA, 20 bp, human
ggggggcacagagtgtgcgc

SEQ ID NO: 344494 - DNA, 20 bp, human
gagggagcgatggcacccgc

SEQ ID NO: 344495 - DNA, 20 bp, human
gcaccctttaacttaaacct

SEQ ID NO: 344496 - DNA, 20 bp, human
gaagggggttagttgggcat

SEQ ID NO: 344497 - DNA, 20 bp, human
gcggcttgtgcctgagaagg

SEQ ID NO: 344498 - DNA, 20 bp, human
gcctgagaagggggttagtt

SEQ ID NO: 344499 - DNA, 20 bp, human
ggagcccaccccaggtactc

SEQ ID NO: 344500 - DNA, 20 bp, human
gtggggtgggctccaagctt

SEQ ID NO: 344501 - DNA, 20 bp, human
gaagccggagtacctggggt

SEQ ID NO: 344502 - DNA, 20 bp, human
gccgcccgaggatgccgtgg

SEQ ID NO: 344503 - DNA, 20 bp, human
ggcacaagccggagtacctg

SEQ ID NO: 344504 - DNA, 20 bp, human
gtgacccccacggcatcctc

SEQ ID NO: 344505 - DNA, 20 bp, human
gctgcctgtcagccaaagct

SEQ ID NO: 344506 - DNA, 20 bp, human
gtacctgttgtgctgatctt

SEQ ID NO: 344507 - DNA, 20 bp, human
gccctcagccagccactatg

SEQ ID NO: 344508 - DNA, 20 bp, human
gccctgctggacggcatcct

SEQ ID NO: 344509 - DNA, 20 bp, human
gtctcattttagccccatag

SEQ ID NO: 344510 - DNA, 20 bp, human
gccactgtttgtctatggag

SEQ ID NO: 344511 - DNA, 20 bp, human
ggggcaaactataatatctc

SEQ ID NO: 344512 - DNA, 20 bp, human
ggcccagcacctatgcactg

SEQ ID NO: 344513 - DNA, 20 bp, human
gaccaaggatgccgtccagc

SEQ ID NO: 344514 - DNA, 20 bp, human
gtgcccaagatcagcacaac

SEQ ID NO: 344515 - DNA, 20 bp, human
gagggccaagcaaatatttg

SEQ ID NO: 344516 - DNA, 20 bp, human
gtcagctgcgactgccgcag

SEQ ID NO: 344517 - DNA, 20 bp, human
gggcacggcacgtgcatcga

SEQ ID NO: 344518 - DNA, 20 bp, human
gggcgccggtagtccagccg

SEQ ID NO: 344519 - DNA, 20 bp, human
gcgacacaaggcggggtagg

SEQ ID NO: 344520 - DNA, 20 bp, human
gagcggccagagatcccgag

SEQ ID NO: 344521 - DNA, 20 bp, human
ggcttctgccagcgcggtga

SEQ ID NO: 344522 - DNA, 20 bp, human
gccccgccttgtgtcgcaga

SEQ ID NO: 344523 - DNA, 20 bp, human
ggcacgtgcatcgacggcat

SEQ ID NO: 344524 - DNA, 20 bp, human
gcgtgccgtgcccgcagcac

SEQ ID NO: 344525 - DNA, 20 bp, human
gccgcgcccctcgggatctc

SEQ ID NO: 344526 - DNA, 20 bp, human
ggaagccggcaaaccgacga

SEQ ID NO: 344527 - DNA, 20 bp, human
ggagcccaaggcccgctcgt

SEQ ID NO: 344528 - DNA, 20 bp, human
ggaccccagtcctcaatcat

SEQ ID NO: 344529 - DNA, 20 bp, human
gacgggcaaaccaacgagag

SEQ ID NO: 344530 - DNA, 20 bp, human
gagccgcgggccaatgattg

SEQ ID NO: 344531 - DNA, 20 bp, human
gcccgccccggcgtccgggt

SEQ ID NO: 344532 - DNA, 20 bp, human
gggcaaaccaacgagagagg

SEQ ID NO: 344533 - DNA, 20 bp, human
gccggctcgcagaccccgag

SEQ ID NO: 344534 - DNA, 20 bp, human
gcgaccctgagggtggacca

SEQ ID NO: 344535 - DNA, 20 bp, human
gggccaatgattgaggactg

SEQ ID NO: 344536 - DNA, 20 bp, human
ggggaggccggccccctagt

SEQ ID NO: 344537 - DNA, 20 bp, human
gggaagcagcccaaggagaa

SEQ ID NO: 344538 - DNA, 20 bp, human
gggcaggagggagcaatgaa

SEQ ID NO: 344539 - DNA, 20 bp, human
gcaatgaagggcggggcaga

SEQ ID NO: 344540 - DNA, 20 bp, human
ggagggagcaatgaagggcg

SEQ ID NO: 344541 - DNA, 20 bp, human
gtcctgccggcgctgactca

SEQ ID NO: 344542 - DNA, 20 bp, human
gcaaggagaagggaaaaggc

SEQ ID NO: 344543 - DNA, 20 bp, human
gtggaaggaggccaggagat

SEQ ID NO: 344544 - DNA, 20 bp, human
gagtgaggaccgtctgggag

SEQ ID NO: 344545 - DNA, 20 bp, human
ggcttggtgagaagtcctgc

SEQ ID NO: 344546 - DNA, 20 bp, human
gcctcagccctgccggcaga

SEQ ID NO: 344547 - DNA, 20 bp, human
gccgccccgctcggtcccag

SEQ ID NO: 344548 - DNA, 20 bp, human
gttgtcaggaatatagggtg

SEQ ID NO: 344549 - DNA, 20 bp, human
gtggcacttcagctgcatgg

SEQ ID NO: 344550 - DNA, 20 bp, human
ggaggcctctgggaccgagc

SEQ ID NO: 344551 - DNA, 20 bp, human
ggaatatagggtgaggcctc

SEQ ID NO: 344552 - DNA, 20 bp, human
gttagacttcacaagcaccc

SEQ ID NO: 344553 - DNA, 20 bp, human
gccgcttaagtgtgcgctgt

SEQ ID NO: 344554 - DNA, 20 bp, human
gtgctgtcttcacggagagc

SEQ ID NO: 344555 - DNA, 20 bp, human
gggcatttgtcaggaatata

SEQ ID NO: 344556 - DNA, 20 bp, human
gtggagctggctcgccgtga

SEQ ID NO: 344557 - DNA, 20 bp, human
gggggcccaaaggctagggt

SEQ ID NO: 344558 - DNA, 20 bp, human
gactcccaggccgaccggga

SEQ ID NO: 344559 - DNA, 20 bp, human
ggtttggggcccaaaggcta

SEQ ID NO: 344560 - DNA, 20 bp, human
gcacccacagggccgtccac

SEQ ID NO: 344561 - DNA, 20 bp, human
gcccactgccattgctcctt

SEQ ID NO: 344562 - DNA, 20 bp, human
ggcgagccagctccacgtcc

SEQ ID NO: 344563 - DNA, 20 bp, human
ggacaatgtgaccctggacg

SEQ ID NO: 344564 - DNA, 20 bp, human
gggccgtccacaggccacac

SEQ ID NO: 344565 - DNA, 20 bp, human
gggcctgtggacggccctgt

SEQ ID NO: 344566 - DNA, 20 bp, human
ggggacagagttcagagtaa

SEQ ID NO: 344567 - DNA, 20 bp, human
gagcccagggatccttgctc

SEQ ID NO: 344568 - DNA, 20 bp, human
ggctccggagcaaggatccc

SEQ ID NO: 344569 - DNA, 20 bp, human
gtgccccttgcccagaccag

SEQ ID NO: 344570 - DNA, 20 bp, human
gaagcaggggctccggagca

SEQ ID NO: 344571 - DNA, 20 bp, human
gggcaaagcctcaggatcac

SEQ ID NO: 344572 - DNA, 20 bp, human
gacaccgggctttgtgatcc

SEQ ID NO: 344573 - DNA, 20 bp, human
gtcagagtaacggaaacggg

SEQ ID NO: 344574 - DNA, 20 bp, human
ggggcagtgactgattaact

SEQ ID NO: 344575 - DNA, 20 bp, human
ggagttcagagtaacggaaa

SEQ ID NO: 344576 - DNA, 20 bp, human
gtaacatcggtgttggagaa

SEQ ID NO: 344577 - DNA, 20 bp, human
gtgtttacactcaggatcca

SEQ ID NO: 344578 - DNA, 20 bp, human
gaggatagaaggatacccag

SEQ ID NO: 344579 - DNA, 20 bp, human
ggcagagatgaggcatccac

SEQ ID NO: 344580 - DNA, 20 bp, human
gctgagtgtaaacatctggg

SEQ ID NO: 344581 - DNA, 20 bp, human
gatctgagtaacatcggtgt

SEQ ID NO: 344582 - DNA, 20 bp, human
ggagatcatctgagtaacat

SEQ ID NO: 344583 - DNA, 20 bp, human
gtatccttctatcctacttg

SEQ ID NO: 344584 - DNA, 20 bp, human
gtggggcagaggaaagcctc

SEQ ID NO: 344585 - DNA, 20 bp, human
gtaccatgggctcaacacag

SEQ ID NO: 344586 - DNA, 20 bp, human
gcgtgtgcgcgtggggcgtg

SEQ ID NO: 344587 - DNA, 20 bp, human
gaaaggcggtggctgggcga

SEQ ID NO: 344588 - DNA, 20 bp, human
gcgcccggcagcacacgcgg

SEQ ID NO: 344589 - DNA, 20 bp, human
gcgggcgccggcgtgagtca

SEQ ID NO: 344590 - DNA, 20 bp, human
gcacgcggggggcacggcgc

SEQ ID NO: 344591 - DNA, 20 bp, human
gagcctccgggccgttataa

SEQ ID NO: 344592 - DNA, 20 bp, human
gcccgcctcgggcgccacgc

SEQ ID NO: 344593 - DNA, 20 bp, human
ggcctgcgtggcgcccgagg

SEQ ID NO: 344594 - DNA, 20 bp, human
gttccggcgcgtgcgaaagg

SEQ ID NO: 344595 - DNA, 20 bp, human
ggccccgccgtgactcacgc

SEQ ID NO: 344596 - DNA, 20 bp, human
gtagcacactggagagagga

SEQ ID NO: 344597 - DNA, 20 bp, human
gttctggagagcaaacaagg

SEQ ID NO: 344598 - DNA, 20 bp, human
gggggtagcacactggagag

SEQ ID NO: 344599 - DNA, 20 bp, human
gcacgttttgaggaatctat

SEQ ID NO: 344600 - DNA, 20 bp, human
gtccctgctttcaatagttt

SEQ ID NO: 344601 - DNA, 20 bp, human
gtaagcagacatccctgggc

SEQ ID NO: 344602 - DNA, 20 bp, human
gcttctaagcagacatccct

SEQ ID NO: 344603 - DNA, 20 bp, human
gggatgtctgcttagaaggc

SEQ ID NO: 344604 - DNA, 20 bp, human
gagtttggggttacatacct

SEQ ID NO: 344605 - DNA, 20 bp, human
gctatatgcctcacgttttg

SEQ ID NO: 344606 - DNA, 20 bp, human
gggagagtcctgtcttccgg

SEQ ID NO: 344607 - DNA, 20 bp, human
gtgaagggctccagactctc

SEQ ID NO: 344608 - DNA, 20 bp, human
gcaccccaccgcgtgctctc

SEQ ID NO: 344609 - DNA, 20 bp, human
gagcccggctccgacgagtg

SEQ ID NO: 344610 - DNA, 20 bp, human
ggcacccgggtcgcgcgcgc

SEQ ID NO: 344611 - DNA, 20 bp, human
gtctcgggctggtgcgtcca

SEQ ID NO: 344612 - DNA, 20 bp, human
gcagcccgagagcacgcggt

SEQ ID NO: 344613 - DNA, 20 bp, human
gggtgcggtgccacgactgg

SEQ ID NO: 344614 - DNA, 20 bp, human
gcaagcgcacggtagaaacc

SEQ ID NO: 344615 - DNA, 20 bp, human
gtgtgtggtccgattcagac

SEQ ID NO: 344616 - DNA, 20 bp, human
gtaagagaaaggttgagaga

SEQ ID NO: 344617 - DNA, 20 bp, human
gacagaatgctcaagtacag

SEQ ID NO: 344618 - DNA, 20 bp, human
gcctctgtctggatttttat

SEQ ID NO: 344619 - DNA, 20 bp, human
gcactgtcctagcaggccct

SEQ ID NO: 344620 - DNA, 20 bp, human
gatccaatcactgtcctagc

SEQ ID NO: 344621 - DNA, 20 bp, human
gatagttgcagttgccagtt

SEQ ID NO: 344622 - DNA, 20 bp, human
gaacttttgataaattgttc

SEQ ID NO: 344623 - DNA, 20 bp, human
gcaatttatcaaaagttatg

SEQ ID NO: 344624 - DNA, 20 bp, human
gggcctgctaggacagtgat

SEQ ID NO: 344625 - DNA, 20 bp, human
gatggtgtagagcaggagga

SEQ ID NO: 344626 - DNA, 20 bp, human
gggcgcaagcgttgcaagaa

SEQ ID NO: 344627 - DNA, 20 bp, human
gtaagtaagggactctgcgg

SEQ ID NO: 344628 - DNA, 20 bp, human
ggcttcgccacgtagccctg

SEQ ID NO: 344629 - DNA, 20 bp, human
ggttgcaagaagggagtgca

SEQ ID NO: 344630 - DNA, 20 bp, human
ggccctggacgcactctgat

SEQ ID NO: 344631 - DNA, 20 bp, human
ggactctgcggggggaaaag

SEQ ID NO: 344632 - DNA, 20 bp, human
gggtagctgcattctaagta

SEQ ID NO: 344633 - DNA, 20 bp, human
gcaggcacctctacaggaaa

SEQ ID NO: 344634 - DNA, 20 bp, human
gtccaatcagagtgcgtcca

SEQ ID NO: 344635 - DNA, 20 bp, human
ggttgagcaggcacctctac

SEQ ID NO: 344636 - DNA, 20 bp, human
ggcctccagcctaatccgga

SEQ ID NO: 344637 - DNA, 20 bp, human
gtcacagaaggtcccttctc

SEQ ID NO: 344638 - DNA, 20 bp, human
gagggaccttctgtgagtca

SEQ ID NO: 344639 - DNA, 20 bp, human
gcagcctaatccggatgggt

SEQ ID NO: 344640 - DNA, 20 bp, human
gcctaatccggatgggtggg

SEQ ID NO: 344641 - DNA, 20 bp, human
gcaaagccatgactcacaga

SEQ ID NO: 344642 - DNA, 20 bp, human
gcaacctgctccagagccac

SEQ ID NO: 344643 - DNA, 20 bp, human
gcacagaccctttatgggtt

SEQ ID NO: 344644 - DNA, 20 bp, human
gtatttcccgaacccataaa

SEQ ID NO: 344645 - DNA, 20 bp, human
gtagagaaagcttgagatct

SEQ ID NO: 344646 - DNA, 20 bp, human
gtgcaaggatctaggtggtg

SEQ ID NO: 344647 - DNA, 20 bp, human
gtggcctcgggtggaagcct

SEQ ID NO: 344648 - DNA, 20 bp, human
gttccacccgaggccaccaa

SEQ ID NO: 344649 - DNA, 20 bp, human
gcacccgaggccaccaaggg

SEQ ID NO: 344650 - DNA, 20 bp, human
gtcagggtgggcctctgttc

SEQ ID NO: 344651 - DNA, 20 bp, human
ggccaccagctgggtccgaa

SEQ ID NO: 344652 - DNA, 20 bp, human
gccgttgcctgcaaggatct

SEQ ID NO: 344653 - DNA, 20 bp, human
gggaccgcccttggtggcct

SEQ ID NO: 344654 - DNA, 20 bp, human
gctgccttggagcataggaa

SEQ ID NO: 344655 - DNA, 20 bp, human
gaaaggcacctcagcagctt

SEQ ID NO: 344656 - DNA, 20 bp, human
gagggaaggtgttctgtcgg

SEQ ID NO: 344657 - DNA, 20 bp, human
gctcagggaggatcacaagc

SEQ ID NO: 344658 - DNA, 20 bp, human
gatgagggaaggtgttctgt

SEQ ID NO: 344659 - DNA, 20 bp, human
gcaagggctcgtattcccag

SEQ ID NO: 344660 - DNA, 20 bp, human
gtcggagggtccagggactg

SEQ ID NO: 344661 - DNA, 20 bp, human
gaggatcacaagccggatga

SEQ ID NO: 344662 - DNA, 20 bp, human
gggcccatccaatcactaca

SEQ ID NO: 344663 - DNA, 20 bp, human
gtgttctgtcggagggtcca

SEQ ID NO: 344664 - DNA, 20 bp, human
gtcacaagccggatgaggga

SEQ ID NO: 344665 - DNA, 20 bp, human
ggtccagggactggggccaa

SEQ ID NO: 344666 - DNA, 20 bp, human
gaggaagcttttcggagctg

SEQ ID NO: 344667 - DNA, 20 bp, human
gggaggaaaagcagcaacta

SEQ ID NO: 344668 - DNA, 20 bp, human
ggtgacgtttccaaagggga

SEQ ID NO: 344669 - DNA, 20 bp, human
ggggggatgggctctagtgt

SEQ ID NO: 344670 - DNA, 20 bp, human
gggatgggctctagtgttgg

SEQ ID NO: 344671 - DNA, 20 bp, human
ggcccccggctgttccgccg

SEQ ID NO: 344672 - DNA, 20 bp, human
gtgtctcagcagtgtttact

SEQ ID NO: 344673 - DNA, 20 bp, human
gaaagcagcaactagggagc

SEQ ID NO: 344674 - DNA, 20 bp, human
ggagaggggaagtgataaca

SEQ ID NO: 344675 - DNA, 20 bp, human
gtcaagaggacaggatccct

SEQ ID NO: 344676 - DNA, 20 bp, human
gcccaggcggcggccatctt

SEQ ID NO: 344677 - DNA, 20 bp, human
ggggagtggcccttggaacc

SEQ ID NO: 344678 - DNA, 20 bp, human
gacgctgcacgggtgttgat

SEQ ID NO: 344679 - DNA, 20 bp, human
gcggctgaggcgcaggaaag

SEQ ID NO: 344680 - DNA, 20 bp, human
gtcacccgcgaacctggaaa

SEQ ID NO: 344681 - DNA, 20 bp, human
gggaaagaggagagcacacg

SEQ ID NO: 344682 - DNA, 20 bp, human
ggggaggtcacccgcgaacc

SEQ ID NO: 344683 - DNA, 20 bp, human
gggcgcaagctgggcggaac

SEQ ID NO: 344684 - DNA, 20 bp, human
ggcgcaaaacctcagcccct

SEQ ID NO: 344685 - DNA, 20 bp, human
gtttgcgcgcctggttccaa

SEQ ID NO: 344686 - DNA, 20 bp, human
gtcagacacgaggtatggtg

SEQ ID NO: 344687 - DNA, 20 bp, human
gcacactcagacacgaggta

SEQ ID NO: 344688 - DNA, 20 bp, human
gggtcctggtgtgggaatat

SEQ ID NO: 344689 - DNA, 20 bp, human
gacagcccccaccagctcat

SEQ ID NO: 344690 - DNA, 20 bp, human
gcccgaagcacctgacatga

SEQ ID NO: 344691 - DNA, 20 bp, human
gggcgggaaagggtggtcac

SEQ ID NO: 344692 - DNA, 20 bp, human
gagggcgtctggcgctgttg

SEQ ID NO: 344693 - DNA, 20 bp, human
ggggtccccgccctcatgtc

SEQ ID NO: 344694 - DNA, 20 bp, human
gaataaatggcgagcgatta

SEQ ID NO: 344695 - DNA, 20 bp, human
gggaatataggcatccatag

SEQ ID NO: 344696 - DNA, 20 bp, human
gcgcgcccgcggcgcttaaa

SEQ ID NO: 344697 - DNA, 20 bp, human
gtgcctaaggagtgcgagtt

SEQ ID NO: 344698 - DNA, 20 bp, human
ggcccgaactcgcactcctt

SEQ ID NO: 344699 - DNA, 20 bp, human
ggcgaggtcccccagcgcgg

SEQ ID NO: 344700 - DNA, 20 bp, human
gtcccgggggtcctcggtca

SEQ ID NO: 344701 - DNA, 20 bp, human
gcccgcggcgcttaaagggc

SEQ ID NO: 344702 - DNA, 20 bp, human
gcacgcggagaaaagcaata

SEQ ID NO: 344703 - DNA, 20 bp, human
gtcgctcggcgatggggttg

SEQ ID NO: 344704 - DNA, 20 bp, human
gcgcgcgcagtgcgtgccta

SEQ ID NO: 344705 - DNA, 20 bp, human
gcagtagagcgcgcgcgggt

SEQ ID NO: 344706 - DNA, 20 bp, human
ggcccgcagatggctcgctc

SEQ ID NO: 344707 - DNA, 20 bp, human
ggaggcgccttcggattcaa

SEQ ID NO: 344708 - DNA, 20 bp, human
ggcgccttcggattcaaggg

SEQ ID NO: 344709 - DNA, 20 bp, human
gcaaggcaagagaacttggg

SEQ ID NO: 344710 - DNA, 20 bp, human
ggccccagcacccaatcgcg

SEQ ID NO: 344711 - DNA, 20 bp, human
gtatccccccttgaatccga

SEQ ID NO: 344712 - DNA, 20 bp, human
gggccggagcgagccatctg

SEQ ID NO: 344713 - DNA, 20 bp, human
gcccaatcgcgaggcgcctt

SEQ ID NO: 344714 - DNA, 20 bp, human
gagacacagctgaaggaaac

SEQ ID NO: 344715 - DNA, 20 bp, human
ggattcaaggggggatagca

SEQ ID NO: 344716 - DNA, 20 bp, human
gcagggctcatgaacctcct

SEQ ID NO: 344717 - DNA, 20 bp, human
ggaggaaggattcagattct

SEQ ID NO: 344718 - DNA, 20 bp, human
gaatgtgcaaacattcaacg

SEQ ID NO: 344719 - DNA, 20 bp, human
gactccgagagtgatcttac

SEQ ID NO: 344720 - DNA, 20 bp, human
gttcagattctgggatgcca

SEQ ID NO: 344721 - DNA, 20 bp, human
gtccagctgaggaaataagg

SEQ ID NO: 344722 - DNA, 20 bp, human
gaggaagcccagcgcattct

SEQ ID NO: 344723 - DNA, 20 bp, human
gctccctgtaagatcactct

SEQ ID NO: 344724 - DNA, 20 bp, human
gagtgcacccagaatgcgct

SEQ ID NO: 344725 - DNA, 20 bp, human
gtcttcctgtctctaatttc

SEQ ID NO: 344726 - DNA, 20 bp, human
ggtgaaggctcagaggaccc

SEQ ID NO: 344727 - DNA, 20 bp, human
ggcagcaggtgcaaggtgga

SEQ ID NO: 344728 - DNA, 20 bp, human
gcatgcccgtgtgtggtcaa

SEQ ID NO: 344729 - DNA, 20 bp, human
ggcagagaaatgaacggtga

SEQ ID NO: 344730 - DNA, 20 bp, human
gtggcacccatgcccgtgtg

SEQ ID NO: 344731 - DNA, 20 bp, human
gtggtcaatggaggtgagat

SEQ ID NO: 344732 - DNA, 20 bp, human
ggcccgtgtgtggtcaatgg

SEQ ID NO: 344733 - DNA, 20 bp, human
gacagccaaagtccaggctg

SEQ ID NO: 344734 - DNA, 20 bp, human
ggcctcaaacagaaaacgtc

SEQ ID NO: 344735 - DNA, 20 bp, human
gggaggtgagataggccctg

SEQ ID NO: 344736 - DNA, 20 bp, human
gcactcacgcacagctgctt

SEQ ID NO: 344737 - DNA, 20 bp, human
gcacgtaaacctccctacga

SEQ ID NO: 344738 - DNA, 20 bp, human
gccctacgaggggaaactac

SEQ ID NO: 344739 - DNA, 20 bp, human
gtggcccggggcgcctgtgg

SEQ ID NO: 344740 - DNA, 20 bp, human
ggccggagggcgccgccagt

SEQ ID NO: 344741 - DNA, 20 bp, human
ggaaactacaggcgcgctgc

SEQ ID NO: 344742 - DNA, 20 bp, human
ggctgtgcgtgagtgcccac

SEQ ID NO: 344743 - DNA, 20 bp, human
gctacaggcgcgctgccgga

SEQ ID NO: 344744 - DNA, 20 bp, human
gtgaacgtggacggaaaccc

SEQ ID NO: 344745 - DNA, 20 bp, human
gaggtttacgtgaacgtgga

SEQ ID NO: 344746 - DNA, 20 bp, human
ggacgccccagccaatcctc

SEQ ID NO: 344747 - DNA, 20 bp, human
gaaagcgccggaggattggc

SEQ ID NO: 344748 - DNA, 20 bp, human
gccgtaaagcgccggaggat

SEQ ID NO: 344749 - DNA, 20 bp, human
gggaacgagccgagtcaatc

SEQ ID NO: 344750 - DNA, 20 bp, human
gacgaacactcggttatttc

SEQ ID NO: 344751 - DNA, 20 bp, human
gggctcgttccgtaaagcgc

SEQ ID NO: 344752 - DNA, 20 bp, human
gaatgcagccgggcaggaaa

SEQ ID NO: 344753 - DNA, 20 bp, human
gtcccagaatgcagccgggc

SEQ ID NO: 344754 - DNA, 20 bp, human
gggaaagggcaatttccgtt

SEQ ID NO: 344755 - DNA, 20 bp, human
gtcctgcccggctgcattct

SEQ ID NO: 344756 - DNA, 20 bp, human
ggtagcgacggcacgccgta

SEQ ID NO: 344757 - DNA, 20 bp, human
gcgttcagcctccaagaaag

SEQ ID NO: 344758 - DNA, 20 bp, human
ggccctccttggtcacgtgt

SEQ ID NO: 344759 - DNA, 20 bp, human
ggaaagcaaggaaattgctc

SEQ ID NO: 344760 - DNA, 20 bp, human
gcccaacacgtgaccaagga

SEQ ID NO: 344761 - DNA, 20 bp, human
gggagacagcggcgtggcgg

SEQ ID NO: 344762 - DNA, 20 bp, human
gaaaccttctgaccgcccta

SEQ ID NO: 344763 - DNA, 20 bp, human
gatacggctgcgcgaattgg

SEQ ID NO: 344764 - DNA, 20 bp, human
gtagctaataggtttagcct

SEQ ID NO: 344765 - DNA, 20 bp, human
gcaaatacggctgcgcgaat

SEQ ID NO: 344766 - DNA, 20 bp, human
gggcactaggcggagagagg

SEQ ID NO: 344767 - DNA, 20 bp, human
gggtaagccgcgaggaggaa

SEQ ID NO: 344768 - DNA, 20 bp, human
gcggccaggaacatcgcgag

SEQ ID NO: 344769 - DNA, 20 bp, human
gggccacgtcccgccgtcct

SEQ ID NO: 344770 - DNA, 20 bp, human
gtagcaggatcggtccacag

SEQ ID NO: 344771 - DNA, 20 bp, human
gccgaagcgaagccggaaac

SEQ ID NO: 344772 - DNA, 20 bp, human
gagggattcggggtggacgt

SEQ ID NO: 344773 - DNA, 20 bp, human
gaatcgctgtggccggacga

SEQ ID NO: 344774 - DNA, 20 bp, human
gtttaagcagggattcgggg

SEQ ID NO: 344775 - DNA, 20 bp, human
ggacggcgggacgtggccct

SEQ ID NO: 344776 - DNA, 20 bp, human
ggcaacgaagggacggtctg

SEQ ID NO: 344777 - DNA, 20 bp, human
gtacgtcatgcgcccctctt

SEQ ID NO: 344778 - DNA, 20 bp, human
gccactccgtacacctaaga

SEQ ID NO: 344779 - DNA, 20 bp, human
gtggtgtcgcaacgaaggga

SEQ ID NO: 344780 - DNA, 20 bp, human
gctagttggtgtcgcaacga

SEQ ID NO: 344781 - DNA, 20 bp, human
gggggcggggccacgccgat

SEQ ID NO: 344782 - DNA, 20 bp, human
gtaggtgtacggagtgggcg

SEQ ID NO: 344783 - DNA, 20 bp, human
gcgaagggacggtctggggg

SEQ ID NO: 344784 - DNA, 20 bp, human
ggtgggcggggcgagctagt

SEQ ID NO: 344785 - DNA, 20 bp, human
gagggcttgcggctagccgg

SEQ ID NO: 344786 - DNA, 20 bp, human
gaacgcggggacctaggaag

SEQ ID NO: 344787 - DNA, 20 bp, human
ggcagagaacgcggggacct

SEQ ID NO: 344788 - DNA, 20 bp, human
gccaatcagagacgctcagt

SEQ ID NO: 344789 - DNA, 20 bp, human
gcttcagcgtgcagagaacg

SEQ ID NO: 344790 - DNA, 20 bp, human
gtatccgagaggggtctcct

SEQ ID NO: 344791 - DNA, 20 bp, human
gaacaagatggcgggcccgg

SEQ ID NO: 344792 - DNA, 20 bp, human
gcagccatgcgaacccttcc

SEQ ID NO: 344793 - DNA, 20 bp, human
gacctccgtacctgactctt

SEQ ID NO: 344794 - DNA, 20 bp, human
gcccctgggaacaagatggc

SEQ ID NO: 344795 - DNA, 20 bp, human
gggcccgccatcttgttccc

SEQ ID NO: 344796 - DNA, 20 bp, human
gcggtccccgccctcgctcg

SEQ ID NO: 344797 - DNA, 20 bp, human
gtccccgccctcgctcgcgg

SEQ ID NO: 344798 - DNA, 20 bp, human
gcacgggcagcgaggatccc

SEQ ID NO: 344799 - DNA, 20 bp, human
ggggcgctgtgtttaagatc

SEQ ID NO: 344800 - DNA, 20 bp, human
gtacctgcctttccctccat

SEQ ID NO: 344801 - DNA, 20 bp, human
gtggggccgcacgggcagcg

SEQ ID NO: 344802 - DNA, 20 bp, human
gctccatagggacttcccaa

SEQ ID NO: 344803 - DNA, 20 bp, human
gaaacgccctcctttccttt

SEQ ID NO: 344804 - DNA, 20 bp, human
gccccgccccgccgcgagcg

SEQ ID NO: 344805 - DNA, 20 bp, human
gaggaaaggagggcgtttag

SEQ ID NO: 344806 - DNA, 20 bp, human
gacaagacgtgggccaagag

SEQ ID NO: 344807 - DNA, 20 bp, human
gcgcggaagacgaggttctg

SEQ ID NO: 344808 - DNA, 20 bp, human
gtgcgtcactgacaagacgt

SEQ ID NO: 344809 - DNA, 20 bp, human
gaacctccaggaaaagctcg

SEQ ID NO: 344810 - DNA, 20 bp, human
ggaaaagctcgcggaagacg

SEQ ID NO: 344811 - DNA, 20 bp, human
ggaactctggagcgagtcaa

SEQ ID NO: 344812 - DNA, 20 bp, human
gaaatggcgtcgtggcattg

SEQ ID NO: 344813 - DNA, 20 bp, human
gggagcggcgcggagcatga

SEQ ID NO: 344814 - DNA, 20 bp, human
ggtagtaggaaatggcgtcg

SEQ ID NO: 344815 - DNA, 20 bp, human
gcgcggtggacggtctgaaa

SEQ ID NO: 344816 - DNA, 20 bp, human
ggcgacgccgagtgaggctg

SEQ ID NO: 344817 - DNA, 20 bp, human
gccgcagagctgcgtgtcgg

SEQ ID NO: 344818 - DNA, 20 bp, human
gtcggcgtcgcctgcatggg

SEQ ID NO: 344819 - DNA, 20 bp, human
gctacggggcgggatcagcg

SEQ ID NO: 344820 - DNA, 20 bp, human
gcgggatcagcggggccaac

SEQ ID NO: 344821 - DNA, 20 bp, human
ggggaagcccgtcagcctgt

SEQ ID NO: 344822 - DNA, 20 bp, human
ggcggggccaacaggctgac

SEQ ID NO: 344823 - DNA, 20 bp, human
ggcgtcgcctgcatgggggg

SEQ ID NO: 344824 - DNA, 20 bp, human
ggatcccgccccgtagcgca

SEQ ID NO: 344825 - DNA, 20 bp, human
gtcctcccccccccccatgc

SEQ ID NO: 344826 - DNA, 20 bp, human
gagcggggccccaaccggcc

SEQ ID NO: 344827 - DNA, 20 bp, human
ggcccccgaccgtcagtcag

SEQ ID NO: 344828 - DNA, 20 bp, human
ggggccgggaccgaacacac

SEQ ID NO: 344829 - DNA, 20 bp, human
gcggcgagcggggccccaac

SEQ ID NO: 344830 - DNA, 20 bp, human
ggggaccgaacacaccgggc

SEQ ID NO: 344831 - DNA, 20 bp, human
gccaaccggcccggtgtgtt

SEQ ID NO: 344832 - DNA, 20 bp, human
gccccccggcacggagaacc

SEQ ID NO: 344833 - DNA, 20 bp, human
ggcggcctggccaatcagag

SEQ ID NO: 344834 - DNA, 20 bp, human
gtgctcccgcctctgactga

SEQ ID NO: 344835 - DNA, 20 bp, human
ggggcctggttctccgtgcc

SEQ ID NO: 344836 - DNA, 20 bp, human
gtacgccctgcgctagtccc

SEQ ID NO: 344837 - DNA, 20 bp, human
ggaggggagccaacaagaga

SEQ ID NO: 344838 - DNA, 20 bp, human
gatggtgggcggtgctgcta

SEQ ID NO: 344839 - DNA, 20 bp, human
gcagcttccgggagcatggt

SEQ ID NO: 344840 - DNA, 20 bp, human
ggcggtgctgctaaggattg

SEQ ID NO: 344841 - DNA, 20 bp, human
ggcggctcccggacggtgga

SEQ ID NO: 344842 - DNA, 20 bp, human
gtgcgctagtcccgggacgt

SEQ ID NO: 344843 - DNA, 20 bp, human
ggcgtagtgtcgcagcttcc

SEQ ID NO: 344844 - DNA, 20 bp, human
gcgcatgtgccgaccgtgta

SEQ ID NO: 344845 - DNA, 20 bp, human
gggacgtggggttttatatc

SEQ ID NO: 344846 - DNA, 20 bp, human
gggagcgcctcctcgtggag

SEQ ID NO: 344847 - DNA, 20 bp, human
gtagggggcaggaacgtggt

SEQ ID NO: 344848 - DNA, 20 bp, human
gtggagaggcggaagaagct

SEQ ID NO: 344849 - DNA, 20 bp, human
gaacgtggtaggcgcgtgcg

SEQ ID NO: 344850 - DNA, 20 bp, human
gggcggaagtcccgacgtcc

SEQ ID NO: 344851 - DNA, 20 bp, human
gacttccggccgcggctagg

SEQ ID NO: 344852 - DNA, 20 bp, human
gcggctagggggcaggaacg

SEQ ID NO: 344853 - DNA, 20 bp, human
gggaccctaactggcccctg

SEQ ID NO: 344854 - DNA, 20 bp, human
gccgcccagggaatcaaaag

SEQ ID NO: 344855 - DNA, 20 bp, human
ggcgcctcctcgtggagagg

SEQ ID NO: 344856 - DNA, 20 bp, human
gaacgcaagggggtgtggtc

SEQ ID NO: 344857 - DNA, 20 bp, human
ggaggaggcgggcccatagg

SEQ ID NO: 344858 - DNA, 20 bp, human
gggaaaggctttgaacgcaa

SEQ ID NO: 344859 - DNA, 20 bp, human
gtgagagagcgaagtctaaa

SEQ ID NO: 344860 - DNA, 20 bp, human
gacagacctcagcgtgtgat

SEQ ID NO: 344861 - DNA, 20 bp, human
gacagcctcggaaatggagg

SEQ ID NO: 344862 - DNA, 20 bp, human
ggcacactgcgccgaggagg

SEQ ID NO: 344863 - DNA, 20 bp, human
gcccgcctcctccatttccg

SEQ ID NO: 344864 - DNA, 20 bp, human
ggaaacagcctcggaaatgg

SEQ ID NO: 344865 - DNA, 20 bp, human
gcggcgccgaggtgctcaga

SEQ ID NO: 344866 - DNA, 20 bp, human
gcaacagggggcaatcaagt

SEQ ID NO: 344867 - DNA, 20 bp, human
gggggcaatcaagtgggtag

SEQ ID NO: 344868 - DNA, 20 bp, human
ggaggcctgcaaccagggaa

SEQ ID NO: 344869 - DNA, 20 bp, human
gccctgttgccgctggggtg

SEQ ID NO: 344870 - DNA, 20 bp, human
gcacccaaagctagaaccta

SEQ ID NO: 344871 - DNA, 20 bp, human
gcaaagctagaacctagggt

SEQ ID NO: 344872 - DNA, 20 bp, human
gccggaggcccgacgggtgg

SEQ ID NO: 344873 - DNA, 20 bp, human
gaggccccgggggatagtga

SEQ ID NO: 344874 - DNA, 20 bp, human
gcacgggcagctcctcccac

SEQ ID NO: 344875 - DNA, 20 bp, human
gtggcctgatggcccgctgg

SEQ ID NO: 344876 - DNA, 20 bp, human
gcaagactggccagaagaat

SEQ ID NO: 344877 - DNA, 20 bp, human
ggggtacagcttggagaatc

SEQ ID NO: 344878 - DNA, 20 bp, human
gtggcatggctttatctaat

SEQ ID NO: 344879 - DNA, 20 bp, human
gttggagaatcaggagcaaa

SEQ ID NO: 344880 - DNA, 20 bp, human
gtgggctgtatctggatgtc

SEQ ID NO: 344881 - DNA, 20 bp, human
gtccccaaaagcatatttcc

SEQ ID NO: 344882 - DNA, 20 bp, human
gttatctaatgggatgaacc

SEQ ID NO: 344883 - DNA, 20 bp, human
gtggttcagcatgtacctgg

SEQ ID NO: 344884 - DNA, 20 bp, human
gatgcttttggggagcaaca

SEQ ID NO: 344885 - DNA, 20 bp, human
gagattagcaaaatgtcttg

SEQ ID NO: 344886 - DNA, 20 bp, human
gtagctaggctgttggggac

SEQ ID NO: 344887 - DNA, 20 bp, human
gtgggtgaagagcatgaacg

SEQ ID NO: 344888 - DNA, 20 bp, human
gagcccggccccctgtagct

SEQ ID NO: 344889 - DNA, 20 bp, human
gacctgagagaatcggaagg

SEQ ID NO: 344890 - DNA, 20 bp, human
gggacaggagacgttggact

SEQ ID NO: 344891 - DNA, 20 bp, human
gccctgtagctaggctgttg

SEQ ID NO: 344892 - DNA, 20 bp, human
ggggatgctggtgacgtctg

SEQ ID NO: 344893 - DNA, 20 bp, human
gtaagagggagcgaagggcg

SEQ ID NO: 344894 - DNA, 20 bp, human
gctacagggggccgggctat

SEQ ID NO: 344895 - DNA, 20 bp, human
gtgttggggacaggagacgt

SEQ ID NO: 344896 - DNA, 20 bp, human
gaagggggaagggaccctaa

SEQ ID NO: 344897 - DNA, 20 bp, human
gtgggaccgcgcgccgcaag

SEQ ID NO: 344898 - DNA, 20 bp, human
gcgcgcgccgcaagggggaa

SEQ ID NO: 344899 - DNA, 20 bp, human
gcgcggtcccaaattgaccc

SEQ ID NO: 344900 - DNA, 20 bp, human
gagccctgtgaaactaatat

SEQ ID NO: 344901 - DNA, 20 bp, human
gggttgttactcaaccgtta

SEQ ID NO: 344902 - DNA, 20 bp, human
gttagtctaaaagtgtgaag

SEQ ID NO: 344903 - DNA, 20 bp, human
ggataagaaacgtgaaacaa

SEQ ID NO: 344904 - DNA, 20 bp, human
gataaggtcttctattcgga

SEQ ID NO: 344905 - DNA, 20 bp, human
gagagacccagggtcaattt

SEQ ID NO: 344906 - DNA, 20 bp, human
ggggagctggaaagtgccgg

SEQ ID NO: 344907 - DNA, 20 bp, human
ggggctgcgaagcacctcga

SEQ ID NO: 344908 - DNA, 20 bp, human
gaggaagagcgggcgtggag

SEQ ID NO: 344909 - DNA, 20 bp, human
ggcggctagatgtagggaag

SEQ ID NO: 344910 - DNA, 20 bp, human
ggcgtccaaaactgctgcca

SEQ ID NO: 344911 - DNA, 20 bp, human
ggggcacagagggagagttc

SEQ ID NO: 344912 - DNA, 20 bp, human
gggggagagccaatgaaccg

SEQ ID NO: 344913 - DNA, 20 bp, human
gcgggcttcaggaccaccca

SEQ ID NO: 344914 - DNA, 20 bp, human
gagcgcggcggctagatgta

SEQ ID NO: 344915 - DNA, 20 bp, human
ggcggagcaaggacaccttc

SEQ ID NO: 344916 - DNA, 20 bp, human
gaggccgccatctcggatga

SEQ ID NO: 344917 - DNA, 20 bp, human
ggctcggccgctgtagtcag

SEQ ID NO: 344918 - DNA, 20 bp, human
gccgggcatccgaagagcgt

SEQ ID NO: 344919 - DNA, 20 bp, human
gcgctgtagtcagtggtgtg

SEQ ID NO: 344920 - DNA, 20 bp, human
ggcggcgccgggcgctgcga

SEQ ID NO: 344921 - DNA, 20 bp, human
gagatcgtatacctcctcgg

SEQ ID NO: 344922 - DNA, 20 bp, human
gagtggtgtggggtgcgcaa

SEQ ID NO: 344923 - DNA, 20 bp, human
gcgctctagccgacgctctt

SEQ ID NO: 344924 - DNA, 20 bp, human
ggaacctgtgacatgcccct

SEQ ID NO: 344925 - DNA, 20 bp, human
ggccatctcggatgagggca

SEQ ID NO: 344926 - DNA, 20 bp, human
ggcagtgggtgtagccacag

SEQ ID NO: 344927 - DNA, 20 bp, human
gcacaggggtggagtcgggc

SEQ ID NO: 344928 - DNA, 20 bp, human
gcgtggcccaccagtgggta

SEQ ID NO: 344929 - DNA, 20 bp, human
ggctccccagggaccaaaac

SEQ ID NO: 344930 - DNA, 20 bp, human
gtgggtaaggcgcggggcag

SEQ ID NO: 344931 - DNA, 20 bp, human
gactagagcccggacagcgg

SEQ ID NO: 344932 - DNA, 20 bp, human
gccaccagtgggtaaggcgc

SEQ ID NO: 344933 - DNA, 20 bp, human
gcgggctggcacgatgggcg

SEQ ID NO: 344934 - DNA, 20 bp, human
gacagcggaggcacctagct

SEQ ID NO: 344935 - DNA, 20 bp, human
gggagtcgggctggcacgat

SEQ ID NO: 344936 - DNA, 20 bp, human
ggatggagacggtgtttcgt

SEQ ID NO: 344937 - DNA, 20 bp, human
gtggctcagtagcctatctt

SEQ ID NO: 344938 - DNA, 20 bp, human
ggcgaatcagcgagcggaga

SEQ ID NO: 344939 - DNA, 20 bp, human
ggataggctactgagccaat

SEQ ID NO: 344940 - DNA, 20 bp, human
ggtgtttcgtgggctccgat

SEQ ID NO: 344941 - DNA, 20 bp, human
ggctgattcgctccaaagat

SEQ ID NO: 344942 - DNA, 20 bp, human
gccaggaggggaaccgcctg

SEQ ID NO: 344943 - DNA, 20 bp, human
gagagggagggatacagacc

SEQ ID NO: 344944 - DNA, 20 bp, human
gcctctccagtcccggcgca

SEQ ID NO: 344945 - DNA, 20 bp, human
gcagctgctgggatgccagg

SEQ ID NO: 344946 - DNA, 20 bp, human
ggcacagcccggcttgtgat

SEQ ID NO: 344947 - DNA, 20 bp, human
gggcgcttctggtatgaata

SEQ ID NO: 344948 - DNA, 20 bp, human
ggaagcgcctcagctctgat

SEQ ID NO: 344949 - DNA, 20 bp, human
gaggggaaggaaagccggag

SEQ ID NO: 344950 - DNA, 20 bp, human
gcgcctcagctctgattggc

SEQ ID NO: 344951 - DNA, 20 bp, human
ggcagagaagagcttgagat

SEQ ID NO: 344952 - DNA, 20 bp, human
ggaggccctccgtgctagta

SEQ ID NO: 344953 - DNA, 20 bp, human
gtctggtatgaataaggaga

SEQ ID NO: 344954 - DNA, 20 bp, human
gcaaaacgccgcaggaggat

SEQ ID NO: 344955 - DNA, 20 bp, human
gtaagcgccgccgcggtctg

SEQ ID NO: 344956 - DNA, 20 bp, human
gactgagcgcgagcagggcc

SEQ ID NO: 344957 - DNA, 20 bp, human
ggagagactgagcgcgagca

SEQ ID NO: 344958 - DNA, 20 bp, human
gatcccgggcgcatcggaac

SEQ ID NO: 344959 - DNA, 20 bp, human
gcaggctcgcattgcaccca

SEQ ID NO: 344960 - DNA, 20 bp, human
gtaacccagggaaagggcgg

SEQ ID NO: 344961 - DNA, 20 bp, human
gcgtctgcctaccacggggg

SEQ ID NO: 344962 - DNA, 20 bp, human
gagctcaactccagctccct

SEQ ID NO: 344963 - DNA, 20 bp, human
gaaacgcgccctacaccccc

SEQ ID NO: 344964 - DNA, 20 bp, human
ggctgtgccatcttgtgtat

SEQ ID NO: 344965 - DNA, 20 bp, human
gacacaagatggcacagccg

SEQ ID NO: 344966 - DNA, 20 bp, human
gaatcactctggtccgactg

SEQ ID NO: 344967 - DNA, 20 bp, human
gcccgcccccaggagatttc

SEQ ID NO: 344968 - DNA, 20 bp, human
ggaggaaacggttgctctag

SEQ ID NO: 344969 - DNA, 20 bp, human
ggaagccggaaatctcctgg

SEQ ID NO: 344970 - DNA, 20 bp, human
gggcggagcggagcccttta

SEQ ID NO: 344971 - DNA, 20 bp, human
ggtactggcctagccgtaaa

SEQ ID NO: 344972 - DNA, 20 bp, human
gggttgctctaggggcggag

SEQ ID NO: 344973 - DNA, 20 bp, human
gcactctggtccgactgagg

SEQ ID NO: 344974 - DNA, 20 bp, human
gcaaccgtttcctcctcagt

SEQ ID NO: 344975 - DNA, 20 bp, human
ggtgccgaagcacggggtct

SEQ ID NO: 344976 - DNA, 20 bp, human
gcgccggtccccgtcttccg

SEQ ID NO: 344977 - DNA, 20 bp, human
gaagacggggaccggcgatt

SEQ ID NO: 344978 - DNA, 20 bp, human
gaagacccgggatccacggg

SEQ ID NO: 344979 - DNA, 20 bp, human
gaagaaggccatcggcggtt

SEQ ID NO: 344980 - DNA, 20 bp, human
gtggcggccatcatccctag

SEQ ID NO: 344981 - DNA, 20 bp, human
gtctgtgggcgggacctccc

SEQ ID NO: 344982 - DNA, 20 bp, human
ggcggaagacccgggatcca

SEQ ID NO: 344983 - DNA, 20 bp, human
gcggggacgcgaggagggaa

SEQ ID NO: 344984 - DNA, 20 bp, human
gccgagaagaaggccatcgg

SEQ ID NO: 344985 - DNA, 20 bp, human
gacggggaccggcgattggg

SEQ ID NO: 344986 - DNA, 20 bp, human
ggctggggctagcagagggc

SEQ ID NO: 344987 - DNA, 20 bp, human
gagccgcaggggcggggttg

SEQ ID NO: 344988 - DNA, 20 bp, human
gctgcggctcaaactcttaa

SEQ ID NO: 344989 - DNA, 20 bp, human
gaacagggtgacagcagcga

SEQ ID NO: 344990 - DNA, 20 bp, human
gtggacggctacaattctaa

SEQ ID NO: 344991 - DNA, 20 bp, human
gaaaaacggtggactggaac

SEQ ID NO: 344992 - DNA, 20 bp, human
gcagtagaataagatctctc

SEQ ID NO: 344993 - DNA, 20 bp, human
gcggtgcgggggcgggattt

SEQ ID NO: 344994 - DNA, 20 bp, human
ggtccagactagaaaaacgg

SEQ ID NO: 344995 - DNA, 20 bp, human
gggggaccatagagacgaag

SEQ ID NO: 344996 - DNA, 20 bp, human
gccgactccttgagaagaaa

SEQ ID NO: 344997 - DNA, 20 bp, human
gtcttctcaaggagtcggtc

SEQ ID NO: 344998 - DNA, 20 bp, human
gactccttgagaagaaacgg

SEQ ID NO: 344999 - DNA, 20 bp, human
gaccctccaggggaggagat

SEQ ID NO: 345000 - DNA, 20 bp, human
ggctgtaggtgggctccgct

SEQ ID NO: 345001 - DNA, 20 bp, human
ggggaaaaataaatcgcgat

SEQ ID NO: 345002 - DNA, 20 bp, human
gggatcaggcgccagccttg

SEQ ID NO: 345003 - DNA, 20 bp, human
gcagccttgaggtgtctgat

SEQ ID NO: 345004 - DNA, 20 bp, human
gacggcggagacctgagacc

SEQ ID NO: 345005 - DNA, 20 bp, human
gcacgggaaaatggttgctc

SEQ ID NO: 345006 - DNA, 20 bp, human
gcctcctcagaagatgaaat

SEQ ID NO: 345007 - DNA, 20 bp, human
gggaccgccacgcaggagga

SEQ ID NO: 345008 - DNA, 20 bp, human
ggggtggatgcaggggcgct

SEQ ID NO: 345009 - DNA, 20 bp, human
gtggggtcagggagcacagg

SEQ ID NO: 345010 - DNA, 20 bp, human
ggaatcccaagggagatctg

SEQ ID NO: 345011 - DNA, 20 bp, human
gtcagaagatgaaatgggtg

SEQ ID NO: 345012 - DNA, 20 bp, human
gtctccagggaccgccacgc

SEQ ID NO: 345013 - DNA, 20 bp, human
gccaagggagatctggggtc

SEQ ID NO: 345014 - DNA, 20 bp, human
gggcgctgggattggatttc

SEQ ID NO: 345015 - DNA, 20 bp, human
gatctggggtcagggagcac

SEQ ID NO: 345016 - DNA, 20 bp, human
ggcacggcgcccctctccgc

SEQ ID NO: 345017 - DNA, 20 bp, human
gggactgcaagcgtcaaccc

SEQ ID NO: 345018 - DNA, 20 bp, human
ggctccccgcccgcggagag

SEQ ID NO: 345019 - DNA, 20 bp, human
gtctcgaagggcaacgtcga

SEQ ID NO: 345020 - DNA, 20 bp, human
gtcggctcggggctgcagac

SEQ ID NO: 345021 - DNA, 20 bp, human
gggcgcccctctccgcgggc

SEQ ID NO: 345022 - DNA, 20 bp, human
ggcaagcaggctgagatgat

SEQ ID NO: 345023 - DNA, 20 bp, human
ggagccgagcgccgcgtctc

SEQ ID NO: 345024 - DNA, 20 bp, human
ggccgcgtctcgggagttga

SEQ ID NO: 345025 - DNA, 20 bp, human
ggcaagcgtcaaccctggcg

SEQ ID NO: 345026 - DNA, 20 bp, human
gagtagggctgaaccgaagt

SEQ ID NO: 345027 - DNA, 20 bp, human
gggctgaggctgcgtaactc

SEQ ID NO: 345028 - DNA, 20 bp, human
gcgggaaggcccagagttac

SEQ ID NO: 345029 - DNA, 20 bp, human
gtagccccaggtgatccaga

SEQ ID NO: 345030 - DNA, 20 bp, human
gccctgggccagatcaggga

SEQ ID NO: 345031 - DNA, 20 bp, human
gtgggccctgggccagatca

SEQ ID NO: 345032 - DNA, 20 bp, human
gtcaatgccaagtggcgaca

SEQ ID NO: 345033 - DNA, 20 bp, human
gcgaggctcgagagacaggg

SEQ ID NO: 345034 - DNA, 20 bp, human
ggcgcaggagagtgtatgtg

SEQ ID NO: 345035 - DNA, 20 bp, human
gtgaggctgcgtaactcagg

SEQ ID NO: 345036 - DNA, 20 bp, human
gaggctgccggctcccccag

SEQ ID NO: 345037 - DNA, 20 bp, human
gctggcgctccggtggtccg

SEQ ID NO: 345038 - DNA, 20 bp, human
gagcgcgcgccaggcatccc

SEQ ID NO: 345039 - DNA, 20 bp, human
gtcccccaggggaatgctcc

SEQ ID NO: 345040 - DNA, 20 bp, human
gaccaccggagcgccagctg

SEQ ID NO: 345041 - DNA, 20 bp, human
ggctcccccagctggcgctc

SEQ ID NO: 345042 - DNA, 20 bp, human
gaagccaggagcattcccct

SEQ ID NO: 345043 - DNA, 20 bp, human
gccgtctcgaaggcacggag

SEQ ID NO: 345044 - DNA, 20 bp, human
gtcacgaccgactgttgaat

SEQ ID NO: 345045 - DNA, 20 bp, human
ggcctttcccgccgtctcga

SEQ ID NO: 345046 - DNA, 20 bp, human
gaacccgaagtcgtcttcat

SEQ ID NO: 345047 - DNA, 20 bp, human
ggcgcgcgagagggagtcaa

SEQ ID NO: 345048 - DNA, 20 bp, human
gcatggacacagggctggat

SEQ ID NO: 345049 - DNA, 20 bp, human
ggactgccctcacctcgcac

SEQ ID NO: 345050 - DNA, 20 bp, human
gtccccgatgaagacgactt

SEQ ID NO: 345051 - DNA, 20 bp, human
gccgcagcaccatcggttcg

SEQ ID NO: 345052 - DNA, 20 bp, human
gcgcgctcccgcagcaccat

SEQ ID NO: 345053 - DNA, 20 bp, human
gcatgcaccagtgcgaggtg

SEQ ID NO: 345054 - DNA, 20 bp, human
gcacagggctggatggggca

SEQ ID NO: 345055 - DNA, 20 bp, human
ggtcttcatcggggactcct

SEQ ID NO: 345056 - DNA, 20 bp, human
gccaaggccagaggagacat

SEQ ID NO: 345057 - DNA, 20 bp, human
ggggtagcaaagggctttgt

SEQ ID NO: 345058 - DNA, 20 bp, human
gaggatgtgcagatgagtga

SEQ ID NO: 345059 - DNA, 20 bp, human
gggcaggatggggtagcaaa

SEQ ID NO: 345060 - DNA, 20 bp, human
gacagaggcccccagagagt

SEQ ID NO: 345061 - DNA, 20 bp, human
gtcctgctcaacccactgag

SEQ ID NO: 345062 - DNA, 20 bp, human
gaagggatcaagctgacttg

SEQ ID NO: 345063 - DNA, 20 bp, human
gaaggctgagggagtgggtt

SEQ ID NO: 345064 - DNA, 20 bp, human
gtgggctgtaactgccacag

SEQ ID NO: 345065 - DNA, 20 bp, human
gaggagagggcatcgggctt

SEQ ID NO: 345066 - DNA, 20 bp, human
gcctgtgtgggtgtggatca

SEQ ID NO: 345067 - DNA, 20 bp, human
gagcccgcagagtctggagg

SEQ ID NO: 345068 - DNA, 20 bp, human
ggaggcagctaagaggtttg

SEQ ID NO: 345069 - DNA, 20 bp, human
gcggggggcccggtccagac

SEQ ID NO: 345070 - DNA, 20 bp, human
ggcggcctcaaagctgttag

SEQ ID NO: 345071 - DNA, 20 bp, human
gacccagaaccccaaccagt

SEQ ID NO: 345072 - DNA, 20 bp, human
gaggccaggagggcggcagt

SEQ ID NO: 345073 - DNA, 20 bp, human
gctgcagcgcgcccactggt

SEQ ID NO: 345074 - DNA, 20 bp, human
gagtggcccaaccggagaac

SEQ ID NO: 345075 - DNA, 20 bp, human
ggcaggggcacagaacggtt

SEQ ID NO: 345076 - DNA, 20 bp, human
gggtcccacgagcacatcca

SEQ ID NO: 345077 - DNA, 20 bp, human
ggcctcccgacagtgctctg

SEQ ID NO: 345078 - DNA, 20 bp, human
gaccgcagagcactgtcggg

SEQ ID NO: 345079 - DNA, 20 bp, human
gcagtgctctgcggtaggcg

SEQ ID NO: 345080 - DNA, 20 bp, human
gactaataacgtgggacgtc

SEQ ID NO: 345081 - DNA, 20 bp, human
ggacacatcctggtgcgccg

SEQ ID NO: 345082 - DNA, 20 bp, human
gttagaacaagagcgaggtg

SEQ ID NO: 345083 - DNA, 20 bp, human
gtgctcgtgggacccaatgg

SEQ ID NO: 345084 - DNA, 20 bp, human
gatgtgctcgtgggacccaa

SEQ ID NO: 345085 - DNA, 20 bp, human
ggaaccacgtaggaagggtg

SEQ ID NO: 345086 - DNA, 20 bp, human
gatactcttacaggcctcta

SEQ ID NO: 345087 - DNA, 20 bp, human
ggatacctccgcctctagag

SEQ ID NO: 345088 - DNA, 20 bp, human
gatccgtggctataattggt

SEQ ID NO: 345089 - DNA, 20 bp, human
gcaattatagccacggatac

SEQ ID NO: 345090 - DNA, 20 bp, human
gtaattggtcggacacgctg

SEQ ID NO: 345091 - DNA, 20 bp, human
ggtccgaccaattatagcca

SEQ ID NO: 345092 - DNA, 20 bp, human
gccgtgctgtccagtatccg

SEQ ID NO: 345093 - DNA, 20 bp, human
gaagaaaacatgagttctaa

SEQ ID NO: 345094 - DNA, 20 bp, human
gatgttttcttgtgatttca

SEQ ID NO: 345095 - DNA, 20 bp, human
gatgtagcatttggatgggt

SEQ ID NO: 345096 - DNA, 20 bp, human
gtacacctgctgcccaatag

SEQ ID NO: 345097 - DNA, 20 bp, human
gacctgctgcccaatagcgg

SEQ ID NO: 345098 - DNA, 20 bp, human
gcaaccacagccaccgctat

SEQ ID NO: 345099 - DNA, 20 bp, human
gtgcccaatagcggtggctg

SEQ ID NO: 345100 - DNA, 20 bp, human
ggagcatctgtgccgctcta

SEQ ID NO: 345101 - DNA, 20 bp, human
ggtaacgcgcagggcacttc

SEQ ID NO: 345102 - DNA, 20 bp, human
gtggttggtcggtcacgctg

SEQ ID NO: 345103 - DNA, 20 bp, human
gaaggacaagaacttgatac

SEQ ID NO: 345104 - DNA, 20 bp, human
gcagatgctcggccccctag

SEQ ID NO: 345105 - DNA, 20 bp, human
gtctgtgccgctctagggcc

SEQ ID NO: 345106 - DNA, 20 bp, human
gcggaggcggcagctcgcgt

SEQ ID NO: 345107 - DNA, 20 bp, human
ggggtcagcgcgcgcgggtg

SEQ ID NO: 345108 - DNA, 20 bp, human
gtagcacctccgcctgtcgg

SEQ ID NO: 345109 - DNA, 20 bp, human
gcctccgccccaccaccgac

SEQ ID NO: 345110 - DNA, 20 bp, human
ggggccggaatcctgacagg

SEQ ID NO: 345111 - DNA, 20 bp, human
ggggtgggcctaggatgcgg

SEQ ID NO: 345112 - DNA, 20 bp, human
gaagagaaccgtgttgtggc

SEQ ID NO: 345113 - DNA, 20 bp, human
gggggcggggccgtcagcgg

SEQ ID NO: 345114 - DNA, 20 bp, human
ggggtagcacctccgcctgt

SEQ ID NO: 345115 - DNA, 20 bp, human
ggggagaaggggcgcgattg

SEQ ID NO: 345116 - DNA, 20 bp, human
gggtcacgccacagcccatc

SEQ ID NO: 345117 - DNA, 20 bp, human
gggccctgatgcacttacag

SEQ ID NO: 345118 - DNA, 20 bp, human
gggcctctaagaccctggat

SEQ ID NO: 345119 - DNA, 20 bp, human
gctgtggcgtgacccatcca

SEQ ID NO: 345120 - DNA, 20 bp, human
ggggccatcccctgcactgg

SEQ ID NO: 345121 - DNA, 20 bp, human
ggggtcccaggatccctgat

SEQ ID NO: 345122 - DNA, 20 bp, human
gacatgctgtgaatccaggt

SEQ ID NO: 345123 - DNA, 20 bp, human
gctgtggttagaggtacagg

SEQ ID NO: 345124 - DNA, 20 bp, human
gggccctgctgctgcttccg

SEQ ID NO: 345125 - DNA, 20 bp, human
gcaccactgtaagtgcatca

SEQ ID NO: 345126 - DNA, 20 bp, human
gaatttgggtcccaacaggt

SEQ ID NO: 345127 - DNA, 20 bp, human
ggcctactacctaggggaga

SEQ ID NO: 345128 - DNA, 20 bp, human
gtcggtgggcagcaatgctg

SEQ ID NO: 345129 - DNA, 20 bp, human
gcgggacaaggacttttggg

SEQ ID NO: 345130 - DNA, 20 bp, human
gcatgcctggcagagacgga

SEQ ID NO: 345131 - DNA, 20 bp, human
ggactctgtgacacactctg

SEQ ID NO: 345132 - DNA, 20 bp, human
gttgcggagaacatctgcgg

SEQ ID NO: 345133 - DNA, 20 bp, human
gttggagggtagtgaggaag

SEQ ID NO: 345134 - DNA, 20 bp, human
ggcctggcagagacggaggg

SEQ ID NO: 345135 - DNA, 20 bp, human
gtagaaacgcagcaaaggga

SEQ ID NO: 345136 - DNA, 20 bp, human
gttagcccagcaggatgtgg

SEQ ID NO: 345137 - DNA, 20 bp, human
gaggatgtggtggtaggatg

SEQ ID NO: 345138 - DNA, 20 bp, human
gcacacagacaaccaatgaa

SEQ ID NO: 345139 - DNA, 20 bp, human
gtggtgaggtccacccagta

SEQ ID NO: 345140 - DNA, 20 bp, human
ggtggtggtaggatgtggtt

SEQ ID NO: 345141 - DNA, 20 bp, human
gataaacatgagcagaacaa

SEQ ID NO: 345142 - DNA, 20 bp, human
gcaaaacctaatctttcagg

SEQ ID NO: 345143 - DNA, 20 bp, human
gcctcaccacctgaaagatt

SEQ ID NO: 345144 - DNA, 20 bp, human
ggttagtctttccccttcat

SEQ ID NO: 345145 - DNA, 20 bp, human
gtcatcatttgattttcaat

SEQ ID NO: 345146 - DNA, 20 bp, human
gagggtgagcacgtcctcag

SEQ ID NO: 345147 - DNA, 20 bp, human
ggcgagggggcgtgtgcaag

SEQ ID NO: 345148 - DNA, 20 bp, human
gcagacccagcgaggcgtcg

SEQ ID NO: 345149 - DNA, 20 bp, human
gcgtgtgcaagaggcggagc

SEQ ID NO: 345150 - DNA, 20 bp, human
gtcagagggcagacccagcg

SEQ ID NO: 345151 - DNA, 20 bp, human
gcgaggcgtcgtggcagctg

SEQ ID NO: 345152 - DNA, 20 bp, human
ggggtcgaaggacatcgtgt

SEQ ID NO: 345153 - DNA, 20 bp, human
gcgtggggccctcggaagag

SEQ ID NO: 345154 - DNA, 20 bp, human
ggctgccacgacgcctcgct

SEQ ID NO: 345155 - DNA, 20 bp, human
gcgaccgcagtgctgggcgg

SEQ ID NO: 345156 - DNA, 20 bp, human
gagggtgagcacgtcctcag

SEQ ID NO: 345157 - DNA, 20 bp, human
ggcgagggggcgtgtgcaag

SEQ ID NO: 345158 - DNA, 20 bp, human
gcagacccagcgaggcgtcg

SEQ ID NO: 345159 - DNA, 20 bp, human
gcgtgtgcaagaggcggagc

SEQ ID NO: 345160 - DNA, 20 bp, human
gtcagagggcagacccagcg

SEQ ID NO: 345161 - DNA, 20 bp, human
gcgaggcgtcgtggcagctg

SEQ ID NO: 345162 - DNA, 20 bp, human
ggggtcgaaggacatcgtgt

SEQ ID NO: 345163 - DNA, 20 bp, human
gcgtggggccctcggaagag

SEQ ID NO: 345164 - DNA, 20 bp, human
ggctgccacgacgcctcgct

SEQ ID NO: 345165 - DNA, 20 bp, human
gcgaccgcagtgctgggcgg

SEQ ID NO: 345166 - DNA, 20 bp, human
gcccagggtgcgatgtgcga

SEQ ID NO: 345167 - DNA, 20 bp, human
gccgggaatcggggtgccca

SEQ ID NO: 345168 - DNA, 20 bp, human
ggcggcccagccgggaatcg

SEQ ID NO: 345169 - DNA, 20 bp, human
gggctcccgccgggtagcag

SEQ ID NO: 345170 - DNA, 20 bp, human
gggtccacctgtgtgtcggg

SEQ ID NO: 345171 - DNA, 20 bp, human
gcgacacacaggtggaccca

SEQ ID NO: 345172 - DNA, 20 bp, human
gccggcgggagccatttccc

SEQ ID NO: 345173 - DNA, 20 bp, human
gctgcccgggagccacgtcc

SEQ ID NO: 345174 - DNA, 20 bp, human
gacggcacccatgcctgggg

SEQ ID NO: 345175 - DNA, 20 bp, human
gagctcgtgcacctgggaaa

SEQ ID NO: 345176 - DNA, 20 bp, human
gtgcccgggacaggaaaagt

SEQ ID NO: 345177 - DNA, 20 bp, human
gcagggtgagagttgctgaa

SEQ ID NO: 345178 - DNA, 20 bp, human
gatggggtgaagtgagttgg

SEQ ID NO: 345179 - DNA, 20 bp, human
gaaagctaggtgcccgggac

SEQ ID NO: 345180 - DNA, 20 bp, human
gggaggatgcagcaggtcaa

SEQ ID NO: 345181 - DNA, 20 bp, human
gacactaaagctaggtgccc

SEQ ID NO: 345182 - DNA, 20 bp, human
gccgggacaggaaaagtggg

SEQ ID NO: 345183 - DNA, 20 bp, human
gcctgctggggagagcggag

SEQ ID NO: 345184 - DNA, 20 bp, human
gcggcccagctgccccgcaa

SEQ ID NO: 345185 - DNA, 20 bp, human
ggggaaacgtgtcaccagcc

SEQ ID NO: 345186 - DNA, 20 bp, human
gctgcccccggagggaagga

SEQ ID NO: 345187 - DNA, 20 bp, human
gtcctcgcggcgtgtggctg

SEQ ID NO: 345188 - DNA, 20 bp, human
gcccggcgggctggagaacc

SEQ ID NO: 345189 - DNA, 20 bp, human
ggaggacggtcacccacctg

SEQ ID NO: 345190 - DNA, 20 bp, human
ggggctggagaaccgggtct

SEQ ID NO: 345191 - DNA, 20 bp, human
gccgacccggtccacactcc

SEQ ID NO: 345192 - DNA, 20 bp, human
gctactaggaagccacgggg

SEQ ID NO: 345193 - DNA, 20 bp, human
gctggcgggtgtgagcccgg

SEQ ID NO: 345194 - DNA, 20 bp, human
gccagcgtgcacgaccggtg

SEQ ID NO: 345195 - DNA, 20 bp, human
gcacctgcggcgccgagacc

SEQ ID NO: 345196 - DNA, 20 bp, human
gaggtctggtgaggacccac

SEQ ID NO: 345197 - DNA, 20 bp, human
gcgggactgactggtcacat

SEQ ID NO: 345198 - DNA, 20 bp, human
ggaccagtcagtcccgcggg

SEQ ID NO: 345199 - DNA, 20 bp, human
gagcctcccgcgggactgac

SEQ ID NO: 345200 - DNA, 20 bp, human
gctcagatctctctcatcag

SEQ ID NO: 345201 - DNA, 20 bp, human
gtgtctgcccaaactggtac

SEQ ID NO: 345202 - DNA, 20 bp, human
ggcttagtccagcctcccgc

SEQ ID NO: 345203 - DNA, 20 bp, human
gcccaaactggtacaggatg

SEQ ID NO: 345204 - DNA, 20 bp, human
gtgggctgtggtattaattg

SEQ ID NO: 345205 - DNA, 20 bp, human
gaggcataaaatcttcccat

SEQ ID NO: 345206 - DNA, 20 bp, human
gacagcgcatgggacagggg

SEQ ID NO: 345207 - DNA, 20 bp, human
gggagcggggcgatgcgatg

SEQ ID NO: 345208 - DNA, 20 bp, human
ggtcccatgcgctgtgaacc

SEQ ID NO: 345209 - DNA, 20 bp, human
gttcacagcgcatgggacag

SEQ ID NO: 345210 - DNA, 20 bp, human
gaacttgcagcgtcccggcc

SEQ ID NO: 345211 - DNA, 20 bp, human
ggggctgcgaagtagaaagg

SEQ ID NO: 345212 - DNA, 20 bp, human
gggggcgatgcgatgcgggg

SEQ ID NO: 345213 - DNA, 20 bp, human
ggaaccaagtctcggtagtt

SEQ ID NO: 345214 - DNA, 20 bp, human
gcacgccgaggtaacttcca

SEQ ID NO: 345215 - DNA, 20 bp, human
gcatgcgctgtgaacccggc

SEQ ID NO: 345216 - DNA, 20 bp, human
gccctggaagtagagggtta

SEQ ID NO: 345217 - DNA, 20 bp, human
gtctaggcgcggagggaggt

SEQ ID NO: 345218 - DNA, 20 bp, human
gtcagccgcggagtgagcga

SEQ ID NO: 345219 - DNA, 20 bp, human
ggccgggcgcgcggagcatg

SEQ ID NO: 345220 - DNA, 20 bp, human
gcataaagaggagggactta

SEQ ID NO: 345221 - DNA, 20 bp, human
gggaccccgattggctaagg

SEQ ID NO: 345222 - DNA, 20 bp, human
gcccgcctccttagccaatc

SEQ ID NO: 345223 - DNA, 20 bp, human
gagggcactaggaccccgat

SEQ ID NO: 345224 - DNA, 20 bp, human
ggggcggcggttgcccggat

SEQ ID NO: 345225 - DNA, 20 bp, human
gcattcccgccccctcaaca

SEQ ID NO: 345226 - DNA, 20 bp, human
gtgaatgaacagcctgtggg

SEQ ID NO: 345227 - DNA, 20 bp, human
gcgtgaaggattcactcctc

SEQ ID NO: 345228 - DNA, 20 bp, human
gttcaaaggcagatcgggag

SEQ ID NO: 345229 - DNA, 20 bp, human
gaaggctagcagaatagggg

SEQ ID NO: 345230 - DNA, 20 bp, human
ggtactccacagatcgcctc

SEQ ID NO: 345231 - DNA, 20 bp, human
gccagccaactcagagtgag

SEQ ID NO: 345232 - DNA, 20 bp, human
gattcactcctctggatcag

SEQ ID NO: 345233 - DNA, 20 bp, human
gaggaattaacagcaggtgg

SEQ ID NO: 345234 - DNA, 20 bp, human
ggacaccccgaggcgatctg

SEQ ID NO: 345235 - DNA, 20 bp, human
ggaacagccgtggtgtaagt

SEQ ID NO: 345236 - DNA, 20 bp, human
ggcggcccaaccccgacaga

SEQ ID NO: 345237 - DNA, 20 bp, human
ggatccggccgtctctgcgc

SEQ ID NO: 345238 - DNA, 20 bp, human
gagcaccctctgtcggggtt

SEQ ID NO: 345239 - DNA, 20 bp, human
gtcacgtgaagcctccgtgg

SEQ ID NO: 345240 - DNA, 20 bp, human
ggcgccagcaccctctgtcg

SEQ ID NO: 345241 - DNA, 20 bp, human
gggatcacgtgaagcctccg

SEQ ID NO: 345242 - DNA, 20 bp, human
ggggtgctggcgcttcctgc

SEQ ID NO: 345243 - DNA, 20 bp, human
ggaaactccctccgtccagc

SEQ ID NO: 345244 - DNA, 20 bp, human
ggcgcttcctgctggacgga

SEQ ID NO: 345245 - DNA, 20 bp, human
gcgtcatgacgtagtacgta

SEQ ID NO: 345246 - DNA, 20 bp, human
ggggcggggttaagagagaa

SEQ ID NO: 345247 - DNA, 20 bp, human
gcgcgggggtgggaaacgag

SEQ ID NO: 345248 - DNA, 20 bp, human
ggtcttcccagcagaagcgg

SEQ ID NO: 345249 - DNA, 20 bp, human
gagaaggggcgggaacaggg

SEQ ID NO: 345250 - DNA, 20 bp, human
ggtggctaggagagacgtgg

SEQ ID NO: 345251 - DNA, 20 bp, human
ggagagacgtggcggcccaa

SEQ ID NO: 345252 - DNA, 20 bp, human
gccgagccaggctttctcca

SEQ ID NO: 345253 - DNA, 20 bp, human
gttcccagcagaagcggtgg

SEQ ID NO: 345254 - DNA, 20 bp, human
ggcccaacggctgactactt

SEQ ID NO: 345255 - DNA, 20 bp, human
gcgtgtgggagtgcacagag

SEQ ID NO: 345256 - DNA, 20 bp, human
gccaaggtgtcgaataccat

SEQ ID NO: 345257 - DNA, 20 bp, human
gagagcgggtaggggtcggg

SEQ ID NO: 345258 - DNA, 20 bp, human
gcggacagacgaactcccag

SEQ ID NO: 345259 - DNA, 20 bp, human
gtgggcttcccgatctctag

SEQ ID NO: 345260 - DNA, 20 bp, human
gtaaaggccagagctccatg

SEQ ID NO: 345261 - DNA, 20 bp, human
ggccagagcgggtaggggtc

SEQ ID NO: 345262 - DNA, 20 bp, human
gaggaggggcgccccactcc

SEQ ID NO: 345263 - DNA, 20 bp, human
gtaatcccccaggtatccca

SEQ ID NO: 345264 - DNA, 20 bp, human
ggggtcgaatctaatccccc

SEQ ID NO: 345265 - DNA, 20 bp, human
gtcccgcccagggcaggtaa

SEQ ID NO: 345266 - DNA, 20 bp, human
gcgcccgcgccccactctgc

SEQ ID NO: 345267 - DNA, 20 bp, human
gacggcgtagcagggagctc

SEQ ID NO: 345268 - DNA, 20 bp, human
ggcgtagcagggagctccgg

SEQ ID NO: 345269 - DNA, 20 bp, human
gtggggacaggacgcgggtt

SEQ ID NO: 345270 - DNA, 20 bp, human
gttccgagggcccacgcctt

SEQ ID NO: 345271 - DNA, 20 bp, human
gcagtcgtgacccaaggcgt

SEQ ID NO: 345272 - DNA, 20 bp, human
ggctacgccgtatcttccga

SEQ ID NO: 345273 - DNA, 20 bp, human
gcgtgggccctcggaagata

SEQ ID NO: 345274 - DNA, 20 bp, human
gggaccagggctttgaccaa

SEQ ID NO: 345275 - DNA, 20 bp, human
gcggggcagcgcgacgattg

SEQ ID NO: 345276 - DNA, 20 bp, human
gcggggccagaactggcggc

SEQ ID NO: 345277 - DNA, 20 bp, human
gcagtgggccggcgtctccc

SEQ ID NO: 345278 - DNA, 20 bp, human
gcaggcggctggcccgcccg

SEQ ID NO: 345279 - DNA, 20 bp, human
gcacccgcgccgccaaggcg

SEQ ID NO: 345280 - DNA, 20 bp, human
gagcgccctcggcgcgtcca

SEQ ID NO: 345281 - DNA, 20 bp, human
ggccagttctggccccgcct

SEQ ID NO: 345282 - DNA, 20 bp, human
gcgtccagggcttttcgctt

SEQ ID NO: 345283 - DNA, 20 bp, human
gaaaagccctggacgcgccg

SEQ ID NO: 345284 - DNA, 20 bp, human
ggcgggctcccgggagacgc

SEQ ID NO: 345285 - DNA, 20 bp, human
gtggccccgccttggcggcg

SEQ ID NO: 345286 - DNA, 20 bp, human
gccaaaggaacccaaactgg

SEQ ID NO: 345287 - DNA, 20 bp, human
gtgaatgccggggtaagagg

SEQ ID NO: 345288 - DNA, 20 bp, human
ggcttgaatgccggggtaag

SEQ ID NO: 345289 - DNA, 20 bp, human
ggaggctagaccaggcgagg

SEQ ID NO: 345290 - DNA, 20 bp, human
ggggagggggggagcttaaa

SEQ ID NO: 345291 - DNA, 20 bp, human
ggaaacacggaggctagacc

SEQ ID NO: 345292 - DNA, 20 bp, human
gtagaccaggcgaggcgggt

SEQ ID NO: 345293 - DNA, 20 bp, human
gggcgaggcgggtgggacta

SEQ ID NO: 345294 - DNA, 20 bp, human
gaatcactgagtcttggtgg

SEQ ID NO: 345295 - DNA, 20 bp, human
gtcagtgattgtattgtggg

SEQ ID NO: 345296 - DNA, 20 bp, human
gcatgctcccgcctgagaaa

SEQ ID NO: 345297 - DNA, 20 bp, human
gctccctcggaacagacgcc

SEQ ID NO: 345298 - DNA, 20 bp, human
gcctgagaaaggggtgataa

SEQ ID NO: 345299 - DNA, 20 bp, human
gggtgcgtcaacgtggtggg

SEQ ID NO: 345300 - DNA, 20 bp, human
gtgccgggcgtctgttccga

SEQ ID NO: 345301 - DNA, 20 bp, human
gttgtgacacggacctggtg

SEQ ID NO: 345302 - DNA, 20 bp, human
ggggtgataagggcatgtga

SEQ ID NO: 345303 - DNA, 20 bp, human
gaggaggtggcttgattgcc

SEQ ID NO: 345304 - DNA, 20 bp, human
gcgttggtgcgtcaacgtgg

SEQ ID NO: 345305 - DNA, 20 bp, human
ggctggagtaagttaaaagt

SEQ ID NO: 345306 - DNA, 20 bp, human
gaggggccggggacttaaga

SEQ ID NO: 345307 - DNA, 20 bp, human
gtggaggcgcgcgtgagaag

SEQ ID NO: 345308 - DNA, 20 bp, human
ggcggcggagcgtaggggag

SEQ ID NO: 345309 - DNA, 20 bp, human
ggccggaggctcgcgagggg

SEQ ID NO: 345310 - DNA, 20 bp, human
gggagggagcaagtcagcta

SEQ ID NO: 345311 - DNA, 20 bp, human
gcgacggcggcggagcgtag

SEQ ID NO: 345312 - DNA, 20 bp, human
gctcccttgggctggcggga

SEQ ID NO: 345313 - DNA, 20 bp, human
ggtccccgggccggttgcct

SEQ ID NO: 345314 - DNA, 20 bp, human
gtacccaggcaaccggcccg

SEQ ID NO: 345315 - DNA, 20 bp, human
gcccgcccctcgcgagcctc

SEQ ID NO: 345316 - DNA, 20 bp, human
gcctcgctcagggattgtca

SEQ ID NO: 345317 - DNA, 20 bp, human
gccctgagcgaggggaagtc

SEQ ID NO: 345318 - DNA, 20 bp, human
ggaaccgaggtcatctctga

SEQ ID NO: 345319 - DNA, 20 bp, human
gcagaagagtccacccctaa

SEQ ID NO: 345320 - DNA, 20 bp, human
gaggatgtagggatatagaa

SEQ ID NO: 345321 - DNA, 20 bp, human
ggctagctgccccgttttca

SEQ ID NO: 345322 - DNA, 20 bp, human
gagggctcagagtggaaccg

SEQ ID NO: 345323 - DNA, 20 bp, human
gaactctttccccttagggg

SEQ ID NO: 345324 - DNA, 20 bp, human
gtaaggggaaagagttaagc

SEQ ID NO: 345325 - DNA, 20 bp, human
gaagcagggctgcgctcctg

SEQ ID NO: 345326 - DNA, 20 bp, human
gcatacacagggttgcggtg

SEQ ID NO: 345327 - DNA, 20 bp, human
gtgcctgcccgcccgggtgt

SEQ ID NO: 345328 - DNA, 20 bp, human
gtgccccaggatggcacccc

SEQ ID NO: 345329 - DNA, 20 bp, human
ggtgaggactcatgagataa

SEQ ID NO: 345330 - DNA, 20 bp, human
gggcgacatacacagggttg

SEQ ID NO: 345331 - DNA, 20 bp, human
gcaaagtggcgacatacaca

SEQ ID NO: 345332 - DNA, 20 bp, human
gacacatggcagcctgcccc

SEQ ID NO: 345333 - DNA, 20 bp, human
gttgctaagtagaagtacaa

SEQ ID NO: 345334 - DNA, 20 bp, human
gcgccaggaaacacactcgc

SEQ ID NO: 345335 - DNA, 20 bp, human
gagagcaatcacacactccc

SEQ ID NO: 345336 - DNA, 20 bp, human
gagacctttagaaatccaaa

SEQ ID NO: 345337 - DNA, 20 bp, human
gtcccctgcaataatatcac

SEQ ID NO: 345338 - DNA, 20 bp, human
gccccgtgatattattgcag

SEQ ID NO: 345339 - DNA, 20 bp, human
ggcaaatgagattttccaac

SEQ ID NO: 345340 - DNA, 20 bp, human
gttctgctgttctaacagtt

SEQ ID NO: 345341 - DNA, 20 bp, human
gggatcttaaacaaatctgg

SEQ ID NO: 345342 - DNA, 20 bp, human
gctgttctaacagtttgggg

SEQ ID NO: 345343 - DNA, 20 bp, human
gttctctctaactctgatgt

SEQ ID NO: 345344 - DNA, 20 bp, human
gctatttttggttccgtaga

SEQ ID NO: 345345 - DNA, 20 bp, human
gggagaaagtaagcatatta

SEQ ID NO: 345346 - DNA, 20 bp, human
gccaaacgctgtgggcgcga

SEQ ID NO: 345347 - DNA, 20 bp, human
gaacgctctgctctacagaa

SEQ ID NO: 345348 - DNA, 20 bp, human
gttactgtggattatctctt

SEQ ID NO: 345349 - DNA, 20 bp, human
gaacgctgtgggcgcgaggg

SEQ ID NO: 345350 - DNA, 20 bp, human
gcagccgccttccgcagcat

SEQ ID NO: 345351 - DNA, 20 bp, human
ggggtgggtgggatcggtgg

SEQ ID NO: 345352 - DNA, 20 bp, human
gaaattggaaaagagggtgg

SEQ ID NO: 345353 - DNA, 20 bp, human
gccagcagggcgggggagtt

SEQ ID NO: 345354 - DNA, 20 bp, human
gaggaaatcaaccaatgctg

SEQ ID NO: 345355 - DNA, 20 bp, human
gaggaaagcggaggccagca

SEQ ID NO: 345356 - DNA, 20 bp, human
gcgggcggggccgttgttgg

SEQ ID NO: 345357 - DNA, 20 bp, human
gtcaagaaggggcgtgtggc

SEQ ID NO: 345358 - DNA, 20 bp, human
gggcgcagcgcgtgcaccag

SEQ ID NO: 345359 - DNA, 20 bp, human
gcactccctaaaaagtgggt

SEQ ID NO: 345360 - DNA, 20 bp, human
ggggggcggcccagagacga

SEQ ID NO: 345361 - DNA, 20 bp, human
gcagcgccagcagccggggt

SEQ ID NO: 345362 - DNA, 20 bp, human
gctcccactccctaaaaagt

SEQ ID NO: 345363 - DNA, 20 bp, human
ggcgaggtttgcttcaagaa

SEQ ID NO: 345364 - DNA, 20 bp, human
ggcccgcccggcgctgacgt

SEQ ID NO: 345365 - DNA, 20 bp, human
gacctggcagggagcagcgg

SEQ ID NO: 345366 - DNA, 20 bp, human
gtcctgcaaggatactggga

SEQ ID NO: 345367 - DNA, 20 bp, human
gaaagcccagctctgttatc

SEQ ID NO: 345368 - DNA, 20 bp, human
gagaccggctgtttcctgca

SEQ ID NO: 345369 - DNA, 20 bp, human
gaagccccagataacagagc

SEQ ID NO: 345370 - DNA, 20 bp, human
gtcacgaggatccagagagg

SEQ ID NO: 345371 - DNA, 20 bp, human
gtgtttcctgcaaggatact

SEQ ID NO: 345372 - DNA, 20 bp, human
gaggtcaaatgcaagatttt

SEQ ID NO: 345373 - DNA, 20 bp, human
ggactttgctcctctcatgt

SEQ ID NO: 345374 - DNA, 20 bp, human
gtaaatacattcccaatagg

SEQ ID NO: 345375 - DNA, 20 bp, human
gctcgtctttatacctcacg

SEQ ID NO: 345376 - DNA, 20 bp, human
gcacatagctaggtaccctg

SEQ ID NO: 345377 - DNA, 20 bp, human
gagagctcggatcctccgca

SEQ ID NO: 345378 - DNA, 20 bp, human
ggaggatccgagctctcctg

SEQ ID NO: 345379 - DNA, 20 bp, human
gaggcagtgatgatcaccag

SEQ ID NO: 345380 - DNA, 20 bp, human
ggctcagatctgtgcagtca

SEQ ID NO: 345381 - DNA, 20 bp, human
gtggtgaccccaggagagct

SEQ ID NO: 345382 - DNA, 20 bp, human
ggccaggtctatgcagacag

SEQ ID NO: 345383 - DNA, 20 bp, human
gtcaccaggctgaagtcgca

SEQ ID NO: 345384 - DNA, 20 bp, human
gttgtcatcatcatcaaagg

SEQ ID NO: 345385 - DNA, 20 bp, human
gatagctaggtaccctgcgg

SEQ ID NO: 345386 - DNA, 20 bp, human
ggctccgcgcgggcaccctc

SEQ ID NO: 345387 - DNA, 20 bp, human
gccggccgcgcaagctgctc

SEQ ID NO: 345388 - DNA, 20 bp, human
gcccgcgcggagcacggtct

SEQ ID NO: 345389 - DNA, 20 bp, human
gcaggggccgagcgtaggtc

SEQ ID NO: 345390 - DNA, 20 bp, human
ggagaggaccggaaaagaga

SEQ ID NO: 345391 - DNA, 20 bp, human
gtacggggcgacgaggttgg

SEQ ID NO: 345392 - DNA, 20 bp, human
gctgctgggaccgagcccga

SEQ ID NO: 345393 - DNA, 20 bp, human
gagaaggcgcggacgcagcg

SEQ ID NO: 345394 - DNA, 20 bp, human
gcccggccggcggagaggac

SEQ ID NO: 345395 - DNA, 20 bp, human
gcgggaactctgccccctgg

SEQ ID NO: 345396 - DNA, 20 bp, human
gggaactgctaaagcggggc

SEQ ID NO: 345397 - DNA, 20 bp, human
ggaggagactgagacagcga

SEQ ID NO: 345398 - DNA, 20 bp, human
gcgccagagtctgtacacag

SEQ ID NO: 345399 - DNA, 20 bp, human
gtgtaggaactgctaaagcg

SEQ ID NO: 345400 - DNA, 20 bp, human
gtggcaggtcaagcgtctgt

SEQ ID NO: 345401 - DNA, 20 bp, human
ggaggctgctgatgcagcat

SEQ ID NO: 345402 - DNA, 20 bp, human
gtctcctcctctccgctctt

SEQ ID NO: 345403 - DNA, 20 bp, human
ggctgctgaggataagataa

SEQ ID NO: 345404 - DNA, 20 bp, human
ggggtactgaagatatgctg

SEQ ID NO: 345405 - DNA, 20 bp, human
gagaccgaagagcggagagg

SEQ ID NO: 345406 - DNA, 20 bp, human
gagcacggcccgcaccgggg

SEQ ID NO: 345407 - DNA, 20 bp, human
gccgacgcgaaaatgagatg

SEQ ID NO: 345408 - DNA, 20 bp, human
ggcgggcagcaggtgcggga

SEQ ID NO: 345409 - DNA, 20 bp, human
gaatgagatgggggaactaa

SEQ ID NO: 345410 - DNA, 20 bp, human
gaggagacgccgtcagcctg

SEQ ID NO: 345411 - DNA, 20 bp, human
gaatccagcacggcccgcac

SEQ ID NO: 345412 - DNA, 20 bp, human
gggccccagtctcagataat

SEQ ID NO: 345413 - DNA, 20 bp, human
gcagcgagtaagtgacacag

SEQ ID NO: 345414 - DNA, 20 bp, human
gcggagtcccttgacacttc

SEQ ID NO: 345415 - DNA, 20 bp, human
gagcctccgaagcagatcca

SEQ ID NO: 345416 - DNA, 20 bp, human
gcgagctgatgcaagaacat

SEQ ID NO: 345417 - DNA, 20 bp, human
gctgcaaggatgctaggatg

SEQ ID NO: 345418 - DNA, 20 bp, human
gctagcatccttgcaggaaa

SEQ ID NO: 345419 - DNA, 20 bp, human
gatgggaagcagaaagctgc

SEQ ID NO: 345420 - DNA, 20 bp, human
gcctcacagacactcctctc

SEQ ID NO: 345421 - DNA, 20 bp, human
gaggtcaaatccaagtctta

SEQ ID NO: 345422 - DNA, 20 bp, human
ggaccttcccgctgagtgac

SEQ ID NO: 345423 - DNA, 20 bp, human
gaactttgcacatctcatgg

SEQ ID NO: 345424 - DNA, 20 bp, human
gctccagtcactcagcggga

SEQ ID NO: 345425 - DNA, 20 bp, human
gagagcggccctttcctgca

SEQ ID NO: 345426 - DNA, 20 bp, human
ggaggacggggtcaccaaga

SEQ ID NO: 345427 - DNA, 20 bp, human
gaggttgtaggtggaggacg

SEQ ID NO: 345428 - DNA, 20 bp, human
ggttgaagacccgcccctag

SEQ ID NO: 345429 - DNA, 20 bp, human
gaaggagcagccatgcctct

SEQ ID NO: 345430 - DNA, 20 bp, human
gcctggctttcagcccctag

SEQ ID NO: 345431 - DNA, 20 bp, human
ggggtcaccaagagggcagc

SEQ ID NO: 345432 - DNA, 20 bp, human
gcgggtggggcctagaggca

SEQ ID NO: 345433 - DNA, 20 bp, human
gggggtccccaggctttaag

SEQ ID NO: 345434 - DNA, 20 bp, human
gggcatggctgctccttcat

SEQ ID NO: 345435 - DNA, 20 bp, human
gggccccacccggccttcag

SEQ ID NO: 345436 - DNA, 20 bp, human
ggaggaagccagccgctaca

SEQ ID NO: 345437 - DNA, 20 bp, human
gaaacctggggcgacctgca

SEQ ID NO: 345438 - DNA, 20 bp, human
gccaccccggctgtgggtcc

SEQ ID NO: 345439 - DNA, 20 bp, human
gccagccgctacagggctct

SEQ ID NO: 345440 - DNA, 20 bp, human
gtgcccaggacccacagccg

SEQ ID NO: 345441 - DNA, 20 bp, human
gcctcccaggataaaacctg

SEQ ID NO: 345442 - DNA, 20 bp, human
gcagcaggctcgagagaccc

SEQ ID NO: 345443 - DNA, 20 bp, human
ggatgcgggtcagggtgtgt

SEQ ID NO: 345444 - DNA, 20 bp, human
gggcgctccagaaaccacca

SEQ ID NO: 345445 - DNA, 20 bp, human
gcctgacattaattgtccag

SEQ ID NO: 345446 - DNA, 20 bp, human
ggggctgctccaccctgctc

SEQ ID NO: 345447 - DNA, 20 bp, human
gcaccggggcccacctgcgc

SEQ ID NO: 345448 - DNA, 20 bp, human
gaggccgcgcgccagacccg

SEQ ID NO: 345449 - DNA, 20 bp, human
gctcgcctgcggccggagca

SEQ ID NO: 345450 - DNA, 20 bp, human
gaggccgagcgtccctgcgc

SEQ ID NO: 345451 - DNA, 20 bp, human
gtcccctcgccgctcgcctg

SEQ ID NO: 345452 - DNA, 20 bp, human
ggggatgcgcggtgttcaaa

SEQ ID NO: 345453 - DNA, 20 bp, human
ggggcacggtttatgtgcag

SEQ ID NO: 345454 - DNA, 20 bp, human
gtccaccctgctccggccgc

SEQ ID NO: 345455 - DNA, 20 bp, human
ggggccacacctggtgtatg

SEQ ID NO: 345456 - DNA, 20 bp, human
gcgtgctgcgctggggtgag

SEQ ID NO: 345457 - DNA, 20 bp, human
gggtctgccctggggtctcg

SEQ ID NO: 345458 - DNA, 20 bp, human
gcctggggtctcggggttca

SEQ ID NO: 345459 - DNA, 20 bp, human
gcacggggtgccgttggcct

SEQ ID NO: 345460 - DNA, 20 bp, human
ggctatgcggcccaacccgt

SEQ ID NO: 345461 - DNA, 20 bp, human
gacggcaccccgtgctgcgc

SEQ ID NO: 345462 - DNA, 20 bp, human
ggctcagggtccaggaaccg

SEQ ID NO: 345463 - DNA, 20 bp, human
gcaggccgggccgacgggtt

SEQ ID NO: 345464 - DNA, 20 bp, human
gggctaggtcacggaggagt

SEQ ID NO: 345465 - DNA, 20 bp, human
gcgtgcaccgcggtcagctc

SEQ ID NO: 345466 - DNA, 20 bp, human
gagactggctatttcctgga

SEQ ID NO: 345467 - DNA, 20 bp, human
gctacgtttggccactctgt

SEQ ID NO: 345468 - DNA, 20 bp, human
ggacaggggaaaccaatccc

SEQ ID NO: 345469 - DNA, 20 bp, human
gctggagcccccacgagagg

SEQ ID NO: 345470 - DNA, 20 bp, human
ggagaatggcctgggtgtct

SEQ ID NO: 345471 - DNA, 20 bp, human
gggagtccttttaactattg

SEQ ID NO: 345472 - DNA, 20 bp, human
gttccaagaatcaggagagg

SEQ ID NO: 345473 - DNA, 20 bp, human
gcttggaagggtataaggac

SEQ ID NO: 345474 - DNA, 20 bp, human
gttcctggagcccccacgag

SEQ ID NO: 345475 - DNA, 20 bp, human
gaagactttcctcctctcgt

SEQ ID NO: 345476 - DNA, 20 bp, human
gagggaaggggtgaggataa

SEQ ID NO: 345477 - DNA, 20 bp, human
ggggccctgggcagaacgaa

SEQ ID NO: 345478 - DNA, 20 bp, human
gggagcaggggtgacgatgg

SEQ ID NO: 345479 - DNA, 20 bp, human
gaaggggtgaggataaggga

SEQ ID NO: 345480 - DNA, 20 bp, human
gggagtgaggatgaccgagg

SEQ ID NO: 345481 - DNA, 20 bp, human
gcaggggtgacgatggagga

SEQ ID NO: 345482 - DNA, 20 bp, human
ggtgctgcatacctgggccc

SEQ ID NO: 345483 - DNA, 20 bp, human
ggacgatggaggacggggtg

SEQ ID NO: 345484 - DNA, 20 bp, human
gcgaggggggttaggctcca

SEQ ID NO: 345485 - DNA, 20 bp, human
gaacgaagggtatacagcct

SEQ ID NO: 345486 - DNA, 20 bp, human
gccggggcccggatggtcca

SEQ ID NO: 345487 - DNA, 20 bp, human
ggcactccttacttgaccag

SEQ ID NO: 345488 - DNA, 20 bp, human
gacagggccctggaccatcc

SEQ ID NO: 345489 - DNA, 20 bp, human
gccgggccccggtcctccac

SEQ ID NO: 345490 - DNA, 20 bp, human
gtggggaccagtgcagtctt

SEQ ID NO: 345491 - DNA, 20 bp, human
gcccaaaccaaagactgcac

SEQ ID NO: 345492 - DNA, 20 bp, human
gcagggggagacttgacctt

SEQ ID NO: 345493 - DNA, 20 bp, human
gcttacttgaccagaggcag

SEQ ID NO: 345494 - DNA, 20 bp, human
ggggactggttcaaagttgg

SEQ ID NO: 345495 - DNA, 20 bp, human
gcgagacagagcaagatgct

SEQ ID NO: 345496 - DNA, 20 bp, human
ggaaatgctggggtgagaca

SEQ ID NO: 345497 - DNA, 20 bp, human
gtgggcaagaggagacggag

SEQ ID NO: 345498 - DNA, 20 bp, human
gacaagtcggggtaaccctg

SEQ ID NO: 345499 - DNA, 20 bp, human
ggggagttccctggaggaac

SEQ ID NO: 345500 - DNA, 20 bp, human
gaggtccgccccgttcctcc

SEQ ID NO: 345501 - DNA, 20 bp, human
ggaaagggggcgatgacgag

SEQ ID NO: 345502 - DNA, 20 bp, human
gcgcaccacggccgggagat

SEQ ID NO: 345503 - DNA, 20 bp, human
gtgggcgcctggtacaagtc

SEQ ID NO: 345504 - DNA, 20 bp, human
gacacgaggatggggacctc

SEQ ID NO: 345505 - DNA, 20 bp, human
gcaggctgcacacgaggatg

SEQ ID NO: 345506 - DNA, 20 bp, human
gcctcacgggcatgactcat

SEQ ID NO: 345507 - DNA, 20 bp, human
gacacctgttgggtgggaga

SEQ ID NO: 345508 - DNA, 20 bp, human
gtgggaccatcaggagtcac

SEQ ID NO: 345509 - DNA, 20 bp, human
gctcctggacacctgttggg

SEQ ID NO: 345510 - DNA, 20 bp, human
ggagatgtgcgcagggctct

SEQ ID NO: 345511 - DNA, 20 bp, human
gctagctcctggacacctgt

SEQ ID NO: 345512 - DNA, 20 bp, human
ggatgggctccagccaggga

SEQ ID NO: 345513 - DNA, 20 bp, human
gctggctggagcccatctct

SEQ ID NO: 345514 - DNA, 20 bp, human
gctgggaatctgagaggatc

SEQ ID NO: 345515 - DNA, 20 bp, human
ggagacatgagatgtgcgca

SEQ ID NO: 345516 - DNA, 20 bp, human
gagtgtaacaaagatgggag

SEQ ID NO: 345517 - DNA, 20 bp, human
gttacagtctagatgacatt

SEQ ID NO: 345518 - DNA, 20 bp, human
gaggacaaaaaacaccaagt

SEQ ID NO: 345519 - DNA, 20 bp, human
gaagctagtgtaacaaagat

SEQ ID NO: 345520 - DNA, 20 bp, human
gtgatgaaacagtgatcaga

SEQ ID NO: 345521 - DNA, 20 bp, human
gggcctggtgacaattcaga

SEQ ID NO: 345522 - DNA, 20 bp, human
gagactaccaaagtcatcct

SEQ ID NO: 345523 - DNA, 20 bp, human
gctatgctcccaattatcca

SEQ ID NO: 345524 - DNA, 20 bp, human
gtggctcaatgctgttgctc

SEQ ID NO: 345525 - DNA, 20 bp, human
ggcattgagccaagaaaata

SEQ ID NO: 345526 - DNA, 20 bp, human
gcatgtgcccaggtcgggag

SEQ ID NO: 345527 - DNA, 20 bp, human
gagacacagacatgtgctgg

SEQ ID NO: 345528 - DNA, 20 bp, human
gagccatcatgtgcccaggt

SEQ ID NO: 345529 - DNA, 20 bp, human
ggggagtgccatctgctagt

SEQ ID NO: 345530 - DNA, 20 bp, human
ggggagccagtcacatgttg

SEQ ID NO: 345531 - DNA, 20 bp, human
gtggggtgcaaccacctgtt

SEQ ID NO: 345532 - DNA, 20 bp, human
gggggtgcagtcgcatgtcc

SEQ ID NO: 345533 - DNA, 20 bp, human
gactggctcccactagcaga

SEQ ID NO: 345534 - DNA, 20 bp, human
ggcagtcgcatgtccaggtc

SEQ ID NO: 345535 - DNA, 20 bp, human
ggggagctagtcacccgctg

SEQ ID NO: 345536 - DNA, 20 bp, human
gggaccggggtccaacaagt

SEQ ID NO: 345537 - DNA, 20 bp, human
ggatctgagtgaaaccgcga

SEQ ID NO: 345538 - DNA, 20 bp, human
gggaaccagggcgcctgcga

SEQ ID NO: 345539 - DNA, 20 bp, human
gggggcagggccggtgccta

SEQ ID NO: 345540 - DNA, 20 bp, human
gggtgcctagggggtggaaa

SEQ ID NO: 345541 - DNA, 20 bp, human
ggagccgacttgttggaccc

SEQ ID NO: 345542 - DNA, 20 bp, human
ggaaccctgcccagggccaa

SEQ ID NO: 345543 - DNA, 20 bp, human
gaccatgcctacaaggtcag

SEQ ID NO: 345544 - DNA, 20 bp, human
gctggacatagtctggagtg

SEQ ID NO: 345545 - DNA, 20 bp, human
gacagctcgcgcccctgcca

SEQ ID NO: 345546 - DNA, 20 bp, human
gagacacaggaaccacatag

SEQ ID NO: 345547 - DNA, 20 bp, human
gcacaggaaccacatagagg

SEQ ID NO: 345548 - DNA, 20 bp, human
gtgcacaaagctgtaaactc

SEQ ID NO: 345549 - DNA, 20 bp, human
gacagaggtaaaaagcatca

SEQ ID NO: 345550 - DNA, 20 bp, human
ggagacctagatgccctaca

SEQ ID NO: 345551 - DNA, 20 bp, human
gccaaaagcactgagcttga

SEQ ID NO: 345552 - DNA, 20 bp, human
gagagagattctgagtcaca

SEQ ID NO: 345553 - DNA, 20 bp, human
gtgtgcaaattggccctgta

SEQ ID NO: 345554 - DNA, 20 bp, human
gaagtgtgccagggagacac

SEQ ID NO: 345555 - DNA, 20 bp, human
gttcaggaagaagtgtgcca

SEQ ID NO: 345556 - DNA, 20 bp, human
gcaccgggagtaccactcca

SEQ ID NO: 345557 - DNA, 20 bp, human
gaggcagtgtggtcatggca

SEQ ID NO: 345558 - DNA, 20 bp, human
gcgggagtaccactccaggg

SEQ ID NO: 345559 - DNA, 20 bp, human
gggcctaggaggcactgtca

SEQ ID NO: 345560 - DNA, 20 bp, human
ggcagagagctgggcctagg

SEQ ID NO: 345561 - DNA, 20 bp, human
gtaggcctccaaccttgggg

SEQ ID NO: 345562 - DNA, 20 bp, human
gccctctcacgcctccctgg

SEQ ID NO: 345563 - DNA, 20 bp, human
ggctcagaactacacactgg

SEQ ID NO: 345564 - DNA, 20 bp, human
ggagtggtactcccggtgct

SEQ ID NO: 345565 - DNA, 20 bp, human
gtcaccttgtggccctggca

SEQ ID NO: 345566 - DNA, 20 bp, human
gtgggagagcagggtttctg

SEQ ID NO: 345567 - DNA, 20 bp, human
gagccactcctcaacaccac

SEQ ID NO: 345568 - DNA, 20 bp, human
gtctctagcaaggagataga

SEQ ID NO: 345569 - DNA, 20 bp, human
gctagcaaggagatagaagg

SEQ ID NO: 345570 - DNA, 20 bp, human
gttgaggagtggctggttga

SEQ ID NO: 345571 - DNA, 20 bp, human
gcccttcaggatctggcagc

SEQ ID NO: 345572 - DNA, 20 bp, human
gctcccaggaagaggccaat

SEQ ID NO: 345573 - DNA, 20 bp, human
gaggaaatgaacccagtatc

SEQ ID NO: 345574 - DNA, 20 bp, human
gttcctggactcaggctccc

SEQ ID NO: 345575 - DNA, 20 bp, human
gagaactagcttctcctaga

SEQ ID NO: 345576 - DNA, 20 bp, human
gaggctcccgatgaggtgga

SEQ ID NO: 345577 - DNA, 20 bp, human
gacctcatcgggagcctccc

SEQ ID NO: 345578 - DNA, 20 bp, human
ggagagctgcgaagagagag

SEQ ID NO: 345579 - DNA, 20 bp, human
gcagggccctccacctcatc

SEQ ID NO: 345580 - DNA, 20 bp, human
gctagacagctgccactctg

SEQ ID NO: 345581 - DNA, 20 bp, human
gactctgaggcgagggccct

SEQ ID NO: 345582 - DNA, 20 bp, human
gcgcagctctccgtggactc

SEQ ID NO: 345583 - DNA, 20 bp, human
gctctcttcgcagctctccg

SEQ ID NO: 345584 - DNA, 20 bp, human
ggagaggactcatctgagtc

SEQ ID NO: 345585 - DNA, 20 bp, human
gcaggagacgctgagtgcct

SEQ ID NO: 345586 - DNA, 20 bp, human
ggcccgggaggtataaggga

SEQ ID NO: 345587 - DNA, 20 bp, human
gcccagcccgggaggtataa

SEQ ID NO: 345588 - DNA, 20 bp, human
ggtcactaggggcgcccttg

SEQ ID NO: 345589 - DNA, 20 bp, human
gtaagggagggctgtcacta

SEQ ID NO: 345590 - DNA, 20 bp, human
gcctgcgtggcgccccccag

SEQ ID NO: 345591 - DNA, 20 bp, human
gtcccgggctgggtacgccc

SEQ ID NO: 345592 - DNA, 20 bp, human
gccccaggggccacccgcca

SEQ ID NO: 345593 - DNA, 20 bp, human
ggccaaggagggaagtcagc

SEQ ID NO: 345594 - DNA, 20 bp, human
gggaccagcggagtgaggag

SEQ ID NO: 345595 - DNA, 20 bp, human
gccacccgccacggcgctcg

SEQ ID NO: 345596 - DNA, 20 bp, human
gaacagggaagaaggagtgt

SEQ ID NO: 345597 - DNA, 20 bp, human
gcccgtgactggaacagcaa

SEQ ID NO: 345598 - DNA, 20 bp, human
gcctcagaagccgacactct

SEQ ID NO: 345599 - DNA, 20 bp, human
gggaacaagccaccaagact

SEQ ID NO: 345600 - DNA, 20 bp, human
gacggcacataaaagactct

SEQ ID NO: 345601 - DNA, 20 bp, human
gccccgccccgccccagtct

SEQ ID NO: 345602 - DNA, 20 bp, human
gcgtgtgaaagagtgtctcg

SEQ ID NO: 345603 - DNA, 20 bp, human
gcctgtgacctggggtagga

SEQ ID NO: 345604 - DNA, 20 bp, human
gcaagccaccaagactgggg

SEQ ID NO: 345605 - DNA, 20 bp, human
gaaggggaaggtgccagctt

SEQ ID NO: 345606 - DNA, 20 bp, human
gcgcggctgcaaggcatcaa

SEQ ID NO: 345607 - DNA, 20 bp, human
ggaagcgggtaagggacgtg

SEQ ID NO: 345608 - DNA, 20 bp, human
gatgggagttgtagtcggcg

SEQ ID NO: 345609 - DNA, 20 bp, human
gagcggctgccaggcatgat

SEQ ID NO: 345610 - DNA, 20 bp, human
gggactagtgaagcgggtaa

SEQ ID NO: 345611 - DNA, 20 bp, human
gtcaggggatccagcgaata

SEQ ID NO: 345612 - DNA, 20 bp, human
gtaagggacgtgcggaatcg

SEQ ID NO: 345613 - DNA, 20 bp, human
gcgaatacggcgatccgatt

SEQ ID NO: 345614 - DNA, 20 bp, human
gtgggaggctgcagcccgaa

SEQ ID NO: 345615 - DNA, 20 bp, human
ggtgcctgaaatagtttcag

SEQ ID NO: 345616 - DNA, 20 bp, human
gaggaagcccacaactgggg

SEQ ID NO: 345617 - DNA, 20 bp, human
ggagtggggtagacagaccg

SEQ ID NO: 345618 - DNA, 20 bp, human
gtacgaggagctaggatgaa

SEQ ID NO: 345619 - DNA, 20 bp, human
gtgggagtgtaagatgctga

SEQ ID NO: 345620 - DNA, 20 bp, human
gactgaggaagcccacaact

SEQ ID NO: 345621 - DNA, 20 bp, human
gacaagcatgtgtggacaca

SEQ ID NO: 345622 - DNA, 20 bp, human
ggcaccaccaagcaactgtc

SEQ ID NO: 345623 - DNA, 20 bp, human
gcacagggcgggcgctgagt

SEQ ID NO: 345624 - DNA, 20 bp, human
gtggggacttacgaggagct

SEQ ID NO: 345625 - DNA, 20 bp, human
ggagaaggcaagctttttgc

SEQ ID NO: 345626 - DNA, 20 bp, human
ggtcagagagaagggaacct

SEQ ID NO: 345627 - DNA, 20 bp, human
gagggaacctgggataagaa

SEQ ID NO: 345628 - DNA, 20 bp, human
gtgcctctgtgcagccgtcc

SEQ ID NO: 345629 - DNA, 20 bp, human
gccccaagtgatgtcacaat

SEQ ID NO: 345630 - DNA, 20 bp, human
ggccacgaagacttcttttc

SEQ ID NO: 345631 - DNA, 20 bp, human
ggggggctctggatctgagc

SEQ ID NO: 345632 - DNA, 20 bp, human
gaaaggcatgtcttccatgt

SEQ ID NO: 345633 - DNA, 20 bp, human
gtcagcaacactcaggaagc

SEQ ID NO: 345634 - DNA, 20 bp, human
gggctttatcagcaacactc

SEQ ID NO: 345635 - DNA, 20 bp, human
gttccgggacggctgcacag

SEQ ID NO: 345636 - DNA, 20 bp, human
gacggggcagacactcctgg

SEQ ID NO: 345637 - DNA, 20 bp, human
gagagcgtcagaagctgcta

SEQ ID NO: 345638 - DNA, 20 bp, human
gggagcttacagctatgacg

SEQ ID NO: 345639 - DNA, 20 bp, human
gatgacggggcagacactcc

SEQ ID NO: 345640 - DNA, 20 bp, human
gcatagctgtaagctcctca

SEQ ID NO: 345641 - DNA, 20 bp, human
gggctcctttgacagaaggg

SEQ ID NO: 345642 - DNA, 20 bp, human
ggatggagccgcagaaacaa

SEQ ID NO: 345643 - DNA, 20 bp, human
gacccccagtgcggcaatta

SEQ ID NO: 345644 - DNA, 20 bp, human
gacccggaaggtggactccg

SEQ ID NO: 345645 - DNA, 20 bp, human
gagaaatggccacattgggg

SEQ ID NO: 345646 - DNA, 20 bp, human
ggtcccctagtccggaaaca

SEQ ID NO: 345647 - DNA, 20 bp, human
gaatcgatggtctcaggtgg

SEQ ID NO: 345648 - DNA, 20 bp, human
gctagtccggaaacagggag

SEQ ID NO: 345649 - DNA, 20 bp, human
gctgagaaatcgatggtctc

SEQ ID NO: 345650 - DNA, 20 bp, human
gttctcagaaacgcccgcct

SEQ ID NO: 345651 - DNA, 20 bp, human
gtcagccaacggccggaaag

SEQ ID NO: 345652 - DNA, 20 bp, human
gggctccaggcgttgctggt

SEQ ID NO: 345653 - DNA, 20 bp, human
gacggcccgaagacctctgc

SEQ ID NO: 345654 - DNA, 20 bp, human
gagaaatcgatggtctcagg

SEQ ID NO: 345655 - DNA, 20 bp, human
ggctgcaagtgacctcggga

SEQ ID NO: 345656 - DNA, 20 bp, human
gtggataaacagtgacatga

SEQ ID NO: 345657 - DNA, 20 bp, human
ggaagcaatgtcagctccag

SEQ ID NO: 345658 - DNA, 20 bp, human
ggaaagaaatccttcagttg

SEQ ID NO: 345659 - DNA, 20 bp, human
gcaaagaggagtttaatgtc

SEQ ID NO: 345660 - DNA, 20 bp, human
ggaaaaatagcatcacacag

SEQ ID NO: 345661 - DNA, 20 bp, human
gtggacataatgtagccctc

SEQ ID NO: 345662 - DNA, 20 bp, human
gcagactaaaacatttggta

SEQ ID NO: 345663 - DNA, 20 bp, human
gttggggttgcctcaactga

SEQ ID NO: 345664 - DNA, 20 bp, human
gctgtaagctcttggaaggt

SEQ ID NO: 345665 - DNA, 20 bp, human
gggagtttaatgtcaggcag

SEQ ID NO: 345666 - DNA, 20 bp, human
gaggagagtcgtcacattcc

SEQ ID NO: 345667 - DNA, 20 bp, human
gcagcaccgtctggccacgc

SEQ ID NO: 345668 - DNA, 20 bp, human
gacgggcctgcagctctgaa

SEQ ID NO: 345669 - DNA, 20 bp, human
gctgaaaggactcatgactt

SEQ ID NO: 345670 - DNA, 20 bp, human
gcacatacacactacacacc

SEQ ID NO: 345671 - DNA, 20 bp, human
gaggccagttatgcccccca

SEQ ID NO: 345672 - DNA, 20 bp, human
gcccataaccagcctaagga

SEQ ID NO: 345673 - DNA, 20 bp, human
gctgtgtgtgtcctcttatg

SEQ ID NO: 345674 - DNA, 20 bp, human
gagctcccataaccagccta

SEQ ID NO: 345675 - DNA, 20 bp, human
gtgtgtcctcttatgtggtg

SEQ ID NO: 345676 - DNA, 20 bp, human
gtccccgcggggcttggcgg

SEQ ID NO: 345677 - DNA, 20 bp, human
gacggtggatctgggaatca

SEQ ID NO: 345678 - DNA, 20 bp, human
gccgcggcctagccagggga

SEQ ID NO: 345679 - DNA, 20 bp, human
gcgcccccgcggcctagcca

SEQ ID NO: 345680 - DNA, 20 bp, human
gtccggggcccgcgctcagg

SEQ ID NO: 345681 - DNA, 20 bp, human
ggggaagcagcggcctgacg

SEQ ID NO: 345682 - DNA, 20 bp, human
gcccgcggggactctggagc

SEQ ID NO: 345683 - DNA, 20 bp, human
ggccgcaagggacgcgtccg

SEQ ID NO: 345684 - DNA, 20 bp, human
gtgagccagcgtgctcttgg

SEQ ID NO: 345685 - DNA, 20 bp, human
ggccgccgccccctgccgga

SEQ ID NO: 345686 - DNA, 20 bp, human
gggccgctcgcgagaagcaa

SEQ ID NO: 345687 - DNA, 20 bp, human
gggcgaggctggtgctcgga

SEQ ID NO: 345688 - DNA, 20 bp, human
ggacccgtacccttccccca

SEQ ID NO: 345689 - DNA, 20 bp, human
gggccggagaccctcagccg

SEQ ID NO: 345690 - DNA, 20 bp, human
ggtcggggacagagccacaa

SEQ ID NO: 345691 - DNA, 20 bp, human
gggcctgagagtccggctgg

SEQ ID NO: 345692 - DNA, 20 bp, human
gtcccgccggacaatgcacc

SEQ ID NO: 345693 - DNA, 20 bp, human
ggtggctctgtccccgacgg

SEQ ID NO: 345694 - DNA, 20 bp, human
gggaagggtacgggtcccgc

SEQ ID NO: 345695 - DNA, 20 bp, human
gagatgtagaaagtagtccc

SEQ ID NO: 345696 - DNA, 20 bp, human
gtgggagtcagaacggactc

SEQ ID NO: 345697 - DNA, 20 bp, human
gtggccagggacccccgact

SEQ ID NO: 345698 - DNA, 20 bp, human
gtgtcacccacccaagtcgg

SEQ ID NO: 345699 - DNA, 20 bp, human
gcgtggcaggtgtgtcccgt

SEQ ID NO: 345700 - DNA, 20 bp, human
ggtgggcatgtgttgctctg

SEQ ID NO: 345701 - DNA, 20 bp, human
gcagggacccccgacttggg

SEQ ID NO: 345702 - DNA, 20 bp, human
gtgggcattgggcaactcaa

SEQ ID NO: 345703 - DNA, 20 bp, human
gctccctgacgaggtccctg

SEQ ID NO: 345704 - DNA, 20 bp, human
gaggagacgcctccctgacg

SEQ ID NO: 345705 - DNA, 20 bp, human
ggggacacacctgccacggc

SEQ ID NO: 345706 - DNA, 20 bp, human
ggttgcagatcgggagacgg

SEQ ID NO: 345707 - DNA, 20 bp, human
gccagccagcaggcactgac

SEQ ID NO: 345708 - DNA, 20 bp, human
gcccgagctgcggagatcgt

SEQ ID NO: 345709 - DNA, 20 bp, human
ggagctgcggagatcgtggg

SEQ ID NO: 345710 - DNA, 20 bp, human
gggggggagtccaggcgtca

SEQ ID NO: 345711 - DNA, 20 bp, human
gcactgaccgggttgcagat

SEQ ID NO: 345712 - DNA, 20 bp, human
gttcccccgcatctgcaggg

SEQ ID NO: 345713 - DNA, 20 bp, human
gcgggttgcagatcgggaga

SEQ ID NO: 345714 - DNA, 20 bp, human
gcagggaggccatgtagggc

SEQ ID NO: 345715 - DNA, 20 bp, human
ggtcgtaattataacccccc

SEQ ID NO: 345716 - DNA, 20 bp, human
ggcgtggcgtggggcgacgt

SEQ ID NO: 345717 - DNA, 20 bp, human
ggtccctagcaaccgaggga

SEQ ID NO: 345718 - DNA, 20 bp, human
ggggaaggattgttttctga

SEQ ID NO: 345719 - DNA, 20 bp, human
ggtcgccccgcccccagcgg

SEQ ID NO: 345720 - DNA, 20 bp, human
gctcgccggaaagacgtccc

SEQ ID NO: 345721 - DNA, 20 bp, human
ggccaagggggcgtggcgtg

SEQ ID NO: 345722 - DNA, 20 bp, human
gcacgcccccttggcctcgc

SEQ ID NO: 345723 - DNA, 20 bp, human
gcgcttacgcagttcctccc

SEQ ID NO: 345724 - DNA, 20 bp, human
ggcaatgtccctagcaaccg

SEQ ID NO: 345725 - DNA, 20 bp, human
gagggacattgcggagttgc

SEQ ID NO: 345726 - DNA, 20 bp, human
gggctcctccgccaatcgca

SEQ ID NO: 345727 - DNA, 20 bp, human
gggtgcaggggtatggcgag

SEQ ID NO: 345728 - DNA, 20 bp, human
ggggaggcactcagctagat

SEQ ID NO: 345729 - DNA, 20 bp, human
ggtgctgcggcctcctgacg

SEQ ID NO: 345730 - DNA, 20 bp, human
gccctgggcgagacggtcga

SEQ ID NO: 345731 - DNA, 20 bp, human
gacggccctgcgattggcgg

SEQ ID NO: 345732 - DNA, 20 bp, human
ggcggtcagcgggggaaggt

SEQ ID NO: 345733 - DNA, 20 bp, human
ggaaagtgggtgtgccgccc

SEQ ID NO: 345734 - DNA, 20 bp, human
gtctgccgcaggcaccgccg

SEQ ID NO: 345735 - DNA, 20 bp, human
gtctgccctaataaggaaag

SEQ ID NO: 345736 - DNA, 20 bp, human
gaggaggggtaagacaacac

SEQ ID NO: 345737 - DNA, 20 bp, human
ggtaaggggagggactgcgt

SEQ ID NO: 345738 - DNA, 20 bp, human
ggggcgtggtcaggtcggga

SEQ ID NO: 345739 - DNA, 20 bp, human
gagacggggttgtaagggga

SEQ ID NO: 345740 - DNA, 20 bp, human
gggaggagacggggttgtaa

SEQ ID NO: 345741 - DNA, 20 bp, human
ggggagggactgcgtcggag

SEQ ID NO: 345742 - DNA, 20 bp, human
gagaggcgggaccaggatcg

SEQ ID NO: 345743 - DNA, 20 bp, human
gaagacaacacaggcctgag

SEQ ID NO: 345744 - DNA, 20 bp, human
gagccaaatggggtatagaa

SEQ ID NO: 345745 - DNA, 20 bp, human
ggaccacgcccccacgatcc

SEQ ID NO: 345746 - DNA, 20 bp, human
gaagaaacaagcatagctac

SEQ ID NO: 345747 - DNA, 20 bp, human
gtggatgcttaaggattttg

SEQ ID NO: 345748 - DNA, 20 bp, human
gagatgtttctggatgctta

SEQ ID NO: 345749 - DNA, 20 bp, human
gctgcagtgaatcgggaggt

SEQ ID NO: 345750 - DNA, 20 bp, human
ggaggtgggccaagacatgc

SEQ ID NO: 345751 - DNA, 20 bp, human
gttgctttgtttgtgctgtg

SEQ ID NO: 345752 - DNA, 20 bp, human
ggtacctagaaaccacagta

SEQ ID NO: 345753 - DNA, 20 bp, human
gcatgaatctgcagtgaatc

SEQ ID NO: 345754 - DNA, 20 bp, human
ggaatctgcagtgaatcggg

SEQ ID NO: 345755 - DNA, 20 bp, human
gtctgcaggaattcccacct

SEQ ID NO: 345756 - DNA, 20 bp, human
gaagaaacaagcatagctac

SEQ ID NO: 345757 - DNA, 20 bp, human
gtggatgcttaaggattttg

SEQ ID NO: 345758 - DNA, 20 bp, human
gagatgtttctggatgctta

SEQ ID NO: 345759 - DNA, 20 bp, human
gctgcagtgaatcgggaggt

SEQ ID NO: 345760 - DNA, 20 bp, human
ggaggtgggccaagacatgc

SEQ ID NO: 345761 - DNA, 20 bp, human
gttgctttgtttgtgctgtg

SEQ ID NO: 345762 - DNA, 20 bp, human
ggtacctagaaaccacagta

SEQ ID NO: 345763 - DNA, 20 bp, human
gcatgaatctgcagtgaatc

SEQ ID NO: 345764 - DNA, 20 bp, human
ggaatctgcagtgaatcggg

SEQ ID NO: 345765 - DNA, 20 bp, human
gtctgcaggaattcccacct

SEQ ID NO: 345766 - DNA, 20 bp, human
gaaggggaggccaataggag

SEQ ID NO: 345767 - DNA, 20 bp, human
gtgagggcgcctgcgcgaag

SEQ ID NO: 345768 - DNA, 20 bp, human
ggaaaggaagggctatgggg

SEQ ID NO: 345769 - DNA, 20 bp, human
gggcgaaaggaagggctatg

SEQ ID NO: 345770 - DNA, 20 bp, human
gtcagggcgctgttgagctc

SEQ ID NO: 345771 - DNA, 20 bp, human
ggcgcgaaggggaggccaat

SEQ ID NO: 345772 - DNA, 20 bp, human
gatgggaggggcgaaaggaa

SEQ ID NO: 345773 - DNA, 20 bp, human
gccctcagaggcgctgagtc

SEQ ID NO: 345774 - DNA, 20 bp, human
ggggcgcctgcgcgaagggg

SEQ ID NO: 345775 - DNA, 20 bp, human
gataggagggggcaatggga

SEQ ID NO: 345776 - DNA, 20 bp, human
gcgggcacagggtgtgagtc

SEQ ID NO: 345777 - DNA, 20 bp, human
gccaggcactccaagagcaa

SEQ ID NO: 345778 - DNA, 20 bp, human
gaggggagggatagtgttcc

SEQ ID NO: 345779 - DNA, 20 bp, human
gtccaagagcaaaggcgaag

SEQ ID NO: 345780 - DNA, 20 bp, human
gccccagaggaggcacggaa

SEQ ID NO: 345781 - DNA, 20 bp, human
gccaggaatccccgggcaca

SEQ ID NO: 345782 - DNA, 20 bp, human
ggggggctcacattccagga

SEQ ID NO: 345783 - DNA, 20 bp, human
gccaggaactactgcagcag

SEQ ID NO: 345784 - DNA, 20 bp, human
gaatgggggcagagactcct

SEQ ID NO: 345785 - DNA, 20 bp, human
gagactcctcggggtgtgag

SEQ ID NO: 345786 - DNA, 20 bp, human
gctcagaagcgcgaccaatg

SEQ ID NO: 345787 - DNA, 20 bp, human
gaaggagctcacatccccat

SEQ ID NO: 345788 - DNA, 20 bp, human
gcccgcccgaggattgtggg

SEQ ID NO: 345789 - DNA, 20 bp, human
gcggcgcaggaacaaggcgg

SEQ ID NO: 345790 - DNA, 20 bp, human
ggcagggcctgcgacagcac

SEQ ID NO: 345791 - DNA, 20 bp, human
ggcgacagcacgggccaatg

SEQ ID NO: 345792 - DNA, 20 bp, human
gtcgcaggccctgcgctaat

SEQ ID NO: 345793 - DNA, 20 bp, human
gccgactcggcgcaggaaca

SEQ ID NO: 345794 - DNA, 20 bp, human
gggttgaaacagtaaacgcg

SEQ ID NO: 345795 - DNA, 20 bp, human
gtgaaacagtaaacgcgagg

SEQ ID NO: 345796 - DNA, 20 bp, human
ggggaggtgcaggtcgctca

SEQ ID NO: 345797 - DNA, 20 bp, human
ggcccggggtggctgagata

SEQ ID NO: 345798 - DNA, 20 bp, human
ggtggctgagatatggccct

SEQ ID NO: 345799 - DNA, 20 bp, human
gtatggcctcaaatggggag

SEQ ID NO: 345800 - DNA, 20 bp, human
gaacccgctggtgttgactg

SEQ ID NO: 345801 - DNA, 20 bp, human
gggtgggagaggcataatct

SEQ ID NO: 345802 - DNA, 20 bp, human
ggtcgctcagggaggagact

SEQ ID NO: 345803 - DNA, 20 bp, human
gggagccagtgagggccccg

SEQ ID NO: 345804 - DNA, 20 bp, human
gttcagccctcagcccgggg

SEQ ID NO: 345805 - DNA, 20 bp, human
gtggccttgcactgtgaggt

SEQ ID NO: 345806 - DNA, 20 bp, human
ggcgtcccggaagtagctgg

SEQ ID NO: 345807 - DNA, 20 bp, human
ggtgtctgggagccagacgc

SEQ ID NO: 345808 - DNA, 20 bp, human
gtggaggactcagcactcgg

SEQ ID NO: 345809 - DNA, 20 bp, human
gtcaaagagctgggtggccg

SEQ ID NO: 345810 - DNA, 20 bp, human
gaaggcgacgaggcgcggac

SEQ ID NO: 345811 - DNA, 20 bp, human
gcgggtgagcagggtgagta

SEQ ID NO: 345812 - DNA, 20 bp, human
gtcagcactcggtggtgtct

SEQ ID NO: 345813 - DNA, 20 bp, human
gcgggacgctctagacaggc

SEQ ID NO: 345814 - DNA, 20 bp, human
gtagctgggggaaggcgacg

SEQ ID NO: 345815 - DNA, 20 bp, human
gcttccgggacgctctagac

SEQ ID NO: 345816 - DNA, 20 bp, human
gagcctggggaggccagcgt

SEQ ID NO: 345817 - DNA, 20 bp, human
gtccccgcgcggccacgggg

SEQ ID NO: 345818 - DNA, 20 bp, human
gacgctgggcggacccggca

SEQ ID NO: 345819 - DNA, 20 bp, human
gaggcctggggctgtgacgc

SEQ ID NO: 345820 - DNA, 20 bp, human
ggagagcaccgctaggcctg

SEQ ID NO: 345821 - DNA, 20 bp, human
ggaggcgcccgatcgcgaag

SEQ ID NO: 345822 - DNA, 20 bp, human
gcggggaccgcatgaaatgg

SEQ ID NO: 345823 - DNA, 20 bp, human
ggggcggggaccgcatgaaa

SEQ ID NO: 345824 - DNA, 20 bp, human
ggtcacagccccaggcctag

SEQ ID NO: 345825 - DNA, 20 bp, human
gggagggcccccttcgcgat

SEQ ID NO: 345826 - DNA, 20 bp, human
gggggacctagcgacaaggg

SEQ ID NO: 345827 - DNA, 20 bp, human
gacgtggacacaagtggggt

SEQ ID NO: 345828 - DNA, 20 bp, human
gagagacgtggacacaagtg

SEQ ID NO: 345829 - DNA, 20 bp, human
gcctcctagggacacgcgtg

SEQ ID NO: 345830 - DNA, 20 bp, human
ggccccttgagccacacgta

SEQ ID NO: 345831 - DNA, 20 bp, human
ggtctggggaatagaaccag

SEQ ID NO: 345832 - DNA, 20 bp, human
gcttgtctggggcgggtctt

SEQ ID NO: 345833 - DNA, 20 bp, human
gcagcggggacctagcgaca

SEQ ID NO: 345834 - DNA, 20 bp, human
gagcgcgtgtggcatgtaac

SEQ ID NO: 345835 - DNA, 20 bp, human
gtgcagccgggccttacgtg

SEQ ID NO: 345836 - DNA, 20 bp, human
ggcccagcgtggctaggagg

SEQ ID NO: 345837 - DNA, 20 bp, human
ggggcagagggggacaaggt

SEQ ID NO: 345838 - DNA, 20 bp, human
gtgaacagaccgcgggagga

SEQ ID NO: 345839 - DNA, 20 bp, human
gtgcaagcggacagggctgg

SEQ ID NO: 345840 - DNA, 20 bp, human
gctggagggcggaggtggtt

SEQ ID NO: 345841 - DNA, 20 bp, human
ggggtctgcccgagggttcg

SEQ ID NO: 345842 - DNA, 20 bp, human
gccttggcggcgtctcccgg

SEQ ID NO: 345843 - DNA, 20 bp, human
gcgctgcgctgcaagcggac

SEQ ID NO: 345844 - DNA, 20 bp, human
gtgcagcgcagcgctcgccc

SEQ ID NO: 345845 - DNA, 20 bp, human
gactgcgggcgcgcgagcgg

SEQ ID NO: 345846 - DNA, 20 bp, human
ggacggtccgggccgctcga

SEQ ID NO: 345847 - DNA, 20 bp, human
gctcgagggctgcactgcga

SEQ ID NO: 345848 - DNA, 20 bp, human
ggggctgcactgcgagggtc

SEQ ID NO: 345849 - DNA, 20 bp, human
ggaggcggggccgacgcctc

SEQ ID NO: 345850 - DNA, 20 bp, human
gtcccccctccccgaggcgt

SEQ ID NO: 345851 - DNA, 20 bp, human
ggggaggcagcggacggtcc

SEQ ID NO: 345852 - DNA, 20 bp, human
gtggctgggcctccgaggcg

SEQ ID NO: 345853 - DNA, 20 bp, human
gaccctggcggaggctggcg

SEQ ID NO: 345854 - DNA, 20 bp, human
gcccagtaacgtcaaagcga

SEQ ID NO: 345855 - DNA, 20 bp, human
ggggtcccggcctctctgac

SEQ ID NO: 345856 - DNA, 20 bp, human
ggcgctgggcctaggaagag

SEQ ID NO: 345857 - DNA, 20 bp, human
gaagagaggctcttatcttg

SEQ ID NO: 345858 - DNA, 20 bp, human
gcttgtgggcaggaagtgtg

SEQ ID NO: 345859 - DNA, 20 bp, human
ggtgaggtgttgagcagcta

SEQ ID NO: 345860 - DNA, 20 bp, human
gaggctcttatcttgtgggc

SEQ ID NO: 345861 - DNA, 20 bp, human
gctccaaggagcaggggcat

SEQ ID NO: 345862 - DNA, 20 bp, human
ggataagagcctctcttcct

SEQ ID NO: 345863 - DNA, 20 bp, human
gaacctggggcagaagcgca

SEQ ID NO: 345864 - DNA, 20 bp, human
ggcctctccctgccatgcag

SEQ ID NO: 345865 - DNA, 20 bp, human
gtgagcagctagggaaccct

SEQ ID NO: 345866 - DNA, 20 bp, human
ggcggccggcccacggagga

SEQ ID NO: 345867 - DNA, 20 bp, human
gcggcctggagaaacgattg

SEQ ID NO: 345868 - DNA, 20 bp, human
ggctctgggcggattccgtc

SEQ ID NO: 345869 - DNA, 20 bp, human
gggaaggccaggtggagctc

SEQ ID NO: 345870 - DNA, 20 bp, human
gccggctctggcgtcgttgg

SEQ ID NO: 345871 - DNA, 20 bp, human
ggttggcggccggcccacgg

SEQ ID NO: 345872 - DNA, 20 bp, human
ggtgggttgtcggggttctg

SEQ ID NO: 345873 - DNA, 20 bp, human
ggagccggaaatgacgacaa

SEQ ID NO: 345874 - DNA, 20 bp, human
ggaaatgacgacaacggtga

SEQ ID NO: 345875 - DNA, 20 bp, human
gacaacccacgccagcgctc

SEQ ID NO: 345876 - DNA, 20 bp, human
ggcgtggggcggtaggacat

SEQ ID NO: 345877 - DNA, 20 bp, human
gactccaggtggggccccag

SEQ ID NO: 345878 - DNA, 20 bp, human
gcgcgcccgggactccaggt

SEQ ID NO: 345879 - DNA, 20 bp, human
gactaagcgacgaccttaga

SEQ ID NO: 345880 - DNA, 20 bp, human
ggtggggccccagtggacga

SEQ ID NO: 345881 - DNA, 20 bp, human
gacgaccttagaaggagtgg

SEQ ID NO: 345882 - DNA, 20 bp, human
gttcacgccgcgtggatgac

SEQ ID NO: 345883 - DNA, 20 bp, human
gacgctgctgccaggcccgc

SEQ ID NO: 345884 - DNA, 20 bp, human
gcgcccaggccacgcccggt

SEQ ID NO: 345885 - DNA, 20 bp, human
gggaacgcggcgtcgcccac

SEQ ID NO: 345886 - DNA, 20 bp, human
gccccagggcgcttgcgcgt

SEQ ID NO: 345887 - DNA, 20 bp, human
gcttggtaagcgcctggaga

SEQ ID NO: 345888 - DNA, 20 bp, human
gtcccagtgctcctaagcaa

SEQ ID NO: 345889 - DNA, 20 bp, human
gaccggggagtctatgggga

SEQ ID NO: 345890 - DNA, 20 bp, human
gtcctaccggggagtctatg

SEQ ID NO: 345891 - DNA, 20 bp, human
ggccctccccatagactccc

SEQ ID NO: 345892 - DNA, 20 bp, human
gcagggcgcttgcgcgtggg

SEQ ID NO: 345893 - DNA, 20 bp, human
gtggagggcttgggtaaaaa

SEQ ID NO: 345894 - DNA, 20 bp, human
gtaagagcagccagacctgg

SEQ ID NO: 345895 - DNA, 20 bp, human
gcgagcgcttggtaagcgcc

SEQ ID NO: 345896 - DNA, 20 bp, human
gtgtccccattgctcttggt

SEQ ID NO: 345897 - DNA, 20 bp, human
gcaccccgaccaagagcaat

SEQ ID NO: 345898 - DNA, 20 bp, human
gccgcacaaagtgtgtattg

SEQ ID NO: 345899 - DNA, 20 bp, human
ggagaagtgctccttccacc

SEQ ID NO: 345900 - DNA, 20 bp, human
ggacacgattggagaaaaga

SEQ ID NO: 345901 - DNA, 20 bp, human
ggaggacctgggtttcccag

SEQ ID NO: 345902 - DNA, 20 bp, human
gcaagagcaatggggacagc

SEQ ID NO: 345903 - DNA, 20 bp, human
gctgaaggggagagccagac

SEQ ID NO: 345904 - DNA, 20 bp, human
gaatggggtgtcactctgac

SEQ ID NO: 345905 - DNA, 20 bp, human
ggccctctttcatccccgtc

SEQ ID NO: 345906 - DNA, 20 bp, human
gtaccccgacccagggccat

SEQ ID NO: 345907 - DNA, 20 bp, human
gtgaatgtgtaccccgaccc

SEQ ID NO: 345908 - DNA, 20 bp, human
gtctgtgtttcaggtccctg

SEQ ID NO: 345909 - DNA, 20 bp, human
gagaggcctccacaatcccc

SEQ ID NO: 345910 - DNA, 20 bp, human
gcaggacctgggtgtcctag

SEQ ID NO: 345911 - DNA, 20 bp, human
gttcaggtccctggggattg

SEQ ID NO: 345912 - DNA, 20 bp, human
gtggctgcagcttccaagaa

SEQ ID NO: 345913 - DNA, 20 bp, human
gacaaaaggaaaacagaagg

SEQ ID NO: 345914 - DNA, 20 bp, human
gtagaggaaactgtcctttc

SEQ ID NO: 345915 - DNA, 20 bp, human
gggtatgtgtgtcactgtgt

SEQ ID NO: 345916 - DNA, 20 bp, human
ggagtggacggtcttgtcgt

SEQ ID NO: 345917 - DNA, 20 bp, human
gaggtgaatacttcagggtt

SEQ ID NO: 345918 - DNA, 20 bp, human
gtacttctggacatccaagc

SEQ ID NO: 345919 - DNA, 20 bp, human
gagcatccccttccctcaga

SEQ ID NO: 345920 - DNA, 20 bp, human
gtcatttggatttaagctgg

SEQ ID NO: 345921 - DNA, 20 bp, human
gtaccctgggactgaccggg

SEQ ID NO: 345922 - DNA, 20 bp, human
gtgagggaaggggatgctcc

SEQ ID NO: 345923 - DNA, 20 bp, human
ggaaacaggtgaatacttca

SEQ ID NO: 345924 - DNA, 20 bp, human
gagaatataaggggagtgga

SEQ ID NO: 345925 - DNA, 20 bp, human
gccacaggtgatgccatctg

SEQ ID NO: 345926 - DNA, 20 bp, human
ggagcatttctcaagctcgt

SEQ ID NO: 345927 - DNA, 20 bp, human
ggggtgagctctgtgttgtc

SEQ ID NO: 345928 - DNA, 20 bp, human
gcatttctcaagctcgtggg

SEQ ID NO: 345929 - DNA, 20 bp, human
gcaatgggacgtcactgtga

SEQ ID NO: 345930 - DNA, 20 bp, human
ggagacacacacgacccaca

SEQ ID NO: 345931 - DNA, 20 bp, human
gctctgtgttgtctggtaag

SEQ ID NO: 345932 - DNA, 20 bp, human
ggtgcagctcctgcactgaa

SEQ ID NO: 345933 - DNA, 20 bp, human
gggtactgaatgttcatcct

SEQ ID NO: 345934 - DNA, 20 bp, human
gcagtacctgggtttcccag

SEQ ID NO: 345935 - DNA, 20 bp, human
gggggagagccagatgagga

SEQ ID NO: 345936 - DNA, 20 bp, human
gtctccgcatggctctggtt

SEQ ID NO: 345937 - DNA, 20 bp, human
gcactgctgaaaaaggcaga

SEQ ID NO: 345938 - DNA, 20 bp, human
gcagcctcctgctctccgca

SEQ ID NO: 345939 - DNA, 20 bp, human
gccagagccatgcggagagc

SEQ ID NO: 345940 - DNA, 20 bp, human
gggtatgtgtgtgactctgt

SEQ ID NO: 345941 - DNA, 20 bp, human
ggagccatgcggagagcagg

SEQ ID NO: 345942 - DNA, 20 bp, human
gggtgcacattcacgccctt

SEQ ID NO: 345943 - DNA, 20 bp, human
gggttgggcaagcgcagtcc

SEQ ID NO: 345944 - DNA, 20 bp, human
ggtgtgaactgtgtgtttcc

SEQ ID NO: 345945 - DNA, 20 bp, human
gcttccaaggatggacgttc

SEQ ID NO: 345946 - DNA, 20 bp, human
gaagctgtgtggctccgaag

SEQ ID NO: 345947 - DNA, 20 bp, human
gtcggcgcccgctagcactg

SEQ ID NO: 345948 - DNA, 20 bp, human
gtatccgggcctctctccct

SEQ ID NO: 345949 - DNA, 20 bp, human
gaccactccgcaaaccgcag

SEQ ID NO: 345950 - DNA, 20 bp, human
gagcacccggcgaagctgtg

SEQ ID NO: 345951 - DNA, 20 bp, human
gcaagcgaagaagaaaggac

SEQ ID NO: 345952 - DNA, 20 bp, human
gggagcatgcggcggttgca

SEQ ID NO: 345953 - DNA, 20 bp, human
gtctccctaacacgcagcca

SEQ ID NO: 345954 - DNA, 20 bp, human
gaagcgaacttggggacgta

SEQ ID NO: 345955 - DNA, 20 bp, human
gcacgcagagaagccagcag

SEQ ID NO: 345956 - DNA, 20 bp, human
ggggacgggcactctcctga

SEQ ID NO: 345957 - DNA, 20 bp, human
ggcctgccaatcaacctctt

SEQ ID NO: 345958 - DNA, 20 bp, human
gggcactctcctgaaggggt

SEQ ID NO: 345959 - DNA, 20 bp, human
ggcccgtccccgccccgaag

SEQ ID NO: 345960 - DNA, 20 bp, human
gccaatcaacctcttcgggg

SEQ ID NO: 345961 - DNA, 20 bp, human
gacgggtcggtgatagaaaa

SEQ ID NO: 345962 - DNA, 20 bp, human
gcagccgcgtagcccagttt

SEQ ID NO: 345963 - DNA, 20 bp, human
gtgaccgctgcctgcgagac

SEQ ID NO: 345964 - DNA, 20 bp, human
gggcggactctcccgaaact

SEQ ID NO: 345965 - DNA, 20 bp, human
gtatcaccgacccgtctcgc

SEQ ID NO: 345966 - DNA, 20 bp, human
gaggcgcaggttctgcctgt

SEQ ID NO: 345967 - DNA, 20 bp, human
ggagacgcctggatcatcgc

SEQ ID NO: 345968 - DNA, 20 bp, human
gaacctgcgcctaattgtct

SEQ ID NO: 345969 - DNA, 20 bp, human
gtcgttagcgggtatcctgg

SEQ ID NO: 345970 - DNA, 20 bp, human
gcaggcgtctcggtcgttag

SEQ ID NO: 345971 - DNA, 20 bp, human
ggcagctgctctttgataaa

SEQ ID NO: 345972 - DNA, 20 bp, human
gtatcaaagagcagctgcga

SEQ ID NO: 345973 - DNA, 20 bp, human
gagcccagacaattaggcgc

SEQ ID NO: 345974 - DNA, 20 bp, human
gtgaccacgaccccccagtg

SEQ ID NO: 345975 - DNA, 20 bp, human
gggaaagaaaccccactggg

SEQ ID NO: 345976 - DNA, 20 bp, human
gcggtcggaaagttttaagg

SEQ ID NO: 345977 - DNA, 20 bp, human
ggcggagcctcggaagatct

SEQ ID NO: 345978 - DNA, 20 bp, human
gtgagactggcgggaaaacc

SEQ ID NO: 345979 - DNA, 20 bp, human
ggagcggtcggaaagtttta

SEQ ID NO: 345980 - DNA, 20 bp, human
gcatacacaggaacctagaa

SEQ ID NO: 345981 - DNA, 20 bp, human
gtagaagggctacgtgacag

SEQ ID NO: 345982 - DNA, 20 bp, human
gtcagttcctagatcttccg

SEQ ID NO: 345983 - DNA, 20 bp, human
gctggcgggaaaacctggct

SEQ ID NO: 345984 - DNA, 20 bp, human
gccgcccgccgccgagcggt

SEQ ID NO: 345985 - DNA, 20 bp, human
gtgccggcggctgagagctg

SEQ ID NO: 345986 - DNA, 20 bp, human
gtgtgcgcatgctgaaagca

SEQ ID NO: 345987 - DNA, 20 bp, human
gaggccgcggatcagaaccg

SEQ ID NO: 345988 - DNA, 20 bp, human
gccggggcggtcttccagca

SEQ ID NO: 345989 - DNA, 20 bp, human
gaagggctccgtgggagagg

SEQ ID NO: 345990 - DNA, 20 bp, human
gccgtggggtaggtaaagaa

SEQ ID NO: 345991 - DNA, 20 bp, human
gccagcagggaaaatggcgc

SEQ ID NO: 345992 - DNA, 20 bp, human
gtcccagtcctccgtggggt

SEQ ID NO: 345993 - DNA, 20 bp, human
ggttgtagttctaagaagcg

SEQ ID NO: 345994 - DNA, 20 bp, human
gatgcgcacaggcacagaat

SEQ ID NO: 345995 - DNA, 20 bp, human
gctactgggagcgactgcta

SEQ ID NO: 345996 - DNA, 20 bp, human
gtgcagaagcaatggaggcg

SEQ ID NO: 345997 - DNA, 20 bp, human
gcgcgcatgtgcagaagcaa

SEQ ID NO: 345998 - DNA, 20 bp, human
gggctccggcccccaggacg

SEQ ID NO: 345999 - DNA, 20 bp, human
gccaggacgaggagtattgt

SEQ ID NO: 346000 - DNA, 20 bp, human
gtcgggacgcggaggaagac

SEQ ID NO: 346001 - DNA, 20 bp, human
gttctctgtggctcgttccg

SEQ ID NO: 346002 - DNA, 20 bp, human
ggaaaaaagcgggccgcgag

SEQ ID NO: 346003 - DNA, 20 bp, human
gaaagtacgcgaaccgaagg

SEQ ID NO: 346004 - DNA, 20 bp, human
gagtattgtgggaaaaaagc

SEQ ID NO: 346005 - DNA, 20 bp, human
ggaacgagccacagagaaaa

SEQ ID NO: 346006 - DNA, 20 bp, human
ggacgcggaagtccttcttg

SEQ ID NO: 346007 - DNA, 20 bp, human
gtagaacccgtgcccctcgt

SEQ ID NO: 346008 - DNA, 20 bp, human
gcgcgggggtgctgaggctc

SEQ ID NO: 346009 - DNA, 20 bp, human
ggggccaaaggctcaccaga

SEQ ID NO: 346010 - DNA, 20 bp, human
gctcgtgggagctgggtcgc

SEQ ID NO: 346011 - DNA, 20 bp, human
ggcgcagaaccgctgggttg

SEQ ID NO: 346012 - DNA, 20 bp, human
ggggcgctgcagcttaggct

SEQ ID NO: 346013 - DNA, 20 bp, human
gcgtgcccacggctcctcgg

SEQ ID NO: 346014 - DNA, 20 bp, human
gcggttctgcgcatgcgcgg

SEQ ID NO: 346015 - DNA, 20 bp, human
gtggaggagttgctgtgcca

SEQ ID NO: 346016 - DNA, 20 bp, human
gccaacgcgcttcctcacga

SEQ ID NO: 346017 - DNA, 20 bp, human
gaaatcgcgggtggttgcta

SEQ ID NO: 346018 - DNA, 20 bp, human
gtaaggcggaagtacctccc

SEQ ID NO: 346019 - DNA, 20 bp, human
gccaagactggcaattggaa

SEQ ID NO: 346020 - DNA, 20 bp, human
ggaccaaccaagccctcgtg

SEQ ID NO: 346021 - DNA, 20 bp, human
gggcttggttggtccggagg

SEQ ID NO: 346022 - DNA, 20 bp, human
gcgaactcactacacgcctt

SEQ ID NO: 346023 - DNA, 20 bp, human
gttcctcacgagggcttggt

SEQ ID NO: 346024 - DNA, 20 bp, human
ggagggcttggttggtccgg

SEQ ID NO: 346025 - DNA, 20 bp, human
gagttcccgcctaggtgatt

SEQ ID NO: 346026 - DNA, 20 bp, human
ggccccgccccctaaggggg

SEQ ID NO: 346027 - DNA, 20 bp, human
gcgcaggcgcataccttcaa

SEQ ID NO: 346028 - DNA, 20 bp, human
ggaggccccgccccctaagg

SEQ ID NO: 346029 - DNA, 20 bp, human
gtgcaagagcggaagaaacg

SEQ ID NO: 346030 - DNA, 20 bp, human
gtcactccaccaccccctta

SEQ ID NO: 346031 - DNA, 20 bp, human
ggactatagcaaggacgaaa

SEQ ID NO: 346032 - DNA, 20 bp, human
ggccaagcaggcctcttgag

SEQ ID NO: 346033 - DNA, 20 bp, human
gcagagctcagtgctcgaac

SEQ ID NO: 346034 - DNA, 20 bp, human
gaaggacgaaaaggcttcct

SEQ ID NO: 346035 - DNA, 20 bp, human
gcagcagtctgaccagacac

SEQ ID NO: 346036 - DNA, 20 bp, human
ggggcggcgtcaggcggcga

SEQ ID NO: 346037 - DNA, 20 bp, human
gggtcaggccgaaccaccgg

SEQ ID NO: 346038 - DNA, 20 bp, human
gcggggtcaggccgaaccac

SEQ ID NO: 346039 - DNA, 20 bp, human
gagcgtcaggcggcgtcggg

SEQ ID NO: 346040 - DNA, 20 bp, human
gccgaaccaccggtggccgg

SEQ ID NO: 346041 - DNA, 20 bp, human
gtatccacctcgatgaccac

SEQ ID NO: 346042 - DNA, 20 bp, human
gggtgcgagggggtcgccgg

SEQ ID NO: 346043 - DNA, 20 bp, human
ggcctgacgccgcccgtcgc

SEQ ID NO: 346044 - DNA, 20 bp, human
gtagtggcgccgggagtcgc

SEQ ID NO: 346045 - DNA, 20 bp, human
gggccgggcgctgggtgcga

SEQ ID NO: 346046 - DNA, 20 bp, human
ggctatgcgtcagacatgaa

SEQ ID NO: 346047 - DNA, 20 bp, human
gaagaatgccgtcaactcac

SEQ ID NO: 346048 - DNA, 20 bp, human
gcaagcgcgaggacatccgc

SEQ ID NO: 346049 - DNA, 20 bp, human
gcaacacggtagtggggaaa

SEQ ID NO: 346050 - DNA, 20 bp, human
gtgccgtgacaccatccctg

SEQ ID NO: 346051 - DNA, 20 bp, human
gccctggggcaacacggtag

SEQ ID NO: 346052 - DNA, 20 bp, human
ggggcgcggggacttccggg

SEQ ID NO: 346053 - DNA, 20 bp, human
ggacatccgcaggcagccaa

SEQ ID NO: 346054 - DNA, 20 bp, human
gcggtagcacgctgtgttgg

SEQ ID NO: 346055 - DNA, 20 bp, human
gacggaagtccttgctcctt

SEQ ID NO: 346056 - DNA, 20 bp, human
gctcctggagggctgcacgg

SEQ ID NO: 346057 - DNA, 20 bp, human
ggctagtcgttgctcctgga

SEQ ID NO: 346058 - DNA, 20 bp, human
ggcacggcggcttgtccctt

SEQ ID NO: 346059 - DNA, 20 bp, human
gtcacgctagtcgttgctcc

SEQ ID NO: 346060 - DNA, 20 bp, human
gcgactagcgtgagatagag

SEQ ID NO: 346061 - DNA, 20 bp, human
gagcgctgacagggatgtaa

SEQ ID NO: 346062 - DNA, 20 bp, human
gtagcgtgagatagagaggc

SEQ ID NO: 346063 - DNA, 20 bp, human
gctgtcagcgctttttggaa

SEQ ID NO: 346064 - DNA, 20 bp, human
gttctcctgaagttcgctcc

SEQ ID NO: 346065 - DNA, 20 bp, human
gccggaagtggcgtaacgtc

SEQ ID NO: 346066 - DNA, 20 bp, human
gagcaaggggctcagatgga

SEQ ID NO: 346067 - DNA, 20 bp, human
gtaagagcaaggggctcaga

SEQ ID NO: 346068 - DNA, 20 bp, human
ggacctgaacaagtccagaa

SEQ ID NO: 346069 - DNA, 20 bp, human
gagcacagagggcacagcaa

SEQ ID NO: 346070 - DNA, 20 bp, human
gggactggaggtcagagttg

SEQ ID NO: 346071 - DNA, 20 bp, human
gaggctagggtaagagcaag

SEQ ID NO: 346072 - DNA, 20 bp, human
ggaggtcagagttgaggcta

SEQ ID NO: 346073 - DNA, 20 bp, human
ggggtactctgttggataga

SEQ ID NO: 346074 - DNA, 20 bp, human
ggccacgggcctttgaggaa

SEQ ID NO: 346075 - DNA, 20 bp, human
gtgtgcagacaagaggtcac

SEQ ID NO: 346076 - DNA, 20 bp, human
ggaccccagccacaaattcc

SEQ ID NO: 346077 - DNA, 20 bp, human
gccgcccaactccagatagt

SEQ ID NO: 346078 - DNA, 20 bp, human
gctgaaaggagacaggatga

SEQ ID NO: 346079 - DNA, 20 bp, human
gagggacgctacagagaagc

SEQ ID NO: 346080 - DNA, 20 bp, human
ggccccgcatgggagaaaca

SEQ ID NO: 346081 - DNA, 20 bp, human
gggtgaaggtctgaccgtga

SEQ ID NO: 346082 - DNA, 20 bp, human
ggaattgtctacctcgtcct

SEQ ID NO: 346083 - DNA, 20 bp, human
gagcacaaatggatggagca

SEQ ID NO: 346084 - DNA, 20 bp, human
gtgactctcagatgcgtcat

SEQ ID NO: 346085 - DNA, 20 bp, human
gtatctggagttgggcgggg

SEQ ID NO: 346086 - DNA, 20 bp, human
ggtcgcgagaggttgcaaag

SEQ ID NO: 346087 - DNA, 20 bp, human
gcacgtgtgggtgtcaaaaa

SEQ ID NO: 346088 - DNA, 20 bp, human
gcctgcacagcctgctccgg

SEQ ID NO: 346089 - DNA, 20 bp, human
gagaaactgggcgtcacata

SEQ ID NO: 346090 - DNA, 20 bp, human
ggacgtacaactgtcgcgag

SEQ ID NO: 346091 - DNA, 20 bp, human
gagaggttgcaaagcgggcg

SEQ ID NO: 346092 - DNA, 20 bp, human
gatgttcagtgcttgtctct

SEQ ID NO: 346093 - DNA, 20 bp, human
gaaatcacgcagtgtatgta

SEQ ID NO: 346094 - DNA, 20 bp, human
gtaaggtgccgagcacgtgt

SEQ ID NO: 346095 - DNA, 20 bp, human
ggcctgcagcacgacttcca

SEQ ID NO: 346096 - DNA, 20 bp, human
gcacgtgggctggtgaaact

SEQ ID NO: 346097 - DNA, 20 bp, human
gacggtgcatagtgggatct

SEQ ID NO: 346098 - DNA, 20 bp, human
gtccctgaggtcccgagtcc

SEQ ID NO: 346099 - DNA, 20 bp, human
ggcggaagagacttgcgaca

SEQ ID NO: 346100 - DNA, 20 bp, human
gccctgtcggtcaccagtac

SEQ ID NO: 346101 - DNA, 20 bp, human
ggacctggactcgggacctc

SEQ ID NO: 346102 - DNA, 20 bp, human
ggtgcatagtgggatctcgg

SEQ ID NO: 346103 - DNA, 20 bp, human
gtgcaaagtcaaaacggagg

SEQ ID NO: 346104 - DNA, 20 bp, human
gcaccagcccacgtgcgcgc

SEQ ID NO: 346105 - DNA, 20 bp, human
gggttgcaaagtcaaaacgg

SEQ ID NO: 346106 - DNA, 20 bp, human
gctaggtggcgaccgagaca

SEQ ID NO: 346107 - DNA, 20 bp, human
ggctgctggaagtcgtctac

SEQ ID NO: 346108 - DNA, 20 bp, human
gatgcgatgcgaagcgatgt

SEQ ID NO: 346109 - DNA, 20 bp, human
gaacatgcagtaatcctagg

SEQ ID NO: 346110 - DNA, 20 bp, human
gctgaacatgcagtaatcct

SEQ ID NO: 346111 - DNA, 20 bp, human
gcgaacggcaggggagctca

SEQ ID NO: 346112 - DNA, 20 bp, human
gggaccccccgcccaaagtc

SEQ ID NO: 346113 - DNA, 20 bp, human
ggcagacgccggatccatga

SEQ ID NO: 346114 - DNA, 20 bp, human
ggggtcgcggtccggacttt

SEQ ID NO: 346115 - DNA, 20 bp, human
ggcatcgcatcgcatctccg

SEQ ID NO: 346116 - DNA, 20 bp, human
gggcgtgactggttgaaaat

SEQ ID NO: 346117 - DNA, 20 bp, human
gtgggaggactcaccgctaa

SEQ ID NO: 346118 - DNA, 20 bp, human
gagcacgcctccaaaaagaa

SEQ ID NO: 346119 - DNA, 20 bp, human
gaggtcggccatctttgaga

SEQ ID NO: 346120 - DNA, 20 bp, human
gaaaacgtccatgttgcgta

SEQ ID NO: 346121 - DNA, 20 bp, human
gaggttgccatcttgtttaa

SEQ ID NO: 346122 - DNA, 20 bp, human
gtctttgagaagggcgtgac

SEQ ID NO: 346123 - DNA, 20 bp, human
gtgcgtaagggaagtgaggt

SEQ ID NO: 346124 - DNA, 20 bp, human
gaacctcaggcgcgttaaca

SEQ ID NO: 346125 - DNA, 20 bp, human
gtagggaaatggcctcagaa

SEQ ID NO: 346126 - DNA, 20 bp, human
gtgggagcgaagctactccg

SEQ ID NO: 346127 - DNA, 20 bp, human
gtccgaggttgacggcagaa

SEQ ID NO: 346128 - DNA, 20 bp, human
gtgagcacttgatggcagcg

SEQ ID NO: 346129 - DNA, 20 bp, human
ggaagctactccgaggttga

SEQ ID NO: 346130 - DNA, 20 bp, human
gaaaagtacagtactgcatg

SEQ ID NO: 346131 - DNA, 20 bp, human
ggagtagcttcgctcccaga

SEQ ID NO: 346132 - DNA, 20 bp, human
gagcgctctgtcacgctctt

SEQ ID NO: 346133 - DNA, 20 bp, human
ggctctttggtcgcgctttg

SEQ ID NO: 346134 - DNA, 20 bp, human
gagcctcccaaagtgccgaa

SEQ ID NO: 346135 - DNA, 20 bp, human
gtcccttctgccgtcaacct

SEQ ID NO: 346136 - DNA, 20 bp, human
gctaagagagtgggtagtga

SEQ ID NO: 346137 - DNA, 20 bp, human
gccctgagccctaagagagt

SEQ ID NO: 346138 - DNA, 20 bp, human
gctagggctagagaatcgct

SEQ ID NO: 346139 - DNA, 20 bp, human
gtctccagcccgcttcagtt

SEQ ID NO: 346140 - DNA, 20 bp, human
ggattccactaacgagtgag

SEQ ID NO: 346141 - DNA, 20 bp, human
gacccactctcttagggctc

SEQ ID NO: 346142 - DNA, 20 bp, human
gtctcttagggctcagggat

SEQ ID NO: 346143 - DNA, 20 bp, human
gagttcccctcactcgttag

SEQ ID NO: 346144 - DNA, 20 bp, human
gcatccaaactgaagcgggc

SEQ ID NO: 346145 - DNA, 20 bp, human
gactgaaagtaacaaaagtt

SEQ ID NO: 346146 - DNA, 20 bp, human
ggacccggaactgctttctt

SEQ ID NO: 346147 - DNA, 20 bp, human
gcggcaggagacctggtcgc

SEQ ID NO: 346148 - DNA, 20 bp, human
gtgacacccggaaccgggaa

SEQ ID NO: 346149 - DNA, 20 bp, human
gagaaagtgacacccggaac

SEQ ID NO: 346150 - DNA, 20 bp, human
gcccccgttgccagcgacgc

SEQ ID NO: 346151 - DNA, 20 bp, human
ggcaggtgccgccttgcttg

SEQ ID NO: 346152 - DNA, 20 bp, human
gttaacgcaagggggtggtg

SEQ ID NO: 346153 - DNA, 20 bp, human
ggaaacaagtccagtctgag

SEQ ID NO: 346154 - DNA, 20 bp, human
gaaaaagagccgagcacttc

SEQ ID NO: 346155 - DNA, 20 bp, human
gttgcttggggcttggttca

SEQ ID NO: 346156 - DNA, 20 bp, human
gggcgatgggttacagtaag

SEQ ID NO: 346157 - DNA, 20 bp, human
gcatccgctggaaacagggg

SEQ ID NO: 346158 - DNA, 20 bp, human
gaggagggacggaagtgcga

SEQ ID NO: 346159 - DNA, 20 bp, human
gtggaccaggaccatcacac

SEQ ID NO: 346160 - DNA, 20 bp, human
gttcccccgacccccataac

SEQ ID NO: 346161 - DNA, 20 bp, human
gcgggggaatgatgggtcaa

SEQ ID NO: 346162 - DNA, 20 bp, human
gttctctgctctcccgttat

SEQ ID NO: 346163 - DNA, 20 bp, human
gcgggcatccgctggaaaca

SEQ ID NO: 346164 - DNA, 20 bp, human
gcaaaagcccacttggcgat

SEQ ID NO: 346165 - DNA, 20 bp, human
gcgaaagccacagatcgaag

SEQ ID NO: 346166 - DNA, 20 bp, human
gaggcagggagaggcgagaa

SEQ ID NO: 346167 - DNA, 20 bp, human
gtgccccgagacaagtgacg

SEQ ID NO: 346168 - DNA, 20 bp, human
gcgcggcgctaacgtgtgta

SEQ ID NO: 346169 - DNA, 20 bp, human
gaaaactggtgcaagtggaa

SEQ ID NO: 346170 - DNA, 20 bp, human
gctgcctcgtcacttgtctc

SEQ ID NO: 346171 - DNA, 20 bp, human
gcctcctggcggcgccgcga

SEQ ID NO: 346172 - DNA, 20 bp, human
ggcgagaagggtgtgcgtga

SEQ ID NO: 346173 - DNA, 20 bp, human
ggggaaagcgaaatcgaaag

SEQ ID NO: 346174 - DNA, 20 bp, human
gccccagccgccagtagggg

SEQ ID NO: 346175 - DNA, 20 bp, human
gccggtggggcctgaagctc

SEQ ID NO: 346176 - DNA, 20 bp, human
gcagggagcaacgctaggaa

SEQ ID NO: 346177 - DNA, 20 bp, human
gacaggttgcaagaagaggc

SEQ ID NO: 346178 - DNA, 20 bp, human
gcgctcttgtgggtgactac

SEQ ID NO: 346179 - DNA, 20 bp, human
gaagaagaggcggggtttag

SEQ ID NO: 346180 - DNA, 20 bp, human
gaggagggacggaagtgcga

SEQ ID NO: 346181 - DNA, 20 bp, human
gtgtcgacgtcacacgacct

SEQ ID NO: 346182 - DNA, 20 bp, human
ggaaggcggcgccagggaga

SEQ ID NO: 346183 - DNA, 20 bp, human
gtaggaagggcgggcagaaa

SEQ ID NO: 346184 - DNA, 20 bp, human
gagaaagggcacgctcttgt

SEQ ID NO: 346185 - DNA, 20 bp, human
ggagcaacgctaggaagggc

SEQ ID NO: 346186 - DNA, 20 bp, human
gtgaccaagttgtgctccaa

SEQ ID NO: 346187 - DNA, 20 bp, human
gggcttgtgcgggcggtcta

SEQ ID NO: 346188 - DNA, 20 bp, human
ggaagtcgttagggacgcta

SEQ ID NO: 346189 - DNA, 20 bp, human
gccagaggcggaagtcgtta

SEQ ID NO: 346190 - DNA, 20 bp, human
gtgtgctccaagggcttgtg

SEQ ID NO: 346191 - DNA, 20 bp, human
gggacgctacggaagctgat

SEQ ID NO: 346192 - DNA, 20 bp, human
ggaccgcccgcacaagccct

SEQ ID NO: 346193 - DNA, 20 bp, human
gttgacaagcgcctcataac

SEQ ID NO: 346194 - DNA, 20 bp, human
gctccaagggcttgtgcggg

SEQ ID NO: 346195 - DNA, 20 bp, human
gaagcccttggagcacaact

SEQ ID NO: 346196 - DNA, 20 bp, human
ggagccctggggaaacgctt

SEQ ID NO: 346197 - DNA, 20 bp, human
ggtgccaaagcgtttcccca

SEQ ID NO: 346198 - DNA, 20 bp, human
gctctgaagcactgcataaa

SEQ ID NO: 346199 - DNA, 20 bp, human
gggactgattacctgtgaga

SEQ ID NO: 346200 - DNA, 20 bp, human
gtccccaccggaagtaaatt

SEQ ID NO: 346201 - DNA, 20 bp, human
gtctgagcccaatttacttc

SEQ ID NO: 346202 - DNA, 20 bp, human
ggggaaagggaagacaccac

SEQ ID NO: 346203 - DNA, 20 bp, human
ggggaaacgctttggcacgc

SEQ ID NO: 346204 - DNA, 20 bp, human
gtatgcagtgcttcagagtc

SEQ ID NO: 346205 - DNA, 20 bp, human
gagcccaatttacttccggt

SEQ ID NO: 346206 - DNA, 20 bp, human
gagcacggccggagctggtc

SEQ ID NO: 346207 - DNA, 20 bp, human
gcctccgcaagcatctgtca

SEQ ID NO: 346208 - DNA, 20 bp, human
gagaagggtgggatccgcga

SEQ ID NO: 346209 - DNA, 20 bp, human
ggctggtcgggtcaagagtc

SEQ ID NO: 346210 - DNA, 20 bp, human
gcctatgtgtaaaaccggaa

SEQ ID NO: 346211 - DNA, 20 bp, human
ggcccggcaaaaataggacg

SEQ ID NO: 346212 - DNA, 20 bp, human
gacgcgggcgggaacgtttc

SEQ ID NO: 346213 - DNA, 20 bp, human
gaacgtttcggggtccgcgg

SEQ ID NO: 346214 - DNA, 20 bp, human
gttggtctttggaatcggag

SEQ ID NO: 346215 - DNA, 20 bp, human
gttgccgggcgcgagaggtg

SEQ ID NO: 346216 - DNA, 20 bp, human
gggagcaaagcgacccctcc

SEQ ID NO: 346217 - DNA, 20 bp, human
ggaactatggagtccgggag

SEQ ID NO: 346218 - DNA, 20 bp, human
ggggccggacctcaagccat

SEQ ID NO: 346219 - DNA, 20 bp, human
gcacgccggcgccttcgcag

SEQ ID NO: 346220 - DNA, 20 bp, human
gcgcagaggcccatggcttg

SEQ ID NO: 346221 - DNA, 20 bp, human
gggaacttgcgcattcgggc

SEQ ID NO: 346222 - DNA, 20 bp, human
gtgaaggggaagccttccgg

SEQ ID NO: 346223 - DNA, 20 bp, human
gggctgaaggggaagccttc

SEQ ID NO: 346224 - DNA, 20 bp, human
ggcgggcctcgaacggtgat

SEQ ID NO: 346225 - DNA, 20 bp, human
ggaacggtgattggctgaag

SEQ ID NO: 346226 - DNA, 20 bp, human
gaagggcaggataggacgaa

SEQ ID NO: 346227 - DNA, 20 bp, human
gcatgagcttatgttgaggg

SEQ ID NO: 346228 - DNA, 20 bp, human
gcggctgagaggtgctggaa

SEQ ID NO: 346229 - DNA, 20 bp, human
gtaggacgaagggctggtct

SEQ ID NO: 346230 - DNA, 20 bp, human
gtacccgcaggcgcgagggc

SEQ ID NO: 346231 - DNA, 20 bp, human
gcatctcgccctgccgtgga

SEQ ID NO: 346232 - DNA, 20 bp, human
ggcgcatgagcttatgttga

SEQ ID NO: 346233 - DNA, 20 bp, human
gtgacgacaacggaagtccc

SEQ ID NO: 346234 - DNA, 20 bp, human
gtccgtacccgcaggcgcga

SEQ ID NO: 346235 - DNA, 20 bp, human
ggcgccatctcgccctgccg

SEQ ID NO: 346236 - DNA, 20 bp, human
gctaagggaaccatgatggg

SEQ ID NO: 346237 - DNA, 20 bp, human
gagttcaggggctttggaag

SEQ ID NO: 346238 - DNA, 20 bp, human
ggtgcggcgagaccacacta

SEQ ID NO: 346239 - DNA, 20 bp, human
gcacactaagggaaccatga

SEQ ID NO: 346240 - DNA, 20 bp, human
gggcggctactcgagttcag

SEQ ID NO: 346241 - DNA, 20 bp, human
gcgcgcaagcgcggaagcgg

SEQ ID NO: 346242 - DNA, 20 bp, human
gagcgcggaagcggaggatt

SEQ ID NO: 346243 - DNA, 20 bp, human
gagaagaattccgggtcaat

SEQ ID NO: 346244 - DNA, 20 bp, human
gtactcgagttcaggggctt

SEQ ID NO: 346245 - DNA, 20 bp, human
ggggacgcaggggacgcaag

SEQ ID NO: 346246 - DNA, 20 bp, human
gtaggtgaaccgagacatag

SEQ ID NO: 346247 - DNA, 20 bp, human
gaagacggggccaaccggaa

SEQ ID NO: 346248 - DNA, 20 bp, human
gcgagacatagaggtggaag

SEQ ID NO: 346249 - DNA, 20 bp, human
gggcttgcaagaaacggtat

SEQ ID NO: 346250 - DNA, 20 bp, human
gcgccggcatacactgaaag

SEQ ID NO: 346251 - DNA, 20 bp, human
ggtgaaccgagacatagagg

SEQ ID NO: 346252 - DNA, 20 bp, human
ggaagtggagtagaaagacg

SEQ ID NO: 346253 - DNA, 20 bp, human
gggcgaaaccctgcctggag

SEQ ID NO: 346254 - DNA, 20 bp, human
ggaaaccctgcctggagggg

SEQ ID NO: 346255 - DNA, 20 bp, human
gtgggcgaacccacccctcc

SEQ ID NO: 346256 - DNA, 20 bp, human
ggtcccgcgcaacggaacac

SEQ ID NO: 346257 - DNA, 20 bp, human
gctccccagccctcgcggaa

SEQ ID NO: 346258 - DNA, 20 bp, human
gctgagagaaagggtgttga

SEQ ID NO: 346259 - DNA, 20 bp, human
gagcaatggcgggtgatggt

SEQ ID NO: 346260 - DNA, 20 bp, human
gtacccttccgcgagggctg

SEQ ID NO: 346261 - DNA, 20 bp, human
gggtcaggagtcccgcgcaa

SEQ ID NO: 346262 - DNA, 20 bp, human
gtctgtgtacccttccgcga

SEQ ID NO: 346263 - DNA, 20 bp, human
ggtcctggcgagaagcgagc

SEQ ID NO: 346264 - DNA, 20 bp, human
ggccaggggagaattcgcgc

SEQ ID NO: 346265 - DNA, 20 bp, human
ggcgcagaagacgcaggcca

SEQ ID NO: 346266 - DNA, 20 bp, human
gctaggggccaagtctgtga

SEQ ID NO: 346267 - DNA, 20 bp, human
gcgcgcgacgggaaaagaaa

SEQ ID NO: 346268 - DNA, 20 bp, human
gcccagaggcgccgcgcgac

SEQ ID NO: 346269 - DNA, 20 bp, human
gaacgaggaaggccggtgat

SEQ ID NO: 346270 - DNA, 20 bp, human
gtccaccggcaacttgacta

SEQ ID NO: 346271 - DNA, 20 bp, human
gagagcagttccgggcaggg

SEQ ID NO: 346272 - DNA, 20 bp, human
gaaagaaaagggaacgagga

SEQ ID NO: 346273 - DNA, 20 bp, human
gagccggggtgggtagtcgc

SEQ ID NO: 346274 - DNA, 20 bp, human
gtgtagttctgcactgctag

SEQ ID NO: 346275 - DNA, 20 bp, human
gaaaagggaacgaggaaggc

SEQ ID NO: 346276 - DNA, 20 bp, human
ggagagcgggaccgcctcgc

SEQ ID NO: 346277 - DNA, 20 bp, human
gggcggccggcgaggaaaag

SEQ ID NO: 346278 - DNA, 20 bp, human
gactcaggaacccctctcag

SEQ ID NO: 346279 - DNA, 20 bp, human
gtacaggcggagggacccga

SEQ ID NO: 346280 - DNA, 20 bp, human
gtagtctctccgccgggcgc

SEQ ID NO: 346281 - DNA, 20 bp, human
gcgcagtgggagctctagat

SEQ ID NO: 346282 - DNA, 20 bp, human
gagcgggaccgcctcgcagg

SEQ ID NO: 346283 - DNA, 20 bp, human
gtcctagcgggcggccggcg

SEQ ID NO: 346284 - DNA, 20 bp, human
gttgcagcccacctgcgagg

SEQ ID NO: 346285 - DNA, 20 bp, human
gctccccagcgcctcctagc

SEQ ID NO: 346286 - DNA, 20 bp, human
gccagcgccggggacctcga

SEQ ID NO: 346287 - DNA, 20 bp, human
ggcactgccgcggacagcct

SEQ ID NO: 346288 - DNA, 20 bp, human
gaaaacctgacgctgcaggc

SEQ ID NO: 346289 - DNA, 20 bp, human
gcgggtgcgcgggcaacttc

SEQ ID NO: 346290 - DNA, 20 bp, human
gcctgagtggcaaccagcgc

SEQ ID NO: 346291 - DNA, 20 bp, human
ggtccgcggcagtgcctgag

SEQ ID NO: 346292 - DNA, 20 bp, human
gggtggggcttgaggcgcgc

SEQ ID NO: 346293 - DNA, 20 bp, human
gagacaaaacctgacgctgc

SEQ ID NO: 346294 - DNA, 20 bp, human
gctcgaggggtcctttgcgt

SEQ ID NO: 346295 - DNA, 20 bp, human
gagcgtcaggttttgtctct

SEQ ID NO: 346296 - DNA, 20 bp, human
gcagccaagtgcgcgggaag

SEQ ID NO: 346297 - DNA, 20 bp, human
gggaagtgggctgcaaacgc

SEQ ID NO: 346298 - DNA, 20 bp, human
gaacgccggagagttttgtc

SEQ ID NO: 346299 - DNA, 20 bp, human
ggagcaattccgggtcacaa

SEQ ID NO: 346300 - DNA, 20 bp, human
gggaaatgctcactcacttc

SEQ ID NO: 346301 - DNA, 20 bp, human
gcctgtggtcgaacccgcta

SEQ ID NO: 346302 - DNA, 20 bp, human
gacagcgcgtctctgcgctc

SEQ ID NO: 346303 - DNA, 20 bp, human
ggcgggccccgctggttgct

SEQ ID NO: 346304 - DNA, 20 bp, human
gtgggagcgccgtagcaggc

SEQ ID NO: 346305 - DNA, 20 bp, human
gttgaggcgtcaaagagtgt

SEQ ID NO: 346306 - DNA, 20 bp, human
ggcccggcgtctcctgtctc

SEQ ID NO: 346307 - DNA, 20 bp, human
gagtcaagcggatgtccagg

SEQ ID NO: 346308 - DNA, 20 bp, human
ggccgcagagcgcagaggta

SEQ ID NO: 346309 - DNA, 20 bp, human
gactctccgtcgtctccaat

SEQ ID NO: 346310 - DNA, 20 bp, human
ggagagtcaagcggatgtcc

SEQ ID NO: 346311 - DNA, 20 bp, human
ggagacgacggagagtcaag

SEQ ID NO: 346312 - DNA, 20 bp, human
gaatcgggctgattcatcgc

SEQ ID NO: 346313 - DNA, 20 bp, human
ggagaaaaaggaggcgtcgg

SEQ ID NO: 346314 - DNA, 20 bp, human
gctctggcaggactgtgagg

SEQ ID NO: 346315 - DNA, 20 bp, human
gcggaagtgcttcgcggcgg

SEQ ID NO: 346316 - DNA, 20 bp, human
gggcggggctctcaggccga

SEQ ID NO: 346317 - DNA, 20 bp, human
gggcgactatggcgcggggg

SEQ ID NO: 346318 - DNA, 20 bp, human
ggaaactccgaagaggtcgg

SEQ ID NO: 346319 - DNA, 20 bp, human
ggccaggggcgactatggcg

SEQ ID NO: 346320 - DNA, 20 bp, human
gcccacacggccaagtcccg

SEQ ID NO: 346321 - DNA, 20 bp, human
gaggggcgactatggcgcgg

SEQ ID NO: 346322 - DNA, 20 bp, human
ggctctcaggccgagggggt

SEQ ID NO: 346323 - DNA, 20 bp, human
gagtctccacctgcctccga

SEQ ID NO: 346324 - DNA, 20 bp, human
gaactcgcgcgcgtcggtcg

SEQ ID NO: 346325 - DNA, 20 bp, human
gcctgcgaccggaaacgccg

SEQ ID NO: 346326 - DNA, 20 bp, human
ggaaggaggagcttcgagga

SEQ ID NO: 346327 - DNA, 20 bp, human
gccgaggtgcaggatgaagg

SEQ ID NO: 346328 - DNA, 20 bp, human
gagcggggaggagcctttat

SEQ ID NO: 346329 - DNA, 20 bp, human
gaagccccacgaacccataa

SEQ ID NO: 346330 - DNA, 20 bp, human
ggtcccctcaggctccaatc

SEQ ID NO: 346331 - DNA, 20 bp, human
gaggagcttcgaggaaggag

SEQ ID NO: 346332 - DNA, 20 bp, human
ggtccacgagaggtcccctc

SEQ ID NO: 346333 - DNA, 20 bp, human
gcgatggccgagtcaacaaa

SEQ ID NO: 346334 - DNA, 20 bp, human
gagcctgaggggacctctcg

SEQ ID NO: 346335 - DNA, 20 bp, human
gctctcgagtgcatttctgt

SEQ ID NO: 346336 - DNA, 20 bp, human
gcgtcttgagggtagttgaa

SEQ ID NO: 346337 - DNA, 20 bp, human
gaacgcaacgtgggggacgg

SEQ ID NO: 346338 - DNA, 20 bp, human
gcccgctggccggatctcag

SEQ ID NO: 346339 - DNA, 20 bp, human
ggtcccccacgttgcgttct

SEQ ID NO: 346340 - DNA, 20 bp, human
ggatctcaggggagctatgg

SEQ ID NO: 346341 - DNA, 20 bp, human
gaattggaggagttgttgtt

SEQ ID NO: 346342 - DNA, 20 bp, human
gccaagccgaggtctgtgat

SEQ ID NO: 346343 - DNA, 20 bp, human
ggcaatggcagggaaagtgg

SEQ ID NO: 346344 - DNA, 20 bp, human
gaactcccagaacgcaacgt

SEQ ID NO: 346345 - DNA, 20 bp, human
gtgccgccaaacaaatttgt

SEQ ID NO: 346346 - DNA, 20 bp, human
ggctgctcagggaaatgcgg

SEQ ID NO: 346347 - DNA, 20 bp, human
gcaactgtagccagtggttg

SEQ ID NO: 346348 - DNA, 20 bp, human
gtgtccctgagatggctatg

SEQ ID NO: 346349 - DNA, 20 bp, human
gccggccagcggagcggcga

SEQ ID NO: 346350 - DNA, 20 bp, human
gctaacggaggcttctcgcg

SEQ ID NO: 346351 - DNA, 20 bp, human
ggtcgctgctcagggaaatg

SEQ ID NO: 346352 - DNA, 20 bp, human
gctagatgacgccagactga

SEQ ID NO: 346353 - DNA, 20 bp, human
gcagccccatagccatctca

SEQ ID NO: 346354 - DNA, 20 bp, human
ggggaaatgcggaggccagt

SEQ ID NO: 346355 - DNA, 20 bp, human
gggaagttaaacagcctcgt

SEQ ID NO: 346356 - DNA, 20 bp, human
gggaacgcctcacccggcct

SEQ ID NO: 346357 - DNA, 20 bp, human
gtcctctgctggacacctcc

SEQ ID NO: 346358 - DNA, 20 bp, human
gccgggtgaggcgttcccgg

SEQ ID NO: 346359 - DNA, 20 bp, human
gagcccccgtgaccacacag

SEQ ID NO: 346360 - DNA, 20 bp, human
gccaccctcaaggccccctg

SEQ ID NO: 346361 - DNA, 20 bp, human
gccctgcggagtcccagagt

SEQ ID NO: 346362 - DNA, 20 bp, human
gctgccggcggagacgggac

SEQ ID NO: 346363 - DNA, 20 bp, human
gaggacgctgccggcggaga

SEQ ID NO: 346364 - DNA, 20 bp, human
gcttccggtcccgtctccgc

SEQ ID NO: 346365 - DNA, 20 bp, human
gctgcgcccctgtgtggtca

SEQ ID NO: 346366 - DNA, 20 bp, human
gaacgcacggcgagggacga

SEQ ID NO: 346367 - DNA, 20 bp, human
gccagggaaacgcacggcga

SEQ ID NO: 346368 - DNA, 20 bp, human
gcgccaccgccgtcatttgt

SEQ ID NO: 346369 - DNA, 20 bp, human
gttaagggccgaagggacac

SEQ ID NO: 346370 - DNA, 20 bp, human
gcgcccacaaatgacggcgg

SEQ ID NO: 346371 - DNA, 20 bp, human
ggaagaaggaggccgcgcga

SEQ ID NO: 346372 - DNA, 20 bp, human
gctccgcccacaaatgacgg

SEQ ID NO: 346373 - DNA, 20 bp, human
gcaagtcgccggtgtccctt

SEQ ID NO: 346374 - DNA, 20 bp, human
gccgccgcgcgaggcactct

SEQ ID NO: 346375 - DNA, 20 bp, human
gcgcgcgagggctgacgaac

SEQ ID NO: 346376 - DNA, 20 bp, human
gggcgccacctcgagagcga

SEQ ID NO: 346377 - DNA, 20 bp, human
gaggtggagcccaaggcccg

SEQ ID NO: 346378 - DNA, 20 bp, human
gagcgacggcgggctacccg

SEQ ID NO: 346379 - DNA, 20 bp, human
gtagcccgccgtcgctctcg

SEQ ID NO: 346380 - DNA, 20 bp, human
ggaaccgtgaggtgggtagg

SEQ ID NO: 346381 - DNA, 20 bp, human
ggacatgttcattaagggca

SEQ ID NO: 346382 - DNA, 20 bp, human
gccacctcgagagcgacggc

SEQ ID NO: 346383 - DNA, 20 bp, human
ggctctcgaggtggcgccct

SEQ ID NO: 346384 - DNA, 20 bp, human
gagcactcagactgaagcca

SEQ ID NO: 346385 - DNA, 20 bp, human
gccaactgacatgttcatta

SEQ ID NO: 346386 - DNA, 20 bp, human
ggacccggcaggagtagcgt

SEQ ID NO: 346387 - DNA, 20 bp, human
gactcctgccgggtcaccac

SEQ ID NO: 346388 - DNA, 20 bp, human
gcgttggtgtgcaattgcgt

SEQ ID NO: 346389 - DNA, 20 bp, human
gcgaacgcgagaacagtcaa

SEQ ID NO: 346390 - DNA, 20 bp, human
gcgagaacagtcaaggggcg

SEQ ID NO: 346391 - DNA, 20 bp, human
ggggcttgggatggggctta

SEQ ID NO: 346392 - DNA, 20 bp, human
ggcgcctgtggtgacccggc

SEQ ID NO: 346393 - DNA, 20 bp, human
gcgagatcatcccctagcgt

SEQ ID NO: 346394 - DNA, 20 bp, human
gcaattgcacaccaacgcta

SEQ ID NO: 346395 - DNA, 20 bp, human
gcaggcgcacgtgttccggc

SEQ ID NO: 346396 - DNA, 20 bp, human
gtccccgcgccgcctcgcga

SEQ ID NO: 346397 - DNA, 20 bp, human
gcacccgccgccctcctctg

SEQ ID NO: 346398 - DNA, 20 bp, human
gggtcagccctgccatggaa

SEQ ID NO: 346399 - DNA, 20 bp, human
gaggaggcggggtcggatgg

SEQ ID NO: 346400 - DNA, 20 bp, human
gggaccgggccagcggaggt

SEQ ID NO: 346401 - DNA, 20 bp, human
ggaagctggccctcgcgagg

SEQ ID NO: 346402 - DNA, 20 bp, human
gtgcggcaccgccccttcca

SEQ ID NO: 346403 - DNA, 20 bp, human
gcaccgccccttccatggca

SEQ ID NO: 346404 - DNA, 20 bp, human
gggggcggtgccgcagagga

SEQ ID NO: 346405 - DNA, 20 bp, human
ggacgcggagagactggctt

SEQ ID NO: 346406 - DNA, 20 bp, human
gcaggggctgcccgagggag

SEQ ID NO: 346407 - DNA, 20 bp, human
gccactaggagaggcggtgc

SEQ ID NO: 346408 - DNA, 20 bp, human
gagtggcaactggctgggaa

SEQ ID NO: 346409 - DNA, 20 bp, human
gagggaggggctagggtaag

SEQ ID NO: 346410 - DNA, 20 bp, human
gagggccaactggaagtcca

SEQ ID NO: 346411 - DNA, 20 bp, human
gtaagtgggaccgcggagac

SEQ ID NO: 346412 - DNA, 20 bp, human
gctggctgggaatggctgag

SEQ ID NO: 346413 - DNA, 20 bp, human
gcaactggaagtccagggtt

SEQ ID NO: 346414 - DNA, 20 bp, human
ggcccccgctccagtctccg

SEQ ID NO: 346415 - DNA, 20 bp, human
gcgcctctcctagtggcaac

SEQ ID NO: 346416 - DNA, 20 bp, human
ggcgcagccgcgatgaggca

SEQ ID NO: 346417 - DNA, 20 bp, human
ggcgcgacggcgttgtcccc

SEQ ID NO: 346418 - DNA, 20 bp, human
gccggggtcaagtgtcgggt

SEQ ID NO: 346419 - DNA, 20 bp, human
gactgccggggtcaagtgtc

SEQ ID NO: 346420 - DNA, 20 bp, human
gcgcacgtgcacagcctcgc

SEQ ID NO: 346421 - DNA, 20 bp, human
gttccccgagcctacgtcac

SEQ ID NO: 346422 - DNA, 20 bp, human
gccgcgatgaggcatggctt

SEQ ID NO: 346423 - DNA, 20 bp, human
gaagtcggggacccgggtac

SEQ ID NO: 346424 - DNA, 20 bp, human
ggagaaggtcccttcggtga

SEQ ID NO: 346425 - DNA, 20 bp, human
ggacgtaggctcggggaagt

SEQ ID NO: 346426 - DNA, 20 bp, human
gcggggcggagcgacggcgt

SEQ ID NO: 346427 - DNA, 20 bp, human
gccgccccggaagtgacttg

SEQ ID NO: 346428 - DNA, 20 bp, human
ggaagaaggcgcagcccgtt

SEQ ID NO: 346429 - DNA, 20 bp, human
ggcggcagctggagcccaac

SEQ ID NO: 346430 - DNA, 20 bp, human
ggggcccagaggttccggac

SEQ ID NO: 346431 - DNA, 20 bp, human
gcggcctcgtgtttccggtg

SEQ ID NO: 346432 - DNA, 20 bp, human
ggccgggcccacggcgaaga

SEQ ID NO: 346433 - DNA, 20 bp, human
gcggcctcaagtcacttccg

SEQ ID NO: 346434 - DNA, 20 bp, human
gaggacaatagcttggaatt

SEQ ID NO: 346435 - DNA, 20 bp, human
ggctgcgccttcttcgccgt

SEQ ID NO: 346436 - DNA, 20 bp, human
ggcactgaaaggttccgcca

SEQ ID NO: 346437 - DNA, 20 bp, human
gaagaggccaccttgctgag

SEQ ID NO: 346438 - DNA, 20 bp, human
ggggcacagcgtcctccaag

SEQ ID NO: 346439 - DNA, 20 bp, human
ggtatgctaggccggggaag

SEQ ID NO: 346440 - DNA, 20 bp, human
gcaactgcgtgaggcgcgcc

SEQ ID NO: 346441 - DNA, 20 bp, human
gacccggcttccggctttga

SEQ ID NO: 346442 - DNA, 20 bp, human
gtccgccagggagtgcgagc

SEQ ID NO: 346443 - DNA, 20 bp, human
gcagcaaggtggcctcttgg

SEQ ID NO: 346444 - DNA, 20 bp, human
gacaacagccagccggtgaa

SEQ ID NO: 346445 - DNA, 20 bp, human
gaggacgctgtgcccgcgtc

SEQ ID NO: 346446 - DNA, 20 bp, human
gcgcgggcgggcggtgtaga

SEQ ID NO: 346447 - DNA, 20 bp, human
gagcttgggctgtgcgcgga

SEQ ID NO: 346448 - DNA, 20 bp, human
ggcccagggcatgacagcgc

SEQ ID NO: 346449 - DNA, 20 bp, human
gctacgtcccgccccgcaca

SEQ ID NO: 346450 - DNA, 20 bp, human
gcgcccgcgctgtcatgccc

SEQ ID NO: 346451 - DNA, 20 bp, human
gggggtgtggccgcgagctt

SEQ ID NO: 346452 - DNA, 20 bp, human
gcgcgcacagcccaagctcg

SEQ ID NO: 346453 - DNA, 20 bp, human
ggagcgagccctgtgcgggg

SEQ ID NO: 346454 - DNA, 20 bp, human
ggacgtagcgcccgcgcggt

SEQ ID NO: 346455 - DNA, 20 bp, human
gctgcggggactgctggccc

SEQ ID NO: 346456 - DNA, 20 bp, human
gagaagcggcggggagacgc

SEQ ID NO: 346457 - DNA, 20 bp, human
gggcccgtccagctaactgc

SEQ ID NO: 346458 - DNA, 20 bp, human
gaccctggcaagcaaggcga

SEQ ID NO: 346459 - DNA, 20 bp, human
gcaacgccgcgtcaggccgg

SEQ ID NO: 346460 - DNA, 20 bp, human
gccggcgcccagggactcaa

SEQ ID NO: 346461 - DNA, 20 bp, human
gtaactgccggttcagaggg

SEQ ID NO: 346462 - DNA, 20 bp, human
ggggagctgcgctaggcgaa

SEQ ID NO: 346463 - DNA, 20 bp, human
gaaacagtggcggacaaaca

SEQ ID NO: 346464 - DNA, 20 bp, human
gttagctggacgggcctcaa

SEQ ID NO: 346465 - DNA, 20 bp, human
gatggggtgcgctgaggtct

SEQ ID NO: 346466 - DNA, 20 bp, human
ggggctcccgggcttctgag

SEQ ID NO: 346467 - DNA, 20 bp, human
gccgggagccccaagtctcc

SEQ ID NO: 346468 - DNA, 20 bp, human
gctaccagcgacgatcccga

SEQ ID NO: 346469 - DNA, 20 bp, human
gctgacttccggaaggtgga

SEQ ID NO: 346470 - DNA, 20 bp, human
ggccgcggcgcttctggtcc

SEQ ID NO: 346471 - DNA, 20 bp, human
gttctggtcccggagacttg

SEQ ID NO: 346472 - DNA, 20 bp, human
gtggacggaacccgcggacg

SEQ ID NO: 346473 - DNA, 20 bp, human
gcctgctcgaccacgggctt

SEQ ID NO: 346474 - DNA, 20 bp, human
gtccgggaccagaagcgccg

SEQ ID NO: 346475 - DNA, 20 bp, human
gccacttccgggcgcggcgc

SEQ ID NO: 346476 - DNA, 20 bp, human
gtccgagggtggggttctga

SEQ ID NO: 346477 - DNA, 20 bp, human
gtcgccctcaattctctctt

SEQ ID NO: 346478 - DNA, 20 bp, human
gagtaaggcctccgagggtg

SEQ ID NO: 346479 - DNA, 20 bp, human
gaacgacagtaaggcctccg

SEQ ID NO: 346480 - DNA, 20 bp, human
gcggccttgacatggttgtc

SEQ ID NO: 346481 - DNA, 20 bp, human
gcccttcagaaccccaccct

SEQ ID NO: 346482 - DNA, 20 bp, human
gccccattacagaacttgtg

SEQ ID NO: 346483 - DNA, 20 bp, human
gagaaaatacggccttgaca

SEQ ID NO: 346484 - DNA, 20 bp, human
gttgtcaggaaacgacagta

SEQ ID NO: 346485 - DNA, 20 bp, human
gtctgtctatattaccagaa

SEQ ID NO: 346486 - DNA, 20 bp, human
ggaggggcgatcccgggctt

SEQ ID NO: 346487 - DNA, 20 bp, human
gcaccagtacctctctggac

SEQ ID NO: 346488 - DNA, 20 bp, human
ggaggccagcaagacaacca

SEQ ID NO: 346489 - DNA, 20 bp, human
gccagagaggtactggtgtg

SEQ ID NO: 346490 - DNA, 20 bp, human
gtgggggcgtggtcgaggcg

SEQ ID NO: 346491 - DNA, 20 bp, human
gttcgctttcggccccggaa

SEQ ID NO: 346492 - DNA, 20 bp, human
ggcgatcccgggcttgggtt

SEQ ID NO: 346493 - DNA, 20 bp, human
gactgacgcggggcattcaa

SEQ ID NO: 346494 - DNA, 20 bp, human
ggggcgaagtgtcacggcct

SEQ ID NO: 346495 - DNA, 20 bp, human
gagggacagctactccgccc

SEQ ID NO: 346496 - DNA, 20 bp, human
gcaacatggctctcaggtga

SEQ ID NO: 346497 - DNA, 20 bp, human
ggccaagcagggtgactcac

SEQ ID NO: 346498 - DNA, 20 bp, human
ggactgagaggatgggagca

SEQ ID NO: 346499 - DNA, 20 bp, human
gaggctgggcctcttgatct

SEQ ID NO: 346500 - DNA, 20 bp, human
gagtaaaggactgagaggat

SEQ ID NO: 346501 - DNA, 20 bp, human
gagaaagtggagtgtgtggt

SEQ ID NO: 346502 - DNA, 20 bp, human
gaaagaggagtcgcttccac

SEQ ID NO: 346503 - DNA, 20 bp, human
gctctgttctgccacaggct

SEQ ID NO: 346504 - DNA, 20 bp, human
gggcagaacagagctgccgg

SEQ ID NO: 346505 - DNA, 20 bp, human
ggccagtgagtcaccctgct

SEQ ID NO: 346506 - DNA, 20 bp, human
gaaacccgttgggaaggcct

SEQ ID NO: 346507 - DNA, 20 bp, human
ggggctggaggactaaaata

SEQ ID NO: 346508 - DNA, 20 bp, human
gcaggctctgggtcatgata

SEQ ID NO: 346509 - DNA, 20 bp, human
gataagggacgccaccttca

SEQ ID NO: 346510 - DNA, 20 bp, human
gaaccagggtggggtgacgc

SEQ ID NO: 346511 - DNA, 20 bp, human
ggggaagcaccgtaattaca

SEQ ID NO: 346512 - DNA, 20 bp, human
ggtggggtgacgcaggctct

SEQ ID NO: 346513 - DNA, 20 bp, human
gagcctgcgtcaccccaccc

SEQ ID NO: 346514 - DNA, 20 bp, human
gaggggtgacacatcagccc

SEQ ID NO: 346515 - DNA, 20 bp, human
gagaactggtcaaacccgtt

SEQ ID NO: 346516 - DNA, 20 bp, human
gcgcatgcgcggtcagtcaa

SEQ ID NO: 346517 - DNA, 20 bp, human
gtgcaatcgacaaatctcct

SEQ ID NO: 346518 - DNA, 20 bp, human
gtgcgcactcgcggcaccaa

SEQ ID NO: 346519 - DNA, 20 bp, human
gcggtcagtcaacggtccgt

SEQ ID NO: 346520 - DNA, 20 bp, human
gaggacgtcttcaccctcct

SEQ ID NO: 346521 - DNA, 20 bp, human
ggtgcgcaggcgcgtcgttc

SEQ ID NO: 346522 - DNA, 20 bp, human
gatcgacaaatctcctagga

SEQ ID NO: 346523 - DNA, 20 bp, human
gcctccgccaaagccggcgc

SEQ ID NO: 346524 - DNA, 20 bp, human
ggcagcgttatgcgcatgcg

SEQ ID NO: 346525 - DNA, 20 bp, human
gggaggggtgggacttgcac

SEQ ID NO: 346526 - DNA, 20 bp, human
gtggcacctccgctttgcag

SEQ ID NO: 346527 - DNA, 20 bp, human
ggccaccaccacttaggata

SEQ ID NO: 346528 - DNA, 20 bp, human
gggagcagcttctgaaggtc

SEQ ID NO: 346529 - DNA, 20 bp, human
ggagaggtgcacggtgcctg

SEQ ID NO: 346530 - DNA, 20 bp, human
gccgggctgggaggacgatt

SEQ ID NO: 346531 - DNA, 20 bp, human
ggtgcacctctcagactgca

SEQ ID NO: 346532 - DNA, 20 bp, human
gcttaggataaggataggtg

SEQ ID NO: 346533 - DNA, 20 bp, human
gtatacgcttgcagcagtgt

SEQ ID NO: 346534 - DNA, 20 bp, human
gctatccttatcctaagtgg

SEQ ID NO: 346535 - DNA, 20 bp, human
gtgcagaggaaaagagctcc

SEQ ID NO: 346536 - DNA, 20 bp, human
gaggccgaggcgcgaagggt

SEQ ID NO: 346537 - DNA, 20 bp, human
gtggccgggaggaactatcc

SEQ ID NO: 346538 - DNA, 20 bp, human
gcacgggaggagcttgttcc

SEQ ID NO: 346539 - DNA, 20 bp, human
gagctccaacgccggaacca

SEQ ID NO: 346540 - DNA, 20 bp, human
gacgacctgtggcccaatgg

SEQ ID NO: 346541 - DNA, 20 bp, human
gcccgtgcgcgatgacgaca

SEQ ID NO: 346542 - DNA, 20 bp, human
gacctgtggcccaatggcgg

SEQ ID NO: 346543 - DNA, 20 bp, human
gctcccgggtccgcaaagct

SEQ ID NO: 346544 - DNA, 20 bp, human
ggggcccagctttgcggacc

SEQ ID NO: 346545 - DNA, 20 bp, human
gggagctcgggacgcaggcg

SEQ ID NO: 346546 - DNA, 20 bp, human
gcaccctgacttagtgggga

SEQ ID NO: 346547 - DNA, 20 bp, human
gagcagatgcctggattcga

SEQ ID NO: 346548 - DNA, 20 bp, human
ggctgtgtggaatgtcgggg

SEQ ID NO: 346549 - DNA, 20 bp, human
ggagcccttaactcttagaa

SEQ ID NO: 346550 - DNA, 20 bp, human
gccacccttctaagagttaa

SEQ ID NO: 346551 - DNA, 20 bp, human
gcccagcaccctgacttagt

SEQ ID NO: 346552 - DNA, 20 bp, human
gggtccctccccactaagtc

SEQ ID NO: 346553 - DNA, 20 bp, human
ggcaggggccggcagtgaag

SEQ ID NO: 346554 - DNA, 20 bp, human
gtgcctggagtggaagtcag

SEQ ID NO: 346555 - DNA, 20 bp, human
gagtccacgggaaccctcca

SEQ ID NO: 346556 - DNA, 20 bp, human
gcaccgggatgcagtcttct

SEQ ID NO: 346557 - DNA, 20 bp, human
ggtggcggagccgagggttg

SEQ ID NO: 346558 - DNA, 20 bp, human
gatcccggtggcggagccga

SEQ ID NO: 346559 - DNA, 20 bp, human
gcggagactctctttcccgt

SEQ ID NO: 346560 - DNA, 20 bp, human
gggtgaatcctcagggggag

SEQ ID NO: 346561 - DNA, 20 bp, human
gggccggaagtcagccggtg

SEQ ID NO: 346562 - DNA, 20 bp, human
ggccacacgcgcaccgtgat

SEQ ID NO: 346563 - DNA, 20 bp, human
gtgctcggcggcccagcaga

SEQ ID NO: 346564 - DNA, 20 bp, human
ggcccccaccggctgacttc

SEQ ID NO: 346565 - DNA, 20 bp, human
gcccctcggagctgattccc

SEQ ID NO: 346566 - DNA, 20 bp, human
gggagcaagcagggcaccgg

SEQ ID NO: 346567 - DNA, 20 bp, human
gcccaaggggtcccagagtt

SEQ ID NO: 346568 - DNA, 20 bp, human
gggtgccctgcttgctccca

SEQ ID NO: 346569 - DNA, 20 bp, human
gccagaggcacctgctccac

SEQ ID NO: 346570 - DNA, 20 bp, human
gcctccactgcgccggtagg

SEQ ID NO: 346571 - DNA, 20 bp, human
gtggctggcaactttcggca

SEQ ID NO: 346572 - DNA, 20 bp, human
ggctcctggacattcccaag

SEQ ID NO: 346573 - DNA, 20 bp, human
ggcgctgcgttcctagctcc

SEQ ID NO: 346574 - DNA, 20 bp, human
gccagaggctggagagaccg

SEQ ID NO: 346575 - DNA, 20 bp, human
gccactgcgccggtaggcgg

SEQ ID NO: 346576 - DNA, 20 bp, human
gaagcggcgggtacttgaag

SEQ ID NO: 346577 - DNA, 20 bp, human
gtacccgccgcttcttgctt

SEQ ID NO: 346578 - DNA, 20 bp, human
ggcgcggcgttcaaagtgtg

SEQ ID NO: 346579 - DNA, 20 bp, human
ggggcaggcaaagcgacttc

SEQ ID NO: 346580 - DNA, 20 bp, human
gtgccagctggcctcaggcg

SEQ ID NO: 346581 - DNA, 20 bp, human
ggcggggaggaggtcgagag

SEQ ID NO: 346582 - DNA, 20 bp, human
gccaccaaagcaagaagcgg

SEQ ID NO: 346583 - DNA, 20 bp, human
ggtacagcgtggaaatgggc

SEQ ID NO: 346584 - DNA, 20 bp, human
ggcgttcaaagtgtgcgggg

SEQ ID NO: 346585 - DNA, 20 bp, human
gtacttgaagcggagtgagc

SEQ ID NO: 346586 - DNA, 20 bp, human
gtgagcaggcagcaagatga

SEQ ID NO: 346587 - DNA, 20 bp, human
gtgagcccgcacctcgggag

SEQ ID NO: 346588 - DNA, 20 bp, human
gctagcaagtcattctggag

SEQ ID NO: 346589 - DNA, 20 bp, human
gctggcgggtgacacacctg

SEQ ID NO: 346590 - DNA, 20 bp, human
ggtgtctgctcccagactat

SEQ ID NO: 346591 - DNA, 20 bp, human
gggacacagtctgggaccca

SEQ ID NO: 346592 - DNA, 20 bp, human
gaggggcttacccaggtcta

SEQ ID NO: 346593 - DNA, 20 bp, human
ggcccagcctggaagggtgc

SEQ ID NO: 346594 - DNA, 20 bp, human
ggcccgaggcctgcgcagga

SEQ ID NO: 346595 - DNA, 20 bp, human
gccgcactagcaagtcattc

SEQ ID NO: 346596 - DNA, 20 bp, human
ggctctgcggggtgatagac

SEQ ID NO: 346597 - DNA, 20 bp, human
gacgctgtggggctttaaat

SEQ ID NO: 346598 - DNA, 20 bp, human
gagcgccgagggtcccgccc

SEQ ID NO: 346599 - DNA, 20 bp, human
gtccctgcgcgagacctggg

SEQ ID NO: 346600 - DNA, 20 bp, human
ggggaccctcggcgctcacc

SEQ ID NO: 346601 - DNA, 20 bp, human
gtcggcgctcacccggccag

SEQ ID NO: 346602 - DNA, 20 bp, human
gcccgcccaggtctcgcgca

SEQ ID NO: 346603 - DNA, 20 bp, human
gcggccgtcgcaatcgggag

SEQ ID NO: 346604 - DNA, 20 bp, human
ggacggcggccgtcgcaatc

SEQ ID NO: 346605 - DNA, 20 bp, human
ggaaggaggcagctagcttc

SEQ ID NO: 346606 - DNA, 20 bp, human
gtggccctagggcctctcaa

SEQ ID NO: 346607 - DNA, 20 bp, human
gtactcaagagagcgaaaaa

SEQ ID NO: 346608 - DNA, 20 bp, human
gtctcaaagagcgagggatg

SEQ ID NO: 346609 - DNA, 20 bp, human
ggaggcttctcaaagagcga

SEQ ID NO: 346610 - DNA, 20 bp, human
gaggaaatgctgtggcccta

SEQ ID NO: 346611 - DNA, 20 bp, human
gggacctgggcactgcacag

SEQ ID NO: 346612 - DNA, 20 bp, human
gtcactaccaagtcacccct

SEQ ID NO: 346613 - DNA, 20 bp, human
gtaccccttgagaggcccta

SEQ ID NO: 346614 - DNA, 20 bp, human
gctaccaagtcacccctggg

SEQ ID NO: 346615 - DNA, 20 bp, human
gggtctgtgcgtctctggat

SEQ ID NO: 346616 - DNA, 20 bp, human
gcctagctaacgccacgccc

SEQ ID NO: 346617 - DNA, 20 bp, human
gaacttctccactcactgga

SEQ ID NO: 346618 - DNA, 20 bp, human
gctgacccggaagtgctcgg

SEQ ID NO: 346619 - DNA, 20 bp, human
gcacttccgggtcagccagt

SEQ ID NO: 346620 - DNA, 20 bp, human
gacccggaagtgctcggcgg

SEQ ID NO: 346621 - DNA, 20 bp, human
ggccgccgccgagcacttcc

SEQ ID NO: 346622 - DNA, 20 bp, human
ggcgtggcgttagctagggt

SEQ ID NO: 346623 - DNA, 20 bp, human
gcgcgcgcgctcgttctccg

SEQ ID NO: 346624 - DNA, 20 bp, human
gttggtggccttccagtgag

SEQ ID NO: 346625 - DNA, 20 bp, human
gtctctgggagtgtgtcttg

SEQ ID NO: 346626 - DNA, 20 bp, human
gcatcttgagagtgggtacg

SEQ ID NO: 346627 - DNA, 20 bp, human
ggggtacgtggcgagtcagg

SEQ ID NO: 346628 - DNA, 20 bp, human
gaataaccgcctcccccaat

SEQ ID NO: 346629 - DNA, 20 bp, human
gaaatcgcaggcgcctattg

SEQ ID NO: 346630 - DNA, 20 bp, human
ggagacgccatcttgagagt

SEQ ID NO: 346631 - DNA, 20 bp, human
gcgggacccagagaaatcgc

SEQ ID NO: 346632 - DNA, 20 bp, human
gcggaaacggcttgtgtagt

SEQ ID NO: 346633 - DNA, 20 bp, human
gaagccacgcgccagctgac

SEQ ID NO: 346634 - DNA, 20 bp, human
gtcaaggccgaaggcggaaa

SEQ ID NO: 346635 - DNA, 20 bp, human
ggggcaggacccgcccgcct

SEQ ID NO: 346636 - DNA, 20 bp, human
gtgggggcgtcctgcagtca

SEQ ID NO: 346637 - DNA, 20 bp, human
ggcagggcgctgggactagg

SEQ ID NO: 346638 - DNA, 20 bp, human
gaggggaaaccaggtcgccg

SEQ ID NO: 346639 - DNA, 20 bp, human
ggagggagaaaggcgcgcga

SEQ ID NO: 346640 - DNA, 20 bp, human
ggcagaacgccaggttccag

SEQ ID NO: 346641 - DNA, 20 bp, human
gaacgccaggttccagagga

SEQ ID NO: 346642 - DNA, 20 bp, human
gggcttggagtgaaaagtgg

SEQ ID NO: 346643 - DNA, 20 bp, human
gcagcgggaggcgagcggca

SEQ ID NO: 346644 - DNA, 20 bp, human
ggcccgacggaaattgccga

SEQ ID NO: 346645 - DNA, 20 bp, human
gaggcgagcggcagggcgct

SEQ ID NO: 346646 - DNA, 20 bp, human
gagggtgggcgcgagcgcag

SEQ ID NO: 346647 - DNA, 20 bp, human
gccggctgccagcggggcga

SEQ ID NO: 346648 - DNA, 20 bp, human
gcccgctggcagccggcctc

SEQ ID NO: 346649 - DNA, 20 bp, human
gtcccgcgaacgcaggaggg

SEQ ID NO: 346650 - DNA, 20 bp, human
gcgctcccgcgaacgcagga

SEQ ID NO: 346651 - DNA, 20 bp, human
ggggacgcgctcgcggggtg

SEQ ID NO: 346652 - DNA, 20 bp, human
gcggggtcttacagcgaccg

SEQ ID NO: 346653 - DNA, 20 bp, human
gtacagcgaccgcgggaaga

SEQ ID NO: 346654 - DNA, 20 bp, human
ggtggaaggagagtgggaac

SEQ ID NO: 346655 - DNA, 20 bp, human
gtaggcggggacgcgctcgc

SEQ ID NO: 346656 - DNA, 20 bp, human
gcctggacagcaaaaatccg

SEQ ID NO: 346657 - DNA, 20 bp, human
gctagaaggccatgaagcga

SEQ ID NO: 346658 - DNA, 20 bp, human
gatccaggggcgtagagcag

SEQ ID NO: 346659 - DNA, 20 bp, human
gtggccttctagtagttcca

SEQ ID NO: 346660 - DNA, 20 bp, human
ggtcctgcagttagagagag

SEQ ID NO: 346661 - DNA, 20 bp, human
gagcctctgctctacgcccc

SEQ ID NO: 346662 - DNA, 20 bp, human
gcacctcgcccttcgcttca

SEQ ID NO: 346663 - DNA, 20 bp, human
ggcagaggctcacgggaagc

SEQ ID NO: 346664 - DNA, 20 bp, human
gggccatgaagcgaagggcg

SEQ ID NO: 346665 - DNA, 20 bp, human
ggctctctaccttaaaaggt

SEQ ID NO: 346666 - DNA, 20 bp, human
gctagccgccagccgaacac

SEQ ID NO: 346667 - DNA, 20 bp, human
gccggcccttgcgcctgtcc

SEQ ID NO: 346668 - DNA, 20 bp, human
gggaacggcggagtctcgat

SEQ ID NO: 346669 - DNA, 20 bp, human
gctagctgggactagcggaa

SEQ ID NO: 346670 - DNA, 20 bp, human
gcggcggcgaggcgaagcga

SEQ ID NO: 346671 - DNA, 20 bp, human
gggcgctcccggcatccctc

SEQ ID NO: 346672 - DNA, 20 bp, human
gagtgcctggacaggcgcaa

SEQ ID NO: 346673 - DNA, 20 bp, human
ggtcctgcgaccaaagggga

SEQ ID NO: 346674 - DNA, 20 bp, human
gcggcgaggcgaagcgaagg

SEQ ID NO: 346675 - DNA, 20 bp, human
gttctggcgaggccggtgtt

SEQ ID NO: 346676 - DNA, 20 bp, human
gatcccgcgccgcactatgg

SEQ ID NO: 346677 - DNA, 20 bp, human
gctctcggggcgcccagaat

SEQ ID NO: 346678 - DNA, 20 bp, human
gagcatcccgcgccgcacta

SEQ ID NO: 346679 - DNA, 20 bp, human
gtcctctgtccgtaacccgt

SEQ ID NO: 346680 - DNA, 20 bp, human
gactatggaggcagccatct

SEQ ID NO: 346681 - DNA, 20 bp, human
gaggaacagccaacgggtta

SEQ ID NO: 346682 - DNA, 20 bp, human
gtaccaaaaggaacagccaa

SEQ ID NO: 346683 - DNA, 20 bp, human
ggccaacgggttacggacag

SEQ ID NO: 346684 - DNA, 20 bp, human
ggtgcggcgcgggatgctcc

SEQ ID NO: 346685 - DNA, 20 bp, human
ggtcgtcgagagcgacaaaa

SEQ ID NO: 346686 - DNA, 20 bp, human
gcgtgcctcgaccttcagga

SEQ ID NO: 346687 - DNA, 20 bp, human
gcagggaacagctccgctat

SEQ ID NO: 346688 - DNA, 20 bp, human
gacgaaagcaatcataaaat

SEQ ID NO: 346689 - DNA, 20 bp, human
gggtttgaaagacttcgtca

SEQ ID NO: 346690 - DNA, 20 bp, human
gagatcacttctacatgggg

SEQ ID NO: 346691 - DNA, 20 bp, human
ggatgagatcacttctacat

SEQ ID NO: 346692 - DNA, 20 bp, human
ggctccgctattggctgaag

SEQ ID NO: 346693 - DNA, 20 bp, human
gcgcaggaacgacatttacg

SEQ ID NO: 346694 - DNA, 20 bp, human
gcccaccttcctgaaggtcg

SEQ ID NO: 346695 - DNA, 20 bp, human
gaaagcgtgcctcgaccttc

SEQ ID NO: 346696 - DNA, 20 bp, human
gcggatctgagcgtcatggg

SEQ ID NO: 346697 - DNA, 20 bp, human
gccacggcggaccacctcaa

SEQ ID NO: 346698 - DNA, 20 bp, human
ggccggggctgcagtctcga

SEQ ID NO: 346699 - DNA, 20 bp, human
gccagtgccccaagtcgctc

SEQ ID NO: 346700 - DNA, 20 bp, human
gcgtcgggagtgaactccgg

SEQ ID NO: 346701 - DNA, 20 bp, human
gggaaaaggcacaccaggga

SEQ ID NO: 346702 - DNA, 20 bp, human
ggggggctcggtcataaagc

SEQ ID NO: 346703 - DNA, 20 bp, human
gcgcgcgggccgcgactccc

SEQ ID NO: 346704 - DNA, 20 bp, human
gctgcacctcggggacatca

SEQ ID NO: 346705 - DNA, 20 bp, human
gaagtcgctcagggatcccg

SEQ ID NO: 346706 - DNA, 20 bp, human
gccggcccgctgctaggtaa

SEQ ID NO: 346707 - DNA, 20 bp, human
gcggggcgacgccctcccat

SEQ ID NO: 346708 - DNA, 20 bp, human
gctaggtaacggcgccgcag

SEQ ID NO: 346709 - DNA, 20 bp, human
gtcccgcccgcggggcccca

SEQ ID NO: 346710 - DNA, 20 bp, human
gcggccaagtgtaagtccag

SEQ ID NO: 346711 - DNA, 20 bp, human
gacgccctcccattggctga

SEQ ID NO: 346712 - DNA, 20 bp, human
ggtaacggcgccgcaggggg

SEQ ID NO: 346713 - DNA, 20 bp, human
ggcgcggctagggtaatttg

SEQ ID NO: 346714 - DNA, 20 bp, human
gcggcgccgttacctagcag

SEQ ID NO: 346715 - DNA, 20 bp, human
gcgcggcccggcccgctgct

SEQ ID NO: 346716 - DNA, 20 bp, human
gtatctctgggtcttcccgg

SEQ ID NO: 346717 - DNA, 20 bp, human
gtaaagagttctcaggagtg

SEQ ID NO: 346718 - DNA, 20 bp, human
gccgcccaggaacacgagga

SEQ ID NO: 346719 - DNA, 20 bp, human
ggcactggctggtgccgaga

SEQ ID NO: 346720 - DNA, 20 bp, human
gtcccctctcagcgcgggcg

SEQ ID NO: 346721 - DNA, 20 bp, human
gagactctgcgcgcccgccc

SEQ ID NO: 346722 - DNA, 20 bp, human
ggggtcatgacgagccgcgg

SEQ ID NO: 346723 - DNA, 20 bp, human
ggagagactcggctctgagc

SEQ ID NO: 346724 - DNA, 20 bp, human
gccaccccgtcgttggcctt

SEQ ID NO: 346725 - DNA, 20 bp, human
ggcgcggcgcggagcccccc

SEQ ID NO: 346726 - DNA, 20 bp, human
gccgccgcgccttgaatcag

SEQ ID NO: 346727 - DNA, 20 bp, human
gtggcccggaccgtctgcag

SEQ ID NO: 346728 - DNA, 20 bp, human
gaaggcgcagcgacccctgg

SEQ ID NO: 346729 - DNA, 20 bp, human
gccaccgcgcggatcggcag

SEQ ID NO: 346730 - DNA, 20 bp, human
ggggcggggaccgaccccca

SEQ ID NO: 346731 - DNA, 20 bp, human
gctcctaccacgggtcgcgg

SEQ ID NO: 346732 - DNA, 20 bp, human
ggcgtggcgcagggtctcgc

SEQ ID NO: 346733 - DNA, 20 bp, human
gtgggtatcaggaaactcgg

SEQ ID NO: 346734 - DNA, 20 bp, human
gcggagcccgagaggcgcca

SEQ ID NO: 346735 - DNA, 20 bp, human
gcccgcccctgcagacggtc

SEQ ID NO: 346736 - DNA, 20 bp, human
gcggaagcggaggctgcgtt

SEQ ID NO: 346737 - DNA, 20 bp, human
gaattgcgagtccataggat

SEQ ID NO: 346738 - DNA, 20 bp, human
gcaggggttctgcacataca

SEQ ID NO: 346739 - DNA, 20 bp, human
gctatggactcgcaatttat

SEQ ID NO: 346740 - DNA, 20 bp, human
gtggcgtgcctggtttctca

SEQ ID NO: 346741 - DNA, 20 bp, human
gtctccaggaaaccgttggg

SEQ ID NO: 346742 - DNA, 20 bp, human
gaaacacatttcagattagt

SEQ ID NO: 346743 - DNA, 20 bp, human
gtcagattagttgggcgacg

SEQ ID NO: 346744 - DNA, 20 bp, human
gagcctccgcttccggagcg

SEQ ID NO: 346745 - DNA, 20 bp, human
gtccagccgcgctccggaag

SEQ ID NO: 346746 - DNA, 20 bp, human
ggggccggggaaagaccagg

SEQ ID NO: 346747 - DNA, 20 bp, human
gggcgcggggagaccgggga

SEQ ID NO: 346748 - DNA, 20 bp, human
ggtggggccggggaaagacc

SEQ ID NO: 346749 - DNA, 20 bp, human
gtgtggggtgagcgcggagt

SEQ ID NO: 346750 - DNA, 20 bp, human
gaccaggcggagtggttgtg

SEQ ID NO: 346751 - DNA, 20 bp, human
gagcgcctgcgagctggatc

SEQ ID NO: 346752 - DNA, 20 bp, human
ggactgcagcaccgagatga

SEQ ID NO: 346753 - DNA, 20 bp, human
gcagcaagttgcagcaaggc

SEQ ID NO: 346754 - DNA, 20 bp, human
gagtaggagcgcatggaggt

SEQ ID NO: 346755 - DNA, 20 bp, human
gcgagggaacgctgctcatg

SEQ ID NO: 346756 - DNA, 20 bp, human
gagtaggggcccgtcaccag

SEQ ID NO: 346757 - DNA, 20 bp, human
gggcccgtcaccaggggaaa

SEQ ID NO: 346758 - DNA, 20 bp, human
gctggcccgtgagacaagat

SEQ ID NO: 346759 - DNA, 20 bp, human
gggtgtccggctcctggtgt

SEQ ID NO: 346760 - DNA, 20 bp, human
gagtgcaggtgtccggctcc

SEQ ID NO: 346761 - DNA, 20 bp, human
gctgacaggtaccagagcca

SEQ ID NO: 346762 - DNA, 20 bp, human
ggttgagtggatcaagtgaa

SEQ ID NO: 346763 - DNA, 20 bp, human
gaaacccaatcttgtctcac

SEQ ID NO: 346764 - DNA, 20 bp, human
gcaccaggggaaacggctcg

SEQ ID NO: 346765 - DNA, 20 bp, human
ggcaccaggtggcttgacag

SEQ ID NO: 346766 - DNA, 20 bp, human
gagcgcggctgcgctgtgta

SEQ ID NO: 346767 - DNA, 20 bp, human
ggggttacgcggggagacag

SEQ ID NO: 346768 - DNA, 20 bp, human
gcgcgctcccgggcccacgt

SEQ ID NO: 346769 - DNA, 20 bp, human
gagtgggcgagaccatgtgc

SEQ ID NO: 346770 - DNA, 20 bp, human
gcaagtccacaggacttcag

SEQ ID NO: 346771 - DNA, 20 bp, human
gacagcgtggggacggccgg

SEQ ID NO: 346772 - DNA, 20 bp, human
gggaatagcgagccggagaa

SEQ ID NO: 346773 - DNA, 20 bp, human
gtcagctaggatgacagcgt

SEQ ID NO: 346774 - DNA, 20 bp, human
gaccatgtgccgggttacgc

SEQ ID NO: 346775 - DNA, 20 bp, human
gctgccccaggccgcggtgg

SEQ ID NO: 346776 - DNA, 20 bp, human
gaggccgccggggatgtctg

SEQ ID NO: 346777 - DNA, 20 bp, human
gtgctgggaaggatgacgcc

SEQ ID NO: 346778 - DNA, 20 bp, human
gccgcagggcggtccggctc

SEQ ID NO: 346779 - DNA, 20 bp, human
ggatggcgcgggtctcgcca

SEQ ID NO: 346780 - DNA, 20 bp, human
gcgcggggccggccagtaaa

SEQ ID NO: 346781 - DNA, 20 bp, human
gaaggatgacgcctggttgc

SEQ ID NO: 346782 - DNA, 20 bp, human
gccgggtcgcatggggtgaa

SEQ ID NO: 346783 - DNA, 20 bp, human
gtgcgtccaacccgcgacgt

SEQ ID NO: 346784 - DNA, 20 bp, human
gtaaccacagacatccccgg

SEQ ID NO: 346785 - DNA, 20 bp, human
ggctgggctccgggatccgt

SEQ ID NO: 346786 - DNA, 20 bp, human
ggggcgcctcggaagaccga

SEQ ID NO: 346787 - DNA, 20 bp, human
gtcggaagaccgaggggagg

SEQ ID NO: 346788 - DNA, 20 bp, human
gccggcgggcggtgatgtgg

SEQ ID NO: 346789 - DNA, 20 bp, human
gagccccaggcagctacact

SEQ ID NO: 346790 - DNA, 20 bp, human
ggggggcagagcggtagctc

SEQ ID NO: 346791 - DNA, 20 bp, human
gcaggctggcggctgggaac

SEQ ID NO: 346792 - DNA, 20 bp, human
gcgcagagtccccaagccgc

SEQ ID NO: 346793 - DNA, 20 bp, human
gcgggaccgcgccgggcgag

SEQ ID NO: 346794 - DNA, 20 bp, human
gtcagtagagcctgcggctt

SEQ ID NO: 346795 - DNA, 20 bp, human
gtgcccagtgtagctgcctg

SEQ ID NO: 346796 - DNA, 20 bp, human
gccaagccctacctcttcgt

SEQ ID NO: 346797 - DNA, 20 bp, human
gaacggccccggaccagggt

SEQ ID NO: 346798 - DNA, 20 bp, human
ggacccacggggcgtgtcct

SEQ ID NO: 346799 - DNA, 20 bp, human
gaaaacgcggggaacggccc

SEQ ID NO: 346800 - DNA, 20 bp, human
ggggcgtggcaagggtttga

SEQ ID NO: 346801 - DNA, 20 bp, human
gcgtgtcctacgaagaggta

SEQ ID NO: 346802 - DNA, 20 bp, human
gaagggcgtgtcctacgaag

SEQ ID NO: 346803 - DNA, 20 bp, human
gagggcttggcaaggaccca

SEQ ID NO: 346804 - DNA, 20 bp, human
gggcacaggggagactaaaa

SEQ ID NO: 346805 - DNA, 20 bp, human
gcaggcaaaaacgcggggaa

SEQ ID NO: 346806 - DNA, 20 bp, human
gagctcctggggcgaggaaa

SEQ ID NO: 346807 - DNA, 20 bp, human
gctggggcgaggaaaaggcg

SEQ ID NO: 346808 - DNA, 20 bp, human
gcgccccaggagctcccaaa

SEQ ID NO: 346809 - DNA, 20 bp, human
gggtccctggcacgcgccta

SEQ ID NO: 346810 - DNA, 20 bp, human
gagcgcgcgcgggtacgcag

SEQ ID NO: 346811 - DNA, 20 bp, human
gtacagaatccagtatgcag

SEQ ID NO: 346812 - DNA, 20 bp, human
ggccccgcgcacctcggata

SEQ ID NO: 346813 - DNA, 20 bp, human
gggctggcgcgatgggtccc

SEQ ID NO: 346814 - DNA, 20 bp, human
gcaatcagagcgcggtgtgc

SEQ ID NO: 346815 - DNA, 20 bp, human
gtgccccgcgtgcggctcca

SEQ ID NO: 346816 - DNA, 20 bp, human
ggcgtcccgcctctcaaaga

SEQ ID NO: 346817 - DNA, 20 bp, human
ggcgctggcattgaagagcg

SEQ ID NO: 346818 - DNA, 20 bp, human
gaaagatgagcgaagagggg

SEQ ID NO: 346819 - DNA, 20 bp, human
gcacacccctctttgagagg

SEQ ID NO: 346820 - DNA, 20 bp, human
gctgagaacgcagcgcgtca

SEQ ID NO: 346821 - DNA, 20 bp, human
ggaagaactactaaagtgga

SEQ ID NO: 346822 - DNA, 20 bp, human
gtctcagtagagacagactc

SEQ ID NO: 346823 - DNA, 20 bp, human
gcagcagccacctgagagga

SEQ ID NO: 346824 - DNA, 20 bp, human
gccacctgagaggagggcaa

SEQ ID NO: 346825 - DNA, 20 bp, human
gacagactctggtgccgagt

SEQ ID NO: 346826 - DNA, 20 bp, human
gtgagcccgagtgtgactag

SEQ ID NO: 346827 - DNA, 20 bp, human
gcacacccctagtcacactc

SEQ ID NO: 346828 - DNA, 20 bp, human
gccagtgcatgtgtgtttag

SEQ ID NO: 346829 - DNA, 20 bp, human
gttcatgaagcggggatggg

SEQ ID NO: 346830 - DNA, 20 bp, human
gtccttcatgaagcggggat

SEQ ID NO: 346831 - DNA, 20 bp, human
gcagtctccttcatgaagcg

SEQ ID NO: 346832 - DNA, 20 bp, human
gcaggggctgccggcattga

SEQ ID NO: 346833 - DNA, 20 bp, human
gccatctgtccactgttcct

SEQ ID NO: 346834 - DNA, 20 bp, human
gggagactgcagaagtccag

SEQ ID NO: 346835 - DNA, 20 bp, human
gttgagagtgaccagtgtgt

SEQ ID NO: 346836 - DNA, 20 bp, human
gtctctgggaccagtgggca

SEQ ID NO: 346837 - DNA, 20 bp, human
gaagcctggcccataaatag

SEQ ID NO: 346838 - DNA, 20 bp, human
gcaacccagcggccctgata

SEQ ID NO: 346839 - DNA, 20 bp, human
gaagtcaccagaggcctcgg

SEQ ID NO: 346840 - DNA, 20 bp, human
gtgaacactcgtgatgctgg

SEQ ID NO: 346841 - DNA, 20 bp, human
gctggcccgcagggtcccga

SEQ ID NO: 346842 - DNA, 20 bp, human
gggcgcttatgcaagaggcc

SEQ ID NO: 346843 - DNA, 20 bp, human
gggaaagggaatgatggtag

SEQ ID NO: 346844 - DNA, 20 bp, human
ggggtggcagggctcggaaa

SEQ ID NO: 346845 - DNA, 20 bp, human
gttgcataagcgccctgtgg

SEQ ID NO: 346846 - DNA, 20 bp, human
gtcctggggcggggattgag

SEQ ID NO: 346847 - DNA, 20 bp, human
ggggccgggttggagaccgg

SEQ ID NO: 346848 - DNA, 20 bp, human
ggcggggccgggttggagac

SEQ ID NO: 346849 - DNA, 20 bp, human
gtgctcgggggattgggcgt

SEQ ID NO: 346850 - DNA, 20 bp, human
gcctctgccgtctactcctc

SEQ ID NO: 346851 - DNA, 20 bp, human
gtcttggggcggggtcgtga

SEQ ID NO: 346852 - DNA, 20 bp, human
gcacctgcgcctacctgcgg

SEQ ID NO: 346853 - DNA, 20 bp, human
gtggagaccggaggagtaga

SEQ ID NO: 346854 - DNA, 20 bp, human
gccctggttgtggacatgaa

SEQ ID NO: 346855 - DNA, 20 bp, human
gcgggggtcagttcctgggg

SEQ ID NO: 346856 - DNA, 20 bp, human
gtgctcctggcaatgggcgg

SEQ ID NO: 346857 - DNA, 20 bp, human
ggagcctcactcctcgtgga

SEQ ID NO: 346858 - DNA, 20 bp, human
ggctccctccacgaggagtg

SEQ ID NO: 346859 - DNA, 20 bp, human
gaggagccgccccaggaaga

SEQ ID NO: 346860 - DNA, 20 bp, human
ggcaagaggcccgatcctgg

SEQ ID NO: 346861 - DNA, 20 bp, human
ggagtgaggctccctggagt

SEQ ID NO: 346862 - DNA, 20 bp, human
gccccgcgcacgcccgctgg

SEQ ID NO: 346863 - DNA, 20 bp, human
gaaaatgtgagcgtcgtctg

SEQ ID NO: 346864 - DNA, 20 bp, human
gccctggaggccagcaaggg

SEQ ID NO: 346865 - DNA, 20 bp, human
gggcccccagcgggcgtgcg

SEQ ID NO: 346866 - DNA, 20 bp, human
gtgtccgcgagctgcagggg

SEQ ID NO: 346867 - DNA, 20 bp, human
gcacccgctgggcgcggcac

SEQ ID NO: 346868 - DNA, 20 bp, human
ggcaggacgcgtcacactcg

SEQ ID NO: 346869 - DNA, 20 bp, human
gggacgcgtcacactcgcgg

SEQ ID NO: 346870 - DNA, 20 bp, human
gtccgcccccgcactgtcgg

SEQ ID NO: 346871 - DNA, 20 bp, human
gggggcgttccgagtccctg

SEQ ID NO: 346872 - DNA, 20 bp, human
gtccccgccggcgcgcccca

SEQ ID NO: 346873 - DNA, 20 bp, human
gccgccccccgacagtgcgg

SEQ ID NO: 346874 - DNA, 20 bp, human
ggcccagtgccgcgcccagc

SEQ ID NO: 346875 - DNA, 20 bp, human
gagtgcgggggcggagacga

SEQ ID NO: 346876 - DNA, 20 bp, human
gcaggagcagggcgtttcag

SEQ ID NO: 346877 - DNA, 20 bp, human
gcaacccaggcgatcaggat

SEQ ID NO: 346878 - DNA, 20 bp, human
gccccctcggccttataaag

SEQ ID NO: 346879 - DNA, 20 bp, human
ggctgcgccccgcaccatgg

SEQ ID NO: 346880 - DNA, 20 bp, human
gaactggaggagaccccagt

SEQ ID NO: 346881 - DNA, 20 bp, human
gggtgtggacagaaccgagg

SEQ ID NO: 346882 - DNA, 20 bp, human
ggaccccaggcaaactgccg

SEQ ID NO: 346883 - DNA, 20 bp, human
ggataggcaacagccaagag

SEQ ID NO: 346884 - DNA, 20 bp, human
gcggccttataaaggggact

SEQ ID NO: 346885 - DNA, 20 bp, human
ggtgccgagtcccctttata

SEQ ID NO: 346886 - DNA, 20 bp, human
gcattggccggattggaagg

SEQ ID NO: 346887 - DNA, 20 bp, human
gtgggcgccgcagggaagac

SEQ ID NO: 346888 - DNA, 20 bp, human
gccgcagggaagactggcgg

SEQ ID NO: 346889 - DNA, 20 bp, human
gtggaagccgagttcaggag

SEQ ID NO: 346890 - DNA, 20 bp, human
gtggccggattggaaggggg

SEQ ID NO: 346891 - DNA, 20 bp, human
ggtgcggagtgggaactcgg

SEQ ID NO: 346892 - DNA, 20 bp, human
ggctccgcccccttccaatc

SEQ ID NO: 346893 - DNA, 20 bp, human
gcggtcgccggggaaagcac

SEQ ID NO: 346894 - DNA, 20 bp, human
gtcccactccgcacctccga

SEQ ID NO: 346895 - DNA, 20 bp, human
gaaagcaccggggcttccca

SEQ ID NO: 346896 - DNA, 20 bp, human
gtgcggccaccaaaatctcc

SEQ ID NO: 346897 - DNA, 20 bp, human
gtgaataagacccatctcaa

SEQ ID NO: 346898 - DNA, 20 bp, human
ggatacactgataagacaag

SEQ ID NO: 346899 - DNA, 20 bp, human
ggcgggtccaggacatctga

SEQ ID NO: 346900 - DNA, 20 bp, human
ggcaactcgatcctactttc

SEQ ID NO: 346901 - DNA, 20 bp, human
gctacaggtgagatggcgtt

SEQ ID NO: 346902 - DNA, 20 bp, human
gaatggagtgagttggattg

SEQ ID NO: 346903 - DNA, 20 bp, human
ggctgccgctacaggtgaga

SEQ ID NO: 346904 - DNA, 20 bp, human
gggctgacgttggggtcaac

SEQ ID NO: 346905 - DNA, 20 bp, human
gacatctgagggctgaccct

SEQ ID NO: 346906 - DNA, 20 bp, human
gtgcagggaaagcacaaagt

SEQ ID NO: 346907 - DNA, 20 bp, human
ggctctggagccctccttcc

SEQ ID NO: 346908 - DNA, 20 bp, human
ggtgtcccggacccagtccc

SEQ ID NO: 346909 - DNA, 20 bp, human
gacgccccgccccacggcag

SEQ ID NO: 346910 - DNA, 20 bp, human
gagagccagggactgggtcc

SEQ ID NO: 346911 - DNA, 20 bp, human
gggaaagcacaaagtgggag

SEQ ID NO: 346912 - DNA, 20 bp, human
ggccctgctgccgctgccgt

SEQ ID NO: 346913 - DNA, 20 bp, human
gcaagaagcagagagtctcc

SEQ ID NO: 346914 - DNA, 20 bp, human
gtgctgccgctgccgtgggg

SEQ ID NO: 346915 - DNA, 20 bp, human
gtaccctgaccctgcggagg

SEQ ID NO: 346916 - DNA, 20 bp, human
gcgggccggccgcttcgcgt

SEQ ID NO: 346917 - DNA, 20 bp, human
ggggcgaaatcagagacacg

SEQ ID NO: 346918 - DNA, 20 bp, human
gggggtgagggcgacgctaa

SEQ ID NO: 346919 - DNA, 20 bp, human
ggttcccgagcgggcctctg

SEQ ID NO: 346920 - DNA, 20 bp, human
gaggaagcggacaatgaggc

SEQ ID NO: 346921 - DNA, 20 bp, human
gggcacgcgcggcgtttaaa

SEQ ID NO: 346922 - DNA, 20 bp, human
ggcgccccgcgggttggccg

SEQ ID NO: 346923 - DNA, 20 bp, human
gccaaggccccttcgggttc

SEQ ID NO: 346924 - DNA, 20 bp, human
ggcaacacctggtgccgggt

SEQ ID NO: 346925 - DNA, 20 bp, human
gaggcggtcaaggtggggcg

SEQ ID NO: 346926 - DNA, 20 bp, human
gaggagaggcgggaacgcgt

SEQ ID NO: 346927 - DNA, 20 bp, human
ggaacgcgtagggactagca

SEQ ID NO: 346928 - DNA, 20 bp, human
gtaacgcgagaagacagagc

SEQ ID NO: 346929 - DNA, 20 bp, human
ggactagcagggggcggagt

SEQ ID NO: 346930 - DNA, 20 bp, human
gcgtgcgtgcaaacgagggg

SEQ ID NO: 346931 - DNA, 20 bp, human
ggcgccggagcccaaaaaca

SEQ ID NO: 346932 - DNA, 20 bp, human
gggcgcatggcagggcagtt

SEQ ID NO: 346933 - DNA, 20 bp, human
gcgtagggactagcaggggg

SEQ ID NO: 346934 - DNA, 20 bp, human
gtctagagatatctacggaa

SEQ ID NO: 346935 - DNA, 20 bp, human
gaggcggagggacacggagt

SEQ ID NO: 346936 - DNA, 20 bp, human
gaagatggcggctgtcgaag

SEQ ID NO: 346937 - DNA, 20 bp, human
ggcagagccggtaacggtgg

SEQ ID NO: 346938 - DNA, 20 bp, human
ggctgcagagccggtaacgg

SEQ ID NO: 346939 - DNA, 20 bp, human
ggtcgaagcggctgcagagc

SEQ ID NO: 346940 - DNA, 20 bp, human
ggagccggtaacggtggtgg

SEQ ID NO: 346941 - DNA, 20 bp, human
gccgcctcgcacggtggcag

SEQ ID NO: 346942 - DNA, 20 bp, human
ggcgtccggcccggcgaatc

SEQ ID NO: 346943 - DNA, 20 bp, human
gttccccgggaatttaattc

SEQ ID NO: 346944 - DNA, 20 bp, human
gcagccgccaccaccgttac

SEQ ID NO: 346945 - DNA, 20 bp, human
gccaaaggcgaaagacgaag

SEQ ID NO: 346946 - DNA, 20 bp, human
gtccctgtgtgtagcgtcta

SEQ ID NO: 346947 - DNA, 20 bp, human
gtgccctggttccagcagat

SEQ ID NO: 346948 - DNA, 20 bp, human
ggccctagacgctacacaca

SEQ ID NO: 346949 - DNA, 20 bp, human
gtctgaagaccccacggtga

SEQ ID NO: 346950 - DNA, 20 bp, human
gttccccgggaatttaattc

SEQ ID NO: 346951 - DNA, 20 bp, human
gaacccatctgctggaacca

SEQ ID NO: 346952 - DNA, 20 bp, human
gaagatggcggctgtcgaag

SEQ ID NO: 346953 - DNA, 20 bp, human
gctccagagtgcagatccct

SEQ ID NO: 346954 - DNA, 20 bp, human
gaggaagagagaacatgacc

SEQ ID NO: 346955 - DNA, 20 bp, human
gaaacaggtgaatgataccg

SEQ ID NO: 346956 - DNA, 20 bp, human
gaagatggcggctgtcgaag

SEQ ID NO: 346957 - DNA, 20 bp, human
ggcagagccggtaacggtgg

SEQ ID NO: 346958 - DNA, 20 bp, human
ggctgcagagccggtaacgg

SEQ ID NO: 346959 - DNA, 20 bp, human
ggtcgaagcggctgcagagc

SEQ ID NO: 346960 - DNA, 20 bp, human
ggagccggtaacggtggtgg

SEQ ID NO: 346961 - DNA, 20 bp, human
gccgcctcgcacggtggcag

SEQ ID NO: 346962 - DNA, 20 bp, human
ggcgtccggcccggcgaatc

SEQ ID NO: 346963 - DNA, 20 bp, human
gttccccgggaatttaattc

SEQ ID NO: 346964 - DNA, 20 bp, human
gcagccgccaccaccgttac

SEQ ID NO: 346965 - DNA, 20 bp, human
gccaaaggcgaaagacgaag

SEQ ID NO: 346966 - DNA, 20 bp, human
gtctgtgcccatggaaaagg

SEQ ID NO: 346967 - DNA, 20 bp, human
ggagaagagggcaccgtgct

SEQ ID NO: 346968 - DNA, 20 bp, human
gttatccccaagccatctct

SEQ ID NO: 346969 - DNA, 20 bp, human
ggctctgatgcatccgagca

SEQ ID NO: 346970 - DNA, 20 bp, human
gggtgtgttagactgtcgga

SEQ ID NO: 346971 - DNA, 20 bp, human
gcatccccagagatggcttg

SEQ ID NO: 346972 - DNA, 20 bp, human
gggaccagctaaagaaagtt

SEQ ID NO: 346973 - DNA, 20 bp, human
gcctctgcacctagctgcgc

SEQ ID NO: 346974 - DNA, 20 bp, human
gtgcttgagggagaattttg

SEQ ID NO: 346975 - DNA, 20 bp, human
gctggcagcctgggagggat

SEQ ID NO: 346976 - DNA, 20 bp, human
gaaggtgtcagtgacgtgtc

SEQ ID NO: 346977 - DNA, 20 bp, human
gtgccccagcacccggtggt

SEQ ID NO: 346978 - DNA, 20 bp, human
gacgtgtcagggggacattc

SEQ ID NO: 346979 - DNA, 20 bp, human
ggggccacagaagttaacca

SEQ ID NO: 346980 - DNA, 20 bp, human
gcagcacccggtggtgggat

SEQ ID NO: 346981 - DNA, 20 bp, human
gcagggggacattcaggagg

SEQ ID NO: 346982 - DNA, 20 bp, human
gataaaacccatcccaccac

SEQ ID NO: 346983 - DNA, 20 bp, human
gatgcaaccttgcttatgat

SEQ ID NO: 346984 - DNA, 20 bp, human
gaaatgaaatgtggaaccgc

SEQ ID NO: 346985 - DNA, 20 bp, human
gtgggggcaaagcccaccag

SEQ ID NO: 346986 - DNA, 20 bp, human
gtccccgctccaggtaacgg

SEQ ID NO: 346987 - DNA, 20 bp, human
gcggggctgcacactcggat

SEQ ID NO: 346988 - DNA, 20 bp, human
gtcggaggaaagtttctcgt

SEQ ID NO: 346989 - DNA, 20 bp, human
gccctccccgctccaggtaa

SEQ ID NO: 346990 - DNA, 20 bp, human
gggcccggccggctggagga

SEQ ID NO: 346991 - DNA, 20 bp, human
gatggaacgcggggtgtccc

SEQ ID NO: 346992 - DNA, 20 bp, human
gcacccgcttaaaggcgagg

SEQ ID NO: 346993 - DNA, 20 bp, human
gcttaaaggcgaggaggcgt

SEQ ID NO: 346994 - DNA, 20 bp, human
ggccggggccacccgcttaa

SEQ ID NO: 346995 - DNA, 20 bp, human
ggggatagggctaaagcgat

SEQ ID NO: 346996 - DNA, 20 bp, human
gtggcaggtggctcagtgat

SEQ ID NO: 346997 - DNA, 20 bp, human
ggccctctggagaacagtga

SEQ ID NO: 346998 - DNA, 20 bp, human
gtggaggcagcgatgggaga

SEQ ID NO: 346999 - DNA, 20 bp, human
gaggctccaagcctaagtga

SEQ ID NO: 347000 - DNA, 20 bp, human
ggggcgggtggacggggagt

SEQ ID NO: 347001 - DNA, 20 bp, human
gccagagagggagacactgg

SEQ ID NO: 347002 - DNA, 20 bp, human
ggggaaccaagagaggatgt

SEQ ID NO: 347003 - DNA, 20 bp, human
gggagatggatgtcctggat

SEQ ID NO: 347004 - DNA, 20 bp, human
gagcctcccggggtagtagg

SEQ ID NO: 347005 - DNA, 20 bp, human
gctctggagaacagtgaggg

SEQ ID NO: 347006 - DNA, 20 bp, human
gtgggctggggagtgatcaa

SEQ ID NO: 347007 - DNA, 20 bp, human
ggggccctccgaggtccgca

SEQ ID NO: 347008 - DNA, 20 bp, human
gcgccccggtccgacccctg

SEQ ID NO: 347009 - DNA, 20 bp, human
gtggtgggaggggacgaaca

SEQ ID NO: 347010 - DNA, 20 bp, human
gggagaggacttttggggaa

SEQ ID NO: 347011 - DNA, 20 bp, human
gtgggaggagaaaatgtggt

SEQ ID NO: 347012 - DNA, 20 bp, human
gaaacagccaaggaggtatg

SEQ ID NO: 347013 - DNA, 20 bp, human
ggggctggggtgggcggagt

SEQ ID NO: 347014 - DNA, 20 bp, human
gggtccgcaggggtcggacc

SEQ ID NO: 347015 - DNA, 20 bp, human
gcccgccccaaagcgggctg

SEQ ID NO: 347016 - DNA, 20 bp, human
gcccaggcagtggaaccttc

SEQ ID NO: 347017 - DNA, 20 bp, human
gggtggccccaccctctctt

SEQ ID NO: 347018 - DNA, 20 bp, human
gtgagagcccggccccgaaa

SEQ ID NO: 347019 - DNA, 20 bp, human
gcccgtgtgtgtgcgtgtag

SEQ ID NO: 347020 - DNA, 20 bp, human
ggcactgcgggcaagcggca

SEQ ID NO: 347021 - DNA, 20 bp, human
gtatgacaggtcccaagaga

SEQ ID NO: 347022 - DNA, 20 bp, human
gcaggaggaaaaccagggtc

SEQ ID NO: 347023 - DNA, 20 bp, human
gcaggtcccaagagagggtg

SEQ ID NO: 347024 - DNA, 20 bp, human
ggcgggaggcgtcgggacgt

SEQ ID NO: 347025 - DNA, 20 bp, human
gagggcggggctgcttcttt

SEQ ID NO: 347026 - DNA, 20 bp, human
gggcggggtttggaagctta

SEQ ID NO: 347027 - DNA, 20 bp, human
gtactgcggtcagagggccg

SEQ ID NO: 347028 - DNA, 20 bp, human
gggtttggaagcttagggat

SEQ ID NO: 347029 - DNA, 20 bp, human
gccctctgaccgcagtacgc

SEQ ID NO: 347030 - DNA, 20 bp, human
ggggaaatgcggaacgtcag

SEQ ID NO: 347031 - DNA, 20 bp, human
gaggggagagttactagtct

SEQ ID NO: 347032 - DNA, 20 bp, human
gagtacgcaggcgcgcgact

SEQ ID NO: 347033 - DNA, 20 bp, human
ggcaggcgcgcgactaggcc

SEQ ID NO: 347034 - DNA, 20 bp, human
gccggaaacgtggggcgccc

SEQ ID NO: 347035 - DNA, 20 bp, human
ggcctgcgtactgcggtcag

SEQ ID NO: 347036 - DNA, 20 bp, human
ggctgggcagaggaagtaag

SEQ ID NO: 347037 - DNA, 20 bp, human
ggggtgaaaagccgctttag

SEQ ID NO: 347038 - DNA, 20 bp, human
gtaagtgcttcaaggatctt

SEQ ID NO: 347039 - DNA, 20 bp, human
gcctgccccgcagagaagaa

SEQ ID NO: 347040 - DNA, 20 bp, human
gggtggcactagatatagac

SEQ ID NO: 347041 - DNA, 20 bp, human
gtcaatgctgaggtcaccca

SEQ ID NO: 347042 - DNA, 20 bp, human
ggagctccgggcagtgtgcg

SEQ ID NO: 347043 - DNA, 20 bp, human
gtgtatgctcgccgctaaag

SEQ ID NO: 347044 - DNA, 20 bp, human
ggggcggagcccagcccatg

SEQ ID NO: 347045 - DNA, 20 bp, human
ggggcttagggacagaactg

SEQ ID NO: 347046 - DNA, 20 bp, human
gcctggggcggtggaactcg

SEQ ID NO: 347047 - DNA, 20 bp, human
gggacagactggggcgagta

SEQ ID NO: 347048 - DNA, 20 bp, human
gaggagggaaaaatttgtgg

SEQ ID NO: 347049 - DNA, 20 bp, human
ggggcgagtaaggttaagaa

SEQ ID NO: 347050 - DNA, 20 bp, human
gaaaaaaccctgcccccacc

SEQ ID NO: 347051 - DNA, 20 bp, human
gaattgcgtaagcccggtgg

SEQ ID NO: 347052 - DNA, 20 bp, human
ggccttggatgggataccgg

SEQ ID NO: 347053 - DNA, 20 bp, human
ggggcagggttttttaccca

SEQ ID NO: 347054 - DNA, 20 bp, human
gaaggcgatcagtccagaac

SEQ ID NO: 347055 - DNA, 20 bp, human
gggggcggtggaactcgggg

SEQ ID NO: 347056 - DNA, 20 bp, human
gcccacccatgtcaaaaccg

SEQ ID NO: 347057 - DNA, 20 bp, human
ggataacagcatattcaact

SEQ ID NO: 347058 - DNA, 20 bp, human
gatacacctcggttttgaca

SEQ ID NO: 347059 - DNA, 20 bp, human
gaaggatttgctgcaattaa

SEQ ID NO: 347060 - DNA, 20 bp, human
gacctcggttttgacatggg

SEQ ID NO: 347061 - DNA, 20 bp, human
gcaattttctattctaaata

SEQ ID NO: 347062 - DNA, 20 bp, human
gagaaatatataggtagtca

SEQ ID NO: 347063 - DNA, 20 bp, human
gagtacactaatcaacattt

SEQ ID NO: 347064 - DNA, 20 bp, human
gtttttaacctgccttagaa

SEQ ID NO: 347065 - DNA, 20 bp, human
ggttttatccattctaaggc

SEQ ID NO: 347066 - DNA, 20 bp, human
gagagtgtgcaccgcccaat

SEQ ID NO: 347067 - DNA, 20 bp, human
gcatacacacacccattggg

SEQ ID NO: 347068 - DNA, 20 bp, human
ggatgtcactcccaattctc

SEQ ID NO: 347069 - DNA, 20 bp, human
gcagataattggatactaaa

SEQ ID NO: 347070 - DNA, 20 bp, human
gcagcatttggcttgacaag

SEQ ID NO: 347071 - DNA, 20 bp, human
ggaccagaagtgacatggat

SEQ ID NO: 347072 - DNA, 20 bp, human
ggcacatacacacacccatt

SEQ ID NO: 347073 - DNA, 20 bp, human
gttctctggatctcaactat

SEQ ID NO: 347074 - DNA, 20 bp, human
ggtcttctgcttaccaagag

SEQ ID NO: 347075 - DNA, 20 bp, human
gcacatagaatttttctcga

SEQ ID NO: 347076 - DNA, 20 bp, human
gccctccccccactgggcgt

SEQ ID NO: 347077 - DNA, 20 bp, human
gtggcggccggaacacctaa

SEQ ID NO: 347078 - DNA, 20 bp, human
ggcgcggggcgtgcagttag

SEQ ID NO: 347079 - DNA, 20 bp, human
ggcttcgccccacgcccagt

SEQ ID NO: 347080 - DNA, 20 bp, human
gaacacctaagggctcagtg

SEQ ID NO: 347081 - DNA, 20 bp, human
gtcggggtcgcggtctgcgg

SEQ ID NO: 347082 - DNA, 20 bp, human
gaggcggctgccgagggtct

SEQ ID NO: 347083 - DNA, 20 bp, human
gtcaggaggccgaacggccg

SEQ ID NO: 347084 - DNA, 20 bp, human
gtagagacggactgacagac

SEQ ID NO: 347085 - DNA, 20 bp, human
gctctggccaaggatgggga

SEQ ID NO: 347086 - DNA, 20 bp, human
gagaggcccagaaagatcga

SEQ ID NO: 347087 - DNA, 20 bp, human
gaaagacagacggaaatgga

SEQ ID NO: 347088 - DNA, 20 bp, human
gagggcttagacacatcctt

SEQ ID NO: 347089 - DNA, 20 bp, human
gaaatggcaaagggtacgtg

SEQ ID NO: 347090 - DNA, 20 bp, human
gacgaacagtcagatggaga

SEQ ID NO: 347091 - DNA, 20 bp, human
gctggcggaaggaccgtcag

SEQ ID NO: 347092 - DNA, 20 bp, human
gcacatccttagggcagctc

SEQ ID NO: 347093 - DNA, 20 bp, human
ggacacagggggtgtgtcag

SEQ ID NO: 347094 - DNA, 20 bp, human
gacctcagagagtgagaaga

SEQ ID NO: 347095 - DNA, 20 bp, human
gaaggacgtcctggtctgga

SEQ ID NO: 347096 - DNA, 20 bp, human
gggacccagtgacttcgagg

SEQ ID NO: 347097 - DNA, 20 bp, human
ggcgggacccagtgacttcg

SEQ ID NO: 347098 - DNA, 20 bp, human
gcccagggggcggagggcaa

SEQ ID NO: 347099 - DNA, 20 bp, human
gggcgcacccggatccgcct

SEQ ID NO: 347100 - DNA, 20 bp, human
gcacccggatccgcctgggg

SEQ ID NO: 347101 - DNA, 20 bp, human
gttccagggccctgtctcta

SEQ ID NO: 347102 - DNA, 20 bp, human
gacagcgataagatggctaa

SEQ ID NO: 347103 - DNA, 20 bp, human
gcccgaggacagcgataaga

SEQ ID NO: 347104 - DNA, 20 bp, human
gcactgggtcccgcagccca

SEQ ID NO: 347105 - DNA, 20 bp, human
gaagcagaaacattgcgaat

SEQ ID NO: 347106 - DNA, 20 bp, human
gcaggccttcccatttgcta

SEQ ID NO: 347107 - DNA, 20 bp, human
gcacacacaccttttttcta

SEQ ID NO: 347108 - DNA, 20 bp, human
gtaaatgcaccttagcaaat

SEQ ID NO: 347109 - DNA, 20 bp, human
ggggtcctgggtatatattg

SEQ ID NO: 347110 - DNA, 20 bp, human
gcaaaacaggcaaaaagtca

SEQ ID NO: 347111 - DNA, 20 bp, human
gggcaaaaagtcagggtcct

SEQ ID NO: 347112 - DNA, 20 bp, human
gatggaagcctggtgctcat

SEQ ID NO: 347113 - DNA, 20 bp, human
gacaggagatatacattaac

SEQ ID NO: 347114 - DNA, 20 bp, human
ggagattactcagttatgtt

SEQ ID NO: 347115 - DNA, 20 bp, human
gtgcctagcccatgagcacc

SEQ ID NO: 347116 - DNA, 20 bp, human
gtctccccgcccgtgaagcg

SEQ ID NO: 347117 - DNA, 20 bp, human
gcacgggcggggagacatgc

SEQ ID NO: 347118 - DNA, 20 bp, human
gggcgagggcgggtcgttag

SEQ ID NO: 347119 - DNA, 20 bp, human
gcgtgtgtcgtcgatcagga

SEQ ID NO: 347120 - DNA, 20 bp, human
ggccgggcggcgcaggttgg

SEQ ID NO: 347121 - DNA, 20 bp, human
ggcacttgaaacttgttctc

SEQ ID NO: 347122 - DNA, 20 bp, human
gggcggcagccccgcttcac

SEQ ID NO: 347123 - DNA, 20 bp, human
gcagccccgcttcacgggcg

SEQ ID NO: 347124 - DNA, 20 bp, human
ggggagacatgctggccggg

SEQ ID NO: 347125 - DNA, 20 bp, human
gaggcgagttgaaaaccgag

SEQ ID NO: 347126 - DNA, 20 bp, human
gtccggagttcccgcctctc

SEQ ID NO: 347127 - DNA, 20 bp, human
ggggaactccggactgagac

SEQ ID NO: 347128 - DNA, 20 bp, human
gggcccgcgccgacgcagca

SEQ ID NO: 347129 - DNA, 20 bp, human
gccccgagaggcgggaactc

SEQ ID NO: 347130 - DNA, 20 bp, human
gagcccgcggcgtgaggcgt

SEQ ID NO: 347131 - DNA, 20 bp, human
gcatgcccagtccccccgag

SEQ ID NO: 347132 - DNA, 20 bp, human
gccaccccgaaaccccggcg

SEQ ID NO: 347133 - DNA, 20 bp, human
gagaggacgcgcgcctcagc

SEQ ID NO: 347134 - DNA, 20 bp, human
ggcccgacccggtctcagtc

SEQ ID NO: 347135 - DNA, 20 bp, human
gtgaccgcgccggggtttcg

SEQ ID NO: 347136 - DNA, 20 bp, human
gggtgtggttaacaactcag

SEQ ID NO: 347137 - DNA, 20 bp, human
gtcctccccacttccttaaa

SEQ ID NO: 347138 - DNA, 20 bp, human
gaaggggcacataacatccg

SEQ ID NO: 347139 - DNA, 20 bp, human
gcggaggaaaccaacttctc

SEQ ID NO: 347140 - DNA, 20 bp, human
ggggagttaactgctcacaa

SEQ ID NO: 347141 - DNA, 20 bp, human
gccggcgctcagggaattgg

SEQ ID NO: 347142 - DNA, 20 bp, human
gtccccacttccttaaaggg

SEQ ID NO: 347143 - DNA, 20 bp, human
gtgagcgccgggcagacctg

SEQ ID NO: 347144 - DNA, 20 bp, human
gtgcccggcgctcagggaat

SEQ ID NO: 347145 - DNA, 20 bp, human
gtggaggggtgttaggaatt

SEQ ID NO: 347146 - DNA, 20 bp, human
gcgggcgctaagtgctcaga

SEQ ID NO: 347147 - DNA, 20 bp, human
gccggcctgagcgcaggaga

SEQ ID NO: 347148 - DNA, 20 bp, human
gcgcactatgggaacccact

SEQ ID NO: 347149 - DNA, 20 bp, human
gaggacttgtggggccggct

SEQ ID NO: 347150 - DNA, 20 bp, human
gcactgggcaagcaccgcca

SEQ ID NO: 347151 - DNA, 20 bp, human
gctcccggttggggcttctt

SEQ ID NO: 347152 - DNA, 20 bp, human
gtgcccatgaggccgctctc

SEQ ID NO: 347153 - DNA, 20 bp, human
gaggaggagccggggtgctc

SEQ ID NO: 347154 - DNA, 20 bp, human
gcacttagcgcccgcactat

SEQ ID NO: 347155 - DNA, 20 bp, human
ggaggaggacctcccggttg

SEQ ID NO: 347156 - DNA, 20 bp, human
gcggggaggagctcagtagg

SEQ ID NO: 347157 - DNA, 20 bp, human
gcggatccctgcagagtcgg

SEQ ID NO: 347158 - DNA, 20 bp, human
ggtgggtacagcaaatactc

SEQ ID NO: 347159 - DNA, 20 bp, human
gcaaggctcagggaagtgca

SEQ ID NO: 347160 - DNA, 20 bp, human
gtccctgcagagtcggtggt

SEQ ID NO: 347161 - DNA, 20 bp, human
gcgccccctcctcgccgagg

SEQ ID NO: 347162 - DNA, 20 bp, human
gggaggggagggggcgtcgt

SEQ ID NO: 347163 - DNA, 20 bp, human
gacccaccaccgactctgca

SEQ ID NO: 347164 - DNA, 20 bp, human
ggtcccgaggcgtcccgagc

SEQ ID NO: 347165 - DNA, 20 bp, human
gtcccggatccctgcagagt

SEQ ID NO: 347166 - DNA, 20 bp, human
gagtttgccgggtctcagca

SEQ ID NO: 347167 - DNA, 20 bp, human
gtcgcactgtcattcaaggc

SEQ ID NO: 347168 - DNA, 20 bp, human
gtgcgcagcgcgggacgcgc

SEQ ID NO: 347169 - DNA, 20 bp, human
gtcccatgcccggccgctat

SEQ ID NO: 347170 - DNA, 20 bp, human
gtggacaagcgtgcttaaag

SEQ ID NO: 347171 - DNA, 20 bp, human
gtcccgcagctgttttgctg

SEQ ID NO: 347172 - DNA, 20 bp, human
gggagcgggcgctcgctcat

SEQ ID NO: 347173 - DNA, 20 bp, human
ggcgctcggcttcccatgcc

SEQ ID NO: 347174 - DNA, 20 bp, human
ggccaatagcggccgggcat

SEQ ID NO: 347175 - DNA, 20 bp, human
gcttccgagcagccgcgggg

SEQ ID NO: 347176 - DNA, 20 bp, human
ggagagctagggagtcggga

SEQ ID NO: 347177 - DNA, 20 bp, human
gagggaggacgagaccagga

SEQ ID NO: 347178 - DNA, 20 bp, human
ggaggatgaaagcgagggga

SEQ ID NO: 347179 - DNA, 20 bp, human
gcggccgcggagaaagagtg

SEQ ID NO: 347180 - DNA, 20 bp, human
gggaagggaacccgcttata

SEQ ID NO: 347181 - DNA, 20 bp, human
gggcagctctgctggtgcgg

SEQ ID NO: 347182 - DNA, 20 bp, human
ggccgcggtagctcgatccc

SEQ ID NO: 347183 - DNA, 20 bp, human
gctgggaagcccctcccgtc

SEQ ID NO: 347184 - DNA, 20 bp, human
gataggaggatgaaagcgag

SEQ ID NO: 347185 - DNA, 20 bp, human
gataaggcggcgctgcccga

SEQ ID NO: 347186 - DNA, 20 bp, human
gtccctgcggagcaagaaaa

SEQ ID NO: 347187 - DNA, 20 bp, human
ggactcaattacgccctgac

SEQ ID NO: 347188 - DNA, 20 bp, human
gaattacgccctgacaggga

SEQ ID NO: 347189 - DNA, 20 bp, human
ggagcgggccaggaggacga

SEQ ID NO: 347190 - DNA, 20 bp, human
gcagggcgtaattgagtcaa

SEQ ID NO: 347191 - DNA, 20 bp, human
gacgaaggctgggcgaggga

SEQ ID NO: 347192 - DNA, 20 bp, human
gagcagaggaaaatccaaag

SEQ ID NO: 347193 - DNA, 20 bp, human
gtaaaagcagaatactccag

SEQ ID NO: 347194 - DNA, 20 bp, human
ggaaccaagaggccatgaga

SEQ ID NO: 347195 - DNA, 20 bp, human
gatgagaggagcgggccagg

SEQ ID NO: 347196 - DNA, 20 bp, human
gtggccggagcgtaccaagg

SEQ ID NO: 347197 - DNA, 20 bp, human
gcctgcgggcctctccggcg

SEQ ID NO: 347198 - DNA, 20 bp, human
gacgggagcccctaccgaat

SEQ ID NO: 347199 - DNA, 20 bp, human
ggagcccctaccgaatgggg

SEQ ID NO: 347200 - DNA, 20 bp, human
gtccggcgcgggggagtcct

SEQ ID NO: 347201 - DNA, 20 bp, human
gccgggcgggagcggagtgt

SEQ ID NO: 347202 - DNA, 20 bp, human
gctgccaccccattcggtag

SEQ ID NO: 347203 - DNA, 20 bp, human
gacgcgcgagccacaacttc

SEQ ID NO: 347204 - DNA, 20 bp, human
ggcggtcctgcgggcctctc

SEQ ID NO: 347205 - DNA, 20 bp, human
ggtaccaagcgcgtccgagg

SEQ ID NO: 347206 - DNA, 20 bp, human
ggcgccggctataaagggga

SEQ ID NO: 347207 - DNA, 20 bp, human
gccctccggacgtcactccg

SEQ ID NO: 347208 - DNA, 20 bp, human
gaccctccagccaccaatcg

SEQ ID NO: 347209 - DNA, 20 bp, human
ggggagggcttgtgacgcaa

SEQ ID NO: 347210 - DNA, 20 bp, human
gggccgccgccggtgtgaac

SEQ ID NO: 347211 - DNA, 20 bp, human
ggctcctggcccgcggttcc

SEQ ID NO: 347212 - DNA, 20 bp, human
gcgggccaggagccgacagg

SEQ ID NO: 347213 - DNA, 20 bp, human
gagtcggagcatccccgggg

SEQ ID NO: 347214 - DNA, 20 bp, human
gggttccaggccgcgattgg

SEQ ID NO: 347215 - DNA, 20 bp, human
ggccgcggagtgacgtccgg

SEQ ID NO: 347216 - DNA, 20 bp, human
gagcggaacgaaccacgagg

SEQ ID NO: 347217 - DNA, 20 bp, human
gaaggcgagtccatgtgatc

SEQ ID NO: 347218 - DNA, 20 bp, human
gcgcacctgggctgggtcga

SEQ ID NO: 347219 - DNA, 20 bp, human
gggaacgaaccacgaggagg

SEQ ID NO: 347220 - DNA, 20 bp, human
gccccgcagcgccccctgag

SEQ ID NO: 347221 - DNA, 20 bp, human
gggcgctgacccactgccct

SEQ ID NO: 347222 - DNA, 20 bp, human
gagccagtcagcgaacgcgg

SEQ ID NO: 347223 - DNA, 20 bp, human
gcgtgggcgagcgactcccc

SEQ ID NO: 347224 - DNA, 20 bp, human
ggccctccgcgttcgctgac

SEQ ID NO: 347225 - DNA, 20 bp, human
ggtgtgacctgcaaggtcga

SEQ ID NO: 347226 - DNA, 20 bp, human
gcgcccccgaggccgcccct

SEQ ID NO: 347227 - DNA, 20 bp, human
ggagccaaggtcagtccccg

SEQ ID NO: 347228 - DNA, 20 bp, human
gggacccgctgggtcacgtg

SEQ ID NO: 347229 - DNA, 20 bp, human
ggggagcgctccccacgccg

SEQ ID NO: 347230 - DNA, 20 bp, human
gcgtggggagcgctcccatt

SEQ ID NO: 347231 - DNA, 20 bp, human
gcggccgcgcctgtgcgcga

SEQ ID NO: 347232 - DNA, 20 bp, human
gctaggcgcccggcaggcac

SEQ ID NO: 347233 - DNA, 20 bp, human
gtccggcgcgcgccctaagc

SEQ ID NO: 347234 - DNA, 20 bp, human
gggcgcgcgccctaagccgg

SEQ ID NO: 347235 - DNA, 20 bp, human
ggccgcggctccaccggctt

SEQ ID NO: 347236 - DNA, 20 bp, human
gggcggtgagggaaccgtga

SEQ ID NO: 347237 - DNA, 20 bp, human
ggaaaggggaccctaagtaa

SEQ ID NO: 347238 - DNA, 20 bp, human
ggaaccgtgagggacgctga

SEQ ID NO: 347239 - DNA, 20 bp, human
ggggaccctaagtaagggga

SEQ ID NO: 347240 - DNA, 20 bp, human
ggaacgggcgcgggcggtga

SEQ ID NO: 347241 - DNA, 20 bp, human
gggccagcacacgtcacgtg

SEQ ID NO: 347242 - DNA, 20 bp, human
ggacggcgtgaggacggcta

SEQ ID NO: 347243 - DNA, 20 bp, human
gcggaccgtgacgagagcgg

SEQ ID NO: 347244 - DNA, 20 bp, human
gggctctgggcattttcgaa

SEQ ID NO: 347245 - DNA, 20 bp, human
gtgaggggatggcgcgggtg

SEQ ID NO: 347246 - DNA, 20 bp, human
ggggagcgcgcgccactcgg

SEQ ID NO: 347247 - DNA, 20 bp, human
gccccggcacgctttccagg

SEQ ID NO: 347248 - DNA, 20 bp, human
gaggcgggtgcactttcctc

SEQ ID NO: 347249 - DNA, 20 bp, human
ggagccccggcacgctttcc

SEQ ID NO: 347250 - DNA, 20 bp, human
gccagctctaccgaccgcga

SEQ ID NO: 347251 - DNA, 20 bp, human
gagtggcgcgcgctcccaag

SEQ ID NO: 347252 - DNA, 20 bp, human
gtctaccgaccgcgaggggg

SEQ ID NO: 347253 - DNA, 20 bp, human
gaggcgttctggcccccgag

SEQ ID NO: 347254 - DNA, 20 bp, human
gcgtccgctcctccccctcg

SEQ ID NO: 347255 - DNA, 20 bp, human
ggggcgtgacgggcggtggc

SEQ ID NO: 347256 - DNA, 20 bp, human
ggcgcaggcgggataggggc

SEQ ID NO: 347257 - DNA, 20 bp, human
gcagtgacgcgccgggatgg

SEQ ID NO: 347258 - DNA, 20 bp, human
gtcgcgccaaggcccgctgc

SEQ ID NO: 347259 - DNA, 20 bp, human
gccgcggccgcctagggaat

SEQ ID NO: 347260 - DNA, 20 bp, human
gccccgcccggctcgcgcca

SEQ ID NO: 347261 - DNA, 20 bp, human
gccgctgattccaattccct

SEQ ID NO: 347262 - DNA, 20 bp, human
gctcctgagcgcctgcaacc

SEQ ID NO: 347263 - DNA, 20 bp, human
gcagtcccaaacccttttcc

SEQ ID NO: 347264 - DNA, 20 bp, human
gcaggcgctcaggagcgcta

SEQ ID NO: 347265 - DNA, 20 bp, human
gtggaagagcgttccaacaa

SEQ ID NO: 347266 - DNA, 20 bp, human
gcggccgaatcccgagggga

SEQ ID NO: 347267 - DNA, 20 bp, human
ggcggctcgcgttcccggtg

SEQ ID NO: 347268 - DNA, 20 bp, human
gagcccgaggtcgtgcgttg

SEQ ID NO: 347269 - DNA, 20 bp, human
gccaggaaggagtaccgggg

SEQ ID NO: 347270 - DNA, 20 bp, human
gcggtccaggaaggagtacc

SEQ ID NO: 347271 - DNA, 20 bp, human
gcgctcggccgaatcccgag

SEQ ID NO: 347272 - DNA, 20 bp, human
ggcagcgccaagggccccat

SEQ ID NO: 347273 - DNA, 20 bp, human
gctggaagccctggcggcgg

SEQ ID NO: 347274 - DNA, 20 bp, human
ggccgccagggcttccagcg

SEQ ID NO: 347275 - DNA, 20 bp, human
ggccccctcccctcgggatt

SEQ ID NO: 347276 - DNA, 20 bp, human
gcagccgccatcttggctga

SEQ ID NO: 347277 - DNA, 20 bp, human
ggtaaccgggagcgcccaag

SEQ ID NO: 347278 - DNA, 20 bp, human
gtcctggcgctcccgtcttt

SEQ ID NO: 347279 - DNA, 20 bp, human
gatggcgccgaggttgtaac

SEQ ID NO: 347280 - DNA, 20 bp, human
gagggtaattcccgcctctt

SEQ ID NO: 347281 - DNA, 20 bp, human
gcggactacgcgaggagagg

SEQ ID NO: 347282 - DNA, 20 bp, human
gactgaggcaagccgaaaga

SEQ ID NO: 347283 - DNA, 20 bp, human
gactacgcgaggagaggggg

SEQ ID NO: 347284 - DNA, 20 bp, human
gataggagggcgaatagcga

SEQ ID NO: 347285 - DNA, 20 bp, human
gggaagcagtgattatagga

SEQ ID NO: 347286 - DNA, 20 bp, human
ggggactggcgggactctgg

SEQ ID NO: 347287 - DNA, 20 bp, human
gaacctcggtccctcctccg

SEQ ID NO: 347288 - DNA, 20 bp, human
ggaaactgggaccccggcga

SEQ ID NO: 347289 - DNA, 20 bp, human
gggctcgcaccgggtgacgg

SEQ ID NO: 347290 - DNA, 20 bp, human
gaggagggaccgaggtttcc

SEQ ID NO: 347291 - DNA, 20 bp, human
gaccgggtgacggcggggac

SEQ ID NO: 347292 - DNA, 20 bp, human
ggcctctcgcgggctcgcac

SEQ ID NO: 347293 - DNA, 20 bp, human
gctggcgggactctggagga

SEQ ID NO: 347294 - DNA, 20 bp, human
ggctgcactaggcctctcgc

SEQ ID NO: 347295 - DNA, 20 bp, human
ggcgggctcgcaccgggtga

SEQ ID NO: 347296 - DNA, 20 bp, human
ggaggtgcatgactacttta

SEQ ID NO: 347297 - DNA, 20 bp, human
gcgcgctattagatatctcg

SEQ ID NO: 347298 - DNA, 20 bp, human
gagccccgcccacggcgcgt

SEQ ID NO: 347299 - DNA, 20 bp, human
gggagccgggggcggtgcta

SEQ ID NO: 347300 - DNA, 20 bp, human
gagagccccaaagcggagga

SEQ ID NO: 347301 - DNA, 20 bp, human
ggggctctccaggcccggga

SEQ ID NO: 347302 - DNA, 20 bp, human
gtgactcaacgggccgggtc

SEQ ID NO: 347303 - DNA, 20 bp, human
gagcccacgcgccgtgggcg

SEQ ID NO: 347304 - DNA, 20 bp, human
gtggagagcccacgcgccgt

SEQ ID NO: 347305 - DNA, 20 bp, human
gcggcgcgcgcctgttgcct

SEQ ID NO: 347306 - DNA, 20 bp, human
ggccgggaatggcagcgcgg

SEQ ID NO: 347307 - DNA, 20 bp, human
gacttcctgcttcccgtcag

SEQ ID NO: 347308 - DNA, 20 bp, human
gtcagcggaggaccgagcga

SEQ ID NO: 347309 - DNA, 20 bp, human
gaccgagcgacggccgggaa

SEQ ID NO: 347310 - DNA, 20 bp, human
ggggaagcaggaagtggcgg

SEQ ID NO: 347311 - DNA, 20 bp, human
ggtcgcgagcggtgacatca

SEQ ID NO: 347312 - DNA, 20 bp, human
gtggcagcgcgggggctccg

SEQ ID NO: 347313 - DNA, 20 bp, human
ggcagcgggcccggacgggt

SEQ ID NO: 347314 - DNA, 20 bp, human
gtctacgccaccgacccgtc

SEQ ID NO: 347315 - DNA, 20 bp, human
gggaggaagcaaggatgctt

SEQ ID NO: 347316 - DNA, 20 bp, human
ggctagctgtgttcctgagg

SEQ ID NO: 347317 - DNA, 20 bp, human
gatctgcgggcgcagcgctt

SEQ ID NO: 347318 - DNA, 20 bp, human
gcgggcggggatgcatctgc

SEQ ID NO: 347319 - DNA, 20 bp, human
gccgcgcatctgggtggcgg

SEQ ID NO: 347320 - DNA, 20 bp, human
gtgagcgggccaagccctag

SEQ ID NO: 347321 - DNA, 20 bp, human
gacgccccggaaatggagtc

SEQ ID NO: 347322 - DNA, 20 bp, human
ggcggcggggacgcgcccgt

SEQ ID NO: 347323 - DNA, 20 bp, human
ggcccggggtgctcagaggt

SEQ ID NO: 347324 - DNA, 20 bp, human
gggggaggaggaaccgggaa

SEQ ID NO: 347325 - DNA, 20 bp, human
gcggggccacgccccggaaa

SEQ ID NO: 347326 - DNA, 20 bp, human
gggtcgaggggagctcgggg

SEQ ID NO: 347327 - DNA, 20 bp, human
gcctggcgacctcgtcccta

SEQ ID NO: 347328 - DNA, 20 bp, human
ggatgccaggcgggccaatg

SEQ ID NO: 347329 - DNA, 20 bp, human
gaaagccaggcccaaggcac

SEQ ID NO: 347330 - DNA, 20 bp, human
ggacctcgtccctagggagg

SEQ ID NO: 347331 - DNA, 20 bp, human
gaggcgggccaatgaggtcg

SEQ ID NO: 347332 - DNA, 20 bp, human
gcacctcctccctagggacg

SEQ ID NO: 347333 - DNA, 20 bp, human
gtgcggtcctcccagtgccg

SEQ ID NO: 347334 - DNA, 20 bp, human
gggagctactcgcaccactg

SEQ ID NO: 347335 - DNA, 20 bp, human
gaatgaggtcgaggggagct

SEQ ID NO: 347336 - DNA, 20 bp, human
ggccgcggagcccggctctg

SEQ ID NO: 347337 - DNA, 20 bp, human
gaggaaggggccgtgcgagt

SEQ ID NO: 347338 - DNA, 20 bp, human
ggcggggaggaatgcggccc

SEQ ID NO: 347339 - DNA, 20 bp, human
ggggaggaatgcggcccggg

SEQ ID NO: 347340 - DNA, 20 bp, human
gcctgcagcccggcattcct

SEQ ID NO: 347341 - DNA, 20 bp, human
gaggggccgtgcgagtggga

SEQ ID NO: 347342 - DNA, 20 bp, human
gaggaccggatgaaactccc

SEQ ID NO: 347343 - DNA, 20 bp, human
ggagcaggcgccggcggcca

SEQ ID NO: 347344 - DNA, 20 bp, human
gtggaggcgcgccgtccttg

SEQ ID NO: 347345 - DNA, 20 bp, human
gctggaatccgaggaatgcc

SEQ ID NO: 347346 - DNA, 20 bp, human
gcggaagtggcatagaagac

SEQ ID NO: 347347 - DNA, 20 bp, human
gtagcgccctgcaagttagg

SEQ ID NO: 347348 - DNA, 20 bp, human
gcagcctggagggtaatttg

SEQ ID NO: 347349 - DNA, 20 bp, human
ggtgcgctagatgggaggga

SEQ ID NO: 347350 - DNA, 20 bp, human
gctgccccaaattaccctcc

SEQ ID NO: 347351 - DNA, 20 bp, human
ggtgcggcctgacaagaagg

SEQ ID NO: 347352 - DNA, 20 bp, human
gaggcggtgcgctagatggg

SEQ ID NO: 347353 - DNA, 20 bp, human
gccctagcgccctgcaagtt

SEQ ID NO: 347354 - DNA, 20 bp, human
ggaacaaaagaatgcggaag

SEQ ID NO: 347355 - DNA, 20 bp, human
gctgcaagttagggggatga

SEQ ID NO: 347356 - DNA, 20 bp, human
gggcagcccgcgaggaccta

SEQ ID NO: 347357 - DNA, 20 bp, human
gcggagccctaggtcctcgc

SEQ ID NO: 347358 - DNA, 20 bp, human
ggcccggggtggggctacgc

SEQ ID NO: 347359 - DNA, 20 bp, human
gggcgcggatcccgatctga

SEQ ID NO: 347360 - DNA, 20 bp, human
ggctacgcgggctcagaaca

SEQ ID NO: 347361 - DNA, 20 bp, human
gagcccgcgtagccccaccc

SEQ ID NO: 347362 - DNA, 20 bp, human
gacgcgggctcagaacacgg

SEQ ID NO: 347363 - DNA, 20 bp, human
gagggcggggactcagtcac

SEQ ID NO: 347364 - DNA, 20 bp, human
ggctcagaacacggtggctg

SEQ ID NO: 347365 - DNA, 20 bp, human
ggcgctcgggccgctgtggc

SEQ ID NO: 347366 - DNA, 20 bp, human
gagcgcggggttactggaat

SEQ ID NO: 347367 - DNA, 20 bp, human
gcgtgccggcgacttctcag

SEQ ID NO: 347368 - DNA, 20 bp, human
gcccgagcgcggcgcgaagt

SEQ ID NO: 347369 - DNA, 20 bp, human
ggggaaagtacctggagcgt

SEQ ID NO: 347370 - DNA, 20 bp, human
gcggccgtggggaaagtacc

SEQ ID NO: 347371 - DNA, 20 bp, human
ggggccaggggaccacccgg

SEQ ID NO: 347372 - DNA, 20 bp, human
gtcttccgacaagagagagg

SEQ ID NO: 347373 - DNA, 20 bp, human
ggctccaggtactttcccca

SEQ ID NO: 347374 - DNA, 20 bp, human
ggagcgcggcgcgaagtcgg

SEQ ID NO: 347375 - DNA, 20 bp, human
gcgcggcgcgaagtcggcgg

SEQ ID NO: 347376 - DNA, 20 bp, human
gattctggcttcctgttttc

SEQ ID NO: 347377 - DNA, 20 bp, human
ggaagatgccgttgacgtgc

SEQ ID NO: 347378 - DNA, 20 bp, human
ggcgcacagggtggtgcaca

SEQ ID NO: 347379 - DNA, 20 bp, human
gtgcctctaccggtcttcca

SEQ ID NO: 347380 - DNA, 20 bp, human
gccctctggggcctcattag

SEQ ID NO: 347381 - DNA, 20 bp, human
ggtggtgcacagggcccgca

SEQ ID NO: 347382 - DNA, 20 bp, human
gcactgagagcccatcgccg

SEQ ID NO: 347383 - DNA, 20 bp, human
gtgccttggaagaccggtag

SEQ ID NO: 347384 - DNA, 20 bp, human
ggcccgcagggaatttacag

SEQ ID NO: 347385 - DNA, 20 bp, human
gtcccggcctggcaagcaga

SEQ ID NO: 347386 - DNA, 20 bp, human
gagcgtatctccagttctca

SEQ ID NO: 347387 - DNA, 20 bp, human
gaacaagaactccttgaaga

SEQ ID NO: 347388 - DNA, 20 bp, human
gtggctttgtgtgttttacc

SEQ ID NO: 347389 - DNA, 20 bp, human
ggatacatcattggagtgga

SEQ ID NO: 347390 - DNA, 20 bp, human
gcaggatattccttgagaac

SEQ ID NO: 347391 - DNA, 20 bp, human
gtcagcacctaatttagctt

SEQ ID NO: 347392 - DNA, 20 bp, human
gatataaagagatacatcat

SEQ ID NO: 347393 - DNA, 20 bp, human
gccacaaataaatatgtgaa

SEQ ID NO: 347394 - DNA, 20 bp, human
ggccacacctaagctaaatt

SEQ ID NO: 347395 - DNA, 20 bp, human
ggtgaacaaaaattgtttgc

SEQ ID NO: 347396 - DNA, 20 bp, human
gcccacccgggcagtctccc

SEQ ID NO: 347397 - DNA, 20 bp, human
gtgcaggggtcacaaggcgt

SEQ ID NO: 347398 - DNA, 20 bp, human
gaggcccaggtgaggaaagg

SEQ ID NO: 347399 - DNA, 20 bp, human
gctggcccgggagactgccc

SEQ ID NO: 347400 - DNA, 20 bp, human
gggtcacaaggcgtgggttg

SEQ ID NO: 347401 - DNA, 20 bp, human
gtcacagctcaggcccaccc

SEQ ID NO: 347402 - DNA, 20 bp, human
gtgtgacccctgcacgtcaa

SEQ ID NO: 347403 - DNA, 20 bp, human
ggcccgggagactgcccggg

SEQ ID NO: 347404 - DNA, 20 bp, human
gccaactggcgaggctgctg

SEQ ID NO: 347405 - DNA, 20 bp, human
gaaggcgtgggttgtggccc

SEQ ID NO: 347406 - DNA, 20 bp, human
gccctgtgcaccaccctgtg

SEQ ID NO: 347407 - DNA, 20 bp, human
gattctggcttcctgttttc

SEQ ID NO: 347408 - DNA, 20 bp, human
ggggagagggggacccgcac

SEQ ID NO: 347409 - DNA, 20 bp, human
gccctctggggcctcattag

SEQ ID NO: 347410 - DNA, 20 bp, human
gtgcctctaccggtcttcca

SEQ ID NO: 347411 - DNA, 20 bp, human
gcactgagagcccatcgccg

SEQ ID NO: 347412 - DNA, 20 bp, human
gtgccttggaagaccggtag

SEQ ID NO: 347413 - DNA, 20 bp, human
ggcccgcagggaatttacag

SEQ ID NO: 347414 - DNA, 20 bp, human
ggggcaaagctccagtgcgc

SEQ ID NO: 347415 - DNA, 20 bp, human
ggagggggacccgcacaggg

SEQ ID NO: 347416 - DNA, 20 bp, human
gatataaagagatacgtcat

SEQ ID NO: 347417 - DNA, 20 bp, human
ggatacgtcattggagtgga

SEQ ID NO: 347418 - DNA, 20 bp, human
gagcgtatctccagttctca

SEQ ID NO: 347419 - DNA, 20 bp, human
gccacaaataaatatgtgaa

SEQ ID NO: 347420 - DNA, 20 bp, human
gtcagcacctaatttagctt

SEQ ID NO: 347421 - DNA, 20 bp, human
gaacaagaactccttgaaga

SEQ ID NO: 347422 - DNA, 20 bp, human
gaagagatacgtcattggag

SEQ ID NO: 347423 - DNA, 20 bp, human
gtggctttgtgtgttttacc

SEQ ID NO: 347424 - DNA, 20 bp, human
ggccacacctaagctaaatt

SEQ ID NO: 347425 - DNA, 20 bp, human
gcaggatattccttgagaac

SEQ ID NO: 347426 - DNA, 20 bp, human
ggaagatgccgttgacgtgc

SEQ ID NO: 347427 - DNA, 20 bp, human
gcccacccgggcagtctccc

SEQ ID NO: 347428 - DNA, 20 bp, human
gtgcaggggtcacaaggcgt

SEQ ID NO: 347429 - DNA, 20 bp, human
gcctggcccgggagactgcc

SEQ ID NO: 347430 - DNA, 20 bp, human
gaggcccaggtgaggaaagg

SEQ ID NO: 347431 - DNA, 20 bp, human
gggtcacaaggcgtgggttg

SEQ ID NO: 347432 - DNA, 20 bp, human
gtcacagctcaggcccaccc

SEQ ID NO: 347433 - DNA, 20 bp, human
gtgtgacccctgcacgtcaa

SEQ ID NO: 347434 - DNA, 20 bp, human
ggcccgggagactgcccggg

SEQ ID NO: 347435 - DNA, 20 bp, human
gccaactggcgaggctgctg

SEQ ID NO: 347436 - DNA, 20 bp, human
gggaatgcgggcagccgcgc

SEQ ID NO: 347437 - DNA, 20 bp, human
ggcccgtgacctcagagagt

SEQ ID NO: 347438 - DNA, 20 bp, human
ggacagctgcgcccggccgc

SEQ ID NO: 347439 - DNA, 20 bp, human
gtccgcccgcccggctcagg

SEQ ID NO: 347440 - DNA, 20 bp, human
gtgagccgggcgggcggatc

SEQ ID NO: 347441 - DNA, 20 bp, human
gcagaccgtcggaccgacgc

SEQ ID NO: 347442 - DNA, 20 bp, human
ggggactgacaggttatttg

SEQ ID NO: 347443 - DNA, 20 bp, human
ggcgtcccgcgtcggtccga

SEQ ID NO: 347444 - DNA, 20 bp, human
gcctcagagagttggaatgc

SEQ ID NO: 347445 - DNA, 20 bp, human
gtccaactctctgaggtcac

SEQ ID NO: 347446 - DNA, 20 bp, human
ggggccctggagtgagatga

SEQ ID NO: 347447 - DNA, 20 bp, human
gagtacgtaaccaccttctg

SEQ ID NO: 347448 - DNA, 20 bp, human
gctaactagaacgtaaagtg

SEQ ID NO: 347449 - DNA, 20 bp, human
gtacgtactaatttcctcta

SEQ ID NO: 347450 - DNA, 20 bp, human
ggtgccttccttctcagcaa

SEQ ID NO: 347451 - DNA, 20 bp, human
ggttatgtgaccacagaagg

SEQ ID NO: 347452 - DNA, 20 bp, human
gcagccatcatctcactcca

SEQ ID NO: 347453 - DNA, 20 bp, human
gaactctgcaaagttcagtt

SEQ ID NO: 347454 - DNA, 20 bp, human
gacccggactgttcatcgaa

SEQ ID NO: 347455 - DNA, 20 bp, human
gttgtgctcactgggaaaat

SEQ ID NO: 347456 - DNA, 20 bp, human
gtcttcgcgcggagggagta

SEQ ID NO: 347457 - DNA, 20 bp, human
gcgtgggagggcaagttcat

SEQ ID NO: 347458 - DNA, 20 bp, human
gtcgcgcggagggagtaggg

SEQ ID NO: 347459 - DNA, 20 bp, human
gactacgcgagcgggtggct

SEQ ID NO: 347460 - DNA, 20 bp, human
gtcgccagcccgaggcgaaa

SEQ ID NO: 347461 - DNA, 20 bp, human
gcccagaagccgtttcgcct

SEQ ID NO: 347462 - DNA, 20 bp, human
ggaagtcactggtcacggga

SEQ ID NO: 347463 - DNA, 20 bp, human
ggtcaagagccgtggaggac

SEQ ID NO: 347464 - DNA, 20 bp, human
gccttcgtgccggaagtcac

SEQ ID NO: 347465 - DNA, 20 bp, human
gacggctcttgacaatacgt

SEQ ID NO: 347466 - DNA, 20 bp, human
gcgccccgacgcatctccta

SEQ ID NO: 347467 - DNA, 20 bp, human
gcctagggaaggcaagaagt

SEQ ID NO: 347468 - DNA, 20 bp, human
gcgggtgcgcggttgagctg

SEQ ID NO: 347469 - DNA, 20 bp, human
ggcccctaggagatgcgtcg

SEQ ID NO: 347470 - DNA, 20 bp, human
gtgcatgcgcgagggaactc

SEQ ID NO: 347471 - DNA, 20 bp, human
gagtgccaagggacgagcac

SEQ ID NO: 347472 - DNA, 20 bp, human
gactgggcatgctcagacgg

SEQ ID NO: 347473 - DNA, 20 bp, human
gggacctgcccggagctcgg

SEQ ID NO: 347474 - DNA, 20 bp, human
gtggctgcatgcatgcgcga

SEQ ID NO: 347475 - DNA, 20 bp, human
gggagctcggcggagagccc

SEQ ID NO: 347476 - DNA, 20 bp, human
gcgcaggcgccgccagtcag

SEQ ID NO: 347477 - DNA, 20 bp, human
ggccgctcctggccactgac

SEQ ID NO: 347478 - DNA, 20 bp, human
ggcgccgccagtcagtggcc

SEQ ID NO: 347479 - DNA, 20 bp, human
gtatgctgcggcctaggaga

SEQ ID NO: 347480 - DNA, 20 bp, human
ggtgcgagagagagcggcct

SEQ ID NO: 347481 - DNA, 20 bp, human
ggcatagcaaccgaacatgg

SEQ ID NO: 347482 - DNA, 20 bp, human
ggcagcatagcaaccgaaca

SEQ ID NO: 347483 - DNA, 20 bp, human
gaccctgcctcgctagcgca

SEQ ID NO: 347484 - DNA, 20 bp, human
gtgtccctctgcgctccgac

SEQ ID NO: 347485 - DNA, 20 bp, human
gggagcgcagagggacacgc

SEQ ID NO: 347486 - DNA, 20 bp, human
gtggtgaggcggtcgggcga

SEQ ID NO: 347487 - DNA, 20 bp, human
ggggtgccaaacccacccgg

SEQ ID NO: 347488 - DNA, 20 bp, human
gcggacggaccgaaggacgg

SEQ ID NO: 347489 - DNA, 20 bp, human
gcctgctcccggggcacgaa

SEQ ID NO: 347490 - DNA, 20 bp, human
gactccgcgcagagttgctc

SEQ ID NO: 347491 - DNA, 20 bp, human
ggcccccgtcgcatacacac

SEQ ID NO: 347492 - DNA, 20 bp, human
ggctcgccgggaattgcgca

SEQ ID NO: 347493 - DNA, 20 bp, human
ggcggcggaagcccgcccgg

SEQ ID NO: 347494 - DNA, 20 bp, human
gagatgaggtcaggggttaa

SEQ ID NO: 347495 - DNA, 20 bp, human
gccgacccggggctcccaag

SEQ ID NO: 347496 - DNA, 20 bp, human
gcatgcgtgaagtattatct

SEQ ID NO: 347497 - DNA, 20 bp, human
gcccacacgtctgcaatcaa

SEQ ID NO: 347498 - DNA, 20 bp, human
gaaaagcagctggtggagga

SEQ ID NO: 347499 - DNA, 20 bp, human
gtcgttttagagcacagcaa

SEQ ID NO: 347500 - DNA, 20 bp, human
gaggcgcggccgaccccttg

SEQ ID NO: 347501 - DNA, 20 bp, human
gcccggtggtcccagttctg

SEQ ID NO: 347502 - DNA, 20 bp, human
ggaggagggagagatgccgt

SEQ ID NO: 347503 - DNA, 20 bp, human
gattgcagacgtgtgggaag

SEQ ID NO: 347504 - DNA, 20 bp, human
gcgtctgcaatcaaaggctc

SEQ ID NO: 347505 - DNA, 20 bp, human
gagatgccgtgggaccgtct

SEQ ID NO: 347506 - DNA, 20 bp, human
gggaggcagccgacccctgg

SEQ ID NO: 347507 - DNA, 20 bp, human
ggtgcccagcaagtaggcag

SEQ ID NO: 347508 - DNA, 20 bp, human
ggcgggaggcagccgacccc

SEQ ID NO: 347509 - DNA, 20 bp, human
gggccccgttccctgggaat

SEQ ID NO: 347510 - DNA, 20 bp, human
ggcccaaggccccgttccct

SEQ ID NO: 347511 - DNA, 20 bp, human
gttacagaggcgggagacgg

SEQ ID NO: 347512 - DNA, 20 bp, human
gcatggtgaggcgacagctg

SEQ ID NO: 347513 - DNA, 20 bp, human
gtggcccctcacccattccc

SEQ ID NO: 347514 - DNA, 20 bp, human
ggaaagcaggatggtcggga

SEQ ID NO: 347515 - DNA, 20 bp, human
gtcccgcctgtgcccttctg

SEQ ID NO: 347516 - DNA, 20 bp, human
gttctcaatggagccgcggg

SEQ ID NO: 347517 - DNA, 20 bp, human
ggcgaggacgcagtccggga

SEQ ID NO: 347518 - DNA, 20 bp, human
ggttgccttccgtccagcta

SEQ ID NO: 347519 - DNA, 20 bp, human
gcacaagctggcggcgagga

SEQ ID NO: 347520 - DNA, 20 bp, human
ggggaccctagctggacgga

SEQ ID NO: 347521 - DNA, 20 bp, human
ggtgaggctcagatcctcgg

SEQ ID NO: 347522 - DNA, 20 bp, human
ggactgcgtcctcgctccgc

SEQ ID NO: 347523 - DNA, 20 bp, human
gggaggggaccctagctgga

SEQ ID NO: 347524 - DNA, 20 bp, human
gcgtctcattcacaagctgg

SEQ ID NO: 347525 - DNA, 20 bp, human
gagacagagaggagcccggg

SEQ ID NO: 347526 - DNA, 20 bp, human
gccggcaagtgagcgcccag

SEQ ID NO: 347527 - DNA, 20 bp, human
gccggggtccagcttcccga

SEQ ID NO: 347528 - DNA, 20 bp, human
ggccccggggcgaacccctc

SEQ ID NO: 347529 - DNA, 20 bp, human
ggacagcgaacgggcgtctc

SEQ ID NO: 347530 - DNA, 20 bp, human
gaacacgcgtcttacagcca

SEQ ID NO: 347531 - DNA, 20 bp, human
gagcgcccagcggagcgcaa

SEQ ID NO: 347532 - DNA, 20 bp, human
ggaggcctgtgactgtagaa

SEQ ID NO: 347533 - DNA, 20 bp, human
gggcgctcacttgccggctg

SEQ ID NO: 347534 - DNA, 20 bp, human
gtctcctggtagctccagag

SEQ ID NO: 347535 - DNA, 20 bp, human
gagctggaccccggaaggac

SEQ ID NO: 347536 - DNA, 20 bp, human
gcctcctattgaattgtttg

SEQ ID NO: 347537 - DNA, 20 bp, human
gcttccccaaacaattcaat

SEQ ID NO: 347538 - DNA, 20 bp, human
ggaaatgtgccttcatggtg

SEQ ID NO: 347539 - DNA, 20 bp, human
gacttttccccccaccatga

SEQ ID NO: 347540 - DNA, 20 bp, human
gagaagcagtcacatgccaa

SEQ ID NO: 347541 - DNA, 20 bp, human
gggaaggaaatgtgccttca

SEQ ID NO: 347542 - DNA, 20 bp, human
gacctcacctacctttcctt

SEQ ID NO: 347543 - DNA, 20 bp, human
gtgaagagatgtaatgtttc

SEQ ID NO: 347544 - DNA, 20 bp, human
gtgagatcgtcatcttcact

SEQ ID NO: 347545 - DNA, 20 bp, human
ggtctgtttccttagaaaga

SEQ ID NO: 347546 - DNA, 20 bp, human
gaggacccttacagtatttt

SEQ ID NO: 347547 - DNA, 20 bp, human
gtaaaggagcattatttgga

SEQ ID NO: 347548 - DNA, 20 bp, human
gctgtaagggtcctctttgc

SEQ ID NO: 347549 - DNA, 20 bp, human
gactgtaaaggagcattatt

SEQ ID NO: 347550 - DNA, 20 bp, human
ggctagctgcatgaactgct

SEQ ID NO: 347551 - DNA, 20 bp, human
gggtgtaattacttgaatta

SEQ ID NO: 347552 - DNA, 20 bp, human
gagcaagtggtttgttctta

SEQ ID NO: 347553 - DNA, 20 bp, human
gttaaaagattttcccatca

SEQ ID NO: 347554 - DNA, 20 bp, human
gcagcataagtataacaaaa

SEQ ID NO: 347555 - DNA, 20 bp, human
gttgttctaagtcagtagaa

SEQ ID NO: 347556 - DNA, 20 bp, human
gcagcctcctccagagagac

SEQ ID NO: 347557 - DNA, 20 bp, human
gaggggcaggtggggtatgt

SEQ ID NO: 347558 - DNA, 20 bp, human
gacctgctgctgcaagggtg

SEQ ID NO: 347559 - DNA, 20 bp, human
gcggggagatggtccctcag

SEQ ID NO: 347560 - DNA, 20 bp, human
ggctgcatccagcttcaagt

SEQ ID NO: 347561 - DNA, 20 bp, human
gtccctgcctgacaatccag

SEQ ID NO: 347562 - DNA, 20 bp, human
gccaggggagcaatgcctgt

SEQ ID NO: 347563 - DNA, 20 bp, human
gcacatgtgcagaaggtctg

SEQ ID NO: 347564 - DNA, 20 bp, human
ggaaagctgggcgctggctt

SEQ ID NO: 347565 - DNA, 20 bp, human
ggaccaggggtcctgcagca

SEQ ID NO: 347566 - DNA, 20 bp, human
gctcccacgtaacacaaacc

SEQ ID NO: 347567 - DNA, 20 bp, human
gtaggagtcttagactatcc

SEQ ID NO: 347568 - DNA, 20 bp, human
gggtgattgtgatggaacca

SEQ ID NO: 347569 - DNA, 20 bp, human
gtatccgggtttgtgttacg

SEQ ID NO: 347570 - DNA, 20 bp, human
ggggctaattcaacttctcc

SEQ ID NO: 347571 - DNA, 20 bp, human
ggtcatactttgtttgtatt

SEQ ID NO: 347572 - DNA, 20 bp, human
gaacttggtttgtaaaatgt

SEQ ID NO: 347573 - DNA, 20 bp, human
gctaacctctgctatttacc

SEQ ID NO: 347574 - DNA, 20 bp, human
gcaatggattgtgtctgtca

SEQ ID NO: 347575 - DNA, 20 bp, human
gtttaggagagcctaaaatt

SEQ ID NO: 347576 - DNA, 20 bp, human
gtgtttggcattaaaaaagt

SEQ ID NO: 347577 - DNA, 20 bp, human
gcattaaaaaagtgggtttg

SEQ ID NO: 347578 - DNA, 20 bp, human
gatgacattagtagtgaaat

SEQ ID NO: 347579 - DNA, 20 bp, human
gtgaattgaagacaattgtt

SEQ ID NO: 347580 - DNA, 20 bp, human
gtcaattgatcagataaaaa

SEQ ID NO: 347581 - DNA, 20 bp, human
gtcagataaaaaaggaaaac

SEQ ID NO: 347582 - DNA, 20 bp, human
gtatattctttaaatattat

SEQ ID NO: 347583 - DNA, 20 bp, human
ggatttagcagaaggaatag

SEQ ID NO: 347584 - DNA, 20 bp, human
gatataaaagttcatgctgt

SEQ ID NO: 347585 - DNA, 20 bp, human
gttaatttcatttatctaca

SEQ ID NO: 347586 - DNA, 20 bp, human
gtatggcaggcactcacacc

SEQ ID NO: 347587 - DNA, 20 bp, human
ggacccaggtgcgtagacag

SEQ ID NO: 347588 - DNA, 20 bp, human
ggggataaggcgcctgtctg

SEQ ID NO: 347589 - DNA, 20 bp, human
gcccacctgcgaggcgggta

SEQ ID NO: 347590 - DNA, 20 bp, human
gggcgcggggagcgcatcca

SEQ ID NO: 347591 - DNA, 20 bp, human
gggcgcccgccccacctgcg

SEQ ID NO: 347592 - DNA, 20 bp, human
gcacacctggtggagagcaa

SEQ ID NO: 347593 - DNA, 20 bp, human
gccaggaagtggcctgacta

SEQ ID NO: 347594 - DNA, 20 bp, human
gggcaggcactcacacctgg

SEQ ID NO: 347595 - DNA, 20 bp, human
gagggccatacccgcctcgc

SEQ ID NO: 347596 - DNA, 20 bp, human
gtggaaactttccgggggga

SEQ ID NO: 347597 - DNA, 20 bp, human
gaatgtggaaactttccggg

SEQ ID NO: 347598 - DNA, 20 bp, human
gagaaacccgtggaatccat

SEQ ID NO: 347599 - DNA, 20 bp, human
gaccaccccaagctggtttc

SEQ ID NO: 347600 - DNA, 20 bp, human
gtaagttggaagaatgcctt

SEQ ID NO: 347601 - DNA, 20 bp, human
gaaactttccggggggaggg

SEQ ID NO: 347602 - DNA, 20 bp, human
gcctcctaaaagagcctagt

SEQ ID NO: 347603 - DNA, 20 bp, human
gtgacaaaggattacctact

SEQ ID NO: 347604 - DNA, 20 bp, human
gccccagtataagaagaaga

SEQ ID NO: 347605 - DNA, 20 bp, human
gtggcttggatagaaacccg

SEQ ID NO: 347606 - DNA, 20 bp, human
gtcgacttggcgttgggttg

SEQ ID NO: 347607 - DNA, 20 bp, human
gagcgagagtgcacgagggg

SEQ ID NO: 347608 - DNA, 20 bp, human
gtacgagcgagagtgcacga

SEQ ID NO: 347609 - DNA, 20 bp, human
gtagagccgcggagccgctg

SEQ ID NO: 347610 - DNA, 20 bp, human
gactctcgctcgtagagccg

SEQ ID NO: 347611 - DNA, 20 bp, human
gtcaatattgaggttccggt

SEQ ID NO: 347612 - DNA, 20 bp, human
gtggatgtagtatcagagtt

SEQ ID NO: 347613 - DNA, 20 bp, human
ggggagccactagaaggatc

SEQ ID NO: 347614 - DNA, 20 bp, human
ggggttcaatattgaggttc

SEQ ID NO: 347615 - DNA, 20 bp, human
ggggttcgggttcaatattg

SEQ ID NO: 347616 - DNA, 20 bp, human
ggcgaggggcccctcaagtc

SEQ ID NO: 347617 - DNA, 20 bp, human
ggcaaggcgggagccaagcg

SEQ ID NO: 347618 - DNA, 20 bp, human
gcgaaggagcgagcgaacag

SEQ ID NO: 347619 - DNA, 20 bp, human
ggccctggcgaggggaaagg

SEQ ID NO: 347620 - DNA, 20 bp, human
gtctccgcgcggcctctact

SEQ ID NO: 347621 - DNA, 20 bp, human
gaacatgtgagcatggatcc

SEQ ID NO: 347622 - DNA, 20 bp, human
gcgagggacccagcgcaagg

SEQ ID NO: 347623 - DNA, 20 bp, human
gcttggctcccgccttgcgc

SEQ ID NO: 347624 - DNA, 20 bp, human
gtgtcccagtagaggccgcg

SEQ ID NO: 347625 - DNA, 20 bp, human
gaaaacaagccggccccaga

SEQ ID NO: 347626 - DNA, 20 bp, human
ggggcgcggcacccggtacc

SEQ ID NO: 347627 - DNA, 20 bp, human
gacaaagtggagtgggctgg

SEQ ID NO: 347628 - DNA, 20 bp, human
ggtgcagagggagatttcgg

SEQ ID NO: 347629 - DNA, 20 bp, human
ggagctagaggcagcggtga

SEQ ID NO: 347630 - DNA, 20 bp, human
gccggtacctggggtgcaga

SEQ ID NO: 347631 - DNA, 20 bp, human
gctgcctctagctctgacac

SEQ ID NO: 347632 - DNA, 20 bp, human
ggatgtgtgatcacccacca

SEQ ID NO: 347633 - DNA, 20 bp, human
gtgggtaggagactgttagg

SEQ ID NO: 347634 - DNA, 20 bp, human
ggctgcacggatgcgggacg

SEQ ID NO: 347635 - DNA, 20 bp, human
gactccctcgcctccctggt

SEQ ID NO: 347636 - DNA, 20 bp, human
gcgcttcctctgcccgcggg

SEQ ID NO: 347637 - DNA, 20 bp, human
gagcccgggaccaggctccg

SEQ ID NO: 347638 - DNA, 20 bp, human
gtccgcgcgtcatgcggctg

SEQ ID NO: 347639 - DNA, 20 bp, human
ggccgcggatcccctcccgc

SEQ ID NO: 347640 - DNA, 20 bp, human
gtccgcggccggctcggagg

SEQ ID NO: 347641 - DNA, 20 bp, human
ggccccagccgcatgacgcg

SEQ ID NO: 347642 - DNA, 20 bp, human
ggagcgcttcctctgcccgc

SEQ ID NO: 347643 - DNA, 20 bp, human
gggaagcgatgaatattcag

SEQ ID NO: 347644 - DNA, 20 bp, human
ggcctcctccgcgcgtcatg

SEQ ID NO: 347645 - DNA, 20 bp, human
gagcgcgcaggggcttcgcg

SEQ ID NO: 347646 - DNA, 20 bp, human
gcgggctccgggcgcttctg

SEQ ID NO: 347647 - DNA, 20 bp, human
gcccaggctgcgaacaaagg

SEQ ID NO: 347648 - DNA, 20 bp, human
gcgggcgcttctgaggaatg

SEQ ID NO: 347649 - DNA, 20 bp, human
gtggcgcgcgtctctccggc

SEQ ID NO: 347650 - DNA, 20 bp, human
gccgccagccgctgctcgga

SEQ ID NO: 347651 - DNA, 20 bp, human
gagcggttgctgattgaaag

SEQ ID NO: 347652 - DNA, 20 bp, human
gtgcgaacaaaggcggcgcg

SEQ ID NO: 347653 - DNA, 20 bp, human
gacagggcagcgagctgcgc

SEQ ID NO: 347654 - DNA, 20 bp, human
gcgcggggcgacgtcacccc

SEQ ID NO: 347655 - DNA, 20 bp, human
ggcgtctctccggcaggagg

SEQ ID NO: 347656 - DNA, 20 bp, human
gacccttgggtgttatgcaa

SEQ ID NO: 347657 - DNA, 20 bp, human
ggtagtgaatcaattcccag

SEQ ID NO: 347658 - DNA, 20 bp, human
gaatgatgactttatcttgg

SEQ ID NO: 347659 - DNA, 20 bp, human
gttcccttgcataacaccca

SEQ ID NO: 347660 - DNA, 20 bp, human
ggttttaggcagataggcag

SEQ ID NO: 347661 - DNA, 20 bp, human
gtgtgaagggcccagaagta

SEQ ID NO: 347662 - DNA, 20 bp, human
gggcccagaagtacggtact

SEQ ID NO: 347663 - DNA, 20 bp, human
gtggcaatgaaacttcccct

SEQ ID NO: 347664 - DNA, 20 bp, human
gaggcaaactactcagttgg

SEQ ID NO: 347665 - DNA, 20 bp, human
gtcaagaaaaccctcctcat

SEQ ID NO: 347666 - DNA, 20 bp, human
gctgacgcccgcttcggcgg

SEQ ID NO: 347667 - DNA, 20 bp, human
gtcggcggcggtagtggctg

SEQ ID NO: 347668 - DNA, 20 bp, human
ggaagcgggcgtcagccgcg

SEQ ID NO: 347669 - DNA, 20 bp, human
ggccgccgcggcccgctaga

SEQ ID NO: 347670 - DNA, 20 bp, human
ggccgccagaagtttgtccc

SEQ ID NO: 347671 - DNA, 20 bp, human
gcctccgggagctcggctgg

SEQ ID NO: 347672 - DNA, 20 bp, human
gcgagctcccggaggcgctc

SEQ ID NO: 347673 - DNA, 20 bp, human
ggcgcgggccggcggggcac

SEQ ID NO: 347674 - DNA, 20 bp, human
ggaagggagcgctcacgtca

SEQ ID NO: 347675 - DNA, 20 bp, human
gcgcgctcacaaactactcg

SEQ ID NO: 347676 - DNA, 20 bp, human
gcgtaagagccctgtcggag

SEQ ID NO: 347677 - DNA, 20 bp, human
gtaggtcccccgctccgaca

SEQ ID NO: 347678 - DNA, 20 bp, human
gtacagggatggggccaagt

SEQ ID NO: 347679 - DNA, 20 bp, human
gggccgcgttgcagcgagag

SEQ ID NO: 347680 - DNA, 20 bp, human
gcaacgcggccaaccgcagg

SEQ ID NO: 347681 - DNA, 20 bp, human
gaagagccctgtcggagcgg

SEQ ID NO: 347682 - DNA, 20 bp, human
gcctactatttgatggagga

SEQ ID NO: 347683 - DNA, 20 bp, human
gtgtcgtcagcacccgcctg

SEQ ID NO: 347684 - DNA, 20 bp, human
gtgcccctctcgctgcaacg

SEQ ID NO: 347685 - DNA, 20 bp, human
gctgcaacgcggccaaccgc

SEQ ID NO: 347686 - DNA, 20 bp, human
gcggcgcctgcgagtgggga

SEQ ID NO: 347687 - DNA, 20 bp, human
gggccgcggcgcctgcgagt

SEQ ID NO: 347688 - DNA, 20 bp, human
gggggggcaggaatgcaggt

SEQ ID NO: 347689 - DNA, 20 bp, human
gcaggcggggaggggatcgg

SEQ ID NO: 347690 - DNA, 20 bp, human
gggggcgttccgagcgggga

SEQ ID NO: 347691 - DNA, 20 bp, human
ggccctggactccccggccc

SEQ ID NO: 347692 - DNA, 20 bp, human
ggtcgccgcaagagcgcgag

SEQ ID NO: 347693 - DNA, 20 bp, human
gagggcggacgcgcgtccgg

SEQ ID NO: 347694 - DNA, 20 bp, human
gcgcgcctctcgcgctcttg

SEQ ID NO: 347695 - DNA, 20 bp, human
gggacggggcgttccgagcg

SEQ ID NO: 347696 - DNA, 20 bp, human
gggtctgtgtggtgagcgag

SEQ ID NO: 347697 - DNA, 20 bp, human
gagcagggacactctcactc

SEQ ID NO: 347698 - DNA, 20 bp, human
gccagcccgccgtagtcctc

SEQ ID NO: 347699 - DNA, 20 bp, human
gacggtgagagtgttgaaat

SEQ ID NO: 347700 - DNA, 20 bp, human
ggaggctgctgtcattttat

SEQ ID NO: 347701 - DNA, 20 bp, human
gtgctgccagaggactacgg

SEQ ID NO: 347702 - DNA, 20 bp, human
gccgatcctggtggagggtt

SEQ ID NO: 347703 - DNA, 20 bp, human
gcctcctctggcagccgcgg

SEQ ID NO: 347704 - DNA, 20 bp, human
gagcgggccgatcctggtgg

SEQ ID NO: 347705 - DNA, 20 bp, human
gatcctggtggagggttggg

SEQ ID NO: 347706 - DNA, 20 bp, human
ggatgactggctgtaggttc

SEQ ID NO: 347707 - DNA, 20 bp, human
gcctacagccagtcatccaa

SEQ ID NO: 347708 - DNA, 20 bp, human
gtgttaagtttcagcattgg

SEQ ID NO: 347709 - DNA, 20 bp, human
gcagagctattgagtaatat

SEQ ID NO: 347710 - DNA, 20 bp, human
gttactatcagagatcttgg

SEQ ID NO: 347711 - DNA, 20 bp, human
gaccctctggtcatgtggaa

SEQ ID NO: 347712 - DNA, 20 bp, human
gtcatgaacccttggatgac

SEQ ID NO: 347713 - DNA, 20 bp, human
gtgcactggagcctaccctc

SEQ ID NO: 347714 - DNA, 20 bp, human
gagcctaccctctggtcatg

SEQ ID NO: 347715 - DNA, 20 bp, human
gtgaaggctctaagtttctc

SEQ ID NO: 347716 - DNA, 20 bp, human
gggggaagggggaagtgcgg

SEQ ID NO: 347717 - DNA, 20 bp, human
gccaagccgccgctaagacc

SEQ ID NO: 347718 - DNA, 20 bp, human
gagagtaggctccatcgctg

SEQ ID NO: 347719 - DNA, 20 bp, human
gcatcgctggggtggtggtt

SEQ ID NO: 347720 - DNA, 20 bp, human
ggcgggggagacacttgctg

SEQ ID NO: 347721 - DNA, 20 bp, human
gcttctccgggtcttagcgg

SEQ ID NO: 347722 - DNA, 20 bp, human
ggccggccctcacgaggcaa

SEQ ID NO: 347723 - DNA, 20 bp, human
gcccaccttcggatttgtga

SEQ ID NO: 347724 - DNA, 20 bp, human
gacacttgctgtggttacta

SEQ ID NO: 347725 - DNA, 20 bp, human
gtagatgggggcacgaccac

SEQ ID NO: 347726 - DNA, 20 bp, human
ggcggaagggatgacgtcac

SEQ ID NO: 347727 - DNA, 20 bp, human
gtggctccggggtgtttaaa

SEQ ID NO: 347728 - DNA, 20 bp, human
gggcggcggcgctggcggaa

SEQ ID NO: 347729 - DNA, 20 bp, human
gggcgcgcgagcgggagcta

SEQ ID NO: 347730 - DNA, 20 bp, human
gcctgcccccgacccggcgg

SEQ ID NO: 347731 - DNA, 20 bp, human
ggcttcgcgggacacgtggg

SEQ ID NO: 347732 - DNA, 20 bp, human
ggtggggcgcggggcttcgc

SEQ ID NO: 347733 - DNA, 20 bp, human
ggctgcgcagtgacgcgcac

SEQ ID NO: 347734 - DNA, 20 bp, human
gatgacgtcaccggctgggg

SEQ ID NO: 347735 - DNA, 20 bp, human
gacggcgcagcgcggtcacg

SEQ ID NO: 347736 - DNA, 20 bp, human
gcgcgcctggcacacgcccg

SEQ ID NO: 347737 - DNA, 20 bp, human
gaggaccctgcccggcgtgt

SEQ ID NO: 347738 - DNA, 20 bp, human
gaagaggcgaggaccctgcc

SEQ ID NO: 347739 - DNA, 20 bp, human
gggcccgagctggtcggccc

SEQ ID NO: 347740 - DNA, 20 bp, human
gtctccggggccgaccagct

SEQ ID NO: 347741 - DNA, 20 bp, human
gcggcggcggcgttaggact

SEQ ID NO: 347742 - DNA, 20 bp, human
gctgcccggcgtgtgggtgc

SEQ ID NO: 347743 - DNA, 20 bp, human
gccgcccgggcgctccgcct

SEQ ID NO: 347744 - DNA, 20 bp, human
gcgaactgaggcgggaggct

SEQ ID NO: 347745 - DNA, 20 bp, human
ggcccgcgtgtgccagccgc

SEQ ID NO: 347746 - DNA, 20 bp, human
gcaagcggggcgctgacgtc

SEQ ID NO: 347747 - DNA, 20 bp, human
gggtccgtggagacgtccgt

SEQ ID NO: 347748 - DNA, 20 bp, human
gacccagccgcggggcctca

SEQ ID NO: 347749 - DNA, 20 bp, human
ggcgggtgctgcagcgggtc

SEQ ID NO: 347750 - DNA, 20 bp, human
gcccgctgcagcacccgccg

SEQ ID NO: 347751 - DNA, 20 bp, human
gtccccgccatgaggccccg

SEQ ID NO: 347752 - DNA, 20 bp, human
gaggggcgcgccagggctag

SEQ ID NO: 347753 - DNA, 20 bp, human
gctgtacgggagctaggcgt

SEQ ID NO: 347754 - DNA, 20 bp, human
ggccacggcgggtgctgcag

SEQ ID NO: 347755 - DNA, 20 bp, human
gggcgtccagacccagccgc

SEQ ID NO: 347756 - DNA, 20 bp, human
gtcgcggagctcatcgtcaa

SEQ ID NO: 347757 - DNA, 20 bp, human
gcccctcgagggtgaggtcc

SEQ ID NO: 347758 - DNA, 20 bp, human
ggccgggacctcaccctcga

SEQ ID NO: 347759 - DNA, 20 bp, human
gctgggacacacagcggtac

SEQ ID NO: 347760 - DNA, 20 bp, human
ggtgaggtcccggcgctccc

SEQ ID NO: 347761 - DNA, 20 bp, human
ggcgggcgtctctaacttcg

SEQ ID NO: 347762 - DNA, 20 bp, human
gggtcagctggtggacgccg

SEQ ID NO: 347763 - DNA, 20 bp, human
gacctcaccctcgaggggcg

SEQ ID NO: 347764 - DNA, 20 bp, human
ggtacaggtcctgctcggcg

SEQ ID NO: 347765 - DNA, 20 bp, human
gggcgtggccgtggggggtg

SEQ ID NO: 347766 - DNA, 20 bp, human
gcggacagagggaggattgt

SEQ ID NO: 347767 - DNA, 20 bp, human
ggcggatccctctaactcca

SEQ ID NO: 347768 - DNA, 20 bp, human
ggcagcgaaaccactggcag

SEQ ID NO: 347769 - DNA, 20 bp, human
ggagttagagggatccgctg

SEQ ID NO: 347770 - DNA, 20 bp, human
gactggcagcggacagaggg

SEQ ID NO: 347771 - DNA, 20 bp, human
gaccactggcagcggacaga

SEQ ID NO: 347772 - DNA, 20 bp, human
gtccagggcagcgaaaccac

SEQ ID NO: 347773 - DNA, 20 bp, human
gtctggctgtgcgggacaat

SEQ ID NO: 347774 - DNA, 20 bp, human
ggcggctgccgctctgggtc

SEQ ID NO: 347775 - DNA, 20 bp, human
gctgggatccggacccagag

SEQ ID NO: 347776 - DNA, 20 bp, human
gccaaccatcccgggaaggg

SEQ ID NO: 347777 - DNA, 20 bp, human
ggcagaaggggagatcgacg

SEQ ID NO: 347778 - DNA, 20 bp, human
gggagatcgacgaggcgggg

SEQ ID NO: 347779 - DNA, 20 bp, human
ggtcccggtgcgcacggacg

SEQ ID NO: 347780 - DNA, 20 bp, human
gggccagaactgctgggcgg

SEQ ID NO: 347781 - DNA, 20 bp, human
gccaactattccaaccatcc

SEQ ID NO: 347782 - DNA, 20 bp, human
gtattccaaccatcccggga

SEQ ID NO: 347783 - DNA, 20 bp, human
gggtggggcgctcggctctt

SEQ ID NO: 347784 - DNA, 20 bp, human
gaggggagatcgacgaggcg

SEQ ID NO: 347785 - DNA, 20 bp, human
gaccccagaaagggagggac

SEQ ID NO: 347786 - DNA, 20 bp, human
gtggccgccatgcttctgag

SEQ ID NO: 347787 - DNA, 20 bp, human
gccaacgtccaatccgggcc

SEQ ID NO: 347788 - DNA, 20 bp, human
gtggccgagtccgggaaccc

SEQ ID NO: 347789 - DNA, 20 bp, human
gcgtcccacacaagtcccga

SEQ ID NO: 347790 - DNA, 20 bp, human
gccgcccctcagaagcatgg

SEQ ID NO: 347791 - DNA, 20 bp, human
gcgaggcggtggccgagtcc

SEQ ID NO: 347792 - DNA, 20 bp, human
gtgtcccttcgggacttgtg

SEQ ID NO: 347793 - DNA, 20 bp, human
ggcgcctgggttcccggact

SEQ ID NO: 347794 - DNA, 20 bp, human
gggcgtcacagtgtcccttc

SEQ ID NO: 347795 - DNA, 20 bp, human
gggcggtgtcggagtgaatg

SEQ ID NO: 347796 - DNA, 20 bp, human
ggagctcgccgaaaggaggg

SEQ ID NO: 347797 - DNA, 20 bp, human
ggcgggtgtgagagtccgta

SEQ ID NO: 347798 - DNA, 20 bp, human
gaagtgacgtgagcgggttc

SEQ ID NO: 347799 - DNA, 20 bp, human
gaaccgagctcgccgaaagg

SEQ ID NO: 347800 - DNA, 20 bp, human
ggccctgtgggtgtggcaag

SEQ ID NO: 347801 - DNA, 20 bp, human
ggggaggaacgtatcccttc

SEQ ID NO: 347802 - DNA, 20 bp, human
gtcctcgcgggatttcagtt

SEQ ID NO: 347803 - DNA, 20 bp, human
gaggaacgtatcccttctgg

SEQ ID NO: 347804 - DNA, 20 bp, human
gtacctacccgctccgaccc

SEQ ID NO: 347805 - DNA, 20 bp, human
gttctggaggctgtctcagg

SEQ ID NO: 347806 - DNA, 20 bp, human
gtggcctgggtgagctagaa

SEQ ID NO: 347807 - DNA, 20 bp, human
gtaggggaaagacccattgt

SEQ ID NO: 347808 - DNA, 20 bp, human
gaaagcacgccgggaccggt

SEQ ID NO: 347809 - DNA, 20 bp, human
gccacggtccggtccgacaa

SEQ ID NO: 347810 - DNA, 20 bp, human
gacgccgggaccggttggtt

SEQ ID NO: 347811 - DNA, 20 bp, human
gaaaccaaaccaaccggtcc

SEQ ID NO: 347812 - DNA, 20 bp, human
ggaaagacccattgtcggac

SEQ ID NO: 347813 - DNA, 20 bp, human
ggcatcttgggatcagggcg

SEQ ID NO: 347814 - DNA, 20 bp, human
gctgccgtacaaaagcatgg

SEQ ID NO: 347815 - DNA, 20 bp, human
gcgccaccctggccacggtc

SEQ ID NO: 347816 - DNA, 20 bp, human
gggcctcgggagacagttaa

SEQ ID NO: 347817 - DNA, 20 bp, human
gcacccttaactgtctcccg

SEQ ID NO: 347818 - DNA, 20 bp, human
gctcgctatctgaatctctt

SEQ ID NO: 347819 - DNA, 20 bp, human
gcagacgggccctaactacg

SEQ ID NO: 347820 - DNA, 20 bp, human
gcaaacagatcaaggacaca

SEQ ID NO: 347821 - DNA, 20 bp, human
ggacccaaagtgtgcccaga

SEQ ID NO: 347822 - DNA, 20 bp, human
gtgtctcccgaggccgggat

SEQ ID NO: 347823 - DNA, 20 bp, human
ggggatacctaagcataccc

SEQ ID NO: 347824 - DNA, 20 bp, human
gagcggagacgcacttccta

SEQ ID NO: 347825 - DNA, 20 bp, human
gacgcactgcgcagccgcgg

SEQ ID NO: 347826 - DNA, 20 bp, human
ggaaaggacctaagcagcca

SEQ ID NO: 347827 - DNA, 20 bp, human
gcaagaaagagcttttgggg

SEQ ID NO: 347828 - DNA, 20 bp, human
gttgcaagaaagagcttttg

SEQ ID NO: 347829 - DNA, 20 bp, human
gctgggcggaagagccaatt

SEQ ID NO: 347830 - DNA, 20 bp, human
gccaagtagaaccaatggaa

SEQ ID NO: 347831 - DNA, 20 bp, human
gtattaagctgcatggactg

SEQ ID NO: 347832 - DNA, 20 bp, human
ggcgagttgtggtttaaacc

SEQ ID NO: 347833 - DNA, 20 bp, human
gtccatgcagcttaataata

SEQ ID NO: 347834 - DNA, 20 bp, human
gccacaactcgcggcccaat

SEQ ID NO: 347835 - DNA, 20 bp, human
gtttctgggaagaaaaaact

SEQ ID NO: 347836 - DNA, 20 bp, human
gtcgcctcccggcgcggctg

SEQ ID NO: 347837 - DNA, 20 bp, human
ggaggcgagcccgttggcga

SEQ ID NO: 347838 - DNA, 20 bp, human
gtgccccgcccctcgccaac

SEQ ID NO: 347839 - DNA, 20 bp, human
gaggggcggggcagatggcg

SEQ ID NO: 347840 - DNA, 20 bp, human
gcgagcccgttggcgagggg

SEQ ID NO: 347841 - DNA, 20 bp, human
gccggcgccgcggctgttcc

SEQ ID NO: 347842 - DNA, 20 bp, human
gcagtgcgcctgcgcgatag

SEQ ID NO: 347843 - DNA, 20 bp, human
gtctccgcccggaacagccg

SEQ ID NO: 347844 - DNA, 20 bp, human
gcactgaacctcagccgcgc

SEQ ID NO: 347845 - DNA, 20 bp, human
gggaagtggacctgcgaggt

SEQ ID NO: 347846 - DNA, 20 bp, human
gaaacctgggtaggaatctc

SEQ ID NO: 347847 - DNA, 20 bp, human
gtggatgtggaaatagggct

SEQ ID NO: 347848 - DNA, 20 bp, human
gttaacaatgtgtaagagtt

SEQ ID NO: 347849 - DNA, 20 bp, human
ggggttttacctccatttta

SEQ ID NO: 347850 - DNA, 20 bp, human
gtctccccaccactgcatgc

SEQ ID NO: 347851 - DNA, 20 bp, human
ggccaactctgatctactgg

SEQ ID NO: 347852 - DNA, 20 bp, human
gaaatggtcaaaaaccactt

SEQ ID NO: 347853 - DNA, 20 bp, human
ggaactcatataaagagcac

SEQ ID NO: 347854 - DNA, 20 bp, human
gaatccagcatgcagtggtg

SEQ ID NO: 347855 - DNA, 20 bp, human
ggaagacttgcatttattaa

SEQ ID NO: 347856 - DNA, 20 bp, human
gcccctcccccaccaaattc

SEQ ID NO: 347857 - DNA, 20 bp, human
gacgctgcagtcagattaat

SEQ ID NO: 347858 - DNA, 20 bp, human
ggctggtggcactgcggtaa

SEQ ID NO: 347859 - DNA, 20 bp, human
ggagttcccctgaatttggt

SEQ ID NO: 347860 - DNA, 20 bp, human
gctgcagtcagattaattgg

SEQ ID NO: 347861 - DNA, 20 bp, human
gttaattggaggagggtcag

SEQ ID NO: 347862 - DNA, 20 bp, human
ggatgaatgagtaatgctgg

SEQ ID NO: 347863 - DNA, 20 bp, human
gtactcattcatccccattc

SEQ ID NO: 347864 - DNA, 20 bp, human
ggcacaatattaaaccgcaa

SEQ ID NO: 347865 - DNA, 20 bp, human
gtgctgaggaaagcctgaat

SEQ ID NO: 347866 - DNA, 20 bp, human
gccgcaggagagggtgaagg

SEQ ID NO: 347867 - DNA, 20 bp, human
gagggtgaaggtggctccgt

SEQ ID NO: 347868 - DNA, 20 bp, human
gccttgccgtctctccggat

SEQ ID NO: 347869 - DNA, 20 bp, human
gaagccccatgtagatatat

SEQ ID NO: 347870 - DNA, 20 bp, human
gagcaacccatccggagaga

SEQ ID NO: 347871 - DNA, 20 bp, human
gtctccggatgggttgctcg

SEQ ID NO: 347872 - DNA, 20 bp, human
ggcaggaagccgccccagtg

SEQ ID NO: 347873 - DNA, 20 bp, human
gcctccacgagcaacccatc

SEQ ID NO: 347874 - DNA, 20 bp, human
gtccctccagccgcaggaga

SEQ ID NO: 347875 - DNA, 20 bp, human
gaccctctcctgcggctgga

SEQ ID NO: 347876 - DNA, 20 bp, human
gtaagaacgcgcttccgggg

SEQ ID NO: 347877 - DNA, 20 bp, human
gcccgggaggggcgacggaa

SEQ ID NO: 347878 - DNA, 20 bp, human
gcgcgcacctcgggcgtcta

SEQ ID NO: 347879 - DNA, 20 bp, human
gacggtaaacgcccccggga

SEQ ID NO: 347880 - DNA, 20 bp, human
ggcgccgcgggactcgagtc

SEQ ID NO: 347881 - DNA, 20 bp, human
gggcgtggcccgcgcacctc

SEQ ID NO: 347882 - DNA, 20 bp, human
ggaaggggcgtgctcttggc

SEQ ID NO: 347883 - DNA, 20 bp, human
ggtactacgcacgcccgcgt

SEQ ID NO: 347884 - DNA, 20 bp, human
gcgtgctcttggccgggcga

SEQ ID NO: 347885 - DNA, 20 bp, human
gaggaacggtaaacgccccc

SEQ ID NO: 347886 - DNA, 20 bp, human
ggccgaaggcggggtcccgc

SEQ ID NO: 347887 - DNA, 20 bp, human
gtggttgccatgccaaccca

SEQ ID NO: 347888 - DNA, 20 bp, human
gtgggcacgcggggttgcgc

SEQ ID NO: 347889 - DNA, 20 bp, human
ggtgaactcgggaaactcgc

SEQ ID NO: 347890 - DNA, 20 bp, human
gagactcggtggagcgtcac

SEQ ID NO: 347891 - DNA, 20 bp, human
ggcagcggcatgtgcggaga

SEQ ID NO: 347892 - DNA, 20 bp, human
ggaggagcgcgtccgagact

SEQ ID NO: 347893 - DNA, 20 bp, human
gcggggccggagcctatccc

SEQ ID NO: 347894 - DNA, 20 bp, human
gcgccgccagggccgaaggc

SEQ ID NO: 347895 - DNA, 20 bp, human
gacaacatggcggcccactg

SEQ ID NO: 347896 - DNA, 20 bp, human
ggagaacgtgcgcacgcgca

SEQ ID NO: 347897 - DNA, 20 bp, human
gcggcggcagcgcgggagca

SEQ ID NO: 347898 - DNA, 20 bp, human
gagggaagcgcgagcccgca

SEQ ID NO: 347899 - DNA, 20 bp, human
ggcgcgagcccgcaaggtga

SEQ ID NO: 347900 - DNA, 20 bp, human
ggggctcgcgcttccctcct

SEQ ID NO: 347901 - DNA, 20 bp, human
gggagggcacgccggagagg

SEQ ID NO: 347902 - DNA, 20 bp, human
gggcgcgcgcagtgcacccc

SEQ ID NO: 347903 - DNA, 20 bp, human
gagtgcaccccgggagaaag

SEQ ID NO: 347904 - DNA, 20 bp, human
gctcaccctcggtacttcgg

SEQ ID NO: 347905 - DNA, 20 bp, human
gagggacgcaaggcattaaa

SEQ ID NO: 347906 - DNA, 20 bp, human
gcggcggcagctaaaacgga

SEQ ID NO: 347907 - DNA, 20 bp, human
ggacgcgccaggagccgata

SEQ ID NO: 347908 - DNA, 20 bp, human
ggccgcggcggcagctaaaa

SEQ ID NO: 347909 - DNA, 20 bp, human
gcggagggacgcgagagcga

SEQ ID NO: 347910 - DNA, 20 bp, human
gctcacgcgcgagaaggggg

SEQ ID NO: 347911 - DNA, 20 bp, human
ggggcgcgagccacggagtt

SEQ ID NO: 347912 - DNA, 20 bp, human
ggcgcgctcacgcgcgagaa

SEQ ID NO: 347913 - DNA, 20 bp, human
gtggggcgcgtctgaggagg

SEQ ID NO: 347914 - DNA, 20 bp, human
gcggtgggtggaggaagtgt

SEQ ID NO: 347915 - DNA, 20 bp, human
ggcggaaagagcgcgctcgg

SEQ ID NO: 347916 - DNA, 20 bp, human
gcgggtgggcgcgtacagta

SEQ ID NO: 347917 - DNA, 20 bp, human
gggccctcaccctacaaccc

SEQ ID NO: 347918 - DNA, 20 bp, human
gcagacgagacccggtaaca

SEQ ID NO: 347919 - DNA, 20 bp, human
gcccacccagccagggttgt

SEQ ID NO: 347920 - DNA, 20 bp, human
gcccgcagatctcgcgagag

SEQ ID NO: 347921 - DNA, 20 bp, human
ggggcgccctgctactgtac

SEQ ID NO: 347922 - DNA, 20 bp, human
ggactccccagtacagtagc

SEQ ID NO: 347923 - DNA, 20 bp, human
gcagccagggttgtagggtg

SEQ ID NO: 347924 - DNA, 20 bp, human
ggccactctcgcgagatctg

SEQ ID NO: 347925 - DNA, 20 bp, human
gagacgagacagacgagacc

SEQ ID NO: 347926 - DNA, 20 bp, human
gcgggcggcaagctgagagt

SEQ ID NO: 347927 - DNA, 20 bp, human
gcgcagaggggtgacgtcag

SEQ ID NO: 347928 - DNA, 20 bp, human
gtaaggctggcaagtcccca

SEQ ID NO: 347929 - DNA, 20 bp, human
ggggcggctgagtcacgcta

SEQ ID NO: 347930 - DNA, 20 bp, human
gggcgcgtagacagacgcag

SEQ ID NO: 347931 - DNA, 20 bp, human
gcgcgcgccggaagtggcta

SEQ ID NO: 347932 - DNA, 20 bp, human
ggccccggaagcgagaagga

SEQ ID NO: 347933 - DNA, 20 bp, human
gctcgcggccggaagcgccg

SEQ ID NO: 347934 - DNA, 20 bp, human
ggcgggacggagtgacttca

SEQ ID NO: 347935 - DNA, 20 bp, human
gcgcggcggcgtggcgcaga

SEQ ID NO: 347936 - DNA, 20 bp, human
ggggtgcagcgggagtgcga

SEQ ID NO: 347937 - DNA, 20 bp, human
ggcgaggggactggacaggt

SEQ ID NO: 347938 - DNA, 20 bp, human
gactggacaggtgggaagat

SEQ ID NO: 347939 - DNA, 20 bp, human
gcctgcatcccggtggaatc

SEQ ID NO: 347940 - DNA, 20 bp, human
gccggcgcgtggggtgcagc

SEQ ID NO: 347941 - DNA, 20 bp, human
gctagagtcctgcatcccgg

SEQ ID NO: 347942 - DNA, 20 bp, human
gcagctagagtcctgcatcc

SEQ ID NO: 347943 - DNA, 20 bp, human
gtgactgaagcccggcgcgt

SEQ ID NO: 347944 - DNA, 20 bp, human
gggaagtgtagtctcttcgc

SEQ ID NO: 347945 - DNA, 20 bp, human
gggtggggcaggaacggggg

SEQ ID NO: 347946 - DNA, 20 bp, human
gggggcggagactagggggt

SEQ ID NO: 347947 - DNA, 20 bp, human
gcggccgcggtgctggatgc

SEQ ID NO: 347948 - DNA, 20 bp, human
ggcggggattagggtgttga

SEQ ID NO: 347949 - DNA, 20 bp, human
gtgggcgggcgacagcaccc

SEQ ID NO: 347950 - DNA, 20 bp, human
gggattagggtgttgagggc

SEQ ID NO: 347951 - DNA, 20 bp, human
ggcgaccagtcgcgcggccg

SEQ ID NO: 347952 - DNA, 20 bp, human
gggaacgaccgactgcacgg

SEQ ID NO: 347953 - DNA, 20 bp, human
gagcgcggacaaaactaatt

SEQ ID NO: 347954 - DNA, 20 bp, human
ggtcgcccgcccagcggagc

SEQ ID NO: 347955 - DNA, 20 bp, human
gaccgtgcgggtgaagggca

SEQ ID NO: 347956 - DNA, 20 bp, human
gttctgggagtggaccagtc

SEQ ID NO: 347957 - DNA, 20 bp, human
gctacctcccccacgagcga

SEQ ID NO: 347958 - DNA, 20 bp, human
ggtcccaccgaggcttttct

SEQ ID NO: 347959 - DNA, 20 bp, human
ggctacaactccctagacgt

SEQ ID NO: 347960 - DNA, 20 bp, human
gggtgggactccgacgtcta

SEQ ID NO: 347961 - DNA, 20 bp, human
ggctttactcccagcccgac

SEQ ID NO: 347962 - DNA, 20 bp, human
gactccttcgctcgtggggg

SEQ ID NO: 347963 - DNA, 20 bp, human
ggacagtcaggggtaggagc

SEQ ID NO: 347964 - DNA, 20 bp, human
gggagtggaccagtcgggct

SEQ ID NO: 347965 - DNA, 20 bp, human
gcacgcactccttcgctcgt

SEQ ID NO: 347966 - DNA, 20 bp, human
gcaggcgcccgagccctcat

SEQ ID NO: 347967 - DNA, 20 bp, human
gggcccagattctgccctgt

SEQ ID NO: 347968 - DNA, 20 bp, human
gtgggcggagaaacggtagc

SEQ ID NO: 347969 - DNA, 20 bp, human
ggcgcccgagccctcatggg

SEQ ID NO: 347970 - DNA, 20 bp, human
gtggactacacctcccatga

SEQ ID NO: 347971 - DNA, 20 bp, human
ggcgggacagcaataaaagg

SEQ ID NO: 347972 - DNA, 20 bp, human
gacacctcccatgagggctc

SEQ ID NO: 347973 - DNA, 20 bp, human
gtaccgtttctccgcccaca

SEQ ID NO: 347974 - DNA, 20 bp, human
gagctggactagaaaacctc

SEQ ID NO: 347975 - DNA, 20 bp, human
ggaggtgtagtccaagtttg

SEQ ID NO: 347976 - DNA, 20 bp, human
gcggtcgcgaggaaggtcca

SEQ ID NO: 347977 - DNA, 20 bp, human
ggtccagggtgaacgcgcgt

SEQ ID NO: 347978 - DNA, 20 bp, human
gtaggctgggagtccgcgtt

SEQ ID NO: 347979 - DNA, 20 bp, human
gcgcgcctgagtcgcaccag

SEQ ID NO: 347980 - DNA, 20 bp, human
gtctgccgctggtgcgactc

SEQ ID NO: 347981 - DNA, 20 bp, human
gccggcccacccactcggag

SEQ ID NO: 347982 - DNA, 20 bp, human
gcggagcggcctgcaagcca

SEQ ID NO: 347983 - DNA, 20 bp, human
gtcaggcgcggtcgcgagga

SEQ ID NO: 347984 - DNA, 20 bp, human
gccccggggcgggtccagtc

SEQ ID NO: 347985 - DNA, 20 bp, human
ggccagggagcgccccaacg

SEQ ID NO: 347986 - DNA, 20 bp, human
ggaagcccatcggggaagtg

SEQ ID NO: 347987 - DNA, 20 bp, human
ggacaggggcgtaattaaag

SEQ ID NO: 347988 - DNA, 20 bp, human
gtcggaggctgaaacactta

SEQ ID NO: 347989 - DNA, 20 bp, human
gtccccgatgggcttcatct

SEQ ID NO: 347990 - DNA, 20 bp, human
ggcgccaagatgaagcccat

SEQ ID NO: 347991 - DNA, 20 bp, human
gggggcggggccaacccggc

SEQ ID NO: 347992 - DNA, 20 bp, human
ggtagggcgcgtctttacgt

SEQ ID NO: 347993 - DNA, 20 bp, human
ggcccatcggggaagtgggg

SEQ ID NO: 347994 - DNA, 20 bp, human
gaaactccacgtattgcgta

SEQ ID NO: 347995 - DNA, 20 bp, human
gactaggaagcgccgcgaag

SEQ ID NO: 347996 - DNA, 20 bp, human
gagagcgcggggtgaccgcg

SEQ ID NO: 347997 - DNA, 20 bp, human
gggcggccagagtcggggag

SEQ ID NO: 347998 - DNA, 20 bp, human
gggtcaccccgcgctctcgc

SEQ ID NO: 347999 - DNA, 20 bp, human
ggaggcgcgcaccaaccacg

SEQ ID NO: 348000 - DNA, 20 bp, human
gcggtggcaccgcgccacgg

SEQ ID NO: 348001 - DNA, 20 bp, human
ggccacggcggccagagtcg

SEQ ID NO: 348002 - DNA, 20 bp, human
ggggagcggctgcaaagtgc

SEQ ID NO: 348003 - DNA, 20 bp, human
ggtagagcgcctgcgctcgg

SEQ ID NO: 348004 - DNA, 20 bp, human
gtccagggaccaccccggtc

SEQ ID NO: 348005 - DNA, 20 bp, human
ggggcgcgctcggggagtgt

SEQ ID NO: 348006 - DNA, 20 bp, human
gactctgagcgcagcgggag

SEQ ID NO: 348007 - DNA, 20 bp, human
gggtccgcgcgccttcttgc

SEQ ID NO: 348008 - DNA, 20 bp, human
gtggcctggcggtgcaggag

SEQ ID NO: 348009 - DNA, 20 bp, human
gcgggcctggcatggcgcca

SEQ ID NO: 348010 - DNA, 20 bp, human
gcccgctgcgctcagagtcc

SEQ ID NO: 348011 - DNA, 20 bp, human
gccgccggcaagaaggcgcg

SEQ ID NO: 348012 - DNA, 20 bp, human
gtccctgcgtcgggtgggtc

SEQ ID NO: 348013 - DNA, 20 bp, human
gcggccagggcacgagggaa

SEQ ID NO: 348014 - DNA, 20 bp, human
gggctgcggccagggcacga

SEQ ID NO: 348015 - DNA, 20 bp, human
gcgccaggccaggggtccgc

SEQ ID NO: 348016 - DNA, 20 bp, human
gcgcctgcgcaggtctctcc

SEQ ID NO: 348017 - DNA, 20 bp, human
gcggtgcccactagaagagg

SEQ ID NO: 348018 - DNA, 20 bp, human
gaatgtgggcgacctcacac

SEQ ID NO: 348019 - DNA, 20 bp, human
ggtgaggtcgcccacattcc

SEQ ID NO: 348020 - DNA, 20 bp, human
gggaagccgcctcttctagt

SEQ ID NO: 348021 - DNA, 20 bp, human
ggtcgcccacattccaggtg

SEQ ID NO: 348022 - DNA, 20 bp, human
ggactggagcggaggggagt

SEQ ID NO: 348023 - DNA, 20 bp, human
ggacagatcctgagcccacc

SEQ ID NO: 348024 - DNA, 20 bp, human
gagaggcggcttcctgtgtg

SEQ ID NO: 348025 - DNA, 20 bp, human
ggatctgtcccatcacgagt

SEQ ID NO: 348026 - DNA, 20 bp, human
ggacgaggagacagcgcctg

SEQ ID NO: 348027 - DNA, 20 bp, human
ggggacagagccctttctta

SEQ ID NO: 348028 - DNA, 20 bp, human
gcacccagctaaggaatcgg

SEQ ID NO: 348029 - DNA, 20 bp, human
gttaacctggtgagagacat

SEQ ID NO: 348030 - DNA, 20 bp, human
gcccaggcctagccagggct

SEQ ID NO: 348031 - DNA, 20 bp, human
gcctggcttctgcactgcta

SEQ ID NO: 348032 - DNA, 20 bp, human
gcgtcataggtgatggcaac

SEQ ID NO: 348033 - DNA, 20 bp, human
gtctcctccgattccttagc

SEQ ID NO: 348034 - DNA, 20 bp, human
gacccacatcagattggtag

SEQ ID NO: 348035 - DNA, 20 bp, human
gtggtgcgttggaagtgaaa

SEQ ID NO: 348036 - DNA, 20 bp, human
gaggggtagctcccgagcga

SEQ ID NO: 348037 - DNA, 20 bp, human
gaacgctaacccctcccctc

SEQ ID NO: 348038 - DNA, 20 bp, human
gtcgcgatccgcctctgctt

SEQ ID NO: 348039 - DNA, 20 bp, human
gccccggcgggcgcgcatcg

SEQ ID NO: 348040 - DNA, 20 bp, human
gcccgtgatgtcagccagag

SEQ ID NO: 348041 - DNA, 20 bp, human
ggccttcccgaccgaagcag

SEQ ID NO: 348042 - DNA, 20 bp, human
gcgtgcgctcgggctccgac

SEQ ID NO: 348043 - DNA, 20 bp, human
gttcccgaccgaagcagagg

SEQ ID NO: 348044 - DNA, 20 bp, human
gccagctggaaggcggccga

SEQ ID NO: 348045 - DNA, 20 bp, human
ggcgcgcatcgaggccagga

SEQ ID NO: 348046 - DNA, 20 bp, human
ggaatcccggggaggaacag

SEQ ID NO: 348047 - DNA, 20 bp, human
gaggaacaggggtggaatcc

SEQ ID NO: 348048 - DNA, 20 bp, human
ggggaactactcgggagcag

SEQ ID NO: 348049 - DNA, 20 bp, human
ggggcgaccttagaatcctg

SEQ ID NO: 348050 - DNA, 20 bp, human
gcgagaatggaatcccgggg

SEQ ID NO: 348051 - DNA, 20 bp, human
ggcggggcgtgggaactact

SEQ ID NO: 348052 - DNA, 20 bp, human
gagggggcgtggtttaacgc

SEQ ID NO: 348053 - DNA, 20 bp, human
gggagcgagaatggaatccc

SEQ ID NO: 348054 - DNA, 20 bp, human
gtcctggggaggagcgagaa

SEQ ID NO: 348055 - DNA, 20 bp, human
gggcgtggctagaccttagg

SEQ ID NO: 348056 - DNA, 20 bp, human
gcgcccggggatcagacggg

SEQ ID NO: 348057 - DNA, 20 bp, human
ggggcgcccgctctgagagt

SEQ ID NO: 348058 - DNA, 20 bp, human
gacgggaggtggagttgcgc

SEQ ID NO: 348059 - DNA, 20 bp, human
ggagacagggcttgcgcccg

SEQ ID NO: 348060 - DNA, 20 bp, human
gaggtggagttgcgcgggga

SEQ ID NO: 348061 - DNA, 20 bp, human
gccacctcccgtctgatccc

SEQ ID NO: 348062 - DNA, 20 bp, human
gcttgcgcccggggatcaga

SEQ ID NO: 348063 - DNA, 20 bp, human
gcaccccgccccacgcaaga

SEQ ID NO: 348064 - DNA, 20 bp, human
gcgggcgggtgccgagggga

SEQ ID NO: 348065 - DNA, 20 bp, human
gggcccccgtggacccgcga

SEQ ID NO: 348066 - DNA, 20 bp, human
gtatgtggaaggggctatga

SEQ ID NO: 348067 - DNA, 20 bp, human
gtacctgcgagtatgtggaa

SEQ ID NO: 348068 - DNA, 20 bp, human
gaaaggggcaaggcccttgt

SEQ ID NO: 348069 - DNA, 20 bp, human
ggaaggggctatgaagggag

SEQ ID NO: 348070 - DNA, 20 bp, human
gaggccaggccaggatgaaa

SEQ ID NO: 348071 - DNA, 20 bp, human
ggccccttccacatactcgc

SEQ ID NO: 348072 - DNA, 20 bp, human
gaggagggaaggacctgggt

SEQ ID NO: 348073 - DNA, 20 bp, human
gaggcaagggtggggactaa

SEQ ID NO: 348074 - DNA, 20 bp, human
gaaggcccttgtgggtagaa

SEQ ID NO: 348075 - DNA, 20 bp, human
gtaataggcgccagggaggg

SEQ ID NO: 348076 - DNA, 20 bp, human
gccgggcgaggaatccacgt

SEQ ID NO: 348077 - DNA, 20 bp, human
gaatccacgtgggctggtct

SEQ ID NO: 348078 - DNA, 20 bp, human
ggaggcgccgaatgagaaat

SEQ ID NO: 348079 - DNA, 20 bp, human
ggcgaggaatccacgtgggc

SEQ ID NO: 348080 - DNA, 20 bp, human
gcatgcgcaggctcctgttt

SEQ ID NO: 348081 - DNA, 20 bp, human
gcgccgaatgagaaatagga

SEQ ID NO: 348082 - DNA, 20 bp, human
gaatggaagcggaagcagcc

SEQ ID NO: 348083 - DNA, 20 bp, human
gatgcctgcgggctttgtaa

SEQ ID NO: 348084 - DNA, 20 bp, human
gcagggcagagcgcatgcgc

SEQ ID NO: 348085 - DNA, 20 bp, human
gtcccctcctatttctcatt

SEQ ID NO: 348086 - DNA, 20 bp, human
gaaggcccccgccttgggag

SEQ ID NO: 348087 - DNA, 20 bp, human
gtcaaactccgcctcggggc

SEQ ID NO: 348088 - DNA, 20 bp, human
gtaagaggcgccctgcagtg

SEQ ID NO: 348089 - DNA, 20 bp, human
gcggagaaggcccccgcctt

SEQ ID NO: 348090 - DNA, 20 bp, human
gcccccgggaagtgtctctg

SEQ ID NO: 348091 - DNA, 20 bp, human
ggtggtgcgcgaccccgtcc

SEQ ID NO: 348092 - DNA, 20 bp, human
gcccccgccttgggaggggt

SEQ ID NO: 348093 - DNA, 20 bp, human
gacagcgcgcgcgcccggga

SEQ ID NO: 348094 - DNA, 20 bp, human
gtcgcgttcaaactccgcct

SEQ ID NO: 348095 - DNA, 20 bp, human
gcaccccggagccacactgc

SEQ ID NO: 348096 - DNA, 20 bp, human
ggcaagaggcgatgagtata

SEQ ID NO: 348097 - DNA, 20 bp, human
gctactctgcgtgggaagga

SEQ ID NO: 348098 - DNA, 20 bp, human
gaatatcaaaagtgcgggag

SEQ ID NO: 348099 - DNA, 20 bp, human
gaatagggggcggaatcaaa

SEQ ID NO: 348100 - DNA, 20 bp, human
ggacgtccatccctggccaa

SEQ ID NO: 348101 - DNA, 20 bp, human
ggatgatagacgtccatccc

SEQ ID NO: 348102 - DNA, 20 bp, human
gccgaggggaggagtaacaa

SEQ ID NO: 348103 - DNA, 20 bp, human
ggtcaagtgtggaatctgag

SEQ ID NO: 348104 - DNA, 20 bp, human
ggaatctgagtggaggaata

SEQ ID NO: 348105 - DNA, 20 bp, human
gggggcggaatcaaaggggg

SEQ ID NO: 348106 - DNA, 20 bp, human
gacgtcacaaagctccgctg

SEQ ID NO: 348107 - DNA, 20 bp, human
ggcggggcggcgtcacgcgc

SEQ ID NO: 348108 - DNA, 20 bp, human
gtcacaaagctccgctgggg

SEQ ID NO: 348109 - DNA, 20 bp, human
gcccgcccgcagaggtcggc

SEQ ID NO: 348110 - DNA, 20 bp, human
gcgcgtccggccgacctctg

SEQ ID NO: 348111 - DNA, 20 bp, human
gtccccgggagcggagcccg

SEQ ID NO: 348112 - DNA, 20 bp, human
gactgcggcgaggaagtccc

SEQ ID NO: 348113 - DNA, 20 bp, human
ggacgcgcggtgcggacccc

SEQ ID NO: 348114 - DNA, 20 bp, human
ggccccaggcaggggagcgg

SEQ ID NO: 348115 - DNA, 20 bp, human
gacgcgcggggctgacccgg

SEQ ID NO: 348116 - DNA, 20 bp, human
ggggctggggactgtgtcag

SEQ ID NO: 348117 - DNA, 20 bp, human
ggggagcaggaggctctcgg

SEQ ID NO: 348118 - DNA, 20 bp, human
gctccccctgggacgtgaat

SEQ ID NO: 348119 - DNA, 20 bp, human
ggtgtggaggcactgacgca

SEQ ID NO: 348120 - DNA, 20 bp, human
gctcaactggcgttgggctg

SEQ ID NO: 348121 - DNA, 20 bp, human
gacccccggcaggtctcaac

SEQ ID NO: 348122 - DNA, 20 bp, human
gggcaggtctcaactggcgt

SEQ ID NO: 348123 - DNA, 20 bp, human
gggaagaggcagctgtaaca

SEQ ID NO: 348124 - DNA, 20 bp, human
gacatcgtctagaaatacga

SEQ ID NO: 348125 - DNA, 20 bp, human
gctgacgcatggctctgtct

SEQ ID NO: 348126 - DNA, 20 bp, human
gaggggatggcaactacccg

SEQ ID NO: 348127 - DNA, 20 bp, human
gtacccggggtccggaggcg

SEQ ID NO: 348128 - DNA, 20 bp, human
ggggctgcgagtgtcggggc

SEQ ID NO: 348129 - DNA, 20 bp, human
gtggtccagtcaccgacctg

SEQ ID NO: 348130 - DNA, 20 bp, human
ggggcagccctcggagaagt

SEQ ID NO: 348131 - DNA, 20 bp, human
gcggccccggagccgcaggt

SEQ ID NO: 348132 - DNA, 20 bp, human
ggccgcgggccgctctggaa

SEQ ID NO: 348133 - DNA, 20 bp, human
ggcaactacccggggtccgg

SEQ ID NO: 348134 - DNA, 20 bp, human
gggggcgagcgcttgggact

SEQ ID NO: 348135 - DNA, 20 bp, human
gtgactggaccagccgggaa

SEQ ID NO: 348136 - DNA, 20 bp, human
gcgccctcatcccggtgggg

SEQ ID NO: 348137 - DNA, 20 bp, human
gggccgccccaccgggatga

SEQ ID NO: 348138 - DNA, 20 bp, human
ggtctcgagcgcagaatcag

SEQ ID NO: 348139 - DNA, 20 bp, human
gggggcgcggaggagagcat

SEQ ID NO: 348140 - DNA, 20 bp, human
gtgagcgcaggcagaaacca

SEQ ID NO: 348141 - DNA, 20 bp, human
ggggatgagggcgctcaggc

SEQ ID NO: 348142 - DNA, 20 bp, human
gaagtggagaagcttcgcgt

SEQ ID NO: 348143 - DNA, 20 bp, human
gggggcggcccgcatggcca

SEQ ID NO: 348144 - DNA, 20 bp, human
gggcccctctgaatccccga

SEQ ID NO: 348145 - DNA, 20 bp, human
ggagcgccctcatcccggtg

SEQ ID NO: 348146 - DNA, 20 bp, human
gaggagggatatcacattac

SEQ ID NO: 348147 - DNA, 20 bp, human
gtggtggaaagcagctccca

SEQ ID NO: 348148 - DNA, 20 bp, human
gcactagactcccagaggcg

SEQ ID NO: 348149 - DNA, 20 bp, human
gccaccacggctcccaaact

SEQ ID NO: 348150 - DNA, 20 bp, human
gacacccctctgaccaatcc

SEQ ID NO: 348151 - DNA, 20 bp, human
gaggacagctggaggctaag

SEQ ID NO: 348152 - DNA, 20 bp, human
gtgagggcacaagcagctct

SEQ ID NO: 348153 - DNA, 20 bp, human
gctcctcctggattggtcag

SEQ ID NO: 348154 - DNA, 20 bp, human
ggaactctgcctgcccttta

SEQ ID NO: 348155 - DNA, 20 bp, human
ggcttctcgtcctcgcctct

SEQ ID NO: 348156 - DNA, 20 bp, human
ggacccagcgcagaacgtgt

SEQ ID NO: 348157 - DNA, 20 bp, human
ggggcggcgcgtgttgacag

SEQ ID NO: 348158 - DNA, 20 bp, human
gcatggcagccgcgaggcgg

SEQ ID NO: 348159 - DNA, 20 bp, human
ggcccccacacgttctgcgc

SEQ ID NO: 348160 - DNA, 20 bp, human
ggctaagggcaccgggtctg

SEQ ID NO: 348161 - DNA, 20 bp, human
gcaggcccatggcagccgcg

SEQ ID NO: 348162 - DNA, 20 bp, human
gcggcgctaggactccgggg

SEQ ID NO: 348163 - DNA, 20 bp, human
gtgggtcggcgctaggactc

SEQ ID NO: 348164 - DNA, 20 bp, human
gacccggtgcccttagctcc

SEQ ID NO: 348165 - DNA, 20 bp, human
gtctctggatctgaggatcc

SEQ ID NO: 348166 - DNA, 20 bp, human
ggggaccggggaaaagtgtg

SEQ ID NO: 348167 - DNA, 20 bp, human
gccccccgaggcgctccaat

SEQ ID NO: 348168 - DNA, 20 bp, human
ggccaattggagcgcctcgg

SEQ ID NO: 348169 - DNA, 20 bp, human
gccggggaaaagtgtgtggt

SEQ ID NO: 348170 - DNA, 20 bp, human
ggagcccgaggcgccgagag

SEQ ID NO: 348171 - DNA, 20 bp, human
gcggctctcgcgagtctggg

SEQ ID NO: 348172 - DNA, 20 bp, human
gcgcaccgtggggttgggac

SEQ ID NO: 348173 - DNA, 20 bp, human
ggaggcgctccaattggcgc

SEQ ID NO: 348174 - DNA, 20 bp, human
ggagcgcgcctcttgatgga

SEQ ID NO: 348175 - DNA, 20 bp, human
ggccgggcgccggcgccaat

SEQ ID NO: 348176 - DNA, 20 bp, human
gagtcggcggcgctaccgag

SEQ ID NO: 348177 - DNA, 20 bp, human
ggaaggagggctcctgaatg

SEQ ID NO: 348178 - DNA, 20 bp, human
gagagagcgtacttgtctca

SEQ ID NO: 348179 - DNA, 20 bp, human
gttgtctgactggaagagaa

SEQ ID NO: 348180 - DNA, 20 bp, human
gaggcgtgtacttggaagga

SEQ ID NO: 348181 - DNA, 20 bp, human
gtgaacccaacatggcccaa

SEQ ID NO: 348182 - DNA, 20 bp, human
gtatagacgccacgagtcgg

SEQ ID NO: 348183 - DNA, 20 bp, human
gatcgaaatagttgtctgac

SEQ ID NO: 348184 - DNA, 20 bp, human
gccatgttgggttcacgagt

SEQ ID NO: 348185 - DNA, 20 bp, human
gaaggaggcgtgtacttgga

SEQ ID NO: 348186 - DNA, 20 bp, human
gccagcgacgcccactgccc

SEQ ID NO: 348187 - DNA, 20 bp, human
ggcggggccagcaagctcgc

SEQ ID NO: 348188 - DNA, 20 bp, human
gtgggcgtcgctgggcgggg

SEQ ID NO: 348189 - DNA, 20 bp, human
gccgcccccgccaagagccc

SEQ ID NO: 348190 - DNA, 20 bp, human
ggcgccccctcgcggctaag

SEQ ID NO: 348191 - DNA, 20 bp, human
gactgcccgggctcttggcg

SEQ ID NO: 348192 - DNA, 20 bp, human
gcggggcgcgcgtgcacagg

SEQ ID NO: 348193 - DNA, 20 bp, human
ggggcgggaccagcgtgcgc

SEQ ID NO: 348194 - DNA, 20 bp, human
ggacacccccgcgagcttgc

SEQ ID NO: 348195 - DNA, 20 bp, human
ggaccagcgtgcgcaggggg

SEQ ID NO: 348196 - DNA, 20 bp, human
gggcggattccagccccgag

SEQ ID NO: 348197 - DNA, 20 bp, human
ggcacagccggtcccggctg

SEQ ID NO: 348198 - DNA, 20 bp, human
gccgccgcgctgtcccgctc

SEQ ID NO: 348199 - DNA, 20 bp, human
ggcgctgtcccgctcggggc

SEQ ID NO: 348200 - DNA, 20 bp, human
ggggagcgacgagtaagtgg

SEQ ID NO: 348201 - DNA, 20 bp, human
ggctgcggcacagccggtcc

SEQ ID NO: 348202 - DNA, 20 bp, human
ggcggggagcgacgagtaag

SEQ ID NO: 348203 - DNA, 20 bp, human
gtacggtgcggccccggacg

SEQ ID NO: 348204 - DNA, 20 bp, human
gacgccccctcggccacaaa

SEQ ID NO: 348205 - DNA, 20 bp, human
gtggcggcgcggtacggttt

SEQ ID NO: 348206 - DNA, 20 bp, human
gtggggccccaggccgtcgg

SEQ ID NO: 348207 - DNA, 20 bp, human
gcgatcctggcgtcccccga

SEQ ID NO: 348208 - DNA, 20 bp, human
ggggccccaatccagaggcc

SEQ ID NO: 348209 - DNA, 20 bp, human
gcagctggagggcgcgatcc

SEQ ID NO: 348210 - DNA, 20 bp, human
ggattggggccccaggccgt

SEQ ID NO: 348211 - DNA, 20 bp, human
gtgcaccagcgggtacagac

SEQ ID NO: 348212 - DNA, 20 bp, human
gtggcctgcgaggtgggacc

SEQ ID NO: 348213 - DNA, 20 bp, human
ggtggcgcctgcttgtctct

SEQ ID NO: 348214 - DNA, 20 bp, human
gctcccgggtcccacctcgc

SEQ ID NO: 348215 - DNA, 20 bp, human
gccgcagaggggctcatggg

SEQ ID NO: 348216 - DNA, 20 bp, human
gggatcccggggcgcgagag

SEQ ID NO: 348217 - DNA, 20 bp, human
gcggggcgcgagagaggcga

SEQ ID NO: 348218 - DNA, 20 bp, human
gggagagggtgtctatccgg

SEQ ID NO: 348219 - DNA, 20 bp, human
ggccggagagggtgtctatc

SEQ ID NO: 348220 - DNA, 20 bp, human
gcttcccgggacctacacgt

SEQ ID NO: 348221 - DNA, 20 bp, human
gagaggcgagggccggcggt

SEQ ID NO: 348222 - DNA, 20 bp, human
ggaccccacgtgtaggtccc

SEQ ID NO: 348223 - DNA, 20 bp, human
gcaggaggagcgcgggtcag

SEQ ID NO: 348224 - DNA, 20 bp, human
gcggccgcgcccggattcgc

SEQ ID NO: 348225 - DNA, 20 bp, human
gaggggaccgcgtgccggag

SEQ ID NO: 348226 - DNA, 20 bp, human
gcgactggagggcggaactc

SEQ ID NO: 348227 - DNA, 20 bp, human
gtcctccgctcgcgactgga

SEQ ID NO: 348228 - DNA, 20 bp, human
gcgtccgggcgaccaatcag

SEQ ID NO: 348229 - DNA, 20 bp, human
gcgggcacgcggcctggctc

SEQ ID NO: 348230 - DNA, 20 bp, human
gccgcccgggagatatccgc

SEQ ID NO: 348231 - DNA, 20 bp, human
gaatcagtggccaggatctc

SEQ ID NO: 348232 - DNA, 20 bp, human
gtccgctcgcgactggaggg

SEQ ID NO: 348233 - DNA, 20 bp, human
gtccgccctccagtcgcgag

SEQ ID NO: 348234 - DNA, 20 bp, human
gtcacgccaagctgccacag

SEQ ID NO: 348235 - DNA, 20 bp, human
gcctggctcgggccgcggat

SEQ ID NO: 348236 - DNA, 20 bp, human
gtaaccaatcggcgagggtg

SEQ ID NO: 348237 - DNA, 20 bp, human
gcccagtaaccaatcggcga

SEQ ID NO: 348238 - DNA, 20 bp, human
gcgggccaataagcagcgag

SEQ ID NO: 348239 - DNA, 20 bp, human
gcggggcgcggcctgtggat

SEQ ID NO: 348240 - DNA, 20 bp, human
gggctgagagaaactggggg

SEQ ID NO: 348241 - DNA, 20 bp, human
gcaatcggcgagggtgggga

SEQ ID NO: 348242 - DNA, 20 bp, human
ggggaggcgagtcctattgg

SEQ ID NO: 348243 - DNA, 20 bp, human
gacggggaggcgagtcctat

SEQ ID NO: 348244 - DNA, 20 bp, human
gtgggacggcacactccggc

SEQ ID NO: 348245 - DNA, 20 bp, human
gtactcgcgctcggagaggc

SEQ ID NO: 348246 - DNA, 20 bp, human
gaggagccacagggttgaat

SEQ ID NO: 348247 - DNA, 20 bp, human
ggcgccaaattgttgaggtg

SEQ ID NO: 348248 - DNA, 20 bp, human
gaacaggttgcaagtcattg

SEQ ID NO: 348249 - DNA, 20 bp, human
ggctgggaggtgcctgacca

SEQ ID NO: 348250 - DNA, 20 bp, human
gaactgggggaccctctagg

SEQ ID NO: 348251 - DNA, 20 bp, human
gtgctgttcccaatctgcag

SEQ ID NO: 348252 - DNA, 20 bp, human
gtacaaagccacttctttgc

SEQ ID NO: 348253 - DNA, 20 bp, human
gaagccacttctttgctggg

SEQ ID NO: 348254 - DNA, 20 bp, human
gtctgcaaacaccgcctaga

SEQ ID NO: 348255 - DNA, 20 bp, human
gcagctcctattcaaccctg

SEQ ID NO: 348256 - DNA, 20 bp, human
gagaaccagagcatagggcc

SEQ ID NO: 348257 - DNA, 20 bp, human
ggagttctttatatagtcta

SEQ ID NO: 348258 - DNA, 20 bp, human
gcgtatcgcgtatctaatga

SEQ ID NO: 348259 - DNA, 20 bp, human
gatgtgagaaccagagcata

SEQ ID NO: 348260 - DNA, 20 bp, human
gctttatatagtctagggac

SEQ ID NO: 348261 - DNA, 20 bp, human
ggaatcttttgccaagtctc

SEQ ID NO: 348262 - DNA, 20 bp, human
gtattcttatagtaaatgat

SEQ ID NO: 348263 - DNA, 20 bp, human
gaaaaacatttgtaccttaa

SEQ ID NO: 348264 - DNA, 20 bp, human
gtgtcttatcagtttaatga

SEQ ID NO: 348265 - DNA, 20 bp, human
gttaatgatggtgtccttta

SEQ ID NO: 348266 - DNA, 20 bp, human
ggctctggcgcccggcactg

SEQ ID NO: 348267 - DNA, 20 bp, human
gggacaggtcgctgccgcct

SEQ ID NO: 348268 - DNA, 20 bp, human
gggcaagcccggcagaaagt

SEQ ID NO: 348269 - DNA, 20 bp, human
gtctctggtgtagtccgagg

SEQ ID NO: 348270 - DNA, 20 bp, human
gctggcaggagcggccacga

SEQ ID NO: 348271 - DNA, 20 bp, human
gcggcggcacacgcgaacgc

SEQ ID NO: 348272 - DNA, 20 bp, human
gaaagtgggagcgactggag

SEQ ID NO: 348273 - DNA, 20 bp, human
ggcacacgcgaacgccggga

SEQ ID NO: 348274 - DNA, 20 bp, human
gagatctctggtgtagtccg

SEQ ID NO: 348275 - DNA, 20 bp, human
ggccggtcccaggaacccga

SEQ ID NO: 348276 - DNA, 20 bp, human
gcaagctggggcggtgccaa

SEQ ID NO: 348277 - DNA, 20 bp, human
gacaggaggacgtctgtgta

SEQ ID NO: 348278 - DNA, 20 bp, human
ggtgtagggaagcacgtcgt

SEQ ID NO: 348279 - DNA, 20 bp, human
gggagggcagaggaagtgcc

SEQ ID NO: 348280 - DNA, 20 bp, human
ggaggctctggggccgcagt

SEQ ID NO: 348281 - DNA, 20 bp, human
gtctggggccgcagtgggct

SEQ ID NO: 348282 - DNA, 20 bp, human
gttgaaagctgctggcgcgg

SEQ ID NO: 348283 - DNA, 20 bp, human
gctgcactcccaccgcgtcc

SEQ ID NO: 348284 - DNA, 20 bp, human
gcccacccccgagcccactg

SEQ ID NO: 348285 - DNA, 20 bp, human
gtgccaagggctggcaagtg

SEQ ID NO: 348286 - DNA, 20 bp, human
gggactggactgatggtaga

SEQ ID NO: 348287 - DNA, 20 bp, human
gagcaggcagagtgctggat

SEQ ID NO: 348288 - DNA, 20 bp, human
gtggagctccccagcctcaa

SEQ ID NO: 348289 - DNA, 20 bp, human
gggactgatggtagagggga

SEQ ID NO: 348290 - DNA, 20 bp, human
gtggagggttggatacaaga

SEQ ID NO: 348291 - DNA, 20 bp, human
ggctcagggagctattttga

SEQ ID NO: 348292 - DNA, 20 bp, human
ggtgcaaggcctggaggaag

SEQ ID NO: 348293 - DNA, 20 bp, human
gccgcctcccctgcaatggg

SEQ ID NO: 348294 - DNA, 20 bp, human
gccaagaccctcccattgca

SEQ ID NO: 348295 - DNA, 20 bp, human
gccagtcttggcggcccaag

SEQ ID NO: 348296 - DNA, 20 bp, human
gcgcctcttgctccaagccg

SEQ ID NO: 348297 - DNA, 20 bp, human
gaggcgcgcgcgggccgtgg

SEQ ID NO: 348298 - DNA, 20 bp, human
gcgcggggacgggcttcggg

SEQ ID NO: 348299 - DNA, 20 bp, human
gaggcgcgcgctgcccaccc

SEQ ID NO: 348300 - DNA, 20 bp, human
ggctccaagccggggctcgc

SEQ ID NO: 348301 - DNA, 20 bp, human
gccagagcgggttttacagg

SEQ ID NO: 348302 - DNA, 20 bp, human
gggagctggagagttctcgg

SEQ ID NO: 348303 - DNA, 20 bp, human
gtgtaaaacccgctctgggg

SEQ ID NO: 348304 - DNA, 20 bp, human
ggggcccgcgagccccggct

SEQ ID NO: 348305 - DNA, 20 bp, human
gacccgggctgcaagagccg

SEQ ID NO: 348306 - DNA, 20 bp, human
gagccgaaggcgcacccggg

SEQ ID NO: 348307 - DNA, 20 bp, human
gctgccggaccgtaccatcc

SEQ ID NO: 348308 - DNA, 20 bp, human
ggcccacaccagctcaccga

SEQ ID NO: 348309 - DNA, 20 bp, human
gggcctcccgggtgcgcctt

SEQ ID NO: 348310 - DNA, 20 bp, human
gccactgagcgctgcgggga

SEQ ID NO: 348311 - DNA, 20 bp, human
gtaccacggcaccacgcgag

SEQ ID NO: 348312 - DNA, 20 bp, human
gccgcagcgctcagtggtgg

SEQ ID NO: 348313 - DNA, 20 bp, human
gctgccgcccctcggtgagc

SEQ ID NO: 348314 - DNA, 20 bp, human
gcgcccgggatggtacggtc

SEQ ID NO: 348315 - DNA, 20 bp, human
gagacgctacgcctgaaaac

SEQ ID NO: 348316 - DNA, 20 bp, human
gtctccccctgcaaccgcac

SEQ ID NO: 348317 - DNA, 20 bp, human
ggaaagcaaaaaatatgggt

SEQ ID NO: 348318 - DNA, 20 bp, human
ggacttacatgtgggacatt

SEQ ID NO: 348319 - DNA, 20 bp, human
gctttcctgtgcggttgcag

SEQ ID NO: 348320 - DNA, 20 bp, human
gtgaacagtttctttcctgt

SEQ ID NO: 348321 - DNA, 20 bp, human
gataactgggtgaatgcttc

SEQ ID NO: 348322 - DNA, 20 bp, human
ggttaagaaagttctaagat

SEQ ID NO: 348323 - DNA, 20 bp, human
gttgtcaactattaataact

SEQ ID NO: 348324 - DNA, 20 bp, human
gcaatcattcatcggaatag

SEQ ID NO: 348325 - DNA, 20 bp, human
ggtcaaatatgagagaagca

SEQ ID NO: 348326 - DNA, 20 bp, human
gggattatctggtaaggcac

SEQ ID NO: 348327 - DNA, 20 bp, human
ggaagcaacgaattgtctcg

SEQ ID NO: 348328 - DNA, 20 bp, human
gtaccagataatccgaccta

SEQ ID NO: 348329 - DNA, 20 bp, human
gccgaaacgcagccggcagc

SEQ ID NO: 348330 - DNA, 20 bp, human
gtgagctcccgagcacccgt

SEQ ID NO: 348331 - DNA, 20 bp, human
gtcatggaataactacattc

SEQ ID NO: 348332 - DNA, 20 bp, human
gggggtcaggatgttcccga

SEQ ID NO: 348333 - DNA, 20 bp, human
ggtgaacggtggcaatcaag

SEQ ID NO: 348334 - DNA, 20 bp, human
gtgtttctgcgagaaattag

SEQ ID NO: 348335 - DNA, 20 bp, human
ggttgcttccgaaacgcagc

SEQ ID NO: 348336 - DNA, 20 bp, human
ggccaagaatgcatggtgga

SEQ ID NO: 348337 - DNA, 20 bp, human
gtgagaaggtagatgcacag

SEQ ID NO: 348338 - DNA, 20 bp, human
ggtgacaccgcctggttaat

SEQ ID NO: 348339 - DNA, 20 bp, human
gccactggggttcctatgtc

SEQ ID NO: 348340 - DNA, 20 bp, human
gctaggcacggggtggagca

SEQ ID NO: 348341 - DNA, 20 bp, human
gtgtggccaagaatgcatgg

SEQ ID NO: 348342 - DNA, 20 bp, human
gggagtgttgcctattaacc

SEQ ID NO: 348343 - DNA, 20 bp, human
ggcctgtggccaagaatgca

SEQ ID NO: 348344 - DNA, 20 bp, human
gtccaggatgcaggggataa

SEQ ID NO: 348345 - DNA, 20 bp, human
ggcaaaactgacaatccact

SEQ ID NO: 348346 - DNA, 20 bp, human
gctgccctggggctgtcctc

SEQ ID NO: 348347 - DNA, 20 bp, human
gcgcccgtgggaaaagcagt

SEQ ID NO: 348348 - DNA, 20 bp, human
gggcgtcatctatagtccgg

SEQ ID NO: 348349 - DNA, 20 bp, human
gaacgctgccgaggagtagg

SEQ ID NO: 348350 - DNA, 20 bp, human
gggactatagatgacgcccg

SEQ ID NO: 348351 - DNA, 20 bp, human
gaagccgggagctcggccac

SEQ ID NO: 348352 - DNA, 20 bp, human
gttgtagtctggtaaggcgg

SEQ ID NO: 348353 - DNA, 20 bp, human
ggcccgccccgcctactcct

SEQ ID NO: 348354 - DNA, 20 bp, human
gggaaacgctgccgaggagt

SEQ ID NO: 348355 - DNA, 20 bp, human
gctaactccctacaactctg

SEQ ID NO: 348356 - DNA, 20 bp, human
gaactcttgccccccaagag

SEQ ID NO: 348357 - DNA, 20 bp, human
gggccccgccccctgactca

SEQ ID NO: 348358 - DNA, 20 bp, human
gggcagctgctgtagccccg

SEQ ID NO: 348359 - DNA, 20 bp, human
gacagactgccactcttggg

SEQ ID NO: 348360 - DNA, 20 bp, human
ggcgacggcgctgatggctg

SEQ ID NO: 348361 - DNA, 20 bp, human
gtggagcgtctggcactggg

SEQ ID NO: 348362 - DNA, 20 bp, human
gcagacagactgccactctt

SEQ ID NO: 348363 - DNA, 20 bp, human
ggggctcttaacttgccgtt

SEQ ID NO: 348364 - DNA, 20 bp, human
gaggcactgggggcgcccga

SEQ ID NO: 348365 - DNA, 20 bp, human
gtgtctggagcgtctggcac

SEQ ID NO: 348366 - DNA, 20 bp, human
gttgaaggttccttatcagg

SEQ ID NO: 348367 - DNA, 20 bp, human
ggatgctgacaaagaatgtc

SEQ ID NO: 348368 - DNA, 20 bp, human
gtgtcaaagctcattctaaa

SEQ ID NO: 348369 - DNA, 20 bp, human
gtgagcacagattccctaaa

SEQ ID NO: 348370 - DNA, 20 bp, human
ggagagtaatgaccctttta

SEQ ID NO: 348371 - DNA, 20 bp, human
gaggttgaaggttccttatc

SEQ ID NO: 348372 - DNA, 20 bp, human
gtaaattctgataggtactg

SEQ ID NO: 348373 - DNA, 20 bp, human
ggaactctattcagaggcct

SEQ ID NO: 348374 - DNA, 20 bp, human
gccttacaagcaggtgacaa

SEQ ID NO: 348375 - DNA, 20 bp, human
ggcattgcagattcatttct

SEQ ID NO: 348376 - DNA, 20 bp, human
gcctccggggagagccaatg

SEQ ID NO: 348377 - DNA, 20 bp, human
gagccaatggggtccttcct

SEQ ID NO: 348378 - DNA, 20 bp, human
gcgccaaggaaggaccccat

SEQ ID NO: 348379 - DNA, 20 bp, human
gcaagttcccagttccacgg

SEQ ID NO: 348380 - DNA, 20 bp, human
ggacaaaccggcctttccgg

SEQ ID NO: 348381 - DNA, 20 bp, human
gccgccctgtgttgtttaaa

SEQ ID NO: 348382 - DNA, 20 bp, human
gtgaatgccgacctgcagac

SEQ ID NO: 348383 - DNA, 20 bp, human
gatcccctttaaacaacaca

SEQ ID NO: 348384 - DNA, 20 bp, human
gggtccttccttggcgggag

SEQ ID NO: 348385 - DNA, 20 bp, human
gaatgagagtgaagcctccg

SEQ ID NO: 348386 - DNA, 20 bp, human
ggggcgccccgccacccgga

SEQ ID NO: 348387 - DNA, 20 bp, human
ggcccctgggacggggacat

SEQ ID NO: 348388 - DNA, 20 bp, human
ggccgggctaagggcgagga

SEQ ID NO: 348389 - DNA, 20 bp, human
gccacccgccagcaagtgct

SEQ ID NO: 348390 - DNA, 20 bp, human
gtcgccgatgtccccgtccc

SEQ ID NO: 348391 - DNA, 20 bp, human
ggccgaagttacagtccctc

SEQ ID NO: 348392 - DNA, 20 bp, human
gccggccaaccccgccaaga

SEQ ID NO: 348393 - DNA, 20 bp, human
ggccgccgcgcgttccctct

SEQ ID NO: 348394 - DNA, 20 bp, human
gtagcgcgctgccacgctcg

SEQ ID NO: 348395 - DNA, 20 bp, human
gcagcaagtgctgggcctcg

SEQ ID NO: 348396 - DNA, 20 bp, human
ggccggccgggacccgctaa

SEQ ID NO: 348397 - DNA, 20 bp, human
gcgcgcagggcggccgttag

SEQ ID NO: 348398 - DNA, 20 bp, human
ggcccgccgccccgcgaccg

SEQ ID NO: 348399 - DNA, 20 bp, human
ggccgttagcgggtcccggc

SEQ ID NO: 348400 - DNA, 20 bp, human
gcggcggctgccccggtcgc

SEQ ID NO: 348401 - DNA, 20 bp, human
ggagttcgcctcagttcagg

SEQ ID NO: 348402 - DNA, 20 bp, human
ggggcctgggcgcaaggact

SEQ ID NO: 348403 - DNA, 20 bp, human
ggaggagcgcagtcggagcg

SEQ ID NO: 348404 - DNA, 20 bp, human
ggcggagttcgcctcagttc

SEQ ID NO: 348405 - DNA, 20 bp, human
gcaggcgagaggaattccag

SEQ ID NO: 348406 - DNA, 20 bp, human
gcggaccttcgcaaaccccg

SEQ ID NO: 348407 - DNA, 20 bp, human
gccagccccggggtttgcga

SEQ ID NO: 348408 - DNA, 20 bp, human
gacgcggcgggaggctaccc

SEQ ID NO: 348409 - DNA, 20 bp, human
gtgcgaaggtccggggtagg

SEQ ID NO: 348410 - DNA, 20 bp, human
ggtttgcgaaggtccggggt

SEQ ID NO: 348411 - DNA, 20 bp, human
ggcctcccgccgcgtcgcgc

SEQ ID NO: 348412 - DNA, 20 bp, human
gtggccgcctttgttagctt

SEQ ID NO: 348413 - DNA, 20 bp, human
ggcgggcgcagtcgacccaa

SEQ ID NO: 348414 - DNA, 20 bp, human
gggcgcagtcgacccaaggg

SEQ ID NO: 348415 - DNA, 20 bp, human
gcccggggctgggcggccct

SEQ ID NO: 348416 - DNA, 20 bp, human
ggaaccaaccccaataccta

SEQ ID NO: 348417 - DNA, 20 bp, human
gagaatggcacgacccaaat

SEQ ID NO: 348418 - DNA, 20 bp, human
gcccctgcctacatccggaa

SEQ ID NO: 348419 - DNA, 20 bp, human
gctcccttaggtattggggt

SEQ ID NO: 348420 - DNA, 20 bp, human
gccagcctcccttaggtatt

SEQ ID NO: 348421 - DNA, 20 bp, human
gttgggtcgtgccattctca

SEQ ID NO: 348422 - DNA, 20 bp, human
ggcgaaaccaataagaacta

SEQ ID NO: 348423 - DNA, 20 bp, human
ggaagtaggctccgccttag

SEQ ID NO: 348424 - DNA, 20 bp, human
gtcgctgctcgctgtggggt

SEQ ID NO: 348425 - DNA, 20 bp, human
gaacgcgtcccagagggaag

SEQ ID NO: 348426 - DNA, 20 bp, human
gggccctgaaagtcagagga

SEQ ID NO: 348427 - DNA, 20 bp, human
gggcaggcaggcattttgga

SEQ ID NO: 348428 - DNA, 20 bp, human
ggggcctcgggctccttcac

SEQ ID NO: 348429 - DNA, 20 bp, human
gtgggtgttgggtgagaaca

SEQ ID NO: 348430 - DNA, 20 bp, human
gccctcctggccctaaccca

SEQ ID NO: 348431 - DNA, 20 bp, human
gggccggctgacagcttgat

SEQ ID NO: 348432 - DNA, 20 bp, human
gagcaggccctgaaagtcag

SEQ ID NO: 348433 - DNA, 20 bp, human
ggctgaggaatctgcaggcc

SEQ ID NO: 348434 - DNA, 20 bp, human
gtgcctgcctgccctcacca

SEQ ID NO: 348435 - DNA, 20 bp, human
gagcatgtgctccctggtga

SEQ ID NO: 348436 - DNA, 20 bp, human
gaagatctaggggtcccagg

SEQ ID NO: 348437 - DNA, 20 bp, human
gggtcccaggggggggactg

SEQ ID NO: 348438 - DNA, 20 bp, human
gccatcagcctcaagatcta

SEQ ID NO: 348439 - DNA, 20 bp, human
gggccagttcccagtttcac

SEQ ID NO: 348440 - DNA, 20 bp, human
ggggactgcggtgaggaagg

SEQ ID NO: 348441 - DNA, 20 bp, human
gtcaccgcagtcccccccct

SEQ ID NO: 348442 - DNA, 20 bp, human
gctcaagatctaggggtccc

SEQ ID NO: 348443 - DNA, 20 bp, human
ggtgggcttgatgagatcac

SEQ ID NO: 348444 - DNA, 20 bp, human
gggcagccctggtggacagc

SEQ ID NO: 348445 - DNA, 20 bp, human
ggacagtgacccctgacagc

SEQ ID NO: 348446 - DNA, 20 bp, human
gctgtcccggggaaacattt

SEQ ID NO: 348447 - DNA, 20 bp, human
gacgctgccagcctgtcccg

SEQ ID NO: 348448 - DNA, 20 bp, human
ggggactgcaggagaagaac

SEQ ID NO: 348449 - DNA, 20 bp, human
gtgcccaggcacgcagatcg

SEQ ID NO: 348450 - DNA, 20 bp, human
gggcgcccagcggcaggaag

SEQ ID NO: 348451 - DNA, 20 bp, human
gcagcgtagatgtgagcagg

SEQ ID NO: 348452 - DNA, 20 bp, human
gccagcactgctcggaagcc

SEQ ID NO: 348453 - DNA, 20 bp, human
ggatcctgctaataaaacag

SEQ ID NO: 348454 - DNA, 20 bp, human
ggaagaggaagtagatcagg

SEQ ID NO: 348455 - DNA, 20 bp, human
gggagaagaaccggcctaac

SEQ ID NO: 348456 - DNA, 20 bp, human
gccgcccagcgcctttctca

SEQ ID NO: 348457 - DNA, 20 bp, human
ggcagcaagttggtgagcca

SEQ ID NO: 348458 - DNA, 20 bp, human
gaagtcttccctcgccctga

SEQ ID NO: 348459 - DNA, 20 bp, human
gcatgccctgagaaaggcgc

SEQ ID NO: 348460 - DNA, 20 bp, human
gtccccgcaccctcagggcg

SEQ ID NO: 348461 - DNA, 20 bp, human
ggggtgcggggaagcggcgt

SEQ ID NO: 348462 - DNA, 20 bp, human
ggcgttggcgccactgaagc

SEQ ID NO: 348463 - DNA, 20 bp, human
gttccctcgccctgagggtg

SEQ ID NO: 348464 - DNA, 20 bp, human
ggccgcttccccgcaccctc

SEQ ID NO: 348465 - DNA, 20 bp, human
ggggtgaagggtgggtacgc

SEQ ID NO: 348466 - DNA, 20 bp, human
gagagcggatagtggatcct

SEQ ID NO: 348467 - DNA, 20 bp, human
gtggcctagtagtggagtct

SEQ ID NO: 348468 - DNA, 20 bp, human
gtggccgctagagcggatag

SEQ ID NO: 348469 - DNA, 20 bp, human
gaggcagtcccagatctcgc

SEQ ID NO: 348470 - DNA, 20 bp, human
ggcgagccgctccataccct

SEQ ID NO: 348471 - DNA, 20 bp, human
gaaagtgaacgcttcagcag

SEQ ID NO: 348472 - DNA, 20 bp, human
ggtggagtctcggaaggcta

SEQ ID NO: 348473 - DNA, 20 bp, human
ggggcgtgctcgaccaaagg

SEQ ID NO: 348474 - DNA, 20 bp, human
gccgtggcttggcctagtag

SEQ ID NO: 348475 - DNA, 20 bp, human
ggatagtggatcctagggta

SEQ ID NO: 348476 - DNA, 20 bp, human
ggcagcgagcggctgggctc

SEQ ID NO: 348477 - DNA, 20 bp, human
gggctgggctcgggcgacga

SEQ ID NO: 348478 - DNA, 20 bp, human
gatgctgaacgagctccgga

SEQ ID NO: 348479 - DNA, 20 bp, human
ggggagaagcgcaggggcgt

SEQ ID NO: 348480 - DNA, 20 bp, human
gcgccccgggagaagcgcag

SEQ ID NO: 348481 - DNA, 20 bp, human
gccggacggactgcagcgag

SEQ ID NO: 348482 - DNA, 20 bp, human
gcggactgcagcgagcggct

SEQ ID NO: 348483 - DNA, 20 bp, human
ggagggctggaagtcgatcc

SEQ ID NO: 348484 - DNA, 20 bp, human
gcccacctctggcgtgccga

SEQ ID NO: 348485 - DNA, 20 bp, human
gagcggaggcgcagattccc

SEQ ID NO: 348486 - DNA, 20 bp, human
ggacagggcagggatctagg

SEQ ID NO: 348487 - DNA, 20 bp, human
gccaagtactcggtgttgaa

SEQ ID NO: 348488 - DNA, 20 bp, human
gcccggcggctaaggagagc

SEQ ID NO: 348489 - DNA, 20 bp, human
gtgtctgcttgtcccgccga

SEQ ID NO: 348490 - DNA, 20 bp, human
ggcggctaaggagagcgggc

SEQ ID NO: 348491 - DNA, 20 bp, human
ggggcggggcattaaaaagc

SEQ ID NO: 348492 - DNA, 20 bp, human
gtaaggagagcgggcaggca

SEQ ID NO: 348493 - DNA, 20 bp, human
gaaagccatcccggcggcta

SEQ ID NO: 348494 - DNA, 20 bp, human
gcaggacagggcagggatct

SEQ ID NO: 348495 - DNA, 20 bp, human
gccagggtcgcggcggcagt

SEQ ID NO: 348496 - DNA, 20 bp, human
gcggccgctgcgccccatgt

SEQ ID NO: 348497 - DNA, 20 bp, human
gagtgcggacagctcccttc

SEQ ID NO: 348498 - DNA, 20 bp, human
gcactcgccgcggcccgcgt

SEQ ID NO: 348499 - DNA, 20 bp, human
gtcgccgcgagtcccggccg

SEQ ID NO: 348500 - DNA, 20 bp, human
gagcagcgggggatcctcca

SEQ ID NO: 348501 - DNA, 20 bp, human
ggcggaaggcgggaagtctg

SEQ ID NO: 348502 - DNA, 20 bp, human
gccgctgcgccccatgttgg

SEQ ID NO: 348503 - DNA, 20 bp, human
gtgctcgccggggccatgtg

SEQ ID NO: 348504 - DNA, 20 bp, human
ggcttcgcgagggacagttg

SEQ ID NO: 348505 - DNA, 20 bp, human
gtggctatcgccccgcgcgg

SEQ ID NO: 348506 - DNA, 20 bp, human
gatggctcaccacccggcca

SEQ ID NO: 348507 - DNA, 20 bp, human
ggtggctgggccggcctcgg

SEQ ID NO: 348508 - DNA, 20 bp, human
ggaggtgtacagtccggtaa

SEQ ID NO: 348509 - DNA, 20 bp, human
gtcggcggaccgcgaaagga

SEQ ID NO: 348510 - DNA, 20 bp, human
gggcctcggcggaccgcgaa

SEQ ID NO: 348511 - DNA, 20 bp, human
gcccccgtatccaacggaag

SEQ ID NO: 348512 - DNA, 20 bp, human
ggtggtgagccatcctttcg

SEQ ID NO: 348513 - DNA, 20 bp, human
gcctgcctccgcccgcaagg

SEQ ID NO: 348514 - DNA, 20 bp, human
gcctcggagcagcgcgaccc

SEQ ID NO: 348515 - DNA, 20 bp, human
gcaacggaagaggagtccgt

SEQ ID NO: 348516 - DNA, 20 bp, human
gagggcggggtcagacgtga

SEQ ID NO: 348517 - DNA, 20 bp, human
ggggcggggctgccacgcat

SEQ ID NO: 348518 - DNA, 20 bp, human
ggggcggggcggaacagaac

SEQ ID NO: 348519 - DNA, 20 bp, human
ggggctgccacgcatgggcg

SEQ ID NO: 348520 - DNA, 20 bp, human
gggcgtcatcagactcttgg

SEQ ID NO: 348521 - DNA, 20 bp, human
ggcgccggcgcacgtgacgg

SEQ ID NO: 348522 - DNA, 20 bp, human
gcgcagcccgggaatcggag

SEQ ID NO: 348523 - DNA, 20 bp, human
gtggcgcgcagcccgggaat

SEQ ID NO: 348524 - DNA, 20 bp, human
gaacagaactgggcgcgcgg

SEQ ID NO: 348525 - DNA, 20 bp, human
gggggtcagacgtgaggggg

SEQ ID NO: 348526 - DNA, 20 bp, human
ggagcccgggaaagcgtcgg

SEQ ID NO: 348527 - DNA, 20 bp, human
gatccgtggggccgactcca

SEQ ID NO: 348528 - DNA, 20 bp, human
gcgtcgggggaccatggcaa

SEQ ID NO: 348529 - DNA, 20 bp, human
gggcccgggcaggcgagctg

SEQ ID NO: 348530 - DNA, 20 bp, human
gctggagcccgggaaagcgt

SEQ ID NO: 348531 - DNA, 20 bp, human
gttgactgtcggaaccacgt

SEQ ID NO: 348532 - DNA, 20 bp, human
gatggcgggagcagctaccc

SEQ ID NO: 348533 - DNA, 20 bp, human
gccaccagccgcatgatccg

SEQ ID NO: 348534 - DNA, 20 bp, human
gcgaagaatcagaattgaac

SEQ ID NO: 348535 - DNA, 20 bp, human
ggtgaccacgcgatccgttc

SEQ ID NO: 348536 - DNA, 20 bp, human
gggcctgcgcagagcctcgt

SEQ ID NO: 348537 - DNA, 20 bp, human
ggtaactgagccaacgcgag

SEQ ID NO: 348538 - DNA, 20 bp, human
gctgcgcaggccgctcgcgt

SEQ ID NO: 348539 - DNA, 20 bp, human
gttgatgacggcaagagcga

SEQ ID NO: 348540 - DNA, 20 bp, human
gctcccacgaggctctgcgc

SEQ ID NO: 348541 - DNA, 20 bp, human
ggggacctctgccgttgcta

SEQ ID NO: 348542 - DNA, 20 bp, human
gcgtgggagtggtggttcga

SEQ ID NO: 348543 - DNA, 20 bp, human
gcagagcctcgtgggagtgg

SEQ ID NO: 348544 - DNA, 20 bp, human
ggctgcctccgggtcacgct

SEQ ID NO: 348545 - DNA, 20 bp, human
gttcaagcgagccttgatga

SEQ ID NO: 348546 - DNA, 20 bp, human
gttacaagactgtgccaaca

SEQ ID NO: 348547 - DNA, 20 bp, human
ggggggaggtaacgcaggaa

SEQ ID NO: 348548 - DNA, 20 bp, human
gtaggagaagcggtttgtgt

SEQ ID NO: 348549 - DNA, 20 bp, human
gcagcggcccgggtctctct

SEQ ID NO: 348550 - DNA, 20 bp, human
gggcctgggggaggtaacgc

SEQ ID NO: 348551 - DNA, 20 bp, human
gttcttgtcacctattggga

SEQ ID NO: 348552 - DNA, 20 bp, human
ggagaagcggtttgtgttgg

SEQ ID NO: 348553 - DNA, 20 bp, human
gaggtgcgccccctcccaat

SEQ ID NO: 348554 - DNA, 20 bp, human
ggagacgcagcgccaccgcg

SEQ ID NO: 348555 - DNA, 20 bp, human
gcgtgttcttgtcacctatt

SEQ ID NO: 348556 - DNA, 20 bp, human
gagtgggagccctctgttcc

SEQ ID NO: 348557 - DNA, 20 bp, human
gagaacccacaggttcccga

SEQ ID NO: 348558 - DNA, 20 bp, human
gtgggcttgaaccagtgggt

SEQ ID NO: 348559 - DNA, 20 bp, human
gtgatagtgaaaagcagact

SEQ ID NO: 348560 - DNA, 20 bp, human
gtgaaccagtgggtgggctc

SEQ ID NO: 348561 - DNA, 20 bp, human
gtattgagatggtgagaacc

SEQ ID NO: 348562 - DNA, 20 bp, human
ggttagaggttgagtaggag

SEQ ID NO: 348563 - DNA, 20 bp, human
gaaagaaaaccaaaaggggc

SEQ ID NO: 348564 - DNA, 20 bp, human
ggaggcattccagctgttag

SEQ ID NO: 348565 - DNA, 20 bp, human
gcagaaaagaaaaccaaaag

SEQ ID NO: 348566 - DNA, 20 bp, human
gtagccgagaggaatgagga

SEQ ID NO: 348567 - DNA, 20 bp, human
ggctccgcccccaacgccgt

SEQ ID NO: 348568 - DNA, 20 bp, human
gggccgcgcccactgagttc

SEQ ID NO: 348569 - DNA, 20 bp, human
gtatatagccgagaggaatg

SEQ ID NO: 348570 - DNA, 20 bp, human
ggacctgaactcagtgggcg

SEQ ID NO: 348571 - DNA, 20 bp, human
gacgccgtggggccttctgg

SEQ ID NO: 348572 - DNA, 20 bp, human
gcactgagttcaggtcacgt

SEQ ID NO: 348573 - DNA, 20 bp, human
gggtcacgtaggggagaagc

SEQ ID NO: 348574 - DNA, 20 bp, human
gacaacaaggcattttccat

SEQ ID NO: 348575 - DNA, 20 bp, human
gtggggcgcgcgtcaggcct

SEQ ID NO: 348576 - DNA, 20 bp, human
ggcggttacttaccacggat

SEQ ID NO: 348577 - DNA, 20 bp, human
gacctcaggctccaactcgt

SEQ ID NO: 348578 - DNA, 20 bp, human
gggctccaactcgtgggaaa

SEQ ID NO: 348579 - DNA, 20 bp, human
ggcacggctctccgcggcct

SEQ ID NO: 348580 - DNA, 20 bp, human
gaagaggcggggctagtgcg

SEQ ID NO: 348581 - DNA, 20 bp, human
gggcggggctagtgcgtggt

SEQ ID NO: 348582 - DNA, 20 bp, human
gggctagtgcgtggtgggaa

SEQ ID NO: 348583 - DNA, 20 bp, human
gcaaagagaacgaagaggcg

SEQ ID NO: 348584 - DNA, 20 bp, human
gcaagggcggttacttacca

SEQ ID NO: 348585 - DNA, 20 bp, human
ggagaaaaagaaccaatccg

SEQ ID NO: 348586 - DNA, 20 bp, human
gtgaatatgcaaagactgtc

SEQ ID NO: 348587 - DNA, 20 bp, human
ggatgcatttcagatattct

SEQ ID NO: 348588 - DNA, 20 bp, human
gtgcatattcacagtttcat

SEQ ID NO: 348589 - DNA, 20 bp, human
gagatattctgggtggtgac

SEQ ID NO: 348590 - DNA, 20 bp, human
ggcatttcagatattctggg

SEQ ID NO: 348591 - DNA, 20 bp, human
ggaagatgcaaaactgtcac

SEQ ID NO: 348592 - DNA, 20 bp, human
gtgtgacaggtaaagtcagt

SEQ ID NO: 348593 - DNA, 20 bp, human
ggccataaataatttaggta

SEQ ID NO: 348594 - DNA, 20 bp, human
gaccatacctaaattattta

SEQ ID NO: 348595 - DNA, 20 bp, human
gatttatggcttgttcttta

SEQ ID NO: 348596 - DNA, 20 bp, human
ggtaacgcggaaggaggaga

SEQ ID NO: 348597 - DNA, 20 bp, human
ggctcccagtgactccggat

SEQ ID NO: 348598 - DNA, 20 bp, human
gctgccgcacgcactcccgc

SEQ ID NO: 348599 - DNA, 20 bp, human
gctgacacaggtaacgcgga

SEQ ID NO: 348600 - DNA, 20 bp, human
ggcaggcggtaggccccgca

SEQ ID NO: 348601 - DNA, 20 bp, human
gccgaggctcccagtgactc

SEQ ID NO: 348602 - DNA, 20 bp, human
ggacaccaatccggagtcac

SEQ ID NO: 348603 - DNA, 20 bp, human
ggaggggcacgcgggaagcc

SEQ ID NO: 348604 - DNA, 20 bp, human
gaacccggaaagggagaaaa

SEQ ID NO: 348605 - DNA, 20 bp, human
gacacaggtaacgcggaagg

SEQ ID NO: 348606 - DNA, 20 bp, human
gcggctgccgggaacgaacg

SEQ ID NO: 348607 - DNA, 20 bp, human
gggcggggatccagccaaca

SEQ ID NO: 348608 - DNA, 20 bp, human
gggaacgaacgcggaaaccc

SEQ ID NO: 348609 - DNA, 20 bp, human
gaaggcctgagcatcgacga

SEQ ID NO: 348610 - DNA, 20 bp, human
gaggcgaggagacacggaca

SEQ ID NO: 348611 - DNA, 20 bp, human
gggccgggatccagccatca

SEQ ID NO: 348612 - DNA, 20 bp, human
gttcctgcccggcccggtga

SEQ ID NO: 348613 - DNA, 20 bp, human
gagggaggggacgttcttct

SEQ ID NO: 348614 - DNA, 20 bp, human
ggacacggacagggaaacta

SEQ ID NO: 348615 - DNA, 20 bp, human
gagtgacgggcgcccggagg

SEQ ID NO: 348616 - DNA, 20 bp, human
gcaaacacaagtcccggagt

SEQ ID NO: 348617 - DNA, 20 bp, human
ggccaagagctgcgtgagga

SEQ ID NO: 348618 - DNA, 20 bp, human
ggagtgggaagcttggagct

SEQ ID NO: 348619 - DNA, 20 bp, human
gcaacagacgctggcggctg

SEQ ID NO: 348620 - DNA, 20 bp, human
gaagaaacaggaacatgccc

SEQ ID NO: 348621 - DNA, 20 bp, human
gcccacccaaacacaagtcc

SEQ ID NO: 348622 - DNA, 20 bp, human
gtttagccgaaggtatcgga

SEQ ID NO: 348623 - DNA, 20 bp, human
gtgggagccgcggcaggtag

SEQ ID NO: 348624 - DNA, 20 bp, human
gggcagtcaacagacgctgg

SEQ ID NO: 348625 - DNA, 20 bp, human
gccccggcggcaggaaatcc

SEQ ID NO: 348626 - DNA, 20 bp, human
gaggatgtctagactggaga

SEQ ID NO: 348627 - DNA, 20 bp, human
ggagcccgctccagcaggat

SEQ ID NO: 348628 - DNA, 20 bp, human
ggtgaagaggatgtctagac

SEQ ID NO: 348629 - DNA, 20 bp, human
ggctcagtcaatgccctcgg

SEQ ID NO: 348630 - DNA, 20 bp, human
gttcaccaatcctgctggag

SEQ ID NO: 348631 - DNA, 20 bp, human
gacagtggctaatccagaca

SEQ ID NO: 348632 - DNA, 20 bp, human
ggaccttgcaatatgacttg

SEQ ID NO: 348633 - DNA, 20 bp, human
gtctggattagccactgtct

SEQ ID NO: 348634 - DNA, 20 bp, human
gactgagtgggttgggcaag

SEQ ID NO: 348635 - DNA, 20 bp, human
gggtgggccctgccctccga

SEQ ID NO: 348636 - DNA, 20 bp, human
ggaggcggaccgcaaggcta

SEQ ID NO: 348637 - DNA, 20 bp, human
gcacgcgcacaagagggcat

SEQ ID NO: 348638 - DNA, 20 bp, human
gtaacgccgcgcaccctatc

SEQ ID NO: 348639 - DNA, 20 bp, human
ggtctccaagcctcagtctg

SEQ ID NO: 348640 - DNA, 20 bp, human
gggcgcgccgaagtggcgag

SEQ ID NO: 348641 - DNA, 20 bp, human
gtgcgcagaggcggaccgca

SEQ ID NO: 348642 - DNA, 20 bp, human
gctccctgtggccgcctgat

SEQ ID NO: 348643 - DNA, 20 bp, human
gaaggctagggcgtgaggga

SEQ ID NO: 348644 - DNA, 20 bp, human
gctggacccagaggggagaa

SEQ ID NO: 348645 - DNA, 20 bp, human
gagagggcacggggaaaagg

SEQ ID NO: 348646 - DNA, 20 bp, human
gcccctgagcccaacaaggg

SEQ ID NO: 348647 - DNA, 20 bp, human
gccgcccctgagcccaacaa

SEQ ID NO: 348648 - DNA, 20 bp, human
gtaaggggaagtacttccgg

SEQ ID NO: 348649 - DNA, 20 bp, human
gcgcgcacaccgcccttgtt

SEQ ID NO: 348650 - DNA, 20 bp, human
gcgcgagagtcgagatgcgt

SEQ ID NO: 348651 - DNA, 20 bp, human
gcctgccggaaatggcgcag

SEQ ID NO: 348652 - DNA, 20 bp, human
gcgggaccgcctgtgagtgg

SEQ ID NO: 348653 - DNA, 20 bp, human
gtcgctaaaggaggctcaaa

SEQ ID NO: 348654 - DNA, 20 bp, human
gaatggcgcagcggcaggga

SEQ ID NO: 348655 - DNA, 20 bp, human
gaggggctcttcacccagtc

SEQ ID NO: 348656 - DNA, 20 bp, human
gaggggcgagctcaagaggg

SEQ ID NO: 348657 - DNA, 20 bp, human
ggggcggggcggaagactgc

SEQ ID NO: 348658 - DNA, 20 bp, human
gtatcaggggcgagctcaag

SEQ ID NO: 348659 - DNA, 20 bp, human
gcgagctcaagagggcgggg

SEQ ID NO: 348660 - DNA, 20 bp, human
ggatggaagtagtgctctga

SEQ ID NO: 348661 - DNA, 20 bp, human
gcgaggagggtggtaccaag

SEQ ID NO: 348662 - DNA, 20 bp, human
gcggacgcgccagcctatca

SEQ ID NO: 348663 - DNA, 20 bp, human
gaacgtcccgatgacgtcat

SEQ ID NO: 348664 - DNA, 20 bp, human
gaggacaccgagggcgagga

SEQ ID NO: 348665 - DNA, 20 bp, human
gcctgtccgggaagagaaat

SEQ ID NO: 348666 - DNA, 20 bp, human
gccgccggcctcagcagcgc

SEQ ID NO: 348667 - DNA, 20 bp, human
gtcagcagcgcgggcagctc

SEQ ID NO: 348668 - DNA, 20 bp, human
gcaggggatcacgtgcgcag

SEQ ID NO: 348669 - DNA, 20 bp, human
gaggtggtaggtgacggatg

SEQ ID NO: 348670 - DNA, 20 bp, human
gggagcaggcggctcgggca

SEQ ID NO: 348671 - DNA, 20 bp, human
gcctccggcgcccgggtgcc

SEQ ID NO: 348672 - DNA, 20 bp, human
gggatcacgtgcgcaggggc

SEQ ID NO: 348673 - DNA, 20 bp, human
ggtggccggaagccttaaag

SEQ ID NO: 348674 - DNA, 20 bp, human
ggccacgcccctcatggcca

SEQ ID NO: 348675 - DNA, 20 bp, human
ggctgccaaaggtcgcacgg

SEQ ID NO: 348676 - DNA, 20 bp, human
gcgcgcgcctccagtcgcca

SEQ ID NO: 348677 - DNA, 20 bp, human
ggctggggaccgctcgtgag

SEQ ID NO: 348678 - DNA, 20 bp, human
gggcggggcctcgaggtcag

SEQ ID NO: 348679 - DNA, 20 bp, human
gggcgcaatggcggggaccc

SEQ ID NO: 348680 - DNA, 20 bp, human
gccaagcagcatcaagcccc

SEQ ID NO: 348681 - DNA, 20 bp, human
gtggcgggtcctagggacgt

SEQ ID NO: 348682 - DNA, 20 bp, human
gcgcgacgcgggcgcaatgg

SEQ ID NO: 348683 - DNA, 20 bp, human
ggtcgccacggcaaccaggg

SEQ ID NO: 348684 - DNA, 20 bp, human
gtggcccagtggcgggtcct

SEQ ID NO: 348685 - DNA, 20 bp, human
ggcgcgcgacgcgggcgcaa

SEQ ID NO: 348686 - DNA, 20 bp, human
gtctacagcaagccggcgag

SEQ ID NO: 348687 - DNA, 20 bp, human
gaagctcgggacccccgctc

SEQ ID NO: 348688 - DNA, 20 bp, human
ggtgtgtcgcggcagtgcag

SEQ ID NO: 348689 - DNA, 20 bp, human
gttgctgtagaggcaggcgc

SEQ ID NO: 348690 - DNA, 20 bp, human
ggcagtgcagcggccgcgaa

SEQ ID NO: 348691 - DNA, 20 bp, human
gtggcgagcgagagacgcaa

SEQ ID NO: 348692 - DNA, 20 bp, human
gcccccgctctggcgaaacg

SEQ ID NO: 348693 - DNA, 20 bp, human
gcgtcccgcgcccgaagctc

SEQ ID NO: 348694 - DNA, 20 bp, human
gctgacgtcaggcccgacgg

SEQ ID NO: 348695 - DNA, 20 bp, human
ggcaggcgccgggtgtgtcg

SEQ ID NO: 348696 - DNA, 20 bp, human
gcgggcacggatagcggaaa

SEQ ID NO: 348697 - DNA, 20 bp, human
ggggccgcggcgaaaatggg

SEQ ID NO: 348698 - DNA, 20 bp, human
gcggcagcgggcacggatag

SEQ ID NO: 348699 - DNA, 20 bp, human
gaccctgcgacggggagatg

SEQ ID NO: 348700 - DNA, 20 bp, human
ggacacccggagccacccaa

SEQ ID NO: 348701 - DNA, 20 bp, human
gccctgccggaggattccgc

SEQ ID NO: 348702 - DNA, 20 bp, human
gagcccgcgtcctcccgagt

SEQ ID NO: 348703 - DNA, 20 bp, human
gggaaaggggcgcgaccccg

SEQ ID NO: 348704 - DNA, 20 bp, human
gcggggacgctgcagacaaa

SEQ ID NO: 348705 - DNA, 20 bp, human
ggcagggcggaggtgaagaa

SEQ ID NO: 348706 - DNA, 20 bp, human
gcccgctccgggctggtctg

SEQ ID NO: 348707 - DNA, 20 bp, human
ggaccagcccggagcgggaa

SEQ ID NO: 348708 - DNA, 20 bp, human
gccggcgaggcggtgcgaca

SEQ ID NO: 348709 - DNA, 20 bp, human
gcccgccgccccaaccggcg

SEQ ID NO: 348710 - DNA, 20 bp, human
gcaacccggcctcgcttgtg

SEQ ID NO: 348711 - DNA, 20 bp, human
ggtggggagccctacacccg

SEQ ID NO: 348712 - DNA, 20 bp, human
ggccgcagaccagcccggag

SEQ ID NO: 348713 - DNA, 20 bp, human
gcggtgcgcggcctctgcag

SEQ ID NO: 348714 - DNA, 20 bp, human
gtcaccgggccgctggccgc

SEQ ID NO: 348715 - DNA, 20 bp, human
ggctccccacaagcgaggcc

SEQ ID NO: 348716 - DNA, 20 bp, human
gcgcgcgcccgggcctcggt

SEQ ID NO: 348717 - DNA, 20 bp, human
ggcagcatcccggacgagga

SEQ ID NO: 348718 - DNA, 20 bp, human
gaggcagggaaagagcggcg

SEQ ID NO: 348719 - DNA, 20 bp, human
ggggcaggaagcgcaggcgc

SEQ ID NO: 348720 - DNA, 20 bp, human
gtcagagtgaaagccgagta

SEQ ID NO: 348721 - DNA, 20 bp, human
ggaaagagcggcgcgggttg

SEQ ID NO: 348722 - DNA, 20 bp, human
gtgaaagagccggcggaaga

SEQ ID NO: 348723 - DNA, 20 bp, human
gggcagcagcatcccggacg

SEQ ID NO: 348724 - DNA, 20 bp, human
gcggggcggctggccgcgag

SEQ ID NO: 348725 - DNA, 20 bp, human
ggcagtacccaaccgaggcc

SEQ ID NO: 348726 - DNA, 20 bp, human
ggggagctacaattaccgaa

SEQ ID NO: 348727 - DNA, 20 bp, human
gagacaggccggcctaagct

SEQ ID NO: 348728 - DNA, 20 bp, human
gaggagaggcggcacccctc

SEQ ID NO: 348729 - DNA, 20 bp, human
gcacccttttgagcaggcca

SEQ ID NO: 348730 - DNA, 20 bp, human
gtacaattaccgaaaggctg

SEQ ID NO: 348731 - DNA, 20 bp, human
gaggccggcctaagctagga

SEQ ID NO: 348732 - DNA, 20 bp, human
gggaagagtaaggtcctaag

SEQ ID NO: 348733 - DNA, 20 bp, human
gcgcccaggctccgggaaag

SEQ ID NO: 348734 - DNA, 20 bp, human
ggcctcagaatggaagagta

SEQ ID NO: 348735 - DNA, 20 bp, human
gtcaaaagggtgggcgggca

SEQ ID NO: 348736 - DNA, 20 bp, human
gcccgtggggcgggcctcag

SEQ ID NO: 348737 - DNA, 20 bp, human
gaggaaggggcgtggctagc

SEQ ID NO: 348738 - DNA, 20 bp, human
gcgcgacaagtccagaggtg

SEQ ID NO: 348739 - DNA, 20 bp, human
gggcggcgcgacaagtccag

SEQ ID NO: 348740 - DNA, 20 bp, human
gagctggcggagcccggaag

SEQ ID NO: 348741 - DNA, 20 bp, human
gggccggaccacaaaagaag

SEQ ID NO: 348742 - DNA, 20 bp, human
gcgcaggtctgcgtggaacc

SEQ ID NO: 348743 - DNA, 20 bp, human
gacttgtcgcgccgccgctg

SEQ ID NO: 348744 - DNA, 20 bp, human
ggccgctgaggcccgcccca

SEQ ID NO: 348745 - DNA, 20 bp, human
ggtctgcgtggaacctggtg

SEQ ID NO: 348746 - DNA, 20 bp, human
gggagcgcgcgcaggagagc

SEQ ID NO: 348747 - DNA, 20 bp, human
gccagcgtcgcctgctcgat

SEQ ID NO: 348748 - DNA, 20 bp, human
gtgggctggcgcgaggcggt

SEQ ID NO: 348749 - DNA, 20 bp, human
ggagcgggaccccatcgagc

SEQ ID NO: 348750 - DNA, 20 bp, human
gccgccccctctctccgggg

SEQ ID NO: 348751 - DNA, 20 bp, human
gccgccgccgccccggagag

SEQ ID NO: 348752 - DNA, 20 bp, human
gagcggagcacggtagaagt

SEQ ID NO: 348753 - DNA, 20 bp, human
gtgggaggagaaaccggcgg

SEQ ID NO: 348754 - DNA, 20 bp, human
gcggtgggaggagaaaccgg

SEQ ID NO: 348755 - DNA, 20 bp, human
gcgcctgcccactcgctcgc

SEQ ID NO: 348756 - DNA, 20 bp, human
gctaccccagccatactcag

SEQ ID NO: 348757 - DNA, 20 bp, human
gcagtccagggtcagatcct

SEQ ID NO: 348758 - DNA, 20 bp, human
gggctgatgccacctgaggg

SEQ ID NO: 348759 - DNA, 20 bp, human
ggtgccaggaaatgcaggac

SEQ ID NO: 348760 - DNA, 20 bp, human
gctgaaaaacgggctccagt

SEQ ID NO: 348761 - DNA, 20 bp, human
gctgggctgatgccacctga

SEQ ID NO: 348762 - DNA, 20 bp, human
gggaggctggacctcaaagc

SEQ ID NO: 348763 - DNA, 20 bp, human
gaggctctggaaatcttacc

SEQ ID NO: 348764 - DNA, 20 bp, human
ggcgtggcctccgtgcacat

SEQ ID NO: 348765 - DNA, 20 bp, human
gagacccaaacgagaagtta

SEQ ID NO: 348766 - DNA, 20 bp, human
gccgccttgaggtagctcca

SEQ ID NO: 348767 - DNA, 20 bp, human
gcagccgtggagctacctca

SEQ ID NO: 348768 - DNA, 20 bp, human
ggcgctgtgtgtgactttgt

SEQ ID NO: 348769 - DNA, 20 bp, human
gtcctcccctgcgcaagcgc

SEQ ID NO: 348770 - DNA, 20 bp, human
gctacctcaaggcggaactg

SEQ ID NO: 348771 - DNA, 20 bp, human
ggcagtccggaaaaacgccg

SEQ ID NO: 348772 - DNA, 20 bp, human
gtccccacctgcgcttgcgc

SEQ ID NO: 348773 - DNA, 20 bp, human
gtcagtgggaggactcagtc

SEQ ID NO: 348774 - DNA, 20 bp, human
gactccccagttccgccttg

SEQ ID NO: 348775 - DNA, 20 bp, human
ggaaggtggcagacgtggag

SEQ ID NO: 348776 - DNA, 20 bp, human
gagcaggggcagtgtcgtat

SEQ ID NO: 348777 - DNA, 20 bp, human
gggtacaaagcgccaggtga

SEQ ID NO: 348778 - DNA, 20 bp, human
ggcggaaagccctcacagga

SEQ ID NO: 348779 - DNA, 20 bp, human
gcagcactggtttaattcac

SEQ ID NO: 348780 - DNA, 20 bp, human
ggtgtcgtatgggccagcac

SEQ ID NO: 348781 - DNA, 20 bp, human
gctttccgctaggccggcga

SEQ ID NO: 348782 - DNA, 20 bp, human
gtggctgttccttcctgtga

SEQ ID NO: 348783 - DNA, 20 bp, human
gcgcaaaagcccacaagaca

SEQ ID NO: 348784 - DNA, 20 bp, human
gccgctaggccggcgaaggc

SEQ ID NO: 348785 - DNA, 20 bp, human
gggtgagggcggccagcaca

SEQ ID NO: 348786 - DNA, 20 bp, human
gtggggcatgcgtacctgaa

SEQ ID NO: 348787 - DNA, 20 bp, human
ggccaagcgccgcgcctctg

SEQ ID NO: 348788 - DNA, 20 bp, human
gcctagccagcgagtcagag

SEQ ID NO: 348789 - DNA, 20 bp, human
gccccctggcggattggcta

SEQ ID NO: 348790 - DNA, 20 bp, human
gacttcgctcggactccccc

SEQ ID NO: 348791 - DNA, 20 bp, human
ggcacccccggcagtccctc

SEQ ID NO: 348792 - DNA, 20 bp, human
gcggccttagccaatccgcc

SEQ ID NO: 348793 - DNA, 20 bp, human
gcggactccccctggcggat

SEQ ID NO: 348794 - DNA, 20 bp, human
gttggcgggaagctgagtcc

SEQ ID NO: 348795 - DNA, 20 bp, human
gggggagtggtcaaaccgga

SEQ ID NO: 348796 - DNA, 20 bp, human
gccgctgcgcaggcgtagtc

SEQ ID NO: 348797 - DNA, 20 bp, human
gctgcgcagcggggctgagt

SEQ ID NO: 348798 - DNA, 20 bp, human
ggctggcgcattgccttctg

SEQ ID NO: 348799 - DNA, 20 bp, human
ggcctcgccgcgctgattcc

SEQ ID NO: 348800 - DNA, 20 bp, human
gttgcactccggacgcactc

SEQ ID NO: 348801 - DNA, 20 bp, human
ggcgcaaacgtcttcttctc

SEQ ID NO: 348802 - DNA, 20 bp, human
gcctcaagcctgagtgcgtc

SEQ ID NO: 348803 - DNA, 20 bp, human
gaaatgcgggtgatgacgcg

SEQ ID NO: 348804 - DNA, 20 bp, human
gcacaacgtgggtattggga

SEQ ID NO: 348805 - DNA, 20 bp, human
gggaaagcctgaccgcgact

SEQ ID NO: 348806 - DNA, 20 bp, human
gaaacggcgaggtccagcag

SEQ ID NO: 348807 - DNA, 20 bp, human
gagcacggagcccacgtcgg

SEQ ID NO: 348808 - DNA, 20 bp, human
ggcggtgggcggaggaggat

SEQ ID NO: 348809 - DNA, 20 bp, human
gcggtccgggcccccgacgt

SEQ ID NO: 348810 - DNA, 20 bp, human
gaactcggatgcttgcgaaa

SEQ ID NO: 348811 - DNA, 20 bp, human
ggggcccgaacgaggcgaag

SEQ ID NO: 348812 - DNA, 20 bp, human
gacgcccgggagctcaagag

SEQ ID NO: 348813 - DNA, 20 bp, human
ggagcctcggctggagaact

SEQ ID NO: 348814 - DNA, 20 bp, human
gggcggaggaggatagggcg

SEQ ID NO: 348815 - DNA, 20 bp, human
ggaggctcgggactgctgca

SEQ ID NO: 348816 - DNA, 20 bp, human
ggcttctggggcatctcccg

SEQ ID NO: 348817 - DNA, 20 bp, human
ggtgacccgaggtgtgacgt

SEQ ID NO: 348818 - DNA, 20 bp, human
gagcgcctactggcaatcta

SEQ ID NO: 348819 - DNA, 20 bp, human
gacccgaggtgtgacgtagg

SEQ ID NO: 348820 - DNA, 20 bp, human
ggaagaacgtgcctggacgt

SEQ ID NO: 348821 - DNA, 20 bp, human
gaacgtgcctggacgtgggc

SEQ ID NO: 348822 - DNA, 20 bp, human
gagccccagaagaacgtgcc

SEQ ID NO: 348823 - DNA, 20 bp, human
gtcctcctacgtcacacctc

SEQ ID NO: 348824 - DNA, 20 bp, human
gggaaggagacgccattaga

SEQ ID NO: 348825 - DNA, 20 bp, human
gaggtggctcgcaagcggcg

SEQ ID NO: 348826 - DNA, 20 bp, human
gtcacccgccatcttgggat

SEQ ID NO: 348827 - DNA, 20 bp, human
gggccccgccctctcagcga

SEQ ID NO: 348828 - DNA, 20 bp, human
gcccgccctctcagcgaagg

SEQ ID NO: 348829 - DNA, 20 bp, human
gggcctcgcggggtggtcac

SEQ ID NO: 348830 - DNA, 20 bp, human
ggggcggggcccgaagccga

SEQ ID NO: 348831 - DNA, 20 bp, human
ggccggccggcgcggatcgg

SEQ ID NO: 348832 - DNA, 20 bp, human
gcccactcacccgccatctt

SEQ ID NO: 348833 - DNA, 20 bp, human
gccggccggccggcgcggat

SEQ ID NO: 348834 - DNA, 20 bp, human
gtgggctcgggggatgccag

SEQ ID NO: 348835 - DNA, 20 bp, human
gtcagcgaaggtggctgccg

SEQ ID NO: 348836 - DNA, 20 bp, human
gccacccgccagaacagggg

SEQ ID NO: 348837 - DNA, 20 bp, human
gggaaagaggggtggagcga

SEQ ID NO: 348838 - DNA, 20 bp, human
gcggcgggtccacagatgag

SEQ ID NO: 348839 - DNA, 20 bp, human
gccaagtcccgactggggaa

SEQ ID NO: 348840 - DNA, 20 bp, human
ggggaggagtctaaatgcca

SEQ ID NO: 348841 - DNA, 20 bp, human
gcggcgctgcgtccccagtc

SEQ ID NO: 348842 - DNA, 20 bp, human
ggcctggtgggcgggaaaga

SEQ ID NO: 348843 - DNA, 20 bp, human
gagccactcaatctgagccc

SEQ ID NO: 348844 - DNA, 20 bp, human
gccagccacccgccagaaca

SEQ ID NO: 348845 - DNA, 20 bp, human
gactggggaaggggcgaccc

SEQ ID NO: 348846 - DNA, 20 bp, human
gggaagcggtggctactgtg

SEQ ID NO: 348847 - DNA, 20 bp, human
gcccgcgccacgtgaccttg

SEQ ID NO: 348848 - DNA, 20 bp, human
gggctactgtgtggctgcgc

SEQ ID NO: 348849 - DNA, 20 bp, human
gggagggggctagagggcga

SEQ ID NO: 348850 - DNA, 20 bp, human
gtccccgataaggtctacct

SEQ ID NO: 348851 - DNA, 20 bp, human
ggccgcaaggtcacgtggcg

SEQ ID NO: 348852 - DNA, 20 bp, human
ggcggggccgcaaggtcacg

SEQ ID NO: 348853 - DNA, 20 bp, human
gaggcctgcaaggtcctgaa

SEQ ID NO: 348854 - DNA, 20 bp, human
ggcggtacccgaatccctat

SEQ ID NO: 348855 - DNA, 20 bp, human
gaaggtcctgaagggaggtt

SEQ ID NO: 348856 - DNA, 20 bp, human
gagaagcagctccagcgggg

SEQ ID NO: 348857 - DNA, 20 bp, human
gctcccgcttgcgggagccc

SEQ ID NO: 348858 - DNA, 20 bp, human
ggcgggggggaagcgaaaaa

SEQ ID NO: 348859 - DNA, 20 bp, human
ggacgtcagacaggttcgac

SEQ ID NO: 348860 - DNA, 20 bp, human
gtcagacaggttcgacaggt

SEQ ID NO: 348861 - DNA, 20 bp, human
gtgcacactcagccctcagt

SEQ ID NO: 348862 - DNA, 20 bp, human
ggagctgcttctcccgcttg

SEQ ID NO: 348863 - DNA, 20 bp, human
gcttctggaatctgtggtga

SEQ ID NO: 348864 - DNA, 20 bp, human
ggcctcaagtgggtttctga

SEQ ID NO: 348865 - DNA, 20 bp, human
ggctgagaacaggaagagcg

SEQ ID NO: 348866 - DNA, 20 bp, human
gcacgggcaggggtcgtgat

SEQ ID NO: 348867 - DNA, 20 bp, human
ggccgccaatgccgtgcgtg

SEQ ID NO: 348868 - DNA, 20 bp, human
gaaggggtgtcctgagatgt

SEQ ID NO: 348869 - DNA, 20 bp, human
gcaaatacacccccgctcgg

SEQ ID NO: 348870 - DNA, 20 bp, human
gtggctgcgcgcccgtggag

SEQ ID NO: 348871 - DNA, 20 bp, human
gcccgccccacgcacggcat

SEQ ID NO: 348872 - DNA, 20 bp, human
ggccaatgccgtgcgtgggg

SEQ ID NO: 348873 - DNA, 20 bp, human
gatacacccccgctcggcgg

SEQ ID NO: 348874 - DNA, 20 bp, human
gccggggtgactcctggccc

SEQ ID NO: 348875 - DNA, 20 bp, human
gcaggggtcgtgatcggggg

SEQ ID NO: 348876 - DNA, 20 bp, human
ggggccgctcccgaggtgac

SEQ ID NO: 348877 - DNA, 20 bp, human
gcccccgcccggctggcggg

SEQ ID NO: 348878 - DNA, 20 bp, human
ggaaactagtgttgggacaa

SEQ ID NO: 348879 - DNA, 20 bp, human
gctcacagaggacccctcgg

SEQ ID NO: 348880 - DNA, 20 bp, human
ggggcagcggaaactagtgt

SEQ ID NO: 348881 - DNA, 20 bp, human
ggctgtcgcgctctccccgg

SEQ ID NO: 348882 - DNA, 20 bp, human
gggcgagcggggccttttcg

SEQ ID NO: 348883 - DNA, 20 bp, human
gtgagtacgcccggcacctc

SEQ ID NO: 348884 - DNA, 20 bp, human
gccacctcgctctcctttac

SEQ ID NO: 348885 - DNA, 20 bp, human
gcggactcgggaacctcggg

SEQ ID NO: 348886 - DNA, 20 bp, human
gatgaagtctccacactgtg

SEQ ID NO: 348887 - DNA, 20 bp, human
ggatgtgcggagctcacctc

SEQ ID NO: 348888 - DNA, 20 bp, human
ggtgagaaacacactcctct

SEQ ID NO: 348889 - DNA, 20 bp, human
gccgccgcggcggactccga

SEQ ID NO: 348890 - DNA, 20 bp, human
gaggagagaacgcaatgtca

SEQ ID NO: 348891 - DNA, 20 bp, human
gaaaaatgagctcgctggta

SEQ ID NO: 348892 - DNA, 20 bp, human
gcccagggcgctgtgagaac

SEQ ID NO: 348893 - DNA, 20 bp, human
gctgccactcgcagtcctga

SEQ ID NO: 348894 - DNA, 20 bp, human
gcccatccggagccacaggt

SEQ ID NO: 348895 - DNA, 20 bp, human
ggtgtctgcaagtcccaacg

SEQ ID NO: 348896 - DNA, 20 bp, human
gaccactcgcggccctggac

SEQ ID NO: 348897 - DNA, 20 bp, human
gcgcccgacgtgcgcgtagg

SEQ ID NO: 348898 - DNA, 20 bp, human
gacgcccgggctacgcgcca

SEQ ID NO: 348899 - DNA, 20 bp, human
gggtgtgggggacattccgg

SEQ ID NO: 348900 - DNA, 20 bp, human
gcgcggccctggactggtgt

SEQ ID NO: 348901 - DNA, 20 bp, human
gcgggttggctctgaggcgg

SEQ ID NO: 348902 - DNA, 20 bp, human
gcaaccctggcgcgtagccc

SEQ ID NO: 348903 - DNA, 20 bp, human
gactggtgtgggggacattc

SEQ ID NO: 348904 - DNA, 20 bp, human
ggggcggggccgcgcgcaga

SEQ ID NO: 348905 - DNA, 20 bp, human
ggtcactgctccaccccgtc

SEQ ID NO: 348906 - DNA, 20 bp, human
gggccgcagaacttccgggt

SEQ ID NO: 348907 - DNA, 20 bp, human
ggggctcgcccgctcaaacg

SEQ ID NO: 348908 - DNA, 20 bp, human
gagggcggaccgggcaaggc

SEQ ID NO: 348909 - DNA, 20 bp, human
gccggcggccgcagaacttc

SEQ ID NO: 348910 - DNA, 20 bp, human
ggtcagccgccgggagtgag

SEQ ID NO: 348911 - DNA, 20 bp, human
gcgcggcggctgttattgtt

SEQ ID NO: 348912 - DNA, 20 bp, human
gctggaagacagggcggacc

SEQ ID NO: 348913 - DNA, 20 bp, human
gctggcccagccctgcacgc

SEQ ID NO: 348914 - DNA, 20 bp, human
gccggcgccgccggaggaaa

SEQ ID NO: 348915 - DNA, 20 bp, human
gctcgcccgctcaaacgtgg

SEQ ID NO: 348916 - DNA, 20 bp, human
ggcgctgggctatcgccccc

SEQ ID NO: 348917 - DNA, 20 bp, human
gcgacctaaggatgattccg

SEQ ID NO: 348918 - DNA, 20 bp, human
gactccccggaatcatcctt

SEQ ID NO: 348919 - DNA, 20 bp, human
gcgtccctggaggtggcgta

SEQ ID NO: 348920 - DNA, 20 bp, human
ggggggcggtgggagcgatg

SEQ ID NO: 348921 - DNA, 20 bp, human
ggtgctagaagcgtccctgg

SEQ ID NO: 348922 - DNA, 20 bp, human
ggtagggtactcccgaccta

SEQ ID NO: 348923 - DNA, 20 bp, human
ggaagtgctagaagcgtccc

SEQ ID NO: 348924 - DNA, 20 bp, human
ggggcggacccggaacccag

SEQ ID NO: 348925 - DNA, 20 bp, human
gttatccctccaaactccag

SEQ ID NO: 348926 - DNA, 20 bp, human
gctcgggagcggtgctttct

SEQ ID NO: 348927 - DNA, 20 bp, human
ggtccccaatagccatgctc

SEQ ID NO: 348928 - DNA, 20 bp, human
gctcccgagcatggctattg

SEQ ID NO: 348929 - DNA, 20 bp, human
gtgggacgcgcccagagtga

SEQ ID NO: 348930 - DNA, 20 bp, human
ggcccagagtgaaggagcaa

SEQ ID NO: 348931 - DNA, 20 bp, human
gattgcctgggtatcccttc

SEQ ID NO: 348932 - DNA, 20 bp, human
ggagccgggcagaggtttta

SEQ ID NO: 348933 - DNA, 20 bp, human
gacgtcctgaagggataccc

SEQ ID NO: 348934 - DNA, 20 bp, human
gaaagcaccgctcccgagca

SEQ ID NO: 348935 - DNA, 20 bp, human
gcatggctattggggacgtt

SEQ ID NO: 348936 - DNA, 20 bp, human
gcgacgccgcaggtcccggg

SEQ ID NO: 348937 - DNA, 20 bp, human
gccgcgcggggctggtccga

SEQ ID NO: 348938 - DNA, 20 bp, human
ggcgtcgggtccagcctcgc

SEQ ID NO: 348939 - DNA, 20 bp, human
gtcccaggaacgcccccgga

SEQ ID NO: 348940 - DNA, 20 bp, human
ggtcagccacccgggacctg

SEQ ID NO: 348941 - DNA, 20 bp, human
ggggggaggccgacccgcgc

SEQ ID NO: 348942 - DNA, 20 bp, human
gcgcggggctggtccgaggg

SEQ ID NO: 348943 - DNA, 20 bp, human
gtggacccgacgcgcccggg

SEQ ID NO: 348944 - DNA, 20 bp, human
gaatccgccggcgacgccgc

SEQ ID NO: 348945 - DNA, 20 bp, human
gggcccagaaatagcagcgg

SEQ ID NO: 348946 - DNA, 20 bp, human
gacgccgcctgaccggtcac

SEQ ID NO: 348947 - DNA, 20 bp, human
gcccgctgacgccgcctgac

SEQ ID NO: 348948 - DNA, 20 bp, human
gcgagggcagggccggacga

SEQ ID NO: 348949 - DNA, 20 bp, human
gcccgggccgcgagcactgg

SEQ ID NO: 348950 - DNA, 20 bp, human
ggggttctgggtcctgtgac

SEQ ID NO: 348951 - DNA, 20 bp, human
gagggcctggcgccggcttg

SEQ ID NO: 348952 - DNA, 20 bp, human
ggcgagcactggcgggttct

SEQ ID NO: 348953 - DNA, 20 bp, human
gcaggcggcgtcagcgggcg

SEQ ID NO: 348954 - DNA, 20 bp, human
gaccggtcaggcggcgtcag

SEQ ID NO: 348955 - DNA, 20 bp, human
ggggccccggaggttcactg

SEQ ID NO: 348956 - DNA, 20 bp, human
gcacacaggcagaaggctcg

SEQ ID NO: 348957 - DNA, 20 bp, human
gcaacacaaaagccagggag

SEQ ID NO: 348958 - DNA, 20 bp, human
gcctgtgtgcgccctcggac

SEQ ID NO: 348959 - DNA, 20 bp, human
gtgcgcgcgcgcgcgtgaag

SEQ ID NO: 348960 - DNA, 20 bp, human
gggaccggatgctctggcga

SEQ ID NO: 348961 - DNA, 20 bp, human
gcggctggagcagcgcggta

SEQ ID NO: 348962 - DNA, 20 bp, human
gcctgcctgcattcccggga

SEQ ID NO: 348963 - DNA, 20 bp, human
ggggtccgtcccgggaatgc

SEQ ID NO: 348964 - DNA, 20 bp, human
gaggaggaaagagacggggt

SEQ ID NO: 348965 - DNA, 20 bp, human
gcttccctcgggtccgtccc

SEQ ID NO: 348966 - DNA, 20 bp, human
gcaggcgtgggacctgtcgg

SEQ ID NO: 348967 - DNA, 20 bp, human
gtacacgcccccgtcaaagg

SEQ ID NO: 348968 - DNA, 20 bp, human
gggcggggctgggtcagtca

SEQ ID NO: 348969 - DNA, 20 bp, human
gaagccgcgcaatcactccg

SEQ ID NO: 348970 - DNA, 20 bp, human
gcgcccccggagtgattgcg

SEQ ID NO: 348971 - DNA, 20 bp, human
gaaggtgcgcaggcgcgctc

SEQ ID NO: 348972 - DNA, 20 bp, human
gggcaggcggctccgtgcgg

SEQ ID NO: 348973 - DNA, 20 bp, human
gtggagagcaacggtaagga

SEQ ID NO: 348974 - DNA, 20 bp, human
ggccacacctgtgcgggcaa

SEQ ID NO: 348975 - DNA, 20 bp, human
gggtctacctaggcaggcgt

SEQ ID NO: 348976 - DNA, 20 bp, human
gggaggggaagcgtgcgaag

SEQ ID NO: 348977 - DNA, 20 bp, human
gactctatgagtcacctccc

SEQ ID NO: 348978 - DNA, 20 bp, human
ggggaggtcgggggtgagga

SEQ ID NO: 348979 - DNA, 20 bp, human
gaaggcgcagccgggtatag

SEQ ID NO: 348980 - DNA, 20 bp, human
gttctgccctgggaggtcgg

SEQ ID NO: 348981 - DNA, 20 bp, human
gctcgagggaggttaaagaa

SEQ ID NO: 348982 - DNA, 20 bp, human
gtgagcggggcaacgcagaa

SEQ ID NO: 348983 - DNA, 20 bp, human
gagcctggggagtccctatc

SEQ ID NO: 348984 - DNA, 20 bp, human
gtgcacaaaggagttgtccc

SEQ ID NO: 348985 - DNA, 20 bp, human
gcagacgtctctctcctcgg

SEQ ID NO: 348986 - DNA, 20 bp, human
gcgcgtgcgcgacccgggcg

SEQ ID NO: 348987 - DNA, 20 bp, human
gcgcctgcgcagtggtgggg

SEQ ID NO: 348988 - DNA, 20 bp, human
ggcttgctgggactccgtca

SEQ ID NO: 348989 - DNA, 20 bp, human
gacggagtcccagcaagcgc

SEQ ID NO: 348990 - DNA, 20 bp, human
gaagacgggcccgcgcttgc

SEQ ID NO: 348991 - DNA, 20 bp, human
ggctgcgcctgcgcagtggt

SEQ ID NO: 348992 - DNA, 20 bp, human
ggcggcgacgacgctccccg

SEQ ID NO: 348993 - DNA, 20 bp, human
ggagccccgccccacggtcg

SEQ ID NO: 348994 - DNA, 20 bp, human
gctctcagcgcccagggtgg

SEQ ID NO: 348995 - DNA, 20 bp, human
gcaggggccggggccgtaga

SEQ ID NO: 348996 - DNA, 20 bp, human
gcaggttctggtgatcagct

SEQ ID NO: 348997 - DNA, 20 bp, human
gaacaagggcggtgctggat

SEQ ID NO: 348998 - DNA, 20 bp, human
gtcgtgggcggggtctgcgt

SEQ ID NO: 348999 - DNA, 20 bp, human
gatcaccatgacaacaaggg

SEQ ID NO: 349000 - DNA, 20 bp, human
ggtgctggatgggtgggcgg

SEQ ID NO: 349001 - DNA, 20 bp, human
gccaagcatccagcttgcac

SEQ ID NO: 349002 - DNA, 20 bp, human
gaccgtggagagattcgcgc

SEQ ID NO: 349003 - DNA, 20 bp, human
ggagaacctgcctggagtct

SEQ ID NO: 349004 - DNA, 20 bp, human
gggcggggctatggaggccc

SEQ ID NO: 349005 - DNA, 20 bp, human
gggcggggtctgcgttggac

SEQ ID NO: 349006 - DNA, 20 bp, human
gcctgaggggtcccggtcga

SEQ ID NO: 349007 - DNA, 20 bp, human
gtccgagccggtgtcgtcga

SEQ ID NO: 349008 - DNA, 20 bp, human
gtccctgagcaacaccggct

SEQ ID NO: 349009 - DNA, 20 bp, human
gccgcagggtctgcgtgaag

SEQ ID NO: 349010 - DNA, 20 bp, human
gaggggtcccggtcgaggga

SEQ ID NO: 349011 - DNA, 20 bp, human
gcagcctccctgagcaacac

SEQ ID NO: 349012 - DNA, 20 bp, human
gccgcggcccgctcccccag

SEQ ID NO: 349013 - DNA, 20 bp, human
ggtcgccccctcgacgacac

SEQ ID NO: 349014 - DNA, 20 bp, human
ggcagcagacggggtccccg

SEQ ID NO: 349015 - DNA, 20 bp, human
gagccgagccggtgttgctc

SEQ ID NO: 349016 - DNA, 20 bp, human
ggaaaggccccgttgaccac

SEQ ID NO: 349017 - DNA, 20 bp, human
gactccgcggtcttggagag

SEQ ID NO: 349018 - DNA, 20 bp, human
gccgggactggcagctgaaa

SEQ ID NO: 349019 - DNA, 20 bp, human
gggagacaggagcgagtccc

SEQ ID NO: 349020 - DNA, 20 bp, human
gaggaagcccaagactggct

SEQ ID NO: 349021 - DNA, 20 bp, human
gccaagaccgcggagtagga

SEQ ID NO: 349022 - DNA, 20 bp, human
ggctgaaaggggttcgcgtg

SEQ ID NO: 349023 - DNA, 20 bp, human
gaccaagcccagccagtctt

SEQ ID NO: 349024 - DNA, 20 bp, human
gaccacaggtctgaagtcac

SEQ ID NO: 349025 - DNA, 20 bp, human
ggcgggagatggccggtgaa

SEQ ID NO: 349026 - DNA, 20 bp, human
gtgggcgccggcaggaaagt

SEQ ID NO: 349027 - DNA, 20 bp, human
gggcgcccagtgagcgttga

SEQ ID NO: 349028 - DNA, 20 bp, human
ggcgaactcccgcccctgac

SEQ ID NO: 349029 - DNA, 20 bp, human
ggggcgggttggtcagatta

SEQ ID NO: 349030 - DNA, 20 bp, human
gggcggtggcgcgtgggagg

SEQ ID NO: 349031 - DNA, 20 bp, human
gaggggcggggcctctggac

SEQ ID NO: 349032 - DNA, 20 bp, human
gggcaggaaagtgggcgtgg

SEQ ID NO: 349033 - DNA, 20 bp, human
ggccgcaggaatatgctgga

SEQ ID NO: 349034 - DNA, 20 bp, human
gactctccctcaacgctcac

SEQ ID NO: 349035 - DNA, 20 bp, human
ggccttccagcatattcctg

SEQ ID NO: 349036 - DNA, 20 bp, human
gtgggtggggtagttagaaa

SEQ ID NO: 349037 - DNA, 20 bp, human
gccgccgcactatctgtaag

SEQ ID NO: 349038 - DNA, 20 bp, human
gaggcgtcgcgtctacgcgg

SEQ ID NO: 349039 - DNA, 20 bp, human
gcccaggcgtcgcgtctacg

SEQ ID NO: 349040 - DNA, 20 bp, human
gaagaggagcgcacacaaaa

SEQ ID NO: 349041 - DNA, 20 bp, human
ggaacagttttaatgaacag

SEQ ID NO: 349042 - DNA, 20 bp, human
ggtggggtagttagaaaggg

SEQ ID NO: 349043 - DNA, 20 bp, human
gagttttaatgaacagaggg

SEQ ID NO: 349044 - DNA, 20 bp, human
ggcgggggattacagtaacc

SEQ ID NO: 349045 - DNA, 20 bp, human
gtgactcatcactgacaacc

SEQ ID NO: 349046 - DNA, 20 bp, human
gctagcgtgtgcatccagta

SEQ ID NO: 349047 - DNA, 20 bp, human
ggggccccgcctccccgagg

SEQ ID NO: 349048 - DNA, 20 bp, human
gcgtgtgcatccagtagggg

SEQ ID NO: 349049 - DNA, 20 bp, human
gcatccagtaggggcgggag

SEQ ID NO: 349050 - DNA, 20 bp, human
ggacgcacgcagagccagat

SEQ ID NO: 349051 - DNA, 20 bp, human
gccccgaggcggacaggagg

SEQ ID NO: 349052 - DNA, 20 bp, human
gcctccccgaggcggacagg

SEQ ID NO: 349053 - DNA, 20 bp, human
ggattgacgtgcaaatgggg

SEQ ID NO: 349054 - DNA, 20 bp, human
gacaggaggcggacgagagg

SEQ ID NO: 349055 - DNA, 20 bp, human
gccaccattggacaagagga

SEQ ID NO: 349056 - DNA, 20 bp, human
gcacgagagtcacccagaca

SEQ ID NO: 349057 - DNA, 20 bp, human
gcacccagacatgggggacc

SEQ ID NO: 349058 - DNA, 20 bp, human
gtacacctgctaggagttga

SEQ ID NO: 349059 - DNA, 20 bp, human
gccggccctcaactcctagc

SEQ ID NO: 349060 - DNA, 20 bp, human
ggccctcaggcgccactgtg

SEQ ID NO: 349061 - DNA, 20 bp, human
gtcctcacagtggcgcctga

SEQ ID NO: 349062 - DNA, 20 bp, human
gtcctagcaggtgtaatccg

SEQ ID NO: 349063 - DNA, 20 bp, human
gtccaggccccgcccaaggg

SEQ ID NO: 349064 - DNA, 20 bp, human
ggccactgtgaggacctgac

SEQ ID NO: 349065 - DNA, 20 bp, human
gtgaagacggagccatagaa

SEQ ID NO: 349066 - DNA, 20 bp, human
gctccgcggccgagcccgac

SEQ ID NO: 349067 - DNA, 20 bp, human
gagactgggagaggtaaccc

SEQ ID NO: 349068 - DNA, 20 bp, human
gcgcggccgagcccgactgg

SEQ ID NO: 349069 - DNA, 20 bp, human
gaaggagtagggaggctccg

SEQ ID NO: 349070 - DNA, 20 bp, human
ggagcgtttggaaaggagta

SEQ ID NO: 349071 - DNA, 20 bp, human
ggcggatcgagcctgtttaa

SEQ ID NO: 349072 - DNA, 20 bp, human
gaacccaggagcgtttggaa

SEQ ID NO: 349073 - DNA, 20 bp, human
gagcaagcaaaccattaaac

SEQ ID NO: 349074 - DNA, 20 bp, human
gaggagccccgtgcactcct

SEQ ID NO: 349075 - DNA, 20 bp, human
gtgcagagctgatagggcac

SEQ ID NO: 349076 - DNA, 20 bp, human
gcgaagaggggccgagtctt

SEQ ID NO: 349077 - DNA, 20 bp, human
gaggggccgagtcttgggcg

SEQ ID NO: 349078 - DNA, 20 bp, human
gtttcagagagcgggtggga

SEQ ID NO: 349079 - DNA, 20 bp, human
ggggaaaatgagatgttgct

SEQ ID NO: 349080 - DNA, 20 bp, human
ggggctttcagagagcgggt

SEQ ID NO: 349081 - DNA, 20 bp, human
gagatgttgcttggctagga

SEQ ID NO: 349082 - DNA, 20 bp, human
gggaagggccgttcccggag

SEQ ID NO: 349083 - DNA, 20 bp, human
gggatgggggaggacgaaga

SEQ ID NO: 349084 - DNA, 20 bp, human
gaggacgggctctagacgct

SEQ ID NO: 349085 - DNA, 20 bp, human
ggaaagccccgcccaagact

SEQ ID NO: 349086 - DNA, 20 bp, human
ggagtcttgccctagtaagt

SEQ ID NO: 349087 - DNA, 20 bp, human
gaagaagagcgaaagagaac

SEQ ID NO: 349088 - DNA, 20 bp, human
gctaaagacttaacagacct

SEQ ID NO: 349089 - DNA, 20 bp, human
gaagactcatgaacaggggg

SEQ ID NO: 349090 - DNA, 20 bp, human
gggcaagactcatgaacagg

SEQ ID NO: 349091 - DNA, 20 bp, human
ggcagcactcctacttacta

SEQ ID NO: 349092 - DNA, 20 bp, human
gtagggcaagactcatgaac

SEQ ID NO: 349093 - DNA, 20 bp, human
gtggtactaactacaaatat

SEQ ID NO: 349094 - DNA, 20 bp, human
gcctgtgatgaatacagaaa

SEQ ID NO: 349095 - DNA, 20 bp, human
gacaagaccctaaactcatg

SEQ ID NO: 349096 - DNA, 20 bp, human
gggagccaaagtcgacgtgg

SEQ ID NO: 349097 - DNA, 20 bp, human
gggcccgggtcacgtgacta

SEQ ID NO: 349098 - DNA, 20 bp, human
gggtggagccaaagtcgacg

SEQ ID NO: 349099 - DNA, 20 bp, human
gttggctccacctgcagcgg

SEQ ID NO: 349100 - DNA, 20 bp, human
gaaagtcgacgtggaggctt

SEQ ID NO: 349101 - DNA, 20 bp, human
gcaggctggcccaggcgcct

SEQ ID NO: 349102 - DNA, 20 bp, human
gtcggcgtagacacacaact

SEQ ID NO: 349103 - DNA, 20 bp, human
gcgccgtagtcacgtgaccc

SEQ ID NO: 349104 - DNA, 20 bp, human
gggcccaggcgcctagggcg

SEQ ID NO: 349105 - DNA, 20 bp, human
gcctgcgcctgcgcagtact

SEQ ID NO: 349106 - DNA, 20 bp, human
ggcggcccgcgggatgttgg

SEQ ID NO: 349107 - DNA, 20 bp, human
gggagaccacggcgctcgga

SEQ ID NO: 349108 - DNA, 20 bp, human
gaaggagggccgggtgagga

SEQ ID NO: 349109 - DNA, 20 bp, human
gagcaggggtggcccaaagt

SEQ ID NO: 349110 - DNA, 20 bp, human
ggtgcggagggcgactggag

SEQ ID NO: 349111 - DNA, 20 bp, human
gaggggtggcccaaagtggg

SEQ ID NO: 349112 - DNA, 20 bp, human
gccggatcccagcgccgggc

SEQ ID NO: 349113 - DNA, 20 bp, human
gacggcgctcggagggaacc

SEQ ID NO: 349114 - DNA, 20 bp, human
ggatccggcgcgcgctccca

SEQ ID NO: 349115 - DNA, 20 bp, human
gacagggagaccacggcgct

SEQ ID NO: 349116 - DNA, 20 bp, human
gctggcccgaggttcctccg

SEQ ID NO: 349117 - DNA, 20 bp, human
ggccaggcggggctcgtcgc

SEQ ID NO: 349118 - DNA, 20 bp, human
gcggaagcgcgtccgccccc

SEQ ID NO: 349119 - DNA, 20 bp, human
gggcggggcgagcccggcat

SEQ ID NO: 349120 - DNA, 20 bp, human
gagcggccggtcctcacgga

SEQ ID NO: 349121 - DNA, 20 bp, human
ggccggtcctcacggaggga

SEQ ID NO: 349122 - DNA, 20 bp, human
gcagtcccgcgttccctcgg

SEQ ID NO: 349123 - DNA, 20 bp, human
ggagccccgcctggcgccag

SEQ ID NO: 349124 - DNA, 20 bp, human
gacggagggagggcggggta

SEQ ID NO: 349125 - DNA, 20 bp, human
gcctccgcgggcggtttccc

SEQ ID NO: 349126 - DNA, 20 bp, human
gaggactgaaagggaatggg

SEQ ID NO: 349127 - DNA, 20 bp, human
gtagcttgggaagtgaattt

SEQ ID NO: 349128 - DNA, 20 bp, human
gacaccaggtagcactgaca

SEQ ID NO: 349129 - DNA, 20 bp, human
gtctgggcaactgtgtccat

SEQ ID NO: 349130 - DNA, 20 bp, human
gggtctgggaagcttatgca

SEQ ID NO: 349131 - DNA, 20 bp, human
gcgccagggcatgaaacacc

SEQ ID NO: 349132 - DNA, 20 bp, human
ggaagcttatgcacgggcaa

SEQ ID NO: 349133 - DNA, 20 bp, human
gcactgacagggctgtagaa

SEQ ID NO: 349134 - DNA, 20 bp, human
gctgtagaaaggtgacagag

SEQ ID NO: 349135 - DNA, 20 bp, human
gaatgccctgctgtctgtga

SEQ ID NO: 349136 - DNA, 20 bp, human
gacacagcgtagggtacata

SEQ ID NO: 349137 - DNA, 20 bp, human
gtcgctgaaccggtttccca

SEQ ID NO: 349138 - DNA, 20 bp, human
gggaaggacgggtatgagat

SEQ ID NO: 349139 - DNA, 20 bp, human
gatgtgtggggcattatata

SEQ ID NO: 349140 - DNA, 20 bp, human
gaagcgtcatacacagcgta

SEQ ID NO: 349141 - DNA, 20 bp, human
gaggaaaacaatcgctgaac

SEQ ID NO: 349142 - DNA, 20 bp, human
gcacagcagttaattcatca

SEQ ID NO: 349143 - DNA, 20 bp, human
gataaagtgaaatgaggtgg

SEQ ID NO: 349144 - DNA, 20 bp, human
ggatcacatgaaagttttaa

SEQ ID NO: 349145 - DNA, 20 bp, human
gtacgaaataaagtgaaatg

SEQ ID NO: 349146 - DNA, 20 bp, human
gttactctcgtcaccgcctc

SEQ ID NO: 349147 - DNA, 20 bp, human
gcgggtgggcgacagcccgg

SEQ ID NO: 349148 - DNA, 20 bp, human
ggtgacgagagtaagatgga

SEQ ID NO: 349149 - DNA, 20 bp, human
gtggtggaccgcagttgcta

SEQ ID NO: 349150 - DNA, 20 bp, human
gggcagctgcgcgctttcac

SEQ ID NO: 349151 - DNA, 20 bp, human
gccaatggaggcccggagac

SEQ ID NO: 349152 - DNA, 20 bp, human
gcccacccgcccctcctgaa

SEQ ID NO: 349153 - DNA, 20 bp, human
ggggcggagccagaacaagc

SEQ ID NO: 349154 - DNA, 20 bp, human
gggcggtgacgagagtaaga

SEQ ID NO: 349155 - DNA, 20 bp, human
ggacagcgacctttcaggag

SEQ ID NO: 349156 - DNA, 20 bp, human
gcggggaagtcgtgacggac

SEQ ID NO: 349157 - DNA, 20 bp, human
ggccgtgtggaacgccgtga

SEQ ID NO: 349158 - DNA, 20 bp, human
ggcagacaggccaatggctg

SEQ ID NO: 349159 - DNA, 20 bp, human
gacctctggtgactacggga

SEQ ID NO: 349160 - DNA, 20 bp, human
ggagggcggggaagtcgtga

SEQ ID NO: 349161 - DNA, 20 bp, human
gactacgggaaggcagggcg

SEQ ID NO: 349162 - DNA, 20 bp, human
ggaagaggcggtgcgaccgg

SEQ ID NO: 349163 - DNA, 20 bp, human
ggacgggcgggtgggccaat

SEQ ID NO: 349164 - DNA, 20 bp, human
ggggcgacctctggtgacta

SEQ ID NO: 349165 - DNA, 20 bp, human
gggtgaagaggcggtgcgac

SEQ ID NO: 349166 - DNA, 20 bp, human
gaagttggggtcagcgtatg

SEQ ID NO: 349167 - DNA, 20 bp, human
gagcgtatggggaaaagcac

SEQ ID NO: 349168 - DNA, 20 bp, human
ggcagtgcaagctgccagga

SEQ ID NO: 349169 - DNA, 20 bp, human
gcgtggccatgcccaggcct

SEQ ID NO: 349170 - DNA, 20 bp, human
gggccattggcttcacaccc

SEQ ID NO: 349171 - DNA, 20 bp, human
gggccactgaccgtgtcaga

SEQ ID NO: 349172 - DNA, 20 bp, human
gatcctatgaccactcgagt

SEQ ID NO: 349173 - DNA, 20 bp, human
gggcctgggtgtgaagccaa

SEQ ID NO: 349174 - DNA, 20 bp, human
ggtagtgtaatcacagcaaa

SEQ ID NO: 349175 - DNA, 20 bp, human
gttccctctgacacggtcag

SEQ ID NO: 349176 - DNA, 20 bp, human
ggtacccggcggggcaccga

SEQ ID NO: 349177 - DNA, 20 bp, human
ggagcggtgtggagcgggta

SEQ ID NO: 349178 - DNA, 20 bp, human
gcccaggccggggctaatga

SEQ ID NO: 349179 - DNA, 20 bp, human
gcggtgtggagcgggtaagg

SEQ ID NO: 349180 - DNA, 20 bp, human
ggagggttgggcgccaacta

SEQ ID NO: 349181 - DNA, 20 bp, human
gcgggggagcggtgtggagc

SEQ ID NO: 349182 - DNA, 20 bp, human
gaggccactctggaagtgag

SEQ ID NO: 349183 - DNA, 20 bp, human
gcctctgtgggttccctagt

SEQ ID NO: 349184 - DNA, 20 bp, human
gtaaactagatgaagtgagg

SEQ ID NO: 349185 - DNA, 20 bp, human
ggggtacggtggctgggcgc

SEQ ID NO: 349186 - DNA, 20 bp, human
gcgtaggcggaacccgggtc

SEQ ID NO: 349187 - DNA, 20 bp, human
gaacccgggtcgggctgagg

SEQ ID NO: 349188 - DNA, 20 bp, human
ggctccgtgccacaccagtc

SEQ ID NO: 349189 - DNA, 20 bp, human
gctgaggtgggcccgagggt

SEQ ID NO: 349190 - DNA, 20 bp, human
gcgcccccagcccaaccctc

SEQ ID NO: 349191 - DNA, 20 bp, human
gcgggctgaggtgggcccga

SEQ ID NO: 349192 - DNA, 20 bp, human
gtcgaggtcggagctgaggg

SEQ ID NO: 349193 - DNA, 20 bp, human
gcggggacgtaggcggaacc

SEQ ID NO: 349194 - DNA, 20 bp, human
gtggggacggagtcgagttc

SEQ ID NO: 349195 - DNA, 20 bp, human
ggagtcggggcggtgtgctg

SEQ ID NO: 349196 - DNA, 20 bp, human
gttccctgagggctggacca

SEQ ID NO: 349197 - DNA, 20 bp, human
gaaatcacaccacacctcca

SEQ ID NO: 349198 - DNA, 20 bp, human
gtaccttaaatagactccta

SEQ ID NO: 349199 - DNA, 20 bp, human
gaagaatttgttcaccacct

SEQ ID NO: 349200 - DNA, 20 bp, human
gaaccttaggagtctattta

SEQ ID NO: 349201 - DNA, 20 bp, human
gggtagaattacttccctga

SEQ ID NO: 349202 - DNA, 20 bp, human
gaggatcgacttagatgagg

SEQ ID NO: 349203 - DNA, 20 bp, human
gtgccagtcacatttacaca

SEQ ID NO: 349204 - DNA, 20 bp, human
ggggaggatcgacttagatg

SEQ ID NO: 349205 - DNA, 20 bp, human
gaacttgctaagtgagccaa

SEQ ID NO: 349206 - DNA, 20 bp, human
ggcggggcgcgtgaggactt

SEQ ID NO: 349207 - DNA, 20 bp, human
gcgcgccggaagcacgtgcg

SEQ ID NO: 349208 - DNA, 20 bp, human
ggggccctccaccctccgtc

SEQ ID NO: 349209 - DNA, 20 bp, human
gcggcaggtgggggcgttgg

SEQ ID NO: 349210 - DNA, 20 bp, human
gtggcggtgtgcgctgaggt

SEQ ID NO: 349211 - DNA, 20 bp, human
gcgcgtgcgcacggggaggc

SEQ ID NO: 349212 - DNA, 20 bp, human
gtgggcagagcggcaggtgg

SEQ ID NO: 349213 - DNA, 20 bp, human
ggctctggcggtgtgcgctg

SEQ ID NO: 349214 - DNA, 20 bp, human
gaggaggaaggtgcccgcac

SEQ ID NO: 349215 - DNA, 20 bp, human
ggcagccgctgggagaccgg

SEQ ID NO: 349216 - DNA, 20 bp, human
ggggggcgggacaagaggcg

SEQ ID NO: 349217 - DNA, 20 bp, human
ggacaagaggcgcggattgg

SEQ ID NO: 349218 - DNA, 20 bp, human
gcgggacaagaggcgcggat

SEQ ID NO: 349219 - DNA, 20 bp, human
ggggggcagagtcgagtctc

SEQ ID NO: 349220 - DNA, 20 bp, human
gtgagaaggaccaagcccaa

SEQ ID NO: 349221 - DNA, 20 bp, human
gccaggcgacgctttccgaa

SEQ ID NO: 349222 - DNA, 20 bp, human
gcagagtcgagtctccggat

SEQ ID NO: 349223 - DNA, 20 bp, human
ggatacaaatgcaaagaagg

SEQ ID NO: 349224 - DNA, 20 bp, human
gggagcgggtcgcgccggag

SEQ ID NO: 349225 - DNA, 20 bp, human
gagtccgctccgatccaatc

SEQ ID NO: 349226 - DNA, 20 bp, human
gcaggcggactggcgatgat

SEQ ID NO: 349227 - DNA, 20 bp, human
gccgccccgcgaacaaacct

SEQ ID NO: 349228 - DNA, 20 bp, human
ggggagaaaggcggccagtt

SEQ ID NO: 349229 - DNA, 20 bp, human
gtgtcacgtgaccctgcgag

SEQ ID NO: 349230 - DNA, 20 bp, human
gcccgcgaacaaacctaggc

SEQ ID NO: 349231 - DNA, 20 bp, human
ggaacaaacctaggcgggga

SEQ ID NO: 349232 - DNA, 20 bp, human
gcggatctgagccactcgca

SEQ ID NO: 349233 - DNA, 20 bp, human
gagccggcggctggccttag

SEQ ID NO: 349234 - DNA, 20 bp, human
ggcgaggaagcggaaggagc

SEQ ID NO: 349235 - DNA, 20 bp, human
ggaaggggcgaggaagcgga

SEQ ID NO: 349236 - DNA, 20 bp, human
gggccacaagccaatagcga

SEQ ID NO: 349237 - DNA, 20 bp, human
gagtcaaaaggcggggtcat

SEQ ID NO: 349238 - DNA, 20 bp, human
gtacgagcaagggacgcgac

SEQ ID NO: 349239 - DNA, 20 bp, human
gggagaaaggcgagtctctt

SEQ ID NO: 349240 - DNA, 20 bp, human
ggagggagaaacctcgaaga

SEQ ID NO: 349241 - DNA, 20 bp, human
gcaccaacaagtacgagcaa

SEQ ID NO: 349242 - DNA, 20 bp, human
ggaaacctcgaagatggacg

SEQ ID NO: 349243 - DNA, 20 bp, human
gatagcccaccctcgaaggt

SEQ ID NO: 349244 - DNA, 20 bp, human
gattacccgcctaccttcga

SEQ ID NO: 349245 - DNA, 20 bp, human
gctcgaagatggacgaggta

SEQ ID NO: 349246 - DNA, 20 bp, human
ggaacgcgggagtggcggta

SEQ ID NO: 349247 - DNA, 20 bp, human
gccgacctacccagcggcgc

SEQ ID NO: 349248 - DNA, 20 bp, human
gcaccctaagcccaagtccc

SEQ ID NO: 349249 - DNA, 20 bp, human
ggccactcccgcgttcctac

SEQ ID NO: 349250 - DNA, 20 bp, human
ggggagcgcgcgagggatcg

SEQ ID NO: 349251 - DNA, 20 bp, human
gagcggcgccggtaggaacg

SEQ ID NO: 349252 - DNA, 20 bp, human
gtcttggccgacctacccag

SEQ ID NO: 349253 - DNA, 20 bp, human
gcggggcggaggtggagatc

SEQ ID NO: 349254 - DNA, 20 bp, human
gacctgggagtattgagggg

SEQ ID NO: 349255 - DNA, 20 bp, human
gtgacagtgcggagaccaat

SEQ ID NO: 349256 - DNA, 20 bp, human
gtcctgacctctagtgggga

SEQ ID NO: 349257 - DNA, 20 bp, human
gggggcctcctgacctctag

SEQ ID NO: 349258 - DNA, 20 bp, human
gtccctgccctccccactag

SEQ ID NO: 349259 - DNA, 20 bp, human
gagaggtcaggaggccccac

SEQ ID NO: 349260 - DNA, 20 bp, human
ggccctccccactagaggtc

SEQ ID NO: 349261 - DNA, 20 bp, human
gggctatactagatgtctac

SEQ ID NO: 349262 - DNA, 20 bp, human
ggaaccatgagcctgaagtt

SEQ ID NO: 349263 - DNA, 20 bp, human
ggggggacctccaactgtaa

SEQ ID NO: 349264 - DNA, 20 bp, human
gctcctctttacagctcaga

SEQ ID NO: 349265 - DNA, 20 bp, human
gcaccatctgagctgtaaag

SEQ ID NO: 349266 - DNA, 20 bp, human
gagcccacacgcgagtgagg

SEQ ID NO: 349267 - DNA, 20 bp, human
gtcctcccgcacggcggcga

SEQ ID NO: 349268 - DNA, 20 bp, human
gcaagccagggataagttag

SEQ ID NO: 349269 - DNA, 20 bp, human
gccagggataagttagtggg

SEQ ID NO: 349270 - DNA, 20 bp, human
gggcggcgacggggcaggtt

SEQ ID NO: 349271 - DNA, 20 bp, human
gtctaccggctcctcccgca

SEQ ID NO: 349272 - DNA, 20 bp, human
gataatgagccaatcggaag

SEQ ID NO: 349273 - DNA, 20 bp, human
ggccctcgagctgtggaaag

SEQ ID NO: 349274 - DNA, 20 bp, human
ggaggaggcggggcaagcca

SEQ ID NO: 349275 - DNA, 20 bp, human
ggggcaggttaggtttccac

SEQ ID NO: 349276 - DNA, 20 bp, human
ggggccccgcatgacatcag

SEQ ID NO: 349277 - DNA, 20 bp, human
gatgtcatgcggggcccgcg

SEQ ID NO: 349278 - DNA, 20 bp, human
gtcaaaagaggggtagagtg

SEQ ID NO: 349279 - DNA, 20 bp, human
gagacacggtcccccccggg

SEQ ID NO: 349280 - DNA, 20 bp, human
gccccccggggggctctcag

SEQ ID NO: 349281 - DNA, 20 bp, human
gcgcatgacatcagaggctg

SEQ ID NO: 349282 - DNA, 20 bp, human
ggtggggaagacagacgcag

SEQ ID NO: 349283 - DNA, 20 bp, human
ggggagggggccgactggcg

SEQ ID NO: 349284 - DNA, 20 bp, human
gtctaggcctcgagagggaa

SEQ ID NO: 349285 - DNA, 20 bp, human
ggcagcggggcagcgagaca

SEQ ID NO: 349286 - DNA, 20 bp, human
gttctgacctctcacagaga

SEQ ID NO: 349287 - DNA, 20 bp, human
gttctgttcaaatgcaaggt

SEQ ID NO: 349288 - DNA, 20 bp, human
gatctctcctaacatcaggc

SEQ ID NO: 349289 - DNA, 20 bp, human
gcaacatctctcctaacatc

SEQ ID NO: 349290 - DNA, 20 bp, human
gtcagtctaatacaagtctt

SEQ ID NO: 349291 - DNA, 20 bp, human
gtcacagagacggggagata

SEQ ID NO: 349292 - DNA, 20 bp, human
ggagatcccggatacatctg

SEQ ID NO: 349293 - DNA, 20 bp, human
gtatttaaaaaactgtgttg

SEQ ID NO: 349294 - DNA, 20 bp, human
gttattgtaatatagaaata

SEQ ID NO: 349295 - DNA, 20 bp, human
gtaacttacactataataca

SEQ ID NO: 349296 - DNA, 20 bp, human
gggaacgtgacgcaaggttg

SEQ ID NO: 349297 - DNA, 20 bp, human
ggcagccggaacgtgacgca

SEQ ID NO: 349298 - DNA, 20 bp, human
gccaccgaagaggggacaag

SEQ ID NO: 349299 - DNA, 20 bp, human
ggtgacgcaaggttgaggcg

SEQ ID NO: 349300 - DNA, 20 bp, human
ggacgctcgacgccagggtg

SEQ ID NO: 349301 - DNA, 20 bp, human
ggatggggacaaccatttgg

SEQ ID NO: 349302 - DNA, 20 bp, human
ggctcgacgccagggtgcgg

SEQ ID NO: 349303 - DNA, 20 bp, human
ggcgtcgagcgtctcgtgac

SEQ ID NO: 349304 - DNA, 20 bp, human
gggctgagggaatctgtctg

SEQ ID NO: 349305 - DNA, 20 bp, human
gcggcggcggtggcggaagt

SEQ ID NO: 349306 - DNA, 20 bp, human
gaagccttgaaacttggtgt

SEQ ID NO: 349307 - DNA, 20 bp, human
gcgtgacgcttgcggaggaa

SEQ ID NO: 349308 - DNA, 20 bp, human
ggctcaccgcgaagcctcct

SEQ ID NO: 349309 - DNA, 20 bp, human
gtccgcaagcgtcacgtgca

SEQ ID NO: 349310 - DNA, 20 bp, human
gccactggggccagatgatg

SEQ ID NO: 349311 - DNA, 20 bp, human
gatctggccccagtggtgta

SEQ ID NO: 349312 - DNA, 20 bp, human
gctgggaaatgtagtgccac

SEQ ID NO: 349313 - DNA, 20 bp, human
gtcaaactccctcgacagtt

SEQ ID NO: 349314 - DNA, 20 bp, human
gacttggagcatgatggatg

SEQ ID NO: 349315 - DNA, 20 bp, human
gcatttcccagctttcctcg

SEQ ID NO: 349316 - DNA, 20 bp, human
gcctgcgtcccgccagtcgc

SEQ ID NO: 349317 - DNA, 20 bp, human
gagtcgcggggcttcaaatg

SEQ ID NO: 349318 - DNA, 20 bp, human
gcgcggggagaccttgggag

SEQ ID NO: 349319 - DNA, 20 bp, human
gcgggcctggagccaataag

SEQ ID NO: 349320 - DNA, 20 bp, human
gcaggggcgggcgtcggccg

SEQ ID NO: 349321 - DNA, 20 bp, human
gcccgccccactgtaggaga

SEQ ID NO: 349322 - DNA, 20 bp, human
gggcccgctgcgcgtcaccg

SEQ ID NO: 349323 - DNA, 20 bp, human
gccggcactagggagagcac

SEQ ID NO: 349324 - DNA, 20 bp, human
gccagtcgcggggagacctt

SEQ ID NO: 349325 - DNA, 20 bp, human
ggcttcaaatggggacgagg

SEQ ID NO: 349326 - DNA, 20 bp, human
gccgtgcggccaatcggcga

SEQ ID NO: 349327 - DNA, 20 bp, human
gtcctcgcggggcacgcccg

SEQ ID NO: 349328 - DNA, 20 bp, human
ggggacttgtagttcctccg

SEQ ID NO: 349329 - DNA, 20 bp, human
gtgccccgcgaggactgtcc

SEQ ID NO: 349330 - DNA, 20 bp, human
gccgcccctcctctcggaga

SEQ ID NO: 349331 - DNA, 20 bp, human
gccgcgccccgggacttcat

SEQ ID NO: 349332 - DNA, 20 bp, human
ggccgcctggacagtcctcg

SEQ ID NO: 349333 - DNA, 20 bp, human
gcccgcgaggactgtccagg

SEQ ID NO: 349334 - DNA, 20 bp, human
gctgctatgggcggggtgac

SEQ ID NO: 349335 - DNA, 20 bp, human
gaggccttctccgagaggag

SEQ ID NO: 349336 - DNA, 20 bp, human
gtcgcccgaacgcagacggg

SEQ ID NO: 349337 - DNA, 20 bp, human
ggtcccgcggccgagaccct

SEQ ID NO: 349338 - DNA, 20 bp, human
ggcagacgggaggacacttc

SEQ ID NO: 349339 - DNA, 20 bp, human
gcgaaggaaaagcacgatcc

SEQ ID NO: 349340 - DNA, 20 bp, human
gctgtcgcccgaacgcagac

SEQ ID NO: 349341 - DNA, 20 bp, human
gtcaggagcaatcgacccga

SEQ ID NO: 349342 - DNA, 20 bp, human
gtcccccagggtctcggccg

SEQ ID NO: 349343 - DNA, 20 bp, human
gagaccctgggggacgggcg

SEQ ID NO: 349344 - DNA, 20 bp, human
gacctcatgagcacagtcac

SEQ ID NO: 349345 - DNA, 20 bp, human
gtgctcccgtccagcgcgga

SEQ ID NO: 349346 - DNA, 20 bp, human
gggagcgcttgccacatgga

SEQ ID NO: 349347 - DNA, 20 bp, human
ggtgcctactaatcggctag

SEQ ID NO: 349348 - DNA, 20 bp, human
gggacaagggagaccagggt

SEQ ID NO: 349349 - DNA, 20 bp, human
gtgccgctgtgcctactaat

SEQ ID NO: 349350 - DNA, 20 bp, human
gaaagaagagtgggcgagcc

SEQ ID NO: 349351 - DNA, 20 bp, human
gccagggagcgcttgccaca

SEQ ID NO: 349352 - DNA, 20 bp, human
ggataaatgaggtagatcag

SEQ ID NO: 349353 - DNA, 20 bp, human
gcctactaatcggctagggg

SEQ ID NO: 349354 - DNA, 20 bp, human
ggggtccccaccgccgagaa

SEQ ID NO: 349355 - DNA, 20 bp, human
gcctcgtgcccctttctcgg

SEQ ID NO: 349356 - DNA, 20 bp, human
gaggatgggcgctatgatgg

SEQ ID NO: 349357 - DNA, 20 bp, human
gtgacggtgactaagaggat

SEQ ID NO: 349358 - DNA, 20 bp, human
gaagaggatgggcgctatga

SEQ ID NO: 349359 - DNA, 20 bp, human
gagtcctgacggtgactaag

SEQ ID NO: 349360 - DNA, 20 bp, human
gccacccagcggagtcgacg

SEQ ID NO: 349361 - DNA, 20 bp, human
gcaactcccacaatactcgg

SEQ ID NO: 349362 - DNA, 20 bp, human
gacagtccccagctgctccg

SEQ ID NO: 349363 - DNA, 20 bp, human
gctacaactcccacaatact

SEQ ID NO: 349364 - DNA, 20 bp, human
gctgactcgcaaaacacctt

SEQ ID NO: 349365 - DNA, 20 bp, human
ggcgcgcgccgtcactttct

SEQ ID NO: 349366 - DNA, 20 bp, human
gcgggaggggagggtttcgg

SEQ ID NO: 349367 - DNA, 20 bp, human
gcggcgggaggggagggttt

SEQ ID NO: 349368 - DNA, 20 bp, human
gggggcctcgggagcgcgga

SEQ ID NO: 349369 - DNA, 20 bp, human
gagtaagagaggaggaccga

SEQ ID NO: 349370 - DNA, 20 bp, human
ggcgcctgacccagcggcgc

SEQ ID NO: 349371 - DNA, 20 bp, human
ggtgacgttggcccgagggg

SEQ ID NO: 349372 - DNA, 20 bp, human
ggggagggtttcggcggagc

SEQ ID NO: 349373 - DNA, 20 bp, human
ggctgagtgccgagcggagc

SEQ ID NO: 349374 - DNA, 20 bp, human
gcacgtgacgttggcccgag

SEQ ID NO: 349375 - DNA, 20 bp, human
gcagaggcctggcctctcga

SEQ ID NO: 349376 - DNA, 20 bp, human
ggccccggacggaggatggg

SEQ ID NO: 349377 - DNA, 20 bp, human
gaggaggcataattggagca

SEQ ID NO: 349378 - DNA, 20 bp, human
ggggccgactcgggaatctt

SEQ ID NO: 349379 - DNA, 20 bp, human
ggccccgccccggctcttct

SEQ ID NO: 349380 - DNA, 20 bp, human
ggaggccccggacggaggat

SEQ ID NO: 349381 - DNA, 20 bp, human
gcagccaagaagagccgggg

SEQ ID NO: 349382 - DNA, 20 bp, human
ggccagcaggaagcggtgac

SEQ ID NO: 349383 - DNA, 20 bp, human
gaagagcctgatctagacac

SEQ ID NO: 349384 - DNA, 20 bp, human
gggcggccggagccgatcaa

SEQ ID NO: 349385 - DNA, 20 bp, human
gagcctgatctagacacagg

SEQ ID NO: 349386 - DNA, 20 bp, human
gtggaggggtcccccagacc

SEQ ID NO: 349387 - DNA, 20 bp, human
ggggtcccccagaccgggag

SEQ ID NO: 349388 - DNA, 20 bp, human
gctggcgtccactcccggtc

SEQ ID NO: 349389 - DNA, 20 bp, human
gcccctccggggtggagtca

SEQ ID NO: 349390 - DNA, 20 bp, human
ggcgtccactcccggtctgg

SEQ ID NO: 349391 - DNA, 20 bp, human
gagtcagcgccgggccctcg

SEQ ID NO: 349392 - DNA, 20 bp, human
gggacgggataaataagccg

SEQ ID NO: 349393 - DNA, 20 bp, human
gagagcctggcgtccactcc

SEQ ID NO: 349394 - DNA, 20 bp, human
gagccgtgactccaccccgg

SEQ ID NO: 349395 - DNA, 20 bp, human
gcgctcttccgggtcctggg

SEQ ID NO: 349396 - DNA, 20 bp, human
gcaggcgcacagtcctgagg

SEQ ID NO: 349397 - DNA, 20 bp, human
gggcccaataccgggaagcg

SEQ ID NO: 349398 - DNA, 20 bp, human
ggccccctgccccgtctcat

SEQ ID NO: 349399 - DNA, 20 bp, human
ggcgcctgcgcgaagtgcac

SEQ ID NO: 349400 - DNA, 20 bp, human
ggtcgcagacctatgagacg

SEQ ID NO: 349401 - DNA, 20 bp, human
ggaccctattggcccaatac

SEQ ID NO: 349402 - DNA, 20 bp, human
gtcccggtattgggccaata

SEQ ID NO: 349403 - DNA, 20 bp, human
gcgcctcgcttcccggtatt

SEQ ID NO: 349404 - DNA, 20 bp, human
gctcacgtgagtaaaggggt

SEQ ID NO: 349405 - DNA, 20 bp, human
ggcgcaggcgcacagtcctg

SEQ ID NO: 349406 - DNA, 20 bp, human
gtgcgcgctcctgatgtcgg

SEQ ID NO: 349407 - DNA, 20 bp, human
gcgccgccgcccggcagagt

SEQ ID NO: 349408 - DNA, 20 bp, human
gcggcgctggagaacctccg

SEQ ID NO: 349409 - DNA, 20 bp, human
gtcggaggcgcccactctgc

SEQ ID NO: 349410 - DNA, 20 bp, human
ggcgtgcgcgctcctgatgt

SEQ ID NO: 349411 - DNA, 20 bp, human
gagtgggcgcctccgacatc

SEQ ID NO: 349412 - DNA, 20 bp, human
gagcgcgcacgccgcgcaga

SEQ ID NO: 349413 - DNA, 20 bp, human
gcgaaaggcgggagtacggg

SEQ ID NO: 349414 - DNA, 20 bp, human
gaaccagagctgttagagca

SEQ ID NO: 349415 - DNA, 20 bp, human
ggtccctgctctaacagctc

SEQ ID NO: 349416 - DNA, 20 bp, human
gaagtgcgagtggatccaaa

SEQ ID NO: 349417 - DNA, 20 bp, human
gcggcctccggggtaaaggt

SEQ ID NO: 349418 - DNA, 20 bp, human
gcaaagggtcgagcggagtg

SEQ ID NO: 349419 - DNA, 20 bp, human
gcgtccagagtcaaaggccc

SEQ ID NO: 349420 - DNA, 20 bp, human
gggaaacgccggtttctccg

SEQ ID NO: 349421 - DNA, 20 bp, human
gtggggagccccggagaaac

SEQ ID NO: 349422 - DNA, 20 bp, human
gtggaagagggcggcctccg

SEQ ID NO: 349423 - DNA, 20 bp, human
gtggctccgcggcgactcct

SEQ ID NO: 349424 - DNA, 20 bp, human
gcgtaacgtgcgttcgctgg

SEQ ID NO: 349425 - DNA, 20 bp, human
gagggcggcctccggggtaa

SEQ ID NO: 349426 - DNA, 20 bp, human
ggtagcgtgcgtgtgaaatg

SEQ ID NO: 349427 - DNA, 20 bp, human
ggaaacgcagcgcactctgc

SEQ ID NO: 349428 - DNA, 20 bp, human
gcgcactcgtacacaccagg

SEQ ID NO: 349429 - DNA, 20 bp, human
gaaggctgtcggtgtggcca

SEQ ID NO: 349430 - DNA, 20 bp, human
gcttggggagggacttgcgg

SEQ ID NO: 349431 - DNA, 20 bp, human
ggtgcccgggagccgtggga

SEQ ID NO: 349432 - DNA, 20 bp, human
gcaggtggctaacaggtacg

SEQ ID NO: 349433 - DNA, 20 bp, human
gcggctcggaggcgcgtgcg

SEQ ID NO: 349434 - DNA, 20 bp, human
gaacaggtacgaggcgtttc

SEQ ID NO: 349435 - DNA, 20 bp, human
gctagagcggcgccacgtcc

SEQ ID NO: 349436 - DNA, 20 bp, human
gagcgatcagtggggtccta

SEQ ID NO: 349437 - DNA, 20 bp, human
ggacacctatgagcgatcag

SEQ ID NO: 349438 - DNA, 20 bp, human
ggaccccactgatcgctcat

SEQ ID NO: 349439 - DNA, 20 bp, human
gaaagtgtggtcagctatat

SEQ ID NO: 349440 - DNA, 20 bp, human
ggggacaagcatatggtcgc

SEQ ID NO: 349441 - DNA, 20 bp, human
ggtcgcaggactttggacgc

SEQ ID NO: 349442 - DNA, 20 bp, human
gtggggtcctacggcagccg

SEQ ID NO: 349443 - DNA, 20 bp, human
gcagctatatcggagcgcga

SEQ ID NO: 349444 - DNA, 20 bp, human
gccggctcctaagtctaccc

SEQ ID NO: 349445 - DNA, 20 bp, human
gctatatcggagcgcgatgg

SEQ ID NO: 349446 - DNA, 20 bp, human
gtaagtggctaggtgtcggc

SEQ ID NO: 349447 - DNA, 20 bp, human
gacacctagccacttaggtt

SEQ ID NO: 349448 - DNA, 20 bp, human
gtgcgcagtagagtccagag

SEQ ID NO: 349449 - DNA, 20 bp, human
gtaggttaggcaatgaatga

SEQ ID NO: 349450 - DNA, 20 bp, human
gcgctggcgcggcttggcag

SEQ ID NO: 349451 - DNA, 20 bp, human
ggggtatggagatgtgtcac

SEQ ID NO: 349452 - DNA, 20 bp, human
gattcattgcctaacctaag

SEQ ID NO: 349453 - DNA, 20 bp, human
gtggcgcggcttggcagagg

SEQ ID NO: 349454 - DNA, 20 bp, human
gaaaacctagacaaatcatt

SEQ ID NO: 349455 - DNA, 20 bp, human
ggcgcagacgctgtctctgc

SEQ ID NO: 349456 - DNA, 20 bp, human
gctccctcggggtccttgcg

SEQ ID NO: 349457 - DNA, 20 bp, human
ggctgctacgcaaccgcgca

SEQ ID NO: 349458 - DNA, 20 bp, human
gcgggtgccgcccgcctaga

SEQ ID NO: 349459 - DNA, 20 bp, human
ggccgcagggagtgcgcatg

SEQ ID NO: 349460 - DNA, 20 bp, human
ggccgcccgcctagagggag

SEQ ID NO: 349461 - DNA, 20 bp, human
gtgagcacgtcaggggtggg

SEQ ID NO: 349462 - DNA, 20 bp, human
ggactggggctcctggctgt

SEQ ID NO: 349463 - DNA, 20 bp, human
gtggagcggtgagcacgtca

SEQ ID NO: 349464 - DNA, 20 bp, human
ggcggccgagtgcgggactg

SEQ ID NO: 349465 - DNA, 20 bp, human
gtgcgcatgcggccgagtgc

SEQ ID NO: 349466 - DNA, 20 bp, human
gttctgaagaaaacacacaa

SEQ ID NO: 349467 - DNA, 20 bp, human
gctccctcggggtccttgtg

SEQ ID NO: 349468 - DNA, 20 bp, human
gggctgtgggtgtggtaccg

SEQ ID NO: 349469 - DNA, 20 bp, human
ggctgctacgcaaccgcaca

SEQ ID NO: 349470 - DNA, 20 bp, human
gcgggtgccgcccgcctaga

SEQ ID NO: 349471 - DNA, 20 bp, human
ggccgcagggagtgcgcatg

SEQ ID NO: 349472 - DNA, 20 bp, human
ggccgcccgcctagagggag

SEQ ID NO: 349473 - DNA, 20 bp, human
gaaggcctgaaggaccccgc

SEQ ID NO: 349474 - DNA, 20 bp, human
gcgccccggcggggtccttc

SEQ ID NO: 349475 - DNA, 20 bp, human
ggactggggctcctggctgt

SEQ ID NO: 349476 - DNA, 20 bp, human
gtgcttccccagctggtcgc

SEQ ID NO: 349477 - DNA, 20 bp, human
gtggtctggtaaaaggtagc

SEQ ID NO: 349478 - DNA, 20 bp, human
gcattggctggtctggtaaa

SEQ ID NO: 349479 - DNA, 20 bp, human
gaaggtttcactgaactcat

SEQ ID NO: 349480 - DNA, 20 bp, human
ggcgtgactgtcttgatcga

SEQ ID NO: 349481 - DNA, 20 bp, human
gcccccagcgcttcaactac

SEQ ID NO: 349482 - DNA, 20 bp, human
ggggcgtggttcatttaagc

SEQ ID NO: 349483 - DNA, 20 bp, human
gcaacagggtaattcattag

SEQ ID NO: 349484 - DNA, 20 bp, human
gtaggggaggatagttaaga

SEQ ID NO: 349485 - DNA, 20 bp, human
gaagacagtcacgctccgag

SEQ ID NO: 349486 - DNA, 20 bp, human
gggaagtggccgagtcccgt

SEQ ID NO: 349487 - DNA, 20 bp, human
ggcgacggagagaggcccgc

SEQ ID NO: 349488 - DNA, 20 bp, human
gcggcgcgcggggcggaaag

SEQ ID NO: 349489 - DNA, 20 bp, human
gagaggcccgcagggccgac

SEQ ID NO: 349490 - DNA, 20 bp, human
gcggccacttccggcgcgcg

SEQ ID NO: 349491 - DNA, 20 bp, human
gctaccgagactggtggaac

SEQ ID NO: 349492 - DNA, 20 bp, human
gaggcccgttccaccagtct

SEQ ID NO: 349493 - DNA, 20 bp, human
gcgagtcccgtcggccctgc

SEQ ID NO: 349494 - DNA, 20 bp, human
gggccagcttggcacttgta

SEQ ID NO: 349495 - DNA, 20 bp, human
gtccgcgtctctaccgagac

SEQ ID NO: 349496 - DNA, 20 bp, human
gacgggacacgcaggatcgg

SEQ ID NO: 349497 - DNA, 20 bp, human
gcgagccggcgccaagatgg

SEQ ID NO: 349498 - DNA, 20 bp, human
gagcacgggacacgcaggat

SEQ ID NO: 349499 - DNA, 20 bp, human
gagaggagcacgggacacgc

SEQ ID NO: 349500 - DNA, 20 bp, human
gaggcgcagcggctaatcga

SEQ ID NO: 349501 - DNA, 20 bp, human
gcggctacggggcgccgcga

SEQ ID NO: 349502 - DNA, 20 bp, human
ggctggggcgaccggggtct

SEQ ID NO: 349503 - DNA, 20 bp, human
gcggttctggcgcgcagttc

SEQ ID NO: 349504 - DNA, 20 bp, human
ggcggacgctggggcgaccg

SEQ ID NO: 349505 - DNA, 20 bp, human
gatcgaggggaagctcaagg

SEQ ID NO: 349506 - DNA, 20 bp, human
gcccgcggccggagccgagt

SEQ ID NO: 349507 - DNA, 20 bp, human
ggccgctcccggagtttctc

SEQ ID NO: 349508 - DNA, 20 bp, human
ggccgctcccaggttccggg

SEQ ID NO: 349509 - DNA, 20 bp, human
gggaagcgctcgggcccact

SEQ ID NO: 349510 - DNA, 20 bp, human
gtccagagaaactccgggag

SEQ ID NO: 349511 - DNA, 20 bp, human
gtgcaggcccggccacgccc

SEQ ID NO: 349512 - DNA, 20 bp, human
gtggcgcgctaaagcggcct

SEQ ID NO: 349513 - DNA, 20 bp, human
gggctgccacgccccgcggc

SEQ ID NO: 349514 - DNA, 20 bp, human
ggcggccccgcccggaacct

SEQ ID NO: 349515 - DNA, 20 bp, human
gccgaagtccagagaaactc

SEQ ID NO: 349516 - DNA, 20 bp, human
gccacaggccccctgcgtgg

SEQ ID NO: 349517 - DNA, 20 bp, human
gacctgggggccctctgtgc

SEQ ID NO: 349518 - DNA, 20 bp, human
gtgctggagcctccacgcag

SEQ ID NO: 349519 - DNA, 20 bp, human
ggggcaggaggaaacggaag

SEQ ID NO: 349520 - DNA, 20 bp, human
ggccccctgcaaacgaccgt

SEQ ID NO: 349521 - DNA, 20 bp, human
gctgaggagcagcggtggtg

SEQ ID NO: 349522 - DNA, 20 bp, human
gctccccacggtcgtttgca

SEQ ID NO: 349523 - DNA, 20 bp, human
gtccccacaggccccctgcg

SEQ ID NO: 349524 - DNA, 20 bp, human
gaccaggtgctggtgatccc

SEQ ID NO: 349525 - DNA, 20 bp, human
ggaggctcacttcctgtcca

SEQ ID NO: 349526 - DNA, 20 bp, human
gccgccgggtccaggtcgct

SEQ ID NO: 349527 - DNA, 20 bp, human
gcggcccgggggtctcctac

SEQ ID NO: 349528 - DNA, 20 bp, human
ggagccagctgggaactccg

SEQ ID NO: 349529 - DNA, 20 bp, human
ggggcggggccgcccgaacc

SEQ ID NO: 349530 - DNA, 20 bp, human
gggcctgcgctgcgccccga

SEQ ID NO: 349531 - DNA, 20 bp, human
ggtctcctacgggtccctcg

SEQ ID NO: 349532 - DNA, 20 bp, human
gtgcgccccgagggacccgt

SEQ ID NO: 349533 - DNA, 20 bp, human
ggcgcagctctgcccgggtt

SEQ ID NO: 349534 - DNA, 20 bp, human
gctgccttgaagggacggga

SEQ ID NO: 349535 - DNA, 20 bp, human
gcggagagagcccagcgacc

SEQ ID NO: 349536 - DNA, 20 bp, human
gctcccgcgccgtccctcta

SEQ ID NO: 349537 - DNA, 20 bp, human
gacgcgtcagggccacgcgg

SEQ ID NO: 349538 - DNA, 20 bp, human
gacgtcacaccgtagaggga

SEQ ID NO: 349539 - DNA, 20 bp, human
gacgcggaggtgacgggaac

SEQ ID NO: 349540 - DNA, 20 bp, human
gagggccacgcggaggtgac

SEQ ID NO: 349541 - DNA, 20 bp, human
gcggtgtgacgtacgcgtca

SEQ ID NO: 349542 - DNA, 20 bp, human
ggcgtacgtcacaccgtaga

SEQ ID NO: 349543 - DNA, 20 bp, human
gcgtacgcgtcagggccacg

SEQ ID NO: 349544 - DNA, 20 bp, human
gtggcatcctgaatgacttc

SEQ ID NO: 349545 - DNA, 20 bp, human
ggaggcgcggagcgaagtga

SEQ ID NO: 349546 - DNA, 20 bp, human
gcagacctggaggacgaccg

SEQ ID NO: 349547 - DNA, 20 bp, human
gcaccgagaccggaaggagg

SEQ ID NO: 349548 - DNA, 20 bp, human
ggaaaggaggccaagagcgc

SEQ ID NO: 349549 - DNA, 20 bp, human
gcgtgccgcgccaccgagac

SEQ ID NO: 349550 - DNA, 20 bp, human
ggccgccgaaccatagagat

SEQ ID NO: 349551 - DNA, 20 bp, human
gaaccatagagatcggaaat

SEQ ID NO: 349552 - DNA, 20 bp, human
gagctccgcggtcgtcctcc

SEQ ID NO: 349553 - DNA, 20 bp, human
ggcgagcggcagcgccggaa

SEQ ID NO: 349554 - DNA, 20 bp, human
ggcggcacgcgcggctctct

SEQ ID NO: 349555 - DNA, 20 bp, human
gcgcgggcggcgaggcaaga

SEQ ID NO: 349556 - DNA, 20 bp, human
gtcaacgccgagcctctcgg

SEQ ID NO: 349557 - DNA, 20 bp, human
gtggagggtgggcataactc

SEQ ID NO: 349558 - DNA, 20 bp, human
gactggtcggcgcaagcgaa

SEQ ID NO: 349559 - DNA, 20 bp, human
gggtcggcgcaagcgaaggg

SEQ ID NO: 349560 - DNA, 20 bp, human
ggcgcccgaagccgtcgcgg

SEQ ID NO: 349561 - DNA, 20 bp, human
ggggccgccggggcaggcta

SEQ ID NO: 349562 - DNA, 20 bp, human
gcgaaagccaggtaaccagt

SEQ ID NO: 349563 - DNA, 20 bp, human
gccgaaggagtgtgtgactt

SEQ ID NO: 349564 - DNA, 20 bp, human
gtcccggggaccttccagac

SEQ ID NO: 349565 - DNA, 20 bp, human
gtcggcgttgagcccgggta

SEQ ID NO: 349566 - DNA, 20 bp, human
gcccgcctctggcgcgtcgc

SEQ ID NO: 349567 - DNA, 20 bp, human
gggaagttgtagtagtatgt

SEQ ID NO: 349568 - DNA, 20 bp, human
ggaccttgacagatctggtg

SEQ ID NO: 349569 - DNA, 20 bp, human
ggcccgcgacgcgccagagg

SEQ ID NO: 349570 - DNA, 20 bp, human
gtagcgcggggaatttcgag

SEQ ID NO: 349571 - DNA, 20 bp, human
gcgcagtacaagcccttaag

SEQ ID NO: 349572 - DNA, 20 bp, human
ggcgggctgctgacgtaatg

SEQ ID NO: 349573 - DNA, 20 bp, human
gggtaagtgcggcagaagcc

SEQ ID NO: 349574 - DNA, 20 bp, human
gtcgagtggtgttggagcgc

SEQ ID NO: 349575 - DNA, 20 bp, human
gacctcccagtgttgtgata

SEQ ID NO: 349576 - DNA, 20 bp, human
gcggcagagcggcggggaaa

SEQ ID NO: 349577 - DNA, 20 bp, human
gcgcctgcgccgctccttct

SEQ ID NO: 349578 - DNA, 20 bp, human
gcctcccgcccccaggagtc

SEQ ID NO: 349579 - DNA, 20 bp, human
gcccccagaaggagcggcgc

SEQ ID NO: 349580 - DNA, 20 bp, human
gtccccgacggcagagcggc

SEQ ID NO: 349581 - DNA, 20 bp, human
gcggctccccgacggcagag

SEQ ID NO: 349582 - DNA, 20 bp, human
gcaggagtccggctccccga

SEQ ID NO: 349583 - DNA, 20 bp, human
gtgggcggcaggaagagccg

SEQ ID NO: 349584 - DNA, 20 bp, human
gccccgccgctctgccgtcg

SEQ ID NO: 349585 - DNA, 20 bp, human
gggaacccgccctctgtttg

SEQ ID NO: 349586 - DNA, 20 bp, human
gcggggcagtgggcgatgga

SEQ ID NO: 349587 - DNA, 20 bp, human
ggacgggactgacaggggat

SEQ ID NO: 349588 - DNA, 20 bp, human
ggcgatggacgggactgaca

SEQ ID NO: 349589 - DNA, 20 bp, human
gagggcgggccagcgaccga

SEQ ID NO: 349590 - DNA, 20 bp, human
gggagactgcgcactaggac

SEQ ID NO: 349591 - DNA, 20 bp, human
gagggcgcagggcgttggtg

SEQ ID NO: 349592 - DNA, 20 bp, human
gtggaggggtatggacgggc

SEQ ID NO: 349593 - DNA, 20 bp, human
gagagggacgggcaggacat

SEQ ID NO: 349594 - DNA, 20 bp, human
gtgggggtacggacagagta

SEQ ID NO: 349595 - DNA, 20 bp, human
gggccagcgaccgagggact

SEQ ID NO: 349596 - DNA, 20 bp, human
gaacgggcatggcgtcactc

SEQ ID NO: 349597 - DNA, 20 bp, human
gctcgtgcgcatgcccacaa

SEQ ID NO: 349598 - DNA, 20 bp, human
gtaaactccgcgctgtgggc

SEQ ID NO: 349599 - DNA, 20 bp, human
ggacctgcgcactccctcct

SEQ ID NO: 349600 - DNA, 20 bp, human
gagactaaactccgcgctgt

SEQ ID NO: 349601 - DNA, 20 bp, human
gtgcctgccccggaagtggt

SEQ ID NO: 349602 - DNA, 20 bp, human
ggtgacgccatgcccgttat

SEQ ID NO: 349603 - DNA, 20 bp, human
gactcaggagaccacgtgtg

SEQ ID NO: 349604 - DNA, 20 bp, human
gccgttatcggtgacgtcac

SEQ ID NO: 349605 - DNA, 20 bp, human
gcttgctcggcccgcacacg

SEQ ID NO: 349606 - DNA, 20 bp, human
gggcggtcctggaatgtcgg

SEQ ID NO: 349607 - DNA, 20 bp, human
gtgggcggcaagggctcctg

SEQ ID NO: 349608 - DNA, 20 bp, human
gggaacgcgcctgcgtaatc

SEQ ID NO: 349609 - DNA, 20 bp, human
gagacccggcagagtggatg

SEQ ID NO: 349610 - DNA, 20 bp, human
ggtcgctaggaggaagcccc

SEQ ID NO: 349611 - DNA, 20 bp, human
ggcggggcggaaggcggtcc

SEQ ID NO: 349612 - DNA, 20 bp, human
gcccacgcgaaaaacctggg

SEQ ID NO: 349613 - DNA, 20 bp, human
gcccgcccccaattctgggg

SEQ ID NO: 349614 - DNA, 20 bp, human
ggaagcgcttcgtggagacc

SEQ ID NO: 349615 - DNA, 20 bp, human
ggcctggacccggattacgc

SEQ ID NO: 349616 - DNA, 20 bp, human
gtgcggtacggcgaagcaga

SEQ ID NO: 349617 - DNA, 20 bp, human
gtacggcgaagcagagggct

SEQ ID NO: 349618 - DNA, 20 bp, human
ggccgccctgcggatcacgt

SEQ ID NO: 349619 - DNA, 20 bp, human
gccggcgtgccccaggagag

SEQ ID NO: 349620 - DNA, 20 bp, human
ggccaggggcagcggacttc

SEQ ID NO: 349621 - DNA, 20 bp, human
gcgtccacgccgctctcctg

SEQ ID NO: 349622 - DNA, 20 bp, human
ggacttccggatctttgctg

SEQ ID NO: 349623 - DNA, 20 bp, human
gcgtgcgcagctccgacttc

SEQ ID NO: 349624 - DNA, 20 bp, human
gccgtaccgcacccggaagt

SEQ ID NO: 349625 - DNA, 20 bp, human
gaggcactgacttttggaag

SEQ ID NO: 349626 - DNA, 20 bp, human
gcagggcggaagcggggaga

SEQ ID NO: 349627 - DNA, 20 bp, human
gctgcgcgctaacccaagac

SEQ ID NO: 349628 - DNA, 20 bp, human
ggctctcgagctcccgtctt

SEQ ID NO: 349629 - DNA, 20 bp, human
gttagcgcgcagggcggaag

SEQ ID NO: 349630 - DNA, 20 bp, human
gcttacgcaaaaagggaaga

SEQ ID NO: 349631 - DNA, 20 bp, human
gggtggggcgagggatttca

SEQ ID NO: 349632 - DNA, 20 bp, human
ggcagtctgtaaactcgcgc

SEQ ID NO: 349633 - DNA, 20 bp, human
gagcggggagaaggcggatc

SEQ ID NO: 349634 - DNA, 20 bp, human
gggcgtgaccctgggcgaga

SEQ ID NO: 349635 - DNA, 20 bp, human
gacccgcgagggactggggt

SEQ ID NO: 349636 - DNA, 20 bp, human
gaaaagcggtgccttgggga

SEQ ID NO: 349637 - DNA, 20 bp, human
gggctctggtggaccggata

SEQ ID NO: 349638 - DNA, 20 bp, human
gtggaccggatacggaaaag

SEQ ID NO: 349639 - DNA, 20 bp, human
gaagcatggctggtgatgat

SEQ ID NO: 349640 - DNA, 20 bp, human
gcaaagcacaaactcggctc

SEQ ID NO: 349641 - DNA, 20 bp, human
gcccgcccaaaaccagactt

SEQ ID NO: 349642 - DNA, 20 bp, human
ggcgccgccgcaagcatggc

SEQ ID NO: 349643 - DNA, 20 bp, human
gagcacaaactcggctctgg

SEQ ID NO: 349644 - DNA, 20 bp, human
ggggactaatccctctgtaa

SEQ ID NO: 349645 - DNA, 20 bp, human
gtacggaaaagcggtgcctt

SEQ ID NO: 349646 - DNA, 20 bp, human
gaaccggggcgcgtgggtgg

SEQ ID NO: 349647 - DNA, 20 bp, human
ggcccggaaccgcctattaa

SEQ ID NO: 349648 - DNA, 20 bp, human
gtggccttagcctaatctca

SEQ ID NO: 349649 - DNA, 20 bp, human
gtggaggggcggattcgggg

SEQ ID NO: 349650 - DNA, 20 bp, human
gtgagacaaccggggcgcgt

SEQ ID NO: 349651 - DNA, 20 bp, human
gttgtctcaccactgaaggt

SEQ ID NO: 349652 - DNA, 20 bp, human
ggacaaccggggcgcgtggg

SEQ ID NO: 349653 - DNA, 20 bp, human
gaggctaaggccaggtcttg

SEQ ID NO: 349654 - DNA, 20 bp, human
gaaggccaggtcttgagggg

SEQ ID NO: 349655 - DNA, 20 bp, human
gaaaccctgagattaggcta

SEQ ID NO: 349656 - DNA, 20 bp, human
ggaggcccaggttggctccg

SEQ ID NO: 349657 - DNA, 20 bp, human
gcaagccgcggagccaacct

SEQ ID NO: 349658 - DNA, 20 bp, human
gggctactgtatccaatcag

SEQ ID NO: 349659 - DNA, 20 bp, human
gagccaacctgggcctctgc

SEQ ID NO: 349660 - DNA, 20 bp, human
ggcttcagattcgatctgtt

SEQ ID NO: 349661 - DNA, 20 bp, human
gactgattgagtcgtcattc

SEQ ID NO: 349662 - DNA, 20 bp, human
ggacgactcaatcagtgctt

SEQ ID NO: 349663 - DNA, 20 bp, human
ggctttgcggcgttttccgc

SEQ ID NO: 349664 - DNA, 20 bp, human
gtgcttcggttgttgctttg

SEQ ID NO: 349665 - DNA, 20 bp, human
gccaaagagaatgtgaaaca

SEQ ID NO: 349666 - DNA, 20 bp, human
gggattttggggaatcaaaa

SEQ ID NO: 349667 - DNA, 20 bp, human
ggtggcgtggagaacccact

SEQ ID NO: 349668 - DNA, 20 bp, human
gttggggaatcaaaacggaa

SEQ ID NO: 349669 - DNA, 20 bp, human
gtgggagtagtgagcgtaac

SEQ ID NO: 349670 - DNA, 20 bp, human
ggtcagacgtaaagcggaag

SEQ ID NO: 349671 - DNA, 20 bp, human
gcaaggcccggagccccgtg

SEQ ID NO: 349672 - DNA, 20 bp, human
gtctgcggcctggccgcacg

SEQ ID NO: 349673 - DNA, 20 bp, human
gcaggctcacctgctaaccc

SEQ ID NO: 349674 - DNA, 20 bp, human
gtgatgaggaatctctaaat

SEQ ID NO: 349675 - DNA, 20 bp, human
gctgactgtaaaacgatgga

SEQ ID NO: 349676 - DNA, 20 bp, human
gtgagcgcggagggggtcgt

SEQ ID NO: 349677 - DNA, 20 bp, human
ggggactcgggaacctgtgc

SEQ ID NO: 349678 - DNA, 20 bp, human
gccagcctggaacccggaag

SEQ ID NO: 349679 - DNA, 20 bp, human
gactcgggaacctgtgcagg

SEQ ID NO: 349680 - DNA, 20 bp, human
ggtggcgtgttgagcgcgga

SEQ ID NO: 349681 - DNA, 20 bp, human
gtggcctgcagcgccatctg

SEQ ID NO: 349682 - DNA, 20 bp, human
gagaaggtagaggccgaatg

SEQ ID NO: 349683 - DNA, 20 bp, human
ggcgctcaacacgccacccg

SEQ ID NO: 349684 - DNA, 20 bp, human
ggtaagctccctgggggtaa

SEQ ID NO: 349685 - DNA, 20 bp, human
gagaggccgaatgtggccgc

SEQ ID NO: 349686 - DNA, 20 bp, human
gaggccgcgcagaggagaat

SEQ ID NO: 349687 - DNA, 20 bp, human
gcccacgcccagcgccggag

SEQ ID NO: 349688 - DNA, 20 bp, human
gagggaagcggcagggcgag

SEQ ID NO: 349689 - DNA, 20 bp, human
gggcgcgcagggaagcggca

SEQ ID NO: 349690 - DNA, 20 bp, human
ggcgcagaggagaatgggaa

SEQ ID NO: 349691 - DNA, 20 bp, human
ggcgcctccaggttgcttta

SEQ ID NO: 349692 - DNA, 20 bp, human
gaaccgtaaatcaagtcgga

SEQ ID NO: 349693 - DNA, 20 bp, human
gaaggaaccgtaaatcaagt

SEQ ID NO: 349694 - DNA, 20 bp, human
gtcccctccgacttgattta

SEQ ID NO: 349695 - DNA, 20 bp, human
gccgaacccacgcccagcgc

SEQ ID NO: 349696 - DNA, 20 bp, human
ggggcgcagcgcgcctcccc

SEQ ID NO: 349697 - DNA, 20 bp, human
gcggccgtctcaccgtcctc

SEQ ID NO: 349698 - DNA, 20 bp, human
gagccctgaggacggtgaga

SEQ ID NO: 349699 - DNA, 20 bp, human
gctgggccgtgctgtggcgg

SEQ ID NO: 349700 - DNA, 20 bp, human
ggacggtgagacggccgcgg

SEQ ID NO: 349701 - DNA, 20 bp, human
gaggggcggagctgtaggtg

SEQ ID NO: 349702 - DNA, 20 bp, human
ggggccgtgagcaagaagct

SEQ ID NO: 349703 - DNA, 20 bp, human
ggctaggtgtctcgcgcagg

SEQ ID NO: 349704 - DNA, 20 bp, human
gcgacagcgcggaagtcgcg

SEQ ID NO: 349705 - DNA, 20 bp, human
gagccgaggcggtagatgtg

SEQ ID NO: 349706 - DNA, 20 bp, human
ggggtcgtccaatcagagta

SEQ ID NO: 349707 - DNA, 20 bp, human
gaatcagagtagggcaggac

SEQ ID NO: 349708 - DNA, 20 bp, human
gcatgcgcagtgatgcagta

SEQ ID NO: 349709 - DNA, 20 bp, human
gcgtccaatcagagtagggc

SEQ ID NO: 349710 - DNA, 20 bp, human
gcggcgggctcgtccgcgat

SEQ ID NO: 349711 - DNA, 20 bp, human
gcgggatccttgagcttctc

SEQ ID NO: 349712 - DNA, 20 bp, human
gttaccgcctagcacttaga

SEQ ID NO: 349713 - DNA, 20 bp, human
gaagctcaaggatcccgcct

SEQ ID NO: 349714 - DNA, 20 bp, human
ggcctcggcgaagccaatcg

SEQ ID NO: 349715 - DNA, 20 bp, human
gtccgcgattggcttcgccg

SEQ ID NO: 349716 - DNA, 20 bp, human
gcggttgggcgagaagagag

SEQ ID NO: 349717 - DNA, 20 bp, human
gcgtgacttagatgggaggg

SEQ ID NO: 349718 - DNA, 20 bp, human
gtggctgcgttcgatgagtt

SEQ ID NO: 349719 - DNA, 20 bp, human
gctgccgtcgtatcacccat

SEQ ID NO: 349720 - DNA, 20 bp, human
gctaagtcacgcctcctagt

SEQ ID NO: 349721 - DNA, 20 bp, human
gcgctcgcgacccaaggaag

SEQ ID NO: 349722 - DNA, 20 bp, human
gcgcgacccaaggaagaggc

SEQ ID NO: 349723 - DNA, 20 bp, human
gtaggaggcgtgacttagat

SEQ ID NO: 349724 - DNA, 20 bp, human
gcagagcccagactcctcat

SEQ ID NO: 349725 - DNA, 20 bp, human
gaatagtgctgcgcccaatg

SEQ ID NO: 349726 - DNA, 20 bp, human
gtgtgagttcatgctggtat

SEQ ID NO: 349727 - DNA, 20 bp, human
gttacctgtggtttgtctac

SEQ ID NO: 349728 - DNA, 20 bp, human
gactcctgtagacaaaccac

SEQ ID NO: 349729 - DNA, 20 bp, human
gaggagtacttaaaattaac

SEQ ID NO: 349730 - DNA, 20 bp, human
gaaacaaaatgttttacctg

SEQ ID NO: 349731 - DNA, 20 bp, human
gtgtggttttgggagcatga

SEQ ID NO: 349732 - DNA, 20 bp, human
gaggagtgtgatggcttcct

SEQ ID NO: 349733 - DNA, 20 bp, human
gctggtttagaggtggttat

SEQ ID NO: 349734 - DNA, 20 bp, human
ggtagttcctggtttagagg

SEQ ID NO: 349735 - DNA, 20 bp, human
gataatgtattaattttgac

SEQ ID NO: 349736 - DNA, 20 bp, human
gggaacgccccgatctccag

SEQ ID NO: 349737 - DNA, 20 bp, human
gaacgtgcgccgtcacgtga

SEQ ID NO: 349738 - DNA, 20 bp, human
gtgacggcgcacgttgtccg

SEQ ID NO: 349739 - DNA, 20 bp, human
gaggctctgccgtcacgtga

SEQ ID NO: 349740 - DNA, 20 bp, human
gggaaggccgaggcgtgccg

SEQ ID NO: 349741 - DNA, 20 bp, human
ggggtgtcacgtgaccgggg

SEQ ID NO: 349742 - DNA, 20 bp, human
gacgtgagaaaaacgctcac

SEQ ID NO: 349743 - DNA, 20 bp, human
gcaggggcggtgcgcgggaa

SEQ ID NO: 349744 - DNA, 20 bp, human
gccaggggcacggaaggccg

SEQ ID NO: 349745 - DNA, 20 bp, human
ggccgcgcaccggattgcga

SEQ ID NO: 349746 - DNA, 20 bp, human
gcacctgggccgtcgagctg

SEQ ID NO: 349747 - DNA, 20 bp, human
gtgaaggggtgattgcttga

SEQ ID NO: 349748 - DNA, 20 bp, human
gcctctgctctcattggttg

SEQ ID NO: 349749 - DNA, 20 bp, human
gcccggtgacaggatggtga

SEQ ID NO: 349750 - DNA, 20 bp, human
gggagacagaaattgccgta

SEQ ID NO: 349751 - DNA, 20 bp, human
ggacggtggtggtgactgag

SEQ ID NO: 349752 - DNA, 20 bp, human
gcgtcgccgccctcttcctc

SEQ ID NO: 349753 - DNA, 20 bp, human
gttcccaaacggctttacgg

SEQ ID NO: 349754 - DNA, 20 bp, human
gaggaccgtgcccctatccc

SEQ ID NO: 349755 - DNA, 20 bp, human
gaaggcctggctctcgggtg

SEQ ID NO: 349756 - DNA, 20 bp, human
ggacggggatgcagcctcga

SEQ ID NO: 349757 - DNA, 20 bp, human
gaggctgcatccccgtccat

SEQ ID NO: 349758 - DNA, 20 bp, human
gccaacctgctagaaaaggc

SEQ ID NO: 349759 - DNA, 20 bp, human
gtgccggccgcccaatggac

SEQ ID NO: 349760 - DNA, 20 bp, human
ggaaaaggcgggctgtgctc

SEQ ID NO: 349761 - DNA, 20 bp, human
gtcgaggaggcggggtctcc

SEQ ID NO: 349762 - DNA, 20 bp, human
ggccacaaagggtggggcgg

SEQ ID NO: 349763 - DNA, 20 bp, human
gcctcctgccggccgcccaa

SEQ ID NO: 349764 - DNA, 20 bp, human
gcagaaagaaagcctcgagg

SEQ ID NO: 349765 - DNA, 20 bp, human
gaaagaaagcctcgaggagg

SEQ ID NO: 349766 - DNA, 20 bp, human
ggcagcggctacatcaactt

SEQ ID NO: 349767 - DNA, 20 bp, human
gcgcacgcgcgttgtttccg

SEQ ID NO: 349768 - DNA, 20 bp, human
ggctctggcgcgaaggacga

SEQ ID NO: 349769 - DNA, 20 bp, human
gtcgccccggcggaaagcgg

SEQ ID NO: 349770 - DNA, 20 bp, human
gcgaacctgctctggcgcga

SEQ ID NO: 349771 - DNA, 20 bp, human
ggcaggcttaaggaggcttc

SEQ ID NO: 349772 - DNA, 20 bp, human
ggaaactgccctgactaccg

SEQ ID NO: 349773 - DNA, 20 bp, human
ggtcgcttagtaacttgcag

SEQ ID NO: 349774 - DNA, 20 bp, human
gttccgggcgacgcaggaag

SEQ ID NO: 349775 - DNA, 20 bp, human
gccatggcggcggttaacga

SEQ ID NO: 349776 - DNA, 20 bp, human
gggagaggggagaatggcga

SEQ ID NO: 349777 - DNA, 20 bp, human
gctggtgtgagcaggatggt

SEQ ID NO: 349778 - DNA, 20 bp, human
gaaatgttatccaacagcgt

SEQ ID NO: 349779 - DNA, 20 bp, human
gcatcctgctcacaccagag

SEQ ID NO: 349780 - DNA, 20 bp, human
gccctggaacaactgaggtc

SEQ ID NO: 349781 - DNA, 20 bp, human
gtgaacgggttagggacagt

SEQ ID NO: 349782 - DNA, 20 bp, human
gaaccccctctggtgtgagc

SEQ ID NO: 349783 - DNA, 20 bp, human
gcagggggtaccaggaagaa

SEQ ID NO: 349784 - DNA, 20 bp, human
ggtgcccacacccacgctgt

SEQ ID NO: 349785 - DNA, 20 bp, human
ggttagggacagtgggagag

SEQ ID NO: 349786 - DNA, 20 bp, human
gggcccccacctacatatca

SEQ ID NO: 349787 - DNA, 20 bp, human
gccaccatgcaaaccgggtg

SEQ ID NO: 349788 - DNA, 20 bp, human
gagggtaactcgtccagaat

SEQ ID NO: 349789 - DNA, 20 bp, human
gggtgaatccagtactgaat

SEQ ID NO: 349790 - DNA, 20 bp, human
ggtcttggtccttctactga

SEQ ID NO: 349791 - DNA, 20 bp, human
ggtcacgtgtgagtgattct

SEQ ID NO: 349792 - DNA, 20 bp, human
gacagtgcgaacacgagctc

SEQ ID NO: 349793 - DNA, 20 bp, human
gggagctccaggtctcaaga

SEQ ID NO: 349794 - DNA, 20 bp, human
gcacccaccagaaatgaggt

SEQ ID NO: 349795 - DNA, 20 bp, human
gaagcctaaaccctgaaaaa

SEQ ID NO: 349796 - DNA, 20 bp, human
gagcgctgcagtagaaagtg

SEQ ID NO: 349797 - DNA, 20 bp, human
gtagacttggatgagcaact

SEQ ID NO: 349798 - DNA, 20 bp, human
gtggctgagagacacctgat

SEQ ID NO: 349799 - DNA, 20 bp, human
ggtagaaagtggggtagact

SEQ ID NO: 349800 - DNA, 20 bp, human
ggcagccagcaaagtctgac

SEQ ID NO: 349801 - DNA, 20 bp, human
ggcggtgatgattacatgag

SEQ ID NO: 349802 - DNA, 20 bp, human
gtcagccagtcagactttgc

SEQ ID NO: 349803 - DNA, 20 bp, human
ggatctgcgcacaggacggt

SEQ ID NO: 349804 - DNA, 20 bp, human
gtggataccgatgcacagaa

SEQ ID NO: 349805 - DNA, 20 bp, human
gactctgcaacgcagggaga

SEQ ID NO: 349806 - DNA, 20 bp, human
gtgccggagcgggtgaagaa

SEQ ID NO: 349807 - DNA, 20 bp, human
ggactggggaagtagtggag

SEQ ID NO: 349808 - DNA, 20 bp, human
gaagggaagggacactagca

SEQ ID NO: 349809 - DNA, 20 bp, human
gggccaccaagctgccggag

SEQ ID NO: 349810 - DNA, 20 bp, human
gggagtggggcccgggcacg

SEQ ID NO: 349811 - DNA, 20 bp, human
ggggacactagcatggaaac

SEQ ID NO: 349812 - DNA, 20 bp, human
gcccagggcggggtgagcca

SEQ ID NO: 349813 - DNA, 20 bp, human
gccgccctgggcacagccat

SEQ ID NO: 349814 - DNA, 20 bp, human
gcacgaggccaccaagctgc

SEQ ID NO: 349815 - DNA, 20 bp, human
ggctactgggcgtagtcact

SEQ ID NO: 349816 - DNA, 20 bp, human
gaggacgagcaccgagtcga

SEQ ID NO: 349817 - DNA, 20 bp, human
ggcgtggcctagcgatctgg

SEQ ID NO: 349818 - DNA, 20 bp, human
gtagaagtcgactgccagta

SEQ ID NO: 349819 - DNA, 20 bp, human
gtcgacttctaacttggctc

SEQ ID NO: 349820 - DNA, 20 bp, human
gaacctcttcagcttcgaaa

SEQ ID NO: 349821 - DNA, 20 bp, human
gagatcgctaggccacgccc

SEQ ID NO: 349822 - DNA, 20 bp, human
gggagagccggtggcgtcgc

SEQ ID NO: 349823 - DNA, 20 bp, human
gtggcagtcgacttctaact

SEQ ID NO: 349824 - DNA, 20 bp, human
gtgagttcaggccagagcga

SEQ ID NO: 349825 - DNA, 20 bp, human
ggtggccagaggcctagaag

SEQ ID NO: 349826 - DNA, 20 bp, human
ggggtctcctggcccatgat

SEQ ID NO: 349827 - DNA, 20 bp, human
ggagggctaaccacaaatga

SEQ ID NO: 349828 - DNA, 20 bp, human
gaatgatggcagccaatcat

SEQ ID NO: 349829 - DNA, 20 bp, human
gcatgtgcgagagtttgctg

SEQ ID NO: 349830 - DNA, 20 bp, human
gcgcacatggttctacactc

SEQ ID NO: 349831 - DNA, 20 bp, human
gtccctccctgagaatgttt

SEQ ID NO: 349832 - DNA, 20 bp, human
ggattggctgccatcatttg

SEQ ID NO: 349833 - DNA, 20 bp, human
gtggcagccaatcatgggcc

SEQ ID NO: 349834 - DNA, 20 bp, human
gttccaacccaaacattctc

SEQ ID NO: 349835 - DNA, 20 bp, human
ggtggttagccctccatggt

SEQ ID NO: 349836 - DNA, 20 bp, human
gcccaacagggtgtaccctc

SEQ ID NO: 349837 - DNA, 20 bp, human
gttgagggagatacccaaca

SEQ ID NO: 349838 - DNA, 20 bp, human
gtgttcataagaacatctgt

SEQ ID NO: 349839 - DNA, 20 bp, human
gtgaaagagttaaatcctga

SEQ ID NO: 349840 - DNA, 20 bp, human
gtcctgagggtacaccctgt

SEQ ID NO: 349841 - DNA, 20 bp, human
gaatgcaaggctcagaagga

SEQ ID NO: 349842 - DNA, 20 bp, human
gcctgatataaagttggtag

SEQ ID NO: 349843 - DNA, 20 bp, human
gagagctggcaaagaaaacc

SEQ ID NO: 349844 - DNA, 20 bp, human
gctttcactactagcaacaa

SEQ ID NO: 349845 - DNA, 20 bp, human
gttatgaacactgatctaat

SEQ ID NO: 349846 - DNA, 20 bp, human
gccgccagggggtgctgtcg

SEQ ID NO: 349847 - DNA, 20 bp, human
gcgcgaggaaaaaagttccc

SEQ ID NO: 349848 - DNA, 20 bp, human
gcaccgggatcccaccgcag

SEQ ID NO: 349849 - DNA, 20 bp, human
gggggcgcgcggaccgccag

SEQ ID NO: 349850 - DNA, 20 bp, human
gacggcccacctggcgcccg

SEQ ID NO: 349851 - DNA, 20 bp, human
ggaggaaaaaagttcccggg

SEQ ID NO: 349852 - DNA, 20 bp, human
gtgggatcccggtgcggcct

SEQ ID NO: 349853 - DNA, 20 bp, human
ggcctggctgcgctcgctcg

SEQ ID NO: 349854 - DNA, 20 bp, human
gggcctctgcggtgggatcc

SEQ ID NO: 349855 - DNA, 20 bp, human
gggggcgcgcacggcccacc

SEQ ID NO: 349856 - DNA, 20 bp, human
gcccgccgacctggatccag

SEQ ID NO: 349857 - DNA, 20 bp, human
ggatccagtgggagcgggaa

SEQ ID NO: 349858 - DNA, 20 bp, human
gctctggccgggacctgcgg

SEQ ID NO: 349859 - DNA, 20 bp, human
gacctggatccagtgggagc

SEQ ID NO: 349860 - DNA, 20 bp, human
gaatttggggccgcgagggg

SEQ ID NO: 349861 - DNA, 20 bp, human
gcccactggatccaggtcgg

SEQ ID NO: 349862 - DNA, 20 bp, human
gtcacctgactcgcggaatt

SEQ ID NO: 349863 - DNA, 20 bp, human
ggccccaaattccgcgagtc

SEQ ID NO: 349864 - DNA, 20 bp, human
gggggccgcgaggggtggaa

SEQ ID NO: 349865 - DNA, 20 bp, human
gagaagggtcccacgatccc

SEQ ID NO: 349866 - DNA, 20 bp, human
ggtgatctcgcccacgggga

SEQ ID NO: 349867 - DNA, 20 bp, human
gtcgccgccggccgcctgaa

SEQ ID NO: 349868 - DNA, 20 bp, human
gccaggaagaaggggtgtcg

SEQ ID NO: 349869 - DNA, 20 bp, human
gcacgcacaaccagcagcgg

SEQ ID NO: 349870 - DNA, 20 bp, human
gcggggaggaggaccttggg

SEQ ID NO: 349871 - DNA, 20 bp, human
ggcggggtgccaggaagaag

SEQ ID NO: 349872 - DNA, 20 bp, human
ggggggcgaaagggtacccg

SEQ ID NO: 349873 - DNA, 20 bp, human
gggcgaaagggtacccgagg

SEQ ID NO: 349874 - DNA, 20 bp, human
ggactcggtgacagcggcga

SEQ ID NO: 349875 - DNA, 20 bp, human
gggaccctactgcctcccgg

SEQ ID NO: 349876 - DNA, 20 bp, human
gggcctgggccgcagaacag

SEQ ID NO: 349877 - DNA, 20 bp, human
gctgagaggagggtgatcat

SEQ ID NO: 349878 - DNA, 20 bp, human
gaggtgaagtcatctcccgg

SEQ ID NO: 349879 - DNA, 20 bp, human
gggagcgacttcctgtccgt

SEQ ID NO: 349880 - DNA, 20 bp, human
gccgcagaacagtggctcgg

SEQ ID NO: 349881 - DNA, 20 bp, human
ggcgccccggaagtgatctg

SEQ ID NO: 349882 - DNA, 20 bp, human
ggacagccctcagcttgcag

SEQ ID NO: 349883 - DNA, 20 bp, human
gacagtggctcggagggcgc

SEQ ID NO: 349884 - DNA, 20 bp, human
gagccactgttctgcggccc

SEQ ID NO: 349885 - DNA, 20 bp, human
gccccggaagtgatctgtgg

SEQ ID NO: 349886 - DNA, 20 bp, human
gtggaaaatcagcctcggat

SEQ ID NO: 349887 - DNA, 20 bp, human
gcggaagccacgcccgtcgg

SEQ ID NO: 349888 - DNA, 20 bp, human
gggggctgtcagccaatccg

SEQ ID NO: 349889 - DNA, 20 bp, human
gcctcggaagccacgcccgt

SEQ ID NO: 349890 - DNA, 20 bp, human
gtggctgacagccccccgac

SEQ ID NO: 349891 - DNA, 20 bp, human
gagggcaagaacggaagcga

SEQ ID NO: 349892 - DNA, 20 bp, human
gaagctgccccaggcacggg

SEQ ID NO: 349893 - DNA, 20 bp, human
ggggcgcgctctcgagagga

SEQ ID NO: 349894 - DNA, 20 bp, human
gggcccgcccccccgtgcct

SEQ ID NO: 349895 - DNA, 20 bp, human
gcggcagctcaatgacaaat

SEQ ID NO: 349896 - DNA, 20 bp, human
ggcgccccgcgcgagagccc

SEQ ID NO: 349897 - DNA, 20 bp, human
gggctgaagccgtcaagggc

SEQ ID NO: 349898 - DNA, 20 bp, human
gcgacctgggctctcgcgcg

SEQ ID NO: 349899 - DNA, 20 bp, human
gcgtcaagggcaggcgacct

SEQ ID NO: 349900 - DNA, 20 bp, human
gcagacggctgaagccgtca

SEQ ID NO: 349901 - DNA, 20 bp, human
gcagcgagcctggggacgaa

SEQ ID NO: 349902 - DNA, 20 bp, human
gtccttggcgagaggccttc

SEQ ID NO: 349903 - DNA, 20 bp, human
gtggctggacgccggggcct

SEQ ID NO: 349904 - DNA, 20 bp, human
ggggacggaacgggacgagg

SEQ ID NO: 349905 - DNA, 20 bp, human
gacggcttcagccgtctgag

SEQ ID NO: 349906 - DNA, 20 bp, human
gaactcttgacgtcagaagg

SEQ ID NO: 349907 - DNA, 20 bp, human
gccaaggcggggagtgccac

SEQ ID NO: 349908 - DNA, 20 bp, human
ggccacgggtgatctcatgc

SEQ ID NO: 349909 - DNA, 20 bp, human
ggccgaaacggagacgagtg

SEQ ID NO: 349910 - DNA, 20 bp, human
gcggtggcgaacggtgtccg

SEQ ID NO: 349911 - DNA, 20 bp, human
gtacacaggaaaccaaggcg

SEQ ID NO: 349912 - DNA, 20 bp, human
gctctgccgtcggtggcgaa

SEQ ID NO: 349913 - DNA, 20 bp, human
ggccagcatgagatcacccg

SEQ ID NO: 349914 - DNA, 20 bp, human
gaagaagcttcaaccttaag

SEQ ID NO: 349915 - DNA, 20 bp, human
ggagaatctcaagaaaggca

SEQ ID NO: 349916 - DNA, 20 bp, human
gtagcggggacgcgctcaga

SEQ ID NO: 349917 - DNA, 20 bp, human
gcaggaaggcggtgtcgacg

SEQ ID NO: 349918 - DNA, 20 bp, human
gcacacaggccgaactctcc

SEQ ID NO: 349919 - DNA, 20 bp, human
ggtgtcccgccaggagagtt

SEQ ID NO: 349920 - DNA, 20 bp, human
gcgtccgcgccaaaacctag

SEQ ID NO: 349921 - DNA, 20 bp, human
gcgcgctcagagggccgaga

SEQ ID NO: 349922 - DNA, 20 bp, human
gtccccgctaggttttggcg

SEQ ID NO: 349923 - DNA, 20 bp, human
gcaggccgaactctcctggc

SEQ ID NO: 349924 - DNA, 20 bp, human
gagaccgccagcctgattgg

SEQ ID NO: 349925 - DNA, 20 bp, human
gaaggcgcctcgaatcacaa

SEQ ID NO: 349926 - DNA, 20 bp, human
ggcgtcccgcgcggcgatct

SEQ ID NO: 349927 - DNA, 20 bp, human
gaattcccgagacacagagc

SEQ ID NO: 349928 - DNA, 20 bp, human
gcgatctgggatagctgcgc

SEQ ID NO: 349929 - DNA, 20 bp, human
ggctgcgcaggcgcagcttc

SEQ ID NO: 349930 - DNA, 20 bp, human
gcctccctctccacttgatc

SEQ ID NO: 349931 - DNA, 20 bp, human
gctaatcagagctttctacg

SEQ ID NO: 349932 - DNA, 20 bp, human
gattccggatcaagtggaga

SEQ ID NO: 349933 - DNA, 20 bp, human
gccacttgatccggaatggg

SEQ ID NO: 349934 - DNA, 20 bp, human
gctatcccagatcgccgcgc

SEQ ID NO: 349935 - DNA, 20 bp, human
ggaacgcaatgcgtcccgcg

SEQ ID NO: 349936 - DNA, 20 bp, human
gggcggggtctgaacaaaga

SEQ ID NO: 349937 - DNA, 20 bp, human
ggcggggccggggaggtcga

SEQ ID NO: 349938 - DNA, 20 bp, human
ggaggtcgaggggtgcgcgt

SEQ ID NO: 349939 - DNA, 20 bp, human
gctcgccgaggtcagacccg

SEQ ID NO: 349940 - DNA, 20 bp, human
ggccgaggtcagacccgggg

SEQ ID NO: 349941 - DNA, 20 bp, human
ggcggaaccggagagtccga

SEQ ID NO: 349942 - DNA, 20 bp, human
ggggtctgaacaaagagggc

SEQ ID NO: 349943 - DNA, 20 bp, human
gcgcgcacgcacgcgtccct

SEQ ID NO: 349944 - DNA, 20 bp, human
gcagcagcgtgacacgcaaa

SEQ ID NO: 349945 - DNA, 20 bp, human
gtctgacctcggcgagggcg

SEQ ID NO: 349946 - DNA, 20 bp, human
ggccccgccgcgtgagctcg

SEQ ID NO: 349947 - DNA, 20 bp, human
gagcccgcccgcaggtgcga

SEQ ID NO: 349948 - DNA, 20 bp, human
gagctcggggacgcgctcgg

SEQ ID NO: 349949 - DNA, 20 bp, human
gcggccttggacaacaggcc

SEQ ID NO: 349950 - DNA, 20 bp, human
gcagccgggcctgttgtcca

SEQ ID NO: 349951 - DNA, 20 bp, human
ggacgtgcacgcgctgtctg

SEQ ID NO: 349952 - DNA, 20 bp, human
gacgctcccagcgccatgtg

SEQ ID NO: 349953 - DNA, 20 bp, human
ggaacacccgcgtcggcccg

SEQ ID NO: 349954 - DNA, 20 bp, human
ggagccggggcggaaccgag

SEQ ID NO: 349955 - DNA, 20 bp, human
ggacgcgggtgttccccccg

SEQ ID NO: 349956 - DNA, 20 bp, human
gcggagacacgcaaatcggc

SEQ ID NO: 349957 - DNA, 20 bp, human
gcgtctgcagatgagctcgg

SEQ ID NO: 349958 - DNA, 20 bp, human
gcccccaaccagctcgttgt

SEQ ID NO: 349959 - DNA, 20 bp, human
gggggcggagacacgcaaat

SEQ ID NO: 349960 - DNA, 20 bp, human
gaaccagctcgttgtagggg

SEQ ID NO: 349961 - DNA, 20 bp, human
ggggaggaccgcggatgcag

SEQ ID NO: 349962 - DNA, 20 bp, human
gcagatgagctcggaggccg

SEQ ID NO: 349963 - DNA, 20 bp, human
gctggagcgcgggcagacgc

SEQ ID NO: 349964 - DNA, 20 bp, human
ggtaggaaccgtccgctcca

SEQ ID NO: 349965 - DNA, 20 bp, human
gggcgggcctctcatccaat

SEQ ID NO: 349966 - DNA, 20 bp, human
gcaacggagcgcgctcgcgg

SEQ ID NO: 349967 - DNA, 20 bp, human
ggggccgaaaagctgcgggc

SEQ ID NO: 349968 - DNA, 20 bp, human
gccgcggggccgaaaagctg

SEQ ID NO: 349969 - DNA, 20 bp, human
gacgagagcggacctggcgg

SEQ ID NO: 349970 - DNA, 20 bp, human
gcgctgcgggcaccgatcac

SEQ ID NO: 349971 - DNA, 20 bp, human
gcccaactgccgccggtgat

SEQ ID NO: 349972 - DNA, 20 bp, human
gtcccaccggccaaacaacg

SEQ ID NO: 349973 - DNA, 20 bp, human
gcgggcggtggggttgcgga

SEQ ID NO: 349974 - DNA, 20 bp, human
gccccgtccgcgccaggggt

SEQ ID NO: 349975 - DNA, 20 bp, human
gtcactgaggacaaatgagg

SEQ ID NO: 349976 - DNA, 20 bp, human
gtcccaggagacagagaagg

SEQ ID NO: 349977 - DNA, 20 bp, human
ggaaaggtccagagcttcgg

SEQ ID NO: 349978 - DNA, 20 bp, human
ggggaggagggactgagacg

SEQ ID NO: 349979 - DNA, 20 bp, human
gcccggcttcccaggcgcat

SEQ ID NO: 349980 - DNA, 20 bp, human
gccctcggccggcaccactg

SEQ ID NO: 349981 - DNA, 20 bp, human
gggggagagcccatgcgcct

SEQ ID NO: 349982 - DNA, 20 bp, human
gaagagaagcttagagtggg

SEQ ID NO: 349983 - DNA, 20 bp, human
gagggactgagacgcggctt

SEQ ID NO: 349984 - DNA, 20 bp, human
gctgaagagaagcttagagt

SEQ ID NO: 349985 - DNA, 20 bp, human
gttggaaaggtccagagctt

SEQ ID NO: 349986 - DNA, 20 bp, human
gagggggaaacgcagatcta

SEQ ID NO: 349987 - DNA, 20 bp, human
ggaggcagcagcagcaatcg

SEQ ID NO: 349988 - DNA, 20 bp, human
ggccgccgccgcctcgcatt

SEQ ID NO: 349989 - DNA, 20 bp, human
gccgagcggggttgggcccg

SEQ ID NO: 349990 - DNA, 20 bp, human
ggggaaacgcagatctaggg

SEQ ID NO: 349991 - DNA, 20 bp, human
gacacactcccaatgcgagg

SEQ ID NO: 349992 - DNA, 20 bp, human
ggacgatgggatctctcccc

SEQ ID NO: 349993 - DNA, 20 bp, human
ggatcccatcgtcttctctc

SEQ ID NO: 349994 - DNA, 20 bp, human
gagcacacactcccaatgcg

SEQ ID NO: 349995 - DNA, 20 bp, human
ggctcggctccccctctcgc

SEQ ID NO: 349996 - DNA, 20 bp, human
ggtgtgccgccccccgggag

SEQ ID NO: 349997 - DNA, 20 bp, human
gccactgcggctccccgcgt

SEQ ID NO: 349998 - DNA, 20 bp, human
gcccccctgcaaagttttac

SEQ ID NO: 349999 - DNA, 20 bp, human
gggccggtaaaactttgcag

SEQ ID NO: 350000 - DNA, 20 bp, human
gtctccaggcccctcccggg

SEQ ID NO: 350001 - DNA, 20 bp, human
gccggggggcggcacacttg

SEQ ID NO: 350002 - DNA, 20 bp, human
gcccggccctggcacccacg

SEQ ID NO: 350003 - DNA, 20 bp, human
gacgcccagaacctcggagg

SEQ ID NO: 350004 - DNA, 20 bp, human
gcgcctgcacctgggcggag

SEQ ID NO: 350005 - DNA, 20 bp, human
gctgggcggagaggtagata

SEQ ID NO: 350006 - DNA, 20 bp, human
ggggtgagctacgagagggt

SEQ ID NO: 350007 - DNA, 20 bp, human
gccaacgccggcgaggcgga

SEQ ID NO: 350008 - DNA, 20 bp, human
ggggagctgtccagcctcgc

SEQ ID NO: 350009 - DNA, 20 bp, human
gggagtcgggagaaggtctg

SEQ ID NO: 350010 - DNA, 20 bp, human
gtggcgcccaggactctcca

SEQ ID NO: 350011 - DNA, 20 bp, human
gacggcggcggccacgtggg

SEQ ID NO: 350012 - DNA, 20 bp, human
ggaaccgggatctatttcgg

SEQ ID NO: 350013 - DNA, 20 bp, human
gtggacagctcccggaaccc

SEQ ID NO: 350014 - DNA, 20 bp, human
gcagacccgaaagagagagg

SEQ ID NO: 350015 - DNA, 20 bp, human
ggagcccccgaaatagatcc

SEQ ID NO: 350016 - DNA, 20 bp, human
ggggcggctggagtctcagc

SEQ ID NO: 350017 - DNA, 20 bp, human
gcggccgcaggcgtggtctg

SEQ ID NO: 350018 - DNA, 20 bp, human
gcccacccggcgcgcctgca

SEQ ID NO: 350019 - DNA, 20 bp, human
gcctgagggcggaccccctg

SEQ ID NO: 350020 - DNA, 20 bp, human
gctggggacaagctggggta

SEQ ID NO: 350021 - DNA, 20 bp, human
gaggtggggtgccggctgat

SEQ ID NO: 350022 - DNA, 20 bp, human
gtgagctggggtgagcgtgg

SEQ ID NO: 350023 - DNA, 20 bp, human
gagtctcagcggggtgagag

SEQ ID NO: 350024 - DNA, 20 bp, human
ggtgggggccggctgacggt

SEQ ID NO: 350025 - DNA, 20 bp, human
gcccacatctggaggcaacg

SEQ ID NO: 350026 - DNA, 20 bp, human
ggcccctgagcgggagacgt

SEQ ID NO: 350027 - DNA, 20 bp, human
ggacgttgggcgcggcccga

SEQ ID NO: 350028 - DNA, 20 bp, human
gcggtcgctgcgcttagggt

SEQ ID NO: 350029 - DNA, 20 bp, human
gtgcgcgcacgcacgcaacg

SEQ ID NO: 350030 - DNA, 20 bp, human
ggaggcgcggtggaccgcgt

SEQ ID NO: 350031 - DNA, 20 bp, human
gagcgcgtacgcaagccggc

SEQ ID NO: 350032 - DNA, 20 bp, human
gcgggcggtcgctgcgctta

SEQ ID NO: 350033 - DNA, 20 bp, human
gcgggagcgcgtacgcaagc

SEQ ID NO: 350034 - DNA, 20 bp, human
gcgcgcccgggagcccgccc

SEQ ID NO: 350035 - DNA, 20 bp, human
gcggcgcacgcggtccccac

SEQ ID NO: 350036 - DNA, 20 bp, human
gcgctcctctggctgacggg

SEQ ID NO: 350037 - DNA, 20 bp, human
ggagctggctaaagtggttg

SEQ ID NO: 350038 - DNA, 20 bp, human
gcggcccgcccgtcagccag

SEQ ID NO: 350039 - DNA, 20 bp, human
gcgcgctggcggactaagag

SEQ ID NO: 350040 - DNA, 20 bp, human
gcccgcgcgcacttccgtcc

SEQ ID NO: 350041 - DNA, 20 bp, human
gccgggagtgcgcgctcctc

SEQ ID NO: 350042 - DNA, 20 bp, human
gcttcccgccaaaacgcccg

SEQ ID NO: 350043 - DNA, 20 bp, human
gaagtgcgcgcgggtgtcgc

SEQ ID NO: 350044 - DNA, 20 bp, human
ggggaagtggcctgtcacaa

SEQ ID NO: 350045 - DNA, 20 bp, human
gcccgcctggggcgaagccg

SEQ ID NO: 350046 - DNA, 20 bp, human
gtcgagaggcggagcaactc

SEQ ID NO: 350047 - DNA, 20 bp, human
ggaggcggagcaactcgggc

SEQ ID NO: 350048 - DNA, 20 bp, human
ggggaaaccgagtccgagtc

SEQ ID NO: 350049 - DNA, 20 bp, human
gcgggctggtagagaattct

SEQ ID NO: 350050 - DNA, 20 bp, human
gtcgagagctctgcattgtg

SEQ ID NO: 350051 - DNA, 20 bp, human
gggcgtgtcagtgtccaaag

SEQ ID NO: 350052 - DNA, 20 bp, human
gtgggacaggcttatggctg

SEQ ID NO: 350053 - DNA, 20 bp, human
gtctcgatgggacaggctta

SEQ ID NO: 350054 - DNA, 20 bp, human
gcgagtccggcacccctctt

SEQ ID NO: 350055 - DNA, 20 bp, human
gatgcagagctctcgagagg

SEQ ID NO: 350056 - DNA, 20 bp, human
gccctccagcgcttcgaatg

SEQ ID NO: 350057 - DNA, 20 bp, human
gtcgaagcgctggaggggcg

SEQ ID NO: 350058 - DNA, 20 bp, human
gggacggttgagattcccgg

SEQ ID NO: 350059 - DNA, 20 bp, human
gcacggggcggggccgatag

SEQ ID NO: 350060 - DNA, 20 bp, human
gacggaggcggtgcacgggg

SEQ ID NO: 350061 - DNA, 20 bp, human
ggaaacttgagcgcaaggga

SEQ ID NO: 350062 - DNA, 20 bp, human
gaagggacggttgagattcc

SEQ ID NO: 350063 - DNA, 20 bp, human
ggcgacggaggcggtgcacg

SEQ ID NO: 350064 - DNA, 20 bp, human
gtgaggctgcgaaggacgag

SEQ ID NO: 350065 - DNA, 20 bp, human
gccgataggggcgtgtcctc

SEQ ID NO: 350066 - DNA, 20 bp, human
ggcagcgccgcgtgctctga

SEQ ID NO: 350067 - DNA, 20 bp, human
gggctacggcgctgcgtcac

SEQ ID NO: 350068 - DNA, 20 bp, human
gtgcgccacgttggcgacgt

SEQ ID NO: 350069 - DNA, 20 bp, human
gcgccagtgtccacagccta

SEQ ID NO: 350070 - DNA, 20 bp, human
ggcaagccgggatcagattt

SEQ ID NO: 350071 - DNA, 20 bp, human
gggcggccgaaatctgatcc

SEQ ID NO: 350072 - DNA, 20 bp, human
gagcgccgacgtcgccaacg

SEQ ID NO: 350073 - DNA, 20 bp, human
gtgagggtgtcttggcaagc

SEQ ID NO: 350074 - DNA, 20 bp, human
gaaatctacgccctaggctg

SEQ ID NO: 350075 - DNA, 20 bp, human
ggaccactgtgacgaacttg

SEQ ID NO: 350076 - DNA, 20 bp, human
gctgcagggcaggcgatccg

SEQ ID NO: 350077 - DNA, 20 bp, human
gctaggagcgcggctcgtca

SEQ ID NO: 350078 - DNA, 20 bp, human
ggagcgcggctcgtcagggc

SEQ ID NO: 350079 - DNA, 20 bp, human
gtggccgcctcacacggagt

SEQ ID NO: 350080 - DNA, 20 bp, human
gcaggtgcgtgctaggagcg

SEQ ID NO: 350081 - DNA, 20 bp, human
gtccccgccctctcagtcgg

SEQ ID NO: 350082 - DNA, 20 bp, human
gtgcgcagtggcagcgacta

SEQ ID NO: 350083 - DNA, 20 bp, human
gggaaccccggaaaacgagt

SEQ ID NO: 350084 - DNA, 20 bp, human
gaacaagccgactccgtgtg

SEQ ID NO: 350085 - DNA, 20 bp, human
gtcagcgcgcaggcgcgagc

SEQ ID NO: 350086 - DNA, 20 bp, human
gaggcaggcaagacgggcat

SEQ ID NO: 350087 - DNA, 20 bp, human
gttactgtaacataagggca

SEQ ID NO: 350088 - DNA, 20 bp, human
gggaactggtaatgagctca

SEQ ID NO: 350089 - DNA, 20 bp, human
gtgtgcatgtgaaatctaaa

SEQ ID NO: 350090 - DNA, 20 bp, human
gataaagaggcaggcaagac

SEQ ID NO: 350091 - DNA, 20 bp, human
ggtaaacacctcctagtctt

SEQ ID NO: 350092 - DNA, 20 bp, human
gcacctcctagtcttcggaa

SEQ ID NO: 350093 - DNA, 20 bp, human
gtaaaatgcaagctgaaagc

SEQ ID NO: 350094 - DNA, 20 bp, human
gcttaagggactctggaagg

SEQ ID NO: 350095 - DNA, 20 bp, human
gctcccttccgaagactagg

SEQ ID NO: 350096 - DNA, 20 bp, human
gcggctcgaagcagtgacgt

SEQ ID NO: 350097 - DNA, 20 bp, human
ggcgaggcgccggcggggat

SEQ ID NO: 350098 - DNA, 20 bp, human
gagaggtgagagccgtgtgg

SEQ ID NO: 350099 - DNA, 20 bp, human
gagagcgcagctagagtttc

SEQ ID NO: 350100 - DNA, 20 bp, human
ggatgccattggcctccaca

SEQ ID NO: 350101 - DNA, 20 bp, human
gactctagctgcgctctggc

SEQ ID NO: 350102 - DNA, 20 bp, human
gcgaagcagtgacgtaggcg

SEQ ID NO: 350103 - DNA, 20 bp, human
gctctggcaggctgcgagct

SEQ ID NO: 350104 - DNA, 20 bp, human
gcaggctgcgagctaggttt

SEQ ID NO: 350105 - DNA, 20 bp, human
gagtgacgtaggcgaggcgc

SEQ ID NO: 350106 - DNA, 20 bp, human
ggggcccgccagtcgctcgt

SEQ ID NO: 350107 - DNA, 20 bp, human
gagcgactggcgggcccggg

SEQ ID NO: 350108 - DNA, 20 bp, human
ggcgccgcaggtcccttcgg

SEQ ID NO: 350109 - DNA, 20 bp, human
gcgcgggcggcgctaggcga

SEQ ID NO: 350110 - DNA, 20 bp, human
gcgctcgtgggcaggatcgc

SEQ ID NO: 350111 - DNA, 20 bp, human
gaggaggcggacacctccga

SEQ ID NO: 350112 - DNA, 20 bp, human
gacacctccgaagggacctg

SEQ ID NO: 350113 - DNA, 20 bp, human
gagaggcgcgagcggtgcga

SEQ ID NO: 350114 - DNA, 20 bp, human
gccggcgccgcaggtccctt

SEQ ID NO: 350115 - DNA, 20 bp, human
gcaagtgggaggggattcgc

SEQ ID NO: 350116 - DNA, 20 bp, human
gtctgcgcgcggtgcgccat

SEQ ID NO: 350117 - DNA, 20 bp, human
gcgcgcggtgcgccatggga

SEQ ID NO: 350118 - DNA, 20 bp, human
gccccatcgcgctcccagat

SEQ ID NO: 350119 - DNA, 20 bp, human
gtccccatctgggagcgcga

SEQ ID NO: 350120 - DNA, 20 bp, human
gccatgggacgggtagttcg

SEQ ID NO: 350121 - DNA, 20 bp, human
gccgcggcggatgatggcgg

SEQ ID NO: 350122 - DNA, 20 bp, human
ggcaccgcggcggatgatgg

SEQ ID NO: 350123 - DNA, 20 bp, human
gccggctgaacacctccctg

SEQ ID NO: 350124 - DNA, 20 bp, human
gaaactgaaagggcattcga

SEQ ID NO: 350125 - DNA, 20 bp, human
ggtagtccggttccccatct

SEQ ID NO: 350126 - DNA, 20 bp, human
gggacggtggggtctgcctt

SEQ ID NO: 350127 - DNA, 20 bp, human
gctgccttggggttggactt

SEQ ID NO: 350128 - DNA, 20 bp, human
gggggtcagcggctttgctc

SEQ ID NO: 350129 - DNA, 20 bp, human
ggtggcagctgcgaaaccca

SEQ ID NO: 350130 - DNA, 20 bp, human
gtgcgcctggcgggacggtg

SEQ ID NO: 350131 - DNA, 20 bp, human
gaaccctaagtccaacccca

SEQ ID NO: 350132 - DNA, 20 bp, human
gctccggaagccgcgctctt

SEQ ID NO: 350133 - DNA, 20 bp, human
gggagcatgctcgtgaccac

SEQ ID NO: 350134 - DNA, 20 bp, human
gaggcgcactcctaagagcg

SEQ ID NO: 350135 - DNA, 20 bp, human
gctcttaggagtgcgcctgg

SEQ ID NO: 350136 - DNA, 20 bp, human
gcggaacgccgtggggaagg

SEQ ID NO: 350137 - DNA, 20 bp, human
ggagccgcgcacactggagc

SEQ ID NO: 350138 - DNA, 20 bp, human
gcgcccctccaagttggcga

SEQ ID NO: 350139 - DNA, 20 bp, human
gtgtgcgcggctcctttaag

SEQ ID NO: 350140 - DNA, 20 bp, human
gaagcctggagctaccggga

SEQ ID NO: 350141 - DNA, 20 bp, human
gttcccggctccagtgtgcg

SEQ ID NO: 350142 - DNA, 20 bp, human
gcagccatcgccaacttgga

SEQ ID NO: 350143 - DNA, 20 bp, human
ggaggggcggggcagaacca

SEQ ID NO: 350144 - DNA, 20 bp, human
gcggactccggaacgccgtg

SEQ ID NO: 350145 - DNA, 20 bp, human
gcgttccggagtccgcttaa

SEQ ID NO: 350146 - DNA, 20 bp, human
gaggcagctaaggggcccgt

SEQ ID NO: 350147 - DNA, 20 bp, human
gccgccgcgcgccgggtcct

SEQ ID NO: 350148 - DNA, 20 bp, human
gatgcaggccggctagaggc

SEQ ID NO: 350149 - DNA, 20 bp, human
ggggccccttagctgcctct

SEQ ID NO: 350150 - DNA, 20 bp, human
gagccggcctgcatcgcagc

SEQ ID NO: 350151 - DNA, 20 bp, human
gtgcgctccggctgcgatgc

SEQ ID NO: 350152 - DNA, 20 bp, human
ggtgggcagggcctgcgctc

SEQ ID NO: 350153 - DNA, 20 bp, human
ggctaaggggcccgtgggca

SEQ ID NO: 350154 - DNA, 20 bp, human
ggggaaggggcgggcctagg

SEQ ID NO: 350155 - DNA, 20 bp, human
gcagctagagagaagaacct

SEQ ID NO: 350156 - DNA, 20 bp, human
gctccgcagtgagtggggag

SEQ ID NO: 350157 - DNA, 20 bp, human
gccccctccccgaactgcgg

SEQ ID NO: 350158 - DNA, 20 bp, human
ggccccgccgcaggtcctgg

SEQ ID NO: 350159 - DNA, 20 bp, human
gcgccgccgcagttcgggga

SEQ ID NO: 350160 - DNA, 20 bp, human
gtggggcccacggcccccat

SEQ ID NO: 350161 - DNA, 20 bp, human
gttgggctccgcagtgagtg

SEQ ID NO: 350162 - DNA, 20 bp, human
gcagacaagcggagcccatg

SEQ ID NO: 350163 - DNA, 20 bp, human
gctgggcccgggttaggctg

SEQ ID NO: 350164 - DNA, 20 bp, human
gtcctccaggacctgcggcg

SEQ ID NO: 350165 - DNA, 20 bp, human
gccgagcgcccgggtgagga

SEQ ID NO: 350166 - DNA, 20 bp, human
gctggggagaaccgagtggg

SEQ ID NO: 350167 - DNA, 20 bp, human
gcgcgctggggagaaccgag

SEQ ID NO: 350168 - DNA, 20 bp, human
gggtgcgtcgggctccccga

SEQ ID NO: 350169 - DNA, 20 bp, human
gcgctcgggccggaacgcgc

SEQ ID NO: 350170 - DNA, 20 bp, human
gtcggcatcaaggacagggt

SEQ ID NO: 350171 - DNA, 20 bp, human
ggcggggcgccaggtacggg

SEQ ID NO: 350172 - DNA, 20 bp, human
ggaagggcccagcattaagt

SEQ ID NO: 350173 - DNA, 20 bp, human
gcggcggcgctgcctgcgat

SEQ ID NO: 350174 - DNA, 20 bp, human
gccgcctcggcatcaaggac

SEQ ID NO: 350175 - DNA, 20 bp, human
gggggcggggcgccaggtac

SEQ ID NO: 350176 - DNA, 20 bp, human
gaggccgaggaggttgtgga

SEQ ID NO: 350177 - DNA, 20 bp, human
gctgccctccacaacctcct

SEQ ID NO: 350178 - DNA, 20 bp, human
ggagccccttccggagctgt

SEQ ID NO: 350179 - DNA, 20 bp, human
gcccaacccgagcttcctgt

SEQ ID NO: 350180 - DNA, 20 bp, human
ggaacccacagctccggaag

SEQ ID NO: 350181 - DNA, 20 bp, human
ggcaccaagataggccgagg

SEQ ID NO: 350182 - DNA, 20 bp, human
ggaggcaccaagataggccg

SEQ ID NO: 350183 - DNA, 20 bp, human
gtgtgggccgggctgctaac

SEQ ID NO: 350184 - DNA, 20 bp, human
gtgggctccccgccctgcac

SEQ ID NO: 350185 - DNA, 20 bp, human
gctgccagccgagccccttc

SEQ ID NO: 350186 - DNA, 20 bp, human
ggagccggcctgaagagctc

SEQ ID NO: 350187 - DNA, 20 bp, human
gtagcctcgctcgccacaga

SEQ ID NO: 350188 - DNA, 20 bp, human
gtgagcatgctcggtgggga

SEQ ID NO: 350189 - DNA, 20 bp, human
gcctcgctcgccacagaggg

SEQ ID NO: 350190 - DNA, 20 bp, human
ggcactgagcatgctcggtg

SEQ ID NO: 350191 - DNA, 20 bp, human
ggggccggagctcttcaggc

SEQ ID NO: 350192 - DNA, 20 bp, human
gaaaaggcactgagcatgct

SEQ ID NO: 350193 - DNA, 20 bp, human
ggtgggctgcgagtcggggc

SEQ ID NO: 350194 - DNA, 20 bp, human
gggcgggcccggagaaaaca

SEQ ID NO: 350195 - DNA, 20 bp, human
ggtcggggccggagctcttc

SEQ ID NO: 350196 - DNA, 20 bp, human
ggagccccgcaaagcctctc

SEQ ID NO: 350197 - DNA, 20 bp, human
gcccccgccccctaggcgac

SEQ ID NO: 350198 - DNA, 20 bp, human
gggccgcgagcgctcccgag

SEQ ID NO: 350199 - DNA, 20 bp, human
gtcgcggcccgtcgcctagg

SEQ ID NO: 350200 - DNA, 20 bp, human
ggctcccgagaggctttgcg

SEQ ID NO: 350201 - DNA, 20 bp, human
gcgctcgcggcccgtcgcct

SEQ ID NO: 350202 - DNA, 20 bp, human
gcgcgcccagtcagacccca

SEQ ID NO: 350203 - DNA, 20 bp, human
gcggcccgtcgcctaggggg

SEQ ID NO: 350204 - DNA, 20 bp, human
gcgggcgcgcgctcgagcgc

SEQ ID NO: 350205 - DNA, 20 bp, human
gcaggccctggggtctgact

SEQ ID NO: 350206 - DNA, 20 bp, human
gttggggagtggcgcgagtt

SEQ ID NO: 350207 - DNA, 20 bp, human
gccccgcggaaaaccaggag

SEQ ID NO: 350208 - DNA, 20 bp, human
gcccaaatcggactcaaatc

SEQ ID NO: 350209 - DNA, 20 bp, human
gtaggaactggctggaagat

SEQ ID NO: 350210 - DNA, 20 bp, human
gagtggcgcgagttaggaac

SEQ ID NO: 350211 - DNA, 20 bp, human
gccgcccggggctgagtgaa

SEQ ID NO: 350212 - DNA, 20 bp, human
gctgtgggagagagcgcgat

SEQ ID NO: 350213 - DNA, 20 bp, human
gagagcgcgatgggccgcgg

SEQ ID NO: 350214 - DNA, 20 bp, human
ggcgcgagttaggaactggc

SEQ ID NO: 350215 - DNA, 20 bp, human
gctcgcgccactccccaaat

SEQ ID NO: 350216 - DNA, 20 bp, human
ggggaaagagcgtagagtcg

SEQ ID NO: 350217 - DNA, 20 bp, human
gaaagagcgtagagtcgggg

SEQ ID NO: 350218 - DNA, 20 bp, human
gcctgggaaaagcccggcga

SEQ ID NO: 350219 - DNA, 20 bp, human
gggagcagagggcccaaccg

SEQ ID NO: 350220 - DNA, 20 bp, human
gaggaactgcagcccgagca

SEQ ID NO: 350221 - DNA, 20 bp, human
gggaaatctgcgaactgggg

SEQ ID NO: 350222 - DNA, 20 bp, human
ggcgtagagtcggggagggt

SEQ ID NO: 350223 - DNA, 20 bp, human
gtggggaggagggcgagcct

SEQ ID NO: 350224 - DNA, 20 bp, human
ggggaaagtcccacctcttc

SEQ ID NO: 350225 - DNA, 20 bp, human
gaagaagaggaagttacagg

SEQ ID NO: 350226 - DNA, 20 bp, human
ggggccaaagggattttgaa

SEQ ID NO: 350227 - DNA, 20 bp, human
gcgtgggactctgaaataga

SEQ ID NO: 350228 - DNA, 20 bp, human
gtgcacactggtctgagcgt

SEQ ID NO: 350229 - DNA, 20 bp, human
gatgcctgagaggcaccggt

SEQ ID NO: 350230 - DNA, 20 bp, human
gcaactgaggaccgagtcac

SEQ ID NO: 350231 - DNA, 20 bp, human
gccacccagcggcagaaccc

SEQ ID NO: 350232 - DNA, 20 bp, human
gttactcatcagcacaacag

SEQ ID NO: 350233 - DNA, 20 bp, human
ggctgaaaggggatatctct

SEQ ID NO: 350234 - DNA, 20 bp, human
gctcctggcatgccccagaa

SEQ ID NO: 350235 - DNA, 20 bp, human
gaaatagaaggcgtggcata

SEQ ID NO: 350236 - DNA, 20 bp, human
gagggcagagcgtgtgaatc

SEQ ID NO: 350237 - DNA, 20 bp, human
ggctaatgatgctgacagag

SEQ ID NO: 350238 - DNA, 20 bp, human
gggagtgggacagagatcac

SEQ ID NO: 350239 - DNA, 20 bp, human
gtcagcatcattagcagcta

SEQ ID NO: 350240 - DNA, 20 bp, human
gcatgcttgtgttgagtgtg

SEQ ID NO: 350241 - DNA, 20 bp, human
gtgtgctgtgtttctgttag

SEQ ID NO: 350242 - DNA, 20 bp, human
gcacaaggaaagccatttcc

SEQ ID NO: 350243 - DNA, 20 bp, human
gcaaacttggttagtggagt

SEQ ID NO: 350244 - DNA, 20 bp, human
ggaagactgagagctgtgtg

SEQ ID NO: 350245 - DNA, 20 bp, human
gcacaataatgtaattatat

SEQ ID NO: 350246 - DNA, 20 bp, human
gtatccccagggggcaggag

SEQ ID NO: 350247 - DNA, 20 bp, human
ggcgccctgccttacggtag

SEQ ID NO: 350248 - DNA, 20 bp, human
gggcaccgggcgctgaagca

SEQ ID NO: 350249 - DNA, 20 bp, human
gtgccccctggggatactct

SEQ ID NO: 350250 - DNA, 20 bp, human
gttacggtagaggaatgcgt

SEQ ID NO: 350251 - DNA, 20 bp, human
gccctccccaggactggcgg

SEQ ID NO: 350252 - DNA, 20 bp, human
gggagcggccccgaagtgtg

SEQ ID NO: 350253 - DNA, 20 bp, human
gtccccaggactggcggagg

SEQ ID NO: 350254 - DNA, 20 bp, human
gctcaggcggatgtccactc

SEQ ID NO: 350255 - DNA, 20 bp, human
ggtggaggcgccctgcctta

SEQ ID NO: 350256 - DNA, 20 bp, human
ggggcgccgcagtgcagcgg

SEQ ID NO: 350257 - DNA, 20 bp, human
gggtggggccccagtctccg

SEQ ID NO: 350258 - DNA, 20 bp, human
gctcagaggccccggggtga

SEQ ID NO: 350259 - DNA, 20 bp, human
ggctgcactgcggcgcccgt

SEQ ID NO: 350260 - DNA, 20 bp, human
ggctgctgaggaagactcat

SEQ ID NO: 350261 - DNA, 20 bp, human
ggacacctgtcgcaggtggc

SEQ ID NO: 350262 - DNA, 20 bp, human
gccccgcggtcccgctgctg

SEQ ID NO: 350263 - DNA, 20 bp, human
gtggtcgccaggcgtccggg

SEQ ID NO: 350264 - DNA, 20 bp, human
gccctccagccttttctgaa

SEQ ID NO: 350265 - DNA, 20 bp, human
gtcccccagcagcgggaccg

SEQ ID NO: 350266 - DNA, 20 bp, human
ggtcccgagtgggagatccg

SEQ ID NO: 350267 - DNA, 20 bp, human
ggggcccgcgcacctgggcg

SEQ ID NO: 350268 - DNA, 20 bp, human
ggcagctttcgcaggcgaaa

SEQ ID NO: 350269 - DNA, 20 bp, human
gctcccactcgggacccggg

SEQ ID NO: 350270 - DNA, 20 bp, human
gccgagtgggagatccgagg

SEQ ID NO: 350271 - DNA, 20 bp, human
gggcgcgcgccaatgggcag

SEQ ID NO: 350272 - DNA, 20 bp, human
gttcctcccgggtcccgagt

SEQ ID NO: 350273 - DNA, 20 bp, human
gtgggcaccggctcatccac

SEQ ID NO: 350274 - DNA, 20 bp, human
gaagcgagagggcgcgactg

SEQ ID NO: 350275 - DNA, 20 bp, human
gtcgcctgcgaaagctgcct

SEQ ID NO: 350276 - DNA, 20 bp, human
gttccgtcttctccatccgt

SEQ ID NO: 350277 - DNA, 20 bp, human
gcacagtggagttactccct

SEQ ID NO: 350278 - DNA, 20 bp, human
gcctcacctaaatcagtcac

SEQ ID NO: 350279 - DNA, 20 bp, human
gcagaccccgtgactgattt

SEQ ID NO: 350280 - DNA, 20 bp, human
gcacgctaagaaacgcccaa

SEQ ID NO: 350281 - DNA, 20 bp, human
gccactgtgacgttaaaatt

SEQ ID NO: 350282 - DNA, 20 bp, human
gtgtgacgttaaaattgggg

SEQ ID NO: 350283 - DNA, 20 bp, human
gttccggtgtctccaacgga

SEQ ID NO: 350284 - DNA, 20 bp, human
gtaaatctcacgacgacagc

SEQ ID NO: 350285 - DNA, 20 bp, human
gcggagacaagtctgcgcgg

SEQ ID NO: 350286 - DNA, 20 bp, human
gagccgaggaagggtagggg

SEQ ID NO: 350287 - DNA, 20 bp, human
ggcgctggggttgaccgcga

SEQ ID NO: 350288 - DNA, 20 bp, human
gaccgcgagggaaacagtaa

SEQ ID NO: 350289 - DNA, 20 bp, human
gcgctcctggccgtgaagag

SEQ ID NO: 350290 - DNA, 20 bp, human
gcgcgagttcaagcctcgtg

SEQ ID NO: 350291 - DNA, 20 bp, human
gggcttgaactcgcgcgctg

SEQ ID NO: 350292 - DNA, 20 bp, human
gagggaaacagtaagggact

SEQ ID NO: 350293 - DNA, 20 bp, human
gctcgcccccgcgccgcacg

SEQ ID NO: 350294 - DNA, 20 bp, human
gttcaagcctcgtgcggcgc

SEQ ID NO: 350295 - DNA, 20 bp, human
gcaaggctgagaggacgcgg

SEQ ID NO: 350296 - DNA, 20 bp, human
gggcgcgggctagggaaggg

SEQ ID NO: 350297 - DNA, 20 bp, human
gcggccgggcgcctgaaggg

SEQ ID NO: 350298 - DNA, 20 bp, human
gggccggactgccgactgta

SEQ ID NO: 350299 - DNA, 20 bp, human
ggccgccaaccactcacttc

SEQ ID NO: 350300 - DNA, 20 bp, human
gcgtccagccgagacgcaga

SEQ ID NO: 350301 - DNA, 20 bp, human
gcgcgagtcggccctacagt

SEQ ID NO: 350302 - DNA, 20 bp, human
gaaccccgccttctgcgtct

SEQ ID NO: 350303 - DNA, 20 bp, human
gagccgagacgcagaaggcg

SEQ ID NO: 350304 - DNA, 20 bp, human
ggcgcggccgggcgcctgaa

SEQ ID NO: 350305 - DNA, 20 bp, human
gtcccagggcgctaggacag

SEQ ID NO: 350306 - DNA, 20 bp, human
ggtgcctaagggacgcccaa

SEQ ID NO: 350307 - DNA, 20 bp, human
ggggagggcccgtgctgcca

SEQ ID NO: 350308 - DNA, 20 bp, human
gcgtgctgccagggcggtca

SEQ ID NO: 350309 - DNA, 20 bp, human
ggcggtcaggggtgtcttga

SEQ ID NO: 350310 - DNA, 20 bp, human
gacccccttgggcgtccctt

SEQ ID NO: 350311 - DNA, 20 bp, human
gccacccgcgagctgggacg

SEQ ID NO: 350312 - DNA, 20 bp, human
ggcccaagggggtgcccagg

SEQ ID NO: 350313 - DNA, 20 bp, human
ggaagccacgtcccagctcg

SEQ ID NO: 350314 - DNA, 20 bp, human
gccaggggatgctgcggtca

SEQ ID NO: 350315 - DNA, 20 bp, human
gtcagtgtcagaggtgccta

SEQ ID NO: 350316 - DNA, 20 bp, human
gcagtcaggggcggatctac

SEQ ID NO: 350317 - DNA, 20 bp, human
gcaccgaccaatcaccagtc

SEQ ID NO: 350318 - DNA, 20 bp, human
gagggtacggagcagaggta

SEQ ID NO: 350319 - DNA, 20 bp, human
gcctctccttaatagacctc

SEQ ID NO: 350320 - DNA, 20 bp, human
gcgggaagggcgagtcttaa

SEQ ID NO: 350321 - DNA, 20 bp, human
gtccgcccctgactggtgat

SEQ ID NO: 350322 - DNA, 20 bp, human
gcccttcccgaggtctatta

SEQ ID NO: 350323 - DNA, 20 bp, human
gaccaatcaccagtcagggg

SEQ ID NO: 350324 - DNA, 20 bp, human
ggccactcctagttgaagac

SEQ ID NO: 350325 - DNA, 20 bp, human
gcccagactgaaggggcgga

SEQ ID NO: 350326 - DNA, 20 bp, human
gcggggcggggcggtggaaa

SEQ ID NO: 350327 - DNA, 20 bp, human
gtggagaagccccggatccc

SEQ ID NO: 350328 - DNA, 20 bp, human
gaagccccggatccccggct

SEQ ID NO: 350329 - DNA, 20 bp, human
gccgggaatgggttaagcca

SEQ ID NO: 350330 - DNA, 20 bp, human
gccacccggaatcctcgcca

SEQ ID NO: 350331 - DNA, 20 bp, human
gcaggggcggtgcctggacg

SEQ ID NO: 350332 - DNA, 20 bp, human
gctgcagcgggagaaacgca

SEQ ID NO: 350333 - DNA, 20 bp, human
ggaaagggggtggtgcccgg

SEQ ID NO: 350334 - DNA, 20 bp, human
gtccccaagtccgcaggccg

SEQ ID NO: 350335 - DNA, 20 bp, human
gcttctccagggattctccg

SEQ ID NO: 350336 - DNA, 20 bp, human
gtctgtgtgacagaagtagt

SEQ ID NO: 350337 - DNA, 20 bp, human
gaaggttagcagcccgggta

SEQ ID NO: 350338 - DNA, 20 bp, human
gtgagccaggagcagcgtcc

SEQ ID NO: 350339 - DNA, 20 bp, human
gaacgcgagcgatccgagca

SEQ ID NO: 350340 - DNA, 20 bp, human
gcccccatgcgagctgtttg

SEQ ID NO: 350341 - DNA, 20 bp, human
gctggctgtctgcttttgca

SEQ ID NO: 350342 - DNA, 20 bp, human
gtaccccttgggaaaggctt

SEQ ID NO: 350343 - DNA, 20 bp, human
gtctgacatcaccaactccc

SEQ ID NO: 350344 - DNA, 20 bp, human
ggcaccgtcggggtaggatc

SEQ ID NO: 350345 - DNA, 20 bp, human
gtaggaagtgagctgttcag

SEQ ID NO: 350346 - DNA, 20 bp, human
gagctggacggaggctaaag

SEQ ID NO: 350347 - DNA, 20 bp, human
ggtgcttcggcagctagcac

SEQ ID NO: 350348 - DNA, 20 bp, human
ggtggggcttggagagcgaa

SEQ ID NO: 350349 - DNA, 20 bp, human
gagcacgcatataaaatcat

SEQ ID NO: 350350 - DNA, 20 bp, human
gtaagcaagcgcgcgcgccg

SEQ ID NO: 350351 - DNA, 20 bp, human
gcatacgtacactcgctccg

SEQ ID NO: 350352 - DNA, 20 bp, human
gccaggtcggggttggaaga

SEQ ID NO: 350353 - DNA, 20 bp, human
gtgctcgggagaatgcttgc

SEQ ID NO: 350354 - DNA, 20 bp, human
gttaaaagcgaagcctggag

SEQ ID NO: 350355 - DNA, 20 bp, human
gcttggagagcgaagggggc

SEQ ID NO: 350356 - DNA, 20 bp, human
ggaagcctagcaaatgggaa

SEQ ID NO: 350357 - DNA, 20 bp, human
gagaaaaggttggcatcacg

SEQ ID NO: 350358 - DNA, 20 bp, human
gctccccagggtaggcaatg

SEQ ID NO: 350359 - DNA, 20 bp, human
gctggggaggcgccagagac

SEQ ID NO: 350360 - DNA, 20 bp, human
gcccagggtaggcaatgggg

SEQ ID NO: 350361 - DNA, 20 bp, human
ggcagaggaggtcagtgtcc

SEQ ID NO: 350362 - DNA, 20 bp, human
gtcacggaagcctagcaaat

SEQ ID NO: 350363 - DNA, 20 bp, human
gactgaggtgggctagggga

SEQ ID NO: 350364 - DNA, 20 bp, human
gtacttggatctgcaggtga

SEQ ID NO: 350365 - DNA, 20 bp, human
gcgtgactccatcctctggg

SEQ ID NO: 350366 - DNA, 20 bp, human
ggccgcagcgggcattgatg

SEQ ID NO: 350367 - DNA, 20 bp, human
ggctgcgggaaacgtggaaa

SEQ ID NO: 350368 - DNA, 20 bp, human
gcgggcttagtgctaggatg

SEQ ID NO: 350369 - DNA, 20 bp, human
gccagaagaggcgccgagga

SEQ ID NO: 350370 - DNA, 20 bp, human
gacgcggtacgaggtagcac

SEQ ID NO: 350371 - DNA, 20 bp, human
gtagcactaagcccgggcag

SEQ ID NO: 350372 - DNA, 20 bp, human
gggcgggccgcgattcctcg

SEQ ID NO: 350373 - DNA, 20 bp, human
gacgcctccccgaggaatcg

SEQ ID NO: 350374 - DNA, 20 bp, human
ggggccgcgattcctcgggg

SEQ ID NO: 350375 - DNA, 20 bp, human
gggtgggagaagtcgccaga

SEQ ID NO: 350376 - DNA, 20 bp, human
ggtcatgagggctggatcga

SEQ ID NO: 350377 - DNA, 20 bp, human
gcagagggaggtgggaccga

SEQ ID NO: 350378 - DNA, 20 bp, human
gccagaggccggtcccactg

SEQ ID NO: 350379 - DNA, 20 bp, human
ggagggctggatcgagggga

SEQ ID NO: 350380 - DNA, 20 bp, human
gaggagccagagttgctgga

SEQ ID NO: 350381 - DNA, 20 bp, human
ggaggccggtcccactgggg

SEQ ID NO: 350382 - DNA, 20 bp, human
ggggcacagaaagtccttgg

SEQ ID NO: 350383 - DNA, 20 bp, human
gaggcgcagggaaggacgtg

SEQ ID NO: 350384 - DNA, 20 bp, human
gtggacctcggggacgtggg

SEQ ID NO: 350385 - DNA, 20 bp, human
ggacccagggagagacacaa

SEQ ID NO: 350386 - DNA, 20 bp, human
gtgggagcagccagagtcga

SEQ ID NO: 350387 - DNA, 20 bp, human
gaggttgaaacagtgtcaaa

SEQ ID NO: 350388 - DNA, 20 bp, human
gggtgctttaaagccacctt

SEQ ID NO: 350389 - DNA, 20 bp, human
gacacaagccatggactcat

SEQ ID NO: 350390 - DNA, 20 bp, human
gagctatttctctagatgga

SEQ ID NO: 350391 - DNA, 20 bp, human
gaagagacaactgtttaaaa

SEQ ID NO: 350392 - DNA, 20 bp, human
gacctttatttctcaagcaa

SEQ ID NO: 350393 - DNA, 20 bp, human
gttgtgatctgcctccccgt

SEQ ID NO: 350394 - DNA, 20 bp, human
gtcatttcttacacaagcca

SEQ ID NO: 350395 - DNA, 20 bp, human
gtaaagcaccaatgagtcca

SEQ ID NO: 350396 - DNA, 20 bp, human
gcccaaacgtccctgagttg

SEQ ID NO: 350397 - DNA, 20 bp, human
ggtcccgtcggactgggtgc

SEQ ID NO: 350398 - DNA, 20 bp, human
gactgcgaggagaacccgcg

SEQ ID NO: 350399 - DNA, 20 bp, human
gacccgcggggatttcggtc

SEQ ID NO: 350400 - DNA, 20 bp, human
gggagcgaggccgcaactca

SEQ ID NO: 350401 - DNA, 20 bp, human
gcgccagcacccagtccgac

SEQ ID NO: 350402 - DNA, 20 bp, human
ggccgcaactcagggacgtt

SEQ ID NO: 350403 - DNA, 20 bp, human
gctcctgaccgaaatccccg

SEQ ID NO: 350404 - DNA, 20 bp, human
gctcagggacgtttgggcga

SEQ ID NO: 350405 - DNA, 20 bp, human
gctccggtccgctgtcccgt

SEQ ID NO: 350406 - DNA, 20 bp, human
gctctgccctgcagccgcga

SEQ ID NO: 350407 - DNA, 20 bp, human
gcggggaggcgggtcgtata

SEQ ID NO: 350408 - DNA, 20 bp, human
ggggtgatgccagccaatca

SEQ ID NO: 350409 - DNA, 20 bp, human
ggggaaatcccgagtgcatc

SEQ ID NO: 350410 - DNA, 20 bp, human
ggctacgtcctcgatgtcta

SEQ ID NO: 350411 - DNA, 20 bp, human
ggtagagccacagtgcgcat

SEQ ID NO: 350412 - DNA, 20 bp, human
gtggctggcatcaccctccg

SEQ ID NO: 350413 - DNA, 20 bp, human
gctgcggcgcacttccgtag

SEQ ID NO: 350414 - DNA, 20 bp, human
gagccacacggctccttgat

SEQ ID NO: 350415 - DNA, 20 bp, human
ggcgggtcgtataaggaggt

SEQ ID NO: 350416 - DNA, 20 bp, human
gggcgcgcgcctgtctcccg

SEQ ID NO: 350417 - DNA, 20 bp, human
gggaaaaggaagagtccaga

SEQ ID NO: 350418 - DNA, 20 bp, human
ggccacgccaacaggagatg

SEQ ID NO: 350419 - DNA, 20 bp, human
ggcgcggccgcatctcctgt

SEQ ID NO: 350420 - DNA, 20 bp, human
ggagagggcagcttgtgcgc

SEQ ID NO: 350421 - DNA, 20 bp, human
gaaagccggagagaccagag

SEQ ID NO: 350422 - DNA, 20 bp, human
gggtccccctctggtctctc

SEQ ID NO: 350423 - DNA, 20 bp, human
gaaacaaagccccgggagac

SEQ ID NO: 350424 - DNA, 20 bp, human
gttgtgcgcaggcgcgttcc

SEQ ID NO: 350425 - DNA, 20 bp, human
gtcccggggctttgtttgat

SEQ ID NO: 350426 - DNA, 20 bp, human
gcccaaagggggcaggtaag

SEQ ID NO: 350427 - DNA, 20 bp, human
gtctcagcaagcaacgaagt

SEQ ID NO: 350428 - DNA, 20 bp, human
ggggggagctggactgacag

SEQ ID NO: 350429 - DNA, 20 bp, human
gctgctgttgctggacctag

SEQ ID NO: 350430 - DNA, 20 bp, human
gcgaggcccgcccccaaagg

SEQ ID NO: 350431 - DNA, 20 bp, human
ggtactgctgctggcgtagc

SEQ ID NO: 350432 - DNA, 20 bp, human
gagcaacgaagtgggcagtt

SEQ ID NO: 350433 - DNA, 20 bp, human
ggatggaccagaatacgagg

SEQ ID NO: 350434 - DNA, 20 bp, human
ggtggacgaaggtgactctc

SEQ ID NO: 350435 - DNA, 20 bp, human
ggggtctgtggcaggggcac

SEQ ID NO: 350436 - DNA, 20 bp, human
gcccggctcgggggtggcga

SEQ ID NO: 350437 - DNA, 20 bp, human
ggcggtgaatggagacccgg

SEQ ID NO: 350438 - DNA, 20 bp, human
gaaggcggtgaatggagacc

SEQ ID NO: 350439 - DNA, 20 bp, human
gtaagggtagctcccagtcg

SEQ ID NO: 350440 - DNA, 20 bp, human
ggtgaatggagacccggggg

SEQ ID NO: 350441 - DNA, 20 bp, human
gaatggagacccgggggggg

SEQ ID NO: 350442 - DNA, 20 bp, human
gggcttggggcgctggctaa

SEQ ID NO: 350443 - DNA, 20 bp, human
ggccctgccgcctgcgtagc

SEQ ID NO: 350444 - DNA, 20 bp, human
gcggccttaaaatccccacc

SEQ ID NO: 350445 - DNA, 20 bp, human
gcgggagtacggttctctgc

SEQ ID NO: 350446 - DNA, 20 bp, human
gacccggggggcgcagggat

SEQ ID NO: 350447 - DNA, 20 bp, human
gtgcctggcggaagagacga

SEQ ID NO: 350448 - DNA, 20 bp, human
gcgcctgcaagaccgccagt

SEQ ID NO: 350449 - DNA, 20 bp, human
gcccctgctcccaactggcc

SEQ ID NO: 350450 - DNA, 20 bp, human
gctggcgggtggcggagacc

SEQ ID NO: 350451 - DNA, 20 bp, human
gtgcaggggcggggttggca

SEQ ID NO: 350452 - DNA, 20 bp, human
gaagaccgccagttggccga

SEQ ID NO: 350453 - DNA, 20 bp, human
gcagggacggcgctggcggg

SEQ ID NO: 350454 - DNA, 20 bp, human
gggaccctcggccgcgctcg

SEQ ID NO: 350455 - DNA, 20 bp, human
gaactggcccgggccctgca

SEQ ID NO: 350456 - DNA, 20 bp, human
gatgtattttttgtattggt

SEQ ID NO: 350457 - DNA, 20 bp, human
gaaatatgtattttttgtat

SEQ ID NO: 350458 - DNA, 20 bp, human
gccgcgaccggggttcccca

SEQ ID NO: 350459 - DNA, 20 bp, human
gaggggcggggcctgtgagg

SEQ ID NO: 350460 - DNA, 20 bp, human
gccggggccgcagctctcat

SEQ ID NO: 350461 - DNA, 20 bp, human
gaggaggcgctgacactcgc

SEQ ID NO: 350462 - DNA, 20 bp, human
gcggcgcggtggctcgaggg

SEQ ID NO: 350463 - DNA, 20 bp, human
ggggaaccccggtcgcggat

SEQ ID NO: 350464 - DNA, 20 bp, human
gaccggggttccccagggcg

SEQ ID NO: 350465 - DNA, 20 bp, human
gagccggcgcggtggctcga

SEQ ID NO: 350466 - DNA, 20 bp, human
gatgtattttttgtattggt

SEQ ID NO: 350467 - DNA, 20 bp, human
gaaatatgtattttttgtat

SEQ ID NO: 350468 - DNA, 20 bp, human
gggactgggcgccgcagggg

SEQ ID NO: 350469 - DNA, 20 bp, human
gctgggcgccgcaggggggg

SEQ ID NO: 350470 - DNA, 20 bp, human
gccgcgaccggggttcccca

SEQ ID NO: 350471 - DNA, 20 bp, human
gaggggcggggcctgtgagg

SEQ ID NO: 350472 - DNA, 20 bp, human
gccggggccgcagctctcat

SEQ ID NO: 350473 - DNA, 20 bp, human
gaggaggcgctgacactcgc

SEQ ID NO: 350474 - DNA, 20 bp, human
gcggcgcggtggctcgaggg

SEQ ID NO: 350475 - DNA, 20 bp, human
ggggaaccccggtcgcggat

SEQ ID NO: 350476 - DNA, 20 bp, human
ggccacgcccatcaggacgg

SEQ ID NO: 350477 - DNA, 20 bp, human
ggagacaagggtgcaccgcc

SEQ ID NO: 350478 - DNA, 20 bp, human
ggaggggcccccgtcctgat

SEQ ID NO: 350479 - DNA, 20 bp, human
gcgctctggcgcgcatgact

SEQ ID NO: 350480 - DNA, 20 bp, human
gcgcacgggcggcggagaca

SEQ ID NO: 350481 - DNA, 20 bp, human
gtgactggggtgccggtaga

SEQ ID NO: 350482 - DNA, 20 bp, human
gcgccagagcgcacgggcgg

SEQ ID NO: 350483 - DNA, 20 bp, human
gcggagaggtgtgaatatgt

SEQ ID NO: 350484 - DNA, 20 bp, human
ggactctgaacggaccccca

SEQ ID NO: 350485 - DNA, 20 bp, human
gcaagggtgcaccgccaggt

SEQ ID NO: 350486 - DNA, 20 bp, human
gcagcggcaggcggcatccc

SEQ ID NO: 350487 - DNA, 20 bp, human
gctgcggcgcagtccctccc

SEQ ID NO: 350488 - DNA, 20 bp, human
gggcggcatcccagggtgat

SEQ ID NO: 350489 - DNA, 20 bp, human
ggacaggcgggctagaaccc

SEQ ID NO: 350490 - DNA, 20 bp, human
gctgaagctgaacttgtcat

SEQ ID NO: 350491 - DNA, 20 bp, human
gcgagtaacgaagccgggga

SEQ ID NO: 350492 - DNA, 20 bp, human
ggcggcggatcccacaaacc

SEQ ID NO: 350493 - DNA, 20 bp, human
gtgcactcgagtaacgaagc

SEQ ID NO: 350494 - DNA, 20 bp, human
ggaaagtaggcgggacaggc

SEQ ID NO: 350495 - DNA, 20 bp, human
gacccggaccgctcaatacc

SEQ ID NO: 350496 - DNA, 20 bp, human
gcaggttgctggaggttcga

SEQ ID NO: 350497 - DNA, 20 bp, human
ggttgctggaggttcgaggg

SEQ ID NO: 350498 - DNA, 20 bp, human
gccagactgcctccctgacg

SEQ ID NO: 350499 - DNA, 20 bp, human
gtctacactccggccaactg

SEQ ID NO: 350500 - DNA, 20 bp, human
gcaagtgctgcctccccgtc

SEQ ID NO: 350501 - DNA, 20 bp, human
gagagaggaggtgggttacc

SEQ ID NO: 350502 - DNA, 20 bp, human
gtgctgcctccccgtcaggg

SEQ ID NO: 350503 - DNA, 20 bp, human
ggactgcctccctgacgggg

SEQ ID NO: 350504 - DNA, 20 bp, human
gcacagtgcgggcaggttgc

SEQ ID NO: 350505 - DNA, 20 bp, human
gacgtggagttgggttccga

SEQ ID NO: 350506 - DNA, 20 bp, human
gaggctgcatataagggcgg

SEQ ID NO: 350507 - DNA, 20 bp, human
ggggcgtgacgcaccgagct

SEQ ID NO: 350508 - DNA, 20 bp, human
ggtgacgcaccgagctggga

SEQ ID NO: 350509 - DNA, 20 bp, human
gcgacctcgtcacccgctgc

SEQ ID NO: 350510 - DNA, 20 bp, human
gtgccgggctcctgctctct

SEQ ID NO: 350511 - DNA, 20 bp, human
ggggactgggagccggtgcg

SEQ ID NO: 350512 - DNA, 20 bp, human
gagcccggcagcgggtgacg

SEQ ID NO: 350513 - DNA, 20 bp, human
gccgagcaggctgcatataa

SEQ ID NO: 350514 - DNA, 20 bp, human
gcgcgggaggtgcaggaatg

SEQ ID NO: 350515 - DNA, 20 bp, human
gctcctgctctctgggcgcg

SEQ ID NO: 350516 - DNA, 20 bp, human
ggggcatctgcctgcgagag

SEQ ID NO: 350517 - DNA, 20 bp, human
gcgccctgcgggtgacagtg

SEQ ID NO: 350518 - DNA, 20 bp, human
ggggaggcgcggctcgcggg

SEQ ID NO: 350519 - DNA, 20 bp, human
gccctccttccccctctcgc

SEQ ID NO: 350520 - DNA, 20 bp, human
gaaccccaggctcctgatga

SEQ ID NO: 350521 - DNA, 20 bp, human
gacaaagttctcctcatctg

SEQ ID NO: 350522 - DNA, 20 bp, human
gtgtcacccgcagggcgaag

SEQ ID NO: 350523 - DNA, 20 bp, human
gaaggcggcccgggcctcgg

SEQ ID NO: 350524 - DNA, 20 bp, human
gcgccccggaggccgcgaaa

SEQ ID NO: 350525 - DNA, 20 bp, human
ggggttctgccacctttcgg

SEQ ID NO: 350526 - DNA, 20 bp, human
gcgcgcgccagcacgttctg

SEQ ID NO: 350527 - DNA, 20 bp, human
gtggccggaactgggattcg

SEQ ID NO: 350528 - DNA, 20 bp, human
ggcaagcagcggtggactcc

SEQ ID NO: 350529 - DNA, 20 bp, human
ggctgcttgccgcgcaggtg

SEQ ID NO: 350530 - DNA, 20 bp, human
gtaggggtaggattccgaat

SEQ ID NO: 350531 - DNA, 20 bp, human
gggcgtgggaactggagaag

SEQ ID NO: 350532 - DNA, 20 bp, human
gagacctggctggccggaac

SEQ ID NO: 350533 - DNA, 20 bp, human
gaggtaaggtaggtaggggt

SEQ ID NO: 350534 - DNA, 20 bp, human
gcggggggagcattgccctt

SEQ ID NO: 350535 - DNA, 20 bp, human
ggactccggggcgtgggaac

SEQ ID NO: 350536 - DNA, 20 bp, human
gagctggtcagagagtgcag

SEQ ID NO: 350537 - DNA, 20 bp, human
gcctcaggggcaatgctggt

SEQ ID NO: 350538 - DNA, 20 bp, human
gcacgtggatgtggtatgga

SEQ ID NO: 350539 - DNA, 20 bp, human
gggggcctcaggggcaatgc

SEQ ID NO: 350540 - DNA, 20 bp, human
gcagcccacgaggatctcga

SEQ ID NO: 350541 - DNA, 20 bp, human
ggggagcagggctgatccat

SEQ ID NO: 350542 - DNA, 20 bp, human
ggggccctgctctggcagtc

SEQ ID NO: 350543 - DNA, 20 bp, human
gaaggcacgtggatgtggta

SEQ ID NO: 350544 - DNA, 20 bp, human
ggcggggcctgtcgggagca

SEQ ID NO: 350545 - DNA, 20 bp, human
ggatcagccctgctcccgac

SEQ ID NO: 350546 - DNA, 20 bp, human
ggacgcgctgcgggagtctg

SEQ ID NO: 350547 - DNA, 20 bp, human
gccggcaggcaagtcccagt

SEQ ID NO: 350548 - DNA, 20 bp, human
gcacccaggctgacgcgctg

SEQ ID NO: 350549 - DNA, 20 bp, human
gtcccgcagcgcgtcagcct

SEQ ID NO: 350550 - DNA, 20 bp, human
gcgggagtctggggcccact

SEQ ID NO: 350551 - DNA, 20 bp, human
ggggcctctgccgcgtggga

SEQ ID NO: 350552 - DNA, 20 bp, human
gcaggcgcctgagccaaggg

SEQ ID NO: 350553 - DNA, 20 bp, human
gccgcgggcctctgccgcgt

SEQ ID NO: 350554 - DNA, 20 bp, human
gccgccgcgcacgcccccct

SEQ ID NO: 350555 - DNA, 20 bp, human
gcgcacgccccccttggctc

SEQ ID NO: 350556 - DNA, 20 bp, human
ggccgcggaggcctgaacgc

SEQ ID NO: 350557 - DNA, 20 bp, human
gtccgcggccggggcacgga

SEQ ID NO: 350558 - DNA, 20 bp, human
gccgccgccaggcgctcgtg

SEQ ID NO: 350559 - DNA, 20 bp, human
gcgggcggcgctgcacacca

SEQ ID NO: 350560 - DNA, 20 bp, human
ggcgccccctcgtggcactc

SEQ ID NO: 350561 - DNA, 20 bp, human
ggcagcgccgcgttgctccg

SEQ ID NO: 350562 - DNA, 20 bp, human
ggcactcaggcagcgcggag

SEQ ID NO: 350563 - DNA, 20 bp, human
ggcgccaggaccacccgctc

SEQ ID NO: 350564 - DNA, 20 bp, human
gtcccccaatgggacatccc

SEQ ID NO: 350565 - DNA, 20 bp, human
gcgggtggtcctggcgcggg

SEQ ID NO: 350566 - DNA, 20 bp, human
gacaactggcacttaacccc

SEQ ID NO: 350567 - DNA, 20 bp, human
gtaacatccgagggagagaa

SEQ ID NO: 350568 - DNA, 20 bp, human
ggcggcgcactgtagacctg

SEQ ID NO: 350569 - DNA, 20 bp, human
gcgcaaagacgcaaactccc

SEQ ID NO: 350570 - DNA, 20 bp, human
gtaacccaatgaaaccccga

SEQ ID NO: 350571 - DNA, 20 bp, human
ggctgaaacgggctcttcga

SEQ ID NO: 350572 - DNA, 20 bp, human
ggcggctctgcgcctcggcg

SEQ ID NO: 350573 - DNA, 20 bp, human
gtgcgcgcggctctgcgcct

SEQ ID NO: 350574 - DNA, 20 bp, human
gccgcgcgcaggctgcaact

SEQ ID NO: 350575 - DNA, 20 bp, human
gcgagccttcggggtttcat

SEQ ID NO: 350576 - DNA, 20 bp, human
gggcgcccgagcagaggcag

SEQ ID NO: 350577 - DNA, 20 bp, human
ggggatggggcggatcaggg

SEQ ID NO: 350578 - DNA, 20 bp, human
gtactggtctgcgtgtgtgt

SEQ ID NO: 350579 - DNA, 20 bp, human
ggacgcgagccggggcaagc

SEQ ID NO: 350580 - DNA, 20 bp, human
gcgccgggatggggcggatc

SEQ ID NO: 350581 - DNA, 20 bp, human
gccgactttgccctttaaat

SEQ ID NO: 350582 - DNA, 20 bp, human
gtggcgcagcccgcttgccc

SEQ ID NO: 350583 - DNA, 20 bp, human
gctcgggcgcccgccgggat

SEQ ID NO: 350584 - DNA, 20 bp, human
gttaaagggcaaagtcggcg

SEQ ID NO: 350585 - DNA, 20 bp, human
ggtggagcgcggccccgcga

SEQ ID NO: 350586 - DNA, 20 bp, human
ggccggggcacccgcggaaa

SEQ ID NO: 350587 - DNA, 20 bp, human
gggccaaagggttaagtctc

SEQ ID NO: 350588 - DNA, 20 bp, human
gggcggctgcaggaaacgtg

SEQ ID NO: 350589 - DNA, 20 bp, human
gcccctgagacttaaccctt

SEQ ID NO: 350590 - DNA, 20 bp, human
gaggcgtggaagctgcgggt

SEQ ID NO: 350591 - DNA, 20 bp, human
ggcgggaaagggggtcccat

SEQ ID NO: 350592 - DNA, 20 bp, human
gagagcgcggagtccggcag

SEQ ID NO: 350593 - DNA, 20 bp, human
ggccaagagaggtcgaaggc

SEQ ID NO: 350594 - DNA, 20 bp, human
gggcacagggcacatgtcta

SEQ ID NO: 350595 - DNA, 20 bp, human
ggagaggtcgaaggcgggca

SEQ ID NO: 350596 - DNA, 20 bp, human
gggcagaggcaagactatct

SEQ ID NO: 350597 - DNA, 20 bp, human
gtctttggctaactttggca

SEQ ID NO: 350598 - DNA, 20 bp, human
gtgaccttgtgtagtatctc

SEQ ID NO: 350599 - DNA, 20 bp, human
ggggagttcgagatcatctt

SEQ ID NO: 350600 - DNA, 20 bp, human
gggcaaatgcaccaaatgac

SEQ ID NO: 350601 - DNA, 20 bp, human
gcaactagtgctcttcatcc

SEQ ID NO: 350602 - DNA, 20 bp, human
gacaattaatctcaggagct

SEQ ID NO: 350603 - DNA, 20 bp, human
gtgctcttcatcctggcatt

SEQ ID NO: 350604 - DNA, 20 bp, human
gtgcatttgccaagtgggag

SEQ ID NO: 350605 - DNA, 20 bp, human
gactcaagtgcaggaagtga

SEQ ID NO: 350606 - DNA, 20 bp, human
ggggaggggggcgacggaat

SEQ ID NO: 350607 - DNA, 20 bp, human
ggccggggtacctttccgtg

SEQ ID NO: 350608 - DNA, 20 bp, human
gcggtagagccaggcgggga

SEQ ID NO: 350609 - DNA, 20 bp, human
ggcaaggctctgccaaaatc

SEQ ID NO: 350610 - DNA, 20 bp, human
gtgggcgtgcgcacccatgg

SEQ ID NO: 350611 - DNA, 20 bp, human
gagtgagtatgtgtagggcc

SEQ ID NO: 350612 - DNA, 20 bp, human
gctgcaccgcaaatgggagg

SEQ ID NO: 350613 - DNA, 20 bp, human
gtacacatactcactccccc

SEQ ID NO: 350614 - DNA, 20 bp, human
gctgccaaaatctgggagtg

SEQ ID NO: 350615 - DNA, 20 bp, human
gccgcctgagaactccgtac

SEQ ID NO: 350616 - DNA, 20 bp, human
gccgaggggcttcacgagga

SEQ ID NO: 350617 - DNA, 20 bp, human
gcaccctcggagtcgcggga

SEQ ID NO: 350618 - DNA, 20 bp, human
gggcacgccccctgctggac

SEQ ID NO: 350619 - DNA, 20 bp, human
gggcccaccctcggagtcgc

SEQ ID NO: 350620 - DNA, 20 bp, human
gatggtgcaacccgccagtt

SEQ ID NO: 350621 - DNA, 20 bp, human
gcggccccgcgggcagaaac

SEQ ID NO: 350622 - DNA, 20 bp, human
gggccactcccggggttaaa

SEQ ID NO: 350623 - DNA, 20 bp, human
ggagtcgcgggaaggccgag

SEQ ID NO: 350624 - DNA, 20 bp, human
gcaacccgccagttgggaaa

SEQ ID NO: 350625 - DNA, 20 bp, human
gggccttcccgcgactccga

SEQ ID NO: 350626 - DNA, 20 bp, human
gcaactcaggggttatgagg

SEQ ID NO: 350627 - DNA, 20 bp, human
gatctcatgagcatgcagag

SEQ ID NO: 350628 - DNA, 20 bp, human
gtgacctcctggcacggtgg

SEQ ID NO: 350629 - DNA, 20 bp, human
gctctcgaacggcaagagag

SEQ ID NO: 350630 - DNA, 20 bp, human
gagctgataagtcacactga

SEQ ID NO: 350631 - DNA, 20 bp, human
gtaagccaagggacgctgag

SEQ ID NO: 350632 - DNA, 20 bp, human
gtttcactggggctctcgaa

SEQ ID NO: 350633 - DNA, 20 bp, human
gtgagtgagatgagagagca

SEQ ID NO: 350634 - DNA, 20 bp, human
gtctcactcaagtttcactg

SEQ ID NO: 350635 - DNA, 20 bp, human
ggtggcgggcggtatttatc

SEQ ID NO: 350636 - DNA, 20 bp, human
gagcccgccggggagcttga

SEQ ID NO: 350637 - DNA, 20 bp, human
gccaccctcaagctccccgg

SEQ ID NO: 350638 - DNA, 20 bp, human
ggggtctcgacaccgaaaga

SEQ ID NO: 350639 - DNA, 20 bp, human
ggtgggagagccagcgatgc

SEQ ID NO: 350640 - DNA, 20 bp, human
gacggggatcccttctgctg

SEQ ID NO: 350641 - DNA, 20 bp, human
gggggagatagagagcccgc

SEQ ID NO: 350642 - DNA, 20 bp, human
gagaagggatccccgtgtgg

SEQ ID NO: 350643 - DNA, 20 bp, human
gtctcgacaccgaaagatgg

SEQ ID NO: 350644 - DNA, 20 bp, human
gctgaggtttccggcatcgc

SEQ ID NO: 350645 - DNA, 20 bp, human
gctctatctcccccatcttt

SEQ ID NO: 350646 - DNA, 20 bp, human
ggggtccccggctccctatg

SEQ ID NO: 350647 - DNA, 20 bp, human
gtacaccacaaagtcctgga

SEQ ID NO: 350648 - DNA, 20 bp, human
ggggaaacgaggatgcacta

SEQ ID NO: 350649 - DNA, 20 bp, human
gggcgaggtgggaactcgtc

SEQ ID NO: 350650 - DNA, 20 bp, human
gcacatacaccacaaagtcc

SEQ ID NO: 350651 - DNA, 20 bp, human
gcgcgagagcagcacgtgtt

SEQ ID NO: 350652 - DNA, 20 bp, human
gggaactcgtctggccgcgg

SEQ ID NO: 350653 - DNA, 20 bp, human
gtgaggaaggtgtccacata

SEQ ID NO: 350654 - DNA, 20 bp, human
gatgtccggggcgttgagga

SEQ ID NO: 350655 - DNA, 20 bp, human
gagcacgtgtttgggcgagg

SEQ ID NO: 350656 - DNA, 20 bp, human
gagggtcgcaggaaggtgac

SEQ ID NO: 350657 - DNA, 20 bp, human
ggtcgcaggaaggtgactgg

SEQ ID NO: 350658 - DNA, 20 bp, human
ggggacacgcggaggaggta

SEQ ID NO: 350659 - DNA, 20 bp, human
gaggccccgctcgctcgcgc

SEQ ID NO: 350660 - DNA, 20 bp, human
gcccaggaagggtcgcagga

SEQ ID NO: 350661 - DNA, 20 bp, human
gggggacagagatcccggag

SEQ ID NO: 350662 - DNA, 20 bp, human
ggaaggggtaggccctctcc

SEQ ID NO: 350663 - DNA, 20 bp, human
ggaggaggtaaggaaggggt

SEQ ID NO: 350664 - DNA, 20 bp, human
ggggacccgcgccgcgagag

SEQ ID NO: 350665 - DNA, 20 bp, human
gggcgcctgggttggcgctg

SEQ ID NO: 350666 - DNA, 20 bp, human
gagagtctggaggggtgcga

SEQ ID NO: 350667 - DNA, 20 bp, human
gcccgcagggagagtctgga

SEQ ID NO: 350668 - DNA, 20 bp, human
gccgcccaagcgaatatgtc

SEQ ID NO: 350669 - DNA, 20 bp, human
gaattcccgcagggagagtc

SEQ ID NO: 350670 - DNA, 20 bp, human
ggctcctccaccctcctcaa

SEQ ID NO: 350671 - DNA, 20 bp, human
gttacagctaaattcccgca

SEQ ID NO: 350672 - DNA, 20 bp, human
gtgctcgcgctggaaggagg

SEQ ID NO: 350673 - DNA, 20 bp, human
gaggagctgaagaaaggcat

SEQ ID NO: 350674 - DNA, 20 bp, human
gggtgcgaaggtcgaggcca

SEQ ID NO: 350675 - DNA, 20 bp, human
ggagcctgacatattcgctt

SEQ ID NO: 350676 - DNA, 20 bp, human
ggacggtggccgtatctcca

SEQ ID NO: 350677 - DNA, 20 bp, human
gcggcaggactgcggctccg

SEQ ID NO: 350678 - DNA, 20 bp, human
ggctccaggcgctctgcggc

SEQ ID NO: 350679 - DNA, 20 bp, human
ggcggagctgactatcgccg

SEQ ID NO: 350680 - DNA, 20 bp, human
gactccggctggctgctgcg

SEQ ID NO: 350681 - DNA, 20 bp, human
gccgaggctgtgcgcttcgc

SEQ ID NO: 350682 - DNA, 20 bp, human
gcccacaggtctagtgactc

SEQ ID NO: 350683 - DNA, 20 bp, human
gagtcctgccgcagagcgcc

SEQ ID NO: 350684 - DNA, 20 bp, human
gccgcgagcagctagcagcc

SEQ ID NO: 350685 - DNA, 20 bp, human
gtcgcagaatgcctgactag

SEQ ID NO: 350686 - DNA, 20 bp, human
gcggagccccgtgaggcgcg

SEQ ID NO: 350687 - DNA, 20 bp, human
gcgccgcgcgagtgcagtct

SEQ ID NO: 350688 - DNA, 20 bp, human
ggcgccccgggattggctgt

SEQ ID NO: 350689 - DNA, 20 bp, human
ggggggcggggcctcgtgta

SEQ ID NO: 350690 - DNA, 20 bp, human
ggggagcagcgggtggtccg

SEQ ID NO: 350691 - DNA, 20 bp, human
gcggccgcggagaaaacagc

SEQ ID NO: 350692 - DNA, 20 bp, human
gcgcgagtgcagtctgggtc

SEQ ID NO: 350693 - DNA, 20 bp, human
gagaagaggcagcgggcgga

SEQ ID NO: 350694 - DNA, 20 bp, human
gtgactccaggcgcctccgg

SEQ ID NO: 350695 - DNA, 20 bp, human
ggtccggaatggctctgtgg

SEQ ID NO: 350696 - DNA, 20 bp, human
gggggcgctcgggagggtga

SEQ ID NO: 350697 - DNA, 20 bp, human
gaaggagccccagggctagg

SEQ ID NO: 350698 - DNA, 20 bp, human
ggggctccgcagcccttaca

SEQ ID NO: 350699 - DNA, 20 bp, human
gcccccaaacccggccggga

SEQ ID NO: 350700 - DNA, 20 bp, human
gagattgagtgggaggttca

SEQ ID NO: 350701 - DNA, 20 bp, human
gggcttggtagaacaaaggg

SEQ ID NO: 350702 - DNA, 20 bp, human
gggctggcttggtagaacaa

SEQ ID NO: 350703 - DNA, 20 bp, human
ggggctgccaccccgcgggg

SEQ ID NO: 350704 - DNA, 20 bp, human
ggcagcccttacaaggaatt

SEQ ID NO: 350705 - DNA, 20 bp, human
gcgccaccaaattccttgta

SEQ ID NO: 350706 - DNA, 20 bp, human
ggggtctgtgagtggagctc

SEQ ID NO: 350707 - DNA, 20 bp, human
ggcgatgaggtcattcctgg

SEQ ID NO: 350708 - DNA, 20 bp, human
gggagcgatgaggtcattcc

SEQ ID NO: 350709 - DNA, 20 bp, human
gctaccacagggaacggggg

SEQ ID NO: 350710 - DNA, 20 bp, human
gcattggggcaggaacgccg

SEQ ID NO: 350711 - DNA, 20 bp, human
gcccgttccctgtggtaggt

SEQ ID NO: 350712 - DNA, 20 bp, human
gacagtgcaggcattctcga

SEQ ID NO: 350713 - DNA, 20 bp, human
gggcccgggtccgcttgcag

SEQ ID NO: 350714 - DNA, 20 bp, human
gcgccctcgcctccggccag

SEQ ID NO: 350715 - DNA, 20 bp, human
ggtggagcgggacacgaacg

SEQ ID NO: 350716 - DNA, 20 bp, human
ggtgaggaggggacgaagga

SEQ ID NO: 350717 - DNA, 20 bp, human
gactgtggggcccgaaggcg

SEQ ID NO: 350718 - DNA, 20 bp, human
gagggccagggccggatgtg

SEQ ID NO: 350719 - DNA, 20 bp, human
gtcgttgtggccgtccgggg

SEQ ID NO: 350720 - DNA, 20 bp, human
gcctcccccaggatccagac

SEQ ID NO: 350721 - DNA, 20 bp, human
gcaatggaaacctgggtgca

SEQ ID NO: 350722 - DNA, 20 bp, human
ggctgaggagagccgcgcaa

SEQ ID NO: 350723 - DNA, 20 bp, human
ggagccgcgcaatggaaacc

SEQ ID NO: 350724 - DNA, 20 bp, human
gcacccaggtttccattgcg

SEQ ID NO: 350725 - DNA, 20 bp, human
gccgtcgttgtggccgtccg

SEQ ID NO: 350726 - DNA, 20 bp, human
gctaccaagcccacctccag

SEQ ID NO: 350727 - DNA, 20 bp, human
gagaagctccgcccctagag

SEQ ID NO: 350728 - DNA, 20 bp, human
ggctccgcccctagagggga

SEQ ID NO: 350729 - DNA, 20 bp, human
gggcgggagcctggacgagc

SEQ ID NO: 350730 - DNA, 20 bp, human
gcggacgagcagatccggta

SEQ ID NO: 350731 - DNA, 20 bp, human
gcccagcccggaagaatcgc

SEQ ID NO: 350732 - DNA, 20 bp, human
gggagtggctgtcacagctc

SEQ ID NO: 350733 - DNA, 20 bp, human
ggccacagcattgtctggga

SEQ ID NO: 350734 - DNA, 20 bp, human
gcggaagaatcgctggcggc

SEQ ID NO: 350735 - DNA, 20 bp, human
gcgggtgaaccgaggagctt

SEQ ID NO: 350736 - DNA, 20 bp, human
ggctccccccacctgcgggc

SEQ ID NO: 350737 - DNA, 20 bp, human
gagaaacccgcgcgcctgga

SEQ ID NO: 350738 - DNA, 20 bp, human
gtcggccggtcgcccgtccg

SEQ ID NO: 350739 - DNA, 20 bp, human
gccgccccttccaggcgcgc

SEQ ID NO: 350740 - DNA, 20 bp, human
gcccgcaccagggtcctgta

SEQ ID NO: 350741 - DNA, 20 bp, human
gggtggggaggtcaaaaact

SEQ ID NO: 350742 - DNA, 20 bp, human
gcagacgcagccctagcgcc

SEQ ID NO: 350743 - DNA, 20 bp, human
gcccggaaagccgggcgcta

SEQ ID NO: 350744 - DNA, 20 bp, human
ggtcgcggaacccggaaagc

SEQ ID NO: 350745 - DNA, 20 bp, human
gctggctcgagtttcggaga

SEQ ID NO: 350746 - DNA, 20 bp, human
ggggcggcggggaagatttg

SEQ ID NO: 350747 - DNA, 20 bp, human
gcacgcccctcactccgcac

SEQ ID NO: 350748 - DNA, 20 bp, human
gccgctctgggaacgccggt

SEQ ID NO: 350749 - DNA, 20 bp, human
gcgccccgctctgggaacgc

SEQ ID NO: 350750 - DNA, 20 bp, human
gacggggcggtgccattggc

SEQ ID NO: 350751 - DNA, 20 bp, human
gacggccaaaggtgccgccc

SEQ ID NO: 350752 - DNA, 20 bp, human
ggggcgggacggagagaccg

SEQ ID NO: 350753 - DNA, 20 bp, human
ggggaacgccggtaggttcc

SEQ ID NO: 350754 - DNA, 20 bp, human
gttcccagagcggggcggac

SEQ ID NO: 350755 - DNA, 20 bp, human
ggcggacggggcggtgccat

SEQ ID NO: 350756 - DNA, 20 bp, human
ggagggcgcatttctgcggg

SEQ ID NO: 350757 - DNA, 20 bp, human
gacccccttcggtccgtcgg

SEQ ID NO: 350758 - DNA, 20 bp, human
gtctgcgcgagtgtggattt

SEQ ID NO: 350759 - DNA, 20 bp, human
gggcgcgtgagggtgcgggt

SEQ ID NO: 350760 - DNA, 20 bp, human
gggggcggggagagtcggag

SEQ ID NO: 350761 - DNA, 20 bp, human
ggaaccgccgacggaccgaa

SEQ ID NO: 350762 - DNA, 20 bp, human
ggagagtcggagtggcagga

SEQ ID NO: 350763 - DNA, 20 bp, human
gcagctgcaggattccgcag

SEQ ID NO: 350764 - DNA, 20 bp, human
ggtccgtcggcggttctctt

SEQ ID NO: 350765 - DNA, 20 bp, human
gaggcagggctgaaggccta

SEQ ID NO: 350766 - DNA, 20 bp, human
gggatcgctgatcgcgtcgg

SEQ ID NO: 350767 - DNA, 20 bp, human
gctgtgcctcagtgcatgtt

SEQ ID NO: 350768 - DNA, 20 bp, human
gtcccagcccggcagagaca

SEQ ID NO: 350769 - DNA, 20 bp, human
gtctccttttcgccacagca

SEQ ID NO: 350770 - DNA, 20 bp, human
gccaggatcgctgatcgcgt

SEQ ID NO: 350771 - DNA, 20 bp, human
gcgcgagtcactcacctgta

SEQ ID NO: 350772 - DNA, 20 bp, human
gcacctgtaggggaggtccg

SEQ ID NO: 350773 - DNA, 20 bp, human
ggaaataattaacagctcct

SEQ ID NO: 350774 - DNA, 20 bp, human
gggcctcggacctcccctac

SEQ ID NO: 350775 - DNA, 20 bp, human
gcctgcgcccgcgcgggcct

SEQ ID NO: 350776 - DNA, 20 bp, human
ggcgacgagccaatgggtcg

SEQ ID NO: 350777 - DNA, 20 bp, human
gtcggggaggggcgtgacag

SEQ ID NO: 350778 - DNA, 20 bp, human
gccccccgagactacaggtg

SEQ ID NO: 350779 - DNA, 20 bp, human
gccgcccctagcacccctat

SEQ ID NO: 350780 - DNA, 20 bp, human
gacgagccaatgggtcgggg

SEQ ID NO: 350781 - DNA, 20 bp, human
gcgtgacagaggcagccaat

SEQ ID NO: 350782 - DNA, 20 bp, human
gccgccccccccgagactac

SEQ ID NO: 350783 - DNA, 20 bp, human
ggggcgcggcgacgagccaa

SEQ ID NO: 350784 - DNA, 20 bp, human
ggcagccaataggggtgcta

SEQ ID NO: 350785 - DNA, 20 bp, human
gcccacacctgtagtctcgg

SEQ ID NO: 350786 - DNA, 20 bp, human
gccgctgcccggcgaagggg

SEQ ID NO: 350787 - DNA, 20 bp, human
gaaacccgagcgcccggccg

SEQ ID NO: 350788 - DNA, 20 bp, human
gtcagccgctgcccggcgaa

SEQ ID NO: 350789 - DNA, 20 bp, human
gcggctgaaacccgagcgcc

SEQ ID NO: 350790 - DNA, 20 bp, human
gcgggggcgcccccctcggc

SEQ ID NO: 350791 - DNA, 20 bp, human
ggccgggagagacctcgtaa

SEQ ID NO: 350792 - DNA, 20 bp, human
gccgcgcctggcccgctcgc

SEQ ID NO: 350793 - DNA, 20 bp, human
gctcccgcggccggtgcctc

SEQ ID NO: 350794 - DNA, 20 bp, human
gggagcgcgggcgtaggagt

SEQ ID NO: 350795 - DNA, 20 bp, human
gtgcgcgagcgctcggccag

SEQ ID NO: 350796 - DNA, 20 bp, human
ggatctggggtcgaatgagt

SEQ ID NO: 350797 - DNA, 20 bp, human
gtggagctgaccaggagttg

SEQ ID NO: 350798 - DNA, 20 bp, human
gaagctgggcaggtctccag

SEQ ID NO: 350799 - DNA, 20 bp, human
ggaccccagatcccctgcca

SEQ ID NO: 350800 - DNA, 20 bp, human
gacaagcatggtaataccaa

SEQ ID NO: 350801 - DNA, 20 bp, human
gagtgaaactcccgttccat

SEQ ID NO: 350802 - DNA, 20 bp, human
gccagcttcagcctcgaaga

SEQ ID NO: 350803 - DNA, 20 bp, human
ggaagctggaaaccggatca

SEQ ID NO: 350804 - DNA, 20 bp, human
ggtgaaaagtcatctgatca

SEQ ID NO: 350805 - DNA, 20 bp, human
gacttgagagtgtggagcag

SEQ ID NO: 350806 - DNA, 20 bp, human
gtagcgtcgctgcgacggaa

SEQ ID NO: 350807 - DNA, 20 bp, human
gcggcatagagcggcaacga

SEQ ID NO: 350808 - DNA, 20 bp, human
gttagccaacggggcaaggg

SEQ ID NO: 350809 - DNA, 20 bp, human
gggggcggagcggcatagag

SEQ ID NO: 350810 - DNA, 20 bp, human
gcgagggcgcgcccgtcgat

SEQ ID NO: 350811 - DNA, 20 bp, human
gtcgcagcgacgctactcag

SEQ ID NO: 350812 - DNA, 20 bp, human
gtcgctgcgacggaaggggg

SEQ ID NO: 350813 - DNA, 20 bp, human
gcagtggatgtgcacctggg

SEQ ID NO: 350814 - DNA, 20 bp, human
gcgcagcttgaactcttgag

SEQ ID NO: 350815 - DNA, 20 bp, human
ggcttgaactcttgagaggt

SEQ ID NO: 350816 - DNA, 20 bp, human
ggaggtcagccgggccctga

SEQ ID NO: 350817 - DNA, 20 bp, human
ggggtcacgaaggctgcggt

SEQ ID NO: 350818 - DNA, 20 bp, human
gagcagggtcacgaaggctg

SEQ ID NO: 350819 - DNA, 20 bp, human
gtcgtggagcctagagtcaa

SEQ ID NO: 350820 - DNA, 20 bp, human
gagcgcctgccattgactct

SEQ ID NO: 350821 - DNA, 20 bp, human
gagggcagtgcgaggtcagc

SEQ ID NO: 350822 - DNA, 20 bp, human
gggagcctagagtcaatggc

SEQ ID NO: 350823 - DNA, 20 bp, human
gtcccacctggtttgcaggg

SEQ ID NO: 350824 - DNA, 20 bp, human
gccttcgtgaccctgctgaa

SEQ ID NO: 350825 - DNA, 20 bp, human
gctgcgggagcgtgaactgt

SEQ ID NO: 350826 - DNA, 20 bp, human
gcctgcggacccgcgagagg

SEQ ID NO: 350827 - DNA, 20 bp, human
ggggggaggttcccgcgagg

SEQ ID NO: 350828 - DNA, 20 bp, human
gagcccgagaaccacctcgc

SEQ ID NO: 350829 - DNA, 20 bp, human
gttcccgcgaggtggttctc

SEQ ID NO: 350830 - DNA, 20 bp, human
gtgcgcgtccgcgccctcac

SEQ ID NO: 350831 - DNA, 20 bp, human
ggagagctgcggcgtcacat

SEQ ID NO: 350832 - DNA, 20 bp, human
gcgaaggcctcgcagagagg

SEQ ID NO: 350833 - DNA, 20 bp, human
gccgcctgcggacccgcgag

SEQ ID NO: 350834 - DNA, 20 bp, human
gtgggcccaaccgcggggaa

SEQ ID NO: 350835 - DNA, 20 bp, human
gaacgcccagggtcgttctc

SEQ ID NO: 350836 - DNA, 20 bp, human
gaggacacgcccctctgtgg

SEQ ID NO: 350837 - DNA, 20 bp, human
ggcccaggggtggccactag

SEQ ID NO: 350838 - DNA, 20 bp, human
gccgcggcgggatgcctgat

SEQ ID NO: 350839 - DNA, 20 bp, human
gacactccggggatccgcgg

SEQ ID NO: 350840 - DNA, 20 bp, human
ggctgggtccagggcgagag

SEQ ID NO: 350841 - DNA, 20 bp, human
gctcacccggcccagccaca

SEQ ID NO: 350842 - DNA, 20 bp, human
gagggtaagcccgaagtaga

SEQ ID NO: 350843 - DNA, 20 bp, human
gacgcccctctgtggaggga

SEQ ID NO: 350844 - DNA, 20 bp, human
gacccctagtcctgcctcag

SEQ ID NO: 350845 - DNA, 20 bp, human
gggctcctcccctctcgccc

SEQ ID NO: 350846 - DNA, 20 bp, human
ggagggctggggctctaagt

SEQ ID NO: 350847 - DNA, 20 bp, human
ggcccctcccacttggtcct

SEQ ID NO: 350848 - DNA, 20 bp, human
ggggctctaagtgggtggct

SEQ ID NO: 350849 - DNA, 20 bp, human
ggctggggggatagtcttac

SEQ ID NO: 350850 - DNA, 20 bp, human
ggaacagcccaggaccaagt

SEQ ID NO: 350851 - DNA, 20 bp, human
gagccaggtcggggctgcgt

SEQ ID NO: 350852 - DNA, 20 bp, human
gccacactaggacctaccct

SEQ ID NO: 350853 - DNA, 20 bp, human
gccttgccataagacggcaa

SEQ ID NO: 350854 - DNA, 20 bp, human
gcagcccaggaccaagtggg

SEQ ID NO: 350855 - DNA, 20 bp, human
gagctcaaggtgattaattg

SEQ ID NO: 350856 - DNA, 20 bp, human
ggggcctcatccctatcccg

SEQ ID NO: 350857 - DNA, 20 bp, human
ggggcccgccggcgtctgtg

SEQ ID NO: 350858 - DNA, 20 bp, human
gcggcgtctgtggggaactg

SEQ ID NO: 350859 - DNA, 20 bp, human
gcggaagtgacgttttcccg

SEQ ID NO: 350860 - DNA, 20 bp, human
gaggccggggtgcacttaac

SEQ ID NO: 350861 - DNA, 20 bp, human
gtcacgtccgcgaggctccc

SEQ ID NO: 350862 - DNA, 20 bp, human
gggcgcgtccggtttttctc

SEQ ID NO: 350863 - DNA, 20 bp, human
gaaccaccccctccaggccg

SEQ ID NO: 350864 - DNA, 20 bp, human
gctcgcggacgtgacgccgc

SEQ ID NO: 350865 - DNA, 20 bp, human
ggggccccgcagggaatatc

SEQ ID NO: 350866 - DNA, 20 bp, human
ggaggagcggagccaatcga

SEQ ID NO: 350867 - DNA, 20 bp, human
gaacctgccggccggagagc

SEQ ID NO: 350868 - DNA, 20 bp, human
ggccccagcggagtctccca

SEQ ID NO: 350869 - DNA, 20 bp, human
gtgaccctgggagactccgc

SEQ ID NO: 350870 - DNA, 20 bp, human
gtctacgcaggtccggaagt

SEQ ID NO: 350871 - DNA, 20 bp, human
gagtcggcagcctgccggga

SEQ ID NO: 350872 - DNA, 20 bp, human
gcgcagagaggcgtctacgc

SEQ ID NO: 350873 - DNA, 20 bp, human
gggctccgctcctccgcgac

SEQ ID NO: 350874 - DNA, 20 bp, human
gcggcagcctgccgggaagg

SEQ ID NO: 350875 - DNA, 20 bp, human
ggggacaccagaccctcgat

SEQ ID NO: 350876 - DNA, 20 bp, human
ggacacgagatgcaagttag

SEQ ID NO: 350877 - DNA, 20 bp, human
gttacaggaattaaaactca

SEQ ID NO: 350878 - DNA, 20 bp, human
ggaggttgaacttgcgttga

SEQ ID NO: 350879 - DNA, 20 bp, human
gttcaaggtctccttctgct

SEQ ID NO: 350880 - DNA, 20 bp, human
ggaccacagagtttctttgg

SEQ ID NO: 350881 - DNA, 20 bp, human
gagggcagaacttcagtcct

SEQ ID NO: 350882 - DNA, 20 bp, human
gaaactcaaccaaaagattc

SEQ ID NO: 350883 - DNA, 20 bp, human
ggagaagttacagttattga

SEQ ID NO: 350884 - DNA, 20 bp, human
gagtcatctaaaggaattag

SEQ ID NO: 350885 - DNA, 20 bp, human
gtttagatgactttgctcca

SEQ ID NO: 350886 - DNA, 20 bp, human
gcaaatgcgaagttcaatca

SEQ ID NO: 350887 - DNA, 20 bp, human
gcaccggaagtcagcctccg

SEQ ID NO: 350888 - DNA, 20 bp, human
gaagtccagggctgcctgac

SEQ ID NO: 350889 - DNA, 20 bp, human
ggctccaggctatgagcttt

SEQ ID NO: 350890 - DNA, 20 bp, human
gcttgtcctgggaccagctg

SEQ ID NO: 350891 - DNA, 20 bp, human
gtagagtagggtgcttgtcc

SEQ ID NO: 350892 - DNA, 20 bp, human
gggccccggaggctgacttc

SEQ ID NO: 350893 - DNA, 20 bp, human
gctaaacttggggggcgcgt

SEQ ID NO: 350894 - DNA, 20 bp, human
ggctcatgggaaatagagta

SEQ ID NO: 350895 - DNA, 20 bp, human
gagcctccggggcccacagc

SEQ ID NO: 350896 - DNA, 20 bp, human
gagggcgtggtcatgcgtag

SEQ ID NO: 350897 - DNA, 20 bp, human
gtgggggcgtggccgagaat

SEQ ID NO: 350898 - DNA, 20 bp, human
gtgggtgaggcgttaacagt

SEQ ID NO: 350899 - DNA, 20 bp, human
ggggctcgagggcgtggctc

SEQ ID NO: 350900 - DNA, 20 bp, human
ggagactctgcgtgactctg

SEQ ID NO: 350901 - DNA, 20 bp, human
gaagagggccaggcccgcgt

SEQ ID NO: 350902 - DNA, 20 bp, human
ggggcgtggctcgggctcga

SEQ ID NO: 350903 - DNA, 20 bp, human
ggcgtggtcttctgcagtgg

SEQ ID NO: 350904 - DNA, 20 bp, human
gtgggtgtagctctgtacta

SEQ ID NO: 350905 - DNA, 20 bp, human
gggcctgggctgttgcactg

SEQ ID NO: 350906 - DNA, 20 bp, human
gattggttaaactacaaaat

SEQ ID NO: 350907 - DNA, 20 bp, human
gtgaagcaatgggcaggtgt

SEQ ID NO: 350908 - DNA, 20 bp, human
gcagttgtaacgtgtgacta

SEQ ID NO: 350909 - DNA, 20 bp, human
gaatgggcaggtgtgggatt

SEQ ID NO: 350910 - DNA, 20 bp, human
gaacatcttaatttcttgat

SEQ ID NO: 350911 - DNA, 20 bp, human
gtgcatttgaagcaatgggc

SEQ ID NO: 350912 - DNA, 20 bp, human
ggcaatgaacatactgatta

SEQ ID NO: 350913 - DNA, 20 bp, human
gacattgcatttgaagcaat

SEQ ID NO: 350914 - DNA, 20 bp, human
gaagtcactgaaactattat

SEQ ID NO: 350915 - DNA, 20 bp, human
gctgaagtttatgtatcaat

SEQ ID NO: 350916 - DNA, 20 bp, human
gtagctttccgcggggaccg

SEQ ID NO: 350917 - DNA, 20 bp, human
ggctggaagtcggctcgggg

SEQ ID NO: 350918 - DNA, 20 bp, human
ggcgcgcaatcgctggaagt

SEQ ID NO: 350919 - DNA, 20 bp, human
gagtcggctcggggaggcgt

SEQ ID NO: 350920 - DNA, 20 bp, human
gctactccgcgcgtctggat

SEQ ID NO: 350921 - DNA, 20 bp, human
gaatcgctggaagtcggctc

SEQ ID NO: 350922 - DNA, 20 bp, human
ggaaagctactccgcgcgtc

SEQ ID NO: 350923 - DNA, 20 bp, human
gtgcgcgcgccggcgttgac

SEQ ID NO: 350924 - DNA, 20 bp, human
gagcgctcctaatggcggga

SEQ ID NO: 350925 - DNA, 20 bp, human
gctcctaatggcgggatggg

SEQ ID NO: 350926 - DNA, 20 bp, human
gcctgctaatgcaagaaacc

SEQ ID NO: 350927 - DNA, 20 bp, human
gaaggtcgtcccctagtgct

SEQ ID NO: 350928 - DNA, 20 bp, human
gcaacagggcaagaactagt

SEQ ID NO: 350929 - DNA, 20 bp, human
ggaagccgcggggccttcta

SEQ ID NO: 350930 - DNA, 20 bp, human
gaaacgaacaaggaaggcgg

SEQ ID NO: 350931 - DNA, 20 bp, human
gcacctgaaacgaacaagga

SEQ ID NO: 350932 - DNA, 20 bp, human
gactaggggacgaccttccc

SEQ ID NO: 350933 - DNA, 20 bp, human
gctgaaacgaacaaggaagg

SEQ ID NO: 350934 - DNA, 20 bp, human
gctacacacccgagcactag

SEQ ID NO: 350935 - DNA, 20 bp, human
gacgccgctgaacacacaac

SEQ ID NO: 350936 - DNA, 20 bp, human
gacaaagcgcggggtcacgt

SEQ ID NO: 350937 - DNA, 20 bp, human
ggggagagctcgccttgcag

SEQ ID NO: 350938 - DNA, 20 bp, human
gcgcggaaactgaaagagca

SEQ ID NO: 350939 - DNA, 20 bp, human
gctcacagggaggctcggtg

SEQ ID NO: 350940 - DNA, 20 bp, human
gctggcgtgcgcggataggc

SEQ ID NO: 350941 - DNA, 20 bp, human
gggttgcgcgtcaggaggac

SEQ ID NO: 350942 - DNA, 20 bp, human
gttattggaagcagcagcta

SEQ ID NO: 350943 - DNA, 20 bp, human
gtctgcttcaaaagggaggg

SEQ ID NO: 350944 - DNA, 20 bp, human
ggaggcggggctggcgtgcg

SEQ ID NO: 350945 - DNA, 20 bp, human
gtcaggaggaccggctcaca

SEQ ID NO: 350946 - DNA, 20 bp, human
gtggcgatgcgcaggcgcga

SEQ ID NO: 350947 - DNA, 20 bp, human
gcggctggccggctgagtgg

SEQ ID NO: 350948 - DNA, 20 bp, human
ggtctgggagccaacggctc

SEQ ID NO: 350949 - DNA, 20 bp, human
gccctgggaaaagtgagagg

SEQ ID NO: 350950 - DNA, 20 bp, human
gcaggaagttggcgatgcgc

SEQ ID NO: 350951 - DNA, 20 bp, human
gcatcgccaacttcctgccg

SEQ ID NO: 350952 - DNA, 20 bp, human
ggggcggatgagggcccgag

SEQ ID NO: 350953 - DNA, 20 bp, human
ggaggcggagaggcgggtct

SEQ ID NO: 350954 - DNA, 20 bp, human
gcgttcggaggcgggcttct

SEQ ID NO: 350955 - DNA, 20 bp, human
gtcacgcggcgttcggaggc

SEQ ID NO: 350956 - DNA, 20 bp, human
ggggaagcgagcactttctg

SEQ ID NO: 350957 - DNA, 20 bp, human
gaatcccgaggcaatctcgg

SEQ ID NO: 350958 - DNA, 20 bp, human
ggggcccgggctacactcgg

SEQ ID NO: 350959 - DNA, 20 bp, human
gcgacccagagctccgggtg

SEQ ID NO: 350960 - DNA, 20 bp, human
gcccgggctacactcggtgg

SEQ ID NO: 350961 - DNA, 20 bp, human
ggcgaagggctcccggggta

SEQ ID NO: 350962 - DNA, 20 bp, human
gcccgaggcaatctcggagg

SEQ ID NO: 350963 - DNA, 20 bp, human
ggggttgtgtctgatgaaat

SEQ ID NO: 350964 - DNA, 20 bp, human
gtcggtgcggcccatcccgg

SEQ ID NO: 350965 - DNA, 20 bp, human
ggagctgcgtgcttggcgaa

SEQ ID NO: 350966 - DNA, 20 bp, human
gtcgcagaaagtggccggac

SEQ ID NO: 350967 - DNA, 20 bp, human
ggaaagtggccggacaggtt

SEQ ID NO: 350968 - DNA, 20 bp, human
gcacctcgggacaggtggta

SEQ ID NO: 350969 - DNA, 20 bp, human
ggcttcagacccaacctgtc

SEQ ID NO: 350970 - DNA, 20 bp, human
gactgccctgagccgccagg

SEQ ID NO: 350971 - DNA, 20 bp, human
gcagcctcacagtgattatg

SEQ ID NO: 350972 - DNA, 20 bp, human
ggcaggggtgcctgggtcgg

SEQ ID NO: 350973 - DNA, 20 bp, human
gccatctcgcagaaagtggc

SEQ ID NO: 350974 - DNA, 20 bp, human
ggtctgaagccacatagagt

SEQ ID NO: 350975 - DNA, 20 bp, human
gcccgggccctccgtgtcac

SEQ ID NO: 350976 - DNA, 20 bp, human
gagctcgcaggctttgttct

SEQ ID NO: 350977 - DNA, 20 bp, human
gggccgggctctttcctcct

SEQ ID NO: 350978 - DNA, 20 bp, human
gtccttggcctgccttccgc

SEQ ID NO: 350979 - DNA, 20 bp, human
gacaggctatgacacggttg

SEQ ID NO: 350980 - DNA, 20 bp, human
gacatgagagcactagtaag

SEQ ID NO: 350981 - DNA, 20 bp, human
ggtagttgcggggacctggg

SEQ ID NO: 350982 - DNA, 20 bp, human
gggctgccccacgcagccag

SEQ ID NO: 350983 - DNA, 20 bp, human
gagcccagcctgctcccgca

SEQ ID NO: 350984 - DNA, 20 bp, human
gctccctgcgggagcaggct

SEQ ID NO: 350985 - DNA, 20 bp, human
gccgcagggagcctgcgccg

SEQ ID NO: 350986 - DNA, 20 bp, human
ggacccgcgatcagccccgg

SEQ ID NO: 350987 - DNA, 20 bp, human
gcggtcccggcgctcctgtt

SEQ ID NO: 350988 - DNA, 20 bp, human
gtgcggggtcccagcggtcc

SEQ ID NO: 350989 - DNA, 20 bp, human
gccactgcccggctacccgg

SEQ ID NO: 350990 - DNA, 20 bp, human
gtgacccgggcgggagtccg

SEQ ID NO: 350991 - DNA, 20 bp, human
gtcgccccaaacaggagcgc

SEQ ID NO: 350992 - DNA, 20 bp, human
ggggtggggtcgccccaaac

SEQ ID NO: 350993 - DNA, 20 bp, human
gtcccgcccgggtcaccctg

SEQ ID NO: 350994 - DNA, 20 bp, human
gtccgccgccgccgggtagc

SEQ ID NO: 350995 - DNA, 20 bp, human
gcgcgatcagccccggagga

SEQ ID NO: 350996 - DNA, 20 bp, human
ggcgcggggcgggacgaaga

SEQ ID NO: 350997 - DNA, 20 bp, human
gacaactgacgcgagggtgg

SEQ ID NO: 350998 - DNA, 20 bp, human
gaaggcgggcggggcaacga

SEQ ID NO: 350999 - DNA, 20 bp, human
gactggacgcaagaaggggc

SEQ ID NO: 351000 - DNA, 20 bp, human
gaggaagactcacgcctggc

SEQ ID NO: 351001 - DNA, 20 bp, human
gaagactcacgcctggcagg

SEQ ID NO: 351002 - DNA, 20 bp, human
ggaggggcgaaggcccgagg

SEQ ID NO: 351003 - DNA, 20 bp, human
gcgggaggaagactcacgcc

SEQ ID NO: 351004 - DNA, 20 bp, human
gggagcgacaactgacgcga

SEQ ID NO: 351005 - DNA, 20 bp, human
gagaaggggcggggcgacaa

SEQ ID NO: 351006 - DNA, 20 bp, human
gcaagggatggggtctacat

SEQ ID NO: 351007 - DNA, 20 bp, human
gaatttggccaaaagagcaa

SEQ ID NO: 351008 - DNA, 20 bp, human
gccaagtgacagagggaacc

SEQ ID NO: 351009 - DNA, 20 bp, human
gcaagagaccaagtgacaga

SEQ ID NO: 351010 - DNA, 20 bp, human
gggtctacatgggattttta

SEQ ID NO: 351011 - DNA, 20 bp, human
gtcttttggccaaattcagt

SEQ ID NO: 351012 - DNA, 20 bp, human
gagggctgatactagttaaa

SEQ ID NO: 351013 - DNA, 20 bp, human
gaaatccagcaggttaatgt

SEQ ID NO: 351014 - DNA, 20 bp, human
gaaatcagagagagagcggg

SEQ ID NO: 351015 - DNA, 20 bp, human
gttgaagctaccaaaatgga

SEQ ID NO: 351016 - DNA, 20 bp, human
gcactgtggcagcaccggga

SEQ ID NO: 351017 - DNA, 20 bp, human
gtggcagcaccgggaaggcg

SEQ ID NO: 351018 - DNA, 20 bp, human
gggaggccgggaagcgatcg

SEQ ID NO: 351019 - DNA, 20 bp, human
gcccgccactgtggcagcac

SEQ ID NO: 351020 - DNA, 20 bp, human
gggggaagctcgggaatctc

SEQ ID NO: 351021 - DNA, 20 bp, human
gatcctccgacccgccactg

SEQ ID NO: 351022 - DNA, 20 bp, human
gactacggagattgccgagg

SEQ ID NO: 351023 - DNA, 20 bp, human
ggcgcgggaggctacggcga

SEQ ID NO: 351024 - DNA, 20 bp, human
ggggctggagttctacatcc

SEQ ID NO: 351025 - DNA, 20 bp, human
ggaagcgatcggggaagctc

SEQ ID NO: 351026 - DNA, 20 bp, human
gatctcccaactccagaagc

SEQ ID NO: 351027 - DNA, 20 bp, human
gaggggcaagcgccatgtgc

SEQ ID NO: 351028 - DNA, 20 bp, human
gcaaactgccattctccagc

SEQ ID NO: 351029 - DNA, 20 bp, human
gactccagaagcaggcctgc

SEQ ID NO: 351030 - DNA, 20 bp, human
gaattaccttaggcattcag

SEQ ID NO: 351031 - DNA, 20 bp, human
gtaccttaggcattcagggg

SEQ ID NO: 351032 - DNA, 20 bp, human
gtactctgattaattacctt

SEQ ID NO: 351033 - DNA, 20 bp, human
gagaggacacaggtaatgag

SEQ ID NO: 351034 - DNA, 20 bp, human
gaccagcctagtgagagcaa

SEQ ID NO: 351035 - DNA, 20 bp, human
gtattttaaggatgcgatga

SEQ ID NO: 351036 - DNA, 20 bp, human
gaagactgttagcttctcag

SEQ ID NO: 351037 - DNA, 20 bp, human
gccaccgtgcagtccatccc

SEQ ID NO: 351038 - DNA, 20 bp, human
gtatgccccaggggagtaaa

SEQ ID NO: 351039 - DNA, 20 bp, human
gtggaagagtccctgggatt

SEQ ID NO: 351040 - DNA, 20 bp, human
gagaggggcggaccctggga

SEQ ID NO: 351041 - DNA, 20 bp, human
ggtggggtggaagagtccct

SEQ ID NO: 351042 - DNA, 20 bp, human
gatccctggtggcaaacagt

SEQ ID NO: 351043 - DNA, 20 bp, human
gtcaatccctcgatccctgg

SEQ ID NO: 351044 - DNA, 20 bp, human
ggggatcagcaccctccaaa

SEQ ID NO: 351045 - DNA, 20 bp, human
gggagagtgcggacagtggt

SEQ ID NO: 351046 - DNA, 20 bp, human
gaggagggccctgttacgtg

SEQ ID NO: 351047 - DNA, 20 bp, human
ggagtctcgccatatcagga

SEQ ID NO: 351048 - DNA, 20 bp, human
gcctctgcggccccgaagct

SEQ ID NO: 351049 - DNA, 20 bp, human
gccgagccgggcgctcggaa

SEQ ID NO: 351050 - DNA, 20 bp, human
gtgtgcaccgagactattcc

SEQ ID NO: 351051 - DNA, 20 bp, human
gaggtcggtgcgtctgtcgg

SEQ ID NO: 351052 - DNA, 20 bp, human
gcgcacgccgcccagcttcg

SEQ ID NO: 351053 - DNA, 20 bp, human
ggctcggaaaggcgtccccg

SEQ ID NO: 351054 - DNA, 20 bp, human
gtggtgggcggggtgatttc

SEQ ID NO: 351055 - DNA, 20 bp, human
ggggccttctccataggaag

SEQ ID NO: 351056 - DNA, 20 bp, human
ggccgaggggcgggaaaggt

SEQ ID NO: 351057 - DNA, 20 bp, human
gaagcgccgaggggcgggaa

SEQ ID NO: 351058 - DNA, 20 bp, human
ggtggggcctggcgagggta

SEQ ID NO: 351059 - DNA, 20 bp, human
gctcaaaatgatgggtggat

SEQ ID NO: 351060 - DNA, 20 bp, human
gggagtttccccacctagga

SEQ ID NO: 351061 - DNA, 20 bp, human
gcccgcctcaaaatgatggg

SEQ ID NO: 351062 - DNA, 20 bp, human
gtttcccgcctcaaaatgat

SEQ ID NO: 351063 - DNA, 20 bp, human
ggcgcagcgaccctcctagg

SEQ ID NO: 351064 - DNA, 20 bp, human
gcctcggcctatggggtggt

SEQ ID NO: 351065 - DNA, 20 bp, human
gcctggggtctgagcggcgc

SEQ ID NO: 351066 - DNA, 20 bp, human
gagctcccctagtttcacca

SEQ ID NO: 351067 - DNA, 20 bp, human
gccaggccggcggttcaagg

SEQ ID NO: 351068 - DNA, 20 bp, human
gcagcccgtgctcaagacta

SEQ ID NO: 351069 - DNA, 20 bp, human
gcacccgtagtcttgagcac

SEQ ID NO: 351070 - DNA, 20 bp, human
gagtccaggccggcggttca

SEQ ID NO: 351071 - DNA, 20 bp, human
gttcacccctggtgaaacta

SEQ ID NO: 351072 - DNA, 20 bp, human
ggaaacgtagtccaggccgg

SEQ ID NO: 351073 - DNA, 20 bp, human
gaccgtgagaacattcaaca

SEQ ID NO: 351074 - DNA, 20 bp, human
gtttggcccccttgaaccgc

SEQ ID NO: 351075 - DNA, 20 bp, human
gcggtcagcgtcgtttgcgg

SEQ ID NO: 351076 - DNA, 20 bp, human
gaggtcgcagccttcggaca

SEQ ID NO: 351077 - DNA, 20 bp, human
gaggactgtggctacctcga

SEQ ID NO: 351078 - DNA, 20 bp, human
ggagtcctgtgcaatgcccg

SEQ ID NO: 351079 - DNA, 20 bp, human
ggggaagtgacacggaagta

SEQ ID NO: 351080 - DNA, 20 bp, human
gatctgcaagccctgtccga

SEQ ID NO: 351081 - DNA, 20 bp, human
ggtcaccccgggcattgcac

SEQ ID NO: 351082 - DNA, 20 bp, human
gggtgaccaaaaagccctcg

SEQ ID NO: 351083 - DNA, 20 bp, human
gcatgtgtctacatccgggt

SEQ ID NO: 351084 - DNA, 20 bp, human
gagacccaggtgccacaacc

SEQ ID NO: 351085 - DNA, 20 bp, human
gtgacactcactggctagaa

SEQ ID NO: 351086 - DNA, 20 bp, human
gggagcgttcgcaaggggtg

SEQ ID NO: 351087 - DNA, 20 bp, human
gctaggggagcgttcgcaag

SEQ ID NO: 351088 - DNA, 20 bp, human
ggcccgctaggggacagccc

SEQ ID NO: 351089 - DNA, 20 bp, human
gcgactgtgcgcagctgcag

SEQ ID NO: 351090 - DNA, 20 bp, human
gaaagcgggccctgccgaat

SEQ ID NO: 351091 - DNA, 20 bp, human
gcgctcccctagtggagaaa

SEQ ID NO: 351092 - DNA, 20 bp, human
ggccagcgcttgccaatcag

SEQ ID NO: 351093 - DNA, 20 bp, human
ggggcggtgaccaatcgccg

SEQ ID NO: 351094 - DNA, 20 bp, human
gtcctctgattggcaagcgc

SEQ ID NO: 351095 - DNA, 20 bp, human
ggccagggctgtcccctagc

SEQ ID NO: 351096 - DNA, 20 bp, human
gctgctccctcgcctggcgt

SEQ ID NO: 351097 - DNA, 20 bp, human
gccagccctacgccaggcga

SEQ ID NO: 351098 - DNA, 20 bp, human
ggccacgcccccagcggact

SEQ ID NO: 351099 - DNA, 20 bp, human
gggtaccccaagtccgctgg

SEQ ID NO: 351100 - DNA, 20 bp, human
gtggcgtagggctgggcggt

SEQ ID NO: 351101 - DNA, 20 bp, human
gggggcgaggcatggctcca

SEQ ID NO: 351102 - DNA, 20 bp, human
ggcgccgtaaagccggagaa

SEQ ID NO: 351103 - DNA, 20 bp, human
ggtaaagccggagaaggggc

SEQ ID NO: 351104 - DNA, 20 bp, human
gtacggcgccgcctgggtga

SEQ ID NO: 351105 - DNA, 20 bp, human
gccaggcggcgccgtaaagc

SEQ ID NO: 351106 - DNA, 20 bp, human
gagggccactagcccaaggt

SEQ ID NO: 351107 - DNA, 20 bp, human
gcaagcgcgctgacggtctc

SEQ ID NO: 351108 - DNA, 20 bp, human
gggcgcacaggaccgacctt

SEQ ID NO: 351109 - DNA, 20 bp, human
gacggcgtggttgacgtcaa

SEQ ID NO: 351110 - DNA, 20 bp, human
ggctagtggccctggcgggt

SEQ ID NO: 351111 - DNA, 20 bp, human
gtgcgccaacagtcgcaagc

SEQ ID NO: 351112 - DNA, 20 bp, human
gggccgcgcaagcgcgctga

SEQ ID NO: 351113 - DNA, 20 bp, human
gagtccctgcttgcgactgt

SEQ ID NO: 351114 - DNA, 20 bp, human
ggcggctccgcgttccagaa

SEQ ID NO: 351115 - DNA, 20 bp, human
gaggaccgaccttgggctag

SEQ ID NO: 351116 - DNA, 20 bp, human
gcgtgcgcaagcttggtggt

SEQ ID NO: 351117 - DNA, 20 bp, human
gcccctcgctagaggagggg

SEQ ID NO: 351118 - DNA, 20 bp, human
gcgcgcgtgcgcaagcttgg

SEQ ID NO: 351119 - DNA, 20 bp, human
gaaagtcgaggtccctgggc

SEQ ID NO: 351120 - DNA, 20 bp, human
gtagatgtgctgagaatctt

SEQ ID NO: 351121 - DNA, 20 bp, human
gtcctctagcgaggggaaac

SEQ ID NO: 351122 - DNA, 20 bp, human
ggcctcccctcctctagcga

SEQ ID NO: 351123 - DNA, 20 bp, human
gcagggacctcgactttcaa

SEQ ID NO: 351124 - DNA, 20 bp, human
ggcgaggggaaacgggtgag

SEQ ID NO: 351125 - DNA, 20 bp, human
ggtagacaactgtcgaagta

SEQ ID NO: 351126 - DNA, 20 bp, human
ggctctaggccctctgggat

SEQ ID NO: 351127 - DNA, 20 bp, human
gagcccgctcgttagctgag

SEQ ID NO: 351128 - DNA, 20 bp, human
gacagcccgtggcgggagag

SEQ ID NO: 351129 - DNA, 20 bp, human
ggctgagggaagatgtgctc

SEQ ID NO: 351130 - DNA, 20 bp, human
gcggtcgccagccattcctg

SEQ ID NO: 351131 - DNA, 20 bp, human
gcaccccctcagctaacgag

SEQ ID NO: 351132 - DNA, 20 bp, human
gcgaccaatcagaaacgctg

SEQ ID NO: 351133 - DNA, 20 bp, human
gacgaccggcagtcctcctc

SEQ ID NO: 351134 - DNA, 20 bp, human
gcaaccccctctcccgccac

SEQ ID NO: 351135 - DNA, 20 bp, human
gagcgggctctaggccctct

SEQ ID NO: 351136 - DNA, 20 bp, human
ggctctaggccctctgggat

SEQ ID NO: 351137 - DNA, 20 bp, human
gacagcccgtggcgggagag

SEQ ID NO: 351138 - DNA, 20 bp, human
gagcccgctcgttagctgag

SEQ ID NO: 351139 - DNA, 20 bp, human
ggctgagggaagatgtgctc

SEQ ID NO: 351140 - DNA, 20 bp, human
gcaccccctcagctaacgag

SEQ ID NO: 351141 - DNA, 20 bp, human
gcaaccccctctcccgccac

SEQ ID NO: 351142 - DNA, 20 bp, human
gcgaccaatcagaaacgctg

SEQ ID NO: 351143 - DNA, 20 bp, human
gagcgggctctaggccctct

SEQ ID NO: 351144 - DNA, 20 bp, human
gaaccgccacagcccgtggc

SEQ ID NO: 351145 - DNA, 20 bp, human
ggcggtctctggcccgggtg

SEQ ID NO: 351146 - DNA, 20 bp, human
ggggcaagagatcagcgtga

SEQ ID NO: 351147 - DNA, 20 bp, human
gagggcggacctacaaacgt

SEQ ID NO: 351148 - DNA, 20 bp, human
gtacctaagaggccggcaag

SEQ ID NO: 351149 - DNA, 20 bp, human
gctaagaggccggcaagagg

SEQ ID NO: 351150 - DNA, 20 bp, human
ggcgtccgtggtaaccaatc

SEQ ID NO: 351151 - DNA, 20 bp, human
ggaagccgaactcgctgatt

SEQ ID NO: 351152 - DNA, 20 bp, human
gcttgcccaatcagcgagtt

SEQ ID NO: 351153 - DNA, 20 bp, human
gcggacgccaattacctaag

SEQ ID NO: 351154 - DNA, 20 bp, human
gtcgcgaggttggtgcccat

SEQ ID NO: 351155 - DNA, 20 bp, human
gcggcgaagcccacgtttgt

SEQ ID NO: 351156 - DNA, 20 bp, human
gccgcccaaccactgttatt

SEQ ID NO: 351157 - DNA, 20 bp, human
ggggttcccaaccccctagt

SEQ ID NO: 351158 - DNA, 20 bp, human
gcctagtcggagtacctcat

SEQ ID NO: 351159 - DNA, 20 bp, human
gacaacaaatgtaaccaatg

SEQ ID NO: 351160 - DNA, 20 bp, human
gcgtgaccgcagagtgcgag

SEQ ID NO: 351161 - DNA, 20 bp, human
ggtactccgactagggggtt

SEQ ID NO: 351162 - DNA, 20 bp, human
ggaacccaataacagtggtt

SEQ ID NO: 351163 - DNA, 20 bp, human
gcccgccccgcagtcctcat

SEQ ID NO: 351164 - DNA, 20 bp, human
ggttgggaacccaataacag

SEQ ID NO: 351165 - DNA, 20 bp, human
gagcaagaagtaccgttaca

SEQ ID NO: 351166 - DNA, 20 bp, human
ggtcctgccacgtgactctg

SEQ ID NO: 351167 - DNA, 20 bp, human
gtcacagggtcacctggcac

SEQ ID NO: 351168 - DNA, 20 bp, human
gcaggtgaccctgtgagtgc

SEQ ID NO: 351169 - DNA, 20 bp, human
gccactcacccagcactcac

SEQ ID NO: 351170 - DNA, 20 bp, human
gccccagatcccaacggcca

SEQ ID NO: 351171 - DNA, 20 bp, human
gtgggcgacgcagcgcgatg

SEQ ID NO: 351172 - DNA, 20 bp, human
ggcggagcaagacccgcgcc

SEQ ID NO: 351173 - DNA, 20 bp, human
gctgccacgtgactctgcgg

SEQ ID NO: 351174 - DNA, 20 bp, human
gcccgcatggccgatgcttg

SEQ ID NO: 351175 - DNA, 20 bp, human
ggagtgtagtgaaccctgag

SEQ ID NO: 351176 - DNA, 20 bp, human
gtggcccgctggtcatcctc

SEQ ID NO: 351177 - DNA, 20 bp, human
gaacctggacatggcccata

SEQ ID NO: 351178 - DNA, 20 bp, human
ggggctaaggtggccatgtc

SEQ ID NO: 351179 - DNA, 20 bp, human
gccacgcgcaacctcttcat

SEQ ID NO: 351180 - DNA, 20 bp, human
gctggaccacagcgtatctg

SEQ ID NO: 351181 - DNA, 20 bp, human
ggaccacagcgtatctgagg

SEQ ID NO: 351182 - DNA, 20 bp, human
ggaaggcataggcaccgccc

SEQ ID NO: 351183 - DNA, 20 bp, human
gagcgggccctggactacta

SEQ ID NO: 351184 - DNA, 20 bp, human
ggatgcccgaggatgaccag

SEQ ID NO: 351185 - DNA, 20 bp, human
ggctacctcccgctacacgg

SEQ ID NO: 351186 - DNA, 20 bp, human
gcggaggggagcgtgcagtg

SEQ ID NO: 351187 - DNA, 20 bp, human
ggtaagaagacgccggcgga

SEQ ID NO: 351188 - DNA, 20 bp, human
ggatggtaagaagacgccgg

SEQ ID NO: 351189 - DNA, 20 bp, human
gccagggcgacacctcttga

SEQ ID NO: 351190 - DNA, 20 bp, human
gtgcagtgcggtcctcccgc

SEQ ID NO: 351191 - DNA, 20 bp, human
ggaggaggagaagtggtccg

SEQ ID NO: 351192 - DNA, 20 bp, human
gtctcctcctcaccatctgg

SEQ ID NO: 351193 - DNA, 20 bp, human
gccacaaggcttggggagcg

SEQ ID NO: 351194 - DNA, 20 bp, human
ggaggccgggctttctgata

SEQ ID NO: 351195 - DNA, 20 bp, human
gcttgatggtaagaagacgc

SEQ ID NO: 351196 - DNA, 20 bp, human
ggtcccgccctcagccttaa

SEQ ID NO: 351197 - DNA, 20 bp, human
gtcgaggggcgcgtgtggtc

SEQ ID NO: 351198 - DNA, 20 bp, human
ggactcgaacgggtcgggga

SEQ ID NO: 351199 - DNA, 20 bp, human
ggcccctcgaggccctgtca

SEQ ID NO: 351200 - DNA, 20 bp, human
gctggtgagtgtccttgaca

SEQ ID NO: 351201 - DNA, 20 bp, human
ggtccctgagtaagggtctc

SEQ ID NO: 351202 - DNA, 20 bp, human
ggacctctgggggacctcag

SEQ ID NO: 351203 - DNA, 20 bp, human
gtgccagagacccttactca

SEQ ID NO: 351204 - DNA, 20 bp, human
gggagcgagtctcatggggt

SEQ ID NO: 351205 - DNA, 20 bp, human
ggtccttgacagggcctcga

SEQ ID NO: 351206 - DNA, 20 bp, human
gctgtgagacgccaatgcag

SEQ ID NO: 351207 - DNA, 20 bp, human
ggccaatgcagcggagaagg

SEQ ID NO: 351208 - DNA, 20 bp, human
ggcccaggcccaccccttgt

SEQ ID NO: 351209 - DNA, 20 bp, human
ggagccggaacacagtcacg

SEQ ID NO: 351210 - DNA, 20 bp, human
ggtcacaccccacaaggggt

SEQ ID NO: 351211 - DNA, 20 bp, human
ggcctgacctgtccggaagt

SEQ ID NO: 351212 - DNA, 20 bp, human
ggggcgcttgcattttgcgc

SEQ ID NO: 351213 - DNA, 20 bp, human
ggggaggtcacaccccacaa

SEQ ID NO: 351214 - DNA, 20 bp, human
ggccacgcctacttccggac

SEQ ID NO: 351215 - DNA, 20 bp, human
ggccgccttctccgctgcat

SEQ ID NO: 351216 - DNA, 20 bp, human
ggcccccgcccccgcgtggc

SEQ ID NO: 351217 - DNA, 20 bp, human
ggtcccggccggccacgcgg

SEQ ID NO: 351218 - DNA, 20 bp, human
gtgtccttcccggtggcgcg

SEQ ID NO: 351219 - DNA, 20 bp, human
ggccgcagagcagctcccgc

SEQ ID NO: 351220 - DNA, 20 bp, human
gttcctgcgcccagggtcgg

SEQ ID NO: 351221 - DNA, 20 bp, human
gcgcccccgcgtggccggcc

SEQ ID NO: 351222 - DNA, 20 bp, human
gagagagctcaagggagggg

SEQ ID NO: 351223 - DNA, 20 bp, human
gggactgggcacggggaccc

SEQ ID NO: 351224 - DNA, 20 bp, human
ggctgggctacggaccctga

SEQ ID NO: 351225 - DNA, 20 bp, human
gcggcgagagagctcaaggg

SEQ ID NO: 351226 - DNA, 20 bp, human
ggggcgacgtcatgacgcaa

SEQ ID NO: 351227 - DNA, 20 bp, human
gcggcgcggcgctagcctcg

SEQ ID NO: 351228 - DNA, 20 bp, human
gcaagcaggcaaaaactcga

SEQ ID NO: 351229 - DNA, 20 bp, human
gcatccaggtgcattatacc

SEQ ID NO: 351230 - DNA, 20 bp, human
gacaatcccgtcaagccccg

SEQ ID NO: 351231 - DNA, 20 bp, human
ggcgtctagggcttcttccg

SEQ ID NO: 351232 - DNA, 20 bp, human
gcctccggacgctctcaaga

SEQ ID NO: 351233 - DNA, 20 bp, human
ggctagcctcggggcttgac

SEQ ID NO: 351234 - DNA, 20 bp, human
gcggaagctacagctacctc

SEQ ID NO: 351235 - DNA, 20 bp, human
ggggcttgacgggattgtgg

SEQ ID NO: 351236 - DNA, 20 bp, human
gtaaccaatgagagagtgat

SEQ ID NO: 351237 - DNA, 20 bp, human
gccaatcaatgggaactcgg

SEQ ID NO: 351238 - DNA, 20 bp, human
gcgcatgcgcagattgggga

SEQ ID NO: 351239 - DNA, 20 bp, human
ggggaaaacgggactgaaaa

SEQ ID NO: 351240 - DNA, 20 bp, human
gtggctaaagtcctaagtat

SEQ ID NO: 351241 - DNA, 20 bp, human
gctacgcgagcaccaggagt

SEQ ID NO: 351242 - DNA, 20 bp, human
gtagactagaccagtgcgat

SEQ ID NO: 351243 - DNA, 20 bp, human
gccaatgagagagtgatggg

SEQ ID NO: 351244 - DNA, 20 bp, human
gtggttaaatgacttgcgga

SEQ ID NO: 351245 - DNA, 20 bp, human
gtctgaggttagccaatcaa

SEQ ID NO: 351246 - DNA, 20 bp, human
gtgctgccgcggccaatcgc

SEQ ID NO: 351247 - DNA, 20 bp, human
gccgccgccccccagctgtt

SEQ ID NO: 351248 - DNA, 20 bp, human
gtgtagccggcgatggggta

SEQ ID NO: 351249 - DNA, 20 bp, human
gcagcaccagccgggaccca

SEQ ID NO: 351250 - DNA, 20 bp, human
ggtcccggctggtgctgcgc

SEQ ID NO: 351251 - DNA, 20 bp, human
ggacctggactggcgaactg

SEQ ID NO: 351252 - DNA, 20 bp, human
gttggccgcggcagcacctg

SEQ ID NO: 351253 - DNA, 20 bp, human
gtagggctggagacgcctgt

SEQ ID NO: 351254 - DNA, 20 bp, human
gaccccagggtgtccagctt

SEQ ID NO: 351255 - DNA, 20 bp, human
gccagccgggcgtcgacccc

SEQ ID NO: 351256 - DNA, 20 bp, human
gtctctatggttattcgtct

SEQ ID NO: 351257 - DNA, 20 bp, human
gatgacccaccatgtttgat

SEQ ID NO: 351258 - DNA, 20 bp, human
gacggcgcgaggagtgttag

SEQ ID NO: 351259 - DNA, 20 bp, human
gatagagaagcagcgtctag

SEQ ID NO: 351260 - DNA, 20 bp, human
gcgtctagcggttactagaa

SEQ ID NO: 351261 - DNA, 20 bp, human
gggtgagtcagagccaacag

SEQ ID NO: 351262 - DNA, 20 bp, human
gttgaggtcaaggttccggc

SEQ ID NO: 351263 - DNA, 20 bp, human
gggctccaatcaaacatggt

SEQ ID NO: 351264 - DNA, 20 bp, human
gtcctcgcgccgtgcccagc

SEQ ID NO: 351265 - DNA, 20 bp, human
gcgtagtcgtaagattcagt

SEQ ID NO: 351266 - DNA, 20 bp, human
ggggagagacgtaaggtcgg

SEQ ID NO: 351267 - DNA, 20 bp, human
gtaccggcagccatcttctt

SEQ ID NO: 351268 - DNA, 20 bp, human
ggctgggagagacgtaaggt

SEQ ID NO: 351269 - DNA, 20 bp, human
ggcctgctgggagagacgta

SEQ ID NO: 351270 - DNA, 20 bp, human
gaggtcggcggagaatgcgc

SEQ ID NO: 351271 - DNA, 20 bp, human
gaattgatgaagtctcgcgg

SEQ ID NO: 351272 - DNA, 20 bp, human
gaaggcgaagggcagctcaa

SEQ ID NO: 351273 - DNA, 20 bp, human
ggggaaccccagctcgtccc

SEQ ID NO: 351274 - DNA, 20 bp, human
gggccacggccgtcttaccg

SEQ ID NO: 351275 - DNA, 20 bp, human
ggggcagccctcagtcatta

SEQ ID NO: 351276 - DNA, 20 bp, human
gaaaggctcgctcgccccgc

SEQ ID NO: 351277 - DNA, 20 bp, human
gaggagagatatagcaaggt

SEQ ID NO: 351278 - DNA, 20 bp, human
gggcaggcggtacccagtca

SEQ ID NO: 351279 - DNA, 20 bp, human
gaggcggtacccagtcaggg

SEQ ID NO: 351280 - DNA, 20 bp, human
gagggaggagagatatagca

SEQ ID NO: 351281 - DNA, 20 bp, human
gagggccccctctctcttac

SEQ ID NO: 351282 - DNA, 20 bp, human
gaagagagagggggccctga

SEQ ID NO: 351283 - DNA, 20 bp, human
gcggcggcgtggtcaaaaaa

SEQ ID NO: 351284 - DNA, 20 bp, human
ggggctcgccgggttccccc

SEQ ID NO: 351285 - DNA, 20 bp, human
gccacctcagccttcgggct

SEQ ID NO: 351286 - DNA, 20 bp, human
gagggcgatgctagggcagg

SEQ ID NO: 351287 - DNA, 20 bp, human
ggggcgtagcttctggagcg

SEQ ID NO: 351288 - DNA, 20 bp, human
gttttcctccggtctctttt

SEQ ID NO: 351289 - DNA, 20 bp, human
gagtggcgagggcgatgcta

SEQ ID NO: 351290 - DNA, 20 bp, human
gcgccccggggcgtagcttc

SEQ ID NO: 351291 - DNA, 20 bp, human
ggttgcccaaaagagaccgg

SEQ ID NO: 351292 - DNA, 20 bp, human
ggcgatgctagggcaggggg

SEQ ID NO: 351293 - DNA, 20 bp, human
ggaggaaaacatggtcggga

SEQ ID NO: 351294 - DNA, 20 bp, human
gctccagaagctacgccccg

SEQ ID NO: 351295 - DNA, 20 bp, human
gctcacacgccgagagattc

SEQ ID NO: 351296 - DNA, 20 bp, human
gtcccggcgtgcgtgctgat

SEQ ID NO: 351297 - DNA, 20 bp, human
gcagcaggagcggagtggtg

SEQ ID NO: 351298 - DNA, 20 bp, human
ggaagggacagcaaagcgaa

SEQ ID NO: 351299 - DNA, 20 bp, human
gacgcgcaaggggaacgttc

SEQ ID NO: 351300 - DNA, 20 bp, human
gcgcacgccgggacgcgcaa

SEQ ID NO: 351301 - DNA, 20 bp, human
gtcagcatcccccccacaac

SEQ ID NO: 351302 - DNA, 20 bp, human
gccggaaacaccccatttcg

SEQ ID NO: 351303 - DNA, 20 bp, human
gggggggatgctgacgttta

SEQ ID NO: 351304 - DNA, 20 bp, human
ggcagtgttctccgcgaaat

SEQ ID NO: 351305 - DNA, 20 bp, human
gaggacgggaggatgatgtc

SEQ ID NO: 351306 - DNA, 20 bp, human
gaggtccagcgtacggtccg

SEQ ID NO: 351307 - DNA, 20 bp, human
gccggctcctaacgggagac

SEQ ID NO: 351308 - DNA, 20 bp, human
gtgaacccggaatcgaccta

SEQ ID NO: 351309 - DNA, 20 bp, human
gctcccgttaggagccgggg

SEQ ID NO: 351310 - DNA, 20 bp, human
ggcggtgcaccctgggatga

SEQ ID NO: 351311 - DNA, 20 bp, human
gcggcagcccgtctcccgtt

SEQ ID NO: 351312 - DNA, 20 bp, human
gggcgtgcaacgcaaacacg

SEQ ID NO: 351313 - DNA, 20 bp, human
gttgcctccccggctcctaa

SEQ ID NO: 351314 - DNA, 20 bp, human
gaacccaaatgtttgaagca

SEQ ID NO: 351315 - DNA, 20 bp, human
gggggacgactgctggccat

SEQ ID NO: 351316 - DNA, 20 bp, human
gccgactgccggaggggagg

SEQ ID NO: 351317 - DNA, 20 bp, human
gctggcgcgcagctgcagtc

SEQ ID NO: 351318 - DNA, 20 bp, human
gccgcccggcggccgactgc

SEQ ID NO: 351319 - DNA, 20 bp, human
gggagtgaaggacgtcttct

SEQ ID NO: 351320 - DNA, 20 bp, human
gcggcggccgactgccggag

SEQ ID NO: 351321 - DNA, 20 bp, human
gcggttaggggtgaacgcag

SEQ ID NO: 351322 - DNA, 20 bp, human
gggcgaggaccaccaaccga

SEQ ID NO: 351323 - DNA, 20 bp, human
gggaacccggaagtgcgagc

SEQ ID NO: 351324 - DNA, 20 bp, human
gggagcaggtttgtcgccgt

SEQ ID NO: 351325 - DNA, 20 bp, human
gtccgggcacttccgctctc

SEQ ID NO: 351326 - DNA, 20 bp, human
gcggtgcgctccacgaggga

SEQ ID NO: 351327 - DNA, 20 bp, human
ggggagcgcacgcgggctga

SEQ ID NO: 351328 - DNA, 20 bp, human
gcgcgcggcgattgggggga

SEQ ID NO: 351329 - DNA, 20 bp, human
gagcgcacgcgggctgaggg

SEQ ID NO: 351330 - DNA, 20 bp, human
gcccgggcgcgcggcgattg

SEQ ID NO: 351331 - DNA, 20 bp, human
gatcgccgcgcgcccgggtg

SEQ ID NO: 351332 - DNA, 20 bp, human
gagggcggatccgggcctgg

SEQ ID NO: 351333 - DNA, 20 bp, human
gccgccaggcccgaccactc

SEQ ID NO: 351334 - DNA, 20 bp, human
gctgcggggactctgcgccc

SEQ ID NO: 351335 - DNA, 20 bp, human
gtgggcgcgcctttctctcc

SEQ ID NO: 351336 - DNA, 20 bp, human
ggagacagagcgggtctcta

SEQ ID NO: 351337 - DNA, 20 bp, human
ggtatcgcgagacctaagta

SEQ ID NO: 351338 - DNA, 20 bp, human
gattgcgcgagattgggcta

SEQ ID NO: 351339 - DNA, 20 bp, human
ggaaaggcgcctcactgaat

SEQ ID NO: 351340 - DNA, 20 bp, human
gcgagacctaagtatggctc

SEQ ID NO: 351341 - DNA, 20 bp, human
gaggaggcgccacgaggggg

SEQ ID NO: 351342 - DNA, 20 bp, human
gtagggcaaagacagttggt

SEQ ID NO: 351343 - DNA, 20 bp, human
ggatttgggtgcttacgcgg

SEQ ID NO: 351344 - DNA, 20 bp, human
ggcctcactgaatgggggat

SEQ ID NO: 351345 - DNA, 20 bp, human
ggcaatcattgcgcgagatt

SEQ ID NO: 351346 - DNA, 20 bp, human
gacagcccgtggcgggagag

SEQ ID NO: 351347 - DNA, 20 bp, human
gagcccgctcgttagctgag

SEQ ID NO: 351348 - DNA, 20 bp, human
ggctgagggaagatgtgctc

SEQ ID NO: 351349 - DNA, 20 bp, human
ggctctaggccctctgggat

SEQ ID NO: 351350 - DNA, 20 bp, human
gcaccccctcagctaacgag

SEQ ID NO: 351351 - DNA, 20 bp, human
gcaaccccctctcccgccac

SEQ ID NO: 351352 - DNA, 20 bp, human
gcgaccaatcagaaacgctg

SEQ ID NO: 351353 - DNA, 20 bp, human
gagcgggctctaggccctct

SEQ ID NO: 351354 - DNA, 20 bp, human
gaaccgccacagcccgtggc

SEQ ID NO: 351355 - DNA, 20 bp, human
ggcggtctctggcccgggtg

SEQ ID NO: 351356 - DNA, 20 bp, human
ggggcaagagatcagcgtga

SEQ ID NO: 351357 - DNA, 20 bp, human
gagggcggacctacaaacgt

SEQ ID NO: 351358 - DNA, 20 bp, human
ggcgtccgtggtaaccaatc

SEQ ID NO: 351359 - DNA, 20 bp, human
gtacctaagaggccggcaag

SEQ ID NO: 351360 - DNA, 20 bp, human
gctaagaggccggcaagagg

SEQ ID NO: 351361 - DNA, 20 bp, human
gcggacgccaattacctaag

SEQ ID NO: 351362 - DNA, 20 bp, human
gtgccggcctcttaggtaat

SEQ ID NO: 351363 - DNA, 20 bp, human
ggtggtaaccaatcaggaag

SEQ ID NO: 351364 - DNA, 20 bp, human
gtcgcgaggttggtgcccat

SEQ ID NO: 351365 - DNA, 20 bp, human
ggaagccgaactcgctgatt

SEQ ID NO: 351366 - DNA, 20 bp, human
gccgcgcggcggacttctaa

SEQ ID NO: 351367 - DNA, 20 bp, human
gagccaggaattagtggtaa

SEQ ID NO: 351368 - DNA, 20 bp, human
gaggctcgactggaaacggt

SEQ ID NO: 351369 - DNA, 20 bp, human
ggggtattgtgatggagcat

SEQ ID NO: 351370 - DNA, 20 bp, human
ggactctggctacatcgtga

SEQ ID NO: 351371 - DNA, 20 bp, human
gtcgactggaaacggtaggt

SEQ ID NO: 351372 - DNA, 20 bp, human
gcaagtcccagaactccgcg

SEQ ID NO: 351373 - DNA, 20 bp, human
ggcagtgttgataagttcaa

SEQ ID NO: 351374 - DNA, 20 bp, human
ggtcccagaactccgcgcgg

SEQ ID NO: 351375 - DNA, 20 bp, human
gagtccgccgcgcggagttc

SEQ ID NO: 351376 - DNA, 20 bp, human
gtgggcctatgagagcacag

SEQ ID NO: 351377 - DNA, 20 bp, human
ggggtgtggccaaatctcat

SEQ ID NO: 351378 - DNA, 20 bp, human
gtcaaccccagggttgggca

SEQ ID NO: 351379 - DNA, 20 bp, human
gagatttggccacaccctca

SEQ ID NO: 351380 - DNA, 20 bp, human
gacacacgaacgcaagaacc

SEQ ID NO: 351381 - DNA, 20 bp, human
gggcggccccgctttcctgg

SEQ ID NO: 351382 - DNA, 20 bp, human
gacaccctcagggggaatat

SEQ ID NO: 351383 - DNA, 20 bp, human
ggagcgaagcaaagtcagtt

SEQ ID NO: 351384 - DNA, 20 bp, human
gctatgagagcacagcggag

SEQ ID NO: 351385 - DNA, 20 bp, human
ggcgcatgacgtcatacatt

SEQ ID NO: 351386 - DNA, 20 bp, human
gagtccgagctcccactcag

SEQ ID NO: 351387 - DNA, 20 bp, human
gggtcgcagaacagccggat

SEQ ID NO: 351388 - DNA, 20 bp, human
gcggctgttctgcgacctcg

SEQ ID NO: 351389 - DNA, 20 bp, human
gaacagccggatcgggtgga

SEQ ID NO: 351390 - DNA, 20 bp, human
ggcggtccttccacccgatc

SEQ ID NO: 351391 - DNA, 20 bp, human
ggtggaagcactctggagag

SEQ ID NO: 351392 - DNA, 20 bp, human
gacaagttgcaaaactacgg

SEQ ID NO: 351393 - DNA, 20 bp, human
ggcagaacagccggatcggg

SEQ ID NO: 351394 - DNA, 20 bp, human
gttggaggctacgaagaaaa

SEQ ID NO: 351395 - DNA, 20 bp, human
ggaggctacgaagaaaaggg

SEQ ID NO: 351396 - DNA, 20 bp, human
gcaaagcgggaaagtcttgg

SEQ ID NO: 351397 - DNA, 20 bp, human
gtgcaccggacccaagcgag

SEQ ID NO: 351398 - DNA, 20 bp, human
gcctgtgggcgcgaaagcgc

SEQ ID NO: 351399 - DNA, 20 bp, human
gcggtccagacgagggtttc

SEQ ID NO: 351400 - DNA, 20 bp, human
gaaaagtgcggcactgtgat

SEQ ID NO: 351401 - DNA, 20 bp, human
gtgggcgcgaaagcgcggga

SEQ ID NO: 351402 - DNA, 20 bp, human
gagattgtgggcgtctgtct

SEQ ID NO: 351403 - DNA, 20 bp, human
gactgcccctcgcttgggtc

SEQ ID NO: 351404 - DNA, 20 bp, human
ggccagactgcccctcgctt

SEQ ID NO: 351405 - DNA, 20 bp, human
gagctgcgcggtccagacga

SEQ ID NO: 351406 - DNA, 20 bp, human
ggcgccccctggcgacgcgg

SEQ ID NO: 351407 - DNA, 20 bp, human
gagggtcccccgcgtcgcca

SEQ ID NO: 351408 - DNA, 20 bp, human
gtgagacttagactgggtca

SEQ ID NO: 351409 - DNA, 20 bp, human
gcaactgataacttgggcct

SEQ ID NO: 351410 - DNA, 20 bp, human
ggatgaggccttccggggag

SEQ ID NO: 351411 - DNA, 20 bp, human
gaatccttggccttaggggt

SEQ ID NO: 351412 - DNA, 20 bp, human
gaccgagccggcaaaggctt

SEQ ID NO: 351413 - DNA, 20 bp, human
gaggatttgagacttagact

SEQ ID NO: 351414 - DNA, 20 bp, human
gacagcgctgcctaatgcac

SEQ ID NO: 351415 - DNA, 20 bp, human
gcggagcaccgagccggcaa

SEQ ID NO: 351416 - DNA, 20 bp, human
gtggcctaagcagccccacg

SEQ ID NO: 351417 - DNA, 20 bp, human
gcccgaagctaatccctgat

SEQ ID NO: 351418 - DNA, 20 bp, human
gatgaggcaccactcctcgt

SEQ ID NO: 351419 - DNA, 20 bp, human
gtaagcagccccacgaggag

SEQ ID NO: 351420 - DNA, 20 bp, human
ggtgaagagagcgattttta

SEQ ID NO: 351421 - DNA, 20 bp, human
gagggattagcttcggggcg

SEQ ID NO: 351422 - DNA, 20 bp, human
gcaggcatttcgagcaattg

SEQ ID NO: 351423 - DNA, 20 bp, human
gctgcgcgctgggaaacgag

SEQ ID NO: 351424 - DNA, 20 bp, human
gacacgaggaccagcgcgag

SEQ ID NO: 351425 - DNA, 20 bp, human
gtccaatcagggattagctt

SEQ ID NO: 351426 - DNA, 20 bp, human
gagcaggcaaggtgaagcga

SEQ ID NO: 351427 - DNA, 20 bp, human
gtgtggtcagagttagacat

SEQ ID NO: 351428 - DNA, 20 bp, human
gggccttgatggcagagatt

SEQ ID NO: 351429 - DNA, 20 bp, human
gtgcccggggagagctcccg

SEQ ID NO: 351430 - DNA, 20 bp, human
ggccccaggccctgctgcga

SEQ ID NO: 351431 - DNA, 20 bp, human
gtggcactggcctttagcca

SEQ ID NO: 351432 - DNA, 20 bp, human
gaaggccccggcaaaggtca

SEQ ID NO: 351433 - DNA, 20 bp, human
gcaaagaaaatcggccttga

SEQ ID NO: 351434 - DNA, 20 bp, human
gtgcagtgtcattcagctga

SEQ ID NO: 351435 - DNA, 20 bp, human
gaggcgcggaatgggccaac

SEQ ID NO: 351436 - DNA, 20 bp, human
gtctccgccgagccgctcgg

SEQ ID NO: 351437 - DNA, 20 bp, human
ggtgccgcccccgagcggct

SEQ ID NO: 351438 - DNA, 20 bp, human
gaggccgaggacgtcggagc

SEQ ID NO: 351439 - DNA, 20 bp, human
gggggccgatcgatctcctc

SEQ ID NO: 351440 - DNA, 20 bp, human
gggagccggaggagatcgat

SEQ ID NO: 351441 - DNA, 20 bp, human
gcctgccgtaagcctgtagt

SEQ ID NO: 351442 - DNA, 20 bp, human
gccgtaagcctgtagtgggt

SEQ ID NO: 351443 - DNA, 20 bp, human
ggataaaagggagctcagta

SEQ ID NO: 351444 - DNA, 20 bp, human
gcccggcaggccgaggacgt

SEQ ID NO: 351445 - DNA, 20 bp, human
gaagagagcgggatgagtta

SEQ ID NO: 351446 - DNA, 20 bp, human
ggcgccgcgccaccaccaac

SEQ ID NO: 351447 - DNA, 20 bp, human
gtcggctcccgcgaggggaa

SEQ ID NO: 351448 - DNA, 20 bp, human
gggtcactcggctcccgcga

SEQ ID NO: 351449 - DNA, 20 bp, human
gaccacgcagcacgggggcg

SEQ ID NO: 351450 - DNA, 20 bp, human
gccgccacccggaggtgcga

SEQ ID NO: 351451 - DNA, 20 bp, human
gtgagctggcgcgcgagaaa

SEQ ID NO: 351452 - DNA, 20 bp, human
gagccgagtgaccaatcccg

SEQ ID NO: 351453 - DNA, 20 bp, human
ggcagtggcgaccctttcca

SEQ ID NO: 351454 - DNA, 20 bp, human
gaaagggcccggtcgcgtcc

SEQ ID NO: 351455 - DNA, 20 bp, human
ggtcgccactgctgcgtcag

SEQ ID NO: 351456 - DNA, 20 bp, human
gaagcggcctggctgtgcga

SEQ ID NO: 351457 - DNA, 20 bp, human
gagcgtcctaagtgacagga

SEQ ID NO: 351458 - DNA, 20 bp, human
gcgagggctgccgggaaatg

SEQ ID NO: 351459 - DNA, 20 bp, human
ggtctggcgaccacatttcc

SEQ ID NO: 351460 - DNA, 20 bp, human
ggataagcgtgaggtactgt

SEQ ID NO: 351461 - DNA, 20 bp, human
ggcacagccaggccgcttcg

SEQ ID NO: 351462 - DNA, 20 bp, human
gaggtactgtgggtaggaga

SEQ ID NO: 351463 - DNA, 20 bp, human
gagaagtccaatcctcgaag

SEQ ID NO: 351464 - DNA, 20 bp, human
gagcgtgaggtactgtgggt

SEQ ID NO: 351465 - DNA, 20 bp, human
gcgcaggaggcgggtgacag

SEQ ID NO: 351466 - DNA, 20 bp, human
gctggcagggagcaaacctc

SEQ ID NO: 351467 - DNA, 20 bp, human
gttgctccctgccagcagct

SEQ ID NO: 351468 - DNA, 20 bp, human
gggtaagcgcgccttcttat

SEQ ID NO: 351469 - DNA, 20 bp, human
ggcaggggacttgccttctg

SEQ ID NO: 351470 - DNA, 20 bp, human
gctactccgcgtgacctgct

SEQ ID NO: 351471 - DNA, 20 bp, human
gcggcgggagtaagagtctg

SEQ ID NO: 351472 - DNA, 20 bp, human
gccttcttattggatggcga

SEQ ID NO: 351473 - DNA, 20 bp, human
gaaggcaagtcccctgcgcg

SEQ ID NO: 351474 - DNA, 20 bp, human
gagcgcgccttcttattgga

SEQ ID NO: 351475 - DNA, 20 bp, human
gggccgagcgctgaaggcag

SEQ ID NO: 351476 - DNA, 20 bp, human
gtagtcatcgggtccgacac

SEQ ID NO: 351477 - DNA, 20 bp, human
gccgccttgcctttaacgag

SEQ ID NO: 351478 - DNA, 20 bp, human
ggggcgacgacgtgcgcgga

SEQ ID NO: 351479 - DNA, 20 bp, human
gcttccgcaggctcagttat

SEQ ID NO: 351480 - DNA, 20 bp, human
gttaaaggcaaggcggcttc

SEQ ID NO: 351481 - DNA, 20 bp, human
gaccctgctcctctgatcac

SEQ ID NO: 351482 - DNA, 20 bp, human
gccaggatacccctcgttaa

SEQ ID NO: 351483 - DNA, 20 bp, human
ggacacaggctggactgatc

SEQ ID NO: 351484 - DNA, 20 bp, human
gcggcttctggctcttccgc

SEQ ID NO: 351485 - DNA, 20 bp, human
ggacagggacacattgttca

SEQ ID NO: 351486 - DNA, 20 bp, human
gttaggaggtacagactaca

SEQ ID NO: 351487 - DNA, 20 bp, human
gtagtctgtacctcctaaga

SEQ ID NO: 351488 - DNA, 20 bp, human
ggcctagtgcggaaagatac

SEQ ID NO: 351489 - DNA, 20 bp, human
gagtcaagctgaccaatcaa

SEQ ID NO: 351490 - DNA, 20 bp, human
ggataccggaagtgtttctg

SEQ ID NO: 351491 - DNA, 20 bp, human
gaattggggcgggcctagtg

SEQ ID NO: 351492 - DNA, 20 bp, human
gagcagctgccgcggttaag

SEQ ID NO: 351493 - DNA, 20 bp, human
gatggccacagaaacacttc

SEQ ID NO: 351494 - DNA, 20 bp, human
gtacagactacagggggccg

SEQ ID NO: 351495 - DNA, 20 bp, human
gaagctaaatcatccatctt

SEQ ID NO: 351496 - DNA, 20 bp, human
gccgggacccgctggaggtg

SEQ ID NO: 351497 - DNA, 20 bp, human
gaaagcgatctggactcaca

SEQ ID NO: 351498 - DNA, 20 bp, human
gcccaggctcgcggttggac

SEQ ID NO: 351499 - DNA, 20 bp, human
gcacctcccaggctcgcggt

SEQ ID NO: 351500 - DNA, 20 bp, human
gtaaccactcctcacctccc

SEQ ID NO: 351501 - DNA, 20 bp, human
gagtccagatcgctttgtgt

SEQ ID NO: 351502 - DNA, 20 bp, human
gccagatcgctttgtgtcgg

SEQ ID NO: 351503 - DNA, 20 bp, human
gactcagccctcacctccag

SEQ ID NO: 351504 - DNA, 20 bp, human
gggggtggagggggaatgcg

SEQ ID NO: 351505 - DNA, 20 bp, human
gaggctcgcggttggacggg

SEQ ID NO: 351506 - DNA, 20 bp, human
ggaggcagaggcacttccac

SEQ ID NO: 351507 - DNA, 20 bp, human
gttctccaaggcaatgtctc

SEQ ID NO: 351508 - DNA, 20 bp, human
gagtgtgtgagataagctca

SEQ ID NO: 351509 - DNA, 20 bp, human
gagttaacagagtctgaatg

SEQ ID NO: 351510 - DNA, 20 bp, human
gtatagctgagatctaaggg

SEQ ID NO: 351511 - DNA, 20 bp, human
gaatcggaacttgttcatag

SEQ ID NO: 351512 - DNA, 20 bp, human
ggaggcaggagaattgcgga

SEQ ID NO: 351513 - DNA, 20 bp, human
gcttgggcattaggacccag

SEQ ID NO: 351514 - DNA, 20 bp, human
gcactgtaagtgtaaagtag

SEQ ID NO: 351515 - DNA, 20 bp, human
ggttgcagtgagccggatcc

SEQ ID NO: 351516 - DNA, 20 bp, human
gcccgaacaccatgtcactc

SEQ ID NO: 351517 - DNA, 20 bp, human
gagctcttgtgtggggtaga

SEQ ID NO: 351518 - DNA, 20 bp, human
ggcagcgtacgcagtccaga

SEQ ID NO: 351519 - DNA, 20 bp, human
gacaaaaagcagctcttgtg

SEQ ID NO: 351520 - DNA, 20 bp, human
gtgaagaactcaaatgcggg

SEQ ID NO: 351521 - DNA, 20 bp, human
gcgtacgctgctccctggag

SEQ ID NO: 351522 - DNA, 20 bp, human
gagaactcaaatgcgggcgg

SEQ ID NO: 351523 - DNA, 20 bp, human
gtctccctcccagagtgaca

SEQ ID NO: 351524 - DNA, 20 bp, human
ggatagccagcagagggaat

SEQ ID NO: 351525 - DNA, 20 bp, human
gcggaactttgcttgcagca

SEQ ID NO: 351526 - DNA, 20 bp, human
gaccgagggcccgggaaaaa

SEQ ID NO: 351527 - DNA, 20 bp, human
gtctgtcgacccaacaccga

SEQ ID NO: 351528 - DNA, 20 bp, human
gacagaggagccagccaatg

SEQ ID NO: 351529 - DNA, 20 bp, human
gttcccgggccctcggtgtt

SEQ ID NO: 351530 - DNA, 20 bp, human
ggagggcccgggaaaaaggg

SEQ ID NO: 351531 - DNA, 20 bp, human
ggtagagaaaacggttagaa

SEQ ID NO: 351532 - DNA, 20 bp, human
ggacccaacaccgagggccc

SEQ ID NO: 351533 - DNA, 20 bp, human
gggaacgaggctgaaggacc

SEQ ID NO: 351534 - DNA, 20 bp, human
ggccagccaatggggagact

SEQ ID NO: 351535 - DNA, 20 bp, human
gcgtttgtaaagaacgggtg

SEQ ID NO: 351536 - DNA, 20 bp, human
ggactctggactgggagcga

SEQ ID NO: 351537 - DNA, 20 bp, human
gcgccagtggccagtcgatt

SEQ ID NO: 351538 - DNA, 20 bp, human
ggaagagccggggcgtaccg

SEQ ID NO: 351539 - DNA, 20 bp, human
ggctgcgtgcggttacctct

SEQ ID NO: 351540 - DNA, 20 bp, human
gggggtaaaggcacaagcct

SEQ ID NO: 351541 - DNA, 20 bp, human
gtaggagcgaaggtccaagt

SEQ ID NO: 351542 - DNA, 20 bp, human
ggcgctgcgctgcctttccc

SEQ ID NO: 351543 - DNA, 20 bp, human
ggccacgccccggtacgccc

SEQ ID NO: 351544 - DNA, 20 bp, human
gacctcgcgccggaagagcc

SEQ ID NO: 351545 - DNA, 20 bp, human
gcggttacctcttggagagg

SEQ ID NO: 351546 - DNA, 20 bp, human
gacggcgcgcgatgacggtg

SEQ ID NO: 351547 - DNA, 20 bp, human
gatcgcggaatggatggaaa

SEQ ID NO: 351548 - DNA, 20 bp, human
ggtggggtccgccgcgatcg

SEQ ID NO: 351549 - DNA, 20 bp, human
gcccggatgtggccagggat

SEQ ID NO: 351550 - DNA, 20 bp, human
ggtggccggggattggctat

SEQ ID NO: 351551 - DNA, 20 bp, human
gttgggcttgagtgaggaag

SEQ ID NO: 351552 - DNA, 20 bp, human
ggactcacggcgcgcgatga

SEQ ID NO: 351553 - DNA, 20 bp, human
ggcgagcccggatgtggcca

SEQ ID NO: 351554 - DNA, 20 bp, human
gtggactcagggaactccat

SEQ ID NO: 351555 - DNA, 20 bp, human
gggggcggggacttggatat

SEQ ID NO: 351556 - DNA, 20 bp, human
gaagccgttaagaccgggtc

SEQ ID NO: 351557 - DNA, 20 bp, human
gaagaccgggtcaggtgaac

SEQ ID NO: 351558 - DNA, 20 bp, human
gaaactgccgactttcccga

SEQ ID NO: 351559 - DNA, 20 bp, human
gtcacctgacccggtcttaa

SEQ ID NO: 351560 - DNA, 20 bp, human
ggaaacagccgaccaatcac

SEQ ID NO: 351561 - DNA, 20 bp, human
gcctgctgcctgtgattggt

SEQ ID NO: 351562 - DNA, 20 bp, human
gccggtcttaacggcttcaa

SEQ ID NO: 351563 - DNA, 20 bp, human
gcgagctcgctcgtcgaggg

SEQ ID NO: 351564 - DNA, 20 bp, human
gcagagggccaattcgccgt

SEQ ID NO: 351565 - DNA, 20 bp, human
gaattcgccgtcgggaaagt

SEQ ID NO: 351566 - DNA, 20 bp, human
gaccttacgtcatagttctt

SEQ ID NO: 351567 - DNA, 20 bp, human
gcgagcgctctcgtggaggg

SEQ ID NO: 351568 - DNA, 20 bp, human
gtcccaagaactatgacgta

SEQ ID NO: 351569 - DNA, 20 bp, human
gtggttgttggttacattgg

SEQ ID NO: 351570 - DNA, 20 bp, human
gcggctcctaccggttgggg

SEQ ID NO: 351571 - DNA, 20 bp, human
gacaccaacgtctatgatac

SEQ ID NO: 351572 - DNA, 20 bp, human
ggagggggttgtgggatcgt

SEQ ID NO: 351573 - DNA, 20 bp, human
gagggcggctcctaccggtt

SEQ ID NO: 351574 - DNA, 20 bp, human
gccttcgagcgctctcgtgg

SEQ ID NO: 351575 - DNA, 20 bp, human
gacgtctatgatacaggtag

SEQ ID NO: 351576 - DNA, 20 bp, human
gacaaaaaattgcccagctg

SEQ ID NO: 351577 - DNA, 20 bp, human
ggactagcttgggcactatg

SEQ ID NO: 351578 - DNA, 20 bp, human
gtatttttaaaaatagacaa

SEQ ID NO: 351579 - DNA, 20 bp, human
gcaaaggggcactaacttca

SEQ ID NO: 351580 - DNA, 20 bp, human
gtagaaatgagatttttgtc

SEQ ID NO: 351581 - DNA, 20 bp, human
gtgcagtgagcagttcactt

SEQ ID NO: 351582 - DNA, 20 bp, human
gtgaaaagaatctatttatg

SEQ ID NO: 351583 - DNA, 20 bp, human
gagcagttcactttggcgac

SEQ ID NO: 351584 - DNA, 20 bp, human
gtcaggaagggaattttact

SEQ ID NO: 351585 - DNA, 20 bp, human
gtttgtaacactcagagcaa

SEQ ID NO: 351586 - DNA, 20 bp, human
gacaaaaaattgcccagctg

SEQ ID NO: 351587 - DNA, 20 bp, human
ggactagcttgggcactatg

SEQ ID NO: 351588 - DNA, 20 bp, human
gtatttttaaaaatagacaa

SEQ ID NO: 351589 - DNA, 20 bp, human
gcaaaggggcactaacttca

SEQ ID NO: 351590 - DNA, 20 bp, human
gtagaaatgagatttttgtc

SEQ ID NO: 351591 - DNA, 20 bp, human
gtgcagtgagcagttcactt

SEQ ID NO: 351592 - DNA, 20 bp, human
gtgaaaagaatctatttatg

SEQ ID NO: 351593 - DNA, 20 bp, human
gagcagttcactttggcgac

SEQ ID NO: 351594 - DNA, 20 bp, human
gtcaggaagggaattttact

SEQ ID NO: 351595 - DNA, 20 bp, human
gtttgtaacactcagagcaa

SEQ ID NO: 351596 - DNA, 20 bp, human
gggcgggcagcggtagattg

SEQ ID NO: 351597 - DNA, 20 bp, human
gcagcggtagattgaggcac

SEQ ID NO: 351598 - DNA, 20 bp, human
gtgtgccatgtggcgggcag

SEQ ID NO: 351599 - DNA, 20 bp, human
gaatggagctgcaggcccgc

SEQ ID NO: 351600 - DNA, 20 bp, human
gctgcagctccattatgtcg

SEQ ID NO: 351601 - DNA, 20 bp, human
gaccccacaaggactctcta

SEQ ID NO: 351602 - DNA, 20 bp, human
ggcggcggcggtggtttgag

SEQ ID NO: 351603 - DNA, 20 bp, human
gtctaccgctgcccgccaca

SEQ ID NO: 351604 - DNA, 20 bp, human
gaagagttaccgcgacataa

SEQ ID NO: 351605 - DNA, 20 bp, human
gggaactcagagtctgtatt

SEQ ID NO: 351606 - DNA, 20 bp, human
gcaggggcgggggatgtcga

SEQ ID NO: 351607 - DNA, 20 bp, human
gaaagcaaacgtcccgtctc

SEQ ID NO: 351608 - DNA, 20 bp, human
gcgggggatgtcgaagggtc

SEQ ID NO: 351609 - DNA, 20 bp, human
gagcgccctccggggacagg

SEQ ID NO: 351610 - DNA, 20 bp, human
gaagctgggaggttcaacta

SEQ ID NO: 351611 - DNA, 20 bp, human
gttagcgagggcgggcgcag

SEQ ID NO: 351612 - DNA, 20 bp, human
gccccagcagccgaagagtt

SEQ ID NO: 351613 - DNA, 20 bp, human
gctacaatggatcctcccgc

SEQ ID NO: 351614 - DNA, 20 bp, human
gagagccccctgtccccgga

SEQ ID NO: 351615 - DNA, 20 bp, human
ggtctgaaacgaaggtggcg

SEQ ID NO: 351616 - DNA, 20 bp, human
gataccaggactttgttcgt

SEQ ID NO: 351617 - DNA, 20 bp, human
gccaaaaatgagctgctcta

SEQ ID NO: 351618 - DNA, 20 bp, human
gtaacccacgaacaaagtcc

SEQ ID NO: 351619 - DNA, 20 bp, human
ggtgacccatagtacatgtg

SEQ ID NO: 351620 - DNA, 20 bp, human
gtggctggctgggtccccat

SEQ ID NO: 351621 - DNA, 20 bp, human
gtgtgggacaaggggcccat

SEQ ID NO: 351622 - DNA, 20 bp, human
gtaaagttcagcgagactat

SEQ ID NO: 351623 - DNA, 20 bp, human
gtctaccccacatgtactat

SEQ ID NO: 351624 - DNA, 20 bp, human
gtgctctagggccctgctta

SEQ ID NO: 351625 - DNA, 20 bp, human
ggtgtcctgcaccataagca

SEQ ID NO: 351626 - DNA, 20 bp, human
gcatgtgaggacaaatctaa

SEQ ID NO: 351627 - DNA, 20 bp, human
gtagacccagccctacctag

SEQ ID NO: 351628 - DNA, 20 bp, human
gagctagatgtgcaagtcac

SEQ ID NO: 351629 - DNA, 20 bp, human
gccaagacacactttccccg

SEQ ID NO: 351630 - DNA, 20 bp, human
gtaaggcagaacaggagaac

SEQ ID NO: 351631 - DNA, 20 bp, human
gtacgcaggtttccactcct

SEQ ID NO: 351632 - DNA, 20 bp, human
ggacagagctcggcgagcct

SEQ ID NO: 351633 - DNA, 20 bp, human
gcccttgggaagaggtggtt

SEQ ID NO: 351634 - DNA, 20 bp, human
gtcagccactaggtagggct

SEQ ID NO: 351635 - DNA, 20 bp, human
gtcccccaacagttgagagt

SEQ ID NO: 351636 - DNA, 20 bp, human
gtatcggggaggagtggcca

SEQ ID NO: 351637 - DNA, 20 bp, human
gtcaaccctgggtatcgggg

SEQ ID NO: 351638 - DNA, 20 bp, human
gcactcctccccgataccca

SEQ ID NO: 351639 - DNA, 20 bp, human
ggggctaaactcctgagttg

SEQ ID NO: 351640 - DNA, 20 bp, human
ggtagcaggaactaaaataa

SEQ ID NO: 351641 - DNA, 20 bp, human
gaagatgcaatgtaccttct

SEQ ID NO: 351642 - DNA, 20 bp, human
gacatcaaccctgggtatcg

SEQ ID NO: 351643 - DNA, 20 bp, human
gaatagaagcccatcgtttt

SEQ ID NO: 351644 - DNA, 20 bp, human
gtgtctctcccgtggcctca

SEQ ID NO: 351645 - DNA, 20 bp, human
gggaagccttgccccaactc

SEQ ID NO: 351646 - DNA, 20 bp, human
gcccgggctccggtgagtca

SEQ ID NO: 351647 - DNA, 20 bp, human
ggtaactgagccagggccgc

SEQ ID NO: 351648 - DNA, 20 bp, human
ggtgcagggtaactgagcca

SEQ ID NO: 351649 - DNA, 20 bp, human
gactgtgcccgaggctgtcc

SEQ ID NO: 351650 - DNA, 20 bp, human
gactcaccggagcccgggca

SEQ ID NO: 351651 - DNA, 20 bp, human
gcggccgctggcacgagtgc

SEQ ID NO: 351652 - DNA, 20 bp, human
gcgcggggtgaaagaccgaa

SEQ ID NO: 351653 - DNA, 20 bp, human
gaggccacggtcttcccgcc

SEQ ID NO: 351654 - DNA, 20 bp, human
gaggctcgagtcaacctggc

SEQ ID NO: 351655 - DNA, 20 bp, human
gcggtctagggtggcctccg

SEQ ID NO: 351656 - DNA, 20 bp, human
gtgaaggaggggcagggatt

SEQ ID NO: 351657 - DNA, 20 bp, human
gtccccgcatggtgagtttg

SEQ ID NO: 351658 - DNA, 20 bp, human
gcctgccagaaatgaggtgg

SEQ ID NO: 351659 - DNA, 20 bp, human
gcccaagcctgccagaaatg

SEQ ID NO: 351660 - DNA, 20 bp, human
gacccccaaactcaccatgc

SEQ ID NO: 351661 - DNA, 20 bp, human
gccagcctcaggtgtctccc

SEQ ID NO: 351662 - DNA, 20 bp, human
ggagacacctgaggctggtc

SEQ ID NO: 351663 - DNA, 20 bp, human
ggccaacactgacctttgga

SEQ ID NO: 351664 - DNA, 20 bp, human
gaggcttgggaaccgtccca

SEQ ID NO: 351665 - DNA, 20 bp, human
gggaggccaacactgacctt

SEQ ID NO: 351666 - DNA, 20 bp, human
ggggagcgcagcggcttcta

SEQ ID NO: 351667 - DNA, 20 bp, human
gtgggacatgagaaagcagt

SEQ ID NO: 351668 - DNA, 20 bp, human
gagaggaagccccaaggaaa

SEQ ID NO: 351669 - DNA, 20 bp, human
gcaggagcaccgggctgagg

SEQ ID NO: 351670 - DNA, 20 bp, human
gatgtggcccgaaacagtct

SEQ ID NO: 351671 - DNA, 20 bp, human
ggcggcttctaggggtgagt

SEQ ID NO: 351672 - DNA, 20 bp, human
gggggaagctgccgcgcggt

SEQ ID NO: 351673 - DNA, 20 bp, human
ggcagcttccccctttcctt

SEQ ID NO: 351674 - DNA, 20 bp, human
ggggtcattaacatataagc

SEQ ID NO: 351675 - DNA, 20 bp, human
gaccagcaatcacttctctc

SEQ ID NO: 351676 - DNA, 20 bp, human
gtccccatggaccacacgga

SEQ ID NO: 351677 - DNA, 20 bp, human
gaaaccggaggggattacta

SEQ ID NO: 351678 - DNA, 20 bp, human
gcacacggagggctcgcccg

SEQ ID NO: 351679 - DNA, 20 bp, human
gagccctccgtgtggtccat

SEQ ID NO: 351680 - DNA, 20 bp, human
gtgcgcatgctccatcgcct

SEQ ID NO: 351681 - DNA, 20 bp, human
gtcgcgccgcccgcagagta

SEQ ID NO: 351682 - DNA, 20 bp, human
gtccagggaaggcagcgagc

SEQ ID NO: 351683 - DNA, 20 bp, human
gtacggggacgaggaatgga

SEQ ID NO: 351684 - DNA, 20 bp, human
gttactacggggacgaggaa

SEQ ID NO: 351685 - DNA, 20 bp, human
gcatgctccatcgcctgggt

SEQ ID NO: 351686 - DNA, 20 bp, human
ggggcgcccgagatggcagg

SEQ ID NO: 351687 - DNA, 20 bp, human
gagggggcgcccgagatggc

SEQ ID NO: 351688 - DNA, 20 bp, human
ggcccggggccttggagata

SEQ ID NO: 351689 - DNA, 20 bp, human
gctctcaggagcgaccgcca

SEQ ID NO: 351690 - DNA, 20 bp, human
gaggggctgcgccctgttgc

SEQ ID NO: 351691 - DNA, 20 bp, human
gccccctgtttgctcggggt

SEQ ID NO: 351692 - DNA, 20 bp, human
gcgcacctgctgggcagatg

SEQ ID NO: 351693 - DNA, 20 bp, human
gcactgcgcacgagaacgcg

SEQ ID NO: 351694 - DNA, 20 bp, human
gccccggccccctgtttgct

SEQ ID NO: 351695 - DNA, 20 bp, human
gcgcacgagaacgcgcggct

SEQ ID NO: 351696 - DNA, 20 bp, human
ggtcccgcgccccgtccctc

SEQ ID NO: 351697 - DNA, 20 bp, human
gcgaccagccgctgagtcgg

SEQ ID NO: 351698 - DNA, 20 bp, human
gagccggcagcccacgtcca

SEQ ID NO: 351699 - DNA, 20 bp, human
gggacggagccccccgcggg

SEQ ID NO: 351700 - DNA, 20 bp, human
gcggctgcagcccggaggga

SEQ ID NO: 351701 - DNA, 20 bp, human
gctccgccctccctggacgt

SEQ ID NO: 351702 - DNA, 20 bp, human
ggggtcgccgcttccgcccg

SEQ ID NO: 351703 - DNA, 20 bp, human
gcccccgggggccaagggaa

SEQ ID NO: 351704 - DNA, 20 bp, human
gctccctggacgtgggctgc

SEQ ID NO: 351705 - DNA, 20 bp, human
gtctgcgcgccccgggactt

SEQ ID NO: 351706 - DNA, 20 bp, human
gtgacccaggcgagagagag

SEQ ID NO: 351707 - DNA, 20 bp, human
gcccgccgcgcggtctccgg

SEQ ID NO: 351708 - DNA, 20 bp, human
gaatccccaccgcccaccgt

SEQ ID NO: 351709 - DNA, 20 bp, human
ggccggggcgagcccacggt

SEQ ID NO: 351710 - DNA, 20 bp, human
gccgcccgccgcgcggtctc

SEQ ID NO: 351711 - DNA, 20 bp, human
ggacccacggggcagtgaga

SEQ ID NO: 351712 - DNA, 20 bp, human
gcgttcccccggagaccgcg

SEQ ID NO: 351713 - DNA, 20 bp, human
gcacggggctccacctcccg

SEQ ID NO: 351714 - DNA, 20 bp, human
ggcccaccgtgggctcgccc

SEQ ID NO: 351715 - DNA, 20 bp, human
gggtcgcagtgaaaaggcgg

SEQ ID NO: 351716 - DNA, 20 bp, human
gctcgcgcgccagtaagggg

SEQ ID NO: 351717 - DNA, 20 bp, human
gagggggcggtggccggagt

SEQ ID NO: 351718 - DNA, 20 bp, human
gcacccgcgaactgtaggcc

SEQ ID NO: 351719 - DNA, 20 bp, human
gcgggtggaaacgttcgaaa

SEQ ID NO: 351720 - DNA, 20 bp, human
gctccccggcctacagttcg

SEQ ID NO: 351721 - DNA, 20 bp, human
gcgccccacccgcgaactgt

SEQ ID NO: 351722 - DNA, 20 bp, human
ggctacgtgagctagccggg

SEQ ID NO: 351723 - DNA, 20 bp, human
gtggcgcgcgaggcggaggt

SEQ ID NO: 351724 - DNA, 20 bp, human
gctgcgacagcccctttaag

SEQ ID NO: 351725 - DNA, 20 bp, human
gtccgcctcgcgcgccagta

SEQ ID NO: 351726 - DNA, 20 bp, human
ggagactggggcggagacga

SEQ ID NO: 351727 - DNA, 20 bp, human
gcgcccgccccgcctcctga

SEQ ID NO: 351728 - DNA, 20 bp, human
ggagcaaagctctgagtcac

SEQ ID NO: 351729 - DNA, 20 bp, human
gagggcgaggatcctccctc

SEQ ID NO: 351730 - DNA, 20 bp, human
gggaccggttcatctgctca

SEQ ID NO: 351731 - DNA, 20 bp, human
gacgccctgagcagatgaac

SEQ ID NO: 351732 - DNA, 20 bp, human
gccaacgcccggagggagac

SEQ ID NO: 351733 - DNA, 20 bp, human
gcaaaggcgccggtgcggga

SEQ ID NO: 351734 - DNA, 20 bp, human
gtcgcggcggagagcgtcgc

SEQ ID NO: 351735 - DNA, 20 bp, human
gagcccaaaggcgccggtgc

SEQ ID NO: 351736 - DNA, 20 bp, human
gcaccccgatcacgtgacaa

SEQ ID NO: 351737 - DNA, 20 bp, human
ggatcggggtggatccgctg

SEQ ID NO: 351738 - DNA, 20 bp, human
gggctcccttgtcacgtgat

SEQ ID NO: 351739 - DNA, 20 bp, human
ggggagccccggagcactgt

SEQ ID NO: 351740 - DNA, 20 bp, human
gagccccggagcactgtggg

SEQ ID NO: 351741 - DNA, 20 bp, human
gccgggagtcgggagttgga

SEQ ID NO: 351742 - DNA, 20 bp, human
gccacggaggcggacctgga

SEQ ID NO: 351743 - DNA, 20 bp, human
gaaggactaggcaagccgaa

SEQ ID NO: 351744 - DNA, 20 bp, human
gattacgcaagcccgggagt

SEQ ID NO: 351745 - DNA, 20 bp, human
ggtggatccgctgaggcaga

SEQ ID NO: 351746 - DNA, 20 bp, human
gagcatagggaaaatgacta

SEQ ID NO: 351747 - DNA, 20 bp, human
gagaatggaaaaaacagctg

SEQ ID NO: 351748 - DNA, 20 bp, human
gtcaagtcctgcatgcttgc

SEQ ID NO: 351749 - DNA, 20 bp, human
gacaaagtgtaagtttctac

SEQ ID NO: 351750 - DNA, 20 bp, human
ggtaagtttctactggaaag

SEQ ID NO: 351751 - DNA, 20 bp, human
gtgtctgcctgcaagcatgc

SEQ ID NO: 351752 - DNA, 20 bp, human
gactcagacaacacgctcct

SEQ ID NO: 351753 - DNA, 20 bp, human
gtaagaagggtcgtcccatt

SEQ ID NO: 351754 - DNA, 20 bp, human
ggggtcgtcccattcggccg

SEQ ID NO: 351755 - DNA, 20 bp, human
gtgaatggaattactaccag

SEQ ID NO: 351756 - DNA, 20 bp, human
gaattcaagcagcgttagct

SEQ ID NO: 351757 - DNA, 20 bp, human
gggtaagaggagataattag

SEQ ID NO: 351758 - DNA, 20 bp, human
gaggatgcccagaacatgtg

SEQ ID NO: 351759 - DNA, 20 bp, human
ggggcatcctaatgcatccc

SEQ ID NO: 351760 - DNA, 20 bp, human
ggaacggcccggctcgctca

SEQ ID NO: 351761 - DNA, 20 bp, human
gtgcctagagataaaaggct

SEQ ID NO: 351762 - DNA, 20 bp, human
gcctaatgcatcccgggcat

SEQ ID NO: 351763 - DNA, 20 bp, human
gtatgtttgcaaaaagcagg

SEQ ID NO: 351764 - DNA, 20 bp, human
ggctggtcgtctgtcattta

SEQ ID NO: 351765 - DNA, 20 bp, human
gaacttcctgctcatctcga

SEQ ID NO: 351766 - DNA, 20 bp, human
gcgccctgccagaacaggag

SEQ ID NO: 351767 - DNA, 20 bp, human
gagggagaagagcacgagtg

SEQ ID NO: 351768 - DNA, 20 bp, human
gccgctctcgccggcgtcga

SEQ ID NO: 351769 - DNA, 20 bp, human
gaggacgcgcagtcacgcag

SEQ ID NO: 351770 - DNA, 20 bp, human
gtgggactagggcggtgtcc

SEQ ID NO: 351771 - DNA, 20 bp, human
ggtcccctcctgttctggca

SEQ ID NO: 351772 - DNA, 20 bp, human
gcgggccgccggttgccggg

SEQ ID NO: 351773 - DNA, 20 bp, human
ggcgcgcgccctgccagaac

SEQ ID NO: 351774 - DNA, 20 bp, human
gcggcgagacacccccaccc

SEQ ID NO: 351775 - DNA, 20 bp, human
ggccgccacgccctcgacgc

SEQ ID NO: 351776 - DNA, 20 bp, human
gcgggcctgagacggccaat

SEQ ID NO: 351777 - DNA, 20 bp, human
gaatcggcttctaaagaagt

SEQ ID NO: 351778 - DNA, 20 bp, human
gggagtgtccccatgaaatc

SEQ ID NO: 351779 - DNA, 20 bp, human
gcggccgaaaccctgctctt

SEQ ID NO: 351780 - DNA, 20 bp, human
gggcccgaagagcagggttt

SEQ ID NO: 351781 - DNA, 20 bp, human
gtgcaccgggtcacgtgagg

SEQ ID NO: 351782 - DNA, 20 bp, human
gcgccccgaggccctgccac

SEQ ID NO: 351783 - DNA, 20 bp, human
gttgtagggcccgaagagca

SEQ ID NO: 351784 - DNA, 20 bp, human
gcggggcggtgcgggatgct

SEQ ID NO: 351785 - DNA, 20 bp, human
gtctaaagaagtcgggttgt

SEQ ID NO: 351786 - DNA, 20 bp, human
gcggccgagacggaaacgaa

SEQ ID NO: 351787 - DNA, 20 bp, human
gaaaggggaggggcggcggt

SEQ ID NO: 351788 - DNA, 20 bp, human
gagggggcgtctgcgagaaa

SEQ ID NO: 351789 - DNA, 20 bp, human
ggagcgcagacaagaggagg

SEQ ID NO: 351790 - DNA, 20 bp, human
gtcccgggggtcaactccga

SEQ ID NO: 351791 - DNA, 20 bp, human
gtcccctcggagttgacccc

SEQ ID NO: 351792 - DNA, 20 bp, human
gggcgtctgcgagaaagggg

SEQ ID NO: 351793 - DNA, 20 bp, human
gacccccgggagtctcccat

SEQ ID NO: 351794 - DNA, 20 bp, human
ggacccacggaggaactccc

SEQ ID NO: 351795 - DNA, 20 bp, human
gggccccaatgggagactcc

SEQ ID NO: 351796 - DNA, 20 bp, human
gttcccgcgggaccttgctg

SEQ ID NO: 351797 - DNA, 20 bp, human
ggggaggcctctcgcggtag

SEQ ID NO: 351798 - DNA, 20 bp, human
gctggctgggaggcctctcg

SEQ ID NO: 351799 - DNA, 20 bp, human
gttccccagcaaggtcccgc

SEQ ID NO: 351800 - DNA, 20 bp, human
gcggtagtggatccttcccg

SEQ ID NO: 351801 - DNA, 20 bp, human
ggagaatcagaaactcactg

SEQ ID NO: 351802 - DNA, 20 bp, human
gaaggatccactaccgcgag

SEQ ID NO: 351803 - DNA, 20 bp, human
gtgtaggtatgtagctgcag

SEQ ID NO: 351804 - DNA, 20 bp, human
gcacgcgcaatagacattcc

SEQ ID NO: 351805 - DNA, 20 bp, human
ggaatgtacgttacagaaat

SEQ ID NO: 351806 - DNA, 20 bp, human
gcccctggcccggttccagt

SEQ ID NO: 351807 - DNA, 20 bp, human
ggccccgacccgggtgagaa

SEQ ID NO: 351808 - DNA, 20 bp, human
gcaggcctctggccccgacc

SEQ ID NO: 351809 - DNA, 20 bp, human
ggcccactggaaccgggcca

SEQ ID NO: 351810 - DNA, 20 bp, human
gcgaactcaaggagtctttc

SEQ ID NO: 351811 - DNA, 20 bp, human
gcgcgccacatgcagatcct

SEQ ID NO: 351812 - DNA, 20 bp, human
gttccagtgggcgtgtattt

SEQ ID NO: 351813 - DNA, 20 bp, human
gctgcatgtggcgcgctccc

SEQ ID NO: 351814 - DNA, 20 bp, human
gttggccaggctggctcccc

SEQ ID NO: 351815 - DNA, 20 bp, human
gtccatgccctcttgagggt

SEQ ID NO: 351816 - DNA, 20 bp, human
ggccctgcgggattccccga

SEQ ID NO: 351817 - DNA, 20 bp, human
gggcggagagggggcgagtt

SEQ ID NO: 351818 - DNA, 20 bp, human
gtccttcggggaatcccgca

SEQ ID NO: 351819 - DNA, 20 bp, human
gggccccggcgcggctcctt

SEQ ID NO: 351820 - DNA, 20 bp, human
gccagaggcaatcccctgga

SEQ ID NO: 351821 - DNA, 20 bp, human
gagccccagaggcaatcccc

SEQ ID NO: 351822 - DNA, 20 bp, human
gaaagtggcggccgcagggt

SEQ ID NO: 351823 - DNA, 20 bp, human
gagagggggcgagttgggag

SEQ ID NO: 351824 - DNA, 20 bp, human
gaggaaatcgcgcccctccc

SEQ ID NO: 351825 - DNA, 20 bp, human
gctaacttacggataggccg

SEQ ID NO: 351826 - DNA, 20 bp, human
ggcgcggcgcaggctcgggt

SEQ ID NO: 351827 - DNA, 20 bp, human
ggcgccggcaacgggtccgc

SEQ ID NO: 351828 - DNA, 20 bp, human
gcggccggcggacccgttgc

SEQ ID NO: 351829 - DNA, 20 bp, human
gcgcgcctcgccgcccgcct

SEQ ID NO: 351830 - DNA, 20 bp, human
gaacgggtccgccggccggc

SEQ ID NO: 351831 - DNA, 20 bp, human
gaggcccaaagcgcgctcgc

SEQ ID NO: 351832 - DNA, 20 bp, human
gttgcggcttaggaggatgt

SEQ ID NO: 351833 - DNA, 20 bp, human
ggcgctcgcgggcccgcgaa

SEQ ID NO: 351834 - DNA, 20 bp, human
ggcaggccgcactgcgtgga

SEQ ID NO: 351835 - DNA, 20 bp, human
ggcgggcccgcgaaaggcgc

SEQ ID NO: 351836 - DNA, 20 bp, human
gaccccagcacgttcgagga

SEQ ID NO: 351837 - DNA, 20 bp, human
gcaccaccccagcacgttcg

SEQ ID NO: 351838 - DNA, 20 bp, human
gcccaagccgcccttcaacc

SEQ ID NO: 351839 - DNA, 20 bp, human
gcctctgtggcctccgctga

SEQ ID NO: 351840 - DNA, 20 bp, human
gtagccctcctcgaacgtgc

SEQ ID NO: 351841 - DNA, 20 bp, human
gccaagaaataagtcgttta

SEQ ID NO: 351842 - DNA, 20 bp, human
gaggctcgttggctcgacag

SEQ ID NO: 351843 - DNA, 20 bp, human
gctcgacagaggcacgtgac

SEQ ID NO: 351844 - DNA, 20 bp, human
ggagccaacgagcctcacgc

SEQ ID NO: 351845 - DNA, 20 bp, human
gtactgaaggcccagcatat

SEQ ID NO: 351846 - DNA, 20 bp, human
gcggactctgcctttgtggt

SEQ ID NO: 351847 - DNA, 20 bp, human
gggcagagtccgtgccacga

SEQ ID NO: 351848 - DNA, 20 bp, human
gaagctgcgggacggggtgg

SEQ ID NO: 351849 - DNA, 20 bp, human
ggagcccgctagtgggacac

SEQ ID NO: 351850 - DNA, 20 bp, human
gtggctgtatgagtgtgtaa

SEQ ID NO: 351851 - DNA, 20 bp, human
gttgagccaaaagggaggac

SEQ ID NO: 351852 - DNA, 20 bp, human
gtccggtagggcattagtca

SEQ ID NO: 351853 - DNA, 20 bp, human
gttggttcccaagattacat

SEQ ID NO: 351854 - DNA, 20 bp, human
ggccctgactaatgccctac

SEQ ID NO: 351855 - DNA, 20 bp, human
gccacaaagtgggtacgaag

SEQ ID NO: 351856 - DNA, 20 bp, human
gcccgacgcggaagcagacg

SEQ ID NO: 351857 - DNA, 20 bp, human
gcaccagtgacgcagtccca

SEQ ID NO: 351858 - DNA, 20 bp, human
gcaagcgcccaccgatccgg

SEQ ID NO: 351859 - DNA, 20 bp, human
gcagtgacgcagtcccaggg

SEQ ID NO: 351860 - DNA, 20 bp, human
ggggactcagccactctgac

SEQ ID NO: 351861 - DNA, 20 bp, human
gcggcccccctcactcctag

SEQ ID NO: 351862 - DNA, 20 bp, human
gtcggtgggcgcttgcggaa

SEQ ID NO: 351863 - DNA, 20 bp, human
gcggaaggggacccggctca

SEQ ID NO: 351864 - DNA, 20 bp, human
gcccgcagcctccggatcgg

SEQ ID NO: 351865 - DNA, 20 bp, human
gagggccccgagcccgtcag

SEQ ID NO: 351866 - DNA, 20 bp, human
gggttcccggggctacgagg

SEQ ID NO: 351867 - DNA, 20 bp, human
ggctcctaagcacgtgaccc

SEQ ID NO: 351868 - DNA, 20 bp, human
ggagagggaggacccgtcac

SEQ ID NO: 351869 - DNA, 20 bp, human
gttgtcgctagtggccgctg

SEQ ID NO: 351870 - DNA, 20 bp, human
gtccggttcccggggctacg

SEQ ID NO: 351871 - DNA, 20 bp, human
gtgccccgggtcacgtgctt

SEQ ID NO: 351872 - DNA, 20 bp, human
ggacggatttccggttcccg

SEQ ID NO: 351873 - DNA, 20 bp, human
ggcggccactagcgacaata

SEQ ID NO: 351874 - DNA, 20 bp, human
gaccggaaatccgtctgccc

SEQ ID NO: 351875 - DNA, 20 bp, human
gtgggaggggtgtgctagag

SEQ ID NO: 351876 - DNA, 20 bp, human
gggcccgcgccggatcaggg

SEQ ID NO: 351877 - DNA, 20 bp, human
ggcaccgcccagctccacta

SEQ ID NO: 351878 - DNA, 20 bp, human
gcgcgggcaccgccctgatc

SEQ ID NO: 351879 - DNA, 20 bp, human
gatccggcgcgggccaatag

SEQ ID NO: 351880 - DNA, 20 bp, human
gcaccgccctgatccggcgc

SEQ ID NO: 351881 - DNA, 20 bp, human
gcggctggagggaacgcggg

SEQ ID NO: 351882 - DNA, 20 bp, human
gaccaatggcagcgcggctt

SEQ ID NO: 351883 - DNA, 20 bp, human
gggcttccgctgaagctggg

SEQ ID NO: 351884 - DNA, 20 bp, human
gcttcagcggaagccaatgg

SEQ ID NO: 351885 - DNA, 20 bp, human
gcagccgcgcgctgttgcca

SEQ ID NO: 351886 - DNA, 20 bp, human
gaactgggctagggactgga

SEQ ID NO: 351887 - DNA, 20 bp, human
ggcccgggcgaactgggcta

SEQ ID NO: 351888 - DNA, 20 bp, human
gggactggagggctcggagg

SEQ ID NO: 351889 - DNA, 20 bp, human
gcatcttagagcagggtcta

SEQ ID NO: 351890 - DNA, 20 bp, human
ggccccgctcgcgcgcccat

SEQ ID NO: 351891 - DNA, 20 bp, human
ggcaacaagatcgcggggag

SEQ ID NO: 351892 - DNA, 20 bp, human
ggggcgggcccgggcgaact

SEQ ID NO: 351893 - DNA, 20 bp, human
gaccaatgggcgcgcgagcg

SEQ ID NO: 351894 - DNA, 20 bp, human
gggagccacgtcgccagctg

SEQ ID NO: 351895 - DNA, 20 bp, human
gagctggggtggtgggcgcg

SEQ ID NO: 351896 - DNA, 20 bp, human
gaggaggaggcctatatggc

SEQ ID NO: 351897 - DNA, 20 bp, human
gcgccgcgctgcccaatcag

SEQ ID NO: 351898 - DNA, 20 bp, human
ggggggccggtccaccaatg

SEQ ID NO: 351899 - DNA, 20 bp, human
ggcggtgcgacgtacgttga

SEQ ID NO: 351900 - DNA, 20 bp, human
gcactccgcgccggccatat

SEQ ID NO: 351901 - DNA, 20 bp, human
gcggcccccagcccgtccat

SEQ ID NO: 351902 - DNA, 20 bp, human
gcatgctgggactgcagaga

SEQ ID NO: 351903 - DNA, 20 bp, human
gcgcctccgcaccgcattgg

SEQ ID NO: 351904 - DNA, 20 bp, human
ggtgccccgccactccgcgc

SEQ ID NO: 351905 - DNA, 20 bp, human
gccaggccgcgccgctgatt

SEQ ID NO: 351906 - DNA, 20 bp, human
gcggcctgcccggggaagaa

SEQ ID NO: 351907 - DNA, 20 bp, human
ggcggggccaatgagtgcac

SEQ ID NO: 351908 - DNA, 20 bp, human
gcacgagcgtctcacggggc

SEQ ID NO: 351909 - DNA, 20 bp, human
gcggcaccccgtgcactcat

SEQ ID NO: 351910 - DNA, 20 bp, human
gagctcgcacgagcgtctca

SEQ ID NO: 351911 - DNA, 20 bp, human
ggtcgcccacccttcttccc

SEQ ID NO: 351912 - DNA, 20 bp, human
gactggagagcggccgaatt

SEQ ID NO: 351913 - DNA, 20 bp, human
gaagctggataacagggtaa

SEQ ID NO: 351914 - DNA, 20 bp, human
gctcgtgcgagctcattggg

SEQ ID NO: 351915 - DNA, 20 bp, human
gacgtccacaaaggaaaccg

SEQ ID NO: 351916 - DNA, 20 bp, human
ggagccatctcgcgtcagtt

SEQ ID NO: 351917 - DNA, 20 bp, human
gcgcgcccgtccgtccgggg

SEQ ID NO: 351918 - DNA, 20 bp, human
ggcctggagagatggatcat

SEQ ID NO: 351919 - DNA, 20 bp, human
gcagcccaactgacgcgaga

SEQ ID NO: 351920 - DNA, 20 bp, human
gtggacagccagcggcagcg

SEQ ID NO: 351921 - DNA, 20 bp, human
ggagccaaccccgctgccgc

SEQ ID NO: 351922 - DNA, 20 bp, human
gtccgcgcgcccgtccgtcc

SEQ ID NO: 351923 - DNA, 20 bp, human
gcagccagcggcagcggggt

SEQ ID NO: 351924 - DNA, 20 bp, human
ggagatggatcatggggcgt

SEQ ID NO: 351925 - DNA, 20 bp, human
ggcccgccgtacgtggtttg

SEQ ID NO: 351926 - DNA, 20 bp, human
gctggcggaggcatcggctg

SEQ ID NO: 351927 - DNA, 20 bp, human
ggcaagcggcatcccgagcg

SEQ ID NO: 351928 - DNA, 20 bp, human
ggccggggccagacctccag

SEQ ID NO: 351929 - DNA, 20 bp, human
gtgggagcccagggacgcga

SEQ ID NO: 351930 - DNA, 20 bp, human
gcgggacgcgcgccccacca

SEQ ID NO: 351931 - DNA, 20 bp, human
gtcctgatcccaccccctgg

SEQ ID NO: 351932 - DNA, 20 bp, human
gtgacccctggctactcctg

SEQ ID NO: 351933 - DNA, 20 bp, human
gctcccccaggggcaagtct

SEQ ID NO: 351934 - DNA, 20 bp, human
gccagctgaacatctggccc

SEQ ID NO: 351935 - DNA, 20 bp, human
gggggtgctgaggccgcagc

SEQ ID NO: 351936 - DNA, 20 bp, human
gcggagcggagtgataccgg

SEQ ID NO: 351937 - DNA, 20 bp, human
ggggcgggagatgcacacga

SEQ ID NO: 351938 - DNA, 20 bp, human
gctgcggagcggagtgatac

SEQ ID NO: 351939 - DNA, 20 bp, human
gccgctccgcagggaggttc

SEQ ID NO: 351940 - DNA, 20 bp, human
gccgagcggcggccacgcct

SEQ ID NO: 351941 - DNA, 20 bp, human
gagcggagtgataccggcgg

SEQ ID NO: 351942 - DNA, 20 bp, human
gaggaagaaagcccgagcgg

SEQ ID NO: 351943 - DNA, 20 bp, human
ggccccccccctctgcggac

SEQ ID NO: 351944 - DNA, 20 bp, human
gcgttccttccgcccagaga

SEQ ID NO: 351945 - DNA, 20 bp, human
ggcggggaaaccccgctcgc

SEQ ID NO: 351946 - DNA, 20 bp, human
gaactggccacggccgggag

SEQ ID NO: 351947 - DNA, 20 bp, human
gtctgaagcctcggtcagaa

SEQ ID NO: 351948 - DNA, 20 bp, human
gactccatgtgcccaaacat

SEQ ID NO: 351949 - DNA, 20 bp, human
gggagggaggccgacgatca

SEQ ID NO: 351950 - DNA, 20 bp, human
ggctgcccatccccatgttt

SEQ ID NO: 351951 - DNA, 20 bp, human
gctgcgcgagagaacgagga

SEQ ID NO: 351952 - DNA, 20 bp, human
gaaagaaggcgcattaaggg

SEQ ID NO: 351953 - DNA, 20 bp, human
gcagggcaggactcaagagc

SEQ ID NO: 351954 - DNA, 20 bp, human
gtcttgagtcctgccctggg

SEQ ID NO: 351955 - DNA, 20 bp, human
ggaccactctaattcttgaa

SEQ ID NO: 351956 - DNA, 20 bp, human
ggcaggcaggcaattcatct

SEQ ID NO: 351957 - DNA, 20 bp, human
gggaacatggctgctgttag

SEQ ID NO: 351958 - DNA, 20 bp, human
gcaattcatctcggcctccc

SEQ ID NO: 351959 - DNA, 20 bp, human
gcccgggacgatactagaac

SEQ ID NO: 351960 - DNA, 20 bp, human
gttaatctcactagggttct

SEQ ID NO: 351961 - DNA, 20 bp, human
ggcagcgtgccgatgatggt

SEQ ID NO: 351962 - DNA, 20 bp, human
gaactctgagcatctcgggg

SEQ ID NO: 351963 - DNA, 20 bp, human
ggcacaacccccaccatcat

SEQ ID NO: 351964 - DNA, 20 bp, human
gtgggtgggtgggacgtgcg

SEQ ID NO: 351965 - DNA, 20 bp, human
gtcctgttctagtatcgtcc

SEQ ID NO: 351966 - DNA, 20 bp, human
ggagcagcattatctgtaga

SEQ ID NO: 351967 - DNA, 20 bp, human
gccaacagcaggtacaccta

SEQ ID NO: 351968 - DNA, 20 bp, human
ggcattatctgtagagggag

SEQ ID NO: 351969 - DNA, 20 bp, human
gcctgggcctgggtcgcctc

SEQ ID NO: 351970 - DNA, 20 bp, human
gaggcttaggtgggtctcca

SEQ ID NO: 351971 - DNA, 20 bp, human
gcaaaagcctgaggcgaccc

SEQ ID NO: 351972 - DNA, 20 bp, human
gaagtgctccctcactgcct

SEQ ID NO: 351973 - DNA, 20 bp, human
gtacagggaaggggtgattc

SEQ ID NO: 351974 - DNA, 20 bp, human
ggctccaggcaaagaggctt

SEQ ID NO: 351975 - DNA, 20 bp, human
gccgcctccatggttcatca

SEQ ID NO: 351976 - DNA, 20 bp, human
gtgtcccctctagtgaaaac

SEQ ID NO: 351977 - DNA, 20 bp, human
gcagtgacccggcttccaaa

SEQ ID NO: 351978 - DNA, 20 bp, human
gctgaagaataaaagcaacg

SEQ ID NO: 351979 - DNA, 20 bp, human
gggttgtcagggaaaaatag

SEQ ID NO: 351980 - DNA, 20 bp, human
gctttgctgtgcatagctgt

SEQ ID NO: 351981 - DNA, 20 bp, human
gttcaggccatttggaagcc

SEQ ID NO: 351982 - DNA, 20 bp, human
ggctatttttagagctctac

SEQ ID NO: 351983 - DNA, 20 bp, human
ggcttaactttcaggccatt

SEQ ID NO: 351984 - DNA, 20 bp, human
gaaggcagtaattggttgtc

SEQ ID NO: 351985 - DNA, 20 bp, human
gattcttcagcttaactttc

SEQ ID NO: 351986 - DNA, 20 bp, human
ggcgaagggaggtgcgagga

SEQ ID NO: 351987 - DNA, 20 bp, human
gtgagaggggctacccggct

SEQ ID NO: 351988 - DNA, 20 bp, human
gccaggacaccccacgggag

SEQ ID NO: 351989 - DNA, 20 bp, human
ggggcgtgagctgcgaaggg

SEQ ID NO: 351990 - DNA, 20 bp, human
gagggggcgtgagctgcgaa

SEQ ID NO: 351991 - DNA, 20 bp, human
gccagcccgccagccgtccg

SEQ ID NO: 351992 - DNA, 20 bp, human
gcggccacggccgtgtgaga

SEQ ID NO: 351993 - DNA, 20 bp, human
gccgtgtgagaggggctacc

SEQ ID NO: 351994 - DNA, 20 bp, human
gagcccctctcacacggccg

SEQ ID NO: 351995 - DNA, 20 bp, human
ggctacccggctcggctccg

SEQ ID NO: 351996 - DNA, 20 bp, human
gctcccacgtagccagcctg

SEQ ID NO: 351997 - DNA, 20 bp, human
ggctaatccccaaccatcta

SEQ ID NO: 351998 - DNA, 20 bp, human
gcccaaccatctagggctta

SEQ ID NO: 351999 - DNA, 20 bp, human
gagcctcaggctggctacgt

SEQ ID NO: 352000 - DNA, 20 bp, human
ggccctaagccctagatggt

SEQ ID NO: 352001 - DNA, 20 bp, human
ggcccggggagcagaccttc

SEQ ID NO: 352002 - DNA, 20 bp, human
ggctgggtgaatgatcccac

SEQ ID NO: 352003 - DNA, 20 bp, human
gtagaaagagaagccatagt

SEQ ID NO: 352004 - DNA, 20 bp, human
gcaacttctgccagcgttgg

SEQ ID NO: 352005 - DNA, 20 bp, human
ggggctgtcgcaatttgaat

SEQ ID NO: 352006 - DNA, 20 bp, human
ggatgtagtcctggtgggga

SEQ ID NO: 352007 - DNA, 20 bp, human
gaagagaaacaattgaggat

SEQ ID NO: 352008 - DNA, 20 bp, human
gttactggcaaagagaatgt

SEQ ID NO: 352009 - DNA, 20 bp, human
gtgggagatgtagtcctggt

SEQ ID NO: 352010 - DNA, 20 bp, human
gttaagcatcatggggtttg

SEQ ID NO: 352011 - DNA, 20 bp, human
gctgggctctgctcagagtc

SEQ ID NO: 352012 - DNA, 20 bp, human
gcatctgggtgctagtacat

SEQ ID NO: 352013 - DNA, 20 bp, human
gcagaagagcagttaacctt

SEQ ID NO: 352014 - DNA, 20 bp, human
gcactgccccctcctcccta

SEQ ID NO: 352015 - DNA, 20 bp, human
gttgaggatggggggtttag

SEQ ID NO: 352016 - DNA, 20 bp, human
gtgggcccgcgtccggaact

SEQ ID NO: 352017 - DNA, 20 bp, human
gggacgggacctatgagcat

SEQ ID NO: 352018 - DNA, 20 bp, human
gcctgagcgctgtcacagct

SEQ ID NO: 352019 - DNA, 20 bp, human
gtgtgggcgtggctagtccg

SEQ ID NO: 352020 - DNA, 20 bp, human
gggcgtggctagtccggggg

SEQ ID NO: 352021 - DNA, 20 bp, human
ggctcataggtcccgtccct

SEQ ID NO: 352022 - DNA, 20 bp, human
ggctcaggaccgatgctcat

SEQ ID NO: 352023 - DNA, 20 bp, human
ggtccggaactgggctgcga

SEQ ID NO: 352024 - DNA, 20 bp, human
gcacacagagggtcacagtc

SEQ ID NO: 352025 - DNA, 20 bp, human
ggcccctcgcagcccagttc

SEQ ID NO: 352026 - DNA, 20 bp, human
gtaacccgccagcctcccta

SEQ ID NO: 352027 - DNA, 20 bp, human
gggtgcggctgcttcaggta

SEQ ID NO: 352028 - DNA, 20 bp, human
gtggcgggttaaatctgcag

SEQ ID NO: 352029 - DNA, 20 bp, human
gcctgtggaggaaacgaaac

SEQ ID NO: 352030 - DNA, 20 bp, human
ggaacggcgtgactaggagc

SEQ ID NO: 352031 - DNA, 20 bp, human
gggcagaggaaaccttaggg

SEQ ID NO: 352032 - DNA, 20 bp, human
gggaatgcagagaggatttc

SEQ ID NO: 352033 - DNA, 20 bp, human
gggttaaatctgcaggggtg

SEQ ID NO: 352034 - DNA, 20 bp, human
gtgtgagacagtcacgttga

SEQ ID NO: 352035 - DNA, 20 bp, human
ggaggaaacgaaacaggtga

SEQ ID NO: 352036 - DNA, 20 bp, human
gcctcccagcctaatgatgg

SEQ ID NO: 352037 - DNA, 20 bp, human
gacggagggcgcaggaccca

SEQ ID NO: 352038 - DNA, 20 bp, human
gttgcccagcctccatcatt

SEQ ID NO: 352039 - DNA, 20 bp, human
gtagtggcggacttccccat

SEQ ID NO: 352040 - DNA, 20 bp, human
ggccccacgcgcaccgtcag

SEQ ID NO: 352041 - DNA, 20 bp, human
gcagcctaatgatggaggct

SEQ ID NO: 352042 - DNA, 20 bp, human
ggggacttgtagtttccctc

SEQ ID NO: 352043 - DNA, 20 bp, human
gctgggaggagcttccacgg

SEQ ID NO: 352044 - DNA, 20 bp, human
ggctcctcccagcctaatga

SEQ ID NO: 352045 - DNA, 20 bp, human
ggcccctgacggtgcgcgtg

SEQ ID NO: 352046 - DNA, 20 bp, human
gcaggacttgaggtgtgcaa

SEQ ID NO: 352047 - DNA, 20 bp, human
gtaggggcacattgcccagt

SEQ ID NO: 352048 - DNA, 20 bp, human
ggcatgtagtgggcatagca

SEQ ID NO: 352049 - DNA, 20 bp, human
ggacacagcatgcatgtagt

SEQ ID NO: 352050 - DNA, 20 bp, human
gggaccaggagtgttggtat

SEQ ID NO: 352051 - DNA, 20 bp, human
gcagaggggtgtgtttgcca

SEQ ID NO: 352052 - DNA, 20 bp, human
gccctctgctctaagtacag

SEQ ID NO: 352053 - DNA, 20 bp, human
gatgcatgctgtgtccatga

SEQ ID NO: 352054 - DNA, 20 bp, human
gaccgtgccctagttttcag

SEQ ID NO: 352055 - DNA, 20 bp, human
gacatacacagaactcacac

SEQ ID NO: 352056 - DNA, 20 bp, human
gagaaagacagccaaggggt

SEQ ID NO: 352057 - DNA, 20 bp, human
gcatagatggtcaggaaccc

SEQ ID NO: 352058 - DNA, 20 bp, human
gttggagaccatgacataga

SEQ ID NO: 352059 - DNA, 20 bp, human
gttcctgaccatctatgtca

SEQ ID NO: 352060 - DNA, 20 bp, human
gaattcctgggggcacttca

SEQ ID NO: 352061 - DNA, 20 bp, human
ggaccatgacatagatggtc

SEQ ID NO: 352062 - DNA, 20 bp, human
gtgcactgctctgttggtaa

SEQ ID NO: 352063 - DNA, 20 bp, human
ggggggagcctaggcaaatc

SEQ ID NO: 352064 - DNA, 20 bp, human
ggagaagggggaggaatgac

SEQ ID NO: 352065 - DNA, 20 bp, human
ggctactaggaccttctctc

SEQ ID NO: 352066 - DNA, 20 bp, human
ggcaggggatctgtgggagg

SEQ ID NO: 352067 - DNA, 20 bp, human
ggactctgaccattcatcct

SEQ ID NO: 352068 - DNA, 20 bp, human
gagggtcagtccagaattga

SEQ ID NO: 352069 - DNA, 20 bp, human
ggtgatgtctatagtaggtg

SEQ ID NO: 352070 - DNA, 20 bp, human
gccagaattgagggtctccg

SEQ ID NO: 352071 - DNA, 20 bp, human
gcagatgagcccaggatgaa

SEQ ID NO: 352072 - DNA, 20 bp, human
gattgagggtctccggggga

SEQ ID NO: 352073 - DNA, 20 bp, human
gttctggactgaccctgaac

SEQ ID NO: 352074 - DNA, 20 bp, human
gagagtcaggtgctgcccgg

SEQ ID NO: 352075 - DNA, 20 bp, human
ggcagaggctttgccctgca

SEQ ID NO: 352076 - DNA, 20 bp, human
gtagggtaaagtcccaaaat

SEQ ID NO: 352077 - DNA, 20 bp, human
gcccttgcccctcctaccta

SEQ ID NO: 352078 - DNA, 20 bp, human
gctgacaggatggaagggta

SEQ ID NO: 352079 - DNA, 20 bp, human
gtcagaggctggccctaggt

SEQ ID NO: 352080 - DNA, 20 bp, human
ggggatcttgtggctgtgac

SEQ ID NO: 352081 - DNA, 20 bp, human
gaataggctgacaggatgga

SEQ ID NO: 352082 - DNA, 20 bp, human
gaccctaaacatgcattgaa

SEQ ID NO: 352083 - DNA, 20 bp, human
gtaaaaagaggcgcatgcga

SEQ ID NO: 352084 - DNA, 20 bp, human
ggaggcgcatgcgaggggcg

SEQ ID NO: 352085 - DNA, 20 bp, human
gtcactcctgaaggagatta

SEQ ID NO: 352086 - DNA, 20 bp, human
gcgggagcgcccagggaaat

SEQ ID NO: 352087 - DNA, 20 bp, human
ggggccggccaacgcgaggt

SEQ ID NO: 352088 - DNA, 20 bp, human
gtggctccgggcgtggccgg

SEQ ID NO: 352089 - DNA, 20 bp, human
gtggccgggggtcgcggtct

SEQ ID NO: 352090 - DNA, 20 bp, human
gagcccagcgctctctggaa

SEQ ID NO: 352091 - DNA, 20 bp, human
gggaaatagggcgaatgcgc

SEQ ID NO: 352092 - DNA, 20 bp, human
gccggccaacgcgaggtggg

SEQ ID NO: 352093 - DNA, 20 bp, human
gtctggggccggccaacgcg

SEQ ID NO: 352094 - DNA, 20 bp, human
ggggaagaattcctcctctg

SEQ ID NO: 352095 - DNA, 20 bp, human
gcgcgacccccggccacgcc

SEQ ID NO: 352096 - DNA, 20 bp, human
gagaaccggagcccattggt

SEQ ID NO: 352097 - DNA, 20 bp, human
gctggcaacagggtctcccg

SEQ ID NO: 352098 - DNA, 20 bp, human
gaaggggcgcctgttactag

SEQ ID NO: 352099 - DNA, 20 bp, human
ggggatgcgctcattggtca

SEQ ID NO: 352100 - DNA, 20 bp, human
gtggtcggaacacctcacaa

SEQ ID NO: 352101 - DNA, 20 bp, human
ggtgaggtgttccgaccaat

SEQ ID NO: 352102 - DNA, 20 bp, human
gggaggtcgggtcacctcgg

SEQ ID NO: 352103 - DNA, 20 bp, human
ggccgctggggtccattgtg

SEQ ID NO: 352104 - DNA, 20 bp, human
gagggcgcctcaattggtag

SEQ ID NO: 352105 - DNA, 20 bp, human
gcccgacccccgttccccat

SEQ ID NO: 352106 - DNA, 20 bp, human
gtctcccagagtgaagtcag

SEQ ID NO: 352107 - DNA, 20 bp, human
ggggaacgtgccccgtacca

SEQ ID NO: 352108 - DNA, 20 bp, human
gcgcccggccctttggtgac

SEQ ID NO: 352109 - DNA, 20 bp, human
gcagaagccgacacacagtt

SEQ ID NO: 352110 - DNA, 20 bp, human
gttatggcccaactgtgtgt

SEQ ID NO: 352111 - DNA, 20 bp, human
gaacaaagagccctggtacg

SEQ ID NO: 352112 - DNA, 20 bp, human
gggccgcagccagtcaccaa

SEQ ID NO: 352113 - DNA, 20 bp, human
gcttcactctgggagaacgt

SEQ ID NO: 352114 - DNA, 20 bp, human
ggtccaaggccgaaccaaag

SEQ ID NO: 352115 - DNA, 20 bp, human
gactctgggagaacgtgggc

SEQ ID NO: 352116 - DNA, 20 bp, human
gcccttctctaattggtcaa

SEQ ID NO: 352117 - DNA, 20 bp, human
gtctaattggtcaaggggtg

SEQ ID NO: 352118 - DNA, 20 bp, human
gtgaacggaccgacccggaa

SEQ ID NO: 352119 - DNA, 20 bp, human
ggaagggagttatctgtgat

SEQ ID NO: 352120 - DNA, 20 bp, human
gggcctgcgagacagagcta

SEQ ID NO: 352121 - DNA, 20 bp, human
ggaacaacattacgagttat

SEQ ID NO: 352122 - DNA, 20 bp, human
gcgagagccgccacgtcttc

SEQ ID NO: 352123 - DNA, 20 bp, human
gagggctgctgggaccctaa

SEQ ID NO: 352124 - DNA, 20 bp, human
gagatcggagagtcggacac

SEQ ID NO: 352125 - DNA, 20 bp, human
gataggaagcgctcttaaag

SEQ ID NO: 352126 - DNA, 20 bp, human
gcctgggcagccagtccgtc

SEQ ID NO: 352127 - DNA, 20 bp, human
gggaggcgtcaacgtcatcg

SEQ ID NO: 352128 - DNA, 20 bp, human
ggcccgccgcgcatccgcat

SEQ ID NO: 352129 - DNA, 20 bp, human
gagcggcggacggtctaggc

SEQ ID NO: 352130 - DNA, 20 bp, human
gcggacaagcagccaatggg

SEQ ID NO: 352131 - DNA, 20 bp, human
gtgtccgaggcccgacggac

SEQ ID NO: 352132 - DNA, 20 bp, human
gtcccgcgcagccgtcgcgg

SEQ ID NO: 352133 - DNA, 20 bp, human
gcctcggacaagcagccaat

SEQ ID NO: 352134 - DNA, 20 bp, human
gtgacgttgacgcctcccat

SEQ ID NO: 352135 - DNA, 20 bp, human
gtggctgtcggcccccgcga

SEQ ID NO: 352136 - DNA, 20 bp, human
gagtcggcgtcttgagtcat

SEQ ID NO: 352137 - DNA, 20 bp, human
gggcgaggctggaatcgagg

SEQ ID NO: 352138 - DNA, 20 bp, human
ggcggaaaggcaggttcttt

SEQ ID NO: 352139 - DNA, 20 bp, human
gactcaagacgccgacttcc

SEQ ID NO: 352140 - DNA, 20 bp, human
gtattcccacagcccgggcg

SEQ ID NO: 352141 - DNA, 20 bp, human
gcagcctcgccatcagactc

SEQ ID NO: 352142 - DNA, 20 bp, human
gagcgcgagcgctggcatga

SEQ ID NO: 352143 - DNA, 20 bp, human
gaggctggaatcgaggcggt

SEQ ID NO: 352144 - DNA, 20 bp, human
ggacttccgggcggaaaggc

SEQ ID NO: 352145 - DNA, 20 bp, human
gcaagacgccgacttccggg

SEQ ID NO: 352146 - DNA, 20 bp, human
gctggcccccggctgaaggc

SEQ ID NO: 352147 - DNA, 20 bp, human
gggtccctgccctgcaaacg

SEQ ID NO: 352148 - DNA, 20 bp, human
gcgccctggcccccggctga

SEQ ID NO: 352149 - DNA, 20 bp, human
gtaacgcactagctgaatga

SEQ ID NO: 352150 - DNA, 20 bp, human
gtgtctgcacctgtctaggt

SEQ ID NO: 352151 - DNA, 20 bp, human
gggccgctgcagggttcctt

SEQ ID NO: 352152 - DNA, 20 bp, human
ggacagcatcccacctagac

SEQ ID NO: 352153 - DNA, 20 bp, human
gcgcgcccgccttcagccgg

SEQ ID NO: 352154 - DNA, 20 bp, human
gccgctggaacgctgagggt

SEQ ID NO: 352155 - DNA, 20 bp, human
gggacgcgcccgccttcagc

SEQ ID NO: 352156 - DNA, 20 bp, human
ggtggcggctcttaaagggg

SEQ ID NO: 352157 - DNA, 20 bp, human
gggcggtggcggctcttaaa

SEQ ID NO: 352158 - DNA, 20 bp, human
ggcagggcactgagggtcgg

SEQ ID NO: 352159 - DNA, 20 bp, human
gacagcaggtgccggggcgg

SEQ ID NO: 352160 - DNA, 20 bp, human
ggccacagcaggtgccgggg

SEQ ID NO: 352161 - DNA, 20 bp, human
ggtgggcaggggtcgatttc

SEQ ID NO: 352162 - DNA, 20 bp, human
ggcccagcgccgccgttaaa

SEQ ID NO: 352163 - DNA, 20 bp, human
gaagcgattcgaggaaggca

SEQ ID NO: 352164 - DNA, 20 bp, human
gagggtcggaggcgcatgcc

SEQ ID NO: 352165 - DNA, 20 bp, human
ggggacctcccctttaacgg

SEQ ID NO: 352166 - DNA, 20 bp, human
ggccaggcggccgggctcca

SEQ ID NO: 352167 - DNA, 20 bp, human
gcagcgaggccgtccagcgc

SEQ ID NO: 352168 - DNA, 20 bp, human
gcctgcgctccgctgatagg

SEQ ID NO: 352169 - DNA, 20 bp, human
gcgccgccaccgcctatcag

SEQ ID NO: 352170 - DNA, 20 bp, human
ggctgaggaagggtactgga

SEQ ID NO: 352171 - DNA, 20 bp, human
gcgtcccaaagagctaagga

SEQ ID NO: 352172 - DNA, 20 bp, human
gaggccgtccagcgcgggct

SEQ ID NO: 352173 - DNA, 20 bp, human
gccggcccggcagcctagtc

SEQ ID NO: 352174 - DNA, 20 bp, human
ggcggggtgctgtccggact

SEQ ID NO: 352175 - DNA, 20 bp, human
ggcgctccgctgataggcgg

SEQ ID NO: 352176 - DNA, 20 bp, human
gagaggccggccccttaaag

SEQ ID NO: 352177 - DNA, 20 bp, human
gtgggaaggtggctccactg

SEQ ID NO: 352178 - DNA, 20 bp, human
ggcgcagtgtagccccggag

SEQ ID NO: 352179 - DNA, 20 bp, human
gggcacatcgcccctttaag

SEQ ID NO: 352180 - DNA, 20 bp, human
gtaaaggggcgatgtgccgc

SEQ ID NO: 352181 - DNA, 20 bp, human
ggtggagccaccttcccaat

SEQ ID NO: 352182 - DNA, 20 bp, human
gtcgcgcgtggggcccacag

SEQ ID NO: 352183 - DNA, 20 bp, human
gtgccgcgggactcgcgcgt

SEQ ID NO: 352184 - DNA, 20 bp, human
ggggctccggcttgccacgc

SEQ ID NO: 352185 - DNA, 20 bp, human
gcgagtgctgcccaacccca

SEQ ID NO: 352186 - DNA, 20 bp, human
ggggcgggcctgcaactccg

SEQ ID NO: 352187 - DNA, 20 bp, human
gctcccccgcccagcgccag

SEQ ID NO: 352188 - DNA, 20 bp, human
gacagcgccacaccctggcg

SEQ ID NO: 352189 - DNA, 20 bp, human
gcaactccgcggacgctgcg

SEQ ID NO: 352190 - DNA, 20 bp, human
gggcgagcggaggcgagtgg

SEQ ID NO: 352191 - DNA, 20 bp, human
gggccacctcgcagcgtccg

SEQ ID NO: 352192 - DNA, 20 bp, human
gtaaaaaggatgtggcgtgg

SEQ ID NO: 352193 - DNA, 20 bp, human
gggcgactgcggcggagcag

SEQ ID NO: 352194 - DNA, 20 bp, human
gaacccattgcggggtaaaa

SEQ ID NO: 352195 - DNA, 20 bp, human
ggcgctgtccccctggcgct

SEQ ID NO: 352196 - DNA, 20 bp, human
ggtggcggagggctatgcgg

SEQ ID NO: 352197 - DNA, 20 bp, human
ggaggcagggcggaatggta

SEQ ID NO: 352198 - DNA, 20 bp, human
gagggcgaggagaggcgtgg

SEQ ID NO: 352199 - DNA, 20 bp, human
gggaacggggcgaggcttat

SEQ ID NO: 352200 - DNA, 20 bp, human
ggcggggctgatcacaaagg

SEQ ID NO: 352201 - DNA, 20 bp, human
gaagggcggtgtcagaggat

SEQ ID NO: 352202 - DNA, 20 bp, human
gccctctcccggcggggtct

SEQ ID NO: 352203 - DNA, 20 bp, human
gattggaagggcggtgtcag

SEQ ID NO: 352204 - DNA, 20 bp, human
ggccccccgctaggaccaat

SEQ ID NO: 352205 - DNA, 20 bp, human
gaggccgggctgattctcga

SEQ ID NO: 352206 - DNA, 20 bp, human
gggggcaagcggtgagtttt

SEQ ID NO: 352207 - DNA, 20 bp, human
gcacaactcaggtccccttc

SEQ ID NO: 352208 - DNA, 20 bp, human
gcccagtgtgtgccgggaaa

SEQ ID NO: 352209 - DNA, 20 bp, human
ggctcctctctgggttatta

SEQ ID NO: 352210 - DNA, 20 bp, human
gctgggagtggtcacaactc

SEQ ID NO: 352211 - DNA, 20 bp, human
gcccatgcctgacaccaaag

SEQ ID NO: 352212 - DNA, 20 bp, human
gctctcaagacctacctcaa

SEQ ID NO: 352213 - DNA, 20 bp, human
ggaccactcccagtgtgtgc

SEQ ID NO: 352214 - DNA, 20 bp, human
gaccagtacgagccttttcc

SEQ ID NO: 352215 - DNA, 20 bp, human
ggccgggaaaaggctcgtac

SEQ ID NO: 352216 - DNA, 20 bp, human
gtcctggcacacattaggag

SEQ ID NO: 352217 - DNA, 20 bp, human
gggacacctggatgctgcag

SEQ ID NO: 352218 - DNA, 20 bp, human
gggatcagaaggcctacaga

SEQ ID NO: 352219 - DNA, 20 bp, human
ggccatgggaactggacacc

SEQ ID NO: 352220 - DNA, 20 bp, human
gagtaagagattctggcatc

SEQ ID NO: 352221 - DNA, 20 bp, human
gacaccttgccttctgaagt

SEQ ID NO: 352222 - DNA, 20 bp, human
gttaaagccaccagctaatt

SEQ ID NO: 352223 - DNA, 20 bp, human
gatcaggaatagcttattcc

SEQ ID NO: 352224 - DNA, 20 bp, human
gataaacaatgggtggagca

SEQ ID NO: 352225 - DNA, 20 bp, human
gacatcaacttaccacaaac

SEQ ID NO: 352226 - DNA, 20 bp, human
gggacagttgaggacataga

SEQ ID NO: 352227 - DNA, 20 bp, human
gaagctaagagtaggagtga

SEQ ID NO: 352228 - DNA, 20 bp, human
ggcaaacttcacctcttcct

SEQ ID NO: 352229 - DNA, 20 bp, human
gggatctgggggagggacat

SEQ ID NO: 352230 - DNA, 20 bp, human
gaaagaggagttcctctggt

SEQ ID NO: 352231 - DNA, 20 bp, human
gaaaatccccagtctttgcc

SEQ ID NO: 352232 - DNA, 20 bp, human
gaaagtgttggcctgccaac

SEQ ID NO: 352233 - DNA, 20 bp, human
gtggcctgccaacaggaaag

SEQ ID NO: 352234 - DNA, 20 bp, human
ggtgaagagtgacaatgagt

SEQ ID NO: 352235 - DNA, 20 bp, human
gtctgaaagaggagttcctc

SEQ ID NO: 352236 - DNA, 20 bp, human
ggcaaacttcaactgtttgt

SEQ ID NO: 352237 - DNA, 20 bp, human
gcgggacaggggtcatggag

SEQ ID NO: 352238 - DNA, 20 bp, human
gcggcctgctacagagaaaa

SEQ ID NO: 352239 - DNA, 20 bp, human
ggcaatatgtaggcgggaca

SEQ ID NO: 352240 - DNA, 20 bp, human
ggccaggagctcacttctat

SEQ ID NO: 352241 - DNA, 20 bp, human
gagatctcagggatggtcac

SEQ ID NO: 352242 - DNA, 20 bp, human
gaataacggcaatatgtagg

SEQ ID NO: 352243 - DNA, 20 bp, human
gaaaagattatgccaagggg

SEQ ID NO: 352244 - DNA, 20 bp, human
gtggtcactggagtgaataa

SEQ ID NO: 352245 - DNA, 20 bp, human
gaggaagagtctcctcccct

SEQ ID NO: 352246 - DNA, 20 bp, human
gcggcttcagaatgtacgta

SEQ ID NO: 352247 - DNA, 20 bp, human
gaggtgtgctttgactagcc

SEQ ID NO: 352248 - DNA, 20 bp, human
gccatgaaaaagtaacataa

SEQ ID NO: 352249 - DNA, 20 bp, human
gtgggcttataacagattac

SEQ ID NO: 352250 - DNA, 20 bp, human
gtagataagacttttatgga

SEQ ID NO: 352251 - DNA, 20 bp, human
gcagggagaggttcttttcc

SEQ ID NO: 352252 - DNA, 20 bp, human
gaaggaaatccaccatacca

SEQ ID NO: 352253 - DNA, 20 bp, human
gcatgttgaaggagtggagt

SEQ ID NO: 352254 - DNA, 20 bp, human
gggaaggaaaatctgtgtgt

SEQ ID NO: 352255 - DNA, 20 bp, human
ggaataggttatgacccatg

SEQ ID NO: 352256 - DNA, 20 bp, human
gcgcccacgcctccgggtga

SEQ ID NO: 352257 - DNA, 20 bp, human
gcgtgggcggggcgacctcg

SEQ ID NO: 352258 - DNA, 20 bp, human
gcgacgcagcaaccctcacc

SEQ ID NO: 352259 - DNA, 20 bp, human
gaaccctcacccggaggcgt

SEQ ID NO: 352260 - DNA, 20 bp, human
ggcgccgggggcgtatgcgt

SEQ ID NO: 352261 - DNA, 20 bp, human
ggggagcgggagcttggggt

SEQ ID NO: 352262 - DNA, 20 bp, human
gcgcagcaaccctcacccgg

SEQ ID NO: 352263 - DNA, 20 bp, human
gctgctgcggcggctggctt

SEQ ID NO: 352264 - DNA, 20 bp, human
ggcgggaggggaatttcccg

SEQ ID NO: 352265 - DNA, 20 bp, human
ggcccccacgcatacgcccc

SEQ ID NO: 352266 - DNA, 20 bp, human
gtggccccgacccccggcag

SEQ ID NO: 352267 - DNA, 20 bp, human
gtcgccgaggacgaagaggc

SEQ ID NO: 352268 - DNA, 20 bp, human
gccaagtgcgcgcctcgccg

SEQ ID NO: 352269 - DNA, 20 bp, human
gaagaggctggcgtgcccgg

SEQ ID NO: 352270 - DNA, 20 bp, human
gacgccagcctcttcgtcct

SEQ ID NO: 352271 - DNA, 20 bp, human
gcgcacttggccccgacccc

SEQ ID NO: 352272 - DNA, 20 bp, human
gacgaagaggctggcgtgcc

SEQ ID NO: 352273 - DNA, 20 bp, human
gggagcaagtgcacgccgcg

SEQ ID NO: 352274 - DNA, 20 bp, human
gcggacccaccctccaggcg

SEQ ID NO: 352275 - DNA, 20 bp, human
ggcaagtgcacgccgcgcgg

SEQ ID NO: 352276 - DNA, 20 bp, human
ggcggggcggcggaattccc

SEQ ID NO: 352277 - DNA, 20 bp, human
gtgggcgctcaggaggggtt

SEQ ID NO: 352278 - DNA, 20 bp, human
ggctctggacgagacaactg

SEQ ID NO: 352279 - DNA, 20 bp, human
ggaggctgggcgctcaggag

SEQ ID NO: 352280 - DNA, 20 bp, human
gtgacgtcacgcctggggaa

SEQ ID NO: 352281 - DNA, 20 bp, human
gcccacgcgtcacgtgatcg

SEQ ID NO: 352282 - DNA, 20 bp, human
gacggcggggtgcagaccaa

SEQ ID NO: 352283 - DNA, 20 bp, human
gcaggcgtgacgtcacggcg

SEQ ID NO: 352284 - DNA, 20 bp, human
ggcgtcgctgcccattgctc

SEQ ID NO: 352285 - DNA, 20 bp, human
gcgccggcctgcgcgcccat

SEQ ID NO: 352286 - DNA, 20 bp, human
gccggcacgaggtccactca

SEQ ID NO: 352287 - DNA, 20 bp, human
gaaaggaagcgggaatggca

SEQ ID NO: 352288 - DNA, 20 bp, human
ggagaggcgggatcaggctg

SEQ ID NO: 352289 - DNA, 20 bp, human
gggcggggccaagctgaggt

SEQ ID NO: 352290 - DNA, 20 bp, human
ggagaaagagggcgtgtcca

SEQ ID NO: 352291 - DNA, 20 bp, human
gccccggactccacctaaga

SEQ ID NO: 352292 - DNA, 20 bp, human
gtccggggctcggtagggag

SEQ ID NO: 352293 - DNA, 20 bp, human
gaaggcacgtggcccatcca

SEQ ID NO: 352294 - DNA, 20 bp, human
gtggcctagctacgccgctg

SEQ ID NO: 352295 - DNA, 20 bp, human
gtgaggtgggcggggagtcg

SEQ ID NO: 352296 - DNA, 20 bp, human
gaggcggggttgcaactcca

SEQ ID NO: 352297 - DNA, 20 bp, human
gaggggcggagctcccctgg

SEQ ID NO: 352298 - DNA, 20 bp, human
gtcagctctcccggtatctg

SEQ ID NO: 352299 - DNA, 20 bp, human
gagcacgcacggccggggag

SEQ ID NO: 352300 - DNA, 20 bp, human
ggcgaggggcggagctcccc

SEQ ID NO: 352301 - DNA, 20 bp, human
gccaggcgatggggcttcat

SEQ ID NO: 352302 - DNA, 20 bp, human
gacgtcggggtcgtagaaat

SEQ ID NO: 352303 - DNA, 20 bp, human
gacgtgggcaacttccacta

SEQ ID NO: 352304 - DNA, 20 bp, human
gtgctgcgcaagcacgtagc

SEQ ID NO: 352305 - DNA, 20 bp, human
ggagctgtggccgtagggat

SEQ ID NO: 352306 - DNA, 20 bp, human
gggcgcccggggctttaaga

SEQ ID NO: 352307 - DNA, 20 bp, human
gcacgcgtccccggagtccc

SEQ ID NO: 352308 - DNA, 20 bp, human
gccgccgagccagcccgaga

SEQ ID NO: 352309 - DNA, 20 bp, human
gcgaggggcgcacgcgtccc

SEQ ID NO: 352310 - DNA, 20 bp, human
gcgcccggttcgcacccggg

SEQ ID NO: 352311 - DNA, 20 bp, human
gggagcggccgggacacgtg

SEQ ID NO: 352312 - DNA, 20 bp, human
ggcgaaccgggcgctggccg

SEQ ID NO: 352313 - DNA, 20 bp, human
gggctcggcggcacctcgcg

SEQ ID NO: 352314 - DNA, 20 bp, human
gcgagccagcccgagagggc

SEQ ID NO: 352315 - DNA, 20 bp, human
gtccccgtcccgctccccgg

SEQ ID NO: 352316 - DNA, 20 bp, human
gttcccaggggcgcgagaga

SEQ ID NO: 352317 - DNA, 20 bp, human
ggtagagcagcaccgcccag

SEQ ID NO: 352318 - DNA, 20 bp, human
ggcaccgcccagcggcagag

SEQ ID NO: 352319 - DNA, 20 bp, human
ggaccgcgctctgacgtcgg

SEQ ID NO: 352320 - DNA, 20 bp, human
gggctcgccgctctgccgct

SEQ ID NO: 352321 - DNA, 20 bp, human
gctcaccccgagccgcggag

SEQ ID NO: 352322 - DNA, 20 bp, human
ggctcggggtgagtcgggcg

SEQ ID NO: 352323 - DNA, 20 bp, human
gtcgccgctctgccgctggg

SEQ ID NO: 352324 - DNA, 20 bp, human
gttgaagaggcggatacaag

SEQ ID NO: 352325 - DNA, 20 bp, human
gactgggcggcggtgcccag

SEQ ID NO: 352326 - DNA, 20 bp, human
gtgagggtggcagacgagaa

SEQ ID NO: 352327 - DNA, 20 bp, human
gcctacgcaccgggtgaggg

SEQ ID NO: 352328 - DNA, 20 bp, human
gaccccggggctgccctaat

SEQ ID NO: 352329 - DNA, 20 bp, human
gagccctacgcaccgggtga

SEQ ID NO: 352330 - DNA, 20 bp, human
gcatctgtccactccatcaa

SEQ ID NO: 352331 - DNA, 20 bp, human
gtgttagtgcatccccttga

SEQ ID NO: 352332 - DNA, 20 bp, human
gcggggctgccctaatgggg

SEQ ID NO: 352333 - DNA, 20 bp, human
gtctgccagccctacgcacc

SEQ ID NO: 352334 - DNA, 20 bp, human
gggtggcagacgagaaagga

SEQ ID NO: 352335 - DNA, 20 bp, human
gaggtcccgccttccaagag

SEQ ID NO: 352336 - DNA, 20 bp, human
gtcaaggggcagaacagaca

SEQ ID NO: 352337 - DNA, 20 bp, human
gaatgagcagtgatgtcagc

SEQ ID NO: 352338 - DNA, 20 bp, human
gcccaggtgtctagggggga

SEQ ID NO: 352339 - DNA, 20 bp, human
gtgtgacctcatcagggggt

SEQ ID NO: 352340 - DNA, 20 bp, human
gggggggggtggtatttaaa

SEQ ID NO: 352341 - DNA, 20 bp, human
ggcatgtgtgacctcatcag

SEQ ID NO: 352342 - DNA, 20 bp, human
gtgggctagacactgggcta

SEQ ID NO: 352343 - DNA, 20 bp, human
gaacagacaagggttgcagg

SEQ ID NO: 352344 - DNA, 20 bp, human
gtctttgtgtcgcttctctc

SEQ ID NO: 352345 - DNA, 20 bp, human
gcagaacagacaagggttgc

SEQ ID NO: 352346 - DNA, 20 bp, human
gacagagctaggtgggtgaa

SEQ ID NO: 352347 - DNA, 20 bp, human
ggtacccaggtttccggatg

SEQ ID NO: 352348 - DNA, 20 bp, human
gtaccctggggtagatggca

SEQ ID NO: 352349 - DNA, 20 bp, human
ggctccccatccggaaacct

SEQ ID NO: 352350 - DNA, 20 bp, human
gtaccccagggtaataaatc

SEQ ID NO: 352351 - DNA, 20 bp, human
gctgcgggacagagctaggt

SEQ ID NO: 352352 - DNA, 20 bp, human
gtgaagggtacccaggtttc

SEQ ID NO: 352353 - DNA, 20 bp, human
gagagggctgctagcgtcac

SEQ ID NO: 352354 - DNA, 20 bp, human
gtgccctgccatctacccca

SEQ ID NO: 352355 - DNA, 20 bp, human
gacgctagcagccctctatc

SEQ ID NO: 352356 - DNA, 20 bp, human
ggtcgcggcaggaacaagtg

SEQ ID NO: 352357 - DNA, 20 bp, human
gaaaagctgggatggccgga

SEQ ID NO: 352358 - DNA, 20 bp, human
ggcggcaggaacaagtgcgg

SEQ ID NO: 352359 - DNA, 20 bp, human
gagggactggcccattcgag

SEQ ID NO: 352360 - DNA, 20 bp, human
gcgcgaccctccactcgaat

SEQ ID NO: 352361 - DNA, 20 bp, human
gtacaccaggggccccggca

SEQ ID NO: 352362 - DNA, 20 bp, human
gggggcccctggtgtagggc

SEQ ID NO: 352363 - DNA, 20 bp, human
gccaccccgccctacaccag

SEQ ID NO: 352364 - DNA, 20 bp, human
gcgaatgggccagtccctcc

SEQ ID NO: 352365 - DNA, 20 bp, human
gtcagctgagtgacagtcac

SEQ ID NO: 352366 - DNA, 20 bp, human
gggagccggcgactgaccct

SEQ ID NO: 352367 - DNA, 20 bp, human
gcgggcgcccccgccaagag

SEQ ID NO: 352368 - DNA, 20 bp, human
ggctgccgagggtcagtcgc

SEQ ID NO: 352369 - DNA, 20 bp, human
gtgccccggccgtacctctg

SEQ ID NO: 352370 - DNA, 20 bp, human
gtgacccggcccgctcttgg

SEQ ID NO: 352371 - DNA, 20 bp, human
ggggacgcggcgcccgtcca

SEQ ID NO: 352372 - DNA, 20 bp, human
ggcggcaggcctcggagggt

SEQ ID NO: 352373 - DNA, 20 bp, human
gtgactacaggagctgccga

SEQ ID NO: 352374 - DNA, 20 bp, human
gcccccgccaagagcgggcc

SEQ ID NO: 352375 - DNA, 20 bp, human
gcgaccgcgtggctggccta

SEQ ID NO: 352376 - DNA, 20 bp, human
gcggccgccgctgtcactgt

SEQ ID NO: 352377 - DNA, 20 bp, human
gcgggccggggcactgtaaa

SEQ ID NO: 352378 - DNA, 20 bp, human
ggcaagacccccggaaaggg

SEQ ID NO: 352379 - DNA, 20 bp, human
gtcctcccggcctcacatcc

SEQ ID NO: 352380 - DNA, 20 bp, human
ggagatctccgcgcagaggg

SEQ ID NO: 352381 - DNA, 20 bp, human
ggccggggcactgtaaatgg

SEQ ID NO: 352382 - DNA, 20 bp, human
ggccgggcgccggccaccag

SEQ ID NO: 352383 - DNA, 20 bp, human
gcgctccagacccggatgtg

SEQ ID NO: 352384 - DNA, 20 bp, human
ggggagagagaaacacccac

SEQ ID NO: 352385 - DNA, 20 bp, human
gagagaaacacccaccgggc

SEQ ID NO: 352386 - DNA, 20 bp, human
ggggcaccggagcctgtgac

SEQ ID NO: 352387 - DNA, 20 bp, human
ggcgcgctgggttagttacc

SEQ ID NO: 352388 - DNA, 20 bp, human
gctccgctcccttgcagggt

SEQ ID NO: 352389 - DNA, 20 bp, human
gcgcggcagctgcggggcgt

SEQ ID NO: 352390 - DNA, 20 bp, human
gcaccggagcctgtgacggg

SEQ ID NO: 352391 - DNA, 20 bp, human
gttgcagggtaggcttggaa

SEQ ID NO: 352392 - DNA, 20 bp, human
gtccatgtgccgcgcagctg

SEQ ID NO: 352393 - DNA, 20 bp, human
gaggcacaacattcaagccc

SEQ ID NO: 352394 - DNA, 20 bp, human
gggacaaggcatgggaaatt

SEQ ID NO: 352395 - DNA, 20 bp, human
gtggagagaagctcttttcg

SEQ ID NO: 352396 - DNA, 20 bp, human
gccggcggaagagacgacag

SEQ ID NO: 352397 - DNA, 20 bp, human
gcagacgcgcaggccgttgg

SEQ ID NO: 352398 - DNA, 20 bp, human
gtagccgggcccggagccag

SEQ ID NO: 352399 - DNA, 20 bp, human
gggcccccaagatggcgcga

SEQ ID NO: 352400 - DNA, 20 bp, human
ggcggaagagacgacagcgg

SEQ ID NO: 352401 - DNA, 20 bp, human
gcagcggcggaaacgcgcac

SEQ ID NO: 352402 - DNA, 20 bp, human
gtctgcgccggaagcggaaa

SEQ ID NO: 352403 - DNA, 20 bp, human
gcgcgcaggccgttggcggg

SEQ ID NO: 352404 - DNA, 20 bp, human
gtcgctaagagaaccctcgg

SEQ ID NO: 352405 - DNA, 20 bp, human
gacggcctgcgcgtctgcgc

SEQ ID NO: 352406 - DNA, 20 bp, human
gggtacagcgcggtgtgacg

SEQ ID NO: 352407 - DNA, 20 bp, human
gtcacaccgcgctgtaccaa

SEQ ID NO: 352408 - DNA, 20 bp, human
ggggcgcgatactgcgaggt

SEQ ID NO: 352409 - DNA, 20 bp, human
gcccctccattggtacagcg

SEQ ID NO: 352410 - DNA, 20 bp, human
gaccgcgctgtaccaatgga

SEQ ID NO: 352411 - DNA, 20 bp, human
gcagtatcgcgcccctccat

SEQ ID NO: 352412 - DNA, 20 bp, human
gccgcggcgttgtcaaggct

SEQ ID NO: 352413 - DNA, 20 bp, human
gggggcgcggggggcggtac

SEQ ID NO: 352414 - DNA, 20 bp, human
gcggccgggggcccggccaa

SEQ ID NO: 352415 - DNA, 20 bp, human
gtcctccgcctcccattggc

SEQ ID NO: 352416 - DNA, 20 bp, human
gcctccaggctcccaccgaa

SEQ ID NO: 352417 - DNA, 20 bp, human
gaaaaagggaagcccgtctt

SEQ ID NO: 352418 - DNA, 20 bp, human
gcctgcccctgcccccagta

SEQ ID NO: 352419 - DNA, 20 bp, human
ggaggaaagccgcccttcgg

SEQ ID NO: 352420 - DNA, 20 bp, human
gccaagctcgcaagcctggg

SEQ ID NO: 352421 - DNA, 20 bp, human
gggaaataaccagtgaaaaa

SEQ ID NO: 352422 - DNA, 20 bp, human
gcttcggcgccccctactgg

SEQ ID NO: 352423 - DNA, 20 bp, human
gaacgtgctgcacccaagac

SEQ ID NO: 352424 - DNA, 20 bp, human
ggtaacgcaaggctagtaaa

SEQ ID NO: 352425 - DNA, 20 bp, human
gccaggctcccaccgaaggg

SEQ ID NO: 352426 - DNA, 20 bp, human
gaagaaaccctagcagatat

SEQ ID NO: 352427 - DNA, 20 bp, human
ggttggctggcaggaatatg

SEQ ID NO: 352428 - DNA, 20 bp, human
gtctgagcctatatctgcta

SEQ ID NO: 352429 - DNA, 20 bp, human
gctgagttgaaaactactct

SEQ ID NO: 352430 - DNA, 20 bp, human
gtagaaaatttttagaggat

SEQ ID NO: 352431 - DNA, 20 bp, human
gatacttttttttaggtcct

SEQ ID NO: 352432 - DNA, 20 bp, human
gtcatttagaaaatttttag

SEQ ID NO: 352433 - DNA, 20 bp, human
ggtctctatttttgtgtacc

SEQ ID NO: 352434 - DNA, 20 bp, human
gaaatttactttgattggat

SEQ ID NO: 352435 - DNA, 20 bp, human
gggctggcaggaatatgggg

SEQ ID NO: 352436 - DNA, 20 bp, human
gctaaggctgcagaaacgga

SEQ ID NO: 352437 - DNA, 20 bp, human
gagtacaggcggtggttctt

SEQ ID NO: 352438 - DNA, 20 bp, human
gctaatgcccgaaaggagcc

SEQ ID NO: 352439 - DNA, 20 bp, human
ggacccagctaatgcccgaa

SEQ ID NO: 352440 - DNA, 20 bp, human
ggtgcaagttgtacctactc

SEQ ID NO: 352441 - DNA, 20 bp, human
gggcagggcccgctcacgat

SEQ ID NO: 352442 - DNA, 20 bp, human
gggactgggagtacaggcgg

SEQ ID NO: 352443 - DNA, 20 bp, human
gaattccaagagatgagggt

SEQ ID NO: 352444 - DNA, 20 bp, human
gtgaacagcgatgaaacagt

SEQ ID NO: 352445 - DNA, 20 bp, human
gtaaacagattcggagtcgc

SEQ ID NO: 352446 - DNA, 20 bp, human
gcactccttgcttggtagag

SEQ ID NO: 352447 - DNA, 20 bp, human
ggactggggcactccttgct

SEQ ID NO: 352448 - DNA, 20 bp, human
ggagccgcccgtaatcctcc

SEQ ID NO: 352449 - DNA, 20 bp, human
ggggccgggaggattacggg

SEQ ID NO: 352450 - DNA, 20 bp, human
gtcgcctgggggcgcgtcta

SEQ ID NO: 352451 - DNA, 20 bp, human
gccccaggcgagctggagac

SEQ ID NO: 352452 - DNA, 20 bp, human
ggacgcgcccccaggcgagc

SEQ ID NO: 352453 - DNA, 20 bp, human
gtccccctagacgcgccccc

SEQ ID NO: 352454 - DNA, 20 bp, human
gtccttgcttggtagagggg

SEQ ID NO: 352455 - DNA, 20 bp, human
ggcccgcgcgcgtggccgct

SEQ ID NO: 352456 - DNA, 20 bp, human
gcccgcaggcggaaccgccc

SEQ ID NO: 352457 - DNA, 20 bp, human
gggagcccgacgcctcgcga

SEQ ID NO: 352458 - DNA, 20 bp, human
gcccgccagctccagcggtc

SEQ ID NO: 352459 - DNA, 20 bp, human
ggtcctgccgggcgccgtgg

SEQ ID NO: 352460 - DNA, 20 bp, human
gtggaccccctccccactgg

SEQ ID NO: 352461 - DNA, 20 bp, human
gcgtccggccacccgaccgc

SEQ ID NO: 352462 - DNA, 20 bp, human
ggcctctccctgtcgccgga

SEQ ID NO: 352463 - DNA, 20 bp, human
gggcgccctcgcgaggcgtc

SEQ ID NO: 352464 - DNA, 20 bp, human
ggcccgggcggttccgcctg

SEQ ID NO: 352465 - DNA, 20 bp, human
ggggcgggttgagtcagccc

SEQ ID NO: 352466 - DNA, 20 bp, human
gtgcgccggaggagcgggta

SEQ ID NO: 352467 - DNA, 20 bp, human
gagtgcgggacgcgcggctt

SEQ ID NO: 352468 - DNA, 20 bp, human
gccggaggagcgggtagggg

SEQ ID NO: 352469 - DNA, 20 bp, human
gaccccgcggactcagagaa

SEQ ID NO: 352470 - DNA, 20 bp, human
gcgcgtgtaggagctcagtg

SEQ ID NO: 352471 - DNA, 20 bp, human
ggccggggcgcggcgcgtgt

SEQ ID NO: 352472 - DNA, 20 bp, human
ggagctcagtgcgggacgcg

SEQ ID NO: 352473 - DNA, 20 bp, human
ggcgcggcttgggccgggtg

SEQ ID NO: 352474 - DNA, 20 bp, human
gactgcaagcgggcgcgcac

SEQ ID NO: 352475 - DNA, 20 bp, human
ggctctggctgcgcggggtg

SEQ ID NO: 352476 - DNA, 20 bp, human
ggcaccctgatcaaccagta

SEQ ID NO: 352477 - DNA, 20 bp, human
gcgcccacctggccttgatc

SEQ ID NO: 352478 - DNA, 20 bp, human
gacaaggccactcctgatca

SEQ ID NO: 352479 - DNA, 20 bp, human
gctcctgatcaaggccaggt

SEQ ID NO: 352480 - DNA, 20 bp, human
gatcaggagtggccttgtgt

SEQ ID NO: 352481 - DNA, 20 bp, human
gagtccctactggttgatca

SEQ ID NO: 352482 - DNA, 20 bp, human
ggccactcctgatcaaggcc

SEQ ID NO: 352483 - DNA, 20 bp, human
ggctgcgtcctcactcgtgc

SEQ ID NO: 352484 - DNA, 20 bp, human
ggttgggaagagccaggacc

SEQ ID NO: 352485 - DNA, 20 bp, human
ggagagccagctactggcct

SEQ ID NO: 352486 - DNA, 20 bp, human
gtctctggacatgaagacgg

SEQ ID NO: 352487 - DNA, 20 bp, human
gagcccctgagcagacagta

SEQ ID NO: 352488 - DNA, 20 bp, human
ggtcaggaggtggtgcccca

SEQ ID NO: 352489 - DNA, 20 bp, human
gccacctcctgaccagtctc

SEQ ID NO: 352490 - DNA, 20 bp, human
ggcccctggcattatccctg

SEQ ID NO: 352491 - DNA, 20 bp, human
gcagtctctggacatgaaga

SEQ ID NO: 352492 - DNA, 20 bp, human
gacggaggccctgttggaag

SEQ ID NO: 352493 - DNA, 20 bp, human
gtgccccagggataatgcca

SEQ ID NO: 352494 - DNA, 20 bp, human
gccctccggtcccacatccg

SEQ ID NO: 352495 - DNA, 20 bp, human
gtgtccagagactggtcagg

SEQ ID NO: 352496 - DNA, 20 bp, human
gcccaggtgctagccttatc

SEQ ID NO: 352497 - DNA, 20 bp, human
gtcttcttggcaacccgata

SEQ ID NO: 352498 - DNA, 20 bp, human
gaataccggcagaccacaga

SEQ ID NO: 352499 - DNA, 20 bp, human
gtggcagagatccagagcaa

SEQ ID NO: 352500 - DNA, 20 bp, human
gtcaccaaaacattcagaga

SEQ ID NO: 352501 - DNA, 20 bp, human
gaggtgactgtgataaactt

SEQ ID NO: 352502 - DNA, 20 bp, human
gtcaaagacctgtgccagct

SEQ ID NO: 352503 - DNA, 20 bp, human
gctgtgccagctagggtaac

SEQ ID NO: 352504 - DNA, 20 bp, human
gtgtggtctgccggtattat

SEQ ID NO: 352505 - DNA, 20 bp, human
gcattcagagaaggtctaca

SEQ ID NO: 352506 - DNA, 20 bp, human
gcagcgaagagccaactctc

SEQ ID NO: 352507 - DNA, 20 bp, human
ggaagtacggagagccggga

SEQ ID NO: 352508 - DNA, 20 bp, human
gcgcacagccgcttccgtgc

SEQ ID NO: 352509 - DNA, 20 bp, human
gagcagatgaggcctagccg

SEQ ID NO: 352510 - DNA, 20 bp, human
gggcggagccacagtcctag

SEQ ID NO: 352511 - DNA, 20 bp, human
gaggtgatgattgaccctcc

SEQ ID NO: 352512 - DNA, 20 bp, human
gggctctccgtacttctttt

SEQ ID NO: 352513 - DNA, 20 bp, human
gtcaatcatcacctgagagt

SEQ ID NO: 352514 - DNA, 20 bp, human
gctgggaaatgtagttctcg

SEQ ID NO: 352515 - DNA, 20 bp, human
gaatgtagttctcggggcca

SEQ ID NO: 352516 - DNA, 20 bp, human
gcgccgcggtgctacgcccg

SEQ ID NO: 352517 - DNA, 20 bp, human
gaggcggcgcagtgcgtggg

SEQ ID NO: 352518 - DNA, 20 bp, human
gcggctgcagaacaacaggg

SEQ ID NO: 352519 - DNA, 20 bp, human
gagcgcgcgcggaacgctag

SEQ ID NO: 352520 - DNA, 20 bp, human
ggcaaggggcagcgcctggg

SEQ ID NO: 352521 - DNA, 20 bp, human
gtgaccgggtcgcggctctt

SEQ ID NO: 352522 - DNA, 20 bp, human
gacccggtcaacgaagcgcg

SEQ ID NO: 352523 - DNA, 20 bp, human
gggtgctacgcccgaggctg

SEQ ID NO: 352524 - DNA, 20 bp, human
gccgccttggggctccccag

SEQ ID NO: 352525 - DNA, 20 bp, human
gcagaacaacagggcggggc

SEQ ID NO: 352526 - DNA, 20 bp, human
gagggaggctgcgagtagtg

SEQ ID NO: 352527 - DNA, 20 bp, human
ggaggctgcgagtagtgcgg

SEQ ID NO: 352528 - DNA, 20 bp, human
gtcgccgcgtgcccggggag

SEQ ID NO: 352529 - DNA, 20 bp, human
gggaaaaggagcgagagggc

SEQ ID NO: 352530 - DNA, 20 bp, human
ggctgcgagtagtgcggggg

SEQ ID NO: 352531 - DNA, 20 bp, human
ggggtgtgtgtggcgaaggg

SEQ ID NO: 352532 - DNA, 20 bp, human
gggcgggaaaaggagcgaga

SEQ ID NO: 352533 - DNA, 20 bp, human
gtgggtgaggggcagcggaa

SEQ ID NO: 352534 - DNA, 20 bp, human
gggagggcgggggccgagaa

SEQ ID NO: 352535 - DNA, 20 bp, human
ggtcacggacgcaaccactg

SEQ ID NO: 352536 - DNA, 20 bp, human
gacggccgcgggaggaagta

SEQ ID NO: 352537 - DNA, 20 bp, human
ggacagccctggcgccgcag

SEQ ID NO: 352538 - DNA, 20 bp, human
gccgcgggaggaagtaagga

SEQ ID NO: 352539 - DNA, 20 bp, human
gctgccctgcctgcggtctc

SEQ ID NO: 352540 - DNA, 20 bp, human
gacagccgccgaaggtcggg

SEQ ID NO: 352541 - DNA, 20 bp, human
gctggacgaggagagttctg

SEQ ID NO: 352542 - DNA, 20 bp, human
gagtaatagcgggccccgcg

SEQ ID NO: 352543 - DNA, 20 bp, human
ggggccccgcggggcttttt

SEQ ID NO: 352544 - DNA, 20 bp, human
gctcccggagaccgcaggca

SEQ ID NO: 352545 - DNA, 20 bp, human
ggcgccgctacagccgccga

SEQ ID NO: 352546 - DNA, 20 bp, human
gcaagtcctgggagagaagt

SEQ ID NO: 352547 - DNA, 20 bp, human
gcctgggagagaagtgggtg

SEQ ID NO: 352548 - DNA, 20 bp, human
gttgaacattgcccaagtcc

SEQ ID NO: 352549 - DNA, 20 bp, human
ggggcaatgttcaacacagg

SEQ ID NO: 352550 - DNA, 20 bp, human
gcttgggcaatgttcaacac

SEQ ID NO: 352551 - DNA, 20 bp, human
gctgcgggcaaattgaggaa

SEQ ID NO: 352552 - DNA, 20 bp, human
gggcccagtcctggctccaa

SEQ ID NO: 352553 - DNA, 20 bp, human
gtggagggcgggatccctct

SEQ ID NO: 352554 - DNA, 20 bp, human
gggctccaaggggtgctgtg

SEQ ID NO: 352555 - DNA, 20 bp, human
ggggcccacacagcacccct

SEQ ID NO: 352556 - DNA, 20 bp, human
gtggctgccgaagggaatga

SEQ ID NO: 352557 - DNA, 20 bp, human
ggcctggcttggctgccgaa

SEQ ID NO: 352558 - DNA, 20 bp, human
gcggctcgccctcaacagcc

SEQ ID NO: 352559 - DNA, 20 bp, human
gcgccctcaacagcctggct

SEQ ID NO: 352560 - DNA, 20 bp, human
gagctcgtgcgcctccccgt

SEQ ID NO: 352561 - DNA, 20 bp, human
gagccggcgcaccgtacgct

SEQ ID NO: 352562 - DNA, 20 bp, human
gagcgccggctgcgagactg

SEQ ID NO: 352563 - DNA, 20 bp, human
gacaccagaaaaacacgtgg

SEQ ID NO: 352564 - DNA, 20 bp, human
gcaccgtacgctgggacgtg

SEQ ID NO: 352565 - DNA, 20 bp, human
gccagaaaaacacgtggcgg

SEQ ID NO: 352566 - DNA, 20 bp, human
ggggccgccgccttagccag

SEQ ID NO: 352567 - DNA, 20 bp, human
gacctccccaagatccggga

SEQ ID NO: 352568 - DNA, 20 bp, human
gcggcggcccaagtcccgtg

SEQ ID NO: 352569 - DNA, 20 bp, human
gagagatgcgaacgccggaa

SEQ ID NO: 352570 - DNA, 20 bp, human
gcttgccccagtcaaactcg

SEQ ID NO: 352571 - DNA, 20 bp, human
gcgaacgccggaagggaact

SEQ ID NO: 352572 - DNA, 20 bp, human
gtggttccgcgcagcctggg

SEQ ID NO: 352573 - DNA, 20 bp, human
gcatccccatcccggatctt

SEQ ID NO: 352574 - DNA, 20 bp, human
ggtgtgtgtagcacccggta

SEQ ID NO: 352575 - DNA, 20 bp, human
gggagagacgagcgcttccg

SEQ ID NO: 352576 - DNA, 20 bp, human
ggcgggggcgctaaagtagg

SEQ ID NO: 352577 - DNA, 20 bp, human
ggcgtcgcacctcccgcctc

SEQ ID NO: 352578 - DNA, 20 bp, human
ggcgggccgctgacatcgag

SEQ ID NO: 352579 - DNA, 20 bp, human
ggagaggaaccacggtgctt

SEQ ID NO: 352580 - DNA, 20 bp, human
gctcccgcctctgggcggga

SEQ ID NO: 352581 - DNA, 20 bp, human
gtacctcccggttacacgtc

SEQ ID NO: 352582 - DNA, 20 bp, human
gctgccaaggaaaccaatat

SEQ ID NO: 352583 - DNA, 20 bp, human
gctgacatcgagaggaacca

SEQ ID NO: 352584 - DNA, 20 bp, human
gttggcgggggcgctaaagt

SEQ ID NO: 352585 - DNA, 20 bp, human
gctgccctcggggcagcacc

SEQ ID NO: 352586 - DNA, 20 bp, human
gcaaccgcggcctccagcga

SEQ ID NO: 352587 - DNA, 20 bp, human
ggtgccctggcggccatcgc

SEQ ID NO: 352588 - DNA, 20 bp, human
gccctggcggccatcgctgg

SEQ ID NO: 352589 - DNA, 20 bp, human
gaggtctcccatagcaaccg

SEQ ID NO: 352590 - DNA, 20 bp, human
gtggaggccgcggttgctat

SEQ ID NO: 352591 - DNA, 20 bp, human
gcgagaaagcaggtcgctct

SEQ ID NO: 352592 - DNA, 20 bp, human
gcgcgcccggcggaagccag

SEQ ID NO: 352593 - DNA, 20 bp, human
ggcctccagcgatggccgcc

SEQ ID NO: 352594 - DNA, 20 bp, human
gcgcccggcctgggagcgac

SEQ ID NO: 352595 - DNA, 20 bp, human
ggcgtggcggcgtcaagggg

SEQ ID NO: 352596 - DNA, 20 bp, human
gttggacggaaaggctacgg

SEQ ID NO: 352597 - DNA, 20 bp, human
gattttggacggaaaggcta

SEQ ID NO: 352598 - DNA, 20 bp, human
gccgcgtaaatgattttgga

SEQ ID NO: 352599 - DNA, 20 bp, human
ggtagtgacgtcacgagatt

SEQ ID NO: 352600 - DNA, 20 bp, human
ggaactagagggcatcgacg

SEQ ID NO: 352601 - DNA, 20 bp, human
gaaaggaacggtcttctctg

SEQ ID NO: 352602 - DNA, 20 bp, human
ggtgacgtcactaccggtcg

SEQ ID NO: 352603 - DNA, 20 bp, human
gagtgaacttcagaactaga

SEQ ID NO: 352604 - DNA, 20 bp, human
ggcggccgcgtaaatgattt

SEQ ID NO: 352605 - DNA, 20 bp, human
gaaaacttgtctctgcgttg

SEQ ID NO: 352606 - DNA, 20 bp, human
gaaccctgccggtccaccga

SEQ ID NO: 352607 - DNA, 20 bp, human
gaccctcccggaaggagtag

SEQ ID NO: 352608 - DNA, 20 bp, human
gaagcagcgcgccccagcac

SEQ ID NO: 352609 - DNA, 20 bp, human
gcccgtatacggttttattt

SEQ ID NO: 352610 - DNA, 20 bp, human
ggggagcaatgcaccgggac

SEQ ID NO: 352611 - DNA, 20 bp, human
gggggcgcgctgcttgcgga

SEQ ID NO: 352612 - DNA, 20 bp, human
gccggactttcaggcagaac

SEQ ID NO: 352613 - DNA, 20 bp, human
ggaacggcgggcgaaaagca

SEQ ID NO: 352614 - DNA, 20 bp, human
gacctctactccttccggga

SEQ ID NO: 352615 - DNA, 20 bp, human
gatagcgggctcgggacctt

SEQ ID NO: 352616 - DNA, 20 bp, human
ggacgccctagcaacgcgag

SEQ ID NO: 352617 - DNA, 20 bp, human
gccgccccctcgcgttgcta

SEQ ID NO: 352618 - DNA, 20 bp, human
ggcgtcggttgctaggttac

SEQ ID NO: 352619 - DNA, 20 bp, human
ggctaggttaccggaggcgc

SEQ ID NO: 352620 - DNA, 20 bp, human
gggaggaagtcggaaactgg

SEQ ID NO: 352621 - DNA, 20 bp, human
gtcggttgctaggttaccgg

SEQ ID NO: 352622 - DNA, 20 bp, human
ggagcttggagggacgctgg

SEQ ID NO: 352623 - DNA, 20 bp, human
ggagggaggaagtcggaaac

SEQ ID NO: 352624 - DNA, 20 bp, human
gtgctagggcgtcggttgct

SEQ ID NO: 352625 - DNA, 20 bp, human
gcgatggcaggaattggctt

SEQ ID NO: 352626 - DNA, 20 bp, human
gaccgcctctatggcattgc

SEQ ID NO: 352627 - DNA, 20 bp, human
gcgcgccagcaccttcaaac

SEQ ID NO: 352628 - DNA, 20 bp, human
gccagcaccttcaaactggc

SEQ ID NO: 352629 - DNA, 20 bp, human
ggccggcaatgccatagagg

SEQ ID NO: 352630 - DNA, 20 bp, human
gcgtgcgcggcgcctcgacg

SEQ ID NO: 352631 - DNA, 20 bp, human
gcattgccggcagatgaccc

SEQ ID NO: 352632 - DNA, 20 bp, human
gcccgggggcgggccttctt

SEQ ID NO: 352633 - DNA, 20 bp, human
gtcgaggcgccgcgcacgtc

SEQ ID NO: 352634 - DNA, 20 bp, human
gaatgccatagaggcggtcc

SEQ ID NO: 352635 - DNA, 20 bp, human
gagtatgcctgccagtttga

SEQ ID NO: 352636 - DNA, 20 bp, human
gcggaggcgcgatcccgaga

SEQ ID NO: 352637 - DNA, 20 bp, human
gggcgcctcgctcttctcta

SEQ ID NO: 352638 - DNA, 20 bp, human
gtgagccgtggggccgtagg

SEQ ID NO: 352639 - DNA, 20 bp, human
ggcggagctgaggctcccga

SEQ ID NO: 352640 - DNA, 20 bp, human
ggagctgaggctcccgacgg

SEQ ID NO: 352641 - DNA, 20 bp, human
ggcctcgctcttctctatgg

SEQ ID NO: 352642 - DNA, 20 bp, human
gctcttctctatggtggctc

SEQ ID NO: 352643 - DNA, 20 bp, human
ggggagcctcagctccgcca

SEQ ID NO: 352644 - DNA, 20 bp, human
gcgcccggcggcctcgagcg

SEQ ID NO: 352645 - DNA, 20 bp, human
gccgggctggcctgagccgt

SEQ ID NO: 352646 - DNA, 20 bp, human
ggcggggcggggccatgatg

SEQ ID NO: 352647 - DNA, 20 bp, human
gggctcgaggcgttcggctg

SEQ ID NO: 352648 - DNA, 20 bp, human
ggaggcgttcggctgaggaa

SEQ ID NO: 352649 - DNA, 20 bp, human
gcggggctacggaagccgag

SEQ ID NO: 352650 - DNA, 20 bp, human
gtcacacccggcacttactt

SEQ ID NO: 352651 - DNA, 20 bp, human
gcgaacgcctcgagcccgct

SEQ ID NO: 352652 - DNA, 20 bp, human
ggcggggccatgatggggcg

SEQ ID NO: 352653 - DNA, 20 bp, human
gtaagtgccgggtgtgagcg

SEQ ID NO: 352654 - DNA, 20 bp, human
ggccccaggcgcctaatgtc

SEQ ID NO: 352655 - DNA, 20 bp, human
gtgcagcgggagcttgcggc

SEQ ID NO: 352656 - DNA, 20 bp, human
gggcgtgccgtccacttccg

SEQ ID NO: 352657 - DNA, 20 bp, human
gtcgctgccccggaagtgga

SEQ ID NO: 352658 - DNA, 20 bp, human
ggggccgctgcgttcttaaa

SEQ ID NO: 352659 - DNA, 20 bp, human
gcctgcgccaggagtcggtc

SEQ ID NO: 352660 - DNA, 20 bp, human
gtaaacacctgaaccggcag

SEQ ID NO: 352661 - DNA, 20 bp, human
gtcgcagcgcgcagccacgg

SEQ ID NO: 352662 - DNA, 20 bp, human
gtgcgagcggagaacctggc

SEQ ID NO: 352663 - DNA, 20 bp, human
gtggctgcgcgctgcgatcg

SEQ ID NO: 352664 - DNA, 20 bp, human
gccccgcgccccggaagcga

SEQ ID NO: 352665 - DNA, 20 bp, human
gagcgtgcccgaccgactcc

SEQ ID NO: 352666 - DNA, 20 bp, human
gagatggggtttcacccatc

SEQ ID NO: 352667 - DNA, 20 bp, human
gataagaattaggggctggg

SEQ ID NO: 352668 - DNA, 20 bp, human
gggggtttcacccatcaggc

SEQ ID NO: 352669 - DNA, 20 bp, human
gttgatgaacataagaatta

SEQ ID NO: 352670 - DNA, 20 bp, human
ggaacataagaattaggggc

SEQ ID NO: 352671 - DNA, 20 bp, human
gaaaaaaaaaagagagggac

SEQ ID NO: 352672 - DNA, 20 bp, human
gctcttgctggggttcccct

SEQ ID NO: 352673 - DNA, 20 bp, human
gctggggttcccctaggagg

SEQ ID NO: 352674 - DNA, 20 bp, human
gagttcgagaccagcctgat

SEQ ID NO: 352675 - DNA, 20 bp, human
gggtcatttcacctcctcct

SEQ ID NO: 352676 - DNA, 20 bp, human
gctcgactacatagtctgat

SEQ ID NO: 352677 - DNA, 20 bp, human
ggggcacagagcagctacgc

SEQ ID NO: 352678 - DNA, 20 bp, human
ggtgcccggcttagaggaga

SEQ ID NO: 352679 - DNA, 20 bp, human
ggacgcagatgagcctggaa

SEQ ID NO: 352680 - DNA, 20 bp, human
ggtactgcctgtggcgtggg

SEQ ID NO: 352681 - DNA, 20 bp, human
gcacttgccgcgcatgccag

SEQ ID NO: 352682 - DNA, 20 bp, human
gaggggtggcttgcccttcc

SEQ ID NO: 352683 - DNA, 20 bp, human
gcagcgaggtgagccactgt

SEQ ID NO: 352684 - DNA, 20 bp, human
gtcaagcagccccccaacac

SEQ ID NO: 352685 - DNA, 20 bp, human
ggaccgaggttatgcaagta

SEQ ID NO: 352686 - DNA, 20 bp, human
gaattaggagctgagaggct

SEQ ID NO: 352687 - DNA, 20 bp, human
gataagaattaggagctgag

SEQ ID NO: 352688 - DNA, 20 bp, human
gtcaaatctctgaggacggg

SEQ ID NO: 352689 - DNA, 20 bp, human
gtgagcctgagccagtgacg

SEQ ID NO: 352690 - DNA, 20 bp, human
gggtcatttcaccacctcct

SEQ ID NO: 352691 - DNA, 20 bp, human
ggtactcatggtcttgttct

SEQ ID NO: 352692 - DNA, 20 bp, human
gatgggtgctgccacgtcac

SEQ ID NO: 352693 - DNA, 20 bp, human
gagatggggtttcacccatc

SEQ ID NO: 352694 - DNA, 20 bp, human
gggggtttcacccatcaggc

SEQ ID NO: 352695 - DNA, 20 bp, human
gactgtgctctgagctgagg

SEQ ID NO: 352696 - DNA, 20 bp, human
gccaacccactcccctctgt

SEQ ID NO: 352697 - DNA, 20 bp, human
gactgcccacagaggggagt

SEQ ID NO: 352698 - DNA, 20 bp, human
gttaggaggctggttggatg

SEQ ID NO: 352699 - DNA, 20 bp, human
gccaaccagcctcctaacac

SEQ ID NO: 352700 - DNA, 20 bp, human
gcgttactgcccgtgttagg

SEQ ID NO: 352701 - DNA, 20 bp, human
gactgcccgtgttaggaggc

SEQ ID NO: 352702 - DNA, 20 bp, human
gagaatggtaaaatggtggt

SEQ ID NO: 352703 - DNA, 20 bp, human
ggcctgtggcgtggcgtggt

SEQ ID NO: 352704 - DNA, 20 bp, human
gccaactcgcccgccggcca

SEQ ID NO: 352705 - DNA, 20 bp, human
gatcgggtgtgcgctgcccg

SEQ ID NO: 352706 - DNA, 20 bp, human
gaagaaaaacggactttcac

SEQ ID NO: 352707 - DNA, 20 bp, human
gcactggctgactgattgtc

SEQ ID NO: 352708 - DNA, 20 bp, human
gattgtctggaaaccgtttt

SEQ ID NO: 352709 - DNA, 20 bp, human
gtacttatgttgtgatgtaa

SEQ ID NO: 352710 - DNA, 20 bp, human
gctgcaactacaaagaaaaa

SEQ ID NO: 352711 - DNA, 20 bp, human
ggattctaattaagaagctt

SEQ ID NO: 352712 - DNA, 20 bp, human
gaattaaaatcgtaaaattt

SEQ ID NO: 352713 - DNA, 20 bp, human
ggagagttgagtgtggtctg

SEQ ID NO: 352714 - DNA, 20 bp, human
gggacaggtttttaccttaa

SEQ ID NO: 352715 - DNA, 20 bp, human
gctcagaagtcgttactaat

SEQ ID NO: 352716 - DNA, 20 bp, human
gcatgggcttttatacgaga

SEQ ID NO: 352717 - DNA, 20 bp, human
gtcgtataaaagcccatggc

SEQ ID NO: 352718 - DNA, 20 bp, human
ggattctaattaagaagctt

SEQ ID NO: 352719 - DNA, 20 bp, human
gggacaggtttttaccgtaa

SEQ ID NO: 352720 - DNA, 20 bp, human
ggaaagggtgtggctaaggt

SEQ ID NO: 352721 - DNA, 20 bp, human
ggagggaaagggtgtggcta

SEQ ID NO: 352722 - DNA, 20 bp, human
gagggtgtggctaaggtggg

SEQ ID NO: 352723 - DNA, 20 bp, human
ggagattgttactattggac

SEQ ID NO: 352724 - DNA, 20 bp, human
ggagagttgagtgtggtctg

SEQ ID NO: 352725 - DNA, 20 bp, human
gagattaaaaaggagggaaa

SEQ ID NO: 352726 - DNA, 20 bp, human
gagtggtacaacctttgggg

SEQ ID NO: 352727 - DNA, 20 bp, human
gtcatcataaacggaagggt

SEQ ID NO: 352728 - DNA, 20 bp, human
gtggttggacaatgttttcc

SEQ ID NO: 352729 - DNA, 20 bp, human
gtgtcatcatcataaacgga

SEQ ID NO: 352730 - DNA, 20 bp, human
gatgatgatgacattaaagc

SEQ ID NO: 352731 - DNA, 20 bp, human
ggcctctgactctgattggt

SEQ ID NO: 352732 - DNA, 20 bp, human
gctgaaacctaatcacctcg

SEQ ID NO: 352733 - DNA, 20 bp, human
gttaggggtacttactggac

SEQ ID NO: 352734 - DNA, 20 bp, human
gtactcttaggggtacttac

SEQ ID NO: 352735 - DNA, 20 bp, human
gagtagattcactctaattc

SEQ ID NO: 352736 - DNA, 20 bp, human
gaagttctggtcctttaagt

SEQ ID NO: 352737 - DNA, 20 bp, human
gataacagacggcccgagac

SEQ ID NO: 352738 - DNA, 20 bp, human
gccgagacaggcccacttaa

SEQ ID NO: 352739 - DNA, 20 bp, human
gcgcctcgctgtctgattga

SEQ ID NO: 352740 - DNA, 20 bp, human
gggcggggcacgagaagttc

SEQ ID NO: 352741 - DNA, 20 bp, human
ggccccgcccccctctctca

SEQ ID NO: 352742 - DNA, 20 bp, human
gtgatggccttgagagaggg

SEQ ID NO: 352743 - DNA, 20 bp, human
gtggctgaaagcctcagaga

SEQ ID NO: 352744 - DNA, 20 bp, human
gcgcctggctctttctattt

SEQ ID NO: 352745 - DNA, 20 bp, human
gagccaggcgccataacaga

SEQ ID NO: 352746 - DNA, 20 bp, human
gtgaccgggcggaactccga

SEQ ID NO: 352747 - DNA, 20 bp, human
gcctcagaacccaggggtca

SEQ ID NO: 352748 - DNA, 20 bp, human
gacacaaccttgattaggag

SEQ ID NO: 352749 - DNA, 20 bp, human
gctggcagcctcagaaccca

SEQ ID NO: 352750 - DNA, 20 bp, human
gccgcgtggaggtgaccggg

SEQ ID NO: 352751 - DNA, 20 bp, human
ggatgctcccacctgtggaa

SEQ ID NO: 352752 - DNA, 20 bp, human
gcgctccagcggctgctgtc

SEQ ID NO: 352753 - DNA, 20 bp, human
gcggaactccgagggggcgc

SEQ ID NO: 352754 - DNA, 20 bp, human
gactgccatcaaggtgctga

SEQ ID NO: 352755 - DNA, 20 bp, human
gtcccagcccctcctaatca

SEQ ID NO: 352756 - DNA, 20 bp, human
ggcgacagaactctggtagg

SEQ ID NO: 352757 - DNA, 20 bp, human
ggccctgagcgacagaactc

SEQ ID NO: 352758 - DNA, 20 bp, human
gggctggctgtaaattgacg

SEQ ID NO: 352759 - DNA, 20 bp, human
ggcaagctgctacaacttag

SEQ ID NO: 352760 - DNA, 20 bp, human
gtggagctgtagcttaatca

SEQ ID NO: 352761 - DNA, 20 bp, human
gggaatagacaaagcaccgc

SEQ ID NO: 352762 - DNA, 20 bp, human
ggctacagctccaggaggct

SEQ ID NO: 352763 - DNA, 20 bp, human
gaaaaggcaaaagggcaact

SEQ ID NO: 352764 - DNA, 20 bp, human
gtaccagagttctgtcgctc

SEQ ID NO: 352765 - DNA, 20 bp, human
ggggtaggcgcaggacagag

SEQ ID NO: 352766 - DNA, 20 bp, human
ggggctgcgctcagacgctc

SEQ ID NO: 352767 - DNA, 20 bp, human
ggacgctcacgggtcaccca

SEQ ID NO: 352768 - DNA, 20 bp, human
gcgccccaagcggagaatat

SEQ ID NO: 352769 - DNA, 20 bp, human
gcagggagccccgaccccga

SEQ ID NO: 352770 - DNA, 20 bp, human
gaatggtataggtggtgggg

SEQ ID NO: 352771 - DNA, 20 bp, human
ggtggcgggggatacaactg

SEQ ID NO: 352772 - DNA, 20 bp, human
ggatacaactggggacgcag

SEQ ID NO: 352773 - DNA, 20 bp, human
gagacagactcccttcgcca

SEQ ID NO: 352774 - DNA, 20 bp, human
gtgaaagacgggaacgtagc

SEQ ID NO: 352775 - DNA, 20 bp, human
gtgccctctggcacgttttc

SEQ ID NO: 352776 - DNA, 20 bp, human
gcacccgccccggaaaaaat

SEQ ID NO: 352777 - DNA, 20 bp, human
gacccactcttcttcttcaa

SEQ ID NO: 352778 - DNA, 20 bp, human
gccgctgcttcagctatcgg

SEQ ID NO: 352779 - DNA, 20 bp, human
ggggtattggccacagcgta

SEQ ID NO: 352780 - DNA, 20 bp, human
gcagcggtgctctcattggc

SEQ ID NO: 352781 - DNA, 20 bp, human
ggattcctgccaattgtagg

SEQ ID NO: 352782 - DNA, 20 bp, human
gtgaggaagcctcctacaat

SEQ ID NO: 352783 - DNA, 20 bp, human
gaagctcccgccagagccgc

SEQ ID NO: 352784 - DNA, 20 bp, human
ggcaccgctgcttcagctat

SEQ ID NO: 352785 - DNA, 20 bp, human
gagcgcggtcccgcctcgtc

SEQ ID NO: 352786 - DNA, 20 bp, human
ggcagccgggcccgtcactc

SEQ ID NO: 352787 - DNA, 20 bp, human
gcccgcgcgtgacgtaacta

SEQ ID NO: 352788 - DNA, 20 bp, human
ggatcgccgggaagtccaga

SEQ ID NO: 352789 - DNA, 20 bp, human
gtaaaggggtaggactcgtg

SEQ ID NO: 352790 - DNA, 20 bp, human
gcggggcccggggtgattgg

SEQ ID NO: 352791 - DNA, 20 bp, human
gcgggcccggctgcctttga

SEQ ID NO: 352792 - DNA, 20 bp, human
ggggcggggcccggggtgat

SEQ ID NO: 352793 - DNA, 20 bp, human
gcgggcccgtcactccggca

SEQ ID NO: 352794 - DNA, 20 bp, human
gagagagcgcggcaaacctt

SEQ ID NO: 352795 - DNA, 20 bp, human
gcggcggccggagaagtgat

SEQ ID NO: 352796 - DNA, 20 bp, human
gagaccctacggcgttccat

SEQ ID NO: 352797 - DNA, 20 bp, human
gctccaacgggcccccaaga

SEQ ID NO: 352798 - DNA, 20 bp, human
gccgttaggaaggtggggcg

SEQ ID NO: 352799 - DNA, 20 bp, human
gcggggcggggcgttgttac

SEQ ID NO: 352800 - DNA, 20 bp, human
gacagccaatggaacgccgt

SEQ ID NO: 352801 - DNA, 20 bp, human
ggggcgggccgttaggaagg

SEQ ID NO: 352802 - DNA, 20 bp, human
gcgtgggcgggccgttagga

SEQ ID NO: 352803 - DNA, 20 bp, human
gcgttggaggcgagcgtggg

SEQ ID NO: 352804 - DNA, 20 bp, human
gcgagcgtgggcgggccgtt

SEQ ID NO: 352805 - DNA, 20 bp, human
ggcccgttggaggcgagcgt

SEQ ID NO: 352806 - DNA, 20 bp, human
gactgacggcccccaaaccc

SEQ ID NO: 352807 - DNA, 20 bp, human
ggagtcctgcggtggaatcc

SEQ ID NO: 352808 - DNA, 20 bp, human
gggagacactcgcacgggga

SEQ ID NO: 352809 - DNA, 20 bp, human
gggcggggcggcggggtgac

SEQ ID NO: 352810 - DNA, 20 bp, human
gccaccgcaggactccgaag

SEQ ID NO: 352811 - DNA, 20 bp, human
gacggcccccaaacccgggt

SEQ ID NO: 352812 - DNA, 20 bp, human
gaagcataggcgcacctctt

SEQ ID NO: 352813 - DNA, 20 bp, human
gggtgacggggcacgaggcc

SEQ ID NO: 352814 - DNA, 20 bp, human
gcccaggagtcgtggtgcga

SEQ ID NO: 352815 - DNA, 20 bp, human
gccaccccacccgggtttgg

SEQ ID NO: 352816 - DNA, 20 bp, human
gaagccgcctccgaaaaggg

SEQ ID NO: 352817 - DNA, 20 bp, human
gtctgagccccccttttcgg

SEQ ID NO: 352818 - DNA, 20 bp, human
gtaacccaggaccaaaatgg

SEQ ID NO: 352819 - DNA, 20 bp, human
gatagaagggggaagtcgga

SEQ ID NO: 352820 - DNA, 20 bp, human
gaatggccgctcgtcagatg

SEQ ID NO: 352821 - DNA, 20 bp, human
gagcacggcgcggggcccga

SEQ ID NO: 352822 - DNA, 20 bp, human
gtataatgagtgccgggcga

SEQ ID NO: 352823 - DNA, 20 bp, human
ggccctgagaatgcgggagg

SEQ ID NO: 352824 - DNA, 20 bp, human
gacggcgcggggcccgatgg

SEQ ID NO: 352825 - DNA, 20 bp, human
ggaaaagccgcctccgaaaa

SEQ ID NO: 352826 - DNA, 20 bp, human
ggggcggcctgctctgtcat

SEQ ID NO: 352827 - DNA, 20 bp, human
gggcgccgggctcgtaccgg

SEQ ID NO: 352828 - DNA, 20 bp, human
gcgtgtatctaggcagatcg

SEQ ID NO: 352829 - DNA, 20 bp, human
gcctggtaacagaatctgat

SEQ ID NO: 352830 - DNA, 20 bp, human
ggcggccgccggtacgagcc

SEQ ID NO: 352831 - DNA, 20 bp, human
ggaaggcgccgggctcgtac

SEQ ID NO: 352832 - DNA, 20 bp, human
gatctgcctagatacacggg

SEQ ID NO: 352833 - DNA, 20 bp, human
ggcaggccgcccgtgtatct

SEQ ID NO: 352834 - DNA, 20 bp, human
ggaatctgattggtcaatag

SEQ ID NO: 352835 - DNA, 20 bp, human
ggcggccgctgaagtctgcc

SEQ ID NO: 352836 - DNA, 20 bp, human
gctgggacccggggccgcag

SEQ ID NO: 352837 - DNA, 20 bp, human
gtgggcgcccagggcgtgac

SEQ ID NO: 352838 - DNA, 20 bp, human
gcagcgcaggttgagagaac

SEQ ID NO: 352839 - DNA, 20 bp, human
gcagaaaggacgccgcgcac

SEQ ID NO: 352840 - DNA, 20 bp, human
gttgagagaacgggaaggag

SEQ ID NO: 352841 - DNA, 20 bp, human
gcctgggctgtacctgtgcg

SEQ ID NO: 352842 - DNA, 20 bp, human
gagccgcggtgggccgcggt

SEQ ID NO: 352843 - DNA, 20 bp, human
gatctgccgggaccgcagac

SEQ ID NO: 352844 - DNA, 20 bp, human
ggtgagaaagtgagtttcgc

SEQ ID NO: 352845 - DNA, 20 bp, human
ggcaggttgagagaacggga

SEQ ID NO: 352846 - DNA, 20 bp, human
gcggagcggtaggtgttgtg

SEQ ID NO: 352847 - DNA, 20 bp, human
gaccgggaggggaggacgaa

SEQ ID NO: 352848 - DNA, 20 bp, human
gtctgcgccgggccgcagtg

SEQ ID NO: 352849 - DNA, 20 bp, human
gcacctaccgctccgccggg

SEQ ID NO: 352850 - DNA, 20 bp, human
ggggaggagtccggcccggc

SEQ ID NO: 352851 - DNA, 20 bp, human
gcctggtccacgccccccgg

SEQ ID NO: 352852 - DNA, 20 bp, human
ggtggagagcaggaaaacgt

SEQ ID NO: 352853 - DNA, 20 bp, human
gggccgcgggcgcgacgggc

SEQ ID NO: 352854 - DNA, 20 bp, human
gcgccccccggcggagcggt

SEQ ID NO: 352855 - DNA, 20 bp, human
gagccccggccgctgacggg

SEQ ID NO: 352856 - DNA, 20 bp, human
gctaaccgcttcagagtctc

SEQ ID NO: 352857 - DNA, 20 bp, human
gagtccccatatctgtagcc

SEQ ID NO: 352858 - DNA, 20 bp, human
gtccaagttcacttcctttg

SEQ ID NO: 352859 - DNA, 20 bp, human
gagtcatgcagccgttactg

SEQ ID NO: 352860 - DNA, 20 bp, human
ggatatggggactcacgttg

SEQ ID NO: 352861 - DNA, 20 bp, human
gggacctggctacagatatg

SEQ ID NO: 352862 - DNA, 20 bp, human
ggggcacattagcatcaccc

SEQ ID NO: 352863 - DNA, 20 bp, human
ggggccaaccggctttttca

SEQ ID NO: 352864 - DNA, 20 bp, human
ggcttcagagtctccgggta

SEQ ID NO: 352865 - DNA, 20 bp, human
gtctggcaggcgggcgcatc

SEQ ID NO: 352866 - DNA, 20 bp, human
gcattccctccgagtcggtg

SEQ ID NO: 352867 - DNA, 20 bp, human
gccctcccctaagtcttaaa

SEQ ID NO: 352868 - DNA, 20 bp, human
gccctccgagtcggtgagga

SEQ ID NO: 352869 - DNA, 20 bp, human
gaagacttaggggagggcgt

SEQ ID NO: 352870 - DNA, 20 bp, human
gccgcccattccctccgagt

SEQ ID NO: 352871 - DNA, 20 bp, human
gtccctctggaaaaatctgt

SEQ ID NO: 352872 - DNA, 20 bp, human
ggggcgtctggaacttaaag

SEQ ID NO: 352873 - DNA, 20 bp, human
ggagggcgtgggttccgctg

SEQ ID NO: 352874 - DNA, 20 bp, human
ggccccccaaaagtgaggaa

SEQ ID NO: 352875 - DNA, 20 bp, human
gtgggttccgctggggtcct

SEQ ID NO: 352876 - DNA, 20 bp, human
ggggactgactgcgcatgtg

SEQ ID NO: 352877 - DNA, 20 bp, human
gcatgcgcagtcagtcccgt

SEQ ID NO: 352878 - DNA, 20 bp, human
gaatcccccagctggccgaa

SEQ ID NO: 352879 - DNA, 20 bp, human
gtgtgcggccgcggcccctt

SEQ ID NO: 352880 - DNA, 20 bp, human
gtcagcgtgtgtacgcccgc

SEQ ID NO: 352881 - DNA, 20 bp, human
gagggagcgcggcgcctctg

SEQ ID NO: 352882 - DNA, 20 bp, human
gggccccttcggccagctgg

SEQ ID NO: 352883 - DNA, 20 bp, human
gcgtacacacgctgacgcgc

SEQ ID NO: 352884 - DNA, 20 bp, human
gagctgggggattcgtagac

SEQ ID NO: 352885 - DNA, 20 bp, human
gtgtacgcccgcgggctgtc

SEQ ID NO: 352886 - DNA, 20 bp, human
gcctgtgtgtgtaaagggcg

SEQ ID NO: 352887 - DNA, 20 bp, human
gagggaagatgggaccttat

SEQ ID NO: 352888 - DNA, 20 bp, human
ggcaatgcacattagagtgt

SEQ ID NO: 352889 - DNA, 20 bp, human
ggtgtgtaaagggcgggggt

SEQ ID NO: 352890 - DNA, 20 bp, human
gactaggaatcagctaccca

SEQ ID NO: 352891 - DNA, 20 bp, human
ggggatcagagacagcgcat

SEQ ID NO: 352892 - DNA, 20 bp, human
gagagacagcgcatgggagc

SEQ ID NO: 352893 - DNA, 20 bp, human
ggacctcccagagtttgtta

SEQ ID NO: 352894 - DNA, 20 bp, human
gtgggaggtcaagacatggt

SEQ ID NO: 352895 - DNA, 20 bp, human
gaggaaggccggcaagctta

SEQ ID NO: 352896 - DNA, 20 bp, human
gctgccgtgggatagaatac

SEQ ID NO: 352897 - DNA, 20 bp, human
ggtgaagcaatgaacaactt

SEQ ID NO: 352898 - DNA, 20 bp, human
gctgctgctttatttgagtc

SEQ ID NO: 352899 - DNA, 20 bp, human
gaatccgcatttctcacatt

SEQ ID NO: 352900 - DNA, 20 bp, human
ggtcaggtatatggcattga

SEQ ID NO: 352901 - DNA, 20 bp, human
gatagcatttacaaactgag

SEQ ID NO: 352902 - DNA, 20 bp, human
gtggcttgtgagtactgccg

SEQ ID NO: 352903 - DNA, 20 bp, human
gaagcagcagcaccaccttc

SEQ ID NO: 352904 - DNA, 20 bp, human
gcctgacaacgcataaaaac

SEQ ID NO: 352905 - DNA, 20 bp, human
ggtatatggcattgaaggtg

SEQ ID NO: 352906 - DNA, 20 bp, human
gtccctagctgcagctaact

SEQ ID NO: 352907 - DNA, 20 bp, human
ggctgcagctaactcgggtc

SEQ ID NO: 352908 - DNA, 20 bp, human
ggcagctcctctacactcgg

SEQ ID NO: 352909 - DNA, 20 bp, human
gaggcgcaggcgagctggag

SEQ ID NO: 352910 - DNA, 20 bp, human
gcccgagttagctgcagcta

SEQ ID NO: 352911 - DNA, 20 bp, human
ggggaaccgcgggcgcccac

SEQ ID NO: 352912 - DNA, 20 bp, human
gtgcccactcgaggtcgtca

SEQ ID NO: 352913 - DNA, 20 bp, human
gtgaacgtgttcctctcctc

SEQ ID NO: 352914 - DNA, 20 bp, human
gtgcaaggtaccgagaggga

SEQ ID NO: 352915 - DNA, 20 bp, human
gcctctcggtaccttgcaac

SEQ ID NO: 352916 - DNA, 20 bp, human
gtccccgccgccctccgagg

SEQ ID NO: 352917 - DNA, 20 bp, human
ggggcaggggcctcctcgga

SEQ ID NO: 352918 - DNA, 20 bp, human
ggagaggcgggtaaatattt

SEQ ID NO: 352919 - DNA, 20 bp, human
gcgcgtgggccgggttgtca

SEQ ID NO: 352920 - DNA, 20 bp, human
gcgtcaccgcggttccaggg

SEQ ID NO: 352921 - DNA, 20 bp, human
ggctgcggagccggggcgac

SEQ ID NO: 352922 - DNA, 20 bp, human
ggggcctcctcggagggcgg

SEQ ID NO: 352923 - DNA, 20 bp, human
gcctcgtcaccgcggttcca

SEQ ID NO: 352924 - DNA, 20 bp, human
gccggcccacgcggtgtcct

SEQ ID NO: 352925 - DNA, 20 bp, human
gtcggctgtgaagtggacgt

SEQ ID NO: 352926 - DNA, 20 bp, human
gttggcacctggtgaccgtc

SEQ ID NO: 352927 - DNA, 20 bp, human
gtcatgctgactttatccat

SEQ ID NO: 352928 - DNA, 20 bp, human
gatccatgggactgaagaaa

SEQ ID NO: 352929 - DNA, 20 bp, human
ggccaaaatagaactgagtg

SEQ ID NO: 352930 - DNA, 20 bp, human
gtccagttctgaaggtgatt

SEQ ID NO: 352931 - DNA, 20 bp, human
gcacgccactccgtgatgta

SEQ ID NO: 352932 - DNA, 20 bp, human
gaaagccttacatcacggag

SEQ ID NO: 352933 - DNA, 20 bp, human
gatcacggagtggcgtgggg

SEQ ID NO: 352934 - DNA, 20 bp, human
gggacagaggataaggtcag

SEQ ID NO: 352935 - DNA, 20 bp, human
gacaggaaagccttacatca

SEQ ID NO: 352936 - DNA, 20 bp, human
gtctccgcaggcaaggggcg

SEQ ID NO: 352937 - DNA, 20 bp, human
gggaagagcaggggcagcgt

SEQ ID NO: 352938 - DNA, 20 bp, human
gcgcgagggaaggagcgcgc

SEQ ID NO: 352939 - DNA, 20 bp, human
gcgggctctccgcaggcaag

SEQ ID NO: 352940 - DNA, 20 bp, human
gagggccaaaagctggaccg

SEQ ID NO: 352941 - DNA, 20 bp, human
ggcaggcgcgggctctccgc

SEQ ID NO: 352942 - DNA, 20 bp, human
gccacggagagcgcgcgcga

SEQ ID NO: 352943 - DNA, 20 bp, human
gccaagggagcgcgaacctg

SEQ ID NO: 352944 - DNA, 20 bp, human
gagggagcgcgaacctgagg

SEQ ID NO: 352945 - DNA, 20 bp, human
gagtcggcgacgcctcagag

SEQ ID NO: 352946 - DNA, 20 bp, human
gaccgagatccccgtcggct

SEQ ID NO: 352947 - DNA, 20 bp, human
gctcggtgtatcctcgctgg

SEQ ID NO: 352948 - DNA, 20 bp, human
gagcaggagccaaaagggga

SEQ ID NO: 352949 - DNA, 20 bp, human
gagccagggccgcggactag

SEQ ID NO: 352950 - DNA, 20 bp, human
gacagtggagctggggactc

SEQ ID NO: 352951 - DNA, 20 bp, human
ggacgcgggggggagcggaa

SEQ ID NO: 352952 - DNA, 20 bp, human
gccagcgctcccctagtccg

SEQ ID NO: 352953 - DNA, 20 bp, human
gctcccctagtccgcggccc

SEQ ID NO: 352954 - DNA, 20 bp, human
ggtagggagggtaatcccgt

SEQ ID NO: 352955 - DNA, 20 bp, human
gccggcgggggggttcaagg

SEQ ID NO: 352956 - DNA, 20 bp, human
gccgccccggtcctgggtag

SEQ ID NO: 352957 - DNA, 20 bp, human
gacctggaggaaagatccta

SEQ ID NO: 352958 - DNA, 20 bp, human
gaggggccagaatttggatt

SEQ ID NO: 352959 - DNA, 20 bp, human
gcccgaggccctaaactcct

SEQ ID NO: 352960 - DNA, 20 bp, human
gctcaggaggggccagaatt

SEQ ID NO: 352961 - DNA, 20 bp, human
gccagatcctaggtgagggc

SEQ ID NO: 352962 - DNA, 20 bp, human
ggaggggtcacgaaatctga

SEQ ID NO: 352963 - DNA, 20 bp, human
gggaggaaagatcctagggt

SEQ ID NO: 352964 - DNA, 20 bp, human
gaggtccagatcctaggtga

SEQ ID NO: 352965 - DNA, 20 bp, human
gcggcctctacccaggaccg

SEQ ID NO: 352966 - DNA, 20 bp, human
gcttctggggacagattgat

SEQ ID NO: 352967 - DNA, 20 bp, human
gtccggctggaggcacccag

SEQ ID NO: 352968 - DNA, 20 bp, human
gaggagctcccccacatctg

SEQ ID NO: 352969 - DNA, 20 bp, human
gaggtcctggctcttccgct

SEQ ID NO: 352970 - DNA, 20 bp, human
gtggcgctgggtccggctgg

SEQ ID NO: 352971 - DNA, 20 bp, human
gcctgggctggcgctgggtc

SEQ ID NO: 352972 - DNA, 20 bp, human
ggacagaggactctggtctg

SEQ ID NO: 352973 - DNA, 20 bp, human
gcctctcctgggctggcgct

SEQ ID NO: 352974 - DNA, 20 bp, human
ggccgggcgctgaggccaga

SEQ ID NO: 352975 - DNA, 20 bp, human
gatgtgggggagctcctgtg

SEQ ID NO: 352976 - DNA, 20 bp, human
gagcgggcagtggctcccca

SEQ ID NO: 352977 - DNA, 20 bp, human
gatccctctgaggaagaacc

SEQ ID NO: 352978 - DNA, 20 bp, human
ggaggcccggctgcaagact

SEQ ID NO: 352979 - DNA, 20 bp, human
ggggagccactgcccgctct

SEQ ID NO: 352980 - DNA, 20 bp, human
gcagccgagacggagcctcc

SEQ ID NO: 352981 - DNA, 20 bp, human
ggagctgaaggcagccgaga

SEQ ID NO: 352982 - DNA, 20 bp, human
gagaacacgaccctgatggg

SEQ ID NO: 352983 - DNA, 20 bp, human
gaaggaggcgtcctctcttt

SEQ ID NO: 352984 - DNA, 20 bp, human
gaactcccctgggggatcat

SEQ ID NO: 352985 - DNA, 20 bp, human
gccagcaccaccacccatca

SEQ ID NO: 352986 - DNA, 20 bp, human
gactacgtaaggagttgacg

SEQ ID NO: 352987 - DNA, 20 bp, human
gaaaggaggagcttacagga

SEQ ID NO: 352988 - DNA, 20 bp, human
gtggatataaccagggtccc

SEQ ID NO: 352989 - DNA, 20 bp, human
gtcttcccaaggtgctgaag

SEQ ID NO: 352990 - DNA, 20 bp, human
gcgtaaggagttgacggggg

SEQ ID NO: 352991 - DNA, 20 bp, human
gagtaggacttatggaaagg

SEQ ID NO: 352992 - DNA, 20 bp, human
gacaccaaaggagttctcta

SEQ ID NO: 352993 - DNA, 20 bp, human
gggaagacctggatataacc

SEQ ID NO: 352994 - DNA, 20 bp, human
gaagtgaggtcacatcttgt

SEQ ID NO: 352995 - DNA, 20 bp, human
gctccccagcatgcacaatg

SEQ ID NO: 352996 - DNA, 20 bp, human
gcaccctcccgcatcagcac

SEQ ID NO: 352997 - DNA, 20 bp, human
gtgggtgcggagtgcgccag

SEQ ID NO: 352998 - DNA, 20 bp, human
ggggcgattcggaaagttgg

SEQ ID NO: 352999 - DNA, 20 bp, human
gagccggtgctgatgcggga

SEQ ID NO: 353000 - DNA, 20 bp, human
gggggcgcgggcggcaagtg

SEQ ID NO: 353001 - DNA, 20 bp, human
gcaagtgcggcgactccccg

SEQ ID NO: 353002 - DNA, 20 bp, human
gcgtttgcgcgccgagggga

SEQ ID NO: 353003 - DNA, 20 bp, human
gacccagccggtgctgatgc

SEQ ID NO: 353004 - DNA, 20 bp, human
ggtgtccttcagttaggcgg

SEQ ID NO: 353005 - DNA, 20 bp, human
gtgcgggcgattcggaaagt

SEQ ID NO: 353006 - DNA, 20 bp, human
gccgcctccggctacctcgc

SEQ ID NO: 353007 - DNA, 20 bp, human
gcgcggggccgcgtcgacat

SEQ ID NO: 353008 - DNA, 20 bp, human
gcgagggggcggtgcgcagg

SEQ ID NO: 353009 - DNA, 20 bp, human
gtggcgcgccctctgatcta

SEQ ID NO: 353010 - DNA, 20 bp, human
ggaggtagccggaggcggcc

SEQ ID NO: 353011 - DNA, 20 bp, human
gtgcgcaggcggctggggcg

SEQ ID NO: 353012 - DNA, 20 bp, human
gaggccgcagggcatgaggc

SEQ ID NO: 353013 - DNA, 20 bp, human
gtcgcgctcgggtttcagcg

SEQ ID NO: 353014 - DNA, 20 bp, human
gttggcggagaaccgagtga

SEQ ID NO: 353015 - DNA, 20 bp, human
gctagggccgtggttttccg

SEQ ID NO: 353016 - DNA, 20 bp, human
ggccctctgggtcctgcgat

SEQ ID NO: 353017 - DNA, 20 bp, human
gtgccaatcgcaggacccag

SEQ ID NO: 353018 - DNA, 20 bp, human
ggacgtgcggtcacaaccaa

SEQ ID NO: 353019 - DNA, 20 bp, human
ggcggtcacaaccaatgggg

SEQ ID NO: 353020 - DNA, 20 bp, human
ggacttggagtcgatggaca

SEQ ID NO: 353021 - DNA, 20 bp, human
gagagaggacttggagtcga

SEQ ID NO: 353022 - DNA, 20 bp, human
gtcgaattacactgagcggg

SEQ ID NO: 353023 - DNA, 20 bp, human
gtcacaaccaatggggagga

SEQ ID NO: 353024 - DNA, 20 bp, human
gtgcgattggcaggctgagt

SEQ ID NO: 353025 - DNA, 20 bp, human
ggctgagtcgggctgacgtg

SEQ ID NO: 353026 - DNA, 20 bp, human
ggggcagtgtggcgatatag

SEQ ID NO: 353027 - DNA, 20 bp, human
ggagggaggctccgcctcgg

SEQ ID NO: 353028 - DNA, 20 bp, human
gcctagatggcggagaaatc

SEQ ID NO: 353029 - DNA, 20 bp, human
ggaaatcgggctagctggaa

SEQ ID NO: 353030 - DNA, 20 bp, human
ggggcagcgcgactcggggc

SEQ ID NO: 353031 - DNA, 20 bp, human
gcgggagggaggctccgcct

SEQ ID NO: 353032 - DNA, 20 bp, human
gagcgcgactcggggcggga

SEQ ID NO: 353033 - DNA, 20 bp, human
ggggagagcggcccccgagg

SEQ ID NO: 353034 - DNA, 20 bp, human
gccgactccagaatgagctc

SEQ ID NO: 353035 - DNA, 20 bp, human
gcctctcccagagctcattc

SEQ ID NO: 353036 - DNA, 20 bp, human
gctagtggagaagaccctgg

SEQ ID NO: 353037 - DNA, 20 bp, human
ggggaggggaaacgcctccc

SEQ ID NO: 353038 - DNA, 20 bp, human
ggcccggggatggtgggtac

SEQ ID NO: 353039 - DNA, 20 bp, human
gaggtggatggcatgggcct

SEQ ID NO: 353040 - DNA, 20 bp, human
gcggctcgaaggtcaggcag

SEQ ID NO: 353041 - DNA, 20 bp, human
gcaggaccaggaatacattt

SEQ ID NO: 353042 - DNA, 20 bp, human
gcgggacccggcggcttggc

SEQ ID NO: 353043 - DNA, 20 bp, human
ggaggcgtttcccctcccct

SEQ ID NO: 353044 - DNA, 20 bp, human
ggatggtgggtacaggctta

SEQ ID NO: 353045 - DNA, 20 bp, human
gcatccacctgccaagccgc

SEQ ID NO: 353046 - DNA, 20 bp, human
ggggacctggcgcccaatcc

SEQ ID NO: 353047 - DNA, 20 bp, human
gcggcaggccagaccggaaa

SEQ ID NO: 353048 - DNA, 20 bp, human
gcgactgggcccgcagagag

SEQ ID NO: 353049 - DNA, 20 bp, human
gggccgggcgagctaatcgt

SEQ ID NO: 353050 - DNA, 20 bp, human
gacctggcgcccaatcctgg

SEQ ID NO: 353051 - DNA, 20 bp, human
gagcgcccggcaggccagac

SEQ ID NO: 353052 - DNA, 20 bp, human
gcgcccaggtgccagcccgt

SEQ ID NO: 353053 - DNA, 20 bp, human
gcaggtgccagcccgtggga

SEQ ID NO: 353054 - DNA, 20 bp, human
ggcaccgggtcccccaggat

SEQ ID NO: 353055 - DNA, 20 bp, human
ggcccagggtcaccttccca

SEQ ID NO: 353056 - DNA, 20 bp, human
gaaaaattagcctggggcag

SEQ ID NO: 353057 - DNA, 20 bp, human
gaattcaacagggcttgaaa

SEQ ID NO: 353058 - DNA, 20 bp, human
ggaaacttggttattgaaag

SEQ ID NO: 353059 - DNA, 20 bp, human
gccaactactgaattcaaca

SEQ ID NO: 353060 - DNA, 20 bp, human
gacaatgtccacagtgctcc

SEQ ID NO: 353061 - DNA, 20 bp, human
gagttcagatgcttgtcaag

SEQ ID NO: 353062 - DNA, 20 bp, human
gaactgctatttcttttggc

SEQ ID NO: 353063 - DNA, 20 bp, human
gagtagaagttaaagaaact

SEQ ID NO: 353064 - DNA, 20 bp, human
gtagtttcagatgatgggtt

SEQ ID NO: 353065 - DNA, 20 bp, human
gtttaacttctactatgtaa

SEQ ID NO: 353066 - DNA, 20 bp, human
gaaaaattagcctggggcag

SEQ ID NO: 353067 - DNA, 20 bp, human
ggaaacttggttattgaaag

SEQ ID NO: 353068 - DNA, 20 bp, human
gaattcaacagggcttgaaa

SEQ ID NO: 353069 - DNA, 20 bp, human
gacaatgtccacagtgctcc

SEQ ID NO: 353070 - DNA, 20 bp, human
gccaactactgaattcaaca

SEQ ID NO: 353071 - DNA, 20 bp, human
gagttcagatgcttgtcaag

SEQ ID NO: 353072 - DNA, 20 bp, human
gaactgctatttcttttggc

SEQ ID NO: 353073 - DNA, 20 bp, human
gagtagaagttaaagaaact

SEQ ID NO: 353074 - DNA, 20 bp, human
gtttaacttctactatgtaa

SEQ ID NO: 353075 - DNA, 20 bp, human
gtctgaactgctatttcttt

SEQ ID NO: 353076 - DNA, 20 bp, human
ggttccaatctgctatacat

SEQ ID NO: 353077 - DNA, 20 bp, human
gaaacctatgtatagcagat

SEQ ID NO: 353078 - DNA, 20 bp, human
gattgaaataagcaaatgaa

SEQ ID NO: 353079 - DNA, 20 bp, human
gtactacttgtaaagtctat

SEQ ID NO: 353080 - DNA, 20 bp, human
gggcataattgaaattcaaa

SEQ ID NO: 353081 - DNA, 20 bp, human
gcctccgccggctacgtcag

SEQ ID NO: 353082 - DNA, 20 bp, human
gtgaaagccactgacgtagc

SEQ ID NO: 353083 - DNA, 20 bp, human
gaagccactgacgtagccgg

SEQ ID NO: 353084 - DNA, 20 bp, human
gtggtttacagcacccgcct

SEQ ID NO: 353085 - DNA, 20 bp, human
gtcgagcgccgacgtcgcca

SEQ ID NO: 353086 - DNA, 20 bp, human
ggggaaataccactaaatac

SEQ ID NO: 353087 - DNA, 20 bp, human
gtgaataaataattgcctat

SEQ ID NO: 353088 - DNA, 20 bp, human
gaaatgagaccagtatttag

SEQ ID NO: 353089 - DNA, 20 bp, human
gaaatactggtctcatttgt

SEQ ID NO: 353090 - DNA, 20 bp, human
gttagtggtatttcccctat

SEQ ID NO: 353091 - DNA, 20 bp, human
ggctcgagctgcactcggct

SEQ ID NO: 353092 - DNA, 20 bp, human
gtgtggaacgttggcgactt

SEQ ID NO: 353093 - DNA, 20 bp, human
ggctgaggaactaagagccc

SEQ ID NO: 353094 - DNA, 20 bp, human
gaagactaaactgtgatttg

SEQ ID NO: 353095 - DNA, 20 bp, human
gctgtgatttgaggcagctg

SEQ ID NO: 353096 - DNA, 20 bp, human
gcctgggctcttagttcctc

SEQ ID NO: 353097 - DNA, 20 bp, human
ggggaaataccactaaatac

SEQ ID NO: 353098 - DNA, 20 bp, human
gtgaataaataattgcctat

SEQ ID NO: 353099 - DNA, 20 bp, human
gaaatgagaccagtatttag

SEQ ID NO: 353100 - DNA, 20 bp, human
gaaatactggtctcatttgt

SEQ ID NO: 353101 - DNA, 20 bp, human
gttagtggtatttcccctat

SEQ ID NO: 353102 - DNA, 20 bp, human
gcgctcgagctgcactccgc

SEQ ID NO: 353103 - DNA, 20 bp, human
gtgtggaacgttggcgacct

SEQ ID NO: 353104 - DNA, 20 bp, human
gtcaacagtgtgtggaacgt

SEQ ID NO: 353105 - DNA, 20 bp, human
gctgcactccgctgggctct

SEQ ID NO: 353106 - DNA, 20 bp, human
gcactttgggagtttttgat

SEQ ID NO: 353107 - DNA, 20 bp, human
gtttgggagtttttgatggg

SEQ ID NO: 353108 - DNA, 20 bp, human
gtttaggtctttttttttcg

SEQ ID NO: 353109 - DNA, 20 bp, human
gacatcctgtgttcattaat

SEQ ID NO: 353110 - DNA, 20 bp, human
gctgttgaaggaaattaaag

SEQ ID NO: 353111 - DNA, 20 bp, human
gttattatcactgatagttt

SEQ ID NO: 353112 - DNA, 20 bp, human
gtacacaaaaacttgtatac

SEQ ID NO: 353113 - DNA, 20 bp, human
gaaaaacttgtatacaggcc

SEQ ID NO: 353114 - DNA, 20 bp, human
gacatccaattaatgaacac

SEQ ID NO: 353115 - DNA, 20 bp, human
ggcgccgccctgtggtctga

SEQ ID NO: 353116 - DNA, 20 bp, human
gtttaggtctttttttttcg

SEQ ID NO: 353117 - DNA, 20 bp, human
gtacacaaaaacttgtatac

SEQ ID NO: 353118 - DNA, 20 bp, human
gacatcctgtgttcattaat

SEQ ID NO: 353119 - DNA, 20 bp, human
gctgttgaaggaaattaaag

SEQ ID NO: 353120 - DNA, 20 bp, human
gttattatcactgatagttt

SEQ ID NO: 353121 - DNA, 20 bp, human
gacatccaattaatgaacac

SEQ ID NO: 353122 - DNA, 20 bp, human
ggcgccgccctgtggtctga

SEQ ID NO: 353123 - DNA, 20 bp, human
gacaccctcagaccacaggg

SEQ ID NO: 353124 - DNA, 20 bp, human
gggctcgtggcgccgccctg

SEQ ID NO: 353125 - DNA, 20 bp, human
ggccgcacgctcgtcacagt

SEQ ID NO: 353126 - DNA, 20 bp, human
ggctgcaagcagctaccgca

SEQ ID NO: 353127 - DNA, 20 bp, human
ggcggtgtgtggatgcagat

SEQ ID NO: 353128 - DNA, 20 bp, human
gctcgggcgccccaccagac

SEQ ID NO: 353129 - DNA, 20 bp, human
ggcaagcagctaccgcaggg

SEQ ID NO: 353130 - DNA, 20 bp, human
ggcatccacacaccgccctg

SEQ ID NO: 353131 - DNA, 20 bp, human
gcaggtgttaccagtctggt

SEQ ID NO: 353132 - DNA, 20 bp, human
gcgtctgctgtttggcaccg

SEQ ID NO: 353133 - DNA, 20 bp, human
gtcctctgggaggggcaaga

SEQ ID NO: 353134 - DNA, 20 bp, human
ggacctggggtcctctggga

SEQ ID NO: 353135 - DNA, 20 bp, human
ggtgtggatgcagatgggat

SEQ ID NO: 353136 - DNA, 20 bp, human
gggggaatccaaatggtgtg

SEQ ID NO: 353137 - DNA, 20 bp, human
ggaatgggttccttctgctt

SEQ ID NO: 353138 - DNA, 20 bp, human
gaaggaacccattcacgagt

SEQ ID NO: 353139 - DNA, 20 bp, human
gctccattctggcttcacaa

SEQ ID NO: 353140 - DNA, 20 bp, human
gccgctgcaaatggtcctct

SEQ ID NO: 353141 - DNA, 20 bp, human
ggtgtggctgagagcctaat

SEQ ID NO: 353142 - DNA, 20 bp, human
ggcattgtccaactcgtgaa

SEQ ID NO: 353143 - DNA, 20 bp, human
gtaaggtcggggaatccaaa

SEQ ID NO: 353144 - DNA, 20 bp, human
ggagttgcataaccagggga

SEQ ID NO: 353145 - DNA, 20 bp, human
gagcctgaggacacacacac

SEQ ID NO: 353146 - DNA, 20 bp, human
gcaagtgacctgttctcgtt

SEQ ID NO: 353147 - DNA, 20 bp, human
gggggaacttccagtgtctg

SEQ ID NO: 353148 - DNA, 20 bp, human
gcattaacagcatcagtctt

SEQ ID NO: 353149 - DNA, 20 bp, human
gaagaaaattaaacatacag

SEQ ID NO: 353150 - DNA, 20 bp, human
gcatcagtctttggttctgg

SEQ ID NO: 353151 - DNA, 20 bp, human
gcagcatcagtctttggttc

SEQ ID NO: 353152 - DNA, 20 bp, human
gtaggagggaaagttataag

SEQ ID NO: 353153 - DNA, 20 bp, human
gtcaaggactatccaaagca

SEQ ID NO: 353154 - DNA, 20 bp, human
gttgcacatatctgatagga

SEQ ID NO: 353155 - DNA, 20 bp, human
gtatatagtagaatgcagac

SEQ ID NO: 353156 - DNA, 20 bp, human
gaggactcgcggttccgctc

SEQ ID NO: 353157 - DNA, 20 bp, human
gccccgctggtgaggactcg

SEQ ID NO: 353158 - DNA, 20 bp, human
gccgcccgggcaccccggag

SEQ ID NO: 353159 - DNA, 20 bp, human
gaaccgcgagtcctcaccag

SEQ ID NO: 353160 - DNA, 20 bp, human
ggcacactctgggcgatcgg

SEQ ID NO: 353161 - DNA, 20 bp, human
ggggtcccctcccgggtcac

SEQ ID NO: 353162 - DNA, 20 bp, human
gcggcgcctggctaggagga

SEQ ID NO: 353163 - DNA, 20 bp, human
gggccagtgcaccttatccc

SEQ ID NO: 353164 - DNA, 20 bp, human
ggggcggggacctagagctc

SEQ ID NO: 353165 - DNA, 20 bp, human
gccaggcgcggggcacactc

SEQ ID NO: 353166 - DNA, 20 bp, human
ggggacgctgaggccctcgt

SEQ ID NO: 353167 - DNA, 20 bp, human
gtcccgggacctgggtcggg

SEQ ID NO: 353168 - DNA, 20 bp, human
gtgaaggcgaagtgggacgg

SEQ ID NO: 353169 - DNA, 20 bp, human
ggggtgaaggcgaagtggga

SEQ ID NO: 353170 - DNA, 20 bp, human
gcgcgcccgggttaaccctc

SEQ ID NO: 353171 - DNA, 20 bp, human
gagggagagtgaactggggt

SEQ ID NO: 353172 - DNA, 20 bp, human
ggggccggctcgtttgcctc

SEQ ID NO: 353173 - DNA, 20 bp, human
ggcgtcccgggacctgggtc

SEQ ID NO: 353174 - DNA, 20 bp, human
gggccgaggggggatgtgag

SEQ ID NO: 353175 - DNA, 20 bp, human
gcccccccgacccaggtccc

SEQ ID NO: 353176 - DNA, 20 bp, human
gccccccggggtcgaggcga

SEQ ID NO: 353177 - DNA, 20 bp, human
ggggcggggcgaacctggtg

SEQ ID NO: 353178 - DNA, 20 bp, human
gcgtcgggacagcgtggtaa

SEQ ID NO: 353179 - DNA, 20 bp, human
gcagggatgagaagaagcga

SEQ ID NO: 353180 - DNA, 20 bp, human
gacggggcctccacggccgg

SEQ ID NO: 353181 - DNA, 20 bp, human
ggagaggggcggggcgaacc

SEQ ID NO: 353182 - DNA, 20 bp, human
ggtcccgcccccggccgtgg

SEQ ID NO: 353183 - DNA, 20 bp, human
ggggcgaacctggtgaggcg

SEQ ID NO: 353184 - DNA, 20 bp, human
gcgtggtaacgggactgcca

SEQ ID NO: 353185 - DNA, 20 bp, human
gggggcgagggccttcgcgt

SEQ ID NO: 353186 - DNA, 20 bp, human
ggcaaacacatgttagcaaa

SEQ ID NO: 353187 - DNA, 20 bp, human
gtctgaagtgatcagatgat

SEQ ID NO: 353188 - DNA, 20 bp, human
ggaacacagtgcttaagata

SEQ ID NO: 353189 - DNA, 20 bp, human
ggaactgagtacaaacacat

SEQ ID NO: 353190 - DNA, 20 bp, human
ggagtccagaactgctgtag

SEQ ID NO: 353191 - DNA, 20 bp, human
gtggagtaaatccaggacaa

SEQ ID NO: 353192 - DNA, 20 bp, human
ggctgtagaggaccagttga

SEQ ID NO: 353193 - DNA, 20 bp, human
gtgtttgtaatagattacta

SEQ ID NO: 353194 - DNA, 20 bp, human
gtggtcctctacagcagttc

SEQ ID NO: 353195 - DNA, 20 bp, human
gcagtgcattactgataaag

SEQ ID NO: 353196 - DNA, 20 bp, human
ggagctctaagttcatgcct

SEQ ID NO: 353197 - DNA, 20 bp, human
ggggcaccaacacaaggcag

SEQ ID NO: 353198 - DNA, 20 bp, human
gacgcccccagggtggacaa

SEQ ID NO: 353199 - DNA, 20 bp, human
gccttgtgttggtgcccgtg

SEQ ID NO: 353200 - DNA, 20 bp, human
ggatgctgccaggagtgtgt

SEQ ID NO: 353201 - DNA, 20 bp, human
gagggtggacaaaggtgcct

SEQ ID NO: 353202 - DNA, 20 bp, human
gcacgtgtgtgcatgtccac

SEQ ID NO: 353203 - DNA, 20 bp, human
ggtccacaggaacgccccca

SEQ ID NO: 353204 - DNA, 20 bp, human
gggtcctggccagaccaggc

SEQ ID NO: 353205 - DNA, 20 bp, human
gaggtagtgagcggtgtttc

SEQ ID NO: 353206 - DNA, 20 bp, human
gctgcccgagggttcctcgc

SEQ ID NO: 353207 - DNA, 20 bp, human
gccggccctctgctgcccga

SEQ ID NO: 353208 - DNA, 20 bp, human
gaagcccaccaagcggctgc

SEQ ID NO: 353209 - DNA, 20 bp, human
gcttcccaggacaaacgcga

SEQ ID NO: 353210 - DNA, 20 bp, human
ggagccaggtagctagaaca

SEQ ID NO: 353211 - DNA, 20 bp, human
gccgtcagctccagcctgcg

SEQ ID NO: 353212 - DNA, 20 bp, human
ggaggcgctgcagcccattc

SEQ ID NO: 353213 - DNA, 20 bp, human
gcagcctgcgaggaaccctc

SEQ ID NO: 353214 - DNA, 20 bp, human
gaccccctcgcgtttgtcct

SEQ ID NO: 353215 - DNA, 20 bp, human
gggtgcagcaccacctctag

SEQ ID NO: 353216 - DNA, 20 bp, human
ggggccgggtgcaactttcg

SEQ ID NO: 353217 - DNA, 20 bp, human
gcggggcccgcagccagact

SEQ ID NO: 353218 - DNA, 20 bp, human
gcggcaagagaattggcacg

SEQ ID NO: 353219 - DNA, 20 bp, human
ggcactgctgaccaatcgga

SEQ ID NO: 353220 - DNA, 20 bp, human
gcccgcagccagactgggcc

SEQ ID NO: 353221 - DNA, 20 bp, human
ggctgaccaatcggagggtg

SEQ ID NO: 353222 - DNA, 20 bp, human
gggaaaagcggcaagagaat

SEQ ID NO: 353223 - DNA, 20 bp, human
gtcgcggcagctggagcacg

SEQ ID NO: 353224 - DNA, 20 bp, human
gctgccgcgaaagttgcacc

SEQ ID NO: 353225 - DNA, 20 bp, human
gtccacacgcggcgtcctct

SEQ ID NO: 353226 - DNA, 20 bp, human
gcgcgcggccgcgagagtcc

SEQ ID NO: 353227 - DNA, 20 bp, human
gcctcccgcgaagctccgga

SEQ ID NO: 353228 - DNA, 20 bp, human
gcggcgcccaccgtgcggag

SEQ ID NO: 353229 - DNA, 20 bp, human
gccgagcccctccgcacggt

SEQ ID NO: 353230 - DNA, 20 bp, human
gtcgcccggcgcggccggag

SEQ ID NO: 353231 - DNA, 20 bp, human
gcgagcgcgcgaggtcgggc

SEQ ID NO: 353232 - DNA, 20 bp, human
gcggccgggactctcggctt

SEQ ID NO: 353233 - DNA, 20 bp, human
gtcaccgaagccgagagtcc

SEQ ID NO: 353234 - DNA, 20 bp, human
gcgggcctcccgcgaagctc

SEQ ID NO: 353235 - DNA, 20 bp, human
gccggccgagcccctccgca

SEQ ID NO: 353236 - DNA, 20 bp, human
gtaacactgtcatttcccac

SEQ ID NO: 353237 - DNA, 20 bp, human
gtttggtcctaagttgttta

SEQ ID NO: 353238 - DNA, 20 bp, human
gctttttgaaaagttcctgt

SEQ ID NO: 353239 - DNA, 20 bp, human
gacaatagatcagaatttta

SEQ ID NO: 353240 - DNA, 20 bp, human
gtcatttccctaaacaactt

SEQ ID NO: 353241 - DNA, 20 bp, human
gaaatttgcaaaatgactct

SEQ ID NO: 353242 - DNA, 20 bp, human
gtgaacgagaagttgcactg

SEQ ID NO: 353243 - DNA, 20 bp, human
ggcctgtaatctggaggcta

SEQ ID NO: 353244 - DNA, 20 bp, human
gcaaaaagtttttaaatgtg

SEQ ID NO: 353245 - DNA, 20 bp, human
gaccttagcctccagattac

SEQ ID NO: 353246 - DNA, 20 bp, human
gcacgggactcgaaccccaa

SEQ ID NO: 353247 - DNA, 20 bp, human
gaaaaaggggaacccggctg

SEQ ID NO: 353248 - DNA, 20 bp, human
gcctcctcaccgggctgaga

SEQ ID NO: 353249 - DNA, 20 bp, human
gccacccccaggcgactgtg

SEQ ID NO: 353250 - DNA, 20 bp, human
ggagcccgccccccgcgcgt

SEQ ID NO: 353251 - DNA, 20 bp, human
gcgggcccggggaccgtgct

SEQ ID NO: 353252 - DNA, 20 bp, human
ggagccgcacggtagtagat

SEQ ID NO: 353253 - DNA, 20 bp, human
gaagtcccggcccctggctt

SEQ ID NO: 353254 - DNA, 20 bp, human
gtcggcccccacagtcgcct

SEQ ID NO: 353255 - DNA, 20 bp, human
gccggcccgacagtcgggga

SEQ ID NO: 353256 - DNA, 20 bp, human
gcgcccgccggcggcagtca

SEQ ID NO: 353257 - DNA, 20 bp, human
gagtcacggctgctgccgaa

SEQ ID NO: 353258 - DNA, 20 bp, human
gtgcagactggcacggggat

SEQ ID NO: 353259 - DNA, 20 bp, human
ggcagacgtcagcagcgccc

SEQ ID NO: 353260 - DNA, 20 bp, human
gccccggcttcgagaccctt

SEQ ID NO: 353261 - DNA, 20 bp, human
gcactcgggccacatagcag

SEQ ID NO: 353262 - DNA, 20 bp, human
gcaagaggacgcggattggt

SEQ ID NO: 353263 - DNA, 20 bp, human
gatgggtcagcgcccgccgg

SEQ ID NO: 353264 - DNA, 20 bp, human
ggtcggctgcagactggcac

SEQ ID NO: 353265 - DNA, 20 bp, human
gctgctgacgtctgcggccc

SEQ ID NO: 353266 - DNA, 20 bp, human
gctggagggaggcgagacgt

SEQ ID NO: 353267 - DNA, 20 bp, human
gccgggtaaaaggagtgagg

SEQ ID NO: 353268 - DNA, 20 bp, human
ggtacccctagcacccgcgg

SEQ ID NO: 353269 - DNA, 20 bp, human
gggagtgcgccgccgctgga

SEQ ID NO: 353270 - DNA, 20 bp, human
gcggccgggtaaaaggagtg

SEQ ID NO: 353271 - DNA, 20 bp, human
gtaaaaggagtgagggggcg

SEQ ID NO: 353272 - DNA, 20 bp, human
gggtgctaggggtacccccg

SEQ ID NO: 353273 - DNA, 20 bp, human
ggccccgcgtggggcctcgg

SEQ ID NO: 353274 - DNA, 20 bp, human
gtccaccgccgcgggtgcta

SEQ ID NO: 353275 - DNA, 20 bp, human
ggcggcgcactccaccgccg

SEQ ID NO: 353276 - DNA, 20 bp, human
gcagcctcggggaagagcga

SEQ ID NO: 353277 - DNA, 20 bp, human
ggggggaggctcggagtagg

SEQ ID NO: 353278 - DNA, 20 bp, human
gcctcccttgcctgccgaga

SEQ ID NO: 353279 - DNA, 20 bp, human
gacgtggctgggcaagtcct

SEQ ID NO: 353280 - DNA, 20 bp, human
ggacacgctgagagtttgaa

SEQ ID NO: 353281 - DNA, 20 bp, human
gagcaggcggaggcgcgttt

SEQ ID NO: 353282 - DNA, 20 bp, human
ggagtgggagagcgagcgct

SEQ ID NO: 353283 - DNA, 20 bp, human
gctgccctctcggcaggcaa

SEQ ID NO: 353284 - DNA, 20 bp, human
ggagcgggtcagttggggtt

SEQ ID NO: 353285 - DNA, 20 bp, human
gtcctaggacgggacattgg

SEQ ID NO: 353286 - DNA, 20 bp, human
gttaggacactgacacaaat

SEQ ID NO: 353287 - DNA, 20 bp, human
gaaactaaaggctataatct

SEQ ID NO: 353288 - DNA, 20 bp, human
gaagtcacatacatgtggta

SEQ ID NO: 353289 - DNA, 20 bp, human
gactgacacaaataggtacc

SEQ ID NO: 353290 - DNA, 20 bp, human
gaaaaagagactcagatagt

SEQ ID NO: 353291 - DNA, 20 bp, human
gttcacaatgtgaagatttt

SEQ ID NO: 353292 - DNA, 20 bp, human
ggattatggaatggattcaa

SEQ ID NO: 353293 - DNA, 20 bp, human
gataaagtagctcagtttga

SEQ ID NO: 353294 - DNA, 20 bp, human
gtatttgcatggctttcata

SEQ ID NO: 353295 - DNA, 20 bp, human
gcaatgattcaaagcttatg

SEQ ID NO: 353296 - DNA, 20 bp, human
gggaccagcgcggcgaacga

SEQ ID NO: 353297 - DNA, 20 bp, human
gggctgtagtggaggaataa

SEQ ID NO: 353298 - DNA, 20 bp, human
gcgcgctggtccctgcccag

SEQ ID NO: 353299 - DNA, 20 bp, human
ggtgtccctcgagactccac

SEQ ID NO: 353300 - DNA, 20 bp, human
gacaatacggccgcccaggg

SEQ ID NO: 353301 - DNA, 20 bp, human
gagggacacaggcgtctcca

SEQ ID NO: 353302 - DNA, 20 bp, human
gcgccgcgccggggttgcta

SEQ ID NO: 353303 - DNA, 20 bp, human
ggggtgttcccgtcgcagct

SEQ ID NO: 353304 - DNA, 20 bp, human
ggacccccagcgcggtcacc

SEQ ID NO: 353305 - DNA, 20 bp, human
gggccaggacggctggtccc

SEQ ID NO: 353306 - DNA, 20 bp, human
gtcactcaaaggccccaaat

SEQ ID NO: 353307 - DNA, 20 bp, human
gaggtcgtggaccaactcta

SEQ ID NO: 353308 - DNA, 20 bp, human
gaggtctgttgtgaaggtcg

SEQ ID NO: 353309 - DNA, 20 bp, human
gaaattaggctcagaataca

SEQ ID NO: 353310 - DNA, 20 bp, human
ggggctgatgagagcccatt

SEQ ID NO: 353311 - DNA, 20 bp, human
ggccactaggtctgttgtga

SEQ ID NO: 353312 - DNA, 20 bp, human
gaccttcacaacagacctag

SEQ ID NO: 353313 - DNA, 20 bp, human
gtgagcagcatccctagagt

SEQ ID NO: 353314 - DNA, 20 bp, human
gtgactgtacaaatctaaga

SEQ ID NO: 353315 - DNA, 20 bp, human
gccaactacatagatagatg

SEQ ID NO: 353316 - DNA, 20 bp, human
gtggctggacggtcgtagct

SEQ ID NO: 353317 - DNA, 20 bp, human
gaaggaagttgcttcctgga

SEQ ID NO: 353318 - DNA, 20 bp, human
gatgtctccaccaatgtcag

SEQ ID NO: 353319 - DNA, 20 bp, human
gccggcagctcgaggaccaa

SEQ ID NO: 353320 - DNA, 20 bp, human
ggaaggtggagagaaatagc

SEQ ID NO: 353321 - DNA, 20 bp, human
gtctaaacctctgacattgg

SEQ ID NO: 353322 - DNA, 20 bp, human
gtggaaggaaaagtaccagc

SEQ ID NO: 353323 - DNA, 20 bp, human
ggcagctcgaggaccaaagg

SEQ ID NO: 353324 - DNA, 20 bp, human
ggaaaatccttctgaaaagt

SEQ ID NO: 353325 - DNA, 20 bp, human
gacaggacgcaggcatgtga

SEQ ID NO: 353326 - DNA, 20 bp, human
gctctcttgctaaccggcca

SEQ ID NO: 353327 - DNA, 20 bp, human
gtctgctacaggcactactg

SEQ ID NO: 353328 - DNA, 20 bp, human
gtagtgcctgtagcagagaa

SEQ ID NO: 353329 - DNA, 20 bp, human
gttgctaaccggccagggca

SEQ ID NO: 353330 - DNA, 20 bp, human
gcaggcactactgtggcata

SEQ ID NO: 353331 - DNA, 20 bp, human
gttcctctaaggctctggat

SEQ ID NO: 353332 - DNA, 20 bp, human
gtaaactgtgcacaggtcat

SEQ ID NO: 353333 - DNA, 20 bp, human
gcagcctgcagtttcctcta

SEQ ID NO: 353334 - DNA, 20 bp, human
gctcacatcttccttgtgat

SEQ ID NO: 353335 - DNA, 20 bp, human
ggtcttggaccacttcagat

SEQ ID NO: 353336 - DNA, 20 bp, human
gcacccttgccgaccggggc

SEQ ID NO: 353337 - DNA, 20 bp, human
gtgcccgccccggtcggcaa

SEQ ID NO: 353338 - DNA, 20 bp, human
gctgcagcggcgcccgctgt

SEQ ID NO: 353339 - DNA, 20 bp, human
gcccgctgtcggatgccgag

SEQ ID NO: 353340 - DNA, 20 bp, human
gcgccgctgcagcagctcgc

SEQ ID NO: 353341 - DNA, 20 bp, human
gcgcgggccgcggagctgaa

SEQ ID NO: 353342 - DNA, 20 bp, human
gagtctctcggttttctcgg

SEQ ID NO: 353343 - DNA, 20 bp, human
gggcccctccctgcagcacg

SEQ ID NO: 353344 - DNA, 20 bp, human
gcgccagcaacacgtcagtg

SEQ ID NO: 353345 - DNA, 20 bp, human
gaacacatattaatggggtg

SEQ ID NO: 353346 - DNA, 20 bp, human
gcgaaggtgccggctcggat

SEQ ID NO: 353347 - DNA, 20 bp, human
gcacaccgcccgggcctccc

SEQ ID NO: 353348 - DNA, 20 bp, human
gcaggggcgtccgaaggtgc

SEQ ID NO: 353349 - DNA, 20 bp, human
ggggacagtcacgtgggaca

SEQ ID NO: 353350 - DNA, 20 bp, human
gcgccctcgcgcccctcggg

SEQ ID NO: 353351 - DNA, 20 bp, human
gggccgccgccacaccgccc

SEQ ID NO: 353352 - DNA, 20 bp, human
gggcgcacgtacacacgcgc

SEQ ID NO: 353353 - DNA, 20 bp, human
ggcgtccgaaggtgccggct

SEQ ID NO: 353354 - DNA, 20 bp, human
ggggtggtctagtgaatgga

SEQ ID NO: 353355 - DNA, 20 bp, human
gagggaggaaggctgtgcga

SEQ ID NO: 353356 - DNA, 20 bp, human
gtaagtgcataaactgtgga

SEQ ID NO: 353357 - DNA, 20 bp, human
gcagacgcagagaatcggtc

SEQ ID NO: 353358 - DNA, 20 bp, human
gcgcgggcccgcacattgat

SEQ ID NO: 353359 - DNA, 20 bp, human
gtggataagtgcataaactg

SEQ ID NO: 353360 - DNA, 20 bp, human
gggcccgcacattgatagga

SEQ ID NO: 353361 - DNA, 20 bp, human
ggcaagcaattggctctaat

SEQ ID NO: 353362 - DNA, 20 bp, human
ggatgaatctgtggcgggac

SEQ ID NO: 353363 - DNA, 20 bp, human
gcgtccccaaagcaagcaat

SEQ ID NO: 353364 - DNA, 20 bp, human
ggacaagcccttagagacga

SEQ ID NO: 353365 - DNA, 20 bp, human
gtccggctgacgttgttcgc

SEQ ID NO: 353366 - DNA, 20 bp, human
gcacagacagctgcctccga

SEQ ID NO: 353367 - DNA, 20 bp, human
ggggagcgggagagccacac

SEQ ID NO: 353368 - DNA, 20 bp, human
gcactgccacgcagagtcgg

SEQ ID NO: 353369 - DNA, 20 bp, human
gtctgtgagcgagctgggag

SEQ ID NO: 353370 - DNA, 20 bp, human
gagggagggaagagatcacc

SEQ ID NO: 353371 - DNA, 20 bp, human
gaaacggggtaactggcttg

SEQ ID NO: 353372 - DNA, 20 bp, human
gggaggcgaaacggggtaac

SEQ ID NO: 353373 - DNA, 20 bp, human
ggacacaaggaggcgaaacg

SEQ ID NO: 353374 - DNA, 20 bp, human
gggtggctctccagaattca

SEQ ID NO: 353375 - DNA, 20 bp, human
gtctgcctctccctgaattc

SEQ ID NO: 353376 - DNA, 20 bp, human
gtctgcacgcccatcctcat

SEQ ID NO: 353377 - DNA, 20 bp, human
ggcacccagaggctgtgcgg

SEQ ID NO: 353378 - DNA, 20 bp, human
ggcatcctgccaatgaggat

SEQ ID NO: 353379 - DNA, 20 bp, human
ggccgccgcccgctgggtgt

SEQ ID NO: 353380 - DNA, 20 bp, human
gcacgcccatcctcattggc

SEQ ID NO: 353381 - DNA, 20 bp, human
gcccgctgctggctgaaggt

SEQ ID NO: 353382 - DNA, 20 bp, human
ggggcgtgcagactgtgccc

SEQ ID NO: 353383 - DNA, 20 bp, human
gcttctgcatcctgccaatg

SEQ ID NO: 353384 - DNA, 20 bp, human
ggcctacacccagcgggcgg

SEQ ID NO: 353385 - DNA, 20 bp, human
gcacagcctctgggtgcaga

SEQ ID NO: 353386 - DNA, 20 bp, human
ggggcgcccacctgccgcca

SEQ ID NO: 353387 - DNA, 20 bp, human
gaatccgcgagcggcgccgc

SEQ ID NO: 353388 - DNA, 20 bp, human
gggcgcctagtgagagtcag

SEQ ID NO: 353389 - DNA, 20 bp, human
gggtctcacctgctgctccg

SEQ ID NO: 353390 - DNA, 20 bp, human
ggcgccagccaatccgcgag

SEQ ID NO: 353391 - DNA, 20 bp, human
gcagctgctttccaagtcag

SEQ ID NO: 353392 - DNA, 20 bp, human
gaactccgccccaagttaaa

SEQ ID NO: 353393 - DNA, 20 bp, human
ggcgcatgctaatgagcccg

SEQ ID NO: 353394 - DNA, 20 bp, human
ggcagcgagccttttaactt

SEQ ID NO: 353395 - DNA, 20 bp, human
gccaccgcgctgtattagtg

SEQ ID NO: 353396 - DNA, 20 bp, human
gcgcgtgcccagaacgtgag

SEQ ID NO: 353397 - DNA, 20 bp, human
gggagccgggctgacactag

SEQ ID NO: 353398 - DNA, 20 bp, human
gccacggcggagtaaggggt

SEQ ID NO: 353399 - DNA, 20 bp, human
gcggggaggtcacgtgtggg

SEQ ID NO: 353400 - DNA, 20 bp, human
gctgccaccccctggatcag

SEQ ID NO: 353401 - DNA, 20 bp, human
gagctggagtaggaagcgta

SEQ ID NO: 353402 - DNA, 20 bp, human
gcccacctctagtgtcagcc

SEQ ID NO: 353403 - DNA, 20 bp, human
ggtgcccagaacgtgagggg

SEQ ID NO: 353404 - DNA, 20 bp, human
gcacgcggggaggtcacgtg

SEQ ID NO: 353405 - DNA, 20 bp, human
ggggccagatcgccgcgcga

SEQ ID NO: 353406 - DNA, 20 bp, human
gcaaggggattcagcagatt

SEQ ID NO: 353407 - DNA, 20 bp, human
gaggagtcttgtatgtccaa

SEQ ID NO: 353408 - DNA, 20 bp, human
gaagacttatcttcagatta

SEQ ID NO: 353409 - DNA, 20 bp, human
gagattaaggcctacaccag

SEQ ID NO: 353410 - DNA, 20 bp, human
gtgaagagtcttcagaggaa

SEQ ID NO: 353411 - DNA, 20 bp, human
gctcctaagggtcttgtaaa

SEQ ID NO: 353412 - DNA, 20 bp, human
gctaaaggcttaagtatagg

SEQ ID NO: 353413 - DNA, 20 bp, human
ggcaaaagtcaccctagcat

SEQ ID NO: 353414 - DNA, 20 bp, human
gagtcaccctagcatgggag

SEQ ID NO: 353415 - DNA, 20 bp, human
gtcctgggctgaagcaatgg

SEQ ID NO: 353416 - DNA, 20 bp, human
gtaaaatgccccacccattg

SEQ ID NO: 353417 - DNA, 20 bp, human
gcataattttccccaatggg

SEQ ID NO: 353418 - DNA, 20 bp, human
gggcctgtgcaatagattgt

SEQ ID NO: 353419 - DNA, 20 bp, human
gcaatgaaattgtgagaacc

SEQ ID NO: 353420 - DNA, 20 bp, human
gaagttaaacatgattctag

SEQ ID NO: 353421 - DNA, 20 bp, human
ggagcataattttccccaat

SEQ ID NO: 353422 - DNA, 20 bp, human
gttgtggtaggctttgtaga

SEQ ID NO: 353423 - DNA, 20 bp, human
gcaaagcctaccacaatatt

SEQ ID NO: 353424 - DNA, 20 bp, human
gtgccaacaatctattgcac

SEQ ID NO: 353425 - DNA, 20 bp, human
gtattgtataccaaatattg

SEQ ID NO: 353426 - DNA, 20 bp, human
gaacccggggcgccccggat

SEQ ID NO: 353427 - DNA, 20 bp, human
gaaagcggacggctcggccg

SEQ ID NO: 353428 - DNA, 20 bp, human
ggggagggccttaaagcgga

SEQ ID NO: 353429 - DNA, 20 bp, human
gcacgtgcgcgcgaagacgt

SEQ ID NO: 353430 - DNA, 20 bp, human
gcacaactaagcatgcgccg

SEQ ID NO: 353431 - DNA, 20 bp, human
gagaccgcgtgcgccggcag

SEQ ID NO: 353432 - DNA, 20 bp, human
gaagacgtggggacgcaggc

SEQ ID NO: 353433 - DNA, 20 bp, human
gcacgcacgttcccgatccg

SEQ ID NO: 353434 - DNA, 20 bp, human
gccaacggacgcctctgccc

SEQ ID NO: 353435 - DNA, 20 bp, human
gccaccctccgcctaacagg

SEQ ID NO: 353436 - DNA, 20 bp, human
gccccccccccgtgcgtggg

SEQ ID NO: 353437 - DNA, 20 bp, human
ggtcggggccacttccgggt

SEQ ID NO: 353438 - DNA, 20 bp, human
gccggcctcccacgcacggg

SEQ ID NO: 353439 - DNA, 20 bp, human
ggggaggcgtggcctccggc

SEQ ID NO: 353440 - DNA, 20 bp, human
ggggggctgatcggcgctac

SEQ ID NO: 353441 - DNA, 20 bp, human
ggtcccggcctcccacgcac

SEQ ID NO: 353442 - DNA, 20 bp, human
gggacaacttggcatggggc

SEQ ID NO: 353443 - DNA, 20 bp, human
gctgatcggcgctaccggat

SEQ ID NO: 353444 - DNA, 20 bp, human
gagtaggatggaatcaaaca

SEQ ID NO: 353445 - DNA, 20 bp, human
gggattggacaacttggcat

SEQ ID NO: 353446 - DNA, 20 bp, human
gaggctctcagcacgagact

SEQ ID NO: 353447 - DNA, 20 bp, human
gtctcagcgtgaaaccggag

SEQ ID NO: 353448 - DNA, 20 bp, human
ggggccagagcgggggtgag

SEQ ID NO: 353449 - DNA, 20 bp, human
gcatctaaggggccagagcg

SEQ ID NO: 353450 - DNA, 20 bp, human
ggagacggagatcggcggga

SEQ ID NO: 353451 - DNA, 20 bp, human
gccatcgggccaggccacgg

SEQ ID NO: 353452 - DNA, 20 bp, human
gttggcccgagtgtcacgtc

SEQ ID NO: 353453 - DNA, 20 bp, human
gtggcccgatggtcgcgccc

SEQ ID NO: 353454 - DNA, 20 bp, human
gagcacgagactaggctgtt

SEQ ID NO: 353455 - DNA, 20 bp, human
gagcgcccgacgtgacactc

SEQ ID NO: 353456 - DNA, 20 bp, human
ggcccgacggaggacctggt

SEQ ID NO: 353457 - DNA, 20 bp, human
gccgcctgcggggacacctg

SEQ ID NO: 353458 - DNA, 20 bp, human
gtccccgcaggcggaccctg

SEQ ID NO: 353459 - DNA, 20 bp, human
gagcccggcggccttccggg

SEQ ID NO: 353460 - DNA, 20 bp, human
gtccccagggtccgcctgcg

SEQ ID NO: 353461 - DNA, 20 bp, human
gtcccaccaggtcctccgtc

SEQ ID NO: 353462 - DNA, 20 bp, human
gtcaatctggagccagggag

SEQ ID NO: 353463 - DNA, 20 bp, human
gagagcaggcacggggtaaa

SEQ ID NO: 353464 - DNA, 20 bp, human
ggaggatgggtgtgtatccc

SEQ ID NO: 353465 - DNA, 20 bp, human
gtcgcgctgactcagagctc

SEQ ID NO: 353466 - DNA, 20 bp, human
gggggcgtggccgggctcat

SEQ ID NO: 353467 - DNA, 20 bp, human
ggggaggggcgacttgaaga

SEQ ID NO: 353468 - DNA, 20 bp, human
gggccgcccgcgcgcaggta

SEQ ID NO: 353469 - DNA, 20 bp, human
ggaggcctcagggtccagga

SEQ ID NO: 353470 - DNA, 20 bp, human
gcttctacggggtgtgtagg

SEQ ID NO: 353471 - DNA, 20 bp, human
gcctgcgagcggctgggcgg

SEQ ID NO: 353472 - DNA, 20 bp, human
gtgaggacgccaagagggaa

SEQ ID NO: 353473 - DNA, 20 bp, human
gaagagagaaggaaccacct

SEQ ID NO: 353474 - DNA, 20 bp, human
gctagctctgctgtgccctt

SEQ ID NO: 353475 - DNA, 20 bp, human
gacacctggccccttggctt

SEQ ID NO: 353476 - DNA, 20 bp, human
gggggagcaagcagtggtca

SEQ ID NO: 353477 - DNA, 20 bp, human
ggtaaatggagtcacgggga

SEQ ID NO: 353478 - DNA, 20 bp, human
ggggggccggcgctgagacg

SEQ ID NO: 353479 - DNA, 20 bp, human
gtggagctgcgccagagcgg

SEQ ID NO: 353480 - DNA, 20 bp, human
gagggcgaacggtcttgcat

SEQ ID NO: 353481 - DNA, 20 bp, human
gtggaggcggttcctgtccg

SEQ ID NO: 353482 - DNA, 20 bp, human
gtgcacgcggacgcacaccc

SEQ ID NO: 353483 - DNA, 20 bp, human
gcgctggtaaatggagtcac

SEQ ID NO: 353484 - DNA, 20 bp, human
ggctgagacgcggtgctagc

SEQ ID NO: 353485 - DNA, 20 bp, human
gacagccgcctcttaggagg

SEQ ID NO: 353486 - DNA, 20 bp, human
gctggcctctccaattaccc

SEQ ID NO: 353487 - DNA, 20 bp, human
gacccgccttgatgtggctg

SEQ ID NO: 353488 - DNA, 20 bp, human
gaccaggcaggcccctgccg

SEQ ID NO: 353489 - DNA, 20 bp, human
gggcgcctgggtaattggag

SEQ ID NO: 353490 - DNA, 20 bp, human
ggctgagacccgccttgatg

SEQ ID NO: 353491 - DNA, 20 bp, human
ggccaattgctgcccagctg

SEQ ID NO: 353492 - DNA, 20 bp, human
gacaccaccgaaagtctccc

SEQ ID NO: 353493 - DNA, 20 bp, human
gcaggcctctggcataatga

SEQ ID NO: 353494 - DNA, 20 bp, human
gtcaaggcgggtctcagccc

SEQ ID NO: 353495 - DNA, 20 bp, human
gccacccattcattggtacc

SEQ ID NO: 353496 - DNA, 20 bp, human
gaggaggactcattcatcca

SEQ ID NO: 353497 - DNA, 20 bp, human
gaagacccaagcaggcgaag

SEQ ID NO: 353498 - DNA, 20 bp, human
gacccaagcaggcgaagagg

SEQ ID NO: 353499 - DNA, 20 bp, human
gcctgtactgggcaccaggg

SEQ ID NO: 353500 - DNA, 20 bp, human
ggacccaggcatgaagcagg

SEQ ID NO: 353501 - DNA, 20 bp, human
gtcctcctcttcgcctgctt

SEQ ID NO: 353502 - DNA, 20 bp, human
gctctgacgcctcaaccggg

SEQ ID NO: 353503 - DNA, 20 bp, human
ggtcttagccagggagccgg

SEQ ID NO: 353504 - DNA, 20 bp, human
gggggacccaggcatgaagc

SEQ ID NO: 353505 - DNA, 20 bp, human
gtgcttggcagtcttgctcc

SEQ ID NO: 353506 - DNA, 20 bp, human
gcgggcccagtcggtcagag

SEQ ID NO: 353507 - DNA, 20 bp, human
gtccccggcccggtcaccac

SEQ ID NO: 353508 - DNA, 20 bp, human
gctgaccgactgggcccggg

SEQ ID NO: 353509 - DNA, 20 bp, human
gcgcgccgctctgaccgact

SEQ ID NO: 353510 - DNA, 20 bp, human
ggtgcaggccggtggtgacc

SEQ ID NO: 353511 - DNA, 20 bp, human
gcctccccgcggagtcctcg

SEQ ID NO: 353512 - DNA, 20 bp, human
gccgcccccgaggactccgc

SEQ ID NO: 353513 - DNA, 20 bp, human
gtcaccaccggcctgcactc

SEQ ID NO: 353514 - DNA, 20 bp, human
gatggggactgcgccgtccc

SEQ ID NO: 353515 - DNA, 20 bp, human
gtgcactccgggcccgggct

SEQ ID NO: 353516 - DNA, 20 bp, human
ggccccggggaccaggagcg

SEQ ID NO: 353517 - DNA, 20 bp, human
gacgccccgctcctggtccc

SEQ ID NO: 353518 - DNA, 20 bp, human
ggaccaggagcggggcgtcg

SEQ ID NO: 353519 - DNA, 20 bp, human
ggaagggagtcgcacagtcc

SEQ ID NO: 353520 - DNA, 20 bp, human
gcaaggtagggccaagactt

SEQ ID NO: 353521 - DNA, 20 bp, human
gccacagctgtgccctatca

SEQ ID NO: 353522 - DNA, 20 bp, human
gtggaccctcggcccaaggt

SEQ ID NO: 353523 - DNA, 20 bp, human
gaaagaccccggtctgggct

SEQ ID NO: 353524 - DNA, 20 bp, human
gccgtgagcagggcctctgt

SEQ ID NO: 353525 - DNA, 20 bp, human
ggctgatcctggcactgtta

SEQ ID NO: 353526 - DNA, 20 bp, human
gacgtcgcgggaagctggca

SEQ ID NO: 353527 - DNA, 20 bp, human
gggtccccggcgctgttcct

SEQ ID NO: 353528 - DNA, 20 bp, human
gcgcgctgtcaccacgtcgc

SEQ ID NO: 353529 - DNA, 20 bp, human
gtctgtgtgaccggcctcag

SEQ ID NO: 353530 - DNA, 20 bp, human
gcggggccgccacctccgat

SEQ ID NO: 353531 - DNA, 20 bp, human
gctctccagcatccgcagaa

SEQ ID NO: 353532 - DNA, 20 bp, human
gagcatcccaggaacagcgc

SEQ ID NO: 353533 - DNA, 20 bp, human
gcagtcgcgtcattatgtaa

SEQ ID NO: 353534 - DNA, 20 bp, human
gacgtagcgcagagatgccc

SEQ ID NO: 353535 - DNA, 20 bp, human
gcgcgccggccaatcggagg

SEQ ID NO: 353536 - DNA, 20 bp, human
gggagcagaggctaaggcag

SEQ ID NO: 353537 - DNA, 20 bp, human
ggcagtgggcaggaggatca

SEQ ID NO: 353538 - DNA, 20 bp, human
gagaaaggccccagtatcaa

SEQ ID NO: 353539 - DNA, 20 bp, human
gccgacgcggggaatctttt

SEQ ID NO: 353540 - DNA, 20 bp, human
gaggggcccaacccaagccg

SEQ ID NO: 353541 - DNA, 20 bp, human
gcgcgctcgcccaactggca

SEQ ID NO: 353542 - DNA, 20 bp, human
ggggcacggagcagctgact

SEQ ID NO: 353543 - DNA, 20 bp, human
gtgtcccccagcccgacgcg

SEQ ID NO: 353544 - DNA, 20 bp, human
ggattccccgcgtcgggctg

SEQ ID NO: 353545 - DNA, 20 bp, human
ggggttgggcccctgccagt

SEQ ID NO: 353546 - DNA, 20 bp, human
gggttgtgctggcctctcta

SEQ ID NO: 353547 - DNA, 20 bp, human
gcagaagagaaaggagatgt

SEQ ID NO: 353548 - DNA, 20 bp, human
ggctctagtaaaaacctgga

SEQ ID NO: 353549 - DNA, 20 bp, human
gggatcctgatccagcctta

SEQ ID NO: 353550 - DNA, 20 bp, human
gctggatcaggatcccctcc

SEQ ID NO: 353551 - DNA, 20 bp, human
ggagaaaggagatgtgggtt

SEQ ID NO: 353552 - DNA, 20 bp, human
gtttggctctagtaaaaacc

SEQ ID NO: 353553 - DNA, 20 bp, human
gaagcagagggactatgatg

SEQ ID NO: 353554 - DNA, 20 bp, human
gccgccaaaggccttatctc

SEQ ID NO: 353555 - DNA, 20 bp, human
gcagagggactatgatgggg

SEQ ID NO: 353556 - DNA, 20 bp, human
gctaccgcgctgttgggcgc

SEQ ID NO: 353557 - DNA, 20 bp, human
gcaacagcgcggtagcagcg

SEQ ID NO: 353558 - DNA, 20 bp, human
ggaggcggagagacaaacgg

SEQ ID NO: 353559 - DNA, 20 bp, human
gtctcccgcccgcccctaac

SEQ ID NO: 353560 - DNA, 20 bp, human
ggcagggcggggcaataggt

SEQ ID NO: 353561 - DNA, 20 bp, human
gccgcccgcccctaaccggt

SEQ ID NO: 353562 - DNA, 20 bp, human
gccgttctggccaatcacca

SEQ ID NO: 353563 - DNA, 20 bp, human
ggggcgccggctaggtttga

SEQ ID NO: 353564 - DNA, 20 bp, human
gtagccggcgcccaacagcg

SEQ ID NO: 353565 - DNA, 20 bp, human
gcagccgcgcgatgacgtgt

SEQ ID NO: 353566 - DNA, 20 bp, human
gatttacagcctagctgaag

SEQ ID NO: 353567 - DNA, 20 bp, human
gcaaacgcctttaggacccc

SEQ ID NO: 353568 - DNA, 20 bp, human
ggaccaatggcgagcggcct

SEQ ID NO: 353569 - DNA, 20 bp, human
gcccccaggccgctcgccat

SEQ ID NO: 353570 - DNA, 20 bp, human
gctaatggaccaatggcgag

SEQ ID NO: 353571 - DNA, 20 bp, human
gggcggtgccgccagcagga

SEQ ID NO: 353572 - DNA, 20 bp, human
gtcacgtggagcgggagaac

SEQ ID NO: 353573 - DNA, 20 bp, human
gcgccattggtccattagaa

SEQ ID NO: 353574 - DNA, 20 bp, human
gccgcccttacccattctaa

SEQ ID NO: 353575 - DNA, 20 bp, human
gcgcgtgcgcagactggagc

SEQ ID NO: 353576 - DNA, 20 bp, human
ggcgtctagcagcagggcac

SEQ ID NO: 353577 - DNA, 20 bp, human
ggagcgttaaggtcacgtga

SEQ ID NO: 353578 - DNA, 20 bp, human
gcaacctgggggccgagcca

SEQ ID NO: 353579 - DNA, 20 bp, human
gaccccgggggatcccggga

SEQ ID NO: 353580 - DNA, 20 bp, human
gggtgagcgggatgcagcaa

SEQ ID NO: 353581 - DNA, 20 bp, human
gagcaggggagtgtgtatgc

SEQ ID NO: 353582 - DNA, 20 bp, human
ggggtccccggcggtgcggg

SEQ ID NO: 353583 - DNA, 20 bp, human
gcgagccagggccccggacg

SEQ ID NO: 353584 - DNA, 20 bp, human
gcggagctacggcctaacgg

SEQ ID NO: 353585 - DNA, 20 bp, human
gggagcccggagcccgcctt

SEQ ID NO: 353586 - DNA, 20 bp, human
gtaggaggaagcctgaggtc

SEQ ID NO: 353587 - DNA, 20 bp, human
ggtggcctgggtttgaaata

SEQ ID NO: 353588 - DNA, 20 bp, human
gcagaaactgagggcctaat

SEQ ID NO: 353589 - DNA, 20 bp, human
gggcctaattggcttctaag

SEQ ID NO: 353590 - DNA, 20 bp, human
gcagccaggagcttaggagg

SEQ ID NO: 353591 - DNA, 20 bp, human
gactccagaggtaacttgtg

SEQ ID NO: 353592 - DNA, 20 bp, human
gccaggccaccagactgagc

SEQ ID NO: 353593 - DNA, 20 bp, human
gtgtgacgagatgagagact

SEQ ID NO: 353594 - DNA, 20 bp, human
gctcctgtcagaggagtgtg

SEQ ID NO: 353595 - DNA, 20 bp, human
gcccctcttagaagccaatt

SEQ ID NO: 353596 - DNA, 20 bp, human
gcagccgcgtggggcatcac

SEQ ID NO: 353597 - DNA, 20 bp, human
gtggggcatcacgggaactc

SEQ ID NO: 353598 - DNA, 20 bp, human
gaagagttggcagttcgggg

SEQ ID NO: 353599 - DNA, 20 bp, human
gccccaccctgcttgcttaa

SEQ ID NO: 353600 - DNA, 20 bp, human
gggctgcaatgattggttaa

SEQ ID NO: 353601 - DNA, 20 bp, human
gacgggctcctgagcaatag

SEQ ID NO: 353602 - DNA, 20 bp, human
gcccacgcggctgcaatgat

SEQ ID NO: 353603 - DNA, 20 bp, human
gttaagggatgagtgactcc

SEQ ID NO: 353604 - DNA, 20 bp, human
ggtgaagagttggcagttcg

SEQ ID NO: 353605 - DNA, 20 bp, human
gctcgagccggcacaggtcg

SEQ ID NO: 353606 - DNA, 20 bp, human
ggcagggccagcttgattga

SEQ ID NO: 353607 - DNA, 20 bp, human
gaccccgcgcgcaaacgctg

SEQ ID NO: 353608 - DNA, 20 bp, human
gctgggagaggcagcgaccg

SEQ ID NO: 353609 - DNA, 20 bp, human
ggccgccccctgcagcccga

SEQ ID NO: 353610 - DNA, 20 bp, human
gcgcgcaaacgctgcggcga

SEQ ID NO: 353611 - DNA, 20 bp, human
gccagcttgattgacggccc

SEQ ID NO: 353612 - DNA, 20 bp, human
gtaccgccagagccccgcag

SEQ ID NO: 353613 - DNA, 20 bp, human
gaagaggggcaattctgaat

SEQ ID NO: 353614 - DNA, 20 bp, human
gtggctgtctggagcctcca

SEQ ID NO: 353615 - DNA, 20 bp, human
gaaacgctgcggcgaaggag

SEQ ID NO: 353616 - DNA, 20 bp, human
gaacgtcacagtgcgagcgg

SEQ ID NO: 353617 - DNA, 20 bp, human
ggcggggcagccaggcggaa

SEQ ID NO: 353618 - DNA, 20 bp, human
ggaccggccgcggactccga

SEQ ID NO: 353619 - DNA, 20 bp, human
gggagggctgcgggtggaaa

SEQ ID NO: 353620 - DNA, 20 bp, human
gtggatataaatagccgcga

SEQ ID NO: 353621 - DNA, 20 bp, human
gcgcggccggtcagctccta

SEQ ID NO: 353622 - DNA, 20 bp, human
ggctaacgtcacagtgcgag

SEQ ID NO: 353623 - DNA, 20 bp, human
ggagcccagctgctgactaa

SEQ ID NO: 353624 - DNA, 20 bp, human
ggcacggaggcggatcgccc

SEQ ID NO: 353625 - DNA, 20 bp, human
gacaaaccgacacagagcat

SEQ ID NO: 353626 - DNA, 20 bp, human
gaggggcggaagagcgcggg

SEQ ID NO: 353627 - DNA, 20 bp, human
gcgggaggggcggaagagcg

SEQ ID NO: 353628 - DNA, 20 bp, human
gcctccccgcggcgtcgctg

SEQ ID NO: 353629 - DNA, 20 bp, human
gggaaaggggaaaaccccgt

SEQ ID NO: 353630 - DNA, 20 bp, human
ggggagcggtgctgcgaggc

SEQ ID NO: 353631 - DNA, 20 bp, human
gtgctgcgaggcgggatctg

SEQ ID NO: 353632 - DNA, 20 bp, human
gttggtggaaagcgttcggg

SEQ ID NO: 353633 - DNA, 20 bp, human
ggacgccgcggggagggtct

SEQ ID NO: 353634 - DNA, 20 bp, human
gccgtcacggctgtcgtctt

SEQ ID NO: 353635 - DNA, 20 bp, human
gcgagccgagaccctccccg

SEQ ID NO: 353636 - DNA, 20 bp, human
gatggggcccccgctcactc

SEQ ID NO: 353637 - DNA, 20 bp, human
ggctgcgcccggtccgctga

SEQ ID NO: 353638 - DNA, 20 bp, human
gagctcccggggcctccgcg

SEQ ID NO: 353639 - DNA, 20 bp, human
gcggtcaaggccaagagggg

SEQ ID NO: 353640 - DNA, 20 bp, human
gagagccaggaaaggggggt

SEQ ID NO: 353641 - DNA, 20 bp, human
ggcccccgctcactccggac

SEQ ID NO: 353642 - DNA, 20 bp, human
gttggcggctgggagctctc

SEQ ID NO: 353643 - DNA, 20 bp, human
ggccaagagggggggaaatc

SEQ ID NO: 353644 - DNA, 20 bp, human
gcgtaaccagagccaggaaa

SEQ ID NO: 353645 - DNA, 20 bp, human
gggaaatcgggttgctgggg

SEQ ID NO: 353646 - DNA, 20 bp, human
gtggctctccccgacctgga

SEQ ID NO: 353647 - DNA, 20 bp, human
gtcctcccctaggggattga

SEQ ID NO: 353648 - DNA, 20 bp, human
gttaagaggtgctcggggtg

SEQ ID NO: 353649 - DNA, 20 bp, human
gcaggggcgtccacccctcc

SEQ ID NO: 353650 - DNA, 20 bp, human
gcccctaggggattgaaggc

SEQ ID NO: 353651 - DNA, 20 bp, human
gtggccgcttggccacagga

SEQ ID NO: 353652 - DNA, 20 bp, human
ggacgccggtcctcccctag

SEQ ID NO: 353653 - DNA, 20 bp, human
gaggtgctcggggtggggtc

SEQ ID NO: 353654 - DNA, 20 bp, human
gggagattcctggactgcgg

SEQ ID NO: 353655 - DNA, 20 bp, human
gcccagccttcaatccccta

SEQ ID NO: 353656 - DNA, 20 bp, human
ggggccacgggaggtcggaa

SEQ ID NO: 353657 - DNA, 20 bp, human
gggggcgggggtgtgctcag

SEQ ID NO: 353658 - DNA, 20 bp, human
gcggggcaggaatgtggaag

SEQ ID NO: 353659 - DNA, 20 bp, human
gctcgggcagcgtttcttca

SEQ ID NO: 353660 - DNA, 20 bp, human
gcgctggggccacgggaggt

SEQ ID NO: 353661 - DNA, 20 bp, human
gctagacggcctggagagga

SEQ ID NO: 353662 - DNA, 20 bp, human
gagcgcggccagctcacagt

SEQ ID NO: 353663 - DNA, 20 bp, human
ggtttcttcagggacctaga

SEQ ID NO: 353664 - DNA, 20 bp, human
ggggcagccacctgacaccg

SEQ ID NO: 353665 - DNA, 20 bp, human
gcgtggctggccacgatcta

SEQ ID NO: 353666 - DNA, 20 bp, human
gagctgaatacccacaccca

SEQ ID NO: 353667 - DNA, 20 bp, human
gagagggtccctgccgaagg

SEQ ID NO: 353668 - DNA, 20 bp, human
ggaggcacagccagccaatc

SEQ ID NO: 353669 - DNA, 20 bp, human
gctgcagcaccggaaaaacg

SEQ ID NO: 353670 - DNA, 20 bp, human
ggtggctgcccagcgactcc

SEQ ID NO: 353671 - DNA, 20 bp, human
gaggggcgcgacgtgacgcg

SEQ ID NO: 353672 - DNA, 20 bp, human
gcaatccgggagaccctgtc

SEQ ID NO: 353673 - DNA, 20 bp, human
gaggcggagcctgctaatca

SEQ ID NO: 353674 - DNA, 20 bp, human
gccggtgctgcagtatccct

SEQ ID NO: 353675 - DNA, 20 bp, human
gaggcggcgctgctccgagt

SEQ ID NO: 353676 - DNA, 20 bp, human
gcaggggcagcggactggga

SEQ ID NO: 353677 - DNA, 20 bp, human
ggcccgaccaggaagtccga

SEQ ID NO: 353678 - DNA, 20 bp, human
gcccctgcggtcagtaagtc

SEQ ID NO: 353679 - DNA, 20 bp, human
gaggggaacgtggcaagccc

SEQ ID NO: 353680 - DNA, 20 bp, human
gacgcctagcgcccagggta

SEQ ID NO: 353681 - DNA, 20 bp, human
gaacgtggcaagcccgggac

SEQ ID NO: 353682 - DNA, 20 bp, human
ggcccagggtagggcctcca

SEQ ID NO: 353683 - DNA, 20 bp, human
gtatccctggggttgactga

SEQ ID NO: 353684 - DNA, 20 bp, human
gggcggagagacttgacctt

SEQ ID NO: 353685 - DNA, 20 bp, human
gcccctggaggccctaccct

SEQ ID NO: 353686 - DNA, 20 bp, human
gaaacccagcggtgcggcaa

SEQ ID NO: 353687 - DNA, 20 bp, human
gagaaacatagtctcggagt

SEQ ID NO: 353688 - DNA, 20 bp, human
gtgaaacttccccagatcag

SEQ ID NO: 353689 - DNA, 20 bp, human
gatagtctcggagtagggtg

SEQ ID NO: 353690 - DNA, 20 bp, human
gcctacgtaaaactgaagaa

SEQ ID NO: 353691 - DNA, 20 bp, human
gaggcctttgccgcaccgct

SEQ ID NO: 353692 - DNA, 20 bp, human
gcatttgtgtgggtttaggg

SEQ ID NO: 353693 - DNA, 20 bp, human
gaaacgcaaacccagcggtg

SEQ ID NO: 353694 - DNA, 20 bp, human
gccagatcagaggcagaata

SEQ ID NO: 353695 - DNA, 20 bp, human
gcaggggtgaacgcacggca

SEQ ID NO: 353696 - DNA, 20 bp, human
gtggagtgggaaaacactag

SEQ ID NO: 353697 - DNA, 20 bp, human
gcgcaagcagcggatgaaac

SEQ ID NO: 353698 - DNA, 20 bp, human
gcgaacaggctcgcaagcag

SEQ ID NO: 353699 - DNA, 20 bp, human
gggggaacgatgccaggaca

SEQ ID NO: 353700 - DNA, 20 bp, human
ggaaccacaccggcagtcct

SEQ ID NO: 353701 - DNA, 20 bp, human
gactgcctgccacagaagca

SEQ ID NO: 353702 - DNA, 20 bp, human
ggagcctgttcgcttgtggc

SEQ ID NO: 353703 - DNA, 20 bp, human
gagagcagagtaaaaccctc

SEQ ID NO: 353704 - DNA, 20 bp, human
gtctagcctggcaaaagata

SEQ ID NO: 353705 - DNA, 20 bp, human
gctgaggaaggctgcaacaa

SEQ ID NO: 353706 - DNA, 20 bp, human
ggagtcgcctggggagccga

SEQ ID NO: 353707 - DNA, 20 bp, human
gatgctgggagaagacgtgg

SEQ ID NO: 353708 - DNA, 20 bp, human
gagcgcccggaagcgtccaa

SEQ ID NO: 353709 - DNA, 20 bp, human
gggaggaggggagtcgcctg

SEQ ID NO: 353710 - DNA, 20 bp, human
gcggaggggcgcgcaggagg

SEQ ID NO: 353711 - DNA, 20 bp, human
gcctccgcgcggccctcgca

SEQ ID NO: 353712 - DNA, 20 bp, human
gaagacgtggaggcctctcg

SEQ ID NO: 353713 - DNA, 20 bp, human
gccgatgctgggagaagacg

SEQ ID NO: 353714 - DNA, 20 bp, human
ggtccaaaggccccgatgct

SEQ ID NO: 353715 - DNA, 20 bp, human
gcagaaaaaggataccccgt

SEQ ID NO: 353716 - DNA, 20 bp, human
ggggtcgcggtgcccaaagg

SEQ ID NO: 353717 - DNA, 20 bp, human
gagggtgggcgaggctccct

SEQ ID NO: 353718 - DNA, 20 bp, human
gcctggcccaagtgtctccg

SEQ ID NO: 353719 - DNA, 20 bp, human
ggcctcgcccaccctccttt

SEQ ID NO: 353720 - DNA, 20 bp, human
gcgcgaccccggagacactt

SEQ ID NO: 353721 - DNA, 20 bp, human
gcgcggtgcccaaaggaggg

SEQ ID NO: 353722 - DNA, 20 bp, human
gccggggtcgcggtgcccaa

SEQ ID NO: 353723 - DNA, 20 bp, human
gcgctgcggcggcctgacag

SEQ ID NO: 353724 - DNA, 20 bp, human
ggaacagcgctcccgctgtc

SEQ ID NO: 353725 - DNA, 20 bp, human
ggctgccctcccggagttta

SEQ ID NO: 353726 - DNA, 20 bp, human
gggccggcgcgtccacacgg

SEQ ID NO: 353727 - DNA, 20 bp, human
ggggccgagaaccggaagtg

SEQ ID NO: 353728 - DNA, 20 bp, human
ggaccctgcgctgtccgccg

SEQ ID NO: 353729 - DNA, 20 bp, human
gctgtggtgccgtgaagcaa

SEQ ID NO: 353730 - DNA, 20 bp, human
gacagcgcggggccgagaac

SEQ ID NO: 353731 - DNA, 20 bp, human
gcgggcggggccggaagtgt

SEQ ID NO: 353732 - DNA, 20 bp, human
gcgggcgggccagagcggac

SEQ ID NO: 353733 - DNA, 20 bp, human
gtgtgcggcgcgccaccgtg

SEQ ID NO: 353734 - DNA, 20 bp, human
gcccgcccggctcgctggtg

SEQ ID NO: 353735 - DNA, 20 bp, human
gagaaccggaagtgcggggc

SEQ ID NO: 353736 - DNA, 20 bp, human
ggcgccgccgcgaccaggcg

SEQ ID NO: 353737 - DNA, 20 bp, human
gggactgcgaacactggcgc

SEQ ID NO: 353738 - DNA, 20 bp, human
gagtccccgcctggtcgcgg

SEQ ID NO: 353739 - DNA, 20 bp, human
ggcgcggtggtcaccctctt

SEQ ID NO: 353740 - DNA, 20 bp, human
gggaccccgcgcacccggtc

SEQ ID NO: 353741 - DNA, 20 bp, human
gccgaggcgccgccgcgacc

SEQ ID NO: 353742 - DNA, 20 bp, human
gaggcggggactgcgaacac

SEQ ID NO: 353743 - DNA, 20 bp, human
gcccccggaacgtgtgttcc

SEQ ID NO: 353744 - DNA, 20 bp, human
ggaggctggcccggctcctt

SEQ ID NO: 353745 - DNA, 20 bp, human
gtccgggaagcgacgcccga

SEQ ID NO: 353746 - DNA, 20 bp, human
gggccccggaccccacccat

SEQ ID NO: 353747 - DNA, 20 bp, human
gcatcggcgaagatctcccg

SEQ ID NO: 353748 - DNA, 20 bp, human
gctaccagcgggtttgtgta

SEQ ID NO: 353749 - DNA, 20 bp, human
ggggccctacacaaacccgc

SEQ ID NO: 353750 - DNA, 20 bp, human
gctcgcagggtgcctggccg

SEQ ID NO: 353751 - DNA, 20 bp, human
gcctggacccattcagtcag

SEQ ID NO: 353752 - DNA, 20 bp, human
gtcggcccagcgctaccagc

SEQ ID NO: 353753 - DNA, 20 bp, human
gggagatcttcgccgatggg

SEQ ID NO: 353754 - DNA, 20 bp, human
gttcgccgatgggtggggtc

SEQ ID NO: 353755 - DNA, 20 bp, human
gggagctccaagagtcacgc

SEQ ID NO: 353756 - DNA, 20 bp, human
gctgccaaatatggagggtc

SEQ ID NO: 353757 - DNA, 20 bp, human
gtggggtggccaaaacacag

SEQ ID NO: 353758 - DNA, 20 bp, human
ggcatgctgccaaatatgga

SEQ ID NO: 353759 - DNA, 20 bp, human
ggccaaagatattcagtctc

SEQ ID NO: 353760 - DNA, 20 bp, human
gggatcgggatcttggagat

SEQ ID NO: 353761 - DNA, 20 bp, human
ggggcctagttattaccctg

SEQ ID NO: 353762 - DNA, 20 bp, human
gggggtgaggggtgtggtat

SEQ ID NO: 353763 - DNA, 20 bp, human
gtggcctgaccctccatatt

SEQ ID NO: 353764 - DNA, 20 bp, human
ggtgtggtatgggtcgtggg

SEQ ID NO: 353765 - DNA, 20 bp, human
ggagatctcacggtgaccat

SEQ ID NO: 353766 - DNA, 20 bp, human
ggacagtctcgctctgtctc

SEQ ID NO: 353767 - DNA, 20 bp, human
gctctgtctctggaatgcag

SEQ ID NO: 353768 - DNA, 20 bp, human
ggtgggagggggagtaggat

SEQ ID NO: 353769 - DNA, 20 bp, human
gcatgcgttgtcctgtagac

SEQ ID NO: 353770 - DNA, 20 bp, human
gggaggggggagtagggcgt

SEQ ID NO: 353771 - DNA, 20 bp, human
gaggggtaagtggtgtagta

SEQ ID NO: 353772 - DNA, 20 bp, human
gtgtgggggaggggggagta

SEQ ID NO: 353773 - DNA, 20 bp, human
gaagtggtgtagtagggtgt

SEQ ID NO: 353774 - DNA, 20 bp, human
gcacgcgttggtggtgtggg

SEQ ID NO: 353775 - DNA, 20 bp, human
gcatgcgtgagtgtggaact

SEQ ID NO: 353776 - DNA, 20 bp, human
ggacagtctcgctctgtctc

SEQ ID NO: 353777 - DNA, 20 bp, human
gctctgtctctggaatgcag

SEQ ID NO: 353778 - DNA, 20 bp, human
ggtgggagggggagtaggat

SEQ ID NO: 353779 - DNA, 20 bp, human
gcatgcgttgtcctgtagac

SEQ ID NO: 353780 - DNA, 20 bp, human
gggaggggggagtagggcgt

SEQ ID NO: 353781 - DNA, 20 bp, human
gaggggtaagtggtgtagta

SEQ ID NO: 353782 - DNA, 20 bp, human
gtgtgggggaggggggagta

SEQ ID NO: 353783 - DNA, 20 bp, human
gaagtggtgtagtagggtgt

SEQ ID NO: 353784 - DNA, 20 bp, human
gcacgcgttggtggtgtggg

SEQ ID NO: 353785 - DNA, 20 bp, human
gcatgcgtgagtgtggaact

SEQ ID NO: 353786 - DNA, 20 bp, human
ggctgggcggggcacgggtc

SEQ ID NO: 353787 - DNA, 20 bp, human
gccaggggttaccgtcccgc

SEQ ID NO: 353788 - DNA, 20 bp, human
ggccttcctggaactctggt

SEQ ID NO: 353789 - DNA, 20 bp, human
ggagcgtgcgggagaagttc

SEQ ID NO: 353790 - DNA, 20 bp, human
ggccaaccagagttccagga

SEQ ID NO: 353791 - DNA, 20 bp, human
gttccggccgcggttgccag

SEQ ID NO: 353792 - DNA, 20 bp, human
gggcggcaatgccgcttcga

SEQ ID NO: 353793 - DNA, 20 bp, human
ggggttaccgtcccgcgggc

SEQ ID NO: 353794 - DNA, 20 bp, human
gaacccctggcaaccgcggc

SEQ ID NO: 353795 - DNA, 20 bp, human
gaagctggccattgcccaat

SEQ ID NO: 353796 - DNA, 20 bp, human
gaagggccgcgggacggggt

SEQ ID NO: 353797 - DNA, 20 bp, human
gcccgcctgaggccgagcac

SEQ ID NO: 353798 - DNA, 20 bp, human
gcgggtgacgagcgcctcaa

SEQ ID NO: 353799 - DNA, 20 bp, human
ggcctcaggcggggctagaa

SEQ ID NO: 353800 - DNA, 20 bp, human
gcgcccagggcgcagctctc

SEQ ID NO: 353801 - DNA, 20 bp, human
ggcctcaaggggcgcgggtt

SEQ ID NO: 353802 - DNA, 20 bp, human
gcggggccgcacgtcctctc

SEQ ID NO: 353803 - DNA, 20 bp, human
ggggttcggggcccgcgacg

SEQ ID NO: 353804 - DNA, 20 bp, human
ggctagaagggccgcgggac

SEQ ID NO: 353805 - DNA, 20 bp, human
gacgagcgcctcaaggggcg

SEQ ID NO: 353806 - DNA, 20 bp, human
gggaaggcgaaaatcccgtt

SEQ ID NO: 353807 - DNA, 20 bp, human
gcgaggagcgagctgacgac

SEQ ID NO: 353808 - DNA, 20 bp, human
gcccctggtcccactcctgc

SEQ ID NO: 353809 - DNA, 20 bp, human
gaaacgccgcagtgcaagcc

SEQ ID NO: 353810 - DNA, 20 bp, human
ggcagtgcaagccgggcgac

SEQ ID NO: 353811 - DNA, 20 bp, human
ggaactgaggtagcccgcgc

SEQ ID NO: 353812 - DNA, 20 bp, human
gtggtcccactcctgccgga

SEQ ID NO: 353813 - DNA, 20 bp, human
ggcgccggcggcagtaggac

SEQ ID NO: 353814 - DNA, 20 bp, human
gctcctgcggaccagatccc

SEQ ID NO: 353815 - DNA, 20 bp, human
gctccggagggggtcaagta

SEQ ID NO: 353816 - DNA, 20 bp, human
gggaagggtcaggacctccg

SEQ ID NO: 353817 - DNA, 20 bp, human
gaggtggggcggagggacaa

SEQ ID NO: 353818 - DNA, 20 bp, human
ggcgcttgataacgcgggtg

SEQ ID NO: 353819 - DNA, 20 bp, human
ggaggcggggccgagtggaa

SEQ ID NO: 353820 - DNA, 20 bp, human
ggcaggtgaacctccggaag

SEQ ID NO: 353821 - DNA, 20 bp, human
gccttcccgcgctttttccg

SEQ ID NO: 353822 - DNA, 20 bp, human
gtcaggctccgggactggaa

SEQ ID NO: 353823 - DNA, 20 bp, human
gccgttggggccgatgatgc

SEQ ID NO: 353824 - DNA, 20 bp, human
gtcctcgccgtccacctcag

SEQ ID NO: 353825 - DNA, 20 bp, human
gtgggacggcggaggcgctc

SEQ ID NO: 353826 - DNA, 20 bp, human
ggtaaccacgcgggaggagc

SEQ ID NO: 353827 - DNA, 20 bp, human
gctaccgcctacacatccgg

SEQ ID NO: 353828 - DNA, 20 bp, human
ggggggcagtggtggtaagt

SEQ ID NO: 353829 - DNA, 20 bp, human
gtgtaggcggtagaatgcac

SEQ ID NO: 353830 - DNA, 20 bp, human
gcgaccgccggatgtgtagg

SEQ ID NO: 353831 - DNA, 20 bp, human
gagtatgaacgggaaggcga

SEQ ID NO: 353832 - DNA, 20 bp, human
gcgacgggtaaccacgcggg

SEQ ID NO: 353833 - DNA, 20 bp, human
gacagcgacgggtaaccacg

SEQ ID NO: 353834 - DNA, 20 bp, human
ggcgccgcccgcggttcggt

SEQ ID NO: 353835 - DNA, 20 bp, human
gggaaccggaaccggagcac

SEQ ID NO: 353836 - DNA, 20 bp, human
ggaagcgatgggcatatctg

SEQ ID NO: 353837 - DNA, 20 bp, human
gaaggggctgggctatctag

SEQ ID NO: 353838 - DNA, 20 bp, human
gtgccgggcgcggaagcgat

SEQ ID NO: 353839 - DNA, 20 bp, human
gacttccggcttagggccga

SEQ ID NO: 353840 - DNA, 20 bp, human
gtcagcgagcccgaagcgga

SEQ ID NO: 353841 - DNA, 20 bp, human
gccggcttagggccgagggt

SEQ ID NO: 353842 - DNA, 20 bp, human
gggctatctaggggcgtggt

SEQ ID NO: 353843 - DNA, 20 bp, human
ggaagtcagcgagcccgaag

SEQ ID NO: 353844 - DNA, 20 bp, human
gcggggccatcgctagctgg

SEQ ID NO: 353845 - DNA, 20 bp, human
ggccacagccgcctcagacg

SEQ ID NO: 353846 - DNA, 20 bp, human
gcgactcagcccctcgactc

SEQ ID NO: 353847 - DNA, 20 bp, human
ggcgcggcctgaggcagaac

SEQ ID NO: 353848 - DNA, 20 bp, human
gagcgcgggtcacaaggaga

SEQ ID NO: 353849 - DNA, 20 bp, human
gcgctggcgcggggctttct

SEQ ID NO: 353850 - DNA, 20 bp, human
ggttttaagacccgagtcga

SEQ ID NO: 353851 - DNA, 20 bp, human
ggtgtggcagggcacggtgg

SEQ ID NO: 353852 - DNA, 20 bp, human
gagaaccgatgggatgtaga

SEQ ID NO: 353853 - DNA, 20 bp, human
ggagccgccagttctgcctc

SEQ ID NO: 353854 - DNA, 20 bp, human
gcggttctgtggagctcgag

SEQ ID NO: 353855 - DNA, 20 bp, human
gccaagaagcgcgggtcaca

SEQ ID NO: 353856 - DNA, 20 bp, human
gtcgcggggtgaaagttgag

SEQ ID NO: 353857 - DNA, 20 bp, human
ggagtcctgggccttgtcag

SEQ ID NO: 353858 - DNA, 20 bp, human
gaaggcccaggactcggtcg

SEQ ID NO: 353859 - DNA, 20 bp, human
ggtgaggcgccggttgctgg

SEQ ID NO: 353860 - DNA, 20 bp, human
gcggggtgaaagttgagggg

SEQ ID NO: 353861 - DNA, 20 bp, human
ggggaactgtggtaccgcga

SEQ ID NO: 353862 - DNA, 20 bp, human
gtagcggctggttcatagat

SEQ ID NO: 353863 - DNA, 20 bp, human
gaggggcggccgtgaggcgc

SEQ ID NO: 353864 - DNA, 20 bp, human
ggccgcccctgacaaggccc

SEQ ID NO: 353865 - DNA, 20 bp, human
gcaggcctcgaccgagtcct

SEQ ID NO: 353866 - DNA, 20 bp, human
gtgccctccgggtccggcgt

SEQ ID NO: 353867 - DNA, 20 bp, human
gggagcactgagccgaccca

SEQ ID NO: 353868 - DNA, 20 bp, human
gcgcccacgccggacccgga

SEQ ID NO: 353869 - DNA, 20 bp, human
ggggaggggcagttcccacg

SEQ ID NO: 353870 - DNA, 20 bp, human
gacccggagggcacgtccgc

SEQ ID NO: 353871 - DNA, 20 bp, human
gagggcacgtccgccgggag

SEQ ID NO: 353872 - DNA, 20 bp, human
gacctcccccgccccctcgg

SEQ ID NO: 353873 - DNA, 20 bp, human
gcgaactccttgcagacctt

SEQ ID NO: 353874 - DNA, 20 bp, human
gcgcccgcccacgccggacc

SEQ ID NO: 353875 - DNA, 20 bp, human
gtgggaactgcccctcccgg

SEQ ID NO: 353876 - DNA, 20 bp, human
gtcaccagaggggcgtgacg

SEQ ID NO: 353877 - DNA, 20 bp, human
ggtgacgcggcagctgggca

SEQ ID NO: 353878 - DNA, 20 bp, human
gccctctggtgagcatcagg

SEQ ID NO: 353879 - DNA, 20 bp, human
ggggaggcgatcgataactc

SEQ ID NO: 353880 - DNA, 20 bp, human
gccggtgtgccgctgactgt

SEQ ID NO: 353881 - DNA, 20 bp, human
gccctcctagaccaagatgg

SEQ ID NO: 353882 - DNA, 20 bp, human
ggagtgcgcgggagtaggtt

SEQ ID NO: 353883 - DNA, 20 bp, human
ggtgccgctgactgttggat

SEQ ID NO: 353884 - DNA, 20 bp, human
gcgcccctctggtgagcatc

SEQ ID NO: 353885 - DNA, 20 bp, human
gaccacctgatgctcaccag

SEQ ID NO: 353886 - DNA, 20 bp, human
gtcagcgaagcaggggctag

SEQ ID NO: 353887 - DNA, 20 bp, human
gagttgggtggggtcaaaaa

SEQ ID NO: 353888 - DNA, 20 bp, human
gaactgaggggtgagctccg

SEQ ID NO: 353889 - DNA, 20 bp, human
gggccccttcagcgaagcag

SEQ ID NO: 353890 - DNA, 20 bp, human
ggagtctggaagcagattcg

SEQ ID NO: 353891 - DNA, 20 bp, human
gctagaggaagcctagtact

SEQ ID NO: 353892 - DNA, 20 bp, human
gcagtcccccaatccgggaa

SEQ ID NO: 353893 - DNA, 20 bp, human
gagcccctgcttcgctgaag

SEQ ID NO: 353894 - DNA, 20 bp, human
gttggggggtgggtctctaa

SEQ ID NO: 353895 - DNA, 20 bp, human
gatcgcctttcccggattgg

SEQ ID NO: 353896 - DNA, 20 bp, human
gaaggtcaacggtatttaga

SEQ ID NO: 353897 - DNA, 20 bp, human
gttagcaatggtttgaggtc

SEQ ID NO: 353898 - DNA, 20 bp, human
ggcaggatgacgccagatga

SEQ ID NO: 353899 - DNA, 20 bp, human
ggcatctgctgcgctagcaa

SEQ ID NO: 353900 - DNA, 20 bp, human
gccagcatactgtgaatcag

SEQ ID NO: 353901 - DNA, 20 bp, human
gccaggtgattctaatggac

SEQ ID NO: 353902 - DNA, 20 bp, human
gtgggatgtaaccaattctc

SEQ ID NO: 353903 - DNA, 20 bp, human
gaataaaactctctggtggt

SEQ ID NO: 353904 - DNA, 20 bp, human
gaccaattctcaggactaac

SEQ ID NO: 353905 - DNA, 20 bp, human
gctggctgccttaaggtcaa

SEQ ID NO: 353906 - DNA, 20 bp, human
gtggacgcctggctggaagt

SEQ ID NO: 353907 - DNA, 20 bp, human
gacagagcccaggcgaccta

SEQ ID NO: 353908 - DNA, 20 bp, human
gtggccccatgactccaaac

SEQ ID NO: 353909 - DNA, 20 bp, human
gcgtccaagagctgaggttc

SEQ ID NO: 353910 - DNA, 20 bp, human
gaacgggcggagcctggatt

SEQ ID NO: 353911 - DNA, 20 bp, human
gagcctggattgggcctgtg

SEQ ID NO: 353912 - DNA, 20 bp, human
gggcggggtagaagcgataa

SEQ ID NO: 353913 - DNA, 20 bp, human
gctccccacaggcccaatcc

SEQ ID NO: 353914 - DNA, 20 bp, human
gagccctgaacctcagctct

SEQ ID NO: 353915 - DNA, 20 bp, human
gggtagaagcgataagggta

SEQ ID NO: 353916 - DNA, 20 bp, human
gggcgcgcggcctccctgtg

SEQ ID NO: 353917 - DNA, 20 bp, human
gcccccaagcgccgactccg

SEQ ID NO: 353918 - DNA, 20 bp, human
ggtccggcggctggagaggg

SEQ ID NO: 353919 - DNA, 20 bp, human
gcggccggggcacgggtgag

SEQ ID NO: 353920 - DNA, 20 bp, human
gccgcggcgcctcccaagtt

SEQ ID NO: 353921 - DNA, 20 bp, human
gcgggtgatcgcttccccac

SEQ ID NO: 353922 - DNA, 20 bp, human
gcggcctggacccctcccgg

SEQ ID NO: 353923 - DNA, 20 bp, human
gcccctggccaggccgggat

SEQ ID NO: 353924 - DNA, 20 bp, human
gtgatcgcttccccacaggg

SEQ ID NO: 353925 - DNA, 20 bp, human
gtggtgggaggagtcagcgc

SEQ ID NO: 353926 - DNA, 20 bp, human
gaggcagccgagaagaggaa

SEQ ID NO: 353927 - DNA, 20 bp, human
gcggggctgcaactgttccc

SEQ ID NO: 353928 - DNA, 20 bp, human
gaagaggaacggggaagttc

SEQ ID NO: 353929 - DNA, 20 bp, human
gtccccgctgccagccacgc

SEQ ID NO: 353930 - DNA, 20 bp, human
ggagagtgcgctccaggatg

SEQ ID NO: 353931 - DNA, 20 bp, human
gacgctggagagtgcgctcc

SEQ ID NO: 353932 - DNA, 20 bp, human
gtcagggcggctcctccccg

SEQ ID NO: 353933 - DNA, 20 bp, human
gggccgcgcacgcgactctt

SEQ ID NO: 353934 - DNA, 20 bp, human
gcggctggaaagcacgaggg

SEQ ID NO: 353935 - DNA, 20 bp, human
gtccacggaaacgcacctcc

SEQ ID NO: 353936 - DNA, 20 bp, human
gccaactcatacacagctta

SEQ ID NO: 353937 - DNA, 20 bp, human
ggtggttaggagctccaatg

SEQ ID NO: 353938 - DNA, 20 bp, human
gggtaatgagacccaaggtt

SEQ ID NO: 353939 - DNA, 20 bp, human
gctaccaagtctctaaacat

SEQ ID NO: 353940 - DNA, 20 bp, human
gtcctaggaaaatgaactga

SEQ ID NO: 353941 - DNA, 20 bp, human
gagaatcagtgcccaacctt

SEQ ID NO: 353942 - DNA, 20 bp, human
ggcccccatgtttagagact

SEQ ID NO: 353943 - DNA, 20 bp, human
gtagaccacaatgtggtgag

SEQ ID NO: 353944 - DNA, 20 bp, human
gaatgtggtaatgagaccca

SEQ ID NO: 353945 - DNA, 20 bp, human
gttggtagagtgcagtggtt

SEQ ID NO: 353946 - DNA, 20 bp, human
gagggccagataggcatgag

SEQ ID NO: 353947 - DNA, 20 bp, human
gagtgcccctcatgcctatc

SEQ ID NO: 353948 - DNA, 20 bp, human
gtgaggggcactgcccaaac

SEQ ID NO: 353949 - DNA, 20 bp, human
gtgggtgatcagggctgtta

SEQ ID NO: 353950 - DNA, 20 bp, human
gtagggacccagggccagat

SEQ ID NO: 353951 - DNA, 20 bp, human
gggtccctatgccaccttgc

SEQ ID NO: 353952 - DNA, 20 bp, human
gcgcagagtcggctcagagg

SEQ ID NO: 353953 - DNA, 20 bp, human
gttgtgttactgcgcagagt

SEQ ID NO: 353954 - DNA, 20 bp, human
gaaaaggtggatgaccagtt

SEQ ID NO: 353955 - DNA, 20 bp, human
gatgaccagttgggtgatca

SEQ ID NO: 353956 - DNA, 20 bp, human
gacccagggccagataggca

SEQ ID NO: 353957 - DNA, 20 bp, human
gcagtgcccccatgcctatc

SEQ ID NO: 353958 - DNA, 20 bp, human
gcgcagagtcggctcagagg

SEQ ID NO: 353959 - DNA, 20 bp, human
gtgggtgatcagggctgtta

SEQ ID NO: 353960 - DNA, 20 bp, human
gtagggacccagggccagat

SEQ ID NO: 353961 - DNA, 20 bp, human
gggtccctatgccaccttgc

SEQ ID NO: 353962 - DNA, 20 bp, human
gcccatgcctatctggccct

SEQ ID NO: 353963 - DNA, 20 bp, human
gttgtgttactgcgcagagt

SEQ ID NO: 353964 - DNA, 20 bp, human
gctgcgcagagtcggctcag

SEQ ID NO: 353965 - DNA, 20 bp, human
gaagaccctccccagcaagg

SEQ ID NO: 353966 - DNA, 20 bp, human
gtggagcagcccggcttctt

SEQ ID NO: 353967 - DNA, 20 bp, human
gggcgcgtcgcccaagaagc

SEQ ID NO: 353968 - DNA, 20 bp, human
ggtgctggagaaccagaggc

SEQ ID NO: 353969 - DNA, 20 bp, human
gaggactcgcccagcccctt

SEQ ID NO: 353970 - DNA, 20 bp, human
gtctccagcactgccgccgc

SEQ ID NO: 353971 - DNA, 20 bp, human
gccgccgggctggagcagcc

SEQ ID NO: 353972 - DNA, 20 bp, human
ggagaagctacgggcggagc

SEQ ID NO: 353973 - DNA, 20 bp, human
gcttgggcgacgcgcccaag

SEQ ID NO: 353974 - DNA, 20 bp, human
gcttctccagctcccgcctc

SEQ ID NO: 353975 - DNA, 20 bp, human
ggcgacgcgcccaaggggct

SEQ ID NO: 353976 - DNA, 20 bp, human
gacccagggccagataggca

SEQ ID NO: 353977 - DNA, 20 bp, human
gcagtgcccccatgcctatc

SEQ ID NO: 353978 - DNA, 20 bp, human
gcgcagagtcggctcagagg

SEQ ID NO: 353979 - DNA, 20 bp, human
gtgggtgatcagggctgtta

SEQ ID NO: 353980 - DNA, 20 bp, human
gtagggacccagggccagat

SEQ ID NO: 353981 - DNA, 20 bp, human
gggtccctatgccaccttgc

SEQ ID NO: 353982 - DNA, 20 bp, human
gcccatgcctatctggccct

SEQ ID NO: 353983 - DNA, 20 bp, human
gttgtgttactgcgcagagt

SEQ ID NO: 353984 - DNA, 20 bp, human
gctgcgcagagtcggctcag

SEQ ID NO: 353985 - DNA, 20 bp, human
gaagaccctccccagcaagg

SEQ ID NO: 353986 - DNA, 20 bp, human
ggctgcagaagcgaccctgg

SEQ ID NO: 353987 - DNA, 20 bp, human
gggaaaggacccggggttcc

SEQ ID NO: 353988 - DNA, 20 bp, human
ggcggctgcagaagcgaccc

SEQ ID NO: 353989 - DNA, 20 bp, human
gcagaagcgaccctggcggg

SEQ ID NO: 353990 - DNA, 20 bp, human
gggctcgctccccggaaccc

SEQ ID NO: 353991 - DNA, 20 bp, human
gcacgtccaccgggtgtccg

SEQ ID NO: 353992 - DNA, 20 bp, human
gccggggaaggacggcgggt

SEQ ID NO: 353993 - DNA, 20 bp, human
gcctggcgcacccgcgggag

SEQ ID NO: 353994 - DNA, 20 bp, human
ggggcggattcgctgggtca

SEQ ID NO: 353995 - DNA, 20 bp, human
gcccgcagcgccacgtccac

SEQ ID NO: 353996 - DNA, 20 bp, human
gcgcgccgagcactgccgag

SEQ ID NO: 353997 - DNA, 20 bp, human
ggagccatcgctggcctcgg

SEQ ID NO: 353998 - DNA, 20 bp, human
gggagggcggctctcgacgc

SEQ ID NO: 353999 - DNA, 20 bp, human
gcgcgcgcggggagcgaaaa

SEQ ID NO: 354000 - DNA, 20 bp, human
gccgcccgcttgctgaggag

SEQ ID NO: 354001 - DNA, 20 bp, human
gacagcgcgcgcgacgccgg

SEQ ID NO: 354002 - DNA, 20 bp, human
gggagcggggcggtctccgc

SEQ ID NO: 354003 - DNA, 20 bp, human
ggccagcgatggctcgggtg

SEQ ID NO: 354004 - DNA, 20 bp, human
ggccgcccgcccgcttgctg

SEQ ID NO: 354005 - DNA, 20 bp, human
ggagcgaaaagggagcgcga

SEQ ID NO: 354006 - DNA, 20 bp, human
gaagagggaggatgactcat

SEQ ID NO: 354007 - DNA, 20 bp, human
gccgccggagacgcccggat

SEQ ID NO: 354008 - DNA, 20 bp, human
ggggaggatgacataggcga

SEQ ID NO: 354009 - DNA, 20 bp, human
ggcccccgccggccgaggct

SEQ ID NO: 354010 - DNA, 20 bp, human
gaaaggcagcatccggggct

SEQ ID NO: 354011 - DNA, 20 bp, human
gtgggtgcccgtgggcggag

SEQ ID NO: 354012 - DNA, 20 bp, human
gtaggcgagggaccagaaga

SEQ ID NO: 354013 - DNA, 20 bp, human
ggaggatgactcatgggtga

SEQ ID NO: 354014 - DNA, 20 bp, human
gcatgggtgaggggtacctg

SEQ ID NO: 354015 - DNA, 20 bp, human
ggcgagggaccagaagaggg

SEQ ID NO: 354016 - DNA, 20 bp, human
gagcgcgcgcgccgcctcgg

SEQ ID NO: 354017 - DNA, 20 bp, human
ggcgccgcctcggaggggaa

SEQ ID NO: 354018 - DNA, 20 bp, human
gtgagcggttcaagggaaag

SEQ ID NO: 354019 - DNA, 20 bp, human
ggcccgaggggcacccaggc

SEQ ID NO: 354020 - DNA, 20 bp, human
gggaactggaggccgggacg

SEQ ID NO: 354021 - DNA, 20 bp, human
ggcgagcgcgtggggaagga

SEQ ID NO: 354022 - DNA, 20 bp, human
gtgtgaagtgagcggttcaa

SEQ ID NO: 354023 - DNA, 20 bp, human
gcaggagccgacatgtttgg

SEQ ID NO: 354024 - DNA, 20 bp, human
gcgaagggctgtgaagtgag

SEQ ID NO: 354025 - DNA, 20 bp, human
ggggagccgagagggtcgtg

SEQ ID NO: 354026 - DNA, 20 bp, human
gaggaggcaagagagtccta

SEQ ID NO: 354027 - DNA, 20 bp, human
gtaggggaatccggggagtt

SEQ ID NO: 354028 - DNA, 20 bp, human
gcggcggcgactgaaaacgg

SEQ ID NO: 354029 - DNA, 20 bp, human
gcccgcccaccaccaaggtc

SEQ ID NO: 354030 - DNA, 20 bp, human
gcccggcaagccaaactccc

SEQ ID NO: 354031 - DNA, 20 bp, human
gggcttgccgggttgtggtt

SEQ ID NO: 354032 - DNA, 20 bp, human
gtgggccggaccttggtggt

SEQ ID NO: 354033 - DNA, 20 bp, human
gaaagaacagatagggtagg

SEQ ID NO: 354034 - DNA, 20 bp, human
gtgggccggcgggaggcgaa

SEQ ID NO: 354035 - DNA, 20 bp, human
gtgggggacctacattaatg

SEQ ID NO: 354036 - DNA, 20 bp, human
gtgtctgggccctggtccga

SEQ ID NO: 354037 - DNA, 20 bp, human
gctcccccggcggcacggat

SEQ ID NO: 354038 - DNA, 20 bp, human
gcggggcgtgggagcccgga

SEQ ID NO: 354039 - DNA, 20 bp, human
ggggcgccgctgcggggcgt

SEQ ID NO: 354040 - DNA, 20 bp, human
gcgcgcacctgccgggcccg

SEQ ID NO: 354041 - DNA, 20 bp, human
ggggaacagccctcggacca

SEQ ID NO: 354042 - DNA, 20 bp, human
ggcccgggggctgctagaag

SEQ ID NO: 354043 - DNA, 20 bp, human
gggcctctccgcaagtcggc

SEQ ID NO: 354044 - DNA, 20 bp, human
ggcgcgaggcgggcttggag

SEQ ID NO: 354045 - DNA, 20 bp, human
ggcctcttctagcagccccc

SEQ ID NO: 354046 - DNA, 20 bp, human
gctcccacaaggctgacctg

SEQ ID NO: 354047 - DNA, 20 bp, human
gacccctgacccccaaagca

SEQ ID NO: 354048 - DNA, 20 bp, human
gaggccccagccatgctctg

SEQ ID NO: 354049 - DNA, 20 bp, human
gagagcagggctagcatgga

SEQ ID NO: 354050 - DNA, 20 bp, human
gaggtggcatcccccagctg

SEQ ID NO: 354051 - DNA, 20 bp, human
gttcaggaatgagtcatcta

SEQ ID NO: 354052 - DNA, 20 bp, human
gtgggcgggaagtggttaag

SEQ ID NO: 354053 - DNA, 20 bp, human
gggtccagaacagaggaggc

SEQ ID NO: 354054 - DNA, 20 bp, human
gaactggcgggtgtgacagg

SEQ ID NO: 354055 - DNA, 20 bp, human
gtagagggtgctctcccaca

SEQ ID NO: 354056 - DNA, 20 bp, human
ggatcagtgaaatggaaatc

SEQ ID NO: 354057 - DNA, 20 bp, human
gtcagtggctgtcagtagaa

SEQ ID NO: 354058 - DNA, 20 bp, human
gtaaacggagctggtcgcgt

SEQ ID NO: 354059 - DNA, 20 bp, human
ggggaataggcgacggggga

SEQ ID NO: 354060 - DNA, 20 bp, human
ggctgtcagtagaatgggtt

SEQ ID NO: 354061 - DNA, 20 bp, human
gtaccacagcagtcgctctt

SEQ ID NO: 354062 - DNA, 20 bp, human
ggtgggcggggaataggcga

SEQ ID NO: 354063 - DNA, 20 bp, human
ggccccaagagcgactgctg

SEQ ID NO: 354064 - DNA, 20 bp, human
gtccagcggtctcacatagc

SEQ ID NO: 354065 - DNA, 20 bp, human
ggcccggcgcagcaaaagct

SEQ ID NO: 354066 - DNA, 20 bp, human
ggcgccctggctctggtctg

SEQ ID NO: 354067 - DNA, 20 bp, human
ggaggcggcaccccgaggtt

SEQ ID NO: 354068 - DNA, 20 bp, human
ggcccgcggggcttcggaga

SEQ ID NO: 354069 - DNA, 20 bp, human
gtgcacatctgtcaggaatg

SEQ ID NO: 354070 - DNA, 20 bp, human
gcaaggctgtggctccgagt

SEQ ID NO: 354071 - DNA, 20 bp, human
ggccgcgagccgctgccgaa

SEQ ID NO: 354072 - DNA, 20 bp, human
ggcacgggcgcccaacctcg

SEQ ID NO: 354073 - DNA, 20 bp, human
gggcttggggccgcagggga

SEQ ID NO: 354074 - DNA, 20 bp, human
gtggggccaaggcgccgcac

SEQ ID NO: 354075 - DNA, 20 bp, human
gggagcctcgaaatcgttca

SEQ ID NO: 354076 - DNA, 20 bp, human
ggttctcccgcccacgggac

SEQ ID NO: 354077 - DNA, 20 bp, human
gcacccgcgccgcgaatggt

SEQ ID NO: 354078 - DNA, 20 bp, human
gcccgtgggcgggagaaccg

SEQ ID NO: 354079 - DNA, 20 bp, human
gggcctctggaagggaaccg

SEQ ID NO: 354080 - DNA, 20 bp, human
ggacgagcccgtcccgtggg

SEQ ID NO: 354081 - DNA, 20 bp, human
gcgtgaggatcctgcgtccc

SEQ ID NO: 354082 - DNA, 20 bp, human
ggagaccgtggttccctaag

SEQ ID NO: 354083 - DNA, 20 bp, human
gcgggacgagcccgtcccgt

SEQ ID NO: 354084 - DNA, 20 bp, human
ggggggagcgggtgtagcgg

SEQ ID NO: 354085 - DNA, 20 bp, human
gggacgggacgtggacgccg

SEQ ID NO: 354086 - DNA, 20 bp, human
gccaggggtcagagccacga

SEQ ID NO: 354087 - DNA, 20 bp, human
ggtgacggggcttagaggaa

SEQ ID NO: 354088 - DNA, 20 bp, human
gtaaggaaccagaaagtctc

SEQ ID NO: 354089 - DNA, 20 bp, human
gagccacgagggcccccgtg

SEQ ID NO: 354090 - DNA, 20 bp, human
gggtgcccacagaaagaaac

SEQ ID NO: 354091 - DNA, 20 bp, human
gggcttagaggaagggacac

SEQ ID NO: 354092 - DNA, 20 bp, human
gaacaagagggtcctcacgg

SEQ ID NO: 354093 - DNA, 20 bp, human
gcacccagggaaatctctga

SEQ ID NO: 354094 - DNA, 20 bp, human
gagggagggggttagatctt

SEQ ID NO: 354095 - DNA, 20 bp, human
gggaaatctctgaagggagg

SEQ ID NO: 354096 - DNA, 20 bp, human
gacagacagccctgcgggcg

SEQ ID NO: 354097 - DNA, 20 bp, human
ggtgctggcgcccctgaagc

SEQ ID NO: 354098 - DNA, 20 bp, human
gctccggtgctcggagtgtg

SEQ ID NO: 354099 - DNA, 20 bp, human
ggtgcggagtcgtgtccaca

SEQ ID NO: 354100 - DNA, 20 bp, human
ggtgggccagggtgggttgt

SEQ ID NO: 354101 - DNA, 20 bp, human
gcgtgggcgatagaacgcgt

SEQ ID NO: 354102 - DNA, 20 bp, human
gtccacagggccggcttcag

SEQ ID NO: 354103 - DNA, 20 bp, human
gggggcctccgggggcacag

SEQ ID NO: 354104 - DNA, 20 bp, human
ggcggtgtgccaggcggtgc

SEQ ID NO: 354105 - DNA, 20 bp, human
gtcccccgtgagtgtagaca

SEQ ID NO: 354106 - DNA, 20 bp, human
gggaacggccactcaggaag

SEQ ID NO: 354107 - DNA, 20 bp, human
gaagcgggcaccctccccta

SEQ ID NO: 354108 - DNA, 20 bp, human
gtctggagctccatagggga

SEQ ID NO: 354109 - DNA, 20 bp, human
gccgacctccggtcaggagg

SEQ ID NO: 354110 - DNA, 20 bp, human
gagtgagcgaatcccttctc

SEQ ID NO: 354111 - DNA, 20 bp, human
ggggaggaacagagcacggc

SEQ ID NO: 354112 - DNA, 20 bp, human
gaggaacagagcacggccgg

SEQ ID NO: 354113 - DNA, 20 bp, human
gtcctgaccggaggtcggaa

SEQ ID NO: 354114 - DNA, 20 bp, human
gtcctccccctcctgaccgg

SEQ ID NO: 354115 - DNA, 20 bp, human
gcttctctggagctccatag

SEQ ID NO: 354116 - DNA, 20 bp, human
gctggatggcgcgctgtata

SEQ ID NO: 354117 - DNA, 20 bp, human
gcccggaagtctgacttgag

SEQ ID NO: 354118 - DNA, 20 bp, human
gcggtgaggggcttccggtt

SEQ ID NO: 354119 - DNA, 20 bp, human
gctgggagtccggagctctc

SEQ ID NO: 354120 - DNA, 20 bp, human
gggaaggcgtgttgagtagc

SEQ ID NO: 354121 - DNA, 20 bp, human
gatgttctgtgctctcagga

SEQ ID NO: 354122 - DNA, 20 bp, human
gcccgcccctgcgccgagct

SEQ ID NO: 354123 - DNA, 20 bp, human
gagcacgggcctcgccgtgc

SEQ ID NO: 354124 - DNA, 20 bp, human
ggagctccggactcccagct

SEQ ID NO: 354125 - DNA, 20 bp, human
ggactcccagctcggcgcag

SEQ ID NO: 354126 - DNA, 20 bp, human
ggaggcggaacgtgtcattg

SEQ ID NO: 354127 - DNA, 20 bp, human
ggtgctgttctcattgatat

SEQ ID NO: 354128 - DNA, 20 bp, human
gctccggagggcgtggttaa

SEQ ID NO: 354129 - DNA, 20 bp, human
gtccgcctcagagagcaaag

SEQ ID NO: 354130 - DNA, 20 bp, human
gacgcgctgcgtcttagtat

SEQ ID NO: 354131 - DNA, 20 bp, human
gcaggcgcaattaggagtag

SEQ ID NO: 354132 - DNA, 20 bp, human
gcgcctgcgctggttggggt

SEQ ID NO: 354133 - DNA, 20 bp, human
gtgccggagcaggcgcaatt

SEQ ID NO: 354134 - DNA, 20 bp, human
gggcgctgtaaagcgcttag

SEQ ID NO: 354135 - DNA, 20 bp, human
gagcgcgtgcgcgagccatc

SEQ ID NO: 354136 - DNA, 20 bp, human
gcccccgggcgggctacttc

SEQ ID NO: 354137 - DNA, 20 bp, human
ggcagggcagggcaagaact

SEQ ID NO: 354138 - DNA, 20 bp, human
gcttgcttctccgagcccgg

SEQ ID NO: 354139 - DNA, 20 bp, human
ggtgccttaaggaggagcta

SEQ ID NO: 354140 - DNA, 20 bp, human
gcgcccctagctcctcctta

SEQ ID NO: 354141 - DNA, 20 bp, human
ggccggaagtagcccgcccg

SEQ ID NO: 354142 - DNA, 20 bp, human
gagatggcagtgcggggaca

SEQ ID NO: 354143 - DNA, 20 bp, human
gacttccggctgctgaccgc

SEQ ID NO: 354144 - DNA, 20 bp, human
gctagcgaagagggcggaag

SEQ ID NO: 354145 - DNA, 20 bp, human
gactgtcctagcgaagaggg

SEQ ID NO: 354146 - DNA, 20 bp, human
gcgcgaggtcccacgagcgg

SEQ ID NO: 354147 - DNA, 20 bp, human
gactgggtggattacagcgg

SEQ ID NO: 354148 - DNA, 20 bp, human
gagtcccggagctctcttgc

SEQ ID NO: 354149 - DNA, 20 bp, human
gggtcccacgagcggcgggg

SEQ ID NO: 354150 - DNA, 20 bp, human
gcggtcctcctccccggcaa

SEQ ID NO: 354151 - DNA, 20 bp, human
gctagcccgcaagagagctc

SEQ ID NO: 354152 - DNA, 20 bp, human
gtcgtgggacctcgcgcccg

SEQ ID NO: 354153 - DNA, 20 bp, human
ggcgcgcacgagagggagaa

SEQ ID NO: 354154 - DNA, 20 bp, human
gagcgccgccccgccgctcg

SEQ ID NO: 354155 - DNA, 20 bp, human
gcgggcgcgctcgacgcgga

SEQ ID NO: 354156 - DNA, 20 bp, human
gcgcctgccgggactagccg

SEQ ID NO: 354157 - DNA, 20 bp, human
gttgacgagcagtctaactg

SEQ ID NO: 354158 - DNA, 20 bp, human
gctgccgggactagccgggg

SEQ ID NO: 354159 - DNA, 20 bp, human
gtagactgctcgtcaagtgt

SEQ ID NO: 354160 - DNA, 20 bp, human
ggcgcctccccggctagtcc

SEQ ID NO: 354161 - DNA, 20 bp, human
gtaactggggctccgcctgc

SEQ ID NO: 354162 - DNA, 20 bp, human
gaagtgtgggaaaagctccg

SEQ ID NO: 354163 - DNA, 20 bp, human
gcaagctactatataaaagg

SEQ ID NO: 354164 - DNA, 20 bp, human
gatagtagcttgtgacgcca

SEQ ID NO: 354165 - DNA, 20 bp, human
ggcgaacgcgcgcgcctccc

SEQ ID NO: 354166 - DNA, 20 bp, human
gaggcgagagccaggcggga

SEQ ID NO: 354167 - DNA, 20 bp, human
gacttcgcaggttacgtcag

SEQ ID NO: 354168 - DNA, 20 bp, human
gctccgctgcgcgacccggg

SEQ ID NO: 354169 - DNA, 20 bp, human
gtaacctgcgaagtttgggg

SEQ ID NO: 354170 - DNA, 20 bp, human
gtcgcaggttacgtcagcgg

SEQ ID NO: 354171 - DNA, 20 bp, human
gctccctccccaaacttcgc

SEQ ID NO: 354172 - DNA, 20 bp, human
gtcagcggcggacggcaagg

SEQ ID NO: 354173 - DNA, 20 bp, human
ggacgtaacctgcgaagttt

SEQ ID NO: 354174 - DNA, 20 bp, human
gacgtcagcggcggacggca

SEQ ID NO: 354175 - DNA, 20 bp, human
gaggttacgtcagcggcgga

SEQ ID NO: 354176 - DNA, 20 bp, human
gcccaggggcgggactgtag

SEQ ID NO: 354177 - DNA, 20 bp, human
gcacctgccgcagccagatt

SEQ ID NO: 354178 - DNA, 20 bp, human
gagtggagatggtgcttagg

SEQ ID NO: 354179 - DNA, 20 bp, human
ggctcaggaaacgctagtca

SEQ ID NO: 354180 - DNA, 20 bp, human
gaggctttgactgtaggagt

SEQ ID NO: 354181 - DNA, 20 bp, human
gactgtagaggcgcctataa

SEQ ID NO: 354182 - DNA, 20 bp, human
gtgcccagcaacacctaatc

SEQ ID NO: 354183 - DNA, 20 bp, human
gtgaaaacaggataacttga

SEQ ID NO: 354184 - DNA, 20 bp, human
ggtaggagtgggttgattgt

SEQ ID NO: 354185 - DNA, 20 bp, human
gctgggcattgaggatgtta

SEQ ID NO: 354186 - DNA, 20 bp, human
gggtcactgcgctctcccct

SEQ ID NO: 354187 - DNA, 20 bp, human
ggacggatgaatagacgctg

SEQ ID NO: 354188 - DNA, 20 bp, human
gtgccagcgcccggtgactg

SEQ ID NO: 354189 - DNA, 20 bp, human
gagcgcccggtgactgcgga

SEQ ID NO: 354190 - DNA, 20 bp, human
gagcttctcacgcttctcac

SEQ ID NO: 354191 - DNA, 20 bp, human
gctggcagagagggcgcccg

SEQ ID NO: 354192 - DNA, 20 bp, human
gcggaagtgacgtaacaggg

SEQ ID NO: 354193 - DNA, 20 bp, human
gtgagaagctctgctcaccc

SEQ ID NO: 354194 - DNA, 20 bp, human
gctacggaagtgacgtaaca

SEQ ID NO: 354195 - DNA, 20 bp, human
gctgggggcgggacgaccta

SEQ ID NO: 354196 - DNA, 20 bp, human
gaggggtgggatgacttggg

SEQ ID NO: 354197 - DNA, 20 bp, human
ggacaggggtgggatgactt

SEQ ID NO: 354198 - DNA, 20 bp, human
gtgaataaacatggtgtcag

SEQ ID NO: 354199 - DNA, 20 bp, human
ggccaggtggacctgaatgt

SEQ ID NO: 354200 - DNA, 20 bp, human
gcacctggcaaatctatctg

SEQ ID NO: 354201 - DNA, 20 bp, human
ggacaccatgtttattcaac

SEQ ID NO: 354202 - DNA, 20 bp, human
gtggtcttataaattattca

SEQ ID NO: 354203 - DNA, 20 bp, human
gcaggccttgctactccctg

SEQ ID NO: 354204 - DNA, 20 bp, human
gaccaggcagggcttataaa

SEQ ID NO: 354205 - DNA, 20 bp, human
gtctcccagttgaataaaca

SEQ ID NO: 354206 - DNA, 20 bp, human
ggcgtcatggagaacgcggg

SEQ ID NO: 354207 - DNA, 20 bp, human
ggcgcagagggtacagagag

SEQ ID NO: 354208 - DNA, 20 bp, human
gcgccgcgtagggccgtcgg

SEQ ID NO: 354209 - DNA, 20 bp, human
gcagcgcggggaagcctacc

SEQ ID NO: 354210 - DNA, 20 bp, human
gcggcctgctgcacattgag

SEQ ID NO: 354211 - DNA, 20 bp, human
ggtctcggacctactggaac

SEQ ID NO: 354212 - DNA, 20 bp, human
gagagacgggggaagctggg

SEQ ID NO: 354213 - DNA, 20 bp, human
gcggcgtgcgcggccaccga

SEQ ID NO: 354214 - DNA, 20 bp, human
gaatgtgcagcaggccgcga

SEQ ID NO: 354215 - DNA, 20 bp, human
gtgcggcgtcatggagaacg

SEQ ID NO: 354216 - DNA, 20 bp, human
ggacccgaggagctccgtga

SEQ ID NO: 354217 - DNA, 20 bp, human
gaaggaaaagcccgggtcgg

SEQ ID NO: 354218 - DNA, 20 bp, human
gaggggaccagagaagttcc

SEQ ID NO: 354219 - DNA, 20 bp, human
gggaccagagaagttccggg

SEQ ID NO: 354220 - DNA, 20 bp, human
gaaagcccgggtcggaggag

SEQ ID NO: 354221 - DNA, 20 bp, human
gtcccctcccggaacttctc

SEQ ID NO: 354222 - DNA, 20 bp, human
gacgaaggaaaagcccgggt

SEQ ID NO: 354223 - DNA, 20 bp, human
ggtggcgccgggtgtcaagg

SEQ ID NO: 354224 - DNA, 20 bp, human
gaagacccgctgccgctcta

SEQ ID NO: 354225 - DNA, 20 bp, human
gccgggtcggaggagcggag

SEQ ID NO: 354226 - DNA, 20 bp, human
gtggtcacctacccaaccta

SEQ ID NO: 354227 - DNA, 20 bp, human
gagtgcatacaccctaggtt

SEQ ID NO: 354228 - DNA, 20 bp, human
gtgtatgcactcacagacaa

SEQ ID NO: 354229 - DNA, 20 bp, human
gaccagaggaccttcagcgg

SEQ ID NO: 354230 - DNA, 20 bp, human
gttccgggacccaccgctga

SEQ ID NO: 354231 - DNA, 20 bp, human
gcccaccgctgaaggtcctc

SEQ ID NO: 354232 - DNA, 20 bp, human
gcgcccgagtcgcggaagga

SEQ ID NO: 354233 - DNA, 20 bp, human
gcatacaccctaggttgggt

SEQ ID NO: 354234 - DNA, 20 bp, human
ggtccctaaaacccagttcc

SEQ ID NO: 354235 - DNA, 20 bp, human
gccggcgcccgagtcgcgga

SEQ ID NO: 354236 - DNA, 20 bp, human
gaggtaagaaccatcagcgt

SEQ ID NO: 354237 - DNA, 20 bp, human
gctagcagcgcagcctgaaa

SEQ ID NO: 354238 - DNA, 20 bp, human
gagaaagaatcaaatgaggg

SEQ ID NO: 354239 - DNA, 20 bp, human
gaggagttgctatgtctcac

SEQ ID NO: 354240 - DNA, 20 bp, human
gagaaccatcagcgtcgggc

SEQ ID NO: 354241 - DNA, 20 bp, human
ggaaagagtgaaggatcgga

SEQ ID NO: 354242 - DNA, 20 bp, human
gtcaggctgcgctgctagaa

SEQ ID NO: 354243 - DNA, 20 bp, human
gtgctggtcctccgctcgag

SEQ ID NO: 354244 - DNA, 20 bp, human
ggcacagtcacagttgtcag

SEQ ID NO: 354245 - DNA, 20 bp, human
ggacaactgtgactgtgcag

SEQ ID NO: 354246 - DNA, 20 bp, human
gagcaggagcacacaaagga

SEQ ID NO: 354247 - DNA, 20 bp, human
ggaggccctcagtggggcaa

SEQ ID NO: 354248 - DNA, 20 bp, human
gccacagccgggcttccaca

SEQ ID NO: 354249 - DNA, 20 bp, human
gtcttcctttgccccactga

SEQ ID NO: 354250 - DNA, 20 bp, human
gctcctcaagatcccggggt

SEQ ID NO: 354251 - DNA, 20 bp, human
gaccccaccccgggatcttg

SEQ ID NO: 354252 - DNA, 20 bp, human
ggaggcgtggtccggtcagc

SEQ ID NO: 354253 - DNA, 20 bp, human
ggtggtccggtcagcaggtt

SEQ ID NO: 354254 - DNA, 20 bp, human
gccacagtttccgttaaatc

SEQ ID NO: 354255 - DNA, 20 bp, human
gtagaggttccctccgctgg

SEQ ID NO: 354256 - DNA, 20 bp, human
gggactccgggtgctctcag

SEQ ID NO: 354257 - DNA, 20 bp, human
gacctcaaaggggtctaggt

SEQ ID NO: 354258 - DNA, 20 bp, human
gtagacccctttgaggtcat

SEQ ID NO: 354259 - DNA, 20 bp, human
ggcacccggagtccgagtga

SEQ ID NO: 354260 - DNA, 20 bp, human
ggtcaggactggcgatgcgt

SEQ ID NO: 354261 - DNA, 20 bp, human
gttgttgctaggctgttgtc

SEQ ID NO: 354262 - DNA, 20 bp, human
gcccgcctgattccgtcact

SEQ ID NO: 354263 - DNA, 20 bp, human
ggcgggcgcccgcgtcgcta

SEQ ID NO: 354264 - DNA, 20 bp, human
ggagtccgagtgacggaatc

SEQ ID NO: 354265 - DNA, 20 bp, human
gtccgagtgacggaatcagg

SEQ ID NO: 354266 - DNA, 20 bp, human
gtggctaataggctgggagt

SEQ ID NO: 354267 - DNA, 20 bp, human
gtcgaggaatcgactgggat

SEQ ID NO: 354268 - DNA, 20 bp, human
gctcccgcggagccttttcg

SEQ ID NO: 354269 - DNA, 20 bp, human
ggagggtggggcctgtcaca

SEQ ID NO: 354270 - DNA, 20 bp, human
gagggggacggcagacgacg

SEQ ID NO: 354271 - DNA, 20 bp, human
ggacggcagacgacgcggca

SEQ ID NO: 354272 - DNA, 20 bp, human
ggcagacgacgcggcaaggc

SEQ ID NO: 354273 - DNA, 20 bp, human
gatgacgcccaccatgtgac

SEQ ID NO: 354274 - DNA, 20 bp, human
gtcgactgggattggctaat

SEQ ID NO: 354275 - DNA, 20 bp, human
gcccagtcgattcctcgaaa

SEQ ID NO: 354276 - DNA, 20 bp, human
ggagtggaaggaaagtccaa

SEQ ID NO: 354277 - DNA, 20 bp, human
ggtaatctataatcctattt

SEQ ID NO: 354278 - DNA, 20 bp, human
ggaaacaactttgtatactt

SEQ ID NO: 354279 - DNA, 20 bp, human
gtgaataaattgttgatgag

SEQ ID NO: 354280 - DNA, 20 bp, human
gctaattaatccaatttata

SEQ ID NO: 354281 - DNA, 20 bp, human
gggattaattagtataatgt

SEQ ID NO: 354282 - DNA, 20 bp, human
gtatagattaccttataaat

SEQ ID NO: 354283 - DNA, 20 bp, human
gtgggcaaatgaaggaaggg

SEQ ID NO: 354284 - DNA, 20 bp, human
gtcaatccataaaaatataa

SEQ ID NO: 354285 - DNA, 20 bp, human
gaaatgaaggaagggcggag

SEQ ID NO: 354286 - DNA, 20 bp, human
ggggagaccaagagctgagg

SEQ ID NO: 354287 - DNA, 20 bp, human
ggggttaattagtatagtgt

SEQ ID NO: 354288 - DNA, 20 bp, human
gcaaacaatttagtatactg

SEQ ID NO: 354289 - DNA, 20 bp, human
gttaggttagaagggttttt

SEQ ID NO: 354290 - DNA, 20 bp, human
gaattttccccctcagctct

SEQ ID NO: 354291 - DNA, 20 bp, human
gtaaaagggccaaggacaga

SEQ ID NO: 354292 - DNA, 20 bp, human
gagaagaacacaactgtaaa

SEQ ID NO: 354293 - DNA, 20 bp, human
gaatgaaggaaaggcagaga

SEQ ID NO: 354294 - DNA, 20 bp, human
gtctgtgtgtgtaaaaggaa

SEQ ID NO: 354295 - DNA, 20 bp, human
gataatctataatcttattt

SEQ ID NO: 354296 - DNA, 20 bp, human
gaagtgataacctttcgcta

SEQ ID NO: 354297 - DNA, 20 bp, human
gataacctttcgctagggac

SEQ ID NO: 354298 - DNA, 20 bp, human
gaaaggttatcacttcgctg

SEQ ID NO: 354299 - DNA, 20 bp, human
gtcaccctgtccctagcgaa

SEQ ID NO: 354300 - DNA, 20 bp, human
gttcgctggggacatgagaa

SEQ ID NO: 354301 - DNA, 20 bp, human
gacatgagaaaggtcgggtt

SEQ ID NO: 354302 - DNA, 20 bp, human
gcctctgctggagaagataa

SEQ ID NO: 354303 - DNA, 20 bp, human
gaatcccaaaaggcggggta

SEQ ID NO: 354304 - DNA, 20 bp, human
ggtcaacatcattgacagag

SEQ ID NO: 354305 - DNA, 20 bp, human
gccccacaacgttagggtcc

SEQ ID NO: 354306 - DNA, 20 bp, human
gcgtccctggggtagggaaa

SEQ ID NO: 354307 - DNA, 20 bp, human
gcatgcgcgtccctggggta

SEQ ID NO: 354308 - DNA, 20 bp, human
gggacgcgcatgctgggcgg

SEQ ID NO: 354309 - DNA, 20 bp, human
gcccagcatgcgcgtccctg

SEQ ID NO: 354310 - DNA, 20 bp, human
gcccgacctggcccagtcaa

SEQ ID NO: 354311 - DNA, 20 bp, human
ggcgggacctgggcggatct

SEQ ID NO: 354312 - DNA, 20 bp, human
gtacccaccagcccttgact

SEQ ID NO: 354313 - DNA, 20 bp, human
gacctgggcggatctgggac

SEQ ID NO: 354314 - DNA, 20 bp, human
gggcggcggaggcgctaggg

SEQ ID NO: 354315 - DNA, 20 bp, human
gcgcccctttccctacccca

SEQ ID NO: 354316 - DNA, 20 bp, human
gtgcccgggagcggggttgt

SEQ ID NO: 354317 - DNA, 20 bp, human
gcccaccccgacgtctaccc

SEQ ID NO: 354318 - DNA, 20 bp, human
gtccctgccgcgaacaccag

SEQ ID NO: 354319 - DNA, 20 bp, human
gtctccgccagggtagacgt

SEQ ID NO: 354320 - DNA, 20 bp, human
gcccaggagcttctccgcca

SEQ ID NO: 354321 - DNA, 20 bp, human
gctctcgagccgcgaggccg

SEQ ID NO: 354322 - DNA, 20 bp, human
gtcccctggtgttcgcggca

SEQ ID NO: 354323 - DNA, 20 bp, human
ggagaagctcctgggcgacg

SEQ ID NO: 354324 - DNA, 20 bp, human
gtccgcagcctgggctttgg

SEQ ID NO: 354325 - DNA, 20 bp, human
gaagctcctgggcgacgggg

SEQ ID NO: 354326 - DNA, 20 bp, human
gcccgtgcaccggaaaccat

SEQ ID NO: 354327 - DNA, 20 bp, human
ggggtgggaaataccccgat

SEQ ID NO: 354328 - DNA, 20 bp, human
gcggcctcagtcctggacgc

SEQ ID NO: 354329 - DNA, 20 bp, human
ggaaagaccccctagagaga

SEQ ID NO: 354330 - DNA, 20 bp, human
ggtttccggtgcacgggctt

SEQ ID NO: 354331 - DNA, 20 bp, human
gccgtgagagcgctctcttc

SEQ ID NO: 354332 - DNA, 20 bp, human
ggcgcctgcgtccaggactg

SEQ ID NO: 354333 - DNA, 20 bp, human
ggggaaataccccgattggg

SEQ ID NO: 354334 - DNA, 20 bp, human
gccattaagtcccacccaat

SEQ ID NO: 354335 - DNA, 20 bp, human
gaccccctaagcccgtgcac

SEQ ID NO: 354336 - DNA, 20 bp, human
gcgggggaaaaggtgccgac

SEQ ID NO: 354337 - DNA, 20 bp, human
gacggccgagacacacggtc

SEQ ID NO: 354338 - DNA, 20 bp, human
gggtgccgaccggcttcgaa

SEQ ID NO: 354339 - DNA, 20 bp, human
gaacgaagcgagctggcggt

SEQ ID NO: 354340 - DNA, 20 bp, human
gaggcgacggccgagacaca

SEQ ID NO: 354341 - DNA, 20 bp, human
ggcaaggttgtgcctagaaa

SEQ ID NO: 354342 - DNA, 20 bp, human
gcccggcgcctccgctatct

SEQ ID NO: 354343 - DNA, 20 bp, human
gaacccaccacgagagggag

SEQ ID NO: 354344 - DNA, 20 bp, human
ggagtggcagcaacgcgaga

SEQ ID NO: 354345 - DNA, 20 bp, human
ggccgaccggcttcgaaggg

SEQ ID NO: 354346 - DNA, 20 bp, human
gagtcagcacagagcgcgaa

SEQ ID NO: 354347 - DNA, 20 bp, human
gcccaagacaggggaaaggc

SEQ ID NO: 354348 - DNA, 20 bp, human
gggccacgggcgccgccgga

SEQ ID NO: 354349 - DNA, 20 bp, human
gtgtgctgactccgcccctc

SEQ ID NO: 354350 - DNA, 20 bp, human
gcgcagagagatgaccgcgc

SEQ ID NO: 354351 - DNA, 20 bp, human
gtgtctgtttccctcagggg

SEQ ID NO: 354352 - DNA, 20 bp, human
gcggtgtgaccggagggaaa

SEQ ID NO: 354353 - DNA, 20 bp, human
gcgggagcagcaagttaagc

SEQ ID NO: 354354 - DNA, 20 bp, human
gctctctgcgccttcccgca

SEQ ID NO: 354355 - DNA, 20 bp, human
gttaagccggtgtgaccgga

SEQ ID NO: 354356 - DNA, 20 bp, human
gaaccccaaaggactccttc

SEQ ID NO: 354357 - DNA, 20 bp, human
gcactcactagctgggggga

SEQ ID NO: 354358 - DNA, 20 bp, human
gcgggctgggaggccactaa

SEQ ID NO: 354359 - DNA, 20 bp, human
ggtgagtgcgcgaacgagaa

SEQ ID NO: 354360 - DNA, 20 bp, human
gtagttcacgcgcacaggga

SEQ ID NO: 354361 - DNA, 20 bp, human
gagcgcgcggcaaatcgggc

SEQ ID NO: 354362 - DNA, 20 bp, human
ggccacgtcaatcaaggcga

SEQ ID NO: 354363 - DNA, 20 bp, human
gtggggggaggggcggctag

SEQ ID NO: 354364 - DNA, 20 bp, human
gcggggaggacgcgagaagg

SEQ ID NO: 354365 - DNA, 20 bp, human
gtcaatcaaggcgacggagg

SEQ ID NO: 354366 - DNA, 20 bp, human
gcactcctggctgctagaga

SEQ ID NO: 354367 - DNA, 20 bp, human
ggtcagaaggcgggaccgcc

SEQ ID NO: 354368 - DNA, 20 bp, human
gcggccctcagccaccaatc

SEQ ID NO: 354369 - DNA, 20 bp, human
gaatggtcgacgtcagaagg

SEQ ID NO: 354370 - DNA, 20 bp, human
gtaggaatgaacggaggaaa

SEQ ID NO: 354371 - DNA, 20 bp, human
gccctcaagttaggaatgaa

SEQ ID NO: 354372 - DNA, 20 bp, human
ggccaatggtcgacgtcaga

SEQ ID NO: 354373 - DNA, 20 bp, human
gccaccaatcaggagcgcgc

SEQ ID NO: 354374 - DNA, 20 bp, human
gagagggcctcttcgcccgg

SEQ ID NO: 354375 - DNA, 20 bp, human
gtcaagttaggaatgaacgg

SEQ ID NO: 354376 - DNA, 20 bp, human
ggcgactagaggagcggata

SEQ ID NO: 354377 - DNA, 20 bp, human
gcgaaggaggagctgagaat

SEQ ID NO: 354378 - DNA, 20 bp, human
gcgggaggtcccagggccta

SEQ ID NO: 354379 - DNA, 20 bp, human
gctggccccgccttcgtccc

SEQ ID NO: 354380 - DNA, 20 bp, human
gcgaaggcggggccagcgga

SEQ ID NO: 354381 - DNA, 20 bp, human
gagggcctagggagcggaag

SEQ ID NO: 354382 - DNA, 20 bp, human
ggccagcggagggcgactag

SEQ ID NO: 354383 - DNA, 20 bp, human
gtagggagcggaagaggtcg

SEQ ID NO: 354384 - DNA, 20 bp, human
gggaagaggtcgcggcgacg

SEQ ID NO: 354385 - DNA, 20 bp, human
ggccagaagacccaatcttc

SEQ ID NO: 354386 - DNA, 20 bp, human
gggatcagggcgacgtccta

SEQ ID NO: 354387 - DNA, 20 bp, human
gacaaaaggctgttttccat

SEQ ID NO: 354388 - DNA, 20 bp, human
gagtttatggaaagccttgg

SEQ ID NO: 354389 - DNA, 20 bp, human
gtgaggagacgaaataaatt

SEQ ID NO: 354390 - DNA, 20 bp, human
gacgaaataaattgggatca

SEQ ID NO: 354391 - DNA, 20 bp, human
gagtagtttatggaaagcct

SEQ ID NO: 354392 - DNA, 20 bp, human
gtttgtctagttttccccca

SEQ ID NO: 354393 - DNA, 20 bp, human
gtccccgcgcccattggttg

SEQ ID NO: 354394 - DNA, 20 bp, human
ggcgaggaaaggaggcggcg

SEQ ID NO: 354395 - DNA, 20 bp, human
gggaaggcgtgcgagggaga

SEQ ID NO: 354396 - DNA, 20 bp, human
gtcccgcgggcgactccact

SEQ ID NO: 354397 - DNA, 20 bp, human
ggtcgcccgcgggaaccggg

SEQ ID NO: 354398 - DNA, 20 bp, human
gccccgccgcgcatgccgag

SEQ ID NO: 354399 - DNA, 20 bp, human
ggcgacccccagaggactac

SEQ ID NO: 354400 - DNA, 20 bp, human
gcggtgaggcgcaaagccgc

SEQ ID NO: 354401 - DNA, 20 bp, human
gtggagtcgcccgcgggaac

SEQ ID NO: 354402 - DNA, 20 bp, human
gcttccggcgccactgtcat

SEQ ID NO: 354403 - DNA, 20 bp, human
gcgcgcctgtagtcctctgg

SEQ ID NO: 354404 - DNA, 20 bp, human
ggccgagtggagtcgcccgc

SEQ ID NO: 354405 - DNA, 20 bp, human
gcaacccagcacccgactcc

SEQ ID NO: 354406 - DNA, 20 bp, human
gccaggccgccgtctttcta

SEQ ID NO: 354407 - DNA, 20 bp, human
gaaaatcaaggacgtgagga

SEQ ID NO: 354408 - DNA, 20 bp, human
gtaggaagaaagactaacgt

SEQ ID NO: 354409 - DNA, 20 bp, human
gagcagccctagaaagacgg

SEQ ID NO: 354410 - DNA, 20 bp, human
gcagcccaagaggtgttctc

SEQ ID NO: 354411 - DNA, 20 bp, human
gtagacttggaggttaacaa

SEQ ID NO: 354412 - DNA, 20 bp, human
gtgtataaggtccacacccc

SEQ ID NO: 354413 - DNA, 20 bp, human
gggcacctgagaacacctct

SEQ ID NO: 354414 - DNA, 20 bp, human
ggggtcagggtggaacgtgc

SEQ ID NO: 354415 - DNA, 20 bp, human
gtgcaatcactcagctcccg

SEQ ID NO: 354416 - DNA, 20 bp, human
gagcaacagggaatgtggta

SEQ ID NO: 354417 - DNA, 20 bp, human
gaacagggaatgtggtaggg

SEQ ID NO: 354418 - DNA, 20 bp, human
ggaaatcgctgccttgaaga

SEQ ID NO: 354419 - DNA, 20 bp, human
gccctacagcattgtatctg

SEQ ID NO: 354420 - DNA, 20 bp, human
gagagtagggagatgaccaa

SEQ ID NO: 354421 - DNA, 20 bp, human
gtacatatgggaaatcagtg

SEQ ID NO: 354422 - DNA, 20 bp, human
gacctcagaactgcttccct

SEQ ID NO: 354423 - DNA, 20 bp, human
gcttcaagagaagaaacatg

SEQ ID NO: 354424 - DNA, 20 bp, human
gaccccagatacaatgctgt

SEQ ID NO: 354425 - DNA, 20 bp, human
gagtaatgtgcagaagacac

SEQ ID NO: 354426 - DNA, 20 bp, human
ggtgaggtagtaagaaataa

SEQ ID NO: 354427 - DNA, 20 bp, human
gaggggcaattggcaaataa

SEQ ID NO: 354428 - DNA, 20 bp, human
gacacagataaggatttccc

SEQ ID NO: 354429 - DNA, 20 bp, human
gacctagagcaggcatgggt

SEQ ID NO: 354430 - DNA, 20 bp, human
ggctatattatagccattgt

SEQ ID NO: 354431 - DNA, 20 bp, human
gtctctcaactgaaaagatc

SEQ ID NO: 354432 - DNA, 20 bp, human
gacccacccatgcctgctct

SEQ ID NO: 354433 - DNA, 20 bp, human
gggggagaatttgtattgtg

SEQ ID NO: 354434 - DNA, 20 bp, human
gagtgacctagagcaggcat

SEQ ID NO: 354435 - DNA, 20 bp, human
gcgattgatcagatttagga

SEQ ID NO: 354436 - DNA, 20 bp, human
gtctgtgttgagcacttcga

SEQ ID NO: 354437 - DNA, 20 bp, human
gagccaagcaggattgacag

SEQ ID NO: 354438 - DNA, 20 bp, human
gagtaccaaactctgagagc

SEQ ID NO: 354439 - DNA, 20 bp, human
ggttcagaaaaggctttctt

SEQ ID NO: 354440 - DNA, 20 bp, human
gcatgccagctctcagagtt

SEQ ID NO: 354441 - DNA, 20 bp, human
gggaagatagaaagtagcaa

SEQ ID NO: 354442 - DNA, 20 bp, human
ggtgcaattgggtggattta

SEQ ID NO: 354443 - DNA, 20 bp, human
gggagggacttggaaggaat

SEQ ID NO: 354444 - DNA, 20 bp, human
gccttgcaagatccagctgg

SEQ ID NO: 354445 - DNA, 20 bp, human
gggggaactatgcctccagc

SEQ ID NO: 354446 - DNA, 20 bp, human
gctcctgggctcccgtgagt

SEQ ID NO: 354447 - DNA, 20 bp, human
gcgtgagtgggatgacaaag

SEQ ID NO: 354448 - DNA, 20 bp, human
gcgaatgctctgttctctga

SEQ ID NO: 354449 - DNA, 20 bp, human
gaaaacatcaaagaaagccc

SEQ ID NO: 354450 - DNA, 20 bp, human
gcaggagggcatgtactcag

SEQ ID NO: 354451 - DNA, 20 bp, human
gtccaatgacactgtagagg

SEQ ID NO: 354452 - DNA, 20 bp, human
gagcctgtgctctcgtggca

SEQ ID NO: 354453 - DNA, 20 bp, human
gtgtgggtgtgacaggagta

SEQ ID NO: 354454 - DNA, 20 bp, human
ggaacttttggcaaggagat

SEQ ID NO: 354455 - DNA, 20 bp, human
gtgtgctaagagggttggat

SEQ ID NO: 354456 - DNA, 20 bp, human
gcatgcagaaacccacagat

SEQ ID NO: 354457 - DNA, 20 bp, human
gggactatgtaccaatctgt

SEQ ID NO: 354458 - DNA, 20 bp, human
gagaacaaatagagccactg

SEQ ID NO: 354459 - DNA, 20 bp, human
gttgggccagcagagcccag

SEQ ID NO: 354460 - DNA, 20 bp, human
ggctggttagatccaaactc

SEQ ID NO: 354461 - DNA, 20 bp, human
gatagttttcatccagagtt

SEQ ID NO: 354462 - DNA, 20 bp, human
ggcaaaactctgtcttacac

SEQ ID NO: 354463 - DNA, 20 bp, human
gctgggcaaacagccctcag

SEQ ID NO: 354464 - DNA, 20 bp, human
gggatattactaaaaatgaa

SEQ ID NO: 354465 - DNA, 20 bp, human
gagagcccagagggagggtc

SEQ ID NO: 354466 - DNA, 20 bp, human
gaggagaaatagagccacag

SEQ ID NO: 354467 - DNA, 20 bp, human
ggaaggcaggcatagtagtt

SEQ ID NO: 354468 - DNA, 20 bp, human
gaaatgactaaatgacacga

SEQ ID NO: 354469 - DNA, 20 bp, human
gggtgaaaactatacgctgc

SEQ ID NO: 354470 - DNA, 20 bp, human
gaagcttcccttggtgggtc

SEQ ID NO: 354471 - DNA, 20 bp, human
ggcatggccagacccaccaa

SEQ ID NO: 354472 - DNA, 20 bp, human
ggactaaatgacacgaaggc

SEQ ID NO: 354473 - DNA, 20 bp, human
ggtgtcatttagtcatttag

SEQ ID NO: 354474 - DNA, 20 bp, human
gccggtgggatctggactct

SEQ ID NO: 354475 - DNA, 20 bp, human
gggaccatgtgtcaatctgt

SEQ ID NO: 354476 - DNA, 20 bp, human
ggctgcggcgccagctccaa

SEQ ID NO: 354477 - DNA, 20 bp, human
gagagcagatggcgggaaac

SEQ ID NO: 354478 - DNA, 20 bp, human
gaggaaggagcgcggatccc

SEQ ID NO: 354479 - DNA, 20 bp, human
gcgtggaggcagtgctctcg

SEQ ID NO: 354480 - DNA, 20 bp, human
gtccaagggcggatccaggc

SEQ ID NO: 354481 - DNA, 20 bp, human
gtgtacacggacggagatgg

SEQ ID NO: 354482 - DNA, 20 bp, human
gcgcagcagcacccgcccca

SEQ ID NO: 354483 - DNA, 20 bp, human
ggcccgttggggtccagctg

SEQ ID NO: 354484 - DNA, 20 bp, human
ggaagggccgcctggcaatt

SEQ ID NO: 354485 - DNA, 20 bp, human
gtgccagcctctgcgtagtt

SEQ ID NO: 354486 - DNA, 20 bp, human
ggaagcactcattccatatc

SEQ ID NO: 354487 - DNA, 20 bp, human
gtactaggctacacaaattc

SEQ ID NO: 354488 - DNA, 20 bp, human
ggagctcctggcagatcacg

SEQ ID NO: 354489 - DNA, 20 bp, human
gcatttatgcatatacttat

SEQ ID NO: 354490 - DNA, 20 bp, human
gttatcacatgtatacagga

SEQ ID NO: 354491 - DNA, 20 bp, human
gatgtattcacttctgttgt

SEQ ID NO: 354492 - DNA, 20 bp, human
gaatgaaagagattagagac

SEQ ID NO: 354493 - DNA, 20 bp, human
gtcattaaatcatgagctcc

SEQ ID NO: 354494 - DNA, 20 bp, human
gtgcatatacttattgggcc

SEQ ID NO: 354495 - DNA, 20 bp, human
gtgatactgttttaaagaac

SEQ ID NO: 354496 - DNA, 20 bp, human
gtagcccgggccagctctta

SEQ ID NO: 354497 - DNA, 20 bp, human
gacttctggcccttgatcct

SEQ ID NO: 354498 - DNA, 20 bp, human
gtgactcttcccaggatcaa

SEQ ID NO: 354499 - DNA, 20 bp, human
ggaacagacacgagggaagt

SEQ ID NO: 354500 - DNA, 20 bp, human
gttgggacatgtaagtggag

SEQ ID NO: 354501 - DNA, 20 bp, human
gggcaggtacaggcatcctt

SEQ ID NO: 354502 - DNA, 20 bp, human
gggccagaagtgtatatgag

SEQ ID NO: 354503 - DNA, 20 bp, human
gggagatggaacagacacga

SEQ ID NO: 354504 - DNA, 20 bp, human
gttgctgaacatgtttaggc

SEQ ID NO: 354505 - DNA, 20 bp, human
gctacgctgtgtctgtttgg

SEQ ID NO: 354506 - DNA, 20 bp, human
gaaaagatacctgggagtgt

SEQ ID NO: 354507 - DNA, 20 bp, human
gcaggggtgttcaatatctt

SEQ ID NO: 354508 - DNA, 20 bp, human
gcccataaaactattgtgag

SEQ ID NO: 354509 - DNA, 20 bp, human
ggccctgcaataactggctt

SEQ ID NO: 354510 - DNA, 20 bp, human
gagtctcagaaaagatacct

SEQ ID NO: 354511 - DNA, 20 bp, human
gctaaacaatagaatgccag

SEQ ID NO: 354512 - DNA, 20 bp, human
gtagggaacttgagaggtcc

SEQ ID NO: 354513 - DNA, 20 bp, human
gcacattgccctgcaataac

SEQ ID NO: 354514 - DNA, 20 bp, human
gaaaaaggcacattatctgc

SEQ ID NO: 354515 - DNA, 20 bp, human
gacctctcacaatagtttta

SEQ ID NO: 354516 - DNA, 20 bp, human
gtgaataaatccagggatgt

SEQ ID NO: 354517 - DNA, 20 bp, human
gtcagagtgccccacatccc

SEQ ID NO: 354518 - DNA, 20 bp, human
gtgtcacatgaataaatcca

SEQ ID NO: 354519 - DNA, 20 bp, human
gcgacaattggaattctgtt

SEQ ID NO: 354520 - DNA, 20 bp, human
gaattccaattgtcgataga

SEQ ID NO: 354521 - DNA, 20 bp, human
gcagcccttctatcgacaat

SEQ ID NO: 354522 - DNA, 20 bp, human
gctgccaccttcactcaaca

SEQ ID NO: 354523 - DNA, 20 bp, human
gggaaaataacttttctgat

SEQ ID NO: 354524 - DNA, 20 bp, human
gacgtgctttgctgtttagc

SEQ ID NO: 354525 - DNA, 20 bp, human
gtgctttgctgtttagctgg

SEQ ID NO: 354526 - DNA, 20 bp, human
gacttgaagaagcggagcca

SEQ ID NO: 354527 - DNA, 20 bp, human
gagggaggggcggtgtcgta

SEQ ID NO: 354528 - DNA, 20 bp, human
ggaggggcggtgtcgtaggg

SEQ ID NO: 354529 - DNA, 20 bp, human
gagggctgagatcccgaagg

SEQ ID NO: 354530 - DNA, 20 bp, human
gacgagttcgggctcgtcag

SEQ ID NO: 354531 - DNA, 20 bp, human
gcccccaggccgcagttcgg

SEQ ID NO: 354532 - DNA, 20 bp, human
gacaggaagttgacgagttc

SEQ ID NO: 354533 - DNA, 20 bp, human
ggcgggcgaggtctgggatg

SEQ ID NO: 354534 - DNA, 20 bp, human
gccgaaggcgggcgaggtct

SEQ ID NO: 354535 - DNA, 20 bp, human
ggaagccctgggcccggcag

SEQ ID NO: 354536 - DNA, 20 bp, human
ggggactacaattcccagga

SEQ ID NO: 354537 - DNA, 20 bp, human
gtcggctgcgtaagcgtcca

SEQ ID NO: 354538 - DNA, 20 bp, human
gacggcagcgacgtcggcgt

SEQ ID NO: 354539 - DNA, 20 bp, human
ggggcgcacggcagcgacgt

SEQ ID NO: 354540 - DNA, 20 bp, human
ggctgcgtaagcgtccacgg

SEQ ID NO: 354541 - DNA, 20 bp, human
gtgacccgtgtcctgggagt

SEQ ID NO: 354542 - DNA, 20 bp, human
gtgggaattgtagtcccgaa

SEQ ID NO: 354543 - DNA, 20 bp, human
gtgttcggccatagcccttc

SEQ ID NO: 354544 - DNA, 20 bp, human
gcctgcttccggccaatccg

SEQ ID NO: 354545 - DNA, 20 bp, human
gcccgcctgcgtggcccggt

SEQ ID NO: 354546 - DNA, 20 bp, human
ggggtgtgtgcccggacaac

SEQ ID NO: 354547 - DNA, 20 bp, human
ggtgacgcccgccacacccc

SEQ ID NO: 354548 - DNA, 20 bp, human
gtagccagcgggctaggatt

SEQ ID NO: 354549 - DNA, 20 bp, human
gcgggcgtcacccgttgtcc

SEQ ID NO: 354550 - DNA, 20 bp, human
gggtctgcggggtgtgtgcc

SEQ ID NO: 354551 - DNA, 20 bp, human
gggctaggattgggtctgcg

SEQ ID NO: 354552 - DNA, 20 bp, human
gcctccatggtctagccagc

SEQ ID NO: 354553 - DNA, 20 bp, human
gagacccaatcctagcccgc

SEQ ID NO: 354554 - DNA, 20 bp, human
ggctctgtggctgcacccag

SEQ ID NO: 354555 - DNA, 20 bp, human
gggtgagtcccccggccccg

SEQ ID NO: 354556 - DNA, 20 bp, human
gaaagcgcgcaggacctctc

SEQ ID NO: 354557 - DNA, 20 bp, human
gagcctccgcggggcctcac

SEQ ID NO: 354558 - DNA, 20 bp, human
gagccctggcgtcgcgtagg

SEQ ID NO: 354559 - DNA, 20 bp, human
gaacccagggaaagcgttag

SEQ ID NO: 354560 - DNA, 20 bp, human
gtccgcggcggcttcccgtg

SEQ ID NO: 354561 - DNA, 20 bp, human
gtggacgcggtgcctctcga

SEQ ID NO: 354562 - DNA, 20 bp, human
gttcccgtgaagctccgcgg

SEQ ID NO: 354563 - DNA, 20 bp, human
gcgacgaagcggccatcgag

SEQ ID NO: 354564 - DNA, 20 bp, human
gacctctcaggaagcctccg

SEQ ID NO: 354565 - DNA, 20 bp, human
gctggcgtcgcgtaggaggg

SEQ ID NO: 354566 - DNA, 20 bp, human
gccgcctgccgcccccggat

SEQ ID NO: 354567 - DNA, 20 bp, human
ggtagctagggcgtgagtat

SEQ ID NO: 354568 - DNA, 20 bp, human
ggggagggggaccaacaaac

SEQ ID NO: 354569 - DNA, 20 bp, human
gcgggggcggcaggcggaaa

SEQ ID NO: 354570 - DNA, 20 bp, human
gttcccccatggcctcgcta

SEQ ID NO: 354571 - DNA, 20 bp, human
gctcccgcgaaagtcctgag

SEQ ID NO: 354572 - DNA, 20 bp, human
gcccctctgcccccctgcga

SEQ ID NO: 354573 - DNA, 20 bp, human
gacacgggaatggaaggagc

SEQ ID NO: 354574 - DNA, 20 bp, human
gctgccgcccccggatggga

SEQ ID NO: 354575 - DNA, 20 bp, human
ggcctcaaccatcccatccg

SEQ ID NO: 354576 - DNA, 20 bp, human
gcggagccaagaaaggagtg

SEQ ID NO: 354577 - DNA, 20 bp, human
ggatgaggaatgtgatgccc

SEQ ID NO: 354578 - DNA, 20 bp, human
gcaagagtgatggatgcagt

SEQ ID NO: 354579 - DNA, 20 bp, human
gttggctgctgccacctgaa

SEQ ID NO: 354580 - DNA, 20 bp, human
gaggtgagtgacatgacccc

SEQ ID NO: 354581 - DNA, 20 bp, human
gagcagggcggagccaagaa

SEQ ID NO: 354582 - DNA, 20 bp, human
gtgggagggaaagcagccac

SEQ ID NO: 354583 - DNA, 20 bp, human
gagcagccacaggctcactc

SEQ ID NO: 354584 - DNA, 20 bp, human
gctgcgtcactgagtcagca

SEQ ID NO: 354585 - DNA, 20 bp, human
ggcagtgcggccttctcaga

SEQ ID NO: 354586 - DNA, 20 bp, human
ggaggcaggagcagctccgc

SEQ ID NO: 354587 - DNA, 20 bp, human
gtcacgccccgccccgtggt

SEQ ID NO: 354588 - DNA, 20 bp, human
ggcagctccgcgggccttga

SEQ ID NO: 354589 - DNA, 20 bp, human
ggccttgagggcgtgtcagg

SEQ ID NO: 354590 - DNA, 20 bp, human
gcctctctgagccaaccacg

SEQ ID NO: 354591 - DNA, 20 bp, human
gacacgggcggtccccccga

SEQ ID NO: 354592 - DNA, 20 bp, human
gtctgagccaaccacggggc

SEQ ID NO: 354593 - DNA, 20 bp, human
ggacacgccctcaaggcccg

SEQ ID NO: 354594 - DNA, 20 bp, human
gctaacctagaccacccgtg

SEQ ID NO: 354595 - DNA, 20 bp, human
gagctcggacccgggagtgt

SEQ ID NO: 354596 - DNA, 20 bp, human
gccagcagccaatggatctg

SEQ ID NO: 354597 - DNA, 20 bp, human
gctgttacgcccaatccctg

SEQ ID NO: 354598 - DNA, 20 bp, human
gaacctgggaatcccctttc

SEQ ID NO: 354599 - DNA, 20 bp, human
gtggagggaatcccacctca

SEQ ID NO: 354600 - DNA, 20 bp, human
gtacgcccaatccctgaggt

SEQ ID NO: 354601 - DNA, 20 bp, human
gagccaatcacaagaggagg

SEQ ID NO: 354602 - DNA, 20 bp, human
ggagttgcagggactgtccc

SEQ ID NO: 354603 - DNA, 20 bp, human
ggtccgcctcctcttgtgat

SEQ ID NO: 354604 - DNA, 20 bp, human
gacaaactagctatggaagc

SEQ ID NO: 354605 - DNA, 20 bp, human
gtgcagggactgtcccgggt

SEQ ID NO: 354606 - DNA, 20 bp, human
ggcccctcagaccacaccgg

SEQ ID NO: 354607 - DNA, 20 bp, human
ggggcggggcccagaagatc

SEQ ID NO: 354608 - DNA, 20 bp, human
gaagatctgggcggagccct

SEQ ID NO: 354609 - DNA, 20 bp, human
gggggcccagaagatctggg

SEQ ID NO: 354610 - DNA, 20 bp, human
gaacagaggcctcagagccg

SEQ ID NO: 354611 - DNA, 20 bp, human
gagcccgccggtgtggtctg

SEQ ID NO: 354612 - DNA, 20 bp, human
gtctgaggcctctgttccca

SEQ ID NO: 354613 - DNA, 20 bp, human
gcacccccgcagccgggggg

SEQ ID NO: 354614 - DNA, 20 bp, human
gggctccgcccagatcttct

SEQ ID NO: 354615 - DNA, 20 bp, human
ggcccctgccggtttgggac

SEQ ID NO: 354616 - DNA, 20 bp, human
ggtaagcagtgcgccctcta

SEQ ID NO: 354617 - DNA, 20 bp, human
gcccgaatgggcaccctaga

SEQ ID NO: 354618 - DNA, 20 bp, human
gggcgcactgcttacatttt

SEQ ID NO: 354619 - DNA, 20 bp, human
gcgctcccaggctccataaa

SEQ ID NO: 354620 - DNA, 20 bp, human
gcgggatctattttagacca

SEQ ID NO: 354621 - DNA, 20 bp, human
gtctaaaatagatcccgaat

SEQ ID NO: 354622 - DNA, 20 bp, human
ggccctctagggtgcccatt

SEQ ID NO: 354623 - DNA, 20 bp, human
gctttgctgacaagtccaca

SEQ ID NO: 354624 - DNA, 20 bp, human
gccaggctccataaaagggg

SEQ ID NO: 354625 - DNA, 20 bp, human
gcaagtccacagggcaaggt

SEQ ID NO: 354626 - DNA, 20 bp, human
gaatgccctcacagtggggt

SEQ ID NO: 354627 - DNA, 20 bp, human
gtgagggcattcaaaataat

SEQ ID NO: 354628 - DNA, 20 bp, human
gaaccacgagacccggatgt

SEQ ID NO: 354629 - DNA, 20 bp, human
ggactgtatatatagtggag

SEQ ID NO: 354630 - DNA, 20 bp, human
gagagggggtgaggtattct

SEQ ID NO: 354631 - DNA, 20 bp, human
gtgcctacatccgggtctcg

SEQ ID NO: 354632 - DNA, 20 bp, human
gtaagtgaaaaacctggact

SEQ ID NO: 354633 - DNA, 20 bp, human
gccaaacattggaatacctg

SEQ ID NO: 354634 - DNA, 20 bp, human
ggtagtttttgcctacatcc

SEQ ID NO: 354635 - DNA, 20 bp, human
gggatggactgtatatatag

SEQ ID NO: 354636 - DNA, 20 bp, human
ggaaggccccgaccacgctg

SEQ ID NO: 354637 - DNA, 20 bp, human
gggactaccgaacgaggggc

SEQ ID NO: 354638 - DNA, 20 bp, human
gctaccggactaccgaacga

SEQ ID NO: 354639 - DNA, 20 bp, human
gctaccgaacgaggggcggg

SEQ ID NO: 354640 - DNA, 20 bp, human
gcggagccgcagcgtggtcg

SEQ ID NO: 354641 - DNA, 20 bp, human
ggccgagggcggggaattcg

SEQ ID NO: 354642 - DNA, 20 bp, human
gtctcctcccgcccctcgtt

SEQ ID NO: 354643 - DNA, 20 bp, human
gacgccgcaaaagcacggag

SEQ ID NO: 354644 - DNA, 20 bp, human
gcggtagtccggtagccccg

SEQ ID NO: 354645 - DNA, 20 bp, human
ggtgcgcccgcaggggccga

SEQ ID NO: 354646 - DNA, 20 bp, human
gtcccctggccaaggattcg

SEQ ID NO: 354647 - DNA, 20 bp, human
gctgtgccgccccgaatcct

SEQ ID NO: 354648 - DNA, 20 bp, human
gtaggtgaaacaccttctat

SEQ ID NO: 354649 - DNA, 20 bp, human
gaagtgaaggacttatttaa

SEQ ID NO: 354650 - DNA, 20 bp, human
gccttttgatcaagaagtga

SEQ ID NO: 354651 - DNA, 20 bp, human
ggtctttaataagaggctga

SEQ ID NO: 354652 - DNA, 20 bp, human
gcctggccaaggattcgggg

SEQ ID NO: 354653 - DNA, 20 bp, human
gaaacgaagtcccctggcca

SEQ ID NO: 354654 - DNA, 20 bp, human
ggggcggcacagaggggaaa

SEQ ID NO: 354655 - DNA, 20 bp, human
gcggctctgacatggttcct

SEQ ID NO: 354656 - DNA, 20 bp, human
gagaacagctgctagtggag

SEQ ID NO: 354657 - DNA, 20 bp, human
ggggcaggagcaatgaatgt

SEQ ID NO: 354658 - DNA, 20 bp, human
gggagacgggagattggttt

SEQ ID NO: 354659 - DNA, 20 bp, human
gcaccgagaacagctgctag

SEQ ID NO: 354660 - DNA, 20 bp, human
gctactccgcctcagcgaga

SEQ ID NO: 354661 - DNA, 20 bp, human
ggtggggaggcgcgggagac

SEQ ID NO: 354662 - DNA, 20 bp, human
ggactgcttggctccgtacc

SEQ ID NO: 354663 - DNA, 20 bp, human
gattgctcctgccccgtcta

SEQ ID NO: 354664 - DNA, 20 bp, human
gtgccgccgtctcgctgagg

SEQ ID NO: 354665 - DNA, 20 bp, human
gggcgggaccagagcacgca

SEQ ID NO: 354666 - DNA, 20 bp, human
ggggcgggacggtgagaaac

SEQ ID NO: 354667 - DNA, 20 bp, human
gaaaaccagtacaaaggggg

SEQ ID NO: 354668 - DNA, 20 bp, human
ggataaaaccagtacaaagg

SEQ ID NO: 354669 - DNA, 20 bp, human
gcgaggagagcacgacacta

SEQ ID NO: 354670 - DNA, 20 bp, human
gactgataaaaccagtacaa

SEQ ID NO: 354671 - DNA, 20 bp, human
gaggggaggaattggttagg

SEQ ID NO: 354672 - DNA, 20 bp, human
gggtaggggaggaattggtt

SEQ ID NO: 354673 - DNA, 20 bp, human
ggatgttaatggaggcgtga

SEQ ID NO: 354674 - DNA, 20 bp, human
gtcctcggtaggggaggaat

SEQ ID NO: 354675 - DNA, 20 bp, human
gcggccctccccctttgtac

SEQ ID NO: 354676 - DNA, 20 bp, human
ggagcccggctcagaatccc

SEQ ID NO: 354677 - DNA, 20 bp, human
ggaagggaaagataaggaca

SEQ ID NO: 354678 - DNA, 20 bp, human
ggcgcctccggcagaaccat

SEQ ID NO: 354679 - DNA, 20 bp, human
gggtagcagggctccgagga

SEQ ID NO: 354680 - DNA, 20 bp, human
gccgaggtggtgagtcgcca

SEQ ID NO: 354681 - DNA, 20 bp, human
gtctgccagggattctgagc

SEQ ID NO: 354682 - DNA, 20 bp, human
gctgggatgcaggcaagccg

SEQ ID NO: 354683 - DNA, 20 bp, human
gggatgcaggcaagccgagg

SEQ ID NO: 354684 - DNA, 20 bp, human
ggacacggctgcgggtagca

SEQ ID NO: 354685 - DNA, 20 bp, human
gggtgcacccgcaaacatgg

SEQ ID NO: 354686 - DNA, 20 bp, human
gagcggggcggtgccacgta

SEQ ID NO: 354687 - DNA, 20 bp, human
ggcggtgccacgtacggctc

SEQ ID NO: 354688 - DNA, 20 bp, human
gtgctagggcacaagagaga

SEQ ID NO: 354689 - DNA, 20 bp, human
ggcccgggggccgactccac

SEQ ID NO: 354690 - DNA, 20 bp, human
gacggctccggaagaagcga

SEQ ID NO: 354691 - DNA, 20 bp, human
gtccccggactctccgtcat

SEQ ID NO: 354692 - DNA, 20 bp, human
gaacaagcacacgcccatga

SEQ ID NO: 354693 - DNA, 20 bp, human
gagggccgacctcggagaga

SEQ ID NO: 354694 - DNA, 20 bp, human
ggaagccaggtcacctttca

SEQ ID NO: 354695 - DNA, 20 bp, human
gcctcggagagagggttcgc

SEQ ID NO: 354696 - DNA, 20 bp, human
gcccacgtgcagcgacgcaa

SEQ ID NO: 354697 - DNA, 20 bp, human
ggtcgctgcacgtggggcgt

SEQ ID NO: 354698 - DNA, 20 bp, human
ggggccaggaggcaggtcaa

SEQ ID NO: 354699 - DNA, 20 bp, human
gccaggaggcaggtcaaggg

SEQ ID NO: 354700 - DNA, 20 bp, human
gtgaaagaaaagcttctgct

SEQ ID NO: 354701 - DNA, 20 bp, human
ggcgacgcaagggcgacgca

SEQ ID NO: 354702 - DNA, 20 bp, human
gtcttgtaatcccgggacac

SEQ ID NO: 354703 - DNA, 20 bp, human
ggcccttgcgtcgctgcacg

SEQ ID NO: 354704 - DNA, 20 bp, human
gcgggagaagcctttttttt

SEQ ID NO: 354705 - DNA, 20 bp, human
gattccacccgtggcctttt

SEQ ID NO: 354706 - DNA, 20 bp, human
ggagggaaatctggaaaacg

SEQ ID NO: 354707 - DNA, 20 bp, human
gcaagcgagctagaggccga

SEQ ID NO: 354708 - DNA, 20 bp, human
gctagaggccgagggaaatc

SEQ ID NO: 354709 - DNA, 20 bp, human
gaggctgccagaattgggac

SEQ ID NO: 354710 - DNA, 20 bp, human
ggggctcgcggggcggtgag

SEQ ID NO: 354711 - DNA, 20 bp, human
ggcagagcccgtcccaattc

SEQ ID NO: 354712 - DNA, 20 bp, human
gacgtggaagccaaatccaa

SEQ ID NO: 354713 - DNA, 20 bp, human
gtctagctcgcttgcgtcag

SEQ ID NO: 354714 - DNA, 20 bp, human
ggcgtcagaggggccccgag

SEQ ID NO: 354715 - DNA, 20 bp, human
gttctggcagcctttggatt

SEQ ID NO: 354716 - DNA, 20 bp, human
gaagactggaggaccagcga

SEQ ID NO: 354717 - DNA, 20 bp, human
gccgcctcccagcaccaaag

SEQ ID NO: 354718 - DNA, 20 bp, human
gccactctaccccagagttt

SEQ ID NO: 354719 - DNA, 20 bp, human
gtccacaaacagcccctcgc

SEQ ID NO: 354720 - DNA, 20 bp, human
gcgcaggaaggagagacaaa

SEQ ID NO: 354721 - DNA, 20 bp, human
ggccaggcccagaaacgcgg

SEQ ID NO: 354722 - DNA, 20 bp, human
ggaggggctgtttgtggagc

SEQ ID NO: 354723 - DNA, 20 bp, human
gcaactcacgtgaccgacgc

SEQ ID NO: 354724 - DNA, 20 bp, human
ggctctttctttcttctcgc

SEQ ID NO: 354725 - DNA, 20 bp, human
gagacaaacggcccgcccgc

SEQ ID NO: 354726 - DNA, 20 bp, human
gggcggggcatcaacacagg

SEQ ID NO: 354727 - DNA, 20 bp, human
gaacacaggcggagactgtc

SEQ ID NO: 354728 - DNA, 20 bp, human
ggcggagactgtcagggatc

SEQ ID NO: 354729 - DNA, 20 bp, human
gagtgctcctagccaatcgg

SEQ ID NO: 354730 - DNA, 20 bp, human
gctccaaggagcgagacgtg

SEQ ID NO: 354731 - DNA, 20 bp, human
ggtttcagggtcaaggagag

SEQ ID NO: 354732 - DNA, 20 bp, human
ggctcggactccagcagagg

SEQ ID NO: 354733 - DNA, 20 bp, human
ggcggctcggactccagcag

SEQ ID NO: 354734 - DNA, 20 bp, human
gtcgcgacgctccctcagtc

SEQ ID NO: 354735 - DNA, 20 bp, human
ggctgaagcttgcaagggca

SEQ ID NO: 354736 - DNA, 20 bp, human
ggacgagcgatgccccggag

SEQ ID NO: 354737 - DNA, 20 bp, human
ggggaggatcttcgcacggt

SEQ ID NO: 354738 - DNA, 20 bp, human
gaaggggcggagttttcctg

SEQ ID NO: 354739 - DNA, 20 bp, human
gcctgggaagactaagtggg

SEQ ID NO: 354740 - DNA, 20 bp, human
gaaaggctccgattggtcgg

SEQ ID NO: 354741 - DNA, 20 bp, human
gggcctgcaaataatagccg

SEQ ID NO: 354742 - DNA, 20 bp, human
gaggcccagcctcccttccc

SEQ ID NO: 354743 - DNA, 20 bp, human
gcccaggcctggggaaactt

SEQ ID NO: 354744 - DNA, 20 bp, human
ggcaggagaaaggctccgat

SEQ ID NO: 354745 - DNA, 20 bp, human
gagggagggtgacgaacaag

SEQ ID NO: 354746 - DNA, 20 bp, human
gccgacctccgcctgctctg

SEQ ID NO: 354747 - DNA, 20 bp, human
ggttgtgagccgggtcgctg

SEQ ID NO: 354748 - DNA, 20 bp, human
gcggcctttcagacgtttta

SEQ ID NO: 354749 - DNA, 20 bp, human
gggagcatccccagagcagg

SEQ ID NO: 354750 - DNA, 20 bp, human
gtgagcggggcctctaagta

SEQ ID NO: 354751 - DNA, 20 bp, human
gcgctaggggaccccctcca

SEQ ID NO: 354752 - DNA, 20 bp, human
gagcctcggccgcagcgacc

SEQ ID NO: 354753 - DNA, 20 bp, human
gcaggtcagcccacacccgg

SEQ ID NO: 354754 - DNA, 20 bp, human
ggggctctgccgccgggtgt

SEQ ID NO: 354755 - DNA, 20 bp, human
gcccggtgggaagccatgga

SEQ ID NO: 354756 - DNA, 20 bp, human
ggccgcggggctgagatctt

SEQ ID NO: 354757 - DNA, 20 bp, human
gcccaaccctggtctagggc

SEQ ID NO: 354758 - DNA, 20 bp, human
gtctctgcagttgaggtttc

SEQ ID NO: 354759 - DNA, 20 bp, human
gcgcctccgcgccttaacct

SEQ ID NO: 354760 - DNA, 20 bp, human
gctgcagagaagaggacttg

SEQ ID NO: 354761 - DNA, 20 bp, human
gcggcaagccgcctaggtta

SEQ ID NO: 354762 - DNA, 20 bp, human
ggccgaagatctcagccccg

SEQ ID NO: 354763 - DNA, 20 bp, human
gcagcggcggaggtggcttc

SEQ ID NO: 354764 - DNA, 20 bp, human
gctgcgcccaaccctggtct

SEQ ID NO: 354765 - DNA, 20 bp, human
gccctgccctagaccagggt

SEQ ID NO: 354766 - DNA, 20 bp, human
ggcgagccccaggaacggtg

SEQ ID NO: 354767 - DNA, 20 bp, human
ggaagcactgagggacacga

SEQ ID NO: 354768 - DNA, 20 bp, human
ggcggggccaaagcaggcgg

SEQ ID NO: 354769 - DNA, 20 bp, human
ggggagacggcgatgaggta

SEQ ID NO: 354770 - DNA, 20 bp, human
gtgggcggggctccaagcgg

SEQ ID NO: 354771 - DNA, 20 bp, human
gggggcggggccaaagcagg

SEQ ID NO: 354772 - DNA, 20 bp, human
ggcgaaagctgcgtactcgg

SEQ ID NO: 354773 - DNA, 20 bp, human
gacgagaagcggggcgtgcg

SEQ ID NO: 354774 - DNA, 20 bp, human
gcggcggaagagacgagaag

SEQ ID NO: 354775 - DNA, 20 bp, human
gtaggcccggccgttgggcg

SEQ ID NO: 354776 - DNA, 20 bp, human
ggatggatcgatgttagaat

SEQ ID NO: 354777 - DNA, 20 bp, human
ggatgttagaataggatctg

SEQ ID NO: 354778 - DNA, 20 bp, human
gaataggatctgaggctgtg

SEQ ID NO: 354779 - DNA, 20 bp, human
gcgggatccgcctcttaaaa

SEQ ID NO: 354780 - DNA, 20 bp, human
gaagctccgcccagccgact

SEQ ID NO: 354781 - DNA, 20 bp, human
gcgcctcttaaaagggtaac

SEQ ID NO: 354782 - DNA, 20 bp, human
ggggtctgagttgtagtcaa

SEQ ID NO: 354783 - DNA, 20 bp, human
gtaagcccgaaatgtccttt

SEQ ID NO: 354784 - DNA, 20 bp, human
gagccgactgggggtagagg

SEQ ID NO: 354785 - DNA, 20 bp, human
gcacatgtatgaggcttctt

SEQ ID NO: 354786 - DNA, 20 bp, human
gagggtggggcaggcgtctg

SEQ ID NO: 354787 - DNA, 20 bp, human
gtctaggggcacatggttag

SEQ ID NO: 354788 - DNA, 20 bp, human
gcgagactccgcgtgagagt

SEQ ID NO: 354789 - DNA, 20 bp, human
gacagcccggagtactagca

SEQ ID NO: 354790 - DNA, 20 bp, human
gcccgccccacgcgcctcat

SEQ ID NO: 354791 - DNA, 20 bp, human
gagtgggaaagagccttaac

SEQ ID NO: 354792 - DNA, 20 bp, human
ggggcaggcgtctgcggaac

SEQ ID NO: 354793 - DNA, 20 bp, human
gcggaccaatgaggcgcgtg

SEQ ID NO: 354794 - DNA, 20 bp, human
gcctagaaacggagaccgta

SEQ ID NO: 354795 - DNA, 20 bp, human
gtacaaaagcagtgtgactt

SEQ ID NO: 354796 - DNA, 20 bp, human
gaggcgggcagtggacgtga

SEQ ID NO: 354797 - DNA, 20 bp, human
gcccgagcgcatgcgtgcca

SEQ ID NO: 354798 - DNA, 20 bp, human
gcccatgggcgcgtccccac

SEQ ID NO: 354799 - DNA, 20 bp, human
ggggaggggaagggcggcac

SEQ ID NO: 354800 - DNA, 20 bp, human
gcgaggcgcctcccattcgg

SEQ ID NO: 354801 - DNA, 20 bp, human
gggggccgcggcgtccagga

SEQ ID NO: 354802 - DNA, 20 bp, human
gcgcacgcgggcgtctcttc

SEQ ID NO: 354803 - DNA, 20 bp, human
gtggacgtgagggcggcgag

SEQ ID NO: 354804 - DNA, 20 bp, human
gcgggtcggtcccaccgaat

SEQ ID NO: 354805 - DNA, 20 bp, human
ggcacgcatgcgctcggggc

SEQ ID NO: 354806 - DNA, 20 bp, human
gctctaagctcttatctaat

SEQ ID NO: 354807 - DNA, 20 bp, human
gaccggatgtgaggcaaaag

SEQ ID NO: 354808 - DNA, 20 bp, human
gagtgcagtgaccggatgtg

SEQ ID NO: 354809 - DNA, 20 bp, human
gtatctagagttaacagtag

SEQ ID NO: 354810 - DNA, 20 bp, human
gaatatctccttcacttgct

SEQ ID NO: 354811 - DNA, 20 bp, human
gttggcttaaatgctgttat

SEQ ID NO: 354812 - DNA, 20 bp, human
ggagcatactgtgaatttat

SEQ ID NO: 354813 - DNA, 20 bp, human
gaccacttttgcctcacatc

SEQ ID NO: 354814 - DNA, 20 bp, human
gtcttatctaattggctgct

SEQ ID NO: 354815 - DNA, 20 bp, human
ggttttgctgttttaaagta

SEQ ID NO: 354816 - DNA, 20 bp, human
gggcaagaggccgccactga

SEQ ID NO: 354817 - DNA, 20 bp, human
ggagctggatgacacttcgt

SEQ ID NO: 354818 - DNA, 20 bp, human
gagctgctagaaacccgcgg

SEQ ID NO: 354819 - DNA, 20 bp, human
gaggagacggggtggcgcca

SEQ ID NO: 354820 - DNA, 20 bp, human
gggggtggcgccaaggaagg

SEQ ID NO: 354821 - DNA, 20 bp, human
gcattaagatgcagcaccgt

SEQ ID NO: 354822 - DNA, 20 bp, human
gagaaaaggcggccgagaaa

SEQ ID NO: 354823 - DNA, 20 bp, human
gagtctgttttcagcaggat

SEQ ID NO: 354824 - DNA, 20 bp, human
ggaatcttggagacctccgc

SEQ ID NO: 354825 - DNA, 20 bp, human
gaaatcagactccctgcgag

SEQ ID NO: 354826 - DNA, 20 bp, human
gggagcgccggggatctggg

SEQ ID NO: 354827 - DNA, 20 bp, human
gaggccccggggcaaatgga

SEQ ID NO: 354828 - DNA, 20 bp, human
gaggccttgggcgaagacgg

SEQ ID NO: 354829 - DNA, 20 bp, human
gcgcgcctggagcccggtga

SEQ ID NO: 354830 - DNA, 20 bp, human
ggagaggtaactggggtccc

SEQ ID NO: 354831 - DNA, 20 bp, human
gcaagaggcgacccctccca

SEQ ID NO: 354832 - DNA, 20 bp, human
gagcgtgaggccgcgtcctg

SEQ ID NO: 354833 - DNA, 20 bp, human
gggggacggtgcttggcggg

SEQ ID NO: 354834 - DNA, 20 bp, human
ggcgtcctggggcggggtga

SEQ ID NO: 354835 - DNA, 20 bp, human
ggtcccgggcctagcgaggc

SEQ ID NO: 354836 - DNA, 20 bp, human
gccagcgggcgaggtcaaga

SEQ ID NO: 354837 - DNA, 20 bp, human
gcccatgtcgtcatcaccca

SEQ ID NO: 354838 - DNA, 20 bp, human
gctgcggttcgcttgactga

SEQ ID NO: 354839 - DNA, 20 bp, human
gtggggagcgtctctagcgc

SEQ ID NO: 354840 - DNA, 20 bp, human
gacgaagctagagtaagctg

SEQ ID NO: 354841 - DNA, 20 bp, human
gcggaaaccatggcaaccat

SEQ ID NO: 354842 - DNA, 20 bp, human
ggaaaagcgcatgcgccacg

SEQ ID NO: 354843 - DNA, 20 bp, human
gaagcgcatgcgccacgggg

SEQ ID NO: 354844 - DNA, 20 bp, human
ggcgggcgaggtcaagatgg

SEQ ID NO: 354845 - DNA, 20 bp, human
gctagcttcgtgccaccccg

SEQ ID NO: 354846 - DNA, 20 bp, human
ggcacagggctcgcagtaag

SEQ ID NO: 354847 - DNA, 20 bp, human
gcagggctcgcagtaagtgg

SEQ ID NO: 354848 - DNA, 20 bp, human
gggggtgacggtggtcgcgc

SEQ ID NO: 354849 - DNA, 20 bp, human
gcgagaggcaggggcgacca

SEQ ID NO: 354850 - DNA, 20 bp, human
gcgcgccggcagcgccgcct

SEQ ID NO: 354851 - DNA, 20 bp, human
gcagtaagtgggggtgacgg

SEQ ID NO: 354852 - DNA, 20 bp, human
gtcgcagtaagtgggggtga

SEQ ID NO: 354853 - DNA, 20 bp, human
gagcgccgccttgggcctgc

SEQ ID NO: 354854 - DNA, 20 bp, human
gcgagccctgtgctcacagg

SEQ ID NO: 354855 - DNA, 20 bp, human
gcgcgccagcgggatccgcc

SEQ ID NO: 354856 - DNA, 20 bp, human
ggcggagcgcgggtcggtag

SEQ ID NO: 354857 - DNA, 20 bp, human
gggaaagtggagcgccccgc

SEQ ID NO: 354858 - DNA, 20 bp, human
gtcgtctcagatgaccatct

SEQ ID NO: 354859 - DNA, 20 bp, human
ggtcggtaggggcgctgcag

SEQ ID NO: 354860 - DNA, 20 bp, human
gcccgcgcgttgccgggaga

SEQ ID NO: 354861 - DNA, 20 bp, human
ggtaggggcgctgcagagga

SEQ ID NO: 354862 - DNA, 20 bp, human
gaaggccgcactgagagccc

SEQ ID NO: 354863 - DNA, 20 bp, human
gcctgctccgggagcgtgac

SEQ ID NO: 354864 - DNA, 20 bp, human
gggtctgggaagtggtacct

SEQ ID NO: 354865 - DNA, 20 bp, human
ggtctcgcctgtcacgctcc

SEQ ID NO: 354866 - DNA, 20 bp, human
gcaggctccggcacgaggag

SEQ ID NO: 354867 - DNA, 20 bp, human
gccctcggtgtaggaatcag

SEQ ID NO: 354868 - DNA, 20 bp, human
gcgcgagcgcgcacagaggc

SEQ ID NO: 354869 - DNA, 20 bp, human
gcagaggccgggcacgcggg

SEQ ID NO: 354870 - DNA, 20 bp, human
ggcctgtcctggggcctgcg

SEQ ID NO: 354871 - DNA, 20 bp, human
gcagctgcacagctcaacgc

SEQ ID NO: 354872 - DNA, 20 bp, human
gagcagcaagctaggaaaga

SEQ ID NO: 354873 - DNA, 20 bp, human
gccaccttttgggacctccc

SEQ ID NO: 354874 - DNA, 20 bp, human
gtccccgaccctcgctgggg

SEQ ID NO: 354875 - DNA, 20 bp, human
gcaggacaggctccggcacg

SEQ ID NO: 354876 - DNA, 20 bp, human
gcactgcagggcaactctaa

SEQ ID NO: 354877 - DNA, 20 bp, human
gtgaaaacctccacttatag

SEQ ID NO: 354878 - DNA, 20 bp, human
gatactaatagtctgtacac

SEQ ID NO: 354879 - DNA, 20 bp, human
gtctgtacactgggaaacac

SEQ ID NO: 354880 - DNA, 20 bp, human
gagaggtgctttattgaagc

SEQ ID NO: 354881 - DNA, 20 bp, human
gagctatggaacaaacttgt

SEQ ID NO: 354882 - DNA, 20 bp, human
ggtgcaaaataactcactgc

SEQ ID NO: 354883 - DNA, 20 bp, human
gacgatgcatgcaaacagag

SEQ ID NO: 354884 - DNA, 20 bp, human
gatagtagaggcattaccac

SEQ ID NO: 354885 - DNA, 20 bp, human
ggagaagcttgttatagtag

SEQ ID NO: 354886 - DNA, 20 bp, human
ggcatcgcagctgccagtca

SEQ ID NO: 354887 - DNA, 20 bp, human
ggggcacagctcgccagcag

SEQ ID NO: 354888 - DNA, 20 bp, human
gatgcccgggactgttgcag

SEQ ID NO: 354889 - DNA, 20 bp, human
ggcgcgcccgggttcggata

SEQ ID NO: 354890 - DNA, 20 bp, human
gtacgacccacatgggaagt

SEQ ID NO: 354891 - DNA, 20 bp, human
ggctcccgctgcaacagtcc

SEQ ID NO: 354892 - DNA, 20 bp, human
gactgttgcagcgggagcgt

SEQ ID NO: 354893 - DNA, 20 bp, human
ggggcagaagaagtgcgcta

SEQ ID NO: 354894 - DNA, 20 bp, human
ggccagtcaaggctaggagg

SEQ ID NO: 354895 - DNA, 20 bp, human
ggctgccagtcaaggctagg

SEQ ID NO: 354896 - DNA, 20 bp, human
gcacccgagccgggctgtat

SEQ ID NO: 354897 - DNA, 20 bp, human
gtctcccgcccacgcaccgg

SEQ ID NO: 354898 - DNA, 20 bp, human
gtctccatagccacccgagc

SEQ ID NO: 354899 - DNA, 20 bp, human
gcccgcccacgcaccggagg

SEQ ID NO: 354900 - DNA, 20 bp, human
gaccgcctccggtgcgtggg

SEQ ID NO: 354901 - DNA, 20 bp, human
ggggctgtatgggcttggct

SEQ ID NO: 354902 - DNA, 20 bp, human
gcggtgcggaaagcactccg

SEQ ID NO: 354903 - DNA, 20 bp, human
gcttgcggcccgtggtgttt

SEQ ID NO: 354904 - DNA, 20 bp, human
ggagccgggctgtatgggct

SEQ ID NO: 354905 - DNA, 20 bp, human
gcgcgattgtgagtgagcgc

SEQ ID NO: 354906 - DNA, 20 bp, human
gcacccttggcgagatagga

SEQ ID NO: 354907 - DNA, 20 bp, human
gtcccctcctatctcgccaa

SEQ ID NO: 354908 - DNA, 20 bp, human
gtcagcacccttggcgagat

SEQ ID NO: 354909 - DNA, 20 bp, human
ggtaaccccaacccagctcg

SEQ ID NO: 354910 - DNA, 20 bp, human
gtgagatctgcaggcgttgt

SEQ ID NO: 354911 - DNA, 20 bp, human
gcttgccgcgagctgggttg

SEQ ID NO: 354912 - DNA, 20 bp, human
gtgcctgcttgccgcgagct

SEQ ID NO: 354913 - DNA, 20 bp, human
gggctcgcgaagaaaaacgc

SEQ ID NO: 354914 - DNA, 20 bp, human
gtggggaaagcagtattgga

SEQ ID NO: 354915 - DNA, 20 bp, human
ggatctgcaggcgttgtggg

SEQ ID NO: 354916 - DNA, 20 bp, human
gcccacaggcaagagagtac

SEQ ID NO: 354917 - DNA, 20 bp, human
gagacaggggcagaacgatg

SEQ ID NO: 354918 - DNA, 20 bp, human
gagacagcggcgcgagacag

SEQ ID NO: 354919 - DNA, 20 bp, human
gccggcgcgtcgcggaggag

SEQ ID NO: 354920 - DNA, 20 bp, human
gaccacccggcgcgtcgcgg

SEQ ID NO: 354921 - DNA, 20 bp, human
gctatcctgaggaagctctg

SEQ ID NO: 354922 - DNA, 20 bp, human
gcgcaccggcgagctaactc

SEQ ID NO: 354923 - DNA, 20 bp, human
ggtctcgcgccgctgtctgc

SEQ ID NO: 354924 - DNA, 20 bp, human
gtgacggccgcgcgcgttcc

SEQ ID NO: 354925 - DNA, 20 bp, human
gtagctcgccggtgcgggtg

SEQ ID NO: 354926 - DNA, 20 bp, human
gggggaaattatgacatcag

SEQ ID NO: 354927 - DNA, 20 bp, human
gtgggataggcatttaatgt

SEQ ID NO: 354928 - DNA, 20 bp, human
gaggcatttaatgtgggaag

SEQ ID NO: 354929 - DNA, 20 bp, human
gttcagtctctccagaacta

SEQ ID NO: 354930 - DNA, 20 bp, human
gatggcattctgtgggaagt

SEQ ID NO: 354931 - DNA, 20 bp, human
ggaaaactggcaactggccc

SEQ ID NO: 354932 - DNA, 20 bp, human
gttcccacagaatgccatac

SEQ ID NO: 354933 - DNA, 20 bp, human
gctaatataaactcttggat

SEQ ID NO: 354934 - DNA, 20 bp, human
gagaaaaaacattatatggc

SEQ ID NO: 354935 - DNA, 20 bp, human
gaaaattatgacatccaaat

SEQ ID NO: 354936 - DNA, 20 bp, human
gtccgccgtggcgcaagctg

SEQ ID NO: 354937 - DNA, 20 bp, human
gatcgcggtccgaggctccg

SEQ ID NO: 354938 - DNA, 20 bp, human
ggtggcgcaagctgtggtac

SEQ ID NO: 354939 - DNA, 20 bp, human
gcacctggcggagtggacga

SEQ ID NO: 354940 - DNA, 20 bp, human
gtcggaccgcgatccgtccc

SEQ ID NO: 354941 - DNA, 20 bp, human
gggcgcctgagatcccggga

SEQ ID NO: 354942 - DNA, 20 bp, human
gacaacgcggccggtcggac

SEQ ID NO: 354943 - DNA, 20 bp, human
gcacaggcgcctgagatccc

SEQ ID NO: 354944 - DNA, 20 bp, human
gagtggacgaagggcgtgat

SEQ ID NO: 354945 - DNA, 20 bp, human
ggctgcgcacgcgcacctgg

SEQ ID NO: 354946 - DNA, 20 bp, human
gggcgacttaatctaggtgg

SEQ ID NO: 354947 - DNA, 20 bp, human
gaatctaggtggaggtaaag

SEQ ID NO: 354948 - DNA, 20 bp, human
ggggcagcagcgacccctgt

SEQ ID NO: 354949 - DNA, 20 bp, human
gtcaatcggcgacttaatct

SEQ ID NO: 354950 - DNA, 20 bp, human
ggccctgcgccggttccctc

SEQ ID NO: 354951 - DNA, 20 bp, human
gccccagcgctcagtggcgg

SEQ ID NO: 354952 - DNA, 20 bp, human
gtcccgtactcaaaggtcga

SEQ ID NO: 354953 - DNA, 20 bp, human
gaacatggcaagagaatccc

SEQ ID NO: 354954 - DNA, 20 bp, human
gtcccttggtctctctttat

SEQ ID NO: 354955 - DNA, 20 bp, human
gaagagagaccaagggaaca

SEQ ID NO: 354956 - DNA, 20 bp, human
gcccttctctgaaggatcac

SEQ ID NO: 354957 - DNA, 20 bp, human
ggcaagggctgggctgtacg

SEQ ID NO: 354958 - DNA, 20 bp, human
gctgggctgtacggggtctc

SEQ ID NO: 354959 - DNA, 20 bp, human
gggtctctgggtcctgaacc

SEQ ID NO: 354960 - DNA, 20 bp, human
gtgaaggatcacaggtagcc

SEQ ID NO: 354961 - DNA, 20 bp, human
ggatcacaggtagccaggcg

SEQ ID NO: 354962 - DNA, 20 bp, human
ggccatacggctagctgcag

SEQ ID NO: 354963 - DNA, 20 bp, human
ggccactgcagctagccgta

SEQ ID NO: 354964 - DNA, 20 bp, human
gcccttgcccccttctctga

SEQ ID NO: 354965 - DNA, 20 bp, human
gcctgaaccagggttgtgac

SEQ ID NO: 354966 - DNA, 20 bp, human
gccaccagaggggaactcgt

SEQ ID NO: 354967 - DNA, 20 bp, human
gagaggggaactcgtgggcg

SEQ ID NO: 354968 - DNA, 20 bp, human
gtcgtgggcgggggagactg

SEQ ID NO: 354969 - DNA, 20 bp, human
gtgggcgggggagactgcgg

SEQ ID NO: 354970 - DNA, 20 bp, human
gccaggtaacccggtcatat

SEQ ID NO: 354971 - DNA, 20 bp, human
gggtggggaataacatcttg

SEQ ID NO: 354972 - DNA, 20 bp, human
ggaaagaaagaaatcggagc

SEQ ID NO: 354973 - DNA, 20 bp, human
ggggggagactgcggaggag

SEQ ID NO: 354974 - DNA, 20 bp, human
gtaggcgctctgccaccaga

SEQ ID NO: 354975 - DNA, 20 bp, human
gtggggtcggggcatggctt

SEQ ID NO: 354976 - DNA, 20 bp, human
gcgccctccgcgttcgcggt

SEQ ID NO: 354977 - DNA, 20 bp, human
ggacgctgacagcgcggcgg

SEQ ID NO: 354978 - DNA, 20 bp, human
ggtccgaccgcgaacgcgga

SEQ ID NO: 354979 - DNA, 20 bp, human
gagggcggtgccgcggggag

SEQ ID NO: 354980 - DNA, 20 bp, human
gggagcgcgcgagagagggt

SEQ ID NO: 354981 - DNA, 20 bp, human
gcccggcccggcccttcggg

SEQ ID NO: 354982 - DNA, 20 bp, human
gtgagactccggcaccaaag

SEQ ID NO: 354983 - DNA, 20 bp, human
gcggcaccaaagggggtggg

SEQ ID NO: 354984 - DNA, 20 bp, human
gcggccgccctccgcgttcg

SEQ ID NO: 354985 - DNA, 20 bp, human
gctcctccggccgagagcca

SEQ ID NO: 354986 - DNA, 20 bp, human
gcggagcagccaatgagcgc

SEQ ID NO: 354987 - DNA, 20 bp, human
gaatccgagccgggataaac

SEQ ID NO: 354988 - DNA, 20 bp, human
gcctccgcgcctgtttatcc

SEQ ID NO: 354989 - DNA, 20 bp, human
gtgggcggggactcgcgacg

SEQ ID NO: 354990 - DNA, 20 bp, human
ggcggcccagggcctcgcgg

SEQ ID NO: 354991 - DNA, 20 bp, human
ggtgcagcgctcgtctcctg

SEQ ID NO: 354992 - DNA, 20 bp, human
ggcggaggggcgacgcgtcc

SEQ ID NO: 354993 - DNA, 20 bp, human
gtcaggccgcgtgatgtcag

SEQ ID NO: 354994 - DNA, 20 bp, human
gaggggcgacgcgtcccggc

SEQ ID NO: 354995 - DNA, 20 bp, human
gacgagcgctgcacccggcc

SEQ ID NO: 354996 - DNA, 20 bp, human
ggggctccacgcttcccgtg

SEQ ID NO: 354997 - DNA, 20 bp, human
ggccgcccgcgggccggaga

SEQ ID NO: 354998 - DNA, 20 bp, human
gggccggcggccaatcgctg

SEQ ID NO: 354999 - DNA, 20 bp, human
gaatcgctgcggcccgctgc

SEQ ID NO: 355000 - DNA, 20 bp, human
gggcccgctgcggggcgcga

SEQ ID NO: 355001 - DNA, 20 bp, human
gtccggcccgcgggcggcca

SEQ ID NO: 355002 - DNA, 20 bp, human
ggccctctccggcccgcggg

SEQ ID NO: 355003 - DNA, 20 bp, human
gagcgcccctgcacagacat

SEQ ID NO: 355004 - DNA, 20 bp, human
gtccccgagtgacccgtgcg

SEQ ID NO: 355005 - DNA, 20 bp, human
gtgcccgtctctctgcacta

SEQ ID NO: 355006 - DNA, 20 bp, human
gcgccccgatgacgtcggag

SEQ ID NO: 355007 - DNA, 20 bp, human
gtcgccgccacagtctgcga

SEQ ID NO: 355008 - DNA, 20 bp, human
gggcgccactccgacgtcat

SEQ ID NO: 355009 - DNA, 20 bp, human
ggtcccgtcgcagactgtgg

SEQ ID NO: 355010 - DNA, 20 bp, human
gcgggtcccgtcgcagactg

SEQ ID NO: 355011 - DNA, 20 bp, human
gtgtggcggcgacagcgcga

SEQ ID NO: 355012 - DNA, 20 bp, human
ggggcgcgccccgatgacgt

SEQ ID NO: 355013 - DNA, 20 bp, human
ggcgtgcccatgtgtcaggt

SEQ ID NO: 355014 - DNA, 20 bp, human
gcctcgcccacctgacacat

SEQ ID NO: 355015 - DNA, 20 bp, human
ggagtgcggcgggaaggcga

SEQ ID NO: 355016 - DNA, 20 bp, human
gtgggacggcccgtgcctca

SEQ ID NO: 355017 - DNA, 20 bp, human
gatcacgaacctgcctggaa

SEQ ID NO: 355018 - DNA, 20 bp, human
ggacagccttacaaagggag

SEQ ID NO: 355019 - DNA, 20 bp, human
gggaagtggctgagggcgat

SEQ ID NO: 355020 - DNA, 20 bp, human
ggcgtcgacagccttacaaa

SEQ ID NO: 355021 - DNA, 20 bp, human
ggatcgcccctccctttgta

SEQ ID NO: 355022 - DNA, 20 bp, human
gagctgtcctgcacgagtgg

SEQ ID NO: 355023 - DNA, 20 bp, human
ggggaggggcgatcgcgcac

SEQ ID NO: 355024 - DNA, 20 bp, human
gggagacacattggcagtcc

SEQ ID NO: 355025 - DNA, 20 bp, human
gcactgctcagactgtcccc

SEQ ID NO: 355026 - DNA, 20 bp, human
gagaaggggcgtaactgatt

SEQ ID NO: 355027 - DNA, 20 bp, human
gcgcgcgcgcaacagagcga

SEQ ID NO: 355028 - DNA, 20 bp, human
gaaggcggccgggagtaagg

SEQ ID NO: 355029 - DNA, 20 bp, human
ggggagtaaggcggagctga

SEQ ID NO: 355030 - DNA, 20 bp, human
ggatggaagcgtgcgagaag

SEQ ID NO: 355031 - DNA, 20 bp, human
gtattcagctgcgaggggac

SEQ ID NO: 355032 - DNA, 20 bp, human
gagtaaggcggagctgaagg

SEQ ID NO: 355033 - DNA, 20 bp, human
gcgcccgcgccggcttccag

SEQ ID NO: 355034 - DNA, 20 bp, human
ggcgagatttgaaggagcgg

SEQ ID NO: 355035 - DNA, 20 bp, human
gtggcggagctcaaggaggt

SEQ ID NO: 355036 - DNA, 20 bp, human
gcccaagggcgaacgttccc

SEQ ID NO: 355037 - DNA, 20 bp, human
ggccagggcgggaccgtctc

SEQ ID NO: 355038 - DNA, 20 bp, human
gaggcctcgcagaaatctca

SEQ ID NO: 355039 - DNA, 20 bp, human
gggaccgtctccggctggga

SEQ ID NO: 355040 - DNA, 20 bp, human
gccacccaggctgcactagg

SEQ ID NO: 355041 - DNA, 20 bp, human
gcggggctgcgacgccaggg

SEQ ID NO: 355042 - DNA, 20 bp, human
gaggcggggctgcgacgcca

SEQ ID NO: 355043 - DNA, 20 bp, human
ggggcgggaccgtctccggc

SEQ ID NO: 355044 - DNA, 20 bp, human
gagggcgaacgttcccgggg

SEQ ID NO: 355045 - DNA, 20 bp, human
gtcgcccttgggcagttttc

SEQ ID NO: 355046 - DNA, 20 bp, human
gctctggccaatcaggtctg

SEQ ID NO: 355047 - DNA, 20 bp, human
gtacatattcatgaggggcg

SEQ ID NO: 355048 - DNA, 20 bp, human
gcaaggacttttcgagagtg

SEQ ID NO: 355049 - DNA, 20 bp, human
ggagggcggggcagtacgcg

SEQ ID NO: 355050 - DNA, 20 bp, human
ggtatcccctctggccaatc

SEQ ID NO: 355051 - DNA, 20 bp, human
ggcggggcagtacgcgcggt

SEQ ID NO: 355052 - DNA, 20 bp, human
gaggaggtaggattgacaag

SEQ ID NO: 355053 - DNA, 20 bp, human
gggttctcctcagacctgat

SEQ ID NO: 355054 - DNA, 20 bp, human
ggaaagaggtgggaactgag

SEQ ID NO: 355055 - DNA, 20 bp, human
gattaatgaagtatcccctc

SEQ ID NO: 355056 - DNA, 20 bp, human
gcccaagctcgctcctgatg

SEQ ID NO: 355057 - DNA, 20 bp, human
gctcgctcctgatggggctg

SEQ ID NO: 355058 - DNA, 20 bp, human
ggccacaaggcgccccttct

SEQ ID NO: 355059 - DNA, 20 bp, human
gtctaggagtggtacctccc

SEQ ID NO: 355060 - DNA, 20 bp, human
gaaaaacgaacggtcctcaa

SEQ ID NO: 355061 - DNA, 20 bp, human
gcctgcagatagccaaacag

SEQ ID NO: 355062 - DNA, 20 bp, human
ggtggtacctcccaggataa

SEQ ID NO: 355063 - DNA, 20 bp, human
gtggccaatagcagctggag

SEQ ID NO: 355064 - DNA, 20 bp, human
gagcgtgccaagagtggttg

SEQ ID NO: 355065 - DNA, 20 bp, human
gcgcggcagcgaccaatcat

SEQ ID NO: 355066 - DNA, 20 bp, human
gggggcgcgagcgtgcgcag

SEQ ID NO: 355067 - DNA, 20 bp, human
gtcgacacgcagcgaactgg

SEQ ID NO: 355068 - DNA, 20 bp, human
gagcgtgcgcagtggctcct

SEQ ID NO: 355069 - DNA, 20 bp, human
gacacgcagcgaactggtgg

SEQ ID NO: 355070 - DNA, 20 bp, human
ggcgctggggaggagcggtg

SEQ ID NO: 355071 - DNA, 20 bp, human
gcccgtcgccgcagcctcca

SEQ ID NO: 355072 - DNA, 20 bp, human
ggcgcgcggtcccgagtgaa

SEQ ID NO: 355073 - DNA, 20 bp, human
gcgcagcgaactggtggcgg

SEQ ID NO: 355074 - DNA, 20 bp, human
gcgccagccgcgcgcgactt

SEQ ID NO: 355075 - DNA, 20 bp, human
gtcggcctcggctccagcca

SEQ ID NO: 355076 - DNA, 20 bp, human
gtggctgaatgggaggcctg

SEQ ID NO: 355077 - DNA, 20 bp, human
gagggctcaagacgctttat

SEQ ID NO: 355078 - DNA, 20 bp, human
ggaaccggggtgctggcgac

SEQ ID NO: 355079 - DNA, 20 bp, human
gccgcccggtaacaaaaccg

SEQ ID NO: 355080 - DNA, 20 bp, human
gggaaccccggttttgttac

SEQ ID NO: 355081 - DNA, 20 bp, human
ggagccctaccgggtgcgtg

SEQ ID NO: 355082 - DNA, 20 bp, human
gaaagcgtcttgagccctac

SEQ ID NO: 355083 - DNA, 20 bp, human
ggtcccggtcgccagcaccc

SEQ ID NO: 355084 - DNA, 20 bp, human
gcccgccacacgcacccggt

SEQ ID NO: 355085 - DNA, 20 bp, human
gggttcccgccacacgcacc

SEQ ID NO: 355086 - DNA, 20 bp, human
ggtgggaacccgcagacgtg

SEQ ID NO: 355087 - DNA, 20 bp, human
gaaaaggccgagtgaggaca

SEQ ID NO: 355088 - DNA, 20 bp, human
gcgccggggcgccacgtccg

SEQ ID NO: 355089 - DNA, 20 bp, human
gtgaggacaagggagaccac

SEQ ID NO: 355090 - DNA, 20 bp, human
gcctgctcgccccacgtctg

SEQ ID NO: 355091 - DNA, 20 bp, human
gtctggtaaggggatgacaa

SEQ ID NO: 355092 - DNA, 20 bp, human
gcacccgagccgcgcgtggg

SEQ ID NO: 355093 - DNA, 20 bp, human
gcgcaggcagacaagcgccg

SEQ ID NO: 355094 - DNA, 20 bp, human
gagggaacagacccagtagt

SEQ ID NO: 355095 - DNA, 20 bp, human
gacaagcgccgcgggccaga

SEQ ID NO: 355096 - DNA, 20 bp, human
ggaaagcggaagtactaatt

SEQ ID NO: 355097 - DNA, 20 bp, human
gcatcattggcgttagtctc

SEQ ID NO: 355098 - DNA, 20 bp, human
gaacgccaatgatggagatc

SEQ ID NO: 355099 - DNA, 20 bp, human
gtaattcggccccctctcat

SEQ ID NO: 355100 - DNA, 20 bp, human
gtcattggcttgaacaagtc

SEQ ID NO: 355101 - DNA, 20 bp, human
gtggccaatcagagtatccg

SEQ ID NO: 355102 - DNA, 20 bp, human
gcgttaaacagcacggaaag

SEQ ID NO: 355103 - DNA, 20 bp, human
gatccccgggaattcagtct

SEQ ID NO: 355104 - DNA, 20 bp, human
gccagccagatctccatcat

SEQ ID NO: 355105 - DNA, 20 bp, human
gaatcagagtatccgaggga

SEQ ID NO: 355106 - DNA, 20 bp, human
ggcaaccgccggggcccccc

SEQ ID NO: 355107 - DNA, 20 bp, human
gtggtggtggcggcccatcg

SEQ ID NO: 355108 - DNA, 20 bp, human
gagaaacaggcggtttgtga

SEQ ID NO: 355109 - DNA, 20 bp, human
gcatggtgacgcagggtcgg

SEQ ID NO: 355110 - DNA, 20 bp, human
ggtcaccatggcaaccgccg

SEQ ID NO: 355111 - DNA, 20 bp, human
gccgaatacccggactgctg

SEQ ID NO: 355112 - DNA, 20 bp, human
ggcgggcggctttgtctcta

SEQ ID NO: 355113 - DNA, 20 bp, human
gtgagagaggggcgtgtttg

SEQ ID NO: 355114 - DNA, 20 bp, human
ggcagtccgggtattcggag

SEQ ID NO: 355115 - DNA, 20 bp, human
gtctccccagcgagagggga

SEQ ID NO: 355116 - DNA, 20 bp, human
gcctcttgagcacacctgct

SEQ ID NO: 355117 - DNA, 20 bp, human
ggggatggcaggagatcaat

SEQ ID NO: 355118 - DNA, 20 bp, human
ggaggtccaaagtcaccaga

SEQ ID NO: 355119 - DNA, 20 bp, human
gtcaatcggacccagaacag

SEQ ID NO: 355120 - DNA, 20 bp, human
gcatagggaaggatccatct

SEQ ID NO: 355121 - DNA, 20 bp, human
gtgatctcctgccatcccct

SEQ ID NO: 355122 - DNA, 20 bp, human
gagaggacagtggaatccga

SEQ ID NO: 355123 - DNA, 20 bp, human
gtggaatccgaggggatggc

SEQ ID NO: 355124 - DNA, 20 bp, human
gacagtggaatccgagggga

SEQ ID NO: 355125 - DNA, 20 bp, human
ggaggcaggtcagcgcacag

SEQ ID NO: 355126 - DNA, 20 bp, human
gcggagccgcccctctcgga

SEQ ID NO: 355127 - DNA, 20 bp, human
gaacctcttccggttggggc

SEQ ID NO: 355128 - DNA, 20 bp, human
gagggacttccggccccaac

SEQ ID NO: 355129 - DNA, 20 bp, human
ggacgcggagccgcccctct

SEQ ID NO: 355130 - DNA, 20 bp, human
ggaagtccctccgagagggg

SEQ ID NO: 355131 - DNA, 20 bp, human
gaaaagctgccgaagctcca

SEQ ID NO: 355132 - DNA, 20 bp, human
gtgactggagtccgcgtagg

SEQ ID NO: 355133 - DNA, 20 bp, human
gcggaggaaccttggagctt

SEQ ID NO: 355134 - DNA, 20 bp, human
gttccggccccaaccggaag

SEQ ID NO: 355135 - DNA, 20 bp, human
gacctccgacccctcctacg

SEQ ID NO: 355136 - DNA, 20 bp, human
gcacctatgtccgactcata

SEQ ID NO: 355137 - DNA, 20 bp, human
ggcttgagccacagttctgt

SEQ ID NO: 355138 - DNA, 20 bp, human
gagccctatgagtcggacat

SEQ ID NO: 355139 - DNA, 20 bp, human
ggagtcggacataggtggat

SEQ ID NO: 355140 - DNA, 20 bp, human
ggaactgtggctcaagcttt

SEQ ID NO: 355141 - DNA, 20 bp, human
gctggccagagtgaaaagga

SEQ ID NO: 355142 - DNA, 20 bp, human
gggcaagggtctagtgaatc

SEQ ID NO: 355143 - DNA, 20 bp, human
gagctgcccagcttgtttct

SEQ ID NO: 355144 - DNA, 20 bp, human
gaatcagtaacttgcgggtc

SEQ ID NO: 355145 - DNA, 20 bp, human
ggagtctcgttctctcaggt

SEQ ID NO: 355146 - DNA, 20 bp, human
gccaccgcggccaggaccta

SEQ ID NO: 355147 - DNA, 20 bp, human
gcgcaccgccgctaggatcc

SEQ ID NO: 355148 - DNA, 20 bp, human
ggccgataagatcctggcag

SEQ ID NO: 355149 - DNA, 20 bp, human
ggtgctgcagccggaggtcc

SEQ ID NO: 355150 - DNA, 20 bp, human
ggccgctgccaggaccttgc

SEQ ID NO: 355151 - DNA, 20 bp, human
gaccgccgctaggatccagg

SEQ ID NO: 355152 - DNA, 20 bp, human
gaccgctgccaggatcttat

SEQ ID NO: 355153 - DNA, 20 bp, human
gcaggcggagaagcccaccg

SEQ ID NO: 355154 - DNA, 20 bp, human
ggcagctgccaggacttgcg

SEQ ID NO: 355155 - DNA, 20 bp, human
gtccgcctggatcctagcgg

SEQ ID NO: 355156 - DNA, 20 bp, human
ggggacacgtgatggaccgt

SEQ ID NO: 355157 - DNA, 20 bp, human
ggcccgcagcttcttgtagt

SEQ ID NO: 355158 - DNA, 20 bp, human
gaagctgcgggccttctttg

SEQ ID NO: 355159 - DNA, 20 bp, human
gacgtgtccctgcaaacggg

SEQ ID NO: 355160 - DNA, 20 bp, human
ggtgatggaccgtaggaaga

SEQ ID NO: 355161 - DNA, 20 bp, human
gcgtttgcagggacacgtga

SEQ ID NO: 355162 - DNA, 20 bp, human
gtgagcagcatgttttggag

SEQ ID NO: 355163 - DNA, 20 bp, human
ggtccctgcaaacgggtggc

SEQ ID NO: 355164 - DNA, 20 bp, human
gttcctgccacccgtttgca

SEQ ID NO: 355165 - DNA, 20 bp, human
ggtgcctgagcagcatgttt

SEQ ID NO: 355166 - DNA, 20 bp, human
gtcaaccggggcggagacga

SEQ ID NO: 355167 - DNA, 20 bp, human
gccaccgggcccgctgcggg

SEQ ID NO: 355168 - DNA, 20 bp, human
gccgaggcgcctctcaaccg

SEQ ID NO: 355169 - DNA, 20 bp, human
gatgacgcacagcacgcggg

SEQ ID NO: 355170 - DNA, 20 bp, human
gcgtcgagccacaactgcgg

SEQ ID NO: 355171 - DNA, 20 bp, human
gcggaggggaggagtcccga

SEQ ID NO: 355172 - DNA, 20 bp, human
gaggcgcctctcaaccgggg

SEQ ID NO: 355173 - DNA, 20 bp, human
gcggggcggagacgacggag

SEQ ID NO: 355174 - DNA, 20 bp, human
gcaccccgacctgtccttgg

SEQ ID NO: 355175 - DNA, 20 bp, human
ggaggtggtagttgcggcgc

SEQ ID NO: 355176 - DNA, 20 bp, human
gccagcgcactcctagaccg

SEQ ID NO: 355177 - DNA, 20 bp, human
gggtggggccgagcgagctg

SEQ ID NO: 355178 - DNA, 20 bp, human
gtgccggtcaggtggttcca

SEQ ID NO: 355179 - DNA, 20 bp, human
ggaaccacctgaccggcagg

SEQ ID NO: 355180 - DNA, 20 bp, human
gggccctggaaccacctgac

SEQ ID NO: 355181 - DNA, 20 bp, human
gaacccttgcgccccggtct

SEQ ID NO: 355182 - DNA, 20 bp, human
gtctaggagtgcgctgggca

SEQ ID NO: 355183 - DNA, 20 bp, human
gagctccgccccagctcgct

SEQ ID NO: 355184 - DNA, 20 bp, human
gctcctagaccggggcgcaa

SEQ ID NO: 355185 - DNA, 20 bp, human
ggagagtctccgcaacatgg

SEQ ID NO: 355186 - DNA, 20 bp, human
gagggtgcgccgccgcgtgt

SEQ ID NO: 355187 - DNA, 20 bp, human
ggggctacgtcggaccgcgg

SEQ ID NO: 355188 - DNA, 20 bp, human
gtctccaggccaacacgcgg

SEQ ID NO: 355189 - DNA, 20 bp, human
gcagaaggttgagcacgagg

SEQ ID NO: 355190 - DNA, 20 bp, human
gtcatccgggcgttgcccgg

SEQ ID NO: 355191 - DNA, 20 bp, human
gcgcgggacgaggacgtgca

SEQ ID NO: 355192 - DNA, 20 bp, human
ggcggtggcgcgggttctcc

SEQ ID NO: 355193 - DNA, 20 bp, human
gccggccaggaaggtgtaaa

SEQ ID NO: 355194 - DNA, 20 bp, human
ggcggtccgacgtagccccc

SEQ ID NO: 355195 - DNA, 20 bp, human
gcgcaccctccctcgcgccg

SEQ ID NO: 355196 - DNA, 20 bp, human
gcggaagtgacgtacggaga

SEQ ID NO: 355197 - DNA, 20 bp, human
gcgcttgcccagcgttgcta

SEQ ID NO: 355198 - DNA, 20 bp, human
gcggggtctcatagtcctat

SEQ ID NO: 355199 - DNA, 20 bp, human
gagaggtcgtagccaggaga

SEQ ID NO: 355200 - DNA, 20 bp, human
ggaggcccgagtactcttag

SEQ ID NO: 355201 - DNA, 20 bp, human
gacaaggcagaacttccggg

SEQ ID NO: 355202 - DNA, 20 bp, human
gcggccgtctgaacgagtga

SEQ ID NO: 355203 - DNA, 20 bp, human
gcccagcgttgctagggagg

SEQ ID NO: 355204 - DNA, 20 bp, human
gacgacctctaagagtactc

SEQ ID NO: 355205 - DNA, 20 bp, human
gacggtcccgtcaatctccg

SEQ ID NO: 355206 - DNA, 20 bp, human
gtccccgccgggtgtcctct

SEQ ID NO: 355207 - DNA, 20 bp, human
gacccggcggggaattccga

SEQ ID NO: 355208 - DNA, 20 bp, human
gtcacccagaggacacccgg

SEQ ID NO: 355209 - DNA, 20 bp, human
gccaggacgccaaggctcca

SEQ ID NO: 355210 - DNA, 20 bp, human
gactccacctccagcccgcg

SEQ ID NO: 355211 - DNA, 20 bp, human
gtcgcctgcgggtcacccag

SEQ ID NO: 355212 - DNA, 20 bp, human
gccggcatccaccttcccca

SEQ ID NO: 355213 - DNA, 20 bp, human
gccggaagaggcgtcgcctg

SEQ ID NO: 355214 - DNA, 20 bp, human
gaaccagtgcgcaaagcaga

SEQ ID NO: 355215 - DNA, 20 bp, human
gcggcggggaattccgaggg

SEQ ID NO: 355216 - DNA, 20 bp, human
gttagctgcgcacccggcca

SEQ ID NO: 355217 - DNA, 20 bp, human
gcgcgtgtttgtcccagccg

SEQ ID NO: 355218 - DNA, 20 bp, human
gcacgcgcagtgacacgcgg

SEQ ID NO: 355219 - DNA, 20 bp, human
gtaagtaggtccgtggaggg

SEQ ID NO: 355220 - DNA, 20 bp, human
ggagcgccagagcccgaccg

SEQ ID NO: 355221 - DNA, 20 bp, human
gtgggtaagtaggtccgtgg

SEQ ID NO: 355222 - DNA, 20 bp, human
gcagtgacacgcggcggctg

SEQ ID NO: 355223 - DNA, 20 bp, human
ggcactgcggctcagaggct

SEQ ID NO: 355224 - DNA, 20 bp, human
gtcccgcgctggccgcggtc

SEQ ID NO: 355225 - DNA, 20 bp, human
gtgcgcacccggccacggct

SEQ ID NO: 355226 - DNA, 20 bp, human
gaggccgcgggccgggacat

SEQ ID NO: 355227 - DNA, 20 bp, human
gccccccccagtggccacag

SEQ ID NO: 355228 - DNA, 20 bp, human
ggggacagccggcgagagtt

SEQ ID NO: 355229 - DNA, 20 bp, human
gcctcctgcagccagcgctt

SEQ ID NO: 355230 - DNA, 20 bp, human
gttccctgggcgccctgtcc

SEQ ID NO: 355231 - DNA, 20 bp, human
gcgggccgggacatcggggc

SEQ ID NO: 355232 - DNA, 20 bp, human
gcgggacatcggggcaggca

SEQ ID NO: 355233 - DNA, 20 bp, human
ggacggcccgtggactccta

SEQ ID NO: 355234 - DNA, 20 bp, human
gctccaggacagggcgccca

SEQ ID NO: 355235 - DNA, 20 bp, human
gtcggctagctgccttccct

SEQ ID NO: 355236 - DNA, 20 bp, human
ggggaatggcggctgcgctg

SEQ ID NO: 355237 - DNA, 20 bp, human
gtactccagcccaaacgacc

SEQ ID NO: 355238 - DNA, 20 bp, human
ggccctcccgccaacctcgc

SEQ ID NO: 355239 - DNA, 20 bp, human
gtgcgcctgcgcaaagtcga

SEQ ID NO: 355240 - DNA, 20 bp, human
gcctgaggaccgccaagaca

SEQ ID NO: 355241 - DNA, 20 bp, human
gtcgcggcgcgacagcagtg

SEQ ID NO: 355242 - DNA, 20 bp, human
gaacccgcgaggttggcggg

SEQ ID NO: 355243 - DNA, 20 bp, human
gggaccgccaagacaggggc

SEQ ID NO: 355244 - DNA, 20 bp, human
ggcgaggcaggggaggagta

SEQ ID NO: 355245 - DNA, 20 bp, human
gcgcgtgtgactcgtctccc

SEQ ID NO: 355246 - DNA, 20 bp, human
gcaggcccgagcagccgagt

SEQ ID NO: 355247 - DNA, 20 bp, human
gggcgcctcccagtgactcc

SEQ ID NO: 355248 - DNA, 20 bp, human
gggggcccggagtcactggg

SEQ ID NO: 355249 - DNA, 20 bp, human
gtgcgcgccgggtacagacg

SEQ ID NO: 355250 - DNA, 20 bp, human
gcccgagcagccgagtgggg

SEQ ID NO: 355251 - DNA, 20 bp, human
gggccccgcgcaggcgtgtg

SEQ ID NO: 355252 - DNA, 20 bp, human
gcgtgtgcggaattccccgc

SEQ ID NO: 355253 - DNA, 20 bp, human
gcactgggaggcgccaccgg

SEQ ID NO: 355254 - DNA, 20 bp, human
ggcgcctgtcccgccccact

SEQ ID NO: 355255 - DNA, 20 bp, human
gccgggtacagacgcgggag

SEQ ID NO: 355256 - DNA, 20 bp, human
gaagcagtgagcccgtgtga

SEQ ID NO: 355257 - DNA, 20 bp, human
gaaagcaaagtcaggtgaca

SEQ ID NO: 355258 - DNA, 20 bp, human
ggaacggaagagaaagttgg

SEQ ID NO: 355259 - DNA, 20 bp, human
gcgggctgagaccctcacac

SEQ ID NO: 355260 - DNA, 20 bp, human
gtcaggtgacaggggctggc

SEQ ID NO: 355261 - DNA, 20 bp, human
ggccaagcttgatgtagttg

SEQ ID NO: 355262 - DNA, 20 bp, human
ggcttgatgtagttgaggaa

SEQ ID NO: 355263 - DNA, 20 bp, human
gtaacagatgttaggtactt

SEQ ID NO: 355264 - DNA, 20 bp, human
gactcggcacggtcacggcc

SEQ ID NO: 355265 - DNA, 20 bp, human
gaagtccgcttcctcagagc

SEQ ID NO: 355266 - DNA, 20 bp, human
gccggggcacggggatgctg

SEQ ID NO: 355267 - DNA, 20 bp, human
ggccagctgtcgccgccaga

SEQ ID NO: 355268 - DNA, 20 bp, human
ggatacaagtggactctccc

SEQ ID NO: 355269 - DNA, 20 bp, human
gcgcccccgacggcgccctc

SEQ ID NO: 355270 - DNA, 20 bp, human
gagagtccacttgtatctca

SEQ ID NO: 355271 - DNA, 20 bp, human
ggagccgactgcgagaagga

SEQ ID NO: 355272 - DNA, 20 bp, human
ggctccggccgcgagaggag

SEQ ID NO: 355273 - DNA, 20 bp, human
gggtgggcaggatcccctct

SEQ ID NO: 355274 - DNA, 20 bp, human
gcgctcgtgccgccggaagt

SEQ ID NO: 355275 - DNA, 20 bp, human
ggcaaccggcgcccggggtc

SEQ ID NO: 355276 - DNA, 20 bp, human
gagaggaggtgcttcggcag

SEQ ID NO: 355277 - DNA, 20 bp, human
gggcgcccgcggcccagtct

SEQ ID NO: 355278 - DNA, 20 bp, human
gaaggcggaaagtcagagag

SEQ ID NO: 355279 - DNA, 20 bp, human
gctggagaggggcaaaaccg

SEQ ID NO: 355280 - DNA, 20 bp, human
ggcaccaggaggaacggagt

SEQ ID NO: 355281 - DNA, 20 bp, human
gcggagagctcaggtgcccg

SEQ ID NO: 355282 - DNA, 20 bp, human
gcggctctcgcgcccagact

SEQ ID NO: 355283 - DNA, 20 bp, human
ggggcagacaggaaaatagt

SEQ ID NO: 355284 - DNA, 20 bp, human
gtggacccacggggtggcca

SEQ ID NO: 355285 - DNA, 20 bp, human
gggagcaagggatgtctaag

SEQ ID NO: 355286 - DNA, 20 bp, human
gactcccccacgaggcagga

SEQ ID NO: 355287 - DNA, 20 bp, human
gggatgcaggcgcgactagg

SEQ ID NO: 355288 - DNA, 20 bp, human
gggagatggtggctccttgt

SEQ ID NO: 355289 - DNA, 20 bp, human
gcacgaggcaggagggtgaa

SEQ ID NO: 355290 - DNA, 20 bp, human
gccttgtggggtcggatatg

SEQ ID NO: 355291 - DNA, 20 bp, human
gactccttccggccctgccg

SEQ ID NO: 355292 - DNA, 20 bp, human
gtaaagtgggtcccatggct

SEQ ID NO: 355293 - DNA, 20 bp, human
gaagagtaaagtgggtccca

SEQ ID NO: 355294 - DNA, 20 bp, human
gtgatttgccctaattcgtt

SEQ ID NO: 355295 - DNA, 20 bp, human
gtggtggctccttgtggggt

SEQ ID NO: 355296 - DNA, 20 bp, human
gtgctctgagggttttgttg

SEQ ID NO: 355297 - DNA, 20 bp, human
gtgaggctgagtgtgaactc

SEQ ID NO: 355298 - DNA, 20 bp, human
gagggctgtaggtgaagcgc

SEQ ID NO: 355299 - DNA, 20 bp, human
ggaggtgtgcgccaaagggg

SEQ ID NO: 355300 - DNA, 20 bp, human
gacacacgcacaccctgagt

SEQ ID NO: 355301 - DNA, 20 bp, human
gtggggaggtgtgcgccaaa

SEQ ID NO: 355302 - DNA, 20 bp, human
gtaggtgaagcgcggggaga

SEQ ID NO: 355303 - DNA, 20 bp, human
gcgctccggcctctccccca

SEQ ID NO: 355304 - DNA, 20 bp, human
ggcggtggtcaaagggtcga

SEQ ID NO: 355305 - DNA, 20 bp, human
gactgaatgcggagaccaaa

SEQ ID NO: 355306 - DNA, 20 bp, human
gcggctacggcgccccggta

SEQ ID NO: 355307 - DNA, 20 bp, human
gggcacgcgcgggccggcta

SEQ ID NO: 355308 - DNA, 20 bp, human
gcagtcttggcgaagagtag

SEQ ID NO: 355309 - DNA, 20 bp, human
gaagagtagcggtaggtcgg

SEQ ID NO: 355310 - DNA, 20 bp, human
ggcccgcgcgtgcccagtct

SEQ ID NO: 355311 - DNA, 20 bp, human
gtcgaaacgcgcgatctcca

SEQ ID NO: 355312 - DNA, 20 bp, human
ggtagggccataacccgccc

SEQ ID NO: 355313 - DNA, 20 bp, human
gcgggccggctacggcgccc

SEQ ID NO: 355314 - DNA, 20 bp, human
gctaaaggaaagcggaatag

SEQ ID NO: 355315 - DNA, 20 bp, human
gtaccttcctacacattcgc

SEQ ID NO: 355316 - DNA, 20 bp, human
gaagaatcccgggtgctatg

SEQ ID NO: 355317 - DNA, 20 bp, human
gaaactctgccaagaatccc

SEQ ID NO: 355318 - DNA, 20 bp, human
gtacagaggccccgcctgga

SEQ ID NO: 355319 - DNA, 20 bp, human
ggctatgtggcttagtttaa

SEQ ID NO: 355320 - DNA, 20 bp, human
gggaaacgtgacaggtctca

SEQ ID NO: 355321 - DNA, 20 bp, human
gcggggatggtggagtacag

SEQ ID NO: 355322 - DNA, 20 bp, human
gacggccaagcgagtactct

SEQ ID NO: 355323 - DNA, 20 bp, human
gtgaggctcatcatcatcta

SEQ ID NO: 355324 - DNA, 20 bp, human
gaggaaaaccacagcgggga

SEQ ID NO: 355325 - DNA, 20 bp, human
gccctacccggaaacgtgac

SEQ ID NO: 355326 - DNA, 20 bp, human
gcctggggagcctcagtcaa

SEQ ID NO: 355327 - DNA, 20 bp, human
ggggctcctcctcaagctgg

SEQ ID NO: 355328 - DNA, 20 bp, human
ggagtcagagggtctcacag

SEQ ID NO: 355329 - DNA, 20 bp, human
gcctcagtcaaaggggtcct

SEQ ID NO: 355330 - DNA, 20 bp, human
ggagtcaggtgatcttgctg

SEQ ID NO: 355331 - DNA, 20 bp, human
gcctgggctcctcctcaagc

SEQ ID NO: 355332 - DNA, 20 bp, human
gaagatggggatcacagaaa

SEQ ID NO: 355333 - DNA, 20 bp, human
ggatagggagacccatgcct

SEQ ID NO: 355334 - DNA, 20 bp, human
gtcaccctgtgcatggtgtg

SEQ ID NO: 355335 - DNA, 20 bp, human
gaatgacagagcaggtcggg

SEQ ID NO: 355336 - DNA, 20 bp, human
gtgagggtcggagccgggta

SEQ ID NO: 355337 - DNA, 20 bp, human
ggctgggcataggttgtggg

SEQ ID NO: 355338 - DNA, 20 bp, human
gggtgtggccgcaagcctca

SEQ ID NO: 355339 - DNA, 20 bp, human
ggaggggtgagggtcggagc

SEQ ID NO: 355340 - DNA, 20 bp, human
ggatgaggcaggtgagcaca

SEQ ID NO: 355341 - DNA, 20 bp, human
gcaggctgggcataggttgt

SEQ ID NO: 355342 - DNA, 20 bp, human
gtggcaggaatgggctgtga

SEQ ID NO: 355343 - DNA, 20 bp, human
gggccgcaagcctcagggat

SEQ ID NO: 355344 - DNA, 20 bp, human
gaggcccacccaggagctca

SEQ ID NO: 355345 - DNA, 20 bp, human
gtgagagcctgtggacacgg

SEQ ID NO: 355346 - DNA, 20 bp, human
ggtcaccatgcgtcagggaa

SEQ ID NO: 355347 - DNA, 20 bp, human
ggggcagactgccaagaagg

SEQ ID NO: 355348 - DNA, 20 bp, human
gtctccaggcgtgggacaga

SEQ ID NO: 355349 - DNA, 20 bp, human
gtgtggtcaccctctggtgg

SEQ ID NO: 355350 - DNA, 20 bp, human
gaacttgtctgaccagtcct

SEQ ID NO: 355351 - DNA, 20 bp, human
gagcctggcacgctaagtcc

SEQ ID NO: 355352 - DNA, 20 bp, human
gccagcccttccctgacgca

SEQ ID NO: 355353 - DNA, 20 bp, human
gctggtcagacaagttctcg

SEQ ID NO: 355354 - DNA, 20 bp, human
gggccagcaacggggcaagg

SEQ ID NO: 355355 - DNA, 20 bp, human
gtgggggcagactgccaaga

SEQ ID NO: 355356 - DNA, 20 bp, human
gccgagccctccgccgaggt

SEQ ID NO: 355357 - DNA, 20 bp, human
ggccgccgagccctccgccg

SEQ ID NO: 355358 - DNA, 20 bp, human
gcctctcattcatgcagcgg

SEQ ID NO: 355359 - DNA, 20 bp, human
gcgggcccgcccctcgcgag

SEQ ID NO: 355360 - DNA, 20 bp, human
gggaacagagccagcggcca

SEQ ID NO: 355361 - DNA, 20 bp, human
ggtgagggacccggatgccc

SEQ ID NO: 355362 - DNA, 20 bp, human
gtaaccaggaacagagccag

SEQ ID NO: 355363 - DNA, 20 bp, human
gccccacccacctcggcgga

SEQ ID NO: 355364 - DNA, 20 bp, human
ggcccggcggcccctcgcga

SEQ ID NO: 355365 - DNA, 20 bp, human
ggggaaactgcccgggcatc

SEQ ID NO: 355366 - DNA, 20 bp, human
gacaaaggcgctcagaggtg

SEQ ID NO: 355367 - DNA, 20 bp, human
gcggaggcggaaaactaaga

SEQ ID NO: 355368 - DNA, 20 bp, human
gcccttagggaagtcggagg

SEQ ID NO: 355369 - DNA, 20 bp, human
ggccgggcctgatggccctg

SEQ ID NO: 355370 - DNA, 20 bp, human
ggaactgcctcagggccatc

SEQ ID NO: 355371 - DNA, 20 bp, human
gggcgctcagaggtgtggaa

SEQ ID NO: 355372 - DNA, 20 bp, human
ggaactggtgagaagttcag

SEQ ID NO: 355373 - DNA, 20 bp, human
gggagccgaaagagaccgga

SEQ ID NO: 355374 - DNA, 20 bp, human
gatgcccttagggaagtcgg

SEQ ID NO: 355375 - DNA, 20 bp, human
ggggccatcaggcccggcta

SEQ ID NO: 355376 - DNA, 20 bp, human
gggcgggagcctaagactct

SEQ ID NO: 355377 - DNA, 20 bp, human
gtctgggctcccagagtctt

SEQ ID NO: 355378 - DNA, 20 bp, human
gtgcctcaggagatctgcac

SEQ ID NO: 355379 - DNA, 20 bp, human
gtctgggagcccagacctga

SEQ ID NO: 355380 - DNA, 20 bp, human
gaggcaagatcatacacgag

SEQ ID NO: 355381 - DNA, 20 bp, human
gcaagctctctgcactgggc

SEQ ID NO: 355382 - DNA, 20 bp, human
gtggcgcaagctctctgcac

SEQ ID NO: 355383 - DNA, 20 bp, human
gccagcaagaagaacgcaag

SEQ ID NO: 355384 - DNA, 20 bp, human
gagatctcctgaggcagcct

SEQ ID NO: 355385 - DNA, 20 bp, human
gggttttgcccctcaggtct

SEQ ID NO: 355386 - DNA, 20 bp, human
gtaggcggggattggttcgt

SEQ ID NO: 355387 - DNA, 20 bp, human
ggaaccaatccccgcctaaa

SEQ ID NO: 355388 - DNA, 20 bp, human
gaccctgctcttttagaggg

SEQ ID NO: 355389 - DNA, 20 bp, human
gcgttcgggcgccattcaaa

SEQ ID NO: 355390 - DNA, 20 bp, human
ggaacagctcccaaattgag

SEQ ID NO: 355391 - DNA, 20 bp, human
gactcattggtccgtttgaa

SEQ ID NO: 355392 - DNA, 20 bp, human
ggcggggattggttcgttgg

SEQ ID NO: 355393 - DNA, 20 bp, human
gaactccagccaatcggtga

SEQ ID NO: 355394 - DNA, 20 bp, human
gcaagaccctgctcttttag

SEQ ID NO: 355395 - DNA, 20 bp, human
gtcccctccccctttaggcg

SEQ ID NO: 355396 - DNA, 20 bp, human
gcggggcttaaggttaaggt

SEQ ID NO: 355397 - DNA, 20 bp, human
gcgcctgcggctatccggaa

SEQ ID NO: 355398 - DNA, 20 bp, human
gtgctggcgcgctctgaggg

SEQ ID NO: 355399 - DNA, 20 bp, human
gaaggggtggaaccagattg

SEQ ID NO: 355400 - DNA, 20 bp, human
ggtggaaccagattggggga

SEQ ID NO: 355401 - DNA, 20 bp, human
gagatgctggcgcgctctga

SEQ ID NO: 355402 - DNA, 20 bp, human
gggggaagagcgcttgactg

SEQ ID NO: 355403 - DNA, 20 bp, human
gaaagcccgggcgactagcc

SEQ ID NO: 355404 - DNA, 20 bp, human
gcttgactgagggaagatgc

SEQ ID NO: 355405 - DNA, 20 bp, human
gagggccaactggaagtcca

SEQ ID NO: 355406 - DNA, 20 bp, human
ggcgcagtgtggtgtggaca

SEQ ID NO: 355407 - DNA, 20 bp, human
gcgcaggtgcgttcccgtcg

SEQ ID NO: 355408 - DNA, 20 bp, human
ggagcatgcgcagtgtggtg

SEQ ID NO: 355409 - DNA, 20 bp, human
gggcgagcatgcgcagtatg

SEQ ID NO: 355410 - DNA, 20 bp, human
gagcatgcgcagtatggggc

SEQ ID NO: 355411 - DNA, 20 bp, human
gggcgtcagcgtctagacgc

SEQ ID NO: 355412 - DNA, 20 bp, human
gccgctgcgcgagcctcgac

SEQ ID NO: 355413 - DNA, 20 bp, human
gtggcaagcatgcgcaatgt

SEQ ID NO: 355414 - DNA, 20 bp, human
gcccaggcctcgtgtagtga

SEQ ID NO: 355415 - DNA, 20 bp, human
gagcatgcgcaatgtgggcc

SEQ ID NO: 355416 - DNA, 20 bp, human
gaagcgacagggattgggcg

SEQ ID NO: 355417 - DNA, 20 bp, human
gcgccccgagcgaagacctg

SEQ ID NO: 355418 - DNA, 20 bp, human
gccaatccctgtcgcttcat

SEQ ID NO: 355419 - DNA, 20 bp, human
gcctgtcgcttcattggctc

SEQ ID NO: 355420 - DNA, 20 bp, human
ggtccgcaggtcttcgctcg

SEQ ID NO: 355421 - DNA, 20 bp, human
gtgaccggcctcccgaaagt

SEQ ID NO: 355422 - DNA, 20 bp, human
gaccgagcgtccggacgtaa

SEQ ID NO: 355423 - DNA, 20 bp, human
gcggtaaaagcgcagagcgg

SEQ ID NO: 355424 - DNA, 20 bp, human
gaagccgactttcgggaggc

SEQ ID NO: 355425 - DNA, 20 bp, human
gcgtccggacgtaaggggcg

SEQ ID NO: 355426 - DNA, 20 bp, human
gcgacccggacccaagaagt

SEQ ID NO: 355427 - DNA, 20 bp, human
gacccgggctccctatgcgc

SEQ ID NO: 355428 - DNA, 20 bp, human
gtgtcgcggcctagcggcga

SEQ ID NO: 355429 - DNA, 20 bp, human
gcgcggcccggcgcacgact

SEQ ID NO: 355430 - DNA, 20 bp, human
gggaaaagggaggagcgctc

SEQ ID NO: 355431 - DNA, 20 bp, human
ggcacgactcggaccagttc

SEQ ID NO: 355432 - DNA, 20 bp, human
gcctcggggtggaaacaaag

SEQ ID NO: 355433 - DNA, 20 bp, human
gcgccggcgcatagggagcc

SEQ ID NO: 355434 - DNA, 20 bp, human
ggggaggaccgcgcgtgtcg

SEQ ID NO: 355435 - DNA, 20 bp, human
ggagtcgcctgcgcgcgcag

SEQ ID NO: 355436 - DNA, 20 bp, human
ggtcaagaggacatcatgga

SEQ ID NO: 355437 - DNA, 20 bp, human
gcctcggggtggaaacaaag

SEQ ID NO: 355438 - DNA, 20 bp, human
gcgcggcccggcgcacgact

SEQ ID NO: 355439 - DNA, 20 bp, human
ggcacgactcggaccagttc

SEQ ID NO: 355440 - DNA, 20 bp, human
gaagttgggttcgaacctgt

SEQ ID NO: 355441 - DNA, 20 bp, human
gtccaccccgagggggaagg

SEQ ID NO: 355442 - DNA, 20 bp, human
gcgctgccctgcggaccgca

SEQ ID NO: 355443 - DNA, 20 bp, human
ggcccccttccccctcgggg

SEQ ID NO: 355444 - DNA, 20 bp, human
gttcgaacccaacttgtccg

SEQ ID NO: 355445 - DNA, 20 bp, human
gtgagcaactgtcacactta

SEQ ID NO: 355446 - DNA, 20 bp, human
gctaggaggcggtcactaga

SEQ ID NO: 355447 - DNA, 20 bp, human
gtaaaattggggctcttcgg

SEQ ID NO: 355448 - DNA, 20 bp, human
ggaggggagaatagcacacc

SEQ ID NO: 355449 - DNA, 20 bp, human
gcccatgcgcgtaccacagg

SEQ ID NO: 355450 - DNA, 20 bp, human
ggtcactagagggcgctctg

SEQ ID NO: 355451 - DNA, 20 bp, human
ggtgaccgcctcctaggctc

SEQ ID NO: 355452 - DNA, 20 bp, human
gggcggggtagccctgtgtg

SEQ ID NO: 355453 - DNA, 20 bp, human
gggaggggaaggtaaaattg

SEQ ID NO: 355454 - DNA, 20 bp, human
ggggccggaagcacagatcc

SEQ ID NO: 355455 - DNA, 20 bp, human
gcggcccatgcgcgtaccac

SEQ ID NO: 355456 - DNA, 20 bp, human
gcgcccgcgccgtctcttgc

SEQ ID NO: 355457 - DNA, 20 bp, human
gccaatggggacatgatggg

SEQ ID NO: 355458 - DNA, 20 bp, human
gcggccaatggggacatgat

SEQ ID NO: 355459 - DNA, 20 bp, human
gagtgcgctcgattgtgggc

SEQ ID NO: 355460 - DNA, 20 bp, human
gtgtgggcgggggcggaaag

SEQ ID NO: 355461 - DNA, 20 bp, human
gaaagaggcgcgttttaaag

SEQ ID NO: 355462 - DNA, 20 bp, human
gccgaccgcggaagtagagt

SEQ ID NO: 355463 - DNA, 20 bp, human
gagttagtgcgctcgattgt

SEQ ID NO: 355464 - DNA, 20 bp, human
gaggcctccgaagcggaagt

SEQ ID NO: 355465 - DNA, 20 bp, human
gcggaagtagagtaggcggg

SEQ ID NO: 355466 - DNA, 20 bp, human
gggccctcgtattagcaacc

SEQ ID NO: 355467 - DNA, 20 bp, human
ggcgcggtgtcagttactat

SEQ ID NO: 355468 - DNA, 20 bp, human
gagccagaggacccgagtgg

SEQ ID NO: 355469 - DNA, 20 bp, human
ggcgccctgcgcaccgttgg

SEQ ID NO: 355470 - DNA, 20 bp, human
gaaaggcagccccggatgtg

SEQ ID NO: 355471 - DNA, 20 bp, human
ggccaatcaccgagagaaag

SEQ ID NO: 355472 - DNA, 20 bp, human
gacagccagcgctcggtcgg

SEQ ID NO: 355473 - DNA, 20 bp, human
gaagttgcgagtgcccacct

SEQ ID NO: 355474 - DNA, 20 bp, human
gtacgcttggtcccgccact

SEQ ID NO: 355475 - DNA, 20 bp, human
gccccccccaacggtgcgca

SEQ ID NO: 355476 - DNA, 20 bp, human
gcaggagctgcctacgagga

SEQ ID NO: 355477 - DNA, 20 bp, human
gtgcctacgaggagggacga

SEQ ID NO: 355478 - DNA, 20 bp, human
gctcctggctgctggtgtag

SEQ ID NO: 355479 - DNA, 20 bp, human
gagccttcgtccctcctcgt

SEQ ID NO: 355480 - DNA, 20 bp, human
ggcaaaggatccgtctgagg

SEQ ID NO: 355481 - DNA, 20 bp, human
gtaaacaaagaggcggggtt

SEQ ID NO: 355482 - DNA, 20 bp, human
gctagacttcctgtctagag

SEQ ID NO: 355483 - DNA, 20 bp, human
gggggcaaaggatccgtctg

SEQ ID NO: 355484 - DNA, 20 bp, human
gccaggcctccactctagac

SEQ ID NO: 355485 - DNA, 20 bp, human
gggggctgagttaaacaaag

SEQ ID NO: 355486 - DNA, 20 bp, human
gaggggggagagcgaaagaa

SEQ ID NO: 355487 - DNA, 20 bp, human
gttagctgtggctcagtaga

SEQ ID NO: 355488 - DNA, 20 bp, human
gcctgctgacaaagtgaggg

SEQ ID NO: 355489 - DNA, 20 bp, human
gtacccagagaaaggtactc

SEQ ID NO: 355490 - DNA, 20 bp, human
gctacctgctgacaaagtga

SEQ ID NO: 355491 - DNA, 20 bp, human
gagcgtgattgcagtcccag

SEQ ID NO: 355492 - DNA, 20 bp, human
gtgtgagcaccaggaggagg

SEQ ID NO: 355493 - DNA, 20 bp, human
gtgattgcagtcccagggga

SEQ ID NO: 355494 - DNA, 20 bp, human
gaaggtactcgggatcgaat

SEQ ID NO: 355495 - DNA, 20 bp, human
gatcccgagtacctttctct

SEQ ID NO: 355496 - DNA, 20 bp, human
gtgcatgggtggtccgccat

SEQ ID NO: 355497 - DNA, 20 bp, human
gacgccgtgtagtataaaca

SEQ ID NO: 355498 - DNA, 20 bp, human
gttgcccaacagaccaatgg

SEQ ID NO: 355499 - DNA, 20 bp, human
gggcaccctgtccccgagga

SEQ ID NO: 355500 - DNA, 20 bp, human
gtggtccgccattggtctgt

SEQ ID NO: 355501 - DNA, 20 bp, human
gtaaacaaggagaagtgggg

SEQ ID NO: 355502 - DNA, 20 bp, human
gcaaacgagctaacgtctgc

SEQ ID NO: 355503 - DNA, 20 bp, human
gtgtgacgtcagcgcgagca

SEQ ID NO: 355504 - DNA, 20 bp, human
gcgtctttaaaaagctggta

SEQ ID NO: 355505 - DNA, 20 bp, human
gacctctgacggggcgagag

SEQ ID NO: 355506 - DNA, 20 bp, human
ggctaaaacttgacggaaaa

SEQ ID NO: 355507 - DNA, 20 bp, human
gcgagttattaccaatccct

SEQ ID NO: 355508 - DNA, 20 bp, human
gtggcccaaagggtaggggc

SEQ ID NO: 355509 - DNA, 20 bp, human
gaggattggcccaaagggta

SEQ ID NO: 355510 - DNA, 20 bp, human
gaagcctgcccaacgatcgt

SEQ ID NO: 355511 - DNA, 20 bp, human
gacacgctgtcgcctggcca

SEQ ID NO: 355512 - DNA, 20 bp, human
ggccttcgcacaatggctat

SEQ ID NO: 355513 - DNA, 20 bp, human
ggccaatagccattgtgcga

SEQ ID NO: 355514 - DNA, 20 bp, human
gcagtcctgccttcgcacaa

SEQ ID NO: 355515 - DNA, 20 bp, human
gacctcctgcccacgatcgt

SEQ ID NO: 355516 - DNA, 20 bp, human
gtaagggcggcgcaagaggg

SEQ ID NO: 355517 - DNA, 20 bp, human
ggacgcgcagagttaagtgc

SEQ ID NO: 355518 - DNA, 20 bp, human
gcgactccccgccgccaagt

SEQ ID NO: 355519 - DNA, 20 bp, human
ggcccacagcacacgttctc

SEQ ID NO: 355520 - DNA, 20 bp, human
gggaggaggcactgtaaggg

SEQ ID NO: 355521 - DNA, 20 bp, human
gcgctccgctggctggtgat

SEQ ID NO: 355522 - DNA, 20 bp, human
ggcgtggctgtcgggaaaga

SEQ ID NO: 355523 - DNA, 20 bp, human
ggcgcaagagggcggaacgc

SEQ ID NO: 355524 - DNA, 20 bp, human
gtgggctcgagggaaagatc

SEQ ID NO: 355525 - DNA, 20 bp, human
gtcgaggaggaggcactgta

SEQ ID NO: 355526 - DNA, 20 bp, human
gcgtcctaggccaactgaga

SEQ ID NO: 355527 - DNA, 20 bp, human
gcagcggcgtcgccccataa

SEQ ID NO: 355528 - DNA, 20 bp, human
gagttggcctaggacggcga

SEQ ID NO: 355529 - DNA, 20 bp, human
ggaccccggctgcccacgat

SEQ ID NO: 355530 - DNA, 20 bp, human
ggggcccgagccctctcagt

SEQ ID NO: 355531 - DNA, 20 bp, human
gtcacctgacgccagcgcca

SEQ ID NO: 355532 - DNA, 20 bp, human
gctgcccgcccccctggcgc

SEQ ID NO: 355533 - DNA, 20 bp, human
gcgcaggccgccagccaccg

SEQ ID NO: 355534 - DNA, 20 bp, human
gcaccgtggtgcctagaccc

SEQ ID NO: 355535 - DNA, 20 bp, human
gggaaggcggaaggctaggg

SEQ ID NO: 355536 - DNA, 20 bp, human
ggagaagaggttccagtctg

SEQ ID NO: 355537 - DNA, 20 bp, human
gggggcgggcgcgattcgag

SEQ ID NO: 355538 - DNA, 20 bp, human
gaggactggggtgatggttc

SEQ ID NO: 355539 - DNA, 20 bp, human
gcgccctggagcaaagaggg

SEQ ID NO: 355540 - DNA, 20 bp, human
ggccccgcccagggccggat

SEQ ID NO: 355541 - DNA, 20 bp, human
gcgcctgcgcaagaggacgg

SEQ ID NO: 355542 - DNA, 20 bp, human
gtctggggcggctaggactg

SEQ ID NO: 355543 - DNA, 20 bp, human
gatggttctggaggcggcga

SEQ ID NO: 355544 - DNA, 20 bp, human
gggtgggttgggagccaatc

SEQ ID NO: 355545 - DNA, 20 bp, human
ggagccaatccggccctggg

SEQ ID NO: 355546 - DNA, 20 bp, human
gaaaacgcccaggatctcgg

SEQ ID NO: 355547 - DNA, 20 bp, human
gaaaccctaacactcctcca

SEQ ID NO: 355548 - DNA, 20 bp, human
gtacccctggaggagtgtta

SEQ ID NO: 355549 - DNA, 20 bp, human
ggcgccgagtggagagctca

SEQ ID NO: 355550 - DNA, 20 bp, human
gaggcctgaaggccgttctc

SEQ ID NO: 355551 - DNA, 20 bp, human
gcacggctgccggggtgttt

SEQ ID NO: 355552 - DNA, 20 bp, human
gaggtcaggcgtcaagctcg

SEQ ID NO: 355553 - DNA, 20 bp, human
gcgcgcgcgtgagaacgtcc

SEQ ID NO: 355554 - DNA, 20 bp, human
gttggagaacctacccctgg

SEQ ID NO: 355555 - DNA, 20 bp, human
gggagagctcacggctgccg

SEQ ID NO: 355556 - DNA, 20 bp, human
gctccgctccgcagcgacaa

SEQ ID NO: 355557 - DNA, 20 bp, human
gaggaggccgccgttcctta

SEQ ID NO: 355558 - DNA, 20 bp, human
ggacaatcgcgtgagtgctg

SEQ ID NO: 355559 - DNA, 20 bp, human
gaggctgccgggagcagact

SEQ ID NO: 355560 - DNA, 20 bp, human
gggttaagtgccgggaaagg

SEQ ID NO: 355561 - DNA, 20 bp, human
gttcccggcacttaaccaat

SEQ ID NO: 355562 - DNA, 20 bp, human
ggcgtagggcggggtcacgt

SEQ ID NO: 355563 - DNA, 20 bp, human
gcggaggcggggcgtagggc

SEQ ID NO: 355564 - DNA, 20 bp, human
gcctcctattggttaagtgc

SEQ ID NO: 355565 - DNA, 20 bp, human
gtcacgtggggctgcgccca

SEQ ID NO: 355566 - DNA, 20 bp, human
ggaaggatagcaaagagtta

SEQ ID NO: 355567 - DNA, 20 bp, human
gcgcgtccgtggagcgggac

SEQ ID NO: 355568 - DNA, 20 bp, human
gtccgggcgcgtccgtggag

SEQ ID NO: 355569 - DNA, 20 bp, human
gtaaggacgcgacgaatggg

SEQ ID NO: 355570 - DNA, 20 bp, human
gggcggggcggtgccgagtg

SEQ ID NO: 355571 - DNA, 20 bp, human
gagttaaggacgcgacgaat

SEQ ID NO: 355572 - DNA, 20 bp, human
gtgccgagtggggcgagaga

SEQ ID NO: 355573 - DNA, 20 bp, human
ggccccctttccgaggtcag

SEQ ID NO: 355574 - DNA, 20 bp, human
gggacgcgcccggacgctac

SEQ ID NO: 355575 - DNA, 20 bp, human
gaagccccgccccctttccg

SEQ ID NO: 355576 - DNA, 20 bp, human
ggtggggcgtggctcggtga

SEQ ID NO: 355577 - DNA, 20 bp, human
ggcctggcgggagtagtctc

SEQ ID NO: 355578 - DNA, 20 bp, human
gaccaagccccgcctactgg

SEQ ID NO: 355579 - DNA, 20 bp, human
gtggtctcccccagtaggcg

SEQ ID NO: 355580 - DNA, 20 bp, human
ggcgggagtagtctcggggt

SEQ ID NO: 355581 - DNA, 20 bp, human
gacgactggcggacggtcgc

SEQ ID NO: 355582 - DNA, 20 bp, human
gtgggcgtggtcaggtgcgt

SEQ ID NO: 355583 - DNA, 20 bp, human
gcagtcttggcgcagcggcg

SEQ ID NO: 355584 - DNA, 20 bp, human
gggtgagggaggtctcgctt

SEQ ID NO: 355585 - DNA, 20 bp, human
ggggcgtggctcggtgaggg

SEQ ID NO: 355586 - DNA, 20 bp, human
gctggggctgcggagaaccg

SEQ ID NO: 355587 - DNA, 20 bp, human
ggcccagaaaagcctggaaa

SEQ ID NO: 355588 - DNA, 20 bp, human
gcggcccgggctttctggaa

SEQ ID NO: 355589 - DNA, 20 bp, human
gtgggccctgagctttcctc

SEQ ID NO: 355590 - DNA, 20 bp, human
ggctgtctgtcttctcgctt

SEQ ID NO: 355591 - DNA, 20 bp, human
gaatggtgtgggctattgtt

SEQ ID NO: 355592 - DNA, 20 bp, human
ggtcagctctgttgcgaggc

SEQ ID NO: 355593 - DNA, 20 bp, human
gcagggcccaggtcggccca

SEQ ID NO: 355594 - DNA, 20 bp, human
ggccccaggtttgctcctca

SEQ ID NO: 355595 - DNA, 20 bp, human
gcccgggctttctggaaagg

SEQ ID NO: 355596 - DNA, 20 bp, human
ggcagcgggaggggtctaga

SEQ ID NO: 355597 - DNA, 20 bp, human
ggggactcgtagttccggcg

SEQ ID NO: 355598 - DNA, 20 bp, human
gagtcccgacgtgccgcgcg

SEQ ID NO: 355599 - DNA, 20 bp, human
gacgtcgggactcgtagttc

SEQ ID NO: 355600 - DNA, 20 bp, human
gttcactgagcgggcactgg

SEQ ID NO: 355601 - DNA, 20 bp, human
ggcggcagggggctagcgtc

SEQ ID NO: 355602 - DNA, 20 bp, human
ggagtcacgtggagacggtc

SEQ ID NO: 355603 - DNA, 20 bp, human
gacactggctcgacccggaa

SEQ ID NO: 355604 - DNA, 20 bp, human
gtgcgagagtcacgtggaga

SEQ ID NO: 355605 - DNA, 20 bp, human
gtgaagggttacagcaaagg

SEQ ID NO: 355606 - DNA, 20 bp, human
ggaaacgcgccgtctggaag

SEQ ID NO: 355607 - DNA, 20 bp, human
gctgcgtgcggcgggaatca

SEQ ID NO: 355608 - DNA, 20 bp, human
gcctaaggtcggacaccctc

SEQ ID NO: 355609 - DNA, 20 bp, human
gcacgaaagcgcgccgtcgg

SEQ ID NO: 355610 - DNA, 20 bp, human
gtgcaggccggggccgacag

SEQ ID NO: 355611 - DNA, 20 bp, human
ggtacagcccagtccacgaa

SEQ ID NO: 355612 - DNA, 20 bp, human
gcagacggcgcgtttctatc

SEQ ID NO: 355613 - DNA, 20 bp, human
gtcggcggctagtgacgtca

SEQ ID NO: 355614 - DNA, 20 bp, human
gaccgcgcagggcctaaggt

SEQ ID NO: 355615 - DNA, 20 bp, human
gggctgtacggtgcgcgtga

SEQ ID NO: 355616 - DNA, 20 bp, human
gtgcgggctgggaccgtcac

SEQ ID NO: 355617 - DNA, 20 bp, human
gctatctggagctgaccgtg

SEQ ID NO: 355618 - DNA, 20 bp, human
gcaacccttcgaagactctt

SEQ ID NO: 355619 - DNA, 20 bp, human
gatagcaaggaggagaactt

SEQ ID NO: 355620 - DNA, 20 bp, human
ggaaagaaggttgacgctca

SEQ ID NO: 355621 - DNA, 20 bp, human
gcacggcggcgagcgctatc

SEQ ID NO: 355622 - DNA, 20 bp, human
gaagggttgccgcttttcgg

SEQ ID NO: 355623 - DNA, 20 bp, human
gtggccttgggaaagtgaat

SEQ ID NO: 355624 - DNA, 20 bp, human
gctgggaccgtcacagggcg

SEQ ID NO: 355625 - DNA, 20 bp, human
ggccccgccccgccctgtga

SEQ ID NO: 355626 - DNA, 20 bp, human
gcggcccggccggtgagcaa

SEQ ID NO: 355627 - DNA, 20 bp, human
ggggcggtaaagcgcaggga

SEQ ID NO: 355628 - DNA, 20 bp, human
gcgggtgcagctagaagagt

SEQ ID NO: 355629 - DNA, 20 bp, human
gtggctggaggaagtccaga

SEQ ID NO: 355630 - DNA, 20 bp, human
gcggggagtaggcccctcta

SEQ ID NO: 355631 - DNA, 20 bp, human
ggcagggaggggatgcggtc

SEQ ID NO: 355632 - DNA, 20 bp, human
gcacccgtgcctcgggactt

SEQ ID NO: 355633 - DNA, 20 bp, human
gcggtcgggagcagatttcg

SEQ ID NO: 355634 - DNA, 20 bp, human
gagacgcggaaggacggaaa

SEQ ID NO: 355635 - DNA, 20 bp, human
gccgcagagccgttgctcac

SEQ ID NO: 355636 - DNA, 20 bp, human
gccgcccggggaggaagcga

SEQ ID NO: 355637 - DNA, 20 bp, human
gggagccggggaatcgagcg

SEQ ID NO: 355638 - DNA, 20 bp, human
ggcggcgcccgggagatccc

SEQ ID NO: 355639 - DNA, 20 bp, human
ggggcctggccggcagtgtc

SEQ ID NO: 355640 - DNA, 20 bp, human
gccctggggcagccgctgaa

SEQ ID NO: 355641 - DNA, 20 bp, human
gcggggccggggcgctgtgt

SEQ ID NO: 355642 - DNA, 20 bp, human
gcgcgccgcgctcgattccc

SEQ ID NO: 355643 - DNA, 20 bp, human
gccgggagatcccaggaggc

SEQ ID NO: 355644 - DNA, 20 bp, human
gagcagcgatcccgcctcct

SEQ ID NO: 355645 - DNA, 20 bp, human
gaagggacccgggaaccttg

SEQ ID NO: 355646 - DNA, 20 bp, human
gtgcgcccgcgcaaggaaag

SEQ ID NO: 355647 - DNA, 20 bp, human
gaaagtccctgggactgacc

SEQ ID NO: 355648 - DNA, 20 bp, human
gaggaagcgttaaagagtca

SEQ ID NO: 355649 - DNA, 20 bp, human
gctgccctcccaggttcaac

SEQ ID NO: 355650 - DNA, 20 bp, human
gtcctagccggtaaagtccc

SEQ ID NO: 355651 - DNA, 20 bp, human
gatgaccgaggctcgtcctc

SEQ ID NO: 355652 - DNA, 20 bp, human
ggtcgcgctggggacgttca

SEQ ID NO: 355653 - DNA, 20 bp, human
ggagggcagcgcgatgaccg

SEQ ID NO: 355654 - DNA, 20 bp, human
gagactccggcccctgtcgc

SEQ ID NO: 355655 - DNA, 20 bp, human
gagtaagcgtgcaaccagcc

SEQ ID NO: 355656 - DNA, 20 bp, human
ggcaggcattacaataccag

SEQ ID NO: 355657 - DNA, 20 bp, human
ggcagctttggagacgccga

SEQ ID NO: 355658 - DNA, 20 bp, human
gtgctgcgatgtttaaccga

SEQ ID NO: 355659 - DNA, 20 bp, human
gaacactaggcacgcagctt

SEQ ID NO: 355660 - DNA, 20 bp, human
gaccggagcagtaggaccca

SEQ ID NO: 355661 - DNA, 20 bp, human
ggaatgatagatcacatgac

SEQ ID NO: 355662 - DNA, 20 bp, human
ggaagggtaagtctcggaaa

SEQ ID NO: 355663 - DNA, 20 bp, human
gcttctattggtggctgcgg

SEQ ID NO: 355664 - DNA, 20 bp, human
ggaaggcattgcatacaaat

SEQ ID NO: 355665 - DNA, 20 bp, human
gtccaagtgtgcgcttctat

SEQ ID NO: 355666 - DNA, 20 bp, human
gggtggaaggacttctagga

SEQ ID NO: 355667 - DNA, 20 bp, human
gctcagaggcggcaccgcgg

SEQ ID NO: 355668 - DNA, 20 bp, human
gggaaggagtgggcacccgg

SEQ ID NO: 355669 - DNA, 20 bp, human
gcacccgggggcgcggagaa

SEQ ID NO: 355670 - DNA, 20 bp, human
ggaggctgcagacacccccg

SEQ ID NO: 355671 - DNA, 20 bp, human
gcacccgcccgctggggagt

SEQ ID NO: 355672 - DNA, 20 bp, human
gcctggtgcactatcctcag

SEQ ID NO: 355673 - DNA, 20 bp, human
gccctccccgggccgactcc

SEQ ID NO: 355674 - DNA, 20 bp, human
gaactcctacgtggtgaggg

SEQ ID NO: 355675 - DNA, 20 bp, human
ggagagccgagagtccccgg

SEQ ID NO: 355676 - DNA, 20 bp, human
gcctcctcgtggcgtcttag

SEQ ID NO: 355677 - DNA, 20 bp, human
ggagggctgcgggccaagac

SEQ ID NO: 355678 - DNA, 20 bp, human
ggcaaagcctggcctcctcg

SEQ ID NO: 355679 - DNA, 20 bp, human
ggccaagacggggcgggatc

SEQ ID NO: 355680 - DNA, 20 bp, human
ggaaggggcaagttcgagga

SEQ ID NO: 355681 - DNA, 20 bp, human
gccgctggcgagtgaggacc

SEQ ID NO: 355682 - DNA, 20 bp, human
gagccaggcggcccatgggg

SEQ ID NO: 355683 - DNA, 20 bp, human
gtatcccgcccctacccaag

SEQ ID NO: 355684 - DNA, 20 bp, human
gtaaagaaggggcaagttcg

SEQ ID NO: 355685 - DNA, 20 bp, human
gagggagccaggcggcccat

SEQ ID NO: 355686 - DNA, 20 bp, human
gagggccaggcaggaagcat

SEQ ID NO: 355687 - DNA, 20 bp, human
gagaactgggaggagaccag

SEQ ID NO: 355688 - DNA, 20 bp, human
gagcgctgaagttagggtcg

SEQ ID NO: 355689 - DNA, 20 bp, human
gtactcggggatttcttaca

SEQ ID NO: 355690 - DNA, 20 bp, human
gagcaggtgtcaaagggata

SEQ ID NO: 355691 - DNA, 20 bp, human
ggaaaccgatgcttcctgcc

SEQ ID NO: 355692 - DNA, 20 bp, human
gcctcagtgccttggagaac

SEQ ID NO: 355693 - DNA, 20 bp, human
ggcactggggaaatggatga

SEQ ID NO: 355694 - DNA, 20 bp, human
gctcaaagccgcttccctcc

SEQ ID NO: 355695 - DNA, 20 bp, human
gagctcacagtgaagaggga

SEQ ID NO: 355696 - DNA, 20 bp, human
ggagaaggcggaccgctggg

SEQ ID NO: 355697 - DNA, 20 bp, human
gtgcgggcaggcggtggaga

SEQ ID NO: 355698 - DNA, 20 bp, human
ggggcgcggacgctcggaag

SEQ ID NO: 355699 - DNA, 20 bp, human
gctgtcgcctccgcagggtg

SEQ ID NO: 355700 - DNA, 20 bp, human
ggcactctgtcgcctccgca

SEQ ID NO: 355701 - DNA, 20 bp, human
gagtgcgggtaagcagctgc

SEQ ID NO: 355702 - DNA, 20 bp, human
gggtggagaaggcggaccgc

SEQ ID NO: 355703 - DNA, 20 bp, human
ggcggggccttgcgggcagg

SEQ ID NO: 355704 - DNA, 20 bp, human
gggctctgaggagccatgca

SEQ ID NO: 355705 - DNA, 20 bp, human
gtctcctcgtcagaagtctc

SEQ ID NO: 355706 - DNA, 20 bp, human
gctcagagaacctcgccagg

SEQ ID NO: 355707 - DNA, 20 bp, human
gggtagtccgcggggtccgg

SEQ ID NO: 355708 - DNA, 20 bp, human
ggttccgcctcggggccgcg

SEQ ID NO: 355709 - DNA, 20 bp, human
gagcgggacagacgcaggaa

SEQ ID NO: 355710 - DNA, 20 bp, human
ggggccgcggggtagtccgc

SEQ ID NO: 355711 - DNA, 20 bp, human
gggcgagggcgggcgaggaa

SEQ ID NO: 355712 - DNA, 20 bp, human
gacacccagggccccctctc

SEQ ID NO: 355713 - DNA, 20 bp, human
gggaggaagcgcggtgcgcg

SEQ ID NO: 355714 - DNA, 20 bp, human
gcgcctcagagaacctcgcc

SEQ ID NO: 355715 - DNA, 20 bp, human
gagagaacctcgccaggggg

SEQ ID NO: 355716 - DNA, 20 bp, human
gagccctggaaccagactgg

SEQ ID NO: 355717 - DNA, 20 bp, human
gggagccaagcgggccaata

SEQ ID NO: 355718 - DNA, 20 bp, human
ggcgcccccaggatatgata

SEQ ID NO: 355719 - DNA, 20 bp, human
gcagcctggggcgcccgctt

SEQ ID NO: 355720 - DNA, 20 bp, human
gtccggggtgagacggactt

SEQ ID NO: 355721 - DNA, 20 bp, human
ggccggcggctgcacgagtc

SEQ ID NO: 355722 - DNA, 20 bp, human
gggaaccagactggcggctg

SEQ ID NO: 355723 - DNA, 20 bp, human
ggccaagcgggccaataggg

SEQ ID NO: 355724 - DNA, 20 bp, human
gccggctccgtgctcgcgat

SEQ ID NO: 355725 - DNA, 20 bp, human
gtccactcgcgctcactcat

SEQ ID NO: 355726 - DNA, 20 bp, human
gcggacacatgtaaagttgt

SEQ ID NO: 355727 - DNA, 20 bp, human
gagcctggggctgcctgaaa

SEQ ID NO: 355728 - DNA, 20 bp, human
gaagccgctggctcagagac

SEQ ID NO: 355729 - DNA, 20 bp, human
gaggcgaagggcttctgcca

SEQ ID NO: 355730 - DNA, 20 bp, human
ggacggtggtaaaggatcaa

SEQ ID NO: 355731 - DNA, 20 bp, human
gcacctgaagaaagcgtaga

SEQ ID NO: 355732 - DNA, 20 bp, human
gcgctggctcagagactgga

SEQ ID NO: 355733 - DNA, 20 bp, human
gagccagcggcttcgggtgc

SEQ ID NO: 355734 - DNA, 20 bp, human
gagggccgtcacctgggaaa

SEQ ID NO: 355735 - DNA, 20 bp, human
gctgaaaggggcagtcctac

SEQ ID NO: 355736 - DNA, 20 bp, human
gactgccgcccgcctccaag

SEQ ID NO: 355737 - DNA, 20 bp, human
gggacccgagcgtaccgcgc

SEQ ID NO: 355738 - DNA, 20 bp, human
ggcccgcggcgcccactcgg

SEQ ID NO: 355739 - DNA, 20 bp, human
ggcaggcgcagcccccgagt

SEQ ID NO: 355740 - DNA, 20 bp, human
gcggagcagcatggtcccgc

SEQ ID NO: 355741 - DNA, 20 bp, human
ggctccagggccgaagcccg

SEQ ID NO: 355742 - DNA, 20 bp, human
gtgcagcggcttcggaaggt

SEQ ID NO: 355743 - DNA, 20 bp, human
ggctccgagccgcttggagg

SEQ ID NO: 355744 - DNA, 20 bp, human
ggctccggaagcgattcatc

SEQ ID NO: 355745 - DNA, 20 bp, human
gtcgggtcccgctctccggg

SEQ ID NO: 355746 - DNA, 20 bp, human
gacttcttacaatgagtttt

SEQ ID NO: 355747 - DNA, 20 bp, human
gggttcccagggtcccgcta

SEQ ID NO: 355748 - DNA, 20 bp, human
gctgcagcggcgggttccca

SEQ ID NO: 355749 - DNA, 20 bp, human
gtcccgctagggcgctgcta

SEQ ID NO: 355750 - DNA, 20 bp, human
ggaacccgccgctgcaggag

SEQ ID NO: 355751 - DNA, 20 bp, human
gtcccctagcagcgccctag

SEQ ID NO: 355752 - DNA, 20 bp, human
gaggtcaccaggggtagcgc

SEQ ID NO: 355753 - DNA, 20 bp, human
gggcctggagggttaaggac

SEQ ID NO: 355754 - DNA, 20 bp, human
gctccgctgccaggtcacca

SEQ ID NO: 355755 - DNA, 20 bp, human
gagcgccctagcgggaccct

SEQ ID NO: 355756 - DNA, 20 bp, human
ggaaaggaacctttgtaaag

SEQ ID NO: 355757 - DNA, 20 bp, human
gcatagaagccactttacaa

SEQ ID NO: 355758 - DNA, 20 bp, human
gctggagcatattgggttca

SEQ ID NO: 355759 - DNA, 20 bp, human
gcatgtgtatatataatctt

SEQ ID NO: 355760 - DNA, 20 bp, human
gtctgcagttgccagattac

SEQ ID NO: 355761 - DNA, 20 bp, human
gaaaaaagtcagagagtagg

SEQ ID NO: 355762 - DNA, 20 bp, human
gagaaaaaaagtcagagagt

SEQ ID NO: 355763 - DNA, 20 bp, human
gccagaggccactggtgtat

SEQ ID NO: 355764 - DNA, 20 bp, human
gtcccccttcttctgaggga

SEQ ID NO: 355765 - DNA, 20 bp, human
gtagaacagccagaggccac

SEQ ID NO: 355766 - DNA, 20 bp, human
gctgaaccaccggggagcag

SEQ ID NO: 355767 - DNA, 20 bp, human
gtgcgcgtgcgcggctccag

SEQ ID NO: 355768 - DNA, 20 bp, human
ggggaagcgggttaagtgaa

SEQ ID NO: 355769 - DNA, 20 bp, human
gggactcgggcctgctagga

SEQ ID NO: 355770 - DNA, 20 bp, human
ggtgagcggcgaactcacga

SEQ ID NO: 355771 - DNA, 20 bp, human
ggcgcacgcggccctgagcg

SEQ ID NO: 355772 - DNA, 20 bp, human
gtagggaactgcagggtcta

SEQ ID NO: 355773 - DNA, 20 bp, human
ggagcagccccgcctcgctc

SEQ ID NO: 355774 - DNA, 20 bp, human
gcgcgcggctctgaaccacc

SEQ ID NO: 355775 - DNA, 20 bp, human
gctggcgctagggaactgca

SEQ ID NO: 355776 - DNA, 20 bp, human
gcgagcgccggggaccttcg

SEQ ID NO: 355777 - DNA, 20 bp, human
gagggagcgtgcccgagacg

SEQ ID NO: 355778 - DNA, 20 bp, human
gcgccccagccccgaccaat

SEQ ID NO: 355779 - DNA, 20 bp, human
gaggtccccggcgctcggtt

SEQ ID NO: 355780 - DNA, 20 bp, human
gggagggtgcgggcgttgag

SEQ ID NO: 355781 - DNA, 20 bp, human
gtccccggcgctcggttcgg

SEQ ID NO: 355782 - DNA, 20 bp, human
ggtcgcggctcccgcgtctc

SEQ ID NO: 355783 - DNA, 20 bp, human
gccgcgtctcccattggtcg

SEQ ID NO: 355784 - DNA, 20 bp, human
gacttcgcagaaagcggtcg

SEQ ID NO: 355785 - DNA, 20 bp, human
gtgcgaagtcggggagggtg

SEQ ID NO: 355786 - DNA, 20 bp, human
gcgccccgatgggcagagcg

SEQ ID NO: 355787 - DNA, 20 bp, human
gggcgcaggaggcaggtccg

SEQ ID NO: 355788 - DNA, 20 bp, human
gccctgccgggggaacgcgc

SEQ ID NO: 355789 - DNA, 20 bp, human
ggggcagacccgccgaactc

SEQ ID NO: 355790 - DNA, 20 bp, human
gcccgctcgcccgccccgat

SEQ ID NO: 355791 - DNA, 20 bp, human
gcgccgcccgcgcgttcccc

SEQ ID NO: 355792 - DNA, 20 bp, human
gggcagagcgaggcttgcgc

SEQ ID NO: 355793 - DNA, 20 bp, human
gagcctcgctctgcccatcg

SEQ ID NO: 355794 - DNA, 20 bp, human
gcgggtgcccccgactttcg

SEQ ID NO: 355795 - DNA, 20 bp, human
gtgccgggggaacgcgcggg

SEQ ID NO: 355796 - DNA, 20 bp, human
gagcgcgcggagtgtctggg

SEQ ID NO: 355797 - DNA, 20 bp, human
gactggctgccaattttggg

SEQ ID NO: 355798 - DNA, 20 bp, human
gcccaagctggcagcggatg

SEQ ID NO: 355799 - DNA, 20 bp, human
gagtctgtggctctcggtct

SEQ ID NO: 355800 - DNA, 20 bp, human
gcccaaggaaggcggaggat

SEQ ID NO: 355801 - DNA, 20 bp, human
ggcgcccgaaaggggacaag

SEQ ID NO: 355802 - DNA, 20 bp, human
ggcgaccggcgaaagcagga

SEQ ID NO: 355803 - DNA, 20 bp, human
ggctgacatcccaaggaagg

SEQ ID NO: 355804 - DNA, 20 bp, human
gagggagcgcgcggagtgtc

SEQ ID NO: 355805 - DNA, 20 bp, human
gcgggcaagcaaaagcgcga

SEQ ID NO: 355806 - DNA, 20 bp, human
gaggggacgtggtggaggcg

SEQ ID NO: 355807 - DNA, 20 bp, human
ggagaggggcttatacgcga

SEQ ID NO: 355808 - DNA, 20 bp, human
ggaggctgggaccgcgggga

SEQ ID NO: 355809 - DNA, 20 bp, human
gcctggagaggctgggaccg

SEQ ID NO: 355810 - DNA, 20 bp, human
gagggccgaccgggagagtc

SEQ ID NO: 355811 - DNA, 20 bp, human
gcagagaagaagggccgacc

SEQ ID NO: 355812 - DNA, 20 bp, human
ggagaaggggacactgatca

SEQ ID NO: 355813 - DNA, 20 bp, human
gagcctctccaggcgctgct

SEQ ID NO: 355814 - DNA, 20 bp, human
ggggcagatccgcaggtgac

SEQ ID NO: 355815 - DNA, 20 bp, human
gtctgcccgactctcccggt

SEQ ID NO: 355816 - DNA, 20 bp, human
gtcctcaaggctccatgcac

SEQ ID NO: 355817 - DNA, 20 bp, human
gagagtgtcctggcaccagg

SEQ ID NO: 355818 - DNA, 20 bp, human
gccttgaggagaaacaggac

SEQ ID NO: 355819 - DNA, 20 bp, human
gaataatgtttccctgtggt

SEQ ID NO: 355820 - DNA, 20 bp, human
gtaagacaggtgacaggcat

SEQ ID NO: 355821 - DNA, 20 bp, human
gaccagtgcatggagccttg

SEQ ID NO: 355822 - DNA, 20 bp, human
ggggactgtgtctcttctct

SEQ ID NO: 355823 - DNA, 20 bp, human
gtctacctaagacaggtgac

SEQ ID NO: 355824 - DNA, 20 bp, human
ggcaggggccgagcaggcag

SEQ ID NO: 355825 - DNA, 20 bp, human
ggaactgaacagtcactggg

SEQ ID NO: 355826 - DNA, 20 bp, human
ggggaggggcagccaatcgt

SEQ ID NO: 355827 - DNA, 20 bp, human
gaggggcagccaatcgtagg

SEQ ID NO: 355828 - DNA, 20 bp, human
gccacccgccagggtagttc

SEQ ID NO: 355829 - DNA, 20 bp, human
gttccaacgccccctacgat

SEQ ID NO: 355830 - DNA, 20 bp, human
gcgccccacgtggccaatct

SEQ ID NO: 355831 - DNA, 20 bp, human
gccagccagaactaccctgg

SEQ ID NO: 355832 - DNA, 20 bp, human
gaggcttggaaggtcctcgg

SEQ ID NO: 355833 - DNA, 20 bp, human
gcctactcactgcacccctt

SEQ ID NO: 355834 - DNA, 20 bp, human
ggtgcagtgagtaggatgac

SEQ ID NO: 355835 - DNA, 20 bp, human
gttggaaggtcctcgggggt

SEQ ID NO: 355836 - DNA, 20 bp, human
ggacacatgcagtctgaaac

SEQ ID NO: 355837 - DNA, 20 bp, human
ggctcagagaagtaaggtgg

SEQ ID NO: 355838 - DNA, 20 bp, human
gagaactaacctttagtcac

SEQ ID NO: 355839 - DNA, 20 bp, human
gtagtcactgggtgacttta

SEQ ID NO: 355840 - DNA, 20 bp, human
gagacacttgaacatatctt

SEQ ID NO: 355841 - DNA, 20 bp, human
ggtgactttatgggagtaaa

SEQ ID NO: 355842 - DNA, 20 bp, human
gacgaattgtatttcagcaa

SEQ ID NO: 355843 - DNA, 20 bp, human
gtgggagagagttaaaaaca

SEQ ID NO: 355844 - DNA, 20 bp, human
gctgtttgctaaagcatacg

SEQ ID NO: 355845 - DNA, 20 bp, human
gtgaacatatcttaggtttc

SEQ ID NO: 355846 - DNA, 20 bp, human
gctaggaactggtttgcttc

SEQ ID NO: 355847 - DNA, 20 bp, human
ggagagaaatgcttgtgtac

SEQ ID NO: 355848 - DNA, 20 bp, human
gtgcagagcatgctaggaac

SEQ ID NO: 355849 - DNA, 20 bp, human
gtgcaagggaaaccttcatg

SEQ ID NO: 355850 - DNA, 20 bp, human
gactggtgaagtactttttc

SEQ ID NO: 355851 - DNA, 20 bp, human
gtgagggttaaaagttgtct

SEQ ID NO: 355852 - DNA, 20 bp, human
gtgtgaaatcttcctcatga

SEQ ID NO: 355853 - DNA, 20 bp, human
ggagaaagttgttattgtgc

SEQ ID NO: 355854 - DNA, 20 bp, human
gtggtgactcagcataacgc

SEQ ID NO: 355855 - DNA, 20 bp, human
gctggtgattagcatcacca

SEQ ID NO: 355856 - DNA, 20 bp, human
gggattatggcaaacccaag

SEQ ID NO: 355857 - DNA, 20 bp, human
gtgtctgggtgggccatgac

SEQ ID NO: 355858 - DNA, 20 bp, human
gctcccgcactaatcctctt

SEQ ID NO: 355859 - DNA, 20 bp, human
ggggttacacggattgttcc

SEQ ID NO: 355860 - DNA, 20 bp, human
gtgttggagctcaggaggct

SEQ ID NO: 355861 - DNA, 20 bp, human
gaacaccaggtcctgagtgg

SEQ ID NO: 355862 - DNA, 20 bp, human
gcataatccagctccctctg

SEQ ID NO: 355863 - DNA, 20 bp, human
gaagaaggaggacccttcga

SEQ ID NO: 355864 - DNA, 20 bp, human
gaacccaagaggattagtgc

SEQ ID NO: 355865 - DNA, 20 bp, human
gtgggccatgacaggcctgc

SEQ ID NO: 355866 - DNA, 20 bp, human
gctgcgcggcctatgaagag

SEQ ID NO: 355867 - DNA, 20 bp, human
gtggctgcgctgggtcgtca

SEQ ID NO: 355868 - DNA, 20 bp, human
ggggcctggcgggcaaacta

SEQ ID NO: 355869 - DNA, 20 bp, human
gacaaccccgcccacagctg

SEQ ID NO: 355870 - DNA, 20 bp, human
gcaggcgtggattggtatgt

SEQ ID NO: 355871 - DNA, 20 bp, human
gccgcgcaggattgctcgag

SEQ ID NO: 355872 - DNA, 20 bp, human
gtcgtcagggcgacgaaaaa

SEQ ID NO: 355873 - DNA, 20 bp, human
ggcaggagccaggcgtggat

SEQ ID NO: 355874 - DNA, 20 bp, human
ggggcgacgaaaaaggggaa

SEQ ID NO: 355875 - DNA, 20 bp, human
ggattggtatgtgggtatgt

SEQ ID NO: 355876 - DNA, 20 bp, human
gacccggagcccctgacttg

SEQ ID NO: 355877 - DNA, 20 bp, human
gtggccgggcgggaacctcc

SEQ ID NO: 355878 - DNA, 20 bp, human
ggcgtcgggccccaagtcag

SEQ ID NO: 355879 - DNA, 20 bp, human
ggccccgcaactcaccccgg

SEQ ID NO: 355880 - DNA, 20 bp, human
ggggccgccggggtgagttg

SEQ ID NO: 355881 - DNA, 20 bp, human
gcaggcgggctgctgcgggt

SEQ ID NO: 355882 - DNA, 20 bp, human
ggatccccgcctccccgcgt

SEQ ID NO: 355883 - DNA, 20 bp, human
ggcggggcgaggcgctagtt

SEQ ID NO: 355884 - DNA, 20 bp, human
gggccccaagtcaggggctc

SEQ ID NO: 355885 - DNA, 20 bp, human
ggtggccgaggctgagactt

SEQ ID NO: 355886 - DNA, 20 bp, human
gcccgcgccaggcctcgctt

SEQ ID NO: 355887 - DNA, 20 bp, human
gctcgcttgggaccatgggt

SEQ ID NO: 355888 - DNA, 20 bp, human
gcgcgcctcggccaatgcgg

SEQ ID NO: 355889 - DNA, 20 bp, human
gaggcctcgcttgggaccat

SEQ ID NO: 355890 - DNA, 20 bp, human
gtggcgcgggacgccggacg

SEQ ID NO: 355891 - DNA, 20 bp, human
gcgctacgcagccgccgcat

SEQ ID NO: 355892 - DNA, 20 bp, human
ggaccatgggtgggtcacgt

SEQ ID NO: 355893 - DNA, 20 bp, human
ggagaccagggcgcagttcc

SEQ ID NO: 355894 - DNA, 20 bp, human
gcgccacggtgccaagctca

SEQ ID NO: 355895 - DNA, 20 bp, human
gcagctcctggcgcgcccct

SEQ ID NO: 355896 - DNA, 20 bp, human
ggaagtcgcgcacttgacga

SEQ ID NO: 355897 - DNA, 20 bp, human
gactagcggaagcaaggggc

SEQ ID NO: 355898 - DNA, 20 bp, human
gttggctccaaaagcctccg

SEQ ID NO: 355899 - DNA, 20 bp, human
gtcgcgcacttgacgagggt

SEQ ID NO: 355900 - DNA, 20 bp, human
gccgcactagcggaagcaag

SEQ ID NO: 355901 - DNA, 20 bp, human
ggtgccgattctccccagtg

SEQ ID NO: 355902 - DNA, 20 bp, human
gacctgagcacgccgaacaa

SEQ ID NO: 355903 - DNA, 20 bp, human
gttttctggagcatgggcag

SEQ ID NO: 355904 - DNA, 20 bp, human
gtacgcgttttctggagcat

SEQ ID NO: 355905 - DNA, 20 bp, human
ggcaaaaccctccgcactag

SEQ ID NO: 355906 - DNA, 20 bp, human
ggcgctgtctctgaaagggg

SEQ ID NO: 355907 - DNA, 20 bp, human
gagaaggggctggatgagtc

SEQ ID NO: 355908 - DNA, 20 bp, human
gtgagtccggaagtggagat

SEQ ID NO: 355909 - DNA, 20 bp, human
gcgccccgcgggtgtctatg

SEQ ID NO: 355910 - DNA, 20 bp, human
ggaagtggggtgtgaagctc

SEQ ID NO: 355911 - DNA, 20 bp, human
gatcgcgctgtctctgaaag

SEQ ID NO: 355912 - DNA, 20 bp, human
gcccggaagttgacagatac

SEQ ID NO: 355913 - DNA, 20 bp, human
ggtgacttgaccccggaagt

SEQ ID NO: 355914 - DNA, 20 bp, human
gatcgcagaaaggtagtctc

SEQ ID NO: 355915 - DNA, 20 bp, human
gggaggcgggacttggatag

SEQ ID NO: 355916 - DNA, 20 bp, human
gcatctgcttccagccagtc

SEQ ID NO: 355917 - DNA, 20 bp, human
gcaacagggctcccctcgtg

SEQ ID NO: 355918 - DNA, 20 bp, human
gatgcgatcaggtgagaagg

SEQ ID NO: 355919 - DNA, 20 bp, human
ggcttccagccagtcagggt

SEQ ID NO: 355920 - DNA, 20 bp, human
gtctaaaagtcccacacgag

SEQ ID NO: 355921 - DNA, 20 bp, human
gattatgcgatcaggtgaga

SEQ ID NO: 355922 - DNA, 20 bp, human
ggtagcaaccactgacacac

SEQ ID NO: 355923 - DNA, 20 bp, human
ggaaggtggccgaccctgac

SEQ ID NO: 355924 - DNA, 20 bp, human
gatccttccctgtgtgtcag

SEQ ID NO: 355925 - DNA, 20 bp, human
gagggaaggattatgcgatc

SEQ ID NO: 355926 - DNA, 20 bp, human
gccagcccgacctgcactga

SEQ ID NO: 355927 - DNA, 20 bp, human
gtggcctcacgcatttcgct

SEQ ID NO: 355928 - DNA, 20 bp, human
gaggccagcccaccaagcag

SEQ ID NO: 355929 - DNA, 20 bp, human
gtccgggtgcagaccgcgaa

SEQ ID NO: 355930 - DNA, 20 bp, human
gcaagcaggggcgtcaccaa

SEQ ID NO: 355931 - DNA, 20 bp, human
ggggtctgtgcgcgcctcca

SEQ ID NO: 355932 - DNA, 20 bp, human
gggacgagaagtcaacataa

SEQ ID NO: 355933 - DNA, 20 bp, human
gaagtcttgagggaaagttc

SEQ ID NO: 355934 - DNA, 20 bp, human
gacctccctcagtgcaggtc

SEQ ID NO: 355935 - DNA, 20 bp, human
gaggctcgtgccaggtcggg

SEQ ID NO: 355936 - DNA, 20 bp, human
gatggtatagagcttacgtg

SEQ ID NO: 355937 - DNA, 20 bp, human
gggaagctggaatctggcgg

SEQ ID NO: 355938 - DNA, 20 bp, human
gaatgctccgagataagacc

SEQ ID NO: 355939 - DNA, 20 bp, human
gtggtgagcgcggtgctgcg

SEQ ID NO: 355940 - DNA, 20 bp, human
ggcctctcccggtcttatct

SEQ ID NO: 355941 - DNA, 20 bp, human
gtccgagataagaccgggag

SEQ ID NO: 355942 - DNA, 20 bp, human
gtgcagcggactggtgagcg

SEQ ID NO: 355943 - DNA, 20 bp, human
gaaaaaaaggatgtgtgttc

SEQ ID NO: 355944 - DNA, 20 bp, human
gtcttatctcggagcattct

SEQ ID NO: 355945 - DNA, 20 bp, human
gagctggaatctggcggcgg

SEQ ID NO: 355946 - DNA, 20 bp, human
gcgcgtgcgggctgcatcag

SEQ ID NO: 355947 - DNA, 20 bp, human
gcggccccaagccctcagta

SEQ ID NO: 355948 - DNA, 20 bp, human
gcacctaggcgagcaggaat

SEQ ID NO: 355949 - DNA, 20 bp, human
gcgagtcagcccggtcctca

SEQ ID NO: 355950 - DNA, 20 bp, human
gcggcggctgggagaggcga

SEQ ID NO: 355951 - DNA, 20 bp, human
gtgactcgcgcccctactga

SEQ ID NO: 355952 - DNA, 20 bp, human
gtggccggtaagtggagttg

SEQ ID NO: 355953 - DNA, 20 bp, human
ggggcctcggggcgagacgc

SEQ ID NO: 355954 - DNA, 20 bp, human
gagcgcgctgccctgaggac

SEQ ID NO: 355955 - DNA, 20 bp, human
ggagaggcgagggttctggc

SEQ ID NO: 355956 - DNA, 20 bp, human
gtctgcgcgcgctcaagccc

SEQ ID NO: 355957 - DNA, 20 bp, human
gcgctcaagcccaggctaaa

SEQ ID NO: 355958 - DNA, 20 bp, human
gaagcccaggctaaaggggg

SEQ ID NO: 355959 - DNA, 20 bp, human
gagctggttccatcctgaga

SEQ ID NO: 355960 - DNA, 20 bp, human
gtaccctcaagccaccaagc

SEQ ID NO: 355961 - DNA, 20 bp, human
gaaactgtttaagggagtcc

SEQ ID NO: 355962 - DNA, 20 bp, human
gtagggattaaactgtttaa

SEQ ID NO: 355963 - DNA, 20 bp, human
gttgccaaccagtacttaaa

SEQ ID NO: 355964 - DNA, 20 bp, human
gaaaaccttgaatatttccc

SEQ ID NO: 355965 - DNA, 20 bp, human
ggagataacccaaaaactgc

SEQ ID NO: 355966 - DNA, 20 bp, human
gccgccccgccccaggcgga

SEQ ID NO: 355967 - DNA, 20 bp, human
gaccggaagcagccactctg

SEQ ID NO: 355968 - DNA, 20 bp, human
ggctgtcagccgtccgcctg

SEQ ID NO: 355969 - DNA, 20 bp, human
gcggaagcctgtacggagaa

SEQ ID NO: 355970 - DNA, 20 bp, human
gtcagccgtccgcctggggc

SEQ ID NO: 355971 - DNA, 20 bp, human
ggaagtcccgcctcctcctg

SEQ ID NO: 355972 - DNA, 20 bp, human
gaagcagccactctgcggtg

SEQ ID NO: 355973 - DNA, 20 bp, human
gctagagcgtcaccccgatt

SEQ ID NO: 355974 - DNA, 20 bp, human
gagcctgtacggagaagggg

SEQ ID NO: 355975 - DNA, 20 bp, human
gggacttcctcaccgcagag

SEQ ID NO: 355976 - DNA, 20 bp, human
gccccctccctcagctgaag

SEQ ID NO: 355977 - DNA, 20 bp, human
gaaggcacagaggtattagg

SEQ ID NO: 355978 - DNA, 20 bp, human
gctgatgcttggctttattt

SEQ ID NO: 355979 - DNA, 20 bp, human
gtgggaaggattgaggtctc

SEQ ID NO: 355980 - DNA, 20 bp, human
gggaccttggcaccattctc

SEQ ID NO: 355981 - DNA, 20 bp, human
ggggtgactgggatcagctc

SEQ ID NO: 355982 - DNA, 20 bp, human
gccaccccttcagctgaggg

SEQ ID NO: 355983 - DNA, 20 bp, human
gtgttcccataacagttgtt

SEQ ID NO: 355984 - DNA, 20 bp, human
ggccccagagaatggtgcca

SEQ ID NO: 355985 - DNA, 20 bp, human
gggtgggagtggccagcgtc

SEQ ID NO: 355986 - DNA, 20 bp, human
gttgcgaccccggaagtaaa

SEQ ID NO: 355987 - DNA, 20 bp, human
gggaagtaaaaggttaagga

SEQ ID NO: 355988 - DNA, 20 bp, human
gtacagagtaagacatggta

SEQ ID NO: 355989 - DNA, 20 bp, human
gctgggcacatagatgcgca

SEQ ID NO: 355990 - DNA, 20 bp, human
gcaacaacaaaaaccgtgcc

SEQ ID NO: 355991 - DNA, 20 bp, human
ggtcaaaaactttgcgaccc

SEQ ID NO: 355992 - DNA, 20 bp, human
ggctttactattttcttgaa

SEQ ID NO: 355993 - DNA, 20 bp, human
gttagtttacgttttacttg

SEQ ID NO: 355994 - DNA, 20 bp, human
gacgtaaactaatccaggca

SEQ ID NO: 355995 - DNA, 20 bp, human
gcaagaaaatagtaaagctg

SEQ ID NO: 355996 - DNA, 20 bp, human
gccggggacggcctcgtaga

SEQ ID NO: 355997 - DNA, 20 bp, human
gcgctggcggccatcttgat

SEQ ID NO: 355998 - DNA, 20 bp, human
gagagggcgtctagaggcgc

SEQ ID NO: 355999 - DNA, 20 bp, human
gcctctagacgccctctacg

SEQ ID NO: 356000 - DNA, 20 bp, human
gggcgcgattccaatcaaga

SEQ ID NO: 356001 - DNA, 20 bp, human
ggcgcgtaacgccacttccg

SEQ ID NO: 356002 - DNA, 20 bp, human
gccggcgcacgtaatcgccg

SEQ ID NO: 356003 - DNA, 20 bp, human
gacgaggccgtccccggaag

SEQ ID NO: 356004 - DNA, 20 bp, human
gtaactccaggaaagagccg

SEQ ID NO: 356005 - DNA, 20 bp, human
gccccctggttaagagttgc

SEQ ID NO: 356006 - DNA, 20 bp, human
ggcaggctcaggcacagcgg

SEQ ID NO: 356007 - DNA, 20 bp, human
gacgccgcgcagtgatgctg

SEQ ID NO: 356008 - DNA, 20 bp, human
gcgggtggctggtaaggggc

SEQ ID NO: 356009 - DNA, 20 bp, human
gcagccgctacgggcaacgg

SEQ ID NO: 356010 - DNA, 20 bp, human
ggggacaggcgccgttgggg

SEQ ID NO: 356011 - DNA, 20 bp, human
gggagcttgggaatgcaagg

SEQ ID NO: 356012 - DNA, 20 bp, human
gactccacagcatcactgcg

SEQ ID NO: 356013 - DNA, 20 bp, human
ggtggccgcctctctgctcc

SEQ ID NO: 356014 - DNA, 20 bp, human
gccgctacgggcaacggggg

SEQ ID NO: 356015 - DNA, 20 bp, human
gtggacctccaacggcacaa

SEQ ID NO: 356016 - DNA, 20 bp, human
gacacccaccctggcctgga

SEQ ID NO: 356017 - DNA, 20 bp, human
gagcttcagatcctcatttt

SEQ ID NO: 356018 - DNA, 20 bp, human
gttatgcttctgaagtatgt

SEQ ID NO: 356019 - DNA, 20 bp, human
gctagaagtcagaatggagt

SEQ ID NO: 356020 - DNA, 20 bp, human
gcctggcctggatggaggat

SEQ ID NO: 356021 - DNA, 20 bp, human
gacattaattaaaccttagt

SEQ ID NO: 356022 - DNA, 20 bp, human
gctacagaatttcacatttc

SEQ ID NO: 356023 - DNA, 20 bp, human
gtcagatcctcattttgggc

SEQ ID NO: 356024 - DNA, 20 bp, human
gatacttcagaagcataaac

SEQ ID NO: 356025 - DNA, 20 bp, human
gcccatcttcacacccaccc

SEQ ID NO: 356026 - DNA, 20 bp, human
gtgactaaagaaagccatca

SEQ ID NO: 356027 - DNA, 20 bp, human
gctgacagcttgatacaata

SEQ ID NO: 356028 - DNA, 20 bp, human
gacagcttgatacaataggg

SEQ ID NO: 356029 - DNA, 20 bp, human
gtatgtatcaagaccttctc

SEQ ID NO: 356030 - DNA, 20 bp, human
gcgttggtgaaggtagatgg

SEQ ID NO: 356031 - DNA, 20 bp, human
gtgaaggtagatggaggcat

SEQ ID NO: 356032 - DNA, 20 bp, human
ggcctgccggattagaaatg

SEQ ID NO: 356033 - DNA, 20 bp, human
gttgggaaatggatatgact

SEQ ID NO: 356034 - DNA, 20 bp, human
gaagaccttctcaggcctgc

SEQ ID NO: 356035 - DNA, 20 bp, human
gcaccgttggtgaaggtaga

SEQ ID NO: 356036 - DNA, 20 bp, human
gagggagaatagctccagac

SEQ ID NO: 356037 - DNA, 20 bp, human
gtagcacaggagaatttccc

SEQ ID NO: 356038 - DNA, 20 bp, human
ggcgccacgggatttagcac

SEQ ID NO: 356039 - DNA, 20 bp, human
ggcaaacaggctagagtcca

SEQ ID NO: 356040 - DNA, 20 bp, human
gtctcctgtgctaaatcccg

SEQ ID NO: 356041 - DNA, 20 bp, human
gactacgctcttccagctgt

SEQ ID NO: 356042 - DNA, 20 bp, human
ggaacgagagcgcgaagcta

SEQ ID NO: 356043 - DNA, 20 bp, human
gtcttccagctgtcggacct

SEQ ID NO: 356044 - DNA, 20 bp, human
ggcgacacccgcgagcgcca

SEQ ID NO: 356045 - DNA, 20 bp, human
gaagcgcaccccgactgccg

SEQ ID NO: 356046 - DNA, 20 bp, human
ggaaacggcaaccaggggat

SEQ ID NO: 356047 - DNA, 20 bp, human
ggtgctgaccgccaatcccc

SEQ ID NO: 356048 - DNA, 20 bp, human
ggctaagatgccttggagga

SEQ ID NO: 356049 - DNA, 20 bp, human
gagatcccagctggtcgaaa

SEQ ID NO: 356050 - DNA, 20 bp, human
gtggtcgaaacggcaaccag

SEQ ID NO: 356051 - DNA, 20 bp, human
ggtgcctggagaaagaaagg

SEQ ID NO: 356052 - DNA, 20 bp, human
ggggtgggaagcgaacccct

SEQ ID NO: 356053 - DNA, 20 bp, human
ggcaccgcacacataaatca

SEQ ID NO: 356054 - DNA, 20 bp, human
gcagcgctaagatgccttgg

SEQ ID NO: 356055 - DNA, 20 bp, human
gcaaagccctgtgtgagcaa

SEQ ID NO: 356056 - DNA, 20 bp, human
gcccagctggagccaaacca

SEQ ID NO: 356057 - DNA, 20 bp, human
gtgggacgcttcctcttaga

SEQ ID NO: 356058 - DNA, 20 bp, human
gactacgtgactggggtacg

SEQ ID NO: 356059 - DNA, 20 bp, human
gccaaaaggggccccactcc

SEQ ID NO: 356060 - DNA, 20 bp, human
gcgtgactggggtacgtggt

SEQ ID NO: 356061 - DNA, 20 bp, human
gccaccactgctgcctgtaa

SEQ ID NO: 356062 - DNA, 20 bp, human
gaagagggctgccctctaag

SEQ ID NO: 356063 - DNA, 20 bp, human
gtcctcgtggatgtctggta

SEQ ID NO: 356064 - DNA, 20 bp, human
gggtacctcgaggagggcaa

SEQ ID NO: 356065 - DNA, 20 bp, human
gtgaagagccacacccaaaa

SEQ ID NO: 356066 - DNA, 20 bp, human
gccgtcgcggagagcattat

SEQ ID NO: 356067 - DNA, 20 bp, human
ggggaagtgtacttaggcca

SEQ ID NO: 356068 - DNA, 20 bp, human
gggattggtagtccagactg

SEQ ID NO: 356069 - DNA, 20 bp, human
gccagactgaggcgcagata

SEQ ID NO: 356070 - DNA, 20 bp, human
ggccaagacccgcccgtaga

SEQ ID NO: 356071 - DNA, 20 bp, human
gaagtgccggagcccgtcgc

SEQ ID NO: 356072 - DNA, 20 bp, human
gctgctgcgcgggtcttgct

SEQ ID NO: 356073 - DNA, 20 bp, human
ggcggagagcattatgggat

SEQ ID NO: 356074 - DNA, 20 bp, human
gtaagcgaccagatttccgg

SEQ ID NO: 356075 - DNA, 20 bp, human
gtctgcgtgccctgctgcgc

SEQ ID NO: 356076 - DNA, 20 bp, human
gggcggccagctgacgaatg

SEQ ID NO: 356077 - DNA, 20 bp, human
gcgggcgcaagcgccaagag

SEQ ID NO: 356078 - DNA, 20 bp, human
gccaagagcggctgcgtcta

SEQ ID NO: 356079 - DNA, 20 bp, human
gcgcagatcagagaggtgac

SEQ ID NO: 356080 - DNA, 20 bp, human
ggagtcctgtcgaagacggg

SEQ ID NO: 356081 - DNA, 20 bp, human
gcgggcttctcgcgaccatg

SEQ ID NO: 356082 - DNA, 20 bp, human
gcgtcttcgacaggactcta

SEQ ID NO: 356083 - DNA, 20 bp, human
gcatgtgctgggctacgccc

SEQ ID NO: 356084 - DNA, 20 bp, human
ggtcgcgagaagcccgcttc

SEQ ID NO: 356085 - DNA, 20 bp, human
ggagaggtgaccgggtacca

SEQ ID NO: 356086 - DNA, 20 bp, human
gaggactgcgacaactctgt

SEQ ID NO: 356087 - DNA, 20 bp, human
gcgaatcggcacattaccgg

SEQ ID NO: 356088 - DNA, 20 bp, human
ggaacccagccgcttcccta

SEQ ID NO: 356089 - DNA, 20 bp, human
gcgctgctgctggaccccta

SEQ ID NO: 356090 - DNA, 20 bp, human
ggcccagcgacgccccccag

SEQ ID NO: 356091 - DNA, 20 bp, human
gactctgtgggttaccgcgc

SEQ ID NO: 356092 - DNA, 20 bp, human
gggcccacccaaccgctctg

SEQ ID NO: 356093 - DNA, 20 bp, human
ggccccccagcggccagaga

SEQ ID NO: 356094 - DNA, 20 bp, human
gagagaaggccgcgcttctc

SEQ ID NO: 356095 - DNA, 20 bp, human
gcgtcgctgggccgctaggc

SEQ ID NO: 356096 - DNA, 20 bp, human
gcgtccctgcgtctctggtt

SEQ ID NO: 356097 - DNA, 20 bp, human
gtaagcgcgccacttggcgc

SEQ ID NO: 356098 - DNA, 20 bp, human
gcgtcccaaccagagacgca

SEQ ID NO: 356099 - DNA, 20 bp, human
ggctgtgggtagactccccc

SEQ ID NO: 356100 - DNA, 20 bp, human
gcatcctcctcaggactcta

SEQ ID NO: 356101 - DNA, 20 bp, human
gtccccctggcggccaggga

SEQ ID NO: 356102 - DNA, 20 bp, human
ggaagcagcagctgtgcagt

SEQ ID NO: 356103 - DNA, 20 bp, human
ggactctatggttcccgcga

SEQ ID NO: 356104 - DNA, 20 bp, human
gcccaagatggctagcagaa

SEQ ID NO: 356105 - DNA, 20 bp, human
gaagagttcctagcccaaga

SEQ ID NO: 356106 - DNA, 20 bp, human
gtggctagcactacccacaa

SEQ ID NO: 356107 - DNA, 20 bp, human
ggaccaccagctcgtgacac

SEQ ID NO: 356108 - DNA, 20 bp, human
gtagccactgcaggcgacgc

SEQ ID NO: 356109 - DNA, 20 bp, human
gggcgacgctggctgaagac

SEQ ID NO: 356110 - DNA, 20 bp, human
gaaccacagagatgaagacg

SEQ ID NO: 356111 - DNA, 20 bp, human
gtggctgaagaccgggatct

SEQ ID NO: 356112 - DNA, 20 bp, human
ggggagaagccgacgctgca

SEQ ID NO: 356113 - DNA, 20 bp, human
gggaggagagaacgtcctca

SEQ ID NO: 356114 - DNA, 20 bp, human
ggggtagtgctagccactgc

SEQ ID NO: 356115 - DNA, 20 bp, human
gactcaaggacgtgctgatt

SEQ ID NO: 356116 - DNA, 20 bp, human
ggcacacaacaagtgctcga

SEQ ID NO: 356117 - DNA, 20 bp, human
gggcgcctgaggctgacggc

SEQ ID NO: 356118 - DNA, 20 bp, human
ggctccggagaagtctgaga

SEQ ID NO: 356119 - DNA, 20 bp, human
gggaatatgggaaacagcta

SEQ ID NO: 356120 - DNA, 20 bp, human
ggaagctagagattccgaaa

SEQ ID NO: 356121 - DNA, 20 bp, human
gatggcgacaagggcgtctc

SEQ ID NO: 356122 - DNA, 20 bp, human
gaggctgacggctggcaagc

SEQ ID NO: 356123 - DNA, 20 bp, human
gcgcctgcccacaacaaaca

SEQ ID NO: 356124 - DNA, 20 bp, human
ggctggcaagcagggcaccg

SEQ ID NO: 356125 - DNA, 20 bp, human
gactacggacccctcagggg

SEQ ID NO: 356126 - DNA, 20 bp, human
gcggccccgcaatgcactct

SEQ ID NO: 356127 - DNA, 20 bp, human
gcggggcggccgtgattcct

SEQ ID NO: 356128 - DNA, 20 bp, human
gcgccccgccgcattctcag

SEQ ID NO: 356129 - DNA, 20 bp, human
gagcggcaacatgtctgcga

SEQ ID NO: 356130 - DNA, 20 bp, human
gtgaagcgccggggcagtaa

SEQ ID NO: 356131 - DNA, 20 bp, human
gcaatcagagccccgaaagg

SEQ ID NO: 356132 - DNA, 20 bp, human
gagcgcccggcgcttctggt

SEQ ID NO: 356133 - DNA, 20 bp, human
gacggcggccctagggctgc

SEQ ID NO: 356134 - DNA, 20 bp, human
ggtctgcgacggcggcccta

SEQ ID NO: 356135 - DNA, 20 bp, human
gctgggccctgagtaaccga

SEQ ID NO: 356136 - DNA, 20 bp, human
gcccggcgagagatcacgtg

SEQ ID NO: 356137 - DNA, 20 bp, human
gcgtgcgcagagattcccca

SEQ ID NO: 356138 - DNA, 20 bp, human
gctgaccgcggaggtccaac

SEQ ID NO: 356139 - DNA, 20 bp, human
gggcacagcgctgaccgcgg

SEQ ID NO: 356140 - DNA, 20 bp, human
ggtccaaccggaagaatgtc

SEQ ID NO: 356141 - DNA, 20 bp, human
ggccccacgtgatctctcgc

SEQ ID NO: 356142 - DNA, 20 bp, human
gatcacgtggggcgcggagg

SEQ ID NO: 356143 - DNA, 20 bp, human
gagagggcccgccttccctg

SEQ ID NO: 356144 - DNA, 20 bp, human
gaatgtccggattggacatt

SEQ ID NO: 356145 - DNA, 20 bp, human
gggattggacattcggaaga

SEQ ID NO: 356146 - DNA, 20 bp, human
ggggaaactcgaatgtgagt

SEQ ID NO: 356147 - DNA, 20 bp, human
gactgcaggtggtgacgggc

SEQ ID NO: 356148 - DNA, 20 bp, human
gaaagccaggtacttcacta

SEQ ID NO: 356149 - DNA, 20 bp, human
gccacccaccccactgaggt

SEQ ID NO: 356150 - DNA, 20 bp, human
gccacatgcactaccatctg

SEQ ID NO: 356151 - DNA, 20 bp, human
gaggtacttcactagggaga

SEQ ID NO: 356152 - DNA, 20 bp, human
gtgcatgtggagtcatctca

SEQ ID NO: 356153 - DNA, 20 bp, human
gcccatgggcccacctcagt

SEQ ID NO: 356154 - DNA, 20 bp, human
gcccttggaagtggggtttt

SEQ ID NO: 356155 - DNA, 20 bp, human
gtgtggagtcatctcatggt

SEQ ID NO: 356156 - DNA, 20 bp, human
gtgggaaaacatggcggagt

SEQ ID NO: 356157 - DNA, 20 bp, human
gcaagctcactgggaaaaca

SEQ ID NO: 356158 - DNA, 20 bp, human
gctggcgttaagttgctttt

SEQ ID NO: 356159 - DNA, 20 bp, human
gcacgcacgcaccaaccaat

SEQ ID NO: 356160 - DNA, 20 bp, human
gtcaaatggcatgcgaccaa

SEQ ID NO: 356161 - DNA, 20 bp, human
gaaaacatggcggagtcggc

SEQ ID NO: 356162 - DNA, 20 bp, human
gacgcgctcgcaagctcact

SEQ ID NO: 356163 - DNA, 20 bp, human
gcaccgacgtgagcaccgat

SEQ ID NO: 356164 - DNA, 20 bp, human
ggacgtgagcaccgattggt

SEQ ID NO: 356165 - DNA, 20 bp, human
ggaagaacgcaccgcccctg

SEQ ID NO: 356166 - DNA, 20 bp, human
gtctcgagaggtgagagagt

SEQ ID NO: 356167 - DNA, 20 bp, human
gcggcctcccagagcgtcat

SEQ ID NO: 356168 - DNA, 20 bp, human
gcgctcaggctcgaatcttg

SEQ ID NO: 356169 - DNA, 20 bp, human
ggcggccgcggcgccccact

SEQ ID NO: 356170 - DNA, 20 bp, human
gctcgaatcttgcggagcag

SEQ ID NO: 356171 - DNA, 20 bp, human
gagagttggcggcgaggtct

SEQ ID NO: 356172 - DNA, 20 bp, human
gtcggcagaactccgccacc

SEQ ID NO: 356173 - DNA, 20 bp, human
gtggcggagttctgccgagt

SEQ ID NO: 356174 - DNA, 20 bp, human
ggcggcctgggcgtctcgag

SEQ ID NO: 356175 - DNA, 20 bp, human
ggtcatgggacatgtagttc

SEQ ID NO: 356176 - DNA, 20 bp, human
gtcctcagatctcgtttctt

SEQ ID NO: 356177 - DNA, 20 bp, human
gaggaagagcggtggatttt

SEQ ID NO: 356178 - DNA, 20 bp, human
gaaaacgaattgcctactta

SEQ ID NO: 356179 - DNA, 20 bp, human
ggccgaagaaacgagatctg

SEQ ID NO: 356180 - DNA, 20 bp, human
gcaggagaaacactcacctc

SEQ ID NO: 356181 - DNA, 20 bp, human
gagggttgtagttctaggac

SEQ ID NO: 356182 - DNA, 20 bp, human
gaaaacagggttgtagttct

SEQ ID NO: 356183 - DNA, 20 bp, human
gcctgaaagtggtttgtaaa

SEQ ID NO: 356184 - DNA, 20 bp, human
gtaaccagagagatgacctg

SEQ ID NO: 356185 - DNA, 20 bp, human
ggaaaaatgcgctaactgaa

SEQ ID NO: 356186 - DNA, 20 bp, human
gcaaaggggtttctgtagag

SEQ ID NO: 356187 - DNA, 20 bp, human
ggaagcagtgctgtagttac

SEQ ID NO: 356188 - DNA, 20 bp, human
gcccttggtgggggaaagta

SEQ ID NO: 356189 - DNA, 20 bp, human
gcgcctggaagatccagcat

SEQ ID NO: 356190 - DNA, 20 bp, human
ggaaagcaagcccttggtgg

SEQ ID NO: 356191 - DNA, 20 bp, human
gtttctgtagagcgggaggg

SEQ ID NO: 356192 - DNA, 20 bp, human
ggggtttctgtagagcggga

SEQ ID NO: 356193 - DNA, 20 bp, human
gcgtcgagtcattttacgcc

SEQ ID NO: 356194 - DNA, 20 bp, human
gaaagtgggtcatagcccga

SEQ ID NO: 356195 - DNA, 20 bp, human
gccggcgcccccaccagtgg

SEQ ID NO: 356196 - DNA, 20 bp, human
gggaagggccagcacgtcgg

SEQ ID NO: 356197 - DNA, 20 bp, human
gctgactagccgggcgataa

SEQ ID NO: 356198 - DNA, 20 bp, human
gaacaagcgcaacgtccaag

SEQ ID NO: 356199 - DNA, 20 bp, human
gcgcaacgtccaagagggaa

SEQ ID NO: 356200 - DNA, 20 bp, human
ggacccggcgggcccagtgt

SEQ ID NO: 356201 - DNA, 20 bp, human
gggcagagagcatagagcgc

SEQ ID NO: 356202 - DNA, 20 bp, human
gactgagaggccgtcggcgt

SEQ ID NO: 356203 - DNA, 20 bp, human
gcgagaacacggcctgggta

SEQ ID NO: 356204 - DNA, 20 bp, human
gagagaggcccccgacgtgc

SEQ ID NO: 356205 - DNA, 20 bp, human
gacgtcacatgggtgcgacg

SEQ ID NO: 356206 - DNA, 20 bp, human
gtctgcgcgcgcggcacgtc

SEQ ID NO: 356207 - DNA, 20 bp, human
ggcgcgcagacgctccgttg

SEQ ID NO: 356208 - DNA, 20 bp, human
gccagtcccggctgcaacta

SEQ ID NO: 356209 - DNA, 20 bp, human
gtgttccaccacgaccgcaa

SEQ ID NO: 356210 - DNA, 20 bp, human
ggccgcccctagttgcagcc

SEQ ID NO: 356211 - DNA, 20 bp, human
gaggcggaactttgagtagc

SEQ ID NO: 356212 - DNA, 20 bp, human
gtggacgtgcggcattgaga

SEQ ID NO: 356213 - DNA, 20 bp, human
gtcccggctgcaactagggg

SEQ ID NO: 356214 - DNA, 20 bp, human
gcgctccgttgcggtcgtgg

SEQ ID NO: 356215 - DNA, 20 bp, human
gacgaagtctcgctgaagag

SEQ ID NO: 356216 - DNA, 20 bp, human
ggaagtcagctggattgcgc

SEQ ID NO: 356217 - DNA, 20 bp, human
gtgcgcaggcggagtgagag

SEQ ID NO: 356218 - DNA, 20 bp, human
gtacagataaccacgtgatt

SEQ ID NO: 356219 - DNA, 20 bp, human
gtcactcatagcctccatat

SEQ ID NO: 356220 - DNA, 20 bp, human
gaaaaagtaccccttccgta

SEQ ID NO: 356221 - DNA, 20 bp, human
gtactagacatgcgcagcaa

SEQ ID NO: 356222 - DNA, 20 bp, human
gtaccactttccctacggaa

SEQ ID NO: 356223 - DNA, 20 bp, human
gcctcccattatctgcgaag

SEQ ID NO: 356224 - DNA, 20 bp, human
gttggctcacaactgtactg

SEQ ID NO: 356225 - DNA, 20 bp, human
gcgggcgttcggggggttgt

SEQ ID NO: 356226 - DNA, 20 bp, human
gacaaggcagcttccggcga

SEQ ID NO: 356227 - DNA, 20 bp, human
gcgtaagcgacttctttcta

SEQ ID NO: 356228 - DNA, 20 bp, human
gaaggcggtgacgcaaagga

SEQ ID NO: 356229 - DNA, 20 bp, human
gaggcagcttccggcgaagg

SEQ ID NO: 356230 - DNA, 20 bp, human
gttcccctcttgcgaaagaa

SEQ ID NO: 356231 - DNA, 20 bp, human
gcccttgaaggcccctttcc

SEQ ID NO: 356232 - DNA, 20 bp, human
gtgcccacggcgctgcctga

SEQ ID NO: 356233 - DNA, 20 bp, human
gagtgtcagcttgtgttggc

SEQ ID NO: 356234 - DNA, 20 bp, human
ggtgtcagacagcccggaaa

SEQ ID NO: 356235 - DNA, 20 bp, human
gccgcggcgcgcgccttaca

SEQ ID NO: 356236 - DNA, 20 bp, human
ggcaaaacgcgtcctctccc

SEQ ID NO: 356237 - DNA, 20 bp, human
gcgtggcaaagtgattagtg

SEQ ID NO: 356238 - DNA, 20 bp, human
gccactgcgaacgatcggag

SEQ ID NO: 356239 - DNA, 20 bp, human
gagaaaaggtggcggacgag

SEQ ID NO: 356240 - DNA, 20 bp, human
gctcttggttatgtacgata

SEQ ID NO: 356241 - DNA, 20 bp, human
gctgtcccactgcgaacgat

SEQ ID NO: 356242 - DNA, 20 bp, human
gcgcagtgggacagcccgcc

SEQ ID NO: 356243 - DNA, 20 bp, human
ggcagcgcgcaaggcacgca

SEQ ID NO: 356244 - DNA, 20 bp, human
gagcccaaagataaataaag

SEQ ID NO: 356245 - DNA, 20 bp, human
gcgcaaggcacgcagggtcc

SEQ ID NO: 356246 - DNA, 20 bp, human
ggccctgcagacggccacgc

SEQ ID NO: 356247 - DNA, 20 bp, human
gcggcacagcgccgccgagg

SEQ ID NO: 356248 - DNA, 20 bp, human
gtggatagcgtcctcctcct

SEQ ID NO: 356249 - DNA, 20 bp, human
gtcccgcgtggccgtctgca

SEQ ID NO: 356250 - DNA, 20 bp, human
gagcgcgatggcctcccgcg

SEQ ID NO: 356251 - DNA, 20 bp, human
ggtgcggcacagcgccgccg

SEQ ID NO: 356252 - DNA, 20 bp, human
gacctgcatgctgccgaaga

SEQ ID NO: 356253 - DNA, 20 bp, human
gtggaaatccacaagggcaa

SEQ ID NO: 356254 - DNA, 20 bp, human
ggccctgtgtcaccaggtcc

SEQ ID NO: 356255 - DNA, 20 bp, human
gacgctatccacgccctctt

SEQ ID NO: 356256 - DNA, 20 bp, human
gtgtgcccgcggaaagccga

SEQ ID NO: 356257 - DNA, 20 bp, human
gccggacgagagtaggccat

SEQ ID NO: 356258 - DNA, 20 bp, human
gtcccggaaaagaaagcggg

SEQ ID NO: 356259 - DNA, 20 bp, human
ggggcacacgcgggtggctg

SEQ ID NO: 356260 - DNA, 20 bp, human
ggcgctgaggccggtaaccc

SEQ ID NO: 356261 - DNA, 20 bp, human
gtgcgctgccggacgagagt

SEQ ID NO: 356262 - DNA, 20 bp, human
gggcctctacagttacctag

SEQ ID NO: 356263 - DNA, 20 bp, human
gcggatacggacgcacgcga

SEQ ID NO: 356264 - DNA, 20 bp, human
gtaggccatcggctttccgc

SEQ ID NO: 356265 - DNA, 20 bp, human
gccttgccctgattggaaag

SEQ ID NO: 356266 - DNA, 20 bp, human
gttagccctctctgcgaagt

SEQ ID NO: 356267 - DNA, 20 bp, human
gcgaggtgaggttttgtttc

SEQ ID NO: 356268 - DNA, 20 bp, human
gaagaggccggtttttgctc

SEQ ID NO: 356269 - DNA, 20 bp, human
gaactcccacttcgcagaga

SEQ ID NO: 356270 - DNA, 20 bp, human
gactgcacgacagatggtgg

SEQ ID NO: 356271 - DNA, 20 bp, human
ggggccctcgaaagtggcag

SEQ ID NO: 356272 - DNA, 20 bp, human
gataaggcagcgcccagagg

SEQ ID NO: 356273 - DNA, 20 bp, human
gaggtagaagcgcaagagat

SEQ ID NO: 356274 - DNA, 20 bp, human
gaccccactgccactttcga

SEQ ID NO: 356275 - DNA, 20 bp, human
gaagtcgattcaaaggacac

SEQ ID NO: 356276 - DNA, 20 bp, human
gaagctttagtgcctttgag

SEQ ID NO: 356277 - DNA, 20 bp, human
ggcgccactcctcccctcaa

SEQ ID NO: 356278 - DNA, 20 bp, human
gccccggagcagagccctca

SEQ ID NO: 356279 - DNA, 20 bp, human
gctttagtgcctttgagggg

SEQ ID NO: 356280 - DNA, 20 bp, human
gaggcactaaagcttcatgg

SEQ ID NO: 356281 - DNA, 20 bp, human
gccctctgggaacggtagtt

SEQ ID NO: 356282 - DNA, 20 bp, human
gttgcagagcggcgccctct

SEQ ID NO: 356283 - DNA, 20 bp, human
gctccaatgctcgttcccac

SEQ ID NO: 356284 - DNA, 20 bp, human
gggcgctcgggtctggtccc

SEQ ID NO: 356285 - DNA, 20 bp, human
gagcgaacgaattgggaaca

SEQ ID NO: 356286 - DNA, 20 bp, human
gcccagagggcctgccaaaa

SEQ ID NO: 356287 - DNA, 20 bp, human
gcaggagcatcgaaggatat

SEQ ID NO: 356288 - DNA, 20 bp, human
ggagaaccctccagcgcctc

SEQ ID NO: 356289 - DNA, 20 bp, human
gatgattacgtcatcaagga

SEQ ID NO: 356290 - DNA, 20 bp, human
gtaaggtcgctgcggggatg

SEQ ID NO: 356291 - DNA, 20 bp, human
gggtgtctacagccatgcca

SEQ ID NO: 356292 - DNA, 20 bp, human
gccagaggaagtcagctgtc

SEQ ID NO: 356293 - DNA, 20 bp, human
gaactcctctctgtcgtccc

SEQ ID NO: 356294 - DNA, 20 bp, human
ggaggtacggaggtaccctt

SEQ ID NO: 356295 - DNA, 20 bp, human
gtacgtcatcaaggagggcc

SEQ ID NO: 356296 - DNA, 20 bp, human
ggcagcacccgggtctcgga

SEQ ID NO: 356297 - DNA, 20 bp, human
ggaagggagacactaggacc

SEQ ID NO: 356298 - DNA, 20 bp, human
ggggcgcggagtttgagcga

SEQ ID NO: 356299 - DNA, 20 bp, human
ggtctcggaagggagacact

SEQ ID NO: 356300 - DNA, 20 bp, human
ggtgctgccgctgaatcctc

SEQ ID NO: 356301 - DNA, 20 bp, human
gtatggctagtgtcacctag

SEQ ID NO: 356302 - DNA, 20 bp, human
ggggagacactaggacctgg

SEQ ID NO: 356303 - DNA, 20 bp, human
gctctgggaagggtagtccc

SEQ ID NO: 356304 - DNA, 20 bp, human
gttgagcgaggggagtaaac

SEQ ID NO: 356305 - DNA, 20 bp, human
gggaggggacggtgagtgca

SEQ ID NO: 356306 - DNA, 20 bp, human
gcccggggccgccaggaatg

SEQ ID NO: 356307 - DNA, 20 bp, human
gtgtgtagggcctgcggtag

SEQ ID NO: 356308 - DNA, 20 bp, human
gccgtaggagcgaagtcgaa

SEQ ID NO: 356309 - DNA, 20 bp, human
gagtcgaatggcgcccccag

SEQ ID NO: 356310 - DNA, 20 bp, human
ggggccaggcacgggcagaa

SEQ ID NO: 356311 - DNA, 20 bp, human
gcggcacggaaactcacttc

SEQ ID NO: 356312 - DNA, 20 bp, human
gccctccgtgggcaccgtgg

SEQ ID NO: 356313 - DNA, 20 bp, human
ggcggcggccacaaacccgc

SEQ ID NO: 356314 - DNA, 20 bp, human
gcctgcttgtgtagggcctg

SEQ ID NO: 356315 - DNA, 20 bp, human
gttccggccctgcgcactca

SEQ ID NO: 356316 - DNA, 20 bp, human
ggggcggaagaagctcatga

SEQ ID NO: 356317 - DNA, 20 bp, human
gaaagcctgaagggcgggac

SEQ ID NO: 356318 - DNA, 20 bp, human
gaagctcatgagggaaacgc

SEQ ID NO: 356319 - DNA, 20 bp, human
ggccctcccagctcttccgt

SEQ ID NO: 356320 - DNA, 20 bp, human
ggtgctgagtctcgtgttgc

SEQ ID NO: 356321 - DNA, 20 bp, human
gcaccggggtgaaaggttag

SEQ ID NO: 356322 - DNA, 20 bp, human
gcgtggcaaagcctgaaggg

SEQ ID NO: 356323 - DNA, 20 bp, human
gcccggccgacggaagagct

SEQ ID NO: 356324 - DNA, 20 bp, human
gaagtgaggtcactcctcac

SEQ ID NO: 356325 - DNA, 20 bp, human
gccctcctagcgccagagaa

SEQ ID NO: 356326 - DNA, 20 bp, human
ggcggtgtacggtttcggtg

SEQ ID NO: 356327 - DNA, 20 bp, human
gccaccaggacactccgtga

SEQ ID NO: 356328 - DNA, 20 bp, human
gttggcagcccagacgaaaa

SEQ ID NO: 356329 - DNA, 20 bp, human
ggaagcccggcctctgtgac

SEQ ID NO: 356330 - DNA, 20 bp, human
ggtagggagtggatgactag

SEQ ID NO: 356331 - DNA, 20 bp, human
gggaagccccgaccatggta

SEQ ID NO: 356332 - DNA, 20 bp, human
gtggctcaagcaagcacggg

SEQ ID NO: 356333 - DNA, 20 bp, human
ggaaagaggaagcgactagc

SEQ ID NO: 356334 - DNA, 20 bp, human
ggccaagtctcgcgaggtat

SEQ ID NO: 356335 - DNA, 20 bp, human
ggggcaaaacgcctcacttc

SEQ ID NO: 356336 - DNA, 20 bp, human
ggaggcggctcgatgatgtt

SEQ ID NO: 356337 - DNA, 20 bp, human
gagggccgagagcgtattcc

SEQ ID NO: 356338 - DNA, 20 bp, human
gcatcatcgagccgcctcgg

SEQ ID NO: 356339 - DNA, 20 bp, human
gtcggaactcttcggttaga

SEQ ID NO: 356340 - DNA, 20 bp, human
ggagccactcggaaatccag

SEQ ID NO: 356341 - DNA, 20 bp, human
ggggaatattcggaactctt

SEQ ID NO: 356342 - DNA, 20 bp, human
ggtcccaggacctctcgaat

SEQ ID NO: 356343 - DNA, 20 bp, human
gatcgagccgcctcggaggt

SEQ ID NO: 356344 - DNA, 20 bp, human
ggaaaattcgctcaacgctc

SEQ ID NO: 356345 - DNA, 20 bp, human
gggttcccggaatacgctct

SEQ ID NO: 356346 - DNA, 20 bp, human
gagggaggaggcagcctgaa

SEQ ID NO: 356347 - DNA, 20 bp, human
ggtagcaccgcctccacgtc

SEQ ID NO: 356348 - DNA, 20 bp, human
ggcttgcctccgcccccttc

SEQ ID NO: 356349 - DNA, 20 bp, human
ggaacgcaagccagacgtgg

SEQ ID NO: 356350 - DNA, 20 bp, human
gcgcaagccagacgtggagg

SEQ ID NO: 356351 - DNA, 20 bp, human
gagtccttgagggatgttgt

SEQ ID NO: 356352 - DNA, 20 bp, human
gctactggaaaagcttcccc

SEQ ID NO: 356353 - DNA, 20 bp, human
ggaaatagggtcaacaacgc

SEQ ID NO: 356354 - DNA, 20 bp, human
ggaagaacgcaagccagacg

SEQ ID NO: 356355 - DNA, 20 bp, human
gtgcccaacaacatccctca

SEQ ID NO: 356356 - DNA, 20 bp, human
gtctgaacgaaagctaggag

SEQ ID NO: 356357 - DNA, 20 bp, human
gtgggtgagccacaaatcta

SEQ ID NO: 356358 - DNA, 20 bp, human
ggcggcagacgacaggtcgg

SEQ ID NO: 356359 - DNA, 20 bp, human
gacagaaattacacactcta

SEQ ID NO: 356360 - DNA, 20 bp, human
gcccgcggcagacgacaggt

SEQ ID NO: 356361 - DNA, 20 bp, human
gcggagaggtgggctaaggg

SEQ ID NO: 356362 - DNA, 20 bp, human
gccgcggagaggtgggctaa

SEQ ID NO: 356363 - DNA, 20 bp, human
gacactctacggcgaggggt

SEQ ID NO: 356364 - DNA, 20 bp, human
gaggagcggaagagcgtgcg

SEQ ID NO: 356365 - DNA, 20 bp, human
gcgcgctcgcacgccggaag

SEQ ID NO: 356366 - DNA, 20 bp, human
gctagctagaatggctgcgg

SEQ ID NO: 356367 - DNA, 20 bp, human
gaggggcggagcaaaagcgg

SEQ ID NO: 356368 - DNA, 20 bp, human
ggaaacagatcgcaagcaga

SEQ ID NO: 356369 - DNA, 20 bp, human
gtggctgcgggggccgtacg

SEQ ID NO: 356370 - DNA, 20 bp, human
gagagccggaactgcgggac

SEQ ID NO: 356371 - DNA, 20 bp, human
gagatcgcaagcagaagggg

SEQ ID NO: 356372 - DNA, 20 bp, human
gcacggcagagccggaactg

SEQ ID NO: 356373 - DNA, 20 bp, human
ggatggccggggaacgagaa

SEQ ID NO: 356374 - DNA, 20 bp, human
gttggtaccgctagctagaa

SEQ ID NO: 356375 - DNA, 20 bp, human
ggcggctgctgttggtgagt

SEQ ID NO: 356376 - DNA, 20 bp, human
gaggcaagggggtgtggcta

SEQ ID NO: 356377 - DNA, 20 bp, human
gaggcgagctatgatgtaag

SEQ ID NO: 356378 - DNA, 20 bp, human
gcagctagcaggcgtcgtgg

SEQ ID NO: 356379 - DNA, 20 bp, human
gcgaagtggggccagctagc

SEQ ID NO: 356380 - DNA, 20 bp, human
ggacgctgcagagtgagtat

SEQ ID NO: 356381 - DNA, 20 bp, human
gtaagcggcgcgcgccgaag

SEQ ID NO: 356382 - DNA, 20 bp, human
gagctcgcggcccaaaagcg

SEQ ID NO: 356383 - DNA, 20 bp, human
gttgaggtcccgcttctcga

SEQ ID NO: 356384 - DNA, 20 bp, human
gcacaatcccaaaggaggat

SEQ ID NO: 356385 - DNA, 20 bp, human
ggtggcggggccgcgctttt

SEQ ID NO: 356386 - DNA, 20 bp, human
gggcggaaatagcccaaaag

SEQ ID NO: 356387 - DNA, 20 bp, human
gtctacgtagtcccaaggat

SEQ ID NO: 356388 - DNA, 20 bp, human
gaaatagcccaaaagcggat

SEQ ID NO: 356389 - DNA, 20 bp, human
ggacaataataactaggaat

SEQ ID NO: 356390 - DNA, 20 bp, human
gaccactaagaggcgcactt

SEQ ID NO: 356391 - DNA, 20 bp, human
ggctaataagacctggtgga

SEQ ID NO: 356392 - DNA, 20 bp, human
gtaacccctgggtcctagca

SEQ ID NO: 356393 - DNA, 20 bp, human
gcttcggagtagaagaaacg

SEQ ID NO: 356394 - DNA, 20 bp, human
gttctcttctgaccactaag

SEQ ID NO: 356395 - DNA, 20 bp, human
gctgatgggtcgtaacccct

SEQ ID NO: 356396 - DNA, 20 bp, human
ggtgccgcccctctgtgggc

SEQ ID NO: 356397 - DNA, 20 bp, human
gcgacgcacctctccgacgt

SEQ ID NO: 356398 - DNA, 20 bp, human
gccacagaggggcggcacgt

SEQ ID NO: 356399 - DNA, 20 bp, human
gtggttgccgtacaacgtgg

SEQ ID NO: 356400 - DNA, 20 bp, human
gagggaaccaccacgttgta

SEQ ID NO: 356401 - DNA, 20 bp, human
gagagagtatccgtgttgta

SEQ ID NO: 356402 - DNA, 20 bp, human
gatctctgcccacgtcggag

SEQ ID NO: 356403 - DNA, 20 bp, human
gcgtcggcttccgtacaaca

SEQ ID NO: 356404 - DNA, 20 bp, human
gcgttggttgccgtacaacg

SEQ ID NO: 356405 - DNA, 20 bp, human
gaggccacgcagaaatctat

SEQ ID NO: 356406 - DNA, 20 bp, human
gaggcgagcactacaaggcg

SEQ ID NO: 356407 - DNA, 20 bp, human
gacgccgacctcgctatcag

SEQ ID NO: 356408 - DNA, 20 bp, human
gatcaggggtgccgtgaatg

SEQ ID NO: 356409 - DNA, 20 bp, human
ggtaccacggcgttcctcgg

SEQ ID NO: 356410 - DNA, 20 bp, human
ggctccggccctaccaggcg

SEQ ID NO: 356411 - DNA, 20 bp, human
gagctgggcgccagtagtct

SEQ ID NO: 356412 - DNA, 20 bp, human
gactgcccgccccgcctggt

SEQ ID NO: 356413 - DNA, 20 bp, human
ggaggtcggcgtcacggtgt

SEQ ID NO: 356414 - DNA, 20 bp, human
ggccaatggcgccgcagcgg

SEQ ID NO: 356415 - DNA, 20 bp, human
gaaccgaggcccaacgtggg

SEQ ID NO: 356416 - DNA, 20 bp, human
gtaccaagatgaaaggactt

SEQ ID NO: 356417 - DNA, 20 bp, human
gtggaaaggcgaaccctgag

SEQ ID NO: 356418 - DNA, 20 bp, human
ggtaagagtgctattgaatg

SEQ ID NO: 356419 - DNA, 20 bp, human
gcgtccccggacgccgtagg

SEQ ID NO: 356420 - DNA, 20 bp, human
gaagatgcctaaattgaggg

SEQ ID NO: 356421 - DNA, 20 bp, human
gctatggcaacgcacagctt

SEQ ID NO: 356422 - DNA, 20 bp, human
gttcctaagtcctttcatct

SEQ ID NO: 356423 - DNA, 20 bp, human
gcgggaacatcctccactca

SEQ ID NO: 356424 - DNA, 20 bp, human
gactacttgggaacaaggga

SEQ ID NO: 356425 - DNA, 20 bp, human
gcagctttggcggatttagc

SEQ ID NO: 356426 - DNA, 20 bp, human
ggaaccagtggaggtggcta

SEQ ID NO: 356427 - DNA, 20 bp, human
gctggagtcggaaccagtgg

SEQ ID NO: 356428 - DNA, 20 bp, human
ggagctggagtcggaaccag

SEQ ID NO: 356429 - DNA, 20 bp, human
gcgagcccgggagctggagt

SEQ ID NO: 356430 - DNA, 20 bp, human
ggggaagactccagccgcca

SEQ ID NO: 356431 - DNA, 20 bp, human
gggagtaaacgcgcatgctc

SEQ ID NO: 356432 - DNA, 20 bp, human
gtgcagggtcggcccgaaat

SEQ ID NO: 356433 - DNA, 20 bp, human
ggcccgaaataggcggagtt

SEQ ID NO: 356434 - DNA, 20 bp, human
gaggtgatgtcgtcgatgca

SEQ ID NO: 356435 - DNA, 20 bp, human
gcggcacgcgctccccctgg

SEQ ID NO: 356436 - DNA, 20 bp, human
gcggctgagaggactcagtt

SEQ ID NO: 356437 - DNA, 20 bp, human
gggagcaatcatagagtgta

SEQ ID NO: 356438 - DNA, 20 bp, human
ggcgggcgggagcttaagga

SEQ ID NO: 356439 - DNA, 20 bp, human
gaggactcagttcggagccg

SEQ ID NO: 356440 - DNA, 20 bp, human
gaacgttgaaagctgcgggg

SEQ ID NO: 356441 - DNA, 20 bp, human
gcccgatcgcacttcctcat

SEQ ID NO: 356442 - DNA, 20 bp, human
gggtgagtggaccacccttt

SEQ ID NO: 356443 - DNA, 20 bp, human
gacgtagtggcgttcagtga

SEQ ID NO: 356444 - DNA, 20 bp, human
gagtcctctcagccgcccga

SEQ ID NO: 356445 - DNA, 20 bp, human
gaaggactccgcctaaaggg

SEQ ID NO: 356446 - DNA, 20 bp, human
gcggctgagaggactcagtt

SEQ ID NO: 356447 - DNA, 20 bp, human
gggagcaatcatagagtgta

SEQ ID NO: 356448 - DNA, 20 bp, human
ggcgggcgggagcttaagga

SEQ ID NO: 356449 - DNA, 20 bp, human
gaggactcagttcggagccg

SEQ ID NO: 356450 - DNA, 20 bp, human
gaacgttgaaagctgcgggg

SEQ ID NO: 356451 - DNA, 20 bp, human
gcccgatcgcacttcctcat

SEQ ID NO: 356452 - DNA, 20 bp, human
gggtgagtggaccacccttt

SEQ ID NO: 356453 - DNA, 20 bp, human
gacgtagtggcgttcagtga

SEQ ID NO: 356454 - DNA, 20 bp, human
gagtcctctcagccgcccga

SEQ ID NO: 356455 - DNA, 20 bp, human
gaaggactccgcctaaaggg

SEQ ID NO: 356456 - DNA, 20 bp, human
gacaacccgcaactgccccg

SEQ ID NO: 356457 - DNA, 20 bp, human
gacgcggcctcgcctcactc

SEQ ID NO: 356458 - DNA, 20 bp, human
ggtgtgccgcggggcagttg

SEQ ID NO: 356459 - DNA, 20 bp, human
gtctaaggggcgggccggag

SEQ ID NO: 356460 - DNA, 20 bp, human
gggagggccgcggtgtgccg

SEQ ID NO: 356461 - DNA, 20 bp, human
gggcccgccccttagaccgt

SEQ ID NO: 356462 - DNA, 20 bp, human
gcagttgcgggttgtcataa

SEQ ID NO: 356463 - DNA, 20 bp, human
gcaccaaccaacggtctaag

SEQ ID NO: 356464 - DNA, 20 bp, human
ggccgtctagggcccctgta

SEQ ID NO: 356465 - DNA, 20 bp, human
gactgccccgcggcacaccg

SEQ ID NO: 356466 - DNA, 20 bp, human
gcgtcgtcgtagtgtaggtg

SEQ ID NO: 356467 - DNA, 20 bp, human
gcggccgagaccagaaagac

SEQ ID NO: 356468 - DNA, 20 bp, human
ggcgtccgtcgtcgtagtgt

SEQ ID NO: 356469 - DNA, 20 bp, human
gcggatgggcgagtcttcgt

SEQ ID NO: 356470 - DNA, 20 bp, human
gggagtcccgcccgcctttc

SEQ ID NO: 356471 - DNA, 20 bp, human
gccgcaggaagtgcttccct

SEQ ID NO: 356472 - DNA, 20 bp, human
ggaggatgcggtaccaggca

SEQ ID NO: 356473 - DNA, 20 bp, human
gaagaggaggatgcggtacc

SEQ ID NO: 356474 - DNA, 20 bp, human
gcatccggtcgccagaaaac

SEQ ID NO: 356475 - DNA, 20 bp, human
gcggccctcagggtctaagc

SEQ ID NO: 356476 - DNA, 20 bp, human
gcctaggtccgagcccagaa

SEQ ID NO: 356477 - DNA, 20 bp, human
gggtgcgcaggcgcggtatt

SEQ ID NO: 356478 - DNA, 20 bp, human
gggtgcgggagaagaaaaca

SEQ ID NO: 356479 - DNA, 20 bp, human
ggcgcaggcgcggtattagg

SEQ ID NO: 356480 - DNA, 20 bp, human
gttaggcggacgagcggaag

SEQ ID NO: 356481 - DNA, 20 bp, human
gtacccagattcgcaaacta

SEQ ID NO: 356482 - DNA, 20 bp, human
gaggaagagacgcggtgcgc

SEQ ID NO: 356483 - DNA, 20 bp, human
ggagcggaagtggctggtag

SEQ ID NO: 356484 - DNA, 20 bp, human
ggcggcgacatggtgagtgt

SEQ ID NO: 356485 - DNA, 20 bp, human
ggacctaggtcgcggcgaca

SEQ ID NO: 356486 - DNA, 20 bp, human
gcctcccaacggaggaaact

SEQ ID NO: 356487 - DNA, 20 bp, human
gaagaggcgggggtcctagg

SEQ ID NO: 356488 - DNA, 20 bp, human
gggggcagggctgctgaaat

SEQ ID NO: 356489 - DNA, 20 bp, human
gggggtctgaggggttgcgg

SEQ ID NO: 356490 - DNA, 20 bp, human
gtgggtgagaaaggtaatct

SEQ ID NO: 356491 - DNA, 20 bp, human
gcactgccaggtgaaatctg

SEQ ID NO: 356492 - DNA, 20 bp, human
gcgcgtggagggtgtcgggg

SEQ ID NO: 356493 - DNA, 20 bp, human
gcaagcagcaaccggggaaa

SEQ ID NO: 356494 - DNA, 20 bp, human
gtgcagctccaagaatggaa

SEQ ID NO: 356495 - DNA, 20 bp, human
gcgaggatcaagactcatgt

SEQ ID NO: 356496 - DNA, 20 bp, human
gtgggcgggactaaccctaa

SEQ ID NO: 356497 - DNA, 20 bp, human
gtaaccctaagggagggcag

SEQ ID NO: 356498 - DNA, 20 bp, human
gtgcgctcccgtggcgccgt

SEQ ID NO: 356499 - DNA, 20 bp, human
gggtgcccctagcacactgc

SEQ ID NO: 356500 - DNA, 20 bp, human
ggcaccctgcttcgtaagtg

SEQ ID NO: 356501 - DNA, 20 bp, human
gccctgggggaacgcactta

SEQ ID NO: 356502 - DNA, 20 bp, human
gcttagaaggcgcttccgat

SEQ ID NO: 356503 - DNA, 20 bp, human
gctactttggcatttatcac

SEQ ID NO: 356504 - DNA, 20 bp, human
gggggcccggcagtgtgcta

SEQ ID NO: 356505 - DNA, 20 bp, human
ggcacactgccgggcccctg

SEQ ID NO: 356506 - DNA, 20 bp, human
gccccgagccacagctcagt

SEQ ID NO: 356507 - DNA, 20 bp, human
gtgagcctctggccccgcca

SEQ ID NO: 356508 - DNA, 20 bp, human
gcagtggggcgggaccgccc

SEQ ID NO: 356509 - DNA, 20 bp, human
gcacgcaggagtcggaccca

SEQ ID NO: 356510 - DNA, 20 bp, human
gctgtggctcggggagccgt

SEQ ID NO: 356511 - DNA, 20 bp, human
ggtgtcaccaagttgacttt

SEQ ID NO: 356512 - DNA, 20 bp, human
gtcctggctcgtgtgctcgc

SEQ ID NO: 356513 - DNA, 20 bp, human
gcggcggtggctcgatggga

SEQ ID NO: 356514 - DNA, 20 bp, human
ggaaccgccaatgcctccag

SEQ ID NO: 356515 - DNA, 20 bp, human
gctagcatccggggaaatcg

SEQ ID NO: 356516 - DNA, 20 bp, human
gagtggggcacccggagcca

SEQ ID NO: 356517 - DNA, 20 bp, human
gccccagggccatcgaggaa

SEQ ID NO: 356518 - DNA, 20 bp, human
gcctgggagaaggcccccac

SEQ ID NO: 356519 - DNA, 20 bp, human
gcccagccccagggccatcg

SEQ ID NO: 356520 - DNA, 20 bp, human
gtgggggccaaggtagccgg

SEQ ID NO: 356521 - DNA, 20 bp, human
gtgcctggccagtcctgtcc

SEQ ID NO: 356522 - DNA, 20 bp, human
gctggcactcctttcctcga

SEQ ID NO: 356523 - DNA, 20 bp, human
gctcccaggcagcggccaag

SEQ ID NO: 356524 - DNA, 20 bp, human
gtggggacagggcagacgag

SEQ ID NO: 356525 - DNA, 20 bp, human
gaccccctctgcctccaagt

SEQ ID NO: 356526 - DNA, 20 bp, human
gggcaaggtggggcggtcaa

SEQ ID NO: 356527 - DNA, 20 bp, human
gggaaggtgacatatacagc

SEQ ID NO: 356528 - DNA, 20 bp, human
gttgcggaataatccatagg

SEQ ID NO: 356529 - DNA, 20 bp, human
gacccctgacgtcgccggtc

SEQ ID NO: 356530 - DNA, 20 bp, human
gacaaacaggacttattgta

SEQ ID NO: 356531 - DNA, 20 bp, human
gtcttaggcggggcaaggtg

SEQ ID NO: 356532 - DNA, 20 bp, human
gtacctcgactcgcgagagt

SEQ ID NO: 356533 - DNA, 20 bp, human
ggagttggcctcgcccccta

SEQ ID NO: 356534 - DNA, 20 bp, human
gaagagactagactcactga

SEQ ID NO: 356535 - DNA, 20 bp, human
gcggctgaactgcgcagcag

SEQ ID NO: 356536 - DNA, 20 bp, human
ggaccctcttgtagaagggt

SEQ ID NO: 356537 - DNA, 20 bp, human
gcaagggcggggctacccaa

SEQ ID NO: 356538 - DNA, 20 bp, human
gcgtcctcatactaaatctg

SEQ ID NO: 356539 - DNA, 20 bp, human
gttcggaccctcttgtagaa

SEQ ID NO: 356540 - DNA, 20 bp, human
ggggtagccccgcccttggg

SEQ ID NO: 356541 - DNA, 20 bp, human
gggggcaaagggcgtgaaag

SEQ ID NO: 356542 - DNA, 20 bp, human
gtacccaatgggcgtaacag

SEQ ID NO: 356543 - DNA, 20 bp, human
gctcccaagaagcaatgcga

SEQ ID NO: 356544 - DNA, 20 bp, human
gggacctagaggtgcagacg

SEQ ID NO: 356545 - DNA, 20 bp, human
gtgggcgtaacagtggtttt

SEQ ID NO: 356546 - DNA, 20 bp, human
gaatgctcggggtatctcac

SEQ ID NO: 356547 - DNA, 20 bp, human
ggtatctcacaggatccgtg

SEQ ID NO: 356548 - DNA, 20 bp, human
gcgtgcggtgaggaggagca

SEQ ID NO: 356549 - DNA, 20 bp, human
gtcacaggatccgtgcggtg

SEQ ID NO: 356550 - DNA, 20 bp, human
ggtgacgtgtgaaagagaga

SEQ ID NO: 356551 - DNA, 20 bp, human
gtaccccgagcattggaacc

SEQ ID NO: 356552 - DNA, 20 bp, human
gtgtgaaagagagagggcgt

SEQ ID NO: 356553 - DNA, 20 bp, human
ggcgcagtatgtagcgcgga

SEQ ID NO: 356554 - DNA, 20 bp, human
gtctccaggttccaatgctc

SEQ ID NO: 356555 - DNA, 20 bp, human
gagagagggcgtcggccaca

SEQ ID NO: 356556 - DNA, 20 bp, human
gacagccagtcgaggcgcgg

SEQ ID NO: 356557 - DNA, 20 bp, human
gccggatctggggcatcatg

SEQ ID NO: 356558 - DNA, 20 bp, human
gccggtctataagcaatcat

SEQ ID NO: 356559 - DNA, 20 bp, human
gggaaagagaattaaggtcc

SEQ ID NO: 356560 - DNA, 20 bp, human
gcaggggtcggacatgtcca

SEQ ID NO: 356561 - DNA, 20 bp, human
gagagtggcgaagaaccgga

SEQ ID NO: 356562 - DNA, 20 bp, human
gcttgcaaggtaagaatcgc

SEQ ID NO: 356563 - DNA, 20 bp, human
gtcacttccttccggatctg

SEQ ID NO: 356564 - DNA, 20 bp, human
ggttcggatggcgaaggatt

SEQ ID NO: 356565 - DNA, 20 bp, human
ggaaccggagggagccacta

SEQ ID NO: 356566 - DNA, 20 bp, human
gaggctgcgctgacaggatt

SEQ ID NO: 356567 - DNA, 20 bp, human
gtccccatgaggctcgtcct

SEQ ID NO: 356568 - DNA, 20 bp, human
gttcccaggacgagcctcat

SEQ ID NO: 356569 - DNA, 20 bp, human
gtcagcgcagcctggggatt

SEQ ID NO: 356570 - DNA, 20 bp, human
gactccgggtcctaatcccc

SEQ ID NO: 356571 - DNA, 20 bp, human
gtcctgggaacattatgggg

SEQ ID NO: 356572 - DNA, 20 bp, human
gccgccgggcgggcgaagac

SEQ ID NO: 356573 - DNA, 20 bp, human
ggagaagccccacgactcat

SEQ ID NO: 356574 - DNA, 20 bp, human
ggctcgtcctgggaacatta

SEQ ID NO: 356575 - DNA, 20 bp, human
ggcaaagagtgctgacacct

SEQ ID NO: 356576 - DNA, 20 bp, human
gcggggaagagagactgcgg

SEQ ID NO: 356577 - DNA, 20 bp, human
gggcgctggggcgggtatga

SEQ ID NO: 356578 - DNA, 20 bp, human
gaaagctaaaaatcgaggcg

SEQ ID NO: 356579 - DNA, 20 bp, human
gaagagagactgcggcggga

SEQ ID NO: 356580 - DNA, 20 bp, human
gagatcgcgagagttgatac

SEQ ID NO: 356581 - DNA, 20 bp, human
gcggcggctgactaggtttt

SEQ ID NO: 356582 - DNA, 20 bp, human
gcgtccgccgggtcggccta

SEQ ID NO: 356583 - DNA, 20 bp, human
gccgccctaggccgacccgg

SEQ ID NO: 356584 - DNA, 20 bp, human
gggagagacgcgggaaagtg

SEQ ID NO: 356585 - DNA, 20 bp, human
ggaggctgcggcggctgact

SEQ ID NO: 356586 - DNA, 20 bp, human
gctgtgctgcgtctctgggg

SEQ ID NO: 356587 - DNA, 20 bp, human
gcggctgtgctgcgtctctg

SEQ ID NO: 356588 - DNA, 20 bp, human
gggacctcaagggctcactg

SEQ ID NO: 356589 - DNA, 20 bp, human
ggacgccataggtgcattgt

SEQ ID NO: 356590 - DNA, 20 bp, human
gagacgcagcacagccgcgc

SEQ ID NO: 356591 - DNA, 20 bp, human
gagctaggagcggacgccat

SEQ ID NO: 356592 - DNA, 20 bp, human
ggaagtgcggcgccgtagct

SEQ ID NO: 356593 - DNA, 20 bp, human
gaacttggaggctatggctt

SEQ ID NO: 356594 - DNA, 20 bp, human
gtggaaaaacttggaggcta

SEQ ID NO: 356595 - DNA, 20 bp, human
gtagccgcagtgagcccttg

SEQ ID NO: 356596 - DNA, 20 bp, human
gaaggtgtcctggtgtgcgt

SEQ ID NO: 356597 - DNA, 20 bp, human
ggcaggcgcaccaggagacg

SEQ ID NO: 356598 - DNA, 20 bp, human
gtctcctggtgcgcctgcgc

SEQ ID NO: 356599 - DNA, 20 bp, human
gtgtgcgtgggctcggaagg

SEQ ID NO: 356600 - DNA, 20 bp, human
gcaccaggagacgcggctga

SEQ ID NO: 356601 - DNA, 20 bp, human
gcggggcttgtagtcaccag

SEQ ID NO: 356602 - DNA, 20 bp, human
gacaccttccgggcgcgcca

SEQ ID NO: 356603 - DNA, 20 bp, human
gtggaggaggagaagtaggc

SEQ ID NO: 356604 - DNA, 20 bp, human
gccccggcgtgcaccgcgct

SEQ ID NO: 356605 - DNA, 20 bp, human
gttcaccggggtctccggga

SEQ ID NO: 356606 - DNA, 20 bp, human
gctaactcccgggaaaggac

SEQ ID NO: 356607 - DNA, 20 bp, human
gagcgcagtgcaggggttga

SEQ ID NO: 356608 - DNA, 20 bp, human
gcactgcgctagtcctaaag

SEQ ID NO: 356609 - DNA, 20 bp, human
gcggcggggcgaacgggttt

SEQ ID NO: 356610 - DNA, 20 bp, human
ggatcgctaactcccgggaa

SEQ ID NO: 356611 - DNA, 20 bp, human
gagccaagctgctccacgat

SEQ ID NO: 356612 - DNA, 20 bp, human
gtgagtgcgcgacgcacgta

SEQ ID NO: 356613 - DNA, 20 bp, human
gtgggcatgggcgctctgaa

SEQ ID NO: 356614 - DNA, 20 bp, human
gttaggactagcgcagtgca

SEQ ID NO: 356615 - DNA, 20 bp, human
gagcccgcaccctggggccc

SEQ ID NO: 356616 - DNA, 20 bp, human
gggaaagccgcctttaagta

SEQ ID NO: 356617 - DNA, 20 bp, human
gccttcgcgaccctacttaa

SEQ ID NO: 356618 - DNA, 20 bp, human
gaacgaatacaggcaaccat

SEQ ID NO: 356619 - DNA, 20 bp, human
gggaaggcgctgcctcgcgt

SEQ ID NO: 356620 - DNA, 20 bp, human
gcgccggcgggaagcatgga

SEQ ID NO: 356621 - DNA, 20 bp, human
gcaaactaaaaggtatgacg

SEQ ID NO: 356622 - DNA, 20 bp, human
ggggcgccaggggtcgccgg

SEQ ID NO: 356623 - DNA, 20 bp, human
ggccccaggcggaacagaat

SEQ ID NO: 356624 - DNA, 20 bp, human
ggctatccgcggtttctgat

SEQ ID NO: 356625 - DNA, 20 bp, human
ggatggcgcagccaatagac

SEQ ID NO: 356626 - DNA, 20 bp, human
gcctgcgcactgcgcctgat

SEQ ID NO: 356627 - DNA, 20 bp, human
gaatcggcgcccgcaccggg

SEQ ID NO: 356628 - DNA, 20 bp, human
gggcgctgaccctgagagta

SEQ ID NO: 356629 - DNA, 20 bp, human
ggtccgcgtggacacataag

SEQ ID NO: 356630 - DNA, 20 bp, human
gaaagtgggaccgtatttgc

SEQ ID NO: 356631 - DNA, 20 bp, human
gggacgcagcccttactctc

SEQ ID NO: 356632 - DNA, 20 bp, human
gagtgcgcaggcgccttcag

SEQ ID NO: 356633 - DNA, 20 bp, human
ggaccaatcggcgcccgcac

SEQ ID NO: 356634 - DNA, 20 bp, human
gaggcgaagtccgaatacct

SEQ ID NO: 356635 - DNA, 20 bp, human
gaatacggtcccactttatt

SEQ ID NO: 356636 - DNA, 20 bp, human
gactccctccccgtcgtcat

SEQ ID NO: 356637 - DNA, 20 bp, human
gcagccaatgacgacgggga

SEQ ID NO: 356638 - DNA, 20 bp, human
gcgcgaaaagtgcctgacgg

SEQ ID NO: 356639 - DNA, 20 bp, human
gcccacgcgccgttccgggt

SEQ ID NO: 356640 - DNA, 20 bp, human
gaagggccaccgaaactcgt

SEQ ID NO: 356641 - DNA, 20 bp, human
gttaaccccgcctcttgcgt

SEQ ID NO: 356642 - DNA, 20 bp, human
gtggcggccgcgctccatgt

SEQ ID NO: 356643 - DNA, 20 bp, human
gcactctgaggcgcctcatg

SEQ ID NO: 356644 - DNA, 20 bp, human
gggtgcaccgctgccggaag

SEQ ID NO: 356645 - DNA, 20 bp, human
gtgggggtgctaggtaccga

SEQ ID NO: 356646 - DNA, 20 bp, human
gtggcggcgccgaacaagga

SEQ ID NO: 356647 - DNA, 20 bp, human
gaccctgtctccggggcaac

SEQ ID NO: 356648 - DNA, 20 bp, human
gaggcgccgggtcggcttcc

SEQ ID NO: 356649 - DNA, 20 bp, human
gagcagccgttcattgggca

SEQ ID NO: 356650 - DNA, 20 bp, human
gggcaaccgggaagccgacc

SEQ ID NO: 356651 - DNA, 20 bp, human
gcggctgctcagtggcggga

SEQ ID NO: 356652 - DNA, 20 bp, human
gtatcccgagcagctctgag

SEQ ID NO: 356653 - DNA, 20 bp, human
gccactgagcagccgttcat

SEQ ID NO: 356654 - DNA, 20 bp, human
gtcccggttgccccggagac

SEQ ID NO: 356655 - DNA, 20 bp, human
gggctttagcaatcaggcgc

SEQ ID NO: 356656 - DNA, 20 bp, human
gtcccggtagctcccggaat

SEQ ID NO: 356657 - DNA, 20 bp, human
gcagacaggccaatcagaag

SEQ ID NO: 356658 - DNA, 20 bp, human
ggaacaggaagggtctcgtc

SEQ ID NO: 356659 - DNA, 20 bp, human
gagacggggccgcttctgat

SEQ ID NO: 356660 - DNA, 20 bp, human
ggagacggtcggttccaagt

SEQ ID NO: 356661 - DNA, 20 bp, human
gccgtctcgggcccaccccg

SEQ ID NO: 356662 - DNA, 20 bp, human
ggcaaggccctgtgagcggg

SEQ ID NO: 356663 - DNA, 20 bp, human
ggcctggcccaaccgcgtcc

SEQ ID NO: 356664 - DNA, 20 bp, human
gccctgtgagcgggaggact

SEQ ID NO: 356665 - DNA, 20 bp, human
gaagcacaggtcagtgtccg

SEQ ID NO: 356666 - DNA, 20 bp, human
ggggtcgcggccaactgaga

SEQ ID NO: 356667 - DNA, 20 bp, human
gcccacgaagcgtgacgccc

SEQ ID NO: 356668 - DNA, 20 bp, human
gcgccctctggtgtccactc

SEQ ID NO: 356669 - DNA, 20 bp, human
gcctgatccggagctgagag

SEQ ID NO: 356670 - DNA, 20 bp, human
gcgtgtgtgcaatttgcttg

SEQ ID NO: 356671 - DNA, 20 bp, human
gccaggcgcgaatcctgatc

SEQ ID NO: 356672 - DNA, 20 bp, human
ggattcgcgcctgggtcctt

SEQ ID NO: 356673 - DNA, 20 bp, human
gtcgccgcaaggacccgcca

SEQ ID NO: 356674 - DNA, 20 bp, human
ggctcggccgctctcagctc

SEQ ID NO: 356675 - DNA, 20 bp, human
gaccacgcggcgtcgtccta

SEQ ID NO: 356676 - DNA, 20 bp, human
gcgtccgcgcgaggcctcct

SEQ ID NO: 356677 - DNA, 20 bp, human
gcccgggcggggctgtgcga

SEQ ID NO: 356678 - DNA, 20 bp, human
ggcctccgggaggctcccga

SEQ ID NO: 356679 - DNA, 20 bp, human
gggaggcctcacaaactcat

SEQ ID NO: 356680 - DNA, 20 bp, human
gccctgggcatggattgctg

SEQ ID NO: 356681 - DNA, 20 bp, human
gagtttgtgaggcctccggg

SEQ ID NO: 356682 - DNA, 20 bp, human
gaggcctcgcggtccttcac

SEQ ID NO: 356683 - DNA, 20 bp, human
gggaccgcgaggccttccag

SEQ ID NO: 356684 - DNA, 20 bp, human
gcagccttctgtcctgaaaa

SEQ ID NO: 356685 - DNA, 20 bp, human
gcctcgcgcggacgcccggg

SEQ ID NO: 356686 - DNA, 20 bp, human
gtcgccaggaaaggctagtg

SEQ ID NO: 356687 - DNA, 20 bp, human
ggctacgcgggcgtgggagc

SEQ ID NO: 356688 - DNA, 20 bp, human
gtcctcagctacgcgggcgt

SEQ ID NO: 356689 - DNA, 20 bp, human
gggaaaggctagtgaggctg

SEQ ID NO: 356690 - DNA, 20 bp, human
gcgctgcggggcgcatgagc

SEQ ID NO: 356691 - DNA, 20 bp, human
ggacccagactcgccaggaa

SEQ ID NO: 356692 - DNA, 20 bp, human
gtctgggtcctcagctacgc

SEQ ID NO: 356693 - DNA, 20 bp, human
gagagccaaccctcacaaac

SEQ ID NO: 356694 - DNA, 20 bp, human
gcccggccgggccgggtcag

SEQ ID NO: 356695 - DNA, 20 bp, human
gtcccacgcccgcgtagctg

SEQ ID NO: 356696 - DNA, 20 bp, human
gctccggggcgtaacagcgg

SEQ ID NO: 356697 - DNA, 20 bp, human
gccccgctgggactggtccg

SEQ ID NO: 356698 - DNA, 20 bp, human
ggaactgtcctgcctccctc

SEQ ID NO: 356699 - DNA, 20 bp, human
gtggcccttagaagatggga

SEQ ID NO: 356700 - DNA, 20 bp, human
gaagtcctgcgtctgaagga

SEQ ID NO: 356701 - DNA, 20 bp, human
ggggccgcgcacgccccgag

SEQ ID NO: 356702 - DNA, 20 bp, human
gggccagcgggttgtttccg

SEQ ID NO: 356703 - DNA, 20 bp, human
gccccgaggcatctccgccg

SEQ ID NO: 356704 - DNA, 20 bp, human
ggccccggaccagtcccagc

SEQ ID NO: 356705 - DNA, 20 bp, human
gtccctccggggcgtaacag

SEQ ID NO: 356706 - DNA, 20 bp, human
gcgaatccctagtcaactgg

SEQ ID NO: 356707 - DNA, 20 bp, human
gaggtagagacggactgcgc

SEQ ID NO: 356708 - DNA, 20 bp, human
ggggaattggaacccctcca

SEQ ID NO: 356709 - DNA, 20 bp, human
gagtcaactggaggtagaga

SEQ ID NO: 356710 - DNA, 20 bp, human
gctccgaatccctagtcaac

SEQ ID NO: 356711 - DNA, 20 bp, human
gcaaagcccgctattctctg

SEQ ID NO: 356712 - DNA, 20 bp, human
gaatcagagaattctgctaa

SEQ ID NO: 356713 - DNA, 20 bp, human
ggactgccacagagaatagc

SEQ ID NO: 356714 - DNA, 20 bp, human
ggagaactaccccaagacga

SEQ ID NO: 356715 - DNA, 20 bp, human
gtaaaaagaccctcgtcttg

SEQ ID NO: 356716 - DNA, 20 bp, human
gaggcgaggccgggaggcga

SEQ ID NO: 356717 - DNA, 20 bp, human
gcgcactgcccctgtagcgg

SEQ ID NO: 356718 - DNA, 20 bp, human
gcactccggagaggggaaag

SEQ ID NO: 356719 - DNA, 20 bp, human
ggctccgagcgcttcctccc

SEQ ID NO: 356720 - DNA, 20 bp, human
gggggtggggggacccggtc

SEQ ID NO: 356721 - DNA, 20 bp, human
gcagacgcgacgggccgggg

SEQ ID NO: 356722 - DNA, 20 bp, human
ggggccggggaggaagcgct

SEQ ID NO: 356723 - DNA, 20 bp, human
gtccccccacccccgctaca

SEQ ID NO: 356724 - DNA, 20 bp, human
gggaccgtccagttgttcgg

SEQ ID NO: 356725 - DNA, 20 bp, human
ggaagcgctcggagcagtgc

SEQ ID NO: 356726 - DNA, 20 bp, human
gcaccaaagagcggctgcgt

SEQ ID NO: 356727 - DNA, 20 bp, human
gccctggcggcggtggagtg

SEQ ID NO: 356728 - DNA, 20 bp, human
gggtatgcggccggagggaa

SEQ ID NO: 356729 - DNA, 20 bp, human
gagcccacgcagccgctctt

SEQ ID NO: 356730 - DNA, 20 bp, human
gtgctgtgcgcccctggcgg

SEQ ID NO: 356731 - DNA, 20 bp, human
ggcgcacagcagcgggtatg

SEQ ID NO: 356732 - DNA, 20 bp, human
ggcaggaagcggtccctctg

SEQ ID NO: 356733 - DNA, 20 bp, human
gtcagacatccaccaaagag

SEQ ID NO: 356734 - DNA, 20 bp, human
gcctcggtcaggcccctcag

SEQ ID NO: 356735 - DNA, 20 bp, human
gcccacgcccggcgcatcct

SEQ ID NO: 356736 - DNA, 20 bp, human
ggccgagaagtggaaccgcc

SEQ ID NO: 356737 - DNA, 20 bp, human
gaggcctgaaccctccttaa

SEQ ID NO: 356738 - DNA, 20 bp, human
gatgcctgggttactctcag

SEQ ID NO: 356739 - DNA, 20 bp, human
gagtgcaggggaggcggaca

SEQ ID NO: 356740 - DNA, 20 bp, human
gggacaggggcgtgatgcct

SEQ ID NO: 356741 - DNA, 20 bp, human
gggagtcgaaacaagtgcag

SEQ ID NO: 356742 - DNA, 20 bp, human
gcaagccctgggaaaacgcg

SEQ ID NO: 356743 - DNA, 20 bp, human
gcggccgtggtgagagcgtg

SEQ ID NO: 356744 - DNA, 20 bp, human
gagtggaaccgccaggcgga

SEQ ID NO: 356745 - DNA, 20 bp, human
gcagcaagatggcgtccggc

SEQ ID NO: 356746 - DNA, 20 bp, human
gaaggctggaagacgaggta

SEQ ID NO: 356747 - DNA, 20 bp, human
gagagaaaggctggaagacg

SEQ ID NO: 356748 - DNA, 20 bp, human
gaagagtggcgggaaccaga

SEQ ID NO: 356749 - DNA, 20 bp, human
gcagctgggaccctgtagag

SEQ ID NO: 356750 - DNA, 20 bp, human
gggcaagggccggagcagag

SEQ ID NO: 356751 - DNA, 20 bp, human
gcgcgccagaaaggttccga

SEQ ID NO: 356752 - DNA, 20 bp, human
gcgtgaaaagggcacgtggg

SEQ ID NO: 356753 - DNA, 20 bp, human
gaccgctcgagcctgcacac

SEQ ID NO: 356754 - DNA, 20 bp, human
gagcggccgccgcctccaaa

SEQ ID NO: 356755 - DNA, 20 bp, human
gagggcgtggaggcgtgaaa

SEQ ID NO: 356756 - DNA, 20 bp, human
gtgaaagccgtaggtgggga

SEQ ID NO: 356757 - DNA, 20 bp, human
gtgcgtgaaagccgtaggtg

SEQ ID NO: 356758 - DNA, 20 bp, human
ggcccctccttgcagcgtgt

SEQ ID NO: 356759 - DNA, 20 bp, human
gaacgcccgacctggctcac

SEQ ID NO: 356760 - DNA, 20 bp, human
gggagggaagctagggggtg

SEQ ID NO: 356761 - DNA, 20 bp, human
gtggggatggtgcacgcgct

SEQ ID NO: 356762 - DNA, 20 bp, human
ggctcctacacgctgcaagg

SEQ ID NO: 356763 - DNA, 20 bp, human
ggcagctcctacacgctgca

SEQ ID NO: 356764 - DNA, 20 bp, human
gtgcacgcgctgggctcttc

SEQ ID NO: 356765 - DNA, 20 bp, human
gctcttctggaggtacggac

SEQ ID NO: 356766 - DNA, 20 bp, human
ggctgcgcgctgctcttggg

SEQ ID NO: 356767 - DNA, 20 bp, human
ggcgcgctgctcttgggagg

SEQ ID NO: 356768 - DNA, 20 bp, human
gccgggaacgagcaccacca

SEQ ID NO: 356769 - DNA, 20 bp, human
gcgcgctgcgcgctgctctt

SEQ ID NO: 356770 - DNA, 20 bp, human
gggggctgttggaacttggc

SEQ ID NO: 356771 - DNA, 20 bp, human
gcccggcgctcgctcgaggg

SEQ ID NO: 356772 - DNA, 20 bp, human
ggcccgcacctcccacggcc

SEQ ID NO: 356773 - DNA, 20 bp, human
gagcaaacagcggccccttc

SEQ ID NO: 356774 - DNA, 20 bp, human
ggcgcggcggtgcggccgga

SEQ ID NO: 356775 - DNA, 20 bp, human
gccaccagggctggagcgga

SEQ ID NO: 356776 - DNA, 20 bp, human
ggtccccgcggcatctccga

SEQ ID NO: 356777 - DNA, 20 bp, human
gcagcaccgggactccgggg

SEQ ID NO: 356778 - DNA, 20 bp, human
gcggacagcgggtgccagga

SEQ ID NO: 356779 - DNA, 20 bp, human
gcggagtcccggtgctggag

SEQ ID NO: 356780 - DNA, 20 bp, human
gcgggccgttgctaggggag

SEQ ID NO: 356781 - DNA, 20 bp, human
ggacccggggccagtggagt

SEQ ID NO: 356782 - DNA, 20 bp, human
gaggcgcgcgaggaacccag

SEQ ID NO: 356783 - DNA, 20 bp, human
gcgcagcctccccggagtcc

SEQ ID NO: 356784 - DNA, 20 bp, human
gggcacccgctgtccgttct

SEQ ID NO: 356785 - DNA, 20 bp, human
gttcgccggcccgcggacag

SEQ ID NO: 356786 - DNA, 20 bp, human
ggcggtgcctgaagaactgg

SEQ ID NO: 356787 - DNA, 20 bp, human
ggagcctggggtggcctcgg

SEQ ID NO: 356788 - DNA, 20 bp, human
gagggactcacgcacgcact

SEQ ID NO: 356789 - DNA, 20 bp, human
gcgtgcgtgagtccctcagg

SEQ ID NO: 356790 - DNA, 20 bp, human
ggccaccccaggctccccgc

SEQ ID NO: 356791 - DNA, 20 bp, human
ggaactggcggatctgacca

SEQ ID NO: 356792 - DNA, 20 bp, human
ggcaccgccgaggccacccc

SEQ ID NO: 356793 - DNA, 20 bp, human
gacggagcctgaccgcctga

SEQ ID NO: 356794 - DNA, 20 bp, human
ggtgagtccctcaggcggtc

SEQ ID NO: 356795 - DNA, 20 bp, human
gcaagctcagaagttcccgg

SEQ ID NO: 356796 - DNA, 20 bp, human
ggcggtgcctgaagaactgg

SEQ ID NO: 356797 - DNA, 20 bp, human
ggagcctggggtggcctcgg

SEQ ID NO: 356798 - DNA, 20 bp, human
gagggactcacgcacgcact

SEQ ID NO: 356799 - DNA, 20 bp, human
gcgtgcgtgagtccctcagg

SEQ ID NO: 356800 - DNA, 20 bp, human
ggccaccccaggctccccgc

SEQ ID NO: 356801 - DNA, 20 bp, human
ggaactggcggatctgacca

SEQ ID NO: 356802 - DNA, 20 bp, human
ggcaccgccgaggccacccc

SEQ ID NO: 356803 - DNA, 20 bp, human
gacggagcctgaccgcctga

SEQ ID NO: 356804 - DNA, 20 bp, human
ggtgagtccctcaggcggtc

SEQ ID NO: 356805 - DNA, 20 bp, human
gcaagctcagaagttcccgg

SEQ ID NO: 356806 - DNA, 20 bp, human
gggcgattcgggcactgtga

SEQ ID NO: 356807 - DNA, 20 bp, human
gacgggcgggaagtgctaga

SEQ ID NO: 356808 - DNA, 20 bp, human
ggggcgcgattatttaggca

SEQ ID NO: 356809 - DNA, 20 bp, human
gggcactgtgaaggactgac

SEQ ID NO: 356810 - DNA, 20 bp, human
gactgtgaaggactgacggg

SEQ ID NO: 356811 - DNA, 20 bp, human
gttaaaccagcgggcgattc

SEQ ID NO: 356812 - DNA, 20 bp, human
ggctgcccacgaactttcag

SEQ ID NO: 356813 - DNA, 20 bp, human
gacgccgggcgcgattattt

SEQ ID NO: 356814 - DNA, 20 bp, human
gggagtgctaggagcatgtg

SEQ ID NO: 356815 - DNA, 20 bp, human
gctggagaggaagtgacgta

SEQ ID NO: 356816 - DNA, 20 bp, human
ggcccagggaactcattcta

SEQ ID NO: 356817 - DNA, 20 bp, human
gggccacgcctccgcaaaga

SEQ ID NO: 356818 - DNA, 20 bp, human
gcgggagccacctctttcga

SEQ ID NO: 356819 - DNA, 20 bp, human
gtctctgccaggccggtcct

SEQ ID NO: 356820 - DNA, 20 bp, human
ggagttccctgggcctcggt

SEQ ID NO: 356821 - DNA, 20 bp, human
gggtccttggcgagtgcaac

SEQ ID NO: 356822 - DNA, 20 bp, human
gggagtgcacatgcgcacag

SEQ ID NO: 356823 - DNA, 20 bp, human
gtggcgctcggcgggataca

SEQ ID NO: 356824 - DNA, 20 bp, human
gagtgcaacaggcactacgc

SEQ ID NO: 356825 - DNA, 20 bp, human
gcctcagaaccgcctcaatc

SEQ ID NO: 356826 - DNA, 20 bp, human
gtagtcacacagacgggcgg

SEQ ID NO: 356827 - DNA, 20 bp, human
gttgccagagcgggaatttg

SEQ ID NO: 356828 - DNA, 20 bp, human
gcctcctgcgtgagaggaag

SEQ ID NO: 356829 - DNA, 20 bp, human
gaccgatgcatgccgggatg

SEQ ID NO: 356830 - DNA, 20 bp, human
gcccggcatgcatcggtctt

SEQ ID NO: 356831 - DNA, 20 bp, human
ggctccgcctcctgcgtgag

SEQ ID NO: 356832 - DNA, 20 bp, human
ggcgacgctgaaatgcattt

SEQ ID NO: 356833 - DNA, 20 bp, human
gatgcatgccgggatgaggc

SEQ ID NO: 356834 - DNA, 20 bp, human
gcagcctcaaattcccgctc

SEQ ID NO: 356835 - DNA, 20 bp, human
gcgaatgctgcgctgggggt

SEQ ID NO: 356836 - DNA, 20 bp, human
gtacacccgcggggtgaggt

SEQ ID NO: 356837 - DNA, 20 bp, human
gagggcgggagtcaggatgg

SEQ ID NO: 356838 - DNA, 20 bp, human
gtcccggaagtatacctctg

SEQ ID NO: 356839 - DNA, 20 bp, human
gaaggggcgctgccgctcca

SEQ ID NO: 356840 - DNA, 20 bp, human
gacgaagcggctacacccgc

SEQ ID NO: 356841 - DNA, 20 bp, human
gacctcagaggtatacttcc

SEQ ID NO: 356842 - DNA, 20 bp, human
gcctaagcgacagtacgaag

SEQ ID NO: 356843 - DNA, 20 bp, human
gcctcgccccgtgacctcag

SEQ ID NO: 356844 - DNA, 20 bp, human
gggagagcgaaaagaggtag

SEQ ID NO: 356845 - DNA, 20 bp, human
ggccagggcgggagtcagga

SEQ ID NO: 356846 - DNA, 20 bp, human
gcgaacccgaggctcagaca

SEQ ID NO: 356847 - DNA, 20 bp, human
gccaaagtcccactccgtgg

SEQ ID NO: 356848 - DNA, 20 bp, human
gaagcggctctgcagacctc

SEQ ID NO: 356849 - DNA, 20 bp, human
gtgtccaaagtcccactccg

SEQ ID NO: 356850 - DNA, 20 bp, human
gcgtctggagggcaaaacac

SEQ ID NO: 356851 - DNA, 20 bp, human
gcccgaggctcagacagggg

SEQ ID NO: 356852 - DNA, 20 bp, human
gtcccactccgtggaggaag

SEQ ID NO: 356853 - DNA, 20 bp, human
gcgtgtgcgcgcacggccga

SEQ ID NO: 356854 - DNA, 20 bp, human
gtgcagagccgcttcctcca

SEQ ID NO: 356855 - DNA, 20 bp, human
gcgcgcttccgctttcccgg

SEQ ID NO: 356856 - DNA, 20 bp, human
ggaatcgacctcccccggtg

SEQ ID NO: 356857 - DNA, 20 bp, human
ggaaaggcggagcctcctca

SEQ ID NO: 356858 - DNA, 20 bp, human
gcaactgccaacccctgagg

SEQ ID NO: 356859 - DNA, 20 bp, human
ggttggcagttgagagtcga

SEQ ID NO: 356860 - DNA, 20 bp, human
gccgcctaggagaaggacga

SEQ ID NO: 356861 - DNA, 20 bp, human
gcctctcccaggccccaccg

SEQ ID NO: 356862 - DNA, 20 bp, human
gaaggtgagccgttcgttgg

SEQ ID NO: 356863 - DNA, 20 bp, human
gaggagaaggacgagggtga

SEQ ID NO: 356864 - DNA, 20 bp, human
gtagacgaacctccaacgaa

SEQ ID NO: 356865 - DNA, 20 bp, human
gcgcacggagttatgggaag

SEQ ID NO: 356866 - DNA, 20 bp, human
gcagcggcgggaaggccctt

SEQ ID NO: 356867 - DNA, 20 bp, human
gcctgtgaggcggaagtggc

SEQ ID NO: 356868 - DNA, 20 bp, human
gggcctgggagtgtcgtgtg

SEQ ID NO: 356869 - DNA, 20 bp, human
gcggaagtggcgggctctgt

SEQ ID NO: 356870 - DNA, 20 bp, human
ggtgtcgtgtgcggactgaa

SEQ ID NO: 356871 - DNA, 20 bp, human
gcggactgaagggaaggctg

SEQ ID NO: 356872 - DNA, 20 bp, human
gcgtctggtcagcggcggga

SEQ ID NO: 356873 - DNA, 20 bp, human
gcgtgtgcggactgaaggga

SEQ ID NO: 356874 - DNA, 20 bp, human
ggcgggctctgtgggcggaa

SEQ ID NO: 356875 - DNA, 20 bp, human
gctgttgcggctaacgggcg

SEQ ID NO: 356876 - DNA, 20 bp, human
ggtgagctccatgacagtaa

SEQ ID NO: 356877 - DNA, 20 bp, human
gaaaatgaccattactgtca

SEQ ID NO: 356878 - DNA, 20 bp, human
gctcctctccctggcgtgtg

SEQ ID NO: 356879 - DNA, 20 bp, human
gcgctcccctcggttgactt

SEQ ID NO: 356880 - DNA, 20 bp, human
gaggagaagcatccggtcct

SEQ ID NO: 356881 - DNA, 20 bp, human
gacgctagagcacatcgcac

SEQ ID NO: 356882 - DNA, 20 bp, human
gcgcgggccggagacttgtc

SEQ ID NO: 356883 - DNA, 20 bp, human
gctagagcacatcgcacggg

SEQ ID NO: 356884 - DNA, 20 bp, human
gatctcttccacacacgcca

SEQ ID NO: 356885 - DNA, 20 bp, human
gcgagcccaagtcaaccgag

SEQ ID NO: 356886 - DNA, 20 bp, human
gggaagaggcggtgcgatct

SEQ ID NO: 356887 - DNA, 20 bp, human
gaaaggcgcaccggaagttg

SEQ ID NO: 356888 - DNA, 20 bp, human
gctgcgatgccgctggatca

SEQ ID NO: 356889 - DNA, 20 bp, human
ggcttgggtaccacaacttc

SEQ ID NO: 356890 - DNA, 20 bp, human
ggaagtggttagagctgaaa

SEQ ID NO: 356891 - DNA, 20 bp, human
ggccgccgctgcgaccatgg

SEQ ID NO: 356892 - DNA, 20 bp, human
gtcccggcgagtccgttccc

SEQ ID NO: 356893 - DNA, 20 bp, human
gaccatggctgcagcacaag

SEQ ID NO: 356894 - DNA, 20 bp, human
gggctggatttatgagagta

SEQ ID NO: 356895 - DNA, 20 bp, human
gcgaggaagggtcactgctc

SEQ ID NO: 356896 - DNA, 20 bp, human
gaggggagggtgtctagtga

SEQ ID NO: 356897 - DNA, 20 bp, human
gagagcgagggtagacgctg

SEQ ID NO: 356898 - DNA, 20 bp, human
gagggccaaggggtcgcgcg

SEQ ID NO: 356899 - DNA, 20 bp, human
ggaaacgcgggaggaaaccc

SEQ ID NO: 356900 - DNA, 20 bp, human
gtgtctagtgaggggtggag

SEQ ID NO: 356901 - DNA, 20 bp, human
gcgtccccgcctagagggga

SEQ ID NO: 356902 - DNA, 20 bp, human
ggccaaggggtcgcgcgtgg

SEQ ID NO: 356903 - DNA, 20 bp, human
gtggctggaaggaacagtgg

SEQ ID NO: 356904 - DNA, 20 bp, human
ggagggtgtctagtgagggg

SEQ ID NO: 356905 - DNA, 20 bp, human
gcggccggggcgagcgaaaa

SEQ ID NO: 356906 - DNA, 20 bp, human
ggaaactggaggcgggtcca

SEQ ID NO: 356907 - DNA, 20 bp, human
gcccgaacagagggatccgg

SEQ ID NO: 356908 - DNA, 20 bp, human
gtacacttgagcggaagaag

SEQ ID NO: 356909 - DNA, 20 bp, human
ggaaacccgagcccgaacag

SEQ ID NO: 356910 - DNA, 20 bp, human
gcgggttggccaatcctctc

SEQ ID NO: 356911 - DNA, 20 bp, human
gggtctcgtggctccgtggc

SEQ ID NO: 356912 - DNA, 20 bp, human
gccacgagacccgagaggat

SEQ ID NO: 356913 - DNA, 20 bp, human
gtgcggacggcttccgggga

SEQ ID NO: 356914 - DNA, 20 bp, human
ggcagtccctgtcgtctcgg

SEQ ID NO: 356915 - DNA, 20 bp, human
gggaagtgcccatctttctt

SEQ ID NO: 356916 - DNA, 20 bp, human
ggcaccgcggagccaatcac

SEQ ID NO: 356917 - DNA, 20 bp, human
gagcactcagagcccggtga

SEQ ID NO: 356918 - DNA, 20 bp, human
ggccccgccccaagcgggag

SEQ ID NO: 356919 - DNA, 20 bp, human
gcccgctcccgcttggggcg

SEQ ID NO: 356920 - DNA, 20 bp, human
ggccgcggctggggccggac

SEQ ID NO: 356921 - DNA, 20 bp, human
gcggggctgcggagatctcg

SEQ ID NO: 356922 - DNA, 20 bp, human
gtccgcagccccgccccaag

SEQ ID NO: 356923 - DNA, 20 bp, human
gcaatcacaggttgtcttat

SEQ ID NO: 356924 - DNA, 20 bp, human
ggaaaagcgactataaacgc

SEQ ID NO: 356925 - DNA, 20 bp, human
gcgggtggattcccgagccg

SEQ ID NO: 356926 - DNA, 20 bp, human
gcctagaggcggtcgcacaa

SEQ ID NO: 356927 - DNA, 20 bp, human
gagccgaagtcccgcagggt

SEQ ID NO: 356928 - DNA, 20 bp, human
ggcgccccctgtccgcacgg

SEQ ID NO: 356929 - DNA, 20 bp, human
ggaggagccgaagtcccgca

SEQ ID NO: 356930 - DNA, 20 bp, human
ggtccccgcctgcgccgaga

SEQ ID NO: 356931 - DNA, 20 bp, human
gcaggtggccctctcggcgc

SEQ ID NO: 356932 - DNA, 20 bp, human
gcgggcgccccctgtccgca

SEQ ID NO: 356933 - DNA, 20 bp, human
gcggctcctccgtgcggaca

SEQ ID NO: 356934 - DNA, 20 bp, human
gggagcactagtggagttgg

SEQ ID NO: 356935 - DNA, 20 bp, human
gggacttcggctcctccgtg

SEQ ID NO: 356936 - DNA, 20 bp, human
gctggggcgcggggcgtcgt

SEQ ID NO: 356937 - DNA, 20 bp, human
gtccgtggggcacaacccag

SEQ ID NO: 356938 - DNA, 20 bp, human
gagtgcgtcacggcgacggc

SEQ ID NO: 356939 - DNA, 20 bp, human
gggtccgagaacctccttgc

SEQ ID NO: 356940 - DNA, 20 bp, human
gtgcccgccgatatctctgc

SEQ ID NO: 356941 - DNA, 20 bp, human
gagaacctccttgccggaag

SEQ ID NO: 356942 - DNA, 20 bp, human
ggccggccgggctagagata

SEQ ID NO: 356943 - DNA, 20 bp, human
gccaccacagcgagtctgcg

SEQ ID NO: 356944 - DNA, 20 bp, human
gcaggctaagacgccacaca

SEQ ID NO: 356945 - DNA, 20 bp, human
ggaggggtcgactgcgtccg

SEQ ID NO: 356946 - DNA, 20 bp, human
ggggctaggtcagagtagga

SEQ ID NO: 356947 - DNA, 20 bp, human
ggctgggcggggcttgctcg

SEQ ID NO: 356948 - DNA, 20 bp, human
ggtcccgctctcagtggctt

SEQ ID NO: 356949 - DNA, 20 bp, human
gccccgcgtcccgctctcag

SEQ ID NO: 356950 - DNA, 20 bp, human
gcccgtggcgccgacaggat

SEQ ID NO: 356951 - DNA, 20 bp, human
ggggcggggcttgctcgcgg

SEQ ID NO: 356952 - DNA, 20 bp, human
gcgcggggctaggtcagagt

SEQ ID NO: 356953 - DNA, 20 bp, human
gccgcgcctgacccgaggct

SEQ ID NO: 356954 - DNA, 20 bp, human
gtcaggcgcggcgcagacag

SEQ ID NO: 356955 - DNA, 20 bp, human
gggcggatgcgaatagagta

SEQ ID NO: 356956 - DNA, 20 bp, human
gggtcagtctagagttccag

SEQ ID NO: 356957 - DNA, 20 bp, human
gtagtcggctcgagttgttc

SEQ ID NO: 356958 - DNA, 20 bp, human
gagttgttctggttctggat

SEQ ID NO: 356959 - DNA, 20 bp, human
gggcagcctaaatcaggcat

SEQ ID NO: 356960 - DNA, 20 bp, human
gaccccgggaagagccggcg

SEQ ID NO: 356961 - DNA, 20 bp, human
gaacgcgcacggaaggaccc

SEQ ID NO: 356962 - DNA, 20 bp, human
gccccacgccggctcttccc

SEQ ID NO: 356963 - DNA, 20 bp, human
gggccaaaagtctgtgaggc

SEQ ID NO: 356964 - DNA, 20 bp, human
gcctaaatcaggcatcggcg

SEQ ID NO: 356965 - DNA, 20 bp, human
gggggcgtgggcgcgccacg

SEQ ID NO: 356966 - DNA, 20 bp, human
gctcgccctctagcctgagg

SEQ ID NO: 356967 - DNA, 20 bp, human
ggggaggggccgtcgggtag

SEQ ID NO: 356968 - DNA, 20 bp, human
gtcacaactagcgcagactc

SEQ ID NO: 356969 - DNA, 20 bp, human
ggactccggcagtatttagg

SEQ ID NO: 356970 - DNA, 20 bp, human
gctagcctgaggcggaagac

SEQ ID NO: 356971 - DNA, 20 bp, human
gccaggcagaagaagtccca

SEQ ID NO: 356972 - DNA, 20 bp, human
gcggcagtatttaggcggtg

SEQ ID NO: 356973 - DNA, 20 bp, human
gagggcgagcgcttcgccgt

SEQ ID NO: 356974 - DNA, 20 bp, human
gagtgcgcaagtgcagcagg

SEQ ID NO: 356975 - DNA, 20 bp, human
gtatttaggcggtgcggctt

SEQ ID NO: 356976 - DNA, 20 bp, human
gaaggcgcactcgttattag

SEQ ID NO: 356977 - DNA, 20 bp, human
gagcccagggcgtcccccgg

SEQ ID NO: 356978 - DNA, 20 bp, human
gggtctaagcacttggggca

SEQ ID NO: 356979 - DNA, 20 bp, human
gcgccaccgggggacgccct

SEQ ID NO: 356980 - DNA, 20 bp, human
gtcgttattagaggccagag

SEQ ID NO: 356981 - DNA, 20 bp, human
gcgtgaaagttgccagacgc

SEQ ID NO: 356982 - DNA, 20 bp, human
ggccgactcggaagcaattc

SEQ ID NO: 356983 - DNA, 20 bp, human
gtgccagacgctggaccaca

SEQ ID NO: 356984 - DNA, 20 bp, human
gtagggatctcatgctatat

SEQ ID NO: 356985 - DNA, 20 bp, human
gtaggtgtaggattacgaag

SEQ ID NO: 356986 - DNA, 20 bp, human
ggggagctgccattttcgga

SEQ ID NO: 356987 - DNA, 20 bp, human
gatgcgtcaccatgttgaga

SEQ ID NO: 356988 - DNA, 20 bp, human
gcaaggtaaccctctcaaca

SEQ ID NO: 356989 - DNA, 20 bp, human
ggggttaccttgctaatttg

SEQ ID NO: 356990 - DNA, 20 bp, human
ggggagaaggagccatatcc

SEQ ID NO: 356991 - DNA, 20 bp, human
ggttaaagaccttccgaaaa

SEQ ID NO: 356992 - DNA, 20 bp, human
gtattaggctccaactgtca

SEQ ID NO: 356993 - DNA, 20 bp, human
gactttgatccgccgcagtg

SEQ ID NO: 356994 - DNA, 20 bp, human
ggatcttgtgccaccatgtt

SEQ ID NO: 356995 - DNA, 20 bp, human
ggtagtgtgctctatataag

SEQ ID NO: 356996 - DNA, 20 bp, human
ggagaaataagcccaggcta

SEQ ID NO: 356997 - DNA, 20 bp, human
gtaaggggtgggtccttcgg

SEQ ID NO: 356998 - DNA, 20 bp, human
gtcctagtctggcaccgggt

SEQ ID NO: 356999 - DNA, 20 bp, human
ggggacggcagtcaggcatt

SEQ ID NO: 357000 - DNA, 20 bp, human
gtccaacccggtgccagact

SEQ ID NO: 357001 - DNA, 20 bp, human
gggtgtggtcgcctaagggg

SEQ ID NO: 357002 - DNA, 20 bp, human
gaccgggttggattgtcgct

SEQ ID NO: 357003 - DNA, 20 bp, human
gtcccagcgacaatccaacc

SEQ ID NO: 357004 - DNA, 20 bp, human
gtttaaaaggaggtcgaggg

SEQ ID NO: 357005 - DNA, 20 bp, human
gggagctccgggaaaccccg

SEQ ID NO: 357006 - DNA, 20 bp, human
gagggcgcagggaagacccg

SEQ ID NO: 357007 - DNA, 20 bp, human
gccagggtgccaagtcccgt

SEQ ID NO: 357008 - DNA, 20 bp, human
gagtaatcctcggaaggggt

SEQ ID NO: 357009 - DNA, 20 bp, human
gcgcagggaagacccgggga

SEQ ID NO: 357010 - DNA, 20 bp, human
gcggggatggtgagcgttcc

SEQ ID NO: 357011 - DNA, 20 bp, human
ggacgccgcagcagggtact

SEQ ID NO: 357012 - DNA, 20 bp, human
gccccctaccaccgagagga

SEQ ID NO: 357013 - DNA, 20 bp, human
gaggccctcctctcggtggt

SEQ ID NO: 357014 - DNA, 20 bp, human
gggagcgcccgcggccaccg

SEQ ID NO: 357015 - DNA, 20 bp, human
gcaagtcccgtgggtctaac

SEQ ID NO: 357016 - DNA, 20 bp, human
gccagcggtggagacgtcac

SEQ ID NO: 357017 - DNA, 20 bp, human
gagccgctggatgagacggg

SEQ ID NO: 357018 - DNA, 20 bp, human
gccgcagccgctggatgaga

SEQ ID NO: 357019 - DNA, 20 bp, human
gcgcccttcagtatcgcgga

SEQ ID NO: 357020 - DNA, 20 bp, human
ggacagggctgcaccatggg

SEQ ID NO: 357021 - DNA, 20 bp, human
gtggtatcgcgagacgggag

SEQ ID NO: 357022 - DNA, 20 bp, human
ggctgcgcccttcagtatcg

SEQ ID NO: 357023 - DNA, 20 bp, human
gttccgtccgcgatactgaa

SEQ ID NO: 357024 - DNA, 20 bp, human
gggggctgctgggaaagacg

SEQ ID NO: 357025 - DNA, 20 bp, human
gcgccacccgtctcatccag

SEQ ID NO: 357026 - DNA, 20 bp, human
ggaaatcttagaggcgttgt

SEQ ID NO: 357027 - DNA, 20 bp, human
ggcgcccggcggtcggatac

SEQ ID NO: 357028 - DNA, 20 bp, human
gagaatagcactagaagctg

SEQ ID NO: 357029 - DNA, 20 bp, human
gtgtggtcaggttgtttcgc

SEQ ID NO: 357030 - DNA, 20 bp, human
ggtatggtgacgtcatcaac

SEQ ID NO: 357031 - DNA, 20 bp, human
gtgcgccggtatccgaccgc

SEQ ID NO: 357032 - DNA, 20 bp, human
gaggaaacgcgtgcgcagtg

SEQ ID NO: 357033 - DNA, 20 bp, human
gtcttagaggcgttgtgggc

SEQ ID NO: 357034 - DNA, 20 bp, human
gcccagaatgcagtgctcaa

SEQ ID NO: 357035 - DNA, 20 bp, human
gacgcgtgcgcagtgtggtc

SEQ ID NO: 357036 - DNA, 20 bp, human
gtgcgcgaggaccccgatgg

SEQ ID NO: 357037 - DNA, 20 bp, human
gcggccctgctaagggagaa

SEQ ID NO: 357038 - DNA, 20 bp, human
gaagggaagccgtttcccgc

SEQ ID NO: 357039 - DNA, 20 bp, human
gagtcgcggaccagtccaac

SEQ ID NO: 357040 - DNA, 20 bp, human
gcaacaggcaggcagatcag

SEQ ID NO: 357041 - DNA, 20 bp, human
ggctaagacagcccgagtcg

SEQ ID NO: 357042 - DNA, 20 bp, human
gcgagaacccggccctgcta

SEQ ID NO: 357043 - DNA, 20 bp, human
ggtcccgcgcttgtccttca

SEQ ID NO: 357044 - DNA, 20 bp, human
gcgcgggcttcatacagaca

SEQ ID NO: 357045 - DNA, 20 bp, human
gccacccggcgccgccatcg

SEQ ID NO: 357046 - DNA, 20 bp, human
gcacgcctgtgggtgctcat

SEQ ID NO: 357047 - DNA, 20 bp, human
gtaaagggcgcgagcgacga

SEQ ID NO: 357048 - DNA, 20 bp, human
ggcgctgcgtgcacgcctgt

SEQ ID NO: 357049 - DNA, 20 bp, human
gtacgtaagtaaggcgtcca

SEQ ID NO: 357050 - DNA, 20 bp, human
ggggaaagaagaatgtaggc

SEQ ID NO: 357051 - DNA, 20 bp, human
gagggcgcgagcgacgacgg

SEQ ID NO: 357052 - DNA, 20 bp, human
ggaaaggggcttcatccagc

SEQ ID NO: 357053 - DNA, 20 bp, human
ggaagaatgtaggcaggaac

SEQ ID NO: 357054 - DNA, 20 bp, human
gcaagcaatgtgaggtgcag

SEQ ID NO: 357055 - DNA, 20 bp, human
gtctggcccctacactttca

SEQ ID NO: 357056 - DNA, 20 bp, human
gtgcactcctgttggaacaa

SEQ ID NO: 357057 - DNA, 20 bp, human
gtccaaacccttgttccaac

SEQ ID NO: 357058 - DNA, 20 bp, human
gtactctgtgctgcgttctg

SEQ ID NO: 357059 - DNA, 20 bp, human
gtcctgttggaacaagggtt

SEQ ID NO: 357060 - DNA, 20 bp, human
gggttggaggtatttagttt

SEQ ID NO: 357061 - DNA, 20 bp, human
gaacaagggtttggaaccat

SEQ ID NO: 357062 - DNA, 20 bp, human
gagggttgctgcactcctgt

SEQ ID NO: 357063 - DNA, 20 bp, human
gaccgtaaagccaaataaca

SEQ ID NO: 357064 - DNA, 20 bp, human
gagcacagagtaggccacct

SEQ ID NO: 357065 - DNA, 20 bp, human
gatgatgacgagtctgactt

SEQ ID NO: 357066 - DNA, 20 bp, human
gaggccgcgcggcatgccgc

SEQ ID NO: 357067 - DNA, 20 bp, human
gcatgccgcgggctcactgg

SEQ ID NO: 357068 - DNA, 20 bp, human
ggtgtagaccaaggcgtcgg

SEQ ID NO: 357069 - DNA, 20 bp, human
ggagcccgcggcatgccgcg

SEQ ID NO: 357070 - DNA, 20 bp, human
ggcagcctccagtgagcccg

SEQ ID NO: 357071 - DNA, 20 bp, human
ggctgtgtagaccaaggcgt

SEQ ID NO: 357072 - DNA, 20 bp, human
ggcggcctccccacacacga

SEQ ID NO: 357073 - DNA, 20 bp, human
gagcgccactctttctactg

SEQ ID NO: 357074 - DNA, 20 bp, human
gtggttacctgtggtttctg

SEQ ID NO: 357075 - DNA, 20 bp, human
gcgacatcgccatcgtgtgt

SEQ ID NO: 357076 - DNA, 20 bp, human
gggaaagagggtgtctccta

SEQ ID NO: 357077 - DNA, 20 bp, human
gaggaaccgccgcggaaaga

SEQ ID NO: 357078 - DNA, 20 bp, human
gagtcccggcgcgccagcaa

SEQ ID NO: 357079 - DNA, 20 bp, human
gcgcggcggttcctcaactc

SEQ ID NO: 357080 - DNA, 20 bp, human
ggagggaggaaatcgccctt

SEQ ID NO: 357081 - DNA, 20 bp, human
gagacaccctctttccgcgg

SEQ ID NO: 357082 - DNA, 20 bp, human
gggcggagcagctgaaaatc

SEQ ID NO: 357083 - DNA, 20 bp, human
gcagccctttgctggcgcgc

SEQ ID NO: 357084 - DNA, 20 bp, human
gatgagctacacaacatccc

SEQ ID NO: 357085 - DNA, 20 bp, human
gtttcttgccatctgctggt

SEQ ID NO: 357086 - DNA, 20 bp, human
gccatggcgaaactctgcga

SEQ ID NO: 357087 - DNA, 20 bp, human
ggaaaagtgaaacatcgcca

SEQ ID NO: 357088 - DNA, 20 bp, human
gtgcctaccccccgtcaagt

SEQ ID NO: 357089 - DNA, 20 bp, human
gttcggtcgcccctacttgg

SEQ ID NO: 357090 - DNA, 20 bp, human
gtgagtgagaagtttagttc

SEQ ID NO: 357091 - DNA, 20 bp, human
gtgcctccatcatttgaaaa

SEQ ID NO: 357092 - DNA, 20 bp, human
gtcctgaaacagcacgattt

SEQ ID NO: 357093 - DNA, 20 bp, human
gaaaaagggccgttctacct

SEQ ID NO: 357094 - DNA, 20 bp, human
gggaactatcggtcttacca

SEQ ID NO: 357095 - DNA, 20 bp, human
gggcagatatactaggagtt

SEQ ID NO: 357096 - DNA, 20 bp, human
gataggttggttacccgagg

SEQ ID NO: 357097 - DNA, 20 bp, human
gcaacggaagaataataggt

SEQ ID NO: 357098 - DNA, 20 bp, human
gcgagctgtgacctctacaa

SEQ ID NO: 357099 - DNA, 20 bp, human
gagcacaacaaaaagtcccg

SEQ ID NO: 357100 - DNA, 20 bp, human
gtgttgtgcttcctcccctc

SEQ ID NO: 357101 - DNA, 20 bp, human
gaatctgcggtgataaacag

SEQ ID NO: 357102 - DNA, 20 bp, human
gggttacccgaggcggaatc

SEQ ID NO: 357103 - DNA, 20 bp, human
gtcagttccagattccgcct

SEQ ID NO: 357104 - DNA, 20 bp, human
gataataggttggttacccg

SEQ ID NO: 357105 - DNA, 20 bp, human
gtaggtgtcagttatgccac

SEQ ID NO: 357106 - DNA, 20 bp, human
gtgcaactgcgcatgcgctt

SEQ ID NO: 357107 - DNA, 20 bp, human
gtccctatagaccaatccgg

SEQ ID NO: 357108 - DNA, 20 bp, human
ggagtcagagggaactgaac

SEQ ID NO: 357109 - DNA, 20 bp, human
ggccctagaagcgtgcctgg

SEQ ID NO: 357110 - DNA, 20 bp, human
gtgcaggcgcccacaagaca

SEQ ID NO: 357111 - DNA, 20 bp, human
ggccgcggcgaggagtcaga

SEQ ID NO: 357112 - DNA, 20 bp, human
gaacctggacctgcggaggg

SEQ ID NO: 357113 - DNA, 20 bp, human
ggtgtccctatagaccaatc

SEQ ID NO: 357114 - DNA, 20 bp, human
gacaagacagggcaactacg

SEQ ID NO: 357115 - DNA, 20 bp, human
gaaaacttccgggtcagcac

SEQ ID NO: 357116 - DNA, 20 bp, human
gtagcggaagtgagcatggg

SEQ ID NO: 357117 - DNA, 20 bp, human
gagggcctgggaggtaaagt

SEQ ID NO: 357118 - DNA, 20 bp, human
gccaaccgactttacctccc

SEQ ID NO: 357119 - DNA, 20 bp, human
gcatgggtgggcggtacttc

SEQ ID NO: 357120 - DNA, 20 bp, human
gggatagcggaagtgagcat

SEQ ID NO: 357121 - DNA, 20 bp, human
gttccgggcgagattaatca

SEQ ID NO: 357122 - DNA, 20 bp, human
gaacccgcgtgtaattctga

SEQ ID NO: 357123 - DNA, 20 bp, human
ggagcagaagtacgggatag

SEQ ID NO: 357124 - DNA, 20 bp, human
gtctgaggttgtgccagtgg

SEQ ID NO: 357125 - DNA, 20 bp, human
ggcgagatgagcagaagtac

SEQ ID NO: 357126 - DNA, 20 bp, human
gctccctgtgggcctacaaa

SEQ ID NO: 357127 - DNA, 20 bp, human
ggatgtgcagggtaagggcg

SEQ ID NO: 357128 - DNA, 20 bp, human
ggtacccaacagacaaagac

SEQ ID NO: 357129 - DNA, 20 bp, human
gcctggtgctgggaaaccac

SEQ ID NO: 357130 - DNA, 20 bp, human
gggaccaaggcggatgtgca

SEQ ID NO: 357131 - DNA, 20 bp, human
gttaccctgcacatccgcct

SEQ ID NO: 357132 - DNA, 20 bp, human
ggtggtggccgggaccaagg

SEQ ID NO: 357133 - DNA, 20 bp, human
gaccacaggccctgagtgat

SEQ ID NO: 357134 - DNA, 20 bp, human
ggcacccaacaggtggaaac

SEQ ID NO: 357135 - DNA, 20 bp, human
gttccctttgtaggcccaca

SEQ ID NO: 357136 - DNA, 20 bp, human
gggtacaccactggaaggga

SEQ ID NO: 357137 - DNA, 20 bp, human
gtgggaatgccgcgccgcgg

SEQ ID NO: 357138 - DNA, 20 bp, human
gagaggataggggatctcta

SEQ ID NO: 357139 - DNA, 20 bp, human
gccctggtgtggtgtgtcca

SEQ ID NO: 357140 - DNA, 20 bp, human
ggagaacggtggccctggtg

SEQ ID NO: 357141 - DNA, 20 bp, human
gtccgccggagaggccctgc

SEQ ID NO: 357142 - DNA, 20 bp, human
gcggcgcggcattcccagcg

SEQ ID NO: 357143 - DNA, 20 bp, human
gcctaaggggagtgggtctc

SEQ ID NO: 357144 - DNA, 20 bp, human
gcggcggcgccgggtgacgg

SEQ ID NO: 357145 - DNA, 20 bp, human
gcgggggagaacggtggccc

SEQ ID NO: 357146 - DNA, 20 bp, human
ggggcggcgctgatgattgg

SEQ ID NO: 357147 - DNA, 20 bp, human
gcggggcggtgggctctcat

SEQ ID NO: 357148 - DNA, 20 bp, human
gagcgccgccctgtggttcc

SEQ ID NO: 357149 - DNA, 20 bp, human
gacagggcggcgctgatgat

SEQ ID NO: 357150 - DNA, 20 bp, human
gctctcccgggcggggcggt

SEQ ID NO: 357151 - DNA, 20 bp, human
gggagctggttcttgtagga

SEQ ID NO: 357152 - DNA, 20 bp, human
gccgccccgccccgccacta

SEQ ID NO: 357153 - DNA, 20 bp, human
gaggggtggtgagcgctgat

SEQ ID NO: 357154 - DNA, 20 bp, human
gagcggcgggcgctgattgg

SEQ ID NO: 357155 - DNA, 20 bp, human
ggccgtgggcggaaccgcgt

SEQ ID NO: 357156 - DNA, 20 bp, human
ggcctcgcctactttcagga

SEQ ID NO: 357157 - DNA, 20 bp, human
ggcgagcccaacagatctgg

SEQ ID NO: 357158 - DNA, 20 bp, human
gatacctgtctctcaaagcg

SEQ ID NO: 357159 - DNA, 20 bp, human
gccatgttgtgagcggaagt

SEQ ID NO: 357160 - DNA, 20 bp, human
gtcgctgttctgctgggagc

SEQ ID NO: 357161 - DNA, 20 bp, human
gcgacgcccccagatctgtt

SEQ ID NO: 357162 - DNA, 20 bp, human
ggcggcggtcgctgttctgc

SEQ ID NO: 357163 - DNA, 20 bp, human
gaggttggggcgcagaagga

SEQ ID NO: 357164 - DNA, 20 bp, human
gtgagagacaggtatcgctt

SEQ ID NO: 357165 - DNA, 20 bp, human
gccaccgccgcgcgcaccca

SEQ ID NO: 357166 - DNA, 20 bp, human
ggccctgcgcggcctgagtc

SEQ ID NO: 357167 - DNA, 20 bp, human
gggagagtcgagtaaggtcc

SEQ ID NO: 357168 - DNA, 20 bp, human
gggaactggaaacaccccgt

SEQ ID NO: 357169 - DNA, 20 bp, human
gcccggagcgcacggccctg

SEQ ID NO: 357170 - DNA, 20 bp, human
gagtctgtgccccaaggtgg

SEQ ID NO: 357171 - DNA, 20 bp, human
gcctgagcccgtgggtaacc

SEQ ID NO: 357172 - DNA, 20 bp, human
ggagccatccctgagcccgt

SEQ ID NO: 357173 - DNA, 20 bp, human
gttcccgggagagtcgagta

SEQ ID NO: 357174 - DNA, 20 bp, human
gggctgcagccggcattccc

SEQ ID NO: 357175 - DNA, 20 bp, human
ggaggctccaggttacccac

SEQ ID NO: 357176 - DNA, 20 bp, human
gcgcgcgcgtctgccaacgc

SEQ ID NO: 357177 - DNA, 20 bp, human
ggcccaatgggaaccggcgt

SEQ ID NO: 357178 - DNA, 20 bp, human
gtcacagcgtactgcccaat

SEQ ID NO: 357179 - DNA, 20 bp, human
gaaggggtgtgaccgttctg

SEQ ID NO: 357180 - DNA, 20 bp, human
gcgtactgcccaatgggaac

SEQ ID NO: 357181 - DNA, 20 bp, human
gggcgctcggggtctctgat

SEQ ID NO: 357182 - DNA, 20 bp, human
gccctgtgtccaatcagcga

SEQ ID NO: 357183 - DNA, 20 bp, human
gtgccaacgccggttcccat

SEQ ID NO: 357184 - DNA, 20 bp, human
ggatcgaagctggggaataa

SEQ ID NO: 357185 - DNA, 20 bp, human
ggggtgtgaccgttctgggg

SEQ ID NO: 357186 - DNA, 20 bp, human
gctgctccgtggacttgaga

SEQ ID NO: 357187 - DNA, 20 bp, human
gtggtgggtggtgggataga

SEQ ID NO: 357188 - DNA, 20 bp, human
ggggaatctccattgacgtt

SEQ ID NO: 357189 - DNA, 20 bp, human
gtgaagggggcgggatagag

SEQ ID NO: 357190 - DNA, 20 bp, human
gtccccagcttggggtgaag

SEQ ID NO: 357191 - DNA, 20 bp, human
gctgtgccgccgccgtgggg

SEQ ID NO: 357192 - DNA, 20 bp, human
gggcgtcacccaaacgtcaa

SEQ ID NO: 357193 - DNA, 20 bp, human
gaatggagattccccagctt

SEQ ID NO: 357194 - DNA, 20 bp, human
gggagtgggcaggtttaccg

SEQ ID NO: 357195 - DNA, 20 bp, human
gcccccttcaccccaagctg

SEQ ID NO: 357196 - DNA, 20 bp, human
gtggacatgcgcagaactat

SEQ ID NO: 357197 - DNA, 20 bp, human
gtacgtgtggagaactcctg

SEQ ID NO: 357198 - DNA, 20 bp, human
gagaactatcggcaggatcc

SEQ ID NO: 357199 - DNA, 20 bp, human
gagtcctccaagcgcgactt

SEQ ID NO: 357200 - DNA, 20 bp, human
gcatgcgcagaactatcggc

SEQ ID NO: 357201 - DNA, 20 bp, human
gatcggcaggatccaggcgc

SEQ ID NO: 357202 - DNA, 20 bp, human
ggcgtaggagcatgcgtaca

SEQ ID NO: 357203 - DNA, 20 bp, human
ggaagccaaacagtgggcag

SEQ ID NO: 357204 - DNA, 20 bp, human
gggctcctaaagttcagcgt

SEQ ID NO: 357205 - DNA, 20 bp, human
ggttccgtgaagccaaacag

SEQ ID NO: 357206 - DNA, 20 bp, human
ggggaattgtagtcctagag

SEQ ID NO: 357207 - DNA, 20 bp, human
ggcctggtggggaacaaaga

SEQ ID NO: 357208 - DNA, 20 bp, human
gttccgtcgcaaggcctctc

SEQ ID NO: 357209 - DNA, 20 bp, human
ggcgcgcgccggtgacgcaa

SEQ ID NO: 357210 - DNA, 20 bp, human
ggctcccagaaagccttgct

SEQ ID NO: 357211 - DNA, 20 bp, human
gttcccgagaggccttgcga

SEQ ID NO: 357212 - DNA, 20 bp, human
gcctgcggaaaggattctgc

SEQ ID NO: 357213 - DNA, 20 bp, human
gaggccggctgcgtgatgaa

SEQ ID NO: 357214 - DNA, 20 bp, human
ggcagtacccgtctccaaca

SEQ ID NO: 357215 - DNA, 20 bp, human
ggccttgctgggaagaccga

SEQ ID NO: 357216 - DNA, 20 bp, human
gccaaaggggctagaatcta

SEQ ID NO: 357217 - DNA, 20 bp, human
gcagtcccaggtgccccaaa

SEQ ID NO: 357218 - DNA, 20 bp, human
gaggctatctcccgcttcta

SEQ ID NO: 357219 - DNA, 20 bp, human
gaaggggctagaatctaagg

SEQ ID NO: 357220 - DNA, 20 bp, human
gtctcccctccccctagaag

SEQ ID NO: 357221 - DNA, 20 bp, human
gtacaagaggtcgtctttag

SEQ ID NO: 357222 - DNA, 20 bp, human
gcagcggcgaagcggcgagg

SEQ ID NO: 357223 - DNA, 20 bp, human
ggaggtctccgcagtgacgg

SEQ ID NO: 357224 - DNA, 20 bp, human
ggacggagctagcgtacaag

SEQ ID NO: 357225 - DNA, 20 bp, human
gagggaggaccacgctctcc

SEQ ID NO: 357226 - DNA, 20 bp, human
gcccagccgtgcagaccttg

SEQ ID NO: 357227 - DNA, 20 bp, human
ggcggggggcggtttagaga

SEQ ID NO: 357228 - DNA, 20 bp, human
gggccccgcacgctggatgc

SEQ ID NO: 357229 - DNA, 20 bp, human
gcaccaatcaccgcccggct

SEQ ID NO: 357230 - DNA, 20 bp, human
ggccgcaaggtctgcacggc

SEQ ID NO: 357231 - DNA, 20 bp, human
gtaaagccgcaaggtctgca

SEQ ID NO: 357232 - DNA, 20 bp, human
gagcaggtctagaatcatcc

SEQ ID NO: 357233 - DNA, 20 bp, human
gagccgagccgggcggtgat

SEQ ID NO: 357234 - DNA, 20 bp, human
gatcatccagggatgcggaa

SEQ ID NO: 357235 - DNA, 20 bp, human
gtaaaccaccaatcaccgcc

SEQ ID NO: 357236 - DNA, 20 bp, human
gtgcaacctgcactgaagac

SEQ ID NO: 357237 - DNA, 20 bp, human
gtaggaggctagagagtccc

SEQ ID NO: 357238 - DNA, 20 bp, human
ggaaccttgggagccggtac

SEQ ID NO: 357239 - DNA, 20 bp, human
ggctagagagtcccaggaag

SEQ ID NO: 357240 - DNA, 20 bp, human
gcaccaaagtacgaatccta

SEQ ID NO: 357241 - DNA, 20 bp, human
ggtaccggaacgctcggaaa

SEQ ID NO: 357242 - DNA, 20 bp, human
ggctctggggacgagtgtct

SEQ ID NO: 357243 - DNA, 20 bp, human
ggtccccagagccgcttcct

SEQ ID NO: 357244 - DNA, 20 bp, human
gcactgaagacgggaacctt

SEQ ID NO: 357245 - DNA, 20 bp, human
gcgccctaggattcgtactt

SEQ ID NO: 357246 - DNA, 20 bp, human
ggaggctgctgcggtcgttt

SEQ ID NO: 357247 - DNA, 20 bp, human
ggtcgtttaggatgagatgt

SEQ ID NO: 357248 - DNA, 20 bp, human
gcggctgcgttgaaaaagag

SEQ ID NO: 357249 - DNA, 20 bp, human
gagtcgccgggggtcggcag

SEQ ID NO: 357250 - DNA, 20 bp, human
ggtcggaggcgagtcgccgg

SEQ ID NO: 357251 - DNA, 20 bp, human
ggcgactcgcctccgaccct

SEQ ID NO: 357252 - DNA, 20 bp, human
gcattgaggcgggtgaaggg

SEQ ID NO: 357253 - DNA, 20 bp, human
gggaagggggtctgcggcgt

SEQ ID NO: 357254 - DNA, 20 bp, human
gggcgtctggactcctcagt

SEQ ID NO: 357255 - DNA, 20 bp, human
gctagggccacgagcctagg

SEQ ID NO: 357256 - DNA, 20 bp, human
gaggccccgaccaacctctc

SEQ ID NO: 357257 - DNA, 20 bp, human
gaatcagaagaggcgttggc

SEQ ID NO: 357258 - DNA, 20 bp, human
gctagagcggcgtgctaacc

SEQ ID NO: 357259 - DNA, 20 bp, human
ggagaagcagtggagacgtg

SEQ ID NO: 357260 - DNA, 20 bp, human
gagtggaaacctgagaagta

SEQ ID NO: 357261 - DNA, 20 bp, human
gagccaatcagaagaggcgt

SEQ ID NO: 357262 - DNA, 20 bp, human
gcacccggtcactgagaaag

SEQ ID NO: 357263 - DNA, 20 bp, human
gaaggttctccctacttctc

SEQ ID NO: 357264 - DNA, 20 bp, human
gaaaaaccaccgtccagggg

SEQ ID NO: 357265 - DNA, 20 bp, human
gactaggttttttccggcca

SEQ ID NO: 357266 - DNA, 20 bp, human
gtcccggcagcgttcttctc

SEQ ID NO: 357267 - DNA, 20 bp, human
gccgaccaggatgccgctac

SEQ ID NO: 357268 - DNA, 20 bp, human
gcgggcttgcgccgcaggag

SEQ ID NO: 357269 - DNA, 20 bp, human
gtatgcacagggcgtcgctg

SEQ ID NO: 357270 - DNA, 20 bp, human
gtggggcgcttgtgactttg

SEQ ID NO: 357271 - DNA, 20 bp, human
gtctgggctgtagccggtag

SEQ ID NO: 357272 - DNA, 20 bp, human
gaagcgccccagatccgacc

SEQ ID NO: 357273 - DNA, 20 bp, human
gagaaagtcgagcggaagaa

SEQ ID NO: 357274 - DNA, 20 bp, human
gcggcatcctggtcggatct

SEQ ID NO: 357275 - DNA, 20 bp, human
ggtagccggtagcggcatcc

SEQ ID NO: 357276 - DNA, 20 bp, human
gccaggagacacccattctg

SEQ ID NO: 357277 - DNA, 20 bp, human
gaacaggttcatgagcaagt

SEQ ID NO: 357278 - DNA, 20 bp, human
gacctactgtagtgacaaac

SEQ ID NO: 357279 - DNA, 20 bp, human
ggctgggaccagagtgattc

SEQ ID NO: 357280 - DNA, 20 bp, human
gctgaagaatgctatctatg

SEQ ID NO: 357281 - DNA, 20 bp, human
gtgtatgtatttgtgctgtg

SEQ ID NO: 357282 - DNA, 20 bp, human
gggtgtctcctgggatggcc

SEQ ID NO: 357283 - DNA, 20 bp, human
gacctgtttgtcactacagt

SEQ ID NO: 357284 - DNA, 20 bp, human
gttggccagaatatagttcc

SEQ ID NO: 357285 - DNA, 20 bp, human
gtggcaagtgacatatatta

SEQ ID NO: 357286 - DNA, 20 bp, human
ggtaaccgaggtaacggggt

SEQ ID NO: 357287 - DNA, 20 bp, human
gaacaaatggcgattaactg

SEQ ID NO: 357288 - DNA, 20 bp, human
ggggagagaccgctctgagg

SEQ ID NO: 357289 - DNA, 20 bp, human
gagaccaaacctcctcagag

SEQ ID NO: 357290 - DNA, 20 bp, human
ggtccccgaccccgttacct

SEQ ID NO: 357291 - DNA, 20 bp, human
ggccacccagcatgcagcga

SEQ ID NO: 357292 - DNA, 20 bp, human
ggtaggccgcggtgcattct

SEQ ID NO: 357293 - DNA, 20 bp, human
gactggggaaaacggaatta

SEQ ID NO: 357294 - DNA, 20 bp, human
gaacggaattatggtaaccg

SEQ ID NO: 357295 - DNA, 20 bp, human
gtccttcgctgcatgctggg

SEQ ID NO: 357296 - DNA, 20 bp, human
gcacgccggctgctgattgg

SEQ ID NO: 357297 - DNA, 20 bp, human
gctccccaggacaggacgcg

SEQ ID NO: 357298 - DNA, 20 bp, human
gcggggcgggcagtgcgcga

SEQ ID NO: 357299 - DNA, 20 bp, human
gcggcgcgggaggttcggag

SEQ ID NO: 357300 - DNA, 20 bp, human
ggggcacgccggctgctgat

SEQ ID NO: 357301 - DNA, 20 bp, human
ggcccccgcgtcctgtcctg

SEQ ID NO: 357302 - DNA, 20 bp, human
gcagcagccggcgtgcccgg

SEQ ID NO: 357303 - DNA, 20 bp, human
gggcgggcagtgcgcgacgg

SEQ ID NO: 357304 - DNA, 20 bp, human
ggggagctcgggctcgcgga

SEQ ID NO: 357305 - DNA, 20 bp, human
gaggttcggagcgggagctc

SEQ ID NO: 357306 - DNA, 20 bp, human
ggggtggggcgtggggactc

SEQ ID NO: 357307 - DNA, 20 bp, human
gaaggagcggcgcgtgacca

SEQ ID NO: 357308 - DNA, 20 bp, human
gcaaccacgtagagcgtggt

SEQ ID NO: 357309 - DNA, 20 bp, human
gagcgcgtacaggtgcttca

SEQ ID NO: 357310 - DNA, 20 bp, human
ggggcagcccagtgctgccg

SEQ ID NO: 357311 - DNA, 20 bp, human
gtggttgcttggtgttaggt

SEQ ID NO: 357312 - DNA, 20 bp, human
gagccccacggtggcgtctg

SEQ ID NO: 357313 - DNA, 20 bp, human
gacgcacagcgccccgctgg

SEQ ID NO: 357314 - DNA, 20 bp, human
gcacctgtacgcgctgccgg

SEQ ID NO: 357315 - DNA, 20 bp, human
gaccaaggcttacctggcat

SEQ ID NO: 357316 - DNA, 20 bp, human
ggggcctccctgattcgctg

SEQ ID NO: 357317 - DNA, 20 bp, human
gcggccccagcgaatcaggg

SEQ ID NO: 357318 - DNA, 20 bp, human
ggagctgctcgaattaaatt

SEQ ID NO: 357319 - DNA, 20 bp, human
gataggaagacgtctgagta

SEQ ID NO: 357320 - DNA, 20 bp, human
ggaggcccagtcccgaggcg

SEQ ID NO: 357321 - DNA, 20 bp, human
gcagaccccgcctcgggact

SEQ ID NO: 357322 - DNA, 20 bp, human
gtcagggaggcccagtcccg

SEQ ID NO: 357323 - DNA, 20 bp, human
gcactcggccccagcgaatc

SEQ ID NO: 357324 - DNA, 20 bp, human
ggtcctcagatcgcgaccct

SEQ ID NO: 357325 - DNA, 20 bp, human
gttatcgcagaccccgcctc

SEQ ID NO: 357326 - DNA, 20 bp, human
gggtcagctggagtgtcaat

SEQ ID NO: 357327 - DNA, 20 bp, human
gaatcggaatggtgaccggg

SEQ ID NO: 357328 - DNA, 20 bp, human
ggcgctctccctaaaagcat

SEQ ID NO: 357329 - DNA, 20 bp, human
gtctccctaaaagcatagga

SEQ ID NO: 357330 - DNA, 20 bp, human
gtgtcaatcggaatggtgac

SEQ ID NO: 357331 - DNA, 20 bp, human
gcggggcttttcctccgccc

SEQ ID NO: 357332 - DNA, 20 bp, human
gtcaggctctgagtcccgcc

SEQ ID NO: 357333 - DNA, 20 bp, human
ggctggagtgtcaatcggaa

SEQ ID NO: 357334 - DNA, 20 bp, human
gagcgcgctggctggagcgc

SEQ ID NO: 357335 - DNA, 20 bp, human
gatgccttcctatgctttta

SEQ ID NO: 357336 - DNA, 20 bp, human
gcagctggagcagtggcgtt

SEQ ID NO: 357337 - DNA, 20 bp, human
ggagactcggtgagtgtgta

SEQ ID NO: 357338 - DNA, 20 bp, human
gtgggcgccgccatcttaca

SEQ ID NO: 357339 - DNA, 20 bp, human
gcgtcgggcccctggatccg

SEQ ID NO: 357340 - DNA, 20 bp, human
ggagaagggcgactacaatg

SEQ ID NO: 357341 - DNA, 20 bp, human
gagggcgactacaatgaggc

SEQ ID NO: 357342 - DNA, 20 bp, human
gggacggtgcgcgctcagtg

SEQ ID NO: 357343 - DNA, 20 bp, human
gactacaatgaggcgggagt

SEQ ID NO: 357344 - DNA, 20 bp, human
gccgcaccacgtgacctgca

SEQ ID NO: 357345 - DNA, 20 bp, human
ggcgcccaggtggagcgcgt

SEQ ID NO: 357346 - DNA, 20 bp, human
gtacccctagtcagggagag

SEQ ID NO: 357347 - DNA, 20 bp, human
gcggggcgagggcgtgtgag

SEQ ID NO: 357348 - DNA, 20 bp, human
gcccgactgggttgcgtagg

SEQ ID NO: 357349 - DNA, 20 bp, human
gcccctgccgtgactgtagt

SEQ ID NO: 357350 - DNA, 20 bp, human
ggtgggggggcgtcgaaatc

SEQ ID NO: 357351 - DNA, 20 bp, human
gagccgctctccctgactag

SEQ ID NO: 357352 - DNA, 20 bp, human
gtacagtcacggcaggggcg

SEQ ID NO: 357353 - DNA, 20 bp, human
gggggcgtcgaaatcgggtg

SEQ ID NO: 357354 - DNA, 20 bp, human
gccctcctacgcaacccagt

SEQ ID NO: 357355 - DNA, 20 bp, human
gccaaaagccagtgaacggc

SEQ ID NO: 357356 - DNA, 20 bp, human
gtagctgtctgggaatagag

SEQ ID NO: 357357 - DNA, 20 bp, human
gaatagaggggctgaccggt

SEQ ID NO: 357358 - DNA, 20 bp, human
gtgcggggggagtacgtgat

SEQ ID NO: 357359 - DNA, 20 bp, human
gagagagagcgaggttgcgg

SEQ ID NO: 357360 - DNA, 20 bp, human
gtatggggagtgggtgtcat

SEQ ID NO: 357361 - DNA, 20 bp, human
gaggcgaggtccggagctga

SEQ ID NO: 357362 - DNA, 20 bp, human
ggctactcccctggcgggta

SEQ ID NO: 357363 - DNA, 20 bp, human
gctgaccggtaggcgaggtc

SEQ ID NO: 357364 - DNA, 20 bp, human
ggtcggggatgtaaggtccg

SEQ ID NO: 357365 - DNA, 20 bp, human
gcccgcagcagcgtggaccg

SEQ ID NO: 357366 - DNA, 20 bp, human
ggcgtgagccctaagatgga

SEQ ID NO: 357367 - DNA, 20 bp, human
ggttgctaggggtacgtgtg

SEQ ID NO: 357368 - DNA, 20 bp, human
gggcggcgtgagccctaaga

SEQ ID NO: 357369 - DNA, 20 bp, human
gaaggctcgtcgggcacgga

SEQ ID NO: 357370 - DNA, 20 bp, human
gggcacggagggcggagcga

SEQ ID NO: 357371 - DNA, 20 bp, human
gcaagctggggaggcctaag

SEQ ID NO: 357372 - DNA, 20 bp, human
gctaggggtacgtgtgtggt

SEQ ID NO: 357373 - DNA, 20 bp, human
gctaaagccagttgcggtgg

SEQ ID NO: 357374 - DNA, 20 bp, human
gtaatgaaacctaaccgggg

SEQ ID NO: 357375 - DNA, 20 bp, human
gtacgtgtgtggttggccgg

SEQ ID NO: 357376 - DNA, 20 bp, human
gtggccccacccatccgcta

SEQ ID NO: 357377 - DNA, 20 bp, human
gtccgcccctcgggcggggt

SEQ ID NO: 357378 - DNA, 20 bp, human
gccgctaccaaagggacggg

SEQ ID NO: 357379 - DNA, 20 bp, human
gaggctccgcccctcgggcg

SEQ ID NO: 357380 - DNA, 20 bp, human
gagcgccctaccccgcccga

SEQ ID NO: 357381 - DNA, 20 bp, human
ggccttcagcctctctaatg

SEQ ID NO: 357382 - DNA, 20 bp, human
gcccacattagagaggctga

SEQ ID NO: 357383 - DNA, 20 bp, human
gctgccgctaccaaagggac

SEQ ID NO: 357384 - DNA, 20 bp, human
gcgtgacagactccggggta

SEQ ID NO: 357385 - DNA, 20 bp, human
gtctccatagcggatgggtg

SEQ ID NO: 357386 - DNA, 20 bp, human
gcgttgtatgcgggccgggg

SEQ ID NO: 357387 - DNA, 20 bp, human
gcatctccatagcggtgctc

SEQ ID NO: 357388 - DNA, 20 bp, human
ggctctgagtcaggtgattc

SEQ ID NO: 357389 - DNA, 20 bp, human
gagctcgggcggccaataag

SEQ ID NO: 357390 - DNA, 20 bp, human
gccgaagcccagccgcttat

SEQ ID NO: 357391 - DNA, 20 bp, human
ggggaggaggagtcacgagg

SEQ ID NO: 357392 - DNA, 20 bp, human
ggggctgagggcccgagccg

SEQ ID NO: 357393 - DNA, 20 bp, human
gtgctctcgagtagcagctc

SEQ ID NO: 357394 - DNA, 20 bp, human
ggggcggccaataagcggct

SEQ ID NO: 357395 - DNA, 20 bp, human
gcccggagcccggctctcat

SEQ ID NO: 357396 - DNA, 20 bp, human
gccccgccgagtggtgcccg

SEQ ID NO: 357397 - DNA, 20 bp, human
gcaccactcggcggggcgct

SEQ ID NO: 357398 - DNA, 20 bp, human
ggtcccgggggccccgtgta

SEQ ID NO: 357399 - DNA, 20 bp, human
ggccgcgggcaccactcggc

SEQ ID NO: 357400 - DNA, 20 bp, human
ggcgtgtgtcggtgtgagtc

SEQ ID NO: 357401 - DNA, 20 bp, human
gacggcgggggggacattga

SEQ ID NO: 357402 - DNA, 20 bp, human
ggcgcggcagttcctcccgg

SEQ ID NO: 357403 - DNA, 20 bp, human
gcacacgcacgaggagaccg

SEQ ID NO: 357404 - DNA, 20 bp, human
gcgccggcggaggagtcagc

SEQ ID NO: 357405 - DNA, 20 bp, human
gctccggctgactcctccgc

SEQ ID NO: 357406 - DNA, 20 bp, human
gtctccggacacttaaggag

SEQ ID NO: 357407 - DNA, 20 bp, human
gggaacggcgttcgctgcga

SEQ ID NO: 357408 - DNA, 20 bp, human
gcgaaggggaattccgaatg

SEQ ID NO: 357409 - DNA, 20 bp, human
ggggaattccgaatgaggcg

SEQ ID NO: 357410 - DNA, 20 bp, human
gcaaggagggctcgcgtctc

SEQ ID NO: 357411 - DNA, 20 bp, human
gggggcggaaagttcctcag

SEQ ID NO: 357412 - DNA, 20 bp, human
gagagcgcgtggcgccgctc

SEQ ID NO: 357413 - DNA, 20 bp, human
gcggaaagttcctcagggga

SEQ ID NO: 357414 - DNA, 20 bp, human
ggccgctcagggcaaagcac

SEQ ID NO: 357415 - DNA, 20 bp, human
gcagcgggagggcggtctgt

SEQ ID NO: 357416 - DNA, 20 bp, human
gcactggctagggattagag

SEQ ID NO: 357417 - DNA, 20 bp, human
gagcgagtgcgtgagagtgt

SEQ ID NO: 357418 - DNA, 20 bp, human
ggattagagcggtgtgtccg

SEQ ID NO: 357419 - DNA, 20 bp, human
gcgcactcgctcactggcta

SEQ ID NO: 357420 - DNA, 20 bp, human
ggaggttcgggaggtaaccc

SEQ ID NO: 357421 - DNA, 20 bp, human
gagaagcggggtgacggcac

SEQ ID NO: 357422 - DNA, 20 bp, human
ggggcggggccgcgccgctt

SEQ ID NO: 357423 - DNA, 20 bp, human
gccgccacaaatggccgtct

SEQ ID NO: 357424 - DNA, 20 bp, human
ggtaccgggaggcgtctgga

SEQ ID NO: 357425 - DNA, 20 bp, human
ggcgcggcgtcgcgggagta

SEQ ID NO: 357426 - DNA, 20 bp, human
gcggccacccgcgtcctgac

SEQ ID NO: 357427 - DNA, 20 bp, human
gtggccagtcaggacgcggg

SEQ ID NO: 357428 - DNA, 20 bp, human
gagccgcggcggcggccatt

SEQ ID NO: 357429 - DNA, 20 bp, human
gcacctcggccaatgggaga

SEQ ID NO: 357430 - DNA, 20 bp, human
gagcgccgcgggcccagagt

SEQ ID NO: 357431 - DNA, 20 bp, human
gggtgcggaccaatgggaag

SEQ ID NO: 357432 - DNA, 20 bp, human
gcggcggccattgggcagag

SEQ ID NO: 357433 - DNA, 20 bp, human
gcgctggccagtcaggacgc

SEQ ID NO: 357434 - DNA, 20 bp, human
ggggccgttcgccagctctg

SEQ ID NO: 357435 - DNA, 20 bp, human
gtgccggtcgctggccagtc

SEQ ID NO: 357436 - DNA, 20 bp, human
ggcggcggcggcgctcggac

SEQ ID NO: 357437 - DNA, 20 bp, human
gagggcgtagggcaaacctg

SEQ ID NO: 357438 - DNA, 20 bp, human
gcatcccgggatggcaactg

SEQ ID NO: 357439 - DNA, 20 bp, human
gcaaacctggggctgcggtg

SEQ ID NO: 357440 - DNA, 20 bp, human
gggcccggggcgccttggga

SEQ ID NO: 357441 - DNA, 20 bp, human
gtgaccgcagttgccatccc

SEQ ID NO: 357442 - DNA, 20 bp, human
gcggactggggggggtgagg

SEQ ID NO: 357443 - DNA, 20 bp, human
gcaccctgctaaagtcgggg

SEQ ID NO: 357444 - DNA, 20 bp, human
ggccatcccgggatggatgg

SEQ ID NO: 357445 - DNA, 20 bp, human
gacgtgttactgagcggccg

SEQ ID NO: 357446 - DNA, 20 bp, human
gcttctttgaggtctctaag

SEQ ID NO: 357447 - DNA, 20 bp, human
gagaagactgatgcccaaat

SEQ ID NO: 357448 - DNA, 20 bp, human
ggaatggtcaacagaaaaca

SEQ ID NO: 357449 - DNA, 20 bp, human
gtaattgggctaaagaggaa

SEQ ID NO: 357450 - DNA, 20 bp, human
gggcatcagtcttctatcta

SEQ ID NO: 357451 - DNA, 20 bp, human
gaaactcaggaaatcagtat

SEQ ID NO: 357452 - DNA, 20 bp, human
gagggagggcctctatgaaa

SEQ ID NO: 357453 - DNA, 20 bp, human
gaagaagggccttttcatag

SEQ ID NO: 357454 - DNA, 20 bp, human
gccaaataggttaaaatgtg

SEQ ID NO: 357455 - DNA, 20 bp, human
gctcccttaacaaatttaat

SEQ ID NO: 357456 - DNA, 20 bp, human
gcgcgtctccgccggaggaa

SEQ ID NO: 357457 - DNA, 20 bp, human
ggccccgagggtcccgaact

SEQ ID NO: 357458 - DNA, 20 bp, human
ggggagaggcgtagtcttct

SEQ ID NO: 357459 - DNA, 20 bp, human
ggtaggcttcacagactgac

SEQ ID NO: 357460 - DNA, 20 bp, human
ggggcatgtccatatccaat

SEQ ID NO: 357461 - DNA, 20 bp, human
gaagactacgcctctcccat

SEQ ID NO: 357462 - DNA, 20 bp, human
gtggatatggacatgcccgg

SEQ ID NO: 357463 - DNA, 20 bp, human
gagtctgtgaagcctacccc

SEQ ID NO: 357464 - DNA, 20 bp, human
gtgctacgccagggccccga

SEQ ID NO: 357465 - DNA, 20 bp, human
gggctctaggtgctacgcca

SEQ ID NO: 357466 - DNA, 20 bp, human
gaaccgtttaggattgcgtg

SEQ ID NO: 357467 - DNA, 20 bp, human
gcgtccacgggggtgtcccc

SEQ ID NO: 357468 - DNA, 20 bp, human
gcgctcccggcccttcccat

SEQ ID NO: 357469 - DNA, 20 bp, human
gccgcggccagcctgggtag

SEQ ID NO: 357470 - DNA, 20 bp, human
gacccccggggacacccccg

SEQ ID NO: 357471 - DNA, 20 bp, human
gcgcggcgcgggagatttaa

SEQ ID NO: 357472 - DNA, 20 bp, human
gaggccgccgagaccctcag

SEQ ID NO: 357473 - DNA, 20 bp, human
gggaaccgggaggtcccggg

SEQ ID NO: 357474 - DNA, 20 bp, human
ggggaggaggtgctttcggg

SEQ ID NO: 357475 - DNA, 20 bp, human
gcgcagggacacggatcgaa

SEQ ID NO: 357476 - DNA, 20 bp, human
ggaggcggggagaaaccctt

SEQ ID NO: 357477 - DNA, 20 bp, human
gcgcagggagagtcactcaa

SEQ ID NO: 357478 - DNA, 20 bp, human
gtcggggctccgcctaactt

SEQ ID NO: 357479 - DNA, 20 bp, human
gggcggggctggccgaagtt

SEQ ID NO: 357480 - DNA, 20 bp, human
gggagagtcactcaatggac

SEQ ID NO: 357481 - DNA, 20 bp, human
gggggctggccgaagttagg

SEQ ID NO: 357482 - DNA, 20 bp, human
gtgggtgctgtcgtagttgg

SEQ ID NO: 357483 - DNA, 20 bp, human
ggagacagggataatccctt

SEQ ID NO: 357484 - DNA, 20 bp, human
gccttaggccgcagtagggg

SEQ ID NO: 357485 - DNA, 20 bp, human
gaggcggggccgatgaggtg

SEQ ID NO: 357486 - DNA, 20 bp, human
gcccacgcggggccgctgat

SEQ ID NO: 357487 - DNA, 20 bp, human
gaacgaggagcgggtttcag

SEQ ID NO: 357488 - DNA, 20 bp, human
gtatactcacgcactagcgc

SEQ ID NO: 357489 - DNA, 20 bp, human
gctccaagtagaacgaggag

SEQ ID NO: 357490 - DNA, 20 bp, human
gctcacgcactagcgctggc

SEQ ID NO: 357491 - DNA, 20 bp, human
ggccaatcagcggccccgcg

SEQ ID NO: 357492 - DNA, 20 bp, human
gcctcagggctggatggagc

SEQ ID NO: 357493 - DNA, 20 bp, human
gcagcggccccgcgtgggga

SEQ ID NO: 357494 - DNA, 20 bp, human
gagcatacgccctccccacg

SEQ ID NO: 357495 - DNA, 20 bp, human
gcgtgagtataaggagagac

SEQ ID NO: 357496 - DNA, 20 bp, human
gccacccccgcgctggtaga

SEQ ID NO: 357497 - DNA, 20 bp, human
gctgccttcccgggcttcgt

SEQ ID NO: 357498 - DNA, 20 bp, human
gcacctggataagcatactt

SEQ ID NO: 357499 - DNA, 20 bp, human
gctggacccgtctgggaggt

SEQ ID NO: 357500 - DNA, 20 bp, human
gacaccatctaccagcgcgg

SEQ ID NO: 357501 - DNA, 20 bp, human
gcggagattgcccccaattc

SEQ ID NO: 357502 - DNA, 20 bp, human
gggtgtcaaggtccttgcgt

SEQ ID NO: 357503 - DNA, 20 bp, human
gggtgcgcgccgacgaagcc

SEQ ID NO: 357504 - DNA, 20 bp, human
gcggagccggatgcggaaat

SEQ ID NO: 357505 - DNA, 20 bp, human
gcttgcgtgggagaaggact

SEQ ID NO: 357506 - DNA, 20 bp, human
ggctccctgcctgtgcgcat

SEQ ID NO: 357507 - DNA, 20 bp, human
ggcggtgggtcgggattctg

SEQ ID NO: 357508 - DNA, 20 bp, human
gccgcccatgcgcacaggca

SEQ ID NO: 357509 - DNA, 20 bp, human
gtgcgcctgggcggtgtcgc

SEQ ID NO: 357510 - DNA, 20 bp, human
ggcgcaactgcagcccccgg

SEQ ID NO: 357511 - DNA, 20 bp, human
gctgcgcctgcgcctcgctg

SEQ ID NO: 357512 - DNA, 20 bp, human
gcggctcggccactgcgcgg

SEQ ID NO: 357513 - DNA, 20 bp, human
gcggaggccgaaggctacag

SEQ ID NO: 357514 - DNA, 20 bp, human
ggctggggctgcggtgggtc

SEQ ID NO: 357515 - DNA, 20 bp, human
gtcctcctggccccggcgcg

SEQ ID NO: 357516 - DNA, 20 bp, human
gcgttgctagggaggaagtt

SEQ ID NO: 357517 - DNA, 20 bp, human
ggaggaagttaggttgctaa

SEQ ID NO: 357518 - DNA, 20 bp, human
gccaaggagatccgttgcta

SEQ ID NO: 357519 - DNA, 20 bp, human
ggaagtgacgccagaagaag

SEQ ID NO: 357520 - DNA, 20 bp, human
gctccccatccgaagccagg

SEQ ID NO: 357521 - DNA, 20 bp, human
gccaggaggaggtgtaaaac

SEQ ID NO: 357522 - DNA, 20 bp, human
gctcctcctggcttcggatg

SEQ ID NO: 357523 - DNA, 20 bp, human
gcagccaggaccaggtttca

SEQ ID NO: 357524 - DNA, 20 bp, human
gaggagatccgttgctaggg

SEQ ID NO: 357525 - DNA, 20 bp, human
gtaggttgctaagggttcta

SEQ ID NO: 357526 - DNA, 20 bp, human
gacttggagagagctctgaa

SEQ ID NO: 357527 - DNA, 20 bp, human
gtcgtctagcccagagttcc

SEQ ID NO: 357528 - DNA, 20 bp, human
gaacacaaggttccggggcg

SEQ ID NO: 357529 - DNA, 20 bp, human
ggctccggccccggaactct

SEQ ID NO: 357530 - DNA, 20 bp, human
gggagcctcagaatgtgact

SEQ ID NO: 357531 - DNA, 20 bp, human
gacacgtgagtccggagcgg

SEQ ID NO: 357532 - DNA, 20 bp, human
gcagccgctgattttcgtcc

SEQ ID NO: 357533 - DNA, 20 bp, human
gccggactcacgtgtgagtg

SEQ ID NO: 357534 - DNA, 20 bp, human
gggcgagctagcggaggagt

SEQ ID NO: 357535 - DNA, 20 bp, human
ggggctagacgaccccgccc

SEQ ID NO: 357536 - DNA, 20 bp, human
gtggcgccggcgctgccttt

SEQ ID NO: 357537 - DNA, 20 bp, human
ggtgagcgcggcagtggccc

SEQ ID NO: 357538 - DNA, 20 bp, human
gggcaaccgaaaggcagcgc

SEQ ID NO: 357539 - DNA, 20 bp, human
gtagacggcgaggttagcca

SEQ ID NO: 357540 - DNA, 20 bp, human
gcgggctgatggcgtcacaa

SEQ ID NO: 357541 - DNA, 20 bp, human
gggcgaggttagccagggtt

SEQ ID NO: 357542 - DNA, 20 bp, human
ggcggctcgcagcgcgctct

SEQ ID NO: 357543 - DNA, 20 bp, human
gttgaccaggaagagacgga

SEQ ID NO: 357544 - DNA, 20 bp, human
ggccctggcagctggcggag

SEQ ID NO: 357545 - DNA, 20 bp, human
gccagggttaggacttgacc

SEQ ID NO: 357546 - DNA, 20 bp, human
gaccctgcgactcgggcaga

SEQ ID NO: 357547 - DNA, 20 bp, human
gtctcaacgtggtgacgaat

SEQ ID NO: 357548 - DNA, 20 bp, human
gcagaaaactgcgcggtcga

SEQ ID NO: 357549 - DNA, 20 bp, human
gacccagcaccctgcgactc

SEQ ID NO: 357550 - DNA, 20 bp, human
gactgcgcggtcgagggcca

SEQ ID NO: 357551 - DNA, 20 bp, human
gggcgttcccggtctcaacg

SEQ ID NO: 357552 - DNA, 20 bp, human
ggacaagcaccctgaggttc

SEQ ID NO: 357553 - DNA, 20 bp, human
ggggctgccgtgagcggaag

SEQ ID NO: 357554 - DNA, 20 bp, human
gggcctggtccaagcttctc

SEQ ID NO: 357555 - DNA, 20 bp, human
ggaatgggcagaaaactgcg

SEQ ID NO: 357556 - DNA, 20 bp, human
gcgaatgtcagagttgaccc

SEQ ID NO: 357557 - DNA, 20 bp, human
gtctctgagcggatgaaggt

SEQ ID NO: 357558 - DNA, 20 bp, human
gataaatcagcgcgcgaaag

SEQ ID NO: 357559 - DNA, 20 bp, human
ggccgaaccgcaactcccgg

SEQ ID NO: 357560 - DNA, 20 bp, human
gactgaacatcagagatgtc

SEQ ID NO: 357561 - DNA, 20 bp, human
ggcgctgatttatctctgag

SEQ ID NO: 357562 - DNA, 20 bp, human
gggcctggagcaatacacac

SEQ ID NO: 357563 - DNA, 20 bp, human
gtgacagttacgagaggagc

SEQ ID NO: 357564 - DNA, 20 bp, human
gactgtcaataacctatcca

SEQ ID NO: 357565 - DNA, 20 bp, human
gcacgggactggccatggat

SEQ ID NO: 357566 - DNA, 20 bp, human
ggggctgcaggatccttctc

SEQ ID NO: 357567 - DNA, 20 bp, human
gcggccggacgggagttccc

SEQ ID NO: 357568 - DNA, 20 bp, human
gtctccggggaactcccgtc

SEQ ID NO: 357569 - DNA, 20 bp, human
gtgcccaagagcgccacggg

SEQ ID NO: 357570 - DNA, 20 bp, human
gcgcgcctggctaaactcga

SEQ ID NO: 357571 - DNA, 20 bp, human
gtagccaggcgcggctagaa

SEQ ID NO: 357572 - DNA, 20 bp, human
gccccgcccgtggcgctctt

SEQ ID NO: 357573 - DNA, 20 bp, human
gtgggcagggggtgacgaag

SEQ ID NO: 357574 - DNA, 20 bp, human
gcaaccctggggaggacccc

SEQ ID NO: 357575 - DNA, 20 bp, human
gcgcggctagaagggcaggg

SEQ ID NO: 357576 - DNA, 20 bp, human
gggagcctaggaacttcagg

SEQ ID NO: 357577 - DNA, 20 bp, human
ggctacaagcgtgcatccta

SEQ ID NO: 357578 - DNA, 20 bp, human
gcccgcctcctgaagttcct

SEQ ID NO: 357579 - DNA, 20 bp, human
gcggaagcgccgtggagatg

SEQ ID NO: 357580 - DNA, 20 bp, human
gtaggaagcccgcatctcca

SEQ ID NO: 357581 - DNA, 20 bp, human
ggacccaatggagcagtagg

SEQ ID NO: 357582 - DNA, 20 bp, human
gtcccgcaccaggctcgagt

SEQ ID NO: 357583 - DNA, 20 bp, human
gcgggcttcctactcgagcc

SEQ ID NO: 357584 - DNA, 20 bp, human
gcatcaggccggaagcgccg

SEQ ID NO: 357585 - DNA, 20 bp, human
gtcctactcgagcctggtgc

SEQ ID NO: 357586 - DNA, 20 bp, human
gcggtctagagggcggtcca

SEQ ID NO: 357587 - DNA, 20 bp, human
gatccgggcgaccagaggaa

SEQ ID NO: 357588 - DNA, 20 bp, human
gcggaagcggctcgcaatcc

SEQ ID NO: 357589 - DNA, 20 bp, human
gggtccggggacagtctcgc

SEQ ID NO: 357590 - DNA, 20 bp, human
ggggccggagggtttgtcca

SEQ ID NO: 357591 - DNA, 20 bp, human
gttaggctggcgccagatag

SEQ ID NO: 357592 - DNA, 20 bp, human
gcggtccagggacagctcgg

SEQ ID NO: 357593 - DNA, 20 bp, human
ggggcgggaggcggtctaga

SEQ ID NO: 357594 - DNA, 20 bp, human
gggggcgggtacaaattcct

SEQ ID NO: 357595 - DNA, 20 bp, human
gccgcctagggggtggtcca

SEQ ID NO: 357596 - DNA, 20 bp, human
gcctcaacaaggaagtctca

SEQ ID NO: 357597 - DNA, 20 bp, human
gaactgagattcagttcgcg

SEQ ID NO: 357598 - DNA, 20 bp, human
ggttgaggcaggtaactctg

SEQ ID NO: 357599 - DNA, 20 bp, human
gcatttagttcttaggtctt

SEQ ID NO: 357600 - DNA, 20 bp, human
gaagatgcttaatgaggcca

SEQ ID NO: 357601 - DNA, 20 bp, human
gaatgtaagggaagcaatgg

SEQ ID NO: 357602 - DNA, 20 bp, human
gactctgtgggttaacttga

SEQ ID NO: 357603 - DNA, 20 bp, human
gaacttaatcccctgctcct

SEQ ID NO: 357604 - DNA, 20 bp, human
gtggattaagatgcttaatg

SEQ ID NO: 357605 - DNA, 20 bp, human
gcttaatccatttagttctt

SEQ ID NO: 357606 - DNA, 20 bp, human
gcagccggcggaaggaagag

SEQ ID NO: 357607 - DNA, 20 bp, human
ggcctggggaaagaaccgac

SEQ ID NO: 357608 - DNA, 20 bp, human
gtggggaaagaaccgacagg

SEQ ID NO: 357609 - DNA, 20 bp, human
gggcgcccgggcgctcactg

SEQ ID NO: 357610 - DNA, 20 bp, human
ggctcactgcggcctcctgt

SEQ ID NO: 357611 - DNA, 20 bp, human
gacaagagggcccgggcccg

SEQ ID NO: 357612 - DNA, 20 bp, human
ggaggccgcagtgagcgccc

SEQ ID NO: 357613 - DNA, 20 bp, human
gaggcgggctgcttgccttt

SEQ ID NO: 357614 - DNA, 20 bp, human
ggcgtgaccgcgcgacaaga

SEQ ID NO: 357615 - DNA, 20 bp, human
gtgggtccgggaactcgccc

SEQ ID NO: 357616 - DNA, 20 bp, human
ggaaactgaaagttgaaaca

SEQ ID NO: 357617 - DNA, 20 bp, human
ggactgaagactagagatcg

SEQ ID NO: 357618 - DNA, 20 bp, human
gagatcggggcgagcattcc

SEQ ID NO: 357619 - DNA, 20 bp, human
gtctctgagcaacctgtcat

SEQ ID NO: 357620 - DNA, 20 bp, human
gtgtcctgctccccaatgac

SEQ ID NO: 357621 - DNA, 20 bp, human
ggctgagtgttagtcaaaga

SEQ ID NO: 357622 - DNA, 20 bp, human
gcaacctgtcattggggagc

SEQ ID NO: 357623 - DNA, 20 bp, human
ggctggtggaggatgagtac

SEQ ID NO: 357624 - DNA, 20 bp, human
ggagactgttataatacaag

SEQ ID NO: 357625 - DNA, 20 bp, human
gttataatacaagtggactg

SEQ ID NO: 357626 - DNA, 20 bp, human
gcctgcgcgggccactgtcg

SEQ ID NO: 357627 - DNA, 20 bp, human
gcctagggcgaagtgagcca

SEQ ID NO: 357628 - DNA, 20 bp, human
gggcgggaaacgaaacccgg

SEQ ID NO: 357629 - DNA, 20 bp, human
gcgagcagcggccccgacag

SEQ ID NO: 357630 - DNA, 20 bp, human
gccgcctcggaaacgaaacc

SEQ ID NO: 357631 - DNA, 20 bp, human
gcctcggaaacgaaacctgg

SEQ ID NO: 357632 - DNA, 20 bp, human
ggccggcgggaaacgaaacc

SEQ ID NO: 357633 - DNA, 20 bp, human
ggccccgcagccggcgtccg

SEQ ID NO: 357634 - DNA, 20 bp, human
ggggaagctccaggacgaag

SEQ ID NO: 357635 - DNA, 20 bp, human
gcagcagcgccgccaggcgg

SEQ ID NO: 357636 - DNA, 20 bp, human
gacggccgacaagtggaggg

SEQ ID NO: 357637 - DNA, 20 bp, human
gagaacggccgacaagtgga

SEQ ID NO: 357638 - DNA, 20 bp, human
ggcaactcaccgcccagcgg

SEQ ID NO: 357639 - DNA, 20 bp, human
gaatagaagctcggttggag

SEQ ID NO: 357640 - DNA, 20 bp, human
gatgccgcgcaaagcgtcat

SEQ ID NO: 357641 - DNA, 20 bp, human
gttcatctctggacgaagaa

SEQ ID NO: 357642 - DNA, 20 bp, human
ggttcccagcttttctccgc

SEQ ID NO: 357643 - DNA, 20 bp, human
gcgcactgcccgctgggcat

SEQ ID NO: 357644 - DNA, 20 bp, human
ggtgcgcgaagtcacgcttc

SEQ ID NO: 357645 - DNA, 20 bp, human
gccggctctgagtggaggag

SEQ ID NO: 357646 - DNA, 20 bp, human
ggagctctgacctccgaaga

SEQ ID NO: 357647 - DNA, 20 bp, human
gcctccgcgaggggtaggga

SEQ ID NO: 357648 - DNA, 20 bp, human
gtcgccacagggaccctctt

SEQ ID NO: 357649 - DNA, 20 bp, human
gttgcccaatggagcaatgc

SEQ ID NO: 357650 - DNA, 20 bp, human
gaaggggcgggatcgccaca

SEQ ID NO: 357651 - DNA, 20 bp, human
gggcacaaacatcagacgaa

SEQ ID NO: 357652 - DNA, 20 bp, human
gttcggaggtcagagctcgg

SEQ ID NO: 357653 - DNA, 20 bp, human
gacgatcgctacctcggcca

SEQ ID NO: 357654 - DNA, 20 bp, human
ggtcagagctcggcggggtg

SEQ ID NO: 357655 - DNA, 20 bp, human
ggaggtagcgatcgtctctg

SEQ ID NO: 357656 - DNA, 20 bp, human
gactctggtctgttggagca

SEQ ID NO: 357657 - DNA, 20 bp, human
gcataggcatagctggactc

SEQ ID NO: 357658 - DNA, 20 bp, human
gtgagtcactgggcttgata

SEQ ID NO: 357659 - DNA, 20 bp, human
gcagagcgagcaagactcat

SEQ ID NO: 357660 - DNA, 20 bp, human
gtcaatgcgatctgagtcac

SEQ ID NO: 357661 - DNA, 20 bp, human
gcttcggatgaattctgcat

SEQ ID NO: 357662 - DNA, 20 bp, human
gtcaaagccttcacagcttt

SEQ ID NO: 357663 - DNA, 20 bp, human
ggtaaagaatctacctcact

SEQ ID NO: 357664 - DNA, 20 bp, human
gtcctgaagaacgggcggga

SEQ ID NO: 357665 - DNA, 20 bp, human
gaattctgcataggcatagc

SEQ ID NO: 357666 - DNA, 20 bp, human
gaaagagggcggaaagtgaa

SEQ ID NO: 357667 - DNA, 20 bp, human
ggaggcagtggcaagcccga

SEQ ID NO: 357668 - DNA, 20 bp, human
ggatcccagcgtctcaggga

SEQ ID NO: 357669 - DNA, 20 bp, human
gcgatcccacaatacatcgg

SEQ ID NO: 357670 - DNA, 20 bp, human
gggaaagtgaaaggcgccga

SEQ ID NO: 357671 - DNA, 20 bp, human
gacaggaggcgctctcaagt

SEQ ID NO: 357672 - DNA, 20 bp, human
gccgcgatcccacaatacat

SEQ ID NO: 357673 - DNA, 20 bp, human
gcgggccgccgatgtattgt

SEQ ID NO: 357674 - DNA, 20 bp, human
gaatgaaaacaagggaagcg

SEQ ID NO: 357675 - DNA, 20 bp, human
ggagacgctgggatccgcag

SEQ ID NO: 357676 - DNA, 20 bp, human
gggacggagtcatagagaag

SEQ ID NO: 357677 - DNA, 20 bp, human
gcgcaggctgcggacgttgt

SEQ ID NO: 357678 - DNA, 20 bp, human
gggctgcggacgttgtagga

SEQ ID NO: 357679 - DNA, 20 bp, human
gcagagccaccgcgcggcgc

SEQ ID NO: 357680 - DNA, 20 bp, human
gaagaggatccacaacccag

SEQ ID NO: 357681 - DNA, 20 bp, human
ggcgcgcggcgcatgtgcgg

SEQ ID NO: 357682 - DNA, 20 bp, human
gaaggcggacgcaggcgggg

SEQ ID NO: 357683 - DNA, 20 bp, human
ggagacgccggaggttgggt

SEQ ID NO: 357684 - DNA, 20 bp, human
gccaacctccggcgtctcca

SEQ ID NO: 357685 - DNA, 20 bp, human
gctagtccagagccaccgcg

SEQ ID NO: 357686 - DNA, 20 bp, human
gcaggtgcctcctcaaagaa

SEQ ID NO: 357687 - DNA, 20 bp, human
gagcgtggggtttcgctctc

SEQ ID NO: 357688 - DNA, 20 bp, human
gagcccggccccggaagcga

SEQ ID NO: 357689 - DNA, 20 bp, human
ggtttcgctctccggggcag

SEQ ID NO: 357690 - DNA, 20 bp, human
gcgcaccagaagccagcagt

SEQ ID NO: 357691 - DNA, 20 bp, human
gccacgcgcggccttcccgg

SEQ ID NO: 357692 - DNA, 20 bp, human
ggagctgtggggagtagctt

SEQ ID NO: 357693 - DNA, 20 bp, human
gtcccggaaatgacgcacag

SEQ ID NO: 357694 - DNA, 20 bp, human
gagcctctgtgcgtcatttc

SEQ ID NO: 357695 - DNA, 20 bp, human
gtggggtcctccacactcca

SEQ ID NO: 357696 - DNA, 20 bp, human
gtgaggttccagtgctggtt

SEQ ID NO: 357697 - DNA, 20 bp, human
gggctgtgagtcaaaaactg

SEQ ID NO: 357698 - DNA, 20 bp, human
ggagtcaaaaactgcggttg

SEQ ID NO: 357699 - DNA, 20 bp, human
gttgttctctgtatagatcg

SEQ ID NO: 357700 - DNA, 20 bp, human
gtagatcgaggtccatttag

SEQ ID NO: 357701 - DNA, 20 bp, human
gggataatcaaaactgcacg

SEQ ID NO: 357702 - DNA, 20 bp, human
gcaaactccctaaccagcac

SEQ ID NO: 357703 - DNA, 20 bp, human
gaccatacaaacattttagc

SEQ ID NO: 357704 - DNA, 20 bp, human
gaggtccatttaggggctta

SEQ ID NO: 357705 - DNA, 20 bp, human
gtaaagaataatactcagct

SEQ ID NO: 357706 - DNA, 20 bp, human
gactgtgggacgagaatcga

SEQ ID NO: 357707 - DNA, 20 bp, human
gaacacgactgtgcctccgg

SEQ ID NO: 357708 - DNA, 20 bp, human
gacaccctgcaaatcactgt

SEQ ID NO: 357709 - DNA, 20 bp, human
ggctctgcgcctgcgtcaaa

SEQ ID NO: 357710 - DNA, 20 bp, human
gaacagacccgcgagaacga

SEQ ID NO: 357711 - DNA, 20 bp, human
gccccaaagtaacagcgaac

SEQ ID NO: 357712 - DNA, 20 bp, human
gttgaccacacggccgccgg

SEQ ID NO: 357713 - DNA, 20 bp, human
ggcgaacacgactgtgcctc

SEQ ID NO: 357714 - DNA, 20 bp, human
ggcacagtcgtgttcgcatc

SEQ ID NO: 357715 - DNA, 20 bp, human
gaagcgtccttcgttctcgc

SEQ ID NO: 357716 - DNA, 20 bp, human
gaccgcccgggaatacggag

SEQ ID NO: 357717 - DNA, 20 bp, human
gcccgggcggtgattggtcg

SEQ ID NO: 357718 - DNA, 20 bp, human
ggcccgggaatacggagggg

SEQ ID NO: 357719 - DNA, 20 bp, human
gcccgcccctccgtattccc

SEQ ID NO: 357720 - DNA, 20 bp, human
gcaggcgacgcggacgaagc

SEQ ID NO: 357721 - DNA, 20 bp, human
gcactgctcgggaagcgagg

SEQ ID NO: 357722 - DNA, 20 bp, human
gactgtcatagcaacgggaa

SEQ ID NO: 357723 - DNA, 20 bp, human
ggcgacgcggacgaagcggg

SEQ ID NO: 357724 - DNA, 20 bp, human
gggtgccgtcatagcaacga

SEQ ID NO: 357725 - DNA, 20 bp, human
gtccctcccagcccggaaga

SEQ ID NO: 357726 - DNA, 20 bp, human
gccaccctgtgctcttaaag

SEQ ID NO: 357727 - DNA, 20 bp, human
ggggaaaggctggacgctgg

SEQ ID NO: 357728 - DNA, 20 bp, human
gagcagagctgggaaaaccc

SEQ ID NO: 357729 - DNA, 20 bp, human
gccttgctggtcctgaaggc

SEQ ID NO: 357730 - DNA, 20 bp, human
gcgggggaaaggctggacgc

SEQ ID NO: 357731 - DNA, 20 bp, human
gcaagggcgggacacctgct

SEQ ID NO: 357732 - DNA, 20 bp, human
ggtcctgaaggccgggggaa

SEQ ID NO: 357733 - DNA, 20 bp, human
gtggaaggaaccagcactgt

SEQ ID NO: 357734 - DNA, 20 bp, human
gcctccccgaccccaatcca

SEQ ID NO: 357735 - DNA, 20 bp, human
ggtgggcctggcggcgtccg

SEQ ID NO: 357736 - DNA, 20 bp, human
ggcgatctcagcacgttgaa

SEQ ID NO: 357737 - DNA, 20 bp, human
gtcagcacgttgaagggcca

SEQ ID NO: 357738 - DNA, 20 bp, human
gaaaaattagttaccagggc

SEQ ID NO: 357739 - DNA, 20 bp, human
ggcatctcactacgtggcct

SEQ ID NO: 357740 - DNA, 20 bp, human
gtctgaaaaattagttacca

SEQ ID NO: 357741 - DNA, 20 bp, human
gtaggctgatctccctctcc

SEQ ID NO: 357742 - DNA, 20 bp, human
gaatgaaaaccccaagtgtt

SEQ ID NO: 357743 - DNA, 20 bp, human
gtaatttttcagactttgtc

SEQ ID NO: 357744 - DNA, 20 bp, human
gaacaagcaatgcgatgttg

SEQ ID NO: 357745 - DNA, 20 bp, human
gaattacgtctccaaacact

SEQ ID NO: 357746 - DNA, 20 bp, human
ggggaaaggctggacgctgg

SEQ ID NO: 357747 - DNA, 20 bp, human
gagcagagctgggaaaaccc

SEQ ID NO: 357748 - DNA, 20 bp, human
gtggaaggaaccagcactgt

SEQ ID NO: 357749 - DNA, 20 bp, human
gccaccctgtgctcttaaag

SEQ ID NO: 357750 - DNA, 20 bp, human
gacgctggaggcagcaggcc

SEQ ID NO: 357751 - DNA, 20 bp, human
gccttgctggtcctgaaggc

SEQ ID NO: 357752 - DNA, 20 bp, human
gcaagggcgggacacctgct

SEQ ID NO: 357753 - DNA, 20 bp, human
gcgggggaaaggctggacgc

SEQ ID NO: 357754 - DNA, 20 bp, human
ggtcctgaaggccgggggaa

SEQ ID NO: 357755 - DNA, 20 bp, human
gcctccccgaccccaatcca

SEQ ID NO: 357756 - DNA, 20 bp, human
ggcgatctcagcacgttgaa

SEQ ID NO: 357757 - DNA, 20 bp, human
gtcagcacgttgaagggcca

SEQ ID NO: 357758 - DNA, 20 bp, human
gtaggctgatctccctctcc

SEQ ID NO: 357759 - DNA, 20 bp, human
ggcatctcactacgtggcct

SEQ ID NO: 357760 - DNA, 20 bp, human
gtctgaaaaattagttacca

SEQ ID NO: 357761 - DNA, 20 bp, human
gaaaaattagttaccagggc

SEQ ID NO: 357762 - DNA, 20 bp, human
gaatgaaaaccccaagtgtt

SEQ ID NO: 357763 - DNA, 20 bp, human
gtaatttttcagactttgtc

SEQ ID NO: 357764 - DNA, 20 bp, human
gaacaagcaatgcgatgttg

SEQ ID NO: 357765 - DNA, 20 bp, human
gaattacgtctccaaacact

SEQ ID NO: 357766 - DNA, 20 bp, human
gacacagcggtgagcagaga

SEQ ID NO: 357767 - DNA, 20 bp, human
ggctgtgtgctagcaatcgg

SEQ ID NO: 357768 - DNA, 20 bp, human
ggaggcctgcggggcaacgg

SEQ ID NO: 357769 - DNA, 20 bp, human
gcccgggcacgtaacagagc

SEQ ID NO: 357770 - DNA, 20 bp, human
gcaacccagggttctgtctg

SEQ ID NO: 357771 - DNA, 20 bp, human
gtggaagagcaggagcacgt

SEQ ID NO: 357772 - DNA, 20 bp, human
gcaggggcgtgttatcgcgg

SEQ ID NO: 357773 - DNA, 20 bp, human
gtgccaggggcgtgttatcg

SEQ ID NO: 357774 - DNA, 20 bp, human
gggaagcctgatagattaag

SEQ ID NO: 357775 - DNA, 20 bp, human
gcccacagacacctcatttt

SEQ ID NO: 357776 - DNA, 20 bp, human
gagactggtcgagtctaggt

SEQ ID NO: 357777 - DNA, 20 bp, human
gggtcgagtctaggtcggat

SEQ ID NO: 357778 - DNA, 20 bp, human
ggcctgttgccaggattcga

SEQ ID NO: 357779 - DNA, 20 bp, human
gattggctgcgatagaacga

SEQ ID NO: 357780 - DNA, 20 bp, human
gtgttgccaggattcgaggg

SEQ ID NO: 357781 - DNA, 20 bp, human
ggcgatagaacgaggggcag

SEQ ID NO: 357782 - DNA, 20 bp, human
ggcgcaggatctggagttct

SEQ ID NO: 357783 - DNA, 20 bp, human
gagtctccgccctcgaatcc

SEQ ID NO: 357784 - DNA, 20 bp, human
gagcaagactggtcgagtct

SEQ ID NO: 357785 - DNA, 20 bp, human
ggtgctcaaggcgcaggatc

SEQ ID NO: 357786 - DNA, 20 bp, human
gctggcgcgacgtccaccgt

SEQ ID NO: 357787 - DNA, 20 bp, human
gaacagctgacggggctcga

SEQ ID NO: 357788 - DNA, 20 bp, human
gcggggcggggcttgacctg

SEQ ID NO: 357789 - DNA, 20 bp, human
gggggtgggacagggactcg

SEQ ID NO: 357790 - DNA, 20 bp, human
gggcgggctgaccttgaagg

SEQ ID NO: 357791 - DNA, 20 bp, human
gatcccgcgcagccccacgg

SEQ ID NO: 357792 - DNA, 20 bp, human
gacggggctcgagggggaaa

SEQ ID NO: 357793 - DNA, 20 bp, human
ggcgggtgccgtctcgagtc

SEQ ID NO: 357794 - DNA, 20 bp, human
ggaggacgccagggaacccg

SEQ ID NO: 357795 - DNA, 20 bp, human
gaaaagggatggcgggcctg

SEQ ID NO: 357796 - DNA, 20 bp, human
gcccgtcccaaactctggaa

SEQ ID NO: 357797 - DNA, 20 bp, human
ggacatcccgtcccaaactc

SEQ ID NO: 357798 - DNA, 20 bp, human
gtgtaggggaagccatactg

SEQ ID NO: 357799 - DNA, 20 bp, human
gaggaggtctgggcggtagg

SEQ ID NO: 357800 - DNA, 20 bp, human
gggaagccatactgtggccg

SEQ ID NO: 357801 - DNA, 20 bp, human
gggtctgggcggtaggcggt

SEQ ID NO: 357802 - DNA, 20 bp, human
gctgatgcctaggcctccgt

SEQ ID NO: 357803 - DNA, 20 bp, human
ggggatgtcttcagttgcca

SEQ ID NO: 357804 - DNA, 20 bp, human
gagcgtccagctaggcggaa

SEQ ID NO: 357805 - DNA, 20 bp, human
gagggaaggccaaatatcta

SEQ ID NO: 357806 - DNA, 20 bp, human
gtggctgcgtggaatccccg

SEQ ID NO: 357807 - DNA, 20 bp, human
gcgagccggccccccttcca

SEQ ID NO: 357808 - DNA, 20 bp, human
gagcgcagagcgccagcttc

SEQ ID NO: 357809 - DNA, 20 bp, human
gcctctgcgagcaccaggga

SEQ ID NO: 357810 - DNA, 20 bp, human
gagagcgccagcttcgggca

SEQ ID NO: 357811 - DNA, 20 bp, human
gagcttcgggcaaggacgtg

SEQ ID NO: 357812 - DNA, 20 bp, human
ggaaactggggttttcatga

SEQ ID NO: 357813 - DNA, 20 bp, human
gggagttgttgcgggttctc

SEQ ID NO: 357814 - DNA, 20 bp, human
gaagcagaaggtctgcccca

SEQ ID NO: 357815 - DNA, 20 bp, human
gaagatgagcggagttgttg

SEQ ID NO: 357816 - DNA, 20 bp, human
ggggctggagaggacccctt

SEQ ID NO: 357817 - DNA, 20 bp, human
gaggttggaactgaccctag

SEQ ID NO: 357818 - DNA, 20 bp, human
gggaactgaccctagagggc

SEQ ID NO: 357819 - DNA, 20 bp, human
gcactctggaaagcccgaag

SEQ ID NO: 357820 - DNA, 20 bp, human
gtgcagggagatctgactga

SEQ ID NO: 357821 - DNA, 20 bp, human
gaaacgtcccggtttccctg

SEQ ID NO: 357822 - DNA, 20 bp, human
ggtccaaggcatctaagtct

SEQ ID NO: 357823 - DNA, 20 bp, human
ggggatagataaagagtagc

SEQ ID NO: 357824 - DNA, 20 bp, human
gaggctgcctcggagttcct

SEQ ID NO: 357825 - DNA, 20 bp, human
gtccaagttaggcgcgctgt

SEQ ID NO: 357826 - DNA, 20 bp, human
ggctcccgggagcaccacat

SEQ ID NO: 357827 - DNA, 20 bp, human
ggggcggggaaggaaactgc

SEQ ID NO: 357828 - DNA, 20 bp, human
gagctctggcggggagactt

SEQ ID NO: 357829 - DNA, 20 bp, human
ggtctacagcgcagcatctc

SEQ ID NO: 357830 - DNA, 20 bp, human
gaggaggggggatggctgtg

SEQ ID NO: 357831 - DNA, 20 bp, human
gtgtagacccgggacccctt

SEQ ID NO: 357832 - DNA, 20 bp, human
gaaagttattgaggtcgctc

SEQ ID NO: 357833 - DNA, 20 bp, human
gcgggagcccagcccaacac

SEQ ID NO: 357834 - DNA, 20 bp, human
ggggagacttgggcgcactg

SEQ ID NO: 357835 - DNA, 20 bp, human
ggcgaagagcccctccagaa

SEQ ID NO: 357836 - DNA, 20 bp, human
ggggaaagacgcaagaccgc

SEQ ID NO: 357837 - DNA, 20 bp, human
gcgggacagatcgaactcga

SEQ ID NO: 357838 - DNA, 20 bp, human
ggaactcgagggccccgacc

SEQ ID NO: 357839 - DNA, 20 bp, human
gagggcgcgggggaccgtac

SEQ ID NO: 357840 - DNA, 20 bp, human
gtgggcacgtgcacgtgctc

SEQ ID NO: 357841 - DNA, 20 bp, human
ggggcgggggtcacccgggt

SEQ ID NO: 357842 - DNA, 20 bp, human
ggacgcaagaccgccggctg

SEQ ID NO: 357843 - DNA, 20 bp, human
gaacagccaggcagggtcgg

SEQ ID NO: 357844 - DNA, 20 bp, human
gagacggccggcaagagtaa

SEQ ID NO: 357845 - DNA, 20 bp, human
gccaacgccctcactagacc

SEQ ID NO: 357846 - DNA, 20 bp, human
gcacgcctcaggatgaggac

SEQ ID NO: 357847 - DNA, 20 bp, human
gtggcccaatcaagtctctc

SEQ ID NO: 357848 - DNA, 20 bp, human
gccgccctccaggcgcagac

SEQ ID NO: 357849 - DNA, 20 bp, human
ggggttacgtcgccggaagt

SEQ ID NO: 357850 - DNA, 20 bp, human
ggggcgggactctattgtgg

SEQ ID NO: 357851 - DNA, 20 bp, human
gcgggagcccgatggaaatc

SEQ ID NO: 357852 - DNA, 20 bp, human
gctggccagtcctcatcctg

SEQ ID NO: 357853 - DNA, 20 bp, human
ggagccggagagacttgatt

SEQ ID NO: 357854 - DNA, 20 bp, human
gcgggaccggcccgccctcc

SEQ ID NO: 357855 - DNA, 20 bp, human
gaggaagagctccgcggatt

SEQ ID NO: 357856 - DNA, 20 bp, human
gcaggcgctgggaatgccga

SEQ ID NO: 357857 - DNA, 20 bp, human
ggagggagtagattgtaacg

SEQ ID NO: 357858 - DNA, 20 bp, human
gtagtcgtcgttatcgtcat

SEQ ID NO: 357859 - DNA, 20 bp, human
ggccccgcgtcgcctctcgc

SEQ ID NO: 357860 - DNA, 20 bp, human
ggagatatcgagtgcatcga

SEQ ID NO: 357861 - DNA, 20 bp, human
gctccccaggccctggtcgt

SEQ ID NO: 357862 - DNA, 20 bp, human
ggctgcctggcgctagaacc

SEQ ID NO: 357863 - DNA, 20 bp, human
gtaccaaaagcaataaaggt

SEQ ID NO: 357864 - DNA, 20 bp, human
gcacctgggtccagaccttt

SEQ ID NO: 357865 - DNA, 20 bp, human
gcaggtgatgcccacgacca

SEQ ID NO: 357866 - DNA, 20 bp, human
ggcagtcgggagaacggaat

SEQ ID NO: 357867 - DNA, 20 bp, human
gaatgggcggaactcagggt

SEQ ID NO: 357868 - DNA, 20 bp, human
gcacccccggaatgcgcagt

SEQ ID NO: 357869 - DNA, 20 bp, human
gggggccaagaatacacccc

SEQ ID NO: 357870 - DNA, 20 bp, human
gaaagaccgtgaagagggcg

SEQ ID NO: 357871 - DNA, 20 bp, human
gaacggaatgggcggaactc

SEQ ID NO: 357872 - DNA, 20 bp, human
gctcccgactgcgcattccg

SEQ ID NO: 357873 - DNA, 20 bp, human
ggtcgggagaacggaatggg

SEQ ID NO: 357874 - DNA, 20 bp, human
gattgggtgttctttcatag

SEQ ID NO: 357875 - DNA, 20 bp, human
ggaatgcgcagtcgggagaa

SEQ ID NO: 357876 - DNA, 20 bp, human
gagcgtcccaaaccgtgggg

SEQ ID NO: 357877 - DNA, 20 bp, human
gctctccagacgtgtctcca

SEQ ID NO: 357878 - DNA, 20 bp, human
gtgcgcggggcgccgagaca

SEQ ID NO: 357879 - DNA, 20 bp, human
gctccgcccttaaaagtctg

SEQ ID NO: 357880 - DNA, 20 bp, human
ggctaatcacgttcgttatt

SEQ ID NO: 357881 - DNA, 20 bp, human
gctggccctggagacacgtc

SEQ ID NO: 357882 - DNA, 20 bp, human
gataaactatcctcagcgtg

SEQ ID NO: 357883 - DNA, 20 bp, human
gtggcgcaagctcagttgat

SEQ ID NO: 357884 - DNA, 20 bp, human
gaccgtggggtggacgccac

SEQ ID NO: 357885 - DNA, 20 bp, human
gagagctgttctcctaatat

SEQ ID NO: 357886 - DNA, 20 bp, human
gaccaaaggctggccgactt

SEQ ID NO: 357887 - DNA, 20 bp, human
gaggctggccgacttggggc

SEQ ID NO: 357888 - DNA, 20 bp, human
gacaaaagacacaggtgcct

SEQ ID NO: 357889 - DNA, 20 bp, human
gggtgcctgggaacacacac

SEQ ID NO: 357890 - DNA, 20 bp, human
gctttggtcagctggagtgt

SEQ ID NO: 357891 - DNA, 20 bp, human
gcggccagcctttggtcagc

SEQ ID NO: 357892 - DNA, 20 bp, human
gctctgtatctatatatgtg

SEQ ID NO: 357893 - DNA, 20 bp, human
gcctgtgtcttttgtttgtg

SEQ ID NO: 357894 - DNA, 20 bp, human
ggaaggggaaatgtagcatt

SEQ ID NO: 357895 - DNA, 20 bp, human
gtgtatacgttcagaatctg

SEQ ID NO: 357896 - DNA, 20 bp, human
ggggacactgaggatcgctg

SEQ ID NO: 357897 - DNA, 20 bp, human
gtcgagaccagcatcttcta

SEQ ID NO: 357898 - DNA, 20 bp, human
gaggatcgctgtggagtgtg

SEQ ID NO: 357899 - DNA, 20 bp, human
ggagccgtgcgtccactgca

SEQ ID NO: 357900 - DNA, 20 bp, human
gggaaggcggggacaaactc

SEQ ID NO: 357901 - DNA, 20 bp, human
ggggttagtacggaagttca

SEQ ID NO: 357902 - DNA, 20 bp, human
ggagctcctacctccaaggt

SEQ ID NO: 357903 - DNA, 20 bp, human
gtgcgtccactgcacggagt

SEQ ID NO: 357904 - DNA, 20 bp, human
gcggtcccaaacatcccaga

SEQ ID NO: 357905 - DNA, 20 bp, human
gggggacaaactcaggtgtc

SEQ ID NO: 357906 - DNA, 20 bp, human
ggctgggaacactgcggtcg

SEQ ID NO: 357907 - DNA, 20 bp, human
gagccgcgctgggaacactg

SEQ ID NO: 357908 - DNA, 20 bp, human
gggaagtgagatgacggtcg

SEQ ID NO: 357909 - DNA, 20 bp, human
gcacaagcctgcgggataac

SEQ ID NO: 357910 - DNA, 20 bp, human
gtcggggcgaggaagctgcc

SEQ ID NO: 357911 - DNA, 20 bp, human
gccagggcacaagtttttca

SEQ ID NO: 357912 - DNA, 20 bp, human
gcggaactgggcgaacccgg

SEQ ID NO: 357913 - DNA, 20 bp, human
gtgcgcgtagctcggcttaa

SEQ ID NO: 357914 - DNA, 20 bp, human
gctgactccagtgtcccgag

SEQ ID NO: 357915 - DNA, 20 bp, human
gcgcgcatgcgcactgactg

SEQ ID NO: 357916 - DNA, 20 bp, human
gcaggccaatgtctttcctc

SEQ ID NO: 357917 - DNA, 20 bp, human
gtgccgttgctcatctgctg

SEQ ID NO: 357918 - DNA, 20 bp, human
gccgaggctcaaaattcttc

SEQ ID NO: 357919 - DNA, 20 bp, human
gtgggtcaggttcggtgcat

SEQ ID NO: 357920 - DNA, 20 bp, human
gtgagcaacggcaagcgccg

SEQ ID NO: 357921 - DNA, 20 bp, human
gctgcgctttggttcttgga

SEQ ID NO: 357922 - DNA, 20 bp, human
gaagccggactacgcggcag

SEQ ID NO: 357923 - DNA, 20 bp, human
gaacaccttgagtctgggtc

SEQ ID NO: 357924 - DNA, 20 bp, human
gcgctttggttcttggaagg

SEQ ID NO: 357925 - DNA, 20 bp, human
ggacagtacaacttaaccag

SEQ ID NO: 357926 - DNA, 20 bp, human
gcgcaggcgcaaacagccca

SEQ ID NO: 357927 - DNA, 20 bp, human
gcgcaaacagcccaaggctg

SEQ ID NO: 357928 - DNA, 20 bp, human
ggctgcggccggctgcaaag

SEQ ID NO: 357929 - DNA, 20 bp, human
gtaatcagcacccactgcgc

SEQ ID NO: 357930 - DNA, 20 bp, human
ggcgactccagcagcgtccg

SEQ ID NO: 357931 - DNA, 20 bp, human
gaacagcccaaggctgcggc

SEQ ID NO: 357932 - DNA, 20 bp, human
gaccttatgaatttactctg

SEQ ID NO: 357933 - DNA, 20 bp, human
ggggttgctgtggagaccaa

SEQ ID NO: 357934 - DNA, 20 bp, human
gagcgggaacaatcatttac

SEQ ID NO: 357935 - DNA, 20 bp, human
gttcaaagtacagaagggaa

SEQ ID NO: 357936 - DNA, 20 bp, human
gaacgcgcaaaacgccgtgt

SEQ ID NO: 357937 - DNA, 20 bp, human
gctggctgacagctggggac

SEQ ID NO: 357938 - DNA, 20 bp, human
gaggcccgccgggaccactg

SEQ ID NO: 357939 - DNA, 20 bp, human
gaaacgccgtgtaggcctgg

SEQ ID NO: 357940 - DNA, 20 bp, human
gcggcctagagaggcggtag

SEQ ID NO: 357941 - DNA, 20 bp, human
gggaacgcagaccctggtgg

SEQ ID NO: 357942 - DNA, 20 bp, human
ggcaacggaccggaagtggg

SEQ ID NO: 357943 - DNA, 20 bp, human
gagtccccagcacccggcac

SEQ ID NO: 357944 - DNA, 20 bp, human
gggaaactgttcccccgcgg

SEQ ID NO: 357945 - DNA, 20 bp, human
ggcaaaacgccgtgtaggcc

SEQ ID NO: 357946 - DNA, 20 bp, human
gttcccccgtcgctggttcc

SEQ ID NO: 357947 - DNA, 20 bp, human
gtgccgggaaccagcgacgg

SEQ ID NO: 357948 - DNA, 20 bp, human
gctctgccgggaaccagcga

SEQ ID NO: 357949 - DNA, 20 bp, human
ggcacccggcgacctgcgaa

SEQ ID NO: 357950 - DNA, 20 bp, human
ggcccccgacgcagcgtgag

SEQ ID NO: 357951 - DNA, 20 bp, human
ggctggttcccggcagagag

SEQ ID NO: 357952 - DNA, 20 bp, human
gaaggactccagggcagtcg

SEQ ID NO: 357953 - DNA, 20 bp, human
gacgcggtggacaccggttg

SEQ ID NO: 357954 - DNA, 20 bp, human
ggcctctcacgctgcgtcgg

SEQ ID NO: 357955 - DNA, 20 bp, human
gtgcggctccagcccccgat

SEQ ID NO: 357956 - DNA, 20 bp, human
gtggtcgtggcgtagcgggg

SEQ ID NO: 357957 - DNA, 20 bp, human
gcgacgctctccatgacaac

SEQ ID NO: 357958 - DNA, 20 bp, human
gcacgctaggcgcggcgtag

SEQ ID NO: 357959 - DNA, 20 bp, human
gcggggcggcacgctaggcg

SEQ ID NO: 357960 - DNA, 20 bp, human
gcagaaacccagggtctcac

SEQ ID NO: 357961 - DNA, 20 bp, human
gcacgctggtcgtggcgtag

SEQ ID NO: 357962 - DNA, 20 bp, human
gcggggcggggcggcacgct

SEQ ID NO: 357963 - DNA, 20 bp, human
gccagggtctcacgggaacg

SEQ ID NO: 357964 - DNA, 20 bp, human
gcatggagagcgtcgcttgg

SEQ ID NO: 357965 - DNA, 20 bp, human
gccagcgtgctgcgtcacgg

SEQ ID NO: 357966 - DNA, 20 bp, human
gcgacctggcccgacggccc

SEQ ID NO: 357967 - DNA, 20 bp, human
gcgctcccacagtgctcgcg

SEQ ID NO: 357968 - DNA, 20 bp, human
gccaagccgacctggcccga

SEQ ID NO: 357969 - DNA, 20 bp, human
gagcccgtccggccagtccc

SEQ ID NO: 357970 - DNA, 20 bp, human
gcaggtcggcttggcgccca

SEQ ID NO: 357971 - DNA, 20 bp, human
gtaggcgctcgcgacccgcg

SEQ ID NO: 357972 - DNA, 20 bp, human
ggccaaaggcccagcccgtc

SEQ ID NO: 357973 - DNA, 20 bp, human
gacggccccggagcccccag

SEQ ID NO: 357974 - DNA, 20 bp, human
gcgcccagggactggccgga

SEQ ID NO: 357975 - DNA, 20 bp, human
gtgcacctcgcgagcactgt

SEQ ID NO: 357976 - DNA, 20 bp, human
gaacccgcgtggggccagcg

SEQ ID NO: 357977 - DNA, 20 bp, human
ggggcccgaggaacccgcgt

SEQ ID NO: 357978 - DNA, 20 bp, human
gtcctcgggcccagtcgctt

SEQ ID NO: 357979 - DNA, 20 bp, human
ggccagcgtgggggagtaag

SEQ ID NO: 357980 - DNA, 20 bp, human
gtcctccgagctgtccccga

SEQ ID NO: 357981 - DNA, 20 bp, human
gggccccacgcgggttcctc

SEQ ID NO: 357982 - DNA, 20 bp, human
ggagtgaagtgtgactccgt

SEQ ID NO: 357983 - DNA, 20 bp, human
gtcagaagctagtggacctg

SEQ ID NO: 357984 - DNA, 20 bp, human
gatcccagccgggaggtaga

SEQ ID NO: 357985 - DNA, 20 bp, human
ggccgggctaatcccagggg

SEQ ID NO: 357986 - DNA, 20 bp, human
ggccgcggggaaagcttcgg

SEQ ID NO: 357987 - DNA, 20 bp, human
gcccgccgcgctagagcctg

SEQ ID NO: 357988 - DNA, 20 bp, human
ggcgctagagcctggggtct

SEQ ID NO: 357989 - DNA, 20 bp, human
gaccccaggctctagcgcgg

SEQ ID NO: 357990 - DNA, 20 bp, human
ggggtctcggcaacttccgg

SEQ ID NO: 357991 - DNA, 20 bp, human
gggcctgggacgggagtggg

SEQ ID NO: 357992 - DNA, 20 bp, human
gctggggtctcggcaacttc

SEQ ID NO: 357993 - DNA, 20 bp, human
gcctgtccgggacttaagtc

SEQ ID NO: 357994 - DNA, 20 bp, human
ggcggggaaagcttcggcgg

SEQ ID NO: 357995 - DNA, 20 bp, human
gcgtaccaagtcccagtcgc

SEQ ID NO: 357996 - DNA, 20 bp, human
gaggctggctcgatacaaga

SEQ ID NO: 357997 - DNA, 20 bp, human
ggtcacttggggtgccccca

SEQ ID NO: 357998 - DNA, 20 bp, human
ggacagatcttccctccctg

SEQ ID NO: 357999 - DNA, 20 bp, human
gtaatcagagcagagagaaa

SEQ ID NO: 358000 - DNA, 20 bp, human
gcccccctggcacatgcacc

SEQ ID NO: 358001 - DNA, 20 bp, human
gtgtatcgagccagcctctt

SEQ ID NO: 358002 - DNA, 20 bp, human
gtcccgctccacaaccaagg

SEQ ID NO: 358003 - DNA, 20 bp, human
gtcagagcagagagaaatgg

SEQ ID NO: 358004 - DNA, 20 bp, human
gcagactgaataagcctggg

SEQ ID NO: 358005 - DNA, 20 bp, human
gtggcagtatcagggtctca

SEQ ID NO: 358006 - DNA, 20 bp, human
gccgctccacgcgacagcgt

SEQ ID NO: 358007 - DNA, 20 bp, human
gaaggcgctgacgcggacag

SEQ ID NO: 358008 - DNA, 20 bp, human
ggagacgggtaaagcggttc

SEQ ID NO: 358009 - DNA, 20 bp, human
gaccctggagacgggtaaag

SEQ ID NO: 358010 - DNA, 20 bp, human
gcctgcgcgcatggggatgc

SEQ ID NO: 358011 - DNA, 20 bp, human
gaaagcggttctggccgcga

SEQ ID NO: 358012 - DNA, 20 bp, human
gagggtgctaccctggagac

SEQ ID NO: 358013 - DNA, 20 bp, human
gagtgggtgggaggtttggg

SEQ ID NO: 358014 - DNA, 20 bp, human
gtaaacggtggcaacaatta

SEQ ID NO: 358015 - DNA, 20 bp, human
gcgctgacgcggacagtggg

SEQ ID NO: 358016 - DNA, 20 bp, human
gccgcctccaggaacagcta

SEQ ID NO: 358017 - DNA, 20 bp, human
gtacaactggccaatagatg

SEQ ID NO: 358018 - DNA, 20 bp, human
ggaacccggaggacaggagt

SEQ ID NO: 358019 - DNA, 20 bp, human
gcacctctgtggacagccat

SEQ ID NO: 358020 - DNA, 20 bp, human
gctggccaatagatgtggtc

SEQ ID NO: 358021 - DNA, 20 bp, human
gcggagcatattttaaagta

SEQ ID NO: 358022 - DNA, 20 bp, human
gaggacaggagtaggggggg

SEQ ID NO: 358023 - DNA, 20 bp, human
gcccctttggacccagccaa

SEQ ID NO: 358024 - DNA, 20 bp, human
gggaattgtccccacctctg

SEQ ID NO: 358025 - DNA, 20 bp, human
gtctggagtgctcctcctag

SEQ ID NO: 358026 - DNA, 20 bp, human
gtaaaggggcggaaccaaga

SEQ ID NO: 358027 - DNA, 20 bp, human
gggggcggaaccaagagggt

SEQ ID NO: 358028 - DNA, 20 bp, human
gcggggcggtaccagaggga

SEQ ID NO: 358029 - DNA, 20 bp, human
ggctacggagccaggaagga

SEQ ID NO: 358030 - DNA, 20 bp, human
ggtgggctacggagccagga

SEQ ID NO: 358031 - DNA, 20 bp, human
gcggggaaacgccgaggatc

SEQ ID NO: 358032 - DNA, 20 bp, human
ggggaaagcggcctgaaggg

SEQ ID NO: 358033 - DNA, 20 bp, human
ggaggggaaagcggcctgaa

SEQ ID NO: 358034 - DNA, 20 bp, human
ggcggggcctagatcgcaga

SEQ ID NO: 358035 - DNA, 20 bp, human
gggcgtggccttcttactaa

SEQ ID NO: 358036 - DNA, 20 bp, human
gggttggggagcgtcccttg

SEQ ID NO: 358037 - DNA, 20 bp, human
ggcggcgcctcgcgcgccga

SEQ ID NO: 358038 - DNA, 20 bp, human
ggcctcgcgcgccgagggtt

SEQ ID NO: 358039 - DNA, 20 bp, human
ggggcaaagccggcctcacg

SEQ ID NO: 358040 - DNA, 20 bp, human
gccaaagcgcgcagcggcgc

SEQ ID NO: 358041 - DNA, 20 bp, human
gcgggtgccaaagcgcgcag

SEQ ID NO: 358042 - DNA, 20 bp, human
gagggacgctccccaaccct

SEQ ID NO: 358043 - DNA, 20 bp, human
ggcgcacaaagggccccaag

SEQ ID NO: 358044 - DNA, 20 bp, human
gctcggagcaggcggagtaa

SEQ ID NO: 358045 - DNA, 20 bp, human
gcaatccccgcccacgactg

SEQ ID NO: 358046 - DNA, 20 bp, human
ggagctgcatttgcagggag

SEQ ID NO: 358047 - DNA, 20 bp, human
ggggcaggctaccaaaagaa

SEQ ID NO: 358048 - DNA, 20 bp, human
gagaaggaaagcattaatgc

SEQ ID NO: 358049 - DNA, 20 bp, human
ggcatttcagatacattcag

SEQ ID NO: 358050 - DNA, 20 bp, human
gaaatggagctgcatttgca

SEQ ID NO: 358051 - DNA, 20 bp, human
ggatggtcgaattatgctac

SEQ ID NO: 358052 - DNA, 20 bp, human
gccttgttgctcataccaaa

SEQ ID NO: 358053 - DNA, 20 bp, human
gatgaacttaggagcaatta

SEQ ID NO: 358054 - DNA, 20 bp, human
gtttacgtcttaatgaactt

SEQ ID NO: 358055 - DNA, 20 bp, human
gttctgtttatctcttcata

SEQ ID NO: 358056 - DNA, 20 bp, human
gcccttcaacaccgagtact

SEQ ID NO: 358057 - DNA, 20 bp, human
gcaccacaggagccaggcaa

SEQ ID NO: 358058 - DNA, 20 bp, human
gagggggaaaaagaggtcac

SEQ ID NO: 358059 - DNA, 20 bp, human
gaagatgcgtggtaaggccc

SEQ ID NO: 358060 - DNA, 20 bp, human
gaattccactcacttctcgg

SEQ ID NO: 358061 - DNA, 20 bp, human
gtctgcaccgcggatctgta

SEQ ID NO: 358062 - DNA, 20 bp, human
gtgggccaagatgcgtggta

SEQ ID NO: 358063 - DNA, 20 bp, human
gcaacaccgagtacttggat

SEQ ID NO: 358064 - DNA, 20 bp, human
gcccggcggctaaggagagc

SEQ ID NO: 358065 - DNA, 20 bp, human
ggatctgtagggtggtgaag

SEQ ID NO: 358066 - DNA, 20 bp, human
gcctaggccgccacaccctc

SEQ ID NO: 358067 - DNA, 20 bp, human
gcagggggcgggggattcat

SEQ ID NO: 358068 - DNA, 20 bp, human
gggaatgcgccgcctttgtc

SEQ ID NO: 358069 - DNA, 20 bp, human
gggcgcgggggttggggcgt

SEQ ID NO: 358070 - DNA, 20 bp, human
gcgcgcggcgccggtgcacc

SEQ ID NO: 358071 - DNA, 20 bp, human
gaggcctaggtcccttctct

SEQ ID NO: 358072 - DNA, 20 bp, human
gtcagggcttaagagagttc

SEQ ID NO: 358073 - DNA, 20 bp, human
ggatactaagcaggtgacct

SEQ ID NO: 358074 - DNA, 20 bp, human
gtctgcaccatcctagagaa

SEQ ID NO: 358075 - DNA, 20 bp, human
ggagcccccattccgcagaa

SEQ ID NO: 358076 - DNA, 20 bp, human
ggggccgagcatcttccccg

SEQ ID NO: 358077 - DNA, 20 bp, human
gggcgcagtgaaaacacctt

SEQ ID NO: 358078 - DNA, 20 bp, human
ggggaagagccgtcgagact

SEQ ID NO: 358079 - DNA, 20 bp, human
gcgctccccgcccccgctca

SEQ ID NO: 358080 - DNA, 20 bp, human
ggcagtgaaaacaccttggg

SEQ ID NO: 358081 - DNA, 20 bp, human
ggagcgccgtcctattccca

SEQ ID NO: 358082 - DNA, 20 bp, human
gaggggcgtggagtggtccg

SEQ ID NO: 358083 - DNA, 20 bp, human
ggcgctgctgccttgggaat

SEQ ID NO: 358084 - DNA, 20 bp, human
gcaggtgcctggacggacgc

SEQ ID NO: 358085 - DNA, 20 bp, human
ggggaggcgctccgtgagcg

SEQ ID NO: 358086 - DNA, 20 bp, human
gcctcctagtggtcgagaaa

SEQ ID NO: 358087 - DNA, 20 bp, human
gagcgagtgcgggaaggagt

SEQ ID NO: 358088 - DNA, 20 bp, human
gtcggcaagccagcaaacga

SEQ ID NO: 358089 - DNA, 20 bp, human
gcccccccgcttaagcgacc

SEQ ID NO: 358090 - DNA, 20 bp, human
gccccgcttaagcgacccgg

SEQ ID NO: 358091 - DNA, 20 bp, human
ggtcctccgggtcgcttaag

SEQ ID NO: 358092 - DNA, 20 bp, human
gggagccagcgagtgcggga

SEQ ID NO: 358093 - DNA, 20 bp, human
gggtcgagaaagggttaagt

SEQ ID NO: 358094 - DNA, 20 bp, human
gacgatcgaacacagtcctc

SEQ ID NO: 358095 - DNA, 20 bp, human
gtggctcctccctcgtttgc

SEQ ID NO: 358096 - DNA, 20 bp, human
gctggcctggaaagagtatg

SEQ ID NO: 358097 - DNA, 20 bp, human
gcaggtcccccactctgtct

SEQ ID NO: 358098 - DNA, 20 bp, human
ggcctggaaagagtatgggg

SEQ ID NO: 358099 - DNA, 20 bp, human
gccctgaactgagattgcag

SEQ ID NO: 358100 - DNA, 20 bp, human
gtggtctgaagctcaatctc

SEQ ID NO: 358101 - DNA, 20 bp, human
gtctctgaagaggtgtttca

SEQ ID NO: 358102 - DNA, 20 bp, human
gggaggtgaggactgggaac

SEQ ID NO: 358103 - DNA, 20 bp, human
gaatgatccaagacagagtg

SEQ ID NO: 358104 - DNA, 20 bp, human
gttgccagaagacagagctt

SEQ ID NO: 358105 - DNA, 20 bp, human
ggcttcagaccatctcaccc

SEQ ID NO: 358106 - DNA, 20 bp, human
gggccaaagcagatcagatc

SEQ ID NO: 358107 - DNA, 20 bp, human
gaaggcctagatctgaatct

SEQ ID NO: 358108 - DNA, 20 bp, human
gggccagcacacaggtcaag

SEQ ID NO: 358109 - DNA, 20 bp, human
ggatggtcacagcatatcag

SEQ ID NO: 358110 - DNA, 20 bp, human
gatcttggatgagccactta

SEQ ID NO: 358111 - DNA, 20 bp, human
gaggtcaagcggtttgtgct

SEQ ID NO: 358112 - DNA, 20 bp, human
gaaatgagctcggtttcaga

SEQ ID NO: 358113 - DNA, 20 bp, human
gaactggtctaagattgccc

SEQ ID NO: 358114 - DNA, 20 bp, human
gtgggaccaggaactgaata

SEQ ID NO: 358115 - DNA, 20 bp, human
gtcatccaagattcagatct

SEQ ID NO: 358116 - DNA, 20 bp, human
ggggcagagacatggttcat

SEQ ID NO: 358117 - DNA, 20 bp, human
ggcgacaggtacaagggcac

SEQ ID NO: 358118 - DNA, 20 bp, human
ggtctctgccccaaggacaa

SEQ ID NO: 358119 - DNA, 20 bp, human
gcgaatcccgctgaggtccc

SEQ ID NO: 358120 - DNA, 20 bp, human
gtgtctacctgcctgtgacc

SEQ ID NO: 358121 - DNA, 20 bp, human
gaagatgtgttccaggtcac

SEQ ID NO: 358122 - DNA, 20 bp, human
gcaactgacctttgtccttg

SEQ ID NO: 358123 - DNA, 20 bp, human
gcccaatccaggtcctcaaa

SEQ ID NO: 358124 - DNA, 20 bp, human
gaggctgctgtgctcatgct

SEQ ID NO: 358125 - DNA, 20 bp, human
gtgtgttccaggtcacaggc

SEQ ID NO: 358126 - DNA, 20 bp, human
gggtaggccaaagccagaac

SEQ ID NO: 358127 - DNA, 20 bp, human
gctttggcctacccaggaag

SEQ ID NO: 358128 - DNA, 20 bp, human
gagagctctgttctagattc

SEQ ID NO: 358129 - DNA, 20 bp, human
gcagtttcagtttcggtgtt

SEQ ID NO: 358130 - DNA, 20 bp, human
gggaaccggggctgcatgca

SEQ ID NO: 358131 - DNA, 20 bp, human
gcaaaactgtgttagttaat

SEQ ID NO: 358132 - DNA, 20 bp, human
gagcctgctgggagatgtgg

SEQ ID NO: 358133 - DNA, 20 bp, human
gctcagacagtctaaaatga

SEQ ID NO: 358134 - DNA, 20 bp, human
gcacttcactgcccagggct

SEQ ID NO: 358135 - DNA, 20 bp, human
gctctctcattttttataat

SEQ ID NO: 358136 - DNA, 20 bp, human
gagctctcctggcgacgctg

SEQ ID NO: 358137 - DNA, 20 bp, human
ggcgacgctggggccgcgaa

SEQ ID NO: 358138 - DNA, 20 bp, human
gccgcggcgggcccggagat

SEQ ID NO: 358139 - DNA, 20 bp, human
gcccccggaaacacgtcctg

SEQ ID NO: 358140 - DNA, 20 bp, human
gcgggcccggagatcggtgc

SEQ ID NO: 358141 - DNA, 20 bp, human
gctggtgagcgcaggcgttg

SEQ ID NO: 358142 - DNA, 20 bp, human
gccgcctcccggctcgtcga

SEQ ID NO: 358143 - DNA, 20 bp, human
gcgcagtagtgattctagag

SEQ ID NO: 358144 - DNA, 20 bp, human
ggcgacggagactgctgtcc

SEQ ID NO: 358145 - DNA, 20 bp, human
ggtagtgattctagagaggc

SEQ ID NO: 358146 - DNA, 20 bp, human
gcgccggcaggacctgttcg

SEQ ID NO: 358147 - DNA, 20 bp, human
gggaaggcgaggcggtgaag

SEQ ID NO: 358148 - DNA, 20 bp, human
gagggaaccccgtgaagcgc

SEQ ID NO: 358149 - DNA, 20 bp, human
gtcgaaacagagggaaggcg

SEQ ID NO: 358150 - DNA, 20 bp, human
gaacaggtcctgccggcggc

SEQ ID NO: 358151 - DNA, 20 bp, human
ggaaaaatctcccccaccta

SEQ ID NO: 358152 - DNA, 20 bp, human
gggtgtcacaaagacaacga

SEQ ID NO: 358153 - DNA, 20 bp, human
gcctctgtttcgaaaggttc

SEQ ID NO: 358154 - DNA, 20 bp, human
gccctgcccggcgcttcacg

SEQ ID NO: 358155 - DNA, 20 bp, human
gtcctcttgaactttctccg

SEQ ID NO: 358156 - DNA, 20 bp, human
gcctgccccaagctcttaga

SEQ ID NO: 358157 - DNA, 20 bp, human
gcgggacagagggtgcaaaa

SEQ ID NO: 358158 - DNA, 20 bp, human
gttgcaccctctgtcccgga

SEQ ID NO: 358159 - DNA, 20 bp, human
gcaccctctgtcccggacgg

SEQ ID NO: 358160 - DNA, 20 bp, human
gctcctccgtccgggacaga

SEQ ID NO: 358161 - DNA, 20 bp, human
gtgagctggactcgcccaat

SEQ ID NO: 358162 - DNA, 20 bp, human
gcccaccagctccgtaggag

SEQ ID NO: 358163 - DNA, 20 bp, human
ggatgcgcaccccgcccaga

SEQ ID NO: 358164 - DNA, 20 bp, human
gtcgcccaataggaatgttt

SEQ ID NO: 358165 - DNA, 20 bp, human
gtggcgcccaccagctccgt

SEQ ID NO: 358166 - DNA, 20 bp, human
gggtcccagcggatgcgagg

SEQ ID NO: 358167 - DNA, 20 bp, human
gcggggacccgcggaccctg

SEQ ID NO: 358168 - DNA, 20 bp, human
gcggggcgccgctccccctg

SEQ ID NO: 358169 - DNA, 20 bp, human
ggagaaggaaaggaacgtga

SEQ ID NO: 358170 - DNA, 20 bp, human
gcgaggaggcttagagacgg

SEQ ID NO: 358171 - DNA, 20 bp, human
gtggccgccgagcgcctgga

SEQ ID NO: 358172 - DNA, 20 bp, human
gtgtgaggagccagagtgct

SEQ ID NO: 358173 - DNA, 20 bp, human
gtggaagcaacgtttgcgtg

SEQ ID NO: 358174 - DNA, 20 bp, human
gcgcgaaggccggatttcaa

SEQ ID NO: 358175 - DNA, 20 bp, human
ggaccgagggcccagcactc

SEQ ID NO: 358176 - DNA, 20 bp, human
ggtctggaagtgggttgtac

SEQ ID NO: 358177 - DNA, 20 bp, human
gaaaggatgacaattaatac

SEQ ID NO: 358178 - DNA, 20 bp, human
gcgtagggcaagcaattccc

SEQ ID NO: 358179 - DNA, 20 bp, human
gaccagctgctctgaacgta

SEQ ID NO: 358180 - DNA, 20 bp, human
gaaacctgaccttttaggtt

SEQ ID NO: 358181 - DNA, 20 bp, human
gtttactatagattattatc

SEQ ID NO: 358182 - DNA, 20 bp, human
gatgtagataagaatgaaag

SEQ ID NO: 358183 - DNA, 20 bp, human
gcagtttgactagcacagtc

SEQ ID NO: 358184 - DNA, 20 bp, human
gatagtaaagatggtaaaag

SEQ ID NO: 358185 - DNA, 20 bp, human
gtcatcaattcttcttactt

SEQ ID NO: 358186 - DNA, 20 bp, human
gaggcccagggcccgagggt

SEQ ID NO: 358187 - DNA, 20 bp, human
gcccgctgggccctgtaagg

SEQ ID NO: 358188 - DNA, 20 bp, human
gcctaggggagccgagtcac

SEQ ID NO: 358189 - DNA, 20 bp, human
gaggcagtcagcccagccgg

SEQ ID NO: 358190 - DNA, 20 bp, human
gtgactgcctcccgaccctc

SEQ ID NO: 358191 - DNA, 20 bp, human
ggtgtctagtgcttgaaaag

SEQ ID NO: 358192 - DNA, 20 bp, human
gttacagggcccagcggggg

SEQ ID NO: 358193 - DNA, 20 bp, human
gccagggcccgagggtcggg

SEQ ID NO: 358194 - DNA, 20 bp, human
gaggaggacgctgcccccta

SEQ ID NO: 358195 - DNA, 20 bp, human
gggggagccgagtcacaggc

SEQ ID NO: 358196 - DNA, 20 bp, human
ggggaaccgcagacgctgca

SEQ ID NO: 358197 - DNA, 20 bp, human
gggaacctggctcacagcgg

SEQ ID NO: 358198 - DNA, 20 bp, human
gtgagccaggttccccctcc

SEQ ID NO: 358199 - DNA, 20 bp, human
gaggactagggattcggcac

SEQ ID NO: 358200 - DNA, 20 bp, human
ggagcggtccacctgagtgc

SEQ ID NO: 358201 - DNA, 20 bp, human
gacagagacgagacaaccac

SEQ ID NO: 358202 - DNA, 20 bp, human
ggggggaacctggctcacag

SEQ ID NO: 358203 - DNA, 20 bp, human
gttgtctcgtctctgtcact

SEQ ID NO: 358204 - DNA, 20 bp, human
ggtcacttggttgggctgag

SEQ ID NO: 358205 - DNA, 20 bp, human
gacctggctcacagcggtgg

SEQ ID NO: 358206 - DNA, 20 bp, human
gtccctgtgtgtagcgtcta

SEQ ID NO: 358207 - DNA, 20 bp, human
gttccccgggaatttaattc

SEQ ID NO: 358208 - DNA, 20 bp, human
ggccctagacgctacacaca

SEQ ID NO: 358209 - DNA, 20 bp, human
gaaacaggtgaatgataccg

SEQ ID NO: 358210 - DNA, 20 bp, human
gcccggggaaggcgcgccct

SEQ ID NO: 358211 - DNA, 20 bp, human
gtgccctggttccagcagat

SEQ ID NO: 358212 - DNA, 20 bp, human
gaacccatctgctggaacca

SEQ ID NO: 358213 - DNA, 20 bp, human
gcagtaagcgtcggagaaac

SEQ ID NO: 358214 - DNA, 20 bp, human
ggtcctgaattaaattcccg

SEQ ID NO: 358215 - DNA, 20 bp, human
gtgctgccatggcaacggcg

SEQ ID NO: 358216 - DNA, 20 bp, human
gaggaggagcgaggagtctc

SEQ ID NO: 358217 - DNA, 20 bp, human
gccctctgcggattggtcct

SEQ ID NO: 358218 - DNA, 20 bp, human
gtaccccctccgccctccgt

SEQ ID NO: 358219 - DNA, 20 bp, human
gcagagcccgggccccacgg

SEQ ID NO: 358220 - DNA, 20 bp, human
gcccctcggccagtgacgtc

SEQ ID NO: 358221 - DNA, 20 bp, human
gtccgccctccgtggggccc

SEQ ID NO: 358222 - DNA, 20 bp, human
gccgagggccctgacgtcac

SEQ ID NO: 358223 - DNA, 20 bp, human
ggccgaggaccaatccgcag

SEQ ID NO: 358224 - DNA, 20 bp, human
gccaatccgcagagggtgca

SEQ ID NO: 358225 - DNA, 20 bp, human
gtggtcctcggcctgctggg

SEQ ID NO: 358226 - DNA, 20 bp, human
gaagccccgccccgacgcgt

SEQ ID NO: 358227 - DNA, 20 bp, human
gcagcccacgcgtcggggcg

SEQ ID NO: 358228 - DNA, 20 bp, human
gtccaatcgcggcaccagag

SEQ ID NO: 358229 - DNA, 20 bp, human
ggggctgctgtcaaggacgc

SEQ ID NO: 358230 - DNA, 20 bp, human
gcggggccccacagcgccag

SEQ ID NO: 358231 - DNA, 20 bp, human
gcccccgccggatccaatcg

SEQ ID NO: 358232 - DNA, 20 bp, human
gtccccgcggctagcctgtg

SEQ ID NO: 358233 - DNA, 20 bp, human
gctgccgccagtagccacac

SEQ ID NO: 358234 - DNA, 20 bp, human
gtgacagcagcccacgcgtc

SEQ ID NO: 358235 - DNA, 20 bp, human
gcgcggggattgtgggatgc

SEQ ID NO: 358236 - DNA, 20 bp, human
gccacatcctgtcggagcag

SEQ ID NO: 358237 - DNA, 20 bp, human
gggcaagaaccaattgagat

SEQ ID NO: 358238 - DNA, 20 bp, human
ggccgagtagactttgcaag

SEQ ID NO: 358239 - DNA, 20 bp, human
gccctcttgcaaagtctact

SEQ ID NO: 358240 - DNA, 20 bp, human
gaccaaggacttaactctcc

SEQ ID NO: 358241 - DNA, 20 bp, human
gaacagttaaatttgtaatt

SEQ ID NO: 358242 - DNA, 20 bp, human
gtccgggagagttaagtcct

SEQ ID NO: 358243 - DNA, 20 bp, human
ggagttgccagcccgttgta

SEQ ID NO: 358244 - DNA, 20 bp, human
ggatgggatccacatcctgt

SEQ ID NO: 358245 - DNA, 20 bp, human
gaaccacaagttgggtagcc

SEQ ID NO: 358246 - DNA, 20 bp, human
ggagaggagggccatcagag

SEQ ID NO: 358247 - DNA, 20 bp, human
gcagaaatgtggaggatgac

SEQ ID NO: 358248 - DNA, 20 bp, human
ggctggggcggcatcgccgg

SEQ ID NO: 358249 - DNA, 20 bp, human
ggagtgctaaggggagggta

SEQ ID NO: 358250 - DNA, 20 bp, human
gatcgccggaggcagggtgc

SEQ ID NO: 358251 - DNA, 20 bp, human
gggggctggggcggcatcgc

SEQ ID NO: 358252 - DNA, 20 bp, human
gagatggagagctgacactc

SEQ ID NO: 358253 - DNA, 20 bp, human
gaacccagccctgtctcttt

SEQ ID NO: 358254 - DNA, 20 bp, human
gagagagaggtggagtgcta

SEQ ID NO: 358255 - DNA, 20 bp, human
gtgacactccggattgcact

SEQ ID NO: 358256 - DNA, 20 bp, human
gcgaggcggcacccagaccg

SEQ ID NO: 358257 - DNA, 20 bp, human
ggagcgcgggagagcggccg

SEQ ID NO: 358258 - DNA, 20 bp, human
gagtaaaagccttgtcagga

SEQ ID NO: 358259 - DNA, 20 bp, human
gctgggtgccgcctcggccg

SEQ ID NO: 358260 - DNA, 20 bp, human
gacaatgtgccatcctgaca

SEQ ID NO: 358261 - DNA, 20 bp, human
ggagaagccaacgtgcatca

SEQ ID NO: 358262 - DNA, 20 bp, human
gaaggtaatctccgtgaaca

SEQ ID NO: 358263 - DNA, 20 bp, human
gaccttctggcaaaggagcg

SEQ ID NO: 358264 - DNA, 20 bp, human
gcgcctccctcccctgttca

SEQ ID NO: 358265 - DNA, 20 bp, human
ggggtgcgtgtgagacggag

SEQ ID NO: 358266 - DNA, 20 bp, human
gaaaaggcagaggttgagcg

SEQ ID NO: 358267 - DNA, 20 bp, human
gtggactgtatcacattctg

SEQ ID NO: 358268 - DNA, 20 bp, human
gcttaaccttacaggagttt

SEQ ID NO: 358269 - DNA, 20 bp, human
gtttacttaagagtactgtg

SEQ ID NO: 358270 - DNA, 20 bp, human
ggtgggactgcctaccactg

SEQ ID NO: 358271 - DNA, 20 bp, human
gcagtactcttaagtaaagt

SEQ ID NO: 358272 - DNA, 20 bp, human
ggcaagcactattactggag

SEQ ID NO: 358273 - DNA, 20 bp, human
ggggtctgcttcatatttgc

SEQ ID NO: 358274 - DNA, 20 bp, human
gtcacaaaaggcttgtggta

SEQ ID NO: 358275 - DNA, 20 bp, human
gggttgagcggggagtagaa

SEQ ID NO: 358276 - DNA, 20 bp, human
gtcaccaccggactccaact

SEQ ID NO: 358277 - DNA, 20 bp, human
ggggcagcgcgcggcaatgc

SEQ ID NO: 358278 - DNA, 20 bp, human
gccaggacgcggtgccccaa

SEQ ID NO: 358279 - DNA, 20 bp, human
gttggagtccggtggtgaag

SEQ ID NO: 358280 - DNA, 20 bp, human
gcgcggcaatgccggccccg

SEQ ID NO: 358281 - DNA, 20 bp, human
gcaccggactccaactggga

SEQ ID NO: 358282 - DNA, 20 bp, human
ggtgccaagaggtaagtcgt

SEQ ID NO: 358283 - DNA, 20 bp, human
gtccggtggtgaagcggtgt

SEQ ID NO: 358284 - DNA, 20 bp, human
gaaaggaaggagcctagccg

SEQ ID NO: 358285 - DNA, 20 bp, human
gtgagtttgcagcttggaat

SEQ ID NO: 358286 - DNA, 20 bp, human
ggaggccgcccaacggggag

SEQ ID NO: 358287 - DNA, 20 bp, human
ggcgttcgcggggaggaacg

SEQ ID NO: 358288 - DNA, 20 bp, human
gggcacctcggtggcgttcg

SEQ ID NO: 358289 - DNA, 20 bp, human
gcctgccggaggccgcccaa

SEQ ID NO: 358290 - DNA, 20 bp, human
gccttccgcccctccccgtt

SEQ ID NO: 358291 - DNA, 20 bp, human
gaccgaggtgcccgcgatgg

SEQ ID NO: 358292 - DNA, 20 bp, human
ggcgtcgcacagccaatcgg

SEQ ID NO: 358293 - DNA, 20 bp, human
ggccaccgaggtgcccgcga

SEQ ID NO: 358294 - DNA, 20 bp, human
gacccgagagagggcggcaa

SEQ ID NO: 358295 - DNA, 20 bp, human
ggggttgcgccccagcgtca

SEQ ID NO: 358296 - DNA, 20 bp, human
gcatcctgtgagctgaggtt

SEQ ID NO: 358297 - DNA, 20 bp, human
ggccctgcgcgggagctggt

SEQ ID NO: 358298 - DNA, 20 bp, human
gagggccctggaggcggcaa

SEQ ID NO: 358299 - DNA, 20 bp, human
ggatgcgagaagcctgctcg

SEQ ID NO: 358300 - DNA, 20 bp, human
gagaagcctgctcgcggcct

SEQ ID NO: 358301 - DNA, 20 bp, human
ggctcgcggccttggctcat

SEQ ID NO: 358302 - DNA, 20 bp, human
gctcgtacccaccagagcct

SEQ ID NO: 358303 - DNA, 20 bp, human
gcggcaagggcctggccttg

SEQ ID NO: 358304 - DNA, 20 bp, human
gagagcctgggctctgtcaa

SEQ ID NO: 358305 - DNA, 20 bp, human
ggctgaggttgggttgacac

SEQ ID NO: 358306 - DNA, 20 bp, human
gggaggcgagacccgaggat

SEQ ID NO: 358307 - DNA, 20 bp, human
gtcccgcagcagcctcttgg

SEQ ID NO: 358308 - DNA, 20 bp, human
ggcgccggaaaggggaaacc

SEQ ID NO: 358309 - DNA, 20 bp, human
gcggagggaggcgagacccg

SEQ ID NO: 358310 - DNA, 20 bp, human
ggggactggactcgcggaga

SEQ ID NO: 358311 - DNA, 20 bp, human
ggcgagacccgaggattggg

SEQ ID NO: 358312 - DNA, 20 bp, human
ggacccgggtttcccctttc

SEQ ID NO: 358313 - DNA, 20 bp, human
gccccccgaccttgctaggg

SEQ ID NO: 358314 - DNA, 20 bp, human
gaggctggaaggcgccggaa

SEQ ID NO: 358315 - DNA, 20 bp, human
gctgccccccgaccttgcta

SEQ ID NO: 358316 - DNA, 20 bp, human
gacccaggggccaaaagctt

SEQ ID NO: 358317 - DNA, 20 bp, human
gacgccacgcccatgcgcga

SEQ ID NO: 358318 - DNA, 20 bp, human
gcagctgcgcagcgcagggt

SEQ ID NO: 358319 - DNA, 20 bp, human
gaaaagacgctaaacgctgg

SEQ ID NO: 358320 - DNA, 20 bp, human
gctgcacggaaccaggaccc

SEQ ID NO: 358321 - DNA, 20 bp, human
gatatatcaaaccctctagg

SEQ ID NO: 358322 - DNA, 20 bp, human
gaggatatatcaaaccctct

SEQ ID NO: 358323 - DNA, 20 bp, human
ggctgcaccccttcgcgcat

SEQ ID NO: 358324 - DNA, 20 bp, human
gcttttgtcacccacctaga

SEQ ID NO: 358325 - DNA, 20 bp, human
ggacaaaagacgctaaacgc

SEQ ID NO: 358326 - DNA, 20 bp, human
gacgccacgcccatgcgcga

SEQ ID NO: 358327 - DNA, 20 bp, human
gacccaggggccaaaagctt

SEQ ID NO: 358328 - DNA, 20 bp, human
gcagctgcgcagcgcagggt

SEQ ID NO: 358329 - DNA, 20 bp, human
gtctggaaagagccagactc

SEQ ID NO: 358330 - DNA, 20 bp, human
gggccgagccctcctcacca

SEQ ID NO: 358331 - DNA, 20 bp, human
gaaaagacgctaaacgctgg

SEQ ID NO: 358332 - DNA, 20 bp, human
gcaccccaccctgcacattc

SEQ ID NO: 358333 - DNA, 20 bp, human
gccctcgtgcccaggtccat

SEQ ID NO: 358334 - DNA, 20 bp, human
gctgcacggaaccaggaccc

SEQ ID NO: 358335 - DNA, 20 bp, human
ggctgcaccccttcgcgcat

SEQ ID NO: 358336 - DNA, 20 bp, human
gtgccctgctagggcctgta

SEQ ID NO: 358337 - DNA, 20 bp, human
gctgctagggcctgtagggc

SEQ ID NO: 358338 - DNA, 20 bp, human
ggtagcccagcgcaccgccc

SEQ ID NO: 358339 - DNA, 20 bp, human
ggggctccgcaggcaggact

SEQ ID NO: 358340 - DNA, 20 bp, human
gctcccgcacaagttgtctc

SEQ ID NO: 358341 - DNA, 20 bp, human
ggccgcccacgtgctccccg

SEQ ID NO: 358342 - DNA, 20 bp, human
gccgtcctctcccgccctac

SEQ ID NO: 358343 - DNA, 20 bp, human
gcaggccctagcagggcagg

SEQ ID NO: 358344 - DNA, 20 bp, human
gctccaggatcccggaactc

SEQ ID NO: 358345 - DNA, 20 bp, human
ggggcacagggaaccgggat

SEQ ID NO: 358346 - DNA, 20 bp, human
gctaggctaaagggcccaca

SEQ ID NO: 358347 - DNA, 20 bp, human
gacaatgggcaaaaagagga

SEQ ID NO: 358348 - DNA, 20 bp, human
gttagcctagggaaggggga

SEQ ID NO: 358349 - DNA, 20 bp, human
gggcagcagcacggagactg

SEQ ID NO: 358350 - DNA, 20 bp, human
gggccctttagcctagggaa

SEQ ID NO: 358351 - DNA, 20 bp, human
ggaaaggaggagcctaaaga

SEQ ID NO: 358352 - DNA, 20 bp, human
gagcactcttaagacagcaa

SEQ ID NO: 358353 - DNA, 20 bp, human
gaactcgaactcagtcctgg

SEQ ID NO: 358354 - DNA, 20 bp, human
gagtaactcgaactcagtcc

SEQ ID NO: 358355 - DNA, 20 bp, human
gctgctggcagaatggtgac

SEQ ID NO: 358356 - DNA, 20 bp, human
gggcccgcggaaggtttccc

SEQ ID NO: 358357 - DNA, 20 bp, human
gctcccgggtgctggaaccc

SEQ ID NO: 358358 - DNA, 20 bp, human
ggaccgactcagaaccactg

SEQ ID NO: 358359 - DNA, 20 bp, human
gcgcgggcctccagggccgg

SEQ ID NO: 358360 - DNA, 20 bp, human
gaacccagggaaaccttccg

SEQ ID NO: 358361 - DNA, 20 bp, human
gggccctggaggcccgcgga

SEQ ID NO: 358362 - DNA, 20 bp, human
gaggcggcggttctcaacgc

SEQ ID NO: 358363 - DNA, 20 bp, human
gttcccagtagaacctagtg

SEQ ID NO: 358364 - DNA, 20 bp, human
gtcgccaggcaccaccccgc

SEQ ID NO: 358365 - DNA, 20 bp, human
gcgactcagaaccactgggg

SEQ ID NO: 358366 - DNA, 20 bp, human
gcggagacacagacggaagt

SEQ ID NO: 358367 - DNA, 20 bp, human
gacgccccggatttgatcta

SEQ ID NO: 358368 - DNA, 20 bp, human
gcaggaagcgccggctacgg

SEQ ID NO: 358369 - DNA, 20 bp, human
gctggggtcgggagcacagt

SEQ ID NO: 358370 - DNA, 20 bp, human
ggcacagtgggaccacgccc

SEQ ID NO: 358371 - DNA, 20 bp, human
ggcgcttcctgccgaggctg

SEQ ID NO: 358372 - DNA, 20 bp, human
gacagacggaagtgggtgac

SEQ ID NO: 358373 - DNA, 20 bp, human
ggccgtgagcctatggagag

SEQ ID NO: 358374 - DNA, 20 bp, human
gtccgtctgtgtctccgggt

SEQ ID NO: 358375 - DNA, 20 bp, human
gcggcaggaagcgccggcta

SEQ ID NO: 358376 - DNA, 20 bp, human
gtcccaacgcttcggggcag

SEQ ID NO: 358377 - DNA, 20 bp, human
gcctcccaccgaggctgcgc

SEQ ID NO: 358378 - DNA, 20 bp, human
gcgcgaggagcgagatgttc

SEQ ID NO: 358379 - DNA, 20 bp, human
ggagctggaggcctcaaagt

SEQ ID NO: 358380 - DNA, 20 bp, human
ggggcgtgggccaatggcgc

SEQ ID NO: 358381 - DNA, 20 bp, human
ggggaccccggaggtgtcta

SEQ ID NO: 358382 - DNA, 20 bp, human
gacgggcgtccggaactcct

SEQ ID NO: 358383 - DNA, 20 bp, human
gatgccccgccctcccaccg

SEQ ID NO: 358384 - DNA, 20 bp, human
gagtgggctcagtgacgctg

SEQ ID NO: 358385 - DNA, 20 bp, human
ggggaagcttgcaagacgct

SEQ ID NO: 358386 - DNA, 20 bp, human
gcgagtcgaacgtggaagta

SEQ ID NO: 358387 - DNA, 20 bp, human
gaggcagaacgagtcgaacg

SEQ ID NO: 358388 - DNA, 20 bp, human
gcagcgctgagaggcttcta

SEQ ID NO: 358389 - DNA, 20 bp, human
gagcaagtcccgagcgagtg

SEQ ID NO: 358390 - DNA, 20 bp, human
ggactcgttctgcctggcca

SEQ ID NO: 358391 - DNA, 20 bp, human
gacacctacagccggctcct

SEQ ID NO: 358392 - DNA, 20 bp, human
gtcccggcgcggcagctgtc

SEQ ID NO: 358393 - DNA, 20 bp, human
gcggcatcgcgcgtcagtga

SEQ ID NO: 358394 - DNA, 20 bp, human
gagcccagactcatcgagcg

SEQ ID NO: 358395 - DNA, 20 bp, human
gcgcggtctggcattcgcca

SEQ ID NO: 358396 - DNA, 20 bp, human
gggccacgtctgcggttctg

SEQ ID NO: 358397 - DNA, 20 bp, human
gggtgcagacgttgttgctt

SEQ ID NO: 358398 - DNA, 20 bp, human
gccctggccaatcacggcag

SEQ ID NO: 358399 - DNA, 20 bp, human
gggagactaccggtcggcaa

SEQ ID NO: 358400 - DNA, 20 bp, human
gccgctgcgtgtaggtgaag

SEQ ID NO: 358401 - DNA, 20 bp, human
gcggttctgaggactgggtt

SEQ ID NO: 358402 - DNA, 20 bp, human
gagttgagaagggagactac

SEQ ID NO: 358403 - DNA, 20 bp, human
gacgagccggaagccacgca

SEQ ID NO: 358404 - DNA, 20 bp, human
gggcccggcttacctcggtc

SEQ ID NO: 358405 - DNA, 20 bp, human
gccgaggctcggagttgaga

SEQ ID NO: 358406 - DNA, 20 bp, human
gcaagtgcagacaccaacac

SEQ ID NO: 358407 - DNA, 20 bp, human
gacaccaacaccggcggacg

SEQ ID NO: 358408 - DNA, 20 bp, human
gggcggacgcggctcccaac

SEQ ID NO: 358409 - DNA, 20 bp, human
ggagccgcgtccgccggtgt

SEQ ID NO: 358410 - DNA, 20 bp, human
gaagctggggctcgcctgtt

SEQ ID NO: 358411 - DNA, 20 bp, human
gcgcgtccaaggccgcggac

SEQ ID NO: 358412 - DNA, 20 bp, human
gagccccagcttccggtccg

SEQ ID NO: 358413 - DNA, 20 bp, human
ggtgcagacaccaacaccgg

SEQ ID NO: 358414 - DNA, 20 bp, human
gtctgcacttggaaggacgt

SEQ ID NO: 358415 - DNA, 20 bp, human
ggttggtgtctgcacttgga

SEQ ID NO: 358416 - DNA, 20 bp, human
ggcggggcgagacggagctg

SEQ ID NO: 358417 - DNA, 20 bp, human
ggcgaagcgaaacgggacgt

SEQ ID NO: 358418 - DNA, 20 bp, human
gagctggggcgaagcgaaac

SEQ ID NO: 358419 - DNA, 20 bp, human
ggacgtgggcgaggcgagtc

SEQ ID NO: 358420 - DNA, 20 bp, human
gcttctgggcggaacttcta

SEQ ID NO: 358421 - DNA, 20 bp, human
ggcgaggcgagtccgggcga

SEQ ID NO: 358422 - DNA, 20 bp, human
gcgagtccgggcgagggtca

SEQ ID NO: 358423 - DNA, 20 bp, human
gcctccgcaaccgggcggga

SEQ ID NO: 358424 - DNA, 20 bp, human
gttactgagcaggagcttct

SEQ ID NO: 358425 - DNA, 20 bp, human
gcccccgtcccgcccggttg

SEQ ID NO: 358426 - DNA, 20 bp, human
gccagccgggagaagacgag

SEQ ID NO: 358427 - DNA, 20 bp, human
ggggatgtcacagaacgccg

SEQ ID NO: 358428 - DNA, 20 bp, human
gccccacagccagttccaac

SEQ ID NO: 358429 - DNA, 20 bp, human
gaaagtgcttcctgtgccgg

SEQ ID NO: 358430 - DNA, 20 bp, human
gggcacaggaagcactttct

SEQ ID NO: 358431 - DNA, 20 bp, human
gaggagcggcgtaaagttcc

SEQ ID NO: 358432 - DNA, 20 bp, human
ggctgtggggctgcggcggt

SEQ ID NO: 358433 - DNA, 20 bp, human
ggccgggagaagacgagggg

SEQ ID NO: 358434 - DNA, 20 bp, human
gcgcctgttggaactggctg

SEQ ID NO: 358435 - DNA, 20 bp, human
ggagaagacgaggggaggcg

SEQ ID NO: 358436 - DNA, 20 bp, human
gtaggacatttagagaagga

SEQ ID NO: 358437 - DNA, 20 bp, human
gttagagaaggagggcgggg

SEQ ID NO: 358438 - DNA, 20 bp, human
gtaacgctatctacaaacga

SEQ ID NO: 358439 - DNA, 20 bp, human
gaatcgcatacagctcacag

SEQ ID NO: 358440 - DNA, 20 bp, human
gacatttagagaaggagggc

SEQ ID NO: 358441 - DNA, 20 bp, human
gcccctaatgacacaggaat

SEQ ID NO: 358442 - DNA, 20 bp, human
gctctagctcaatttctttc

SEQ ID NO: 358443 - DNA, 20 bp, human
gcctttgtggaattaactgt

SEQ ID NO: 358444 - DNA, 20 bp, human
gacagggcaaaatgcctttg

SEQ ID NO: 358445 - DNA, 20 bp, human
gttcctattcctgtgtcatt

SEQ ID NO: 358446 - DNA, 20 bp, human
gctcacagctagaacctcac

SEQ ID NO: 358447 - DNA, 20 bp, human
gagcatgctcagaacatggg

SEQ ID NO: 358448 - DNA, 20 bp, human
gagaacctcactggcatgaa

SEQ ID NO: 358449 - DNA, 20 bp, human
gtgtgagcatgctcagaaca

SEQ ID NO: 358450 - DNA, 20 bp, human
gcattatggtgtgtaaaaga

SEQ ID NO: 358451 - DNA, 20 bp, human
ggagcaaattgtacatgctt

SEQ ID NO: 358452 - DNA, 20 bp, human
gatctcccttcatgccagtg

SEQ ID NO: 358453 - DNA, 20 bp, human
gtctcaaatatgaaggatat

SEQ ID NO: 358454 - DNA, 20 bp, human
gagaaggtataataggactt

SEQ ID NO: 358455 - DNA, 20 bp, human
gtatcctcttatacctcagc

SEQ ID NO: 358456 - DNA, 20 bp, human
gtaatcccggggcgccgcga

SEQ ID NO: 358457 - DNA, 20 bp, human
gccgcgaggggcgctttccg

SEQ ID NO: 358458 - DNA, 20 bp, human
ggaaaactggagtggcgggt

SEQ ID NO: 358459 - DNA, 20 bp, human
gccggtgaaaagtgggagtg

SEQ ID NO: 358460 - DNA, 20 bp, human
gctggagaggaaaactggag

SEQ ID NO: 358461 - DNA, 20 bp, human
gcaactctccctcgcggcgc

SEQ ID NO: 358462 - DNA, 20 bp, human
gacccttcctgctgaaactc

SEQ ID NO: 358463 - DNA, 20 bp, human
gggcagaagtctgggctcaa

SEQ ID NO: 358464 - DNA, 20 bp, human
gcgagggagagttgagctgc

SEQ ID NO: 358465 - DNA, 20 bp, human
ggcggctgggttcagcacct

SEQ ID NO: 358466 - DNA, 20 bp, human
ggggctctaaatggcagaga

SEQ ID NO: 358467 - DNA, 20 bp, human
gtagagcccctcttacaggc

SEQ ID NO: 358468 - DNA, 20 bp, human
gtggggctgccctccatagc

SEQ ID NO: 358469 - DNA, 20 bp, human
gcatgcgcccgcctgtaaga

SEQ ID NO: 358470 - DNA, 20 bp, human
gctccctggggtggaggctt

SEQ ID NO: 358471 - DNA, 20 bp, human
gtcaagattggtggtaggtg

SEQ ID NO: 358472 - DNA, 20 bp, human
gggcgcatgcacatataccc

SEQ ID NO: 358473 - DNA, 20 bp, human
gccctctgaggtgtgggcgt

SEQ ID NO: 358474 - DNA, 20 bp, human
gagggagagttaccccgcta

SEQ ID NO: 358475 - DNA, 20 bp, human
gacccctccctctgaggtgt

SEQ ID NO: 358476 - DNA, 20 bp, human
gccgagtcagcgcccgtcgc

SEQ ID NO: 358477 - DNA, 20 bp, human
ggtggcggggggcccgcgac

SEQ ID NO: 358478 - DNA, 20 bp, human
gagccgcgaggaggcggcgt

SEQ ID NO: 358479 - DNA, 20 bp, human
gcgggcgggcggcgatcgcg

SEQ ID NO: 358480 - DNA, 20 bp, human
ggcgggcggcgatcgcgggg

SEQ ID NO: 358481 - DNA, 20 bp, human
gcacggcgctctcaactcgg

SEQ ID NO: 358482 - DNA, 20 bp, human
ggcagcgccgcggtcggagc

SEQ ID NO: 358483 - DNA, 20 bp, human
gccgcgccccgctccgaccg

SEQ ID NO: 358484 - DNA, 20 bp, human
gcgagtgtgtggcgggcccg

SEQ ID NO: 358485 - DNA, 20 bp, human
gttgcacggcgctctcaact

SEQ ID NO: 358486 - DNA, 20 bp, human
gcggcccaagacatgatccc

SEQ ID NO: 358487 - DNA, 20 bp, human
gggtaaaggcattagggcga

SEQ ID NO: 358488 - DNA, 20 bp, human
gaggcgggctaacaggccgg

SEQ ID NO: 358489 - DNA, 20 bp, human
gaaaggcattagggcgaagg

SEQ ID NO: 358490 - DNA, 20 bp, human
gtaccaatatggcggcactc

SEQ ID NO: 358491 - DNA, 20 bp, human
gcgcgcatgcgtgtcagtgc

SEQ ID NO: 358492 - DNA, 20 bp, human
gcattagggcgaaggtggaa

SEQ ID NO: 358493 - DNA, 20 bp, human
ggcgaggcgggctaacaggc

SEQ ID NO: 358494 - DNA, 20 bp, human
gtaccggagtgccgccatat

SEQ ID NO: 358495 - DNA, 20 bp, human
gtgacacgcatgcgcgagtg

SEQ ID NO: 358496 - DNA, 20 bp, human
gcgtccccagaggtccctac

SEQ ID NO: 358497 - DNA, 20 bp, human
gccacccggtagggacctct

SEQ ID NO: 358498 - DNA, 20 bp, human
gcgggcggtcatacatcgat

SEQ ID NO: 358499 - DNA, 20 bp, human
ggggacctctggggacgcgc

SEQ ID NO: 358500 - DNA, 20 bp, human
gacggcggtggcaagagtag

SEQ ID NO: 358501 - DNA, 20 bp, human
gtgaccgcccggtgtaggtc

SEQ ID NO: 358502 - DNA, 20 bp, human
gagagaggcgggagacggca

SEQ ID NO: 358503 - DNA, 20 bp, human
gtcaggagagaggcgggaga

SEQ ID NO: 358504 - DNA, 20 bp, human
ggctcccggcgcgtccccag

SEQ ID NO: 358505 - DNA, 20 bp, human
ggtggcaagagtagcggtga

SEQ ID NO: 358506 - DNA, 20 bp, human
gccagcgcgcacacactccc

SEQ ID NO: 358507 - DNA, 20 bp, human
ggcggagcgtgcaagcccgg

SEQ ID NO: 358508 - DNA, 20 bp, human
ggcggtcggtgtgcgtgccc

SEQ ID NO: 358509 - DNA, 20 bp, human
ggcggcggagcgtgcaagcc

SEQ ID NO: 358510 - DNA, 20 bp, human
gtcccggcaacagcctcacg

SEQ ID NO: 358511 - DNA, 20 bp, human
gtcaggcccctgtcgcggga

SEQ ID NO: 358512 - DNA, 20 bp, human
gtggaactacttccccgggg

SEQ ID NO: 358513 - DNA, 20 bp, human
ggcggcgcgcgcaaactgcg

SEQ ID NO: 358514 - DNA, 20 bp, human
gccctgtcaggcccctgtcg

SEQ ID NO: 358515 - DNA, 20 bp, human
gtacttccccggggcggctt

SEQ ID NO: 358516 - DNA, 20 bp, human
ggggaccggctcttgcggag

SEQ ID NO: 358517 - DNA, 20 bp, human
gtagacgcagtgaccgcgtg

SEQ ID NO: 358518 - DNA, 20 bp, human
gccggcccgcccagagcgaa

SEQ ID NO: 358519 - DNA, 20 bp, human
gccagcctggcccgtccgtc

SEQ ID NO: 358520 - DNA, 20 bp, human
gccggcctgggcaacgcgct

SEQ ID NO: 358521 - DNA, 20 bp, human
gtgcgtgcgcgctcccgggg

SEQ ID NO: 358522 - DNA, 20 bp, human
gcccgtccgtcgggaaagga

SEQ ID NO: 358523 - DNA, 20 bp, human
gctggcccgtccgtcgggaa

SEQ ID NO: 358524 - DNA, 20 bp, human
gcctcggcgggcgaagggct

SEQ ID NO: 358525 - DNA, 20 bp, human
gacgcagtgaccgcgtgggg

SEQ ID NO: 358526 - DNA, 20 bp, human
ggggagagagagtatctagg

SEQ ID NO: 358527 - DNA, 20 bp, human
gtaccccaaatcttggctgg

SEQ ID NO: 358528 - DNA, 20 bp, human
gcaaacctccagccaagatt

SEQ ID NO: 358529 - DNA, 20 bp, human
gcccggccactccccttcgc

SEQ ID NO: 358530 - DNA, 20 bp, human
gtgggcagggctccggcgaa

SEQ ID NO: 358531 - DNA, 20 bp, human
ggccgttggccgccggaggt

SEQ ID NO: 358532 - DNA, 20 bp, human
ggccaagatttggggtatgt

SEQ ID NO: 358533 - DNA, 20 bp, human
ggggagtggccggggagtcc

SEQ ID NO: 358534 - DNA, 20 bp, human
gccccgggccccattggacc

SEQ ID NO: 358535 - DNA, 20 bp, human
gcggggagtcctggtccaat

SEQ ID NO: 358536 - DNA, 20 bp, human
gaccccagcggggcgcaggt

SEQ ID NO: 358537 - DNA, 20 bp, human
gtcccagcgcagccagtaag

SEQ ID NO: 358538 - DNA, 20 bp, human
gtgccctagcccagtccagg

SEQ ID NO: 358539 - DNA, 20 bp, human
gactggctgcgctgggaatc

SEQ ID NO: 358540 - DNA, 20 bp, human
gcccaccgctgcactaaccc

SEQ ID NO: 358541 - DNA, 20 bp, human
ggctccgcgcacttgctcgg

SEQ ID NO: 358542 - DNA, 20 bp, human
ggagcccagggaccccagcg

SEQ ID NO: 358543 - DNA, 20 bp, human
gttaagctcggaaggggcag

SEQ ID NO: 358544 - DNA, 20 bp, human
ggcgccccgctggggtccct

SEQ ID NO: 358545 - DNA, 20 bp, human
gtaggaggctgtgcgctcgc

SEQ ID NO: 358546 - DNA, 20 bp, human
gcccgaccatatagggagct

SEQ ID NO: 358547 - DNA, 20 bp, human
ggctggggcgagaggcgaga

SEQ ID NO: 358548 - DNA, 20 bp, human
ggccgcagcgcacttggctg

SEQ ID NO: 358549 - DNA, 20 bp, human
gcggactgcttggttggcgt

SEQ ID NO: 358550 - DNA, 20 bp, human
ggattagcttggcgctgctg

SEQ ID NO: 358551 - DNA, 20 bp, human
gttggcgctctgcagtgcag

SEQ ID NO: 358552 - DNA, 20 bp, human
ggggcgcgtcgagctggcgg

SEQ ID NO: 358553 - DNA, 20 bp, human
ggccccagccaagtgcgctg

SEQ ID NO: 358554 - DNA, 20 bp, human
ggtggaggacgaggacgaaa

SEQ ID NO: 358555 - DNA, 20 bp, human
ggctaatccccgaccatata

SEQ ID NO: 358556 - DNA, 20 bp, human
ggaacaccctgtggggcaag

SEQ ID NO: 358557 - DNA, 20 bp, human
ggggagggactgttgaagac

SEQ ID NO: 358558 - DNA, 20 bp, human
ggcctggagagaaaggaacg

SEQ ID NO: 358559 - DNA, 20 bp, human
gcacagacgaacaccctgtg

SEQ ID NO: 358560 - DNA, 20 bp, human
ggtactgcaaggcccagctt

SEQ ID NO: 358561 - DNA, 20 bp, human
ggaacggggcaagcaaggct

SEQ ID NO: 358562 - DNA, 20 bp, human
ggcagcagtggatggtgcag

SEQ ID NO: 358563 - DNA, 20 bp, human
gctctccaggcagcagtgga

SEQ ID NO: 358564 - DNA, 20 bp, human
gctgggccttgcagtacctg

SEQ ID NO: 358565 - DNA, 20 bp, human
ggaggtcctgggagggacac

SEQ ID NO: 358566 - DNA, 20 bp, human
gagtacctggggtctaggtg

SEQ ID NO: 358567 - DNA, 20 bp, human
gaccaggcccggagtacctg

SEQ ID NO: 358568 - DNA, 20 bp, human
gcagccagggccagtcctga

SEQ ID NO: 358569 - DNA, 20 bp, human
gctaggtgaggggaaccctc

SEQ ID NO: 358570 - DNA, 20 bp, human
gcccggagtacctggggtct

SEQ ID NO: 358571 - DNA, 20 bp, human
gtgacagctcaaatagctgt

SEQ ID NO: 358572 - DNA, 20 bp, human
gggaaagatcaattgcagta

SEQ ID NO: 358573 - DNA, 20 bp, human
ggcgtggaacacgttgatga

SEQ ID NO: 358574 - DNA, 20 bp, human
gctatttgagctgtcagcca

SEQ ID NO: 358575 - DNA, 20 bp, human
gttcccctcacctagacccc

SEQ ID NO: 358576 - DNA, 20 bp, human
ggggtccgggagcgagggca

SEQ ID NO: 358577 - DNA, 20 bp, human
ggaggcgggtccgggagcga

SEQ ID NO: 358578 - DNA, 20 bp, human
gcccggggtcgggggagtcg

SEQ ID NO: 358579 - DNA, 20 bp, human
gggcctctgcgaggcgggtc

SEQ ID NO: 358580 - DNA, 20 bp, human
gaaagaacccggccgtcctg

SEQ ID NO: 358581 - DNA, 20 bp, human
gccgccgcacgtactaagga

SEQ ID NO: 358582 - DNA, 20 bp, human
gcctccctgcggcacctcgc

SEQ ID NO: 358583 - DNA, 20 bp, human
gcccccagacggacctccta

SEQ ID NO: 358584 - DNA, 20 bp, human
gtaatctgatagtgcctctg

SEQ ID NO: 358585 - DNA, 20 bp, human
gtcccggacccgcctcgcag

SEQ ID NO: 358586 - DNA, 20 bp, human
gtaaaggatgtaaagtaaca

SEQ ID NO: 358587 - DNA, 20 bp, human
gaccacagaagtgctaacta

SEQ ID NO: 358588 - DNA, 20 bp, human
ggtccgttgaagcctattaa

SEQ ID NO: 358589 - DNA, 20 bp, human
gctaaagaatagaatgggct

SEQ ID NO: 358590 - DNA, 20 bp, human
gttactttacatcctttaat

SEQ ID NO: 358591 - DNA, 20 bp, human
gcagaagtgctaactatggg

SEQ ID NO: 358592 - DNA, 20 bp, human
gtctcaaatggaacacgcca

SEQ ID NO: 358593 - DNA, 20 bp, human
gagtgatgttgaggagctat

SEQ ID NO: 358594 - DNA, 20 bp, human
gttgcatttgagtgatgttg

SEQ ID NO: 358595 - DNA, 20 bp, human
gatcctttaataggcttcaa

SEQ ID NO: 358596 - DNA, 20 bp, human
gcgcggaagctgtctgagta

SEQ ID NO: 358597 - DNA, 20 bp, human
gaatcgctggagaggacggt

SEQ ID NO: 358598 - DNA, 20 bp, human
gccgggaagggcgtgggttg

SEQ ID NO: 358599 - DNA, 20 bp, human
gactgcttaaatcgctggag

SEQ ID NO: 358600 - DNA, 20 bp, human
gggcaaggctgggccgggaa

SEQ ID NO: 358601 - DNA, 20 bp, human
gagctgtctgagtaaggctt

SEQ ID NO: 358602 - DNA, 20 bp, human
gcccagaatgagctcataca

SEQ ID NO: 358603 - DNA, 20 bp, human
ggtgagactgcttaaatcgc

SEQ ID NO: 358604 - DNA, 20 bp, human
gtcacaggacggggtggagg

SEQ ID NO: 358605 - DNA, 20 bp, human
gcttaaatcgctggagagga

SEQ ID NO: 358606 - DNA, 20 bp, human
gagggcacccctgtgcgggt

SEQ ID NO: 358607 - DNA, 20 bp, human
gggagggcaaaattcagtct

SEQ ID NO: 358608 - DNA, 20 bp, human
gactccacccacccgcacag

SEQ ID NO: 358609 - DNA, 20 bp, human
gcctggctcagggctaaaaa

SEQ ID NO: 358610 - DNA, 20 bp, human
gagagctaaacctgaaacct

SEQ ID NO: 358611 - DNA, 20 bp, human
ggcacccctgtgcgggtggg

SEQ ID NO: 358612 - DNA, 20 bp, human
ggggatgcaaagttcatcac

SEQ ID NO: 358613 - DNA, 20 bp, human
gacaatctgggctgctcctg

SEQ ID NO: 358614 - DNA, 20 bp, human
gctgtggcagcctaagccac

SEQ ID NO: 358615 - DNA, 20 bp, human
gttcagtctgggtacaatct

SEQ ID NO: 358616 - DNA, 20 bp, human
gtgcaccccggtggatgagg

SEQ ID NO: 358617 - DNA, 20 bp, human
gcccttgattcagaaagaga

SEQ ID NO: 358618 - DNA, 20 bp, human
gccggggtgcataacttgga

SEQ ID NO: 358619 - DNA, 20 bp, human
gtccaccggggtgcataact

SEQ ID NO: 358620 - DNA, 20 bp, human
ggaccacaaaatagatatgg

SEQ ID NO: 358621 - DNA, 20 bp, human
gagagaccacaaaatagata

SEQ ID NO: 358622 - DNA, 20 bp, human
gacacatgagaagttcacca

SEQ ID NO: 358623 - DNA, 20 bp, human
gcataccacctcatccaccg

SEQ ID NO: 358624 - DNA, 20 bp, human
gtatggaacatgggcaactg

SEQ ID NO: 358625 - DNA, 20 bp, human
gctctgctctgtttgatcca

SEQ ID NO: 358626 - DNA, 20 bp, human
ggagcgcccccacttggtca

SEQ ID NO: 358627 - DNA, 20 bp, human
gcctctccctgaccaagtgg

SEQ ID NO: 358628 - DNA, 20 bp, human
gggcctgattgggctgtctc

SEQ ID NO: 358629 - DNA, 20 bp, human
gcaggagtgtgtatgctgag

SEQ ID NO: 358630 - DNA, 20 bp, human
gcagggcaagcggcctgatt

SEQ ID NO: 358631 - DNA, 20 bp, human
gtgcctggacagatctcgtt

SEQ ID NO: 358632 - DNA, 20 bp, human
gccaagtgggggcgctcgtg

SEQ ID NO: 358633 - DNA, 20 bp, human
ggaccagagacagcccaatc

SEQ ID NO: 358634 - DNA, 20 bp, human
ggctcctctccctgaccaag

SEQ ID NO: 358635 - DNA, 20 bp, human
gcacactcctgattagacat

SEQ ID NO: 358636 - DNA, 20 bp, human
gagggtggggcccataaagc

SEQ ID NO: 358637 - DNA, 20 bp, human
gctcgtggcagggtcatggt

SEQ ID NO: 358638 - DNA, 20 bp, human
gaaagagaagcgagaaggct

SEQ ID NO: 358639 - DNA, 20 bp, human
gcctcctcgtggcagggtca

SEQ ID NO: 358640 - DNA, 20 bp, human
ggctgctgcaatagcagggg

SEQ ID NO: 358641 - DNA, 20 bp, human
gatactgcctgctgtccaga

SEQ ID NO: 358642 - DNA, 20 bp, human
gcacttagggtaagagctgg

SEQ ID NO: 358643 - DNA, 20 bp, human
gggacagcaggcagtatatt

SEQ ID NO: 358644 - DNA, 20 bp, human
gctctgtggctccctcctcg

SEQ ID NO: 358645 - DNA, 20 bp, human
gtggctccctcctcgtggca

SEQ ID NO: 358646 - DNA, 20 bp, human
gtggctcggtggggagatag

SEQ ID NO: 358647 - DNA, 20 bp, human
ggggttgggcccttgttaaa

SEQ ID NO: 358648 - DNA, 20 bp, human
gaacctgacagggtagagaa

SEQ ID NO: 358649 - DNA, 20 bp, human
gagggagtgggacagattct

SEQ ID NO: 358650 - DNA, 20 bp, human
gccccagggccaagtcaaga

SEQ ID NO: 358651 - DNA, 20 bp, human
gtaacaagggcccaacccca

SEQ ID NO: 358652 - DNA, 20 bp, human
gacagattctgggagtgcag

SEQ ID NO: 358653 - DNA, 20 bp, human
gcagagggagtggtgaaaac

SEQ ID NO: 358654 - DNA, 20 bp, human
gactgggatcccagtttcag

SEQ ID NO: 358655 - DNA, 20 bp, human
ggtgcagcggggaggagtcc

SEQ ID NO: 358656 - DNA, 20 bp, human
ggggaagtgggaggtgtcgt

SEQ ID NO: 358657 - DNA, 20 bp, human
ggagctggcactctctggga

SEQ ID NO: 358658 - DNA, 20 bp, human
gtggtggagctggcactctc

SEQ ID NO: 358659 - DNA, 20 bp, human
ggggaggtgtcgtggggact

SEQ ID NO: 358660 - DNA, 20 bp, human
ggggactgggcatcctggac

SEQ ID NO: 358661 - DNA, 20 bp, human
gagggctctaggccaggtca

SEQ ID NO: 358662 - DNA, 20 bp, human
ggggaggcaacccctgctct

SEQ ID NO: 358663 - DNA, 20 bp, human
ggcaacctggggccaccctt

SEQ ID NO: 358664 - DNA, 20 bp, human
gtgccagctccaccaccagc

SEQ ID NO: 358665 - DNA, 20 bp, human
ggcatcctggaccggggtga

SEQ ID NO: 358666 - DNA, 20 bp, human
gaaacccccaggggtcggga

SEQ ID NO: 358667 - DNA, 20 bp, human
gggtcgggagggtaacctca

SEQ ID NO: 358668 - DNA, 20 bp, human
gggaatcaggagtgagtcac

SEQ ID NO: 358669 - DNA, 20 bp, human
gctcaaaacccccaggggtc

SEQ ID NO: 358670 - DNA, 20 bp, human
gcagcagtgggcaaatcttc

SEQ ID NO: 358671 - DNA, 20 bp, human
gctgcagcacagggcggcca

SEQ ID NO: 358672 - DNA, 20 bp, human
gatcccagaagggcggtgga

SEQ ID NO: 358673 - DNA, 20 bp, human
gagcagggaggttctgtata

SEQ ID NO: 358674 - DNA, 20 bp, human
gccagcctgggaaaacccga

SEQ ID NO: 358675 - DNA, 20 bp, human
ggggagggtaacctcagggg

SEQ ID NO: 358676 - DNA, 20 bp, human
ggccacacccagttctggga

SEQ ID NO: 358677 - DNA, 20 bp, human
gaggagagagggttgtagag

SEQ ID NO: 358678 - DNA, 20 bp, human
gcccctgctagtaaccgcta

SEQ ID NO: 358679 - DNA, 20 bp, human
gggagtggatagactgagtg

SEQ ID NO: 358680 - DNA, 20 bp, human
gtccctcccagaactgggtg

SEQ ID NO: 358681 - DNA, 20 bp, human
gaacaggaggcttggttcca

SEQ ID NO: 358682 - DNA, 20 bp, human
gtacccacgggtgcccacct

SEQ ID NO: 358683 - DNA, 20 bp, human
gggtaacgggtaagccctag

SEQ ID NO: 358684 - DNA, 20 bp, human
gagcagccacacccagttct

SEQ ID NO: 358685 - DNA, 20 bp, human
ggggcttacccgttacccac

SEQ ID NO: 358686 - DNA, 20 bp, human
ggatgggtctggttcaagaa

SEQ ID NO: 358687 - DNA, 20 bp, human
gaggctgaggtttttgtggt

SEQ ID NO: 358688 - DNA, 20 bp, human
gaggaaggaggcaacaccca

SEQ ID NO: 358689 - DNA, 20 bp, human
gagtcccttgccttcaactg

SEQ ID NO: 358690 - DNA, 20 bp, human
gtcccagctgagtctccttg

SEQ ID NO: 358691 - DNA, 20 bp, human
ggggaccacagttgaaggca

SEQ ID NO: 358692 - DNA, 20 bp, human
gaggctgcaggttaaatctg

SEQ ID NO: 358693 - DNA, 20 bp, human
ggggagaggaatgatgggtc

SEQ ID NO: 358694 - DNA, 20 bp, human
gcaacacccacggaacttga

SEQ ID NO: 358695 - DNA, 20 bp, human
ggaatggcagggagggcttt

SEQ ID NO: 358696 - DNA, 20 bp, human
gaggaggcgtggaaagtcga

SEQ ID NO: 358697 - DNA, 20 bp, human
gcccggggctgttccgggtt

SEQ ID NO: 358698 - DNA, 20 bp, human
ggggctgttccgggttagga

SEQ ID NO: 358699 - DNA, 20 bp, human
gttccgggttaggacgggat

SEQ ID NO: 358700 - DNA, 20 bp, human
gactgagctgcgcagatgag

SEQ ID NO: 358701 - DNA, 20 bp, human
gcccccatcccgtcctaacc

SEQ ID NO: 358702 - DNA, 20 bp, human
gtgaggggagactcgtcacc

SEQ ID NO: 358703 - DNA, 20 bp, human
ggtgacacgtgactcggcaa

SEQ ID NO: 358704 - DNA, 20 bp, human
gtgaccctgagtatcctctg

SEQ ID NO: 358705 - DNA, 20 bp, human
gcggtctggcagaggaagca

SEQ ID NO: 358706 - DNA, 20 bp, human
gtagtagcaggtcagaaaat

SEQ ID NO: 358707 - DNA, 20 bp, human
gcaaatgtgtggaaggataa

SEQ ID NO: 358708 - DNA, 20 bp, human
gcctcacctggagtcttctc

SEQ ID NO: 358709 - DNA, 20 bp, human
gaggcttgccccacatcagg

SEQ ID NO: 358710 - DNA, 20 bp, human
gctgccttaccctcaaatca

SEQ ID NO: 358711 - DNA, 20 bp, human
gtgccccacatcaggtgggt

SEQ ID NO: 358712 - DNA, 20 bp, human
ggtcccacccacctgatgtg

SEQ ID NO: 358713 - DNA, 20 bp, human
ggtcataacaaatgtgtgga

SEQ ID NO: 358714 - DNA, 20 bp, human
ggcacctcttaggactatga

SEQ ID NO: 358715 - DNA, 20 bp, human
gtggaggcttgccccacatc

SEQ ID NO: 358716 - DNA, 20 bp, human
gcccaggcctcccaacccgt

SEQ ID NO: 358717 - DNA, 20 bp, human
gctggctcttcccacgggtt

SEQ ID NO: 358718 - DNA, 20 bp, human
gcctcacctggggccttctc

SEQ ID NO: 358719 - DNA, 20 bp, human
gtgtcccatatcaggtgtgt

SEQ ID NO: 358720 - DNA, 20 bp, human
gtgtcccacacacctgatat

SEQ ID NO: 358721 - DNA, 20 bp, human
gtggaggcttgtcccatatc

SEQ ID NO: 358722 - DNA, 20 bp, human
ggctcttcccacgggttggg

SEQ ID NO: 358723 - DNA, 20 bp, human
gtcttaagactatgagggga

SEQ ID NO: 358724 - DNA, 20 bp, human
ggtgtggaagtactggggga

SEQ ID NO: 358725 - DNA, 20 bp, human
gaaaacgctcagtaagcggt

SEQ ID NO: 358726 - DNA, 20 bp, human
ggctccaggtgagatctctg

SEQ ID NO: 358727 - DNA, 20 bp, human
gaccaggtgacctgggattc

SEQ ID NO: 358728 - DNA, 20 bp, human
gggtgtaggaccaggtgacc

SEQ ID NO: 358729 - DNA, 20 bp, human
gcacccccagagatctcacc

SEQ ID NO: 358730 - DNA, 20 bp, human
gtgtcccacatcagatgggt

SEQ ID NO: 358731 - DNA, 20 bp, human
gctgggggtggtgtaggacc

SEQ ID NO: 358732 - DNA, 20 bp, human
gccaacctaatccaggtctg

SEQ ID NO: 358733 - DNA, 20 bp, human
ggatttctggccagaatccc

SEQ ID NO: 358734 - DNA, 20 bp, human
gccagtggatgtgtcagatt

SEQ ID NO: 358735 - DNA, 20 bp, human
gccaggccgagccttataaa

SEQ ID NO: 358736 - DNA, 20 bp, human
gtggccagggcagtacgcag

SEQ ID NO: 358737 - DNA, 20 bp, human
gaggtaggagaagcggaaag

SEQ ID NO: 358738 - DNA, 20 bp, human
ggtaggggggctctttttct

SEQ ID NO: 358739 - DNA, 20 bp, human
gaggcagctcctttttatag

SEQ ID NO: 358740 - DNA, 20 bp, human
gcagaatgaaaattttgggt

SEQ ID NO: 358741 - DNA, 20 bp, human
gctggtaagtgggactgtct

SEQ ID NO: 358742 - DNA, 20 bp, human
ggactgtagcaactctggca

SEQ ID NO: 358743 - DNA, 20 bp, human
gttcagaagacctggtaagt

SEQ ID NO: 358744 - DNA, 20 bp, human
ggggttgagaacacgtgtcc

SEQ ID NO: 358745 - DNA, 20 bp, human
gtcaggtggggcaagtccgt

SEQ ID NO: 358746 - DNA, 20 bp, human
gaggagcagcaggctcgctc

SEQ ID NO: 358747 - DNA, 20 bp, human
gaggcagggccaaccaagga

SEQ ID NO: 358748 - DNA, 20 bp, human
gggctcgctcggggagagta

SEQ ID NO: 358749 - DNA, 20 bp, human
gggtaatgctgccaggaagg

SEQ ID NO: 358750 - DNA, 20 bp, human
gctctggcaaacactctgtg

SEQ ID NO: 358751 - DNA, 20 bp, human
gggccctttggccctgtctc

SEQ ID NO: 358752 - DNA, 20 bp, human
gccctggcctgaaactggtt

SEQ ID NO: 358753 - DNA, 20 bp, human
gttcctcccaaaccagtttc

SEQ ID NO: 358754 - DNA, 20 bp, human
gggcaggcaggcttctgcct

SEQ ID NO: 358755 - DNA, 20 bp, human
gggcctgaaactggtttggg

SEQ ID NO: 358756 - DNA, 20 bp, human
ggggagccaggattgcacat

SEQ ID NO: 358757 - DNA, 20 bp, human
gcaggattgcacatgggctg

SEQ ID NO: 358758 - DNA, 20 bp, human
gtgggctgaggaagaaaaaa

SEQ ID NO: 358759 - DNA, 20 bp, human
gtggctcccagcaagtcccc

SEQ ID NO: 358760 - DNA, 20 bp, human
gaaaaaagggcctgtagggc

SEQ ID NO: 358761 - DNA, 20 bp, human
gaccctaaaggcaaggttgg

SEQ ID NO: 358762 - DNA, 20 bp, human
gccagtggggccagacttgg

SEQ ID NO: 358763 - DNA, 20 bp, human
ggaagaaaaaagggcctgta

SEQ ID NO: 358764 - DNA, 20 bp, human
ggccctgccacccccgcctt

SEQ ID NO: 358765 - DNA, 20 bp, human
gtaggggaaaacgtgatgtg

SEQ ID NO: 358766 - DNA, 20 bp, human
gaaataaatgctgccctgtg

SEQ ID NO: 358767 - DNA, 20 bp, human
gcatctcgacagttgcttca

SEQ ID NO: 358768 - DNA, 20 bp, human
gtaagggcaagatccagtaa

SEQ ID NO: 358769 - DNA, 20 bp, human
gtggatcttgcccttaatta

SEQ ID NO: 358770 - DNA, 20 bp, human
ggcatgaaccccataattaa

SEQ ID NO: 358771 - DNA, 20 bp, human
gaatataattctacattgga

SEQ ID NO: 358772 - DNA, 20 bp, human
gagggaaaatataatctcag

SEQ ID NO: 358773 - DNA, 20 bp, human
gtgtcgagatggacctttac

SEQ ID NO: 358774 - DNA, 20 bp, human
gagcaaatataattctacat

SEQ ID NO: 358775 - DNA, 20 bp, human
gtggttcagagtcgtaagct

SEQ ID NO: 358776 - DNA, 20 bp, human
gtggaggcagcccacaccct

SEQ ID NO: 358777 - DNA, 20 bp, human
gacacagagggtgggacagt

SEQ ID NO: 358778 - DNA, 20 bp, human
gcaccctgggccttggctgg

SEQ ID NO: 358779 - DNA, 20 bp, human
gagtgatggcgccgagacac

SEQ ID NO: 358780 - DNA, 20 bp, human
gaggtgaacactgtaaaatg

SEQ ID NO: 358781 - DNA, 20 bp, human
ggtaaaatgtggatgcctgg

SEQ ID NO: 358782 - DNA, 20 bp, human
gcagtggggttgggacattc

SEQ ID NO: 358783 - DNA, 20 bp, human
gactgagcacatgaatgggg

SEQ ID NO: 358784 - DNA, 20 bp, human
gcaccctctgtgtcaatatg

SEQ ID NO: 358785 - DNA, 20 bp, human
gaccccgtgcccacttaccc

SEQ ID NO: 358786 - DNA, 20 bp, human
gaggtcgatgagacgggaaa

SEQ ID NO: 358787 - DNA, 20 bp, human
ggagcagcagagagtcgagc

SEQ ID NO: 358788 - DNA, 20 bp, human
gagccagtgggcacggtggg

SEQ ID NO: 358789 - DNA, 20 bp, human
ggcagcggccggaaaaagtg

SEQ ID NO: 358790 - DNA, 20 bp, human
gaaaccgtcccgcctctagg

SEQ ID NO: 358791 - DNA, 20 bp, human
gtggagccagtgggcacggt

SEQ ID NO: 358792 - DNA, 20 bp, human
gtcgagcaggtcgatgagac

SEQ ID NO: 358793 - DNA, 20 bp, human
ggggaaaaggtggagccagt

SEQ ID NO: 358794 - DNA, 20 bp, human
gtcgatgagacgggaaaagg

SEQ ID NO: 358795 - DNA, 20 bp, human
gggggtccaggccgagtaag

SEQ ID NO: 358796 - DNA, 20 bp, human
gaagaaacgtgcctgcagtg

SEQ ID NO: 358797 - DNA, 20 bp, human
gtctctaacgaaattgcgct

SEQ ID NO: 358798 - DNA, 20 bp, human
gaacagcactactcacagca

SEQ ID NO: 358799 - DNA, 20 bp, human
ggtgctgttctgagtctgcg

SEQ ID NO: 358800 - DNA, 20 bp, human
gcgcaatttcgttagagact

SEQ ID NO: 358801 - DNA, 20 bp, human
gactctggcaccagagtctt

SEQ ID NO: 358802 - DNA, 20 bp, human
gcttcatcaggtgggaaagc

SEQ ID NO: 358803 - DNA, 20 bp, human
gggcacgtttcttcatcagg

SEQ ID NO: 358804 - DNA, 20 bp, human
gggcaccagtgggggagtgt

SEQ ID NO: 358805 - DNA, 20 bp, human
gttaatttaggacctaaagc

SEQ ID NO: 358806 - DNA, 20 bp, human
gggggcccccagctgacaga

SEQ ID NO: 358807 - DNA, 20 bp, human
gcccagctgacagagggcgt

SEQ ID NO: 358808 - DNA, 20 bp, human
gtcagcgtctatctgggcga

SEQ ID NO: 358809 - DNA, 20 bp, human
gcgtctcagcagttcagatc

SEQ ID NO: 358810 - DNA, 20 bp, human
gcgcgtagcaggcagggaac

SEQ ID NO: 358811 - DNA, 20 bp, human
gccgcagcggagcactccaa

SEQ ID NO: 358812 - DNA, 20 bp, human
ggcactgtccaggaaagatc

SEQ ID NO: 358813 - DNA, 20 bp, human
gcccgcagccctaggaggat

SEQ ID NO: 358814 - DNA, 20 bp, human
gccagggatcagcgtctatc

SEQ ID NO: 358815 - DNA, 20 bp, human
gaaggctgggtggtttcttc

SEQ ID NO: 358816 - DNA, 20 bp, human
gccagccggccggtcacatc

SEQ ID NO: 358817 - DNA, 20 bp, human
gttacctctgggcttacccc

SEQ ID NO: 358818 - DNA, 20 bp, human
gaattccagatgtgaccggc

SEQ ID NO: 358819 - DNA, 20 bp, human
gccgacaggagctgcacgga

SEQ ID NO: 358820 - DNA, 20 bp, human
ggcagagtgagagatcgggt

SEQ ID NO: 358821 - DNA, 20 bp, human
ggtcccaggggtaagcccag

SEQ ID NO: 358822 - DNA, 20 bp, human
gggctgggacgagggacaga

SEQ ID NO: 358823 - DNA, 20 bp, human
gcggccggttctcacgggtg

SEQ ID NO: 358824 - DNA, 20 bp, human
gtgcagccgccgccggaaag

SEQ ID NO: 358825 - DNA, 20 bp, human
gcgcgccggccggttctcac

SEQ ID NO: 358826 - DNA, 20 bp, human
ggacccagcgggaacaggct

SEQ ID NO: 358827 - DNA, 20 bp, human
gagctcgcccgatgaggaca

SEQ ID NO: 358828 - DNA, 20 bp, human
ggagccggaccctaggggat

SEQ ID NO: 358829 - DNA, 20 bp, human
gggaggagtgccgggttcgc

SEQ ID NO: 358830 - DNA, 20 bp, human
gagggcgagccggaccctag

SEQ ID NO: 358831 - DNA, 20 bp, human
ggagaccaggcggcttgagc

SEQ ID NO: 358832 - DNA, 20 bp, human
gcggaccctaggggattggt

SEQ ID NO: 358833 - DNA, 20 bp, human
gggaaccaggtccgaggtct

SEQ ID NO: 358834 - DNA, 20 bp, human
gcaagcccagacctcggacc

SEQ ID NO: 358835 - DNA, 20 bp, human
gggagaaggggtccaggcta

SEQ ID NO: 358836 - DNA, 20 bp, human
gacagggaggggcaccccaa

SEQ ID NO: 358837 - DNA, 20 bp, human
gtggaggtaaggccgaggac

SEQ ID NO: 358838 - DNA, 20 bp, human
gctcctggagccaacgcgct

SEQ ID NO: 358839 - DNA, 20 bp, human
gcagggtggaggtaaggccg

SEQ ID NO: 358840 - DNA, 20 bp, human
gccaacggtcggcccccacc

SEQ ID NO: 358841 - DNA, 20 bp, human
gggaggggcaccccaacggt

SEQ ID NO: 358842 - DNA, 20 bp, human
gcgttcatggcctcccccgg

SEQ ID NO: 358843 - DNA, 20 bp, human
gctgactgaggcccgacgca

SEQ ID NO: 358844 - DNA, 20 bp, human
gctggtggggaggagtcgtc

SEQ ID NO: 358845 - DNA, 20 bp, human
gggtgcttcgggggtgatca

SEQ ID NO: 358846 - DNA, 20 bp, human
gctgagtgcccgggacccaa

SEQ ID NO: 358847 - DNA, 20 bp, human
ggggagcgggaaattgggag

SEQ ID NO: 358848 - DNA, 20 bp, human
gggcacaggctggcagccat

SEQ ID NO: 358849 - DNA, 20 bp, human
gccccggcggcgactggcac

SEQ ID NO: 358850 - DNA, 20 bp, human
ggtgccgcggcgagtggcac

SEQ ID NO: 358851 - DNA, 20 bp, human
gcgctggggagaagaggctc

SEQ ID NO: 358852 - DNA, 20 bp, human
gtgcccgggacccaagggga

SEQ ID NO: 358853 - DNA, 20 bp, human
ggcccggagggggcagctga

SEQ ID NO: 358854 - DNA, 20 bp, human
ggtcccgggcactcagccca

SEQ ID NO: 358855 - DNA, 20 bp, human
gggggcgcgctccggtgccg

SEQ ID NO: 358856 - DNA, 20 bp, human
gaggctgcggagttgagagt

SEQ ID NO: 358857 - DNA, 20 bp, human
gctgctcctcagcattgagg

SEQ ID NO: 358858 - DNA, 20 bp, human
gtccctcaggttgcacaact

SEQ ID NO: 358859 - DNA, 20 bp, human
gtgagggaacaagatgtgcc

SEQ ID NO: 358860 - DNA, 20 bp, human
gtcccagttgtgcaacctga

SEQ ID NO: 358861 - DNA, 20 bp, human
ggtcttagaccgttttgtag

SEQ ID NO: 358862 - DNA, 20 bp, human
ggcctggcagctgtcagggc

SEQ ID NO: 358863 - DNA, 20 bp, human
gcagagggacttcatttcag

SEQ ID NO: 358864 - DNA, 20 bp, human
gtcgctcccaagaaaccagc

SEQ ID NO: 358865 - DNA, 20 bp, human
gggaaatgactggtagagtc

SEQ ID NO: 358866 - DNA, 20 bp, human
ggggtggaaggaggcttcca

SEQ ID NO: 358867 - DNA, 20 bp, human
gtcccagttgtgtaacctat

SEQ ID NO: 358868 - DNA, 20 bp, human
gcacacatgagatgtggcag

SEQ ID NO: 358869 - DNA, 20 bp, human
gagcaccctgtccattgcca

SEQ ID NO: 358870 - DNA, 20 bp, human
gccagggcacacatgagatg

SEQ ID NO: 358871 - DNA, 20 bp, human
ggtcttagaccagtttgtag

SEQ ID NO: 358872 - DNA, 20 bp, human
gggaaatgaccggtatagtc

SEQ ID NO: 358873 - DNA, 20 bp, human
gactcacagggatttcagtc

SEQ ID NO: 358874 - DNA, 20 bp, human
ggccatcacggggctcccac

SEQ ID NO: 358875 - DNA, 20 bp, human
gaatatcaggacatccagag

SEQ ID NO: 358876 - DNA, 20 bp, human
ggggtggaaggaggcttcca

SEQ ID NO: 358877 - DNA, 20 bp, human
gcacacatgagatgtggcag

SEQ ID NO: 358878 - DNA, 20 bp, human
gtcccagttgtgtaacctat

SEQ ID NO: 358879 - DNA, 20 bp, human
ggggctccaggactaggctg

SEQ ID NO: 358880 - DNA, 20 bp, human
gccagggcacacatgagatg

SEQ ID NO: 358881 - DNA, 20 bp, human
gagcaccctgtccattgcca

SEQ ID NO: 358882 - DNA, 20 bp, human
gaaggtggggctccaggact

SEQ ID NO: 358883 - DNA, 20 bp, human
gcccctctctacattgtcct

SEQ ID NO: 358884 - DNA, 20 bp, human
gggaaatgaccggtatagtc

SEQ ID NO: 358885 - DNA, 20 bp, human
gagccaaggacaatgtagag

SEQ ID NO: 358886 - DNA, 20 bp, human
ggggatgaggtaatgattct

SEQ ID NO: 358887 - DNA, 20 bp, human
ggacctctgtcttcccacac

SEQ ID NO: 358888 - DNA, 20 bp, human
gacttgactgtaccattcat

SEQ ID NO: 358889 - DNA, 20 bp, human
gtagaagtagttttccaaat

SEQ ID NO: 358890 - DNA, 20 bp, human
gataccttgatgacccaatt

SEQ ID NO: 358891 - DNA, 20 bp, human
gatccagtgtgggaagacag

SEQ ID NO: 358892 - DNA, 20 bp, human
gtttccaaattgggtcatca

SEQ ID NO: 358893 - DNA, 20 bp, human
gaccagaagatcaagggtga

SEQ ID NO: 358894 - DNA, 20 bp, human
gggaaaactacttctagata

SEQ ID NO: 358895 - DNA, 20 bp, human
gcacatagatattatgctgt

SEQ ID NO: 358896 - DNA, 20 bp, human
gagcgcccggcgtacccggt

SEQ ID NO: 358897 - DNA, 20 bp, human
gccagggtcctcgataggat

SEQ ID NO: 358898 - DNA, 20 bp, human
gaagctgcggaggagacgac

SEQ ID NO: 358899 - DNA, 20 bp, human
gggtcctcgataggatgggg

SEQ ID NO: 358900 - DNA, 20 bp, human
gggaacacctgattcagtga

SEQ ID NO: 358901 - DNA, 20 bp, human
gacagcagatggcgctgtag

SEQ ID NO: 358902 - DNA, 20 bp, human
gccagagcgcccggcgtacc

SEQ ID NO: 358903 - DNA, 20 bp, human
gtcgtgccagggtcctcgat

SEQ ID NO: 358904 - DNA, 20 bp, human
gcccccaccccatcctatcg

SEQ ID NO: 358905 - DNA, 20 bp, human
ggccgccttggcagctggcc

SEQ ID NO: 358906 - DNA, 20 bp, human
gtcagacccacctactctgc

SEQ ID NO: 358907 - DNA, 20 bp, human
gtactctgctggaaacaagc

SEQ ID NO: 358908 - DNA, 20 bp, human
gtgtttccagcagagtaggt

SEQ ID NO: 358909 - DNA, 20 bp, human
gtgcgagaagtgaggcatat

SEQ ID NO: 358910 - DNA, 20 bp, human
gattttaaatgcgagaagtg

SEQ ID NO: 358911 - DNA, 20 bp, human
gaaaactatagtgcaaagta

SEQ ID NO: 358912 - DNA, 20 bp, human
gcttctttgtttttgtaggc

SEQ ID NO: 358913 - DNA, 20 bp, human
gcagaatggtcatcatttct

SEQ ID NO: 358914 - DNA, 20 bp, human
gtgcaggtaaaaggattaag

SEQ ID NO: 358915 - DNA, 20 bp, human
ggctttatactgcaggtaaa

SEQ ID NO: 358916 - DNA, 20 bp, human
gaggacagaggtggctcgat

SEQ ID NO: 358917 - DNA, 20 bp, human
gctacaacgcagtgcatctc

SEQ ID NO: 358918 - DNA, 20 bp, human
ggaggccaactcgactggac

SEQ ID NO: 358919 - DNA, 20 bp, human
gtgaacttggcgctcgatgg

SEQ ID NO: 358920 - DNA, 20 bp, human
gggagccgcagaggcgtagc

SEQ ID NO: 358921 - DNA, 20 bp, human
gtagtccagctacgcctctg

SEQ ID NO: 358922 - DNA, 20 bp, human
ggccccgcctcaccacaaag

SEQ ID NO: 358923 - DNA, 20 bp, human
gctcgggaggccaactcgac

SEQ ID NO: 358924 - DNA, 20 bp, human
gtcacccagtccagtcgagt

SEQ ID NO: 358925 - DNA, 20 bp, human
gcaacgcagtgcatctcggg

SEQ ID NO: 358926 - DNA, 20 bp, human
gagagatgccgccgacgcgg

SEQ ID NO: 358927 - DNA, 20 bp, human
ggcgccccaccaatccgcag

SEQ ID NO: 358928 - DNA, 20 bp, human
gaagccgctgcggattggtg

SEQ ID NO: 358929 - DNA, 20 bp, human
gcgccgtgacgaagccgctg

SEQ ID NO: 358930 - DNA, 20 bp, human
gcaagggcaaaatggatcgt

SEQ ID NO: 358931 - DNA, 20 bp, human
gtgacgaagccgctgcggat

SEQ ID NO: 358932 - DNA, 20 bp, human
gctccaacccgccgcgtcgg

SEQ ID NO: 358933 - DNA, 20 bp, human
ggattggtggggcgcgtttt

SEQ ID NO: 358934 - DNA, 20 bp, human
ggcgagagatgccgccgacg

SEQ ID NO: 358935 - DNA, 20 bp, human
gacctcggctacaactctac

SEQ ID NO: 358936 - DNA, 20 bp, human
gtcactggagctgagtacca

SEQ ID NO: 358937 - DNA, 20 bp, human
gaaacgaatgccatgctctt

SEQ ID NO: 358938 - DNA, 20 bp, human
gggcctcacttctgtgatcc

SEQ ID NO: 358939 - DNA, 20 bp, human
gaagggtaaagaaagggtta

SEQ ID NO: 358940 - DNA, 20 bp, human
ggtttctggcctcacaagac

SEQ ID NO: 358941 - DNA, 20 bp, human
gtgcaattcctcattgaaga

SEQ ID NO: 358942 - DNA, 20 bp, human
gtcctcattgaagagggcca

SEQ ID NO: 358943 - DNA, 20 bp, human
gatcaaggaagggtaaagaa

SEQ ID NO: 358944 - DNA, 20 bp, human
gacagaaattaaaagtacat

SEQ ID NO: 358945 - DNA, 20 bp, human
gtctaattatactctgctag

SEQ ID NO: 358946 - DNA, 20 bp, human
gtgggtctcgagtacctcat

SEQ ID NO: 358947 - DNA, 20 bp, human
gtgaagagaacaaaaacgtg

SEQ ID NO: 358948 - DNA, 20 bp, human
gaaaaaaggctgctgggtag

SEQ ID NO: 358949 - DNA, 20 bp, human
gggtatggctaacagaagac

SEQ ID NO: 358950 - DNA, 20 bp, human
gtagggggagcgactgactg

SEQ ID NO: 358951 - DNA, 20 bp, human
ggagaacaaaaacgtgtggt

SEQ ID NO: 358952 - DNA, 20 bp, human
ggggagcgactgactgcggc

SEQ ID NO: 358953 - DNA, 20 bp, human
ggcagcattgtcgttcattg

SEQ ID NO: 358954 - DNA, 20 bp, human
gttgttctcttcacttgcaa

SEQ ID NO: 358955 - DNA, 20 bp, human
ggcagcattattgacaccta

SEQ ID NO: 358956 - DNA, 20 bp, human
gttaagccgcgccatttttg

SEQ ID NO: 358957 - DNA, 20 bp, human
ggtactgcgcaggcgtggga

SEQ ID NO: 358958 - DNA, 20 bp, human
gactgcatgtcacgtgacgg

SEQ ID NO: 358959 - DNA, 20 bp, human
ggcgcggcttaaggccccga

SEQ ID NO: 358960 - DNA, 20 bp, human
gtcacgtgacatgcagtcgc

SEQ ID NO: 358961 - DNA, 20 bp, human
gagtacctcacgagactcaa

SEQ ID NO: 358962 - DNA, 20 bp, human
gctgcgcagtacctcgtccg

SEQ ID NO: 358963 - DNA, 20 bp, human
gaccacgtgggcaacgccct

SEQ ID NO: 358964 - DNA, 20 bp, human
gcctagccccaaaaatggcg

SEQ ID NO: 358965 - DNA, 20 bp, human
gcgcatgcgcagaagcactc

SEQ ID NO: 358966 - DNA, 20 bp, human
gcgtcccggcagttcccggc

SEQ ID NO: 358967 - DNA, 20 bp, human
gcgcgctggggcgactggag

SEQ ID NO: 358968 - DNA, 20 bp, human
ggcgcagtgagaacaacgcg

SEQ ID NO: 358969 - DNA, 20 bp, human
ggtgccggggaacccgcggt

SEQ ID NO: 358970 - DNA, 20 bp, human
gctgctaagtacgctagtgg

SEQ ID NO: 358971 - DNA, 20 bp, human
gctcgcgcgtccaccaaccg

SEQ ID NO: 358972 - DNA, 20 bp, human
gcgcatgtgcagttgcaacc

SEQ ID NO: 358973 - DNA, 20 bp, human
gctgcagctcgcatgcgtcc

SEQ ID NO: 358974 - DNA, 20 bp, human
ggtctcgtcagcctcccgcc

SEQ ID NO: 358975 - DNA, 20 bp, human
gcgcgtgcgcggccgcaaag

SEQ ID NO: 358976 - DNA, 20 bp, human
gcgtcccggcagttcccggc

SEQ ID NO: 358977 - DNA, 20 bp, human
gcgcgctggggcgactggag

SEQ ID NO: 358978 - DNA, 20 bp, human
ggtgccggggaacccgcggt

SEQ ID NO: 358979 - DNA, 20 bp, human
gctcgcgcgtccaccaaccg

SEQ ID NO: 358980 - DNA, 20 bp, human
gcgcatgtgcagttgcaacc

SEQ ID NO: 358981 - DNA, 20 bp, human
ggcgcagtgagaacaacgcg

SEQ ID NO: 358982 - DNA, 20 bp, human
gctgctaagtacgctagtgg

SEQ ID NO: 358983 - DNA, 20 bp, human
gccaccaaccgcgggttccc

SEQ ID NO: 358984 - DNA, 20 bp, human
gctgcagctcgcatgcgtcc

SEQ ID NO: 358985 - DNA, 20 bp, human
ggaatggcggagactctgtc

SEQ ID NO: 358986 - DNA, 20 bp, human
gaccctccgtatggagaccg

SEQ ID NO: 358987 - DNA, 20 bp, human
gcgccccggtctccatacgg

SEQ ID NO: 358988 - DNA, 20 bp, human
gccccgccccggtctccata

SEQ ID NO: 358989 - DNA, 20 bp, human
gcaaccttccccaagtcagc

SEQ ID NO: 358990 - DNA, 20 bp, human
gagacagtggggaatcactc

SEQ ID NO: 358991 - DNA, 20 bp, human
gagaagcaaaggcggtgctg

SEQ ID NO: 358992 - DNA, 20 bp, human
ggagtcacccagctgacttg

SEQ ID NO: 358993 - DNA, 20 bp, human
gtgacttggggaaggttggt

SEQ ID NO: 358994 - DNA, 20 bp, human
gcccacttaaggagcagagt

SEQ ID NO: 358995 - DNA, 20 bp, human
gaatcagtaggaccgggtgg

SEQ ID NO: 358996 - DNA, 20 bp, human
ggtcctgaccttgccggagg

SEQ ID NO: 358997 - DNA, 20 bp, human
gaccaatccggaaaggctca

SEQ ID NO: 358998 - DNA, 20 bp, human
gcagaagcaccaatccggaa

SEQ ID NO: 358999 - DNA, 20 bp, human
gaaggctcaaggcggatgga

SEQ ID NO: 359000 - DNA, 20 bp, human
gtgtgtggggcgccagagtc

SEQ ID NO: 359001 - DNA, 20 bp, human
gtaacactgggaacctgtgt

SEQ ID NO: 359002 - DNA, 20 bp, human
gcggaaaggctcaaggcgga

SEQ ID NO: 359003 - DNA, 20 bp, human
gccctcccccagcctaacac

SEQ ID NO: 359004 - DNA, 20 bp, human
ggttcccagtgttaggctgg

SEQ ID NO: 359005 - DNA, 20 bp, human
ggggggagggcacgcgaaag

SEQ ID NO: 359006 - DNA, 20 bp, human
gccggggcggctcaattccg

SEQ ID NO: 359007 - DNA, 20 bp, human
ggggctctttgaaaggcgat

SEQ ID NO: 359008 - DNA, 20 bp, human
gtcccgggcggtcgcaaaga

SEQ ID NO: 359009 - DNA, 20 bp, human
gccagcccgggattgtgggg

SEQ ID NO: 359010 - DNA, 20 bp, human
gggcggctcaattccgggga

SEQ ID NO: 359011 - DNA, 20 bp, human
ggcgaccgcccgggactccg

SEQ ID NO: 359012 - DNA, 20 bp, human
ggggttaacccagtgtcggg

SEQ ID NO: 359013 - DNA, 20 bp, human
gcggccgggccgcggagtcc

SEQ ID NO: 359014 - DNA, 20 bp, human
gcgccgcgccgcccgacact

SEQ ID NO: 359015 - DNA, 20 bp, human
ggccccgcggccggcttatt

SEQ ID NO: 359016 - DNA, 20 bp, human
gatgaggaggggagtttatg

SEQ ID NO: 359017 - DNA, 20 bp, human
gcgggagaagggagcgctag

SEQ ID NO: 359018 - DNA, 20 bp, human
gagctcgggagagtttccgg

SEQ ID NO: 359019 - DNA, 20 bp, human
ggtgctgtgaagcactgcgg

SEQ ID NO: 359020 - DNA, 20 bp, human
gggagcgctagcgggggcgt

SEQ ID NO: 359021 - DNA, 20 bp, human
gtgcccctagagcttaggag

SEQ ID NO: 359022 - DNA, 20 bp, human
ggtctgagggccagaagaag

SEQ ID NO: 359023 - DNA, 20 bp, human
gcggagatggagatcggcag

SEQ ID NO: 359024 - DNA, 20 bp, human
gcagagctcgggagagtttc

SEQ ID NO: 359025 - DNA, 20 bp, human
gctcccctcctaagctctag

SEQ ID NO: 359026 - DNA, 20 bp, human
gcgagacaaaggcgccgggt

SEQ ID NO: 359027 - DNA, 20 bp, human
gagccgcggcggagcagcga

SEQ ID NO: 359028 - DNA, 20 bp, human
ggaccccgcgcgcccggaac

SEQ ID NO: 359029 - DNA, 20 bp, human
gcgcgggcagggctccgacc

SEQ ID NO: 359030 - DNA, 20 bp, human
ggggcgcaggcagcaaactt

SEQ ID NO: 359031 - DNA, 20 bp, human
gtcctcggccgccccgggtg

SEQ ID NO: 359032 - DNA, 20 bp, human
gcgcggcggagcagcgaagg

SEQ ID NO: 359033 - DNA, 20 bp, human
gcggcccctcccggagcgag

SEQ ID NO: 359034 - DNA, 20 bp, human
gagcggcccgggcgagacaa

SEQ ID NO: 359035 - DNA, 20 bp, human
gggcgccgcgcctcctgttc

SEQ ID NO: 359036 - DNA, 20 bp, human
gacccctccctgatcaatga

SEQ ID NO: 359037 - DNA, 20 bp, human
ggggacacgggtcacatctc

SEQ ID NO: 359038 - DNA, 20 bp, human
gggcggggacgaaatcagag

SEQ ID NO: 359039 - DNA, 20 bp, human
gacaaaggcgtgttcatcag

SEQ ID NO: 359040 - DNA, 20 bp, human
gcccctggaagaccccccgg

SEQ ID NO: 359041 - DNA, 20 bp, human
ggggaggggtgaggcattct

SEQ ID NO: 359042 - DNA, 20 bp, human
ggggacctaagttacaaggg

SEQ ID NO: 359043 - DNA, 20 bp, human
gggggggtaacaccagtgag

SEQ ID NO: 359044 - DNA, 20 bp, human
gctggaagaccccccggagg

SEQ ID NO: 359045 - DNA, 20 bp, human
ggcaacagatcgtcctcctc

SEQ ID NO: 359046 - DNA, 20 bp, human
ggagcgagagcgcagggtaa

SEQ ID NO: 359047 - DNA, 20 bp, human
ggggagttgtaagggggggc

SEQ ID NO: 359048 - DNA, 20 bp, human
gcgcggggccggggatgcga

SEQ ID NO: 359049 - DNA, 20 bp, human
ggagcgcagggtaaaggggg

SEQ ID NO: 359050 - DNA, 20 bp, human
gcgagagcgcagggtaaagg

SEQ ID NO: 359051 - DNA, 20 bp, human
gaaagcgggcgcgtgggggt

SEQ ID NO: 359052 - DNA, 20 bp, human
gccctgcgcccgggacactc

SEQ ID NO: 359053 - DNA, 20 bp, human
gccgccccgggccaactccg

SEQ ID NO: 359054 - DNA, 20 bp, human
gcgcgcgggagttgtaaggg

SEQ ID NO: 359055 - DNA, 20 bp, human
gccccacgcgcccgctttta

SEQ ID NO: 359056 - DNA, 20 bp, human
gggagcgcgcccggcacaca

SEQ ID NO: 359057 - DNA, 20 bp, human
ggagctccgaggtgtgtcgg

SEQ ID NO: 359058 - DNA, 20 bp, human
gcctgggcacggctccgcgg

SEQ ID NO: 359059 - DNA, 20 bp, human
ggaagcgggtgcctatttga

SEQ ID NO: 359060 - DNA, 20 bp, human
gtgaaggcgagtaaagacgt

SEQ ID NO: 359061 - DNA, 20 bp, human
gcgggagctccgaggtgtgt

SEQ ID NO: 359062 - DNA, 20 bp, human
gtgcaccaaggctgtccgcc

SEQ ID NO: 359063 - DNA, 20 bp, human
gcggacgcccctcgccctgg

SEQ ID NO: 359064 - DNA, 20 bp, human
ggggctgaggggcatctcac

SEQ ID NO: 359065 - DNA, 20 bp, human
gcagaggggcccgacctcag

SEQ ID NO: 359066 - DNA, 20 bp, human
gctgacccggcgggcggcga

SEQ ID NO: 359067 - DNA, 20 bp, human
gcggcggcgccaattaatct

SEQ ID NO: 359068 - DNA, 20 bp, human
gccgccgctcgggtccgcag

SEQ ID NO: 359069 - DNA, 20 bp, human
ggaggcgctgacccggcggg

SEQ ID NO: 359070 - DNA, 20 bp, human
ggctcgggtccgcaggggag

SEQ ID NO: 359071 - DNA, 20 bp, human
gcgccgccgccgagattaat

SEQ ID NO: 359072 - DNA, 20 bp, human
gtccaccgccgcccggattg

SEQ ID NO: 359073 - DNA, 20 bp, human
gcgccaattaatctcggcgg

SEQ ID NO: 359074 - DNA, 20 bp, human
gcggcgccaattaatctcgg

SEQ ID NO: 359075 - DNA, 20 bp, human
gcggggatggcgcgcgacct

SEQ ID NO: 359076 - DNA, 20 bp, human
ggcccagaaaggctgagtcc

SEQ ID NO: 359077 - DNA, 20 bp, human
gccgcaggccgggcccagaa

SEQ ID NO: 359078 - DNA, 20 bp, human
ggaaaggctgagtcccggag

SEQ ID NO: 359079 - DNA, 20 bp, human
gcgcaggccgagggtcccga

SEQ ID NO: 359080 - DNA, 20 bp, human
gcgcccaggcccttcgtcgg

SEQ ID NO: 359081 - DNA, 20 bp, human
gacggcgccgctcaccgctc

SEQ ID NO: 359082 - DNA, 20 bp, human
gtgagtcccggagcggtgag

SEQ ID NO: 359083 - DNA, 20 bp, human
ggcggaaccacgcaccgctc

SEQ ID NO: 359084 - DNA, 20 bp, human
gttcctgccgcgcaggccga

SEQ ID NO: 359085 - DNA, 20 bp, human
ggggcccaagggtgcgacgc

SEQ ID NO: 359086 - DNA, 20 bp, human
ggagcaccccgactcctccg

SEQ ID NO: 359087 - DNA, 20 bp, human
gcggcactccgcggaggagt

SEQ ID NO: 359088 - DNA, 20 bp, human
gaggccgagcaatctctcct

SEQ ID NO: 359089 - DNA, 20 bp, human
ggccaggcggcactccgcgg

SEQ ID NO: 359090 - DNA, 20 bp, human
gcctcccttcgctcggactg

SEQ ID NO: 359091 - DNA, 20 bp, human
gctctcctggggaagttgtg

SEQ ID NO: 359092 - DNA, 20 bp, human
gctctccccagtccgagcga

SEQ ID NO: 359093 - DNA, 20 bp, human
gaggttcgctgctaagagta

SEQ ID NO: 359094 - DNA, 20 bp, human
ggccgcctggccccgacact

SEQ ID NO: 359095 - DNA, 20 bp, human
ggtagtccagaccgcttccc

SEQ ID NO: 359096 - DNA, 20 bp, human
gtactagaagggacaagatc

SEQ ID NO: 359097 - DNA, 20 bp, human
ggggagttgtagtccagcgc

SEQ ID NO: 359098 - DNA, 20 bp, human
gtggccttccccattcctgg

SEQ ID NO: 359099 - DNA, 20 bp, human
ggaagggacaagatctgggc

SEQ ID NO: 359100 - DNA, 20 bp, human
ggtagtccagcgccggtcgg

SEQ ID NO: 359101 - DNA, 20 bp, human
ggtccagcttaaaacttcat

SEQ ID NO: 359102 - DNA, 20 bp, human
gccctccgacccccgccgac

SEQ ID NO: 359103 - DNA, 20 bp, human
ggaagccctgagcatgtaaa

SEQ ID NO: 359104 - DNA, 20 bp, human
gaccctaaataatatgaagt

SEQ ID NO: 359105 - DNA, 20 bp, human
ggtccagcgccggtcggcgg

SEQ ID NO: 359106 - DNA, 20 bp, human
ggtagttagcaaaagtgaac

SEQ ID NO: 359107 - DNA, 20 bp, human
gtctcagccaacatgacgtt

SEQ ID NO: 359108 - DNA, 20 bp, human
gtatcatgcagcaacaatga

SEQ ID NO: 359109 - DNA, 20 bp, human
ggggagaattctgcaggttt

SEQ ID NO: 359110 - DNA, 20 bp, human
gagctgcaccaactgccttc

SEQ ID NO: 359111 - DNA, 20 bp, human
ggtgattcctaacgtcatgt

SEQ ID NO: 359112 - DNA, 20 bp, human
gaagtcagccatgaaccaga

SEQ ID NO: 359113 - DNA, 20 bp, human
gagtgagaagccagtgctta

SEQ ID NO: 359114 - DNA, 20 bp, human
gttcatggacaaagttccca

SEQ ID NO: 359115 - DNA, 20 bp, human
gggttatagcccataagcac

SEQ ID NO: 359116 - DNA, 20 bp, human
gtcctctgccgggtccatca

SEQ ID NO: 359117 - DNA, 20 bp, human
gaacgtccgccgagcagccg

SEQ ID NO: 359118 - DNA, 20 bp, human
ggggaggccctcacgagcct

SEQ ID NO: 359119 - DNA, 20 bp, human
gaacagagggcacttcttgc

SEQ ID NO: 359120 - DNA, 20 bp, human
ggccccgtgggtcccgtggc

SEQ ID NO: 359121 - DNA, 20 bp, human
gtcgggggctcagacgagtg

SEQ ID NO: 359122 - DNA, 20 bp, human
gtggccttgagcgcagttag

SEQ ID NO: 359123 - DNA, 20 bp, human
ggggaaggggcgtcggggtg

SEQ ID NO: 359124 - DNA, 20 bp, human
gaatcggccctgccaggcgg

SEQ ID NO: 359125 - DNA, 20 bp, human
ggagcgcagttagggggcgg

SEQ ID NO: 359126 - DNA, 20 bp, human
gtgaaaagctagctgaccca

SEQ ID NO: 359127 - DNA, 20 bp, human
gagctcctgtggccgcccct

SEQ ID NO: 359128 - DNA, 20 bp, human
ggcctcatcgccagcctcag

SEQ ID NO: 359129 - DNA, 20 bp, human
gtggctccggaaacagccga

SEQ ID NO: 359130 - DNA, 20 bp, human
gctgacccaggggcggccac

SEQ ID NO: 359131 - DNA, 20 bp, human
ggccgccgcgccgcttcttc

SEQ ID NO: 359132 - DNA, 20 bp, human
ggagacgctatcggaagttg

SEQ ID NO: 359133 - DNA, 20 bp, human
ggccgccagccgaccctggg

SEQ ID NO: 359134 - DNA, 20 bp, human
ggcggcgtcggggactgcca

SEQ ID NO: 359135 - DNA, 20 bp, human
gggtcagctagcttttcaag

SEQ ID NO: 359136 - DNA, 20 bp, human
gataaggtaagtttgaaaca

SEQ ID NO: 359137 - DNA, 20 bp, human
gtctgccttaagattgatat

SEQ ID NO: 359138 - DNA, 20 bp, human
gtaacgtttgcacctctcaa

SEQ ID NO: 359139 - DNA, 20 bp, human
gcaaagctttgcatctcaga

SEQ ID NO: 359140 - DNA, 20 bp, human
gaggtaagtttgaaacaggg

SEQ ID NO: 359141 - DNA, 20 bp, human
gagaaggttctagtgtcttg

SEQ ID NO: 359142 - DNA, 20 bp, human
gagtgtgtacgtgatagtgc

SEQ ID NO: 359143 - DNA, 20 bp, human
gatttcctatatcaatctta

SEQ ID NO: 359144 - DNA, 20 bp, human
gatttgttagaacacatgaa

SEQ ID NO: 359145 - DNA, 20 bp, human
gacctttatttagcagacat

SEQ ID NO: 359146 - DNA, 20 bp, human
gttcctgaggagcctggtag

SEQ ID NO: 359147 - DNA, 20 bp, human
gtgacatttacagaaggggt

SEQ ID NO: 359148 - DNA, 20 bp, human
ggggttaaccagtctactaa

SEQ ID NO: 359149 - DNA, 20 bp, human
ggggtatgtaagaatagtat

SEQ ID NO: 359150 - DNA, 20 bp, human
gatttacagaaggggtgggc

SEQ ID NO: 359151 - DNA, 20 bp, human
gggttaaccccttagtagac

SEQ ID NO: 359152 - DNA, 20 bp, human
gtgtgaaattcaccactacc

SEQ ID NO: 359153 - DNA, 20 bp, human
ggtgttaatggtacaggatt

SEQ ID NO: 359154 - DNA, 20 bp, human
gctcctagccaggagaagca

SEQ ID NO: 359155 - DNA, 20 bp, human
gaaagttctagaactcagag

SEQ ID NO: 359156 - DNA, 20 bp, human
gcgcctggcggtggagatgc

SEQ ID NO: 359157 - DNA, 20 bp, human
ggctcacggcctaaatccag

SEQ ID NO: 359158 - DNA, 20 bp, human
gccgcaccagcccacccggg

SEQ ID NO: 359159 - DNA, 20 bp, human
ggggagctaatgcaaagcag

SEQ ID NO: 359160 - DNA, 20 bp, human
ggcgccgcaccagcccaccc

SEQ ID NO: 359161 - DNA, 20 bp, human
gccagggagacctcccgggt

SEQ ID NO: 359162 - DNA, 20 bp, human
gccgctgggcgcggagcttt

SEQ ID NO: 359163 - DNA, 20 bp, human
gagccagcatctccaccgcc

SEQ ID NO: 359164 - DNA, 20 bp, human
gcagaccagcccgtaggcgg

SEQ ID NO: 359165 - DNA, 20 bp, human
gtccctgggcctgctccggc

SEQ ID NO: 359166 - DNA, 20 bp, human
gggagcgacggtggtggaac

SEQ ID NO: 359167 - DNA, 20 bp, human
ggcgggattggtcggacgtg

SEQ ID NO: 359168 - DNA, 20 bp, human
gtaaggcggggtcgcggcga

SEQ ID NO: 359169 - DNA, 20 bp, human
ggggaggtgtgagccgagta

SEQ ID NO: 359170 - DNA, 20 bp, human
ggcggcgagggcagcccgaa

SEQ ID NO: 359171 - DNA, 20 bp, human
ggcgagggcagcccgaaggg

SEQ ID NO: 359172 - DNA, 20 bp, human
gaggtgtgagccgagtaagg

SEQ ID NO: 359173 - DNA, 20 bp, human
gaggagggggcgggcctctt

SEQ ID NO: 359174 - DNA, 20 bp, human
ggccagccaacgggcggcga

SEQ ID NO: 359175 - DNA, 20 bp, human
ggccgcgaccccgccttact

SEQ ID NO: 359176 - DNA, 20 bp, human
gcgcagccgccggaccgtcc

SEQ ID NO: 359177 - DNA, 20 bp, human
ggacccggcgcaggtccgag

SEQ ID NO: 359178 - DNA, 20 bp, human
gcccagccgggacggtccgg

SEQ ID NO: 359179 - DNA, 20 bp, human
gtcggcggcgcatccagggg

SEQ ID NO: 359180 - DNA, 20 bp, human
gaggggcgcgcgactggcgc

SEQ ID NO: 359181 - DNA, 20 bp, human
gtcccggctgggaaaactcg

SEQ ID NO: 359182 - DNA, 20 bp, human
gagcgtcggcggcgcatcca

SEQ ID NO: 359183 - DNA, 20 bp, human
gcgcagcgctgacccggcgc

SEQ ID NO: 359184 - DNA, 20 bp, human
gacacccctcggacctgcgc

SEQ ID NO: 359185 - DNA, 20 bp, human
ggccgccggaccgtcccggc

SEQ ID NO: 359186 - DNA, 20 bp, human
gtaaggaaggattacactaa

SEQ ID NO: 359187 - DNA, 20 bp, human
gtatctgtagaggatatcag

SEQ ID NO: 359188 - DNA, 20 bp, human
gtgcccacaaagcatcttaa

SEQ ID NO: 359189 - DNA, 20 bp, human
gagctgtgatctatataaga

SEQ ID NO: 359190 - DNA, 20 bp, human
ggcatcttaaaggctaagga

SEQ ID NO: 359191 - DNA, 20 bp, human
gcaaagcatcttaaaggcta

SEQ ID NO: 359192 - DNA, 20 bp, human
gacaggtttatgcaccttgc

SEQ ID NO: 359193 - DNA, 20 bp, human
ggtttccacttgaaacctgt

SEQ ID NO: 359194 - DNA, 20 bp, human
gtcttttagcctatctgtag

SEQ ID NO: 359195 - DNA, 20 bp, human
gtactaggaatcaaaaaata

SEQ ID NO: 359196 - DNA, 20 bp, human
gtcccgaagcagttccggtt

SEQ ID NO: 359197 - DNA, 20 bp, human
gctgccgcggaggagcccga

SEQ ID NO: 359198 - DNA, 20 bp, human
gcagctgctcggagccgaac

SEQ ID NO: 359199 - DNA, 20 bp, human
gagccgaaccggaactgctt

SEQ ID NO: 359200 - DNA, 20 bp, human
gccgcctcccgaagcagttc

SEQ ID NO: 359201 - DNA, 20 bp, human
ggccggtagaaccccgtccc

SEQ ID NO: 359202 - DNA, 20 bp, human
ggaagcgcctcaagcggcgg

SEQ ID NO: 359203 - DNA, 20 bp, human
ggacggggttctaccggcag

SEQ ID NO: 359204 - DNA, 20 bp, human
gaccccgtccccggccggta

SEQ ID NO: 359205 - DNA, 20 bp, human
gggcgcatgcgtcatgccgg

SEQ ID NO: 359206 - DNA, 20 bp, human
gtctcacagcaagctctaat

SEQ ID NO: 359207 - DNA, 20 bp, human
gggcgtgtttaacaactggg

SEQ ID NO: 359208 - DNA, 20 bp, human
ggcagggcgtgtttaacaac

SEQ ID NO: 359209 - DNA, 20 bp, human
gaattggctcagaaacagca

SEQ ID NO: 359210 - DNA, 20 bp, human
gtttaacaactgggaggttg

SEQ ID NO: 359211 - DNA, 20 bp, human
gggaaggaagaatataggtt

SEQ ID NO: 359212 - DNA, 20 bp, human
gtgtctataacaagacaatg

SEQ ID NO: 359213 - DNA, 20 bp, human
gaaccaagcagaccagaagg

SEQ ID NO: 359214 - DNA, 20 bp, human
gtccaacctggtgctctaca

SEQ ID NO: 359215 - DNA, 20 bp, human
gagggctgcagcagacctga

SEQ ID NO: 359216 - DNA, 20 bp, human
gagagtgccagttgagaagc

SEQ ID NO: 359217 - DNA, 20 bp, human
ggtgccagttgagaagcagg

SEQ ID NO: 359218 - DNA, 20 bp, human
gtgcttagaaactgtttacc

SEQ ID NO: 359219 - DNA, 20 bp, human
ggtcctgtaggtagtttttt

SEQ ID NO: 359220 - DNA, 20 bp, human
gcagtactctgactttctga

SEQ ID NO: 359221 - DNA, 20 bp, human
gcaatctaagttcctgttac

SEQ ID NO: 359222 - DNA, 20 bp, human
gaaagagaatggaaatacca

SEQ ID NO: 359223 - DNA, 20 bp, human
gaggtagttttttgggtcac

SEQ ID NO: 359224 - DNA, 20 bp, human
gttataagagttaaggaata

SEQ ID NO: 359225 - DNA, 20 bp, human
gttttaagttataagagtta

SEQ ID NO: 359226 - DNA, 20 bp, human
gccctggcgggattgatttg

SEQ ID NO: 359227 - DNA, 20 bp, human
gcgcctgcgcagggagccca

SEQ ID NO: 359228 - DNA, 20 bp, human
ggctggacgtgaacgcgaaa

SEQ ID NO: 359229 - DNA, 20 bp, human
gctaggctgccctgcccgaa

SEQ ID NO: 359230 - DNA, 20 bp, human
gcggggagtccaaggagtat

SEQ ID NO: 359231 - DNA, 20 bp, human
ggaactgagggcagtgctgg

SEQ ID NO: 359232 - DNA, 20 bp, human
ggcaccgcacccccaattag

SEQ ID NO: 359233 - DNA, 20 bp, human
ggggtagtgtactcattcga

SEQ ID NO: 359234 - DNA, 20 bp, human
gtagacgagcccctaattgg

SEQ ID NO: 359235 - DNA, 20 bp, human
ggtcagtgagcctgcgcagg

SEQ ID NO: 359236 - DNA, 20 bp, human
gcataaggaccaatgagcga

SEQ ID NO: 359237 - DNA, 20 bp, human
gcccggacgcggaacactgg

SEQ ID NO: 359238 - DNA, 20 bp, human
gcggagaaggcggggaatca

SEQ ID NO: 359239 - DNA, 20 bp, human
ggggagggcgcgtggggtga

SEQ ID NO: 359240 - DNA, 20 bp, human
ggcagtcagaacgtcctccg

SEQ ID NO: 359241 - DNA, 20 bp, human
gcgaaggcatcgcgagccag

SEQ ID NO: 359242 - DNA, 20 bp, human
ggtgtgaacatccgggtcac

SEQ ID NO: 359243 - DNA, 20 bp, human
gtgaaggtgggtctgcgaga

SEQ ID NO: 359244 - DNA, 20 bp, human
gcgcggccgtgtgaacatcc

SEQ ID NO: 359245 - DNA, 20 bp, human
gctggcgcgtggactgtgtg

SEQ ID NO: 359246 - DNA, 20 bp, human
gtaatgcacagcatcagata

SEQ ID NO: 359247 - DNA, 20 bp, human
gggaggaagtggcaggtccc

SEQ ID NO: 359248 - DNA, 20 bp, human
gatcagataaggttgagccc

SEQ ID NO: 359249 - DNA, 20 bp, human
gcatgtctaaatatgagatt

SEQ ID NO: 359250 - DNA, 20 bp, human
ggaagtcatatcctgactga

SEQ ID NO: 359251 - DNA, 20 bp, human
gtgtcttgctattttctatg

SEQ ID NO: 359252 - DNA, 20 bp, human
gttatggctctcataactgc

SEQ ID NO: 359253 - DNA, 20 bp, human
gtatgacttcaacatttaca

SEQ ID NO: 359254 - DNA, 20 bp, human
ggtcatatcctgactgaagg

SEQ ID NO: 359255 - DNA, 20 bp, human
gaatttacaatgcattccat

SEQ ID NO: 359256 - DNA, 20 bp, human
ggtagtcgccggagtcagga

SEQ ID NO: 359257 - DNA, 20 bp, human
gcggcccgccctcctgactc

SEQ ID NO: 359258 - DNA, 20 bp, human
gagtcgccggtggtcgtgag

SEQ ID NO: 359259 - DNA, 20 bp, human
gctgtgggaaatgtagtcgc

SEQ ID NO: 359260 - DNA, 20 bp, human
gtcgccggagtcaggagggc

SEQ ID NO: 359261 - DNA, 20 bp, human
gtgccctcaggttaaggcat

SEQ ID NO: 359262 - DNA, 20 bp, human
ggcgctctccacctccttcg

SEQ ID NO: 359263 - DNA, 20 bp, human
gcgagtcagccagtcgccgg

SEQ ID NO: 359264 - DNA, 20 bp, human
ggcaaaggggtgtgttgccc

SEQ ID NO: 359265 - DNA, 20 bp, human
gcgccgcggctcagaggggc

SEQ ID NO: 359266 - DNA, 20 bp, human
gggtgctgacgtccgcgggg

SEQ ID NO: 359267 - DNA, 20 bp, human
ggcaaccaactgctaggcga

SEQ ID NO: 359268 - DNA, 20 bp, human
gcgcctgcgtgttgcgactt

SEQ ID NO: 359269 - DNA, 20 bp, human
gaggcgggtgctgacgtccg

SEQ ID NO: 359270 - DNA, 20 bp, human
gttgcgacttcgggaaaagg

SEQ ID NO: 359271 - DNA, 20 bp, human
gatcccggcaaccaactgct

SEQ ID NO: 359272 - DNA, 20 bp, human
gccggctcgctcaccacgca

SEQ ID NO: 359273 - DNA, 20 bp, human
ggcgtccgtcgcctagcagt

SEQ ID NO: 359274 - DNA, 20 bp, human
gcacaggcgacataagctta

SEQ ID NO: 359275 - DNA, 20 bp, human
gaagctcgacactttatagt

SEQ ID NO: 359276 - DNA, 20 bp, human
gacgtggccgggagacgcac

SEQ ID NO: 359277 - DNA, 20 bp, human
ggcgactgggcggtgaattc

SEQ ID NO: 359278 - DNA, 20 bp, human
gcgggcgccccctggcgact

SEQ ID NO: 359279 - DNA, 20 bp, human
ggcgccccctggcgactggg

SEQ ID NO: 359280 - DNA, 20 bp, human
gggaacgcggaatgttgccc

SEQ ID NO: 359281 - DNA, 20 bp, human
gggggcacgcgccacgtggc

SEQ ID NO: 359282 - DNA, 20 bp, human
gtgcgtcgcggggttgttgg

SEQ ID NO: 359283 - DNA, 20 bp, human
gtcagcctccctccgcggcg

SEQ ID NO: 359284 - DNA, 20 bp, human
ggggagcagaagacgcgcct

SEQ ID NO: 359285 - DNA, 20 bp, human
gacgtggcgcgtgcccccgc

SEQ ID NO: 359286 - DNA, 20 bp, human
ggaccccgcgccatgaggga

SEQ ID NO: 359287 - DNA, 20 bp, human
gcggggtcagggcggagctc

SEQ ID NO: 359288 - DNA, 20 bp, human
gtcatggcgcggggtcaggg

SEQ ID NO: 359289 - DNA, 20 bp, human
gcccgcgccatgagggacgg

SEQ ID NO: 359290 - DNA, 20 bp, human
gccgcgcggcagaaagaaag

SEQ ID NO: 359291 - DNA, 20 bp, human
gcagaaagaaaggggcggga

SEQ ID NO: 359292 - DNA, 20 bp, human
gtggccgcgctatgcatgct

SEQ ID NO: 359293 - DNA, 20 bp, human
gcgcgcttgcgcaggtcccg

SEQ ID NO: 359294 - DNA, 20 bp, human
gtgagcggggtccccgctcc

SEQ ID NO: 359295 - DNA, 20 bp, human
gcgcggcagaaagaaagggg

SEQ ID NO: 359296 - DNA, 20 bp, human
gagcgcgagcgctggcatga

SEQ ID NO: 359297 - DNA, 20 bp, human
gagtcggcgtcttgagtcat

SEQ ID NO: 359298 - DNA, 20 bp, human
ggcgagcgctggcatgaggg

SEQ ID NO: 359299 - DNA, 20 bp, human
ggcggaaaggcaggttcttt

SEQ ID NO: 359300 - DNA, 20 bp, human
ggatgacgtagcgcgagcgc

SEQ ID NO: 359301 - DNA, 20 bp, human
gggagacccccgcgccacac

SEQ ID NO: 359302 - DNA, 20 bp, human
ggacggatataagattgcgt

SEQ ID NO: 359303 - DNA, 20 bp, human
gactcaagacgccgacttcc

SEQ ID NO: 359304 - DNA, 20 bp, human
gctacgtcatcactgcgcga

SEQ ID NO: 359305 - DNA, 20 bp, human
gcactggaaaccaatcaaaa

SEQ ID NO: 359306 - DNA, 20 bp, human
ggccgctggcgcgtcccatt

SEQ ID NO: 359307 - DNA, 20 bp, human
ggcctggcgccggagactgg

SEQ ID NO: 359308 - DNA, 20 bp, human
gccggcgccaggctacttcc

SEQ ID NO: 359309 - DNA, 20 bp, human
gaaccgggctgcagactctc

SEQ ID NO: 359310 - DNA, 20 bp, human
gggcggcggcgacgcccaat

SEQ ID NO: 359311 - DNA, 20 bp, human
ggcccaatgggacgcgccag

SEQ ID NO: 359312 - DNA, 20 bp, human
ggtagcctggcgccggagac

SEQ ID NO: 359313 - DNA, 20 bp, human
gggagcgaactgttgtggtg

SEQ ID NO: 359314 - DNA, 20 bp, human
ggggacagacagtagagacg

SEQ ID NO: 359315 - DNA, 20 bp, human
gcggttcccggttctcgctg

SEQ ID NO: 359316 - DNA, 20 bp, human
gcagcaggaaggggcctgag

SEQ ID NO: 359317 - DNA, 20 bp, human
ggatgggtgcaaggcagggg

SEQ ID NO: 359318 - DNA, 20 bp, human
gggcaggatgggtgcaaggc

SEQ ID NO: 359319 - DNA, 20 bp, human
gcagcccgggctgcaccagt

SEQ ID NO: 359320 - DNA, 20 bp, human
gagaacgaaccccttcagag

SEQ ID NO: 359321 - DNA, 20 bp, human
ggactcccggattctacccc

SEQ ID NO: 359322 - DNA, 20 bp, human
gagtatcctggggtagaatc

SEQ ID NO: 359323 - DNA, 20 bp, human
gcgttctcatgaagtatcct

SEQ ID NO: 359324 - DNA, 20 bp, human
gttcccacctcagagccatg

SEQ ID NO: 359325 - DNA, 20 bp, human
gagcccaccggagtctcagg

SEQ ID NO: 359326 - DNA, 20 bp, human
gggcctccgcgcgcctccca

SEQ ID NO: 359327 - DNA, 20 bp, human
gagggctgacgccgcgagga

SEQ ID NO: 359328 - DNA, 20 bp, human
gccgcggcgcatgttaatga

SEQ ID NO: 359329 - DNA, 20 bp, human
gcgcggcaggaggtttggtg

SEQ ID NO: 359330 - DNA, 20 bp, human
gtctctgataggctgagagg

SEQ ID NO: 359331 - DNA, 20 bp, human
gagggccccaagaggatcgt

SEQ ID NO: 359332 - DNA, 20 bp, human
gagagcagatgggacgggct

SEQ ID NO: 359333 - DNA, 20 bp, human
ggatccggttccgcctgccc

SEQ ID NO: 359334 - DNA, 20 bp, human
ggccccggccacctctccaa

SEQ ID NO: 359335 - DNA, 20 bp, human
gctggccgcggcaggaggtt

SEQ ID NO: 359336 - DNA, 20 bp, human
gggccccgcctgctcccgtc

SEQ ID NO: 359337 - DNA, 20 bp, human
gacaaagcgcgctcggggtc

SEQ ID NO: 359338 - DNA, 20 bp, human
gtacgcgcccggaagtcccg

SEQ ID NO: 359339 - DNA, 20 bp, human
gcgccggaaccctgggtccg

SEQ ID NO: 359340 - DNA, 20 bp, human
ggcccgagtcgctggtggga

SEQ ID NO: 359341 - DNA, 20 bp, human
ggtcgctggtgggacggcac

SEQ ID NO: 359342 - DNA, 20 bp, human
gcgcggcccgagtcgctggt

SEQ ID NO: 359343 - DNA, 20 bp, human
gctagccagacgggagcagg

SEQ ID NO: 359344 - DNA, 20 bp, human
ggccgtcccaccagcgactc

SEQ ID NO: 359345 - DNA, 20 bp, human
gcgcccggaagtcccgggga

SEQ ID NO: 359346 - DNA, 20 bp, human
ggagacccaggcggtgttag

SEQ ID NO: 359347 - DNA, 20 bp, human
ggcacccgccggcccggaag

SEQ ID NO: 359348 - DNA, 20 bp, human
ggcaacccctaacaccgcct

SEQ ID NO: 359349 - DNA, 20 bp, human
gaaggggctgatgcgaactg

SEQ ID NO: 359350 - DNA, 20 bp, human
gtgccaggaggcggaaccta

SEQ ID NO: 359351 - DNA, 20 bp, human
gcgccctaggttccgcctcc

SEQ ID NO: 359352 - DNA, 20 bp, human
gcgctcaactggggaattgg

SEQ ID NO: 359353 - DNA, 20 bp, human
ggagcagcctcgctcaactg

SEQ ID NO: 359354 - DNA, 20 bp, human
ggtggggagaccaggcggct

SEQ ID NO: 359355 - DNA, 20 bp, human
gaacaccccatgcctcccta

SEQ ID NO: 359356 - DNA, 20 bp, human
gagcgtaccgcccaccactg

SEQ ID NO: 359357 - DNA, 20 bp, human
gtagaagccgcagtggtggg

SEQ ID NO: 359358 - DNA, 20 bp, human
gtacgctccgcccagatcct

SEQ ID NO: 359359 - DNA, 20 bp, human
gcccagaaggagctatgcac

SEQ ID NO: 359360 - DNA, 20 bp, human
gaggtcgcctacgggtaatg

SEQ ID NO: 359361 - DNA, 20 bp, human
ggctccgcccagatcctggg

SEQ ID NO: 359362 - DNA, 20 bp, human
gggcctagaagccgcagtgg

SEQ ID NO: 359363 - DNA, 20 bp, human
ggcttctaggccagcttagt

SEQ ID NO: 359364 - DNA, 20 bp, human
ggatcctgggcggagacatg

SEQ ID NO: 359365 - DNA, 20 bp, human
gcctctgagggcggcagagc

SEQ ID NO: 359366 - DNA, 20 bp, human
gaaccgcccggccgcgggtc

SEQ ID NO: 359367 - DNA, 20 bp, human
gtctgtgtcagcagccgggc

SEQ ID NO: 359368 - DNA, 20 bp, human
gaggggccgccgggctgtac

SEQ ID NO: 359369 - DNA, 20 bp, human
gctccggggtgggaccaggc

SEQ ID NO: 359370 - DNA, 20 bp, human
gcgggcggaagtccgggttg

SEQ ID NO: 359371 - DNA, 20 bp, human
ggcgcggcgggcggaagtcc

SEQ ID NO: 359372 - DNA, 20 bp, human
gcggaagttgctctgagctc

SEQ ID NO: 359373 - DNA, 20 bp, human
gacagagcccgacccgcggc

SEQ ID NO: 359374 - DNA, 20 bp, human
gcagcgaccgggaccaccag

SEQ ID NO: 359375 - DNA, 20 bp, human
gtggtcccggtcgctgactg

SEQ ID NO: 359376 - DNA, 20 bp, human
ggcgactgactgaggggcta

SEQ ID NO: 359377 - DNA, 20 bp, human
gtgcgctggacttggaggaa

SEQ ID NO: 359378 - DNA, 20 bp, human
ggcgtggctggggacggctt

SEQ ID NO: 359379 - DNA, 20 bp, human
gcggaggagcagtggtcccc

SEQ ID NO: 359380 - DNA, 20 bp, human
gtccccgccccacgtgacat

SEQ ID NO: 359381 - DNA, 20 bp, human
ggtggctgcgactgactgag

SEQ ID NO: 359382 - DNA, 20 bp, human
gggggaggcggggcggagaa

SEQ ID NO: 359383 - DNA, 20 bp, human
gccccctgcgctggacttgg

SEQ ID NO: 359384 - DNA, 20 bp, human
ggtaccgatgtcacgtgggg

SEQ ID NO: 359385 - DNA, 20 bp, human
ggcctcctgcagccacgccc

SEQ ID NO: 359386 - DNA, 20 bp, human
gacgtcagctattgaccaat

SEQ ID NO: 359387 - DNA, 20 bp, human
gagagctgatggtatggcgt

SEQ ID NO: 359388 - DNA, 20 bp, human
gacgtcgctctcacttctct

SEQ ID NO: 359389 - DNA, 20 bp, human
gccaccttttgaaagaggtg

SEQ ID NO: 359390 - DNA, 20 bp, human
gcaaaaggtggaactgggag

SEQ ID NO: 359391 - DNA, 20 bp, human
gttgccccacctctttcaaa

SEQ ID NO: 359392 - DNA, 20 bp, human
gcagcgctgccaccacccat

SEQ ID NO: 359393 - DNA, 20 bp, human
gaaggagaggcgttacttcc

SEQ ID NO: 359394 - DNA, 20 bp, human
gtctttcaaaaggtggaact

SEQ ID NO: 359395 - DNA, 20 bp, human
gatgggaagagctgatggta

SEQ ID NO: 359396 - DNA, 20 bp, human
gaccggaagcggctggttgg

SEQ ID NO: 359397 - DNA, 20 bp, human
ggcagactgtagcagagctg

SEQ ID NO: 359398 - DNA, 20 bp, human
gccctccccgcgaccggaag

SEQ ID NO: 359399 - DNA, 20 bp, human
gggcgcagtgcggcggtcac

SEQ ID NO: 359400 - DNA, 20 bp, human
gggccccggcctctaagcta

SEQ ID NO: 359401 - DNA, 20 bp, human
ggggcgtgggactatacctc

SEQ ID NO: 359402 - DNA, 20 bp, human
gagacaggagtaggaaactg

SEQ ID NO: 359403 - DNA, 20 bp, human
gcctagcctgagacaggagt

SEQ ID NO: 359404 - DNA, 20 bp, human
ggaagggcgggtcagcgcgc

SEQ ID NO: 359405 - DNA, 20 bp, human
gtcgcggggagggtcgcctg

SEQ ID NO: 359406 - DNA, 20 bp, human
gtccgggcgctatccgtgca

SEQ ID NO: 359407 - DNA, 20 bp, human
gcgggacacagacgacgatt

SEQ ID NO: 359408 - DNA, 20 bp, human
gggacctaaaggtgaggtcg

SEQ ID NO: 359409 - DNA, 20 bp, human
gcacggatagcgcccggaag

SEQ ID NO: 359410 - DNA, 20 bp, human
ggcgacgaaggactctatcg

SEQ ID NO: 359411 - DNA, 20 bp, human
gtgtccgcgacctcaccttt

SEQ ID NO: 359412 - DNA, 20 bp, human
gacgagccaatcagatcctg

SEQ ID NO: 359413 - DNA, 20 bp, human
ggcgctatccgtgcagggat

SEQ ID NO: 359414 - DNA, 20 bp, human
gctcacaggacctaaaggtg

SEQ ID NO: 359415 - DNA, 20 bp, human
ggacgacgattgggcgacga

SEQ ID NO: 359416 - DNA, 20 bp, human
gcattcgcgccgtctcgggt

SEQ ID NO: 359417 - DNA, 20 bp, human
gtgcacattcgcgccgtctc

SEQ ID NO: 359418 - DNA, 20 bp, human
ggcgccgtctcgggtcgggt

SEQ ID NO: 359419 - DNA, 20 bp, human
gtgcaagcgcagggaggccg

SEQ ID NO: 359420 - DNA, 20 bp, human
gggaagcggaattaacccgg

SEQ ID NO: 359421 - DNA, 20 bp, human
ggaacccacccgacccgaga

SEQ ID NO: 359422 - DNA, 20 bp, human
ggttaattccgcttcccttg

SEQ ID NO: 359423 - DNA, 20 bp, human
gtgaggagcgcatgcgcaat

SEQ ID NO: 359424 - DNA, 20 bp, human
ggcggaattaacccggaggt

SEQ ID NO: 359425 - DNA, 20 bp, human
ggcagccgctgtcgtgttgc

SEQ ID NO: 359426 - DNA, 20 bp, human
gcggacagaagttgggtctt

SEQ ID NO: 359427 - DNA, 20 bp, human
gacaacttcggacagaagtt

SEQ ID NO: 359428 - DNA, 20 bp, human
gggccgccgaagacccgctg

SEQ ID NO: 359429 - DNA, 20 bp, human
gcaggaagtggaagccatag

SEQ ID NO: 359430 - DNA, 20 bp, human
gtcacactaggcgataagta

SEQ ID NO: 359431 - DNA, 20 bp, human
gagaagttgggtctttgggc

SEQ ID NO: 359432 - DNA, 20 bp, human
gcttctgtccgaagttgtga

SEQ ID NO: 359433 - DNA, 20 bp, human
gctagtgtgacctggcgctt

SEQ ID NO: 359434 - DNA, 20 bp, human
ggtaccagacgtttacataa

SEQ ID NO: 359435 - DNA, 20 bp, human
gtacataaaggggaggaatc

SEQ ID NO: 359436 - DNA, 20 bp, human
gggagcctctagatcttgga

SEQ ID NO: 359437 - DNA, 20 bp, human
gagctccctccaagatctag

SEQ ID NO: 359438 - DNA, 20 bp, human
ggacgggaaccaactaacta

SEQ ID NO: 359439 - DNA, 20 bp, human
gcctgccaagacttgctaga

SEQ ID NO: 359440 - DNA, 20 bp, human
ggtacggcggggaattcgct

SEQ ID NO: 359441 - DNA, 20 bp, human
gtcttggcaggacccggcag

SEQ ID NO: 359442 - DNA, 20 bp, human
gcccgctcggcgcagcaaca

SEQ ID NO: 359443 - DNA, 20 bp, human
gttgctgcgccgagcggggt

SEQ ID NO: 359444 - DNA, 20 bp, human
gtccccgccgtacaactcag

SEQ ID NO: 359445 - DNA, 20 bp, human
gtccgcaccactgagttgta

SEQ ID NO: 359446 - DNA, 20 bp, human
gcctccctaggggccggcag

SEQ ID NO: 359447 - DNA, 20 bp, human
gcagcccctgccggccccta

SEQ ID NO: 359448 - DNA, 20 bp, human
ggggatggctgcaggcctga

SEQ ID NO: 359449 - DNA, 20 bp, human
ggctgtaagagtaggtcacg

SEQ ID NO: 359450 - DNA, 20 bp, human
gtggacttccttcctcccta

SEQ ID NO: 359451 - DNA, 20 bp, human
ggacatgagacaacaaggta

SEQ ID NO: 359452 - DNA, 20 bp, human
gaagagtaggtcacgtggca

SEQ ID NO: 359453 - DNA, 20 bp, human
gtgcaggcctgatggctgta

SEQ ID NO: 359454 - DNA, 20 bp, human
gctgcgattgctgtaagagt

SEQ ID NO: 359455 - DNA, 20 bp, human
gtctgatgcagacggctctt

SEQ ID NO: 359456 - DNA, 20 bp, human
gaggcagccatgtttgttaa

SEQ ID NO: 359457 - DNA, 20 bp, human
gttaagggaaggagacccga

SEQ ID NO: 359458 - DNA, 20 bp, human
gggaggtcgccataattcta

SEQ ID NO: 359459 - DNA, 20 bp, human
ggaagcgagccctagaatta

SEQ ID NO: 359460 - DNA, 20 bp, human
gggtagatgcggttactatg

SEQ ID NO: 359461 - DNA, 20 bp, human
gcggttctgcggaggataaa

SEQ ID NO: 359462 - DNA, 20 bp, human
ggattcttccggttctgcgg

SEQ ID NO: 359463 - DNA, 20 bp, human
ggataaagggaagacggttg

SEQ ID NO: 359464 - DNA, 20 bp, human
gaaccggaagaatccgatgg

SEQ ID NO: 359465 - DNA, 20 bp, human
ggcgtgcggcgacgtcgcgg

SEQ ID NO: 359466 - DNA, 20 bp, human
gccgggcgcccgtgtgaacc

SEQ ID NO: 359467 - DNA, 20 bp, human
gtgaacccggaggacaaaag

SEQ ID NO: 359468 - DNA, 20 bp, human
gggaagagagggtggtgcct

SEQ ID NO: 359469 - DNA, 20 bp, human
gcccggggccgcggcctcat

SEQ ID NO: 359470 - DNA, 20 bp, human
gggcgcccgtgtgaacccgg

SEQ ID NO: 359471 - DNA, 20 bp, human
ggacacaccggctcccagta

SEQ ID NO: 359472 - DNA, 20 bp, human
gttgtcctccgggttcacac

SEQ ID NO: 359473 - DNA, 20 bp, human
ggacaaaagtgggggcagcg

SEQ ID NO: 359474 - DNA, 20 bp, human
gcccagtagggtttccgcca

SEQ ID NO: 359475 - DNA, 20 bp, human
gtgcccccacttttgtcctc

SEQ ID NO: 359476 - DNA, 20 bp, human
gcacaagatccagctgtcgg

SEQ ID NO: 359477 - DNA, 20 bp, human
gtgtgtgggtgtcccaacct

SEQ ID NO: 359478 - DNA, 20 bp, human
gccgcggggtatctcgaccc

SEQ ID NO: 359479 - DNA, 20 bp, human
gcctgggtagagttcaaggt

SEQ ID NO: 359480 - DNA, 20 bp, human
gctgctgcgacagaattcga

SEQ ID NO: 359481 - DNA, 20 bp, human
ggggtcttaaggcttaccca

SEQ ID NO: 359482 - DNA, 20 bp, human
ggagtgaagcggcttccttg

SEQ ID NO: 359483 - DNA, 20 bp, human
ggggtatctcgacccaggtt

SEQ ID NO: 359484 - DNA, 20 bp, human
gggcttacccagggtctggg

SEQ ID NO: 359485 - DNA, 20 bp, human
ggcctgttctccaagctgat

SEQ ID NO: 359486 - DNA, 20 bp, human
gtgcacggagcgggcggaaa

SEQ ID NO: 359487 - DNA, 20 bp, human
ggggctggagggccgggatt

SEQ ID NO: 359488 - DNA, 20 bp, human
ggagcgggcggaaaagggat

SEQ ID NO: 359489 - DNA, 20 bp, human
gagggatggggattaaaacc

SEQ ID NO: 359490 - DNA, 20 bp, human
gataacagggcgctgtgcga

SEQ ID NO: 359491 - DNA, 20 bp, human
gaaggcggcgtgggggggca

SEQ ID NO: 359492 - DNA, 20 bp, human
gtggggattaaaacccgggc

SEQ ID NO: 359493 - DNA, 20 bp, human
ggattaaaacccgggctgga

SEQ ID NO: 359494 - DNA, 20 bp, human
gggagcgagcgagaaagtgg

SEQ ID NO: 359495 - DNA, 20 bp, human
gccgccagacgcgccaggga

SEQ ID NO: 359496 - DNA, 20 bp, human
gggagctgctctcgtctcgt

SEQ ID NO: 359497 - DNA, 20 bp, human
gcagacgtggcgcttcggac

SEQ ID NO: 359498 - DNA, 20 bp, human
gggggacgccccggccgctc

SEQ ID NO: 359499 - DNA, 20 bp, human
gcccccgggcgcagcgtgcc

SEQ ID NO: 359500 - DNA, 20 bp, human
gtctggatgcgcgtcccggg

SEQ ID NO: 359501 - DNA, 20 bp, human
gacgtctggatgcgcgtccc

SEQ ID NO: 359502 - DNA, 20 bp, human
ggccgaggctcccaccgcca

SEQ ID NO: 359503 - DNA, 20 bp, human
gcgcacaagctccgaagcgg

SEQ ID NO: 359504 - DNA, 20 bp, human
ggctgctgcgcaccgctccc

SEQ ID NO: 359505 - DNA, 20 bp, human
gagacgagagcagctcccgc

SEQ ID NO: 359506 - DNA, 20 bp, human
gaccgggaaaagttgctcgg

SEQ ID NO: 359507 - DNA, 20 bp, human
gcgcgccgagccgaacgtcc

SEQ ID NO: 359508 - DNA, 20 bp, human
gcccctaggcgcactcgtcc

SEQ ID NO: 359509 - DNA, 20 bp, human
gcgcggcgggccgggacgtt

SEQ ID NO: 359510 - DNA, 20 bp, human
gcggcggcacgaagcgcggc

SEQ ID NO: 359511 - DNA, 20 bp, human
gagatctggggaccgaaagg

SEQ ID NO: 359512 - DNA, 20 bp, human
gaaaccgaggacaacccaaa

SEQ ID NO: 359513 - DNA, 20 bp, human
gcgggccgggacgttcggct

SEQ ID NO: 359514 - DNA, 20 bp, human
ggacgcgcaagaggcgaccg

SEQ ID NO: 359515 - DNA, 20 bp, human
gccctccgagcaacttttcc

SEQ ID NO: 359516 - DNA, 20 bp, human
ggtgctcccccgtgtggtga

SEQ ID NO: 359517 - DNA, 20 bp, human
gctcccccgtgtggtgaggg

SEQ ID NO: 359518 - DNA, 20 bp, human
gccccaccctcaccacacgg

SEQ ID NO: 359519 - DNA, 20 bp, human
gaccacacgggggagcacgt

SEQ ID NO: 359520 - DNA, 20 bp, human
gggtcactgcatcataatgg

SEQ ID NO: 359521 - DNA, 20 bp, human
gcgagacttgagcacttcat

SEQ ID NO: 359522 - DNA, 20 bp, human
gtgaccatgcaggggcgggc

SEQ ID NO: 359523 - DNA, 20 bp, human
gataatggcggtcacaatgc

SEQ ID NO: 359524 - DNA, 20 bp, human
ggaaaaatgaggacggaaat

SEQ ID NO: 359525 - DNA, 20 bp, human
gtgatgcagtgaccatgcag

SEQ ID NO: 359526 - DNA, 20 bp, human
gcctccgctagggatcccga

SEQ ID NO: 359527 - DNA, 20 bp, human
gggccgtccccgccgagctg

SEQ ID NO: 359528 - DNA, 20 bp, human
ggctccaggcgcggctccgg

SEQ ID NO: 359529 - DNA, 20 bp, human
gcggccgcggggaaagttta

SEQ ID NO: 359530 - DNA, 20 bp, human
gcaggacctgcttctcgctg

SEQ ID NO: 359531 - DNA, 20 bp, human
gagtgaggacagccgcagct

SEQ ID NO: 359532 - DNA, 20 bp, human
ggcccggtagcctagagcgc

SEQ ID NO: 359533 - DNA, 20 bp, human
gactcgggtgccggcgctct

SEQ ID NO: 359534 - DNA, 20 bp, human
gaaacagggaacaacgtctt

SEQ ID NO: 359535 - DNA, 20 bp, human
gggcacccgagtcccgccgc

SEQ ID NO: 359536 - DNA, 20 bp, human
gacccgccagacttcacaaa

SEQ ID NO: 359537 - DNA, 20 bp, human
gacaggacgctggatcagtg

SEQ ID NO: 359538 - DNA, 20 bp, human
gcgggcgcgcgctcccttat

SEQ ID NO: 359539 - DNA, 20 bp, human
gccttgctgcatctcactta

SEQ ID NO: 359540 - DNA, 20 bp, human
gtcactgtggcgctgttcat

SEQ ID NO: 359541 - DNA, 20 bp, human
gttcacaaacggaggagacg

SEQ ID NO: 359542 - DNA, 20 bp, human
ggcgcgcgcctcgcgtccgt

SEQ ID NO: 359543 - DNA, 20 bp, human
gagtgagaagatggttccag

SEQ ID NO: 359544 - DNA, 20 bp, human
ggagatgcagcaaggcagag

SEQ ID NO: 359545 - DNA, 20 bp, human
gcctttgggagagggcaatg

SEQ ID NO: 359546 - DNA, 20 bp, human
gcctgccagacacactgtga

SEQ ID NO: 359547 - DNA, 20 bp, human
gggcgaaagtaaatacgcca

SEQ ID NO: 359548 - DNA, 20 bp, human
ggtaaaaagccacaatacgc

SEQ ID NO: 359549 - DNA, 20 bp, human
ggcagccgtcacagtgtgtc

SEQ ID NO: 359550 - DNA, 20 bp, human
gggggtgatgggtacataga

SEQ ID NO: 359551 - DNA, 20 bp, human
ggatggcaaaatgttgatag

SEQ ID NO: 359552 - DNA, 20 bp, human
ggcgccgcgcactggtggtt

SEQ ID NO: 359553 - DNA, 20 bp, human
gccaacgctgtgttttaacc

SEQ ID NO: 359554 - DNA, 20 bp, human
gtcgcggcgccgcgcactgg

SEQ ID NO: 359555 - DNA, 20 bp, human
gtgacccaaccaccagtgcg

SEQ ID NO: 359556 - DNA, 20 bp, human
ggggccgggcacctggacta

SEQ ID NO: 359557 - DNA, 20 bp, human
gcggggagtcccaacggcga

SEQ ID NO: 359558 - DNA, 20 bp, human
gccccagagtggtcagcgat

SEQ ID NO: 359559 - DNA, 20 bp, human
gtgcaaccgcgcatctccat

SEQ ID NO: 359560 - DNA, 20 bp, human
gcctgtgcggggagtcccaa

SEQ ID NO: 359561 - DNA, 20 bp, human
gggcacctggactacggctc

SEQ ID NO: 359562 - DNA, 20 bp, human
gcggtgctcgggccccagag

SEQ ID NO: 359563 - DNA, 20 bp, human
ggggtcggctgtggtgtcgg

SEQ ID NO: 359564 - DNA, 20 bp, human
gctgacgccctgacccgggt

SEQ ID NO: 359565 - DNA, 20 bp, human
gcggcccgaggggcggtgct

SEQ ID NO: 359566 - DNA, 20 bp, human
ggcctcgcggactgctgcgc

SEQ ID NO: 359567 - DNA, 20 bp, human
gcggctgccccaagcccggg

SEQ ID NO: 359568 - DNA, 20 bp, human
gagtccgcgaggcccgcgga

SEQ ID NO: 359569 - DNA, 20 bp, human
gtcaaagtgaaccacctcca

SEQ ID NO: 359570 - DNA, 20 bp, human
ggaaccacctccaggggccg

SEQ ID NO: 359571 - DNA, 20 bp, human
gggcgggagaatttcatctt

SEQ ID NO: 359572 - DNA, 20 bp, human
ggaaacccgaggctccttgg

SEQ ID NO: 359573 - DNA, 20 bp, human
gcagccgagccagcgcgggt

SEQ ID NO: 359574 - DNA, 20 bp, human
gccaccgagcagacggggga

SEQ ID NO: 359575 - DNA, 20 bp, human
gaggcctggatgctgcttca

SEQ ID NO: 359576 - DNA, 20 bp, human
gacccagcgcggccggaagg

SEQ ID NO: 359577 - DNA, 20 bp, human
gggtgagcgcgcttgcgcga

SEQ ID NO: 359578 - DNA, 20 bp, human
gcaggtgcgcgctggctgga

SEQ ID NO: 359579 - DNA, 20 bp, human
gaggacccagcgcggccgga

SEQ ID NO: 359580 - DNA, 20 bp, human
gggggagaatctgcgctccg

SEQ ID NO: 359581 - DNA, 20 bp, human
gccgagcgggacggacaaag

SEQ ID NO: 359582 - DNA, 20 bp, human
gagcgcagattctccccgcg

SEQ ID NO: 359583 - DNA, 20 bp, human
gtgcgctccgcggcgcgcgg

SEQ ID NO: 359584 - DNA, 20 bp, human
gcacagaccgggacagtctg

SEQ ID NO: 359585 - DNA, 20 bp, human
ggcgccggtggctcccgagc

SEQ ID NO: 359586 - DNA, 20 bp, human
gggaggagggctcaactctt

SEQ ID NO: 359587 - DNA, 20 bp, human
ggggctcaactcttgggtca

SEQ ID NO: 359588 - DNA, 20 bp, human
gtgactcctggaactggctg

SEQ ID NO: 359589 - DNA, 20 bp, human
gatgtcgctctgctcccagt

SEQ ID NO: 359590 - DNA, 20 bp, human
gcgccccttctgcccccact

SEQ ID NO: 359591 - DNA, 20 bp, human
gacgacccccaaagtcgggg

SEQ ID NO: 359592 - DNA, 20 bp, human
ggccttacgacccccaaagt

SEQ ID NO: 359593 - DNA, 20 bp, human
ggaccccgccccgactttgg

SEQ ID NO: 359594 - DNA, 20 bp, human
ggctggagacctgaattcct

SEQ ID NO: 359595 - DNA, 20 bp, human
gctcctaggcaggcctctgc

SEQ ID NO: 359596 - DNA, 20 bp, human
gccgcctccctcctaggtga

SEQ ID NO: 359597 - DNA, 20 bp, human
ggtaccgggccgaggatagc

SEQ ID NO: 359598 - DNA, 20 bp, human
gactggggggtggtcaagat

SEQ ID NO: 359599 - DNA, 20 bp, human
gagccggcggagtccgtttt

SEQ ID NO: 359600 - DNA, 20 bp, human
gggggggtggtcaagatggg

SEQ ID NO: 359601 - DNA, 20 bp, human
gcggcggagtccgtttttgg

SEQ ID NO: 359602 - DNA, 20 bp, human
gggactccgccggctatcct

SEQ ID NO: 359603 - DNA, 20 bp, human
gcaccccagagccgcggtaa

SEQ ID NO: 359604 - DNA, 20 bp, human
gggcggcgaagactgggggg

SEQ ID NO: 359605 - DNA, 20 bp, human
ggggccgggtttccgcgaag

SEQ ID NO: 359606 - DNA, 20 bp, human
gcggaaggacctcaagggat

SEQ ID NO: 359607 - DNA, 20 bp, human
ggaaggggctgggactccta

SEQ ID NO: 359608 - DNA, 20 bp, human
gaatagcggaaggacctcaa

SEQ ID NO: 359609 - DNA, 20 bp, human
ggctgggactcctacggctc

SEQ ID NO: 359610 - DNA, 20 bp, human
ggcggggcctccacctgcgg

SEQ ID NO: 359611 - DNA, 20 bp, human
gtccttccgctattcggaag

SEQ ID NO: 359612 - DNA, 20 bp, human
gggggacgtggcacatgcag

SEQ ID NO: 359613 - DNA, 20 bp, human
ggggcgtggtctcggttcgg

SEQ ID NO: 359614 - DNA, 20 bp, human
gctggggtctcaagagaacc

SEQ ID NO: 359615 - DNA, 20 bp, human
ggattcgaacccagagccgt

SEQ ID NO: 359616 - DNA, 20 bp, human
gcctacttcctctaaggccg

SEQ ID NO: 359617 - DNA, 20 bp, human
gccgccgggtgccccaaagg

SEQ ID NO: 359618 - DNA, 20 bp, human
gatgccggccccgtaagtca

SEQ ID NO: 359619 - DNA, 20 bp, human
gccggcgcctacttcctcta

SEQ ID NO: 359620 - DNA, 20 bp, human
gcgaggagaattactgtacg

SEQ ID NO: 359621 - DNA, 20 bp, human
gaggaagtaggcgccggcgg

SEQ ID NO: 359622 - DNA, 20 bp, human
gaaggccggggctgactttc

SEQ ID NO: 359623 - DNA, 20 bp, human
gtacggggcggatctcccac

SEQ ID NO: 359624 - DNA, 20 bp, human
gggcaattaccggcagtgcg

SEQ ID NO: 359625 - DNA, 20 bp, human
gcgtccgccgggtgccccaa

SEQ ID NO: 359626 - DNA, 20 bp, human
gatggagcatggtggaaggt

SEQ ID NO: 359627 - DNA, 20 bp, human
ggagatttggagttgagcaa

SEQ ID NO: 359628 - DNA, 20 bp, human
gcatggatggagaagaactc

SEQ ID NO: 359629 - DNA, 20 bp, human
gcagtgaggggctagaatga

SEQ ID NO: 359630 - DNA, 20 bp, human
gagggcagacacccatctct

SEQ ID NO: 359631 - DNA, 20 bp, human
gaaagaggaggtggttggaa

SEQ ID NO: 359632 - DNA, 20 bp, human
gagaggggagaacactaggt

SEQ ID NO: 359633 - DNA, 20 bp, human
ggctcaactccaaatctccc

SEQ ID NO: 359634 - DNA, 20 bp, human
ggggaggcaccgtctggaga

SEQ ID NO: 359635 - DNA, 20 bp, human
ggaggggctagaatgatggg

SEQ ID NO: 359636 - DNA, 20 bp, human
gcggcctgcggggactgaga

SEQ ID NO: 359637 - DNA, 20 bp, human
ggggacgggcccgcaatcga

SEQ ID NO: 359638 - DNA, 20 bp, human
gctgcggggactgagagggt

SEQ ID NO: 359639 - DNA, 20 bp, human
gccacccgcccgggcctcga

SEQ ID NO: 359640 - DNA, 20 bp, human
ggcgcccggaccgtcgattg

SEQ ID NO: 359641 - DNA, 20 bp, human
ggcgctgcagttcccgggac

SEQ ID NO: 359642 - DNA, 20 bp, human
gggcccgcaatcgacggtcc

SEQ ID NO: 359643 - DNA, 20 bp, human
ggacctccggggcgcgggag

SEQ ID NO: 359644 - DNA, 20 bp, human
ggagaccaagagcactcgat

SEQ ID NO: 359645 - DNA, 20 bp, human
gcgggctcctggctacgccc

SEQ ID NO: 359646 - DNA, 20 bp, human
gcagctctccgcggtcacgt

SEQ ID NO: 359647 - DNA, 20 bp, human
gccgccctccccttagtcag

SEQ ID NO: 359648 - DNA, 20 bp, human
gtgacggcagatcgcgcgaa

SEQ ID NO: 359649 - DNA, 20 bp, human
ggcctgcgcgcagctctccg

SEQ ID NO: 359650 - DNA, 20 bp, human
gcgcggcgcccacgtgaccg

SEQ ID NO: 359651 - DNA, 20 bp, human
gcatccgagtacctttgcgg

SEQ ID NO: 359652 - DNA, 20 bp, human
gccccatccgagtacctttg

SEQ ID NO: 359653 - DNA, 20 bp, human
ggcgccataagctgatatga

SEQ ID NO: 359654 - DNA, 20 bp, human
gcctccaccgcaaaggtact

SEQ ID NO: 359655 - DNA, 20 bp, human
gaccgcggagagctgcgcgc

SEQ ID NO: 359656 - DNA, 20 bp, human
gggacagctaatggggtgag

SEQ ID NO: 359657 - DNA, 20 bp, human
gaccgagcacggcgacgtga

SEQ ID NO: 359658 - DNA, 20 bp, human
gcactgtggggcgtcatcgc

SEQ ID NO: 359659 - DNA, 20 bp, human
ggtcgcgcggggacagctaa

SEQ ID NO: 359660 - DNA, 20 bp, human
gtgtccccgcgcgacagagg

SEQ ID NO: 359661 - DNA, 20 bp, human
gcctcccggcgtgcatcgcg

SEQ ID NO: 359662 - DNA, 20 bp, human
gcccgccccatgtgtcccat

SEQ ID NO: 359663 - DNA, 20 bp, human
ggggcggggttcgtgagcaa

SEQ ID NO: 359664 - DNA, 20 bp, human
gggtccgcgcgatgcacgcc

SEQ ID NO: 359665 - DNA, 20 bp, human
gagcacggcgacgtgaaggc

SEQ ID NO: 359666 - DNA, 20 bp, human
gcgcgctaaggtgacgacgg

SEQ ID NO: 359667 - DNA, 20 bp, human
gcgcgccgacagcgagggaa

SEQ ID NO: 359668 - DNA, 20 bp, human
gaagcagaatgtggcgagtc

SEQ ID NO: 359669 - DNA, 20 bp, human
gtgagaccgagaagcgtggt

SEQ ID NO: 359670 - DNA, 20 bp, human
gaggaggctagacaaggcgg

SEQ ID NO: 359671 - DNA, 20 bp, human
gcggcgcgctaaggtgacga

SEQ ID NO: 359672 - DNA, 20 bp, human
ggtactacgaacatgcactc

SEQ ID NO: 359673 - DNA, 20 bp, human
gtgggtggagtcacgtcacg

SEQ ID NO: 359674 - DNA, 20 bp, human
gcctcgctgtcggcgcgcta

SEQ ID NO: 359675 - DNA, 20 bp, human
gtctgcttactcgctcgctc

SEQ ID NO: 359676 - DNA, 20 bp, human
ggggaaagcgcccagcgtcc

SEQ ID NO: 359677 - DNA, 20 bp, human
gagcagccctgcacgcgggg

SEQ ID NO: 359678 - DNA, 20 bp, human
gacgctgggcgctttcccgc

SEQ ID NO: 359679 - DNA, 20 bp, human
ggggcaccctgggacggctc

SEQ ID NO: 359680 - DNA, 20 bp, human
gctgcaccgccccgcgtgca

SEQ ID NO: 359681 - DNA, 20 bp, human
gtgcagagcgcgggatccca

SEQ ID NO: 359682 - DNA, 20 bp, human
gcgccagcagccctgcacgc

SEQ ID NO: 359683 - DNA, 20 bp, human
gagacggccttgcagagcgc

SEQ ID NO: 359684 - DNA, 20 bp, human
gctctgcaaggccgtctccc

SEQ ID NO: 359685 - DNA, 20 bp, human
gacggggcggggcgaacgcc

SEQ ID NO: 359686 - DNA, 20 bp, human
gggccccggagccaaggcga

SEQ ID NO: 359687 - DNA, 20 bp, human
gcctacgggcggcgacgctc

SEQ ID NO: 359688 - DNA, 20 bp, human
ggaaaccatcgagcgcgctg

SEQ ID NO: 359689 - DNA, 20 bp, human
ggccgcccgtaggcccggct

SEQ ID NO: 359690 - DNA, 20 bp, human
ggcccagccgggcctacggg

SEQ ID NO: 359691 - DNA, 20 bp, human
ggacgcgggagtgagcgctg

SEQ ID NO: 359692 - DNA, 20 bp, human
ggcggctgcggcatccaata

SEQ ID NO: 359693 - DNA, 20 bp, human
gtgaaacaggagcccgtcgg

SEQ ID NO: 359694 - DNA, 20 bp, human
gtgccctcgccttggctccg

SEQ ID NO: 359695 - DNA, 20 bp, human
gctggccccagcgcgctcga

SEQ ID NO: 359696 - DNA, 20 bp, human
ggggcagcgcgggatgtgac

SEQ ID NO: 359697 - DNA, 20 bp, human
ggccctgctagcaatctcta

SEQ ID NO: 359698 - DNA, 20 bp, human
ggtggcgctagggtctcctc

SEQ ID NO: 359699 - DNA, 20 bp, human
gcggaaatctgtcagtcgat

SEQ ID NO: 359700 - DNA, 20 bp, human
gtagacgcatggtggcgcta

SEQ ID NO: 359701 - DNA, 20 bp, human
gcagtctcaaccaaacctct

SEQ ID NO: 359702 - DNA, 20 bp, human
ggaggctggagtaggcggag

SEQ ID NO: 359703 - DNA, 20 bp, human
gattggctagagcagtagtg

SEQ ID NO: 359704 - DNA, 20 bp, human
gcctctgccaggcttgccgc

SEQ ID NO: 359705 - DNA, 20 bp, human
gtgtcagtcgattggacgct

SEQ ID NO: 359706 - DNA, 20 bp, human
gcagtcggggcgaaggaaac

SEQ ID NO: 359707 - DNA, 20 bp, human
gcgggcccggaggaacggga

SEQ ID NO: 359708 - DNA, 20 bp, human
gggatccgggcccggaggaa

SEQ ID NO: 359709 - DNA, 20 bp, human
gagcccggagcgtgggatcc

SEQ ID NO: 359710 - DNA, 20 bp, human
gcagctaaagcccggagcgt

SEQ ID NO: 359711 - DNA, 20 bp, human
gccactgagcatgcccggtg

SEQ ID NO: 359712 - DNA, 20 bp, human
ggggcccggatcccacgctc

SEQ ID NO: 359713 - DNA, 20 bp, human
gcacgagcccgcgggatcct

SEQ ID NO: 359714 - DNA, 20 bp, human
gggtgcgcggcccacgactc

SEQ ID NO: 359715 - DNA, 20 bp, human
gttcgccatcccgttcctcc

SEQ ID NO: 359716 - DNA, 20 bp, human
gcagcccacaatagtgcggt

SEQ ID NO: 359717 - DNA, 20 bp, human
gcccacccaccgcactattg

SEQ ID NO: 359718 - DNA, 20 bp, human
gtggctgcgcggagcgtcta

SEQ ID NO: 359719 - DNA, 20 bp, human
gcgaccccggtgccgtcata

SEQ ID NO: 359720 - DNA, 20 bp, human
gaggcagttgggaaggactc

SEQ ID NO: 359721 - DNA, 20 bp, human
ggcgcgatgccctcccccga

SEQ ID NO: 359722 - DNA, 20 bp, human
gcatagggccacgccctcgg

SEQ ID NO: 359723 - DNA, 20 bp, human
ggctggggattcaggggtct

SEQ ID NO: 359724 - DNA, 20 bp, human
gtcgctctgctggggattca

SEQ ID NO: 359725 - DNA, 20 bp, human
gagtgcggtgggtgggcatt

SEQ ID NO: 359726 - DNA, 20 bp, human
gacaggggaaggcccagtgc

SEQ ID NO: 359727 - DNA, 20 bp, human
gcctgtgaggggactccctc

SEQ ID NO: 359728 - DNA, 20 bp, human
gtgaccggggcccctcccca

SEQ ID NO: 359729 - DNA, 20 bp, human
ggcccctccccaaggaggtc

SEQ ID NO: 359730 - DNA, 20 bp, human
gccattagctggtgacgagg

SEQ ID NO: 359731 - DNA, 20 bp, human
gggagtcccctcacaggcag

SEQ ID NO: 359732 - DNA, 20 bp, human
gtgtccggggcagggatcct

SEQ ID NO: 359733 - DNA, 20 bp, human
gaacctgaggcttgttggct

SEQ ID NO: 359734 - DNA, 20 bp, human
gccccggtcacagatcccaa

SEQ ID NO: 359735 - DNA, 20 bp, human
gtgccgggttagggatcaga

SEQ ID NO: 359736 - DNA, 20 bp, human
ggggaagtgtagttcgttag

SEQ ID NO: 359737 - DNA, 20 bp, human
gggctcccgtcgtccatctc

SEQ ID NO: 359738 - DNA, 20 bp, human
gttcccagcaggcctcgcgt

SEQ ID NO: 359739 - DNA, 20 bp, human
gaggggcggtagttggttgt

SEQ ID NO: 359740 - DNA, 20 bp, human
gaaggccggattcctacgcg

SEQ ID NO: 359741 - DNA, 20 bp, human
ggaaggaagtcacatggaag

SEQ ID NO: 359742 - DNA, 20 bp, human
gagtgtagttcgttagtgga

SEQ ID NO: 359743 - DNA, 20 bp, human
gctcgggagactaggaaggc

SEQ ID NO: 359744 - DNA, 20 bp, human
gcaggcctcgcgtaggaatc

SEQ ID NO: 359745 - DNA, 20 bp, human
ggcaacccacggctgctgcg

SEQ ID NO: 359746 - DNA, 20 bp, human
ggacctccgggcggcgggag

SEQ ID NO: 359747 - DNA, 20 bp, human
gtggagccgcggagcacgac

SEQ ID NO: 359748 - DNA, 20 bp, human
gtgagcgcagtgccggagcg

SEQ ID NO: 359749 - DNA, 20 bp, human
ggctccaggcggagacgagg

SEQ ID NO: 359750 - DNA, 20 bp, human
gcgacgggagcgtagttcca

SEQ ID NO: 359751 - DNA, 20 bp, human
gcgctcacatgacctccggg

SEQ ID NO: 359752 - DNA, 20 bp, human
gcgtgctccgcggctccagg

SEQ ID NO: 359753 - DNA, 20 bp, human
gggtcatgtgagcgcagtgc

SEQ ID NO: 359754 - DNA, 20 bp, human
gaacccgggggatctttgga

SEQ ID NO: 359755 - DNA, 20 bp, human
gaaggactacaattgctagt

SEQ ID NO: 359756 - DNA, 20 bp, human
gggtgccaggctcccatctc

SEQ ID NO: 359757 - DNA, 20 bp, human
gctcctggaagatgccgggg

SEQ ID NO: 359758 - DNA, 20 bp, human
ggctcaggaggagcagcctt

SEQ ID NO: 359759 - DNA, 20 bp, human
ggacttccgctctgctccta

SEQ ID NO: 359760 - DNA, 20 bp, human
gcaaccacctgatccggccg

SEQ ID NO: 359761 - DNA, 20 bp, human
gaaggacgacccggccgccc

SEQ ID NO: 359762 - DNA, 20 bp, human
gaggctcctggcataggtat

SEQ ID NO: 359763 - DNA, 20 bp, human
gacagctcctggaagatgcc

SEQ ID NO: 359764 - DNA, 20 bp, human
gtcgtccttctcgcgagctc

SEQ ID NO: 359765 - DNA, 20 bp, human
gggcccgggaactagcacct

SEQ ID NO: 359766 - DNA, 20 bp, human
gctgccctcgcggtgcggga

SEQ ID NO: 359767 - DNA, 20 bp, human
gaaggggcgcccgcacgcaa

SEQ ID NO: 359768 - DNA, 20 bp, human
gtctgagcgccagttcgagg

SEQ ID NO: 359769 - DNA, 20 bp, human
gtcgccctcccgcaccgcga

SEQ ID NO: 359770 - DNA, 20 bp, human
gagggagtcggactcgggac

SEQ ID NO: 359771 - DNA, 20 bp, human
ggcctctgagcgccagttcg

SEQ ID NO: 359772 - DNA, 20 bp, human
gagaggcgccaccattcgga

SEQ ID NO: 359773 - DNA, 20 bp, human
gggcgagctgcgcgtggcct

SEQ ID NO: 359774 - DNA, 20 bp, human
ggggaccggccgagagtgtg

SEQ ID NO: 359775 - DNA, 20 bp, human
ggctcagaggcgccaccatt

SEQ ID NO: 359776 - DNA, 20 bp, human
gggtaccagtaattctgggg

SEQ ID NO: 359777 - DNA, 20 bp, human
gtacggtaccagtaattctg

SEQ ID NO: 359778 - DNA, 20 bp, human
gacagctgcgggtgtgtctg

SEQ ID NO: 359779 - DNA, 20 bp, human
ggggcccggccggaacctac

SEQ ID NO: 359780 - DNA, 20 bp, human
ggcaagtactctggaaacga

SEQ ID NO: 359781 - DNA, 20 bp, human
gcttgcctccccagaattac

SEQ ID NO: 359782 - DNA, 20 bp, human
gcacccgcagctgtgcccgt

SEQ ID NO: 359783 - DNA, 20 bp, human
gaccacctggaatcctagag

SEQ ID NO: 359784 - DNA, 20 bp, human
ggaacctacgggcacagctg

SEQ ID NO: 359785 - DNA, 20 bp, human
ggtgcccgtaggttccggcc

SEQ ID NO: 359786 - DNA, 20 bp, human
gcgaacgggagacgcgaatg

SEQ ID NO: 359787 - DNA, 20 bp, human
gccgctgggcgcacgtgcgg

SEQ ID NO: 359788 - DNA, 20 bp, human
gccctctggtggacaccgga

SEQ ID NO: 359789 - DNA, 20 bp, human
gggagcgtgaagccgggtta

SEQ ID NO: 359790 - DNA, 20 bp, human
gacgccgctgggcgcacgtg

SEQ ID NO: 359791 - DNA, 20 bp, human
ggcgtctcccgttcgccctc

SEQ ID NO: 359792 - DNA, 20 bp, human
gtggacaccggagggaagta

SEQ ID NO: 359793 - DNA, 20 bp, human
gtgggcccaccggctctcat

SEQ ID NO: 359794 - DNA, 20 bp, human
gcgcacgtgcggagggcggc

SEQ ID NO: 359795 - DNA, 20 bp, human
gcaccggagggaagtatgga

SEQ ID NO: 359796 - DNA, 20 bp, human
gacgcccgttcgcgccgttg

SEQ ID NO: 359797 - DNA, 20 bp, human
gggcagcggctgagatcacg

SEQ ID NO: 359798 - DNA, 20 bp, human
gggcgccccaacggcgcgaa

SEQ ID NO: 359799 - DNA, 20 bp, human
gggaaaggggcgtgacgggg

SEQ ID NO: 359800 - DNA, 20 bp, human
gtcccgcctgggcgccccaa

SEQ ID NO: 359801 - DNA, 20 bp, human
gctaggaaaagaaacagctt

SEQ ID NO: 359802 - DNA, 20 bp, human
gggcggtgtaagcttaacct

SEQ ID NO: 359803 - DNA, 20 bp, human
gcctgtgtggccaaaagcgg

SEQ ID NO: 359804 - DNA, 20 bp, human
gcagatcttgcagccgggag

SEQ ID NO: 359805 - DNA, 20 bp, human
gaccctcacacctcccgcct

SEQ ID NO: 359806 - DNA, 20 bp, human
gggcccaagaagtgacgagg

SEQ ID NO: 359807 - DNA, 20 bp, human
gcggggcccaagaagtgacg

SEQ ID NO: 359808 - DNA, 20 bp, human
ggagggaggcttgcgagcga

SEQ ID NO: 359809 - DNA, 20 bp, human
gggaggcttgcgagcgaggg

SEQ ID NO: 359810 - DNA, 20 bp, human
gtccctcctcgtcacttctt

SEQ ID NO: 359811 - DNA, 20 bp, human
ggggcggcggcagacctcgc

SEQ ID NO: 359812 - DNA, 20 bp, human
gggagcccgggttcgaggct

SEQ ID NO: 359813 - DNA, 20 bp, human
ggccctcgacatcataagat

SEQ ID NO: 359814 - DNA, 20 bp, human
gagacctcgcggggccccag

SEQ ID NO: 359815 - DNA, 20 bp, human
gcgctgcggccgcaatgggg

SEQ ID NO: 359816 - DNA, 20 bp, human
gccagcgggcgttcccacac

SEQ ID NO: 359817 - DNA, 20 bp, human
gtgcggaggcttctgcaatg

SEQ ID NO: 359818 - DNA, 20 bp, human
gcgcggtcggccttggcctt

SEQ ID NO: 359819 - DNA, 20 bp, human
gttgagcaggacctttagac

SEQ ID NO: 359820 - DNA, 20 bp, human
gccacgattggccgcaggag

SEQ ID NO: 359821 - DNA, 20 bp, human
gtggcattacagccccgtgt

SEQ ID NO: 359822 - DNA, 20 bp, human
gaggcttctgcaatggggtc

SEQ ID NO: 359823 - DNA, 20 bp, human
ggaatacggcccccctcctg

SEQ ID NO: 359824 - DNA, 20 bp, human
ggcgctgctctgggcccagc

SEQ ID NO: 359825 - DNA, 20 bp, human
gagagcagcgcggtcggcct

SEQ ID NO: 359826 - DNA, 20 bp, human
ggggcggggcgctgatcgga

SEQ ID NO: 359827 - DNA, 20 bp, human
ggggcagcggcagcatggcg

SEQ ID NO: 359828 - DNA, 20 bp, human
gggcgctgatcggacgggca

SEQ ID NO: 359829 - DNA, 20 bp, human
ggacggggcggggcgctgat

SEQ ID NO: 359830 - DNA, 20 bp, human
gaacggaagcgaggccgtgg

SEQ ID NO: 359831 - DNA, 20 bp, human
gcatgctgccgctgccccca

SEQ ID NO: 359832 - DNA, 20 bp, human
gaggaggggagacataggtg

SEQ ID NO: 359833 - DNA, 20 bp, human
gagcatggcggggcttgtct

SEQ ID NO: 359834 - DNA, 20 bp, human
gtgatcggacgggcaggggg

SEQ ID NO: 359835 - DNA, 20 bp, human
gcggggcctgagcgggcccg

SEQ ID NO: 359836 - DNA, 20 bp, human
ggtcatgtgccctgcggcgg

SEQ ID NO: 359837 - DNA, 20 bp, human
ggccgcagggcacatgactg

SEQ ID NO: 359838 - DNA, 20 bp, human
gcaggcgccgcagccactca

SEQ ID NO: 359839 - DNA, 20 bp, human
gacgcgctggggattcaagg

SEQ ID NO: 359840 - DNA, 20 bp, human
gaggccctcagacctatctg

SEQ ID NO: 359841 - DNA, 20 bp, human
ggccgcagtcatgtgccctg

SEQ ID NO: 359842 - DNA, 20 bp, human
ggccctccccggccggtccc

SEQ ID NO: 359843 - DNA, 20 bp, human
gccagcgcgtggcccatggg

SEQ ID NO: 359844 - DNA, 20 bp, human
gcgcagggacgtgacgttcg

SEQ ID NO: 359845 - DNA, 20 bp, human
gaccggggaccggccgggga

SEQ ID NO: 359846 - DNA, 20 bp, human
gaggcaatggcagggctgac

SEQ ID NO: 359847 - DNA, 20 bp, human
gaatgaagttgcaggtccct

SEQ ID NO: 359848 - DNA, 20 bp, human
gcaggctgaggggtcctcgc

SEQ ID NO: 359849 - DNA, 20 bp, human
gggaggggcgggctgccacg

SEQ ID NO: 359850 - DNA, 20 bp, human
gtgaggaaaccaggccggag

SEQ ID NO: 359851 - DNA, 20 bp, human
gaggccacactcccaaagca

SEQ ID NO: 359852 - DNA, 20 bp, human
gaggccttgctttgggagtg

SEQ ID NO: 359853 - DNA, 20 bp, human
ggctgactgcctagctccca

SEQ ID NO: 359854 - DNA, 20 bp, human
gggagccacggctttccatc

SEQ ID NO: 359855 - DNA, 20 bp, human
ggttgcaggtccctgggtgc

SEQ ID NO: 359856 - DNA, 20 bp, human
gtggccgctcgcaaacttgg

SEQ ID NO: 359857 - DNA, 20 bp, human
gagcggccaaatgggggcgg

SEQ ID NO: 359858 - DNA, 20 bp, human
gcgggcaggaaattccacat

SEQ ID NO: 359859 - DNA, 20 bp, human
gtcggtagatgtctagggag

SEQ ID NO: 359860 - DNA, 20 bp, human
gcgcggctggcccgggatca

SEQ ID NO: 359861 - DNA, 20 bp, human
gctgcttcggtagatgtcta

SEQ ID NO: 359862 - DNA, 20 bp, human
gtagatgtctagggagcgga

SEQ ID NO: 359863 - DNA, 20 bp, human
gctgccccgcgcctcatgga

SEQ ID NO: 359864 - DNA, 20 bp, human
gagggtggggtctggagcgc

SEQ ID NO: 359865 - DNA, 20 bp, human
gggaggggcggtggctaggc

SEQ ID NO: 359866 - DNA, 20 bp, human
ggcggcgcgcgcggggtgaa

SEQ ID NO: 359867 - DNA, 20 bp, human
gctcccgcgcgaggcggcgt

SEQ ID NO: 359868 - DNA, 20 bp, human
gggtgagcggcttgcttggg

SEQ ID NO: 359869 - DNA, 20 bp, human
ggggtcgctgcctgaggcgc

SEQ ID NO: 359870 - DNA, 20 bp, human
gcgcgaggcggcgtgggcgt

SEQ ID NO: 359871 - DNA, 20 bp, human
ggcgggtgagcggcttgctt

SEQ ID NO: 359872 - DNA, 20 bp, human
gggcccctaattccgtgcgg

SEQ ID NO: 359873 - DNA, 20 bp, human
gccagtacccggcgcagcaa

SEQ ID NO: 359874 - DNA, 20 bp, human
gtccgacgggaggtttccta

SEQ ID NO: 359875 - DNA, 20 bp, human
gggttgtccttgttgcacgt

SEQ ID NO: 359876 - DNA, 20 bp, human
gtgcgccgagccaatggcaa

SEQ ID NO: 359877 - DNA, 20 bp, human
ggtaaactccggctcgtcat

SEQ ID NO: 359878 - DNA, 20 bp, human
ggggcacacggagaacgggt

SEQ ID NO: 359879 - DNA, 20 bp, human
gcaatggcaacggcaggacg

SEQ ID NO: 359880 - DNA, 20 bp, human
gccctcgggcacacggagaa

SEQ ID NO: 359881 - DNA, 20 bp, human
gcccccaagctccagatcct

SEQ ID NO: 359882 - DNA, 20 bp, human
ggggctggggacccggtttg

SEQ ID NO: 359883 - DNA, 20 bp, human
ggtgcccgagggccggtcct

SEQ ID NO: 359884 - DNA, 20 bp, human
ggggcagagccattgttcgc

SEQ ID NO: 359885 - DNA, 20 bp, human
gtctgcccggcatcccgcgt

SEQ ID NO: 359886 - DNA, 20 bp, human
ggggtggaaggtggctcccg

SEQ ID NO: 359887 - DNA, 20 bp, human
gccaatcaggagcgcccgtg

SEQ ID NO: 359888 - DNA, 20 bp, human
ggctggagggagcgctccga

SEQ ID NO: 359889 - DNA, 20 bp, human
gcggccccgaaaagccgaaa

SEQ ID NO: 359890 - DNA, 20 bp, human
gtggctgcccgggctgaact

SEQ ID NO: 359891 - DNA, 20 bp, human
gcccagcgggctccccagtt

SEQ ID NO: 359892 - DNA, 20 bp, human
gcggggccggcgacgctgga

SEQ ID NO: 359893 - DNA, 20 bp, human
gggaggaggagctgtgaaaa

SEQ ID NO: 359894 - DNA, 20 bp, human
gtgtgaaaatggaacggggc

SEQ ID NO: 359895 - DNA, 20 bp, human
gggagcgctccgaaggagcg

SEQ ID NO: 359896 - DNA, 20 bp, human
ggaggtgtgtggtatgcaac

SEQ ID NO: 359897 - DNA, 20 bp, human
ggcggctgagtcactcaggg

SEQ ID NO: 359898 - DNA, 20 bp, human
gtcagcggctgagtcactca

SEQ ID NO: 359899 - DNA, 20 bp, human
gcacaaccatatcactgaca

SEQ ID NO: 359900 - DNA, 20 bp, human
gtacacccatagtacctgga

SEQ ID NO: 359901 - DNA, 20 bp, human
gaggtactatgggtgtatgg

SEQ ID NO: 359902 - DNA, 20 bp, human
gcagttaaaagggtgatcac

SEQ ID NO: 359903 - DNA, 20 bp, human
gtcagaggtttcttgctcag

SEQ ID NO: 359904 - DNA, 20 bp, human
gagtctaggtgtagaatgtg

SEQ ID NO: 359905 - DNA, 20 bp, human
gctgttgatatcagttaaaa

SEQ ID NO: 359906 - DNA, 20 bp, human
ggaactgggagacccggtgc

SEQ ID NO: 359907 - DNA, 20 bp, human
gccggtgcaggttaattcag

SEQ ID NO: 359908 - DNA, 20 bp, human
gaaagggtgtgcctgagttc

SEQ ID NO: 359909 - DNA, 20 bp, human
gccggaagcaaagcccggaa

SEQ ID NO: 359910 - DNA, 20 bp, human
gccaggaagacctccactct

SEQ ID NO: 359911 - DNA, 20 bp, human
gctccactctcggtagaact

SEQ ID NO: 359912 - DNA, 20 bp, human
ggaggtggggtccggaactc

SEQ ID NO: 359913 - DNA, 20 bp, human
gcccggaagggcggggccaa

SEQ ID NO: 359914 - DNA, 20 bp, human
ggcggagcggggggatgacg

SEQ ID NO: 359915 - DNA, 20 bp, human
ggtggctgcccttaccgccc

SEQ ID NO: 359916 - DNA, 20 bp, human
ggcgcggtcgggaaagaagt

SEQ ID NO: 359917 - DNA, 20 bp, human
gcggtgattggctagagagg

SEQ ID NO: 359918 - DNA, 20 bp, human
gtgaggaaggatggcgcggt

SEQ ID NO: 359919 - DNA, 20 bp, human
gggagtgaggaaggatggcg

SEQ ID NO: 359920 - DNA, 20 bp, human
gccatcagggagcgtgtcag

SEQ ID NO: 359921 - DNA, 20 bp, human
gaggccgaccacgtgtactg

SEQ ID NO: 359922 - DNA, 20 bp, human
ggagcggtgattggctagag

SEQ ID NO: 359923 - DNA, 20 bp, human
gtcaaaagctcgtggagatc

SEQ ID NO: 359924 - DNA, 20 bp, human
gtctccacagtacacgtggt

SEQ ID NO: 359925 - DNA, 20 bp, human
gtcatcaccgagcgccatca

SEQ ID NO: 359926 - DNA, 20 bp, human
ggaacccggtgacgtcagtg

SEQ ID NO: 359927 - DNA, 20 bp, human
gagtgcggagtcaggcgcag

SEQ ID NO: 359928 - DNA, 20 bp, human
gaaaaacctcgcttgtgctg

SEQ ID NO: 359929 - DNA, 20 bp, human
gctgccacactgacgtcacc

SEQ ID NO: 359930 - DNA, 20 bp, human
gagtgtggcagtgcggagtc

SEQ ID NO: 359931 - DNA, 20 bp, human
gacaaaccccagcacaagcg

SEQ ID NO: 359932 - DNA, 20 bp, human
gtacgccacctgtctttttg

SEQ ID NO: 359933 - DNA, 20 bp, human
gtttgccacaaaaagacagg

SEQ ID NO: 359934 - DNA, 20 bp, human
gacttgttataatagtttct

SEQ ID NO: 359935 - DNA, 20 bp, human
gagcggctccctataagcag

SEQ ID NO: 359936 - DNA, 20 bp, human
gcccgggaatggaacaaagg

SEQ ID NO: 359937 - DNA, 20 bp, human
gggaacaaaggaggggcgac

SEQ ID NO: 359938 - DNA, 20 bp, human
ggcagtcctagggtgctcct

SEQ ID NO: 359939 - DNA, 20 bp, human
gctccatgcacgccagaggc

SEQ ID NO: 359940 - DNA, 20 bp, human
gtgcacgccagaggcgggag

SEQ ID NO: 359941 - DNA, 20 bp, human
gtcccccgggaatggaacaa

SEQ ID NO: 359942 - DNA, 20 bp, human
gcgagagtaaagctacgccc

SEQ ID NO: 359943 - DNA, 20 bp, human
ggccagctgaccctgagccc

SEQ ID NO: 359944 - DNA, 20 bp, human
gccctcctttgttccattcc

SEQ ID NO: 359945 - DNA, 20 bp, human
gcaagtaaatgttacttcaa

SEQ ID NO: 359946 - DNA, 20 bp, human
gttatctgggatgcagtctg

SEQ ID NO: 359947 - DNA, 20 bp, human
gccggggcggagctaagatg

SEQ ID NO: 359948 - DNA, 20 bp, human
gggtgagaggcacacttatc

SEQ ID NO: 359949 - DNA, 20 bp, human
gcggagctaagatgcggagg

SEQ ID NO: 359950 - DNA, 20 bp, human
ggaggtcgatggagctgaag

SEQ ID NO: 359951 - DNA, 20 bp, human
gggagctgaagagggtctct

SEQ ID NO: 359952 - DNA, 20 bp, human
gagtctggggagtcctggcg

SEQ ID NO: 359953 - DNA, 20 bp, human
gaggaggtgaatgacttaca

SEQ ID NO: 359954 - DNA, 20 bp, human
gaggtttgtatgcagaatgt

SEQ ID NO: 359955 - DNA, 20 bp, human
gaagcctttcagcttcaaga

SEQ ID NO: 359956 - DNA, 20 bp, human
ggcagcacccagatggggaa

SEQ ID NO: 359957 - DNA, 20 bp, human
gtgtgtgagctcagtttcag

SEQ ID NO: 359958 - DNA, 20 bp, human
gcacacaatgggccacttgg

SEQ ID NO: 359959 - DNA, 20 bp, human
gtgaagggaacccaagtcag

SEQ ID NO: 359960 - DNA, 20 bp, human
gtttcagtggggacagaaac

SEQ ID NO: 359961 - DNA, 20 bp, human
gagggccgagccctgcctgg

SEQ ID NO: 359962 - DNA, 20 bp, human
gtacttggcattggcttggt

SEQ ID NO: 359963 - DNA, 20 bp, human
ggaacccaagtcagaggatg

SEQ ID NO: 359964 - DNA, 20 bp, human
gcagaaactgggttgagaaa

SEQ ID NO: 359965 - DNA, 20 bp, human
gtgcactatttacttggcat

SEQ ID NO: 359966 - DNA, 20 bp, human
gggagtggctgtgtgacagg

SEQ ID NO: 359967 - DNA, 20 bp, human
gtggctgtgtgacaggtggt

SEQ ID NO: 359968 - DNA, 20 bp, human
gagaggccatgccaactgat

SEQ ID NO: 359969 - DNA, 20 bp, human
ggggtggccgagtaggggaa

SEQ ID NO: 359970 - DNA, 20 bp, human
gctggctgccgggtcctaat

SEQ ID NO: 359971 - DNA, 20 bp, human
ggccgagagtggtgggatct

SEQ ID NO: 359972 - DNA, 20 bp, human
gcatggagtggctgtgtgac

SEQ ID NO: 359973 - DNA, 20 bp, human
ggatcggtgaagaaggcagt

SEQ ID NO: 359974 - DNA, 20 bp, human
gccggcagccagcttagatg

SEQ ID NO: 359975 - DNA, 20 bp, human
gtggttggcaagcggcttta

SEQ ID NO: 359976 - DNA, 20 bp, human
gccgccccactcaggatgca

SEQ ID NO: 359977 - DNA, 20 bp, human
gcacctgccagatgcccatg

SEQ ID NO: 359978 - DNA, 20 bp, human
gagtggggcggagcacggga

SEQ ID NO: 359979 - DNA, 20 bp, human
gccccactcaggatgcaggg

SEQ ID NO: 359980 - DNA, 20 bp, human
ggggatgtgacactgatgga

SEQ ID NO: 359981 - DNA, 20 bp, human
gacctccctgcatcctgagt

SEQ ID NO: 359982 - DNA, 20 bp, human
gtcaggaggacagaaaccgg

SEQ ID NO: 359983 - DNA, 20 bp, human
gtgcctctggcaatgttccc

SEQ ID NO: 359984 - DNA, 20 bp, human
gtgtggagccgtggagccca

SEQ ID NO: 359985 - DNA, 20 bp, human
gcagccctcccttcctagcc

SEQ ID NO: 359986 - DNA, 20 bp, human
gcctccctgcactctgactg

SEQ ID NO: 359987 - DNA, 20 bp, human
gtcagagtgcagggaggcgt

SEQ ID NO: 359988 - DNA, 20 bp, human
gcacaggagggtagccctgc

SEQ ID NO: 359989 - DNA, 20 bp, human
gagtgcagggaggcgtgggg

SEQ ID NO: 359990 - DNA, 20 bp, human
gtgtacctagggagtctagc

SEQ ID NO: 359991 - DNA, 20 bp, human
gtggtactggtcatgaggcc

SEQ ID NO: 359992 - DNA, 20 bp, human
gagatggatggcaacagccc

SEQ ID NO: 359993 - DNA, 20 bp, human
gctagctggtactggtcatg

SEQ ID NO: 359994 - DNA, 20 bp, human
gcagtgaacatggtggtgat

SEQ ID NO: 359995 - DNA, 20 bp, human
gtagggagtctagctggtac

SEQ ID NO: 359996 - DNA, 20 bp, human
gcctaaggaggtgacattga

SEQ ID NO: 359997 - DNA, 20 bp, human
gaggaatctctgcatctgag

SEQ ID NO: 359998 - DNA, 20 bp, human
gtctctgcatctgagtgggg

SEQ ID NO: 359999 - DNA, 20 bp, human
gcaggggcacaggtgaatta

SEQ ID NO: 360000 - DNA, 20 bp, human
gtgtagcagtgcaggggcac

SEQ ID NO: 360001 - DNA, 20 bp, human
ggggcacctggtaggtcatg

SEQ ID NO: 360002 - DNA, 20 bp, human
gacctaccaggtgccccggt

SEQ ID NO: 360003 - DNA, 20 bp, human
gtggctggtcctacctaccg

SEQ ID NO: 360004 - DNA, 20 bp, human
ggaaggctgtgttctcttta

SEQ ID NO: 360005 - DNA, 20 bp, human
ggtgagtgttcaggtacatc

SEQ ID NO: 360006 - DNA, 20 bp, human
gttggatccctgacaatctg

SEQ ID NO: 360007 - DNA, 20 bp, human
gaggaaggtctgcctcccat

SEQ ID NO: 360008 - DNA, 20 bp, human
gcacaatagtgtacaccaat

SEQ ID NO: 360009 - DNA, 20 bp, human
gaggctggctgtgttcccat

SEQ ID NO: 360010 - DNA, 20 bp, human
ggaagaataacgagaagagg

SEQ ID NO: 360011 - DNA, 20 bp, human
gggtgtacactattgtgtcc

SEQ ID NO: 360012 - DNA, 20 bp, human
gacctgcatcttcctatggg

SEQ ID NO: 360013 - DNA, 20 bp, human
ggggactaaggtgcctccct

SEQ ID NO: 360014 - DNA, 20 bp, human
gaatacctgcatcttcctat

SEQ ID NO: 360015 - DNA, 20 bp, human
gtcattcctgggagggacta

SEQ ID NO: 360016 - DNA, 20 bp, human
gtggcatgggaccagtaaac

SEQ ID NO: 360017 - DNA, 20 bp, human
gataagctggcacagataca

SEQ ID NO: 360018 - DNA, 20 bp, human
ggcccactgctgggataagc

SEQ ID NO: 360019 - DNA, 20 bp, human
ggctcccaagagtaggtgtg

SEQ ID NO: 360020 - DNA, 20 bp, human
gaaagcctgctcccaagagt

SEQ ID NO: 360021 - DNA, 20 bp, human
gatacctcacacctactctt

SEQ ID NO: 360022 - DNA, 20 bp, human
gtgccagcttatcccagcag

SEQ ID NO: 360023 - DNA, 20 bp, human
ggctggctgtgtttcccctg

SEQ ID NO: 360024 - DNA, 20 bp, human
gtgcacctaggcccactgct

SEQ ID NO: 360025 - DNA, 20 bp, human
ggcaggaagattctacatac

SEQ ID NO: 360026 - DNA, 20 bp, human
ggaaacgctcatcagtgcca

SEQ ID NO: 360027 - DNA, 20 bp, human
gccagctttttgaaccatac

SEQ ID NO: 360028 - DNA, 20 bp, human
ggtgggcaatttcaatttct

SEQ ID NO: 360029 - DNA, 20 bp, human
gtaattagcatataaccgag

SEQ ID NO: 360030 - DNA, 20 bp, human
gattgttagagcagcagctt

SEQ ID NO: 360031 - DNA, 20 bp, human
gtaacttctgaaccttacca

SEQ ID NO: 360032 - DNA, 20 bp, human
gttcaatttctcggagctga

SEQ ID NO: 360033 - DNA, 20 bp, human
gaacttttctgtatagctga

SEQ ID NO: 360034 - DNA, 20 bp, human
gagcttgggctgctggacta

SEQ ID NO: 360035 - DNA, 20 bp, human
gaaattgcccacctctttcc

SEQ ID NO: 360036 - DNA, 20 bp, human
ggggcctgcctgctctcaga

SEQ ID NO: 360037 - DNA, 20 bp, human
ggggtcagaccgcaaagcga

SEQ ID NO: 360038 - DNA, 20 bp, human
gagcctcgacgccagtggat

SEQ ID NO: 360039 - DNA, 20 bp, human
gagtcctcgaggcccgggca

SEQ ID NO: 360040 - DNA, 20 bp, human
gagtgaggcctgatcgtccc

SEQ ID NO: 360041 - DNA, 20 bp, human
gcccgacgttgccacggtct

SEQ ID NO: 360042 - DNA, 20 bp, human
gtgccacggtctgggatcag

SEQ ID NO: 360043 - DNA, 20 bp, human
gagaccgcaaagcgaaggtg

SEQ ID NO: 360044 - DNA, 20 bp, human
ggggagcttccctcgcgcca

SEQ ID NO: 360045 - DNA, 20 bp, human
gtccgctcacggccgtgccc

SEQ ID NO: 360046 - DNA, 20 bp, human
gtggggtgagtcaagtggta

SEQ ID NO: 360047 - DNA, 20 bp, human
gacactggaaaaggtaacag

SEQ ID NO: 360048 - DNA, 20 bp, human
ggtggtagggactagaattc

SEQ ID NO: 360049 - DNA, 20 bp, human
gtccaggagaaggattcgtt

SEQ ID NO: 360050 - DNA, 20 bp, human
ggtttctcatgggaacacac

SEQ ID NO: 360051 - DNA, 20 bp, human
gtagaaggagtgttttcctc

SEQ ID NO: 360052 - DNA, 20 bp, human
ggcccaacgaatccttctcc

SEQ ID NO: 360053 - DNA, 20 bp, human
gtgcttttatttctgtgcaa

SEQ ID NO: 360054 - DNA, 20 bp, human
gtgtagagctttgtttctca

SEQ ID NO: 360055 - DNA, 20 bp, human
gaccatagtagatgtgtgag

SEQ ID NO: 360056 - DNA, 20 bp, human
gaactgtctccaggcgtcca

SEQ ID NO: 360057 - DNA, 20 bp, human
gtgtctcaaggggttttcta

SEQ ID NO: 360058 - DNA, 20 bp, human
ggggcaaaagcagtgagccg

SEQ ID NO: 360059 - DNA, 20 bp, human
gcagccgctggttttgctga

SEQ ID NO: 360060 - DNA, 20 bp, human
gaaagtgagtcaaacgtaag

SEQ ID NO: 360061 - DNA, 20 bp, human
ggtctgagaagcaagttaaa

SEQ ID NO: 360062 - DNA, 20 bp, human
gtctgccaggacagcgcgca

SEQ ID NO: 360063 - DNA, 20 bp, human
gcctgtctgtctctgcgctt

SEQ ID NO: 360064 - DNA, 20 bp, human
gtgcaagaagtgtcagtgtt

SEQ ID NO: 360065 - DNA, 20 bp, human
gaccccttgagacacaagtt

SEQ ID NO: 360066 - DNA, 20 bp, human
gtgggtaggaaggatgatgc

SEQ ID NO: 360067 - DNA, 20 bp, human
gaaaaggatcagtctggagc

SEQ ID NO: 360068 - DNA, 20 bp, human
gaaaaaggccagcgagggag

SEQ ID NO: 360069 - DNA, 20 bp, human
ggcagccttagtgggtagga

SEQ ID NO: 360070 - DNA, 20 bp, human
gaccagccaagcagccttag

SEQ ID NO: 360071 - DNA, 20 bp, human
gtgaaggcagttaactgatg

SEQ ID NO: 360072 - DNA, 20 bp, human
gaccttctggtgctttatga

SEQ ID NO: 360073 - DNA, 20 bp, human
gccaagcagccttagtgggt

SEQ ID NO: 360074 - DNA, 20 bp, human
gacgagaaaaaggccagcga

SEQ ID NO: 360075 - DNA, 20 bp, human
gtcatccttcctacccacta

SEQ ID NO: 360076 - DNA, 20 bp, human
gaggccttgcgggagcgaca

SEQ ID NO: 360077 - DNA, 20 bp, human
gcggggcagtgagaagattc

SEQ ID NO: 360078 - DNA, 20 bp, human
gccacaccatgagggtcctc

SEQ ID NO: 360079 - DNA, 20 bp, human
gctcccgcaaggcctaccag

SEQ ID NO: 360080 - DNA, 20 bp, human
gctggcttctggacagccgt

SEQ ID NO: 360081 - DNA, 20 bp, human
ggcctaccagaggaccctca

SEQ ID NO: 360082 - DNA, 20 bp, human
gcagggaagctcatgaccca

SEQ ID NO: 360083 - DNA, 20 bp, human
gaccctcatggtgtggtagg

SEQ ID NO: 360084 - DNA, 20 bp, human
ggccagggtctctgccccgt

SEQ ID NO: 360085 - DNA, 20 bp, human
gggtcctctggtaggccttg

SEQ ID NO: 360086 - DNA, 20 bp, human
gcccaggcgcgagttgacag

SEQ ID NO: 360087 - DNA, 20 bp, human
gccagcgctgcgctccccgt

SEQ ID NO: 360088 - DNA, 20 bp, human
gcggcgccctgaaacgggag

SEQ ID NO: 360089 - DNA, 20 bp, human
gctggcctggggcaaggcgt

SEQ ID NO: 360090 - DNA, 20 bp, human
ggggacgccgattccgctcc

SEQ ID NO: 360091 - DNA, 20 bp, human
gggaggcggcgccctgaaac

SEQ ID NO: 360092 - DNA, 20 bp, human
gcccaggccaggagcggaat

SEQ ID NO: 360093 - DNA, 20 bp, human
ggagacgatcgcttcccacg

SEQ ID NO: 360094 - DNA, 20 bp, human
ggatggcaaacactataaag

SEQ ID NO: 360095 - DNA, 20 bp, human
gtatgcaggacggtagtgat

SEQ ID NO: 360096 - DNA, 20 bp, human
gtggctggctgtcaagcaat

SEQ ID NO: 360097 - DNA, 20 bp, human
gaggactctaggacgcgcga

SEQ ID NO: 360098 - DNA, 20 bp, human
gtagagtcctagcacgctat

SEQ ID NO: 360099 - DNA, 20 bp, human
gggtgccccggaccactcct

SEQ ID NO: 360100 - DNA, 20 bp, human
ggaccactccttggagacgg

SEQ ID NO: 360101 - DNA, 20 bp, human
gagaggcgccaccgtctcca

SEQ ID NO: 360102 - DNA, 20 bp, human
ggcccgcgtgatgacgcaag

SEQ ID NO: 360103 - DNA, 20 bp, human
ggcgcggcggccaaactggt

SEQ ID NO: 360104 - DNA, 20 bp, human
ggtctccaaggagtggtccg

SEQ ID NO: 360105 - DNA, 20 bp, human
gcgccctgcgactttgaaac

SEQ ID NO: 360106 - DNA, 20 bp, human
ggccctgccgcagacagcaa

SEQ ID NO: 360107 - DNA, 20 bp, human
gcgcccgggcgcgtccggat

SEQ ID NO: 360108 - DNA, 20 bp, human
ggctcggcggccctctgaag

SEQ ID NO: 360109 - DNA, 20 bp, human
gtccgccggcccaggagacg

SEQ ID NO: 360110 - DNA, 20 bp, human
ggctgcgctgggtcaggtga

SEQ ID NO: 360111 - DNA, 20 bp, human
gtgaaagtgcggggatccgc

SEQ ID NO: 360112 - DNA, 20 bp, human
ggcagacagcaaaggtcacg

SEQ ID NO: 360113 - DNA, 20 bp, human
gaggcggggccgcgacgccc

SEQ ID NO: 360114 - DNA, 20 bp, human
gcccgcactttcacttccgg

SEQ ID NO: 360115 - DNA, 20 bp, human
ggctagaagccgcgtctcct

SEQ ID NO: 360116 - DNA, 20 bp, human
ggatggaaggtgaaattctg

SEQ ID NO: 360117 - DNA, 20 bp, human
gagcttcatagttttaggca

SEQ ID NO: 360118 - DNA, 20 bp, human
gagtctgcatcccaatatca

SEQ ID NO: 360119 - DNA, 20 bp, human
gctccagtctatcactgcag

SEQ ID NO: 360120 - DNA, 20 bp, human
gaaacctagattctgagtat

SEQ ID NO: 360121 - DNA, 20 bp, human
gaactatagaaaacccagag

SEQ ID NO: 360122 - DNA, 20 bp, human
gctatagtttgtataagttt

SEQ ID NO: 360123 - DNA, 20 bp, human
ggacaaacataccaacatga

SEQ ID NO: 360124 - DNA, 20 bp, human
gttgcagtttacagaggtat

SEQ ID NO: 360125 - DNA, 20 bp, human
gttcccccttaccttgatat

SEQ ID NO: 360126 - DNA, 20 bp, human
gtctgcggtactgcggagtg

SEQ ID NO: 360127 - DNA, 20 bp, human
gacagttgagcccataactg

SEQ ID NO: 360128 - DNA, 20 bp, human
gggaccttagcatgaagttt

SEQ ID NO: 360129 - DNA, 20 bp, human
gcaaacagcaccccagttat

SEQ ID NO: 360130 - DNA, 20 bp, human
gcttccgagattctatgcta

SEQ ID NO: 360131 - DNA, 20 bp, human
gcctccaaaacttcatgcta

SEQ ID NO: 360132 - DNA, 20 bp, human
gattaaatacttttccaatt

SEQ ID NO: 360133 - DNA, 20 bp, human
gggttttatgtaaaaagcct

SEQ ID NO: 360134 - DNA, 20 bp, human
gtgttattaggtaaaatatg

SEQ ID NO: 360135 - DNA, 20 bp, human
ggggataaaaattatattca

SEQ ID NO: 360136 - DNA, 20 bp, human
gcgggtgctctcccagtcct

SEQ ID NO: 360137 - DNA, 20 bp, human
gccgccctcacccaaggact

SEQ ID NO: 360138 - DNA, 20 bp, human
ggacaggcgtcaccgttgat

SEQ ID NO: 360139 - DNA, 20 bp, human
gtgagggcgggaatttgcta

SEQ ID NO: 360140 - DNA, 20 bp, human
gtgggagagcacccgcggat

SEQ ID NO: 360141 - DNA, 20 bp, human
gctctcccagtccttgggtg

SEQ ID NO: 360142 - DNA, 20 bp, human
ggggcggggcctcttacctc

SEQ ID NO: 360143 - DNA, 20 bp, human
gcaacggtgacgcctgtcag

SEQ ID NO: 360144 - DNA, 20 bp, human
gcggacaccccaacaacgaa

SEQ ID NO: 360145 - DNA, 20 bp, human
gccgcggattggccgatcaa

SEQ ID NO: 360146 - DNA, 20 bp, human
ggaacccggggtcccatcga

SEQ ID NO: 360147 - DNA, 20 bp, human
gggtccgccactgcctgcgg

SEQ ID NO: 360148 - DNA, 20 bp, human
gcccacggcctcgggtgctt

SEQ ID NO: 360149 - DNA, 20 bp, human
ggcgccaccgcaggcagtgg

SEQ ID NO: 360150 - DNA, 20 bp, human
ggtaggaggcaaagtgccaa

SEQ ID NO: 360151 - DNA, 20 bp, human
gtcaagccgagcgccaccgc

SEQ ID NO: 360152 - DNA, 20 bp, human
ggcacgcggcggcggtcaaa

SEQ ID NO: 360153 - DNA, 20 bp, human
gccgtggggagcccctcgat

SEQ ID NO: 360154 - DNA, 20 bp, human
gcgtgctcgcggcaaccgca

SEQ ID NO: 360155 - DNA, 20 bp, human
gtgaaggggagcgagttccc

SEQ ID NO: 360156 - DNA, 20 bp, human
gtacactgcacatttctctt

SEQ ID NO: 360157 - DNA, 20 bp, human
gcggaaaaccagccaaccac

SEQ ID NO: 360158 - DNA, 20 bp, human
gtggttttccggacatgatg

SEQ ID NO: 360159 - DNA, 20 bp, human
gcccaatcctgcagcagtgt

SEQ ID NO: 360160 - DNA, 20 bp, human
gtcttaggctgctaagagga

SEQ ID NO: 360161 - DNA, 20 bp, human
gaagagacgatgttacagtc

SEQ ID NO: 360162 - DNA, 20 bp, human
ggtaatgaaaactgaaatgt

SEQ ID NO: 360163 - DNA, 20 bp, human
gaaattcattgctgtagcta

SEQ ID NO: 360164 - DNA, 20 bp, human
gagcagtgtgggccaacacc

SEQ ID NO: 360165 - DNA, 20 bp, human
gtgttggcccacactgctgc

SEQ ID NO: 360166 - DNA, 20 bp, human
ggaggggccagatatgaggg

SEQ ID NO: 360167 - DNA, 20 bp, human
gcctgcaaggcattcagggg

SEQ ID NO: 360168 - DNA, 20 bp, human
gagggaggggccagatatga

SEQ ID NO: 360169 - DNA, 20 bp, human
gaggagccaagtgtgagttc

SEQ ID NO: 360170 - DNA, 20 bp, human
gtcccctgcaaggcattcag

SEQ ID NO: 360171 - DNA, 20 bp, human
gataaccctgaggcacctgg

SEQ ID NO: 360172 - DNA, 20 bp, human
gtgcaggggaatgggttcct

SEQ ID NO: 360173 - DNA, 20 bp, human
ggccaagtgtgagttcaggg

SEQ ID NO: 360174 - DNA, 20 bp, human
ggtggtaggatggtacaaag

SEQ ID NO: 360175 - DNA, 20 bp, human
gctgttctgacaatcaagat

SEQ ID NO: 360176 - DNA, 20 bp, human
gaagtgagagagccggcatg

SEQ ID NO: 360177 - DNA, 20 bp, human
ggccggctgaactgctgaag

SEQ ID NO: 360178 - DNA, 20 bp, human
gagtgggatctgcaagtagc

SEQ ID NO: 360179 - DNA, 20 bp, human
gaaggcgggaagttgagttc

SEQ ID NO: 360180 - DNA, 20 bp, human
gtagcaggcaagtggccaca

SEQ ID NO: 360181 - DNA, 20 bp, human
gtgaactgcgacccccatgc

SEQ ID NO: 360182 - DNA, 20 bp, human
gacaaaagagccataaacat

SEQ ID NO: 360183 - DNA, 20 bp, human
gattgactgggccatagtta

SEQ ID NO: 360184 - DNA, 20 bp, human
gtctgcaagtagcaggcaag

SEQ ID NO: 360185 - DNA, 20 bp, human
ggtcctagaagtgagagagc

SEQ ID NO: 360186 - DNA, 20 bp, human
gcaaactatcctgactatct

SEQ ID NO: 360187 - DNA, 20 bp, human
ggccttaatcaaagtacatt

SEQ ID NO: 360188 - DNA, 20 bp, human
ggctcatttaacaaggatga

SEQ ID NO: 360189 - DNA, 20 bp, human
gaatcacttgtcagacctag

SEQ ID NO: 360190 - DNA, 20 bp, human
gatggagactgtgcgtataa

SEQ ID NO: 360191 - DNA, 20 bp, human
ggaaatcacctttcaattta

SEQ ID NO: 360192 - DNA, 20 bp, human
gactatttgattggtcatta

SEQ ID NO: 360193 - DNA, 20 bp, human
gtatcctgactatcttggcc

SEQ ID NO: 360194 - DNA, 20 bp, human
gacataaaatctaaccctct

SEQ ID NO: 360195 - DNA, 20 bp, human
gattcctggccaagatagtc

SEQ ID NO: 360196 - DNA, 20 bp, human
ggcggcctagggagggacga

SEQ ID NO: 360197 - DNA, 20 bp, human
gggcgcctcccgggccgctg

SEQ ID NO: 360198 - DNA, 20 bp, human
gcgacttctgggaacgggga

SEQ ID NO: 360199 - DNA, 20 bp, human
gctgcaccggcctctccggg

SEQ ID NO: 360200 - DNA, 20 bp, human
gtgtgtctccgaccccgctg

SEQ ID NO: 360201 - DNA, 20 bp, human
gggaccgcgacttctgggaa

SEQ ID NO: 360202 - DNA, 20 bp, human
gcgggaggcgcccgctgcac

SEQ ID NO: 360203 - DNA, 20 bp, human
gccgctgcaccggcctctcc

SEQ ID NO: 360204 - DNA, 20 bp, human
ggggcgggatgaatcaccgc

SEQ ID NO: 360205 - DNA, 20 bp, human
gtggtcctcagagccccagc

SEQ ID NO: 360206 - DNA, 20 bp, human
gtcaaatagagtggaattat

SEQ ID NO: 360207 - DNA, 20 bp, human
gtccacttttgaccaggaga

SEQ ID NO: 360208 - DNA, 20 bp, human
gacatgacagctccatctcc

SEQ ID NO: 360209 - DNA, 20 bp, human
gaaaggaacgtgaattaaga

SEQ ID NO: 360210 - DNA, 20 bp, human
gtagttgatttcaaatagag

SEQ ID NO: 360211 - DNA, 20 bp, human
ggatggttccacttttgacc

SEQ ID NO: 360212 - DNA, 20 bp, human
ggaaaggttaaagataaggc

SEQ ID NO: 360213 - DNA, 20 bp, human
gtgaacatcacatctctttg

SEQ ID NO: 360214 - DNA, 20 bp, human
gaatcttaagttttcaatga

SEQ ID NO: 360215 - DNA, 20 bp, human
gacattatgtttaaactaaa

SEQ ID NO: 360216 - DNA, 20 bp, human
gatggggtaaatattgtggt

SEQ ID NO: 360217 - DNA, 20 bp, human
gagagagagggagtgtgtaa

SEQ ID NO: 360218 - DNA, 20 bp, human
gcacccccaggctgacgcag

SEQ ID NO: 360219 - DNA, 20 bp, human
gtggatttcaaaaagcaggt

SEQ ID NO: 360220 - DNA, 20 bp, human
gggagtgcggtgcagtagct

SEQ ID NO: 360221 - DNA, 20 bp, human
gagccactgcgtcagcctgg

SEQ ID NO: 360222 - DNA, 20 bp, human
gcccagtgaagtcaaaaagc

SEQ ID NO: 360223 - DNA, 20 bp, human
gacttcactgggatgattgt

SEQ ID NO: 360224 - DNA, 20 bp, human
gccctgctttttgacttcac

SEQ ID NO: 360225 - DNA, 20 bp, human
gggattttgaaagctattag

SEQ ID NO: 360226 - DNA, 20 bp, human
gccctgtgacagaggataat

SEQ ID NO: 360227 - DNA, 20 bp, human
gtggtaccgccatctactgg

SEQ ID NO: 360228 - DNA, 20 bp, human
ggtaaacctgcatgaagcat

SEQ ID NO: 360229 - DNA, 20 bp, human
gaggccgatcgcactcaaag

SEQ ID NO: 360230 - DNA, 20 bp, human
gccccaagatgacagtagag

SEQ ID NO: 360231 - DNA, 20 bp, human
gtcccattatcctctgtcac

SEQ ID NO: 360232 - DNA, 20 bp, human
gaagtggtaccgccatctac

SEQ ID NO: 360233 - DNA, 20 bp, human
gcacctctctactgtcatct

SEQ ID NO: 360234 - DNA, 20 bp, human
ggtgtgtgtccgccagtaga

SEQ ID NO: 360235 - DNA, 20 bp, human
ggactacccatgcttcatgc

SEQ ID NO: 360236 - DNA, 20 bp, human
ggaggtgcggaggcgcgaga

SEQ ID NO: 360237 - DNA, 20 bp, human
gcggcggtgcgcccgagctc

SEQ ID NO: 360238 - DNA, 20 bp, human
gggaggggcacgcccatcag

SEQ ID NO: 360239 - DNA, 20 bp, human
gcgcgcgagcaaagatatcc

SEQ ID NO: 360240 - DNA, 20 bp, human
gacacccggcaagtccgtgc

SEQ ID NO: 360241 - DNA, 20 bp, human
gcgagcaaagatatcccggc

SEQ ID NO: 360242 - DNA, 20 bp, human
ggagccgcctgcgcatgtca

SEQ ID NO: 360243 - DNA, 20 bp, human
ggggtggggagtgtgcacta

SEQ ID NO: 360244 - DNA, 20 bp, human
gggcacgcccatcagggggt

SEQ ID NO: 360245 - DNA, 20 bp, human
gtgtagctccgggaagagaa

SEQ ID NO: 360246 - DNA, 20 bp, human
gcggctgccctcaggaccga

SEQ ID NO: 360247 - DNA, 20 bp, human
ggggcacagagcatcacccc

SEQ ID NO: 360248 - DNA, 20 bp, human
ggggcccaggaggcagtcga

SEQ ID NO: 360249 - DNA, 20 bp, human
ggccacttctggggaaagtg

SEQ ID NO: 360250 - DNA, 20 bp, human
gtctggggaaagtgtggtgg

SEQ ID NO: 360251 - DNA, 20 bp, human
gtgggcgtgcagactctatc

SEQ ID NO: 360252 - DNA, 20 bp, human
gaatctggttggtttgccgt

SEQ ID NO: 360253 - DNA, 20 bp, human
gcaaggtgctgctgctgcac

SEQ ID NO: 360254 - DNA, 20 bp, human
ggaggcagtcgaaggcactg

SEQ ID NO: 360255 - DNA, 20 bp, human
gtaggtggagaccatgaagg

SEQ ID NO: 360256 - DNA, 20 bp, human
gggctccccggcctacgcgg

SEQ ID NO: 360257 - DNA, 20 bp, human
gccccactggagagggagtt

SEQ ID NO: 360258 - DNA, 20 bp, human
gccggctgctggagcaacgg

SEQ ID NO: 360259 - DNA, 20 bp, human
gtgctggagcaacggcggga

SEQ ID NO: 360260 - DNA, 20 bp, human
ggaagacggagcgagcgcag

SEQ ID NO: 360261 - DNA, 20 bp, human
gcctgccgcaccccgcctcg

SEQ ID NO: 360262 - DNA, 20 bp, human
gggctccgggaccgcgaggc

SEQ ID NO: 360263 - DNA, 20 bp, human
ggcagcttgcgcctcctcgg

SEQ ID NO: 360264 - DNA, 20 bp, human
ggtggccgccgcgtaggccg

SEQ ID NO: 360265 - DNA, 20 bp, human
gggggcacggcgtggtcccg

SEQ ID NO: 360266 - DNA, 20 bp, human
gtgagcccccgggtcagtgt

SEQ ID NO: 360267 - DNA, 20 bp, human
gccctgggcgcgtcgctctg

SEQ ID NO: 360268 - DNA, 20 bp, human
gggtgctccgcccgctcgga

SEQ ID NO: 360269 - DNA, 20 bp, human
gtgggcgcgtcgctctgggg

SEQ ID NO: 360270 - DNA, 20 bp, human
gcccgcctgggttcggcctg

SEQ ID NO: 360271 - DNA, 20 bp, human
ggacagacagacataggcgg

SEQ ID NO: 360272 - DNA, 20 bp, human
gtgtcccccctccgagcggg

SEQ ID NO: 360273 - DNA, 20 bp, human
gtgggagtgtgcgccccggc

SEQ ID NO: 360274 - DNA, 20 bp, human
gagcctgtccgcgtccgcgt

SEQ ID NO: 360275 - DNA, 20 bp, human
gtgggttcggcctggggctt

SEQ ID NO: 360276 - DNA, 20 bp, human
gggcctggagattagggcgg

SEQ ID NO: 360277 - DNA, 20 bp, human
gggatgctgaagtcgctcac

SEQ ID NO: 360278 - DNA, 20 bp, human
gctcactggcctggagatta

SEQ ID NO: 360279 - DNA, 20 bp, human
gggaggggtctctgggtcag

SEQ ID NO: 360280 - DNA, 20 bp, human
gctcccccgccctaatctcc

SEQ ID NO: 360281 - DNA, 20 bp, human
ggggtctctgggtcagtggc

SEQ ID NO: 360282 - DNA, 20 bp, human
gcacccgcccacgcccgatc

SEQ ID NO: 360283 - DNA, 20 bp, human
gctgaagtcgctcactggcc

SEQ ID NO: 360284 - DNA, 20 bp, human
gcagcatccagatcgggcgt

SEQ ID NO: 360285 - DNA, 20 bp, human
ggagcagcgcggtgcagctg

SEQ ID NO: 360286 - DNA, 20 bp, human
ggggacccgccgcgagacgc

SEQ ID NO: 360287 - DNA, 20 bp, human
ggggccgcgggctgaggacc

SEQ ID NO: 360288 - DNA, 20 bp, human
gcgccgccgggagcggatca

SEQ ID NO: 360289 - DNA, 20 bp, human
gcgggcccggggacgctcgc

SEQ ID NO: 360290 - DNA, 20 bp, human
gtcaggggcaagagggaaca

SEQ ID NO: 360291 - DNA, 20 bp, human
gagcgccagcgagcgtcccc

SEQ ID NO: 360292 - DNA, 20 bp, human
ggggcgcgaagcgcagggag

SEQ ID NO: 360293 - DNA, 20 bp, human
gcgcggaggggtaggcgcgg

SEQ ID NO: 360294 - DNA, 20 bp, human
ggagcggatcaggggcaaga

SEQ ID NO: 360295 - DNA, 20 bp, human
gcggctcggcgggggcgtag

SEQ ID NO: 360296 - DNA, 20 bp, human
gcagggcggggacccagcta

SEQ ID NO: 360297 - DNA, 20 bp, human
ggacccagctaggggcgcgg

SEQ ID NO: 360298 - DNA, 20 bp, human
gccagcgcctccccgacctt

SEQ ID NO: 360299 - DNA, 20 bp, human
ggggggcgggggtgagataa

SEQ ID NO: 360300 - DNA, 20 bp, human
gccacggccacccattgggt

SEQ ID NO: 360301 - DNA, 20 bp, human
gcctgcgccgcccgcaggag

SEQ ID NO: 360302 - DNA, 20 bp, human
gccaccaccgcgcccctagc

SEQ ID NO: 360303 - DNA, 20 bp, human
gaaaaactccggagcagagg

SEQ ID NO: 360304 - DNA, 20 bp, human
gcacacacgccccacccaat

SEQ ID NO: 360305 - DNA, 20 bp, human
gtgcaccatgcgctaataga

SEQ ID NO: 360306 - DNA, 20 bp, human
gtgcgtccccggaagtacgg

SEQ ID NO: 360307 - DNA, 20 bp, human
gtccgcgtctgcggagtcgc

SEQ ID NO: 360308 - DNA, 20 bp, human
gccactctctggtgctcgga

SEQ ID NO: 360309 - DNA, 20 bp, human
ggagggaactgcatttccta

SEQ ID NO: 360310 - DNA, 20 bp, human
gcggaagtacggaggccgac

SEQ ID NO: 360311 - DNA, 20 bp, human
ggatccaggcccttgcatct

SEQ ID NO: 360312 - DNA, 20 bp, human
gcgcagacgcggagcctttt

SEQ ID NO: 360313 - DNA, 20 bp, human
gccaggcccttgcatcttgg

SEQ ID NO: 360314 - DNA, 20 bp, human
gggatcgcgcaatgcatgcg

SEQ ID NO: 360315 - DNA, 20 bp, human
gcagatccgccaagatgcaa

SEQ ID NO: 360316 - DNA, 20 bp, human
gtcccgagggcaggtgaact

SEQ ID NO: 360317 - DNA, 20 bp, human
gaaggagggctcccgagggc

SEQ ID NO: 360318 - DNA, 20 bp, human
gagagccgggagttttccga

SEQ ID NO: 360319 - DNA, 20 bp, human
ggcaggtgaactgggagtac

SEQ ID NO: 360320 - DNA, 20 bp, human
ggaaggaaggagggctcccg

SEQ ID NO: 360321 - DNA, 20 bp, human
gtagacgcagacaggcaagg

SEQ ID NO: 360322 - DNA, 20 bp, human
gtaaaggtgagcagggcggg

SEQ ID NO: 360323 - DNA, 20 bp, human
gccgggagttttccgaagga

SEQ ID NO: 360324 - DNA, 20 bp, human
ggacctgagaaggcggactc

SEQ ID NO: 360325 - DNA, 20 bp, human
ggcccagagtccgccttctc

SEQ ID NO: 360326 - DNA, 20 bp, human
gtccctgaacctggcgtgtg

SEQ ID NO: 360327 - DNA, 20 bp, human
gcgagcgcggcgagaccgac

SEQ ID NO: 360328 - DNA, 20 bp, human
gggagcttattgggaggcga

SEQ ID NO: 360329 - DNA, 20 bp, human
gtggggtacactcggatgag

SEQ ID NO: 360330 - DNA, 20 bp, human
gctggccacacgcacggtcc

SEQ ID NO: 360331 - DNA, 20 bp, human
gcccccacacgccaggttca

SEQ ID NO: 360332 - DNA, 20 bp, human
ggcggcgagaccgactggga

SEQ ID NO: 360333 - DNA, 20 bp, human
gcggagcgcgtgcgtgcggg

SEQ ID NO: 360334 - DNA, 20 bp, human
gtcgcctaggtgaacgggac

SEQ ID NO: 360335 - DNA, 20 bp, human
gatcgctggtgtcccgaggt

SEQ ID NO: 360336 - DNA, 20 bp, human
gtgaccctggctgagagtaa

SEQ ID NO: 360337 - DNA, 20 bp, human
gccaaaaggggaattcctgg

SEQ ID NO: 360338 - DNA, 20 bp, human
gcctgccccggacccaaaag

SEQ ID NO: 360339 - DNA, 20 bp, human
gaaagatggggcttccaagg

SEQ ID NO: 360340 - DNA, 20 bp, human
gaaacaggctggctgggcgt

SEQ ID NO: 360341 - DNA, 20 bp, human
gactgtgctgcaggcgaggg

SEQ ID NO: 360342 - DNA, 20 bp, human
gcagccagcctgttttaaat

SEQ ID NO: 360343 - DNA, 20 bp, human
gaattccccttttgggtccg

SEQ ID NO: 360344 - DNA, 20 bp, human
gatttcacctgcagagggat

SEQ ID NO: 360345 - DNA, 20 bp, human
gtttgggtccggggcaggtg

SEQ ID NO: 360346 - DNA, 20 bp, human
gacagcccagccttggtgca

SEQ ID NO: 360347 - DNA, 20 bp, human
gtggcccgatacaggggtgt

SEQ ID NO: 360348 - DNA, 20 bp, human
gagcccaggtccggccagtg

SEQ ID NO: 360349 - DNA, 20 bp, human
gggggcccggtccagccaaa

SEQ ID NO: 360350 - DNA, 20 bp, human
ggggcatacgggtcatggaa

SEQ ID NO: 360351 - DNA, 20 bp, human
gcactcccggggacacaggg

SEQ ID NO: 360352 - DNA, 20 bp, human
gtggctggaccgggccccac

SEQ ID NO: 360353 - DNA, 20 bp, human
ggcaaggcctctaagggctg

SEQ ID NO: 360354 - DNA, 20 bp, human
gtcccgggcaaggcctctaa

SEQ ID NO: 360355 - DNA, 20 bp, human
gcaggcggggacaaggtcct

SEQ ID NO: 360356 - DNA, 20 bp, human
gctggggcgcagggcggctt

SEQ ID NO: 360357 - DNA, 20 bp, human
ggcggcctggggaaagcacc

SEQ ID NO: 360358 - DNA, 20 bp, human
gagggggcgttgtgaagtcg

SEQ ID NO: 360359 - DNA, 20 bp, human
gcacctgagaccgcccggag

SEQ ID NO: 360360 - DNA, 20 bp, human
gcaggaagacgcagcgcggc

SEQ ID NO: 360361 - DNA, 20 bp, human
gggcccaggaagacgcagcg

SEQ ID NO: 360362 - DNA, 20 bp, human
gagagacccagcgggaatgc

SEQ ID NO: 360363 - DNA, 20 bp, human
gaagtcgcggggcagtaata

SEQ ID NO: 360364 - DNA, 20 bp, human
ggtgaagtcgtggcccgctc

SEQ ID NO: 360365 - DNA, 20 bp, human
gctggggaggcgggtcccta

SEQ ID NO: 360366 - DNA, 20 bp, human
gtgtccgtcccgctcgttgg

SEQ ID NO: 360367 - DNA, 20 bp, human
gtaacagcgccaccaacgag

SEQ ID NO: 360368 - DNA, 20 bp, human
gctaccgtgcgccggcccct

SEQ ID NO: 360369 - DNA, 20 bp, human
gctaccggaaatcgcgggga

SEQ ID NO: 360370 - DNA, 20 bp, human
ggggcccccgctttggtcgt

SEQ ID NO: 360371 - DNA, 20 bp, human
ggctggaggcgggtctggcg

SEQ ID NO: 360372 - DNA, 20 bp, human
gagacccgcctccagccgca

SEQ ID NO: 360373 - DNA, 20 bp, human
gcgccggcccctgggctgaa

SEQ ID NO: 360374 - DNA, 20 bp, human
gaaatcgcggggagggtcaa

SEQ ID NO: 360375 - DNA, 20 bp, human
gctgaaaggcctctgactac

SEQ ID NO: 360376 - DNA, 20 bp, human
ggcgggagcggaaggatcca

SEQ ID NO: 360377 - DNA, 20 bp, human
ggaaggatccagggctgcgg

SEQ ID NO: 360378 - DNA, 20 bp, human
gtggccgcggcgctggacga

SEQ ID NO: 360379 - DNA, 20 bp, human
gtgaacacgtgacccccggc

SEQ ID NO: 360380 - DNA, 20 bp, human
gtcccgcccaagcactgaca

SEQ ID NO: 360381 - DNA, 20 bp, human
ggggacggccccgcgctcag

SEQ ID NO: 360382 - DNA, 20 bp, human
gcacgggcgcagccgctgac

SEQ ID NO: 360383 - DNA, 20 bp, human
gtcagcgcgtgcgcggaagg

SEQ ID NO: 360384 - DNA, 20 bp, human
gcggaaggcggagcccgccg

SEQ ID NO: 360385 - DNA, 20 bp, human
gggtcacgtgttcatcgaga

SEQ ID NO: 360386 - DNA, 20 bp, human
ggatcccggtgctttgagat

SEQ ID NO: 360387 - DNA, 20 bp, human
gaggcgggcagctaatgcgc

SEQ ID NO: 360388 - DNA, 20 bp, human
gcgagcggctgggacgggat

SEQ ID NO: 360389 - DNA, 20 bp, human
gagattggacgactggggtg

SEQ ID NO: 360390 - DNA, 20 bp, human
gtcgtccaatctcaaagcac

SEQ ID NO: 360391 - DNA, 20 bp, human
gcagcgacctcaatcctgat

SEQ ID NO: 360392 - DNA, 20 bp, human
gctcacggcgcacgttctgt

SEQ ID NO: 360393 - DNA, 20 bp, human
gacggcgcacgttctgtggg

SEQ ID NO: 360394 - DNA, 20 bp, human
ggtaaagaagcgaagctaag

SEQ ID NO: 360395 - DNA, 20 bp, human
gttatggcaaaggtggatcc

SEQ ID NO: 360396 - DNA, 20 bp, human
ggggtggggcgcgtcctgtg

SEQ ID NO: 360397 - DNA, 20 bp, human
gagtgcgcgtgcgtaggggc

SEQ ID NO: 360398 - DNA, 20 bp, human
gaaccccaacggctctcctc

SEQ ID NO: 360399 - DNA, 20 bp, human
gtgagagtgcgcgtgcgtag

SEQ ID NO: 360400 - DNA, 20 bp, human
gaacccctcctctcagtctt

SEQ ID NO: 360401 - DNA, 20 bp, human
ggaccctgaggagagccgtt

SEQ ID NO: 360402 - DNA, 20 bp, human
ggccctggcttcgggcttca

SEQ ID NO: 360403 - DNA, 20 bp, human
gtagggattcggctgcctaa

SEQ ID NO: 360404 - DNA, 20 bp, human
gcagccgaatccctaatttg

SEQ ID NO: 360405 - DNA, 20 bp, human
gcggaaagcggactcatgaa

SEQ ID NO: 360406 - DNA, 20 bp, human
gaacgtgtgacctcagataa

SEQ ID NO: 360407 - DNA, 20 bp, human
gatccctgattggtttggga

SEQ ID NO: 360408 - DNA, 20 bp, human
gcgcccctcccaaaccaatc

SEQ ID NO: 360409 - DNA, 20 bp, human
gcaggctgcaatggggttaa

SEQ ID NO: 360410 - DNA, 20 bp, human
gccaacatccctgattggtt

SEQ ID NO: 360411 - DNA, 20 bp, human
gctgtctgagcccttatctg

SEQ ID NO: 360412 - DNA, 20 bp, human
gaggtctgcaggctgcaatg

SEQ ID NO: 360413 - DNA, 20 bp, human
gtgcagcctgcagacctttt

SEQ ID NO: 360414 - DNA, 20 bp, human
gttggtcctgcaagcccaaa

SEQ ID NO: 360415 - DNA, 20 bp, human
ggtgtggatctgcctcacaa

SEQ ID NO: 360416 - DNA, 20 bp, human
gcatttgcaggggtcctggt

SEQ ID NO: 360417 - DNA, 20 bp, human
ggcggggcctgaatgggcat

SEQ ID NO: 360418 - DNA, 20 bp, human
gggcctgaatgggcatgggg

SEQ ID NO: 360419 - DNA, 20 bp, human
gaggacccctgcaaatgcgc

SEQ ID NO: 360420 - DNA, 20 bp, human
gtcgggggcggggcctgaat

SEQ ID NO: 360421 - DNA, 20 bp, human
gggcccctgcgcatttgcag

SEQ ID NO: 360422 - DNA, 20 bp, human
gccgcctccgtcacgtgatg

SEQ ID NO: 360423 - DNA, 20 bp, human
gtctgcccggcaagcccacc

SEQ ID NO: 360424 - DNA, 20 bp, human
gccggcgccccatcacgtga

SEQ ID NO: 360425 - DNA, 20 bp, human
gggcggggcctgggcggacc

SEQ ID NO: 360426 - DNA, 20 bp, human
gtgttctattcgttctcgcc

SEQ ID NO: 360427 - DNA, 20 bp, human
gagtctatacaagaacctca

SEQ ID NO: 360428 - DNA, 20 bp, human
gagaacagcttctttacaga

SEQ ID NO: 360429 - DNA, 20 bp, human
gaaaactgtgaaaggggaag

SEQ ID NO: 360430 - DNA, 20 bp, human
gctgcaaggactgcctcctt

SEQ ID NO: 360431 - DNA, 20 bp, human
gtctttgggtgagaaatgga

SEQ ID NO: 360432 - DNA, 20 bp, human
ggttcagtttgttccaaacc

SEQ ID NO: 360433 - DNA, 20 bp, human
gtattcgttctcgcctggtt

SEQ ID NO: 360434 - DNA, 20 bp, human
gcagcgagtctgtcgatccc

SEQ ID NO: 360435 - DNA, 20 bp, human
gcagactcgctgctccagcc

SEQ ID NO: 360436 - DNA, 20 bp, human
gtgccgctacgggtcctcag

SEQ ID NO: 360437 - DNA, 20 bp, human
gtacgggtcctcagaggcgg

SEQ ID NO: 360438 - DNA, 20 bp, human
gggcgcgcggggccttctgg

SEQ ID NO: 360439 - DNA, 20 bp, human
gcgggcgtgctaggcggcga

SEQ ID NO: 360440 - DNA, 20 bp, human
gggccgggctgaagaccgga

SEQ ID NO: 360441 - DNA, 20 bp, human
gcaggggccgggctgaagac

SEQ ID NO: 360442 - DNA, 20 bp, human
gaggcggcgagggccggact

SEQ ID NO: 360443 - DNA, 20 bp, human
ggcctagcacgcccggactg

SEQ ID NO: 360444 - DNA, 20 bp, human
gcgtgctaggcggcgagggc

SEQ ID NO: 360445 - DNA, 20 bp, human
gtgtcggcggggcagtccgg

SEQ ID NO: 360446 - DNA, 20 bp, human
gaggccccctccctactcga

SEQ ID NO: 360447 - DNA, 20 bp, human
ggctcaccgtcgagtaggga

SEQ ID NO: 360448 - DNA, 20 bp, human
ggcgctgctcaccgtcgagt

SEQ ID NO: 360449 - DNA, 20 bp, human
gccgccgcaccccgcgcgtc

SEQ ID NO: 360450 - DNA, 20 bp, human
gcccgtgcagccagacgcgc

SEQ ID NO: 360451 - DNA, 20 bp, human
gcagccagacgcgcggggtg

SEQ ID NO: 360452 - DNA, 20 bp, human
ggaggcgccaaaaggatgct

SEQ ID NO: 360453 - DNA, 20 bp, human
gtcgacggtgagcagcgccg

SEQ ID NO: 360454 - DNA, 20 bp, human
ggtcgggaagaggcgccaaa

SEQ ID NO: 360455 - DNA, 20 bp, human
gaagagggggccactttctg

SEQ ID NO: 360456 - DNA, 20 bp, human
gcggccttgcgagtcccacc

SEQ ID NO: 360457 - DNA, 20 bp, human
gtccccgcagtgactccgtg

SEQ ID NO: 360458 - DNA, 20 bp, human
gccattgggcggagactctc

SEQ ID NO: 360459 - DNA, 20 bp, human
ggagccaggtgggactcgca

SEQ ID NO: 360460 - DNA, 20 bp, human
gtcgcaaggccgctctgctc

SEQ ID NO: 360461 - DNA, 20 bp, human
gctacccaggcgcccatttg

SEQ ID NO: 360462 - DNA, 20 bp, human
gcgcgcgccctggtggaaaa

SEQ ID NO: 360463 - DNA, 20 bp, human
gggagctgcaggctccgttc

SEQ ID NO: 360464 - DNA, 20 bp, human
gggtgaggggaatacagtac

SEQ ID NO: 360465 - DNA, 20 bp, human
ggtaggacagggagccaggt

SEQ ID NO: 360466 - DNA, 20 bp, human
gagaagcggaggctgtccta

SEQ ID NO: 360467 - DNA, 20 bp, human
ggggagggattaggcccaca

SEQ ID NO: 360468 - DNA, 20 bp, human
ggctgctggaaacgcagttc

SEQ ID NO: 360469 - DNA, 20 bp, human
gaaacgcagttccggttagg

SEQ ID NO: 360470 - DNA, 20 bp, human
gtggaaacgcagttccggtt

SEQ ID NO: 360471 - DNA, 20 bp, human
gctgggaaggcggtccctgt

SEQ ID NO: 360472 - DNA, 20 bp, human
gcagtggaggcatcagttgc

SEQ ID NO: 360473 - DNA, 20 bp, human
ggagtaaacagacccgggga

SEQ ID NO: 360474 - DNA, 20 bp, human
gggggaacttccgagatcaa

SEQ ID NO: 360475 - DNA, 20 bp, human
gtttaggcctagagaagcgg

SEQ ID NO: 360476 - DNA, 20 bp, human
ggggcgcgctcaaccggcgc

SEQ ID NO: 360477 - DNA, 20 bp, human
ggccgggcaggggtcctcgg

SEQ ID NO: 360478 - DNA, 20 bp, human
gcagccggagcgagcggcag

SEQ ID NO: 360479 - DNA, 20 bp, human
gaaccggcgcgggcggagag

SEQ ID NO: 360480 - DNA, 20 bp, human
gcggcgctcggactgctcct

SEQ ID NO: 360481 - DNA, 20 bp, human
gtcgccactgccgctcgctc

SEQ ID NO: 360482 - DNA, 20 bp, human
gcgcgctcaaccggcgcggg

SEQ ID NO: 360483 - DNA, 20 bp, human
ggggaattccccactcgcgc

SEQ ID NO: 360484 - DNA, 20 bp, human
gcccggcggccaaacccccg

SEQ ID NO: 360485 - DNA, 20 bp, human
gcggagaggggcggtccgcg

SEQ ID NO: 360486 - DNA, 20 bp, human
gcagaggaaagagtgcgcac

SEQ ID NO: 360487 - DNA, 20 bp, human
gtgaaccccaaacccaacag

SEQ ID NO: 360488 - DNA, 20 bp, human
gtggtcctgccaagatatgg

SEQ ID NO: 360489 - DNA, 20 bp, human
ggcaggctaagacctagaga

SEQ ID NO: 360490 - DNA, 20 bp, human
gggctcccccaggtttgggt

SEQ ID NO: 360491 - DNA, 20 bp, human
gtcagggaaagacactgcct

SEQ ID NO: 360492 - DNA, 20 bp, human
gcagtccgacccaaacctgg

SEQ ID NO: 360493 - DNA, 20 bp, human
gggagtggggatgtcctttt

SEQ ID NO: 360494 - DNA, 20 bp, human
gacaatagagacacgtggac

SEQ ID NO: 360495 - DNA, 20 bp, human
ggggtcggactgggggtggc

SEQ ID NO: 360496 - DNA, 20 bp, human
gcggccgcgcccagcgatcc

SEQ ID NO: 360497 - DNA, 20 bp, human
ggggcgccagcgcggcggag

SEQ ID NO: 360498 - DNA, 20 bp, human
ggggcggccctgaccttccc

SEQ ID NO: 360499 - DNA, 20 bp, human
gccccagcaaggtgctccag

SEQ ID NO: 360500 - DNA, 20 bp, human
ggagggggacgtcccggcct

SEQ ID NO: 360501 - DNA, 20 bp, human
gcggaggggccggagggctt

SEQ ID NO: 360502 - DNA, 20 bp, human
gggggacgtcccggcctggg

SEQ ID NO: 360503 - DNA, 20 bp, human
gaagtctgagaacggatggt

SEQ ID NO: 360504 - DNA, 20 bp, human
gggcccctggagcaccttgc

SEQ ID NO: 360505 - DNA, 20 bp, human
gcgcggtgcggttccctctg

SEQ ID NO: 360506 - DNA, 20 bp, human
gacccggagtcggctcccgc

SEQ ID NO: 360507 - DNA, 20 bp, human
gcctccttggtcatcatcaa

SEQ ID NO: 360508 - DNA, 20 bp, human
gccggcgcgcctcctccacc

SEQ ID NO: 360509 - DNA, 20 bp, human
gagtccctgccgggtggagg

SEQ ID NO: 360510 - DNA, 20 bp, human
gagcttgcgctttctgtccg

SEQ ID NO: 360511 - DNA, 20 bp, human
gcacccggcagggactggcg

SEQ ID NO: 360512 - DNA, 20 bp, human
gcatcaaaggaggagttcat

SEQ ID NO: 360513 - DNA, 20 bp, human
gagaaagcgcaagctcgctg

SEQ ID NO: 360514 - DNA, 20 bp, human
gcggcaatcccgcccaaccc

SEQ ID NO: 360515 - DNA, 20 bp, human
gccggaaagagcactgtctc

SEQ ID NO: 360516 - DNA, 20 bp, human
gggggctcgggcgtcgtcgg

SEQ ID NO: 360517 - DNA, 20 bp, human
gcccgagcccccctcttcct

SEQ ID NO: 360518 - DNA, 20 bp, human
gtccggccctccgaggaaga

SEQ ID NO: 360519 - DNA, 20 bp, human
gtcgcccagggccggccaat

SEQ ID NO: 360520 - DNA, 20 bp, human
gcggggtctaggccaggctg

SEQ ID NO: 360521 - DNA, 20 bp, human
gcattggcccgtggcgtcgg

SEQ ID NO: 360522 - DNA, 20 bp, human
gtcctcggagggccggaggc

SEQ ID NO: 360523 - DNA, 20 bp, human
gagcccccctcttcctcgga

SEQ ID NO: 360524 - DNA, 20 bp, human
ggaggggcggggcgtcgccc

SEQ ID NO: 360525 - DNA, 20 bp, human
gcccgcccctccgacgccac

SEQ ID NO: 360526 - DNA, 20 bp, human
gtccacccgaggccggggag

SEQ ID NO: 360527 - DNA, 20 bp, human
gccccggcctcgggtggagg

SEQ ID NO: 360528 - DNA, 20 bp, human
gcaggctgacagccgcgctc

SEQ ID NO: 360529 - DNA, 20 bp, human
gccggggcgggaagcgcagg

SEQ ID NO: 360530 - DNA, 20 bp, human
ggagggaccgtgtgaaaatg

SEQ ID NO: 360531 - DNA, 20 bp, human
gagggctccgagcgttggag

SEQ ID NO: 360532 - DNA, 20 bp, human
gcgacccaggccctcatgtg

SEQ ID NO: 360533 - DNA, 20 bp, human
gtaacacactggaacaggcg

SEQ ID NO: 360534 - DNA, 20 bp, human
gaagtggaccagtgccctca

SEQ ID NO: 360535 - DNA, 20 bp, human
gtgaatggagaaggtgaccc

SEQ ID NO: 360536 - DNA, 20 bp, human
gcccggggaagccgtctcca

SEQ ID NO: 360537 - DNA, 20 bp, human
gcgagcgaaggacctgagaa

SEQ ID NO: 360538 - DNA, 20 bp, human
gggcacgaaaaaggaggtgg

SEQ ID NO: 360539 - DNA, 20 bp, human
ggctccccgactctttccta

SEQ ID NO: 360540 - DNA, 20 bp, human
ggccccatttgaaagaaaaa

SEQ ID NO: 360541 - DNA, 20 bp, human
gccccgggagcagggaggtc

SEQ ID NO: 360542 - DNA, 20 bp, human
gaccgcgcccgggcgcgcag

SEQ ID NO: 360543 - DNA, 20 bp, human
gctcccctaggaaagagtcg

SEQ ID NO: 360544 - DNA, 20 bp, human
gaaaaagggcacgaaaaagg

SEQ ID NO: 360545 - DNA, 20 bp, human
ggcagaccgcgcgcaatcaa

SEQ ID NO: 360546 - DNA, 20 bp, human
gggcacaggcgagtatttag

SEQ ID NO: 360547 - DNA, 20 bp, human
gcggtcaggcagcagggcca

SEQ ID NO: 360548 - DNA, 20 bp, human
gaggcgctggcgcacatggg

SEQ ID NO: 360549 - DNA, 20 bp, human
gagggtgcggtcaggcagca

SEQ ID NO: 360550 - DNA, 20 bp, human
ggtgccaggccgtgtgcagg

SEQ ID NO: 360551 - DNA, 20 bp, human
gtgggaggcaaagacagaca

SEQ ID NO: 360552 - DNA, 20 bp, human
gcctgtgccaggccgtgtgc

SEQ ID NO: 360553 - DNA, 20 bp, human
gagacagacagggtgcggtc

SEQ ID NO: 360554 - DNA, 20 bp, human
gggcaaagacagacagggtg

SEQ ID NO: 360555 - DNA, 20 bp, human
gccgccccctgcacacggcc

SEQ ID NO: 360556 - DNA, 20 bp, human
gaggcgctggcgcacatggg

SEQ ID NO: 360557 - DNA, 20 bp, human
gcggtcaggcagcagggcca

SEQ ID NO: 360558 - DNA, 20 bp, human
gagggtgcggtcaggcagca

SEQ ID NO: 360559 - DNA, 20 bp, human
gtgggaggcaaagacagaca

SEQ ID NO: 360560 - DNA, 20 bp, human
gggcaaagacagacagggtg

SEQ ID NO: 360561 - DNA, 20 bp, human
gggcaggcgctggcgcacat

SEQ ID NO: 360562 - DNA, 20 bp, human
gagacagacagggtgcggtc

SEQ ID NO: 360563 - DNA, 20 bp, human
gggccgggacgccgctataa

SEQ ID NO: 360564 - DNA, 20 bp, human
gcccgcccctctcagcccgg

SEQ ID NO: 360565 - DNA, 20 bp, human
ggcacatgtgcgtcccgggc

SEQ ID NO: 360566 - DNA, 20 bp, human
gttttaagtgacttacccgg

SEQ ID NO: 360567 - DNA, 20 bp, human
gggtggggcagaacctgagt

SEQ ID NO: 360568 - DNA, 20 bp, human
gcggagcaggacgtgaattg

SEQ ID NO: 360569 - DNA, 20 bp, human
gtcctgctccgccccgacgt

SEQ ID NO: 360570 - DNA, 20 bp, human
gggaggggcggggcagtccg

SEQ ID NO: 360571 - DNA, 20 bp, human
gagcaggacgtgaattgggg

SEQ ID NO: 360572 - DNA, 20 bp, human
ggccagggcggggcctacgt

SEQ ID NO: 360573 - DNA, 20 bp, human
gaacctgagttggggcggga

SEQ ID NO: 360574 - DNA, 20 bp, human
gggttcgggcgccttagctc

SEQ ID NO: 360575 - DNA, 20 bp, human
gcggggcctgcgtcagacgg

SEQ ID NO: 360576 - DNA, 20 bp, human
ggaccggggacgaagagtaa

SEQ ID NO: 360577 - DNA, 20 bp, human
gccgccccacctgacacccg

SEQ ID NO: 360578 - DNA, 20 bp, human
gccggggcggagagaagtac

SEQ ID NO: 360579 - DNA, 20 bp, human
gcggggacgaagagtaaggg

SEQ ID NO: 360580 - DNA, 20 bp, human
gcccccgcggccgcaaacgt

SEQ ID NO: 360581 - DNA, 20 bp, human
gacgtcacttcctgccggtt

SEQ ID NO: 360582 - DNA, 20 bp, human
gtccgccccgggtgtcaggt

SEQ ID NO: 360583 - DNA, 20 bp, human
ggcggggccctggaccaatg

SEQ ID NO: 360584 - DNA, 20 bp, human
gcgcaaacgtcggagctaga

SEQ ID NO: 360585 - DNA, 20 bp, human
ggcatgacgtcacttcctgc

SEQ ID NO: 360586 - DNA, 20 bp, human
ggtgaaactcggtatcgtcg

SEQ ID NO: 360587 - DNA, 20 bp, human
ggccaactaaccaggaaccg

SEQ ID NO: 360588 - DNA, 20 bp, human
gtggggcagtgagtgaaact

SEQ ID NO: 360589 - DNA, 20 bp, human
gggccgcacagctgagtctc

SEQ ID NO: 360590 - DNA, 20 bp, human
gcccagccaatcaaagctac

SEQ ID NO: 360591 - DNA, 20 bp, human
gccaatgaggccaactaacc

SEQ ID NO: 360592 - DNA, 20 bp, human
gctgtgcggcctctctacct

SEQ ID NO: 360593 - DNA, 20 bp, human
ggcggcgcccacacttaaga

SEQ ID NO: 360594 - DNA, 20 bp, human
gtggactaactagaccactg

SEQ ID NO: 360595 - DNA, 20 bp, human
gccggtgccatcttaagtgt

SEQ ID NO: 360596 - DNA, 20 bp, human
ggcgaggggcgggtcggcgg

SEQ ID NO: 360597 - DNA, 20 bp, human
gagcatatgcccaagggcga

SEQ ID NO: 360598 - DNA, 20 bp, human
gtaggcaggcgacaccttag

SEQ ID NO: 360599 - DNA, 20 bp, human
gccaagggcgaggggcgggt

SEQ ID NO: 360600 - DNA, 20 bp, human
gagtagtagcatatgcccaa

SEQ ID NO: 360601 - DNA, 20 bp, human
gcctaaagcgagctatgcta

SEQ ID NO: 360602 - DNA, 20 bp, human
gagcgcatgggactctaggc

SEQ ID NO: 360603 - DNA, 20 bp, human
gaaaatactctgtggtgtat

SEQ ID NO: 360604 - DNA, 20 bp, human
gattgccttgcgtttctgaa

SEQ ID NO: 360605 - DNA, 20 bp, human
gatgtgcttcatatgggtgt

SEQ ID NO: 360606 - DNA, 20 bp, human
gcgttccgaaggggccggga

SEQ ID NO: 360607 - DNA, 20 bp, human
gggggtggggcgttccgaag

SEQ ID NO: 360608 - DNA, 20 bp, human
gccacccctcccggcccctt

SEQ ID NO: 360609 - DNA, 20 bp, human
gcacccccggcccgctccta

SEQ ID NO: 360610 - DNA, 20 bp, human
gaggcaagaaccttaggagc

SEQ ID NO: 360611 - DNA, 20 bp, human
gagaaccttaggagcgggcc

SEQ ID NO: 360612 - DNA, 20 bp, human
ggtcctggggggtgtggact

SEQ ID NO: 360613 - DNA, 20 bp, human
gactccgggcccgggcagaa

SEQ ID NO: 360614 - DNA, 20 bp, human
gttggctcccgctcctccgg

SEQ ID NO: 360615 - DNA, 20 bp, human
gtggggcgttccgaaggggc

SEQ ID NO: 360616 - DNA, 20 bp, human
gggtcctcggagctgccaat

SEQ ID NO: 360617 - DNA, 20 bp, human
ggggctcccctgggcgactg

SEQ ID NO: 360618 - DNA, 20 bp, human
gggcagctccgaggaccagt

SEQ ID NO: 360619 - DNA, 20 bp, human
gaaaaggactgagaaaacgc

SEQ ID NO: 360620 - DNA, 20 bp, human
gcgcggcgcccactggtcct

SEQ ID NO: 360621 - DNA, 20 bp, human
gtctgctcaccggcaagcca

SEQ ID NO: 360622 - DNA, 20 bp, human
gtcctctccccagtcgccca

SEQ ID NO: 360623 - DNA, 20 bp, human
gggaaagagaaaagacaacg

SEQ ID NO: 360624 - DNA, 20 bp, human
gtgcttctccgggctcccct

SEQ ID NO: 360625 - DNA, 20 bp, human
gaatcggcgtgtaatcctgt

SEQ ID NO: 360626 - DNA, 20 bp, human
ggagccccgcgctgccgagt

SEQ ID NO: 360627 - DNA, 20 bp, human
gcccgccggacgcacctccg

SEQ ID NO: 360628 - DNA, 20 bp, human
gcgacctccagccccgggat

SEQ ID NO: 360629 - DNA, 20 bp, human
gcccagcgcgggcggaacgg

SEQ ID NO: 360630 - DNA, 20 bp, human
ggcccccagcgcgggcggaa

SEQ ID NO: 360631 - DNA, 20 bp, human
gcacgtgcgtggagccacag

SEQ ID NO: 360632 - DNA, 20 bp, human
gagggtgacgatgggagtcc

SEQ ID NO: 360633 - DNA, 20 bp, human
ggccgcggaggtgcgtccgg

SEQ ID NO: 360634 - DNA, 20 bp, human
gagccggcctcgccgatccc

SEQ ID NO: 360635 - DNA, 20 bp, human
ggcgcgggcggaacggagga

SEQ ID NO: 360636 - DNA, 20 bp, human
gggtttccaactccgcgggc

SEQ ID NO: 360637 - DNA, 20 bp, human
gctcccggagggtaggacta

SEQ ID NO: 360638 - DNA, 20 bp, human
gcccgcccggaattccccag

SEQ ID NO: 360639 - DNA, 20 bp, human
gaggccgcctataagatggg

SEQ ID NO: 360640 - DNA, 20 bp, human
gtccactggggaattccggg

SEQ ID NO: 360641 - DNA, 20 bp, human
gaggtccccagagatcactg

SEQ ID NO: 360642 - DNA, 20 bp, human
ggacgggaaggacttcccta

SEQ ID NO: 360643 - DNA, 20 bp, human
gaacccctagtcctaccctc

SEQ ID NO: 360644 - DNA, 20 bp, human
ggggagttggacctcccgga

SEQ ID NO: 360645 - DNA, 20 bp, human
gggtaggccgcctataagat

SEQ ID NO: 360646 - DNA, 20 bp, human
gcagtcgcacggcgccgggt

SEQ ID NO: 360647 - DNA, 20 bp, human
gcgtccccaaggtaacgggg

SEQ ID NO: 360648 - DNA, 20 bp, human
gcaaggtaacggggcggtag

SEQ ID NO: 360649 - DNA, 20 bp, human
ggatcccgtccccaaggtaa

SEQ ID NO: 360650 - DNA, 20 bp, human
gggtaggggtaaagaggcct

SEQ ID NO: 360651 - DNA, 20 bp, human
ggggacgggatcacccgacc

SEQ ID NO: 360652 - DNA, 20 bp, human
gggcacgaacagccgaagag

SEQ ID NO: 360653 - DNA, 20 bp, human
gtcgggtgatcccgtcccca

SEQ ID NO: 360654 - DNA, 20 bp, human
gcggggcggtaggggtaaag

SEQ ID NO: 360655 - DNA, 20 bp, human
gcggcgccgtgcgactgcgc

SEQ ID NO: 360656 - DNA, 20 bp, human
ggaggcagttggctagaggg

SEQ ID NO: 360657 - DNA, 20 bp, human
ggtctgaacagcagctgtga

SEQ ID NO: 360658 - DNA, 20 bp, human
gggctgtggctgggtaaaca

SEQ ID NO: 360659 - DNA, 20 bp, human
gtgcctcgatcagcaggact

SEQ ID NO: 360660 - DNA, 20 bp, human
ggatcgaggcagttggctag

SEQ ID NO: 360661 - DNA, 20 bp, human
ggcaccacccttcccagatc

SEQ ID NO: 360662 - DNA, 20 bp, human
gcacctccaaatccagacta

SEQ ID NO: 360663 - DNA, 20 bp, human
gctagagggcggtttgtgat

SEQ ID NO: 360664 - DNA, 20 bp, human
gaggaagccagctgagagac

SEQ ID NO: 360665 - DNA, 20 bp, human
gagaagcagcagtgatggat

SEQ ID NO: 360666 - DNA, 20 bp, human
ggggaagccgtgggcggaag

SEQ ID NO: 360667 - DNA, 20 bp, human
gctgcggggctcgggttctt

SEQ ID NO: 360668 - DNA, 20 bp, human
gggaagtgacgactgaagcg

SEQ ID NO: 360669 - DNA, 20 bp, human
gccgaagcctggttcgcctt

SEQ ID NO: 360670 - DNA, 20 bp, human
ggggttcttggggctgttcg

SEQ ID NO: 360671 - DNA, 20 bp, human
gcgtcgacccgggaagtgag

SEQ ID NO: 360672 - DNA, 20 bp, human
gcccgccccaggccgaagcc

SEQ ID NO: 360673 - DNA, 20 bp, human
gcggcgacgcggttgctgcg

SEQ ID NO: 360674 - DNA, 20 bp, human
gcgcggctgaggtgagccaa

SEQ ID NO: 360675 - DNA, 20 bp, human
gagtgacgactgaagcgggg

SEQ ID NO: 360676 - DNA, 20 bp, human
gcagctgaagagtgggatgg

SEQ ID NO: 360677 - DNA, 20 bp, human
gggtccaggcagctgaagag

SEQ ID NO: 360678 - DNA, 20 bp, human
gaccacccaaatgacagaaa

SEQ ID NO: 360679 - DNA, 20 bp, human
gtgcaagctcgacaatcctc

SEQ ID NO: 360680 - DNA, 20 bp, human
gggccctcgctttgcacgtc

SEQ ID NO: 360681 - DNA, 20 bp, human
gggcgctagcttggacggtt

SEQ ID NO: 360682 - DNA, 20 bp, human
gatggaggcgggactaaacc

SEQ ID NO: 360683 - DNA, 20 bp, human
gtcctgccgcggctgtcaca

SEQ ID NO: 360684 - DNA, 20 bp, human
gctccaggcgctagcttgga

SEQ ID NO: 360685 - DNA, 20 bp, human
gaatcccgcacagagctctt

SEQ ID NO: 360686 - DNA, 20 bp, human
ggggaccggctataaaaggc

SEQ ID NO: 360687 - DNA, 20 bp, human
gcaaagcctacagcacaagg

SEQ ID NO: 360688 - DNA, 20 bp, human
gtgaacggaagcgtgagggg

SEQ ID NO: 360689 - DNA, 20 bp, human
gttgctagggcggggctcga

SEQ ID NO: 360690 - DNA, 20 bp, human
gctcacttgacccgccccag

SEQ ID NO: 360691 - DNA, 20 bp, human
gctaggagaagttgctaggg

SEQ ID NO: 360692 - DNA, 20 bp, human
gcacggggcgaggcgttgct

SEQ ID NO: 360693 - DNA, 20 bp, human
gaggggtgaacggaagcgtg

SEQ ID NO: 360694 - DNA, 20 bp, human
gtcgagggaccggctataaa

SEQ ID NO: 360695 - DNA, 20 bp, human
gggggcgggtcaagtgagcc

SEQ ID NO: 360696 - DNA, 20 bp, human
gctagggcctggtcacgtaa

SEQ ID NO: 360697 - DNA, 20 bp, human
gtaaccgaagcggctcagga

SEQ ID NO: 360698 - DNA, 20 bp, human
ggagtcgtcgaaccgagact

SEQ ID NO: 360699 - DNA, 20 bp, human
gagacgaaagcttccgagag

SEQ ID NO: 360700 - DNA, 20 bp, human
ggtggggaaccgggctccta

SEQ ID NO: 360701 - DNA, 20 bp, human
gctgccttcctgagccgctt

SEQ ID NO: 360702 - DNA, 20 bp, human
gtggcggcggaggggccgtg

SEQ ID NO: 360703 - DNA, 20 bp, human
ggtgcgaaaggtaaccgaag

SEQ ID NO: 360704 - DNA, 20 bp, human
gcacgttgacgcagcagcgg

SEQ ID NO: 360705 - DNA, 20 bp, human
gcaacgtgctacgtcatttc

SEQ ID NO: 360706 - DNA, 20 bp, human
gacttaccaatgagtgccca

SEQ ID NO: 360707 - DNA, 20 bp, human
gtgaacagttggtgaagacg

SEQ ID NO: 360708 - DNA, 20 bp, human
gccggtgtccagggactcac

SEQ ID NO: 360709 - DNA, 20 bp, human
gtgcaagcggagtgccgcgc

SEQ ID NO: 360710 - DNA, 20 bp, human
ggcactcattggtaagtcct

SEQ ID NO: 360711 - DNA, 20 bp, human
ggacaccggctcaggatcct

SEQ ID NO: 360712 - DNA, 20 bp, human
ggagagtgagcgtgaacagt

SEQ ID NO: 360713 - DNA, 20 bp, human
ggatcctgagccggtgtcca

SEQ ID NO: 360714 - DNA, 20 bp, human
gtgttcacgctcactctccg

SEQ ID NO: 360715 - DNA, 20 bp, human
gcactgggtcagcgcgggga

SEQ ID NO: 360716 - DNA, 20 bp, human
gcgaggttgaccaatgacaa

SEQ ID NO: 360717 - DNA, 20 bp, human
gaacgggcgcgacctcacgg

SEQ ID NO: 360718 - DNA, 20 bp, human
gaaggccccggcgcgctccc

SEQ ID NO: 360719 - DNA, 20 bp, human
gcttccgcccggaggagaga

SEQ ID NO: 360720 - DNA, 20 bp, human
gggcgccaccatctctcctc

SEQ ID NO: 360721 - DNA, 20 bp, human
gccaatcggcggccgtcacg

SEQ ID NO: 360722 - DNA, 20 bp, human
gggcggccgtcacgtggcct

SEQ ID NO: 360723 - DNA, 20 bp, human
gggggctcggcgtctgcgga

SEQ ID NO: 360724 - DNA, 20 bp, human
ggcgaacgggcgcgacctca

SEQ ID NO: 360725 - DNA, 20 bp, human
ggcctgcgcactcgcgagtc

SEQ ID NO: 360726 - DNA, 20 bp, human
gccggagcgggtactgagtg

SEQ ID NO: 360727 - DNA, 20 bp, human
ggagtcgagcggggctgcag

SEQ ID NO: 360728 - DNA, 20 bp, human
gtcagtacccgctccgggcg

SEQ ID NO: 360729 - DNA, 20 bp, human
gcaccatgccacgcccggag

SEQ ID NO: 360730 - DNA, 20 bp, human
ggtcccgcgctccccgaccg

SEQ ID NO: 360731 - DNA, 20 bp, human
gccgcggacggtggcgttaa

SEQ ID NO: 360732 - DNA, 20 bp, human
gaccacgccggagtcgagcg

SEQ ID NO: 360733 - DNA, 20 bp, human
gccgcgcctgcgcaccacgc

SEQ ID NO: 360734 - DNA, 20 bp, human
ggtagagcgggccctgttcc

SEQ ID NO: 360735 - DNA, 20 bp, human
gtggcgttaagggaacgctg

SEQ ID NO: 360736 - DNA, 20 bp, human
ggtcgcggcctcccacgtag

SEQ ID NO: 360737 - DNA, 20 bp, human
gacagccggctgggagaagt

SEQ ID NO: 360738 - DNA, 20 bp, human
gcggcgctgccgcgtctgac

SEQ ID NO: 360739 - DNA, 20 bp, human
gcacacgtcccctacgtggg

SEQ ID NO: 360740 - DNA, 20 bp, human
gaggggacgtgtgttcttga

SEQ ID NO: 360741 - DNA, 20 bp, human
ggagaagtgggcggagtcgc

SEQ ID NO: 360742 - DNA, 20 bp, human
ggaacacacgtcccctacgt

SEQ ID NO: 360743 - DNA, 20 bp, human
ggttgcagttacgtaacagc

SEQ ID NO: 360744 - DNA, 20 bp, human
gtgggcggagtcgctggtcg

SEQ ID NO: 360745 - DNA, 20 bp, human
gttgaggggacagcagttct

SEQ ID NO: 360746 - DNA, 20 bp, human
gtccctgcgcatgccggaag

SEQ ID NO: 360747 - DNA, 20 bp, human
ggcggtgcgtgtgacgccgg

SEQ ID NO: 360748 - DNA, 20 bp, human
gccgcccggccagccgacca

SEQ ID NO: 360749 - DNA, 20 bp, human
gagagcggttcgcgcgcttc

SEQ ID NO: 360750 - DNA, 20 bp, human
gccggcactgaggcgggaag

SEQ ID NO: 360751 - DNA, 20 bp, human
ggtggcggtgcgtgtgacgc

SEQ ID NO: 360752 - DNA, 20 bp, human
gaccgcgcgcccccgttacc

SEQ ID NO: 360753 - DNA, 20 bp, human
gcagccgaccacggcagcca

SEQ ID NO: 360754 - DNA, 20 bp, human
ggttaccgggaatatggcgg

SEQ ID NO: 360755 - DNA, 20 bp, human
gtcacacgcaccgccacttc

SEQ ID NO: 360756 - DNA, 20 bp, human
gaggcagggcgactttcagg

SEQ ID NO: 360757 - DNA, 20 bp, human
gggtggggctaagacttaga

SEQ ID NO: 360758 - DNA, 20 bp, human
ggtgcgcaatagcgcagtag

SEQ ID NO: 360759 - DNA, 20 bp, human
gaggcggcttccggtttccc

SEQ ID NO: 360760 - DNA, 20 bp, human
ggtcacgggggaagccaaat

SEQ ID NO: 360761 - DNA, 20 bp, human
gcgcgtacgagcaaccaagt

SEQ ID NO: 360762 - DNA, 20 bp, human
ggcccagcctacatccactg

SEQ ID NO: 360763 - DNA, 20 bp, human
gtgggcgccgcgatgttcga

SEQ ID NO: 360764 - DNA, 20 bp, human
gcgagcaaccaagtgggagg

SEQ ID NO: 360765 - DNA, 20 bp, human
gactcctcccctttctgaga

SEQ ID NO: 360766 - DNA, 20 bp, human
gtaaaaacgtggtggttggc

SEQ ID NO: 360767 - DNA, 20 bp, human
gtgacgagagtctctttaaa

SEQ ID NO: 360768 - DNA, 20 bp, human
gcgcctccgccctcgggtgg

SEQ ID NO: 360769 - DNA, 20 bp, human
gggcggaggcgcgccggctg

SEQ ID NO: 360770 - DNA, 20 bp, human
gccggctgggggtcggggtt

SEQ ID NO: 360771 - DNA, 20 bp, human
ggcgcgcctccgccctcggg

SEQ ID NO: 360772 - DNA, 20 bp, human
gacaaaatgaatatgtacgc

SEQ ID NO: 360773 - DNA, 20 bp, human
gaagttggggagtgtgtaga

SEQ ID NO: 360774 - DNA, 20 bp, human
ggagtctctttaaaaggctc

SEQ ID NO: 360775 - DNA, 20 bp, human
gactcccaaacagcaaacgg

SEQ ID NO: 360776 - DNA, 20 bp, human
gagcctgaggcgaacaatgg

SEQ ID NO: 360777 - DNA, 20 bp, human
gcgcaaacacagctgtcgga

SEQ ID NO: 360778 - DNA, 20 bp, human
ggcgagcctgaggcgaacaa

SEQ ID NO: 360779 - DNA, 20 bp, human
gcgctgcaactccgcttcat

SEQ ID NO: 360780 - DNA, 20 bp, human
gctgggcgaagccgatgaag

SEQ ID NO: 360781 - DNA, 20 bp, human
gctccgccattgttcgcctc

SEQ ID NO: 360782 - DNA, 20 bp, human
gaaacacagctgtcggaagg

SEQ ID NO: 360783 - DNA, 20 bp, human
ggggtgaaccggaagtcgag

SEQ ID NO: 360784 - DNA, 20 bp, human
gtggtcctgggcacgctcgg

SEQ ID NO: 360785 - DNA, 20 bp, human
gtgcccaggaccaccaagga

SEQ ID NO: 360786 - DNA, 20 bp, human
gtccctcggccaatcaacgg

SEQ ID NO: 360787 - DNA, 20 bp, human
gccccctagggacccgtagt

SEQ ID NO: 360788 - DNA, 20 bp, human
gccgcccgagccaggcgccg

SEQ ID NO: 360789 - DNA, 20 bp, human
gtccccactacgggtcccta

SEQ ID NO: 360790 - DNA, 20 bp, human
gcccgccgttgattggccga

SEQ ID NO: 360791 - DNA, 20 bp, human
gaaaacaagcgagggcctgg

SEQ ID NO: 360792 - DNA, 20 bp, human
ggcggccggcacaaaattgc

SEQ ID NO: 360793 - DNA, 20 bp, human
ggacccgtagtggggactgc

SEQ ID NO: 360794 - DNA, 20 bp, human
gtgcggccgggctgtgaatg

SEQ ID NO: 360795 - DNA, 20 bp, human
gccgcctgcagtccccacta

SEQ ID NO: 360796 - DNA, 20 bp, human
gtcaccgcgtcccccgaaac

SEQ ID NO: 360797 - DNA, 20 bp, human
gggcccggcgcctggaacgg

SEQ ID NO: 360798 - DNA, 20 bp, human
ggggccgaaccaccccctct

SEQ ID NO: 360799 - DNA, 20 bp, human
gccctccccgccccctggtt

SEQ ID NO: 360800 - DNA, 20 bp, human
ggcagtggcagacgcgggtg

SEQ ID NO: 360801 - DNA, 20 bp, human
gagggcggtggagcccagag

SEQ ID NO: 360802 - DNA, 20 bp, human
gatagcggtccgaatctccc

SEQ ID NO: 360803 - DNA, 20 bp, human
gccgagcgcagtggcagacg

SEQ ID NO: 360804 - DNA, 20 bp, human
gagaacccaaccagggggcg

SEQ ID NO: 360805 - DNA, 20 bp, human
ggagcccagagggggtggtt

SEQ ID NO: 360806 - DNA, 20 bp, human
gaagctggtaaacttttctc

SEQ ID NO: 360807 - DNA, 20 bp, human
gcagctccacagcttccaat

SEQ ID NO: 360808 - DNA, 20 bp, human
gcatacgtctgaaccctaaa

SEQ ID NO: 360809 - DNA, 20 bp, human
gaggccctactccacccagt

SEQ ID NO: 360810 - DNA, 20 bp, human
gctaaccgcgttctgggcac

SEQ ID NO: 360811 - DNA, 20 bp, human
ggcacaggacactttgttgc

SEQ ID NO: 360812 - DNA, 20 bp, human
gcaatcatgacttcatctag

SEQ ID NO: 360813 - DNA, 20 bp, human
gggagaaaaacatgctaact

SEQ ID NO: 360814 - DNA, 20 bp, human
gctatgctgcagatgcaaca

SEQ ID NO: 360815 - DNA, 20 bp, human
gaacccatcagtcagttcta

SEQ ID NO: 360816 - DNA, 20 bp, human
gcaggcgccgcccaagtcca

SEQ ID NO: 360817 - DNA, 20 bp, human
gaggtccagaaaaagaagat

SEQ ID NO: 360818 - DNA, 20 bp, human
gtccaagggcgggactgccg

SEQ ID NO: 360819 - DNA, 20 bp, human
gcagtcccgcccttggactt

SEQ ID NO: 360820 - DNA, 20 bp, human
gtaagaagctggaaattcgg

SEQ ID NO: 360821 - DNA, 20 bp, human
gcgtgcgccggatttctctt

SEQ ID NO: 360822 - DNA, 20 bp, human
gcccacccctggcgctgccg

SEQ ID NO: 360823 - DNA, 20 bp, human
gacgtcgcgcactggggcta

SEQ ID NO: 360824 - DNA, 20 bp, human
gactgccgcggcagcgccag

SEQ ID NO: 360825 - DNA, 20 bp, human
gctgcccacgtcgcgcactg

SEQ ID NO: 360826 - DNA, 20 bp, human
gggaacgcgcttcccgaaag

SEQ ID NO: 360827 - DNA, 20 bp, human
gagaccgatggacccggaaa

SEQ ID NO: 360828 - DNA, 20 bp, human
ggacccggaaagggcggagg

SEQ ID NO: 360829 - DNA, 20 bp, human
gaatagcaagcgaggtggga

SEQ ID NO: 360830 - DNA, 20 bp, human
ggggaagcgcgttccaatcg

SEQ ID NO: 360831 - DNA, 20 bp, human
ggtgggagggattagaccga

SEQ ID NO: 360832 - DNA, 20 bp, human
ggaggtcgtagtcgcgtctg

SEQ ID NO: 360833 - DNA, 20 bp, human
gccgatggacccggaaaggg

SEQ ID NO: 360834 - DNA, 20 bp, human
gtcgctatgcgtgtgcttgt

SEQ ID NO: 360835 - DNA, 20 bp, human
gtgcgtgtgcttgtgggtga

SEQ ID NO: 360836 - DNA, 20 bp, human
gtcaacgccggtgaaggtga

SEQ ID NO: 360837 - DNA, 20 bp, human
gacgcacagacaggggacgt

SEQ ID NO: 360838 - DNA, 20 bp, human
gcgtggtgggaaccctgtta

SEQ ID NO: 360839 - DNA, 20 bp, human
gacggcggaacgcacagaca

SEQ ID NO: 360840 - DNA, 20 bp, human
ggtgtctccttcaccttcac

SEQ ID NO: 360841 - DNA, 20 bp, human
ggcacagccagagaacgtgg

SEQ ID NO: 360842 - DNA, 20 bp, human
gctccaggaggcaggtccga

SEQ ID NO: 360843 - DNA, 20 bp, human
ggggaagacgtgaccctaaa

SEQ ID NO: 360844 - DNA, 20 bp, human
gaacgcacagccagagaacg

SEQ ID NO: 360845 - DNA, 20 bp, human
gagttgacgtggccctaaca

SEQ ID NO: 360846 - DNA, 20 bp, human
ggccaagcctctgtagcatc

SEQ ID NO: 360847 - DNA, 20 bp, human
gtagctatggtcacagaaag

SEQ ID NO: 360848 - DNA, 20 bp, human
ggagcgtgatgaatgagcac

SEQ ID NO: 360849 - DNA, 20 bp, human
ggggcagtggtgatggtcag

SEQ ID NO: 360850 - DNA, 20 bp, human
ggagcacgggatgttgctca

SEQ ID NO: 360851 - DNA, 20 bp, human
gggcagggggttcaagtcca

SEQ ID NO: 360852 - DNA, 20 bp, human
gtaaccaacacctacttcac

SEQ ID NO: 360853 - DNA, 20 bp, human
gtacttcacagggtctcatt

SEQ ID NO: 360854 - DNA, 20 bp, human
gagcatcaggaaaggctggt

SEQ ID NO: 360855 - DNA, 20 bp, human
gtcctgatgctacagaggct

SEQ ID NO: 360856 - DNA, 20 bp, human
gcacccaggcggtgtaaggc

SEQ ID NO: 360857 - DNA, 20 bp, human
gggctcacccaggcggtgta

SEQ ID NO: 360858 - DNA, 20 bp, human
gggtggggacaggatttcta

SEQ ID NO: 360859 - DNA, 20 bp, human
gtctctccccctgccctgat

SEQ ID NO: 360860 - DNA, 20 bp, human
gcagctttacccatcagggc

SEQ ID NO: 360861 - DNA, 20 bp, human
gagagagggaggcagctacc

SEQ ID NO: 360862 - DNA, 20 bp, human
gtgcctgccttacaccgcct

SEQ ID NO: 360863 - DNA, 20 bp, human
gttggcagctttacccatca

SEQ ID NO: 360864 - DNA, 20 bp, human
gtttctaggggagctgtctg

SEQ ID NO: 360865 - DNA, 20 bp, human
gaggtgacaaggcttcaggt

SEQ ID NO: 360866 - DNA, 20 bp, human
ggggaggaggagtgggttgt

SEQ ID NO: 360867 - DNA, 20 bp, human
gctgccaggacccacccccc

SEQ ID NO: 360868 - DNA, 20 bp, human
ggccactgaggctgtcagaa

SEQ ID NO: 360869 - DNA, 20 bp, human
gactgaggctgtcagaaggg

SEQ ID NO: 360870 - DNA, 20 bp, human
gggcctcaagccaggggggt

SEQ ID NO: 360871 - DNA, 20 bp, human
gctggccaagctttcttctt

SEQ ID NO: 360872 - DNA, 20 bp, human
gggcagccaatggggccctg

SEQ ID NO: 360873 - DNA, 20 bp, human
gcacctctgggcagccaatg

SEQ ID NO: 360874 - DNA, 20 bp, human
gcacgaaactgaggacagaa

SEQ ID NO: 360875 - DNA, 20 bp, human
gctgtcctcagtttcgtgaa

SEQ ID NO: 360876 - DNA, 20 bp, human
gggcccagggccaggggtaa

SEQ ID NO: 360877 - DNA, 20 bp, human
gggccctgggccatctcttc

SEQ ID NO: 360878 - DNA, 20 bp, human
ggtgcccgggaaagcggtga

SEQ ID NO: 360879 - DNA, 20 bp, human
gagggtggtgcatgagtcat

SEQ ID NO: 360880 - DNA, 20 bp, human
ggcaaccctcaccgctttcc

SEQ ID NO: 360881 - DNA, 20 bp, human
gtaggcagtgcccgggaaag

SEQ ID NO: 360882 - DNA, 20 bp, human
ggtcttcacccggaggctta

SEQ ID NO: 360883 - DNA, 20 bp, human
gatcccggaagagatggccc

SEQ ID NO: 360884 - DNA, 20 bp, human
gtcagaaaagggaacttatt

SEQ ID NO: 360885 - DNA, 20 bp, human
ggaggagggaccaaggttgc

SEQ ID NO: 360886 - DNA, 20 bp, human
gcgcccaggcccagtgttcc

SEQ ID NO: 360887 - DNA, 20 bp, human
ggcagcaaaggtcacattcc

SEQ ID NO: 360888 - DNA, 20 bp, human
gacactgggcctgggcgagc

SEQ ID NO: 360889 - DNA, 20 bp, human
gggaaggggaattagcaccg

SEQ ID NO: 360890 - DNA, 20 bp, human
gaatcattaggtcatcggaa

SEQ ID NO: 360891 - DNA, 20 bp, human
ggtcacattcctggaacact

SEQ ID NO: 360892 - DNA, 20 bp, human
gggaattagcaccgtggatc

SEQ ID NO: 360893 - DNA, 20 bp, human
gttagcaccgtggatctgga

SEQ ID NO: 360894 - DNA, 20 bp, human
gattcctggaacactgggcc

SEQ ID NO: 360895 - DNA, 20 bp, human
gcccaacaccccatgaagca

SEQ ID NO: 360896 - DNA, 20 bp, human
gcaatcgcgagcaacctctc

SEQ ID NO: 360897 - DNA, 20 bp, human
gctacccgcccacaccggag

SEQ ID NO: 360898 - DNA, 20 bp, human
ggacccaggcttagttgggg

SEQ ID NO: 360899 - DNA, 20 bp, human
ggccccgcggcccttcaccg

SEQ ID NO: 360900 - DNA, 20 bp, human
gaactactggagctcgggtc

SEQ ID NO: 360901 - DNA, 20 bp, human
gccctgagactggactagca

SEQ ID NO: 360902 - DNA, 20 bp, human
ggggcgggagctggcacggt

SEQ ID NO: 360903 - DNA, 20 bp, human
gcggttccgcgtcccggctt

SEQ ID NO: 360904 - DNA, 20 bp, human
gtgtcagctctccgcagcga

SEQ ID NO: 360905 - DNA, 20 bp, human
gtgcacttccgcttccgggg

SEQ ID NO: 360906 - DNA, 20 bp, human
gtgaagacccggggctccta

SEQ ID NO: 360907 - DNA, 20 bp, human
gcaccggcccagcgtccttg

SEQ ID NO: 360908 - DNA, 20 bp, human
gcagccaggaatgaacctga

SEQ ID NO: 360909 - DNA, 20 bp, human
ggcccaccccgcagcattct

SEQ ID NO: 360910 - DNA, 20 bp, human
gccctccgaagggtcggaca

SEQ ID NO: 360911 - DNA, 20 bp, human
gcccgggtcttcactggccg

SEQ ID NO: 360912 - DNA, 20 bp, human
gagacccggggctcctaggg

SEQ ID NO: 360913 - DNA, 20 bp, human
gcacgtggccgcaaggacgc

SEQ ID NO: 360914 - DNA, 20 bp, human
ggaagggtcggacaaggctc

SEQ ID NO: 360915 - DNA, 20 bp, human
gagacgcccaagcgagtcgc

SEQ ID NO: 360916 - DNA, 20 bp, human
gctctggtctcgcacgtcac

SEQ ID NO: 360917 - DNA, 20 bp, human
ggcggggcgcgccctctgga

SEQ ID NO: 360918 - DNA, 20 bp, human
gtggtctcgcacgtcactgg

SEQ ID NO: 360919 - DNA, 20 bp, human
gctccgggtcagggtaactg

SEQ ID NO: 360920 - DNA, 20 bp, human
gcgcacgtcactggaggata

SEQ ID NO: 360921 - DNA, 20 bp, human
gcgagcgcgttgctgcccgg

SEQ ID NO: 360922 - DNA, 20 bp, human
gcctcggaacagctcacttc

SEQ ID NO: 360923 - DNA, 20 bp, human
gtccaaagccctccgggtca

SEQ ID NO: 360924 - DNA, 20 bp, human
ggaaaagggcagacttggtc

SEQ ID NO: 360925 - DNA, 20 bp, human
ggcccgacgggccgtggcgt

SEQ ID NO: 360926 - DNA, 20 bp, human
gagctccgacccgcgagcgt

SEQ ID NO: 360927 - DNA, 20 bp, human
ggccgcggccgagggagcgg

SEQ ID NO: 360928 - DNA, 20 bp, human
ggcgatggttgctaagaaag

SEQ ID NO: 360929 - DNA, 20 bp, human
gaggagctcggagaaggcgc

SEQ ID NO: 360930 - DNA, 20 bp, human
ggaggggccacgaggacctc

SEQ ID NO: 360931 - DNA, 20 bp, human
gaagtgacgcaaaactggga

SEQ ID NO: 360932 - DNA, 20 bp, human
gcctgcgcagttcgggcccc

SEQ ID NO: 360933 - DNA, 20 bp, human
gggcacatccagcagtgcga

SEQ ID NO: 360934 - DNA, 20 bp, human
gaggcggagtgaagccccaa

SEQ ID NO: 360935 - DNA, 20 bp, human
gacggcacttgtggttgtta

SEQ ID NO: 360936 - DNA, 20 bp, human
gcccgcgcggtgtgattaat

SEQ ID NO: 360937 - DNA, 20 bp, human
ggctgcgacccctttaagtc

SEQ ID NO: 360938 - DNA, 20 bp, human
gtaagtggagacacgtgctt

SEQ ID NO: 360939 - DNA, 20 bp, human
gtccgtcagcaacttccggc

SEQ ID NO: 360940 - DNA, 20 bp, human
gcatccaagccggacttaaa

SEQ ID NO: 360941 - DNA, 20 bp, human
ggtaagttatcacttccggc

SEQ ID NO: 360942 - DNA, 20 bp, human
ggctagagagtcgatgactt

SEQ ID NO: 360943 - DNA, 20 bp, human
gtagctccgtcagcaacttc

SEQ ID NO: 360944 - DNA, 20 bp, human
gacggagctacttccgccca

SEQ ID NO: 360945 - DNA, 20 bp, human
gaggggagggccctggagcg

SEQ ID NO: 360946 - DNA, 20 bp, human
gaggccagtgggcatcagaa

SEQ ID NO: 360947 - DNA, 20 bp, human
gcactggcctcagtcccagt

SEQ ID NO: 360948 - DNA, 20 bp, human
gagtagggagcgatgcgctg

SEQ ID NO: 360949 - DNA, 20 bp, human
gtgcctgggtctctgacttc

SEQ ID NO: 360950 - DNA, 20 bp, human
ggatcccgagaggcggagta

SEQ ID NO: 360951 - DNA, 20 bp, human
gggcgagcaagtgtgcccac

SEQ ID NO: 360952 - DNA, 20 bp, human
ggctccctactccgcctctc

SEQ ID NO: 360953 - DNA, 20 bp, human
gcacttgctcgcctcctgcc

SEQ ID NO: 360954 - DNA, 20 bp, human
ggcgcggaaggctctgacac

SEQ ID NO: 360955 - DNA, 20 bp, human
gcctcttaaaggatcccgag

SEQ ID NO: 360956 - DNA, 20 bp, human
ggctccaagcgcctcctcat

SEQ ID NO: 360957 - DNA, 20 bp, human
ggggtcagggctgacaaact

SEQ ID NO: 360958 - DNA, 20 bp, human
gaaaggacccagctgggtca

SEQ ID NO: 360959 - DNA, 20 bp, human
gcctcctggcaggggacctc

SEQ ID NO: 360960 - DNA, 20 bp, human
gcttggggacagatctggag

SEQ ID NO: 360961 - DNA, 20 bp, human
gcctaagtgtgggaagactg

SEQ ID NO: 360962 - DNA, 20 bp, human
gtgggctccaaggtcacggg

SEQ ID NO: 360963 - DNA, 20 bp, human
gtggagccacgcccaggagt

SEQ ID NO: 360964 - DNA, 20 bp, human
ggaggtcccctgcttggctt

SEQ ID NO: 360965 - DNA, 20 bp, human
gggcatggagcgtgtgccag

SEQ ID NO: 360966 - DNA, 20 bp, human
ggggagcccccgcagtaagg

SEQ ID NO: 360967 - DNA, 20 bp, human
gggggctcccgcctgttcgc

SEQ ID NO: 360968 - DNA, 20 bp, human
gcaccctacttgggacaggg

SEQ ID NO: 360969 - DNA, 20 bp, human
gggcgggagcccccgcagta

SEQ ID NO: 360970 - DNA, 20 bp, human
ggctcccgcctgttcgcagg

SEQ ID NO: 360971 - DNA, 20 bp, human
ggcgcaccctacttgggaca

SEQ ID NO: 360972 - DNA, 20 bp, human
gccaggcctccttactgcgg

SEQ ID NO: 360973 - DNA, 20 bp, human
gctgccacctgcgaacaggc

SEQ ID NO: 360974 - DNA, 20 bp, human
gtctccaggattttttgctg

SEQ ID NO: 360975 - DNA, 20 bp, human
ggcccagtgcctctcccgtc

SEQ ID NO: 360976 - DNA, 20 bp, human
gaggggcggggctagaacca

SEQ ID NO: 360977 - DNA, 20 bp, human
gtggaggcagagctagatta

SEQ ID NO: 360978 - DNA, 20 bp, human
gagtggggcgggaccagtta

SEQ ID NO: 360979 - DNA, 20 bp, human
gacatctaaaaataaggggc

SEQ ID NO: 360980 - DNA, 20 bp, human
ggggccatggccggggacgt

SEQ ID NO: 360981 - DNA, 20 bp, human
gtagagaaaggactgggctg

SEQ ID NO: 360982 - DNA, 20 bp, human
gccaatctagagaaaggact

SEQ ID NO: 360983 - DNA, 20 bp, human
ggccccaggcgaactccccc

SEQ ID NO: 360984 - DNA, 20 bp, human
gaaccagggggagttcgcct

SEQ ID NO: 360985 - DNA, 20 bp, human
ggtgtgaccaatctagagaa

SEQ ID NO: 360986 - DNA, 20 bp, human
gagccccacctgttgccctg

SEQ ID NO: 360987 - DNA, 20 bp, human
gccagggcaggctgaatcca

SEQ ID NO: 360988 - DNA, 20 bp, human
gaccacaggagtagagggta

SEQ ID NO: 360989 - DNA, 20 bp, human
ggagcctcagggcaacaggt

SEQ ID NO: 360990 - DNA, 20 bp, human
gggtaggggactgagaggca

SEQ ID NO: 360991 - DNA, 20 bp, human
gtaggacagcgatgtttcct

SEQ ID NO: 360992 - DNA, 20 bp, human
ggacttccgggcctctgttg

SEQ ID NO: 360993 - DNA, 20 bp, human
ggccaagtgtggcccagctc

SEQ ID NO: 360994 - DNA, 20 bp, human
gaacatctgggatgaatcat

SEQ ID NO: 360995 - DNA, 20 bp, human
gctcacccccaacagaggcc

SEQ ID NO: 360996 - DNA, 20 bp, human
ggggcgggaacgacaggatg

SEQ ID NO: 360997 - DNA, 20 bp, human
gacgacgggcggggctaagg

SEQ ID NO: 360998 - DNA, 20 bp, human
ggccccgcccctcggctcgt

SEQ ID NO: 360999 - DNA, 20 bp, human
ggggacagagggatgaggcg

SEQ ID NO: 361000 - DNA, 20 bp, human
gaggcggggaggacggacgc

SEQ ID NO: 361001 - DNA, 20 bp, human
gccaaaggggcgggaacgac

SEQ ID NO: 361002 - DNA, 20 bp, human
gaggcgtggaagacgggcgg

SEQ ID NO: 361003 - DNA, 20 bp, human
gggcgccggaagttggtcga

SEQ ID NO: 361004 - DNA, 20 bp, human
gagtccctggccagcgtcct

SEQ ID NO: 361005 - DNA, 20 bp, human
gaggcgaggaacgacggaag

SEQ ID NO: 361006 - DNA, 20 bp, human
ggggcagcaagttaataatt

SEQ ID NO: 361007 - DNA, 20 bp, human
gcagcagtttcccatcggaa

SEQ ID NO: 361008 - DNA, 20 bp, human
gcctattaagccattccgat

SEQ ID NO: 361009 - DNA, 20 bp, human
gttcagcagcagtttcccat

SEQ ID NO: 361010 - DNA, 20 bp, human
gtcagaccttctcaatatgg

SEQ ID NO: 361011 - DNA, 20 bp, human
gtgctgaagcagaaaggttc

SEQ ID NO: 361012 - DNA, 20 bp, human
gttttcagaccttctcaata

SEQ ID NO: 361013 - DNA, 20 bp, human
gtatgccagttgacttggaa

SEQ ID NO: 361014 - DNA, 20 bp, human
gaaagctatgccagttgact

SEQ ID NO: 361015 - DNA, 20 bp, human
gaattgggaaaaaattccat

SEQ ID NO: 361016 - DNA, 20 bp, human
ggagcgggtgggactaagga

SEQ ID NO: 361017 - DNA, 20 bp, human
gcctggagcgggtgggacta

SEQ ID NO: 361018 - DNA, 20 bp, human
gccttcctgcagaacccgat

SEQ ID NO: 361019 - DNA, 20 bp, human
gcggcgggtcccgtctcgac

SEQ ID NO: 361020 - DNA, 20 bp, human
gcggggcgcgtcactcggag

SEQ ID NO: 361021 - DNA, 20 bp, human
gtcgccgaaaggtccctccc

SEQ ID NO: 361022 - DNA, 20 bp, human
gggggcgtggtttgattccg

SEQ ID NO: 361023 - DNA, 20 bp, human
gctgcagaacccgattggcc

SEQ ID NO: 361024 - DNA, 20 bp, human
ggtgggactaaggagggccc

SEQ ID NO: 361025 - DNA, 20 bp, human
ggattggcctgggtgagctg

SEQ ID NO: 361026 - DNA, 20 bp, human
gcagaccttggaagttaaga

SEQ ID NO: 361027 - DNA, 20 bp, human
ggatagttgtggttctctga

SEQ ID NO: 361028 - DNA, 20 bp, human
gcactaccggtccccagaat

SEQ ID NO: 361029 - DNA, 20 bp, human
gtccaccttcttaacttcca

SEQ ID NO: 361030 - DNA, 20 bp, human
gggtgcaatggccgctcaaa

SEQ ID NO: 361031 - DNA, 20 bp, human
gctgagggaagccaattctg

SEQ ID NO: 361032 - DNA, 20 bp, human
gtctcccaagacttagtttc

SEQ ID NO: 361033 - DNA, 20 bp, human
gtaacttccaaggtctggct

SEQ ID NO: 361034 - DNA, 20 bp, human
gaaggagggtgggagttaat

SEQ ID NO: 361035 - DNA, 20 bp, human
gaatggccgctcaaagggcg

SEQ ID NO: 361036 - DNA, 20 bp, human
ggaacgtagtggttcttaaa

SEQ ID NO: 361037 - DNA, 20 bp, human
gggctgcgacccaaacggag

SEQ ID NO: 361038 - DNA, 20 bp, human
ggaggcgcgccgggattggt

SEQ ID NO: 361039 - DNA, 20 bp, human
gacagcccccgtcccggcga

SEQ ID NO: 361040 - DNA, 20 bp, human
ggggcgccaaagtccgaccc

SEQ ID NO: 361041 - DNA, 20 bp, human
gcgcgccttcgccgggacgg

SEQ ID NO: 361042 - DNA, 20 bp, human
gggcgaaggcgcgaacgtag

SEQ ID NO: 361043 - DNA, 20 bp, human
gcagcagcgaatgcggggta

SEQ ID NO: 361044 - DNA, 20 bp, human
gtaaagggctgcgacccaaa

SEQ ID NO: 361045 - DNA, 20 bp, human
gtgtggaggcgcgccgggat

SEQ ID NO: 361046 - DNA, 20 bp, human
gggcgggcgcagagttacca

SEQ ID NO: 361047 - DNA, 20 bp, human
gcgggcgaaggtaccgagag

SEQ ID NO: 361048 - DNA, 20 bp, human
gcctgagcttgcttaataac

SEQ ID NO: 361049 - DNA, 20 bp, human
gacgtcaagaggaggggacg

SEQ ID NO: 361050 - DNA, 20 bp, human
gcccacgcccctcggccgtc

SEQ ID NO: 361051 - DNA, 20 bp, human
gtctgccacgtcaagaggag

SEQ ID NO: 361052 - DNA, 20 bp, human
gccgcctctgccacgtcaag

SEQ ID NO: 361053 - DNA, 20 bp, human
ggtagcggggaccgagccag

SEQ ID NO: 361054 - DNA, 20 bp, human
gaaggtaccgagaggggagg

SEQ ID NO: 361055 - DNA, 20 bp, human
gagttaccagggcaggccac

SEQ ID NO: 361056 - DNA, 20 bp, human
gcgctggggcgctggccaat

SEQ ID NO: 361057 - DNA, 20 bp, human
gggtggggaaacgtgttccg

SEQ ID NO: 361058 - DNA, 20 bp, human
gtcaaagagcgcttctccga

SEQ ID NO: 361059 - DNA, 20 bp, human
ggccccagcgcgtcatgcca

SEQ ID NO: 361060 - DNA, 20 bp, human
gttgccctgttccaagatgg

SEQ ID NO: 361061 - DNA, 20 bp, human
gcgcttctccgacggactgg

SEQ ID NO: 361062 - DNA, 20 bp, human
gggaagaaggcattagcatg

SEQ ID NO: 361063 - DNA, 20 bp, human
ggcggggcgggtggtgagcg

SEQ ID NO: 361064 - DNA, 20 bp, human
gcggtagctaaggcgatcag

SEQ ID NO: 361065 - DNA, 20 bp, human
gcgcagccagcgctcctcag

SEQ ID NO: 361066 - DNA, 20 bp, human
gtagcacgtgacaccctcgg

SEQ ID NO: 361067 - DNA, 20 bp, human
gggtgtcacgtgctagacgc

SEQ ID NO: 361068 - DNA, 20 bp, human
gggcgtcgccgtgtagggga

SEQ ID NO: 361069 - DNA, 20 bp, human
ggcgacgccagatatcaaca

SEQ ID NO: 361070 - DNA, 20 bp, human
ggtctagcacgtgacaccct

SEQ ID NO: 361071 - DNA, 20 bp, human
gatctggcgtcgccgtgtag

SEQ ID NO: 361072 - DNA, 20 bp, human
gcacgtgacaccctcggagg

SEQ ID NO: 361073 - DNA, 20 bp, human
gcgcaagtgcggaagtgcgc

SEQ ID NO: 361074 - DNA, 20 bp, human
ggtgtcgccatgttgatatc

SEQ ID NO: 361075 - DNA, 20 bp, human
gcacgtctatccagaacctg

SEQ ID NO: 361076 - DNA, 20 bp, human
gaggccgggcacggtcgtcg

SEQ ID NO: 361077 - DNA, 20 bp, human
ggggcacggtcgtcggggtc

SEQ ID NO: 361078 - DNA, 20 bp, human
gctcgcagagccaggatcgt

SEQ ID NO: 361079 - DNA, 20 bp, human
gctggcagagaagagttcgc

SEQ ID NO: 361080 - DNA, 20 bp, human
gtccggccggccgtgagagt

SEQ ID NO: 361081 - DNA, 20 bp, human
ggagctgtcaggtggcctcg

SEQ ID NO: 361082 - DNA, 20 bp, human
gcggccgcgcagccgcaatc

SEQ ID NO: 361083 - DNA, 20 bp, human
ggaactcttctctgccagcc

SEQ ID NO: 361084 - DNA, 20 bp, human
ggccacgtcaccgactctca

SEQ ID NO: 361085 - DNA, 20 bp, human
gtcagattgccccacgatcc

SEQ ID NO: 361086 - DNA, 20 bp, human
ggcgtggggcgcgtgggtca

SEQ ID NO: 361087 - DNA, 20 bp, human
gaccccaggtgtaagtcccg

SEQ ID NO: 361088 - DNA, 20 bp, human
gagggtgtcacccgggaccg

SEQ ID NO: 361089 - DNA, 20 bp, human
ggggcccagcattactggga

SEQ ID NO: 361090 - DNA, 20 bp, human
gtggggcgcgtgggtcaagg

SEQ ID NO: 361091 - DNA, 20 bp, human
ggccccgggacttacacctg

SEQ ID NO: 361092 - DNA, 20 bp, human
gaacgcgcctggcgtcactg

SEQ ID NO: 361093 - DNA, 20 bp, human
gggtgtaagtcccggggcgt

SEQ ID NO: 361094 - DNA, 20 bp, human
gtggactcgcggagaagctt

SEQ ID NO: 361095 - DNA, 20 bp, human
gcaggcctgagtctggcccg

SEQ ID NO: 361096 - DNA, 20 bp, human
gcacaggcggcggccatgat

SEQ ID NO: 361097 - DNA, 20 bp, human
gcgtggaggaggaacttccg

SEQ ID NO: 361098 - DNA, 20 bp, human
gaatacatacgactcagcag

SEQ ID NO: 361099 - DNA, 20 bp, human
gcgactcagcagaggcgcac

SEQ ID NO: 361100 - DNA, 20 bp, human
gcggaaatcaacggggtcag

SEQ ID NO: 361101 - DNA, 20 bp, human
gggtccccgaaatgcagacg

SEQ ID NO: 361102 - DNA, 20 bp, human
gcggccctaaagcgtggagg

SEQ ID NO: 361103 - DNA, 20 bp, human
ggccccctcggaaccggaag

SEQ ID NO: 361104 - DNA, 20 bp, human
ggggacggccccctcggaac

SEQ ID NO: 361105 - DNA, 20 bp, human
ggaggcgcatgcgcggcatc

SEQ ID NO: 361106 - DNA, 20 bp, human
ggggctgcgccgagaaaata

SEQ ID NO: 361107 - DNA, 20 bp, human
gggggcgcgcagccgagaaa

SEQ ID NO: 361108 - DNA, 20 bp, human
gaaaagggaaaaagcgaaaa

SEQ ID NO: 361109 - DNA, 20 bp, human
gggaaaaagcgaaaaggggg

SEQ ID NO: 361110 - DNA, 20 bp, human
gcgaaaagggggaggtcgct

SEQ ID NO: 361111 - DNA, 20 bp, human
ggcagccccgcaggaaggag

SEQ ID NO: 361112 - DNA, 20 bp, human
gtgtaacgcgggaggagtgg

SEQ ID NO: 361113 - DNA, 20 bp, human
gtggcaacgtgtaacgcggg

SEQ ID NO: 361114 - DNA, 20 bp, human
gtcggcgcagccccgcagga

SEQ ID NO: 361115 - DNA, 20 bp, human
gtgaaactgcaacctgttga

SEQ ID NO: 361116 - DNA, 20 bp, human
gggtcccggaagtgccgtgg

SEQ ID NO: 361117 - DNA, 20 bp, human
ggctgtgcgtcgggtgggcg

SEQ ID NO: 361118 - DNA, 20 bp, human
ggcagagcgccaccaaccag

SEQ ID NO: 361119 - DNA, 20 bp, human
gagcccgccacggcacttcc

SEQ ID NO: 361120 - DNA, 20 bp, human
ggccggtcccggaagtgccg

SEQ ID NO: 361121 - DNA, 20 bp, human
gggcgcgcagaatgtggatg

SEQ ID NO: 361122 - DNA, 20 bp, human
ggccgtggcgggctgtgcgt

SEQ ID NO: 361123 - DNA, 20 bp, human
gcggggaaagatgtcgctcc

SEQ ID NO: 361124 - DNA, 20 bp, human
ggtacggctccgctggttgg

SEQ ID NO: 361125 - DNA, 20 bp, human
gccgcctcccaggctaccgc

SEQ ID NO: 361126 - DNA, 20 bp, human
gtcaacgggcggagctaaag

SEQ ID NO: 361127 - DNA, 20 bp, human
ggctccgcccgttgactctg

SEQ ID NO: 361128 - DNA, 20 bp, human
ggtcgtagccgcagagtcaa

SEQ ID NO: 361129 - DNA, 20 bp, human
gtagccgcagagtcaacggg

SEQ ID NO: 361130 - DNA, 20 bp, human
gacccgaagttgctccgcag

SEQ ID NO: 361131 - DNA, 20 bp, human
gtggctgctgggacacaacg

SEQ ID NO: 361132 - DNA, 20 bp, human
ggcccactgcggagcaactt

SEQ ID NO: 361133 - DNA, 20 bp, human
gcggtcaaatgcacgtcttc

SEQ ID NO: 361134 - DNA, 20 bp, human
gaggctcaggcccttccgat

SEQ ID NO: 361135 - DNA, 20 bp, human
gtcgcgggaaccccgaaggt

SEQ ID NO: 361136 - DNA, 20 bp, human
ggaagccaagggttggatag

SEQ ID NO: 361137 - DNA, 20 bp, human
ggcgcaaaggcctgtcacgg

SEQ ID NO: 361138 - DNA, 20 bp, human
gtgagccgggccaaacgtga

SEQ ID NO: 361139 - DNA, 20 bp, human
gccaagggttggatagaggc

SEQ ID NO: 361140 - DNA, 20 bp, human
gcaaacgtgacggaggaagc

SEQ ID NO: 361141 - DNA, 20 bp, human
gaagccgaagggttcaacag

SEQ ID NO: 361142 - DNA, 20 bp, human
gtagacccatccagggatga

SEQ ID NO: 361143 - DNA, 20 bp, human
ggggagtgaagaaaagccga

SEQ ID NO: 361144 - DNA, 20 bp, human
gggaaggataagcgggaaga

SEQ ID NO: 361145 - DNA, 20 bp, human
gccgaagggttcaacagggg

SEQ ID NO: 361146 - DNA, 20 bp, human
gtgacccgctgcgcaatcac

SEQ ID NO: 361147 - DNA, 20 bp, human
gctaccctgtgattgcgcag

SEQ ID NO: 361148 - DNA, 20 bp, human
gcggctgcggaggaccaaag

SEQ ID NO: 361149 - DNA, 20 bp, human
ggcaatcacagggtaggtga

SEQ ID NO: 361150 - DNA, 20 bp, human
ggaccccggcagggcaccgt

SEQ ID NO: 361151 - DNA, 20 bp, human
gtagggccagtctctgaaaa

SEQ ID NO: 361152 - DNA, 20 bp, human
gtgaatagaccagaacttac

SEQ ID NO: 361153 - DNA, 20 bp, human
gcagtttgagccaggctcta

SEQ ID NO: 361154 - DNA, 20 bp, human
ggatctggaccagtaagttc

SEQ ID NO: 361155 - DNA, 20 bp, human
gcgagacactgacagaccca

SEQ ID NO: 361156 - DNA, 20 bp, human
gtcgccgagacctcaagccc

SEQ ID NO: 361157 - DNA, 20 bp, human
gggagccccgctgcatgccg

SEQ ID NO: 361158 - DNA, 20 bp, human
gcggcctcacggagaaactg

SEQ ID NO: 361159 - DNA, 20 bp, human
gtcctggggcctgtcgggaa

SEQ ID NO: 361160 - DNA, 20 bp, human
gcaagccccggcatgcagcg

SEQ ID NO: 361161 - DNA, 20 bp, human
ggtcacgcctcccgagactg

SEQ ID NO: 361162 - DNA, 20 bp, human
ggcttgaggtctcggcgaag

SEQ ID NO: 361163 - DNA, 20 bp, human
gtggtaacgcgagagcgcgc

SEQ ID NO: 361164 - DNA, 20 bp, human
gaggtctcggcgaagcggcg

SEQ ID NO: 361165 - DNA, 20 bp, human
ggcacagccccagtctcggg

SEQ ID NO: 361166 - DNA, 20 bp, human
ggctgtatccctgtggctat

SEQ ID NO: 361167 - DNA, 20 bp, human
ggaggaggagacatatatga

SEQ ID NO: 361168 - DNA, 20 bp, human
gtcatggtgcccatagccac

SEQ ID NO: 361169 - DNA, 20 bp, human
gcatatatgaaggaacgaac

SEQ ID NO: 361170 - DNA, 20 bp, human
gagacagggtccctctctct

SEQ ID NO: 361171 - DNA, 20 bp, human
gctggccacacgcacagaca

SEQ ID NO: 361172 - DNA, 20 bp, human
gctacagaaacgggctattc

SEQ ID NO: 361173 - DNA, 20 bp, human
gacttaagttattagactca

SEQ ID NO: 361174 - DNA, 20 bp, human
gcttcaaattccattcctgt

SEQ ID NO: 361175 - DNA, 20 bp, human
gttttatttgtctgctaaga

SEQ ID NO: 361176 - DNA, 20 bp, human
gcgggcccggtcccaggacc

SEQ ID NO: 361177 - DNA, 20 bp, human
gggtcaccatggcaacgcag

SEQ ID NO: 361178 - DNA, 20 bp, human
gtccccgaagggtgcccagg

SEQ ID NO: 361179 - DNA, 20 bp, human
ggcgcgggtcaggtggcgaa

SEQ ID NO: 361180 - DNA, 20 bp, human
ggcctcctgggcacccttcg

SEQ ID NO: 361181 - DNA, 20 bp, human
ggctcgggcgggcagccgtg

SEQ ID NO: 361182 - DNA, 20 bp, human
ggggccggtaggatcgcgtc

SEQ ID NO: 361183 - DNA, 20 bp, human
ggacgtccgctgcgttgcca

SEQ ID NO: 361184 - DNA, 20 bp, human
ggaggcctgggtcggacgtg

SEQ ID NO: 361185 - DNA, 20 bp, human
gtcggccaacggcccgccct

SEQ ID NO: 361186 - DNA, 20 bp, human
gaactgacgcacgtacggca

SEQ ID NO: 361187 - DNA, 20 bp, human
gccagctgccggtctttcgg

SEQ ID NO: 361188 - DNA, 20 bp, human
gcatcagcgcaaatctgtga

SEQ ID NO: 361189 - DNA, 20 bp, human
ggacgcacgtacggcagggc

SEQ ID NO: 361190 - DNA, 20 bp, human
gtcggcccgcagtggccagc

SEQ ID NO: 361191 - DNA, 20 bp, human
gccgaaggaaaaatataacc

SEQ ID NO: 361192 - DNA, 20 bp, human
gcgcgctcgtagctcccagc

SEQ ID NO: 361193 - DNA, 20 bp, human
gaccttgcctgcaagtccgg

SEQ ID NO: 361194 - DNA, 20 bp, human
ggggccatggcggaggagca

SEQ ID NO: 361195 - DNA, 20 bp, human
gcagctggcgagactgactc

SEQ ID NO: 361196 - DNA, 20 bp, human
gtcctggaagagatgcattg

SEQ ID NO: 361197 - DNA, 20 bp, human
gtccgcaatgcatctcttcc

SEQ ID NO: 361198 - DNA, 20 bp, human
gggtgcttgctctctagtag

SEQ ID NO: 361199 - DNA, 20 bp, human
ggccgctggggctcgtgctg

SEQ ID NO: 361200 - DNA, 20 bp, human
gagctcgctagttggggcgt

SEQ ID NO: 361201 - DNA, 20 bp, human
ggggatccagccggaaaaaa

SEQ ID NO: 361202 - DNA, 20 bp, human
gtaaggaaccaataggacgg

SEQ ID NO: 361203 - DNA, 20 bp, human
gtcgtgctgtggacgtgagt

SEQ ID NO: 361204 - DNA, 20 bp, human
ggaaacccggattccggttc

SEQ ID NO: 361205 - DNA, 20 bp, human
ggcaccgcgcaaggccgctg

SEQ ID NO: 361206 - DNA, 20 bp, human
ggggagagaaggcaccgcta

SEQ ID NO: 361207 - DNA, 20 bp, human
gcccgcacagcaggagcgga

SEQ ID NO: 361208 - DNA, 20 bp, human
ggcccctggaatggggaggt

SEQ ID NO: 361209 - DNA, 20 bp, human
gggccgacctccccattcca

SEQ ID NO: 361210 - DNA, 20 bp, human
gcggggccagcggtccttag

SEQ ID NO: 361211 - DNA, 20 bp, human
gcggctggcgcccctggaat

SEQ ID NO: 361212 - DNA, 20 bp, human
gtggcgcccctggaatgggg

SEQ ID NO: 361213 - DNA, 20 bp, human
gagccggcggattacataac

SEQ ID NO: 361214 - DNA, 20 bp, human
gggcccgttatgtaatccgc

SEQ ID NO: 361215 - DNA, 20 bp, human
ggctcctgctgtgcgggaac

SEQ ID NO: 361216 - DNA, 20 bp, human
gaaggcggagcggttagggg

SEQ ID NO: 361217 - DNA, 20 bp, human
gtccccagcgagctcgctaa

SEQ ID NO: 361218 - DNA, 20 bp, human
gcgagcgcaacggtggaact

SEQ ID NO: 361219 - DNA, 20 bp, human
gtacgccgacgcccggaatc

SEQ ID NO: 361220 - DNA, 20 bp, human
gggtgcgctgggaaactgag

SEQ ID NO: 361221 - DNA, 20 bp, human
ggaaactgagcggtggagga

SEQ ID NO: 361222 - DNA, 20 bp, human
gagctcgctggggacacgca

SEQ ID NO: 361223 - DNA, 20 bp, human
ggagctcgctaagggagacg

SEQ ID NO: 361224 - DNA, 20 bp, human
gggagacgtggcgagcgcaa

SEQ ID NO: 361225 - DNA, 20 bp, human
gggggagggctttgacgtta

SEQ ID NO: 361226 - DNA, 20 bp, human
ggcagcacgtggaggcagtg

SEQ ID NO: 361227 - DNA, 20 bp, human
ggggacccccaggagtcctc

SEQ ID NO: 361228 - DNA, 20 bp, human
gtggggcgcttgcggaaaat

SEQ ID NO: 361229 - DNA, 20 bp, human
ggggacccaccgtagcttgc

SEQ ID NO: 361230 - DNA, 20 bp, human
gtacttccggccggaagaaa

SEQ ID NO: 361231 - DNA, 20 bp, human
ggactcccgcaagctacggt

SEQ ID NO: 361232 - DNA, 20 bp, human
gcggcggcactggacctgcg

SEQ ID NO: 361233 - DNA, 20 bp, human
ggcggaaaatggggaccccc

SEQ ID NO: 361234 - DNA, 20 bp, human
gcccagcccagaggactcct

SEQ ID NO: 361235 - DNA, 20 bp, human
gtccggccggaagtacgcgg

SEQ ID NO: 361236 - DNA, 20 bp, human
gcggcctggcctggaggcta

SEQ ID NO: 361237 - DNA, 20 bp, human
gagccgaggagggcccgaat

SEQ ID NO: 361238 - DNA, 20 bp, human
gacagcaaatggcctcagca

SEQ ID NO: 361239 - DNA, 20 bp, human
gtggcctggaggctaaggcc

SEQ ID NO: 361240 - DNA, 20 bp, human
gagaaatggaggcgcacgga

SEQ ID NO: 361241 - DNA, 20 bp, human
ggaggagggcccgaatgggc

SEQ ID NO: 361242 - DNA, 20 bp, human
gagcaagggtaggaggaacc

SEQ ID NO: 361243 - DNA, 20 bp, human
gtggcctcagcaagggtagg

SEQ ID NO: 361244 - DNA, 20 bp, human
ggagggcccgaatgggctgg

SEQ ID NO: 361245 - DNA, 20 bp, human
gaggggtggcgtgtggttcg

SEQ ID NO: 361246 - DNA, 20 bp, human
gaggaggcggcggacccgcg

SEQ ID NO: 361247 - DNA, 20 bp, human
gggtggttcccgaaacttgg

SEQ ID NO: 361248 - DNA, 20 bp, human
gcacccgcggttcacgctaa

SEQ ID NO: 361249 - DNA, 20 bp, human
ggaggaaggagctgggttta

SEQ ID NO: 361250 - DNA, 20 bp, human
gccgccgggagcatttttcc

SEQ ID NO: 361251 - DNA, 20 bp, human
gaggcctcgagtctgtgcac

SEQ ID NO: 361252 - DNA, 20 bp, human
gtgggaggtgggtcccgcgc

SEQ ID NO: 361253 - DNA, 20 bp, human
ggcgttcacaacaagcgtga

SEQ ID NO: 361254 - DNA, 20 bp, human
gggtgcaggaccctctgcgg

SEQ ID NO: 361255 - DNA, 20 bp, human
ggcccaggcacgaactctcc

SEQ ID NO: 361256 - DNA, 20 bp, human
gaaggtggggcgagtcatga

SEQ ID NO: 361257 - DNA, 20 bp, human
gaacccgcaccaggatcgta

SEQ ID NO: 361258 - DNA, 20 bp, human
ggcttgagggaccggaaggt

SEQ ID NO: 361259 - DNA, 20 bp, human
ggcggggcttgaaggaccgg

SEQ ID NO: 361260 - DNA, 20 bp, human
gtgtgtgggcggggcttgat

SEQ ID NO: 361261 - DNA, 20 bp, human
gtcatgacgggccggggcgt

SEQ ID NO: 361262 - DNA, 20 bp, human
gggggcgagtcatgacgggc

SEQ ID NO: 361263 - DNA, 20 bp, human
ggacgagccgggaacagggc

SEQ ID NO: 361264 - DNA, 20 bp, human
gtgggcggggcttgataggc

SEQ ID NO: 361265 - DNA, 20 bp, human
ggcacaagccgtgcgctccc

SEQ ID NO: 361266 - DNA, 20 bp, human
gccaaccgagaaagctggtg

SEQ ID NO: 361267 - DNA, 20 bp, human
gagggcaagatttacaagtg

SEQ ID NO: 361268 - DNA, 20 bp, human
ggggaaacgtagtccatcgt

SEQ ID NO: 361269 - DNA, 20 bp, human
gggaccacgactcacggaca

SEQ ID NO: 361270 - DNA, 20 bp, human
gacccccggggcggagcaat

SEQ ID NO: 361271 - DNA, 20 bp, human
ggcttctggtccaatcacca

SEQ ID NO: 361272 - DNA, 20 bp, human
gcacccccattgctccgccc

SEQ ID NO: 361273 - DNA, 20 bp, human
ggggccatgtccgtgagtcg

SEQ ID NO: 361274 - DNA, 20 bp, human
gagcgcgtgagtccaagact

SEQ ID NO: 361275 - DNA, 20 bp, human
gggccaatgaatgacccccg

SEQ ID NO: 361276 - DNA, 20 bp, human
gaggggtaggctagaaatta

SEQ ID NO: 361277 - DNA, 20 bp, human
gtggcccaagagtaaggaaa

SEQ ID NO: 361278 - DNA, 20 bp, human
ggtaggctagaaattagggg

SEQ ID NO: 361279 - DNA, 20 bp, human
gcgtgtggacacgtacgagt

SEQ ID NO: 361280 - DNA, 20 bp, human
gtcctctggctgaagataag

SEQ ID NO: 361281 - DNA, 20 bp, human
gcctagagataccagcttac

SEQ ID NO: 361282 - DNA, 20 bp, human
ggctctctaacatgaaagga

SEQ ID NO: 361283 - DNA, 20 bp, human
gaatacagacatctcacaag

SEQ ID NO: 361284 - DNA, 20 bp, human
gcaaccatttccttactctt

SEQ ID NO: 361285 - DNA, 20 bp, human
gtccttactcttgggccaat

SEQ ID NO: 361286 - DNA, 20 bp, human
gtgggcgcccgctgctccga

SEQ ID NO: 361287 - DNA, 20 bp, human
gagcgggcgcccacgcaggt

SEQ ID NO: 361288 - DNA, 20 bp, human
gggtcggtgcccacctgcgt

SEQ ID NO: 361289 - DNA, 20 bp, human
ggagagcaggagcgcggaag

SEQ ID NO: 361290 - DNA, 20 bp, human
gtccgaggggtggaagcccg

SEQ ID NO: 361291 - DNA, 20 bp, human
gaaggtggcgcctcgggcgg

SEQ ID NO: 361292 - DNA, 20 bp, human
gaggccgcccggatccgggc

SEQ ID NO: 361293 - DNA, 20 bp, human
ggcgccggggcccagcgacc

SEQ ID NO: 361294 - DNA, 20 bp, human
gtgcgacccgcaaaaggggt

SEQ ID NO: 361295 - DNA, 20 bp, human
ggagggggatcgcagagagc

SEQ ID NO: 361296 - DNA, 20 bp, human
ggatataaaggcatggacaa

SEQ ID NO: 361297 - DNA, 20 bp, human
ggtaaagaggaaatccccaa

SEQ ID NO: 361298 - DNA, 20 bp, human
gaagcatcgtggatattccc

SEQ ID NO: 361299 - DNA, 20 bp, human
gagtgtctctcatgtagttg

SEQ ID NO: 361300 - DNA, 20 bp, human
gcacagaggaatgactcaca

SEQ ID NO: 361301 - DNA, 20 bp, human
gcatatacgatataaaggca

SEQ ID NO: 361302 - DNA, 20 bp, human
gaattgcatatacgatataa

SEQ ID NO: 361303 - DNA, 20 bp, human
gtggatgacaaacctattct

SEQ ID NO: 361304 - DNA, 20 bp, human
gaattgaaggtagtagacta

SEQ ID NO: 361305 - DNA, 20 bp, human
ggcttcctgtgaataatagg

SEQ ID NO: 361306 - DNA, 20 bp, human
ggccctgagtagtttactct

SEQ ID NO: 361307 - DNA, 20 bp, human
ggcaactggtgtttgaatta

SEQ ID NO: 361308 - DNA, 20 bp, human
gttactctgggctacagccc

SEQ ID NO: 361309 - DNA, 20 bp, human
ggatactctcaagtggccta

SEQ ID NO: 361310 - DNA, 20 bp, human
gagcccagagtaaactactc

SEQ ID NO: 361311 - DNA, 20 bp, human
ggtaaactactcagggcagc

SEQ ID NO: 361312 - DNA, 20 bp, human
gtggccaggatactctcaag

SEQ ID NO: 361313 - DNA, 20 bp, human
gttcaaacaccagttgccct

SEQ ID NO: 361314 - DNA, 20 bp, human
gaaagagcacgagctggtca

SEQ ID NO: 361315 - DNA, 20 bp, human
gtcaagtggcctagggcaac

SEQ ID NO: 361316 - DNA, 20 bp, human
gaggcggccgagctgacaac

SEQ ID NO: 361317 - DNA, 20 bp, human
ggcgacttctggttaggcgg

SEQ ID NO: 361318 - DNA, 20 bp, human
gggcaaccgcgggcactaca

SEQ ID NO: 361319 - DNA, 20 bp, human
ggcggcctgtgacgctcgaa

SEQ ID NO: 361320 - DNA, 20 bp, human
gacttctggttaggcggagg

SEQ ID NO: 361321 - DNA, 20 bp, human
gtgctgacgaggacgaaggt

SEQ ID NO: 361322 - DNA, 20 bp, human
gacaaccggatatgacgtta

SEQ ID NO: 361323 - DNA, 20 bp, human
gatgcaaaaacgcccgtcgg

SEQ ID NO: 361324 - DNA, 20 bp, human
gcagtccttaacgtcatatc

SEQ ID NO: 361325 - DNA, 20 bp, human
gacatctgcgacttctggtt

SEQ ID NO: 361326 - DNA, 20 bp, human
gagggtaaggaaagatgcat

SEQ ID NO: 361327 - DNA, 20 bp, human
gccagtctaggaaaggggtg

SEQ ID NO: 361328 - DNA, 20 bp, human
gaggaggaggatgtgagact

SEQ ID NO: 361329 - DNA, 20 bp, human
gagaggccagtctaggaaag

SEQ ID NO: 361330 - DNA, 20 bp, human
gtctcagtgggaggcaatag

SEQ ID NO: 361331 - DNA, 20 bp, human
gcagttcatttttgtctcag

SEQ ID NO: 361332 - DNA, 20 bp, human
gtccaagggccatttaccac

SEQ ID NO: 361333 - DNA, 20 bp, human
gcagcaacaacaatgagtga

SEQ ID NO: 361334 - DNA, 20 bp, human
gcagtggacttgactcgttt

SEQ ID NO: 361335 - DNA, 20 bp, human
gttatgaaaaagatagggga

SEQ ID NO: 361336 - DNA, 20 bp, human
ggtaacggcggggagtcctg

SEQ ID NO: 361337 - DNA, 20 bp, human
gctgcctggccgcatcctgg

SEQ ID NO: 361338 - DNA, 20 bp, human
gctagcgggaggtaacggcg

SEQ ID NO: 361339 - DNA, 20 bp, human
ggttacctcccgctagctca

SEQ ID NO: 361340 - DNA, 20 bp, human
gggtgccggcgagacgctga

SEQ ID NO: 361341 - DNA, 20 bp, human
gctcgccctgagctagcggg

SEQ ID NO: 361342 - DNA, 20 bp, human
gagtgacggcccaaacgcca

SEQ ID NO: 361343 - DNA, 20 bp, human
ggacctcgccctgagctagc

SEQ ID NO: 361344 - DNA, 20 bp, human
ggctagaggcccagtcccgc

SEQ ID NO: 361345 - DNA, 20 bp, human
gacgtggcgcagcgactcgg

SEQ ID NO: 361346 - DNA, 20 bp, human
ggggtcggaggcgtccgggg

SEQ ID NO: 361347 - DNA, 20 bp, human
gtgtctggccgggctctaat

SEQ ID NO: 361348 - DNA, 20 bp, human
gacgcctccgaccctccggc

SEQ ID NO: 361349 - DNA, 20 bp, human
gggcgcgcgctgatgcgaac

SEQ ID NO: 361350 - DNA, 20 bp, human
gaggggtcgcggtgtctggc

SEQ ID NO: 361351 - DNA, 20 bp, human
gggagggtcggaggcgtccg

SEQ ID NO: 361352 - DNA, 20 bp, human
gcatctcccggccggagggt

SEQ ID NO: 361353 - DNA, 20 bp, human
gagatgcggatagacggacg

SEQ ID NO: 361354 - DNA, 20 bp, human
ggccgggagatgcggataga

SEQ ID NO: 361355 - DNA, 20 bp, human
gctcccggccggagggtcgg

SEQ ID NO: 361356 - DNA, 20 bp, human
gaaggggtcacccccttcca

SEQ ID NO: 361357 - DNA, 20 bp, human
gtccatggaagatggtctgg

SEQ ID NO: 361358 - DNA, 20 bp, human
gccttccatggaagatggtc

SEQ ID NO: 361359 - DNA, 20 bp, human
gactgcctcccctcagtgtc

SEQ ID NO: 361360 - DNA, 20 bp, human
ggttggcagcttagaaatag

SEQ ID NO: 361361 - DNA, 20 bp, human
gaattactcctggatatccc

SEQ ID NO: 361362 - DNA, 20 bp, human
gaagggctgtggtgagtttc

SEQ ID NO: 361363 - DNA, 20 bp, human
gaacttcatgggaagggctg

SEQ ID NO: 361364 - DNA, 20 bp, human
gtattccggcagccttctga

SEQ ID NO: 361365 - DNA, 20 bp, human
gtaaacagcctgacactgag

SEQ ID NO: 361366 - DNA, 20 bp, human
ggtcacaaacaatggggtgt

SEQ ID NO: 361367 - DNA, 20 bp, human
gaaagctgtcacaaacaatg

SEQ ID NO: 361368 - DNA, 20 bp, human
gtaggtctgacactgttctt

SEQ ID NO: 361369 - DNA, 20 bp, human
gagaatgtggttacttaggc

SEQ ID NO: 361370 - DNA, 20 bp, human
gcccaatggctgtgtgtgga

SEQ ID NO: 361371 - DNA, 20 bp, human
gataaagacagggtggtagt

SEQ ID NO: 361372 - DNA, 20 bp, human
gagcgagaatgtggttactt

SEQ ID NO: 361373 - DNA, 20 bp, human
ggcaccccctgcggcagtcc

SEQ ID NO: 361374 - DNA, 20 bp, human
ggggagaagttcttcggttt

SEQ ID NO: 361375 - DNA, 20 bp, human
ggcaaccaagagcctctcta

SEQ ID NO: 361376 - DNA, 20 bp, human
gtggctgccagcgcccttaa

SEQ ID NO: 361377 - DNA, 20 bp, human
gacagcccccagtttcagga

SEQ ID NO: 361378 - DNA, 20 bp, human
gaccgccttcctgaaactgg

SEQ ID NO: 361379 - DNA, 20 bp, human
ggttcgcgccggcccaaaga

SEQ ID NO: 361380 - DNA, 20 bp, human
gagcgcccttaacggcgcga

SEQ ID NO: 361381 - DNA, 20 bp, human
gtggctcgccccgggatccc

SEQ ID NO: 361382 - DNA, 20 bp, human
ggcgctctcccgggatcccg

SEQ ID NO: 361383 - DNA, 20 bp, human
gcaaagacggtcacgtgagc

SEQ ID NO: 361384 - DNA, 20 bp, human
ggctaccgccttcctgaaac

SEQ ID NO: 361385 - DNA, 20 bp, human
gagagcgccgcggttggcgt

SEQ ID NO: 361386 - DNA, 20 bp, human
ggtcttaatggaaggatttg

SEQ ID NO: 361387 - DNA, 20 bp, human
gataaagtttaatgtcttaa

SEQ ID NO: 361388 - DNA, 20 bp, human
gtgtaatcttgataattttt

SEQ ID NO: 361389 - DNA, 20 bp, human
gaaaaatcaggccgcattac

SEQ ID NO: 361390 - DNA, 20 bp, human
gaattcataataattgaacc

SEQ ID NO: 361391 - DNA, 20 bp, human
ggcatgagagaatgaaactc

SEQ ID NO: 361392 - DNA, 20 bp, human
gcacacagatttggcctttt

SEQ ID NO: 361393 - DNA, 20 bp, human
gaagtatgctgaatgtgaat

SEQ ID NO: 361394 - DNA, 20 bp, human
gcattaaactttatagattt

SEQ ID NO: 361395 - DNA, 20 bp, human
gttttctgcagtgtttcctg

SEQ ID NO: 361396 - DNA, 20 bp, human
gaggtcgcgcggtggaaccc

SEQ ID NO: 361397 - DNA, 20 bp, human
ggtggagtcggtgtccgggt

SEQ ID NO: 361398 - DNA, 20 bp, human
gtccgcgcctggttattcat

SEQ ID NO: 361399 - DNA, 20 bp, human
gcggacttcaacctcagtcc

SEQ ID NO: 361400 - DNA, 20 bp, human
gtgaagtccgcgccgaggag

SEQ ID NO: 361401 - DNA, 20 bp, human
ggcgggcgggactccccaac

SEQ ID NO: 361402 - DNA, 20 bp, human
gggaccggggcaagccggtt

SEQ ID NO: 361403 - DNA, 20 bp, human
gaggtcgggaggtcgcgcgg

SEQ ID NO: 361404 - DNA, 20 bp, human
gtcggggtccggagtggagt

SEQ ID NO: 361405 - DNA, 20 bp, human
gagacgcggcgcgaccactg

SEQ ID NO: 361406 - DNA, 20 bp, human
gccggggaagcagaatgaaa

SEQ ID NO: 361407 - DNA, 20 bp, human
gtccccaacactcactagac

SEQ ID NO: 361408 - DNA, 20 bp, human
gtccctgcttcattcggctc

SEQ ID NO: 361409 - DNA, 20 bp, human
gcccggagccgaatgaagca

SEQ ID NO: 361410 - DNA, 20 bp, human
gtgttggggaaacctgtctg

SEQ ID NO: 361411 - DNA, 20 bp, human
gcactagactggctgacaat

SEQ ID NO: 361412 - DNA, 20 bp, human
gagccagtctagtgagtgtt

SEQ ID NO: 361413 - DNA, 20 bp, human
gtcagaggagcttagataaa

SEQ ID NO: 361414 - DNA, 20 bp, human
gtctccctctacatgcgtac

SEQ ID NO: 361415 - DNA, 20 bp, human
gcaggattagagactgccac

SEQ ID NO: 361416 - DNA, 20 bp, human
gagggtgtgcccagtggcgt

SEQ ID NO: 361417 - DNA, 20 bp, human
gtggccaggcggggcaccct

SEQ ID NO: 361418 - DNA, 20 bp, human
ggatcagattacagccccta

SEQ ID NO: 361419 - DNA, 20 bp, human
gcagtgcagggtgaccctga

SEQ ID NO: 361420 - DNA, 20 bp, human
ggccactgggcacaccctca

SEQ ID NO: 361421 - DNA, 20 bp, human
ggctagggggggagtcccca

SEQ ID NO: 361422 - DNA, 20 bp, human
gcgagggcgggaggctaggg

SEQ ID NO: 361423 - DNA, 20 bp, human
ggggctgtaatctgatccct

SEQ ID NO: 361424 - DNA, 20 bp, human
gtacaagagaggagattact

SEQ ID NO: 361425 - DNA, 20 bp, human
gagagaggagattactggga

SEQ ID NO: 361426 - DNA, 20 bp, human
ggggagtggaatgggcacaa

SEQ ID NO: 361427 - DNA, 20 bp, human
gagccaggcgggagtggaat

SEQ ID NO: 361428 - DNA, 20 bp, human
gaggtggccagccaaggcaa

SEQ ID NO: 361429 - DNA, 20 bp, human
gttaaggcccaatatgggag

SEQ ID NO: 361430 - DNA, 20 bp, human
gagtggaatgggcacaaggg

SEQ ID NO: 361431 - DNA, 20 bp, human
ggggccacttagtacttcag

SEQ ID NO: 361432 - DNA, 20 bp, human
gaggaagaaaccccagctcc

SEQ ID NO: 361433 - DNA, 20 bp, human
gccgtgccgtaaagtttaga

SEQ ID NO: 361434 - DNA, 20 bp, human
gtgagtgggggcaccacccg

SEQ ID NO: 361435 - DNA, 20 bp, human
ggggacgacccctcccatat

SEQ ID NO: 361436 - DNA, 20 bp, human
ggctccctgccaggctctcg

SEQ ID NO: 361437 - DNA, 20 bp, human
gcccgcccggtccgcccccg

SEQ ID NO: 361438 - DNA, 20 bp, human
gcgcccgcgagagcctggca

SEQ ID NO: 361439 - DNA, 20 bp, human
ggcctggcagggagccgcgg

SEQ ID NO: 361440 - DNA, 20 bp, human
gagccgcgagctctaagggt

SEQ ID NO: 361441 - DNA, 20 bp, human
gtcgcgggcgcgctcggggt

SEQ ID NO: 361442 - DNA, 20 bp, human
gctcgcggctggcggagatg

SEQ ID NO: 361443 - DNA, 20 bp, human
ggcggagtgagcaacttgct

SEQ ID NO: 361444 - DNA, 20 bp, human
gaggctctcgcgggcgcgct

SEQ ID NO: 361445 - DNA, 20 bp, human
gggccagccgcgagctctaa

SEQ ID NO: 361446 - DNA, 20 bp, human
ggaggggaacatagcatacc

SEQ ID NO: 361447 - DNA, 20 bp, human
gagagtaaaacaagagcgat

SEQ ID NO: 361448 - DNA, 20 bp, human
gtatagaaatgaatcagaac

SEQ ID NO: 361449 - DNA, 20 bp, human
gaaactattaagataacaat

SEQ ID NO: 361450 - DNA, 20 bp, human
ggaactggggaataaaatta

SEQ ID NO: 361451 - DNA, 20 bp, human
gacaaaaacaactttagtca

SEQ ID NO: 361452 - DNA, 20 bp, human
gggtatcagcaaactgacac

SEQ ID NO: 361453 - DNA, 20 bp, human
gtatcatctcactcttaagt

SEQ ID NO: 361454 - DNA, 20 bp, human
gagtgagatgatatggtatt

SEQ ID NO: 361455 - DNA, 20 bp, human
gggggaataaaattaaggac

SEQ ID NO: 361456 - DNA, 20 bp, human
gggaaatggggagttcggga

SEQ ID NO: 361457 - DNA, 20 bp, human
gcagggatgcagtctgtcag

SEQ ID NO: 361458 - DNA, 20 bp, human
ggggctggttatgactggga

SEQ ID NO: 361459 - DNA, 20 bp, human
gggatcctgcgactcctaga

SEQ ID NO: 361460 - DNA, 20 bp, human
gctgctgagtaacgtggggc

SEQ ID NO: 361461 - DNA, 20 bp, human
gcctgctgctgagtaacgtg

SEQ ID NO: 361462 - DNA, 20 bp, human
gcccgaagagaggacctcca

SEQ ID NO: 361463 - DNA, 20 bp, human
gcccgtggaggtcctctctt

SEQ ID NO: 361464 - DNA, 20 bp, human
gagaagtccacattttgatg

SEQ ID NO: 361465 - DNA, 20 bp, human
ggtcgcaggatccacccagc

SEQ ID NO: 361466 - DNA, 20 bp, human
gccccgctccacctgtccgt

SEQ ID NO: 361467 - DNA, 20 bp, human
gagcccggcccacggacagg

SEQ ID NO: 361468 - DNA, 20 bp, human
ggaaccctgagcccggccca

SEQ ID NO: 361469 - DNA, 20 bp, human
gcgcggggtgcccaccgcct

SEQ ID NO: 361470 - DNA, 20 bp, human
gtgtccgtgggccgggctca

SEQ ID NO: 361471 - DNA, 20 bp, human
gggcccacggacaggtggag

SEQ ID NO: 361472 - DNA, 20 bp, human
gccggcaattggccgcccgt

SEQ ID NO: 361473 - DNA, 20 bp, human
gtctgagcgccccgtcccgc

SEQ ID NO: 361474 - DNA, 20 bp, human
ggctcagggttcccaggcgg

SEQ ID NO: 361475 - DNA, 20 bp, human
gggtgggcaccccgcgccgg

SEQ ID NO: 361476 - DNA, 20 bp, human
gggcggccagcgggaccaga

SEQ ID NO: 361477 - DNA, 20 bp, human
ggggaagaccttcccagcta

SEQ ID NO: 361478 - DNA, 20 bp, human
gtggaaggagaagcggcagg

SEQ ID NO: 361479 - DNA, 20 bp, human
gtccacaaatgcaggtcccc

SEQ ID NO: 361480 - DNA, 20 bp, human
gagtctggccaaagcttcag

SEQ ID NO: 361481 - DNA, 20 bp, human
gagtggaggggcagagaaca

SEQ ID NO: 361482 - DNA, 20 bp, human
gagagcctggaagggaggtc

SEQ ID NO: 361483 - DNA, 20 bp, human
gggagccactgccttataag

SEQ ID NO: 361484 - DNA, 20 bp, human
gcctcttcccgcccaggact

SEQ ID NO: 361485 - DNA, 20 bp, human
gcagtggctccacccagtcc

SEQ ID NO: 361486 - DNA, 20 bp, human
gacctgggctcctacccata

SEQ ID NO: 361487 - DNA, 20 bp, human
gtagagagaccccaccttgt

SEQ ID NO: 361488 - DNA, 20 bp, human
gcagggacttcccagtaggt

SEQ ID NO: 361489 - DNA, 20 bp, human
ggatggagattagactgcaa

SEQ ID NO: 361490 - DNA, 20 bp, human
ggcagcagaagcgtgtgtat

SEQ ID NO: 361491 - DNA, 20 bp, human
ggcctgatgtcaaagagtga

SEQ ID NO: 361492 - DNA, 20 bp, human
gatgaaagtgagaccgtctt

SEQ ID NO: 361493 - DNA, 20 bp, human
gtgaaagtgacaggagagta

SEQ ID NO: 361494 - DNA, 20 bp, human
gagaaggttccctatctgga

SEQ ID NO: 361495 - DNA, 20 bp, human
gggcttgggctatgagaaga

SEQ ID NO: 361496 - DNA, 20 bp, human
gccgaccagcggtcgtgggg

SEQ ID NO: 361497 - DNA, 20 bp, human
ggcctcactagctggagtct

SEQ ID NO: 361498 - DNA, 20 bp, human
gtgggccgaccagcggtcgt

SEQ ID NO: 361499 - DNA, 20 bp, human
gaaggaccgcacagtccctt

SEQ ID NO: 361500 - DNA, 20 bp, human
gtttacgggaattgtccaga

SEQ ID NO: 361501 - DNA, 20 bp, human
gctagtgaggccgccccctg

SEQ ID NO: 361502 - DNA, 20 bp, human
gcgacaggccagggtggtcg

SEQ ID NO: 361503 - DNA, 20 bp, human
gccgctctgcccgtgtttac

SEQ ID NO: 361504 - DNA, 20 bp, human
gctaactggctgtgttacgt

SEQ ID NO: 361505 - DNA, 20 bp, human
gggtcggcccaagttagccg

SEQ ID NO: 361506 - DNA, 20 bp, human
gcgccggggctactgatccc

SEQ ID NO: 361507 - DNA, 20 bp, human
gggtcccagaggagccggaa

SEQ ID NO: 361508 - DNA, 20 bp, human
gctgccagcgcccgggaagg

SEQ ID NO: 361509 - DNA, 20 bp, human
gcgtccgcgtcccagcgctc

SEQ ID NO: 361510 - DNA, 20 bp, human
gcgggcgctggcagcgcgag

SEQ ID NO: 361511 - DNA, 20 bp, human
gcgcctagggagttaggggg

SEQ ID NO: 361512 - DNA, 20 bp, human
gtatgcgcctagggagttag

SEQ ID NO: 361513 - DNA, 20 bp, human
gtgggagggtctgagcagtg

SEQ ID NO: 361514 - DNA, 20 bp, human
gagcccgggatcagtagccc

SEQ ID NO: 361515 - DNA, 20 bp, human
gagcggagggggcgcctaaa

SEQ ID NO: 361516 - DNA, 20 bp, human
gcgaaggctcgctcaggagg

SEQ ID NO: 361517 - DNA, 20 bp, human
gggctgctggacacccggag

SEQ ID NO: 361518 - DNA, 20 bp, human
gccccccagcctgacgtcaa

SEQ ID NO: 361519 - DNA, 20 bp, human
ggggccgcgaaggctcgctc

SEQ ID NO: 361520 - DNA, 20 bp, human
gacagcgcctggagggaggt

SEQ ID NO: 361521 - DNA, 20 bp, human
gccagcccgcccggagtctt

SEQ ID NO: 361522 - DNA, 20 bp, human
ggaggtccgggcacccagag

SEQ ID NO: 361523 - DNA, 20 bp, human
gcgccacagcgcctggaggg

SEQ ID NO: 361524 - DNA, 20 bp, human
gcccggaggggttgaggtcc

SEQ ID NO: 361525 - DNA, 20 bp, human
ggggactccgggtatggcca

SEQ ID NO: 361526 - DNA, 20 bp, human
gggcgcgcgcaggcgacggg

SEQ ID NO: 361527 - DNA, 20 bp, human
ggaccgagctcgggtcgagt

SEQ ID NO: 361528 - DNA, 20 bp, human
gcaggcgacggggggaggta

SEQ ID NO: 361529 - DNA, 20 bp, human
gaggaggcagtgcgaggaac

SEQ ID NO: 361530 - DNA, 20 bp, human
gcagccctctggcggagggg

SEQ ID NO: 361531 - DNA, 20 bp, human
gcgggtcgagtcggggactc

SEQ ID NO: 361532 - DNA, 20 bp, human
gacgcgagggggttcctccc

SEQ ID NO: 361533 - DNA, 20 bp, human
gagggctggtgtttcggagg

SEQ ID NO: 361534 - DNA, 20 bp, human
gcagagggctggtgtttcgg

SEQ ID NO: 361535 - DNA, 20 bp, human
gcctctggcggaggggcggt

SEQ ID NO: 361536 - DNA, 20 bp, human
gaggtggaagagtgttgcga

SEQ ID NO: 361537 - DNA, 20 bp, human
gggctgagggacaaccctct

SEQ ID NO: 361538 - DNA, 20 bp, human
gacaaccctctgggcctggc

SEQ ID NO: 361539 - DNA, 20 bp, human
ggagtcaagcacccgttccc

SEQ ID NO: 361540 - DNA, 20 bp, human
gcacctcttggtcctgggaa

SEQ ID NO: 361541 - DNA, 20 bp, human
gggcgcggggacggagtgcg

SEQ ID NO: 361542 - DNA, 20 bp, human
ggttgcgaaggtgaagaaag

SEQ ID NO: 361543 - DNA, 20 bp, human
ggacaagcttgccccttctg

SEQ ID NO: 361544 - DNA, 20 bp, human
gaggagtggggagcaaaagt

SEQ ID NO: 361545 - DNA, 20 bp, human
gacccgttcccaggaccaag

SEQ ID NO: 361546 - DNA, 20 bp, human
gaacagccccgctgtttaaa

SEQ ID NO: 361547 - DNA, 20 bp, human
gcggggctgttcagcgatgt

SEQ ID NO: 361548 - DNA, 20 bp, human
gcccacacaggaaaacaatc

SEQ ID NO: 361549 - DNA, 20 bp, human
gcctgtgtgggctaattcag

SEQ ID NO: 361550 - DNA, 20 bp, human
gaggcgacctgctgctccat

SEQ ID NO: 361551 - DNA, 20 bp, human
gaaaggaagagaatgggaca

SEQ ID NO: 361552 - DNA, 20 bp, human
ggaaaggctgccttagagga

SEQ ID NO: 361553 - DNA, 20 bp, human
ggggtggacaatggtgtgca

SEQ ID NO: 361554 - DNA, 20 bp, human
gtgcggagaaggctcaccac

SEQ ID NO: 361555 - DNA, 20 bp, human
gctgctccatgggtggacaa

SEQ ID NO: 361556 - DNA, 20 bp, human
gagaggcctaacccaggcag

SEQ ID NO: 361557 - DNA, 20 bp, human
ggggaggagaggcctaaccc

SEQ ID NO: 361558 - DNA, 20 bp, human
ggctagacccaggtgaaggt

SEQ ID NO: 361559 - DNA, 20 bp, human
gctgcctcggaagtgcgctg

SEQ ID NO: 361560 - DNA, 20 bp, human
gcagccccagcgcacttccg

SEQ ID NO: 361561 - DNA, 20 bp, human
ggcgctggggctgccactca

SEQ ID NO: 361562 - DNA, 20 bp, human
ggaaggtgggagttctgcct

SEQ ID NO: 361563 - DNA, 20 bp, human
gaatcgggattgagtgaagg

SEQ ID NO: 361564 - DNA, 20 bp, human
gcggctccgccccctcagaa

SEQ ID NO: 361565 - DNA, 20 bp, human
ggccactcgaggtccctgag

SEQ ID NO: 361566 - DNA, 20 bp, human
gaaggcggggccgactgggt

SEQ ID NO: 361567 - DNA, 20 bp, human
gccgcagcgcctagaggtgg

SEQ ID NO: 361568 - DNA, 20 bp, human
gggggcggggtcctgaaagg

SEQ ID NO: 361569 - DNA, 20 bp, human
ggtggcgaggccaccaccag

SEQ ID NO: 361570 - DNA, 20 bp, human
ggggccgcagcgcctagagg

SEQ ID NO: 361571 - DNA, 20 bp, human
gctgaaaggcggggccgact

SEQ ID NO: 361572 - DNA, 20 bp, human
gcgggctataagcatgtgga

SEQ ID NO: 361573 - DNA, 20 bp, human
gggggtcgcccgatggccga

SEQ ID NO: 361574 - DNA, 20 bp, human
gtactctagcacaatagagg

SEQ ID NO: 361575 - DNA, 20 bp, human
gagcatgtggagggtgcacg

SEQ ID NO: 361576 - DNA, 20 bp, human
ggggcgctcgagtttcaccc

SEQ ID NO: 361577 - DNA, 20 bp, human
ggctcggggaggtcaggcgc

SEQ ID NO: 361578 - DNA, 20 bp, human
ggggctcccaggagcgaagg

SEQ ID NO: 361579 - DNA, 20 bp, human
gcgctcgagtttcaccccgg

SEQ ID NO: 361580 - DNA, 20 bp, human
gcggggaggtcaggcgcggg

SEQ ID NO: 361581 - DNA, 20 bp, human
gctcccaggagcgaaggtgg

SEQ ID NO: 361582 - DNA, 20 bp, human
gctcggccgcactcgcactg

SEQ ID NO: 361583 - DNA, 20 bp, human
gaaggtgggggtcctgtacc

SEQ ID NO: 361584 - DNA, 20 bp, human
ggagggacccagtgagacgg

SEQ ID NO: 361585 - DNA, 20 bp, human
gcgcactggggaggctggaa

SEQ ID NO: 361586 - DNA, 20 bp, human
gagtgtgcaatagagtctgg

SEQ ID NO: 361587 - DNA, 20 bp, human
gtacaggtaccttacatcag

SEQ ID NO: 361588 - DNA, 20 bp, human
gtaaggtacctgtaccctac

SEQ ID NO: 361589 - DNA, 20 bp, human
gtgtaccaagcatcacctgt

SEQ ID NO: 361590 - DNA, 20 bp, human
gtgaaaaaatacagctggtt

SEQ ID NO: 361591 - DNA, 20 bp, human
gctgagtgtgcaatagagtc

SEQ ID NO: 361592 - DNA, 20 bp, human
gtctattgcacactcagttg

SEQ ID NO: 361593 - DNA, 20 bp, human
gcctactagatcagaaagtc

SEQ ID NO: 361594 - DNA, 20 bp, human
gttagatcagaccacttggg

SEQ ID NO: 361595 - DNA, 20 bp, human
gagcatcacctgtagggtac

SEQ ID NO: 361596 - DNA, 20 bp, human
gcccgggcggagccaagtcc

SEQ ID NO: 361597 - DNA, 20 bp, human
ggtggggccaggaatcctgg

SEQ ID NO: 361598 - DNA, 20 bp, human
gcagaggcggagaaactacg

SEQ ID NO: 361599 - DNA, 20 bp, human
ggcggagccaagtcccggac

SEQ ID NO: 361600 - DNA, 20 bp, human
ggcggcctctccggtgacag

SEQ ID NO: 361601 - DNA, 20 bp, human
gccgacccaaaggagagctg

SEQ ID NO: 361602 - DNA, 20 bp, human
ggcggagaaactacgcggtg

SEQ ID NO: 361603 - DNA, 20 bp, human
gcccaccgcgcgctaggcgg

SEQ ID NO: 361604 - DNA, 20 bp, human
gtactcctctgtcaccggag

SEQ ID NO: 361605 - DNA, 20 bp, human
ggtgacagaggagtagtgag

SEQ ID NO: 361606 - DNA, 20 bp, human
ggaaaggcccgtggcatgag

SEQ ID NO: 361607 - DNA, 20 bp, human
gaagtggggtctgaggtcag

SEQ ID NO: 361608 - DNA, 20 bp, human
ggggagggtaggccgaagtg

SEQ ID NO: 361609 - DNA, 20 bp, human
gaggcccgtggcatgagggg

SEQ ID NO: 361610 - DNA, 20 bp, human
gcacaggaggctgtagagca

SEQ ID NO: 361611 - DNA, 20 bp, human
ggaagctcagggtcgtgaag

SEQ ID NO: 361612 - DNA, 20 bp, human
gtcaggggccttgaatccca

SEQ ID NO: 361613 - DNA, 20 bp, human
gagggctcttagttaggttc

SEQ ID NO: 361614 - DNA, 20 bp, human
ggcagacagggctcttagtt

SEQ ID NO: 361615 - DNA, 20 bp, human
gtcacaaatcctggaagctc

SEQ ID NO: 361616 - DNA, 20 bp, human
gcctccccgggcagcactat

SEQ ID NO: 361617 - DNA, 20 bp, human
gccaggccgggaggctgaac

SEQ ID NO: 361618 - DNA, 20 bp, human
gggcagcactattggcggag

SEQ ID NO: 361619 - DNA, 20 bp, human
gtggcggagaggtgacgaga

SEQ ID NO: 361620 - DNA, 20 bp, human
gccccgggcagcactattgg

SEQ ID NO: 361621 - DNA, 20 bp, human
gcggagaggtgacgagaagg

SEQ ID NO: 361622 - DNA, 20 bp, human
ggtgtctagccgccctccga

SEQ ID NO: 361623 - DNA, 20 bp, human
gcgactaatcccgccctcgg

SEQ ID NO: 361624 - DNA, 20 bp, human
gagtcgcggcgacccaaagg

SEQ ID NO: 361625 - DNA, 20 bp, human
gaggagcaccgtccacccag

SEQ ID NO: 361626 - DNA, 20 bp, human
ggggccgcggcgccagggtg

SEQ ID NO: 361627 - DNA, 20 bp, human
gagggtgcgcagcagagcgc

SEQ ID NO: 361628 - DNA, 20 bp, human
gcgccctcgcgggtgaaccg

SEQ ID NO: 361629 - DNA, 20 bp, human
gagaaggagcagctactcag

SEQ ID NO: 361630 - DNA, 20 bp, human
gggccacggttcacccgcga

SEQ ID NO: 361631 - DNA, 20 bp, human
ggagctgccgagtgcgtgga

SEQ ID NO: 361632 - DNA, 20 bp, human
gtcccacccccgggcacgga

SEQ ID NO: 361633 - DNA, 20 bp, human
gcctccgcgtccctcctctc

SEQ ID NO: 361634 - DNA, 20 bp, human
gcagcagagcgccggagagg

SEQ ID NO: 361635 - DNA, 20 bp, human
gggagcagctactcagaggt

SEQ ID NO: 361636 - DNA, 20 bp, human
gagcgagagcggaactgctg

SEQ ID NO: 361637 - DNA, 20 bp, human
gtacggggaaagcccagctg

SEQ ID NO: 361638 - DNA, 20 bp, human
gtctcccgggcaactctacg

SEQ ID NO: 361639 - DNA, 20 bp, human
gaagccagtgaggcgagaaa

SEQ ID NO: 361640 - DNA, 20 bp, human
gtggcagaagaccacaagtc

SEQ ID NO: 361641 - DNA, 20 bp, human
gtaggcgaacgcatcctccg

SEQ ID NO: 361642 - DNA, 20 bp, human
gtggctttcctgagcgagag

SEQ ID NO: 361643 - DNA, 20 bp, human
gtgcggacaagccagacttg

SEQ ID NO: 361644 - DNA, 20 bp, human
gcagccttttctcgcctcac

SEQ ID NO: 361645 - DNA, 20 bp, human
gggcagacccaagcgccagg

SEQ ID NO: 361646 - DNA, 20 bp, human
gactttgtcccacactcagc

SEQ ID NO: 361647 - DNA, 20 bp, human
gcctcacccctgctgagtgt

SEQ ID NO: 361648 - DNA, 20 bp, human
gcccagcaacataatgtcaa

SEQ ID NO: 361649 - DNA, 20 bp, human
gttcaggctacaaaagcaat

SEQ ID NO: 361650 - DNA, 20 bp, human
gtctggcatgatgatctaaa

SEQ ID NO: 361651 - DNA, 20 bp, human
gaaggaagatataaatgaca

SEQ ID NO: 361652 - DNA, 20 bp, human
gtaaattattgcatcatgaa

SEQ ID NO: 361653 - DNA, 20 bp, human
ggcctttgacattatgttgc

SEQ ID NO: 361654 - DNA, 20 bp, human
gtctatgattgctcattctt

SEQ ID NO: 361655 - DNA, 20 bp, human
gaggactgataaaaatttgc

SEQ ID NO: 361656 - DNA, 20 bp, human
gactttgtcccacactcagc

SEQ ID NO: 361657 - DNA, 20 bp, human
gcctcacccctgctgagtgt

SEQ ID NO: 361658 - DNA, 20 bp, human
gcccagcaacataatgtcaa

SEQ ID NO: 361659 - DNA, 20 bp, human
gttcaggctacaaaagcaat

SEQ ID NO: 361660 - DNA, 20 bp, human
gtctggcatgatgatctaaa

SEQ ID NO: 361661 - DNA, 20 bp, human
gaaggaagatataaatgaca

SEQ ID NO: 361662 - DNA, 20 bp, human
gtaaattattgcatcatgaa

SEQ ID NO: 361663 - DNA, 20 bp, human
ggcctttgacattatgttgc

SEQ ID NO: 361664 - DNA, 20 bp, human
gtctatgattgctcattctt

SEQ ID NO: 361665 - DNA, 20 bp, human
gaggactgataaaaatttgc

SEQ ID NO: 361666 - DNA, 20 bp, human
gaacagagttaaggaccagt

SEQ ID NO: 361667 - DNA, 20 bp, human
gaggtcaaagaacagagtta

SEQ ID NO: 361668 - DNA, 20 bp, human
gcaccggaagagtcgctagg

SEQ ID NO: 361669 - DNA, 20 bp, human
ggaccagtggggcgcctgcg

SEQ ID NO: 361670 - DNA, 20 bp, human
gcggcgggtaagggagcaga

SEQ ID NO: 361671 - DNA, 20 bp, human
ggagaaaagcataggacgaa

SEQ ID NO: 361672 - DNA, 20 bp, human
gaaccggctgccatgcgaag

SEQ ID NO: 361673 - DNA, 20 bp, human
gggaaccgccttcacagcac

SEQ ID NO: 361674 - DNA, 20 bp, human
ggggcctcgccacaccgcgc

SEQ ID NO: 361675 - DNA, 20 bp, human
gagtggcggcgggaagctgg

SEQ ID NO: 361676 - DNA, 20 bp, human
ggttgctgggctcggaaata

SEQ ID NO: 361677 - DNA, 20 bp, human
gaacaagagtaattgtggga

SEQ ID NO: 361678 - DNA, 20 bp, human
gttgtcccacgggccggctc

SEQ ID NO: 361679 - DNA, 20 bp, human
ggaccccggaacgcctcctc

SEQ ID NO: 361680 - DNA, 20 bp, human
gatcgctgacgagatcggaa

SEQ ID NO: 361681 - DNA, 20 bp, human
gcagcaacaagagtaattgt

SEQ ID NO: 361682 - DNA, 20 bp, human
gcgcgtgcgcagattgagaa

SEQ ID NO: 361683 - DNA, 20 bp, human
ggtcggcagggttttctctt

SEQ ID NO: 361684 - DNA, 20 bp, human
gccacgggccggctccggat

SEQ ID NO: 361685 - DNA, 20 bp, human
ggagaatggagctttccggt

SEQ ID NO: 361686 - DNA, 20 bp, human
ggacgccggcgccacgggac

SEQ ID NO: 361687 - DNA, 20 bp, human
gccgggcggcggatgtgcgc

SEQ ID NO: 361688 - DNA, 20 bp, human
gctcgcgggcctgaccctag

SEQ ID NO: 361689 - DNA, 20 bp, human
gcgcaaaagggaaagtggcg

SEQ ID NO: 361690 - DNA, 20 bp, human
gcagcctcgcgtagcgctct

SEQ ID NO: 361691 - DNA, 20 bp, human
gtggggatgccgctagggtc

SEQ ID NO: 361692 - DNA, 20 bp, human
gaccgctgccggtgggcccg

SEQ ID NO: 361693 - DNA, 20 bp, human
gcacacccggcgaagagcgc

SEQ ID NO: 361694 - DNA, 20 bp, human
gcagcccagagcgctacgcg

SEQ ID NO: 361695 - DNA, 20 bp, human
gagacagagcgcggcgcaaa

SEQ ID NO: 361696 - DNA, 20 bp, human
ggggctaaggacgcggtgac

SEQ ID NO: 361697 - DNA, 20 bp, human
gctaaggacgcggtgacggg

SEQ ID NO: 361698 - DNA, 20 bp, human
ggcctccctcagaacgcgct

SEQ ID NO: 361699 - DNA, 20 bp, human
gctgagggaggccggggcta

SEQ ID NO: 361700 - DNA, 20 bp, human
gtaggggtgtacactagctg

SEQ ID NO: 361701 - DNA, 20 bp, human
gcgggagcgccggaagcggg

SEQ ID NO: 361702 - DNA, 20 bp, human
gccatcccagcgcgttctga

SEQ ID NO: 361703 - DNA, 20 bp, human
gcccttccgcctgcgaggct

SEQ ID NO: 361704 - DNA, 20 bp, human
gtcccagcgcgttctgaggg

SEQ ID NO: 361705 - DNA, 20 bp, human
gcgccccgcctcccgacccg

SEQ ID NO: 361706 - DNA, 20 bp, human
gggcgggcgcccacaagtca

SEQ ID NO: 361707 - DNA, 20 bp, human
gctgcccgcgagccgagtcc

SEQ ID NO: 361708 - DNA, 20 bp, human
gcccctcagcagcccggact

SEQ ID NO: 361709 - DNA, 20 bp, human
gcagcccggactcggctcgc

SEQ ID NO: 361710 - DNA, 20 bp, human
gcgcaccgagccctgacttg

SEQ ID NO: 361711 - DNA, 20 bp, human
gaccctgccgaaagcccggg

SEQ ID NO: 361712 - DNA, 20 bp, human
ggccgcccgggctttcggca

SEQ ID NO: 361713 - DNA, 20 bp, human
ggcgcccacaagtcagggct

SEQ ID NO: 361714 - DNA, 20 bp, human
ggcagctccagcgcccgtgg

SEQ ID NO: 361715 - DNA, 20 bp, human
ggccgagcccgcgccgtgaa

SEQ ID NO: 361716 - DNA, 20 bp, human
ggggaggggcggctgatttc

SEQ ID NO: 361717 - DNA, 20 bp, human
gcgaccggaaatcacttcct

SEQ ID NO: 361718 - DNA, 20 bp, human
gagtcccaggaagtgatttc

SEQ ID NO: 361719 - DNA, 20 bp, human
gccgtcgcctgcccttcgac

SEQ ID NO: 361720 - DNA, 20 bp, human
gcgcccctcccaccttcgac

SEQ ID NO: 361721 - DNA, 20 bp, human
gagtgatttccggtcgaagg

SEQ ID NO: 361722 - DNA, 20 bp, human
gggaaaaacaggaactcctc

SEQ ID NO: 361723 - DNA, 20 bp, human
ggcggctgatttccggtcga

SEQ ID NO: 361724 - DNA, 20 bp, human
gctccctctccaagccggag

SEQ ID NO: 361725 - DNA, 20 bp, human
gatttccggtcgaaggtggg

SEQ ID NO: 361726 - DNA, 20 bp, human
ggccgcctggggcgtaggaa

SEQ ID NO: 361727 - DNA, 20 bp, human
ggcctggggcgtaggaaagg

SEQ ID NO: 361728 - DNA, 20 bp, human
ggacccgtgctggcagtagg

SEQ ID NO: 361729 - DNA, 20 bp, human
gcacgtgcgggggcgggaca

SEQ ID NO: 361730 - DNA, 20 bp, human
gcccccgcacgtgacgccac

SEQ ID NO: 361731 - DNA, 20 bp, human
gagttccctgctctgccgta

SEQ ID NO: 361732 - DNA, 20 bp, human
gtccccggctgcaggcgagc

SEQ ID NO: 361733 - DNA, 20 bp, human
gtccagtggcgtcacgtgcg

SEQ ID NO: 361734 - DNA, 20 bp, human
ggaaagggatgtcgcaaggt

SEQ ID NO: 361735 - DNA, 20 bp, human
gcgcacgctgtactctccag

SEQ ID NO: 361736 - DNA, 20 bp, human
gcggggactgaggcagtaga

SEQ ID NO: 361737 - DNA, 20 bp, human
gcgcggccgcgagcaaagga

SEQ ID NO: 361738 - DNA, 20 bp, human
gagccgcagcgccggtggag

SEQ ID NO: 361739 - DNA, 20 bp, human
gcgtgcgcgtggtggcggag

SEQ ID NO: 361740 - DNA, 20 bp, human
gcgcccctccaccggcgctg

SEQ ID NO: 361741 - DNA, 20 bp, human
gcgtggtggcggagggggat

SEQ ID NO: 361742 - DNA, 20 bp, human
gggttgccgagcagcgtacg

SEQ ID NO: 361743 - DNA, 20 bp, human
gggctcttccgtccaataag

SEQ ID NO: 361744 - DNA, 20 bp, human
gcggacccgaacggggggag

SEQ ID NO: 361745 - DNA, 20 bp, human
gaataagcggacccgaacgg

SEQ ID NO: 361746 - DNA, 20 bp, human
ggggttgcaaacccgaggag

SEQ ID NO: 361747 - DNA, 20 bp, human
ggtggcccgggcgccaaggg

SEQ ID NO: 361748 - DNA, 20 bp, human
ggcagcggggcccgggaaaa

SEQ ID NO: 361749 - DNA, 20 bp, human
gcggcaatgattggtctcgg

SEQ ID NO: 361750 - DNA, 20 bp, human
gttcccgggccccgctgcaa

SEQ ID NO: 361751 - DNA, 20 bp, human
ggtggggggttgcaaacccg

SEQ ID NO: 361752 - DNA, 20 bp, human
gccgttgcatgatgcaaaaa

SEQ ID NO: 361753 - DNA, 20 bp, human
gttgcaaacccgaggagcgg

SEQ ID NO: 361754 - DNA, 20 bp, human
gccgctgcgcactcggggag

SEQ ID NO: 361755 - DNA, 20 bp, human
gagtgcgcagcggagcgtcc

SEQ ID NO: 361756 - DNA, 20 bp, human
gtaaaaggtgcaacaacctc

SEQ ID NO: 361757 - DNA, 20 bp, human
gtcggtggcggagtcgtcat

SEQ ID NO: 361758 - DNA, 20 bp, human
gtaggaagcccgcctctcgg

SEQ ID NO: 361759 - DNA, 20 bp, human
ggagtcgtcattggatgttg

SEQ ID NO: 361760 - DNA, 20 bp, human
ggtccggcggctcctctatc

SEQ ID NO: 361761 - DNA, 20 bp, human
ggaagcccgcctctcggtgg

SEQ ID NO: 361762 - DNA, 20 bp, human
gaggaagattgtgcatgccg

SEQ ID NO: 361763 - DNA, 20 bp, human
ggggcttcctagactctaaa

SEQ ID NO: 361764 - DNA, 20 bp, human
gttgcaaaaccgcttgcaac

SEQ ID NO: 361765 - DNA, 20 bp, human
gactcaagccgtcagaccca

SEQ ID NO: 361766 - DNA, 20 bp, human
gtacaccggaacgccaagag

SEQ ID NO: 361767 - DNA, 20 bp, human
ggctggggtggccgggacta

SEQ ID NO: 361768 - DNA, 20 bp, human
gagaggcaggaagcggcctg

SEQ ID NO: 361769 - DNA, 20 bp, human
gggggctgatcgcgtctatg

SEQ ID NO: 361770 - DNA, 20 bp, human
gtctggccgggctgcgaagc

SEQ ID NO: 361771 - DNA, 20 bp, human
gggggcggggtcagctacac

SEQ ID NO: 361772 - DNA, 20 bp, human
gtgggctgggccaggcaagt

SEQ ID NO: 361773 - DNA, 20 bp, human
gcctctgcggcccacttgcc

SEQ ID NO: 361774 - DNA, 20 bp, human
gcctggagaaggggcgtcgg

SEQ ID NO: 361775 - DNA, 20 bp, human
gcaagtgggccgcagaggcc

SEQ ID NO: 361776 - DNA, 20 bp, human
gaatctgagaacctgactcc

SEQ ID NO: 361777 - DNA, 20 bp, human
ggggctggctcggggcttga

SEQ ID NO: 361778 - DNA, 20 bp, human
gaagggcaggaacctccctg

SEQ ID NO: 361779 - DNA, 20 bp, human
gggggtctcctgtaccatgt

SEQ ID NO: 361780 - DNA, 20 bp, human
gtcgagggcaaggttggaat

SEQ ID NO: 361781 - DNA, 20 bp, human
gccttggtgtgggctggctc

SEQ ID NO: 361782 - DNA, 20 bp, human
gtccatctgctcccttggtg

SEQ ID NO: 361783 - DNA, 20 bp, human
gggcccatgggcttatgcat

SEQ ID NO: 361784 - DNA, 20 bp, human
gcgggggaaagcaaagctcc

SEQ ID NO: 361785 - DNA, 20 bp, human
gcatgggcttatgcatagga

SEQ ID NO: 361786 - DNA, 20 bp, human
gagggtgactgaaaaggata

SEQ ID NO: 361787 - DNA, 20 bp, human
ggaagggctaagggtaaaca

SEQ ID NO: 361788 - DNA, 20 bp, human
ggattctagggtgactgaaa

SEQ ID NO: 361789 - DNA, 20 bp, human
ggaggggtgaggtaaacaac

SEQ ID NO: 361790 - DNA, 20 bp, human
ggggaaagaaggcaacttgg

SEQ ID NO: 361791 - DNA, 20 bp, human
gggactatacctgaggggtg

SEQ ID NO: 361792 - DNA, 20 bp, human
gtaatggtacagtcgggggc

SEQ ID NO: 361793 - DNA, 20 bp, human
ggatttaatggtacagtcgg

SEQ ID NO: 361794 - DNA, 20 bp, human
ggaactttggactatacctg

SEQ ID NO: 361795 - DNA, 20 bp, human
ggtgctgccatgcataatat

SEQ ID NO: 361796 - DNA, 20 bp, human
gaatcagccgcagcggggcg

SEQ ID NO: 361797 - DNA, 20 bp, human
gccttctcagatggcgctcc

SEQ ID NO: 361798 - DNA, 20 bp, human
gcgctgccgtaccgtccagg

SEQ ID NO: 361799 - DNA, 20 bp, human
ggattcgtctagttaaaccc

SEQ ID NO: 361800 - DNA, 20 bp, human
gaggcgctgccgtaccgtcc

SEQ ID NO: 361801 - DNA, 20 bp, human
gcgcgcttttcgctgacttt

SEQ ID NO: 361802 - DNA, 20 bp, human
gtttcgctgacttttggcaa

SEQ ID NO: 361803 - DNA, 20 bp, human
gggcgagcagagtaagaagc

SEQ ID NO: 361804 - DNA, 20 bp, human
gcgtatttgagcatgcgcga

SEQ ID NO: 361805 - DNA, 20 bp, human
gcaggcggcgagttgcattc

SEQ ID NO: 361806 - DNA, 20 bp, human
gtggggcaggaagctgagtg

SEQ ID NO: 361807 - DNA, 20 bp, human
gatggagctacagtgggact

SEQ ID NO: 361808 - DNA, 20 bp, human
gcacgatgatggagctacag

SEQ ID NO: 361809 - DNA, 20 bp, human
ggccaaggccaagaacactt

SEQ ID NO: 361810 - DNA, 20 bp, human
ggggttgaaggtacgtagac

SEQ ID NO: 361811 - DNA, 20 bp, human
gcatcatcgtggtgagacat

SEQ ID NO: 361812 - DNA, 20 bp, human
gttggaatccagatgtgtga

SEQ ID NO: 361813 - DNA, 20 bp, human
gacatggggtatgtgcagag

SEQ ID NO: 361814 - DNA, 20 bp, human
gagaaaacagttcccaggac

SEQ ID NO: 361815 - DNA, 20 bp, human
gctgagtgcggctaacaagg

SEQ ID NO: 361816 - DNA, 20 bp, human
gtggtggggacgagtcctca

SEQ ID NO: 361817 - DNA, 20 bp, human
gccgcaggtgagacccgggg

SEQ ID NO: 361818 - DNA, 20 bp, human
ggtcctcagggcggggtcat

SEQ ID NO: 361819 - DNA, 20 bp, human
gcagggcggggtcatgggtg

SEQ ID NO: 361820 - DNA, 20 bp, human
ggggacgagtcctcagggcg

SEQ ID NO: 361821 - DNA, 20 bp, human
gaggccaggcaggggtccta

SEQ ID NO: 361822 - DNA, 20 bp, human
ggtgaaggcggagtcacggg

SEQ ID NO: 361823 - DNA, 20 bp, human
gcgcacgatctgctctacga

SEQ ID NO: 361824 - DNA, 20 bp, human
gagtggtgaaggcggagtca

SEQ ID NO: 361825 - DNA, 20 bp, human
gcatgggtgaggcgggacct

SEQ ID NO: 361826 - DNA, 20 bp, human
gaggccgccctaggtaggtg

SEQ ID NO: 361827 - DNA, 20 bp, human
gaggcgaggccgccctaggt

SEQ ID NO: 361828 - DNA, 20 bp, human
gaggaagcgcagcaccgcct

SEQ ID NO: 361829 - DNA, 20 bp, human
ggcgcggcccagtgaggcgg

SEQ ID NO: 361830 - DNA, 20 bp, human
gtctcggccacacctaccta

SEQ ID NO: 361831 - DNA, 20 bp, human
gtgagcgtcagcgttggggc

SEQ ID NO: 361832 - DNA, 20 bp, human
gggactgagcgtcagcgttg

SEQ ID NO: 361833 - DNA, 20 bp, human
gctcagtcctcaggcgtcga

SEQ ID NO: 361834 - DNA, 20 bp, human
gcgtctgaggccagaggact

SEQ ID NO: 361835 - DNA, 20 bp, human
gaagacggcgcgaggaatgc

SEQ ID NO: 361836 - DNA, 20 bp, human
gggccggggccagtggagct

SEQ ID NO: 361837 - DNA, 20 bp, human
gtggtgggcgggaggatggt

SEQ ID NO: 361838 - DNA, 20 bp, human
ggagcagagcgcagccgcga

SEQ ID NO: 361839 - DNA, 20 bp, human
gcgcgcccggccgcggtggt

SEQ ID NO: 361840 - DNA, 20 bp, human
ggcagcggagacggtcgttt

SEQ ID NO: 361841 - DNA, 20 bp, human
gcggtcgtttggggacggag

SEQ ID NO: 361842 - DNA, 20 bp, human
ggaagcgaatggtcccttcc

SEQ ID NO: 361843 - DNA, 20 bp, human
gctgctcgccggcgtcccgc

SEQ ID NO: 361844 - DNA, 20 bp, human
ggcggctgcgctctgctcgc

SEQ ID NO: 361845 - DNA, 20 bp, human
gagccgcgagggaggcgcga

SEQ ID NO: 361846 - DNA, 20 bp, human
ggggcccctggttctacttg

SEQ ID NO: 361847 - DNA, 20 bp, human
gttaggctggggtcattgtg

SEQ ID NO: 361848 - DNA, 20 bp, human
gagggcgtcagcttggaggt

SEQ ID NO: 361849 - DNA, 20 bp, human
gtgggagcccagctgacgag

SEQ ID NO: 361850 - DNA, 20 bp, human
gcaaggccccctcgtcagct

SEQ ID NO: 361851 - DNA, 20 bp, human
gaatccccaagtagaaccag

SEQ ID NO: 361852 - DNA, 20 bp, human
gacgccctcaaccactctgc

SEQ ID NO: 361853 - DNA, 20 bp, human
gtgctggggtgagcaaaccc

SEQ ID NO: 361854 - DNA, 20 bp, human
ggtcattgtggggattagaa

SEQ ID NO: 361855 - DNA, 20 bp, human
gagatggagctcagattctt

SEQ ID NO: 361856 - DNA, 20 bp, human
gtagatagagttctgttttg

SEQ ID NO: 361857 - DNA, 20 bp, human
gcttcacttgctctatcctg

SEQ ID NO: 361858 - DNA, 20 bp, human
gtaaaaaccttcatacatac

SEQ ID NO: 361859 - DNA, 20 bp, human
gtctagaccagtatgtatga

SEQ ID NO: 361860 - DNA, 20 bp, human
gtttttttgctctacctcct

SEQ ID NO: 361861 - DNA, 20 bp, human
gagagcaagtgaagagatta

SEQ ID NO: 361862 - DNA, 20 bp, human
gctaaagtgcaataatcctc

SEQ ID NO: 361863 - DNA, 20 bp, human
gttatttatcagaaacttaa

SEQ ID NO: 361864 - DNA, 20 bp, human
gtttatcagaaacttaatgg

SEQ ID NO: 361865 - DNA, 20 bp, human
gagagttctgttttgtggtg

SEQ ID NO: 361866 - DNA, 20 bp, human
gggacaacgcggacgactct

SEQ ID NO: 361867 - DNA, 20 bp, human
gtgcgcagaggcggacaacg

SEQ ID NO: 361868 - DNA, 20 bp, human
gtcggaagccggccgcatgg

SEQ ID NO: 361869 - DNA, 20 bp, human
ggaagccggccgcatggggg

SEQ ID NO: 361870 - DNA, 20 bp, human
gggcttgcgcactcggaagc

SEQ ID NO: 361871 - DNA, 20 bp, human
gacgtggctcggggacggga

SEQ ID NO: 361872 - DNA, 20 bp, human
ggctgcgcgcacgtcacgtg

SEQ ID NO: 361873 - DNA, 20 bp, human
gcccacccccagcctctata

SEQ ID NO: 361874 - DNA, 20 bp, human
gcactcggaagccggccgca

SEQ ID NO: 361875 - DNA, 20 bp, human
gcggagcgatcacggggagg

SEQ ID NO: 361876 - DNA, 20 bp, human
gccgcagcccagtgggtaag

SEQ ID NO: 361877 - DNA, 20 bp, human
gaggtccagcggggagagac

SEQ ID NO: 361878 - DNA, 20 bp, human
gcagcccagtgggtaagggg

SEQ ID NO: 361879 - DNA, 20 bp, human
ggggcggggagcaggtccag

SEQ ID NO: 361880 - DNA, 20 bp, human
gcgcgcccgcaagcgggaac

SEQ ID NO: 361881 - DNA, 20 bp, human
gagcgcgcgtgagtcacgcg

SEQ ID NO: 361882 - DNA, 20 bp, human
ggcaagcgggaactggtccc

SEQ ID NO: 361883 - DNA, 20 bp, human
ggtccccgccgcagcccagt

SEQ ID NO: 361884 - DNA, 20 bp, human
gtagagccgagtcaggggcc

SEQ ID NO: 361885 - DNA, 20 bp, human
gggtcccgggtccacgctgc

SEQ ID NO: 361886 - DNA, 20 bp, human
ggtgccggcgcgaagtgggt

SEQ ID NO: 361887 - DNA, 20 bp, human
gaggctccccgctctgtcct

SEQ ID NO: 361888 - DNA, 20 bp, human
ggagcgagtcggccccgggg

SEQ ID NO: 361889 - DNA, 20 bp, human
gagcctcagctcctcgtccc

SEQ ID NO: 361890 - DNA, 20 bp, human
gccggcaccgctagcagctg

SEQ ID NO: 361891 - DNA, 20 bp, human
ggggccgttcctttttcttt

SEQ ID NO: 361892 - DNA, 20 bp, human
gagctccagaagcaccgcgg

SEQ ID NO: 361893 - DNA, 20 bp, human
gagtgcggaccgctgcggga

SEQ ID NO: 361894 - DNA, 20 bp, human
ggcggagcgagtcggccccg

SEQ ID NO: 361895 - DNA, 20 bp, human
gccgcagcggtccgcactcg

SEQ ID NO: 361896 - DNA, 20 bp, human
gtcatgggacagccaatcag

SEQ ID NO: 361897 - DNA, 20 bp, human
ggcctgctgcctaccctggt

SEQ ID NO: 361898 - DNA, 20 bp, human
gacagccaatcagaggagga

SEQ ID NO: 361899 - DNA, 20 bp, human
gggcagcaggcaggcgtcat

SEQ ID NO: 361900 - DNA, 20 bp, human
ggctgcaaacagacattggg

SEQ ID NO: 361901 - DNA, 20 bp, human
gagtcccctcctcctctgat

SEQ ID NO: 361902 - DNA, 20 bp, human
gcaaacagacattgggaggt

SEQ ID NO: 361903 - DNA, 20 bp, human
gaacacttgggaagaagtgt

SEQ ID NO: 361904 - DNA, 20 bp, human
gcccacaaaaacctatatgg

SEQ ID NO: 361905 - DNA, 20 bp, human
gctggctgcaaacagacatt

SEQ ID NO: 361906 - DNA, 20 bp, human
ggggcggagccacccgaaag

SEQ ID NO: 361907 - DNA, 20 bp, human
gaagccgcgcagcacctctt

SEQ ID NO: 361908 - DNA, 20 bp, human
gagccacccgaaagcggctg

SEQ ID NO: 361909 - DNA, 20 bp, human
gccgaggcgcggtcgggcca

SEQ ID NO: 361910 - DNA, 20 bp, human
gaaacggtcgcctggaaatt

SEQ ID NO: 361911 - DNA, 20 bp, human
ggcccccggggcctcagtcc

SEQ ID NO: 361912 - DNA, 20 bp, human
gcgcccgcggcccaatttcc

SEQ ID NO: 361913 - DNA, 20 bp, human
gcacccgaaagcggctgcgg

SEQ ID NO: 361914 - DNA, 20 bp, human
ggacccacgcgcaacagcgc

SEQ ID NO: 361915 - DNA, 20 bp, human
gcgggtacccgcccagttca

SEQ ID NO: 361916 - DNA, 20 bp, human
ggccccgaggccgtggtctc

SEQ ID NO: 361917 - DNA, 20 bp, human
ggacccgagaccacggcctc

SEQ ID NO: 361918 - DNA, 20 bp, human
gtggacccgggtcccagcga

SEQ ID NO: 361919 - DNA, 20 bp, human
gcgagggcggggggagcgta

SEQ ID NO: 361920 - DNA, 20 bp, human
gccagggctgtaggaggcga

SEQ ID NO: 361921 - DNA, 20 bp, human
gggacccaggtcccccacca

SEQ ID NO: 361922 - DNA, 20 bp, human
gggtctggtcgggtgacccc

SEQ ID NO: 361923 - DNA, 20 bp, human
ggccgccctgggtcgcgcgt

SEQ ID NO: 361924 - DNA, 20 bp, human
ggtggtctcgggtccatggt

SEQ ID NO: 361925 - DNA, 20 bp, human
gggacggatggtccgaggac

SEQ ID NO: 361926 - DNA, 20 bp, human
gtgaaagtagggtatggaga

SEQ ID NO: 361927 - DNA, 20 bp, human
gcgcccaccccttgaaagta

SEQ ID NO: 361928 - DNA, 20 bp, human
gtcaaggggtgggcggtaga

SEQ ID NO: 361929 - DNA, 20 bp, human
gaccccttgaaagtagggta

SEQ ID NO: 361930 - DNA, 20 bp, human
gcagaggacgtggtcaccga

SEQ ID NO: 361931 - DNA, 20 bp, human
gggcgcgaccaagtccggtg

SEQ ID NO: 361932 - DNA, 20 bp, human
gcccccttcgtagaagccta

SEQ ID NO: 361933 - DNA, 20 bp, human
gggaactggtctggccatag

SEQ ID NO: 361934 - DNA, 20 bp, human
gccggtggggggaggtgcaa

SEQ ID NO: 361935 - DNA, 20 bp, human
gaacgcgccgcttcccccta

SEQ ID NO: 361936 - DNA, 20 bp, human
gacgccgggcggctacgctg

SEQ ID NO: 361937 - DNA, 20 bp, human
gaggcggtaatctcgcgaga

SEQ ID NO: 361938 - DNA, 20 bp, human
gaggcttccgggcctagcgg

SEQ ID NO: 361939 - DNA, 20 bp, human
gcccggaagcctcgtctgag

SEQ ID NO: 361940 - DNA, 20 bp, human
gtcgaaatggagcgaggcgg

SEQ ID NO: 361941 - DNA, 20 bp, human
gcagcccgccgattctccaa

SEQ ID NO: 361942 - DNA, 20 bp, human
gaagcctcgtctgagggggc

SEQ ID NO: 361943 - DNA, 20 bp, human
ggtcgagcgagagcctgtgg

SEQ ID NO: 361944 - DNA, 20 bp, human
gtaagcaaggcagctacgcc

SEQ ID NO: 361945 - DNA, 20 bp, human
gactagtgggtggggtgcga

SEQ ID NO: 361946 - DNA, 20 bp, human
gaggcgggaggtgccagctg

SEQ ID NO: 361947 - DNA, 20 bp, human
gggcacctcccgcctcgccg

SEQ ID NO: 361948 - DNA, 20 bp, human
gccccccgacactgccgtcc

SEQ ID NO: 361949 - DNA, 20 bp, human
gagacccccggccgtccaag

SEQ ID NO: 361950 - DNA, 20 bp, human
ggggaccgggacggcagtgt

SEQ ID NO: 361951 - DNA, 20 bp, human
gcggagccccgccgcttgga

SEQ ID NO: 361952 - DNA, 20 bp, human
gcccgccgcttggacggccg

SEQ ID NO: 361953 - DNA, 20 bp, human
gcccccggccgtccaagcgg

SEQ ID NO: 361954 - DNA, 20 bp, human
gaccgggacggcagtgtcgg

SEQ ID NO: 361955 - DNA, 20 bp, human
gcaagctgcgggagacccgt

SEQ ID NO: 361956 - DNA, 20 bp, human
gcggcctccctgtctcgcac

SEQ ID NO: 361957 - DNA, 20 bp, human
gcagccagtgcgagacaggg

SEQ ID NO: 361958 - DNA, 20 bp, human
gagggaggccggtgcgggtg

SEQ ID NO: 361959 - DNA, 20 bp, human
gccgcccgcctgtcaaggcc

SEQ ID NO: 361960 - DNA, 20 bp, human
ggagcagccagtgcgagaca

SEQ ID NO: 361961 - DNA, 20 bp, human
gcccgcctcccgggcggatc

SEQ ID NO: 361962 - DNA, 20 bp, human
ggcccaggactgtcccccag

SEQ ID NO: 361963 - DNA, 20 bp, human
gggaacctgatccgcccggg

SEQ ID NO: 361964 - DNA, 20 bp, human
ggcgctccggtcgtgtgccc

SEQ ID NO: 361965 - DNA, 20 bp, human
ggggcccgagtggccgctgg

SEQ ID NO: 361966 - DNA, 20 bp, human
gtctcgatacaggcagtccc

SEQ ID NO: 361967 - DNA, 20 bp, human
gagactctctccagcccaac

SEQ ID NO: 361968 - DNA, 20 bp, human
gcccgtgggccgtaccattc

SEQ ID NO: 361969 - DNA, 20 bp, human
ggacccggaatcagcctcaa

SEQ ID NO: 361970 - DNA, 20 bp, human
gccccccggccagaatggta

SEQ ID NO: 361971 - DNA, 20 bp, human
gctgggaggggacgcgcgga

SEQ ID NO: 361972 - DNA, 20 bp, human
gccacgggggcggtgattta

SEQ ID NO: 361973 - DNA, 20 bp, human
gcgcgcggagggcttccccc

SEQ ID NO: 361974 - DNA, 20 bp, human
gatgggaaggagacttgtgt

SEQ ID NO: 361975 - DNA, 20 bp, human
gtccagcccaacaggaggat

SEQ ID NO: 361976 - DNA, 20 bp, human
gtgtgtggcgagcgtccgag

SEQ ID NO: 361977 - DNA, 20 bp, human
gggacgctcgccacacacct

SEQ ID NO: 361978 - DNA, 20 bp, human
gcggcgcaggcgcactctgc

SEQ ID NO: 361979 - DNA, 20 bp, human
gccgatacgccatcgcgcta

SEQ ID NO: 361980 - DNA, 20 bp, human
ggcgctagggacgctattgt

SEQ ID NO: 361981 - DNA, 20 bp, human
gcactctgccggcaacgccg

SEQ ID NO: 361982 - DNA, 20 bp, human
ggaaacccacgattaaacga

SEQ ID NO: 361983 - DNA, 20 bp, human
gctagggacgctattgtggg

SEQ ID NO: 361984 - DNA, 20 bp, human
ggtggggtgtgggaacactg

SEQ ID NO: 361985 - DNA, 20 bp, human
gctgaggggtcccaaagaaa

SEQ ID NO: 361986 - DNA, 20 bp, human
gagtgaagcgtgcgggctga

SEQ ID NO: 361987 - DNA, 20 bp, human
ggagaggcgagaccccatga

SEQ ID NO: 361988 - DNA, 20 bp, human
ggggaattgtagtcccgacg

SEQ ID NO: 361989 - DNA, 20 bp, human
gttgtcgcgcggtgcgtcct

SEQ ID NO: 361990 - DNA, 20 bp, human
gcgcgcgaagagttgtcgcg

SEQ ID NO: 361991 - DNA, 20 bp, human
gtgaggggagtgaagcgtgc

SEQ ID NO: 361992 - DNA, 20 bp, human
gaagcgtgcgggctgaagga

SEQ ID NO: 361993 - DNA, 20 bp, human
gtgacccccctggagcggtg

SEQ ID NO: 361994 - DNA, 20 bp, human
gaaggcactgtggggtatgt

SEQ ID NO: 361995 - DNA, 20 bp, human
ggcctcaggagaaatgactc

SEQ ID NO: 361996 - DNA, 20 bp, human
gtactaatgttacatcaact

SEQ ID NO: 361997 - DNA, 20 bp, human
gcggagccccggccgagctt

SEQ ID NO: 361998 - DNA, 20 bp, human
gtaaagcaggagatgaaata

SEQ ID NO: 361999 - DNA, 20 bp, human
gtagtgctaatgtagcatga

SEQ ID NO: 362000 - DNA, 20 bp, human
gttcaacaagctcggagccc

SEQ ID NO: 362001 - DNA, 20 bp, human
ggtacacatttctatttgtg

SEQ ID NO: 362002 - DNA, 20 bp, human
gatcgttgcaaaaaggacag

SEQ ID NO: 362003 - DNA, 20 bp, human
ggttctacatcgttgcaaaa

SEQ ID NO: 362004 - DNA, 20 bp, human
gactgattgcttcacaatta

SEQ ID NO: 362005 - DNA, 20 bp, human
gaaatgtaattcaacaagct

SEQ ID NO: 362006 - DNA, 20 bp, human
gtactaatgttacatcaact

SEQ ID NO: 362007 - DNA, 20 bp, human
gcggagccccggccgagctt

SEQ ID NO: 362008 - DNA, 20 bp, human
gtaaagcaggagatgaaata

SEQ ID NO: 362009 - DNA, 20 bp, human
gtagtgctaatgtagcatga

SEQ ID NO: 362010 - DNA, 20 bp, human
gttcaacaagctcggagccc

SEQ ID NO: 362011 - DNA, 20 bp, human
ggtacacatttctatttgtg

SEQ ID NO: 362012 - DNA, 20 bp, human
gatcgttgcaaaaaggacag

SEQ ID NO: 362013 - DNA, 20 bp, human
ggttctacatcgttgcaaaa

SEQ ID NO: 362014 - DNA, 20 bp, human
gactgattgcttcacaatta

SEQ ID NO: 362015 - DNA, 20 bp, human
gaaatgtaattcaacaagct

SEQ ID NO: 362016 - DNA, 20 bp, human
gacagtaagaaaagctccag

SEQ ID NO: 362017 - DNA, 20 bp, human
gtattaagaccctggagggc

SEQ ID NO: 362018 - DNA, 20 bp, human
gagccggggtgggtaagtgg

SEQ ID NO: 362019 - DNA, 20 bp, human
gaaaaagcacgtggatccac

SEQ ID NO: 362020 - DNA, 20 bp, human
gcccgggagccggctcccat

SEQ ID NO: 362021 - DNA, 20 bp, human
ggtaagtggcggagggtcgc

SEQ ID NO: 362022 - DNA, 20 bp, human
ggtcgtgcttgagccggggt

SEQ ID NO: 362023 - DNA, 20 bp, human
gcacgtgggcaggttggggg

SEQ ID NO: 362024 - DNA, 20 bp, human
gccggctcaagcacgacccg

SEQ ID NO: 362025 - DNA, 20 bp, human
gccgagtgagacgtagggac

SEQ ID NO: 362026 - DNA, 20 bp, human
gacactcttgcagcgcccgc

SEQ ID NO: 362027 - DNA, 20 bp, human
gtgaacctgcaaccccttga

SEQ ID NO: 362028 - DNA, 20 bp, human
gcacgcggctgggaaagctt

SEQ ID NO: 362029 - DNA, 20 bp, human
gagggtcgctggggaaacta

SEQ ID NO: 362030 - DNA, 20 bp, human
ggaaaccctcaaggggttgc

SEQ ID NO: 362031 - DNA, 20 bp, human
ggagcgaagcgccgcccacg

SEQ ID NO: 362032 - DNA, 20 bp, human
gtccaaattcagggtcgctg

SEQ ID NO: 362033 - DNA, 20 bp, human
gaggtccgggcggttggccg

SEQ ID NO: 362034 - DNA, 20 bp, human
gaagagctatccccagttct

SEQ ID NO: 362035 - DNA, 20 bp, human
gaaagggcctggttggtagg

SEQ ID NO: 362036 - DNA, 20 bp, human
gcggggacgcgtgatgggta

SEQ ID NO: 362037 - DNA, 20 bp, human
gccgccggggcgggctgact

SEQ ID NO: 362038 - DNA, 20 bp, human
gcggaccggggacgcgtgat

SEQ ID NO: 362039 - DNA, 20 bp, human
gccgggccctcgggccactg

SEQ ID NO: 362040 - DNA, 20 bp, human
gtccgccggcgcttccggga

SEQ ID NO: 362041 - DNA, 20 bp, human
gtcgggccactggggatcag

SEQ ID NO: 362042 - DNA, 20 bp, human
gcggggccggacgacagccc

SEQ ID NO: 362043 - DNA, 20 bp, human
gctgactgggaggcggctcc

SEQ ID NO: 362044 - DNA, 20 bp, human
ggagcgccggagccggaccg

SEQ ID NO: 362045 - DNA, 20 bp, human
gtccggcgctcacctacccc

SEQ ID NO: 362046 - DNA, 20 bp, human
gggccctgctcccacagccg

SEQ ID NO: 362047 - DNA, 20 bp, human
gcagccgcgggctccacccc

SEQ ID NO: 362048 - DNA, 20 bp, human
gaacccccgggcagtcctga

SEQ ID NO: 362049 - DNA, 20 bp, human
gcggtgggggtggaccttcc

SEQ ID NO: 362050 - DNA, 20 bp, human
gccggtgggcgcggacagtg

SEQ ID NO: 362051 - DNA, 20 bp, human
ggcaggacagcttggagata

SEQ ID NO: 362052 - DNA, 20 bp, human
gtgtgggagcagggcccgcc

SEQ ID NO: 362053 - DNA, 20 bp, human
ggccctgctgggttccaagc

SEQ ID NO: 362054 - DNA, 20 bp, human
gcgggccagcgagcattcag

SEQ ID NO: 362055 - DNA, 20 bp, human
gcaccggcttggaacccagc

SEQ ID NO: 362056 - DNA, 20 bp, human
gtgcgcgtcactagacgaca

SEQ ID NO: 362057 - DNA, 20 bp, human
gcctggaaggaagtgacgcg

SEQ ID NO: 362058 - DNA, 20 bp, human
gggaaacttaacggctaatg

SEQ ID NO: 362059 - DNA, 20 bp, human
gaggaagtgacgcgaggctg

SEQ ID NO: 362060 - DNA, 20 bp, human
ggcctgggtaggataaaaca

SEQ ID NO: 362061 - DNA, 20 bp, human
gtgacgcgaggctgaggggc

SEQ ID NO: 362062 - DNA, 20 bp, human
gtccgtgttttatcctaccc

SEQ ID NO: 362063 - DNA, 20 bp, human
ggtgcatggtaggtaaaggt

SEQ ID NO: 362064 - DNA, 20 bp, human
gcgtcacttccttccaggcc

SEQ ID NO: 362065 - DNA, 20 bp, human
gccaaatgcaagtgcatggt

SEQ ID NO: 362066 - DNA, 20 bp, human
ggcctccccagactcacctg

SEQ ID NO: 362067 - DNA, 20 bp, human
gggaaagcgtcgagcggctt

SEQ ID NO: 362068 - DNA, 20 bp, human
gccgaccggccccttcccta

SEQ ID NO: 362069 - DNA, 20 bp, human
gcaggagggaccctagggaa

SEQ ID NO: 362070 - DNA, 20 bp, human
gcacctgccccaggtgagtc

SEQ ID NO: 362071 - DNA, 20 bp, human
gggcttcggtaggtggggcg

SEQ ID NO: 362072 - DNA, 20 bp, human
ggggcgcggacctcgggatc

SEQ ID NO: 362073 - DNA, 20 bp, human
gggccgcgggaatccccgac

SEQ ID NO: 362074 - DNA, 20 bp, human
ggagcccgagcgacaggaac

SEQ ID NO: 362075 - DNA, 20 bp, human
ggccgccggaaagcgtcgag

SEQ ID NO: 362076 - DNA, 20 bp, human
ggggcgcctgtcattggctg

SEQ ID NO: 362077 - DNA, 20 bp, human
gcgaccggagcggcagaggg

SEQ ID NO: 362078 - DNA, 20 bp, human
ggtggggctaaaccatcctg

SEQ ID NO: 362079 - DNA, 20 bp, human
gttccccctcagccaatgac

SEQ ID NO: 362080 - DNA, 20 bp, human
gtccgcgaccggagcggcag

SEQ ID NO: 362081 - DNA, 20 bp, human
gcgcctgtcattggctgagg

SEQ ID NO: 362082 - DNA, 20 bp, human
gtaaaccatcctggggttgc

SEQ ID NO: 362083 - DNA, 20 bp, human
gcccgcccaccgtccgcgac

SEQ ID NO: 362084 - DNA, 20 bp, human
ggcatccgtgcgtctgtgga

SEQ ID NO: 362085 - DNA, 20 bp, human
gtgacgcatccgtgcgtctg

SEQ ID NO: 362086 - DNA, 20 bp, human
gcggaagtcggcgtgaggtg

SEQ ID NO: 362087 - DNA, 20 bp, human
gcggaagctgtgtcagttgc

SEQ ID NO: 362088 - DNA, 20 bp, human
ggaaatagatatggcgaccg

SEQ ID NO: 362089 - DNA, 20 bp, human
gtgagaccagtggaccagag

SEQ ID NO: 362090 - DNA, 20 bp, human
ggccaagagcatgtcggggc

SEQ ID NO: 362091 - DNA, 20 bp, human
gacacagcttccgcccgggg

SEQ ID NO: 362092 - DNA, 20 bp, human
gaactgacacagcttccgcc

SEQ ID NO: 362093 - DNA, 20 bp, human
gagccacggaaacatgacag

SEQ ID NO: 362094 - DNA, 20 bp, human
gcaccgctgtcatgtttccg

SEQ ID NO: 362095 - DNA, 20 bp, human
gaaacatgacagcggtgcgg

SEQ ID NO: 362096 - DNA, 20 bp, human
gccgctggcgtcaggcgggt

SEQ ID NO: 362097 - DNA, 20 bp, human
gggctgctgcgatcacttcc

SEQ ID NO: 362098 - DNA, 20 bp, human
ggctgcgatcacttcccggt

SEQ ID NO: 362099 - DNA, 20 bp, human
gcccgggctcgcacttccgc

SEQ ID NO: 362100 - DNA, 20 bp, human
ggggccccacgctccgggtc

SEQ ID NO: 362101 - DNA, 20 bp, human
gcacttccgctggcgtcagg

SEQ ID NO: 362102 - DNA, 20 bp, human
gaaaggctggcggccgactc

SEQ ID NO: 362103 - DNA, 20 bp, human
gcggagctcggcgccccaac

SEQ ID NO: 362104 - DNA, 20 bp, human
gcccggagcgtggggcccaa

SEQ ID NO: 362105 - DNA, 20 bp, human
ggaggcgctgcgctctcatt

SEQ ID NO: 362106 - DNA, 20 bp, human
gttacggagtgacgcggaaa

SEQ ID NO: 362107 - DNA, 20 bp, human
gtccgtaaccggaagtgaat

SEQ ID NO: 362108 - DNA, 20 bp, human
gccctcccgctggagaagga

SEQ ID NO: 362109 - DNA, 20 bp, human
gacgcgcacgcgcaaatcta

SEQ ID NO: 362110 - DNA, 20 bp, human
gctcggggccaattcacttc

SEQ ID NO: 362111 - DNA, 20 bp, human
gcgcatgaggagacgtgtag

SEQ ID NO: 362112 - DNA, 20 bp, human
ggcgacgcttgacagagctt

SEQ ID NO: 362113 - DNA, 20 bp, human
gaatccgcaggcaagaatga

SEQ ID NO: 362114 - DNA, 20 bp, human
gggaggggcgcgcacttccg

SEQ ID NO: 362115 - DNA, 20 bp, human
ggatttgcgcgtgcgcgttt

SEQ ID NO: 362116 - DNA, 20 bp, human
ggggtccagccctcgtccag

SEQ ID NO: 362117 - DNA, 20 bp, human
ggctgcggggccgaaggttc

SEQ ID NO: 362118 - DNA, 20 bp, human
gtgtgagcgcgtcggggacg

SEQ ID NO: 362119 - DNA, 20 bp, human
gcaccgccgccccctggacg

SEQ ID NO: 362120 - DNA, 20 bp, human
ggtcctgtagccgaatgctg

SEQ ID NO: 362121 - DNA, 20 bp, human
gcccgcgcggccaccgaggc

SEQ ID NO: 362122 - DNA, 20 bp, human
gcggccgacaaacacaggag

SEQ ID NO: 362123 - DNA, 20 bp, human
gctaccccgcgcggccaccg

SEQ ID NO: 362124 - DNA, 20 bp, human
gagggctggacccaaggcgg

SEQ ID NO: 362125 - DNA, 20 bp, human
gggcccgcgctgcccgggta

SEQ ID NO: 362126 - DNA, 20 bp, human
gttatcggaggagcaaacag

SEQ ID NO: 362127 - DNA, 20 bp, human
gctgcccggacgctttgcct

SEQ ID NO: 362128 - DNA, 20 bp, human
gtggaagctgtacactgccc

SEQ ID NO: 362129 - DNA, 20 bp, human
ggcgtgagtcagacagtctc

SEQ ID NO: 362130 - DNA, 20 bp, human
gccacagcgtcctgtgtcca

SEQ ID NO: 362131 - DNA, 20 bp, human
ggtcctgtgtccaaggtgga

SEQ ID NO: 362132 - DNA, 20 bp, human
gcaaagcgtccgggcagcgt

SEQ ID NO: 362133 - DNA, 20 bp, human
gccgccctgggagatcagag

SEQ ID NO: 362134 - DNA, 20 bp, human
gctgcccaggcaaagcgtcc

SEQ ID NO: 362135 - DNA, 20 bp, human
gttccactgcacttaccgaa

SEQ ID NO: 362136 - DNA, 20 bp, human
gagcaggtgaggcaagtaag

SEQ ID NO: 362137 - DNA, 20 bp, human
gggagagggtgacttgtccc

SEQ ID NO: 362138 - DNA, 20 bp, human
gcacccaggaagtagacttc

SEQ ID NO: 362139 - DNA, 20 bp, human
gctgaaagggcaggtacaac

SEQ ID NO: 362140 - DNA, 20 bp, human
gcacccgaagtctacttcct

SEQ ID NO: 362141 - DNA, 20 bp, human
ggggctgtctgagtttatga

SEQ ID NO: 362142 - DNA, 20 bp, human
ggtctgccgggcaatgagca

SEQ ID NO: 362143 - DNA, 20 bp, human
gtgcccggcagacacaagac

SEQ ID NO: 362144 - DNA, 20 bp, human
ggtacaacaggtgacatgcc

SEQ ID NO: 362145 - DNA, 20 bp, human
gcgggtggaggcagtaggct

SEQ ID NO: 362146 - DNA, 20 bp, human
gaggcagaagctctcgtgat

SEQ ID NO: 362147 - DNA, 20 bp, human
gaagctctcgtgatgggatt

SEQ ID NO: 362148 - DNA, 20 bp, human
gaagcctcccacttggtctt

SEQ ID NO: 362149 - DNA, 20 bp, human
gcccagctcctcctataacc

SEQ ID NO: 362150 - DNA, 20 bp, human
ggggtcatattccgggttat

SEQ ID NO: 362151 - DNA, 20 bp, human
gtcgagaaagaaggcactgg

SEQ ID NO: 362152 - DNA, 20 bp, human
gacctcgagaaagaaggcac

SEQ ID NO: 362153 - DNA, 20 bp, human
gtccgggttataggaggagc

SEQ ID NO: 362154 - DNA, 20 bp, human
gggaaaaccaaagaccaagt

SEQ ID NO: 362155 - DNA, 20 bp, human
gagacagagctgaatcttac

SEQ ID NO: 362156 - DNA, 20 bp, human
gaagacaatgcacagcaaac

SEQ ID NO: 362157 - DNA, 20 bp, human
gtttgtgggacaggcagtca

SEQ ID NO: 362158 - DNA, 20 bp, human
ggcaggtggtggtgtggttg

SEQ ID NO: 362159 - DNA, 20 bp, human
gctgtcccacaaacaaatgg

SEQ ID NO: 362160 - DNA, 20 bp, human
gcaatccaccatttgtttgt

SEQ ID NO: 362161 - DNA, 20 bp, human
ggtctgtggttgtatgatcc

SEQ ID NO: 362162 - DNA, 20 bp, human
gatattctcaaagcgagcct

SEQ ID NO: 362163 - DNA, 20 bp, human
gaacctggtcaatatttgtc

SEQ ID NO: 362164 - DNA, 20 bp, human
gcgagagaaagagtgggagc

SEQ ID NO: 362165 - DNA, 20 bp, human
gtatttgtcaggtcaattct

SEQ ID NO: 362166 - DNA, 20 bp, human
gggcagcaatgatgatactt

SEQ ID NO: 362167 - DNA, 20 bp, human
ggggttgaatattcagtatt

SEQ ID NO: 362168 - DNA, 20 bp, human
gagccacagcccagtgggtg

SEQ ID NO: 362169 - DNA, 20 bp, human
gcagcggcatgatatcgtac

SEQ ID NO: 362170 - DNA, 20 bp, human
gtatttcccagttgctctct

SEQ ID NO: 362171 - DNA, 20 bp, human
gtcgtaccggccacacccac

SEQ ID NO: 362172 - DNA, 20 bp, human
gtgtctagtggacttcatta

SEQ ID NO: 362173 - DNA, 20 bp, human
ggttgataactgggcttctt

SEQ ID NO: 362174 - DNA, 20 bp, human
gcccagttgctctctgggta

SEQ ID NO: 362175 - DNA, 20 bp, human
gcgttgcaaaaggtgtctag

SEQ ID NO: 362176 - DNA, 20 bp, human
gagaactcctccccctgctt

SEQ ID NO: 362177 - DNA, 20 bp, human
gtagacctactcaaataacc

SEQ ID NO: 362178 - DNA, 20 bp, human
gtagagctagtcccataacc

SEQ ID NO: 362179 - DNA, 20 bp, human
gtgttagctggggtcttctc

SEQ ID NO: 362180 - DNA, 20 bp, human
gaagtgttctgttctcggac

SEQ ID NO: 362181 - DNA, 20 bp, human
gtctctgggtagtaaagtgc

SEQ ID NO: 362182 - DNA, 20 bp, human
gctgggtagtaaagtgctgg

SEQ ID NO: 362183 - DNA, 20 bp, human
gcccctgcttgggaaatgcc

SEQ ID NO: 362184 - DNA, 20 bp, human
gactcaaataacctggttat

SEQ ID NO: 362185 - DNA, 20 bp, human
gtgataatttctggtaatac

SEQ ID NO: 362186 - DNA, 20 bp, human
gcctaacagcccacttgacg

SEQ ID NO: 362187 - DNA, 20 bp, human
gccaggagaaccaagaccga

SEQ ID NO: 362188 - DNA, 20 bp, human
gaaagcgaagtccacgttgg

SEQ ID NO: 362189 - DNA, 20 bp, human
gccagagagcacctacctga

SEQ ID NO: 362190 - DNA, 20 bp, human
ggagagaatgttacctctcc

SEQ ID NO: 362191 - DNA, 20 bp, human
ggggcagtgggaggtggtcg

SEQ ID NO: 362192 - DNA, 20 bp, human
gtcagattctcctcgtcaag

SEQ ID NO: 362193 - DNA, 20 bp, human
gtacaagcagttagtcctga

SEQ ID NO: 362194 - DNA, 20 bp, human
gctgaaagcgaagtccacgt

SEQ ID NO: 362195 - DNA, 20 bp, human
gaggtggtcggggctccatc

SEQ ID NO: 362196 - DNA, 20 bp, human
gggaagtggggtgtcttctt

SEQ ID NO: 362197 - DNA, 20 bp, human
gagagtgggtggtactgaga

SEQ ID NO: 362198 - DNA, 20 bp, human
gccacctggggaaccccaag

SEQ ID NO: 362199 - DNA, 20 bp, human
gtacctggtcgggagagagt

SEQ ID NO: 362200 - DNA, 20 bp, human
gtgaagaagtgaaccctctt

SEQ ID NO: 362201 - DNA, 20 bp, human
gagtggggtgtcttcttggg

SEQ ID NO: 362202 - DNA, 20 bp, human
gaggggctggatcagacagg

SEQ ID NO: 362203 - DNA, 20 bp, human
gctccctcctacaacatgag

SEQ ID NO: 362204 - DNA, 20 bp, human
ggagggcccggggaaccact

SEQ ID NO: 362205 - DNA, 20 bp, human
ggagggggtgaaccaacttc

SEQ ID NO: 362206 - DNA, 20 bp, human
gaaaggaaggggctgtcccg

SEQ ID NO: 362207 - DNA, 20 bp, human
ggggagctgcgtctgcaggc

SEQ ID NO: 362208 - DNA, 20 bp, human
gtggtggtgtaaggcttggg

SEQ ID NO: 362209 - DNA, 20 bp, human
ggggcagcgagtgggcatcg

SEQ ID NO: 362210 - DNA, 20 bp, human
gtggcccagctggtggtgta

SEQ ID NO: 362211 - DNA, 20 bp, human
gggtgaaagcctcgggatca

SEQ ID NO: 362212 - DNA, 20 bp, human
ggccggaaacctgccaggaa

SEQ ID NO: 362213 - DNA, 20 bp, human
gcagctggtggtgtaaggct

SEQ ID NO: 362214 - DNA, 20 bp, human
gtggaatgccaacaataggg

SEQ ID NO: 362215 - DNA, 20 bp, human
gggcttggggggcagcgagt

SEQ ID NO: 362216 - DNA, 20 bp, human
gagagtgggtggtactgaga

SEQ ID NO: 362217 - DNA, 20 bp, human
gggaagtggggtgtcttctt

SEQ ID NO: 362218 - DNA, 20 bp, human
gccacctggggaaccccaag

SEQ ID NO: 362219 - DNA, 20 bp, human
gtacctggtcgggagagagt

SEQ ID NO: 362220 - DNA, 20 bp, human
gtgaagaagtgaaccctctt

SEQ ID NO: 362221 - DNA, 20 bp, human
gagtggggtgtcttcttggg

SEQ ID NO: 362222 - DNA, 20 bp, human
gaggggctggatcagacagg

SEQ ID NO: 362223 - DNA, 20 bp, human
gctccctcctacaacatgag

SEQ ID NO: 362224 - DNA, 20 bp, human
ggagggggtgaaccaacttc

SEQ ID NO: 362225 - DNA, 20 bp, human
ggagggcccggggaaccact

SEQ ID NO: 362226 - DNA, 20 bp, human
gcccccgagtcattaaccaa

SEQ ID NO: 362227 - DNA, 20 bp, human
gaccaatgggaggctttgtc

SEQ ID NO: 362228 - DNA, 20 bp, human
gtgggtggttaatggttaga

SEQ ID NO: 362229 - DNA, 20 bp, human
ggtgcccttaattagcacca

SEQ ID NO: 362230 - DNA, 20 bp, human
ggcaccttggtgctaattaa

SEQ ID NO: 362231 - DNA, 20 bp, human
gtcccattggttaatgactc

SEQ ID NO: 362232 - DNA, 20 bp, human
ggaggactaccaagcggtga

SEQ ID NO: 362233 - DNA, 20 bp, human
gggctggagttgcatcaatg

SEQ ID NO: 362234 - DNA, 20 bp, human
gcccaccagactaagaccac

SEQ ID NO: 362235 - DNA, 20 bp, human
gtaggtgtttagctccaatt

SEQ ID NO: 362236 - DNA, 20 bp, human
ggaactttgagtgattgctt

SEQ ID NO: 362237 - DNA, 20 bp, human
gtaaccccagcattaaccct

SEQ ID NO: 362238 - DNA, 20 bp, human
gcatcccagggttaatgctg

SEQ ID NO: 362239 - DNA, 20 bp, human
ggtacaaaaccaaggccaag

SEQ ID NO: 362240 - DNA, 20 bp, human
ggtcttcagcaggcagaata

SEQ ID NO: 362241 - DNA, 20 bp, human
gttgcagcatcagaagtcta

SEQ ID NO: 362242 - DNA, 20 bp, human
gtggcaagagtgtcttcagc

SEQ ID NO: 362243 - DNA, 20 bp, human
gggaattggcagttttttaa

SEQ ID NO: 362244 - DNA, 20 bp, human
gctgggtgatcctttctaat

SEQ ID NO: 362245 - DNA, 20 bp, human
gttgttttacatgaagggtc

SEQ ID NO: 362246 - DNA, 20 bp, human
gtcagaggaaaggattgagc

SEQ ID NO: 362247 - DNA, 20 bp, human
gttagacatgtagagatcag

SEQ ID NO: 362248 - DNA, 20 bp, human
gtggcatgagatcagctgga

SEQ ID NO: 362249 - DNA, 20 bp, human
gtatcatttgcatgtctagc

SEQ ID NO: 362250 - DNA, 20 bp, human
ggacttgagcaacattcagg

SEQ ID NO: 362251 - DNA, 20 bp, human
gcacctggttagttgagcct

SEQ ID NO: 362252 - DNA, 20 bp, human
gaactggcctgctagagtgg

SEQ ID NO: 362253 - DNA, 20 bp, human
gctcctaggctcaactaacc

SEQ ID NO: 362254 - DNA, 20 bp, human
gaatgaagtcatgggtgtcg

SEQ ID NO: 362255 - DNA, 20 bp, human
gtgggagatggttcttggga

SEQ ID NO: 362256 - DNA, 20 bp, human
gtccgggcagcgccctcctc

SEQ ID NO: 362257 - DNA, 20 bp, human
gagaagccgcgcccctgagg

SEQ ID NO: 362258 - DNA, 20 bp, human
gctcacttctgcttgcactt

SEQ ID NO: 362259 - DNA, 20 bp, human
ggaaagaagccgcgcccctg

SEQ ID NO: 362260 - DNA, 20 bp, human
gcagaagtgagcgtggcttc

SEQ ID NO: 362261 - DNA, 20 bp, human
gcccttcccggtgactgcgt

SEQ ID NO: 362262 - DNA, 20 bp, human
gttgccagagattcggggaa

SEQ ID NO: 362263 - DNA, 20 bp, human
gcggactcctacgcagtcac

SEQ ID NO: 362264 - DNA, 20 bp, human
gccctgaggagggcgctgcc

SEQ ID NO: 362265 - DNA, 20 bp, human
ggtaggagtccgagctcccg

SEQ ID NO: 362266 - DNA, 20 bp, human
ggacagaaagagacagttaa

SEQ ID NO: 362267 - DNA, 20 bp, human
ggtgagtaactaaacaactc

SEQ ID NO: 362268 - DNA, 20 bp, human
gtctgtacacatgagagacc

SEQ ID NO: 362269 - DNA, 20 bp, human
ggcttgtgaaactgaatcaa

SEQ ID NO: 362270 - DNA, 20 bp, human
gggtggagctaagaacaggg

SEQ ID NO: 362271 - DNA, 20 bp, human
gctgttggcagactagagaa

SEQ ID NO: 362272 - DNA, 20 bp, human
gcatgccaaatattctctgt

SEQ ID NO: 362273 - DNA, 20 bp, human
gttacaatttgtcagaatcc

SEQ ID NO: 362274 - DNA, 20 bp, human
gtatttggcatggttttccc

SEQ ID NO: 362275 - DNA, 20 bp, human
gccaggagctagaagctgct

SEQ ID NO: 362276 - DNA, 20 bp, human
gtgaagagctgaatcactaa

SEQ ID NO: 362277 - DNA, 20 bp, human
ggaaaagcactggtcatctt

SEQ ID NO: 362278 - DNA, 20 bp, human
gtggtcatcttgggagtctc

SEQ ID NO: 362279 - DNA, 20 bp, human
ggctgtactttccaaccagc

SEQ ID NO: 362280 - DNA, 20 bp, human
gttgatggacttcattttca

SEQ ID NO: 362281 - DNA, 20 bp, human
ggcacttctctgaaaagcac

SEQ ID NO: 362282 - DNA, 20 bp, human
gggcacaaatgaaaagggag

SEQ ID NO: 362283 - DNA, 20 bp, human
gactaagggcacaaatgaaa

SEQ ID NO: 362284 - DNA, 20 bp, human
gagggaggggcaaaatatga

SEQ ID NO: 362285 - DNA, 20 bp, human
ggattcagctcttcacctgc

SEQ ID NO: 362286 - DNA, 20 bp, human
gaacaccaatatttatatac

SEQ ID NO: 362287 - DNA, 20 bp, human
gcatccctgtatataaatat

SEQ ID NO: 362288 - DNA, 20 bp, human
gtcagtatgctattaagaac

SEQ ID NO: 362289 - DNA, 20 bp, human
gattaagaactggaaaacta

SEQ ID NO: 362290 - DNA, 20 bp, human
gcgtttgtcccccagaacca

SEQ ID NO: 362291 - DNA, 20 bp, human
gactgagtggtttaaatagc

SEQ ID NO: 362292 - DNA, 20 bp, human
ggtagtgtgaattcgtttcc

SEQ ID NO: 362293 - DNA, 20 bp, human
gatgcctctctctcagcttg

SEQ ID NO: 362294 - DNA, 20 bp, human
gagaaagagaaaatggtgat

SEQ ID NO: 362295 - DNA, 20 bp, human
ggcaggagtttattctccca

SEQ ID NO: 362296 - DNA, 20 bp, human
gtgagtcagcatctctcgag

SEQ ID NO: 362297 - DNA, 20 bp, human
gcacctttggttcccagcgt

SEQ ID NO: 362298 - DNA, 20 bp, human
gacaatgtacagccaacgct

SEQ ID NO: 362299 - DNA, 20 bp, human
ggcgcatgctcgcttgtgtg

SEQ ID NO: 362300 - DNA, 20 bp, human
gtcatcaggctatacacctt

SEQ ID NO: 362301 - DNA, 20 bp, human
gaccactgctgaagcagatg

SEQ ID NO: 362302 - DNA, 20 bp, human
gtggcattagacacagtacc

SEQ ID NO: 362303 - DNA, 20 bp, human
gtgtggagaactataaatta

SEQ ID NO: 362304 - DNA, 20 bp, human
gtcagaatttttatcaccgc

SEQ ID NO: 362305 - DNA, 20 bp, human
gagattttaaggtgcacgca

SEQ ID NO: 362306 - DNA, 20 bp, human
ggggggaaatcttgaaactg

SEQ ID NO: 362307 - DNA, 20 bp, human
ggagacccaagcgatgctta

SEQ ID NO: 362308 - DNA, 20 bp, human
gcatgccctaagcatcgctt

SEQ ID NO: 362309 - DNA, 20 bp, human
gcttgagcacaagtatagtg

SEQ ID NO: 362310 - DNA, 20 bp, human
gacacagatcaaaagacaga

SEQ ID NO: 362311 - DNA, 20 bp, human
ggcgatgcttagggcatggg

SEQ ID NO: 362312 - DNA, 20 bp, human
ggcatcgcttgggtctccct

SEQ ID NO: 362313 - DNA, 20 bp, human
ggtgattcaacattttactc

SEQ ID NO: 362314 - DNA, 20 bp, human
gttcttgtgtcaggatatta

SEQ ID NO: 362315 - DNA, 20 bp, human
gtagaaatacttgtttgtaa

SEQ ID NO: 362316 - DNA, 20 bp, human
gaggtcagcaacagtaggac

SEQ ID NO: 362317 - DNA, 20 bp, human
ggggtgaggtcagcaacagt

SEQ ID NO: 362318 - DNA, 20 bp, human
ggaacaacatgaggcaggtc

SEQ ID NO: 362319 - DNA, 20 bp, human
gacaggctgcattctgtgta

SEQ ID NO: 362320 - DNA, 20 bp, human
gtcatggaacaacatgaggc

SEQ ID NO: 362321 - DNA, 20 bp, human
gtccatgaggaagaacagac

SEQ ID NO: 362322 - DNA, 20 bp, human
gaatatatagggacaggagt

SEQ ID NO: 362323 - DNA, 20 bp, human
gaataacaatgacaatatat

SEQ ID NO: 362324 - DNA, 20 bp, human
gagggcatttggctaaacaa

SEQ ID NO: 362325 - DNA, 20 bp, human
ggtaggaattgaagccagat

SEQ ID NO: 362326 - DNA, 20 bp, human
gcacttcttcactatctctt

SEQ ID NO: 362327 - DNA, 20 bp, human
gaatgcaagtcagcagtcac

SEQ ID NO: 362328 - DNA, 20 bp, human
ggctcatgtgaaatacatgt

SEQ ID NO: 362329 - DNA, 20 bp, human
ggattaaaaaggaggtacaa

SEQ ID NO: 362330 - DNA, 20 bp, human
gcttgctgcctctccctctg

SEQ ID NO: 362331 - DNA, 20 bp, human
gagctggagtagaatacaaa

SEQ ID NO: 362332 - DNA, 20 bp, human
gatactaaccacagagggag

SEQ ID NO: 362333 - DNA, 20 bp, human
gggagtagaatacaaaggga

SEQ ID NO: 362334 - DNA, 20 bp, human
gaaaatttatgacaaaggac

SEQ ID NO: 362335 - DNA, 20 bp, human
gtccctatagattaaaaagg

SEQ ID NO: 362336 - DNA, 20 bp, human
gcacttcttcactatctctt

SEQ ID NO: 362337 - DNA, 20 bp, human
gatactaaccacagagggaa

SEQ ID NO: 362338 - DNA, 20 bp, human
gaatgcaagtcagcagtcac

SEQ ID NO: 362339 - DNA, 20 bp, human
ggctcatgtgaaatacatgt

SEQ ID NO: 362340 - DNA, 20 bp, human
ggattaaaaaggaggtacaa

SEQ ID NO: 362341 - DNA, 20 bp, human
gagctggagtagaatacaaa

SEQ ID NO: 362342 - DNA, 20 bp, human
gaaaatttatgacaaaggac

SEQ ID NO: 362343 - DNA, 20 bp, human
gggagtagaatacaaaggga

SEQ ID NO: 362344 - DNA, 20 bp, human
gtccctatagattaaaaagg

SEQ ID NO: 362345 - DNA, 20 bp, human
gcttgctgcctttccctctg

SEQ ID NO: 362346 - DNA, 20 bp, human
gtcaccttccggtcctgcgt

SEQ ID NO: 362347 - DNA, 20 bp, human
gaacatgttcgggcaggaag

SEQ ID NO: 362348 - DNA, 20 bp, human
gaaaaggcctccaacatgtt

SEQ ID NO: 362349 - DNA, 20 bp, human
gtaggagaggagtgccgccg

SEQ ID NO: 362350 - DNA, 20 bp, human
gcggcccacgcaggaccgga

SEQ ID NO: 362351 - DNA, 20 bp, human
gtgtctgcacagcttccaaa

SEQ ID NO: 362352 - DNA, 20 bp, human
gcggtcctgcgtgggccgag

SEQ ID NO: 362353 - DNA, 20 bp, human
gcaatcctctcggcccacgc

SEQ ID NO: 362354 - DNA, 20 bp, human
gctctcctactcaagcctct

SEQ ID NO: 362355 - DNA, 20 bp, human
gtcctgcccgaacatgttgg

SEQ ID NO: 362356 - DNA, 20 bp, human
gcggccacgccccattctcg

SEQ ID NO: 362357 - DNA, 20 bp, human
gccgctctggagtacgtgtc

SEQ ID NO: 362358 - DNA, 20 bp, human
gcggggccgggaacgcgcgt

SEQ ID NO: 362359 - DNA, 20 bp, human
gacgctggagccccgagaat

SEQ ID NO: 362360 - DNA, 20 bp, human
ggggaacgcgcgtgggtcga

SEQ ID NO: 362361 - DNA, 20 bp, human
gctggtggggccctgtactg

SEQ ID NO: 362362 - DNA, 20 bp, human
ggatacacggccatccactg

SEQ ID NO: 362363 - DNA, 20 bp, human
gagcgagcgagcagaacggc

SEQ ID NO: 362364 - DNA, 20 bp, human
gccaagccagcgtgtccgag

SEQ ID NO: 362365 - DNA, 20 bp, human
ggggagccgctcggacacgc

SEQ ID NO: 362366 - DNA, 20 bp, human
gtagggagtgtctgagtcag

SEQ ID NO: 362367 - DNA, 20 bp, human
gaagtgctatagaatagagt

SEQ ID NO: 362368 - DNA, 20 bp, human
gccagttgtgccttaatgta

SEQ ID NO: 362369 - DNA, 20 bp, human
gaattattccaggtggggct

SEQ ID NO: 362370 - DNA, 20 bp, human
gaatatgaccgagccccacc

SEQ ID NO: 362371 - DNA, 20 bp, human
gaaataccaaaatcagagca

SEQ ID NO: 362372 - DNA, 20 bp, human
gaatatgaattattccaggt

SEQ ID NO: 362373 - DNA, 20 bp, human
gtaccaaaatcagagcaggg

SEQ ID NO: 362374 - DNA, 20 bp, human
gataaattcaactgtcatag

SEQ ID NO: 362375 - DNA, 20 bp, human
gtttagatatccttacatta

SEQ ID NO: 362376 - DNA, 20 bp, human
ggaagagtatgttttgaccc

SEQ ID NO: 362377 - DNA, 20 bp, human
ggggaaatttacacaggata

SEQ ID NO: 362378 - DNA, 20 bp, human
gcaacagtatctgtcagcct

SEQ ID NO: 362379 - DNA, 20 bp, human
gatgctagggaaatttacac

SEQ ID NO: 362380 - DNA, 20 bp, human
gtgtatgtgaatcagatttc

SEQ ID NO: 362381 - DNA, 20 bp, human
gtgctgtgctctgagtcata

SEQ ID NO: 362382 - DNA, 20 bp, human
gaaatagtatctgactaagg

SEQ ID NO: 362383 - DNA, 20 bp, human
gtcaaaatagtatctgacta

SEQ ID NO: 362384 - DNA, 20 bp, human
ggtggcaagttgcaataaaa

SEQ ID NO: 362385 - DNA, 20 bp, human
gcagtgacttggtgagttta

SEQ ID NO: 362386 - DNA, 20 bp, human
gccagtgcctggtccttgga

SEQ ID NO: 362387 - DNA, 20 bp, human
ggtgaatcaacggtgaaaaa

SEQ ID NO: 362388 - DNA, 20 bp, human
gacacaggcccaaagaatca

SEQ ID NO: 362389 - DNA, 20 bp, human
gagggccagtgcctggtcct

SEQ ID NO: 362390 - DNA, 20 bp, human
gggagtcaaacgtgaatcaa

SEQ ID NO: 362391 - DNA, 20 bp, human
gagtacacaggtaacatcta

SEQ ID NO: 362392 - DNA, 20 bp, human
gcagaaccgttcgattgctc

SEQ ID NO: 362393 - DNA, 20 bp, human
gggtggacgtctaactacag

SEQ ID NO: 362394 - DNA, 20 bp, human
gacaagccagagcaatcgaa

SEQ ID NO: 362395 - DNA, 20 bp, human
gtgtgcaatccctgattctt

SEQ ID NO: 362396 - DNA, 20 bp, human
gctgggagcagggtcaggtc

SEQ ID NO: 362397 - DNA, 20 bp, human
gtaaacgcagaaagcgtggg

SEQ ID NO: 362398 - DNA, 20 bp, human
gcgaccctgcggtataaaag

SEQ ID NO: 362399 - DNA, 20 bp, human
gggtggccgaggtcagagct

SEQ ID NO: 362400 - DNA, 20 bp, human
gtgggaggcgcccgaccctg

SEQ ID NO: 362401 - DNA, 20 bp, human
ggagcctggcgggaccagcg

SEQ ID NO: 362402 - DNA, 20 bp, human
gcgcccccgctggtcccgcc

SEQ ID NO: 362403 - DNA, 20 bp, human
gtgacctcggccaccacgcg

SEQ ID NO: 362404 - DNA, 20 bp, human
gcgcctaaacgcagaaagcg

SEQ ID NO: 362405 - DNA, 20 bp, human
gtctgcgtttaggcggagcc

SEQ ID NO: 362406 - DNA, 20 bp, human
ggggcagagagctggtcagg

SEQ ID NO: 362407 - DNA, 20 bp, human
gaggttccagaggacagggt

SEQ ID NO: 362408 - DNA, 20 bp, human
gagccctgaagtggtgggac

SEQ ID NO: 362409 - DNA, 20 bp, human
gtaaagttcaatcaggccca

SEQ ID NO: 362410 - DNA, 20 bp, human
gcataccctcaaacttggtt

SEQ ID NO: 362411 - DNA, 20 bp, human
ggaacctctgcgagatttag

SEQ ID NO: 362412 - DNA, 20 bp, human
ggaggaaagaaccagttttc

SEQ ID NO: 362413 - DNA, 20 bp, human
gaatctcgcagaggttccag

SEQ ID NO: 362414 - DNA, 20 bp, human
gctaaccaaggaaacaaact

SEQ ID NO: 362415 - DNA, 20 bp, human
ggaaaactatgagagagggt

SEQ ID NO: 362416 - DNA, 20 bp, human
gtatgtggtgacctcaagag

SEQ ID NO: 362417 - DNA, 20 bp, human
gctgctctccaggactgatg

SEQ ID NO: 362418 - DNA, 20 bp, human
gttacagaataaggggattg

SEQ ID NO: 362419 - DNA, 20 bp, human
ggagccagccacatcagtcc

SEQ ID NO: 362420 - DNA, 20 bp, human
gaagctggttgcctggtgtt

SEQ ID NO: 362421 - DNA, 20 bp, human
gaagtgtcagctctaagaac

SEQ ID NO: 362422 - DNA, 20 bp, human
gtggggaccaggctgcattg

SEQ ID NO: 362423 - DNA, 20 bp, human
ggggtttgtgctgaccaagc

SEQ ID NO: 362424 - DNA, 20 bp, human
ggaagagcgccttgtttatg

SEQ ID NO: 362425 - DNA, 20 bp, human
ggttgcctggtgtttggatt

SEQ ID NO: 362426 - DNA, 20 bp, human
gccagagccagtgagtgggt

SEQ ID NO: 362427 - DNA, 20 bp, human
gccagagagggaggtgtcga

SEQ ID NO: 362428 - DNA, 20 bp, human
gagtccgtctgaacagccag

SEQ ID NO: 362429 - DNA, 20 bp, human
gcagcaagtcccagagaggg

SEQ ID NO: 362430 - DNA, 20 bp, human
gtacgtgtgtaagagcattc

SEQ ID NO: 362431 - DNA, 20 bp, human
gtccagccccacccactcac

SEQ ID NO: 362432 - DNA, 20 bp, human
ggcagagggcagaaaggtca

SEQ ID NO: 362433 - DNA, 20 bp, human
gaaggtcaagggaggttctc

SEQ ID NO: 362434 - DNA, 20 bp, human
ggacccgctggctgttcaga

SEQ ID NO: 362435 - DNA, 20 bp, human
gatccgggagagacagacac

SEQ ID NO: 362436 - DNA, 20 bp, human
ggcggcatccgagaagtcgc

SEQ ID NO: 362437 - DNA, 20 bp, human
ggcccgcggccacacaaagg

SEQ ID NO: 362438 - DNA, 20 bp, human
ggcggcccgcggccacacaa

SEQ ID NO: 362439 - DNA, 20 bp, human
gacgacatgccctgcgtctc

SEQ ID NO: 362440 - DNA, 20 bp, human
gcgtctccccggcgcgttcc

SEQ ID NO: 362441 - DNA, 20 bp, human
gcgccaggggtccgtgtcgt

SEQ ID NO: 362442 - DNA, 20 bp, human
ggagaagtcgcaggcggaga

SEQ ID NO: 362443 - DNA, 20 bp, human
gaggactgagcgctgtctca

SEQ ID NO: 362444 - DNA, 20 bp, human
ggggagacgcgcagaccccg

SEQ ID NO: 362445 - DNA, 20 bp, human
ggccccctggaagagacaga

SEQ ID NO: 362446 - DNA, 20 bp, human
gtaagaaggcttgacgggtg

SEQ ID NO: 362447 - DNA, 20 bp, human
ggggcagcaaagcccagatc

SEQ ID NO: 362448 - DNA, 20 bp, human
gaaggcttgacgggtgtggc

SEQ ID NO: 362449 - DNA, 20 bp, human
gaagcctaagaaggcttgac

SEQ ID NO: 362450 - DNA, 20 bp, human
gtggatgaggggttccttgc

SEQ ID NO: 362451 - DNA, 20 bp, human
gaccactcggtccaaattcc

SEQ ID NO: 362452 - DNA, 20 bp, human
gcgagtggtagagacatcgc

SEQ ID NO: 362453 - DNA, 20 bp, human
gcctcaatgtgacaaagggc

SEQ ID NO: 362454 - DNA, 20 bp, human
ggtggctggctctcccccca

SEQ ID NO: 362455 - DNA, 20 bp, human
ggggggaagcattaggtacc

SEQ ID NO: 362456 - DNA, 20 bp, human
gccaccatccattacgccta

SEQ ID NO: 362457 - DNA, 20 bp, human
ggcgccttaggcgtaatgga

SEQ ID NO: 362458 - DNA, 20 bp, human
gtgctggacgctggattaga

SEQ ID NO: 362459 - DNA, 20 bp, human
gaaggaaaatctaaaggaag

SEQ ID NO: 362460 - DNA, 20 bp, human
gaagcgacctgcactcaatt

SEQ ID NO: 362461 - DNA, 20 bp, human
gatggatggtggtgcagcag

SEQ ID NO: 362462 - DNA, 20 bp, human
ggtgtgcgccttaggcgtaa

SEQ ID NO: 362463 - DNA, 20 bp, human
gcagaatccaaattgagtgc

SEQ ID NO: 362464 - DNA, 20 bp, human
ggtgcaggtcgctttaagaa

SEQ ID NO: 362465 - DNA, 20 bp, human
ggtgcaaatgtgtgcgcctt

SEQ ID NO: 362466 - DNA, 20 bp, human
ggggggggacccaaatatag

SEQ ID NO: 362467 - DNA, 20 bp, human
gtggatctggctagccaaga

SEQ ID NO: 362468 - DNA, 20 bp, human
gaagcaatctgaacaggggt

SEQ ID NO: 362469 - DNA, 20 bp, human
gttagatgccctggtgggaa

SEQ ID NO: 362470 - DNA, 20 bp, human
ggcctcccgctcctgagggg

SEQ ID NO: 362471 - DNA, 20 bp, human
gaggcagccaacctgatcct

SEQ ID NO: 362472 - DNA, 20 bp, human
gtggctgagagtaaaggtcc

SEQ ID NO: 362473 - DNA, 20 bp, human
gtctgagcctggctgaacca

SEQ ID NO: 362474 - DNA, 20 bp, human
gagaagcccctttcccacca

SEQ ID NO: 362475 - DNA, 20 bp, human
ggttctgcgtggctgcctca

SEQ ID NO: 362476 - DNA, 20 bp, human
gaccgcttggtcttctttgt

SEQ ID NO: 362477 - DNA, 20 bp, human
gccctggtaggtggggtgaa

SEQ ID NO: 362478 - DNA, 20 bp, human
gagtcccccagggtcaggga

SEQ ID NO: 362479 - DNA, 20 bp, human
gttagcccaaatcccctggt

SEQ ID NO: 362480 - DNA, 20 bp, human
gcccacctaccaggggattt

SEQ ID NO: 362481 - DNA, 20 bp, human
gaatcaggatgggacggaat

SEQ ID NO: 362482 - DNA, 20 bp, human
gagttcctgtaaatcaggat

SEQ ID NO: 362483 - DNA, 20 bp, human
gggggtgaacggggaagctt

SEQ ID NO: 362484 - DNA, 20 bp, human
gcctgtaaatcaggatggga

SEQ ID NO: 362485 - DNA, 20 bp, human
gggggggcagtcttagctat

SEQ ID NO: 362486 - DNA, 20 bp, human
gaaggacacgctgatccccg

SEQ ID NO: 362487 - DNA, 20 bp, human
gtgatccccgtggggactcc

SEQ ID NO: 362488 - DNA, 20 bp, human
gagggaggcagtaggaccca

SEQ ID NO: 362489 - DNA, 20 bp, human
ggaggaagctcgcactctga

SEQ ID NO: 362490 - DNA, 20 bp, human
gggggccggggaggttttga

SEQ ID NO: 362491 - DNA, 20 bp, human
gaggacgtgcgattcggagt

SEQ ID NO: 362492 - DNA, 20 bp, human
gggcgccgggagtccccacg

SEQ ID NO: 362493 - DNA, 20 bp, human
ggtcctactgcctccctcgg

SEQ ID NO: 362494 - DNA, 20 bp, human
ggcagagcccctgcggggaa

SEQ ID NO: 362495 - DNA, 20 bp, human
ggccggggaggttttgaggg

SEQ ID NO: 362496 - DNA, 20 bp, human
gagagggacccccacgggag

SEQ ID NO: 362497 - DNA, 20 bp, human
gccctgattggcgcaggtga

SEQ ID NO: 362498 - DNA, 20 bp, human
gcggacacacaggtcgggga

SEQ ID NO: 362499 - DNA, 20 bp, human
gggcgcctcacccattgagg

SEQ ID NO: 362500 - DNA, 20 bp, human
gcccgccccctcaatgggtg

SEQ ID NO: 362501 - DNA, 20 bp, human
gcccagccggagtcgtgcag

SEQ ID NO: 362502 - DNA, 20 bp, human
gccacccaggcgtctctgct

SEQ ID NO: 362503 - DNA, 20 bp, human
gctgcccggaccggaggcag

SEQ ID NO: 362504 - DNA, 20 bp, human
gcgggggatcctgaggcgat

SEQ ID NO: 362505 - DNA, 20 bp, human
ggacgccggaaggacccaag

SEQ ID NO: 362506 - DNA, 20 bp, human
gtgcattggtaatctgatgt

SEQ ID NO: 362507 - DNA, 20 bp, human
gtggtcaagataaatggagt

SEQ ID NO: 362508 - DNA, 20 bp, human
gagaggaattaatcaagcaa

SEQ ID NO: 362509 - DNA, 20 bp, human
gtattaagaactaacacaat

SEQ ID NO: 362510 - DNA, 20 bp, human
gaagcaatggtcaagataaa

SEQ ID NO: 362511 - DNA, 20 bp, human
gataaacacctgagcgatca

SEQ ID NO: 362512 - DNA, 20 bp, human
ggagttggccttgatcgctc

SEQ ID NO: 362513 - DNA, 20 bp, human
ggtgatttgtctctgtattc

SEQ ID NO: 362514 - DNA, 20 bp, human
gatttgaaaggatgcgctac

SEQ ID NO: 362515 - DNA, 20 bp, human
gggagtttcctgtggatata

SEQ ID NO: 362516 - DNA, 20 bp, human
gtgagtggggaatccggagt

SEQ ID NO: 362517 - DNA, 20 bp, human
ggggcagctgcgcgagtgag

SEQ ID NO: 362518 - DNA, 20 bp, human
gcatgcagggccaatccctg

SEQ ID NO: 362519 - DNA, 20 bp, human
ggcggggcagccacgagagt

SEQ ID NO: 362520 - DNA, 20 bp, human
gattggccctgcatggtgat

SEQ ID NO: 362521 - DNA, 20 bp, human
gtgtagggggcggattctga

SEQ ID NO: 362522 - DNA, 20 bp, human
gtagcgaccgcccactctcg

SEQ ID NO: 362523 - DNA, 20 bp, human
gggggcggattctgaaggag

SEQ ID NO: 362524 - DNA, 20 bp, human
ggggcggagcttgtaggggg

SEQ ID NO: 362525 - DNA, 20 bp, human
gctaagggtagttaggagtc

SEQ ID NO: 362526 - DNA, 20 bp, human
gaaggacgggctgaaagagg

SEQ ID NO: 362527 - DNA, 20 bp, human
ggtcccgggaggcgcgataa

SEQ ID NO: 362528 - DNA, 20 bp, human
gggaggcgcgataaaggccg

SEQ ID NO: 362529 - DNA, 20 bp, human
ggggcgcagtgggcgcctgg

SEQ ID NO: 362530 - DNA, 20 bp, human
gacgaagcggctggtgacaa

SEQ ID NO: 362531 - DNA, 20 bp, human
ggccgcacgtcactcctgca

SEQ ID NO: 362532 - DNA, 20 bp, human
gaagcggctggtgacaaagg

SEQ ID NO: 362533 - DNA, 20 bp, human
gggcgccctgaccgagcgag

SEQ ID NO: 362534 - DNA, 20 bp, human
gcgtaccgctcgctcggtca

SEQ ID NO: 362535 - DNA, 20 bp, human
ggcagtggtggtcctcgggc

SEQ ID NO: 362536 - DNA, 20 bp, human
ggggccgcgcggtaacgtat

SEQ ID NO: 362537 - DNA, 20 bp, human
gtaaagaagtgcaactggca

SEQ ID NO: 362538 - DNA, 20 bp, human
gggcccggggcgctagggag

SEQ ID NO: 362539 - DNA, 20 bp, human
gtaaatggcccggggcgcta

SEQ ID NO: 362540 - DNA, 20 bp, human
gcgcccgtgccccgagacgc

SEQ ID NO: 362541 - DNA, 20 bp, human
gcgcgcccccggggttccga

SEQ ID NO: 362542 - DNA, 20 bp, human
ggctccctgcggttccttta

SEQ ID NO: 362543 - DNA, 20 bp, human
ggcagcgactccggggtgga

SEQ ID NO: 362544 - DNA, 20 bp, human
gtgcacagcgacttggggag

SEQ ID NO: 362545 - DNA, 20 bp, human
gatccggcgtctcggggcac

SEQ ID NO: 362546 - DNA, 20 bp, human
gatgcccccagggtgagaga

SEQ ID NO: 362547 - DNA, 20 bp, human
gcggcggcggcctgagcaga

SEQ ID NO: 362548 - DNA, 20 bp, human
ggggagcccgagagcgcgtg

SEQ ID NO: 362549 - DNA, 20 bp, human
ggcgccccgtgtgcagcctg

SEQ ID NO: 362550 - DNA, 20 bp, human
ggctcctcaggctgcacacg

SEQ ID NO: 362551 - DNA, 20 bp, human
ggtgtccccgggcaccggga

SEQ ID NO: 362552 - DNA, 20 bp, human
gccagaccccacgcgctctc

SEQ ID NO: 362553 - DNA, 20 bp, human
gggttctgcaggatgccccc

SEQ ID NO: 362554 - DNA, 20 bp, human
gagccaagcccccagggcta

SEQ ID NO: 362555 - DNA, 20 bp, human
gcctctcctcggaaatccac

SEQ ID NO: 362556 - DNA, 20 bp, human
gcccgctagagccgagacta

SEQ ID NO: 362557 - DNA, 20 bp, human
gcgggcgcttggctctagga

SEQ ID NO: 362558 - DNA, 20 bp, human
gcggcgcccagctcgggcga

SEQ ID NO: 362559 - DNA, 20 bp, human
gctaggacggcgcccagctc

SEQ ID NO: 362560 - DNA, 20 bp, human
gtgcgcagggagcccatctg

SEQ ID NO: 362561 - DNA, 20 bp, human
gtagagccgagactaggggg

SEQ ID NO: 362562 - DNA, 20 bp, human
gacacctgccttccccagat

SEQ ID NO: 362563 - DNA, 20 bp, human
gctagggggcggtgaggagt

SEQ ID NO: 362564 - DNA, 20 bp, human
gctagcgggcgcttggctct

SEQ ID NO: 362565 - DNA, 20 bp, human
gctcctggccgcacaaccaa

SEQ ID NO: 362566 - DNA, 20 bp, human
ggggctgatccccaccgatg

SEQ ID NO: 362567 - DNA, 20 bp, human
gcctctggcaggctaccctc

SEQ ID NO: 362568 - DNA, 20 bp, human
gtctgcctgggcggggaaga

SEQ ID NO: 362569 - DNA, 20 bp, human
gggcgcacttggggtccgga

SEQ ID NO: 362570 - DNA, 20 bp, human
gcatgcgtagcagccggcag

SEQ ID NO: 362571 - DNA, 20 bp, human
ggcggctcccggtttgtgcc

SEQ ID NO: 362572 - DNA, 20 bp, human
ggccgcgcgcggcgcacttg

SEQ ID NO: 362573 - DNA, 20 bp, human
gcggtggggatcagcccaga

SEQ ID NO: 362574 - DNA, 20 bp, human
gtctccgcccggcacaaacc

SEQ ID NO: 362575 - DNA, 20 bp, human
gaaaagccccgccctctggc

SEQ ID NO: 362576 - DNA, 20 bp, human
ggacagccctaagagtcatt

SEQ ID NO: 362577 - DNA, 20 bp, human
ggatgaaaagggacttcact

SEQ ID NO: 362578 - DNA, 20 bp, human
gggcggagcccgtgactcca

SEQ ID NO: 362579 - DNA, 20 bp, human
ggggctccgccaatcagcac

SEQ ID NO: 362580 - DNA, 20 bp, human
gggggagcgcccggaattct

SEQ ID NO: 362581 - DNA, 20 bp, human
gctcccccggggaccgcagc

SEQ ID NO: 362582 - DNA, 20 bp, human
gcggcggtccagccaatcag

SEQ ID NO: 362583 - DNA, 20 bp, human
ggggagttgtagtccgcctc

SEQ ID NO: 362584 - DNA, 20 bp, human
gggcgctccccggtgctgat

SEQ ID NO: 362585 - DNA, 20 bp, human
gactccgccccctggagtca

SEQ ID NO: 362586 - DNA, 20 bp, human
gggcggttagctaagtagta

SEQ ID NO: 362587 - DNA, 20 bp, human
gcaagttaagtttatctccg

SEQ ID NO: 362588 - DNA, 20 bp, human
gcgaggaagccttgaatctc

SEQ ID NO: 362589 - DNA, 20 bp, human
ggtcgcgccggccaatcgca

SEQ ID NO: 362590 - DNA, 20 bp, human
gcggccaatcgcaggggccg

SEQ ID NO: 362591 - DNA, 20 bp, human
gggccggcgcgactcccagt

SEQ ID NO: 362592 - DNA, 20 bp, human
gtcgggctctcgttgctcat

SEQ ID NO: 362593 - DNA, 20 bp, human
gtccgaggctcggaactgaa

SEQ ID NO: 362594 - DNA, 20 bp, human
gcccgccaatcggacagctc

SEQ ID NO: 362595 - DNA, 20 bp, human
ggctcggaactgaagggagg

SEQ ID NO: 362596 - DNA, 20 bp, human
gggagcctgggcctcggcta

SEQ ID NO: 362597 - DNA, 20 bp, human
ggggaggcagtcttggagag

SEQ ID NO: 362598 - DNA, 20 bp, human
gcggggcggggcgtccaacc

SEQ ID NO: 362599 - DNA, 20 bp, human
gccacccctagccgaggccc

SEQ ID NO: 362600 - DNA, 20 bp, human
gcaagactgcctcccgcctg

SEQ ID NO: 362601 - DNA, 20 bp, human
gaaagggttgcggtgaggaa

SEQ ID NO: 362602 - DNA, 20 bp, human
ggggactctggcgctccgga

SEQ ID NO: 362603 - DNA, 20 bp, human
gccgtccccacccctagccg

SEQ ID NO: 362604 - DNA, 20 bp, human
gctgggcgcgagtgggactc

SEQ ID NO: 362605 - DNA, 20 bp, human
gctgccagggtgtcaagtaa

SEQ ID NO: 362606 - DNA, 20 bp, human
gctgccgcgcgccagtgtcc

SEQ ID NO: 362607 - DNA, 20 bp, human
ggtcgcggcgcggagacaca

SEQ ID NO: 362608 - DNA, 20 bp, human
gggcctgggcggcgggatga

SEQ ID NO: 362609 - DNA, 20 bp, human
gcacagggcccggcgagagg

SEQ ID NO: 362610 - DNA, 20 bp, human
ggccgcggcgccattggcct

SEQ ID NO: 362611 - DNA, 20 bp, human
ggggcccggcgagaggtggg

SEQ ID NO: 362612 - DNA, 20 bp, human
gcggatgctccgcctccggc

SEQ ID NO: 362613 - DNA, 20 bp, human
gggatgagggggcggagtcg

SEQ ID NO: 362614 - DNA, 20 bp, human
gagacacagggcccggcgag

SEQ ID NO: 362615 - DNA, 20 bp, human
ggcgtcacgtggtgagcgag

SEQ ID NO: 362616 - DNA, 20 bp, human
gcagccggctgcaggaccga

SEQ ID NO: 362617 - DNA, 20 bp, human
ggggctggcgggtttggcgt

SEQ ID NO: 362618 - DNA, 20 bp, human
ggagccctgctaattttagc

SEQ ID NO: 362619 - DNA, 20 bp, human
gtatggagagagatatcaag

SEQ ID NO: 362620 - DNA, 20 bp, human
gagggggaaaatggcgtctc

SEQ ID NO: 362621 - DNA, 20 bp, human
gcggaggcggcagagtcggg

SEQ ID NO: 362622 - DNA, 20 bp, human
gctggccgccctagctcggg

SEQ ID NO: 362623 - DNA, 20 bp, human
gcgggcgaggttgcaggaga

SEQ ID NO: 362624 - DNA, 20 bp, human
gtccccggtgagcgctggag

SEQ ID NO: 362625 - DNA, 20 bp, human
gagggagggtgcaaaaggcg

SEQ ID NO: 362626 - DNA, 20 bp, human
gcctcggccggcgccctggg

SEQ ID NO: 362627 - DNA, 20 bp, human
gcgggaccttgacgaatcgg

SEQ ID NO: 362628 - DNA, 20 bp, human
gtggcgaagccgactctccg

SEQ ID NO: 362629 - DNA, 20 bp, human
ggcccgggaccttgacgaat

SEQ ID NO: 362630 - DNA, 20 bp, human
gggtcccccggcagcgcctg

SEQ ID NO: 362631 - DNA, 20 bp, human
gaagctgcgactagtccctg

SEQ ID NO: 362632 - DNA, 20 bp, human
gaggaggccagccagcgctg

SEQ ID NO: 362633 - DNA, 20 bp, human
ggcaacttccgagcctccca

SEQ ID NO: 362634 - DNA, 20 bp, human
gactagtccctgaggaaaag

SEQ ID NO: 362635 - DNA, 20 bp, human
ggcggggcgaatcgctggac

SEQ ID NO: 362636 - DNA, 20 bp, human
gccgctcggccaccgtctcg

SEQ ID NO: 362637 - DNA, 20 bp, human
gtccccaggcactctcccgg

SEQ ID NO: 362638 - DNA, 20 bp, human
gtgtgggagcgcgcgagtga

SEQ ID NO: 362639 - DNA, 20 bp, human
gccgccgccgggagagtgcc

SEQ ID NO: 362640 - DNA, 20 bp, human
ggcttccccaggcactctcc

SEQ ID NO: 362641 - DNA, 20 bp, human
gacgcacgccgcggcggtcg

SEQ ID NO: 362642 - DNA, 20 bp, human
gaaaaggccttcccccgggg

SEQ ID NO: 362643 - DNA, 20 bp, human
gctcgggtcgggctccttag

SEQ ID NO: 362644 - DNA, 20 bp, human
ggagcgcgcgagtgaggggt

SEQ ID NO: 362645 - DNA, 20 bp, human
ggctgcgccgccaaagcccc

SEQ ID NO: 362646 - DNA, 20 bp, human
gcttgaccccaggccgggac

SEQ ID NO: 362647 - DNA, 20 bp, human
ggtgcgtcgctcccggtgtg

SEQ ID NO: 362648 - DNA, 20 bp, human
gccaccgatctgccgccagt

SEQ ID NO: 362649 - DNA, 20 bp, human
gtgcaaggcacgccgactgg

SEQ ID NO: 362650 - DNA, 20 bp, human
ggctctgcccgtcccggcct

SEQ ID NO: 362651 - DNA, 20 bp, human
ggccgggcctgcgaagctga

SEQ ID NO: 362652 - DNA, 20 bp, human
gagggagggagcgacgagcg

SEQ ID NO: 362653 - DNA, 20 bp, human
gacgccgactggcggcagat

SEQ ID NO: 362654 - DNA, 20 bp, human
gacgagcgaggtagcgacgc

SEQ ID NO: 362655 - DNA, 20 bp, human
gaacactgcccggcgggtcc

SEQ ID NO: 362656 - DNA, 20 bp, human
gaggaccccgaacggaacgc

SEQ ID NO: 362657 - DNA, 20 bp, human
gacccagccggcgttccgtt

SEQ ID NO: 362658 - DNA, 20 bp, human
ggcgacatcgtggttggcgg

SEQ ID NO: 362659 - DNA, 20 bp, human
gcggaacgccggctgggtgg

SEQ ID NO: 362660 - DNA, 20 bp, human
gcagctcccgggggcaagag

SEQ ID NO: 362661 - DNA, 20 bp, human
gagccggccgctcttgcccc

SEQ ID NO: 362662 - DNA, 20 bp, human
gagcgtgggccaatgaacgg

SEQ ID NO: 362663 - DNA, 20 bp, human
ggcccacgcttcggacgcat

SEQ ID NO: 362664 - DNA, 20 bp, human
gcccgaacggaacgccggct

SEQ ID NO: 362665 - DNA, 20 bp, human
gccggaggggcggagagagt

SEQ ID NO: 362666 - DNA, 20 bp, human
gccaacgcccagtacagtcg

SEQ ID NO: 362667 - DNA, 20 bp, human
gactcgacgtaggggttatg

SEQ ID NO: 362668 - DNA, 20 bp, human
gaacccctacgtcgagtcag

SEQ ID NO: 362669 - DNA, 20 bp, human
ggtacagtcggggacgaggt

SEQ ID NO: 362670 - DNA, 20 bp, human
gtgctcgcctgcgggttact

SEQ ID NO: 362671 - DNA, 20 bp, human
gcgcgcatgcgcagtgttcg

SEQ ID NO: 362672 - DNA, 20 bp, human
gctgacccctgactcgacgt

SEQ ID NO: 362673 - DNA, 20 bp, human
gcccagtacagtcggggacg

SEQ ID NO: 362674 - DNA, 20 bp, human
ggcggcggaaggggcggacc

SEQ ID NO: 362675 - DNA, 20 bp, human
ggggcggacccgggagactg

SEQ ID NO: 362676 - DNA, 20 bp, human
gggcgtttccgctcgggcag

SEQ ID NO: 362677 - DNA, 20 bp, human
gccggggccgcctagagaag

SEQ ID NO: 362678 - DNA, 20 bp, human
ggggaggtgcggtacactgg

SEQ ID NO: 362679 - DNA, 20 bp, human
gaggggagcggaactctggt

SEQ ID NO: 362680 - DNA, 20 bp, human
gcgccctgcggcaaccggag

SEQ ID NO: 362681 - DNA, 20 bp, human
gccaatgggtgcggggcggt

SEQ ID NO: 362682 - DNA, 20 bp, human
gcctcggctaggtaggggag

SEQ ID NO: 362683 - DNA, 20 bp, human
gtggcggcgagtgggccaat

SEQ ID NO: 362684 - DNA, 20 bp, human
gaggtaggggagcggaactc

SEQ ID NO: 362685 - DNA, 20 bp, human
gggagcggaactctggtggg

SEQ ID NO: 362686 - DNA, 20 bp, human
ggccctcggggacagaccga

SEQ ID NO: 362687 - DNA, 20 bp, human
ggccttcggtctgtccccga

SEQ ID NO: 362688 - DNA, 20 bp, human
gggtctgtccccgagggctg

SEQ ID NO: 362689 - DNA, 20 bp, human
gcgaaggccagggctgtacc

SEQ ID NO: 362690 - DNA, 20 bp, human
gtgagtgcaattggagatcc

SEQ ID NO: 362691 - DNA, 20 bp, human
gagactggccggagttaccg

SEQ ID NO: 362692 - DNA, 20 bp, human
gggtgagcgacgcaactggg

SEQ ID NO: 362693 - DNA, 20 bp, human
gcggtcacttccggcgtctc

SEQ ID NO: 362694 - DNA, 20 bp, human
gttccagcccgcggtaactc

SEQ ID NO: 362695 - DNA, 20 bp, human
gaagccgagggtctggtggc

SEQ ID NO: 362696 - DNA, 20 bp, human
ggcgaggggcaagtgggcga

SEQ ID NO: 362697 - DNA, 20 bp, human
ggggcaagtgggcgaaggga

SEQ ID NO: 362698 - DNA, 20 bp, human
gagcgagggagggagcgcac

SEQ ID NO: 362699 - DNA, 20 bp, human
gtccgaggcgaggggcaagt

SEQ ID NO: 362700 - DNA, 20 bp, human
ggggaactgtcaatcagcga

SEQ ID NO: 362701 - DNA, 20 bp, human
gaccggagcctccgaggcga

SEQ ID NO: 362702 - DNA, 20 bp, human
gaggctccggtgtgccgcct

SEQ ID NO: 362703 - DNA, 20 bp, human
gcccctcgcctcggaggctc

SEQ ID NO: 362704 - DNA, 20 bp, human
gctgtccctttccagaagta

SEQ ID NO: 362705 - DNA, 20 bp, human
gtgaaggccaaggaattgaa

SEQ ID NO: 362706 - DNA, 20 bp, human
gcggcctcagccactcgcgg

SEQ ID NO: 362707 - DNA, 20 bp, human
gtcagccactcgcggaggaa

SEQ ID NO: 362708 - DNA, 20 bp, human
gggagcctgggctgtcatga

SEQ ID NO: 362709 - DNA, 20 bp, human
ggcgcggcgaatcccggctc

SEQ ID NO: 362710 - DNA, 20 bp, human
gcagcgccgggcacacccga

SEQ ID NO: 362711 - DNA, 20 bp, human
ggggcgggcgcggcgaatcc

SEQ ID NO: 362712 - DNA, 20 bp, human
gccaccccttcctccgcgag

SEQ ID NO: 362713 - DNA, 20 bp, human
ggcgcggcctcagccactcg

SEQ ID NO: 362714 - DNA, 20 bp, human
gtggctgaggccgcgcgaga

SEQ ID NO: 362715 - DNA, 20 bp, human
gaacaccgtcatgacagccc

SEQ ID NO: 362716 - DNA, 20 bp, human
gccttctcccgcctcttcgg

SEQ ID NO: 362717 - DNA, 20 bp, human
gtcctccgccgggacctgtc

SEQ ID NO: 362718 - DNA, 20 bp, human
gagacgttgaatggctgcga

SEQ ID NO: 362719 - DNA, 20 bp, human
gcgcccttctcccgcctctt

SEQ ID NO: 362720 - DNA, 20 bp, human
ggcaggctgcccgtagtgat

SEQ ID NO: 362721 - DNA, 20 bp, human
gtcccgacaggtcccggcgg

SEQ ID NO: 362722 - DNA, 20 bp, human
ggggacttccggttctctgt

SEQ ID NO: 362723 - DNA, 20 bp, human
gaccgtcgccagacgttgaa

SEQ ID NO: 362724 - DNA, 20 bp, human
gcgccccgccgccgaagagg

SEQ ID NO: 362725 - DNA, 20 bp, human
gggaatctggggcctcccaa

SEQ ID NO: 362726 - DNA, 20 bp, human
gaatgagaggcgcgtagagc

SEQ ID NO: 362727 - DNA, 20 bp, human
gacgcaaagcggagagcctg

SEQ ID NO: 362728 - DNA, 20 bp, human
gaagggtcaccgggcctcag

SEQ ID NO: 362729 - DNA, 20 bp, human
ggacccttcgcccgcaacca

SEQ ID NO: 362730 - DNA, 20 bp, human
ggggcgggacggcagaacga

SEQ ID NO: 362731 - DNA, 20 bp, human
ggcggggcctgtggcagcga

SEQ ID NO: 362732 - DNA, 20 bp, human
ggccccgcggggccgtgacc

SEQ ID NO: 362733 - DNA, 20 bp, human
ggtgccaggaacactgagag

SEQ ID NO: 362734 - DNA, 20 bp, human
ggctccgctctcagtgttcc

SEQ ID NO: 362735 - DNA, 20 bp, human
gagaaggggagagaacgtcg

SEQ ID NO: 362736 - DNA, 20 bp, human
gtcagaggcgacgaaaacta

SEQ ID NO: 362737 - DNA, 20 bp, human
gttaaggcagagccttccag

SEQ ID NO: 362738 - DNA, 20 bp, human
ggagactggcagggcagagt

SEQ ID NO: 362739 - DNA, 20 bp, human
gcggagactcggtaatatac

SEQ ID NO: 362740 - DNA, 20 bp, human
gggcacacgtgagaagagac

SEQ ID NO: 362741 - DNA, 20 bp, human
gacgtgagaagagactggca

SEQ ID NO: 362742 - DNA, 20 bp, human
ggtaatggggccactagtcg

SEQ ID NO: 362743 - DNA, 20 bp, human
ggtgaccggaacggcactaa

SEQ ID NO: 362744 - DNA, 20 bp, human
gcaccgcgacggtagcctga

SEQ ID NO: 362745 - DNA, 20 bp, human
ggggtcaaatccaaagccgc

SEQ ID NO: 362746 - DNA, 20 bp, human
gtaagtgcgccgagtctctg

SEQ ID NO: 362747 - DNA, 20 bp, human
gtctgaggcgtgaaccagtg

SEQ ID NO: 362748 - DNA, 20 bp, human
ggggagtgcgaccaatcaat

SEQ ID NO: 362749 - DNA, 20 bp, human
gaggcagggcgggactgttg

SEQ ID NO: 362750 - DNA, 20 bp, human
gctagcagtcaatcgggagg

SEQ ID NO: 362751 - DNA, 20 bp, human
ggattggtcgcactccccac

SEQ ID NO: 362752 - DNA, 20 bp, human
gagagcgctagcagtcaatc

SEQ ID NO: 362753 - DNA, 20 bp, human
ggcgctagcagtcaatcggg

SEQ ID NO: 362754 - DNA, 20 bp, human
gcagccaggagcccattgat

SEQ ID NO: 362755 - DNA, 20 bp, human
ggtcgagaggccggcatcac

SEQ ID NO: 362756 - DNA, 20 bp, human
ggggccgcgcggtggatgct

SEQ ID NO: 362757 - DNA, 20 bp, human
ggcgcggcccaggactgtca

SEQ ID NO: 362758 - DNA, 20 bp, human
gacagtcctgggccgcgcgg

SEQ ID NO: 362759 - DNA, 20 bp, human
gccactaccctgacagtcct

SEQ ID NO: 362760 - DNA, 20 bp, human
gagggctcactgcacgtttg

SEQ ID NO: 362761 - DNA, 20 bp, human
gcctgggagcatcagagagg

SEQ ID NO: 362762 - DNA, 20 bp, human
gcatttgtccaggtttttga

SEQ ID NO: 362763 - DNA, 20 bp, human
gaactacaattcccatgagg

SEQ ID NO: 362764 - DNA, 20 bp, human
gaggtgctttagtttttcct

SEQ ID NO: 362765 - DNA, 20 bp, human
gagtcccagcatccaccgcg

SEQ ID NO: 362766 - DNA, 20 bp, human
ggatgagctctgctgcgggt

SEQ ID NO: 362767 - DNA, 20 bp, human
gggccgaggtcaaggttccg

SEQ ID NO: 362768 - DNA, 20 bp, human
gcgggcgctggcgtcacgtc

SEQ ID NO: 362769 - DNA, 20 bp, human
gtccaccctgacggggactc

SEQ ID NO: 362770 - DNA, 20 bp, human
gcaatcccgagtccccgtca

SEQ ID NO: 362771 - DNA, 20 bp, human
gcggcgtgggcggtgcaccg

SEQ ID NO: 362772 - DNA, 20 bp, human
gccggggcttcctgcgggtg

SEQ ID NO: 362773 - DNA, 20 bp, human
gggaaatggccagcgggtaa

SEQ ID NO: 362774 - DNA, 20 bp, human
gacggggactcgggattggt

SEQ ID NO: 362775 - DNA, 20 bp, human
gcggccggccgactcagcgc

SEQ ID NO: 362776 - DNA, 20 bp, human
ggcgactgccctactcatgt

SEQ ID NO: 362777 - DNA, 20 bp, human
ggtgggcagcgcagaagggc

SEQ ID NO: 362778 - DNA, 20 bp, human
ggccgtgtgcccacatgagt

SEQ ID NO: 362779 - DNA, 20 bp, human
gggaaagagggtggcatgct

SEQ ID NO: 362780 - DNA, 20 bp, human
ggccctcaggtaccaggatt

SEQ ID NO: 362781 - DNA, 20 bp, human
gaggccgttaacgggaaaga

SEQ ID NO: 362782 - DNA, 20 bp, human
gccaccctctttcccgttaa

SEQ ID NO: 362783 - DNA, 20 bp, human
gaccgtaaagtctcatgcaa

SEQ ID NO: 362784 - DNA, 20 bp, human
ggcgccggggatcgccgagc

SEQ ID NO: 362785 - DNA, 20 bp, human
gctggtacctgagggcgtca

SEQ ID NO: 362786 - DNA, 20 bp, human
gggggctggtaaagacaggg

SEQ ID NO: 362787 - DNA, 20 bp, human
gagtggggctggtaaagaca

SEQ ID NO: 362788 - DNA, 20 bp, human
gagggtccctccttggactg

SEQ ID NO: 362789 - DNA, 20 bp, human
gcccaactcgagtagtgggg

SEQ ID NO: 362790 - DNA, 20 bp, human
gctacaagaggggctggaaa

SEQ ID NO: 362791 - DNA, 20 bp, human
gtctggctgctcaggtgtgg

SEQ ID NO: 362792 - DNA, 20 bp, human
gcaggtgggtcaggctggaa

SEQ ID NO: 362793 - DNA, 20 bp, human
gtggttggccaggcggggaa

SEQ ID NO: 362794 - DNA, 20 bp, human
gtgagtgggtaccgcagcca

SEQ ID NO: 362795 - DNA, 20 bp, human
gtgaggaattcctacaagag

SEQ ID NO: 362796 - DNA, 20 bp, human
gcgagcgggcagtgagctgg

SEQ ID NO: 362797 - DNA, 20 bp, human
gagcagggagagaaaacgct

SEQ ID NO: 362798 - DNA, 20 bp, human
gcgtggagcgagcgggagga

SEQ ID NO: 362799 - DNA, 20 bp, human
ggggtgccagccgcctcctc

SEQ ID NO: 362800 - DNA, 20 bp, human
gtctgtgccgagcgagtgca

SEQ ID NO: 362801 - DNA, 20 bp, human
gcactcgctcggcacagact

SEQ ID NO: 362802 - DNA, 20 bp, human
gctcggctcccaggacgcaa

SEQ ID NO: 362803 - DNA, 20 bp, human
gcgaacgagcgtggagcgag

SEQ ID NO: 362804 - DNA, 20 bp, human
ggaactgggatgtatctgga

SEQ ID NO: 362805 - DNA, 20 bp, human
ggctgctgggagcgtcagca

SEQ ID NO: 362806 - DNA, 20 bp, human
gctcactcccgcggccccta

SEQ ID NO: 362807 - DNA, 20 bp, human
gggagtgaggattacggccc

SEQ ID NO: 362808 - DNA, 20 bp, human
gcggcccctaggggaggcaa

SEQ ID NO: 362809 - DNA, 20 bp, human
gcgtccccaggatctgacgt

SEQ ID NO: 362810 - DNA, 20 bp, human
gggagggatcatacgagcca

SEQ ID NO: 362811 - DNA, 20 bp, human
ggggtggggtcgaggatcga

SEQ ID NO: 362812 - DNA, 20 bp, human
gggaggcaaaggaaactctc

SEQ ID NO: 362813 - DNA, 20 bp, human
ggggaggtctgaatgtgaac

SEQ ID NO: 362814 - DNA, 20 bp, human
gagagccgaagctcgggcac

SEQ ID NO: 362815 - DNA, 20 bp, human
gccacccgagctactgtaaa

SEQ ID NO: 362816 - DNA, 20 bp, human
gaggccaagcgaggaaatgg

SEQ ID NO: 362817 - DNA, 20 bp, human
gaatggcggcggagttcggt

SEQ ID NO: 362818 - DNA, 20 bp, human
gggtggggcgaactctatga

SEQ ID NO: 362819 - DNA, 20 bp, human
gaaactgccccctgggggag

SEQ ID NO: 362820 - DNA, 20 bp, human
gagtccagaaaggaggggat

SEQ ID NO: 362821 - DNA, 20 bp, human
ggaactctatgacggagcga

SEQ ID NO: 362822 - DNA, 20 bp, human
gcccaagggtcgatggtgaa

SEQ ID NO: 362823 - DNA, 20 bp, human
gctcgcttggcctaacggtt

SEQ ID NO: 362824 - DNA, 20 bp, human
gggaacgagatttacggcgg

SEQ ID NO: 362825 - DNA, 20 bp, human
ggcctgcgttgtagtgtcgc

SEQ ID NO: 362826 - DNA, 20 bp, human
gcggcctgagcgcccggcta

SEQ ID NO: 362827 - DNA, 20 bp, human
ggggagccgaccagacacga

SEQ ID NO: 362828 - DNA, 20 bp, human
ggctgccttggcaacggcgt

SEQ ID NO: 362829 - DNA, 20 bp, human
ggcgtccgacgccgttgcca

SEQ ID NO: 362830 - DNA, 20 bp, human
gcaggccgctgccttggcaa

SEQ ID NO: 362831 - DNA, 20 bp, human
gactgcccccggtgcgcctg

SEQ ID NO: 362832 - DNA, 20 bp, human
gggaagcgcgtcacggcgag

SEQ ID NO: 362833 - DNA, 20 bp, human
ggtactggcctgtggagtaa

SEQ ID NO: 362834 - DNA, 20 bp, human
gaagccctagccgggcgctc

SEQ ID NO: 362835 - DNA, 20 bp, human
gaagccgcgacgccgaagac

SEQ ID NO: 362836 - DNA, 20 bp, human
ggcttcctcacagcatgaat

SEQ ID NO: 362837 - DNA, 20 bp, human
gggcacttaacatgccgggg

SEQ ID NO: 362838 - DNA, 20 bp, human
gttagcacatggacgctggc

SEQ ID NO: 362839 - DNA, 20 bp, human
gaagaaagggcccctgtctg

SEQ ID NO: 362840 - DNA, 20 bp, human
gaagcagcttggcctgctgc

SEQ ID NO: 362841 - DNA, 20 bp, human
gtaagtgcccttggcctctt

SEQ ID NO: 362842 - DNA, 20 bp, human
ggatgcctgaaaggaagcgt

SEQ ID NO: 362843 - DNA, 20 bp, human
gcaagccaggccctctaagc

SEQ ID NO: 362844 - DNA, 20 bp, human
gcactcccattcatgctgtg

SEQ ID NO: 362845 - DNA, 20 bp, human
ggcaatggcaggactcagag

SEQ ID NO: 362846 - DNA, 20 bp, human
gtgcggccgcagcggaccga

SEQ ID NO: 362847 - DNA, 20 bp, human
gtcccgaggcgcgaaggaaa

SEQ ID NO: 362848 - DNA, 20 bp, human
ggctgaaagcgcggcctgga

SEQ ID NO: 362849 - DNA, 20 bp, human
ggcccagcggcgtgagtcag

SEQ ID NO: 362850 - DNA, 20 bp, human
ggggggagaggctgaaagcg

SEQ ID NO: 362851 - DNA, 20 bp, human
gagagggtcccgaggcgcga

SEQ ID NO: 362852 - DNA, 20 bp, human
gacggggccaactttcgcga

SEQ ID NO: 362853 - DNA, 20 bp, human
gcacgcgcagtttgccttcc

SEQ ID NO: 362854 - DNA, 20 bp, human
gggcaaagaaagcacttccg

SEQ ID NO: 362855 - DNA, 20 bp, human
ggccaactttcgcgagggag

SEQ ID NO: 362856 - DNA, 20 bp, human
ggggtgaggggcagtctcga

SEQ ID NO: 362857 - DNA, 20 bp, human
gctgctgctgggacctccct

SEQ ID NO: 362858 - DNA, 20 bp, human
ggaagatggctcagaactcg

SEQ ID NO: 362859 - DNA, 20 bp, human
gctatggggtggccccctca

SEQ ID NO: 362860 - DNA, 20 bp, human
ggaagagactgggtgcgcta

SEQ ID NO: 362861 - DNA, 20 bp, human
ggctgaggcccactgtggac

SEQ ID NO: 362862 - DNA, 20 bp, human
ggactgggagacacctgtgg

SEQ ID NO: 362863 - DNA, 20 bp, human
ggacttccagcatcgccccg

SEQ ID NO: 362864 - DNA, 20 bp, human
ggactgggtgcgctatgggg

SEQ ID NO: 362865 - DNA, 20 bp, human
gctggttagaccctggcgct

SEQ ID NO: 362866 - DNA, 20 bp, human
ggtggtggagcgatgccgag

SEQ ID NO: 362867 - DNA, 20 bp, human
ggaacctgaggttcagcgga

SEQ ID NO: 362868 - DNA, 20 bp, human
gaagccgtccgctgaacctc

SEQ ID NO: 362869 - DNA, 20 bp, human
gccagtccatgttatggaga

SEQ ID NO: 362870 - DNA, 20 bp, human
gaacaggagcaccacaagga

SEQ ID NO: 362871 - DNA, 20 bp, human
ggaggcatctgcgaacctct

SEQ ID NO: 362872 - DNA, 20 bp, human
gtgcgcgagcagttggagtg

SEQ ID NO: 362873 - DNA, 20 bp, human
gccccgggacttaagaaaac

SEQ ID NO: 362874 - DNA, 20 bp, human
gggcgggcaggtatcctgtg

SEQ ID NO: 362875 - DNA, 20 bp, human
gatgcgcaacgtggggactc

SEQ ID NO: 362876 - DNA, 20 bp, human
ggaaccgcgaggtgcattgt

SEQ ID NO: 362877 - DNA, 20 bp, human
gaaacgggagcgcgctccgt

SEQ ID NO: 362878 - DNA, 20 bp, human
gccacctagagggaaccgcg

SEQ ID NO: 362879 - DNA, 20 bp, human
ggacagaactgccacctaga

SEQ ID NO: 362880 - DNA, 20 bp, human
ggcacctcgcggttccctct

SEQ ID NO: 362881 - DNA, 20 bp, human
gtcaccacgcaggcgacttc

SEQ ID NO: 362882 - DNA, 20 bp, human
ggcgacgagcggaagttctt

SEQ ID NO: 362883 - DNA, 20 bp, human
gccacccacaatgcacctcg

SEQ ID NO: 362884 - DNA, 20 bp, human
gggccctgaagtcgcctgcg

SEQ ID NO: 362885 - DNA, 20 bp, human
gaggaaagtggattctacga

SEQ ID NO: 362886 - DNA, 20 bp, human
gcctgagcgagactcgaggc

SEQ ID NO: 362887 - DNA, 20 bp, human
ggcggggcgtagcctccaaa

SEQ ID NO: 362888 - DNA, 20 bp, human
gggtctcaggtgagtaactg

SEQ ID NO: 362889 - DNA, 20 bp, human
gtcgaggccggaagatggaa

SEQ ID NO: 362890 - DNA, 20 bp, human
ggagactcgaggccggaaga

SEQ ID NO: 362891 - DNA, 20 bp, human
gccgggctctgtaccgtaaa

SEQ ID NO: 362892 - DNA, 20 bp, human
gacagagcccggaagtgtct

SEQ ID NO: 362893 - DNA, 20 bp, human
gcgagcctgagcgagactcg

SEQ ID NO: 362894 - DNA, 20 bp, human
gggaacatctcgccttttgg

SEQ ID NO: 362895 - DNA, 20 bp, human
ggtgagtaactggggagcgg

SEQ ID NO: 362896 - DNA, 20 bp, human
gccgaggggccactagagaa

SEQ ID NO: 362897 - DNA, 20 bp, human
gcgggccctgcgcgccgcta

SEQ ID NO: 362898 - DNA, 20 bp, human
gagggctggcacttccccga

SEQ ID NO: 362899 - DNA, 20 bp, human
gcacacccgctgccgtgcgc

SEQ ID NO: 362900 - DNA, 20 bp, human
gcgcgccgctacggccccga

SEQ ID NO: 362901 - DNA, 20 bp, human
gaatcccgtcgcccagcgca

SEQ ID NO: 362902 - DNA, 20 bp, human
gccgtatgccacgtcctctc

SEQ ID NO: 362903 - DNA, 20 bp, human
gtcgcgaccagaccgccgag

SEQ ID NO: 362904 - DNA, 20 bp, human
gtgggaggcgacgcgcactc

SEQ ID NO: 362905 - DNA, 20 bp, human
gctgccgtgcgctgggcgac

SEQ ID NO: 362906 - DNA, 20 bp, human
ggcacccctgacagcttcgg

SEQ ID NO: 362907 - DNA, 20 bp, human
ggggaccggaagtgccgaat

SEQ ID NO: 362908 - DNA, 20 bp, human
ggggtgcagcagccgtctga

SEQ ID NO: 362909 - DNA, 20 bp, human
ggctgcacccctgacagctt

SEQ ID NO: 362910 - DNA, 20 bp, human
gtgccgaatggggaccaaga

SEQ ID NO: 362911 - DNA, 20 bp, human
gaacgaagagggggcctcgc

SEQ ID NO: 362912 - DNA, 20 bp, human
gtctgtgggcagccccaaat

SEQ ID NO: 362913 - DNA, 20 bp, human
gtcgcctccgaagctgtcag

SEQ ID NO: 362914 - DNA, 20 bp, human
gcgaatggggaccaagatgg

SEQ ID NO: 362915 - DNA, 20 bp, human
ggttcattgggcacttctgt

SEQ ID NO: 362916 - DNA, 20 bp, human
gggtcgggcggtagagtcct

SEQ ID NO: 362917 - DNA, 20 bp, human
ggacccaggttaagtttcgg

SEQ ID NO: 362918 - DNA, 20 bp, human
gcacctcaggacgcgagccg

SEQ ID NO: 362919 - DNA, 20 bp, human
gcgaagacggacgtagcggt

SEQ ID NO: 362920 - DNA, 20 bp, human
gaaacttaacctgggtcggg

SEQ ID NO: 362921 - DNA, 20 bp, human
gtcgctaagacaactagcag

SEQ ID NO: 362922 - DNA, 20 bp, human
ggggcggaacggaaacgctc

SEQ ID NO: 362923 - DNA, 20 bp, human
ggtcctcggctcgcgtcctg

SEQ ID NO: 362924 - DNA, 20 bp, human
gggggcgaagacggacgtag

SEQ ID NO: 362925 - DNA, 20 bp, human
gagcctccgaaacttaacct

SEQ ID NO: 362926 - DNA, 20 bp, human
gggggcggggatctccatgg

SEQ ID NO: 362927 - DNA, 20 bp, human
gagtgtgcctcccccctcca

SEQ ID NO: 362928 - DNA, 20 bp, human
gagcgtaactctcgctcata

SEQ ID NO: 362929 - DNA, 20 bp, human
ggcctcccttagccactaag

SEQ ID NO: 362930 - DNA, 20 bp, human
ggcaacattctctgatgggg

SEQ ID NO: 362931 - DNA, 20 bp, human
ggatggggcggggatctcca

SEQ ID NO: 362932 - DNA, 20 bp, human
gcacgcaattggagttgctg

SEQ ID NO: 362933 - DNA, 20 bp, human
gtgctgggacttgtggtctt

SEQ ID NO: 362934 - DNA, 20 bp, human
gtgcatgatggtccacttag

SEQ ID NO: 362935 - DNA, 20 bp, human
gttcgtgcacgcaggcttcc

SEQ ID NO: 362936 - DNA, 20 bp, human
gggcttgcgcagcctcagtc

SEQ ID NO: 362937 - DNA, 20 bp, human
gtgaggctgcgcaagccccg

SEQ ID NO: 362938 - DNA, 20 bp, human
gagaggcccacgcacgagtc

SEQ ID NO: 362939 - DNA, 20 bp, human
gcgagtccggaagtgaggga

SEQ ID NO: 362940 - DNA, 20 bp, human
gtgcgcagcctcagtcgggt

SEQ ID NO: 362941 - DNA, 20 bp, human
gtgcgccacctacccgactg

SEQ ID NO: 362942 - DNA, 20 bp, human
gaatgagaatcggtttcgag

SEQ ID NO: 362943 - DNA, 20 bp, human
gagaagtgggaggtattccg

SEQ ID NO: 362944 - DNA, 20 bp, human
ggcagcctcagtcgggtagg

SEQ ID NO: 362945 - DNA, 20 bp, human
ggtaactcggggttccgcct

SEQ ID NO: 362946 - DNA, 20 bp, human
gcgggaggcaaggactccgc

SEQ ID NO: 362947 - DNA, 20 bp, human
gaggagggatggcgctgggg

SEQ ID NO: 362948 - DNA, 20 bp, human
gccgcgcccgtggagctccc

SEQ ID NO: 362949 - DNA, 20 bp, human
gcctcctggctggggccgcg

SEQ ID NO: 362950 - DNA, 20 bp, human
ggctccgactcattccaata

SEQ ID NO: 362951 - DNA, 20 bp, human
gactccgcgggctggtgtgc

SEQ ID NO: 362952 - DNA, 20 bp, human
gaggcaaggactccgcgggc

SEQ ID NO: 362953 - DNA, 20 bp, human
gcccccctccacccgcgctc

SEQ ID NO: 362954 - DNA, 20 bp, human
ggctgtcgcccgcacgtgac

SEQ ID NO: 362955 - DNA, 20 bp, human
gcccccggcacaccagcccg

SEQ ID NO: 362956 - DNA, 20 bp, human
ggccgaggagagctattcga

SEQ ID NO: 362957 - DNA, 20 bp, human
gaggggcaggaaattaagtt

SEQ ID NO: 362958 - DNA, 20 bp, human
gtcgagggaaaggtgccccg

SEQ ID NO: 362959 - DNA, 20 bp, human
gctctccaacggaccgtcga

SEQ ID NO: 362960 - DNA, 20 bp, human
gggagagctattcgagggaa

SEQ ID NO: 362961 - DNA, 20 bp, human
ggctacctggcagctcgccc

SEQ ID NO: 362962 - DNA, 20 bp, human
gcagccctgcccaaggggcc

SEQ ID NO: 362963 - DNA, 20 bp, human
ggctcgccacggcgtctcat

SEQ ID NO: 362964 - DNA, 20 bp, human
gggggcacctagctagtggc

SEQ ID NO: 362965 - DNA, 20 bp, human
gcgagggccacgttttgctg

SEQ ID NO: 362966 - DNA, 20 bp, human
gtgcgtgtgcgcagtttttt

SEQ ID NO: 362967 - DNA, 20 bp, human
gcaactgtcgtgtgtgcctg

SEQ ID NO: 362968 - DNA, 20 bp, human
gggcctgcacactaatccac

SEQ ID NO: 362969 - DNA, 20 bp, human
gacacacgacagttgcgttt

SEQ ID NO: 362970 - DNA, 20 bp, human
gcgcacacacacattcgggg

SEQ ID NO: 362971 - DNA, 20 bp, human
gtgtgtcaagtccattgcta

SEQ ID NO: 362972 - DNA, 20 bp, human
gcgtggtgtaaagtacatga

SEQ ID NO: 362973 - DNA, 20 bp, human
ggtcacgtcaaatcatggca

SEQ ID NO: 362974 - DNA, 20 bp, human
gggtgccctggtccgggcca

SEQ ID NO: 362975 - DNA, 20 bp, human
ggtcaagtccattgctaggg

SEQ ID NO: 362976 - DNA, 20 bp, human
ggtaaaaaggctgggatgtg

SEQ ID NO: 362977 - DNA, 20 bp, human
gggctgccccctcttgttcg

SEQ ID NO: 362978 - DNA, 20 bp, human
gggagagggaggcaggtctt

SEQ ID NO: 362979 - DNA, 20 bp, human
gtgcagagccggaaagggtg

SEQ ID NO: 362980 - DNA, 20 bp, human
gccgtccttagcccctggaa

SEQ ID NO: 362981 - DNA, 20 bp, human
gggaaaggtgccagtgcagg

SEQ ID NO: 362982 - DNA, 20 bp, human
gacagtcagcaggagaaatc

SEQ ID NO: 362983 - DNA, 20 bp, human
ggcaggagaaatctgggcgt

SEQ ID NO: 362984 - DNA, 20 bp, human
ggatgccagccccgaacaag

SEQ ID NO: 362985 - DNA, 20 bp, human
gggctgcccacatcaggaaa

SEQ ID NO: 362986 - DNA, 20 bp, human
gggggactgaagtttccagt

SEQ ID NO: 362987 - DNA, 20 bp, human
gcagtgagcgaagaaggcgt

SEQ ID NO: 362988 - DNA, 20 bp, human
gcgaagaaggcgttggctgt

SEQ ID NO: 362989 - DNA, 20 bp, human
gggccaataggaatgatcag

SEQ ID NO: 362990 - DNA, 20 bp, human
gtaggccactatgatttgct

SEQ ID NO: 362991 - DNA, 20 bp, human
ggcctcccgcctctcaccca

SEQ ID NO: 362992 - DNA, 20 bp, human
gttggcccctgggtgagagg

SEQ ID NO: 362993 - DNA, 20 bp, human
gaacctctgatcattcctat

SEQ ID NO: 362994 - DNA, 20 bp, human
gtaggcggggccgtgccagc

SEQ ID NO: 362995 - DNA, 20 bp, human
gtcttcgctcactggccaac

SEQ ID NO: 362996 - DNA, 20 bp, human
gccagcgggtggttggggcg

SEQ ID NO: 362997 - DNA, 20 bp, human
gggaggcccagacgcatgat

SEQ ID NO: 362998 - DNA, 20 bp, human
ggcttggcccacacgatggg

SEQ ID NO: 362999 - DNA, 20 bp, human
gcctccgccagcgggtggtt

SEQ ID NO: 363000 - DNA, 20 bp, human
gccgccccgaagacctgctg

SEQ ID NO: 363001 - DNA, 20 bp, human
gggggcttggcccacacgat

SEQ ID NO: 363002 - DNA, 20 bp, human
gactcagcgactcagagcgg

SEQ ID NO: 363003 - DNA, 20 bp, human
gcctcgcgcgtcaggcaatc

SEQ ID NO: 363004 - DNA, 20 bp, human
gtctgagtcgctgagtgaag

SEQ ID NO: 363005 - DNA, 20 bp, human
gaagcggcgcctcgcgcgtc

SEQ ID NO: 363006 - DNA, 20 bp, human
gaaaccgaacccgctcgcga

SEQ ID NO: 363007 - DNA, 20 bp, human
gcctccctcgcgagcgggtt

SEQ ID NO: 363008 - DNA, 20 bp, human
gacggacgtggtaacgagtg

SEQ ID NO: 363009 - DNA, 20 bp, human
gcccgcgccggtgacggacg

SEQ ID NO: 363010 - DNA, 20 bp, human
ggggaatggatcacggcgtg

SEQ ID NO: 363011 - DNA, 20 bp, human
gcgccccgccgggagctgat

SEQ ID NO: 363012 - DNA, 20 bp, human
gtcgttaccacgtccgtcac

SEQ ID NO: 363013 - DNA, 20 bp, human
gcgctcgcgagggaggcgat

SEQ ID NO: 363014 - DNA, 20 bp, human
gaggcgattggctcccgcgc

SEQ ID NO: 363015 - DNA, 20 bp, human
ggctccgagggctcggccgt

SEQ ID NO: 363016 - DNA, 20 bp, human
gagcggcggcatctagggga

SEQ ID NO: 363017 - DNA, 20 bp, human
gcctcacgcgcttgctggaa

SEQ ID NO: 363018 - DNA, 20 bp, human
gggcgagcggcggcatctag

SEQ ID NO: 363019 - DNA, 20 bp, human
ggcttgctggaagggaattc

SEQ ID NO: 363020 - DNA, 20 bp, human
gccctgctcgctcactgtgg

SEQ ID NO: 363021 - DNA, 20 bp, human
ggggctggtcactactttct

SEQ ID NO: 363022 - DNA, 20 bp, human
gcggcctcgcgaccaggtac

SEQ ID NO: 363023 - DNA, 20 bp, human
gatgaagggtaatccgagga

SEQ ID NO: 363024 - DNA, 20 bp, human
gacggtggctggagattcga

SEQ ID NO: 363025 - DNA, 20 bp, human
ggcaagggaggagccaatga

SEQ ID NO: 363026 - DNA, 20 bp, human
gcctgggctgcggcccagag

SEQ ID NO: 363027 - DNA, 20 bp, human
gaggcccgtcggtgcagaag

SEQ ID NO: 363028 - DNA, 20 bp, human
gaaagcaggcttccagccct

SEQ ID NO: 363029 - DNA, 20 bp, human
ggggactttagggggaaagc

SEQ ID NO: 363030 - DNA, 20 bp, human
gtctgcaccgacgggcctgg

SEQ ID NO: 363031 - DNA, 20 bp, human
gcgttccgagcccacgtcag

SEQ ID NO: 363032 - DNA, 20 bp, human
gctggccagactaaaaagga

SEQ ID NO: 363033 - DNA, 20 bp, human
gtaaaaaggagggactttag

SEQ ID NO: 363034 - DNA, 20 bp, human
ggggaggtgtcgggataaat

SEQ ID NO: 363035 - DNA, 20 bp, human
gccgacacctcccctgacgt

SEQ ID NO: 363036 - DNA, 20 bp, human
gagccctggggagaaacgct

SEQ ID NO: 363037 - DNA, 20 bp, human
gtcgaggaaaatgcccaggg

SEQ ID NO: 363038 - DNA, 20 bp, human
ggggccaggcggccggagat

SEQ ID NO: 363039 - DNA, 20 bp, human
ggtgcgccccagccaatctc

SEQ ID NO: 363040 - DNA, 20 bp, human
gagaagaggaaccgaggtgt

SEQ ID NO: 363041 - DNA, 20 bp, human
gtggccccagctccaaggcg

SEQ ID NO: 363042 - DNA, 20 bp, human
gggcgctgggcgggacgctc

SEQ ID NO: 363043 - DNA, 20 bp, human
gagggccaggatagtctagt

SEQ ID NO: 363044 - DNA, 20 bp, human
gggaaggatggagaaggcga

SEQ ID NO: 363045 - DNA, 20 bp, human
ggctgtggcggagagagata

SEQ ID NO: 363046 - DNA, 20 bp, human
ggggcggcgacggagtcgga

SEQ ID NO: 363047 - DNA, 20 bp, human
gcgcgcgccggcttccgctg

SEQ ID NO: 363048 - DNA, 20 bp, human
gcggaccggcagattcgcct

SEQ ID NO: 363049 - DNA, 20 bp, human
gtaggcgctgctgtattcag

SEQ ID NO: 363050 - DNA, 20 bp, human
ggcggccagtcgggcggcga

SEQ ID NO: 363051 - DNA, 20 bp, human
gacccacgaggactcgccca

SEQ ID NO: 363052 - DNA, 20 bp, human
gcgtggcgaaagcgcagcgt

SEQ ID NO: 363053 - DNA, 20 bp, human
ggcgactcggacatggtgag

SEQ ID NO: 363054 - DNA, 20 bp, human
ggccttgggcgagtcctcgt

SEQ ID NO: 363055 - DNA, 20 bp, human
gagtcgggcggcgacggagt

SEQ ID NO: 363056 - DNA, 20 bp, human
gtagtggtccgtgaagtccg

SEQ ID NO: 363057 - DNA, 20 bp, human
gacctcgcggacagtgggaa

SEQ ID NO: 363058 - DNA, 20 bp, human
gggagtgggcgctgatggtg

SEQ ID NO: 363059 - DNA, 20 bp, human
gaacgcgcggggacacagcg

SEQ ID NO: 363060 - DNA, 20 bp, human
gctgacgcacaggaagcggg

SEQ ID NO: 363061 - DNA, 20 bp, human
gactaccgggtccgagagaa

SEQ ID NO: 363062 - DNA, 20 bp, human
gtccgtgaagtccgcggagt

SEQ ID NO: 363063 - DNA, 20 bp, human
ggacttcacggaccactacc

SEQ ID NO: 363064 - DNA, 20 bp, human
gcatgcgcgcattgctacgg

SEQ ID NO: 363065 - DNA, 20 bp, human
gccggaggacgccaagtgca

SEQ ID NO: 363066 - DNA, 20 bp, human
ggcgctgccaaacactaatt

SEQ ID NO: 363067 - DNA, 20 bp, human
gactggatcaagtagggcga

SEQ ID NO: 363068 - DNA, 20 bp, human
gtccggagacacaaagacgg

SEQ ID NO: 363069 - DNA, 20 bp, human
gccaggcacctgcccaccgg

SEQ ID NO: 363070 - DNA, 20 bp, human
gaacaagcggaggcgagcgc

SEQ ID NO: 363071 - DNA, 20 bp, human
gcagacgggaacaaaggctg

SEQ ID NO: 363072 - DNA, 20 bp, human
gtggacgccgaattagtgtt

SEQ ID NO: 363073 - DNA, 20 bp, human
gatgccgggagccccccggt

SEQ ID NO: 363074 - DNA, 20 bp, human
gtcgttgactggatcaagta

SEQ ID NO: 363075 - DNA, 20 bp, human
gccggagccttgcacgtggt

SEQ ID NO: 363076 - DNA, 20 bp, human
gcacctgcgaccacggtact

SEQ ID NO: 363077 - DNA, 20 bp, human
ggggcacgtgggtgcggcct

SEQ ID NO: 363078 - DNA, 20 bp, human
gagggcgactgcaagcggac

SEQ ID NO: 363079 - DNA, 20 bp, human
gaagagggtcaggcgctggg

SEQ ID NO: 363080 - DNA, 20 bp, human
gagggcgcctactccgaaca

SEQ ID NO: 363081 - DNA, 20 bp, human
gtcttcgggcggcaattggt

SEQ ID NO: 363082 - DNA, 20 bp, human
gggcggcaattggtcggcga

SEQ ID NO: 363083 - DNA, 20 bp, human
gcctgctctgcggacttttg

SEQ ID NO: 363084 - DNA, 20 bp, human
gaaaagctgcggctcacttc

SEQ ID NO: 363085 - DNA, 20 bp, human
gaaggggcgcgaaggagtca

SEQ ID NO: 363086 - DNA, 20 bp, human
gaacctggagacacaaggga

SEQ ID NO: 363087 - DNA, 20 bp, human
gagtgcgggtcctacagaca

SEQ ID NO: 363088 - DNA, 20 bp, human
ggggaggcccgggcatgggt

SEQ ID NO: 363089 - DNA, 20 bp, human
gctcaaacctggagacacaa

SEQ ID NO: 363090 - DNA, 20 bp, human
ggagagggaagcggggacca

SEQ ID NO: 363091 - DNA, 20 bp, human
gtgggcccaaaagggagggg

SEQ ID NO: 363092 - DNA, 20 bp, human
gacccctcccttgtgtctcc

SEQ ID NO: 363093 - DNA, 20 bp, human
gtcccagtaagagaggaccc

SEQ ID NO: 363094 - DNA, 20 bp, human
gaatgtgggcccaaaaggga

SEQ ID NO: 363095 - DNA, 20 bp, human
gccgaagggctcaggaatgt

SEQ ID NO: 363096 - DNA, 20 bp, human
gctgctgccgctaccaacaa

SEQ ID NO: 363097 - DNA, 20 bp, human
ggcaggggagacagggatcc

SEQ ID NO: 363098 - DNA, 20 bp, human
gcggtcctcaaggccaggag

SEQ ID NO: 363099 - DNA, 20 bp, human
ggggcccgaagccactagag

SEQ ID NO: 363100 - DNA, 20 bp, human
gtggggcctagggatgggta

SEQ ID NO: 363101 - DNA, 20 bp, human
gccactagagcggctctcca

SEQ ID NO: 363102 - DNA, 20 bp, human
gtcagctagcgagggggtca

SEQ ID NO: 363103 - DNA, 20 bp, human
gactgggccaagctcagaag

SEQ ID NO: 363104 - DNA, 20 bp, human
gcagctctctcagctagcga

SEQ ID NO: 363105 - DNA, 20 bp, human
gaggtgcttggaagcttccg

SEQ ID NO: 363106 - DNA, 20 bp, human
gtcaggctggaggatctcaa

SEQ ID NO: 363107 - DNA, 20 bp, human
gggtgacctcagccaagggg

SEQ ID NO: 363108 - DNA, 20 bp, human
gctgctaaggagcttgctag

SEQ ID NO: 363109 - DNA, 20 bp, human
gagaagagaaatccccccct

SEQ ID NO: 363110 - DNA, 20 bp, human
gatctcaaaggacccttgag

SEQ ID NO: 363111 - DNA, 20 bp, human
gtccccaagagcactcaggc

SEQ ID NO: 363112 - DNA, 20 bp, human
gagcccttacacaggcacta

SEQ ID NO: 363113 - DNA, 20 bp, human
gctccagcctgagtgctctt

SEQ ID NO: 363114 - DNA, 20 bp, human
gcctgcgaaagaggaactcc

SEQ ID NO: 363115 - DNA, 20 bp, human
gcaacctgaccaatctcagc

SEQ ID NO: 363116 - DNA, 20 bp, human
gaatacttaggacccttgag

SEQ ID NO: 363117 - DNA, 20 bp, human
gttgaggggagcacagaacc

SEQ ID NO: 363118 - DNA, 20 bp, human
gtcaggctgcaggaatactt

SEQ ID NO: 363119 - DNA, 20 bp, human
ggtcacccactctgcactca

SEQ ID NO: 363120 - DNA, 20 bp, human
ggtggtagagctctcagggg

SEQ ID NO: 363121 - DNA, 20 bp, human
gcctggtaaagaaaaatacc

SEQ ID NO: 363122 - DNA, 20 bp, human
ggcagcacctggaaggtcat

SEQ ID NO: 363123 - DNA, 20 bp, human
gagaaatgcctcactggcta

SEQ ID NO: 363124 - DNA, 20 bp, human
gtgcagcctgagtgttctgc

SEQ ID NO: 363125 - DNA, 20 bp, human
ggacactggctgggggtcct

SEQ ID NO: 363126 - DNA, 20 bp, human
ggtgggatcaagcacctgga

SEQ ID NO: 363127 - DNA, 20 bp, human
gacgccccgcccagctataa

SEQ ID NO: 363128 - DNA, 20 bp, human
gaggcttgagagcccctggt

SEQ ID NO: 363129 - DNA, 20 bp, human
gggatgggaggggaacaccc

SEQ ID NO: 363130 - DNA, 20 bp, human
gggaacatgggagtctgggc

SEQ ID NO: 363131 - DNA, 20 bp, human
ggaggtgggaccaggtatgg

SEQ ID NO: 363132 - DNA, 20 bp, human
gagagcaaagacaaacactg

SEQ ID NO: 363133 - DNA, 20 bp, human
gacaggccatcagccaggac

SEQ ID NO: 363134 - DNA, 20 bp, human
gcaggaacaggccatcagcc

SEQ ID NO: 363135 - DNA, 20 bp, human
ggagcattgctcaagagtag

SEQ ID NO: 363136 - DNA, 20 bp, human
gcctcagggaagaccatctc

SEQ ID NO: 363137 - DNA, 20 bp, human
gtggtcttccctgaggggaa

SEQ ID NO: 363138 - DNA, 20 bp, human
gcagcaccctgggggattag

SEQ ID NO: 363139 - DNA, 20 bp, human
gtggctgtgctattgagctc

SEQ ID NO: 363140 - DNA, 20 bp, human
gtaagtagttgggcacatgt

SEQ ID NO: 363141 - DNA, 20 bp, human
ggtaggggcccttcccctca

SEQ ID NO: 363142 - DNA, 20 bp, human
ggacacgatgaggaagttcc

SEQ ID NO: 363143 - DNA, 20 bp, human
ggtggaggacacatgagtgg

SEQ ID NO: 363144 - DNA, 20 bp, human
gccctaaaggggccatttcc

SEQ ID NO: 363145 - DNA, 20 bp, human
ggccaaggagttaagtagtt

SEQ ID NO: 363146 - DNA, 20 bp, human
gcccctgtgagagcccccaa

SEQ ID NO: 363147 - DNA, 20 bp, human
gggcccttgggggctctcac

SEQ ID NO: 363148 - DNA, 20 bp, human
gcacgccaggaagacaccca

SEQ ID NO: 363149 - DNA, 20 bp, human
gtctgggcttcggttctgga

SEQ ID NO: 363150 - DNA, 20 bp, human
gagaagtgcagatggcccga

SEQ ID NO: 363151 - DNA, 20 bp, human
gtgtgtgccagccaagccct

SEQ ID NO: 363152 - DNA, 20 bp, human
gcaaggaaggcaggcacgcc

SEQ ID NO: 363153 - DNA, 20 bp, human
gtggagggccaggaacaaac

SEQ ID NO: 363154 - DNA, 20 bp, human
gcatctgcacttctcaccat

SEQ ID NO: 363155 - DNA, 20 bp, human
gccacctgaaaggttcaggg

SEQ ID NO: 363156 - DNA, 20 bp, human
gtggcaggtttccagaacgc

SEQ ID NO: 363157 - DNA, 20 bp, human
gggtttccagaacgcaggtg

SEQ ID NO: 363158 - DNA, 20 bp, human
ggttctgcaaactatagtga

SEQ ID NO: 363159 - DNA, 20 bp, human
gggaatacctgggcaggggt

SEQ ID NO: 363160 - DNA, 20 bp, human
gcatgtgggggcagcagcta

SEQ ID NO: 363161 - DNA, 20 bp, human
gcttatccccacctgcgttc

SEQ ID NO: 363162 - DNA, 20 bp, human
gggcagtgctgttgagacaa

SEQ ID NO: 363163 - DNA, 20 bp, human
ggacctacagcgattgcaaa

SEQ ID NO: 363164 - DNA, 20 bp, human
gtgcagctctgtgaattaag

SEQ ID NO: 363165 - DNA, 20 bp, human
gaaactcccttcaagaagtg

SEQ ID NO: 363166 - DNA, 20 bp, human
gaagccagaagcggagtcgc

SEQ ID NO: 363167 - DNA, 20 bp, human
gcccacaccaccgtgaggat

SEQ ID NO: 363168 - DNA, 20 bp, human
gaccgcgccccgggtccaag

SEQ ID NO: 363169 - DNA, 20 bp, human
ggacccgggcctggacccgg

SEQ ID NO: 363170 - DNA, 20 bp, human
gtccgggcccgggagctacg

SEQ ID NO: 363171 - DNA, 20 bp, human
gtccaagcccatcctcacgg

SEQ ID NO: 363172 - DNA, 20 bp, human
gcctgggcctcgtagctccc

SEQ ID NO: 363173 - DNA, 20 bp, human
gtcctcttggacccggggcg

SEQ ID NO: 363174 - DNA, 20 bp, human
gagagccccacaccaccgtg

SEQ ID NO: 363175 - DNA, 20 bp, human
gggacccgccctccgggtcc

SEQ ID NO: 363176 - DNA, 20 bp, human
gagcccgcccactgcgtggg

SEQ ID NO: 363177 - DNA, 20 bp, human
gtgcgtgcgagggacgtcgg

SEQ ID NO: 363178 - DNA, 20 bp, human
gaaggcgcccgcccacgcag

SEQ ID NO: 363179 - DNA, 20 bp, human
gcgcccgcccacgcagtggg

SEQ ID NO: 363180 - DNA, 20 bp, human
gttaccaggggcaactgctg

SEQ ID NO: 363181 - DNA, 20 bp, human
gcgccggctcgcctggacca

SEQ ID NO: 363182 - DNA, 20 bp, human
gtggagaaagcctgcccacg

SEQ ID NO: 363183 - DNA, 20 bp, human
gagagtgcgcaagtgcgcta

SEQ ID NO: 363184 - DNA, 20 bp, human
gcacgcagtgggcgggctac

SEQ ID NO: 363185 - DNA, 20 bp, human
gaggccgccgccggctcgcc

SEQ ID NO: 363186 - DNA, 20 bp, human
gccacctcggggatcagttc

SEQ ID NO: 363187 - DNA, 20 bp, human
gggctctgggaagcagctta

SEQ ID NO: 363188 - DNA, 20 bp, human
ggaggcgatgcccccagcct

SEQ ID NO: 363189 - DNA, 20 bp, human
ggggccagaactgatccccg

SEQ ID NO: 363190 - DNA, 20 bp, human
gcccgaggtgggattggctc

SEQ ID NO: 363191 - DNA, 20 bp, human
gcgcaggtgggcggtgtgga

SEQ ID NO: 363192 - DNA, 20 bp, human
ggggcggtgggtgtcattcg

SEQ ID NO: 363193 - DNA, 20 bp, human
gtgacgccgaccagcaggga

SEQ ID NO: 363194 - DNA, 20 bp, human
ggatactggggtaggagccc

SEQ ID NO: 363195 - DNA, 20 bp, human
ggattggcagaacctgaggg

SEQ ID NO: 363196 - DNA, 20 bp, human
gcctccgcgcagcgtgggtg

SEQ ID NO: 363197 - DNA, 20 bp, human
ggaggctgcgggaattgggc

SEQ ID NO: 363198 - DNA, 20 bp, human
gaaaccccacccacgctgcg

SEQ ID NO: 363199 - DNA, 20 bp, human
ggcgcggaggctgcgggaat

SEQ ID NO: 363200 - DNA, 20 bp, human
gccgaccaggcacaaagggg

SEQ ID NO: 363201 - DNA, 20 bp, human
gggtcccagagcttctctga

SEQ ID NO: 363202 - DNA, 20 bp, human
gaccaggcacaaaggggtgg

SEQ ID NO: 363203 - DNA, 20 bp, human
gccacaccagcgaccaggtg

SEQ ID NO: 363204 - DNA, 20 bp, human
gcgcagcctccgcgcagcgt

SEQ ID NO: 363205 - DNA, 20 bp, human
ggaggccgaccaggcacaaa

SEQ ID NO: 363206 - DNA, 20 bp, human
gagacggcccggctccccaa

SEQ ID NO: 363207 - DNA, 20 bp, human
gcggaacagtgggcgcgcaa

SEQ ID NO: 363208 - DNA, 20 bp, human
ggtcccgtgtcacagcgcct

SEQ ID NO: 363209 - DNA, 20 bp, human
gtccccaaaggtgcggagca

SEQ ID NO: 363210 - DNA, 20 bp, human
gttgggaggacgtggcccgt

SEQ ID NO: 363211 - DNA, 20 bp, human
ggcgctgtgacacgggacgt

SEQ ID NO: 363212 - DNA, 20 bp, human
gccccgaggcgctgtgacac

SEQ ID NO: 363213 - DNA, 20 bp, human
gcgcacgttgggctcaatga

SEQ ID NO: 363214 - DNA, 20 bp, human
gccatcggagggattttcga

SEQ ID NO: 363215 - DNA, 20 bp, human
gcccgggcccggcgcgacta

SEQ ID NO: 363216 - DNA, 20 bp, human
ggggaggcgcaaggcgttgt

SEQ ID NO: 363217 - DNA, 20 bp, human
gcgctcgctgcggttgatta

SEQ ID NO: 363218 - DNA, 20 bp, human
gcacagctgcctctcccgat

SEQ ID NO: 363219 - DNA, 20 bp, human
gcgcttacaaccgtagactg

SEQ ID NO: 363220 - DNA, 20 bp, human
gttgcgcctcccgctcgctg

SEQ ID NO: 363221 - DNA, 20 bp, human
gcgcaactctccgcagtcta

SEQ ID NO: 363222 - DNA, 20 bp, human
gacagcgactacagcatcgg

SEQ ID NO: 363223 - DNA, 20 bp, human
ggcgggcaccgagacctctc

SEQ ID NO: 363224 - DNA, 20 bp, human
ggcgttgcaaggtgcaaggt

SEQ ID NO: 363225 - DNA, 20 bp, human
ggagttgcggccgtccggag

SEQ ID NO: 363226 - DNA, 20 bp, human
gagaaccattagagttttaa

SEQ ID NO: 363227 - DNA, 20 bp, human
ggggacaatgagtgcgagga

SEQ ID NO: 363228 - DNA, 20 bp, human
gggatgagctgggaactcag

SEQ ID NO: 363229 - DNA, 20 bp, human
gactggaggggacggttgga

SEQ ID NO: 363230 - DNA, 20 bp, human
gagggtgtctatcccagatt

SEQ ID NO: 363231 - DNA, 20 bp, human
ggaggcaatagcctggacga

SEQ ID NO: 363232 - DNA, 20 bp, human
gctggagcatgcaccaaatc

SEQ ID NO: 363233 - DNA, 20 bp, human
gaacactgtggccactggag

SEQ ID NO: 363234 - DNA, 20 bp, human
gccagctcatccccagttgg

SEQ ID NO: 363235 - DNA, 20 bp, human
gaaagcacgcaggggctaag

SEQ ID NO: 363236 - DNA, 20 bp, human
gtgcccagtggtcaagacat

SEQ ID NO: 363237 - DNA, 20 bp, human
gtggtcaagacataggctgt

SEQ ID NO: 363238 - DNA, 20 bp, human
gcagaaagctctatggggcc

SEQ ID NO: 363239 - DNA, 20 bp, human
ggactcagacacatgatgca

SEQ ID NO: 363240 - DNA, 20 bp, human
ggagtctctccccacataag

SEQ ID NO: 363241 - DNA, 20 bp, human
gagcctatgtcttgaccact

SEQ ID NO: 363242 - DNA, 20 bp, human
gttggccgttgagcaaacta

SEQ ID NO: 363243 - DNA, 20 bp, human
gacaaacagaaagctctatg

SEQ ID NO: 363244 - DNA, 20 bp, human
gcatgccttagtttgctcaa

SEQ ID NO: 363245 - DNA, 20 bp, human
gctgtgggtgtagacagcct

SEQ ID NO: 363246 - DNA, 20 bp, human
ggggccagaaggggcctatg

SEQ ID NO: 363247 - DNA, 20 bp, human
ggacccgcatcccagccctg

SEQ ID NO: 363248 - DNA, 20 bp, human
ggccaaggtcctaggtgcag

SEQ ID NO: 363249 - DNA, 20 bp, human
gaggggcgggcacagtcggg

SEQ ID NO: 363250 - DNA, 20 bp, human
gggtggagcggaatccccat

SEQ ID NO: 363251 - DNA, 20 bp, human
gagagcctcacagctccgga

SEQ ID NO: 363252 - DNA, 20 bp, human
ggctgggatgcgggtcgtca

SEQ ID NO: 363253 - DNA, 20 bp, human
gatgcgggtcgtcagggatg

SEQ ID NO: 363254 - DNA, 20 bp, human
gtcagcgatggggaacaaag

SEQ ID NO: 363255 - DNA, 20 bp, human
gaatccccataggccccttc

SEQ ID NO: 363256 - DNA, 20 bp, human
gagcgctgttgcaggggagt

SEQ ID NO: 363257 - DNA, 20 bp, human
gcagcccagtagctgtgagt

SEQ ID NO: 363258 - DNA, 20 bp, human
ggggcctgcacacactcagc

SEQ ID NO: 363259 - DNA, 20 bp, human
gtggggcagcttctgagcgc

SEQ ID NO: 363260 - DNA, 20 bp, human
gtcccctgcaacagcgctca

SEQ ID NO: 363261 - DNA, 20 bp, human
gaaacacatgtgtcaagcac

SEQ ID NO: 363262 - DNA, 20 bp, human
gcgtactccgtacttcaata

SEQ ID NO: 363263 - DNA, 20 bp, human
gatctagcactacagagcag

SEQ ID NO: 363264 - DNA, 20 bp, human
gggactggcaagagctcagg

SEQ ID NO: 363265 - DNA, 20 bp, human
ggcagaggctgtgtggagaa

SEQ ID NO: 363266 - DNA, 20 bp, human
gtgctccgcgggctaggggg

SEQ ID NO: 363267 - DNA, 20 bp, human
ggggagtacgggattaccga

SEQ ID NO: 363268 - DNA, 20 bp, human
ggcagtggcccgccgctaga

SEQ ID NO: 363269 - DNA, 20 bp, human
gaaatcccagcgtgctccgc

SEQ ID NO: 363270 - DNA, 20 bp, human
gcctcggtgcaacctatata

SEQ ID NO: 363271 - DNA, 20 bp, human
gcagcgtgctccgcgggcta

SEQ ID NO: 363272 - DNA, 20 bp, human
gcccgtactccctctagcgg

SEQ ID NO: 363273 - DNA, 20 bp, human
ggggaggggagaatcgagga

SEQ ID NO: 363274 - DNA, 20 bp, human
gggtacacgcgcttcaactt

SEQ ID NO: 363275 - DNA, 20 bp, human
gcccgccgctagagggagta

SEQ ID NO: 363276 - DNA, 20 bp, human
gaggggatgaaacatgagac

SEQ ID NO: 363277 - DNA, 20 bp, human
gaagcttcagcaactgtccc

SEQ ID NO: 363278 - DNA, 20 bp, human
gcgtctgttgctaatgtgag

SEQ ID NO: 363279 - DNA, 20 bp, human
gcgtgagagccctttctcca

SEQ ID NO: 363280 - DNA, 20 bp, human
ggcccaaaaaattttaagtg

SEQ ID NO: 363281 - DNA, 20 bp, human
gcatgcgaagagctgtgtcc

SEQ ID NO: 363282 - DNA, 20 bp, human
gagcagaaaacttctaagac

SEQ ID NO: 363283 - DNA, 20 bp, human
gtggtaatatgccgttcatt

SEQ ID NO: 363284 - DNA, 20 bp, human
gtatcaacattagtttctaa

SEQ ID NO: 363285 - DNA, 20 bp, human
gttttgtaagaagaagagtt

SEQ ID NO: 363286 - DNA, 20 bp, human
gcctgtgtccggaatccact

SEQ ID NO: 363287 - DNA, 20 bp, human
gttaaagcctgccctgtgtc

SEQ ID NO: 363288 - DNA, 20 bp, human
gtccccttagtgttggctgt

SEQ ID NO: 363289 - DNA, 20 bp, human
gttcccacagccaacactaa

SEQ ID NO: 363290 - DNA, 20 bp, human
ggccagtaaaacagcgaagc

SEQ ID NO: 363291 - DNA, 20 bp, human
gagagaaatccccttagtgt

SEQ ID NO: 363292 - DNA, 20 bp, human
gcccagcgatagtatttgtc

SEQ ID NO: 363293 - DNA, 20 bp, human
gattgtcacctagtggattc

SEQ ID NO: 363294 - DNA, 20 bp, human
gtaaaatgattgtcacctag

SEQ ID NO: 363295 - DNA, 20 bp, human
gtccagacaaatactatcgc

SEQ ID NO: 363296 - DNA, 20 bp, human
ggtgacaagcgggaggcgat

SEQ ID NO: 363297 - DNA, 20 bp, human
ggggaagtgcgtcaccaggt

SEQ ID NO: 363298 - DNA, 20 bp, human
gtctcctgacacaatacccc

SEQ ID NO: 363299 - DNA, 20 bp, human
ggcccgagattagttatcaa

SEQ ID NO: 363300 - DNA, 20 bp, human
gttaaggagacgacgaggag

SEQ ID NO: 363301 - DNA, 20 bp, human
gggtccaaagctgaagggat

SEQ ID NO: 363302 - DNA, 20 bp, human
ggacgcggtccaaagctgaa

SEQ ID NO: 363303 - DNA, 20 bp, human
ggcccttgataactaatctc

SEQ ID NO: 363304 - DNA, 20 bp, human
gtaagcttaaggagacgacg

SEQ ID NO: 363305 - DNA, 20 bp, human
gggttctgtgtgctctccgg

SEQ ID NO: 363306 - DNA, 20 bp, human
gcggggctcgccctctcaat

SEQ ID NO: 363307 - DNA, 20 bp, human
gccgcctcgcggtttgctgg

SEQ ID NO: 363308 - DNA, 20 bp, human
gtagccgccagcaaaccgcg

SEQ ID NO: 363309 - DNA, 20 bp, human
ggggcgaggggcgaggcgaa

SEQ ID NO: 363310 - DNA, 20 bp, human
gcctgcgcgacagtgagaag

SEQ ID NO: 363311 - DNA, 20 bp, human
gggttctgtccccattgaga

SEQ ID NO: 363312 - DNA, 20 bp, human
gggccgttatcagtctccat

SEQ ID NO: 363313 - DNA, 20 bp, human
gggggcgcgaggaccgcccg

SEQ ID NO: 363314 - DNA, 20 bp, human
gcacccgccgggaagcgctt

SEQ ID NO: 363315 - DNA, 20 bp, human
gcaggagagagagaacgcgc

SEQ ID NO: 363316 - DNA, 20 bp, human
gaggaacgtggcattcaggt

SEQ ID NO: 363317 - DNA, 20 bp, human
ggctctgtggcatgcattcc

SEQ ID NO: 363318 - DNA, 20 bp, human
gcaggtcggagggttctacg

SEQ ID NO: 363319 - DNA, 20 bp, human
gaacgtggcattcaggtcgg

SEQ ID NO: 363320 - DNA, 20 bp, human
gctgaatgccacgttcctcc

SEQ ID NO: 363321 - DNA, 20 bp, human
gctgtggcatgcattccggg

SEQ ID NO: 363322 - DNA, 20 bp, human
gtcgcaatggggagaataaa

SEQ ID NO: 363323 - DNA, 20 bp, human
ggctccacccatcacgtatc

SEQ ID NO: 363324 - DNA, 20 bp, human
gcaaccggatacgtgatggg

SEQ ID NO: 363325 - DNA, 20 bp, human
gtctgagtgatgtcgcaatg

SEQ ID NO: 363326 - DNA, 20 bp, human
gtcagagagtcccccaggca

SEQ ID NO: 363327 - DNA, 20 bp, human
gtggacctgaattaccaagc

SEQ ID NO: 363328 - DNA, 20 bp, human
gcacacactggctcctggat

SEQ ID NO: 363329 - DNA, 20 bp, human
ggactcagcggagggaatca

SEQ ID NO: 363330 - DNA, 20 bp, human
ggcagccagcttggtaattc

SEQ ID NO: 363331 - DNA, 20 bp, human
gtggttaattagtaactgga

SEQ ID NO: 363332 - DNA, 20 bp, human
ggaactgccgcactctctca

SEQ ID NO: 363333 - DNA, 20 bp, human
gggtggcccccattagggaa

SEQ ID NO: 363334 - DNA, 20 bp, human
gccagtggttaattagtaac

SEQ ID NO: 363335 - DNA, 20 bp, human
gcccgaagccagcttccagc

SEQ ID NO: 363336 - DNA, 20 bp, human
gtcagcccgcgccaagtctg

SEQ ID NO: 363337 - DNA, 20 bp, human
gcggcggtctcctaccccca

SEQ ID NO: 363338 - DNA, 20 bp, human
ggcggcggcagggactgcgg

SEQ ID NO: 363339 - DNA, 20 bp, human
gctggggcgggcggcgtcac

SEQ ID NO: 363340 - DNA, 20 bp, human
gtgcgcctgccgctcccacc

SEQ ID NO: 363341 - DNA, 20 bp, human
ggggagcggcaggcgcaagc

SEQ ID NO: 363342 - DNA, 20 bp, human
ggggcgggcggcgtcaccgg

SEQ ID NO: 363343 - DNA, 20 bp, human
gcgggtggcagctgtgagcg

SEQ ID NO: 363344 - DNA, 20 bp, human
gcgggcggcgtcaccggagg

SEQ ID NO: 363345 - DNA, 20 bp, human
ggggtaggagaccgccgggt

SEQ ID NO: 363346 - DNA, 20 bp, human
ggatgggctgcagatatttg

SEQ ID NO: 363347 - DNA, 20 bp, human
ggagactgatgagcaaaagt

SEQ ID NO: 363348 - DNA, 20 bp, human
gctagaaaagatctagttgg

SEQ ID NO: 363349 - DNA, 20 bp, human
gcaaactaaatctctaacct

SEQ ID NO: 363350 - DNA, 20 bp, human
ggatatttgtggcttgtagt

SEQ ID NO: 363351 - DNA, 20 bp, human
gcctcagttcacgtaggcta

SEQ ID NO: 363352 - DNA, 20 bp, human
gcacctagaaaagatctagt

SEQ ID NO: 363353 - DNA, 20 bp, human
ggttggaggtaaccaaagtg

SEQ ID NO: 363354 - DNA, 20 bp, human
gaatttcctaatagtaagaa

SEQ ID NO: 363355 - DNA, 20 bp, human
gaagtctgaaaaccacactt

SEQ ID NO: 363356 - DNA, 20 bp, human
gcaccggccacgcccgaata

SEQ ID NO: 363357 - DNA, 20 bp, human
gtgtggccgaagagctccga

SEQ ID NO: 363358 - DNA, 20 bp, human
gccaccggcagctccttcgg

SEQ ID NO: 363359 - DNA, 20 bp, human
gacacccccgaaggagctgc

SEQ ID NO: 363360 - DNA, 20 bp, human
ggggcgtggccggtggtgat

SEQ ID NO: 363361 - DNA, 20 bp, human
ggggctgaccgagccatatt

SEQ ID NO: 363362 - DNA, 20 bp, human
ggccacgcccgaatatggct

SEQ ID NO: 363363 - DNA, 20 bp, human
ggctcggtcagccccgccct

SEQ ID NO: 363364 - DNA, 20 bp, human
gtggccggtggtgattggtg

SEQ ID NO: 363365 - DNA, 20 bp, human
gccctggggctgcaccccac

SEQ ID NO: 363366 - DNA, 20 bp, human
ggtgggcccgtggtgttggg

SEQ ID NO: 363367 - DNA, 20 bp, human
gccactgcgggcggagcaga

SEQ ID NO: 363368 - DNA, 20 bp, human
gactctgctaatgacaaaag

SEQ ID NO: 363369 - DNA, 20 bp, human
gtggggcccaagaccggcgc

SEQ ID NO: 363370 - DNA, 20 bp, human
gcacaccaggtcatctctgt

SEQ ID NO: 363371 - DNA, 20 bp, human
gagatgacctggtgtgtgca

SEQ ID NO: 363372 - DNA, 20 bp, human
gaacaccacgggcccacccg

SEQ ID NO: 363373 - DNA, 20 bp, human
ggggtagcggccactgcggg

SEQ ID NO: 363374 - DNA, 20 bp, human
ggggttggcttggtgtaaac

SEQ ID NO: 363375 - DNA, 20 bp, human
gtctggcccgcgccggtctt

SEQ ID NO: 363376 - DNA, 20 bp, human
ggaaggggccaccctcagag

SEQ ID NO: 363377 - DNA, 20 bp, human
gtggcagctgcaggatgttc

SEQ ID NO: 363378 - DNA, 20 bp, human
gggatgttctgggttgatga

SEQ ID NO: 363379 - DNA, 20 bp, human
gactctggccccatgctgat

SEQ ID NO: 363380 - DNA, 20 bp, human
ggcagctgccactctgaggg

SEQ ID NO: 363381 - DNA, 20 bp, human
gatggggccagagtcacact

SEQ ID NO: 363382 - DNA, 20 bp, human
gacagtggagtgaggatcag

SEQ ID NO: 363383 - DNA, 20 bp, human
gggtttctgcagactggaag

SEQ ID NO: 363384 - DNA, 20 bp, human
gctcgtgtcacgcagcatca

SEQ ID NO: 363385 - DNA, 20 bp, human
gtctagtcctagtgtgactc

SEQ ID NO: 363386 - DNA, 20 bp, human
gggccgcagtgaacacccgg

SEQ ID NO: 363387 - DNA, 20 bp, human
gggctcctcccgggaccgag

SEQ ID NO: 363388 - DNA, 20 bp, human
gccggctcgggcagcggact

SEQ ID NO: 363389 - DNA, 20 bp, human
gggtcccgctcggtcccggg

SEQ ID NO: 363390 - DNA, 20 bp, human
gctcctccgggtgttcactg

SEQ ID NO: 363391 - DNA, 20 bp, human
gcgagcgggaccccgaacca

SEQ ID NO: 363392 - DNA, 20 bp, human
gtcggggtcccgctcggtcc

SEQ ID NO: 363393 - DNA, 20 bp, human
gtgggcccctaaaaacgctg

SEQ ID NO: 363394 - DNA, 20 bp, human
gcgggaagccgggccggctc

SEQ ID NO: 363395 - DNA, 20 bp, human
gccgctaggccttacttagt

SEQ ID NO: 363396 - DNA, 20 bp, human
ggggcctaggtcaaagaggt

SEQ ID NO: 363397 - DNA, 20 bp, human
gacagccgcgaggggagagt

SEQ ID NO: 363398 - DNA, 20 bp, human
ggcaccttaaacagccgcga

SEQ ID NO: 363399 - DNA, 20 bp, human
gccagccgactctcccctcg

SEQ ID NO: 363400 - DNA, 20 bp, human
gttaaggtgcagagaaggag

SEQ ID NO: 363401 - DNA, 20 bp, human
ggtgcccgttcctgctgccg

SEQ ID NO: 363402 - DNA, 20 bp, human
gccgcgccgtgggccgagtg

SEQ ID NO: 363403 - DNA, 20 bp, human
gcggcaacagagatcaatct

SEQ ID NO: 363404 - DNA, 20 bp, human
gctcccctcgcggctgttta

SEQ ID NO: 363405 - DNA, 20 bp, human
gagcgccagcgttgattcag

SEQ ID NO: 363406 - DNA, 20 bp, human
gcacccaacaccaccgtcgc

SEQ ID NO: 363407 - DNA, 20 bp, human
ggtcgccgagacccgaccgc

SEQ ID NO: 363408 - DNA, 20 bp, human
gccaggtggatgcccggatg

SEQ ID NO: 363409 - DNA, 20 bp, human
gggagcctgcggtcgggtct

SEQ ID NO: 363410 - DNA, 20 bp, human
ggtgacgtcgcctggcgggg

SEQ ID NO: 363411 - DNA, 20 bp, human
gtgcctgcgacggtggtgtt

SEQ ID NO: 363412 - DNA, 20 bp, human
gactttctaatcagagtcgt

SEQ ID NO: 363413 - DNA, 20 bp, human
gcagagtcgtggggatttta

SEQ ID NO: 363414 - DNA, 20 bp, human
gtctgattagaaagtcccgg

SEQ ID NO: 363415 - DNA, 20 bp, human
ggactctgattagaaagtcc

SEQ ID NO: 363416 - DNA, 20 bp, human
ggcggcacagtctgcgtgac

SEQ ID NO: 363417 - DNA, 20 bp, human
gctgtctcctgaagcgttga

SEQ ID NO: 363418 - DNA, 20 bp, human
ggccgctgctagggcaggaa

SEQ ID NO: 363419 - DNA, 20 bp, human
ggggcgggacgccgctgcta

SEQ ID NO: 363420 - DNA, 20 bp, human
ggttactaggaagtgaaagg

SEQ ID NO: 363421 - DNA, 20 bp, human
gtgccgcccccggctcgcct

SEQ ID NO: 363422 - DNA, 20 bp, human
ggcaagggagggcggttact

SEQ ID NO: 363423 - DNA, 20 bp, human
ggggacgccgctgctagggc

SEQ ID NO: 363424 - DNA, 20 bp, human
gggcaggaaggggcgtgccc

SEQ ID NO: 363425 - DNA, 20 bp, human
ggcggaccgccaccaacaca

SEQ ID NO: 363426 - DNA, 20 bp, human
gggcggctgtggtatcccga

SEQ ID NO: 363427 - DNA, 20 bp, human
gccgcctaccggccaggcag

SEQ ID NO: 363428 - DNA, 20 bp, human
gtaccacagccgccccagga

SEQ ID NO: 363429 - DNA, 20 bp, human
ggggcctccaatctcggcgg

SEQ ID NO: 363430 - DNA, 20 bp, human
gtctcaaccaggccgtcctg

SEQ ID NO: 363431 - DNA, 20 bp, human
gtctgcgcgcgatcggggtg

SEQ ID NO: 363432 - DNA, 20 bp, human
gtggttgagacattcactgg

SEQ ID NO: 363433 - DNA, 20 bp, human
gtgcgcgcggctggtagcag

SEQ ID NO: 363434 - DNA, 20 bp, human
gtgcgcgccgcctaccggcc

SEQ ID NO: 363435 - DNA, 20 bp, human
ggcctcgcccctcccggaaa

SEQ ID NO: 363436 - DNA, 20 bp, human
ggcttggcgctgaggatcgg

SEQ ID NO: 363437 - DNA, 20 bp, human
ggatcctcagcgccaagcca

SEQ ID NO: 363438 - DNA, 20 bp, human
gccacggccggatgcgctca

SEQ ID NO: 363439 - DNA, 20 bp, human
gggtccgccctgagcgcatc

SEQ ID NO: 363440 - DNA, 20 bp, human
gcggccgtggcttggcgctg

SEQ ID NO: 363441 - DNA, 20 bp, human
gcctgctggtggatattacc

SEQ ID NO: 363442 - DNA, 20 bp, human
gcccctcagggagcccgggt

SEQ ID NO: 363443 - DNA, 20 bp, human
gagcgcatccggccgtggct

SEQ ID NO: 363444 - DNA, 20 bp, human
gcgtacgccgcgacgcctgc

SEQ ID NO: 363445 - DNA, 20 bp, human
gattacccgggacctcaaag

SEQ ID NO: 363446 - DNA, 20 bp, human
gccctccgggacggagagaa

SEQ ID NO: 363447 - DNA, 20 bp, human
ggggcaggaccgcctgtaac

SEQ ID NO: 363448 - DNA, 20 bp, human
gaccgcctgtaactggacgg

SEQ ID NO: 363449 - DNA, 20 bp, human
gtacccaggaggttcaaagt

SEQ ID NO: 363450 - DNA, 20 bp, human
gtctccgtcccggagggctt

SEQ ID NO: 363451 - DNA, 20 bp, human
gagaggcgcagttcggagat

SEQ ID NO: 363452 - DNA, 20 bp, human
ggacgcgttgcgcaaggtgg

SEQ ID NO: 363453 - DNA, 20 bp, human
gacaaagtgctggaggactg

SEQ ID NO: 363454 - DNA, 20 bp, human
gcgacgcggaagatgactca

SEQ ID NO: 363455 - DNA, 20 bp, human
gaacttgggaattctccctg

SEQ ID NO: 363456 - DNA, 20 bp, human
ggggtccgcaggaatcgccg

SEQ ID NO: 363457 - DNA, 20 bp, human
gaatcgccggggacaggccg

SEQ ID NO: 363458 - DNA, 20 bp, human
gggccgcggggacccgggta

SEQ ID NO: 363459 - DNA, 20 bp, human
gccaagctgcatcgccgagt

SEQ ID NO: 363460 - DNA, 20 bp, human
gggtctggcgcgcacgtgac

SEQ ID NO: 363461 - DNA, 20 bp, human
gtccgcgctggcccccgcgt

SEQ ID NO: 363462 - DNA, 20 bp, human
gattcctgcggacccagctg

SEQ ID NO: 363463 - DNA, 20 bp, human
gctgtccccggcgattcctg

SEQ ID NO: 363464 - DNA, 20 bp, human
gggggagcggacagtggccg

SEQ ID NO: 363465 - DNA, 20 bp, human
gcgccgagtgggtgagtccg

SEQ ID NO: 363466 - DNA, 20 bp, human
gccggagggcgcccgacgtc

SEQ ID NO: 363467 - DNA, 20 bp, human
gggcgctggcgtggaggttg

SEQ ID NO: 363468 - DNA, 20 bp, human
ggctcctggcgcaggcgacc

SEQ ID NO: 363469 - DNA, 20 bp, human
gcggctgccccgccgagcgg

SEQ ID NO: 363470 - DNA, 20 bp, human
gcccgccctagggaagaggg

SEQ ID NO: 363471 - DNA, 20 bp, human
gccgcctcgggtcctgacgt

SEQ ID NO: 363472 - DNA, 20 bp, human
gcgtccctccctcttcccta

SEQ ID NO: 363473 - DNA, 20 bp, human
gccgccgagcggtggctttc

SEQ ID NO: 363474 - DNA, 20 bp, human
gggggccgagcgctgagtga

SEQ ID NO: 363475 - DNA, 20 bp, human
ggcgcgaaggctcctggcgc

SEQ ID NO: 363476 - DNA, 20 bp, human
ggaagtcaggggagcttcag

SEQ ID NO: 363477 - DNA, 20 bp, human
gagggccagcgctcacaatg

SEQ ID NO: 363478 - DNA, 20 bp, human
ggggttgcgcacagcgacgg

SEQ ID NO: 363479 - DNA, 20 bp, human
ggctgtgcgcaacccccctc

SEQ ID NO: 363480 - DNA, 20 bp, human
gcggcttcgcgccctccatg

SEQ ID NO: 363481 - DNA, 20 bp, human
gcgcctaggggcggcagacc

SEQ ID NO: 363482 - DNA, 20 bp, human
gtctcccgacgggacggaaa

SEQ ID NO: 363483 - DNA, 20 bp, human
ggcacccgctcccgcatgga

SEQ ID NO: 363484 - DNA, 20 bp, human
gcggccgggaaggaccttgt

SEQ ID NO: 363485 - DNA, 20 bp, human
ggccggacggggattcagag

SEQ ID NO: 363486 - DNA, 20 bp, human
gtggacgcgccccgcctagt

SEQ ID NO: 363487 - DNA, 20 bp, human
ggcgtggcggggcgtggcat

SEQ ID NO: 363488 - DNA, 20 bp, human
ggcggccgcgggtcatgctg

SEQ ID NO: 363489 - DNA, 20 bp, human
gtcccaagcttctcaggctg

SEQ ID NO: 363490 - DNA, 20 bp, human
ggctttgcgcccccatccca

SEQ ID NO: 363491 - DNA, 20 bp, human
ggcacccagtcagcgctcag

SEQ ID NO: 363492 - DNA, 20 bp, human
gcgttcccgcccactaggcg

SEQ ID NO: 363493 - DNA, 20 bp, human
gtgagaagcttgggacagta

SEQ ID NO: 363494 - DNA, 20 bp, human
gtggtgtggaccagcagtca

SEQ ID NO: 363495 - DNA, 20 bp, human
gcgcgccccgcctagtgggc

SEQ ID NO: 363496 - DNA, 20 bp, human
ggggaaccagctggttgtta

SEQ ID NO: 363497 - DNA, 20 bp, human
gggaatgaagcggtgcacgg

SEQ ID NO: 363498 - DNA, 20 bp, human
gaagtgacgcaacgtagagg

SEQ ID NO: 363499 - DNA, 20 bp, human
gctaatggaggccggaaatc

SEQ ID NO: 363500 - DNA, 20 bp, human
ggacctctgcgacctaatgg

SEQ ID NO: 363501 - DNA, 20 bp, human
gggaggccggaaatcgggtc

SEQ ID NO: 363502 - DNA, 20 bp, human
gaggaagtgacgcaacgtag

SEQ ID NO: 363503 - DNA, 20 bp, human
gctctagagcgggaatgaag

SEQ ID NO: 363504 - DNA, 20 bp, human
ggagtccaggtgtccaaacg

SEQ ID NO: 363505 - DNA, 20 bp, human
ggcaaaccagacccgatttc

SEQ ID NO: 363506 - DNA, 20 bp, human
gtggagctgccgcacgtggg

SEQ ID NO: 363507 - DNA, 20 bp, human
ggggcggggctggtaggcgc

SEQ ID NO: 363508 - DNA, 20 bp, human
gaggccggctcgagactccc

SEQ ID NO: 363509 - DNA, 20 bp, human
ggcgcccgggagtctcgagc

SEQ ID NO: 363510 - DNA, 20 bp, human
ggggccagacacgcgagctg

SEQ ID NO: 363511 - DNA, 20 bp, human
ggggccggacgcgagggctg

SEQ ID NO: 363512 - DNA, 20 bp, human
gcgagccggcctagccgcag

SEQ ID NO: 363513 - DNA, 20 bp, human
ggtggcctctgcggctaggc

SEQ ID NO: 363514 - DNA, 20 bp, human
ggcgtggagctgccgcacgt

SEQ ID NO: 363515 - DNA, 20 bp, human
gcagacacgcgagctggggc

SEQ ID NO: 363516 - DNA, 20 bp, human
gccctaaggccggttctcta

SEQ ID NO: 363517 - DNA, 20 bp, human
gggaaaccagcgagatgatg

SEQ ID NO: 363518 - DNA, 20 bp, human
ggaccccaggagaccgaaga

SEQ ID NO: 363519 - DNA, 20 bp, human
ggcgccggccccgctgtgga

SEQ ID NO: 363520 - DNA, 20 bp, human
gggactctatcccctaaggc

SEQ ID NO: 363521 - DNA, 20 bp, human
ggaaagaagcgggtgacctt

SEQ ID NO: 363522 - DNA, 20 bp, human
gaagacggtgtgaatctcgt

SEQ ID NO: 363523 - DNA, 20 bp, human
gcacgcggacaacgccacca

SEQ ID NO: 363524 - DNA, 20 bp, human
gcgtcctcccggaggaaatt

SEQ ID NO: 363525 - DNA, 20 bp, human
gtagagtagccgccgagcac

SEQ ID NO: 363526 - DNA, 20 bp, human
gagcagctgtcgcctcgctg

SEQ ID NO: 363527 - DNA, 20 bp, human
gtgagggcaggaggcttgag

SEQ ID NO: 363528 - DNA, 20 bp, human
gctgtcgcctcgctggggat

SEQ ID NO: 363529 - DNA, 20 bp, human
ggggaggaaaggtccatcct

SEQ ID NO: 363530 - DNA, 20 bp, human
gacccacaaggaggaactga

SEQ ID NO: 363531 - DNA, 20 bp, human
ggcgcctcggacccacaagg

SEQ ID NO: 363532 - DNA, 20 bp, human
gagagcgcctcggacccaca

SEQ ID NO: 363533 - DNA, 20 bp, human
gtcctcatgggggagatgag

SEQ ID NO: 363534 - DNA, 20 bp, human
gggcttggaagaagtcctca

SEQ ID NO: 363535 - DNA, 20 bp, human
ggggaaaggggagcacagaa

SEQ ID NO: 363536 - DNA, 20 bp, human
gtaccaatcccgctagtccg

SEQ ID NO: 363537 - DNA, 20 bp, human
gcgcgcgcgagtcggagatt

SEQ ID NO: 363538 - DNA, 20 bp, human
gcgcggctgccagggtcgga

SEQ ID NO: 363539 - DNA, 20 bp, human
gagtccgcggctgccagggt

SEQ ID NO: 363540 - DNA, 20 bp, human
gctggcgcgggtccggaaaa

SEQ ID NO: 363541 - DNA, 20 bp, human
gcaggagagccctccgaccc

SEQ ID NO: 363542 - DNA, 20 bp, human
gaatcgggtgggcacgtggt

SEQ ID NO: 363543 - DNA, 20 bp, human
gaggccggccgcgacagggg

SEQ ID NO: 363544 - DNA, 20 bp, human
ggtgggacgcgaaatcgggt

SEQ ID NO: 363545 - DNA, 20 bp, human
gggctctcctggcgcgggtc

SEQ ID NO: 363546 - DNA, 20 bp, human
gcatccccgtctgagtgcaa

SEQ ID NO: 363547 - DNA, 20 bp, human
ggggttcatacagagagggg

SEQ ID NO: 363548 - DNA, 20 bp, human
gacagggttcatacagagag

SEQ ID NO: 363549 - DNA, 20 bp, human
gtctgtatgaaccctgtgtt

SEQ ID NO: 363550 - DNA, 20 bp, human
gagtaatgcttctgttcttg

SEQ ID NO: 363551 - DNA, 20 bp, human
gacacccttgcactcagacg

SEQ ID NO: 363552 - DNA, 20 bp, human
ggttcgatcgagcttgccaa

SEQ ID NO: 363553 - DNA, 20 bp, human
gcataaggagttgatgatag

SEQ ID NO: 363554 - DNA, 20 bp, human
ggtatgaaccctgtgttggg

SEQ ID NO: 363555 - DNA, 20 bp, human
gtatgtggacccactacgta

SEQ ID NO: 363556 - DNA, 20 bp, human
ggagtcccacagaccgctag

SEQ ID NO: 363557 - DNA, 20 bp, human
gggagccttagccatggaat

SEQ ID NO: 363558 - DNA, 20 bp, human
gcacatgtgggccatttaga

SEQ ID NO: 363559 - DNA, 20 bp, human
gttcctgaatcttgtgaagc

SEQ ID NO: 363560 - DNA, 20 bp, human
ggtgatgctcatggctaggg

SEQ ID NO: 363561 - DNA, 20 bp, human
gaaagcagcggtgtgcttcc

SEQ ID NO: 363562 - DNA, 20 bp, human
gacatgtgactcacagaagt

SEQ ID NO: 363563 - DNA, 20 bp, human
gttcaggaaatgaggagggc

SEQ ID NO: 363564 - DNA, 20 bp, human
gggactatcatcaacttctt

SEQ ID NO: 363565 - DNA, 20 bp, human
gacagcccattccatggcta

SEQ ID NO: 363566 - DNA, 20 bp, human
ggggtgggacaatcgtctta

SEQ ID NO: 363567 - DNA, 20 bp, human
ggaaggtcaggcagcagtaa

SEQ ID NO: 363568 - DNA, 20 bp, human
ggtagatagcggtggtatag

SEQ ID NO: 363569 - DNA, 20 bp, human
gttacccacagccttagttc

SEQ ID NO: 363570 - DNA, 20 bp, human
ggggcagagaaagaatctgg

SEQ ID NO: 363571 - DNA, 20 bp, human
gtgagtcctcgccagaacta

SEQ ID NO: 363572 - DNA, 20 bp, human
ggatagcggtggtatagcgg

SEQ ID NO: 363573 - DNA, 20 bp, human
gacgcagctgtagatagcgg

SEQ ID NO: 363574 - DNA, 20 bp, human
gagcggtggtatagcggtgg

SEQ ID NO: 363575 - DNA, 20 bp, human
gaagttctagtttggggtga

SEQ ID NO: 363576 - DNA, 20 bp, human
ggcaccaagtagcacccctg

SEQ ID NO: 363577 - DNA, 20 bp, human
gagcggctagagaaaggcta

SEQ ID NO: 363578 - DNA, 20 bp, human
gcctgtgggtgacggagaga

SEQ ID NO: 363579 - DNA, 20 bp, human
gacacaaggcggggctcggg

SEQ ID NO: 363580 - DNA, 20 bp, human
gtgctggagcggctagagaa

SEQ ID NO: 363581 - DNA, 20 bp, human
gaaaggctagggcggagatg

SEQ ID NO: 363582 - DNA, 20 bp, human
gcacctgtaagtcagcacga

SEQ ID NO: 363583 - DNA, 20 bp, human
gcgccgggcgacacaaggcg

SEQ ID NO: 363584 - DNA, 20 bp, human
ggtgctgacttacaggtgag

SEQ ID NO: 363585 - DNA, 20 bp, human
gaagcctcaggggtgctact

SEQ ID NO: 363586 - DNA, 20 bp, human
gtggtcgtggctatatacaa

SEQ ID NO: 363587 - DNA, 20 bp, human
gggtgggcgtagtcattcgg

SEQ ID NO: 363588 - DNA, 20 bp, human
gtggctatatacaaggggag

SEQ ID NO: 363589 - DNA, 20 bp, human
gggcctgggaagttagtttg

SEQ ID NO: 363590 - DNA, 20 bp, human
ggaggtgtggtcaggtaact

SEQ ID NO: 363591 - DNA, 20 bp, human
gttcccagaccacacctagt

SEQ ID NO: 363592 - DNA, 20 bp, human
gggggcggtggcaaggtgga

SEQ ID NO: 363593 - DNA, 20 bp, human
gtggtgctcccctagtgggc

SEQ ID NO: 363594 - DNA, 20 bp, human
ggaaagcggtgcgatgcaga

SEQ ID NO: 363595 - DNA, 20 bp, human
gccctagtgggcggggtcta

SEQ ID NO: 363596 - DNA, 20 bp, human
ggaggcggaggggtgtgcta

SEQ ID NO: 363597 - DNA, 20 bp, human
ggctgcgcggagagctgctg

SEQ ID NO: 363598 - DNA, 20 bp, human
gtccctgccggtggagtagg

SEQ ID NO: 363599 - DNA, 20 bp, human
gacgctctccgcctcgaaca

SEQ ID NO: 363600 - DNA, 20 bp, human
ggagcgagaccgcaggcgga

SEQ ID NO: 363601 - DNA, 20 bp, human
ggggaagcgagcgttggagc

SEQ ID NO: 363602 - DNA, 20 bp, human
gcggagggccgtgttcgagg

SEQ ID NO: 363603 - DNA, 20 bp, human
gcgaggcgaggcggagttga

SEQ ID NO: 363604 - DNA, 20 bp, human
gctgctggggaagcgagcgt

SEQ ID NO: 363605 - DNA, 20 bp, human
gccttcccgacactgactga

SEQ ID NO: 363606 - DNA, 20 bp, human
gcccccgccccctgcggaga

SEQ ID NO: 363607 - DNA, 20 bp, human
gctccccaccctctccgcag

SEQ ID NO: 363608 - DNA, 20 bp, human
gccaccctctccgcaggggg

SEQ ID NO: 363609 - DNA, 20 bp, human
ggggactggcagctgcagat

SEQ ID NO: 363610 - DNA, 20 bp, human
ggtcccaggggcttgcggtc

SEQ ID NO: 363611 - DNA, 20 bp, human
gctgggacctggaaggtcta

SEQ ID NO: 363612 - DNA, 20 bp, human
gggagtcaggcctgtgtgca

SEQ ID NO: 363613 - DNA, 20 bp, human
ggtccctctcctgggtacag

SEQ ID NO: 363614 - DNA, 20 bp, human
gcaggccccctgacagctgt

SEQ ID NO: 363615 - DNA, 20 bp, human
gccagccaagagtggaactt

SEQ ID NO: 363616 - DNA, 20 bp, human
gccgccgcgcccacatgccg

SEQ ID NO: 363617 - DNA, 20 bp, human
gtggccgccagaagccgtcg

SEQ ID NO: 363618 - DNA, 20 bp, human
gcccgagctgcggtagtccg

SEQ ID NO: 363619 - DNA, 20 bp, human
gccagggccactcgtcggcg

SEQ ID NO: 363620 - DNA, 20 bp, human
gtgcgccccgccagtcaccc

SEQ ID NO: 363621 - DNA, 20 bp, human
gtgcgtggcctgcgcatctc

SEQ ID NO: 363622 - DNA, 20 bp, human
gcacatgccggggtgactgg

SEQ ID NO: 363623 - DNA, 20 bp, human
gcaggcggcccgagatgcgc

SEQ ID NO: 363624 - DNA, 20 bp, human
gacgcagcctcgccgacgag

SEQ ID NO: 363625 - DNA, 20 bp, human
gcgccagaagccgtcgggga

SEQ ID NO: 363626 - DNA, 20 bp, human
gggagagatcagttcccagc

SEQ ID NO: 363627 - DNA, 20 bp, human
gccaggtgatgccaagacat

SEQ ID NO: 363628 - DNA, 20 bp, human
gcgagtgatctgttagtgga

SEQ ID NO: 363629 - DNA, 20 bp, human
ggcaatctagtccttctcct

SEQ ID NO: 363630 - DNA, 20 bp, human
gagcttctggcaggctcctc

SEQ ID NO: 363631 - DNA, 20 bp, human
gtctggtctgtgtttgaaat

SEQ ID NO: 363632 - DNA, 20 bp, human
ggaaggaacccgcagagaga

SEQ ID NO: 363633 - DNA, 20 bp, human
gagatcagttcccagctggc

SEQ ID NO: 363634 - DNA, 20 bp, human
gatgccgtgcttggtgaccc

SEQ ID NO: 363635 - DNA, 20 bp, human
gacctggggttctgagacaa

SEQ ID NO: 363636 - DNA, 20 bp, human
ggcccggcgctccgcctgga

SEQ ID NO: 363637 - DNA, 20 bp, human
gagccgcggctcggatgacg

SEQ ID NO: 363638 - DNA, 20 bp, human
gggctcgcccggagctcaga

SEQ ID NO: 363639 - DNA, 20 bp, human
gcgtgagtggtggtcgtgga

SEQ ID NO: 363640 - DNA, 20 bp, human
gggaggcggtgcggtagccg

SEQ ID NO: 363641 - DNA, 20 bp, human
gagggcgggaggggctcgcc

SEQ ID NO: 363642 - DNA, 20 bp, human
gccgccgccaggtgatccgg

SEQ ID NO: 363643 - DNA, 20 bp, human
ggaagcgtgagtggtggtcg

SEQ ID NO: 363644 - DNA, 20 bp, human
gacccgtgagtgaggcgcgg

SEQ ID NO: 363645 - DNA, 20 bp, human
ggagaatgaagcgtgagtgg

SEQ ID NO: 363646 - DNA, 20 bp, human
gtccggagggccctcgggga

SEQ ID NO: 363647 - DNA, 20 bp, human
gtgtgtgtaagtgtgtccgg

SEQ ID NO: 363648 - DNA, 20 bp, human
gcaggtccggagggccctcg

SEQ ID NO: 363649 - DNA, 20 bp, human
gggcggggtctcggaagctg

SEQ ID NO: 363650 - DNA, 20 bp, human
ggtggtgctcccgtccccga

SEQ ID NO: 363651 - DNA, 20 bp, human
gcacccaaggccccgcccaa

SEQ ID NO: 363652 - DNA, 20 bp, human
gggcccactgtccagatcca

SEQ ID NO: 363653 - DNA, 20 bp, human
gccgcggcccactgcctgct

SEQ ID NO: 363654 - DNA, 20 bp, human
gcaggcagtgggccgcgggg

SEQ ID NO: 363655 - DNA, 20 bp, human
ggcgtggcgggtacatctca

SEQ ID NO: 363656 - DNA, 20 bp, human
gtgcagaagctgtcgggcaa

SEQ ID NO: 363657 - DNA, 20 bp, human
ggctaccgcgcgccaaccgt

SEQ ID NO: 363658 - DNA, 20 bp, human
ggcggagcgaaggggcggtg

SEQ ID NO: 363659 - DNA, 20 bp, human
gggcctaagcccagatagtg

SEQ ID NO: 363660 - DNA, 20 bp, human
gagcgaaggggcggtgcgga

SEQ ID NO: 363661 - DNA, 20 bp, human
ggggtagaagcctacgctca

SEQ ID NO: 363662 - DNA, 20 bp, human
gggcgcctacggttggcgcg

SEQ ID NO: 363663 - DNA, 20 bp, human
gcccaccttgagcaccgtga

SEQ ID NO: 363664 - DNA, 20 bp, human
ggggcgcgggcgcctacggt

SEQ ID NO: 363665 - DNA, 20 bp, human
ggaacacgaaccagcggctg

SEQ ID NO: 363666 - DNA, 20 bp, human
gggggctgtaacagggtaac

SEQ ID NO: 363667 - DNA, 20 bp, human
gcagagctggggctgtaaca

SEQ ID NO: 363668 - DNA, 20 bp, human
ggtagcaggagggtccggaa

SEQ ID NO: 363669 - DNA, 20 bp, human
gcagaaagagcgtagcagga

SEQ ID NO: 363670 - DNA, 20 bp, human
ggggaagcgccggcctgcgg

SEQ ID NO: 363671 - DNA, 20 bp, human
gtaacagggtaaccggctga

SEQ ID NO: 363672 - DNA, 20 bp, human
ggcggcgttggcgcagtcgt

SEQ ID NO: 363673 - DNA, 20 bp, human
gaacagcgcggagcaggtaa

SEQ ID NO: 363674 - DNA, 20 bp, human
gcccgcgcgcgggtttccat

SEQ ID NO: 363675 - DNA, 20 bp, human
gcaggccggcgcttcccagg

SEQ ID NO: 363676 - DNA, 20 bp, human
gaagtgagggaggagctctt

SEQ ID NO: 363677 - DNA, 20 bp, human
gccccaaggcatctctgcac

SEQ ID NO: 363678 - DNA, 20 bp, human
gagcacagcctggcctttta

SEQ ID NO: 363679 - DNA, 20 bp, human
gcgcgacaacagtccctaaa

SEQ ID NO: 363680 - DNA, 20 bp, human
ggatgccttggggccaaggg

SEQ ID NO: 363681 - DNA, 20 bp, human
gcaggaggcgaaagaagtga

SEQ ID NO: 363682 - DNA, 20 bp, human
gctctgcacaggtctccgat

SEQ ID NO: 363683 - DNA, 20 bp, human
gcaacagtccctaaaaggcc

SEQ ID NO: 363684 - DNA, 20 bp, human
ggtcgcgcgtttaaagtgat

SEQ ID NO: 363685 - DNA, 20 bp, human
gaccacctcagtctaggagg

SEQ ID NO: 363686 - DNA, 20 bp, human
gccaaaaccccggaaggaac

SEQ ID NO: 363687 - DNA, 20 bp, human
gtggaagctgctaaaggcgg

SEQ ID NO: 363688 - DNA, 20 bp, human
gcggtggaagctgctaaagg

SEQ ID NO: 363689 - DNA, 20 bp, human
gtaggggctgaaacagcggt

SEQ ID NO: 363690 - DNA, 20 bp, human
gaagctgctaaaggcggagg

SEQ ID NO: 363691 - DNA, 20 bp, human
gcagcgcttagagagctcgg

SEQ ID NO: 363692 - DNA, 20 bp, human
ggctcggtggaagctgctaa

SEQ ID NO: 363693 - DNA, 20 bp, human
gtccagcccaaaaccccgga

SEQ ID NO: 363694 - DNA, 20 bp, human
gaaacagcggttggcagaga

SEQ ID NO: 363695 - DNA, 20 bp, human
gcagttccagcccaaaaccc

SEQ ID NO: 363696 - DNA, 20 bp, human
ggatagaagcgcggtcagga

SEQ ID NO: 363697 - DNA, 20 bp, human
gcgtgttcgggatagaagcg

SEQ ID NO: 363698 - DNA, 20 bp, human
gcagtccaccagccactcca

SEQ ID NO: 363699 - DNA, 20 bp, human
gcgcccggccgcaggctgaa

SEQ ID NO: 363700 - DNA, 20 bp, human
gccgaacacgcgcaggtggc

SEQ ID NO: 363701 - DNA, 20 bp, human
gaacacgcgcaggtggctgg

SEQ ID NO: 363702 - DNA, 20 bp, human
gtcgggatagaagcgcggtc

SEQ ID NO: 363703 - DNA, 20 bp, human
gcacctcacagcttctgccc

SEQ ID NO: 363704 - DNA, 20 bp, human
gtacctgaagcaggcgggat

SEQ ID NO: 363705 - DNA, 20 bp, human
gtgcgggcacacatcgtctc

SEQ ID NO: 363706 - DNA, 20 bp, human
ggcgcgcctggtaaccgagg

SEQ ID NO: 363707 - DNA, 20 bp, human
ggggccgaaaaggacgatca

SEQ ID NO: 363708 - DNA, 20 bp, human
gacaccgccccgcacgccag

SEQ ID NO: 363709 - DNA, 20 bp, human
gcagaaggggcgccctgcgt

SEQ ID NO: 363710 - DNA, 20 bp, human
gccgccgccgtgctcgggag

SEQ ID NO: 363711 - DNA, 20 bp, human
gtgagctccagatcagggaa

SEQ ID NO: 363712 - DNA, 20 bp, human
gaaggggcctctggcgtgcg

SEQ ID NO: 363713 - DNA, 20 bp, human
ggatcagggcagccgcagaa

SEQ ID NO: 363714 - DNA, 20 bp, human
ggggcctctggcgtgcgggg

SEQ ID NO: 363715 - DNA, 20 bp, human
gcctggtaaccgagggggaa

SEQ ID NO: 363716 - DNA, 20 bp, human
gcgggcgcaggggcaggaat

SEQ ID NO: 363717 - DNA, 20 bp, human
gaggagccgggcacaacctg

SEQ ID NO: 363718 - DNA, 20 bp, human
gcggaagccggggaagagcg

SEQ ID NO: 363719 - DNA, 20 bp, human
ggccgtccacaggttgtgcc

SEQ ID NO: 363720 - DNA, 20 bp, human
gccggccgggggtcgcccgg

SEQ ID NO: 363721 - DNA, 20 bp, human
ggccggcggacacacagcag

SEQ ID NO: 363722 - DNA, 20 bp, human
gggcggacacacagcagcgg

SEQ ID NO: 363723 - DNA, 20 bp, human
gtggggcaggcaccccgcct

SEQ ID NO: 363724 - DNA, 20 bp, human
ggccgggcacaacctgtgga

SEQ ID NO: 363725 - DNA, 20 bp, human
gtacctgcttcccgccaccg

SEQ ID NO: 363726 - DNA, 20 bp, human
gggggccggtacctcagggt

SEQ ID NO: 363727 - DNA, 20 bp, human
ggggcggggccggtacctca

SEQ ID NO: 363728 - DNA, 20 bp, human
gaatcctggaggtccgagct

SEQ ID NO: 363729 - DNA, 20 bp, human
gccggcgggtcccgcaatcc

SEQ ID NO: 363730 - DNA, 20 bp, human
gcccccaggggcctcgtccc

SEQ ID NO: 363731 - DNA, 20 bp, human
ggcgggtcccgcaatcctgg

SEQ ID NO: 363732 - DNA, 20 bp, human
gcccgcccaccctgaggtac

SEQ ID NO: 363733 - DNA, 20 bp, human
gggaggtccgagctgggcgt

SEQ ID NO: 363734 - DNA, 20 bp, human
ggtgggcggggaactgcacg

SEQ ID NO: 363735 - DNA, 20 bp, human
gctcggacctccaggattgc

SEQ ID NO: 363736 - DNA, 20 bp, human
gaacccggatggtggatgag

SEQ ID NO: 363737 - DNA, 20 bp, human
ggtaggagttaaaacccgga

SEQ ID NO: 363738 - DNA, 20 bp, human
gggcaggagcagtggaaggt

SEQ ID NO: 363739 - DNA, 20 bp, human
gcctctgaccacaggatggg

SEQ ID NO: 363740 - DNA, 20 bp, human
gtggcctctgaccacaggat

SEQ ID NO: 363741 - DNA, 20 bp, human
gggaacaggaagtcccgggt

SEQ ID NO: 363742 - DNA, 20 bp, human
ggaaggtaggagttaaaacc

SEQ ID NO: 363743 - DNA, 20 bp, human
gaggtcctgaaagctgcctg

SEQ ID NO: 363744 - DNA, 20 bp, human
gggagttaaaacccggatgg

SEQ ID NO: 363745 - DNA, 20 bp, human
gcagaggtggccctgcgggg

SEQ ID NO: 363746 - DNA, 20 bp, human
gggcggggcgcggccgtctg

SEQ ID NO: 363747 - DNA, 20 bp, human
ggggcgcggccgtctgaggc

SEQ ID NO: 363748 - DNA, 20 bp, human
gtaccctggccggctccggg

SEQ ID NO: 363749 - DNA, 20 bp, human
gccggagctgaggccgcgga

SEQ ID NO: 363750 - DNA, 20 bp, human
gagggggtggtcccgcgccg

SEQ ID NO: 363751 - DNA, 20 bp, human
gtctgaggctggcgagcgtg

SEQ ID NO: 363752 - DNA, 20 bp, human
gtccaggcgggtatccagtc

SEQ ID NO: 363753 - DNA, 20 bp, human
ggccccaggggtcctcgcta

SEQ ID NO: 363754 - DNA, 20 bp, human
gtggtcccgcgcctgggcgg

SEQ ID NO: 363755 - DNA, 20 bp, human
gaaggccccgctaccctggc

SEQ ID NO: 363756 - DNA, 20 bp, human
gagcctacgctcagtgaccc

SEQ ID NO: 363757 - DNA, 20 bp, human
gaggaggggactcccgaaag

SEQ ID NO: 363758 - DNA, 20 bp, human
ggggagctggggttttgcga

SEQ ID NO: 363759 - DNA, 20 bp, human
gcggccggaggtatccgcat

SEQ ID NO: 363760 - DNA, 20 bp, human
gaaacaacgagcctcggagg

SEQ ID NO: 363761 - DNA, 20 bp, human
ggagctgctaagttacaagg

SEQ ID NO: 363762 - DNA, 20 bp, human
gctaagttacaagggggtgg

SEQ ID NO: 363763 - DNA, 20 bp, human
ggactgccgcggcagaaagg

SEQ ID NO: 363764 - DNA, 20 bp, human
ggcggcggagcagaggaaat

SEQ ID NO: 363765 - DNA, 20 bp, human
gcacaaacaacgagcctcgg

SEQ ID NO: 363766 - DNA, 20 bp, human
gctgatagttcataagtgtc

SEQ ID NO: 363767 - DNA, 20 bp, human
gtcttgaattgtgtcatggg

SEQ ID NO: 363768 - DNA, 20 bp, human
gttctttcctttaattaccc

SEQ ID NO: 363769 - DNA, 20 bp, human
gcctgaacctgggtaattaa

SEQ ID NO: 363770 - DNA, 20 bp, human
ggacttacaatcatgctgga

SEQ ID NO: 363771 - DNA, 20 bp, human
gctcatcttgaattgtgtca

SEQ ID NO: 363772 - DNA, 20 bp, human
gacagggtaatgagatagag

SEQ ID NO: 363773 - DNA, 20 bp, human
gaggagacttacaatcatgc

SEQ ID NO: 363774 - DNA, 20 bp, human
gcattcattatcacgagaac

SEQ ID NO: 363775 - DNA, 20 bp, human
gatgaagaaatacctgaacc

SEQ ID NO: 363776 - DNA, 20 bp, human
gccggcttgagagagagcgt

SEQ ID NO: 363777 - DNA, 20 bp, human
gcaagccgggcctcctcggg

SEQ ID NO: 363778 - DNA, 20 bp, human
gctctcaagccgggcctcct

SEQ ID NO: 363779 - DNA, 20 bp, human
gccggcctgctccacggagg

SEQ ID NO: 363780 - DNA, 20 bp, human
ggagagtaactggtgagaag

SEQ ID NO: 363781 - DNA, 20 bp, human
ggggagtgtgaggcctcccg

SEQ ID NO: 363782 - DNA, 20 bp, human
gatggtgccccacgttgctc

SEQ ID NO: 363783 - DNA, 20 bp, human
gtggtcgtttttggttggat

SEQ ID NO: 363784 - DNA, 20 bp, human
ggacggaaatcgagagtaac

SEQ ID NO: 363785 - DNA, 20 bp, human
gatggtctggaggcaaccta

SEQ ID NO: 363786 - DNA, 20 bp, human
gcacagctctccttcgttct

SEQ ID NO: 363787 - DNA, 20 bp, human
gctgttttaaccaagaacga

SEQ ID NO: 363788 - DNA, 20 bp, human
gagctggaatgtggccactc

SEQ ID NO: 363789 - DNA, 20 bp, human
gaagacttgattatctgctg

SEQ ID NO: 363790 - DNA, 20 bp, human
gaacactaatagtgaatttg

SEQ ID NO: 363791 - DNA, 20 bp, human
gtgcgtatctatatttacac

SEQ ID NO: 363792 - DNA, 20 bp, human
gcacatagttgataatttga

SEQ ID NO: 363793 - DNA, 20 bp, human
gaaattgaaacacatgttct

SEQ ID NO: 363794 - DNA, 20 bp, human
gaagctaaaagatggcttta

SEQ ID NO: 363795 - DNA, 20 bp, human
gacattccagctgtgcagac

SEQ ID NO: 363796 - DNA, 20 bp, human
gggaagaagggaactctcat

SEQ ID NO: 363797 - DNA, 20 bp, human
gctgggtggtagatagttaa

SEQ ID NO: 363798 - DNA, 20 bp, human
ggcttctaacagaatgggga

SEQ ID NO: 363799 - DNA, 20 bp, human
gcagaagcttctaacagaat

SEQ ID NO: 363800 - DNA, 20 bp, human
gactctcatgggtagaaagc

SEQ ID NO: 363801 - DNA, 20 bp, human
gacttctgaaatgttctggg

SEQ ID NO: 363802 - DNA, 20 bp, human
gtcgtcacaactgggaagaa

SEQ ID NO: 363803 - DNA, 20 bp, human
gttctgccaaccatgattca

SEQ ID NO: 363804 - DNA, 20 bp, human
gggaccgctctatgcattgt

SEQ ID NO: 363805 - DNA, 20 bp, human
gtcattccatgaatcatggt

SEQ ID NO: 363806 - DNA, 20 bp, human
gaccctgcggggctccggag

SEQ ID NO: 363807 - DNA, 20 bp, human
gggagacgccggggtcgcac

SEQ ID NO: 363808 - DNA, 20 bp, human
ggccgccgaggtgagcgcaa

SEQ ID NO: 363809 - DNA, 20 bp, human
gtgagcgcaagggcggggac

SEQ ID NO: 363810 - DNA, 20 bp, human
gccgccctgcggtctgtgat

SEQ ID NO: 363811 - DNA, 20 bp, human
ggctccgtgcacccgcccac

SEQ ID NO: 363812 - DNA, 20 bp, human
ggtctccggctcttagtgac

SEQ ID NO: 363813 - DNA, 20 bp, human
ggccgaggtgagcgcaaggg

SEQ ID NO: 363814 - DNA, 20 bp, human
gcgcgcccgtcactaagagc

SEQ ID NO: 363815 - DNA, 20 bp, human
gcctgcgcgggcccagtact

SEQ ID NO: 363816 - DNA, 20 bp, human
gcgtgcgcagacggggccgg

SEQ ID NO: 363817 - DNA, 20 bp, human
gacagaggcggcctctcccg

SEQ ID NO: 363818 - DNA, 20 bp, human
gtgcacgtgcgctcttcagc

SEQ ID NO: 363819 - DNA, 20 bp, human
gtgagcggggcgagcctaga

SEQ ID NO: 363820 - DNA, 20 bp, human
gagggcgcgcgtgcgcagac

SEQ ID NO: 363821 - DNA, 20 bp, human
gcaactgctacggcccctct

SEQ ID NO: 363822 - DNA, 20 bp, human
gccgctcaactcactgacag

SEQ ID NO: 363823 - DNA, 20 bp, human
ggcagcgccccctggagtcg

SEQ ID NO: 363824 - DNA, 20 bp, human
gggccggcaccggaagcgtg

SEQ ID NO: 363825 - DNA, 20 bp, human
ggggggcgctgcaactgcta

SEQ ID NO: 363826 - DNA, 20 bp, human
gcccaagcgcgggaacgccc

SEQ ID NO: 363827 - DNA, 20 bp, human
gcgggacaggaggacgtcct

SEQ ID NO: 363828 - DNA, 20 bp, human
ggtcctcggcccgctgacta

SEQ ID NO: 363829 - DNA, 20 bp, human
ggaagccccgccccaagcgc

SEQ ID NO: 363830 - DNA, 20 bp, human
gggcgccaactgcggggatg

SEQ ID NO: 363831 - DNA, 20 bp, human
gggaacaccaaccccgggac

SEQ ID NO: 363832 - DNA, 20 bp, human
gacgtcaagggcgggtgatg

SEQ ID NO: 363833 - DNA, 20 bp, human
ggatgctggcgccaactgcg

SEQ ID NO: 363834 - DNA, 20 bp, human
gctggcggatccctagtcag

SEQ ID NO: 363835 - DNA, 20 bp, human
ggggtgatgcggcctcttaa

SEQ ID NO: 363836 - DNA, 20 bp, human
gggcctgggaagctgggcgt

SEQ ID NO: 363837 - DNA, 20 bp, human
gccgcgcagaagaccggcct

SEQ ID NO: 363838 - DNA, 20 bp, human
gtgcgcggctcaagtagccc

SEQ ID NO: 363839 - DNA, 20 bp, human
gcccacgcttcattgttgcg

SEQ ID NO: 363840 - DNA, 20 bp, human
gcagcccattggccaagccg

SEQ ID NO: 363841 - DNA, 20 bp, human
gcattgttgcgtggagacct

SEQ ID NO: 363842 - DNA, 20 bp, human
gctagctctgagattgtcat

SEQ ID NO: 363843 - DNA, 20 bp, human
ggggcgtggggatgtcctgg

SEQ ID NO: 363844 - DNA, 20 bp, human
gagtgcttcttgctgggcgc

SEQ ID NO: 363845 - DNA, 20 bp, human
gtcgccgcggcttggccaat

SEQ ID NO: 363846 - DNA, 20 bp, human
ggcgccgccgcaatcctcaa

SEQ ID NO: 363847 - DNA, 20 bp, human
ggaggatgaaggcggggcga

SEQ ID NO: 363848 - DNA, 20 bp, human
gggtcagtcggctcggagaa

SEQ ID NO: 363849 - DNA, 20 bp, human
ggggacccgggtccacacgg

SEQ ID NO: 363850 - DNA, 20 bp, human
ggggcgagccggagatggac

SEQ ID NO: 363851 - DNA, 20 bp, human
gggggtcgcccgtccatctc

SEQ ID NO: 363852 - DNA, 20 bp, human
gaacggggaggatgaaggcg

SEQ ID NO: 363853 - DNA, 20 bp, human
ggaccccttgaggattgcgg

SEQ ID NO: 363854 - DNA, 20 bp, human
gaaggatgggtcagtcggct

SEQ ID NO: 363855 - DNA, 20 bp, human
gcccgcgggcgagccggaga

SEQ ID NO: 363856 - DNA, 20 bp, human
gaagccgggcggagtcggag

SEQ ID NO: 363857 - DNA, 20 bp, human
gcagtggggcggagctacat

SEQ ID NO: 363858 - DNA, 20 bp, human
ggggcgggacgggacggcag

SEQ ID NO: 363859 - DNA, 20 bp, human
ggcggagcgagagggcagtg

SEQ ID NO: 363860 - DNA, 20 bp, human
gaggccggcccaatccgcgg

SEQ ID NO: 363861 - DNA, 20 bp, human
ggggctggttggcggaagcc

SEQ ID NO: 363862 - DNA, 20 bp, human
gtggggcggagctacatggg

SEQ ID NO: 363863 - DNA, 20 bp, human
ggggcgggactggcgggaca

SEQ ID NO: 363864 - DNA, 20 bp, human
gctggttggcggaagccggg

SEQ ID NO: 363865 - DNA, 20 bp, human
gctggggagcaggttgtgct

SEQ ID NO: 363866 - DNA, 20 bp, human
ggagcctcgcggcagcgctg

SEQ ID NO: 363867 - DNA, 20 bp, human
ggccgcgcgtccccggcagg

SEQ ID NO: 363868 - DNA, 20 bp, human
gggcgtcagcccagccgctg

SEQ ID NO: 363869 - DNA, 20 bp, human
ggggcgtccctgcggctgag

SEQ ID NO: 363870 - DNA, 20 bp, human
gggctgccacccacccgcag

SEQ ID NO: 363871 - DNA, 20 bp, human
gtcagcccagccgctgcggg

SEQ ID NO: 363872 - DNA, 20 bp, human
ggtgcaggggcacgtggaga

SEQ ID NO: 363873 - DNA, 20 bp, human
ggcctgccccgacgcggccc

SEQ ID NO: 363874 - DNA, 20 bp, human
ggcgcggagaggggtgcctc

SEQ ID NO: 363875 - DNA, 20 bp, human
ggagtctcgcggcacttccc

SEQ ID NO: 363876 - DNA, 20 bp, human
gtcccgccggacccaccggg

SEQ ID NO: 363877 - DNA, 20 bp, human
ggctccggggggatcggcgc

SEQ ID NO: 363878 - DNA, 20 bp, human
gggaactggcggagcagagg

SEQ ID NO: 363879 - DNA, 20 bp, human
ggctccccttcgccgctctc

SEQ ID NO: 363880 - DNA, 20 bp, human
gaggtccggcccagggacgg

SEQ ID NO: 363881 - DNA, 20 bp, human
ggggtgtgtcccgtcggcga

SEQ ID NO: 363882 - DNA, 20 bp, human
gaggccggcggggagtcccc

SEQ ID NO: 363883 - DNA, 20 bp, human
gtgcgcgctgggctcgggtg

SEQ ID NO: 363884 - DNA, 20 bp, human
gtgtcccgtcggcgagggga

SEQ ID NO: 363885 - DNA, 20 bp, human
gcgggctccgtgcgccccgg

SEQ ID NO: 363886 - DNA, 20 bp, human
gcaccgcgcgcgaaccccgc

SEQ ID NO: 363887 - DNA, 20 bp, human
gccccgcccggcctttgtcc

SEQ ID NO: 363888 - DNA, 20 bp, human
ggaaccccgccggccacgtc

SEQ ID NO: 363889 - DNA, 20 bp, human
gtcggggccgggccctttaa

SEQ ID NO: 363890 - DNA, 20 bp, human
gggcgggggccggacgtggc

SEQ ID NO: 363891 - DNA, 20 bp, human
gcaccgggacaaaggccggg

SEQ ID NO: 363892 - DNA, 20 bp, human
gccaaactggcggtggatgg

SEQ ID NO: 363893 - DNA, 20 bp, human
gtcagcaccgggacaaaggc

SEQ ID NO: 363894 - DNA, 20 bp, human
gccgccccccttaaagggcc

SEQ ID NO: 363895 - DNA, 20 bp, human
gggggccggacgtggccggc

SEQ ID NO: 363896 - DNA, 20 bp, human
gccggcgcccggggcgcaag

SEQ ID NO: 363897 - DNA, 20 bp, human
gcgcccggggcgcaaggggg

SEQ ID NO: 363898 - DNA, 20 bp, human
ggggcccccaggggactacg

SEQ ID NO: 363899 - DNA, 20 bp, human
ggggaggaagggtccgtcca

SEQ ID NO: 363900 - DNA, 20 bp, human
ggaggaggccgggacgcagc

SEQ ID NO: 363901 - DNA, 20 bp, human
ggggaaggcgctgtggcgcg

SEQ ID NO: 363902 - DNA, 20 bp, human
ggggcgctgcaagagcctag

SEQ ID NO: 363903 - DNA, 20 bp, human
ggaggtgccgcgcccgctcc

SEQ ID NO: 363904 - DNA, 20 bp, human
ggtaccccgccggagcccgg

SEQ ID NO: 363905 - DNA, 20 bp, human
gccgggcgccggctgcgtcc

SEQ ID NO: 363906 - DNA, 20 bp, human
gggcagtgaaagcgttaaca

SEQ ID NO: 363907 - DNA, 20 bp, human
gtggtaagtaggcagcgccc

SEQ ID NO: 363908 - DNA, 20 bp, human
gtctgggaaaagattgtaag

SEQ ID NO: 363909 - DNA, 20 bp, human
gcaacaaaagcgtggtaagt

SEQ ID NO: 363910 - DNA, 20 bp, human
gaagcaattcagtaaactga

SEQ ID NO: 363911 - DNA, 20 bp, human
ggtgaaagcgttaacagggc

SEQ ID NO: 363912 - DNA, 20 bp, human
gtcagtcttactcatttcaa

SEQ ID NO: 363913 - DNA, 20 bp, human
gaactgcaacaacaaaagcg

SEQ ID NO: 363914 - DNA, 20 bp, human
gtggtcaagctatgaaaaca

SEQ ID NO: 363915 - DNA, 20 bp, human
gcttggatactacagaaaac

SEQ ID NO: 363916 - DNA, 20 bp, human
ggtcccctaggacatctcca

SEQ ID NO: 363917 - DNA, 20 bp, human
gcggccgcgagcacgtgcgc

SEQ ID NO: 363918 - DNA, 20 bp, human
ggagccctggagatgtccta

SEQ ID NO: 363919 - DNA, 20 bp, human
gggggtgcgcgcggaggtca

SEQ ID NO: 363920 - DNA, 20 bp, human
gacccccgcgcacgtgctcg

SEQ ID NO: 363921 - DNA, 20 bp, human
gcaggaccgttcctcttcct

SEQ ID NO: 363922 - DNA, 20 bp, human
gcggcacctccatgcgcccc

SEQ ID NO: 363923 - DNA, 20 bp, human
gcgactagcgagcaggccag

SEQ ID NO: 363924 - DNA, 20 bp, human
ggcgcatggaggtgccgcgg

SEQ ID NO: 363925 - DNA, 20 bp, human
gagaccagcggcaggaagtg

SEQ ID NO: 363926 - DNA, 20 bp, human
ggggcctgcctctccgtcac

SEQ ID NO: 363927 - DNA, 20 bp, human
gcccccaggctctgtagtag

SEQ ID NO: 363928 - DNA, 20 bp, human
gggaacagagatcagagctg

SEQ ID NO: 363929 - DNA, 20 bp, human
gtgcgcctgagggccggtga

SEQ ID NO: 363930 - DNA, 20 bp, human
ggtgtctgtgcagccgccct

SEQ ID NO: 363931 - DNA, 20 bp, human
ggctaatgatcaaccggctg

SEQ ID NO: 363932 - DNA, 20 bp, human
gttccccaatcccagcctgg

SEQ ID NO: 363933 - DNA, 20 bp, human
ggctctgtagtagaggctag

SEQ ID NO: 363934 - DNA, 20 bp, human
gcagctggacggagcaggca

SEQ ID NO: 363935 - DNA, 20 bp, human
ggtctccagctggacggagc

SEQ ID NO: 363936 - DNA, 20 bp, human
gaatgcgaggaatgtgctgc

SEQ ID NO: 363937 - DNA, 20 bp, human
gtccccaggcctgacagtgc

SEQ ID NO: 363938 - DNA, 20 bp, human
gctgtcaggcctggggaaca

SEQ ID NO: 363939 - DNA, 20 bp, human
gctgacagtgcaggagctgt

SEQ ID NO: 363940 - DNA, 20 bp, human
ggctgtagccgggatatcaa

SEQ ID NO: 363941 - DNA, 20 bp, human
gaagcgatctgctgagaggc

SEQ ID NO: 363942 - DNA, 20 bp, human
gcatgaagcgatctgctgag

SEQ ID NO: 363943 - DNA, 20 bp, human
ggctcctgcactgtcaggcc

SEQ ID NO: 363944 - DNA, 20 bp, human
gcctcctccctggcacacga

SEQ ID NO: 363945 - DNA, 20 bp, human
ggaatgtgctgcaggctgat

SEQ ID NO: 363946 - DNA, 20 bp, human
gcctacctgggcccattgga

SEQ ID NO: 363947 - DNA, 20 bp, human
gtctcggcgcctctgcgcgc

SEQ ID NO: 363948 - DNA, 20 bp, human
ggggctgcgggtcgcttgga

SEQ ID NO: 363949 - DNA, 20 bp, human
gtctgcgcgcgggaagatgg

SEQ ID NO: 363950 - DNA, 20 bp, human
gaccccgcggggctcaaggc

SEQ ID NO: 363951 - DNA, 20 bp, human
gcgcgggaagatggcggaac

SEQ ID NO: 363952 - DNA, 20 bp, human
ggcggctccaagcacggtgt

SEQ ID NO: 363953 - DNA, 20 bp, human
gcgcaggcgcgcggggcaag

SEQ ID NO: 363954 - DNA, 20 bp, human
ggccctgttggcgttggtgc

SEQ ID NO: 363955 - DNA, 20 bp, human
gagccccgcggggtccacgc

SEQ ID NO: 363956 - DNA, 20 bp, human
ggggcggagccggcggtggt

SEQ ID NO: 363957 - DNA, 20 bp, human
gtcaggatttggggactcgg

SEQ ID NO: 363958 - DNA, 20 bp, human
ggaggtggggaggagtggtg

SEQ ID NO: 363959 - DNA, 20 bp, human
gagcaagcaggggcggagtc

SEQ ID NO: 363960 - DNA, 20 bp, human
gtgctcccataccccgagga

SEQ ID NO: 363961 - DNA, 20 bp, human
gggggcggagtcaggatttg

SEQ ID NO: 363962 - DNA, 20 bp, human
gtcggggtatgggagcaagc

SEQ ID NO: 363963 - DNA, 20 bp, human
ggtatgggagcaagcagggg

SEQ ID NO: 363964 - DNA, 20 bp, human
gcgccgccctacacagagtg

SEQ ID NO: 363965 - DNA, 20 bp, human
ggcggggagctctctgggag

SEQ ID NO: 363966 - DNA, 20 bp, human
gcatacctggggccctcggc

SEQ ID NO: 363967 - DNA, 20 bp, human
gccagagggcggacacaagt

SEQ ID NO: 363968 - DNA, 20 bp, human
gacaatgtacagatcccaga

SEQ ID NO: 363969 - DNA, 20 bp, human
gctggcgctggaacacacgt

SEQ ID NO: 363970 - DNA, 20 bp, human
gaccaccagccgagggcccc

SEQ ID NO: 363971 - DNA, 20 bp, human
gtctggctcaagctccaggg

SEQ ID NO: 363972 - DNA, 20 bp, human
ggcacggtggacactggcgc

SEQ ID NO: 363973 - DNA, 20 bp, human
gtgtacattgtgcatacctg

SEQ ID NO: 363974 - DNA, 20 bp, human
gccaggggcacggtggacac

SEQ ID NO: 363975 - DNA, 20 bp, human
gtaagctgtggtcatccccg

SEQ ID NO: 363976 - DNA, 20 bp, human
ggtggtcagggcagcctagt

SEQ ID NO: 363977 - DNA, 20 bp, human
gcggacgcgggacggtggtc

SEQ ID NO: 363978 - DNA, 20 bp, human
gctggagccggtgaacggga

SEQ ID NO: 363979 - DNA, 20 bp, human
ggggcagcctagtgggagcg

SEQ ID NO: 363980 - DNA, 20 bp, human
ggccgcctggagccggtgaa

SEQ ID NO: 363981 - DNA, 20 bp, human
ggggccggtgtccaggacga

SEQ ID NO: 363982 - DNA, 20 bp, human
gactgggcacccagcgatcc

SEQ ID NO: 363983 - DNA, 20 bp, human
ggggagggggagttcggacg

SEQ ID NO: 363984 - DNA, 20 bp, human
gaaggtgggcatcacgcagt

SEQ ID NO: 363985 - DNA, 20 bp, human
gccagtctgggagtggtctg

SEQ ID NO: 363986 - DNA, 20 bp, human
gcgctcccgggacctccaat

SEQ ID NO: 363987 - DNA, 20 bp, human
gccacggaagcgcgctcgga

SEQ ID NO: 363988 - DNA, 20 bp, human
gtacggggtcgaccccccta

SEQ ID NO: 363989 - DNA, 20 bp, human
gcccacacgtcgcactaggt

SEQ ID NO: 363990 - DNA, 20 bp, human
gaagcaccggccacaactga

SEQ ID NO: 363991 - DNA, 20 bp, human
ggaagcgcgctcggaggggt

SEQ ID NO: 363992 - DNA, 20 bp, human
gtgggcgcgcccggaacccc

SEQ ID NO: 363993 - DNA, 20 bp, human
gcggaggggtgggacccggc

SEQ ID NO: 363994 - DNA, 20 bp, human
ggacacggcccgagggtctc

SEQ ID NO: 363995 - DNA, 20 bp, human
gccggtgtccggagaccctc

SEQ ID NO: 363996 - DNA, 20 bp, human
gcggagaggtgcgcccaccc

SEQ ID NO: 363997 - DNA, 20 bp, human
gacaacgcgcggggtcccgg

SEQ ID NO: 363998 - DNA, 20 bp, human
gaccccggccccgggcgcga

SEQ ID NO: 363999 - DNA, 20 bp, human
gctggcgcacggggctgaac

SEQ ID NO: 364000 - DNA, 20 bp, human
ggcgccctggggcaagaccc

SEQ ID NO: 364001 - DNA, 20 bp, human
gcggcgagctgcaagctagg

SEQ ID NO: 364002 - DNA, 20 bp, human
gccgcccatccccgcgagcc

SEQ ID NO: 364003 - DNA, 20 bp, human
gtgccctggcgccagcacca

SEQ ID NO: 364004 - DNA, 20 bp, human
gggcctgagtgtcacacacg

SEQ ID NO: 364005 - DNA, 20 bp, human
gcccctgtcggggttgagga

SEQ ID NO: 364006 - DNA, 20 bp, human
gacccctctggggatcaatg

SEQ ID NO: 364007 - DNA, 20 bp, human
gcaccccattgatccccaga

SEQ ID NO: 364008 - DNA, 20 bp, human
gcggcagtggaggatgatag

SEQ ID NO: 364009 - DNA, 20 bp, human
ggactcagctatcacccctc

SEQ ID NO: 364010 - DNA, 20 bp, human
ggtggaggatgatagtggag

SEQ ID NO: 364011 - DNA, 20 bp, human
gcagccttgcgtgtgggcgg

SEQ ID NO: 364012 - DNA, 20 bp, human
gtgacccttgacccctgccc

SEQ ID NO: 364013 - DNA, 20 bp, human
gaaaggttgcccggggagga

SEQ ID NO: 364014 - DNA, 20 bp, human
ggatgctacttgggacgcag

SEQ ID NO: 364015 - DNA, 20 bp, human
ggagggttaaaggttgcccg

SEQ ID NO: 364016 - DNA, 20 bp, human
gctgactcacaggctcagag

SEQ ID NO: 364017 - DNA, 20 bp, human
ggattactagttgtttgtat

SEQ ID NO: 364018 - DNA, 20 bp, human
gcaggagtacaggggaatga

SEQ ID NO: 364019 - DNA, 20 bp, human
ggaggacagtgctgactcac

SEQ ID NO: 364020 - DNA, 20 bp, human
gatggaagagtgggacggaa

SEQ ID NO: 364021 - DNA, 20 bp, human
gatctggggagaagtaaagt

SEQ ID NO: 364022 - DNA, 20 bp, human
gtccagttcgaggttggggc

SEQ ID NO: 364023 - DNA, 20 bp, human
gtcagcactgtcctcacgat

SEQ ID NO: 364024 - DNA, 20 bp, human
gggaagccaggcaggagtac

SEQ ID NO: 364025 - DNA, 20 bp, human
gcccaggggcggggagctaa

SEQ ID NO: 364026 - DNA, 20 bp, human
gacgagcgtgggtcaaaagt

SEQ ID NO: 364027 - DNA, 20 bp, human
gtcttcggatccttattgga

SEQ ID NO: 364028 - DNA, 20 bp, human
ggcttctcaagaacgagcgt

SEQ ID NO: 364029 - DNA, 20 bp, human
gtcaaaagtaggcgtcttat

SEQ ID NO: 364030 - DNA, 20 bp, human
gggcgcgggagcaatagcga

SEQ ID NO: 364031 - DNA, 20 bp, human
ggtaaatctaagccaatcgg

SEQ ID NO: 364032 - DNA, 20 bp, human
gtcgcgcacaaaggcagtgg

SEQ ID NO: 364033 - DNA, 20 bp, human
gctactttcaagcctccgat

SEQ ID NO: 364034 - DNA, 20 bp, human
gaaagtgggaagcgtgaagg

SEQ ID NO: 364035 - DNA, 20 bp, human
gggcacaaggaattagtaac

SEQ ID NO: 364036 - DNA, 20 bp, human
gcagcgcccggtgtcctcgg

SEQ ID NO: 364037 - DNA, 20 bp, human
gggccagcgcccggtgtcct

SEQ ID NO: 364038 - DNA, 20 bp, human
gggcctggaacccgcagcca

SEQ ID NO: 364039 - DNA, 20 bp, human
ggccaggctccgggacgagg

SEQ ID NO: 364040 - DNA, 20 bp, human
gtcaaagccccgtcccgcct

SEQ ID NO: 364041 - DNA, 20 bp, human
ggaggccctccgaggacacc

SEQ ID NO: 364042 - DNA, 20 bp, human
ggccgggcggatgacatcac

SEQ ID NO: 364043 - DNA, 20 bp, human
gctggaacccgcagccaagg

SEQ ID NO: 364044 - DNA, 20 bp, human
gtaggaaataggggaaagaa

SEQ ID NO: 364045 - DNA, 20 bp, human
gagagggaggggctgacctt

SEQ ID NO: 364046 - DNA, 20 bp, human
gtggaaggaaatatctggga

SEQ ID NO: 364047 - DNA, 20 bp, human
ggcacaaatgcagattgcgg

SEQ ID NO: 364048 - DNA, 20 bp, human
gaggttggaaggaaatatct

SEQ ID NO: 364049 - DNA, 20 bp, human
gaatgcagattgcgggggat

SEQ ID NO: 364050 - DNA, 20 bp, human
gcgctgttagacacttttac

SEQ ID NO: 364051 - DNA, 20 bp, human
gtgaaaaatcaaaggttgga

SEQ ID NO: 364052 - DNA, 20 bp, human
ggcaaaacctaacagaataa

SEQ ID NO: 364053 - DNA, 20 bp, human
gatgcgttaaaatgtgacga

SEQ ID NO: 364054 - DNA, 20 bp, human
gaccgagcctttgttgagaa

SEQ ID NO: 364055 - DNA, 20 bp, human
gcaatctgcatttgtgccaa

SEQ ID NO: 364056 - DNA, 20 bp, human
gcgcccgtcagtagtactcc

SEQ ID NO: 364057 - DNA, 20 bp, human
gctggctggtggcccagaac

SEQ ID NO: 364058 - DNA, 20 bp, human
gcagccaggagtactactga

SEQ ID NO: 364059 - DNA, 20 bp, human
gttgtcttgcatcccgttct

SEQ ID NO: 364060 - DNA, 20 bp, human
gggagggaagctctgagcga

SEQ ID NO: 364061 - DNA, 20 bp, human
gggaagctctgagcgagggt

SEQ ID NO: 364062 - DNA, 20 bp, human
gacaagtcagtgaaacaatg

SEQ ID NO: 364063 - DNA, 20 bp, human
ggctctgagcgagggtaggc

SEQ ID NO: 364064 - DNA, 20 bp, human
ggctccgagaggaatccagg

SEQ ID NO: 364065 - DNA, 20 bp, human
gagacaagatcttccaagag

SEQ ID NO: 364066 - DNA, 20 bp, human
gagcggggccggactctaat

SEQ ID NO: 364067 - DNA, 20 bp, human
gagctgtcagcctggggcga

SEQ ID NO: 364068 - DNA, 20 bp, human
gccggactctaattggtcca

SEQ ID NO: 364069 - DNA, 20 bp, human
ggctctgctgatttgatagt

SEQ ID NO: 364070 - DNA, 20 bp, human
gggcaacgacgtgatgacgc

SEQ ID NO: 364071 - DNA, 20 bp, human
gctgacgggtcgctgacggg

SEQ ID NO: 364072 - DNA, 20 bp, human
gcgtccgcggaaatttgaaa

SEQ ID NO: 364073 - DNA, 20 bp, human
gaacttgaagaaagtcgaat

SEQ ID NO: 364074 - DNA, 20 bp, human
gctgacgggcggcggtctgg

SEQ ID NO: 364075 - DNA, 20 bp, human
gtctaattggtccacggcct

SEQ ID NO: 364076 - DNA, 20 bp, human
ggggtgttgcggctctggga

SEQ ID NO: 364077 - DNA, 20 bp, human
ggggcctgcgggtagagcgc

SEQ ID NO: 364078 - DNA, 20 bp, human
ggcaacgagcggctgctcga

SEQ ID NO: 364079 - DNA, 20 bp, human
gcctaaggaaacctcccctg

SEQ ID NO: 364080 - DNA, 20 bp, human
ggccccgcaccccctagctc

SEQ ID NO: 364081 - DNA, 20 bp, human
gcggctctgggagggatgtg

SEQ ID NO: 364082 - DNA, 20 bp, human
ggggttagagccattgcgtt

SEQ ID NO: 364083 - DNA, 20 bp, human
ggggacagggcgaagcgcct

SEQ ID NO: 364084 - DNA, 20 bp, human
gctcagagctaggtgggaca

SEQ ID NO: 364085 - DNA, 20 bp, human
ggcgctgctcagagctaggt

SEQ ID NO: 364086 - DNA, 20 bp, human
gtgaccgggacgcccgagac

SEQ ID NO: 364087 - DNA, 20 bp, human
gggctgggggcgggagtcgc

SEQ ID NO: 364088 - DNA, 20 bp, human
ggctcgctgcggccagtctc

SEQ ID NO: 364089 - DNA, 20 bp, human
gagcgcggagcgcgggaggt

SEQ ID NO: 364090 - DNA, 20 bp, human
ggcggcagctggacactgac

SEQ ID NO: 364091 - DNA, 20 bp, human
ggggagtgacactgctgggg

SEQ ID NO: 364092 - DNA, 20 bp, human
gtgtccagctgccgcggcct

SEQ ID NO: 364093 - DNA, 20 bp, human
ggagaccttcagctgttctg

SEQ ID NO: 364094 - DNA, 20 bp, human
gcggccagtctcgggcgtcc

SEQ ID NO: 364095 - DNA, 20 bp, human
gcagctgggagtgacactgc

SEQ ID NO: 364096 - DNA, 20 bp, human
gctctctgctcagtggggcg

SEQ ID NO: 364097 - DNA, 20 bp, human
gtgcagacgcgggctgtcgg

SEQ ID NO: 364098 - DNA, 20 bp, human
ggggctgtcggcggcagaag

SEQ ID NO: 364099 - DNA, 20 bp, human
gggcggccgcacgtgcggat

SEQ ID NO: 364100 - DNA, 20 bp, human
gggctgcgagctctggagaa

SEQ ID NO: 364101 - DNA, 20 bp, human
ggcgccgctcacccccggga

SEQ ID NO: 364102 - DNA, 20 bp, human
gcgcggccgatccgcacgtg

SEQ ID NO: 364103 - DNA, 20 bp, human
gaccggctcggtgcagacgc

SEQ ID NO: 364104 - DNA, 20 bp, human
gcgaggggcttccttcccgg

SEQ ID NO: 364105 - DNA, 20 bp, human
gaggggcgcgcggagttgat

SEQ ID NO: 364106 - DNA, 20 bp, human
ggaggaggaagaccctgtta

SEQ ID NO: 364107 - DNA, 20 bp, human
gagctcggaagagtgtacgc

SEQ ID NO: 364108 - DNA, 20 bp, human
gcggggcgcttcagtaacaa

SEQ ID NO: 364109 - DNA, 20 bp, human
gcacaggcaagaagtgaagt

SEQ ID NO: 364110 - DNA, 20 bp, human
gcggggctccgctccctaac

SEQ ID NO: 364111 - DNA, 20 bp, human
gggaagaccctgttagggag

SEQ ID NO: 364112 - DNA, 20 bp, human
ggggcagaggatgcgactac

SEQ ID NO: 364113 - DNA, 20 bp, human
gcgcttcagtaacaagggag

SEQ ID NO: 364114 - DNA, 20 bp, human
gcagtaacaagggagaggcg

SEQ ID NO: 364115 - DNA, 20 bp, human
gtcgccacgcggtcccctgt

SEQ ID NO: 364116 - DNA, 20 bp, human
gggaaacaatggtacggcaa

SEQ ID NO: 364117 - DNA, 20 bp, human
gcattgtggaaacaatggta

SEQ ID NO: 364118 - DNA, 20 bp, human
ggaagtgtgcacaaaaagtt

SEQ ID NO: 364119 - DNA, 20 bp, human
ggaaagccacacattcttct

SEQ ID NO: 364120 - DNA, 20 bp, human
gaaaagctgttacctggcca

SEQ ID NO: 364121 - DNA, 20 bp, human
ggccagggctgaaattataa

SEQ ID NO: 364122 - DNA, 20 bp, human
gcacggcattgtggaaacaa

SEQ ID NO: 364123 - DNA, 20 bp, human
gaagttcggtgcacactctg

SEQ ID NO: 364124 - DNA, 20 bp, human
gtccgttataatttcagccc

SEQ ID NO: 364125 - DNA, 20 bp, human
ggctgctcgtcgtggcgtcc

SEQ ID NO: 364126 - DNA, 20 bp, human
gacagagagtccgaataaca

SEQ ID NO: 364127 - DNA, 20 bp, human
ggagacttggggaaagaata

SEQ ID NO: 364128 - DNA, 20 bp, human
ggagcagcgcgaggaatgct

SEQ ID NO: 364129 - DNA, 20 bp, human
gtcggcccagcgcttcctgc

SEQ ID NO: 364130 - DNA, 20 bp, human
gtaaccccgcaggaagcgct

SEQ ID NO: 364131 - DNA, 20 bp, human
ggcgaggaatgctgggatac

SEQ ID NO: 364132 - DNA, 20 bp, human
ggacgctaccatagagactt

SEQ ID NO: 364133 - DNA, 20 bp, human
ggaaaaagcgctaaccccgc

SEQ ID NO: 364134 - DNA, 20 bp, human
gatggtagcgtcagcgtcgg

SEQ ID NO: 364135 - DNA, 20 bp, human
gtggtctctaccttgttatt

SEQ ID NO: 364136 - DNA, 20 bp, human
ggggaggagcgcatgtcttg

SEQ ID NO: 364137 - DNA, 20 bp, human
gaaagtcagggggaaacgca

SEQ ID NO: 364138 - DNA, 20 bp, human
gccattccagggaaagtcag

SEQ ID NO: 364139 - DNA, 20 bp, human
gtcccgcccacctttatctt

SEQ ID NO: 364140 - DNA, 20 bp, human
gtgccaggggcgcatctgat

SEQ ID NO: 364141 - DNA, 20 bp, human
gtggtaacagcagttactcc

SEQ ID NO: 364142 - DNA, 20 bp, human
gttcctaagataaaggtggg

SEQ ID NO: 364143 - DNA, 20 bp, human
gactcagcctctgtggaccg

SEQ ID NO: 364144 - DNA, 20 bp, human
gtgaagcacctaccattcca

SEQ ID NO: 364145 - DNA, 20 bp, human
ggtttccccctgactttccc

SEQ ID NO: 364146 - DNA, 20 bp, human
gtgctccgaaagttccactg

SEQ ID NO: 364147 - DNA, 20 bp, human
ggaagagggtcacgcacctg

SEQ ID NO: 364148 - DNA, 20 bp, human
gatggggaaggcggaggctc

SEQ ID NO: 364149 - DNA, 20 bp, human
ggattccaggagttaagggt

SEQ ID NO: 364150 - DNA, 20 bp, human
gacctggggcagagcctagg

SEQ ID NO: 364151 - DNA, 20 bp, human
gccaggccggcgggaggttt

SEQ ID NO: 364152 - DNA, 20 bp, human
ggggaaggacggcccaagtg

SEQ ID NO: 364153 - DNA, 20 bp, human
gactggggacgatctcgcca

SEQ ID NO: 364154 - DNA, 20 bp, human
gacgatctcgccatggttga

SEQ ID NO: 364155 - DNA, 20 bp, human
ggtaggggagggatcaaccg

SEQ ID NO: 364156 - DNA, 20 bp, human
gccagcggcgagtactgcca

SEQ ID NO: 364157 - DNA, 20 bp, human
ggcgacgccaccatctgctg

SEQ ID NO: 364158 - DNA, 20 bp, human
ggcgttccaggatgaggaga

SEQ ID NO: 364159 - DNA, 20 bp, human
ggcccagggtggtgccatgt

SEQ ID NO: 364160 - DNA, 20 bp, human
ggtcccgagcgcttcgacgg

SEQ ID NO: 364161 - DNA, 20 bp, human
ggaagcggcgttccaggatg

SEQ ID NO: 364162 - DNA, 20 bp, human
gacggctggctggacgcgca

SEQ ID NO: 364163 - DNA, 20 bp, human
ggccccacatggcaccaccc

SEQ ID NO: 364164 - DNA, 20 bp, human
gcgcagggcgtctggcgcat

SEQ ID NO: 364165 - DNA, 20 bp, human
ggctggacgcgcagggcgtc

SEQ ID NO: 364166 - DNA, 20 bp, human
gcctctggagctaatcacag

SEQ ID NO: 364167 - DNA, 20 bp, human
ggggagggtctgatatcttc

SEQ ID NO: 364168 - DNA, 20 bp, human
gtcactctgcagagatttcc

SEQ ID NO: 364169 - DNA, 20 bp, human
ggagctaatcacagcgggtg

SEQ ID NO: 364170 - DNA, 20 bp, human
gcacgtgcgtggataaacgc

SEQ ID NO: 364171 - DNA, 20 bp, human
gagctccagaggcgcgatcc

SEQ ID NO: 364172 - DNA, 20 bp, human
ggagttggggtgtgcggcgg

SEQ ID NO: 364173 - DNA, 20 bp, human
gcctgggggagcggcatggg

SEQ ID NO: 364174 - DNA, 20 bp, human
gccagaggcgcgatccggga

SEQ ID NO: 364175 - DNA, 20 bp, human
gaggttgagagtcaagtcct

SEQ ID NO: 364176 - DNA, 20 bp, human
ggcccccgacaggatgtccc

SEQ ID NO: 364177 - DNA, 20 bp, human
ggcctgggacatcctgtcgg

SEQ ID NO: 364178 - DNA, 20 bp, human
gtgaaccctgccagctgcac

SEQ ID NO: 364179 - DNA, 20 bp, human
gcggatgggaggaaccaccg

SEQ ID NO: 364180 - DNA, 20 bp, human
gacacatgggccaaccctgg

SEQ ID NO: 364181 - DNA, 20 bp, human
gtgcccatggtggctcggat

SEQ ID NO: 364182 - DNA, 20 bp, human
gccgcccgcgctaacccagc

SEQ ID NO: 364183 - DNA, 20 bp, human
gcagttgggcactgcggcca

SEQ ID NO: 364184 - DNA, 20 bp, human
ggagcagggcagtgctctgc

SEQ ID NO: 364185 - DNA, 20 bp, human
ggggctggaccttcacttgt

SEQ ID NO: 364186 - DNA, 20 bp, human
gtccctgagccaagcctaca

SEQ ID NO: 364187 - DNA, 20 bp, human
ggcagctctgggaggcaaat

SEQ ID NO: 364188 - DNA, 20 bp, human
gctagcagccaaggagccaa

SEQ ID NO: 364189 - DNA, 20 bp, human
gtccaccctcttaaagacac

SEQ ID NO: 364190 - DNA, 20 bp, human
ggccaaggagccaaggggcg

SEQ ID NO: 364191 - DNA, 20 bp, human
gttctgaggtcaggccctgt

SEQ ID NO: 364192 - DNA, 20 bp, human
gaggtcaggccctgtaggct

SEQ ID NO: 364193 - DNA, 20 bp, human
gtggctcttagaccccctag

SEQ ID NO: 364194 - DNA, 20 bp, human
gtctttaagagggtggaacg

SEQ ID NO: 364195 - DNA, 20 bp, human
gagggtggccgggagaacat

SEQ ID NO: 364196 - DNA, 20 bp, human
ggggtcctgcgggacaagac

SEQ ID NO: 364197 - DNA, 20 bp, human
gaagacggggagccggtcac

SEQ ID NO: 364198 - DNA, 20 bp, human
ggggagccggtcacggggtg

SEQ ID NO: 364199 - DNA, 20 bp, human
gcggcggcgtggtcccgtcc

SEQ ID NO: 364200 - DNA, 20 bp, human
gaggacccgaagcgcggctc

SEQ ID NO: 364201 - DNA, 20 bp, human
ggccgcccggagccgcgctt

SEQ ID NO: 364202 - DNA, 20 bp, human
gtccgagtctctctcctcga

SEQ ID NO: 364203 - DNA, 20 bp, human
ggaggcgcgccgagcccgca

SEQ ID NO: 364204 - DNA, 20 bp, human
gggccgcgggaccccgtctt

SEQ ID NO: 364205 - DNA, 20 bp, human
gcggctccgcgctccccctg

SEQ ID NO: 364206 - DNA, 20 bp, human
gaaggaagcgagacagatga

SEQ ID NO: 364207 - DNA, 20 bp, human
gtcggggcactgaggaccat

SEQ ID NO: 364208 - DNA, 20 bp, human
ggctggagggaggcgcgcga

SEQ ID NO: 364209 - DNA, 20 bp, human
ggctcaccacaaagcagcat

SEQ ID NO: 364210 - DNA, 20 bp, human
gatcctacagcgctcaggac

SEQ ID NO: 364211 - DNA, 20 bp, human
ggaatgtggtgctgctggca

SEQ ID NO: 364212 - DNA, 20 bp, human
gcgcctgtcctgagcgctgt

SEQ ID NO: 364213 - DNA, 20 bp, human
gctgataatcaagggatctt

SEQ ID NO: 364214 - DNA, 20 bp, human
gcaaatgttcccctggtggg

SEQ ID NO: 364215 - DNA, 20 bp, human
ggagagaaattggcatttcg

SEQ ID NO: 364216 - DNA, 20 bp, human
gaggagcgcggctgccgcga

SEQ ID NO: 364217 - DNA, 20 bp, human
gtcccgctcgggctcggcgc

SEQ ID NO: 364218 - DNA, 20 bp, human
gactgccccgaaacattcat

SEQ ID NO: 364219 - DNA, 20 bp, human
gtcgaaggggatcagttcta

SEQ ID NO: 364220 - DNA, 20 bp, human
gggagccgggaggccccaca

SEQ ID NO: 364221 - DNA, 20 bp, human
gtcggggcagtctttgtgga

SEQ ID NO: 364222 - DNA, 20 bp, human
ggggcagtctttgtggaggg

SEQ ID NO: 364223 - DNA, 20 bp, human
ggtccccgcacctgtaagac

SEQ ID NO: 364224 - DNA, 20 bp, human
gaagccgtgcccatcgacgc

SEQ ID NO: 364225 - DNA, 20 bp, human
gcggaactgggcgctcgaag

SEQ ID NO: 364226 - DNA, 20 bp, human
gaggccccgcacgcctggga

SEQ ID NO: 364227 - DNA, 20 bp, human
ggcgagctctagaggggcgg

SEQ ID NO: 364228 - DNA, 20 bp, human
gggcgcgagctctagagggg

SEQ ID NO: 364229 - DNA, 20 bp, human
ggggaagaggtgactagagc

SEQ ID NO: 364230 - DNA, 20 bp, human
gggcgggcgcgagctctaga

SEQ ID NO: 364231 - DNA, 20 bp, human
gaggatggggacagactaaa

SEQ ID NO: 364232 - DNA, 20 bp, human
gactagagcgggagctagct

SEQ ID NO: 364233 - DNA, 20 bp, human
gggacggggaggagcgagct

SEQ ID NO: 364234 - DNA, 20 bp, human
gcggcagcagccgaggctag

SEQ ID NO: 364235 - DNA, 20 bp, human
gtacccagagagggcgcggg

SEQ ID NO: 364236 - DNA, 20 bp, human
gccgtcaagttcaggaaagg

SEQ ID NO: 364237 - DNA, 20 bp, human
gggtccgccccgtcaagttc

SEQ ID NO: 364238 - DNA, 20 bp, human
ggccccgtcaagttcaggaa

SEQ ID NO: 364239 - DNA, 20 bp, human
gcggacccggagtctccttt

SEQ ID NO: 364240 - DNA, 20 bp, human
gacagagcgcctgcccatcg

SEQ ID NO: 364241 - DNA, 20 bp, human
gaaggcggacccctttaagg

SEQ ID NO: 364242 - DNA, 20 bp, human
gtgacgagaacctagaggga

SEQ ID NO: 364243 - DNA, 20 bp, human
gcgggtgcacacccggaagt

SEQ ID NO: 364244 - DNA, 20 bp, human
gcacctccctggggagtcgg

SEQ ID NO: 364245 - DNA, 20 bp, human
ggcggacccctttaaggagg

SEQ ID NO: 364246 - DNA, 20 bp, human
gagagagcgcagccaagcat

SEQ ID NO: 364247 - DNA, 20 bp, human
ggcgccgcagccaatagcgc

SEQ ID NO: 364248 - DNA, 20 bp, human
gtagtgcagctgcgcacctg

SEQ ID NO: 364249 - DNA, 20 bp, human
gggcagggcctgtttctccg

SEQ ID NO: 364250 - DNA, 20 bp, human
ggcacccgcgctattggctg

SEQ ID NO: 364251 - DNA, 20 bp, human
gagggcctgtttctccgggg

SEQ ID NO: 364252 - DNA, 20 bp, human
gcggcccgccccggagaaac

SEQ ID NO: 364253 - DNA, 20 bp, human
gcagctgcgcacctggggca

SEQ ID NO: 364254 - DNA, 20 bp, human
gcttggctgcgctctctgat

SEQ ID NO: 364255 - DNA, 20 bp, human
gccaaacgcacccgcgctat

SEQ ID NO: 364256 - DNA, 20 bp, human
gtaaccctggggctacagac

SEQ ID NO: 364257 - DNA, 20 bp, human
gaggcgccaaagctaacggg

SEQ ID NO: 364258 - DNA, 20 bp, human
gaaagaaaaaagcggtgagt

SEQ ID NO: 364259 - DNA, 20 bp, human
gggcaagggcctctaaccct

SEQ ID NO: 364260 - DNA, 20 bp, human
ggggatctacgcatgcgtag

SEQ ID NO: 364261 - DNA, 20 bp, human
gcgtagtggtggcccctttg

SEQ ID NO: 364262 - DNA, 20 bp, human
gggttagaggcccttgcctg

SEQ ID NO: 364263 - DNA, 20 bp, human
gtgccctagaccagagttgg

SEQ ID NO: 364264 - DNA, 20 bp, human
gtgctgccctagaccagagt

SEQ ID NO: 364265 - DNA, 20 bp, human
ggctgaggcgccaaagctaa

SEQ ID NO: 364266 - DNA, 20 bp, human
gcgtgggcccgtcactcgct

SEQ ID NO: 364267 - DNA, 20 bp, human
gaaaaaaatctacgtcaccc

SEQ ID NO: 364268 - DNA, 20 bp, human
ggtgacgggcccacggcaga

SEQ ID NO: 364269 - DNA, 20 bp, human
gagacggcgtagaggaactg

SEQ ID NO: 364270 - DNA, 20 bp, human
ggcactgcccgtctctgatt

SEQ ID NO: 364271 - DNA, 20 bp, human
gtgggcgggagacggcgtag

SEQ ID NO: 364272 - DNA, 20 bp, human
gaagctgcccaatcagagac

SEQ ID NO: 364273 - DNA, 20 bp, human
ggcgcccagtgggcgggaga

SEQ ID NO: 364274 - DNA, 20 bp, human
gctagccagaggcgcccagt

SEQ ID NO: 364275 - DNA, 20 bp, human
gacagagtaagcctccagca

SEQ ID NO: 364276 - DNA, 20 bp, human
gagaacgcgggtaacctgtg

SEQ ID NO: 364277 - DNA, 20 bp, human
gtctctgcgtgcgtccgccg

SEQ ID NO: 364278 - DNA, 20 bp, human
gcgctctcccttccaaaaat

SEQ ID NO: 364279 - DNA, 20 bp, human
ggttacccgcgttctctccg

SEQ ID NO: 364280 - DNA, 20 bp, human
gaagcgcccgggtcgcgccg

SEQ ID NO: 364281 - DNA, 20 bp, human
ggtacaccttggtgcgaagg

SEQ ID NO: 364282 - DNA, 20 bp, human
gcgcgggtaacctgtgtggg

SEQ ID NO: 364283 - DNA, 20 bp, human
gcagacaggcagcgcatggg

SEQ ID NO: 364284 - DNA, 20 bp, human
gggagagcgcgcgcgcagga

SEQ ID NO: 364285 - DNA, 20 bp, human
gcaattgccggcctgggggg

SEQ ID NO: 364286 - DNA, 20 bp, human
gcgaccggctgcaccgaggc

SEQ ID NO: 364287 - DNA, 20 bp, human
gtgagcgccgggctgacgtg

SEQ ID NO: 364288 - DNA, 20 bp, human
gggggctgccggagggaaat

SEQ ID NO: 364289 - DNA, 20 bp, human
ggcggggccaaggagccgac

SEQ ID NO: 364290 - DNA, 20 bp, human
ggaggcgatcacgtaccggg

SEQ ID NO: 364291 - DNA, 20 bp, human
gatcacgtaccgggaggtgc

SEQ ID NO: 364292 - DNA, 20 bp, human
ggccggccgcccggactgcc

SEQ ID NO: 364293 - DNA, 20 bp, human
ggggagagaaggccggtccc

SEQ ID NO: 364294 - DNA, 20 bp, human
gggaactgatgcttccctgc

SEQ ID NO: 364295 - DNA, 20 bp, human
gaaaaagagcggggctctgc

SEQ ID NO: 364296 - DNA, 20 bp, human
ggcggaaggcgggacctaaa

SEQ ID NO: 364297 - DNA, 20 bp, human
gccggctataggcggagagg

SEQ ID NO: 364298 - DNA, 20 bp, human
ggggcggaaatcagagcccg

SEQ ID NO: 364299 - DNA, 20 bp, human
ggccccggctataggcggag

SEQ ID NO: 364300 - DNA, 20 bp, human
gatagccggggcccgccgag

SEQ ID NO: 364301 - DNA, 20 bp, human
gcttccacgcaacctctcgg

SEQ ID NO: 364302 - DNA, 20 bp, human
gctcgccttccccggccagt

SEQ ID NO: 364303 - DNA, 20 bp, human
gggcccgccgagaggttgcg

SEQ ID NO: 364304 - DNA, 20 bp, human
gggccggggcgcagagatcg

SEQ ID NO: 364305 - DNA, 20 bp, human
gcagaccgccctccattggg

SEQ ID NO: 364306 - DNA, 20 bp, human
ggccgaatgcccgaagtagg

SEQ ID NO: 364307 - DNA, 20 bp, human
ggaagccagcgcaggagaaa

SEQ ID NO: 364308 - DNA, 20 bp, human
ggggctccccttgaagcgaa

SEQ ID NO: 364309 - DNA, 20 bp, human
gggagccccgccccctactt

SEQ ID NO: 364310 - DNA, 20 bp, human
gggaacgtgtaggggtcccc

SEQ ID NO: 364311 - DNA, 20 bp, human
gctgtgttctctaatggcgt

SEQ ID NO: 364312 - DNA, 20 bp, human
gatggccgaatgcccgaagt

SEQ ID NO: 364313 - DNA, 20 bp, human
gcacacgcccttcgcttcaa

SEQ ID NO: 364314 - DNA, 20 bp, human
ggcgctgtagcgtggggtca

SEQ ID NO: 364315 - DNA, 20 bp, human
gcgggcgcgcgctgtagcgt

SEQ ID NO: 364316 - DNA, 20 bp, human
gcatcccgccggttcaacgc

SEQ ID NO: 364317 - DNA, 20 bp, human
gaaacccccgggcggagaaa

SEQ ID NO: 364318 - DNA, 20 bp, human
gggagccggcgttgaaccgg

SEQ ID NO: 364319 - DNA, 20 bp, human
gcggaactttcaaaaccccc

SEQ ID NO: 364320 - DNA, 20 bp, human
ggtcccgtctccatggagat

SEQ ID NO: 364321 - DNA, 20 bp, human
gtctccatggagattggcgt

SEQ ID NO: 364322 - DNA, 20 bp, human
ggacgccgttcgagaagagg

SEQ ID NO: 364323 - DNA, 20 bp, human
gacgccctttctccgcccgg

SEQ ID NO: 364324 - DNA, 20 bp, human
gcgggacgccgttcgagaag

SEQ ID NO: 364325 - DNA, 20 bp, human
ggaactctcggtgtgaggga

SEQ ID NO: 364326 - DNA, 20 bp, human
gcgcgcgccggcccagtccc

SEQ ID NO: 364327 - DNA, 20 bp, human
gggcctgacacctccctcgg

SEQ ID NO: 364328 - DNA, 20 bp, human
gctcgggggccgggtccctc

SEQ ID NO: 364329 - DNA, 20 bp, human
gcacctcgctcaggtttctc

SEQ ID NO: 364330 - DNA, 20 bp, human
gccccaccgagggaggtgtc

SEQ ID NO: 364331 - DNA, 20 bp, human
gtcaggggaggcgccacgtc

SEQ ID NO: 364332 - DNA, 20 bp, human
gtggacctccccaccgaggg

SEQ ID NO: 364333 - DNA, 20 bp, human
gactgtccaccctcagacct

SEQ ID NO: 364334 - DNA, 20 bp, human
ggaaacctgagcgaggtggt

SEQ ID NO: 364335 - DNA, 20 bp, human
gcggggcctgacacctccct

SEQ ID NO: 364336 - DNA, 20 bp, human
ggtaccgcggggccggtcac

SEQ ID NO: 364337 - DNA, 20 bp, human
gtggacgcgctccccgtgac

SEQ ID NO: 364338 - DNA, 20 bp, human
gccggcccgctcccctccac

SEQ ID NO: 364339 - DNA, 20 bp, human
gcccgcggcccgaagggtga

SEQ ID NO: 364340 - DNA, 20 bp, human
gcggcccgaagggtgaggga

SEQ ID NO: 364341 - DNA, 20 bp, human
gggagctcgtaccgcggggc

SEQ ID NO: 364342 - DNA, 20 bp, human
gcacgcggccgctcgtaccg

SEQ ID NO: 364343 - DNA, 20 bp, human
gcgtccagaggtccagcccg

SEQ ID NO: 364344 - DNA, 20 bp, human
gggtccagcccgcggcccga

SEQ ID NO: 364345 - DNA, 20 bp, human
gcagctctccccggtacgag

SEQ ID NO: 364346 - DNA, 20 bp, human
gcccgcctcgtaccaattaa

SEQ ID NO: 364347 - DNA, 20 bp, human
gtaagtacatgtcaaggtgg

SEQ ID NO: 364348 - DNA, 20 bp, human
gtgtcaaggtggtggcacaa

SEQ ID NO: 364349 - DNA, 20 bp, human
gtgggtaagtactaggtact

SEQ ID NO: 364350 - DNA, 20 bp, human
ggaggcttctgggttagata

SEQ ID NO: 364351 - DNA, 20 bp, human
ggaaagagtaaggaagttag

SEQ ID NO: 364352 - DNA, 20 bp, human
gtacagatggctaattgcca

SEQ ID NO: 364353 - DNA, 20 bp, human
gtggtgagctgaattctgca

SEQ ID NO: 364354 - DNA, 20 bp, human
gtacctagtacttacccaca

SEQ ID NO: 364355 - DNA, 20 bp, human
gcagtgcttactgtgcagaa

SEQ ID NO: 364356 - DNA, 20 bp, human
gaatggggaggggcagtcac

SEQ ID NO: 364357 - DNA, 20 bp, human
gctcccggctggagacgctc

SEQ ID NO: 364358 - DNA, 20 bp, human
ggaacccggcagtaaagagg

SEQ ID NO: 364359 - DNA, 20 bp, human
gtataggatcgctggggagt

SEQ ID NO: 364360 - DNA, 20 bp, human
gctcgcctataggatcgctg

SEQ ID NO: 364361 - DNA, 20 bp, human
gagaaaacggagcaatgggg

SEQ ID NO: 364362 - DNA, 20 bp, human
gcaggccagcggacatagtg

SEQ ID NO: 364363 - DNA, 20 bp, human
ggtaaagaggaggaccaaag

SEQ ID NO: 364364 - DNA, 20 bp, human
gggacaagaaaacggagcaa

SEQ ID NO: 364365 - DNA, 20 bp, human
gtcactgggacctcgcctat

SEQ ID NO: 364366 - DNA, 20 bp, human
gtacataaatgtttctctct

SEQ ID NO: 364367 - DNA, 20 bp, human
gaaacactgataggctggta

SEQ ID NO: 364368 - DNA, 20 bp, human
gtaaactactttcagggtta

SEQ ID NO: 364369 - DNA, 20 bp, human
ggtgcaatttagatcctcac

SEQ ID NO: 364370 - DNA, 20 bp, human
gtttatgtaaactactttca

SEQ ID NO: 364371 - DNA, 20 bp, human
ggcaataaaactttatgagt

SEQ ID NO: 364372 - DNA, 20 bp, human
gagatcaaagacaagataca

SEQ ID NO: 364373 - DNA, 20 bp, human
gggatctaaattgcacacaa

SEQ ID NO: 364374 - DNA, 20 bp, human
gtatctctaaattactgatc

SEQ ID NO: 364375 - DNA, 20 bp, human
gatgtttctactctccagtg

SEQ ID NO: 364376 - DNA, 20 bp, human
gggcaccagctcggagagaa

SEQ ID NO: 364377 - DNA, 20 bp, human
gggaaccggcggcaccagct

SEQ ID NO: 364378 - DNA, 20 bp, human
gctcccgcgacctcaggact

SEQ ID NO: 364379 - DNA, 20 bp, human
gtcggagccctgggccgttt

SEQ ID NO: 364380 - DNA, 20 bp, human
gtcggctcccaaacggccca

SEQ ID NO: 364381 - DNA, 20 bp, human
gaccagctcggagagaaagg

SEQ ID NO: 364382 - DNA, 20 bp, human
gctaggtcttggtatcggag

SEQ ID NO: 364383 - DNA, 20 bp, human
gggctgcgaggactgcaaaa

SEQ ID NO: 364384 - DNA, 20 bp, human
gaaactacggcggccgagaa

SEQ ID NO: 364385 - DNA, 20 bp, human
gaaaggctaggtcttggtat

SEQ ID NO: 364386 - DNA, 20 bp, human
gcgcgcaggcgcacaggcgt

SEQ ID NO: 364387 - DNA, 20 bp, human
gtagctgtgcgggtctccaa

SEQ ID NO: 364388 - DNA, 20 bp, human
gaaggcggcagtaggtgcgg

SEQ ID NO: 364389 - DNA, 20 bp, human
gtccgcgggcgtagctgtgc

SEQ ID NO: 364390 - DNA, 20 bp, human
ggcggggccgcgcctcctca

SEQ ID NO: 364391 - DNA, 20 bp, human
gaggacgcgcgaaacggcgg

SEQ ID NO: 364392 - DNA, 20 bp, human
gtaaataccacacactgcgg

SEQ ID NO: 364393 - DNA, 20 bp, human
gcgctgggagcctggggggg

SEQ ID NO: 364394 - DNA, 20 bp, human
gcggcggccatgaggaggcg

SEQ ID NO: 364395 - DNA, 20 bp, human
gtggccgccgccgcagtgtg

SEQ ID NO: 364396 - DNA, 20 bp, human
gccaccctgcgccggggcgc

SEQ ID NO: 364397 - DNA, 20 bp, human
gcccccggggcttgcgtcag

SEQ ID NO: 364398 - DNA, 20 bp, human
ggggcgggagcgtggacggt

SEQ ID NO: 364399 - DNA, 20 bp, human
gtggcagagccaccctgcgc

SEQ ID NO: 364400 - DNA, 20 bp, human
gagggcgaggggctcgagtt

SEQ ID NO: 364401 - DNA, 20 bp, human
gggccacaccccggggtgcc

SEQ ID NO: 364402 - DNA, 20 bp, human
gaaggcaacttcaggcgggg

SEQ ID NO: 364403 - DNA, 20 bp, human
gacgcgtcagccaggcaccc

SEQ ID NO: 364404 - DNA, 20 bp, human
gccctcagctcaaacgagaa

SEQ ID NO: 364405 - DNA, 20 bp, human
gaggaagcgccggcgctagg

SEQ ID NO: 364406 - DNA, 20 bp, human
gctccctgatgaattgagcc

SEQ ID NO: 364407 - DNA, 20 bp, human
gccgccaggctcaattcatc

SEQ ID NO: 364408 - DNA, 20 bp, human
gaatgcaatgtgctgatcta

SEQ ID NO: 364409 - DNA, 20 bp, human
gtcatcagggagtttcggta

SEQ ID NO: 364410 - DNA, 20 bp, human
gccccagcattaggtatggt

SEQ ID NO: 364411 - DNA, 20 bp, human
gtcaattcatcagggagttt

SEQ ID NO: 364412 - DNA, 20 bp, human
ggacagaaatgttatccttg

SEQ ID NO: 364413 - DNA, 20 bp, human
ggccaaccatacctaatgct

SEQ ID NO: 364414 - DNA, 20 bp, human
gatctccccagcattaggta

SEQ ID NO: 364415 - DNA, 20 bp, human
gggagagtaagatttatcaa

SEQ ID NO: 364416 - DNA, 20 bp, human
gcgaactcgcgcaccctctt

SEQ ID NO: 364417 - DNA, 20 bp, human
ggagaggttctattagagag

SEQ ID NO: 364418 - DNA, 20 bp, human
gtgcgcgagttcgctttccc

SEQ ID NO: 364419 - DNA, 20 bp, human
gactctccatggagagtagg

SEQ ID NO: 364420 - DNA, 20 bp, human
gtctctgcaggtagcagcct

SEQ ID NO: 364421 - DNA, 20 bp, human
gggtaaagtaggtaagaggc

SEQ ID NO: 364422 - DNA, 20 bp, human
ggatgacgtgagactctcca

SEQ ID NO: 364423 - DNA, 20 bp, human
gcgcgcaccctcttggggga

SEQ ID NO: 364424 - DNA, 20 bp, human
gaaagagcccgtcccccaag

SEQ ID NO: 364425 - DNA, 20 bp, human
gacttccgggaccagacttc

SEQ ID NO: 364426 - DNA, 20 bp, human
ggcccgcccgctgacgtcag

SEQ ID NO: 364427 - DNA, 20 bp, human
ggaaactgacacagatttaa

SEQ ID NO: 364428 - DNA, 20 bp, human
ggaaaatcacgggagagagt

SEQ ID NO: 364429 - DNA, 20 bp, human
gtcccgcatttgcccttaaa

SEQ ID NO: 364430 - DNA, 20 bp, human
gtgcagctgtctagctgaag

SEQ ID NO: 364431 - DNA, 20 bp, human
gacagctgcagcccctttaa

SEQ ID NO: 364432 - DNA, 20 bp, human
gaggacggtggccctaccgg

SEQ ID NO: 364433 - DNA, 20 bp, human
gcctaccggcggaggggaaa

SEQ ID NO: 364434 - DNA, 20 bp, human
gcccggagaaaaagtggccc

SEQ ID NO: 364435 - DNA, 20 bp, human
gtaagggcaaatgcgggacc

SEQ ID NO: 364436 - DNA, 20 bp, human
ggccggacgcagagctctaa

SEQ ID NO: 364437 - DNA, 20 bp, human
gacgcagagctctaagggag

SEQ ID NO: 364438 - DNA, 20 bp, human
gtgggacggagcatggggcg

SEQ ID NO: 364439 - DNA, 20 bp, human
gcggggcgggccctccgggt

SEQ ID NO: 364440 - DNA, 20 bp, human
gcagagctctaagggagggg

SEQ ID NO: 364441 - DNA, 20 bp, human
ggcctcgggtgggcggggat

SEQ ID NO: 364442 - DNA, 20 bp, human
gtgggggcggagctcgatgg

SEQ ID NO: 364443 - DNA, 20 bp, human
gaggtcggcggagggctctg

SEQ ID NO: 364444 - DNA, 20 bp, human
gctgccgcgcgctggtatcc

SEQ ID NO: 364445 - DNA, 20 bp, human
gcccatgctccgtcccaccc

SEQ ID NO: 364446 - DNA, 20 bp, human
gctcccgcccgcctagggaa

SEQ ID NO: 364447 - DNA, 20 bp, human
gctacaggaagagccggggc

SEQ ID NO: 364448 - DNA, 20 bp, human
gcgggaggacgggcagttgg

SEQ ID NO: 364449 - DNA, 20 bp, human
gggaaagtgccgtgcctggg

SEQ ID NO: 364450 - DNA, 20 bp, human
gcctaggcgggcgggaggac

SEQ ID NO: 364451 - DNA, 20 bp, human
gagagctacaggaagagccg

SEQ ID NO: 364452 - DNA, 20 bp, human
gccgcttgactcagagctac

SEQ ID NO: 364453 - DNA, 20 bp, human
gtggggtttagggttaggag

SEQ ID NO: 364454 - DNA, 20 bp, human
gcaccccttccctaggcggg

SEQ ID NO: 364455 - DNA, 20 bp, human
gagaggaaagtgccgtgcct

SEQ ID NO: 364456 - DNA, 20 bp, human
gatagggccaagggacacac

SEQ ID NO: 364457 - DNA, 20 bp, human
gagctgggaacgtggcctcc

SEQ ID NO: 364458 - DNA, 20 bp, human
gcaggaatgccctcacttgg

SEQ ID NO: 364459 - DNA, 20 bp, human
gggctgggaaagcagaactt

SEQ ID NO: 364460 - DNA, 20 bp, human
gttagggtggtatccttgag

SEQ ID NO: 364461 - DNA, 20 bp, human
ggaacttgggatagggccaa

SEQ ID NO: 364462 - DNA, 20 bp, human
ggctggccaacccaataaga

SEQ ID NO: 364463 - DNA, 20 bp, human
gtgaggcaggccaccaagtg

SEQ ID NO: 364464 - DNA, 20 bp, human
gcacccaaaccaacaggaac

SEQ ID NO: 364465 - DNA, 20 bp, human
gtctgcggagagcagggaat

SEQ ID NO: 364466 - DNA, 20 bp, human
gaaggtgggccggagagtgt

SEQ ID NO: 364467 - DNA, 20 bp, human
gggagacccagaggacaact

SEQ ID NO: 364468 - DNA, 20 bp, human
gacaactgggcaaggtgggc

SEQ ID NO: 364469 - DNA, 20 bp, human
gaagggaccgttactggagg

SEQ ID NO: 364470 - DNA, 20 bp, human
gccagagctccctgtgtagg

SEQ ID NO: 364471 - DNA, 20 bp, human
gcaggcttgtgtctatcctg

SEQ ID NO: 364472 - DNA, 20 bp, human
gaccttgcccagttgtcctc

SEQ ID NO: 364473 - DNA, 20 bp, human
ggaccagctcaacaagccca

SEQ ID NO: 364474 - DNA, 20 bp, human
ggggtgggggctctccctct

SEQ ID NO: 364475 - DNA, 20 bp, human
gtggcagaaggggaagccga

SEQ ID NO: 364476 - DNA, 20 bp, human
gtggccctccaggaccggga

SEQ ID NO: 364477 - DNA, 20 bp, human
ggcagctgtggagggtctgt

SEQ ID NO: 364478 - DNA, 20 bp, human
ggagctgccacccattcaaa

SEQ ID NO: 364479 - DNA, 20 bp, human
gctcagggaccctcctgtgt

SEQ ID NO: 364480 - DNA, 20 bp, human
ggactcctgggcccccagtt

SEQ ID NO: 364481 - DNA, 20 bp, human
ggtctggagggtccccacac

SEQ ID NO: 364482 - DNA, 20 bp, human
gggcacatccctcccggtcc

SEQ ID NO: 364483 - DNA, 20 bp, human
gcttcgtgctccatttgaat

SEQ ID NO: 364484 - DNA, 20 bp, human
ggagggatgtgccgttcccg

SEQ ID NO: 364485 - DNA, 20 bp, human
gaggctgagagagacgtgct

SEQ ID NO: 364486 - DNA, 20 bp, human
gtggacggggtagtggacgg

SEQ ID NO: 364487 - DNA, 20 bp, human
ggggtccccaggagtggacg

SEQ ID NO: 364488 - DNA, 20 bp, human
ggtcagggccgggtcacccc

SEQ ID NO: 364489 - DNA, 20 bp, human
gtggacggtggatcttccag

SEQ ID NO: 364490 - DNA, 20 bp, human
gcactaccccgtccactcct

SEQ ID NO: 364491 - DNA, 20 bp, human
gcgcacaggaagttgggggt

SEQ ID NO: 364492 - DNA, 20 bp, human
gttctgaacggtgacctcac

SEQ ID NO: 364493 - DNA, 20 bp, human
gaggaagccgcacaggaagt

SEQ ID NO: 364494 - DNA, 20 bp, human
ggctgtggatgtctctctgt

SEQ ID NO: 364495 - DNA, 20 bp, human
gcaaggggaagggcactgag

SEQ ID NO: 364496 - DNA, 20 bp, human
gcacccccactggacgccga

SEQ ID NO: 364497 - DNA, 20 bp, human
gtcaccatcggcgtccagtg

SEQ ID NO: 364498 - DNA, 20 bp, human
ggtctggacaagcccctctg

SEQ ID NO: 364499 - DNA, 20 bp, human
gcccgaggccctgactccca

SEQ ID NO: 364500 - DNA, 20 bp, human
ggcctcagtatcttcaccat

SEQ ID NO: 364501 - DNA, 20 bp, human
gtgtcagggacaaacacatc

SEQ ID NO: 364502 - DNA, 20 bp, human
ggagtctagacttacaagtc

SEQ ID NO: 364503 - DNA, 20 bp, human
gaaggaaagtgctgcagcta

SEQ ID NO: 364504 - DNA, 20 bp, human
gtattctcccatctcgctga

SEQ ID NO: 364505 - DNA, 20 bp, human
gtatgggacctggtgacctc

SEQ ID NO: 364506 - DNA, 20 bp, human
ggaactggggacaggaagcc

SEQ ID NO: 364507 - DNA, 20 bp, human
gcagatctgcaggtccctgt

SEQ ID NO: 364508 - DNA, 20 bp, human
gagggccctcccaggcgtgg

SEQ ID NO: 364509 - DNA, 20 bp, human
gcgcctgggagggccctcac

SEQ ID NO: 364510 - DNA, 20 bp, human
ggcttgaatgatcagacctc

SEQ ID NO: 364511 - DNA, 20 bp, human
gaggtggccgagagcgggtc

SEQ ID NO: 364512 - DNA, 20 bp, human
gcacatgactaaactccacg

SEQ ID NO: 364513 - DNA, 20 bp, human
gaaaccaagaggggaatcac

SEQ ID NO: 364514 - DNA, 20 bp, human
gtctgatcattcaagccccg

SEQ ID NO: 364515 - DNA, 20 bp, human
ggaaacagggccatttcctg

SEQ ID NO: 364516 - DNA, 20 bp, human
gggtcaggaccggaggacat

SEQ ID NO: 364517 - DNA, 20 bp, human
gaaccctcccatttcctcct

SEQ ID NO: 364518 - DNA, 20 bp, human
gcactgggagagaagtgccc

SEQ ID NO: 364519 - DNA, 20 bp, human
gaggcaaaggtcaggaccgg

SEQ ID NO: 364520 - DNA, 20 bp, human
gcggtcacccaaagatgcag

SEQ ID NO: 364521 - DNA, 20 bp, human
gggagcagggatcactatgg

SEQ ID NO: 364522 - DNA, 20 bp, human
gtcctatctggggcgggaag

SEQ ID NO: 364523 - DNA, 20 bp, human
ggggagggtttaatgagcca

SEQ ID NO: 364524 - DNA, 20 bp, human
gataagcacccctgcatctt

SEQ ID NO: 364525 - DNA, 20 bp, human
gaactgaggaagtcctatct

SEQ ID NO: 364526 - DNA, 20 bp, human
gtgtcagggacaaacacatc

SEQ ID NO: 364527 - DNA, 20 bp, human
gtggctgtcaacatcaggga

SEQ ID NO: 364528 - DNA, 20 bp, human
gcacgctgggggtttcaggt

SEQ ID NO: 364529 - DNA, 20 bp, human
gagagggaaggcaagttgtc

SEQ ID NO: 364530 - DNA, 20 bp, human
gcagggacaaacacatcagg

SEQ ID NO: 364531 - DNA, 20 bp, human
gtcaacagccggtaggtgag

SEQ ID NO: 364532 - DNA, 20 bp, human
gagcacacgctgggggtttc

SEQ ID NO: 364533 - DNA, 20 bp, human
gcacatcaggtggacatgac

SEQ ID NO: 364534 - DNA, 20 bp, human
gggttcccaaatccaactgg

SEQ ID NO: 364535 - DNA, 20 bp, human
gccaaatccaactggtggtg

SEQ ID NO: 364536 - DNA, 20 bp, human
gcctgcccaaagaagagcag

SEQ ID NO: 364537 - DNA, 20 bp, human
gagagggagtggagctccga

SEQ ID NO: 364538 - DNA, 20 bp, human
gtcacaggaagccccgaggt

SEQ ID NO: 364539 - DNA, 20 bp, human
gggggaggagcgcgtgatct

SEQ ID NO: 364540 - DNA, 20 bp, human
ggcggggaggaacgggtggc

SEQ ID NO: 364541 - DNA, 20 bp, human
gtcttctttgggcaggtctc

SEQ ID NO: 364542 - DNA, 20 bp, human
gagcaacagagcccggacca

SEQ ID NO: 364543 - DNA, 20 bp, human
gtgggcagggccttggacac

SEQ ID NO: 364544 - DNA, 20 bp, human
gagctcccaggtgtaaacag

SEQ ID NO: 364545 - DNA, 20 bp, human
gactgactttctcatggcgt

SEQ ID NO: 364546 - DNA, 20 bp, human
gaggccctacaggaagtcgg

SEQ ID NO: 364547 - DNA, 20 bp, human
ggcagcatatctggggttgg

SEQ ID NO: 364548 - DNA, 20 bp, human
gggacccaggagtgaatgtc

SEQ ID NO: 364549 - DNA, 20 bp, human
ggcagcagcatatctggggt

SEQ ID NO: 364550 - DNA, 20 bp, human
gtcaccaccgacttcctgta

SEQ ID NO: 364551 - DNA, 20 bp, human
gtagctcagaagtgggactc

SEQ ID NO: 364552 - DNA, 20 bp, human
gggacagaagagtaaccgga

SEQ ID NO: 364553 - DNA, 20 bp, human
gcgtcagcgagtaatccttc

SEQ ID NO: 364554 - DNA, 20 bp, human
gaagaggccctacaggaagt

SEQ ID NO: 364555 - DNA, 20 bp, human
gggaaggacagaagagtaac

SEQ ID NO: 364556 - DNA, 20 bp, human
gagccccgggggtgattcag

SEQ ID NO: 364557 - DNA, 20 bp, human
ggacccctgaatcacccccg

SEQ ID NO: 364558 - DNA, 20 bp, human
gaggtctcaagacttagggg

SEQ ID NO: 364559 - DNA, 20 bp, human
gtcagggccgggtcagtcct

SEQ ID NO: 364560 - DNA, 20 bp, human
ggttgggccctgcatagggt

SEQ ID NO: 364561 - DNA, 20 bp, human
gccaccccatttccactcct

SEQ ID NO: 364562 - DNA, 20 bp, human
gggaggtcccgcaggaggtt

SEQ ID NO: 364563 - DNA, 20 bp, human
gacaaacagtgacagccccg

SEQ ID NO: 364564 - DNA, 20 bp, human
gttaggggaggtcccgcagg

SEQ ID NO: 364565 - DNA, 20 bp, human
gccaaatggaagggcaagtc

SEQ ID NO: 364566 - DNA, 20 bp, human
ggggacccaggagtgaacat

SEQ ID NO: 364567 - DNA, 20 bp, human
gcccaggagtgaacatgggg

SEQ ID NO: 364568 - DNA, 20 bp, human
gacttggggccatgagagat

SEQ ID NO: 364569 - DNA, 20 bp, human
gacccgggcctgacagtgtc

SEQ ID NO: 364570 - DNA, 20 bp, human
gtatctgcgtagctcagagg

SEQ ID NO: 364571 - DNA, 20 bp, human
ggatctcccagggctgaccc

SEQ ID NO: 364572 - DNA, 20 bp, human
gcccagacactgtcaggccc

SEQ ID NO: 364573 - DNA, 20 bp, human
gcttgcttgggggggatgag

SEQ ID NO: 364574 - DNA, 20 bp, human
gcctgcacccccatctctca

SEQ ID NO: 364575 - DNA, 20 bp, human
ggcagaaaatgtcacctaag

SEQ ID NO: 364576 - DNA, 20 bp, human
gcccacaggcgtgtgcccct

SEQ ID NO: 364577 - DNA, 20 bp, human
gttatgttgcagccaatcag

SEQ ID NO: 364578 - DNA, 20 bp, human
ggggcacaaaggttggagga

SEQ ID NO: 364579 - DNA, 20 bp, human
ggtgcccaattggatcttga

SEQ ID NO: 364580 - DNA, 20 bp, human
gaccgcccccagctgcggat

SEQ ID NO: 364581 - DNA, 20 bp, human
gtcccaggggcacacgcctg

SEQ ID NO: 364582 - DNA, 20 bp, human
gagccgtgcatcagctccca

SEQ ID NO: 364583 - DNA, 20 bp, human
ggcggtgccaggtagtttgt

SEQ ID NO: 364584 - DNA, 20 bp, human
gtccaattgggcacaaaggt

SEQ ID NO: 364585 - DNA, 20 bp, human
gaagccctcaagatccaatt

SEQ ID NO: 364586 - DNA, 20 bp, human
ggcggggccaagtcgcccag

SEQ ID NO: 364587 - DNA, 20 bp, human
gcgcccagcggcagatgtca

SEQ ID NO: 364588 - DNA, 20 bp, human
gtgccgcgcaagggaggcaa

SEQ ID NO: 364589 - DNA, 20 bp, human
gcggttgaaccatttcctcg

SEQ ID NO: 364590 - DNA, 20 bp, human
gtcgccctgaccaatcggag

SEQ ID NO: 364591 - DNA, 20 bp, human
ggtggggcggtgccgcgcaa

SEQ ID NO: 364592 - DNA, 20 bp, human
ggtgcccgggccgctccgat

SEQ ID NO: 364593 - DNA, 20 bp, human
ggggccgctccgattggtca

SEQ ID NO: 364594 - DNA, 20 bp, human
gacggctcgccctgaccaat

SEQ ID NO: 364595 - DNA, 20 bp, human
gggcagatgtcagggtcttc

SEQ ID NO: 364596 - DNA, 20 bp, human
gcggagggagagcgggagat

SEQ ID NO: 364597 - DNA, 20 bp, human
gcggccgagcgccgggcgga

SEQ ID NO: 364598 - DNA, 20 bp, human
gcgggcggttgccaagagac

SEQ ID NO: 364599 - DNA, 20 bp, human
gttgacgccagagcgacgcg

SEQ ID NO: 364600 - DNA, 20 bp, human
gtcaaagcgacgtcaatggg

SEQ ID NO: 364601 - DNA, 20 bp, human
gaccgcgggccggtgacgtc

SEQ ID NO: 364602 - DNA, 20 bp, human
ggcgtcaaagcgacgtcaat

SEQ ID NO: 364603 - DNA, 20 bp, human
ggcggctccgggctgacatg

SEQ ID NO: 364604 - DNA, 20 bp, human
gcaccggcccgcggtcgcca

SEQ ID NO: 364605 - DNA, 20 bp, human
gagggggcggggactacggg

SEQ ID NO: 364606 - DNA, 20 bp, human
gcccgcccctggcagcggtg

SEQ ID NO: 364607 - DNA, 20 bp, human
gaccgaagcaccgccgacgt

SEQ ID NO: 364608 - DNA, 20 bp, human
gggcgggcccgagcctggat

SEQ ID NO: 364609 - DNA, 20 bp, human
gcgcctggaaggccgaggaa

SEQ ID NO: 364610 - DNA, 20 bp, human
gacgtcggctgctggagagt

SEQ ID NO: 364611 - DNA, 20 bp, human
gtcgccatggtgaccaatcc

SEQ ID NO: 364612 - DNA, 20 bp, human
gctccagcagccgacgtcgg

SEQ ID NO: 364613 - DNA, 20 bp, human
ggacgtgcgccgacgtcagg

SEQ ID NO: 364614 - DNA, 20 bp, human
ggcgaccccgcccctggcag

SEQ ID NO: 364615 - DNA, 20 bp, human
ggggtgcagagacctggatg

SEQ ID NO: 364616 - DNA, 20 bp, human
gaaccggggcccacgcggga

SEQ ID NO: 364617 - DNA, 20 bp, human
ggcaaccgtgacctcaccgg

SEQ ID NO: 364618 - DNA, 20 bp, human
ggggctcgaccttcccgcgt

SEQ ID NO: 364619 - DNA, 20 bp, human
gggtgaggtcacggttgcca

SEQ ID NO: 364620 - DNA, 20 bp, human
ggggccgcggacgtcactcg

SEQ ID NO: 364621 - DNA, 20 bp, human
ggagccagcgcctcaggaac

SEQ ID NO: 364622 - DNA, 20 bp, human
gcaggaaccggggcccacgc

SEQ ID NO: 364623 - DNA, 20 bp, human
gcctccccgagtgacgtccg

SEQ ID NO: 364624 - DNA, 20 bp, human
ggctcccgggtgcccccctc

SEQ ID NO: 364625 - DNA, 20 bp, human
gggcggtgggaaccttcgat

SEQ ID NO: 364626 - DNA, 20 bp, human
gcgtggcaagtgtaggtctg

SEQ ID NO: 364627 - DNA, 20 bp, human
gctggggctccgcgcaagga

SEQ ID NO: 364628 - DNA, 20 bp, human
gcagtggcagcctattttgc

SEQ ID NO: 364629 - DNA, 20 bp, human
gaccaccaggctgtggtaac

SEQ ID NO: 364630 - DNA, 20 bp, human
gaggaagccgcaggttaaag

SEQ ID NO: 364631 - DNA, 20 bp, human
gcgcgcaaggaaggactgca

SEQ ID NO: 364632 - DNA, 20 bp, human
gaggactgcaaggaagccgc

SEQ ID NO: 364633 - DNA, 20 bp, human
gaaataggctgccactgcgc

SEQ ID NO: 364634 - DNA, 20 bp, human
gcctacacttgccacgccgt

SEQ ID NO: 364635 - DNA, 20 bp, human
ggcgactcgctcagatcttc

SEQ ID NO: 364636 - DNA, 20 bp, human
gcccccgtgcccctcccctt

SEQ ID NO: 364637 - DNA, 20 bp, human
gtccccctgcgcaaacgcgg

SEQ ID NO: 364638 - DNA, 20 bp, human
gcgcggcctcgcccaatcgc

SEQ ID NO: 364639 - DNA, 20 bp, human
gcccccgccccgcaccgagg

SEQ ID NO: 364640 - DNA, 20 bp, human
gcggcggcgaccgtctgagc

SEQ ID NO: 364641 - DNA, 20 bp, human
ggcgccgcgcgctggtctgg

SEQ ID NO: 364642 - DNA, 20 bp, human
gtggtctggcggcccgcgat

SEQ ID NO: 364643 - DNA, 20 bp, human
gctcgtgcaagagtctgcag

SEQ ID NO: 364644 - DNA, 20 bp, human
gctcccacctcggtgcgggg

SEQ ID NO: 364645 - DNA, 20 bp, human
gcagccctccctccccccaa

SEQ ID NO: 364646 - DNA, 20 bp, human
gagggctgagtgacacgagt

SEQ ID NO: 364647 - DNA, 20 bp, human
gccaggggcgaggcgctcat

SEQ ID NO: 364648 - DNA, 20 bp, human
gaagccccctcgcctcccat

SEQ ID NO: 364649 - DNA, 20 bp, human
gtcgtgtcactcagccctat

SEQ ID NO: 364650 - DNA, 20 bp, human
gggcttgtgagtggcattga

SEQ ID NO: 364651 - DNA, 20 bp, human
gaggagtccagcggtcccgc

SEQ ID NO: 364652 - DNA, 20 bp, human
gttactacccgcgggaccgc

SEQ ID NO: 364653 - DNA, 20 bp, human
gcaaccggacagcgccgacc

SEQ ID NO: 364654 - DNA, 20 bp, human
gcattggcctggcgcggcca

SEQ ID NO: 364655 - DNA, 20 bp, human
gcagaaccgggaacgtccgg

SEQ ID NO: 364656 - DNA, 20 bp, human
ggggacccgctcctgagcgc

SEQ ID NO: 364657 - DNA, 20 bp, human
gggagcgcgcgggtctctcc

SEQ ID NO: 364658 - DNA, 20 bp, human
gaggcgcgcctgtgactcca

SEQ ID NO: 364659 - DNA, 20 bp, human
gtctctcccgggagagtccc

SEQ ID NO: 364660 - DNA, 20 bp, human
gcctccgcgtcgctgcctcc

SEQ ID NO: 364661 - DNA, 20 bp, human
gaccccggagctaggatggg

SEQ ID NO: 364662 - DNA, 20 bp, human
gtgcctccagggactctccc

SEQ ID NO: 364663 - DNA, 20 bp, human
gtggacctgcaacaccggga

SEQ ID NO: 364664 - DNA, 20 bp, human
gtgtgactccagggccgcgg

SEQ ID NO: 364665 - DNA, 20 bp, human
gctcccgggagagtccctgg

SEQ ID NO: 364666 - DNA, 20 bp, human
gcccccgagtgaccgagggt

SEQ ID NO: 364667 - DNA, 20 bp, human
gtcacctaccctcggtcact

SEQ ID NO: 364668 - DNA, 20 bp, human
gtcgcaaactggtacaattt

SEQ ID NO: 364669 - DNA, 20 bp, human
gcctaaaagcggacttattg

SEQ ID NO: 364670 - DNA, 20 bp, human
gcaaactggtacaatttagg

SEQ ID NO: 364671 - DNA, 20 bp, human
gagcggacttattggggcaa

SEQ ID NO: 364672 - DNA, 20 bp, human
gcctgagagacacatattgt

SEQ ID NO: 364673 - DNA, 20 bp, human
gtaggataaatgcctaaaag

SEQ ID NO: 364674 - DNA, 20 bp, human
gacaatttaggagggtaatt

SEQ ID NO: 364675 - DNA, 20 bp, human
gtatcaaaactacaaaaaca

SEQ ID NO: 364676 - DNA, 20 bp, human
gaataggcggggttgagtta

SEQ ID NO: 364677 - DNA, 20 bp, human
gggaagctccccgccaatag

SEQ ID NO: 364678 - DNA, 20 bp, human
gcaaccccgcctattggaga

SEQ ID NO: 364679 - DNA, 20 bp, human
gcctaccagtcgagggggaa

SEQ ID NO: 364680 - DNA, 20 bp, human
gccccctcgactggtagggg

SEQ ID NO: 364681 - DNA, 20 bp, human
gcccctcccctaccagtcga

SEQ ID NO: 364682 - DNA, 20 bp, human
gccccgagccccaacactat

SEQ ID NO: 364683 - DNA, 20 bp, human
gtcagcagtccgtctccaat

SEQ ID NO: 364684 - DNA, 20 bp, human
ggccaataggggcgtggaga

SEQ ID NO: 364685 - DNA, 20 bp, human
gagtccgtctccaataggcg

SEQ ID NO: 364686 - DNA, 20 bp, human
ggacctcaagaaactcgagt

SEQ ID NO: 364687 - DNA, 20 bp, human
ggcggcctccccccagtccg

SEQ ID NO: 364688 - DNA, 20 bp, human
gcgagtgggagacgcatccg

SEQ ID NO: 364689 - DNA, 20 bp, human
gaaactcgagtcggcggcga

SEQ ID NO: 364690 - DNA, 20 bp, human
gggcggcgagggagctatat

SEQ ID NO: 364691 - DNA, 20 bp, human
gccggggagccaatagcccg

SEQ ID NO: 364692 - DNA, 20 bp, human
gtggaactaggtaggagaga

SEQ ID NO: 364693 - DNA, 20 bp, human
gaggagggggcgttcaatga

SEQ ID NO: 364694 - DNA, 20 bp, human
gctcaagaaactcgagtcgg

SEQ ID NO: 364695 - DNA, 20 bp, human
ggaagaggcggggcgaaggg

SEQ ID NO: 364696 - DNA, 20 bp, human
gcggggccggacaaagtagg

SEQ ID NO: 364697 - DNA, 20 bp, human
gttgcggggccggacaaagt

SEQ ID NO: 364698 - DNA, 20 bp, human
ggataccaatcttaaggaga

SEQ ID NO: 364699 - DNA, 20 bp, human
gcggggtttgatgacgttga

SEQ ID NO: 364700 - DNA, 20 bp, human
gcaaagtaggcggcgggtct

SEQ ID NO: 364701 - DNA, 20 bp, human
gagaagccaggtaaacgcgt

SEQ ID NO: 364702 - DNA, 20 bp, human
gcgtgcgccatgtccgaagt

SEQ ID NO: 364703 - DNA, 20 bp, human
gaccccgcctccaaaggcgg

SEQ ID NO: 364704 - DNA, 20 bp, human
ggtttgatgacgttgagggg

SEQ ID NO: 364705 - DNA, 20 bp, human
gcaaaccccgcctccaaagg

SEQ ID NO: 364706 - DNA, 20 bp, human
gtggcctccgctagccctcc

SEQ ID NO: 364707 - DNA, 20 bp, human
gaggcaggcacaagtttctc

SEQ ID NO: 364708 - DNA, 20 bp, human
gcaaccgggagggctagcgg

SEQ ID NO: 364709 - DNA, 20 bp, human
gccctcccggttggtctgga

SEQ ID NO: 364710 - DNA, 20 bp, human
ggcggcgggaagcgcagcag

SEQ ID NO: 364711 - DNA, 20 bp, human
gctagccctcccggttggtc

SEQ ID NO: 364712 - DNA, 20 bp, human
gtggccgggagctggacgct

SEQ ID NO: 364713 - DNA, 20 bp, human
gctagtggaatggttgccca

SEQ ID NO: 364714 - DNA, 20 bp, human
gtcccgccgcagacagctcc

SEQ ID NO: 364715 - DNA, 20 bp, human
gccgggagctggacgctagg

SEQ ID NO: 364716 - DNA, 20 bp, human
gtacccgagggcaccagttc

SEQ ID NO: 364717 - DNA, 20 bp, human
gcggaagggaaagtcgagga

SEQ ID NO: 364718 - DNA, 20 bp, human
gcgcgtgtgccaccgcccga

SEQ ID NO: 364719 - DNA, 20 bp, human
gggagggaggggtccaaagc

SEQ ID NO: 364720 - DNA, 20 bp, human
ggagtaggggacaaaggcgg

SEQ ID NO: 364721 - DNA, 20 bp, human
gccctcgggtaagcgacttc

SEQ ID NO: 364722 - DNA, 20 bp, human
ggtcccctactcctgcggaa

SEQ ID NO: 364723 - DNA, 20 bp, human
gcctgcggaagggaaagtcg

SEQ ID NO: 364724 - DNA, 20 bp, human
ggagctggagtggtaaactg

SEQ ID NO: 364725 - DNA, 20 bp, human
gaccagaagtcgcttacccg

SEQ ID NO: 364726 - DNA, 20 bp, human
gaagactcgctgctatttaa

SEQ ID NO: 364727 - DNA, 20 bp, human
ggggtgaggcgagctctggc

SEQ ID NO: 364728 - DNA, 20 bp, human
gtgcagggtgaggcgagctc

SEQ ID NO: 364729 - DNA, 20 bp, human
gggaggcaggaagccgacta

SEQ ID NO: 364730 - DNA, 20 bp, human
gctcgctgctatttaaaggc

SEQ ID NO: 364731 - DNA, 20 bp, human
gtgaacaggtgtttgcattt

SEQ ID NO: 364732 - DNA, 20 bp, human
ggcctcaccctgcattctgc

SEQ ID NO: 364733 - DNA, 20 bp, human
ggaaatgaaagcgcctgcct

SEQ ID NO: 364734 - DNA, 20 bp, human
gtttaaaggctggaacatgt

SEQ ID NO: 364735 - DNA, 20 bp, human
gaagcgcctgccttggaggc

SEQ ID NO: 364736 - DNA, 20 bp, human
ggagactggcggtggtggtc

SEQ ID NO: 364737 - DNA, 20 bp, human
gctaacatgcaaggcactgt

SEQ ID NO: 364738 - DNA, 20 bp, human
gccaccaccgccagtctcat

SEQ ID NO: 364739 - DNA, 20 bp, human
gaccccagctgtgcccaaga

SEQ ID NO: 364740 - DNA, 20 bp, human
gttgctctcacacccatctt

SEQ ID NO: 364741 - DNA, 20 bp, human
gcaaggcactgtgggaaagc

SEQ ID NO: 364742 - DNA, 20 bp, human
gccttggaacagtccttttt

SEQ ID NO: 364743 - DNA, 20 bp, human
gtgcttagatgcaattaggg

SEQ ID NO: 364744 - DNA, 20 bp, human
gttcataactggtctgagac

SEQ ID NO: 364745 - DNA, 20 bp, human
gtccaaggagctaacatgca

SEQ ID NO: 364746 - DNA, 20 bp, human
gccccgaggggcgtgaggga

SEQ ID NO: 364747 - DNA, 20 bp, human
gacagactggagctgcacga

SEQ ID NO: 364748 - DNA, 20 bp, human
gagcacttccgcagccccga

SEQ ID NO: 364749 - DNA, 20 bp, human
gcagcgcggcggtgcgccta

SEQ ID NO: 364750 - DNA, 20 bp, human
ggctgcacgaaggcgaccag

SEQ ID NO: 364751 - DNA, 20 bp, human
ggggggctgccgggagccgt

SEQ ID NO: 364752 - DNA, 20 bp, human
ggcttcgcgcgagtcctcct

SEQ ID NO: 364753 - DNA, 20 bp, human
gaaaagagaatggcgcgcgg

SEQ ID NO: 364754 - DNA, 20 bp, human
gcgagcctggcagagagtga

SEQ ID NO: 364755 - DNA, 20 bp, human
gcgcgaagcggcttggaagt

SEQ ID NO: 364756 - DNA, 20 bp, human
gcctccccccgactccggaa

SEQ ID NO: 364757 - DNA, 20 bp, human
gtggagcggggaaatgacta

SEQ ID NO: 364758 - DNA, 20 bp, human
ggggtctccaaaaaccgcgg

SEQ ID NO: 364759 - DNA, 20 bp, human
gcgggcggcgggaagacggg

SEQ ID NO: 364760 - DNA, 20 bp, human
ggggcagagcgggaccggtc

SEQ ID NO: 364761 - DNA, 20 bp, human
gaccgcgcgagcaggggcga

SEQ ID NO: 364762 - DNA, 20 bp, human
gcaggcgcccgttccggagt

SEQ ID NO: 364763 - DNA, 20 bp, human
gcgcccgttccggagtcggg

SEQ ID NO: 364764 - DNA, 20 bp, human
gccggaacgggcgcctggag

SEQ ID NO: 364765 - DNA, 20 bp, human
ggcggcgggaagacgggagg

SEQ ID NO: 364766 - DNA, 20 bp, human
gaaggagttaagacctcagg

SEQ ID NO: 364767 - DNA, 20 bp, human
gcaagacctcaggatgtggt

SEQ ID NO: 364768 - DNA, 20 bp, human
ggttaagacctcaggtggga

SEQ ID NO: 364769 - DNA, 20 bp, human
gaccaagaagacataaagat

SEQ ID NO: 364770 - DNA, 20 bp, human
gtggggttaggagtcatgga

SEQ ID NO: 364771 - DNA, 20 bp, human
gcaagaggaagtggctgcga

SEQ ID NO: 364772 - DNA, 20 bp, human
gacatcctgaggtcttgaga

SEQ ID NO: 364773 - DNA, 20 bp, human
ggggcaggatgagggatcac

SEQ ID NO: 364774 - DNA, 20 bp, human
gctggcttaagagcaccaaa

SEQ ID NO: 364775 - DNA, 20 bp, human
gactcagttggggcaggatg

SEQ ID NO: 364776 - DNA, 20 bp, human
gaggaaggagcccggtcaaa

SEQ ID NO: 364777 - DNA, 20 bp, human
gaggtgggcactgaggtcat

SEQ ID NO: 364778 - DNA, 20 bp, human
gctaaaaggaggcccccatg

SEQ ID NO: 364779 - DNA, 20 bp, human
ggacgcactccagaatcggg

SEQ ID NO: 364780 - DNA, 20 bp, human
gaagcaggaaaccctttgac

SEQ ID NO: 364781 - DNA, 20 bp, human
gccatcctaggtgcccggga

SEQ ID NO: 364782 - DNA, 20 bp, human
gataggacgcactccagaat

SEQ ID NO: 364783 - DNA, 20 bp, human
gggctccatcctaggtgccc

SEQ ID NO: 364784 - DNA, 20 bp, human
gggtttcctgcttttgtgtc

SEQ ID NO: 364785 - DNA, 20 bp, human
ggatgtgcagaaagtagagg

SEQ ID NO: 364786 - DNA, 20 bp, human
gaaactcaggaaggagtata

SEQ ID NO: 364787 - DNA, 20 bp, human
gaggaaggagtataaggctg

SEQ ID NO: 364788 - DNA, 20 bp, human
gtggggagaacctgtgagat

SEQ ID NO: 364789 - DNA, 20 bp, human
gcaagctaggaagttgctgc

SEQ ID NO: 364790 - DNA, 20 bp, human
gtactctggagtgcaagaaa

SEQ ID NO: 364791 - DNA, 20 bp, human
ggaggctcctagataggcaa

SEQ ID NO: 364792 - DNA, 20 bp, human
gctaggagcctcagacacat

SEQ ID NO: 364793 - DNA, 20 bp, human
gagacacataggctagacaa

SEQ ID NO: 364794 - DNA, 20 bp, human
ggatgggatgaaactcagga

SEQ ID NO: 364795 - DNA, 20 bp, human
gggtccctccatacactacc

SEQ ID NO: 364796 - DNA, 20 bp, human
gaccaagaagacctgaaaat

SEQ ID NO: 364797 - DNA, 20 bp, human
gggacacgaggagggagcac

SEQ ID NO: 364798 - DNA, 20 bp, human
gtgggtttggggacacgagg

SEQ ID NO: 364799 - DNA, 20 bp, human
gagattgtgacttacaaatc

SEQ ID NO: 364800 - DNA, 20 bp, human
gttgacttaaaagcctcaaa

SEQ ID NO: 364801 - DNA, 20 bp, human
gcacaggacctgctcaacac

SEQ ID NO: 364802 - DNA, 20 bp, human
gcaggcacatgaaagtgcta

SEQ ID NO: 364803 - DNA, 20 bp, human
gcaaccaaatgccactccgc

SEQ ID NO: 364804 - DNA, 20 bp, human
gacccattttcaggtcttct

SEQ ID NO: 364805 - DNA, 20 bp, human
gttttcaggataatcagaca

SEQ ID NO: 364806 - DNA, 20 bp, human
gccgagtgcgcttccagccc

SEQ ID NO: 364807 - DNA, 20 bp, human
gtctaccgctccgcctgggc

SEQ ID NO: 364808 - DNA, 20 bp, human
gacactacgggtcacgtggc

SEQ ID NO: 364809 - DNA, 20 bp, human
gggccagaccacaacactac

SEQ ID NO: 364810 - DNA, 20 bp, human
gatggggcgggtcacgtgat

SEQ ID NO: 364811 - DNA, 20 bp, human
gggcgctcccgccacccacg

SEQ ID NO: 364812 - DNA, 20 bp, human
ggcttccagcccaggcggag

SEQ ID NO: 364813 - DNA, 20 bp, human
gctggaagcgcactcggccc

SEQ ID NO: 364814 - DNA, 20 bp, human
gcacgtgacccgtagtgttg

SEQ ID NO: 364815 - DNA, 20 bp, human
gtgcgtctaccgctccgcct

SEQ ID NO: 364816 - DNA, 20 bp, human
gaatgggagtggccgtgata

SEQ ID NO: 364817 - DNA, 20 bp, human
gcgcccggaaaatgtgggaa

SEQ ID NO: 364818 - DNA, 20 bp, human
gcacccagagcgccccagtt

SEQ ID NO: 364819 - DNA, 20 bp, human
gtggtcaggatgcagtacga

SEQ ID NO: 364820 - DNA, 20 bp, human
gccttctgggactcgtagtc

SEQ ID NO: 364821 - DNA, 20 bp, human
gtaagaaagcgcgcgaggac

SEQ ID NO: 364822 - DNA, 20 bp, human
gaagggcgcccggaaaatgt

SEQ ID NO: 364823 - DNA, 20 bp, human
gcgggcgccctttaccaaca

SEQ ID NO: 364824 - DNA, 20 bp, human
gtcagcagccatgttggtaa

SEQ ID NO: 364825 - DNA, 20 bp, human
ggtggcgtcagcagccatgt

SEQ ID NO: 364826 - DNA, 20 bp, human
gcgcgcccaggtagacgtag

SEQ ID NO: 364827 - DNA, 20 bp, human
gtagacgtagaggcgagtag

SEQ ID NO: 364828 - DNA, 20 bp, human
gggaggcgtcggcaaggagg

SEQ ID NO: 364829 - DNA, 20 bp, human
gcgcgccggaggcgtcggca

SEQ ID NO: 364830 - DNA, 20 bp, human
gctgggcgcgccggaggcgt

SEQ ID NO: 364831 - DNA, 20 bp, human
gggaaatgctcactcacttc

SEQ ID NO: 364832 - DNA, 20 bp, human
ggagatgagacaccagacta

SEQ ID NO: 364833 - DNA, 20 bp, human
gctcgcctctacgtctacct

SEQ ID NO: 364834 - DNA, 20 bp, human
gggctccaggtttgacctcc

SEQ ID NO: 364835 - DNA, 20 bp, human
gtgaaaaaggtgtgagcgca

SEQ ID NO: 364836 - DNA, 20 bp, human
gtgaccagaaagagccgaca

SEQ ID NO: 364837 - DNA, 20 bp, human
gatccaggaacgccccctgt

SEQ ID NO: 364838 - DNA, 20 bp, human
gtgtcaattgcgagacgcgg

SEQ ID NO: 364839 - DNA, 20 bp, human
ggccccctgtcggctctttc

SEQ ID NO: 364840 - DNA, 20 bp, human
gtgacagccccagatcatcc

SEQ ID NO: 364841 - DNA, 20 bp, human
gggctgtcaattgcgagacg

SEQ ID NO: 364842 - DNA, 20 bp, human
gaaagcttttatattaacgg

SEQ ID NO: 364843 - DNA, 20 bp, human
gtcgcatcatttaagctttc

SEQ ID NO: 364844 - DNA, 20 bp, human
gggcgttcctggatgatctg

SEQ ID NO: 364845 - DNA, 20 bp, human
gagccgacagggggcgttcc

SEQ ID NO: 364846 - DNA, 20 bp, human
gcctgccgcgggctcgcgag

SEQ ID NO: 364847 - DNA, 20 bp, human
gcggaggtggcaccggtccg

SEQ ID NO: 364848 - DNA, 20 bp, human
gcgagcccgcggcaggccct

SEQ ID NO: 364849 - DNA, 20 bp, human
gtcaccagcccgggaccgca

SEQ ID NO: 364850 - DNA, 20 bp, human
gtggctagcggttggaggaa

SEQ ID NO: 364851 - DNA, 20 bp, human
gacctccgctcgcgagcccg

SEQ ID NO: 364852 - DNA, 20 bp, human
ggctagccagtcaccagccc

SEQ ID NO: 364853 - DNA, 20 bp, human
gcgtgggagactgtattcgg

SEQ ID NO: 364854 - DNA, 20 bp, human
ggcaggcagagacgcacctg

SEQ ID NO: 364855 - DNA, 20 bp, human
gtctctgcctgcgccgggcc

SEQ ID NO: 364856 - DNA, 20 bp, human
gcgcctgcggcgtcagcaag

SEQ ID NO: 364857 - DNA, 20 bp, human
gggtgcgcaggactggaacg

SEQ ID NO: 364858 - DNA, 20 bp, human
gggctccccgatgacccggg

SEQ ID NO: 364859 - DNA, 20 bp, human
gggcgcatgcgccttgccgt

SEQ ID NO: 364860 - DNA, 20 bp, human
gggcggaagcggcctcaaca

SEQ ID NO: 364861 - DNA, 20 bp, human
gatgacccgggcgggaaatt

SEQ ID NO: 364862 - DNA, 20 bp, human
gaaggggctccccgatgacc

SEQ ID NO: 364863 - DNA, 20 bp, human
ggaggccgggtgcgcaggac

SEQ ID NO: 364864 - DNA, 20 bp, human
gcccgggcgggaaattgggg

SEQ ID NO: 364865 - DNA, 20 bp, human
ggtggggcagtcgaggatgt

SEQ ID NO: 364866 - DNA, 20 bp, human
gtacagcaataaatacccgg

SEQ ID NO: 364867 - DNA, 20 bp, human
gagactggcaggtgcttctt

SEQ ID NO: 364868 - DNA, 20 bp, human
gagcgctcacacttcgtgta

SEQ ID NO: 364869 - DNA, 20 bp, human
gacacggcaggccgcgctca

SEQ ID NO: 364870 - DNA, 20 bp, human
gcagggcgcatgcgcaagat

SEQ ID NO: 364871 - DNA, 20 bp, human
gacctgccagtctctttaaa

SEQ ID NO: 364872 - DNA, 20 bp, human
gccctgcctaggtctagcca

SEQ ID NO: 364873 - DNA, 20 bp, human
gcttctttggggcgacgcgg

SEQ ID NO: 364874 - DNA, 20 bp, human
ggctcacacttcgtgtaggg

SEQ ID NO: 364875 - DNA, 20 bp, human
gtttggggcgacgcggcggg

SEQ ID NO: 364876 - DNA, 20 bp, human
gagaagagaagcaggcctgt

SEQ ID NO: 364877 - DNA, 20 bp, human
gcccgtggcacattacccac

SEQ ID NO: 364878 - DNA, 20 bp, human
gtacgggcctgaggagggat

SEQ ID NO: 364879 - DNA, 20 bp, human
gaggcctgcttctcttctca

SEQ ID NO: 364880 - DNA, 20 bp, human
gtcttctcaaggggggcaaa

SEQ ID NO: 364881 - DNA, 20 bp, human
ggcaaagtctctggtttccg

SEQ ID NO: 364882 - DNA, 20 bp, human
gctgcttctcttctcaaggg

SEQ ID NO: 364883 - DNA, 20 bp, human
ggcctgtgggtaatgtgcca

SEQ ID NO: 364884 - DNA, 20 bp, human
gaagtgctgtggaaaccgtc

SEQ ID NO: 364885 - DNA, 20 bp, human
gatgggagtaagaagtgctg

SEQ ID NO: 364886 - DNA, 20 bp, human
ggagcgacgcggcgcgtcat

SEQ ID NO: 364887 - DNA, 20 bp, human
gaggctgcgggcgaagtggg

SEQ ID NO: 364888 - DNA, 20 bp, human
gaggccgagggagagatcgg

SEQ ID NO: 364889 - DNA, 20 bp, human
gcgagagcgggtttgaggag

SEQ ID NO: 364890 - DNA, 20 bp, human
gggtcaggacggtgcaacga

SEQ ID NO: 364891 - DNA, 20 bp, human
gcataggctgcgggcgaagt

SEQ ID NO: 364892 - DNA, 20 bp, human
ggcggcgcgggataggccga

SEQ ID NO: 364893 - DNA, 20 bp, human
gtcacggcgtcgttggtaag

SEQ ID NO: 364894 - DNA, 20 bp, human
gtggcccctggcctttcccg

SEQ ID NO: 364895 - DNA, 20 bp, human
gggactcgacgccgcgggaa

SEQ ID NO: 364896 - DNA, 20 bp, human
gtgccggcggcgcctatccg

SEQ ID NO: 364897 - DNA, 20 bp, human
gttaaagcgcgcagcgtccc

SEQ ID NO: 364898 - DNA, 20 bp, human
gtggctggccagccccggat

SEQ ID NO: 364899 - DNA, 20 bp, human
ggcgtccccggcacgctgat

SEQ ID NO: 364900 - DNA, 20 bp, human
ggaagccagttggggtctga

SEQ ID NO: 364901 - DNA, 20 bp, human
ggtctgagggagctgcgctg

SEQ ID NO: 364902 - DNA, 20 bp, human
gcacgctgattggctgccgg

SEQ ID NO: 364903 - DNA, 20 bp, human
gtgagggagctgcgctgcgg

SEQ ID NO: 364904 - DNA, 20 bp, human
gggtccgcgcatgcagcctc

SEQ ID NO: 364905 - DNA, 20 bp, human
gagctgcgctgcggaggtgt

SEQ ID NO: 364906 - DNA, 20 bp, human
ggggcgaagacgaaaagggg

SEQ ID NO: 364907 - DNA, 20 bp, human
gggcggatgcccaaagaggg

SEQ ID NO: 364908 - DNA, 20 bp, human
ggcccggcccgccgaggctc

SEQ ID NO: 364909 - DNA, 20 bp, human
ggagcggggcgatctgtcag

SEQ ID NO: 364910 - DNA, 20 bp, human
gaggccccgggtcagataac

SEQ ID NO: 364911 - DNA, 20 bp, human
gaaaaggggtggatcgaggt

SEQ ID NO: 364912 - DNA, 20 bp, human
gccgctccgcgcagaactga

SEQ ID NO: 364913 - DNA, 20 bp, human
gggtccggttatctgacccg

SEQ ID NO: 364914 - DNA, 20 bp, human
gtcactggtaacccgagcct

SEQ ID NO: 364915 - DNA, 20 bp, human
ggtgactgacagcgtctcca

SEQ ID NO: 364916 - DNA, 20 bp, human
gtggcagggctgacagtgat

SEQ ID NO: 364917 - DNA, 20 bp, human
gggtctgtggcgtgtcgttg

SEQ ID NO: 364918 - DNA, 20 bp, human
gaataccgagaacgtaagga

SEQ ID NO: 364919 - DNA, 20 bp, human
gggctgacagtgattggcag

SEQ ID NO: 364920 - DNA, 20 bp, human
gttctcggtattgattggca

SEQ ID NO: 364921 - DNA, 20 bp, human
gaaaaccgtccttacgttct

SEQ ID NO: 364922 - DNA, 20 bp, human
gtgtcgttgtggcgttgcca

SEQ ID NO: 364923 - DNA, 20 bp, human
gaatcaataccgagaacgta

SEQ ID NO: 364924 - DNA, 20 bp, human
ggggatgtgcaattagagag

SEQ ID NO: 364925 - DNA, 20 bp, human
gtgattggcagtggttgccg

SEQ ID NO: 364926 - DNA, 20 bp, human
gtcccccaacgtgactcctc

SEQ ID NO: 364927 - DNA, 20 bp, human
ggcaaccggaggagtcacgt

SEQ ID NO: 364928 - DNA, 20 bp, human
ggggaggcgggtgatcgaca

SEQ ID NO: 364929 - DNA, 20 bp, human
gcccaggcacctatacctga

SEQ ID NO: 364930 - DNA, 20 bp, human
ggcatactatatggcagtgg

SEQ ID NO: 364931 - DNA, 20 bp, human
gccatatagtatgcagcaac

SEQ ID NO: 364932 - DNA, 20 bp, human
gtggctatttcgcattcaga

SEQ ID NO: 364933 - DNA, 20 bp, human
gcccggcctagccacctcat

SEQ ID NO: 364934 - DNA, 20 bp, human
gggcgggaaattacctaatg

SEQ ID NO: 364935 - DNA, 20 bp, human
gctttccaagccacgctcct

SEQ ID NO: 364936 - DNA, 20 bp, human
gaagcggccgaatcagggtt

SEQ ID NO: 364937 - DNA, 20 bp, human
gccgcagcgggccaatccgg

SEQ ID NO: 364938 - DNA, 20 bp, human
gcggagccgggaattccgag

SEQ ID NO: 364939 - DNA, 20 bp, human
ggcgcaggcgcagtggaagg

SEQ ID NO: 364940 - DNA, 20 bp, human
gcgtgcgcaggcgcagtgga

SEQ ID NO: 364941 - DNA, 20 bp, human
ggccacgcgcatccgctcct

SEQ ID NO: 364942 - DNA, 20 bp, human
gccctcttctcgacgctcgg

SEQ ID NO: 364943 - DNA, 20 bp, human
gtggaggcggccgaaggtct

SEQ ID NO: 364944 - DNA, 20 bp, human
gatgcgaagcggccgaatca

SEQ ID NO: 364945 - DNA, 20 bp, human
gtcccaggagcggatgcgcg

SEQ ID NO: 364946 - DNA, 20 bp, human
ggagaccccctgtcagtcac

SEQ ID NO: 364947 - DNA, 20 bp, human
gagaaaaagagaggcgagtg

SEQ ID NO: 364948 - DNA, 20 bp, human
gggcgggcgctgtcgagcac

SEQ ID NO: 364949 - DNA, 20 bp, human
gggaggggtagagcggggtg

SEQ ID NO: 364950 - DNA, 20 bp, human
gaagtccaggagctaacggc

SEQ ID NO: 364951 - DNA, 20 bp, human
gagcgcccgccgttagctcc

SEQ ID NO: 364952 - DNA, 20 bp, human
gagccacccggtgactgaca

SEQ ID NO: 364953 - DNA, 20 bp, human
ggactgacagggggtctcca

SEQ ID NO: 364954 - DNA, 20 bp, human
gtgctgattcaagctttgat

SEQ ID NO: 364955 - DNA, 20 bp, human
gaaaagacatgcgagtgtct

SEQ ID NO: 364956 - DNA, 20 bp, human
gggacgaaagggtaacccgg

SEQ ID NO: 364957 - DNA, 20 bp, human
ggcggggcttccggacgaaa

SEQ ID NO: 364958 - DNA, 20 bp, human
gccgtcgccccgcctttccc

SEQ ID NO: 364959 - DNA, 20 bp, human
gacggcgaaggcggggcttc

SEQ ID NO: 364960 - DNA, 20 bp, human
ggccgagccggggaaaggcg

SEQ ID NO: 364961 - DNA, 20 bp, human
ggccccggatgacgcaaacc

SEQ ID NO: 364962 - DNA, 20 bp, human
gtccggacgaaagggtaacc

SEQ ID NO: 364963 - DNA, 20 bp, human
ggctgcccctggtgactcta

SEQ ID NO: 364964 - DNA, 20 bp, human
gtgacgcaaaccgggaacag

SEQ ID NO: 364965 - DNA, 20 bp, human
ggcggggcgacggcgaaggc

SEQ ID NO: 364966 - DNA, 20 bp, human
gcaaaggcacaaaacgccgc

SEQ ID NO: 364967 - DNA, 20 bp, human
gcaaaacgccgcaggaggat

SEQ ID NO: 364968 - DNA, 20 bp, human
gctcccgcccattggagact

SEQ ID NO: 364969 - DNA, 20 bp, human
ggcacagcccggcttgtgat

SEQ ID NO: 364970 - DNA, 20 bp, human
gttacccagtctccaatggg

SEQ ID NO: 364971 - DNA, 20 bp, human
ggaggccctccgtgctagta

SEQ ID NO: 364972 - DNA, 20 bp, human
gtccaatgggcgggagccgg

SEQ ID NO: 364973 - DNA, 20 bp, human
gggcgttacccagtctccaa

SEQ ID NO: 364974 - DNA, 20 bp, human
gtccaccggctcccgcccat

SEQ ID NO: 364975 - DNA, 20 bp, human
ggcgggagccggtggaacgg

SEQ ID NO: 364976 - DNA, 20 bp, human
gcggccgccagcagacgccg

SEQ ID NO: 364977 - DNA, 20 bp, human
gtaagcgcacccgtctcgcg

SEQ ID NO: 364978 - DNA, 20 bp, human
ggggcctcggcgagagactt

SEQ ID NO: 364979 - DNA, 20 bp, human
gcgtctcgcggggtctcctg

SEQ ID NO: 364980 - DNA, 20 bp, human
ggacgggtgcgcttacgcca

SEQ ID NO: 364981 - DNA, 20 bp, human
gacgccacggcgtctgctgg

SEQ ID NO: 364982 - DNA, 20 bp, human
gtaaggccagcaggcgaaga

SEQ ID NO: 364983 - DNA, 20 bp, human
ggtgagtagctgtgcgaatt

SEQ ID NO: 364984 - DNA, 20 bp, human
gtcaagactctgcgtctccg

SEQ ID NO: 364985 - DNA, 20 bp, human
ggagccgaagtctctcgccg

SEQ ID NO: 364986 - DNA, 20 bp, human
gggcaggcggggaccggaac

SEQ ID NO: 364987 - DNA, 20 bp, human
gccccacggtagaaggattg

SEQ ID NO: 364988 - DNA, 20 bp, human
ggccggagccccacggtaga

SEQ ID NO: 364989 - DNA, 20 bp, human
gccacggggtgcctgaagta

SEQ ID NO: 364990 - DNA, 20 bp, human
gcgcggggcgtgggtgcacg

SEQ ID NO: 364991 - DNA, 20 bp, human
gggcgcgtcaggaagtggcg

SEQ ID NO: 364992 - DNA, 20 bp, human
ggcgtggcagcaagggacac

SEQ ID NO: 364993 - DNA, 20 bp, human
ggaggggtgctatgcttgac

SEQ ID NO: 364994 - DNA, 20 bp, human
gatggagtgtccaaagccgt

SEQ ID NO: 364995 - DNA, 20 bp, human
gtgaactggaccggcaattg

SEQ ID NO: 364996 - DNA, 20 bp, human
ggggtgggaagggacacgaa

SEQ ID NO: 364997 - DNA, 20 bp, human
gtgcttcccggcgtagcggt

SEQ ID NO: 364998 - DNA, 20 bp, human
gggaggagccactggtggga

SEQ ID NO: 364999 - DNA, 20 bp, human
gccacgcccaccgctacgcc

SEQ ID NO: 365000 - DNA, 20 bp, human
gctcctgcttcccggcgtag

SEQ ID NO: 365001 - DNA, 20 bp, human
gtctggggccgggaaaaccg

SEQ ID NO: 365002 - DNA, 20 bp, human
gactgcgcatgtgtattcct

SEQ ID NO: 365003 - DNA, 20 bp, human
gaaacgatcagcagttgtga

SEQ ID NO: 365004 - DNA, 20 bp, human
gcgtccgggcgaagccagtc

SEQ ID NO: 365005 - DNA, 20 bp, human
ggcgctccggacgctggatc

SEQ ID NO: 365006 - DNA, 20 bp, human
ggaggcgcgaatcgccgcgg

SEQ ID NO: 365007 - DNA, 20 bp, human
gtcggcgcacatcctcccgg

SEQ ID NO: 365008 - DNA, 20 bp, human
ggcgaggccgcggccgtgat

SEQ ID NO: 365009 - DNA, 20 bp, human
gcacggccgcggcctcgccc

SEQ ID NO: 365010 - DNA, 20 bp, human
gcgggcgggcgcctcgcggt

SEQ ID NO: 365011 - DNA, 20 bp, human
gtggatgtggcgccgggccc

SEQ ID NO: 365012 - DNA, 20 bp, human
gggcccgcgagcgttggcgt

SEQ ID NO: 365013 - DNA, 20 bp, human
gcgcgaggcgcgaatcgccg

SEQ ID NO: 365014 - DNA, 20 bp, human
gtcctcccggcggctcgctc

SEQ ID NO: 365015 - DNA, 20 bp, human
ggcctcgcccgggggcgcga

SEQ ID NO: 365016 - DNA, 20 bp, human
gaggggaggtggcagtataa

SEQ ID NO: 365017 - DNA, 20 bp, human
ggggtggggtatctctcttt

SEQ ID NO: 365018 - DNA, 20 bp, human
gcgactgtattatttacttt

SEQ ID NO: 365019 - DNA, 20 bp, human
gccgcactggggtggttcac

SEQ ID NO: 365020 - DNA, 20 bp, human
gtaattgatgaaggtgtctc

SEQ ID NO: 365021 - DNA, 20 bp, human
gtaagggtatgctaattagt

SEQ ID NO: 365022 - DNA, 20 bp, human
gctaattagtgggagatttt

SEQ ID NO: 365023 - DNA, 20 bp, human
gcacggggcgggtttaactt

SEQ ID NO: 365024 - DNA, 20 bp, human
ggcagtgtgtgtacgcttaa

SEQ ID NO: 365025 - DNA, 20 bp, human
gctggggtggttcacggggc

SEQ ID NO: 365026 - DNA, 20 bp, human
ggggcccggccgccgatacc

SEQ ID NO: 365027 - DNA, 20 bp, human
ggcccgccgctgccttgggc

SEQ ID NO: 365028 - DNA, 20 bp, human
gcggcgcccgccgctgcctt

SEQ ID NO: 365029 - DNA, 20 bp, human
ggatacctggtaataggcgg

SEQ ID NO: 365030 - DNA, 20 bp, human
ggctgcaagcgcaagcgcgg

SEQ ID NO: 365031 - DNA, 20 bp, human
ggccgccgatacctggtaat

SEQ ID NO: 365032 - DNA, 20 bp, human
ggccgccgccgcctattacc

SEQ ID NO: 365033 - DNA, 20 bp, human
ggcgcttgcagcggtagctc

SEQ ID NO: 365034 - DNA, 20 bp, human
gcccagcccaaggcagcggc

SEQ ID NO: 365035 - DNA, 20 bp, human
gactgcgcgctgattggcag

SEQ ID NO: 365036 - DNA, 20 bp, human
ggccgcccgggggagagcga

SEQ ID NO: 365037 - DNA, 20 bp, human
gaagggaacggagccagcgg

SEQ ID NO: 365038 - DNA, 20 bp, human
gggcacgcgcgtccacgagg

SEQ ID NO: 365039 - DNA, 20 bp, human
gaggactcggtgacgtcaga

SEQ ID NO: 365040 - DNA, 20 bp, human
gcgagacgacggggccaggg

SEQ ID NO: 365041 - DNA, 20 bp, human
gcggggaggtgcagcattag

SEQ ID NO: 365042 - DNA, 20 bp, human
gggcacgcgcgcgagacgac

SEQ ID NO: 365043 - DNA, 20 bp, human
ggccctcgctctcccccggg

SEQ ID NO: 365044 - DNA, 20 bp, human
gccggcacagccgaagggag

SEQ ID NO: 365045 - DNA, 20 bp, human
gcccgggcggccggagacgg

SEQ ID NO: 365046 - DNA, 20 bp, human
gcgcgctggccgctgatagc

SEQ ID NO: 365047 - DNA, 20 bp, human
gtagcgaggagcggaaaacg

SEQ ID NO: 365048 - DNA, 20 bp, human
gcggaggggcagacctggac

SEQ ID NO: 365049 - DNA, 20 bp, human
gaggggcagacctggaccgg

SEQ ID NO: 365050 - DNA, 20 bp, human
gtgcgcgcctggggccgcct

SEQ ID NO: 365051 - DNA, 20 bp, human
gcgggcgcggccggagaccg

SEQ ID NO: 365052 - DNA, 20 bp, human
ggtgaactatcgctgcggag

SEQ ID NO: 365053 - DNA, 20 bp, human
ggcagagggccttacccgag

SEQ ID NO: 365054 - DNA, 20 bp, human
ggacccccctaccctcgcta

SEQ ID NO: 365055 - DNA, 20 bp, human
gagagcgtgaactatcgctg

SEQ ID NO: 365056 - DNA, 20 bp, human
gccaccctgcgcttcgatcc

SEQ ID NO: 365057 - DNA, 20 bp, human
ggaagcccggatcgaagcgc

SEQ ID NO: 365058 - DNA, 20 bp, human
ggcgaccgctgcctcgcaat

SEQ ID NO: 365059 - DNA, 20 bp, human
ggcggggcatcgtgggtagg

SEQ ID NO: 365060 - DNA, 20 bp, human
gggcagctggcgactcaagg

SEQ ID NO: 365061 - DNA, 20 bp, human
gctgtgcagtggtaccgtcg

SEQ ID NO: 365062 - DNA, 20 bp, human
ggtcgcggggcatcgtgggt

SEQ ID NO: 365063 - DNA, 20 bp, human
ggagagctcttcacattccc

SEQ ID NO: 365064 - DNA, 20 bp, human
ggctctggaagcagacacgg

SEQ ID NO: 365065 - DNA, 20 bp, human
gttcggtcgcggggcatcgt

SEQ ID NO: 365066 - DNA, 20 bp, human
gagagcgggacgcaggtgca

SEQ ID NO: 365067 - DNA, 20 bp, human
gctggcctctccagctagag

SEQ ID NO: 365068 - DNA, 20 bp, human
gcgtcccgctctagctggag

SEQ ID NO: 365069 - DNA, 20 bp, human
ggggctaagggggactcaag

SEQ ID NO: 365070 - DNA, 20 bp, human
gccgccgcgccatgcgctcc

SEQ ID NO: 365071 - DNA, 20 bp, human
gcgcgcctgccccgccactc

SEQ ID NO: 365072 - DNA, 20 bp, human
gagggcgctagcgactgcgc

SEQ ID NO: 365073 - DNA, 20 bp, human
gtggccctcgggaaccagta

SEQ ID NO: 365074 - DNA, 20 bp, human
gcccaagaacgaagtgggga

SEQ ID NO: 365075 - DNA, 20 bp, human
gcagtcgctagcgccctccc

SEQ ID NO: 365076 - DNA, 20 bp, human
gtgtccaaggcagacctgta

SEQ ID NO: 365077 - DNA, 20 bp, human
gaaatccgggataaggtctt

SEQ ID NO: 365078 - DNA, 20 bp, human
gtagaataactttcttgctt

SEQ ID NO: 365079 - DNA, 20 bp, human
gccaacggctcctataaatc

SEQ ID NO: 365080 - DNA, 20 bp, human
gtaaaagttacggaaaactg

SEQ ID NO: 365081 - DNA, 20 bp, human
gcaaattcctgcatttctaa

SEQ ID NO: 365082 - DNA, 20 bp, human
ggttaagacacgattattac

SEQ ID NO: 365083 - DNA, 20 bp, human
ggaaagttattctaattctt

SEQ ID NO: 365084 - DNA, 20 bp, human
ggaccttatcccggatttat

SEQ ID NO: 365085 - DNA, 20 bp, human
ggtacagataataaaagtta

SEQ ID NO: 365086 - DNA, 20 bp, human
gggcgcgcggcgtcacatcg

SEQ ID NO: 365087 - DNA, 20 bp, human
ggggcccgcccagccgttct

SEQ ID NO: 365088 - DNA, 20 bp, human
gcggctggccgggggatcgg

SEQ ID NO: 365089 - DNA, 20 bp, human
gcctgacggcaggccgagaa

SEQ ID NO: 365090 - DNA, 20 bp, human
gtggcctagaaaggtctttc

SEQ ID NO: 365091 - DNA, 20 bp, human
ggccgagatcgcctgacggc

SEQ ID NO: 365092 - DNA, 20 bp, human
gttaactggggtctttcact

SEQ ID NO: 365093 - DNA, 20 bp, human
gccgcgctgtctcgtcaact

SEQ ID NO: 365094 - DNA, 20 bp, human
gggagaggcgaaaactcttc

SEQ ID NO: 365095 - DNA, 20 bp, human
ggggtctttcactcggctta

SEQ ID NO: 365096 - DNA, 20 bp, human
gtctggacgggaccgggaaa

SEQ ID NO: 365097 - DNA, 20 bp, human
gagcccgtcggactacgaag

SEQ ID NO: 365098 - DNA, 20 bp, human
gactggtcggcccacggggt

SEQ ID NO: 365099 - DNA, 20 bp, human
ggaagtaagggcgagcccgt

SEQ ID NO: 365100 - DNA, 20 bp, human
ggcggaagcgggcggcgcta

SEQ ID NO: 365101 - DNA, 20 bp, human
gtaggcggggaggcggaagc

SEQ ID NO: 365102 - DNA, 20 bp, human
ggcctccccgcctaccccgt

SEQ ID NO: 365103 - DNA, 20 bp, human
gtgcggccgcgaagcagagc

SEQ ID NO: 365104 - DNA, 20 bp, human
ggtcccgcttcgtagtccga

SEQ ID NO: 365105 - DNA, 20 bp, human
gggtcggcccacggggtagg

SEQ ID NO: 365106 - DNA, 20 bp, human
gcctctgctaggaacgagga

SEQ ID NO: 365107 - DNA, 20 bp, human
gaggcacagggcttgcagaa

SEQ ID NO: 365108 - DNA, 20 bp, human
gacttcctctgctaggaacg

SEQ ID NO: 365109 - DNA, 20 bp, human
gcagttcttctgtgtagcat

SEQ ID NO: 365110 - DNA, 20 bp, human
ggagagaagcttgctcagag

SEQ ID NO: 365111 - DNA, 20 bp, human
gcagagtggttactgaaaac

SEQ ID NO: 365112 - DNA, 20 bp, human
gtacatccccagaactctct

SEQ ID NO: 365113 - DNA, 20 bp, human
gctaggaacgaggaaggcac

SEQ ID NO: 365114 - DNA, 20 bp, human
gcattgctctggggtccatt

SEQ ID NO: 365115 - DNA, 20 bp, human
ggaactctctgggcccacga

SEQ ID NO: 365116 - DNA, 20 bp, human
gcaggccagcatgggaactc

SEQ ID NO: 365117 - DNA, 20 bp, human
gggggaaggtggctcctcga

SEQ ID NO: 365118 - DNA, 20 bp, human
gtcccacactcgtcagtcaa

SEQ ID NO: 365119 - DNA, 20 bp, human
gcagctgctcccctagaaac

SEQ ID NO: 365120 - DNA, 20 bp, human
gcccaagttcctgtttctag

SEQ ID NO: 365121 - DNA, 20 bp, human
gtgctgccttgtcatgatcg

SEQ ID NO: 365122 - DNA, 20 bp, human
ggacccccatgttgccagtc

SEQ ID NO: 365123 - DNA, 20 bp, human
gacggcatcacagaccgtcg

SEQ ID NO: 365124 - DNA, 20 bp, human
gccccagactggcaacatgg

SEQ ID NO: 365125 - DNA, 20 bp, human
gtgtggcttagtcttgtcca

SEQ ID NO: 365126 - DNA, 20 bp, human
ggtgctgccgcccgcatctg

SEQ ID NO: 365127 - DNA, 20 bp, human
gataactgtgtcaattgtgc

SEQ ID NO: 365128 - DNA, 20 bp, human
ggtcaattgtgcagggaggc

SEQ ID NO: 365129 - DNA, 20 bp, human
gacaattgacacagttattg

SEQ ID NO: 365130 - DNA, 20 bp, human
gtgacagcaagatcccaact

SEQ ID NO: 365131 - DNA, 20 bp, human
ggctaattgtgttcctagtt

SEQ ID NO: 365132 - DNA, 20 bp, human
gctgtgtcaattgtgcaggg

SEQ ID NO: 365133 - DNA, 20 bp, human
gctagtgcccaaggttacag

SEQ ID NO: 365134 - DNA, 20 bp, human
gaatgctccactagtgccca

SEQ ID NO: 365135 - DNA, 20 bp, human
ggtgttctcacccacagatg

SEQ ID NO: 365136 - DNA, 20 bp, human
gagtgtacagagtaacagag

SEQ ID NO: 365137 - DNA, 20 bp, human
gcatatgttgacttgtcaga

SEQ ID NO: 365138 - DNA, 20 bp, human
gtgtgacagctagccgatgg

SEQ ID NO: 365139 - DNA, 20 bp, human
gagagaagagactccgccat

SEQ ID NO: 365140 - DNA, 20 bp, human
gataaacaatttgtgaatta

SEQ ID NO: 365141 - DNA, 20 bp, human
gttctcttcaactgcctcac

SEQ ID NO: 365142 - DNA, 20 bp, human
gcccttaattcctaaagatt

SEQ ID NO: 365143 - DNA, 20 bp, human
gtggccttgagaccaaaaca

SEQ ID NO: 365144 - DNA, 20 bp, human
gttctgtgacagctagccga

SEQ ID NO: 365145 - DNA, 20 bp, human
gatagcagcagttagctata

SEQ ID NO: 365146 - DNA, 20 bp, human
gagggtccctgcagaacggg

SEQ ID NO: 365147 - DNA, 20 bp, human
ggtgttctccaccccttaca

SEQ ID NO: 365148 - DNA, 20 bp, human
ggggcggggccggtgcttga

SEQ ID NO: 365149 - DNA, 20 bp, human
gggtgacctcagagcgtcgg

SEQ ID NO: 365150 - DNA, 20 bp, human
gccccgcgggccggcccagt

SEQ ID NO: 365151 - DNA, 20 bp, human
ggcggggcggggccacggac

SEQ ID NO: 365152 - DNA, 20 bp, human
ggccggaaggggcgtgtcgg

SEQ ID NO: 365153 - DNA, 20 bp, human
ggggtcccacactccctgta

SEQ ID NO: 365154 - DNA, 20 bp, human
gccccgccgcgagctggcgc

SEQ ID NO: 365155 - DNA, 20 bp, human
ggggagggtccctgcagaac

SEQ ID NO: 365156 - DNA, 20 bp, human
gaagccaggcacttagccta

SEQ ID NO: 365157 - DNA, 20 bp, human
gaacccgcttcctgtatcac

SEQ ID NO: 365158 - DNA, 20 bp, human
gctcccataggctaagtgcc

SEQ ID NO: 365159 - DNA, 20 bp, human
gcctatgggagccaggaaag

SEQ ID NO: 365160 - DNA, 20 bp, human
gcaaagccgggttttggccg

SEQ ID NO: 365161 - DNA, 20 bp, human
gtctgcccaaagccgggttt

SEQ ID NO: 365162 - DNA, 20 bp, human
ggactacacaccccctttcc

SEQ ID NO: 365163 - DNA, 20 bp, human
ggaaaaagtcccagtgatac

SEQ ID NO: 365164 - DNA, 20 bp, human
gagggggtgtgtagtcacct

SEQ ID NO: 365165 - DNA, 20 bp, human
gtgcactcatcggggtcaca

SEQ ID NO: 365166 - DNA, 20 bp, human
gaccacgcctctaagaggaa

SEQ ID NO: 365167 - DNA, 20 bp, human
gttgtcaccacgcctctaag

SEQ ID NO: 365168 - DNA, 20 bp, human
gccccttcctcttagaggcg

SEQ ID NO: 365169 - DNA, 20 bp, human
gaattaggatttttagtgca

SEQ ID NO: 365170 - DNA, 20 bp, human
gttatatgtaaaagtctgta

SEQ ID NO: 365171 - DNA, 20 bp, human
gattaacacagttacaaatt

SEQ ID NO: 365172 - DNA, 20 bp, human
gattttcagtttatgacaga

SEQ ID NO: 365173 - DNA, 20 bp, human
ggacttccccttcctcttag

SEQ ID NO: 365174 - DNA, 20 bp, human
gtttatgaaagatgcaataa

SEQ ID NO: 365175 - DNA, 20 bp, human
gatttgttctagtagatttt

SEQ ID NO: 365176 - DNA, 20 bp, human
gactcaatctcacatgtctg

SEQ ID NO: 365177 - DNA, 20 bp, human
ggaggatatggatatataga

SEQ ID NO: 365178 - DNA, 20 bp, human
gtatatatccatatcctcct

SEQ ID NO: 365179 - DNA, 20 bp, human
gcttctttaaatatcagctg

SEQ ID NO: 365180 - DNA, 20 bp, human
ggatatttaaagaagcagga

SEQ ID NO: 365181 - DNA, 20 bp, human
gcttatacttggaacatata

SEQ ID NO: 365182 - DNA, 20 bp, human
gtttttttctacccacacta

SEQ ID NO: 365183 - DNA, 20 bp, human
gtaccaaatgctgatgaaga

SEQ ID NO: 365184 - DNA, 20 bp, human
gatctctcatagattgctgg

SEQ ID NO: 365185 - DNA, 20 bp, human
gttcaacattattaggcttt

SEQ ID NO: 365186 - DNA, 20 bp, human
gaaccatgtgcatgtgaaag

SEQ ID NO: 365187 - DNA, 20 bp, human
gtaaagtggaagttgtccct

SEQ ID NO: 365188 - DNA, 20 bp, human
gaggatgacagatagtagtg

SEQ ID NO: 365189 - DNA, 20 bp, human
gctagcttaaaatgcttctg

SEQ ID NO: 365190 - DNA, 20 bp, human
gaggccagcgagatccagca

SEQ ID NO: 365191 - DNA, 20 bp, human
gccaaaatccagaacctccc

SEQ ID NO: 365192 - DNA, 20 bp, human
ggcagcatgcctagtcgggg

SEQ ID NO: 365193 - DNA, 20 bp, human
gtgacagatagtagtgaggc

SEQ ID NO: 365194 - DNA, 20 bp, human
gcacatggttggctaacacg

SEQ ID NO: 365195 - DNA, 20 bp, human
ggaaaacatccagaataaag

SEQ ID NO: 365196 - DNA, 20 bp, human
gagccatgatacatagggag

SEQ ID NO: 365197 - DNA, 20 bp, human
gtacgtgcggggacctgggg

SEQ ID NO: 365198 - DNA, 20 bp, human
gtcggggcatgcagtacgtg

SEQ ID NO: 365199 - DNA, 20 bp, human
gtgaggacagaggacgtcag

SEQ ID NO: 365200 - DNA, 20 bp, human
gagcccctccctatgtatca

SEQ ID NO: 365201 - DNA, 20 bp, human
gaggggcttagtgaggacag

SEQ ID NO: 365202 - DNA, 20 bp, human
gcatagggaggggcttagtg

SEQ ID NO: 365203 - DNA, 20 bp, human
gaagagagccatgatacata

SEQ ID NO: 365204 - DNA, 20 bp, human
ggtaaactgtcatgacaatc

SEQ ID NO: 365205 - DNA, 20 bp, human
gaattacccagagagagcta

SEQ ID NO: 365206 - DNA, 20 bp, human
gagcagtcagtacccgccac

SEQ ID NO: 365207 - DNA, 20 bp, human
ggggtactgactgcttccca

SEQ ID NO: 365208 - DNA, 20 bp, human
ggggagatgcgccacgaccc

SEQ ID NO: 365209 - DNA, 20 bp, human
gggagccagatggacgccgt

SEQ ID NO: 365210 - DNA, 20 bp, human
ggggcccggcgcccacataa

SEQ ID NO: 365211 - DNA, 20 bp, human
ggtcgcgccttggcgggcgg

SEQ ID NO: 365212 - DNA, 20 bp, human
ggcgacgcggcgcaggtcgt

SEQ ID NO: 365213 - DNA, 20 bp, human
gcccacccgcgggattgagg

SEQ ID NO: 365214 - DNA, 20 bp, human
ggcgcctcgcgagccgactg

SEQ ID NO: 365215 - DNA, 20 bp, human
gtcagcccacggcgtccatc

SEQ ID NO: 365216 - DNA, 20 bp, human
gagggagcttgggagagcta

SEQ ID NO: 365217 - DNA, 20 bp, human
gagcttgggagagctagggc

SEQ ID NO: 365218 - DNA, 20 bp, human
gaacccactggacatgggga

SEQ ID NO: 365219 - DNA, 20 bp, human
gagaagcagcaaagtgacaa

SEQ ID NO: 365220 - DNA, 20 bp, human
ggcacccaggaatccagcag

SEQ ID NO: 365221 - DNA, 20 bp, human
gcaggaatccagcagaggtc

SEQ ID NO: 365222 - DNA, 20 bp, human
gggcaggcagataaggttct

SEQ ID NO: 365223 - DNA, 20 bp, human
ggcccatgaggcacactcag

SEQ ID NO: 365224 - DNA, 20 bp, human
gtgccctccccatgtccagt

SEQ ID NO: 365225 - DNA, 20 bp, human
gcatgaggcacactcagtgg

SEQ ID NO: 365226 - DNA, 20 bp, human
gaggacattaaacattaacg

SEQ ID NO: 365227 - DNA, 20 bp, human
gctaggatgtcagtttcaag

SEQ ID NO: 365228 - DNA, 20 bp, human
gcaccaagtgacatattttt

SEQ ID NO: 365229 - DNA, 20 bp, human
gtcttgaccaataattttgc

SEQ ID NO: 365230 - DNA, 20 bp, human
gtcttttgaaagccacctta

SEQ ID NO: 365231 - DNA, 20 bp, human
gttatatggcatggttccta

SEQ ID NO: 365232 - DNA, 20 bp, human
gttaatgtttaatgtcctcg

SEQ ID NO: 365233 - DNA, 20 bp, human
gacagggcactcaactattc

SEQ ID NO: 365234 - DNA, 20 bp, human
gttaatgtttcatgccatga

SEQ ID NO: 365235 - DNA, 20 bp, human
ggttacgattaatcatttat

SEQ ID NO: 365236 - DNA, 20 bp, human
gtcaactccggctgctcgct

SEQ ID NO: 365237 - DNA, 20 bp, human
gtcagcgtccagctcaactc

SEQ ID NO: 365238 - DNA, 20 bp, human
gcgaccggttgtgacgtctc

SEQ ID NO: 365239 - DNA, 20 bp, human
ggggagtgacgcgccggcgc

SEQ ID NO: 365240 - DNA, 20 bp, human
gctgctcgctgggctccgac

SEQ ID NO: 365241 - DNA, 20 bp, human
ggtctctgggagtgacgcgc

SEQ ID NO: 365242 - DNA, 20 bp, human
ggaagggaggggcttcggtg

SEQ ID NO: 365243 - DNA, 20 bp, human
gctcccagagacgtcacaac

SEQ ID NO: 365244 - DNA, 20 bp, human
ggaagctgttgtgatcgctg

SEQ ID NO: 365245 - DNA, 20 bp, human
ggggcggggccctgacgcgc

SEQ ID NO: 365246 - DNA, 20 bp, human
gcggaacaaagacctgacaa

SEQ ID NO: 365247 - DNA, 20 bp, human
gcctgtgaatcgccagtaag

SEQ ID NO: 365248 - DNA, 20 bp, human
gagcaggaaaaaaccgttcc

SEQ ID NO: 365249 - DNA, 20 bp, human
gacgccgccgagcacgtcag

SEQ ID NO: 365250 - DNA, 20 bp, human
ggcccatcagagaacttgat

SEQ ID NO: 365251 - DNA, 20 bp, human
gcggagccggcgcagcgatt

SEQ ID NO: 365252 - DNA, 20 bp, human
gtactggcgattcacaggag

SEQ ID NO: 365253 - DNA, 20 bp, human
gcctgacaaaggaccagagc

SEQ ID NO: 365254 - DNA, 20 bp, human
ggccgatcaagttctctgat

SEQ ID NO: 365255 - DNA, 20 bp, human
gtaagtcaagcacccctctt

SEQ ID NO: 365256 - DNA, 20 bp, human
gtggcttaatcattatggga

SEQ ID NO: 365257 - DNA, 20 bp, human
gtgtaggatcaaagtccagt

SEQ ID NO: 365258 - DNA, 20 bp, human
gggtcaccccactaagctcc

SEQ ID NO: 365259 - DNA, 20 bp, human
gtgctctcctggagcttagt

SEQ ID NO: 365260 - DNA, 20 bp, human
gttaaattcaagtaaatagg

SEQ ID NO: 365261 - DNA, 20 bp, human
gttgcctagggcatggaatt

SEQ ID NO: 365262 - DNA, 20 bp, human
gggttgtgttgctgcttaga

SEQ ID NO: 365263 - DNA, 20 bp, human
gaatggtaacactgaactct

SEQ ID NO: 365264 - DNA, 20 bp, human
ggctgccaaggccagtgtct

SEQ ID NO: 365265 - DNA, 20 bp, human
ggtacagcagtccctcctac

SEQ ID NO: 365266 - DNA, 20 bp, human
ggtgtccctggaaagtaggg

SEQ ID NO: 365267 - DNA, 20 bp, human
gattgtgtccctggaaagta

SEQ ID NO: 365268 - DNA, 20 bp, human
gtggtgagtaagaacagaag

SEQ ID NO: 365269 - DNA, 20 bp, human
gcagcatcacattgtgtccc

SEQ ID NO: 365270 - DNA, 20 bp, human
ggggactaagaataatttca

SEQ ID NO: 365271 - DNA, 20 bp, human
gcttgctggccaacagttat

SEQ ID NO: 365272 - DNA, 20 bp, human
gcgccggtggaggaaatgtc

SEQ ID NO: 365273 - DNA, 20 bp, human
gacgctttgctaatgctaca

SEQ ID NO: 365274 - DNA, 20 bp, human
gggcatccaccctactttcc

SEQ ID NO: 365275 - DNA, 20 bp, human
gatctcacatacatattcag

SEQ ID NO: 365276 - DNA, 20 bp, human
gagcccgcggccagaggcgc

SEQ ID NO: 365277 - DNA, 20 bp, human
gaacgtgggcgatccggcaa

SEQ ID NO: 365278 - DNA, 20 bp, human
gctgaggcgcgtggtagtga

SEQ ID NO: 365279 - DNA, 20 bp, human
gggaggctggccgccggatg

SEQ ID NO: 365280 - DNA, 20 bp, human
gcggaccaggccgacaacgt

SEQ ID NO: 365281 - DNA, 20 bp, human
ggccggatcgcccacgttgt

SEQ ID NO: 365282 - DNA, 20 bp, human
ggctccggcggctttgagga

SEQ ID NO: 365283 - DNA, 20 bp, human
ggtgggcgatccggcaaggg

SEQ ID NO: 365284 - DNA, 20 bp, human
ggaaccttctgaatgacgag

SEQ ID NO: 365285 - DNA, 20 bp, human
ggcaccgctgtcgagacctg

SEQ ID NO: 365286 - DNA, 20 bp, human
gagaacacggggtgcctgga

SEQ ID NO: 365287 - DNA, 20 bp, human
gtaaccagacccttccgcca

SEQ ID NO: 365288 - DNA, 20 bp, human
gggaagggtctggttaccca

SEQ ID NO: 365289 - DNA, 20 bp, human
gcagccctggcggaagggtc

SEQ ID NO: 365290 - DNA, 20 bp, human
ggaacaaaggtccactccat

SEQ ID NO: 365291 - DNA, 20 bp, human
gaaggggaacagatgtgttg

SEQ ID NO: 365292 - DNA, 20 bp, human
gggtctggttacccatggag

SEQ ID NO: 365293 - DNA, 20 bp, human
gaaatcagagctaacttggg

SEQ ID NO: 365294 - DNA, 20 bp, human
gcggatgggtaacagggcgt

SEQ ID NO: 365295 - DNA, 20 bp, human
gagtggccagccctggcgga

SEQ ID NO: 365296 - DNA, 20 bp, human
gcccacgcggagtctggatg

SEQ ID NO: 365297 - DNA, 20 bp, human
gctcccgccgggtgccccag

SEQ ID NO: 365298 - DNA, 20 bp, human
ggacctaggctccgcccacg

SEQ ID NO: 365299 - DNA, 20 bp, human
ggctccgcccacgcggagtc

SEQ ID NO: 365300 - DNA, 20 bp, human
gagcctaggtccctggtctg

SEQ ID NO: 365301 - DNA, 20 bp, human
ggcccgcagaccagggacct

SEQ ID NO: 365302 - DNA, 20 bp, human
ggcagggactccagccaata

SEQ ID NO: 365303 - DNA, 20 bp, human
gggcagccgcacatccctat

SEQ ID NO: 365304 - DNA, 20 bp, human
ggtctgcgggccacgcatcc

SEQ ID NO: 365305 - DNA, 20 bp, human
gacgcggagtctggatgcgg

SEQ ID NO: 365306 - DNA, 20 bp, human
gggtactggcaccctcgtga

SEQ ID NO: 365307 - DNA, 20 bp, human
gtggcaccctcgtgatggca

SEQ ID NO: 365308 - DNA, 20 bp, human
gatgagccctgccatcacga

SEQ ID NO: 365309 - DNA, 20 bp, human
gggtgccagtaccccgtgac

SEQ ID NO: 365310 - DNA, 20 bp, human
ggtaaagtgccgccggtcac

SEQ ID NO: 365311 - DNA, 20 bp, human
ggccgccggtcacggggtac

SEQ ID NO: 365312 - DNA, 20 bp, human
gactaggctctgtgtatttc

SEQ ID NO: 365313 - DNA, 20 bp, human
ggatatgagtcagctcccta

SEQ ID NO: 365314 - DNA, 20 bp, human
ggcagtcaatcttaaatatt

SEQ ID NO: 365315 - DNA, 20 bp, human
ggtatggagcagtaaaatac

SEQ ID NO: 365316 - DNA, 20 bp, human
gcagggctaatgacctggtg

SEQ ID NO: 365317 - DNA, 20 bp, human
gttcctcagggctaatgacc

SEQ ID NO: 365318 - DNA, 20 bp, human
ggagatgactgtgcaatgat

SEQ ID NO: 365319 - DNA, 20 bp, human
gtaaacaataggaggtcact

SEQ ID NO: 365320 - DNA, 20 bp, human
gctaggactcatctgtaaga

SEQ ID NO: 365321 - DNA, 20 bp, human
gtactagttaccagttgatg

SEQ ID NO: 365322 - DNA, 20 bp, human
ggggcttacagtactattcc

SEQ ID NO: 365323 - DNA, 20 bp, human
ggactgtgcaatgattggcc

SEQ ID NO: 365324 - DNA, 20 bp, human
gagagtttctttaattcata

SEQ ID NO: 365325 - DNA, 20 bp, human
gaagttaggcttctgcttat

SEQ ID NO: 365326 - DNA, 20 bp, human
gcgcgcgcgcacacgtactt

SEQ ID NO: 365327 - DNA, 20 bp, human
gtgtatgtgagactgaaagg

SEQ ID NO: 365328 - DNA, 20 bp, human
gtgtgagactgaaaggaggt

SEQ ID NO: 365329 - DNA, 20 bp, human
gaatcagctccagcagcaac

SEQ ID NO: 365330 - DNA, 20 bp, human
gtgcatggatttcttcggtg

SEQ ID NO: 365331 - DNA, 20 bp, human
gcgcgcacacgtacttcggc

SEQ ID NO: 365332 - DNA, 20 bp, human
gttgcgctcgcgtgtgtctg

SEQ ID NO: 365333 - DNA, 20 bp, human
ggaatagagcctgttgctgc

SEQ ID NO: 365334 - DNA, 20 bp, human
gtatccggtaaggaaaattc

SEQ ID NO: 365335 - DNA, 20 bp, human
gcctactgttctactgaaaa

SEQ ID NO: 365336 - DNA, 20 bp, human
gcgccgggaggatctccgcg

SEQ ID NO: 365337 - DNA, 20 bp, human
ggcggccagccagtccgcaa

SEQ ID NO: 365338 - DNA, 20 bp, human
ggcagtgcgggcagcacgaa

SEQ ID NO: 365339 - DNA, 20 bp, human
ggggagggaggtgaaggcgt

SEQ ID NO: 365340 - DNA, 20 bp, human
gcctcccggcgacatcactg

SEQ ID NO: 365341 - DNA, 20 bp, human
gccgctgcgggaccgcgggt

SEQ ID NO: 365342 - DNA, 20 bp, human
ggcggagggccggatcgctg

SEQ ID NO: 365343 - DNA, 20 bp, human
gcggcccctgggtggagaga

SEQ ID NO: 365344 - DNA, 20 bp, human
ggcacggggcgcttttgcgt

SEQ ID NO: 365345 - DNA, 20 bp, human
ggctctgcggcgaaaaggag

SEQ ID NO: 365346 - DNA, 20 bp, human
ggttgtcagagaggaccctg

SEQ ID NO: 365347 - DNA, 20 bp, human
gaccctgaggggccccataa

SEQ ID NO: 365348 - DNA, 20 bp, human
ggacccgccttggatctgga

SEQ ID NO: 365349 - DNA, 20 bp, human
gcagccctccagatccaagg

SEQ ID NO: 365350 - DNA, 20 bp, human
ggtgagcagggtccccggac

SEQ ID NO: 365351 - DNA, 20 bp, human
gaggggacccgccttggatc

SEQ ID NO: 365352 - DNA, 20 bp, human
gcgcccgtggctggtgagca

SEQ ID NO: 365353 - DNA, 20 bp, human
gatcccttatggggcccctc

SEQ ID NO: 365354 - DNA, 20 bp, human
gagtggctcttctgagtctg

SEQ ID NO: 365355 - DNA, 20 bp, human
gagagccactccaggactca

SEQ ID NO: 365356 - DNA, 20 bp, human
gagcactcctagtggctcca

SEQ ID NO: 365357 - DNA, 20 bp, human
gctggtggcgggaagacccc

SEQ ID NO: 365358 - DNA, 20 bp, human
gtgggcgggagcactcctag

SEQ ID NO: 365359 - DNA, 20 bp, human
gccacctcggggttgtttta

SEQ ID NO: 365360 - DNA, 20 bp, human
gcccaggccgtggagccact

SEQ ID NO: 365361 - DNA, 20 bp, human
gcagcggggaggaatgcgag

SEQ ID NO: 365362 - DNA, 20 bp, human
ggctctccgcccccgagggg

SEQ ID NO: 365363 - DNA, 20 bp, human
gccgaggtcacacaggaatc

SEQ ID NO: 365364 - DNA, 20 bp, human
ggggaggaatgcgagcgggc

SEQ ID NO: 365365 - DNA, 20 bp, human
ggcggaggaagtgagcgcag

SEQ ID NO: 365366 - DNA, 20 bp, human
ggagggacctggagctacat

SEQ ID NO: 365367 - DNA, 20 bp, human
gcccctacagggtgactgga

SEQ ID NO: 365368 - DNA, 20 bp, human
gtccctccagtcaccctgta

SEQ ID NO: 365369 - DNA, 20 bp, human
gccacgccttggcccctaca

SEQ ID NO: 365370 - DNA, 20 bp, human
gtcagcctggaccagtgggc

SEQ ID NO: 365371 - DNA, 20 bp, human
gaggatcagcctggaccagt

SEQ ID NO: 365372 - DNA, 20 bp, human
gtggggagagaggtcctccc

SEQ ID NO: 365373 - DNA, 20 bp, human
gggccaaggcgtggccaagg

SEQ ID NO: 365374 - DNA, 20 bp, human
gttggcccctacagggtgac

SEQ ID NO: 365375 - DNA, 20 bp, human
ggagatatgtaggaagtgtg

SEQ ID NO: 365376 - DNA, 20 bp, human
gctccccagtgccacccgaa

SEQ ID NO: 365377 - DNA, 20 bp, human
gggtgcgagggatacgtcgg

SEQ ID NO: 365378 - DNA, 20 bp, human
gagagtcgtccctacaacgg

SEQ ID NO: 365379 - DNA, 20 bp, human
gcagaggtgcccccgttgta

SEQ ID NO: 365380 - DNA, 20 bp, human
gatggcctcctcaggccctt

SEQ ID NO: 365381 - DNA, 20 bp, human
ggtgccacccgaagggcctg

SEQ ID NO: 365382 - DNA, 20 bp, human
gaatggtgcgagggatacgt

SEQ ID NO: 365383 - DNA, 20 bp, human
gaacgggggcacctctgtta

SEQ ID NO: 365384 - DNA, 20 bp, human
gcctcctcaggcccttcggg

SEQ ID NO: 365385 - DNA, 20 bp, human
gagggtctcctaaacacctg

SEQ ID NO: 365386 - DNA, 20 bp, human
ggggagctgcgtctgctcaa

SEQ ID NO: 365387 - DNA, 20 bp, human
ggagccactggcggggtttt

SEQ ID NO: 365388 - DNA, 20 bp, human
gggcccccttgcacaaaaac

SEQ ID NO: 365389 - DNA, 20 bp, human
ggcctcctgcatacgggatg

SEQ ID NO: 365390 - DNA, 20 bp, human
gtgcaagggggccactagtc

SEQ ID NO: 365391 - DNA, 20 bp, human
gggctcacgcctcctgcata

SEQ ID NO: 365392 - DNA, 20 bp, human
gtgcaggaggcgtgagccac

SEQ ID NO: 365393 - DNA, 20 bp, human
gccccgcccggagagtgggt

SEQ ID NO: 365394 - DNA, 20 bp, human
gattgcgtgggtgggatgaa

SEQ ID NO: 365395 - DNA, 20 bp, human
ggcgcgccccctctcagcag

SEQ ID NO: 365396 - DNA, 20 bp, human
gcaagcgccccactccctca

SEQ ID NO: 365397 - DNA, 20 bp, human
gacgtgacctacagccctga

SEQ ID NO: 365398 - DNA, 20 bp, human
gcccactccctcagggctgt

SEQ ID NO: 365399 - DNA, 20 bp, human
gtcccaaagctgctgaaacc

SEQ ID NO: 365400 - DNA, 20 bp, human
gctccaggtttcagcagctt

SEQ ID NO: 365401 - DNA, 20 bp, human
ggctgctgaaacctggagac

SEQ ID NO: 365402 - DNA, 20 bp, human
gagaatgacaacttcagtga

SEQ ID NO: 365403 - DNA, 20 bp, human
gggttaataacaataagcaa

SEQ ID NO: 365404 - DNA, 20 bp, human
gaagcaggctaaactgttct

SEQ ID NO: 365405 - DNA, 20 bp, human
gacttcagtgaaggaaatag

SEQ ID NO: 365406 - DNA, 20 bp, human
ggggcggggccgaatacgag

SEQ ID NO: 365407 - DNA, 20 bp, human
gcgacgggagctgtagtcca

SEQ ID NO: 365408 - DNA, 20 bp, human
ggcccgacccgcgtgaagag

SEQ ID NO: 365409 - DNA, 20 bp, human
ggggccgaatacgagtggcc

SEQ ID NO: 365410 - DNA, 20 bp, human
gcgagtggccaggggcacga

SEQ ID NO: 365411 - DNA, 20 bp, human
ggctcgccgcgggacacggc

SEQ ID NO: 365412 - DNA, 20 bp, human
gctgtgctgcacactcactc

SEQ ID NO: 365413 - DNA, 20 bp, human
gacagctcccgtcgtgcccc

SEQ ID NO: 365414 - DNA, 20 bp, human
gtggaagcatcctagagggc

SEQ ID NO: 365415 - DNA, 20 bp, human
gcacagccggaccgaggaaa

SEQ ID NO: 365416 - DNA, 20 bp, human
gacttcacctgcttgccccg

SEQ ID NO: 365417 - DNA, 20 bp, human
gggattcgcgggctctgcga

SEQ ID NO: 365418 - DNA, 20 bp, human
ggggtgcaggagactgagcg

SEQ ID NO: 365419 - DNA, 20 bp, human
ggagactgagcggggattcg

SEQ ID NO: 365420 - DNA, 20 bp, human
gcccgcggcgacttcctgca

SEQ ID NO: 365421 - DNA, 20 bp, human
gacagacgcagcctgggttg

SEQ ID NO: 365422 - DNA, 20 bp, human
gagccccgcgtcccgggtcg

SEQ ID NO: 365423 - DNA, 20 bp, human
gcggtcagacagacgcagcc

SEQ ID NO: 365424 - DNA, 20 bp, human
gccgcggccccacgaaaagt

SEQ ID NO: 365425 - DNA, 20 bp, human
gcccacgaaaagttggcccg

SEQ ID NO: 365426 - DNA, 20 bp, human
gtcacgaggcacttgagggt

SEQ ID NO: 365427 - DNA, 20 bp, human
gaggaccagcgggatctacc

SEQ ID NO: 365428 - DNA, 20 bp, human
ggcaaggtttgagcacaggt

SEQ ID NO: 365429 - DNA, 20 bp, human
gagaaaggatggacaacaag

SEQ ID NO: 365430 - DNA, 20 bp, human
gaaaccttgtctacctcatc

SEQ ID NO: 365431 - DNA, 20 bp, human
gggcagcaaggtttgagcac

SEQ ID NO: 365432 - DNA, 20 bp, human
ggggttcacgaggcacttga

SEQ ID NO: 365433 - DNA, 20 bp, human
gtagctgcgccctgagcaga

SEQ ID NO: 365434 - DNA, 20 bp, human
gatctacctgggtaccaaaa

SEQ ID NO: 365435 - DNA, 20 bp, human
ggtacccaggtagatcccgc

SEQ ID NO: 365436 - DNA, 20 bp, human
gccccgggaccaggggacta

SEQ ID NO: 365437 - DNA, 20 bp, human
gccgctggttgcactgtcga

SEQ ID NO: 365438 - DNA, 20 bp, human
gtggacaagaacattcacct

SEQ ID NO: 365439 - DNA, 20 bp, human
ggtaggggccgcaagcccac

SEQ ID NO: 365440 - DNA, 20 bp, human
gggtcccagctgtcccgtcc

SEQ ID NO: 365441 - DNA, 20 bp, human
gtggcgaggaggcgctgcag

SEQ ID NO: 365442 - DNA, 20 bp, human
gtccacgccctcagagtctg

SEQ ID NO: 365443 - DNA, 20 bp, human
gaaggcccgacccttgcgga

SEQ ID NO: 365444 - DNA, 20 bp, human
gagaaagcccgggataagcc

SEQ ID NO: 365445 - DNA, 20 bp, human
gattcacctgggtaggggca

SEQ ID NO: 365446 - DNA, 20 bp, human
gccctgcagacaagcgtctc

SEQ ID NO: 365447 - DNA, 20 bp, human
gcgtggagctggagcagcgc

SEQ ID NO: 365448 - DNA, 20 bp, human
gccagctccacgtgcgcccg

SEQ ID NO: 365449 - DNA, 20 bp, human
gcagctggatcgggcgcgaa

SEQ ID NO: 365450 - DNA, 20 bp, human
gggacccggtggaggttcta

SEQ ID NO: 365451 - DNA, 20 bp, human
gcagggctgcattgcatccc

SEQ ID NO: 365452 - DNA, 20 bp, human
ggaccctgggcccagatcgg

SEQ ID NO: 365453 - DNA, 20 bp, human
ggaccccagtccgagctccg

SEQ ID NO: 365454 - DNA, 20 bp, human
ggaagggaggatccccgcag

SEQ ID NO: 365455 - DNA, 20 bp, human
gaaggaggctccgagacccg

SEQ ID NO: 365456 - DNA, 20 bp, human
gcggaccgatagtgctggaa

SEQ ID NO: 365457 - DNA, 20 bp, human
gggactgcagtgcccgggta

SEQ ID NO: 365458 - DNA, 20 bp, human
gcccgggtaggggtagtcag

SEQ ID NO: 365459 - DNA, 20 bp, human
gtagtgctggaacgggaggg

SEQ ID NO: 365460 - DNA, 20 bp, human
gccgaggcccagatgttggg

SEQ ID NO: 365461 - DNA, 20 bp, human
ggaaaactccactacccgtc

SEQ ID NO: 365462 - DNA, 20 bp, human
gcccgggcaggggaatgtcc

SEQ ID NO: 365463 - DNA, 20 bp, human
gggtaggggtagtcagaggc

SEQ ID NO: 365464 - DNA, 20 bp, human
gcggggaagaggcgcccgac

SEQ ID NO: 365465 - DNA, 20 bp, human
gcgatagtgctggaacggga

SEQ ID NO: 365466 - DNA, 20 bp, human
ggacttccagactccctaac

SEQ ID NO: 365467 - DNA, 20 bp, human
gtctccacaggcagcctcca

SEQ ID NO: 365468 - DNA, 20 bp, human
ggcctgtggagactcactca

SEQ ID NO: 365469 - DNA, 20 bp, human
gacttgtgttggtcggtcta

SEQ ID NO: 365470 - DNA, 20 bp, human
gctactccagttagggagtc

SEQ ID NO: 365471 - DNA, 20 bp, human
ggtggtaactactccagtta

SEQ ID NO: 365472 - DNA, 20 bp, human
gcaaagaccatttgctcctc

SEQ ID NO: 365473 - DNA, 20 bp, human
gtttttccttgaaaacccag

SEQ ID NO: 365474 - DNA, 20 bp, human
gcagaggacatcaaaagggt

SEQ ID NO: 365475 - DNA, 20 bp, human
ggaatgtgatcaaagaaagc

SEQ ID NO: 365476 - DNA, 20 bp, human
ggcggagtaaagatcaggaa

SEQ ID NO: 365477 - DNA, 20 bp, human
gaacagaaggagttaacgct

SEQ ID NO: 365478 - DNA, 20 bp, human
ggctgggattaacttcttga

SEQ ID NO: 365479 - DNA, 20 bp, human
gagttggggaggtgagagta

SEQ ID NO: 365480 - DNA, 20 bp, human
gtgttcttggaggctgctga

SEQ ID NO: 365481 - DNA, 20 bp, human
ggattgccagactgggtcaa

SEQ ID NO: 365482 - DNA, 20 bp, human
ggccagcggaggtggcttgg

SEQ ID NO: 365483 - DNA, 20 bp, human
gtcaatggttaacactcaac

SEQ ID NO: 365484 - DNA, 20 bp, human
gcgaggaccatcaaagtccc

SEQ ID NO: 365485 - DNA, 20 bp, human
gtgatctttactccgcctgt

SEQ ID NO: 365486 - DNA, 20 bp, human
ggaaagaggcccgggaacgt

SEQ ID NO: 365487 - DNA, 20 bp, human
ggaccgggtgaaagaggccc

SEQ ID NO: 365488 - DNA, 20 bp, human
gccctgggaccgggtgaaag

SEQ ID NO: 365489 - DNA, 20 bp, human
gctcacaggcgagtaaacag

SEQ ID NO: 365490 - DNA, 20 bp, human
gctcgcctgtgagatggctg

SEQ ID NO: 365491 - DNA, 20 bp, human
gaaacgggaccccagccgca

SEQ ID NO: 365492 - DNA, 20 bp, human
gccccagccgcagggcagtg

SEQ ID NO: 365493 - DNA, 20 bp, human
gaaagcctgggggagggtcg

SEQ ID NO: 365494 - DNA, 20 bp, human
ggccacactgccctgcggct

SEQ ID NO: 365495 - DNA, 20 bp, human
ggcctctttcacccggtccc

SEQ ID NO: 365496 - DNA, 20 bp, human
gtcttgattggtcacagcgg

SEQ ID NO: 365497 - DNA, 20 bp, human
ggtggatgaaagttaaaggt

SEQ ID NO: 365498 - DNA, 20 bp, human
ggcaggctgcctaggttctg

SEQ ID NO: 365499 - DNA, 20 bp, human
gccccgcggccgctcttgat

SEQ ID NO: 365500 - DNA, 20 bp, human
gaccaatcaagagcggccgc

SEQ ID NO: 365501 - DNA, 20 bp, human
gcgctcttgattggtcacag

SEQ ID NO: 365502 - DNA, 20 bp, human
gtgtcccggcttcccattgg

SEQ ID NO: 365503 - DNA, 20 bp, human
ggagtcaatttctctccccg

SEQ ID NO: 365504 - DNA, 20 bp, human
gtgctgattccgcagaacct

SEQ ID NO: 365505 - DNA, 20 bp, human
gctctgtcccggcttcccat

SEQ ID NO: 365506 - DNA, 20 bp, human
gcggcggtgggaggcgtctt

SEQ ID NO: 365507 - DNA, 20 bp, human
gccgccgggtggcagaattg

SEQ ID NO: 365508 - DNA, 20 bp, human
gtgcctcggcagcgcaggag

SEQ ID NO: 365509 - DNA, 20 bp, human
gcgcgtcccacagaccccga

SEQ ID NO: 365510 - DNA, 20 bp, human
gtggacagcgcgagatgcta

SEQ ID NO: 365511 - DNA, 20 bp, human
ggagggctggcccgaagcgt

SEQ ID NO: 365512 - DNA, 20 bp, human
ggccacccctcggggtctgt

SEQ ID NO: 365513 - DNA, 20 bp, human
gtcccacagaccccgagggg

SEQ ID NO: 365514 - DNA, 20 bp, human
gacaactccgccccgcacgg

SEQ ID NO: 365515 - DNA, 20 bp, human
gggggcggggccacccctcg

SEQ ID NO: 365516 - DNA, 20 bp, human
gacatcgggtactgaagcca

SEQ ID NO: 365517 - DNA, 20 bp, human
gtggcattgatgcctgaagt

SEQ ID NO: 365518 - DNA, 20 bp, human
gtattgctggtcaaagacct

SEQ ID NO: 365519 - DNA, 20 bp, human
gtttccaaaaatatgagtag

SEQ ID NO: 365520 - DNA, 20 bp, human
gtgggaagacagacattcca

SEQ ID NO: 365521 - DNA, 20 bp, human
gcaactgaaaaggatcaaca

SEQ ID NO: 365522 - DNA, 20 bp, human
gcagttccttggtgttgctt

SEQ ID NO: 365523 - DNA, 20 bp, human
ggtgtcaaactaaaaaccat

SEQ ID NO: 365524 - DNA, 20 bp, human
gcaaacacacagagcagagt

SEQ ID NO: 365525 - DNA, 20 bp, human
gcaatgccaaagcaacacca

SEQ ID NO: 365526 - DNA, 20 bp, human
gttaaccatggcacaacaga

SEQ ID NO: 365527 - DNA, 20 bp, human
gcatggcacaacagagggat

SEQ ID NO: 365528 - DNA, 20 bp, human
ggcactatggagcagaaagt

SEQ ID NO: 365529 - DNA, 20 bp, human
ggtgtcctggcgccatctag

SEQ ID NO: 365530 - DNA, 20 bp, human
gttgaagggtacacctgggg

SEQ ID NO: 365531 - DNA, 20 bp, human
gtggcgccaggacacatcta

SEQ ID NO: 365532 - DNA, 20 bp, human
gggactaaagtgagtgtatg

SEQ ID NO: 365533 - DNA, 20 bp, human
gcaggtgtacccttcaatgt

SEQ ID NO: 365534 - DNA, 20 bp, human
gacacatctatggcatacgt

SEQ ID NO: 365535 - DNA, 20 bp, human
gtcctggcgccatctagtgg

SEQ ID NO: 365536 - DNA, 20 bp, human
gctgccacgcgctcccgtcg

SEQ ID NO: 365537 - DNA, 20 bp, human
ggccccgcctcgcagagctg

SEQ ID NO: 365538 - DNA, 20 bp, human
gccccggcccaggtgcgggt

SEQ ID NO: 365539 - DNA, 20 bp, human
gtgtccacgcgcgacggctc

SEQ ID NO: 365540 - DNA, 20 bp, human
gccagctgactcaggaggtc

SEQ ID NO: 365541 - DNA, 20 bp, human
ggggagcgcgtggcaggccg

SEQ ID NO: 365542 - DNA, 20 bp, human
gtggggaggcaaaacacggt

SEQ ID NO: 365543 - DNA, 20 bp, human
ggggagagccagtctaaacg

SEQ ID NO: 365544 - DNA, 20 bp, human
gtcggggcccacccgcacct

SEQ ID NO: 365545 - DNA, 20 bp, human
gctcctgagtcagctggccg

SEQ ID NO: 365546 - DNA, 20 bp, human
gtactctgaaaagaaggact

SEQ ID NO: 365547 - DNA, 20 bp, human
gctgaaaagaaggactggga

SEQ ID NO: 365548 - DNA, 20 bp, human
gccagcctactctgaaaaga

SEQ ID NO: 365549 - DNA, 20 bp, human
gagaaagattatctttgcaa

SEQ ID NO: 365550 - DNA, 20 bp, human
ggcaactcagtttaactctg

SEQ ID NO: 365551 - DNA, 20 bp, human
ggattgaaaaactgattcca

SEQ ID NO: 365552 - DNA, 20 bp, human
gtcctgctttgctctggatc

SEQ ID NO: 365553 - DNA, 20 bp, human
gcaggcaggcggatcgtttt

SEQ ID NO: 365554 - DNA, 20 bp, human
gctgattccatggtcaggcg

SEQ ID NO: 365555 - DNA, 20 bp, human
ggtttttcaatctgtgctcg

SEQ ID NO: 365556 - DNA, 20 bp, human
gcggatagggcctgtgaaag

SEQ ID NO: 365557 - DNA, 20 bp, human
gaggcaggggactgcggata

SEQ ID NO: 365558 - DNA, 20 bp, human
gcctgtgaaaggggaagcga

SEQ ID NO: 365559 - DNA, 20 bp, human
gtggaggcgtggagtttgat

SEQ ID NO: 365560 - DNA, 20 bp, human
gaggccagcagcgggggttt

SEQ ID NO: 365561 - DNA, 20 bp, human
ggaagagggtaaagcaaaag

SEQ ID NO: 365562 - DNA, 20 bp, human
gtaccccaaacccccgctgc

SEQ ID NO: 365563 - DNA, 20 bp, human
gcccccgggctcctaggtca

SEQ ID NO: 365564 - DNA, 20 bp, human
gggaaattcacagcgcaatt

SEQ ID NO: 365565 - DNA, 20 bp, human
gtaggggtgaagccctgccc

SEQ ID NO: 365566 - DNA, 20 bp, human
gccgccccgggcactaggcg

SEQ ID NO: 365567 - DNA, 20 bp, human
gcgagtggggcgttgagcag

SEQ ID NO: 365568 - DNA, 20 bp, human
gtgcgtgtcttggggagctt

SEQ ID NO: 365569 - DNA, 20 bp, human
ggggcctgagatgtccctat

SEQ ID NO: 365570 - DNA, 20 bp, human
gctggatcactgcgtgtctt

SEQ ID NO: 365571 - DNA, 20 bp, human
ggaggaggtggccggtattc

SEQ ID NO: 365572 - DNA, 20 bp, human
gccggaagttccggcgagtg

SEQ ID NO: 365573 - DNA, 20 bp, human
gcggccctgggttctgggac

SEQ ID NO: 365574 - DNA, 20 bp, human
gcgcccaatagggacatctc

SEQ ID NO: 365575 - DNA, 20 bp, human
gggggcggggccggaagttc

SEQ ID NO: 365576 - DNA, 20 bp, human
gaagcaaacaaatcagattt

SEQ ID NO: 365577 - DNA, 20 bp, human
gttatctcttggtactgttc

SEQ ID NO: 365578 - DNA, 20 bp, human
gatgctcttggatcatcaaa

SEQ ID NO: 365579 - DNA, 20 bp, human
gttaaacctttatcagtatg

SEQ ID NO: 365580 - DNA, 20 bp, human
ggaatccagttgcaaacatg

SEQ ID NO: 365581 - DNA, 20 bp, human
gattacttagcggctaaatt

SEQ ID NO: 365582 - DNA, 20 bp, human
gttttttcatcagagggatg

SEQ ID NO: 365583 - DNA, 20 bp, human
gtcttatttttttcatcaga

SEQ ID NO: 365584 - DNA, 20 bp, human
gccaagagataaagcgcaaa

SEQ ID NO: 365585 - DNA, 20 bp, human
gtctgataagaaacttaatt

SEQ ID NO: 365586 - DNA, 20 bp, human
gcgcggctgaaagcgtgtgg

SEQ ID NO: 365587 - DNA, 20 bp, human
gttcggatgtctgtgtggcg

SEQ ID NO: 365588 - DNA, 20 bp, human
ggcgctgcgcccctgctgag

SEQ ID NO: 365589 - DNA, 20 bp, human
gtgcagttcggatgtctgtg

SEQ ID NO: 365590 - DNA, 20 bp, human
ggcagcgcgcgggtcggact

SEQ ID NO: 365591 - DNA, 20 bp, human
gcgcgcgcgggcgagctaga

SEQ ID NO: 365592 - DNA, 20 bp, human
gtgaaagcgtgtggaggcgc

SEQ ID NO: 365593 - DNA, 20 bp, human
ggggacgccggtcacgtggc

SEQ ID NO: 365594 - DNA, 20 bp, human
gagggacccaagggcgagtc

SEQ ID NO: 365595 - DNA, 20 bp, human
gtcgtcagacagggacccaa

SEQ ID NO: 365596 - DNA, 20 bp, human
ggtaacttacaggaaatagc

SEQ ID NO: 365597 - DNA, 20 bp, human
ggtgatgtaacttaagatta

SEQ ID NO: 365598 - DNA, 20 bp, human
gacttagagaaggcagccgg

SEQ ID NO: 365599 - DNA, 20 bp, human
gtgtttggcactaaagatta

SEQ ID NO: 365600 - DNA, 20 bp, human
ggacagaggttgctcagtct

SEQ ID NO: 365601 - DNA, 20 bp, human
ggagattaggtcagaaatat

SEQ ID NO: 365602 - DNA, 20 bp, human
gttctgacctaatctctttt

SEQ ID NO: 365603 - DNA, 20 bp, human
gagaaggcagccgggggcag

SEQ ID NO: 365604 - DNA, 20 bp, human
gaataattctaacttagaga

SEQ ID NO: 365605 - DNA, 20 bp, human
gctaacttagagaaggcagc

SEQ ID NO: 365606 - DNA, 20 bp, human
gtccagtgtggctctcctga

SEQ ID NO: 365607 - DNA, 20 bp, human
gctcaaagcatgagcagaag

SEQ ID NO: 365608 - DNA, 20 bp, human
gtgcgcgcgcgtctgcgacg

SEQ ID NO: 365609 - DNA, 20 bp, human
gcctcctcctgctcagagag

SEQ ID NO: 365610 - DNA, 20 bp, human
gacgctgtgtcggtgagttg

SEQ ID NO: 365611 - DNA, 20 bp, human
gattgggcctcggagagcgg

SEQ ID NO: 365612 - DNA, 20 bp, human
gccacagcctccagatgatt

SEQ ID NO: 365613 - DNA, 20 bp, human
ggggcgcgtctcctaggtgc

SEQ ID NO: 365614 - DNA, 20 bp, human
ggcccaccgcgcccgcacct

SEQ ID NO: 365615 - DNA, 20 bp, human
gtgaggctaacgatccagtg

SEQ ID NO: 365616 - DNA, 20 bp, human
ggtggaccctgggctcgctg

SEQ ID NO: 365617 - DNA, 20 bp, human
gcatgcgtgtgagtagggca

SEQ ID NO: 365618 - DNA, 20 bp, human
gtgcgcgcaggggagacacg

SEQ ID NO: 365619 - DNA, 20 bp, human
gacgcggggtgtacggaggg

SEQ ID NO: 365620 - DNA, 20 bp, human
gaggtgcatgcgtgtgagta

SEQ ID NO: 365621 - DNA, 20 bp, human
gacacaacccccaggcccgg

SEQ ID NO: 365622 - DNA, 20 bp, human
gcggggtgtacggagggcgg

SEQ ID NO: 365623 - DNA, 20 bp, human
ggcgagaaatgaatgcagag

SEQ ID NO: 365624 - DNA, 20 bp, human
gccgccaacgcgtggaaata

SEQ ID NO: 365625 - DNA, 20 bp, human
gcgagctgaaacagccaatc

SEQ ID NO: 365626 - DNA, 20 bp, human
gtgtccgcgcgctaccgcca

SEQ ID NO: 365627 - DNA, 20 bp, human
ggagccgcgtccctgcgcag

SEQ ID NO: 365628 - DNA, 20 bp, human
ggcgcagggacgcggctcgg

SEQ ID NO: 365629 - DNA, 20 bp, human
gagcgcgcggacatgccccc

SEQ ID NO: 365630 - DNA, 20 bp, human
gcgcgatccgcgcttcggtg

SEQ ID NO: 365631 - DNA, 20 bp, human
gcggggagcggactgggcgg

SEQ ID NO: 365632 - DNA, 20 bp, human
gggctgcagtggtcccggcg

SEQ ID NO: 365633 - DNA, 20 bp, human
ggggtccggcagtcctagag

SEQ ID NO: 365634 - DNA, 20 bp, human
gcagccctggcggtagcgcg

SEQ ID NO: 365635 - DNA, 20 bp, human
gagctggcaacgccgggaga

SEQ ID NO: 365636 - DNA, 20 bp, human
gggcaggggcggaacgagaa

SEQ ID NO: 365637 - DNA, 20 bp, human
gttggggaccagcagtgaat

SEQ ID NO: 365638 - DNA, 20 bp, human
gaatgggcgcatgcgtaagg

SEQ ID NO: 365639 - DNA, 20 bp, human
gtggctctgggtgctgaaac

SEQ ID NO: 365640 - DNA, 20 bp, human
gtgtccgggccgggccaccc

SEQ ID NO: 365641 - DNA, 20 bp, human
ggagctcgccaatgaggacg

SEQ ID NO: 365642 - DNA, 20 bp, human
gggggcggaacgagaagggc

SEQ ID NO: 365643 - DNA, 20 bp, human
gttaggaggctgactaggta

SEQ ID NO: 365644 - DNA, 20 bp, human
gacacggaagggttagtggt

SEQ ID NO: 365645 - DNA, 20 bp, human
gcacccagagccacacggaa

SEQ ID NO: 365646 - DNA, 20 bp, human
gagggactttgagtcctctt

SEQ ID NO: 365647 - DNA, 20 bp, human
gaggtcctgaaatctaatcc

SEQ ID NO: 365648 - DNA, 20 bp, human
gaggcgggaaaaaacagcac

SEQ ID NO: 365649 - DNA, 20 bp, human
ggctagtctcacttgcatcc

SEQ ID NO: 365650 - DNA, 20 bp, human
ggcatcctggattagatttc

SEQ ID NO: 365651 - DNA, 20 bp, human
ggcctggtgcccacgaaggt

SEQ ID NO: 365652 - DNA, 20 bp, human
gtgcccacgaaggtaggtaa

SEQ ID NO: 365653 - DNA, 20 bp, human
gatgagggactggccggtca

SEQ ID NO: 365654 - DNA, 20 bp, human
gggccaaaaatatttcagtg

SEQ ID NO: 365655 - DNA, 20 bp, human
gcagggtggaaacaagaatg

SEQ ID NO: 365656 - DNA, 20 bp, human
ggagaagagcgaggctgtag

SEQ ID NO: 365657 - DNA, 20 bp, human
gaggagagagagatgacatg

SEQ ID NO: 365658 - DNA, 20 bp, human
gtaggtaggcgagtaaaagg

SEQ ID NO: 365659 - DNA, 20 bp, human
ggggcatccgggcaagaaca

SEQ ID NO: 365660 - DNA, 20 bp, human
ggctcggggttgatcagtgt

SEQ ID NO: 365661 - DNA, 20 bp, human
gagagcctgcggggaaaaga

SEQ ID NO: 365662 - DNA, 20 bp, human
gtgtagcggctgcctgttga

SEQ ID NO: 365663 - DNA, 20 bp, human
ggcagggtggggttcctcgc

SEQ ID NO: 365664 - DNA, 20 bp, human
ggggttcagtagtttgggaa

SEQ ID NO: 365665 - DNA, 20 bp, human
gccgggccagggccgagtgt

SEQ ID NO: 365666 - DNA, 20 bp, human
ggggttgcgggacgcgccgt

SEQ ID NO: 365667 - DNA, 20 bp, human
ggacggggccggttccggtt

SEQ ID NO: 365668 - DNA, 20 bp, human
ggcggctcccaccttcgggg

SEQ ID NO: 365669 - DNA, 20 bp, human
ggggccggttccggttgggg

SEQ ID NO: 365670 - DNA, 20 bp, human
gccgccgtccgcaccgggac

SEQ ID NO: 365671 - DNA, 20 bp, human
gaggaagcggaggtctgaag

SEQ ID NO: 365672 - DNA, 20 bp, human
gggacccccccaaccggaac

SEQ ID NO: 365673 - DNA, 20 bp, human
gacgcgccgtcggggagctg

SEQ ID NO: 365674 - DNA, 20 bp, human
gcccaccttcggggaggcga

SEQ ID NO: 365675 - DNA, 20 bp, human
gggggcggctcccaccttcg

SEQ ID NO: 365676 - DNA, 20 bp, human
gtacaaaaggccacacgaat

SEQ ID NO: 365677 - DNA, 20 bp, human
gtggcgactatgctcagggc

SEQ ID NO: 365678 - DNA, 20 bp, human
ggacaagtgtatgagagctc

SEQ ID NO: 365679 - DNA, 20 bp, human
gtctaccttctgagtgactg

SEQ ID NO: 365680 - DNA, 20 bp, human
gaagcatgaagtaaactaag

SEQ ID NO: 365681 - DNA, 20 bp, human
ggtggactttacttcctgag

SEQ ID NO: 365682 - DNA, 20 bp, human
gcctgagcatagtcgccaaa

SEQ ID NO: 365683 - DNA, 20 bp, human
gccttctgagtgactgtggg

SEQ ID NO: 365684 - DNA, 20 bp, human
gagacccctagaaaattact

SEQ ID NO: 365685 - DNA, 20 bp, human
ggtaaagtccactagcagga

SEQ ID NO: 365686 - DNA, 20 bp, human
gcctgctgctggactgtccc

SEQ ID NO: 365687 - DNA, 20 bp, human
gattccgtcgggtggggaag

SEQ ID NO: 365688 - DNA, 20 bp, human
ggggaggtgtggtctcttta

SEQ ID NO: 365689 - DNA, 20 bp, human
ggaaggggccaggatgcggg

SEQ ID NO: 365690 - DNA, 20 bp, human
gagcctccccgggattccgt

SEQ ID NO: 365691 - DNA, 20 bp, human
gatcccgtggcgcctgcgtc

SEQ ID NO: 365692 - DNA, 20 bp, human
gggtctagggccccgggctt

SEQ ID NO: 365693 - DNA, 20 bp, human
gcccacccgacggaatcccg

SEQ ID NO: 365694 - DNA, 20 bp, human
ggccaggcagggcgggccca

SEQ ID NO: 365695 - DNA, 20 bp, human
gaccacacctcccaggaagt

SEQ ID NO: 365696 - DNA, 20 bp, human
ggctcgcagcacatggtcgg

SEQ ID NO: 365697 - DNA, 20 bp, human
gagcgctcgcagcacatggt

SEQ ID NO: 365698 - DNA, 20 bp, human
ggtgcccgagtcgcgggagt

SEQ ID NO: 365699 - DNA, 20 bp, human
gcggtctccgccggcctcgg

SEQ ID NO: 365700 - DNA, 20 bp, human
gggctcaggtccacgtggga

SEQ ID NO: 365701 - DNA, 20 bp, human
gccccggccgcctgcgaccc

SEQ ID NO: 365702 - DNA, 20 bp, human
ggcacggcccgggtcgcagg

SEQ ID NO: 365703 - DNA, 20 bp, human
gcgcgagcgtgcagggtgtt

SEQ ID NO: 365704 - DNA, 20 bp, human
gcgcagaggcgcacccgggt

SEQ ID NO: 365705 - DNA, 20 bp, human
gcacccgggttgggagatcg

SEQ ID NO: 365706 - DNA, 20 bp, human
gcgactgagcatgctccaag

SEQ ID NO: 365707 - DNA, 20 bp, human
ggtctccaggcaccgggagg

SEQ ID NO: 365708 - DNA, 20 bp, human
gcgctcctccgcacccacaa

SEQ ID NO: 365709 - DNA, 20 bp, human
gaaggaggcggtggcgggaa

SEQ ID NO: 365710 - DNA, 20 bp, human
ggtgggggccggacaggctg

SEQ ID NO: 365711 - DNA, 20 bp, human
gtcggtctccaggcaccggg

SEQ ID NO: 365712 - DNA, 20 bp, human
gcgctcggggcactccactt

SEQ ID NO: 365713 - DNA, 20 bp, human
ggcgggcgaggacacgtcag

SEQ ID NO: 365714 - DNA, 20 bp, human
gccaggggtgggggccggac

SEQ ID NO: 365715 - DNA, 20 bp, human
gaggagcgcgcgccaggggt

SEQ ID NO: 365716 - DNA, 20 bp, human
ggaccggcccaagtcaggga

SEQ ID NO: 365717 - DNA, 20 bp, human
ggagaggtggcagtggccaa

SEQ ID NO: 365718 - DNA, 20 bp, human
gtcaggtgagtgtgatgtga

SEQ ID NO: 365719 - DNA, 20 bp, human
gaggccagctgggaatcttg

SEQ ID NO: 365720 - DNA, 20 bp, human
gcatgggaactcagctcccc

SEQ ID NO: 365721 - DNA, 20 bp, human
ggtgaagcttacccggatgg

SEQ ID NO: 365722 - DNA, 20 bp, human
ggaggcgaccggcccaagtc

SEQ ID NO: 365723 - DNA, 20 bp, human
gcaccagactaggaccccct

SEQ ID NO: 365724 - DNA, 20 bp, human
gtctctgtgtctaccacccc

SEQ ID NO: 365725 - DNA, 20 bp, human
ggagacaggagggtgatccc

SEQ ID NO: 365726 - DNA, 20 bp, human
gccgcggccccggccctacc

SEQ ID NO: 365727 - DNA, 20 bp, human
gcaccccggccagtctgaac

SEQ ID NO: 365728 - DNA, 20 bp, human
gacggcgcccacctctctcg

SEQ ID NO: 365729 - DNA, 20 bp, human
gtgactgcgcgggtggttgg

SEQ ID NO: 365730 - DNA, 20 bp, human
gggtggctccaggcctggta

SEQ ID NO: 365731 - DNA, 20 bp, human
gactgcccgagccgcggccc

SEQ ID NO: 365732 - DNA, 20 bp, human
gtgcgcgggtggttggggga

SEQ ID NO: 365733 - DNA, 20 bp, human
ggaaaaccccggggaggaga

SEQ ID NO: 365734 - DNA, 20 bp, human
gccacccgcgcagtcacaac

SEQ ID NO: 365735 - DNA, 20 bp, human
gccaaagccacgagagaggt

SEQ ID NO: 365736 - DNA, 20 bp, human
gtgggcagggagagagacta

SEQ ID NO: 365737 - DNA, 20 bp, human
gcatccagtggaccagaaac

SEQ ID NO: 365738 - DNA, 20 bp, human
gtatacaatgctgttctcac

SEQ ID NO: 365739 - DNA, 20 bp, human
ggaaatcttgagagcactta

SEQ ID NO: 365740 - DNA, 20 bp, human
ggtgggtcaaaatcatccag

SEQ ID NO: 365741 - DNA, 20 bp, human
gtattatgccatgaaattac

SEQ ID NO: 365742 - DNA, 20 bp, human
gacagtgatgtcaaaagatt

SEQ ID NO: 365743 - DNA, 20 bp, human
gtcttgagagcacttatggc

SEQ ID NO: 365744 - DNA, 20 bp, human
gaccttttccttaaagcttc

SEQ ID NO: 365745 - DNA, 20 bp, human
ggaatctgccagtaatttca

SEQ ID NO: 365746 - DNA, 20 bp, human
ggggctcctgaaatcagtga

SEQ ID NO: 365747 - DNA, 20 bp, human
gcccttgctttcagaaaaaa

SEQ ID NO: 365748 - DNA, 20 bp, human
ggtggcagtcagacggcaac

SEQ ID NO: 365749 - DNA, 20 bp, human
gaagcggcaaaaccaagccg

SEQ ID NO: 365750 - DNA, 20 bp, human
gaaacactaggaagtgaata

SEQ ID NO: 365751 - DNA, 20 bp, human
gagtcagacggcaacaggtt

SEQ ID NO: 365752 - DNA, 20 bp, human
gactgccctggcaacttccc

SEQ ID NO: 365753 - DNA, 20 bp, human
gaaaaggcttgttgactgaa

SEQ ID NO: 365754 - DNA, 20 bp, human
gagcggaagccaattcaaag

SEQ ID NO: 365755 - DNA, 20 bp, human
gttcacattcattaggctgt

SEQ ID NO: 365756 - DNA, 20 bp, human
gggacctcataggtgtcctc

SEQ ID NO: 365757 - DNA, 20 bp, human
gcctgaggagacactcacaa

SEQ ID NO: 365758 - DNA, 20 bp, human
ggacactcacaaggggaagg

SEQ ID NO: 365759 - DNA, 20 bp, human
gtgtctcctcaggacctcat

SEQ ID NO: 365760 - DNA, 20 bp, human
gagcaacttaagccctaggg

SEQ ID NO: 365761 - DNA, 20 bp, human
gactgcagaggggattgggc

SEQ ID NO: 365762 - DNA, 20 bp, human
ggaagggcttcttgccaaat

SEQ ID NO: 365763 - DNA, 20 bp, human
gggacacctatgaggtcctg

SEQ ID NO: 365764 - DNA, 20 bp, human
gtgcttcttcaaagcctatt

SEQ ID NO: 365765 - DNA, 20 bp, human
gaggattctttgccacccta

SEQ ID NO: 365766 - DNA, 20 bp, human
ggtgaaacatgtggggtgtc

SEQ ID NO: 365767 - DNA, 20 bp, human
gcagctgggcttgaagcatg

SEQ ID NO: 365768 - DNA, 20 bp, human
ggctgtcagtgaaacatgtg

SEQ ID NO: 365769 - DNA, 20 bp, human
gctccaagctggtaacataa

SEQ ID NO: 365770 - DNA, 20 bp, human
gacagcactatccccttctg

SEQ ID NO: 365771 - DNA, 20 bp, human
ggtcaggatccttataagaa

SEQ ID NO: 365772 - DNA, 20 bp, human
gtgattctgattaaggatga

SEQ ID NO: 365773 - DNA, 20 bp, human
gagacataggtgacctcagc

SEQ ID NO: 365774 - DNA, 20 bp, human
ggggacattgattctgatta

SEQ ID NO: 365775 - DNA, 20 bp, human
gagcccttatgttaccagct

SEQ ID NO: 365776 - DNA, 20 bp, human
ggagttctgggagttctcgt

SEQ ID NO: 365777 - DNA, 20 bp, human
gcccgccgccatcttaggtg

SEQ ID NO: 365778 - DNA, 20 bp, human
gtggcccctgcactttacaa

SEQ ID NO: 365779 - DNA, 20 bp, human
ggagacggtcgtccgaacac

SEQ ID NO: 365780 - DNA, 20 bp, human
gggaccgcggggactagacg

SEQ ID NO: 365781 - DNA, 20 bp, human
gttacaagggggtgcaggag

SEQ ID NO: 365782 - DNA, 20 bp, human
gcccgcagcgaggatgagtg

SEQ ID NO: 365783 - DNA, 20 bp, human
gctccccggcatgcgtagac

SEQ ID NO: 365784 - DNA, 20 bp, human
ggtagaccggcgggcggagc

SEQ ID NO: 365785 - DNA, 20 bp, human
gactagggaagcggagttct

SEQ ID NO: 365786 - DNA, 20 bp, human
gtcattggaaggggaggatc

SEQ ID NO: 365787 - DNA, 20 bp, human
gctcctattaggaaacccgt

SEQ ID NO: 365788 - DNA, 20 bp, human
gaagcagtgccacggtattt

SEQ ID NO: 365789 - DNA, 20 bp, human
gcagaaagtctcattggaag

SEQ ID NO: 365790 - DNA, 20 bp, human
gcacggtatttgggtagatg

SEQ ID NO: 365791 - DNA, 20 bp, human
gaaagtctcattggaagggg

SEQ ID NO: 365792 - DNA, 20 bp, human
gaacccacgggtttcctaat

SEQ ID NO: 365793 - DNA, 20 bp, human
gcacaatcagaaagtctcat

SEQ ID NO: 365794 - DNA, 20 bp, human
gttggaaggggaggatccgg

SEQ ID NO: 365795 - DNA, 20 bp, human
gggtttcctaataggagagt

SEQ ID NO: 365796 - DNA, 20 bp, human
ggggacaggacgaggatgaa

SEQ ID NO: 365797 - DNA, 20 bp, human
ggtctgacagacgaggggag

SEQ ID NO: 365798 - DNA, 20 bp, human
ggggcgggtctgacagacga

SEQ ID NO: 365799 - DNA, 20 bp, human
ggcgtgagttcagaacccac

SEQ ID NO: 365800 - DNA, 20 bp, human
gctggggaaggaacagaatt

SEQ ID NO: 365801 - DNA, 20 bp, human
gaaaatctgggtaggagcca

SEQ ID NO: 365802 - DNA, 20 bp, human
ggggaaggaacagaattggg

SEQ ID NO: 365803 - DNA, 20 bp, human
ggatgaaagggctgcgagag

SEQ ID NO: 365804 - DNA, 20 bp, human
ggtgatggaacagggatagg

SEQ ID NO: 365805 - DNA, 20 bp, human
gcaggagaggagagaaaatc

SEQ ID NO: 365806 - DNA, 20 bp, human
ggggacgctaacatgagctc

SEQ ID NO: 365807 - DNA, 20 bp, human
gcataagcccaggcggctga

SEQ ID NO: 365808 - DNA, 20 bp, human
ggccgcctgggcttatgaat

SEQ ID NO: 365809 - DNA, 20 bp, human
gtgaggggcaggtattgtgc

SEQ ID NO: 365810 - DNA, 20 bp, human
gaggggctggagctaggcca

SEQ ID NO: 365811 - DNA, 20 bp, human
gtggctgtgagcctgtctgc

SEQ ID NO: 365812 - DNA, 20 bp, human
gagaccagcagcagtatccg

SEQ ID NO: 365813 - DNA, 20 bp, human
ggggaccacatccatgctag

SEQ ID NO: 365814 - DNA, 20 bp, human
gtcaaatgcaagttcctcgt

SEQ ID NO: 365815 - DNA, 20 bp, human
gcagacctcagaaaagcaaa

SEQ ID NO: 365816 - DNA, 20 bp, human
gagggcgcgtcggacagtca

SEQ ID NO: 365817 - DNA, 20 bp, human
gcccacactaacctctgctg

SEQ ID NO: 365818 - DNA, 20 bp, human
gagggcggggcataccactc

SEQ ID NO: 365819 - DNA, 20 bp, human
ggaccgacgtcagcagggtg

SEQ ID NO: 365820 - DNA, 20 bp, human
ggggactgacacgtggactt

SEQ ID NO: 365821 - DNA, 20 bp, human
gacccagccagggcgaccgt

SEQ ID NO: 365822 - DNA, 20 bp, human
ggcggggccaacggtcgccc

SEQ ID NO: 365823 - DNA, 20 bp, human
gcctgctgccccataggagc

SEQ ID NO: 365824 - DNA, 20 bp, human
gcgttggccccgctcctatg

SEQ ID NO: 365825 - DNA, 20 bp, human
gtgcccgggtgggtcagcct

SEQ ID NO: 365826 - DNA, 20 bp, human
gcgtcaaaggcaggaaggca

SEQ ID NO: 365827 - DNA, 20 bp, human
gccttagctccctgcgtcaa

SEQ ID NO: 365828 - DNA, 20 bp, human
gagctccctgcgtcaaaggc

SEQ ID NO: 365829 - DNA, 20 bp, human
gccttcctgcctttgacgca

SEQ ID NO: 365830 - DNA, 20 bp, human
gtgactaagtagcaaggaac

SEQ ID NO: 365831 - DNA, 20 bp, human
ggtccagtgcctctttgctt

SEQ ID NO: 365832 - DNA, 20 bp, human
gtctgaatgaaccctgttgg

SEQ ID NO: 365833 - DNA, 20 bp, human
gaggaacaggaactgcacac

SEQ ID NO: 365834 - DNA, 20 bp, human
gttaattgcaacctccaaca

SEQ ID NO: 365835 - DNA, 20 bp, human
gcctgggtctgaatacaaat

SEQ ID NO: 365836 - DNA, 20 bp, human
gagcctggacgaagagtgaa

SEQ ID NO: 365837 - DNA, 20 bp, human
gcggccacgcgctgggtccg

SEQ ID NO: 365838 - DNA, 20 bp, human
ggggctgcagaggtcggaga

SEQ ID NO: 365839 - DNA, 20 bp, human
gccggacggggtaaactgag

SEQ ID NO: 365840 - DNA, 20 bp, human
ggccagggaccaaggcgagg

SEQ ID NO: 365841 - DNA, 20 bp, human
gacgtcacggccggagggag

SEQ ID NO: 365842 - DNA, 20 bp, human
ggcgccgtcgctgcgcagga

SEQ ID NO: 365843 - DNA, 20 bp, human
gggaaagaggtcagagagcc

SEQ ID NO: 365844 - DNA, 20 bp, human
gccggagccgcccggactga

SEQ ID NO: 365845 - DNA, 20 bp, human
gcgcgtggccgagtgccttg

SEQ ID NO: 365846 - DNA, 20 bp, human
ggcgcggaacgcccatccca

SEQ ID NO: 365847 - DNA, 20 bp, human
gcatgctaatgcgacgtcgg

SEQ ID NO: 365848 - DNA, 20 bp, human
gcagcccccgagtggtgccc

SEQ ID NO: 365849 - DNA, 20 bp, human
gtggagagcggacccctgcc

SEQ ID NO: 365850 - DNA, 20 bp, human
ggaggcaagagccgacgcga

SEQ ID NO: 365851 - DNA, 20 bp, human
gccaaggggcctcgaggaac

SEQ ID NO: 365852 - DNA, 20 bp, human
gcctccagccctggagcatc

SEQ ID NO: 365853 - DNA, 20 bp, human
ggtggcccgggcaccactcg

SEQ ID NO: 365854 - DNA, 20 bp, human
gcgcccgctcttctcctctt

SEQ ID NO: 365855 - DNA, 20 bp, human
ggctcatgctaatgcgacgt

SEQ ID NO: 365856 - DNA, 20 bp, human
gcacctcagctgctatatca

SEQ ID NO: 365857 - DNA, 20 bp, human
gcaccatgatatagcagctg

SEQ ID NO: 365858 - DNA, 20 bp, human
ggtggtggattaagataatg

SEQ ID NO: 365859 - DNA, 20 bp, human
gacactgccagcaagtgccc

SEQ ID NO: 365860 - DNA, 20 bp, human
ggattaagataatgaggcgg

SEQ ID NO: 365861 - DNA, 20 bp, human
gtgctggcagtgtgtaactt

SEQ ID NO: 365862 - DNA, 20 bp, human
gtaagataatgaggcggggg

SEQ ID NO: 365863 - DNA, 20 bp, human
gactctgggtccccgggagg

SEQ ID NO: 365864 - DNA, 20 bp, human
ggaagcatggcgaagtggct

SEQ ID NO: 365865 - DNA, 20 bp, human
gtgaggggggtacagctgta

SEQ ID NO: 365866 - DNA, 20 bp, human
ggcggcaggagcgtccccac

SEQ ID NO: 365867 - DNA, 20 bp, human
gcgaacgcgtcctgagggcg

SEQ ID NO: 365868 - DNA, 20 bp, human
gaccccggcggtgaccgggt

SEQ ID NO: 365869 - DNA, 20 bp, human
gcgccccaggatgacgcgga

SEQ ID NO: 365870 - DNA, 20 bp, human
ggctgggagacggccgtggg

SEQ ID NO: 365871 - DNA, 20 bp, human
gcgagtcgcaggtaccggtg

SEQ ID NO: 365872 - DNA, 20 bp, human
gcccgccgaacgcgtcctga

SEQ ID NO: 365873 - DNA, 20 bp, human
gggtagggccgcagcacgag

SEQ ID NO: 365874 - DNA, 20 bp, human
gtgggtgggagggtgccccg

SEQ ID NO: 365875 - DNA, 20 bp, human
gccacggggccgcgtgtcgg

SEQ ID NO: 365876 - DNA, 20 bp, human
gacgtcccagggctcaagcg

SEQ ID NO: 365877 - DNA, 20 bp, human
gcacacgacgtgaactgggg

SEQ ID NO: 365878 - DNA, 20 bp, human
gacgacgtgaactggggcgg

SEQ ID NO: 365879 - DNA, 20 bp, human
gggtcacacgacgtgaactg

SEQ ID NO: 365880 - DNA, 20 bp, human
ggaccctagaggcgtctgta

SEQ ID NO: 365881 - DNA, 20 bp, human
gtcccagggctcaagcgcgg

SEQ ID NO: 365882 - DNA, 20 bp, human
ggccaggcctctgacgtccc

SEQ ID NO: 365883 - DNA, 20 bp, human
gtggaactccactccaaaag

SEQ ID NO: 365884 - DNA, 20 bp, human
gctcaagcgcggaggacatg

SEQ ID NO: 365885 - DNA, 20 bp, human
gcaaaagcggcggcttgcgg

SEQ ID NO: 365886 - DNA, 20 bp, human
gggatccaggcgctcttggt

SEQ ID NO: 365887 - DNA, 20 bp, human
gaaaatctgggcttccacac

SEQ ID NO: 365888 - DNA, 20 bp, human
gtgcccagaaaaccggccct

SEQ ID NO: 365889 - DNA, 20 bp, human
gggcccagggccggttttct

SEQ ID NO: 365890 - DNA, 20 bp, human
ggccctgggccaggaaaatc

SEQ ID NO: 365891 - DNA, 20 bp, human
gtcagcataatgaagcaaga

SEQ ID NO: 365892 - DNA, 20 bp, human
gcccagattttcctggccca

SEQ ID NO: 365893 - DNA, 20 bp, human
ggctttgcatatgcgaatcc

SEQ ID NO: 365894 - DNA, 20 bp, human
gcagacctttcatcccagtg

SEQ ID NO: 365895 - DNA, 20 bp, human
gaacgatcgctgttggattc

SEQ ID NO: 365896 - DNA, 20 bp, human
ggggacgcccggggtcccta

SEQ ID NO: 365897 - DNA, 20 bp, human
gctaccacgcctgctcccta

SEQ ID NO: 365898 - DNA, 20 bp, human
gcaaagccctagcatgagtg

SEQ ID NO: 365899 - DNA, 20 bp, human
gcccggggtccctagggagc

SEQ ID NO: 365900 - DNA, 20 bp, human
gtgcgtgcgtgggacgcccg

SEQ ID NO: 365901 - DNA, 20 bp, human
ggagctggggcggcctctcc

SEQ ID NO: 365902 - DNA, 20 bp, human
gaaagcgagacagactccag

SEQ ID NO: 365903 - DNA, 20 bp, human
gggactcagggttcccggag

SEQ ID NO: 365904 - DNA, 20 bp, human
gaggagagaaaggagtcctg

SEQ ID NO: 365905 - DNA, 20 bp, human
gaacggagagggagacgtgc

SEQ ID NO: 365906 - DNA, 20 bp, human
gggcaggagcccaggatcta

SEQ ID NO: 365907 - DNA, 20 bp, human
gccccgccgctcgtccggga

SEQ ID NO: 365908 - DNA, 20 bp, human
gcgctcgtccgggaaggctt

SEQ ID NO: 365909 - DNA, 20 bp, human
gcccgtgcggggtgaagcgc

SEQ ID NO: 365910 - DNA, 20 bp, human
ggaggccccgccgctcgtcc

SEQ ID NO: 365911 - DNA, 20 bp, human
gagtgaggagggagcgccag

SEQ ID NO: 365912 - DNA, 20 bp, human
gggaccgcgactggagatgg

SEQ ID NO: 365913 - DNA, 20 bp, human
gggggccacgcgggcttcag

SEQ ID NO: 365914 - DNA, 20 bp, human
ggggtgacctggggccacgc

SEQ ID NO: 365915 - DNA, 20 bp, human
gccggctgcccaagccttcc

SEQ ID NO: 365916 - DNA, 20 bp, human
gaaagcgtgaaagtggtcta

SEQ ID NO: 365917 - DNA, 20 bp, human
gagtctgtgcccgggaaagg

SEQ ID NO: 365918 - DNA, 20 bp, human
gaactgacaaagcgtgaaag

SEQ ID NO: 365919 - DNA, 20 bp, human
gtggggaatggaaaccgcac

SEQ ID NO: 365920 - DNA, 20 bp, human
gtgcccgggaaaggaggagt

SEQ ID NO: 365921 - DNA, 20 bp, human
gaggagtctgtgcccgggaa

SEQ ID NO: 365922 - DNA, 20 bp, human
gggcaacttaagaaaagggg

SEQ ID NO: 365923 - DNA, 20 bp, human
ggaaatgcaaaaccgggact

SEQ ID NO: 365924 - DNA, 20 bp, human
ggaatggaaaccgcacaggg

SEQ ID NO: 365925 - DNA, 20 bp, human
gacaccagaagcaggcttgc

SEQ ID NO: 365926 - DNA, 20 bp, human
gcatcagctgggttctgcgg

SEQ ID NO: 365927 - DNA, 20 bp, human
gcgtccttccccttccaatg

SEQ ID NO: 365928 - DNA, 20 bp, human
ggcgggggagggtgggaata

SEQ ID NO: 365929 - DNA, 20 bp, human
gagctgggttctgcggggga

SEQ ID NO: 365930 - DNA, 20 bp, human
gacactgcaaccttgaggtc

SEQ ID NO: 365931 - DNA, 20 bp, human
gtttatagcctcattggaag

SEQ ID NO: 365932 - DNA, 20 bp, human
gaccttgaggtctggtattg

SEQ ID NO: 365933 - DNA, 20 bp, human
ggccacaataccagacctca

SEQ ID NO: 365934 - DNA, 20 bp, human
gtatgcacactgcaaccttg

SEQ ID NO: 365935 - DNA, 20 bp, human
gtatgcacatttctcacacg

SEQ ID NO: 365936 - DNA, 20 bp, human
gacggcgggcgtgaagtgag

SEQ ID NO: 365937 - DNA, 20 bp, human
gggcacccgcgacacgggtg

SEQ ID NO: 365938 - DNA, 20 bp, human
gccctgcggcacccgcgaca

SEQ ID NO: 365939 - DNA, 20 bp, human
ggtcccgccccctgtggcgc

SEQ ID NO: 365940 - DNA, 20 bp, human
gcggacgcagacggggaagt

SEQ ID NO: 365941 - DNA, 20 bp, human
ggcggctcccgggctgtgat

SEQ ID NO: 365942 - DNA, 20 bp, human
gggcgaccgcggggaagtgc

SEQ ID NO: 365943 - DNA, 20 bp, human
ggggagaggccggcgagctc

SEQ ID NO: 365944 - DNA, 20 bp, human
gcggggcgaaagcgccaccc

SEQ ID NO: 365945 - DNA, 20 bp, human
gtggtccccacccgtgtcgc

SEQ ID NO: 365946 - DNA, 20 bp, human
gctgatacccgagatgggcc

SEQ ID NO: 365947 - DNA, 20 bp, human
gctgcagagcgttcggagac

SEQ ID NO: 365948 - DNA, 20 bp, human
ggggccaggtcccccataga

SEQ ID NO: 365949 - DNA, 20 bp, human
gcggggctgatacccgagat

SEQ ID NO: 365950 - DNA, 20 bp, human
gaaggcggggaccgaccctc

SEQ ID NO: 365951 - DNA, 20 bp, human
ggagccgggcccagagacga

SEQ ID NO: 365952 - DNA, 20 bp, human
ggagactggacgagtagggg

SEQ ID NO: 365953 - DNA, 20 bp, human
gggttcgttccctggtgcga

SEQ ID NO: 365954 - DNA, 20 bp, human
ggccccgccccgtcgtctct

SEQ ID NO: 365955 - DNA, 20 bp, human
ggggcccagagacgacgggg

SEQ ID NO: 365956 - DNA, 20 bp, human
gagcggctctgagagtatgg

SEQ ID NO: 365957 - DNA, 20 bp, human
gagagtatgggggaggatct

SEQ ID NO: 365958 - DNA, 20 bp, human
gggctctgagagtatggggg

SEQ ID NO: 365959 - DNA, 20 bp, human
gacctgccctggcctgccgt

SEQ ID NO: 365960 - DNA, 20 bp, human
gtgccctggcctgccgtggg

SEQ ID NO: 365961 - DNA, 20 bp, human
ggccagcggctctgagagta

SEQ ID NO: 365962 - DNA, 20 bp, human
gggccagggcaggtcgcccc

SEQ ID NO: 365963 - DNA, 20 bp, human
gctgaggcattgtgggttcg

SEQ ID NO: 365964 - DNA, 20 bp, human
gtggctgatgcaagctgtcc

SEQ ID NO: 365965 - DNA, 20 bp, human
ggtattaagtttgctgcatg

SEQ ID NO: 365966 - DNA, 20 bp, human
gccaggctccgcagccgtgt

SEQ ID NO: 365967 - DNA, 20 bp, human
gtccgcagccgtgtgggaga

SEQ ID NO: 365968 - DNA, 20 bp, human
ggggacagcgtgcttgcgaa

SEQ ID NO: 365969 - DNA, 20 bp, human
gacagcgtgcttgcgaaggg

SEQ ID NO: 365970 - DNA, 20 bp, human
gcgggggtgagtggcctctc

SEQ ID NO: 365971 - DNA, 20 bp, human
gagggatgctggggcctccg

SEQ ID NO: 365972 - DNA, 20 bp, human
gcccgctccagcagcctcgg

SEQ ID NO: 365973 - DNA, 20 bp, human
gcctccgagggctccggagg

SEQ ID NO: 365974 - DNA, 20 bp, human
ggctccggaggcggtttagg

SEQ ID NO: 365975 - DNA, 20 bp, human
gaggcggagggcatcgcgga

SEQ ID NO: 365976 - DNA, 20 bp, human
gaggagctgggagcagatta

SEQ ID NO: 365977 - DNA, 20 bp, human
ggagtggaccaggtactgga

SEQ ID NO: 365978 - DNA, 20 bp, human
gaacaagaggaacatttgct

SEQ ID NO: 365979 - DNA, 20 bp, human
gtctttctggaaggaagcag

SEQ ID NO: 365980 - DNA, 20 bp, human
gttaaacagttgagtggacc

SEQ ID NO: 365981 - DNA, 20 bp, human
gagttgagtggaccaggtac

SEQ ID NO: 365982 - DNA, 20 bp, human
gagaggaacatttgcttggt

SEQ ID NO: 365983 - DNA, 20 bp, human
gtgggagcagattagggcct

SEQ ID NO: 365984 - DNA, 20 bp, human
gagagcagaccacgtggtct

SEQ ID NO: 365985 - DNA, 20 bp, human
gttcctcttaaacagttgag

SEQ ID NO: 365986 - DNA, 20 bp, human
gtggaccggctccccgctgg

SEQ ID NO: 365987 - DNA, 20 bp, human
ggcggggagccggtccacgt

SEQ ID NO: 365988 - DNA, 20 bp, human
gggagccggtccacgtgggg

SEQ ID NO: 365989 - DNA, 20 bp, human
gccgtcatgcggggttacag

SEQ ID NO: 365990 - DNA, 20 bp, human
gtcggcccggcgtgcccagc

SEQ ID NO: 365991 - DNA, 20 bp, human
gagacggtgccgagactcca

SEQ ID NO: 365992 - DNA, 20 bp, human
gactccagggcgaggccgca

SEQ ID NO: 365993 - DNA, 20 bp, human
gaggcgcggcggggtcacgc

SEQ ID NO: 365994 - DNA, 20 bp, human
ggccaatgagcgccaccgtc

SEQ ID NO: 365995 - DNA, 20 bp, human
gttggcccggcccgcttcgg

SEQ ID NO: 365996 - DNA, 20 bp, human
gaggggctccgcgccgggac

SEQ ID NO: 365997 - DNA, 20 bp, human
gcccggacgcgggggtaagg

SEQ ID NO: 365998 - DNA, 20 bp, human
gccccgccgccccggcagat

SEQ ID NO: 365999 - DNA, 20 bp, human
ggaaactccgagcacccgcc

SEQ ID NO: 366000 - DNA, 20 bp, human
gcagctccacgcgacgccga

SEQ ID NO: 366001 - DNA, 20 bp, human
gtgcggcggcccatctgccg

SEQ ID NO: 366002 - DNA, 20 bp, human
ggcacacgggccagttgcgg

SEQ ID NO: 366003 - DNA, 20 bp, human
gccagggcggcgaggctcta

SEQ ID NO: 366004 - DNA, 20 bp, human
gcggagtttcggggaccgca

SEQ ID NO: 366005 - DNA, 20 bp, human
ggcctcgccgccctgggacc

SEQ ID NO: 366006 - DNA, 20 bp, human
gccctgagggagctactagg

SEQ ID NO: 366007 - DNA, 20 bp, human
gttgcccgggagcgagtcag

SEQ ID NO: 366008 - DNA, 20 bp, human
ggagccctgagggagctact

SEQ ID NO: 366009 - DNA, 20 bp, human
gaccccactgactcgctccc

SEQ ID NO: 366010 - DNA, 20 bp, human
gctgaacttcaattctcttc

SEQ ID NO: 366011 - DNA, 20 bp, human
gagctactaggaggtttgca

SEQ ID NO: 366012 - DNA, 20 bp, human
gcaaatcgtttgctttgccc

SEQ ID NO: 366013 - DNA, 20 bp, human
gacctcctagtagctccctc

SEQ ID NO: 366014 - DNA, 20 bp, human
ggaatacagtatctagtacc

SEQ ID NO: 366015 - DNA, 20 bp, human
gttcctgaaaccagcaccat

SEQ ID NO: 366016 - DNA, 20 bp, human
gaatctaaattcagtactaa

SEQ ID NO: 366017 - DNA, 20 bp, human
gtgaaatttacattggactt

SEQ ID NO: 366018 - DNA, 20 bp, human
gacttgaggacaaacatatt

SEQ ID NO: 366019 - DNA, 20 bp, human
gcttcaggttaaatcacatg

SEQ ID NO: 366020 - DNA, 20 bp, human
gtaaataagctaaaagaaat

SEQ ID NO: 366021 - DNA, 20 bp, human
gttaactgatattatgcttc

SEQ ID NO: 366022 - DNA, 20 bp, human
gtggattcccaaaactaaca

SEQ ID NO: 366023 - DNA, 20 bp, human
gatgaaaagagcagaaagtc

SEQ ID NO: 366024 - DNA, 20 bp, human
ggacaataaaatccgtttaa

SEQ ID NO: 366025 - DNA, 20 bp, human
ggagagagtaaacctttaaa

SEQ ID NO: 366026 - DNA, 20 bp, human
gtgccccagagctctgcgga

SEQ ID NO: 366027 - DNA, 20 bp, human
ggtgtccaggagtgactgtg

SEQ ID NO: 366028 - DNA, 20 bp, human
gccccctccgcagagctctg

SEQ ID NO: 366029 - DNA, 20 bp, human
gccgagctgcccaccaagtg

SEQ ID NO: 366030 - DNA, 20 bp, human
gccaccaagtgtggaccaga

SEQ ID NO: 366031 - DNA, 20 bp, human
ggactaagctcactgtgccc

SEQ ID NO: 366032 - DNA, 20 bp, human
gataaggaggagtttccccg

SEQ ID NO: 366033 - DNA, 20 bp, human
gccacccccaatccggctga

SEQ ID NO: 366034 - DNA, 20 bp, human
gccctcctgacaactgttca

SEQ ID NO: 366035 - DNA, 20 bp, human
gtgagtcagtccctcagtcc

SEQ ID NO: 366036 - DNA, 20 bp, human
ggccgccaggagaaaaactt

SEQ ID NO: 366037 - DNA, 20 bp, human
gaggggatccccctaatttg

SEQ ID NO: 366038 - DNA, 20 bp, human
gggcacacaggggcaccgaa

SEQ ID NO: 366039 - DNA, 20 bp, human
ggggaggggacagagatctc

SEQ ID NO: 366040 - DNA, 20 bp, human
ggccccagccccaaattagg

SEQ ID NO: 366041 - DNA, 20 bp, human
ggctgtgcaagtctctgtgt

SEQ ID NO: 366042 - DNA, 20 bp, human
ggctgccccagccccaaatt

SEQ ID NO: 366043 - DNA, 20 bp, human
gtccaccgaggactcaggac

SEQ ID NO: 366044 - DNA, 20 bp, human
gcaggggcaccgaagggagc

SEQ ID NO: 366045 - DNA, 20 bp, human
gtctgtgcctgcctcaacgc

SEQ ID NO: 366046 - DNA, 20 bp, human
gagccccctaggtgtgactt

SEQ ID NO: 366047 - DNA, 20 bp, human
gttcccaagtcacacctagg

SEQ ID NO: 366048 - DNA, 20 bp, human
gaggagtgacaggtggagca

SEQ ID NO: 366049 - DNA, 20 bp, human
gtagtccacatggatgaagt

SEQ ID NO: 366050 - DNA, 20 bp, human
ggatgaaaaaatagtccaca

SEQ ID NO: 366051 - DNA, 20 bp, human
gcccttcccaagtcacacct

SEQ ID NO: 366052 - DNA, 20 bp, human
gctccagcttataacatctg

SEQ ID NO: 366053 - DNA, 20 bp, human
gagctatcaccactgcccag

SEQ ID NO: 366054 - DNA, 20 bp, human
gaagatacagtcatcacaag

SEQ ID NO: 366055 - DNA, 20 bp, human
gggggctgaggagtgacagg

SEQ ID NO: 366056 - DNA, 20 bp, human
gtccaggggcaaggcaggtc

SEQ ID NO: 366057 - DNA, 20 bp, human
gaccccggcagctctgacca

SEQ ID NO: 366058 - DNA, 20 bp, human
gacagcctgcacaaagacag

SEQ ID NO: 366059 - DNA, 20 bp, human
gctacagccagttgtgtccc

SEQ ID NO: 366060 - DNA, 20 bp, human
gaggggcaggggggttcgtg

SEQ ID NO: 366061 - DNA, 20 bp, human
ggagtgatatctggaaggac

SEQ ID NO: 366062 - DNA, 20 bp, human
gaggtggagccctcgtgtgg

SEQ ID NO: 366063 - DNA, 20 bp, human
gtggggtggggaggtccttg

SEQ ID NO: 366064 - DNA, 20 bp, human
gaagtagtgtcacaatgggg

SEQ ID NO: 366065 - DNA, 20 bp, human
gacaactggctgtagcctcc

SEQ ID NO: 366066 - DNA, 20 bp, human
gcggggctgtcaggctcgag

SEQ ID NO: 366067 - DNA, 20 bp, human
ggagcgcagccgggctacgc

SEQ ID NO: 366068 - DNA, 20 bp, human
gggagggcgttcgagatccg

SEQ ID NO: 366069 - DNA, 20 bp, human
gccagctgcgggtcccctgt

SEQ ID NO: 366070 - DNA, 20 bp, human
gaggctcgagaggtggacgc

SEQ ID NO: 366071 - DNA, 20 bp, human
gggtcccgatgtttcttctc

SEQ ID NO: 366072 - DNA, 20 bp, human
gcaccggcttggacccgccg

SEQ ID NO: 366073 - DNA, 20 bp, human
gacgaaggggcaggatgtga

SEQ ID NO: 366074 - DNA, 20 bp, human
gggctggatgccctggaccc

SEQ ID NO: 366075 - DNA, 20 bp, human
ggatccggggctggatgccc

SEQ ID NO: 366076 - DNA, 20 bp, human
gcggtccccccaagtatctt

SEQ ID NO: 366077 - DNA, 20 bp, human
gggaccgaggggccaagcga

SEQ ID NO: 366078 - DNA, 20 bp, human
gggaccacagcgcgccggga

SEQ ID NO: 366079 - DNA, 20 bp, human
gaaaagccgaagatacttgg

SEQ ID NO: 366080 - DNA, 20 bp, human
gcccgcgcgtcccagtgctc

SEQ ID NO: 366081 - DNA, 20 bp, human
gggggccaagcgacggaggg

SEQ ID NO: 366082 - DNA, 20 bp, human
gcgagggcaccatgcgaccg

SEQ ID NO: 366083 - DNA, 20 bp, human
ggaaaaaagccgaagatact

SEQ ID NO: 366084 - DNA, 20 bp, human
gccgaggggccaagcgacgg

SEQ ID NO: 366085 - DNA, 20 bp, human
ggatacttggggggaccgag

SEQ ID NO: 366086 - DNA, 20 bp, human
gcccacgtcagcagaacctt

SEQ ID NO: 366087 - DNA, 20 bp, human
ggggaggagagtctagagga

SEQ ID NO: 366088 - DNA, 20 bp, human
ggttctgctgacgtgggaag

SEQ ID NO: 366089 - DNA, 20 bp, human
gtgaagctagggctgataca

SEQ ID NO: 366090 - DNA, 20 bp, human
ggaaggggaggagagtctag

SEQ ID NO: 366091 - DNA, 20 bp, human
ggctctgtcgtctctttcct

SEQ ID NO: 366092 - DNA, 20 bp, human
ggaaggatagtagctagtcc

SEQ ID NO: 366093 - DNA, 20 bp, human
gctgggtctgcgggccattg

SEQ ID NO: 366094 - DNA, 20 bp, human
gcgtctctttcctgggtctg

SEQ ID NO: 366095 - DNA, 20 bp, human
gcagactcttcgtcagagag

SEQ ID NO: 366096 - DNA, 20 bp, human
gggcgggtccttcgagggga

SEQ ID NO: 366097 - DNA, 20 bp, human
ggcaggggcgggtccttcga

SEQ ID NO: 366098 - DNA, 20 bp, human
ggggcgagcccgctggtggg

SEQ ID NO: 366099 - DNA, 20 bp, human
gtccgggagcgcccgtgcca

SEQ ID NO: 366100 - DNA, 20 bp, human
gagcccgcccctcccctcga

SEQ ID NO: 366101 - DNA, 20 bp, human
gtggcgattgcaaagcgcga

SEQ ID NO: 366102 - DNA, 20 bp, human
gagcgcagaaaccgtggcac

SEQ ID NO: 366103 - DNA, 20 bp, human
gcacggggcgagcccgctgg

SEQ ID NO: 366104 - DNA, 20 bp, human
ggggcaggattcaagctgga

SEQ ID NO: 366105 - DNA, 20 bp, human
gagcgggctcgccccgtgcc

SEQ ID NO: 366106 - DNA, 20 bp, human
ggcacacagcctcccgggga

SEQ ID NO: 366107 - DNA, 20 bp, human
gaccttagaggacacatcag

SEQ ID NO: 366108 - DNA, 20 bp, human
gccccctgatgtgtcctcta

SEQ ID NO: 366109 - DNA, 20 bp, human
ggctgtcaaaagtggaggag

SEQ ID NO: 366110 - DNA, 20 bp, human
gctggccttgcctgcaagag

SEQ ID NO: 366111 - DNA, 20 bp, human
gagaccagagctgtcaaaag

SEQ ID NO: 366112 - DNA, 20 bp, human
gggtagcaggagagctccac

SEQ ID NO: 366113 - DNA, 20 bp, human
gcacccctgcccggatcaac

SEQ ID NO: 366114 - DNA, 20 bp, human
gccagagctgtcaaaagtgg

SEQ ID NO: 366115 - DNA, 20 bp, human
gccaggcacacagcctcccg

SEQ ID NO: 366116 - DNA, 20 bp, human
gggggaacttcctggttctg

SEQ ID NO: 366117 - DNA, 20 bp, human
gtgtgaatgggggaacttcc

SEQ ID NO: 366118 - DNA, 20 bp, human
gcctggttctgagggaatgt

SEQ ID NO: 366119 - DNA, 20 bp, human
ggaacaggctcagtgtgaat

SEQ ID NO: 366120 - DNA, 20 bp, human
ggtcctctggcgctgaggtg

SEQ ID NO: 366121 - DNA, 20 bp, human
ggggtgaagaagaaagcaag

SEQ ID NO: 366122 - DNA, 20 bp, human
gcctcaggtagccagggaac

SEQ ID NO: 366123 - DNA, 20 bp, human
gtcttcctccaggtgaagca

SEQ ID NO: 366124 - DNA, 20 bp, human
gctctgctcaaccagttccc

SEQ ID NO: 366125 - DNA, 20 bp, human
ggcccagaggtgtgcgaggg

SEQ ID NO: 366126 - DNA, 20 bp, human
gtggctgctcggggcactac

SEQ ID NO: 366127 - DNA, 20 bp, human
gatgccctgagctcactccc

SEQ ID NO: 366128 - DNA, 20 bp, human
ggcactacgggaagattact

SEQ ID NO: 366129 - DNA, 20 bp, human
ggaaggacatgcacccccgc

SEQ ID NO: 366130 - DNA, 20 bp, human
ggacatgcacccccgctgga

SEQ ID NO: 366131 - DNA, 20 bp, human
gctggcggtgcgcatgagat

SEQ ID NO: 366132 - DNA, 20 bp, human
gcaaaggtgcacccctccag

SEQ ID NO: 366133 - DNA, 20 bp, human
gttggtccagctgacttcaa

SEQ ID NO: 366134 - DNA, 20 bp, human
ggccgtcgggatgcatgctg

SEQ ID NO: 366135 - DNA, 20 bp, human
gccctggtccagattcgaag

SEQ ID NO: 366136 - DNA, 20 bp, human
ggccgcgcgtccgggctgga

SEQ ID NO: 366137 - DNA, 20 bp, human
gccgcccgggatccacggga

SEQ ID NO: 366138 - DNA, 20 bp, human
gcgaaacgggcaacgggcag

SEQ ID NO: 366139 - DNA, 20 bp, human
ggttacctccacctcggcgg

SEQ ID NO: 366140 - DNA, 20 bp, human
gggaggggggcgggggaaac

SEQ ID NO: 366141 - DNA, 20 bp, human
ggccgcggttacctccacct

SEQ ID NO: 366142 - DNA, 20 bp, human
ggggggaaacgggacacccc

SEQ ID NO: 366143 - DNA, 20 bp, human
gccggcgcgaaacgggcaac

SEQ ID NO: 366144 - DNA, 20 bp, human
gcccctccagcccggacgcg

SEQ ID NO: 366145 - DNA, 20 bp, human
ggggacaccccgggcccgcc

SEQ ID NO: 366146 - DNA, 20 bp, human
ggatacctggatagatgcca

SEQ ID NO: 366147 - DNA, 20 bp, human
gatctttaaagccctgtcat

SEQ ID NO: 366148 - DNA, 20 bp, human
gtgctccatggcatctatcc

SEQ ID NO: 366149 - DNA, 20 bp, human
gagtgtgctatggaagatta

SEQ ID NO: 366150 - DNA, 20 bp, human
gattcttagttaaaggaaag

SEQ ID NO: 366151 - DNA, 20 bp, human
gttgaatgaatcaataaatc

SEQ ID NO: 366152 - DNA, 20 bp, human
gaatgtctcatataaatgat

SEQ ID NO: 366153 - DNA, 20 bp, human
gatgtcatcatataactata

SEQ ID NO: 366154 - DNA, 20 bp, human
ggaaactgtttaatgatacc

SEQ ID NO: 366155 - DNA, 20 bp, human
gaggtaaagttaatttgtag

SEQ ID NO: 366156 - DNA, 20 bp, human
gtccgtgaccctgctgcaga

SEQ ID NO: 366157 - DNA, 20 bp, human
gggcccattaagaagagagt

SEQ ID NO: 366158 - DNA, 20 bp, human
ggaccccactctcttcttaa

SEQ ID NO: 366159 - DNA, 20 bp, human
gtaggtatctgttttcttta

SEQ ID NO: 366160 - DNA, 20 bp, human
gaatttcctcaagtagtttt

SEQ ID NO: 366161 - DNA, 20 bp, human
gtgtaatctgtgggactcaa

SEQ ID NO: 366162 - DNA, 20 bp, human
gaagttcaatgctgctattg

SEQ ID NO: 366163 - DNA, 20 bp, human
gttccagaacgtgtaatctg

SEQ ID NO: 366164 - DNA, 20 bp, human
gttttctctttgaacttatc

SEQ ID NO: 366165 - DNA, 20 bp, human
gctaaaataaatctgctact

SEQ ID NO: 366166 - DNA, 20 bp, human
gagccccgggccacaggtcg

SEQ ID NO: 366167 - DNA, 20 bp, human
gaggctgcgcccgtcactcg

SEQ ID NO: 366168 - DNA, 20 bp, human
gccacaggtcgcgggaggga

SEQ ID NO: 366169 - DNA, 20 bp, human
gcggacgcacccggccgggg

SEQ ID NO: 366170 - DNA, 20 bp, human
gcgcgcgcgtccttagtccc

SEQ ID NO: 366171 - DNA, 20 bp, human
gtcttctggagcccgacctg

SEQ ID NO: 366172 - DNA, 20 bp, human
gtgactacgcgccagggacc

SEQ ID NO: 366173 - DNA, 20 bp, human
gccacccgcctcactcgccc

SEQ ID NO: 366174 - DNA, 20 bp, human
ggagccggacgcacccggcc

SEQ ID NO: 366175 - DNA, 20 bp, human
gtccgcacgcgcaagggcca

SEQ ID NO: 366176 - DNA, 20 bp, human
gagaagcccggcgggttcca

SEQ ID NO: 366177 - DNA, 20 bp, human
gcccaggaaccggaaggggt

SEQ ID NO: 366178 - DNA, 20 bp, human
gaagacccaggaaccggaag

SEQ ID NO: 366179 - DNA, 20 bp, human
gcagtgtggaaactggaacg

SEQ ID NO: 366180 - DNA, 20 bp, human
ggggttgccacatcttcaca

SEQ ID NO: 366181 - DNA, 20 bp, human
gctggatccaggcaccaaac

SEQ ID NO: 366182 - DNA, 20 bp, human
gaaagctgatggggcattcc

SEQ ID NO: 366183 - DNA, 20 bp, human
gatggggcattcctggatcc

SEQ ID NO: 366184 - DNA, 20 bp, human
gggtcagcacagactgggga

SEQ ID NO: 366185 - DNA, 20 bp, human
ggatccaggcaccaaacagg

SEQ ID NO: 366186 - DNA, 20 bp, human
ggcccccaaggacctgacgg

SEQ ID NO: 366187 - DNA, 20 bp, human
gggcgggcgcgcgaagcaca

SEQ ID NO: 366188 - DNA, 20 bp, human
gccagagagcgagttctcgg

SEQ ID NO: 366189 - DNA, 20 bp, human
gacctgggccccacgtggga

SEQ ID NO: 366190 - DNA, 20 bp, human
gcgagaacgagcttcttccc

SEQ ID NO: 366191 - DNA, 20 bp, human
gaggccagagagcgagttct

SEQ ID NO: 366192 - DNA, 20 bp, human
gagcccccgtcaggtccttg

SEQ ID NO: 366193 - DNA, 20 bp, human
gcccgcccccaaggacctga

SEQ ID NO: 366194 - DNA, 20 bp, human
ggtctgggaatcagcgctcg

SEQ ID NO: 366195 - DNA, 20 bp, human
ggggcgcgcgaagcacaggg

SEQ ID NO: 366196 - DNA, 20 bp, human
ggggacgaccgaggtagccc

SEQ ID NO: 366197 - DNA, 20 bp, human
gagaggagcgagttcggact

SEQ ID NO: 366198 - DNA, 20 bp, human
gggtagcccgggctcggctt

SEQ ID NO: 366199 - DNA, 20 bp, human
gcgggcctcaggtgcactcc

SEQ ID NO: 366200 - DNA, 20 bp, human
gcgggccgggagtgcacctg

SEQ ID NO: 366201 - DNA, 20 bp, human
ggaggtaaggagaaagtcac

SEQ ID NO: 366202 - DNA, 20 bp, human
ggctcggcttaggaaggcag

SEQ ID NO: 366203 - DNA, 20 bp, human
ggctcccagcctctctacta

SEQ ID NO: 366204 - DNA, 20 bp, human
ggccttcctaagccgagccc

SEQ ID NO: 366205 - DNA, 20 bp, human
gggcgctagaggagcgagtt

SEQ ID NO: 366206 - DNA, 20 bp, human
gagggagaggggtgtattag

SEQ ID NO: 366207 - DNA, 20 bp, human
gaggagagggtggactgaat

SEQ ID NO: 366208 - DNA, 20 bp, human
gggagacctgacccttgcat

SEQ ID NO: 366209 - DNA, 20 bp, human
ggggccagagtgggatctat

SEQ ID NO: 366210 - DNA, 20 bp, human
ggcccagtctccttcctaaa

SEQ ID NO: 366211 - DNA, 20 bp, human
gggtccaatagatcccactc

SEQ ID NO: 366212 - DNA, 20 bp, human
ggggtggactgaataggagc

SEQ ID NO: 366213 - DNA, 20 bp, human
gaagtgaggagaagctgcaa

SEQ ID NO: 366214 - DNA, 20 bp, human
gtgtattaggggggcatctg

SEQ ID NO: 366215 - DNA, 20 bp, human
gggacagatcagggagaccg

SEQ ID NO: 366216 - DNA, 20 bp, human
gcaccaggcaagacaggtag

SEQ ID NO: 366217 - DNA, 20 bp, human
gtccctggagacctgatggc

SEQ ID NO: 366218 - DNA, 20 bp, human
gtcactggctcgtggctctg

SEQ ID NO: 366219 - DNA, 20 bp, human
ggggagctctgctgaccaag

SEQ ID NO: 366220 - DNA, 20 bp, human
gctgctgaccaaggggctag

SEQ ID NO: 366221 - DNA, 20 bp, human
gccatccattcagaggtcac

SEQ ID NO: 366222 - DNA, 20 bp, human
gcaggggcctcctcttctta

SEQ ID NO: 366223 - DNA, 20 bp, human
gcgagccagtgacctctgaa

SEQ ID NO: 366224 - DNA, 20 bp, human
ggccagaatccagccctcag

SEQ ID NO: 366225 - DNA, 20 bp, human
gctggggagggcccagtcct

SEQ ID NO: 366226 - DNA, 20 bp, human
ggccctggcaggctcaccga

SEQ ID NO: 366227 - DNA, 20 bp, human
gcaaagggctgcctcagcga

SEQ ID NO: 366228 - DNA, 20 bp, human
gtgccagggctgctcgcgtt

SEQ ID NO: 366229 - DNA, 20 bp, human
gagcgagggccgctgggggt

SEQ ID NO: 366230 - DNA, 20 bp, human
gggacaccacgggcccaaat

SEQ ID NO: 366231 - DNA, 20 bp, human
ggctcaccgaggggagattc

SEQ ID NO: 366232 - DNA, 20 bp, human
ggctgctggctggacaccac

SEQ ID NO: 366233 - DNA, 20 bp, human
gcgcccaacgcgagcagccc

SEQ ID NO: 366234 - DNA, 20 bp, human
gtgcctcagcgagggccgct

SEQ ID NO: 366235 - DNA, 20 bp, human
ggcctggcacctcccgagta

SEQ ID NO: 366236 - DNA, 20 bp, human
gcataattttggcgactcaa

SEQ ID NO: 366237 - DNA, 20 bp, human
gtgaccgcataccatgtagc

SEQ ID NO: 366238 - DNA, 20 bp, human
gcatcagtcaccaaaatgaa

SEQ ID NO: 366239 - DNA, 20 bp, human
gcaaaaattggtacttaaca

SEQ ID NO: 366240 - DNA, 20 bp, human
gcgaagttaaactaaaataa

SEQ ID NO: 366241 - DNA, 20 bp, human
ggaggagtaagctcatatgg

SEQ ID NO: 366242 - DNA, 20 bp, human
gtcgccaaaattatgcttcc

SEQ ID NO: 366243 - DNA, 20 bp, human
gaacgtgtgtgacaagttca

SEQ ID NO: 366244 - DNA, 20 bp, human
gcatggtatgcggtcattcc

SEQ ID NO: 366245 - DNA, 20 bp, human
gcaaagtccagtgctgactt

SEQ ID NO: 366246 - DNA, 20 bp, human
gagcgcccaggcgcagatgt

SEQ ID NO: 366247 - DNA, 20 bp, human
gggaagggcacatgtggcag

SEQ ID NO: 366248 - DNA, 20 bp, human
gaagagagggccagagtcga

SEQ ID NO: 366249 - DNA, 20 bp, human
ggcacatgtggcagaggctt

SEQ ID NO: 366250 - DNA, 20 bp, human
ggggcagggaagggcacatg

SEQ ID NO: 366251 - DNA, 20 bp, human
gaagaacaggtccagcgccc

SEQ ID NO: 366252 - DNA, 20 bp, human
ggcgcagatgtgggcaggga

SEQ ID NO: 366253 - DNA, 20 bp, human
gcagctctggattgcgaaag

SEQ ID NO: 366254 - DNA, 20 bp, human
gcctgcccacatctgcgcct

SEQ ID NO: 366255 - DNA, 20 bp, human
gtggggaagggcctcataca

SEQ ID NO: 366256 - DNA, 20 bp, human
gcgaggcccgggatgttccg

SEQ ID NO: 366257 - DNA, 20 bp, human
gtggtgggaagggtcgcgaa

SEQ ID NO: 366258 - DNA, 20 bp, human
ggcgctccccggaacatccc

SEQ ID NO: 366259 - DNA, 20 bp, human
gggcaggcggggtaaaaagg

SEQ ID NO: 366260 - DNA, 20 bp, human
gccgcccccgcgccggtctg

SEQ ID NO: 366261 - DNA, 20 bp, human
ggaacgggaaggggacggct

SEQ ID NO: 366262 - DNA, 20 bp, human
gggagcgctgccgggtgcca

SEQ ID NO: 366263 - DNA, 20 bp, human
ggggccccagaccggcgcgg

SEQ ID NO: 366264 - DNA, 20 bp, human
gaaggggacggctgggtgcg

SEQ ID NO: 366265 - DNA, 20 bp, human
ggatctttctgcgcagggga

SEQ ID NO: 366266 - DNA, 20 bp, human
gaactcagctccccagttaa

SEQ ID NO: 366267 - DNA, 20 bp, human
gaactggggagctgagttct

SEQ ID NO: 366268 - DNA, 20 bp, human
gtgtcaatgaagcggagcaa

SEQ ID NO: 366269 - DNA, 20 bp, human
gctccccagttaatggctga

SEQ ID NO: 366270 - DNA, 20 bp, human
ggaagcggagcaaaggtata

SEQ ID NO: 366271 - DNA, 20 bp, human
gttccatcagccattaactg

SEQ ID NO: 366272 - DNA, 20 bp, human
gagaccaggctgtagaaagt

SEQ ID NO: 366273 - DNA, 20 bp, human
ggaaagtaggataggagggg

SEQ ID NO: 366274 - DNA, 20 bp, human
ggaagaagattctcggggga

SEQ ID NO: 366275 - DNA, 20 bp, human
gtcagagtttgggtgaagcc

SEQ ID NO: 366276 - DNA, 20 bp, human
gggttctggctcatcccgga

SEQ ID NO: 366277 - DNA, 20 bp, human
gcgccacagccggaactata

SEQ ID NO: 366278 - DNA, 20 bp, human
gcagcgcggagtgcaggcgc

SEQ ID NO: 366279 - DNA, 20 bp, human
ggagagcttcagggtcgccc

SEQ ID NO: 366280 - DNA, 20 bp, human
gataaggccgcgcgacagaa

SEQ ID NO: 366281 - DNA, 20 bp, human
gcgccccctagcgtccctcc

SEQ ID NO: 366282 - DNA, 20 bp, human
ggcgcggcctctcttcgcga

SEQ ID NO: 366283 - DNA, 20 bp, human
gtcatcccggagggacgcta

SEQ ID NO: 366284 - DNA, 20 bp, human
gcccgcccagcgcggagtgc

SEQ ID NO: 366285 - DNA, 20 bp, human
gtcgcgcggccttatagttc

SEQ ID NO: 366286 - DNA, 20 bp, human
ggtggaaggcccactctctc

SEQ ID NO: 366287 - DNA, 20 bp, human
gtgtgggcccacaaagtcaa

SEQ ID NO: 366288 - DNA, 20 bp, human
gcctctgtgtccctggtgga

SEQ ID NO: 366289 - DNA, 20 bp, human
gtgaccaagcctgagagagt

SEQ ID NO: 366290 - DNA, 20 bp, human
gcaggcttggtcaggtgtac

SEQ ID NO: 366291 - DNA, 20 bp, human
gaaaacgaagggaaagtgac

SEQ ID NO: 366292 - DNA, 20 bp, human
ggagagtgggccttccacca

SEQ ID NO: 366293 - DNA, 20 bp, human
gaggcccactctctcaggct

SEQ ID NO: 366294 - DNA, 20 bp, human
gagggcattgtacaagttct

SEQ ID NO: 366295 - DNA, 20 bp, human
gggcgctctgagaaaacgaa

SEQ ID NO: 366296 - DNA, 20 bp, human
gcccaggaggcgtggagcaa

SEQ ID NO: 366297 - DNA, 20 bp, human
gggcgtggagcaaaggactc

SEQ ID NO: 366298 - DNA, 20 bp, human
ggcacagcgcacagcccaga

SEQ ID NO: 366299 - DNA, 20 bp, human
gacgctggcagccgtctctt

SEQ ID NO: 366300 - DNA, 20 bp, human
gaaaaggcacggaggcctgc

SEQ ID NO: 366301 - DNA, 20 bp, human
gaggatttgcaggcgagcaa

SEQ ID NO: 366302 - DNA, 20 bp, human
gggagaaatctcctaagaga

SEQ ID NO: 366303 - DNA, 20 bp, human
gtgaaagtgctgtcaacttt

SEQ ID NO: 366304 - DNA, 20 bp, human
gttctccgcagtgtggacgg

SEQ ID NO: 366305 - DNA, 20 bp, human
ggggctgtgcgctgtgcgct

SEQ ID NO: 366306 - DNA, 20 bp, human
ggggccgcccgcctattcca

SEQ ID NO: 366307 - DNA, 20 bp, human
gtgggcgatagcgacgagga

SEQ ID NO: 366308 - DNA, 20 bp, human
gtggcaaagccaccccggac

SEQ ID NO: 366309 - DNA, 20 bp, human
gcgccgctggccaactccgc

SEQ ID NO: 366310 - DNA, 20 bp, human
gaggagcggggaaggaccga

SEQ ID NO: 366311 - DNA, 20 bp, human
gacgacgaggagacgggcag

SEQ ID NO: 366312 - DNA, 20 bp, human
ggggaaggaccgacggtagg

SEQ ID NO: 366313 - DNA, 20 bp, human
ggagcgcgggcgcggagcgt

SEQ ID NO: 366314 - DNA, 20 bp, human
gcggcgggccctcctaccgt

SEQ ID NO: 366315 - DNA, 20 bp, human
ggcgccgaccatggaatagg

SEQ ID NO: 366316 - DNA, 20 bp, human
ggcctcagagggtaaaggaa

SEQ ID NO: 366317 - DNA, 20 bp, human
gcagcagcctcagagggtaa

SEQ ID NO: 366318 - DNA, 20 bp, human
gcacgtgtactcgtcccgta

SEQ ID NO: 366319 - DNA, 20 bp, human
gggaagcaggggaacatcgc

SEQ ID NO: 366320 - DNA, 20 bp, human
gtgaagagaagagtgcacgg

SEQ ID NO: 366321 - DNA, 20 bp, human
gtcggctcgtcgggaagcag

SEQ ID NO: 366322 - DNA, 20 bp, human
gtcgacgtcggccctcccag

SEQ ID NO: 366323 - DNA, 20 bp, human
gcggccgccgccaaacttgg

SEQ ID NO: 366324 - DNA, 20 bp, human
gccaggggcgagctctcccc

SEQ ID NO: 366325 - DNA, 20 bp, human
gccgcccgggctcggctcgt

SEQ ID NO: 366326 - DNA, 20 bp, human
gccatggcctacagtctcta

SEQ ID NO: 366327 - DNA, 20 bp, human
gtcaggagacccaatctcca

SEQ ID NO: 366328 - DNA, 20 bp, human
ggagaagaggaggattaaac

SEQ ID NO: 366329 - DNA, 20 bp, human
gtcaacccaaacaacttcta

SEQ ID NO: 366330 - DNA, 20 bp, human
gtccggcctccctggagatt

SEQ ID NO: 366331 - DNA, 20 bp, human
ggtgccctgggcagggtatt

SEQ ID NO: 366332 - DNA, 20 bp, human
gcagtcaagcttctctgatc

SEQ ID NO: 366333 - DNA, 20 bp, human
gctgagatgtgccctgggca

SEQ ID NO: 366334 - DNA, 20 bp, human
gtggaaatagctatagacaa

SEQ ID NO: 366335 - DNA, 20 bp, human
gaacttctaggggaaagggc

SEQ ID NO: 366336 - DNA, 20 bp, human
gaaagcgcagccaatggccg

SEQ ID NO: 366337 - DNA, 20 bp, human
gaccgcgagcggcgggacgg

SEQ ID NO: 366338 - DNA, 20 bp, human
gcgcgccgaggcaggcgtag

SEQ ID NO: 366339 - DNA, 20 bp, human
gtggccgaggccgagtccct

SEQ ID NO: 366340 - DNA, 20 bp, human
gagctccgagcagtgggtca

SEQ ID NO: 366341 - DNA, 20 bp, human
ggagagcggcgggatcccca

SEQ ID NO: 366342 - DNA, 20 bp, human
gtcgcggtcgcccagggact

SEQ ID NO: 366343 - DNA, 20 bp, human
gccgcccctgggaccataac

SEQ ID NO: 366344 - DNA, 20 bp, human
gtggcccagctccgagcagt

SEQ ID NO: 366345 - DNA, 20 bp, human
gtttcccggcccgcacgggg

SEQ ID NO: 366346 - DNA, 20 bp, human
gccgccttgtgggtaatctc

SEQ ID NO: 366347 - DNA, 20 bp, human
ggggtcgcgcaaacgagcga

SEQ ID NO: 366348 - DNA, 20 bp, human
gtgtggcggcagctagacat

SEQ ID NO: 366349 - DNA, 20 bp, human
ggacgcaaaagcgtcgtctg

SEQ ID NO: 366350 - DNA, 20 bp, human
gacgaggctagcgcgaggta

SEQ ID NO: 366351 - DNA, 20 bp, human
ggtaatctcagggtgagacg

SEQ ID NO: 366352 - DNA, 20 bp, human
gaacgtcgcggtcgaggcta

SEQ ID NO: 366353 - DNA, 20 bp, human
gccgccgggcattcgagctg

SEQ ID NO: 366354 - DNA, 20 bp, human
gcaccctgagattacccaca

SEQ ID NO: 366355 - DNA, 20 bp, human
gtgcgcagcgcgccgccttg

SEQ ID NO: 366356 - DNA, 20 bp, human
gagaaggggcgtaactgatt

SEQ ID NO: 366357 - DNA, 20 bp, human
gaaggcggccgggagtaagg

SEQ ID NO: 366358 - DNA, 20 bp, human
ggggagtaaggcggagctga

SEQ ID NO: 366359 - DNA, 20 bp, human
gagtaaggcggagctgaagg

SEQ ID NO: 366360 - DNA, 20 bp, human
gcgcgcgcgcaacagagcga

SEQ ID NO: 366361 - DNA, 20 bp, human
ggatggaagcgtgcgagaag

SEQ ID NO: 366362 - DNA, 20 bp, human
gcgcccgcgccggcttccag

SEQ ID NO: 366363 - DNA, 20 bp, human
ggcgcaggcgcgcagcgcaa

SEQ ID NO: 366364 - DNA, 20 bp, human
ggcaaaggcggccgggagta

SEQ ID NO: 366365 - DNA, 20 bp, human
gtcgcgagatcgagtgagta

SEQ ID NO: 366366 - DNA, 20 bp, human
gcggcgcgtcgggatcccat

SEQ ID NO: 366367 - DNA, 20 bp, human
gggcgcgccgcgtgcggaaa

SEQ ID NO: 366368 - DNA, 20 bp, human
gtccctatgcaaatgaactc

SEQ ID NO: 366369 - DNA, 20 bp, human
gcccggcgtcccggccagaa

SEQ ID NO: 366370 - DNA, 20 bp, human
gcgcgcgcgcgccgtcttcc

SEQ ID NO: 366371 - DNA, 20 bp, human
ggaaaacaagcgcgacccat

SEQ ID NO: 366372 - DNA, 20 bp, human
ggggggacgcgcctcccacg

SEQ ID NO: 366373 - DNA, 20 bp, human
gcgcgcgcgccctgacagct

SEQ ID NO: 366374 - DNA, 20 bp, human
gcctggcggcgacctagctg

SEQ ID NO: 366375 - DNA, 20 bp, human
ggccccgagttcatttgcat

SEQ ID NO: 366376 - DNA, 20 bp, human
gtctgccctgcagccgggga

SEQ ID NO: 366377 - DNA, 20 bp, human
gccggggagggctcagatcc

SEQ ID NO: 366378 - DNA, 20 bp, human
gctggggcagtggctggaca

SEQ ID NO: 366379 - DNA, 20 bp, human
gccacctgccctcaggtgac

SEQ ID NO: 366380 - DNA, 20 bp, human
gggccctcggaccgatggga

SEQ ID NO: 366381 - DNA, 20 bp, human
gcggggtgcgcgtgatccag

SEQ ID NO: 366382 - DNA, 20 bp, human
ggcctctgcggcgtgggcag

SEQ ID NO: 366383 - DNA, 20 bp, human
ggctgctggacagcgcagcg

SEQ ID NO: 366384 - DNA, 20 bp, human
gggcgtgggcagaggtaact

SEQ ID NO: 366385 - DNA, 20 bp, human
gtgtgcaagcccgtcacctg

SEQ ID NO: 366386 - DNA, 20 bp, human
gggaagcggcagagttctaa

SEQ ID NO: 366387 - DNA, 20 bp, human
gcagctaaggcgtgagaatt

SEQ ID NO: 366388 - DNA, 20 bp, human
gcgagggtcggaaccactgc

SEQ ID NO: 366389 - DNA, 20 bp, human
ggggcaaccggacttgcggg

SEQ ID NO: 366390 - DNA, 20 bp, human
gctggcgagcacgttaactg

SEQ ID NO: 366391 - DNA, 20 bp, human
ggcgaaataagaggcggaag

SEQ ID NO: 366392 - DNA, 20 bp, human
gggcagagttctaaaggcga

SEQ ID NO: 366393 - DNA, 20 bp, human
ggggcctcgccccggtatca

SEQ ID NO: 366394 - DNA, 20 bp, human
gcacccacctggcgcgtaga

SEQ ID NO: 366395 - DNA, 20 bp, human
gggcttgaggagtgggtcaa

SEQ ID NO: 366396 - DNA, 20 bp, human
gaagctcaggagcgcccctg

SEQ ID NO: 366397 - DNA, 20 bp, human
ggccgtgcccgagccgagac

SEQ ID NO: 366398 - DNA, 20 bp, human
gcggtggcggctcccggtct

SEQ ID NO: 366399 - DNA, 20 bp, human
gctgccgccgaccctggtga

SEQ ID NO: 366400 - DNA, 20 bp, human
ggatgcctgcgcgaagggag

SEQ ID NO: 366401 - DNA, 20 bp, human
gcagcaccacgccgggtcgc

SEQ ID NO: 366402 - DNA, 20 bp, human
gtcggctcgggcacggccct

SEQ ID NO: 366403 - DNA, 20 bp, human
gctcgggcacggccctgggc

SEQ ID NO: 366404 - DNA, 20 bp, human
ggtcggcggcagcaccacgc

SEQ ID NO: 366405 - DNA, 20 bp, human
ggcggctcccggtctcggct

SEQ ID NO: 366406 - DNA, 20 bp, human
gacagtggcaacgccgggtg

SEQ ID NO: 366407 - DNA, 20 bp, human
gaacgccgggtgaggcggga

SEQ ID NO: 366408 - DNA, 20 bp, human
ggaactgacagtggcaacgc

SEQ ID NO: 366409 - DNA, 20 bp, human
ggcggaacagggcgtcaccc

SEQ ID NO: 366410 - DNA, 20 bp, human
ggtggcaacgccgggtgagg

SEQ ID NO: 366411 - DNA, 20 bp, human
gcggggccaggacgcggaac

SEQ ID NO: 366412 - DNA, 20 bp, human
gggctgatggcgtacagcaa

SEQ ID NO: 366413 - DNA, 20 bp, human
gccaaggggctctgccggga

SEQ ID NO: 366414 - DNA, 20 bp, human
gtgctcaggccccttctgtt

SEQ ID NO: 366415 - DNA, 20 bp, human
gcaggccccttctgttcgga

SEQ ID NO: 366416 - DNA, 20 bp, human
gggacagcgaggtgttcgcg

SEQ ID NO: 366417 - DNA, 20 bp, human
ggaacgccagagaacgtcgg

SEQ ID NO: 366418 - DNA, 20 bp, human
ggaaccgggagccgggtacc

SEQ ID NO: 366419 - DNA, 20 bp, human
ggagccgggtacctggtgtc

SEQ ID NO: 366420 - DNA, 20 bp, human
gagctcaggcgcagagaaac

SEQ ID NO: 366421 - DNA, 20 bp, human
gcgacccggaagtggttcta

SEQ ID NO: 366422 - DNA, 20 bp, human
gcgggaacgccagagaacgt

SEQ ID NO: 366423 - DNA, 20 bp, human
gcggcctgacaccaggtacc

SEQ ID NO: 366424 - DNA, 20 bp, human
gtgggctccaaggcgcaagg

SEQ ID NO: 366425 - DNA, 20 bp, human
gaggggccaatcagcgttca

SEQ ID NO: 366426 - DNA, 20 bp, human
gaggccagggaaacatctgc

SEQ ID NO: 366427 - DNA, 20 bp, human
ggaccctgcagatgtttccc

SEQ ID NO: 366428 - DNA, 20 bp, human
gcatgagcgcccagaaggaa

SEQ ID NO: 366429 - DNA, 20 bp, human
gaaatcaacagcagttgtgg

SEQ ID NO: 366430 - DNA, 20 bp, human
ggagcattgctagcagaaag

SEQ ID NO: 366431 - DNA, 20 bp, human
gttgtgggggaggacagtga

SEQ ID NO: 366432 - DNA, 20 bp, human
gatactagccaagaaggcga

SEQ ID NO: 366433 - DNA, 20 bp, human
ggtcacccagggctctgccg

SEQ ID NO: 366434 - DNA, 20 bp, human
ggctgctgctgggtcaccca

SEQ ID NO: 366435 - DNA, 20 bp, human
ggactaaaatagatgcacag

SEQ ID NO: 366436 - DNA, 20 bp, human
ggcctcccgcaagatatcac

SEQ ID NO: 366437 - DNA, 20 bp, human
ggtcctgcccttggtcgcga

SEQ ID NO: 366438 - DNA, 20 bp, human
gggacggcgcacagcttcct

SEQ ID NO: 366439 - DNA, 20 bp, human
gcaagggcaggacagctgga

SEQ ID NO: 366440 - DNA, 20 bp, human
gcaggcggggtccaaggtta

SEQ ID NO: 366441 - DNA, 20 bp, human
gcgaccgacgcgttagaagg

SEQ ID NO: 366442 - DNA, 20 bp, human
gtggttgtgcgcttgaggtc

SEQ ID NO: 366443 - DNA, 20 bp, human
gaagccgggctgcgacctta

SEQ ID NO: 366444 - DNA, 20 bp, human
gggggtccaaggttagggcg

SEQ ID NO: 366445 - DNA, 20 bp, human
ggcacctccttctaacgcgt

SEQ ID NO: 366446 - DNA, 20 bp, human
gtccctgcacccgcaggcgg

SEQ ID NO: 366447 - DNA, 20 bp, human
ggtcccccgcctgcgggtgc

SEQ ID NO: 366448 - DNA, 20 bp, human
gcggctcactagcgttcctg

SEQ ID NO: 366449 - DNA, 20 bp, human
gggctcctggcgcactggcc

SEQ ID NO: 366450 - DNA, 20 bp, human
gccaggctggaggcggctgg

SEQ ID NO: 366451 - DNA, 20 bp, human
gccatccctgcacccgcagg

SEQ ID NO: 366452 - DNA, 20 bp, human
ggtccgcgtcccccgcctgc

SEQ ID NO: 366453 - DNA, 20 bp, human
gcctgcggctcctggcgcac

SEQ ID NO: 366454 - DNA, 20 bp, human
gggggcccggccagtgcgcc

SEQ ID NO: 366455 - DNA, 20 bp, human
gagtgtactgcgactgggcg

SEQ ID NO: 366456 - DNA, 20 bp, human
ggcagagcgcaaagccgcat

SEQ ID NO: 366457 - DNA, 20 bp, human
ggggcccagttggcacggta

SEQ ID NO: 366458 - DNA, 20 bp, human
gcacgagcccggggcaggtc

SEQ ID NO: 366459 - DNA, 20 bp, human
gaagccgcatgggcggggtt

SEQ ID NO: 366460 - DNA, 20 bp, human
gctgccacgcccatcgaagc

SEQ ID NO: 366461 - DNA, 20 bp, human
gaagccctaccgtgccaact

SEQ ID NO: 366462 - DNA, 20 bp, human
gggcctcggccccgcttcga

SEQ ID NO: 366463 - DNA, 20 bp, human
gagcgcaaagccgcatgggc

SEQ ID NO: 366464 - DNA, 20 bp, human
gccgaggccggaagcagccc

SEQ ID NO: 366465 - DNA, 20 bp, human
ggccccgcccacccaaaagt

SEQ ID NO: 366466 - DNA, 20 bp, human
gaactcaagtgaagtgaccc

SEQ ID NO: 366467 - DNA, 20 bp, human
gtctctggaaagaagacccg

SEQ ID NO: 366468 - DNA, 20 bp, human
gaagacccgcggatgggttt

SEQ ID NO: 366469 - DNA, 20 bp, human
gcggaggctcctgatagaga

SEQ ID NO: 366470 - DNA, 20 bp, human
gtacttggcgctccaggcct

SEQ ID NO: 366471 - DNA, 20 bp, human
ggagcgccaagtacaaagcg

SEQ ID NO: 366472 - DNA, 20 bp, human
gacttcacttgagttatcag

SEQ ID NO: 366473 - DNA, 20 bp, human
gggtagtttgtcaaactaga

SEQ ID NO: 366474 - DNA, 20 bp, human
gtagtttgacaaactaccgg

SEQ ID NO: 366475 - DNA, 20 bp, human
gcaggctttgtctcctagat

SEQ ID NO: 366476 - DNA, 20 bp, human
ggaactgccaccctgcccgg

SEQ ID NO: 366477 - DNA, 20 bp, human
gagcctcgacggccaggagg

SEQ ID NO: 366478 - DNA, 20 bp, human
gcgggggaacccacggccag

SEQ ID NO: 366479 - DNA, 20 bp, human
gccacccgccccctggccgt

SEQ ID NO: 366480 - DNA, 20 bp, human
ggcagagcgccggtggatga

SEQ ID NO: 366481 - DNA, 20 bp, human
gctgggcgcagtagcctcga

SEQ ID NO: 366482 - DNA, 20 bp, human
gcgggcaggtggcagagcgc

SEQ ID NO: 366483 - DNA, 20 bp, human
ggggagccgaagcccggagg

SEQ ID NO: 366484 - DNA, 20 bp, human
ggggggaggcgtggcctcca

SEQ ID NO: 366485 - DNA, 20 bp, human
gccagggcaccctcatccac

SEQ ID NO: 366486 - DNA, 20 bp, human
ggaacaccagagttccttct

SEQ ID NO: 366487 - DNA, 20 bp, human
gcggggaaggtgtaaggcgc

SEQ ID NO: 366488 - DNA, 20 bp, human
gtccccccaatgcaggtcgg

SEQ ID NO: 366489 - DNA, 20 bp, human
gtagggagctcagtggtctc

SEQ ID NO: 366490 - DNA, 20 bp, human
ggccgagcggggaaggtgta

SEQ ID NO: 366491 - DNA, 20 bp, human
gcttctgggaagacgggcta

SEQ ID NO: 366492 - DNA, 20 bp, human
ggcggggaggtcaagtggaa

SEQ ID NO: 366493 - DNA, 20 bp, human
gctcccccgacctgcattgg

SEQ ID NO: 366494 - DNA, 20 bp, human
ggagacgcaagttctggcgc

SEQ ID NO: 366495 - DNA, 20 bp, human
ggtagagcgctgtcggggat

SEQ ID NO: 366496 - DNA, 20 bp, human
ggggcccgcctccagagagc

SEQ ID NO: 366497 - DNA, 20 bp, human
gctcgccgcgctggcctcgg

SEQ ID NO: 366498 - DNA, 20 bp, human
gctgggagctgggtctcggg

SEQ ID NO: 366499 - DNA, 20 bp, human
gctccagagagccggaagtg

SEQ ID NO: 366500 - DNA, 20 bp, human
ggggaggtgctgtgcggacc

SEQ ID NO: 366501 - DNA, 20 bp, human
ggcgctggcctcggcggcac

SEQ ID NO: 366502 - DNA, 20 bp, human
gcgagcccgcgcggagcgca

SEQ ID NO: 366503 - DNA, 20 bp, human
ggagctcgccgcgctggcct

SEQ ID NO: 366504 - DNA, 20 bp, human
gggtctcgggaggtgctgtg

SEQ ID NO: 366505 - DNA, 20 bp, human
gactgggcagaggtcgaccc

SEQ ID NO: 366506 - DNA, 20 bp, human
gcctccctgcagttaactct

SEQ ID NO: 366507 - DNA, 20 bp, human
gtgaaggggttggcagctag

SEQ ID NO: 366508 - DNA, 20 bp, human
gttctccaagagttaactgc

SEQ ID NO: 366509 - DNA, 20 bp, human
gagtgagaggcacaaagatc

SEQ ID NO: 366510 - DNA, 20 bp, human
gcagatgaacaaacagccta

SEQ ID NO: 366511 - DNA, 20 bp, human
ggaactgggcccgtttgcag

SEQ ID NO: 366512 - DNA, 20 bp, human
gccaatgaacacagagcccg

SEQ ID NO: 366513 - DNA, 20 bp, human
gaagcagccaatgacagctg

SEQ ID NO: 366514 - DNA, 20 bp, human
gtaactcttggagaagaggc

SEQ ID NO: 366515 - DNA, 20 bp, human
gatcaggttgctcaagtgag

SEQ ID NO: 366516 - DNA, 20 bp, human
gcatccttgtgcaagcaaca

SEQ ID NO: 366517 - DNA, 20 bp, human
gtctcagaagagtatcctgg

SEQ ID NO: 366518 - DNA, 20 bp, human
gctgtacaggtttggtagct

SEQ ID NO: 366519 - DNA, 20 bp, human
gactccatgttgcttgcaca

SEQ ID NO: 366520 - DNA, 20 bp, human
ggtttctcagaagagtatcc

SEQ ID NO: 366521 - DNA, 20 bp, human
gactttaaaagttttcagga

SEQ ID NO: 366522 - DNA, 20 bp, human
gagttttcaggatggacagc

SEQ ID NO: 366523 - DNA, 20 bp, human
gaggctacaccatatagctt

SEQ ID NO: 366524 - DNA, 20 bp, human
ggtcacatgctgtacaggtt

SEQ ID NO: 366525 - DNA, 20 bp, human
ggtaggcaactgcaacatag

SEQ ID NO: 366526 - DNA, 20 bp, human
gccggccgcgggtccctctg

SEQ ID NO: 366527 - DNA, 20 bp, human
gcccggcctccatggcaacg

SEQ ID NO: 366528 - DNA, 20 bp, human
gaaaaatgcaaggaggggca

SEQ ID NO: 366529 - DNA, 20 bp, human
ggggccgggctaggactgac

SEQ ID NO: 366530 - DNA, 20 bp, human
gcgcggaaaaaatgcaagga

SEQ ID NO: 366531 - DNA, 20 bp, human
gaggtgggagggagcgacaa

SEQ ID NO: 366532 - DNA, 20 bp, human
gccagcgcggaaaaaatgca

SEQ ID NO: 366533 - DNA, 20 bp, human
gagaaccagccgcgttgcca

SEQ ID NO: 366534 - DNA, 20 bp, human
gcggccaatcagagacgtag

SEQ ID NO: 366535 - DNA, 20 bp, human
gtcgcccgtcagtcctagcc

SEQ ID NO: 366536 - DNA, 20 bp, human
gtaggcgctagcaacgcctc

SEQ ID NO: 366537 - DNA, 20 bp, human
gctagtgaggggcccgaagt

SEQ ID NO: 366538 - DNA, 20 bp, human
gaggggaaaaggtgggatgt

SEQ ID NO: 366539 - DNA, 20 bp, human
gcgctagcaacgcctcaggg

SEQ ID NO: 366540 - DNA, 20 bp, human
ggcgacttcgctaatactac

SEQ ID NO: 366541 - DNA, 20 bp, human
gctcagggcggaggaatgac

SEQ ID NO: 366542 - DNA, 20 bp, human
gacgcgcccagggactctag

SEQ ID NO: 366543 - DNA, 20 bp, human
ggaaaggggtgggtctaact

SEQ ID NO: 366544 - DNA, 20 bp, human
gtctaagatcaaaggggaaa

SEQ ID NO: 366545 - DNA, 20 bp, human
gtagcaacgcctcagggcgg

SEQ ID NO: 366546 - DNA, 20 bp, human
gacgcccggccaatgaggcg

SEQ ID NO: 366547 - DNA, 20 bp, human
gcggcgaagcgcagtgcccg

SEQ ID NO: 366548 - DNA, 20 bp, human
gacggcgcggacaacacccc

SEQ ID NO: 366549 - DNA, 20 bp, human
ggggtggcggggttgagccg

SEQ ID NO: 366550 - DNA, 20 bp, human
gaccccgcgtactccgggtg

SEQ ID NO: 366551 - DNA, 20 bp, human
ggccctgccggcaggcacga

SEQ ID NO: 366552 - DNA, 20 bp, human
gccgccgcgcctcattggcc

SEQ ID NO: 366553 - DNA, 20 bp, human
gggagtacgcggggtggctc

SEQ ID NO: 366554 - DNA, 20 bp, human
gcttcgccgccgcgcctcat

SEQ ID NO: 366555 - DNA, 20 bp, human
ggggtggctctggtctggac

SEQ ID NO: 366556 - DNA, 20 bp, human
gaagccgggcggaagagctg

SEQ ID NO: 366557 - DNA, 20 bp, human
ggcgggcaggggcgggaata

SEQ ID NO: 366558 - DNA, 20 bp, human
gagtacgcgtcgcccattgg

SEQ ID NO: 366559 - DNA, 20 bp, human
ggggcgacgcgtacttgcag

SEQ ID NO: 366560 - DNA, 20 bp, human
ggcaagtacgcgtcgcccat

SEQ ID NO: 366561 - DNA, 20 bp, human
gtgtgcccttcgcgcgtcgt

SEQ ID NO: 366562 - DNA, 20 bp, human
gcgcgaagggcacacatctt

SEQ ID NO: 366563 - DNA, 20 bp, human
gttccgcccggcttgtgcgc

SEQ ID NO: 366564 - DNA, 20 bp, human
gggagaacgcgatgacgcta

SEQ ID NO: 366565 - DNA, 20 bp, human
gaatcctcccgcgcacaagc

SEQ ID NO: 366566 - DNA, 20 bp, human
ggggctgcgtgcaggctcgt

SEQ ID NO: 366567 - DNA, 20 bp, human
gccccagatggggacacgga

SEQ ID NO: 366568 - DNA, 20 bp, human
gtccccatctggggctgtca

SEQ ID NO: 366569 - DNA, 20 bp, human
gagtgctggcagaaaccaat

SEQ ID NO: 366570 - DNA, 20 bp, human
gcctgaggggcacttgggac

SEQ ID NO: 366571 - DNA, 20 bp, human
gaagatcctgaggggcactt

SEQ ID NO: 366572 - DNA, 20 bp, human
gttcccctgccgctgcctga

SEQ ID NO: 366573 - DNA, 20 bp, human
gaaaccaatgggagctgagg

SEQ ID NO: 366574 - DNA, 20 bp, human
gcgacctcctcagctcccat

SEQ ID NO: 366575 - DNA, 20 bp, human
gtcaggggtgtggctagtgc

SEQ ID NO: 366576 - DNA, 20 bp, human
gtgggctttctgatgaggga

SEQ ID NO: 366577 - DNA, 20 bp, human
ggaggcggtgagcattgagc

SEQ ID NO: 366578 - DNA, 20 bp, human
gactcctgacacgtggctcc

SEQ ID NO: 366579 - DNA, 20 bp, human
gtccgctcgtagaagtgcgc

SEQ ID NO: 366580 - DNA, 20 bp, human
gggccagagcagtaaaccag

SEQ ID NO: 366581 - DNA, 20 bp, human
gacttctacgagcggagcct

SEQ ID NO: 366582 - DNA, 20 bp, human
ggtgtcaggcgtcacgtggc

SEQ ID NO: 366583 - DNA, 20 bp, human
gcaggcgtcaccgcgcatcc

SEQ ID NO: 366584 - DNA, 20 bp, human
gacacgtgactcctgacacg

SEQ ID NO: 366585 - DNA, 20 bp, human
ggcctgcgcacttctacgag

SEQ ID NO: 366586 - DNA, 20 bp, human
ggctccgcgagtcacgtgac

SEQ ID NO: 366587 - DNA, 20 bp, human
gcacgtgactcgcggagcgg

SEQ ID NO: 366588 - DNA, 20 bp, human
gggaaagcgcgatggagggg

SEQ ID NO: 366589 - DNA, 20 bp, human
gcggcggaaagcgcgatgga

SEQ ID NO: 366590 - DNA, 20 bp, human
gcagggcggagactcgggag

SEQ ID NO: 366591 - DNA, 20 bp, human
gaaaagcggaagtcgcctgt

SEQ ID NO: 366592 - DNA, 20 bp, human
gtgccggcaaacgttagcaa

SEQ ID NO: 366593 - DNA, 20 bp, human
gtgccggcaaaactacggag

SEQ ID NO: 366594 - DNA, 20 bp, human
gcgaggcagggcggagactc

SEQ ID NO: 366595 - DNA, 20 bp, human
gatgctccagcccacggacg

SEQ ID NO: 366596 - DNA, 20 bp, human
ggggaggttgcgcagttctg

SEQ ID NO: 366597 - DNA, 20 bp, human
gagccccgagcgaatgactg

SEQ ID NO: 366598 - DNA, 20 bp, human
ggcgtggaggcagtggaaac

SEQ ID NO: 366599 - DNA, 20 bp, human
gctccccagtcattcgctcg

SEQ ID NO: 366600 - DNA, 20 bp, human
gggcgcgcgagtctggggcg

SEQ ID NO: 366601 - DNA, 20 bp, human
gggcctaggccggagcgtgg

SEQ ID NO: 366602 - DNA, 20 bp, human
gtcacgggcgcgcgagtctg

SEQ ID NO: 366603 - DNA, 20 bp, human
gttccactgcctccacgctc

SEQ ID NO: 366604 - DNA, 20 bp, human
ggttaggacgcggatgtggg

SEQ ID NO: 366605 - DNA, 20 bp, human
ggtctggggcggggcgtgac

SEQ ID NO: 366606 - DNA, 20 bp, human
gtggagggagagcgtggata

SEQ ID NO: 366607 - DNA, 20 bp, human
ggggcctggaccctgggatc

SEQ ID NO: 366608 - DNA, 20 bp, human
gcctggaccctgggatctgg

SEQ ID NO: 366609 - DNA, 20 bp, human
gtctgggggaaaggtcactt

SEQ ID NO: 366610 - DNA, 20 bp, human
ggggaaaggtcacttgggac

SEQ ID NO: 366611 - DNA, 20 bp, human
ggagagcgtggatagggaga

SEQ ID NO: 366612 - DNA, 20 bp, human
gaaaggtcacttgggactgg

SEQ ID NO: 366613 - DNA, 20 bp, human
gagaaggtgccaaccagccc

SEQ ID NO: 366614 - DNA, 20 bp, human
ggtccctggcatggggtaca

SEQ ID NO: 366615 - DNA, 20 bp, human
ggtcaccaggggcatatcag

SEQ ID NO: 366616 - DNA, 20 bp, human
gcggctccgcggccaaaggg

SEQ ID NO: 366617 - DNA, 20 bp, human
ggagccggctcggcgctgat

SEQ ID NO: 366618 - DNA, 20 bp, human
gctctcggcgctcctgtccc

SEQ ID NO: 366619 - DNA, 20 bp, human
gtgtccccggaatcacccgg

SEQ ID NO: 366620 - DNA, 20 bp, human
gccgcctccgggtgattccg

SEQ ID NO: 366621 - DNA, 20 bp, human
ggacgcggcggttttgttat

SEQ ID NO: 366622 - DNA, 20 bp, human
ggccgactccggctccggaa

SEQ ID NO: 366623 - DNA, 20 bp, human
ggactccggctccggaaggg

SEQ ID NO: 366624 - DNA, 20 bp, human
gtggctgagggcctcggttg

SEQ ID NO: 366625 - DNA, 20 bp, human
gggccaaagggaggagctct

SEQ ID NO: 366626 - DNA, 20 bp, human
gagaacgcgtgcccggaggg

SEQ ID NO: 366627 - DNA, 20 bp, human
gcggtgacctaccaccctcc

SEQ ID NO: 366628 - DNA, 20 bp, human
gtcacgacgctcacaccaat

SEQ ID NO: 366629 - DNA, 20 bp, human
gcataaacagaggctcccat

SEQ ID NO: 366630 - DNA, 20 bp, human
gggccagaacgcgtgcccgg

SEQ ID NO: 366631 - DNA, 20 bp, human
ggcgcagcgcgacggagagt

SEQ ID NO: 366632 - DNA, 20 bp, human
gtggctcccgacataaacag

SEQ ID NO: 366633 - DNA, 20 bp, human
ggggagcctctgtttatgtc

SEQ ID NO: 366634 - DNA, 20 bp, human
gcgcgtgcccggagggtggt

SEQ ID NO: 366635 - DNA, 20 bp, human
ggtctcaggtgctaggagcg

SEQ ID NO: 366636 - DNA, 20 bp, human
gggcgagaggagacgtgggg

SEQ ID NO: 366637 - DNA, 20 bp, human
gaggggcaggggaggtcatt

SEQ ID NO: 366638 - DNA, 20 bp, human
gcgggggcgagaggagacgt

SEQ ID NO: 366639 - DNA, 20 bp, human
ggtcccgcacaccaatggcg

SEQ ID NO: 366640 - DNA, 20 bp, human
ggccgcggcgcctgacgcca

SEQ ID NO: 366641 - DNA, 20 bp, human
gggccagagacaccaatcgc

SEQ ID NO: 366642 - DNA, 20 bp, human
gccactgtcccgcacaccaa

SEQ ID NO: 366643 - DNA, 20 bp, human
gcaggggaggtcattgggga

SEQ ID NO: 366644 - DNA, 20 bp, human
gcgggacggtgacgtcacac

SEQ ID NO: 366645 - DNA, 20 bp, human
gtcccggcgattggtgtctc

SEQ ID NO: 366646 - DNA, 20 bp, human
gtgaaaacgcccagaactga

SEQ ID NO: 366647 - DNA, 20 bp, human
gttactgggcagaccaggtc

SEQ ID NO: 366648 - DNA, 20 bp, human
gtgggacgcttgtcacgtga

SEQ ID NO: 366649 - DNA, 20 bp, human
gccggaggaactctgtagaa

SEQ ID NO: 366650 - DNA, 20 bp, human
gcagacgctccattaagttc

SEQ ID NO: 366651 - DNA, 20 bp, human
ggaaggggagatttcgcttc

SEQ ID NO: 366652 - DNA, 20 bp, human
gccttgcacccagaacttaa

SEQ ID NO: 366653 - DNA, 20 bp, human
gaatagcccacgttggctag

SEQ ID NO: 366654 - DNA, 20 bp, human
gacgtgacaagcgtcccacc

SEQ ID NO: 366655 - DNA, 20 bp, human
ggggagatttcgcttccggg

SEQ ID NO: 366656 - DNA, 20 bp, human
gtctccgcccggacctgcga

SEQ ID NO: 366657 - DNA, 20 bp, human
gcgcaagcccggagtgtccc

SEQ ID NO: 366658 - DNA, 20 bp, human
gcccgcgcggccccgtcaag

SEQ ID NO: 366659 - DNA, 20 bp, human
gcggtcccgcccccttgacg

SEQ ID NO: 366660 - DNA, 20 bp, human
ggcggagccggggacactcc

SEQ ID NO: 366661 - DNA, 20 bp, human
ggggcggagacgcgagtggg

SEQ ID NO: 366662 - DNA, 20 bp, human
gggaccgtcgcaggtccggg

SEQ ID NO: 366663 - DNA, 20 bp, human
gaagggggcgggaccgtcgc

SEQ ID NO: 366664 - DNA, 20 bp, human
ggcagctctcagcgctggac

SEQ ID NO: 366665 - DNA, 20 bp, human
gggccgaccagccgcaagcc

SEQ ID NO: 366666 - DNA, 20 bp, human
ggaaaggaggcccgtgtcag

SEQ ID NO: 366667 - DNA, 20 bp, human
ggatcatgatggcacaggag

SEQ ID NO: 366668 - DNA, 20 bp, human
ggacaggtggggtcctgaat

SEQ ID NO: 366669 - DNA, 20 bp, human
ggggcagccttgatgatccg

SEQ ID NO: 366670 - DNA, 20 bp, human
ggtgctgatcatgatggcac

SEQ ID NO: 366671 - DNA, 20 bp, human
ggcggctgaaaggggcaagg

SEQ ID NO: 366672 - DNA, 20 bp, human
gcctgccctctccccatccg

SEQ ID NO: 366673 - DNA, 20 bp, human
gtctcccacggatggggaga

SEQ ID NO: 366674 - DNA, 20 bp, human
ggcgacctgacccctgacac

SEQ ID NO: 366675 - DNA, 20 bp, human
gccagaggctgaaccaggac

SEQ ID NO: 366676 - DNA, 20 bp, human
gcagctgcagagggcatcgg

SEQ ID NO: 366677 - DNA, 20 bp, human
gagagcccggcggggatata

SEQ ID NO: 366678 - DNA, 20 bp, human
ggcccggcggggatataagg

SEQ ID NO: 366679 - DNA, 20 bp, human
gtcccagctgcagagggcat

SEQ ID NO: 366680 - DNA, 20 bp, human
ggcgaagccggggcagacac

SEQ ID NO: 366681 - DNA, 20 bp, human
gcccgccgggctctcgcgag

SEQ ID NO: 366682 - DNA, 20 bp, human
gctcgcgccgcgcattggct

SEQ ID NO: 366683 - DNA, 20 bp, human
gggggctgtccctgcaactt

SEQ ID NO: 366684 - DNA, 20 bp, human
gagcggcccggtgtctgccc

SEQ ID NO: 366685 - DNA, 20 bp, human
gagaggaggcgggtcgcggc

SEQ ID NO: 366686 - DNA, 20 bp, human
ggcgcaaagcacaaacgagt

SEQ ID NO: 366687 - DNA, 20 bp, human
gacaaacgagtgggctgcgg

SEQ ID NO: 366688 - DNA, 20 bp, human
ggaaacccgacctgcagacg

SEQ ID NO: 366689 - DNA, 20 bp, human
gagcacaaacgagtgggctg

SEQ ID NO: 366690 - DNA, 20 bp, human
gcgaggcgcgagaaggacgg

SEQ ID NO: 366691 - DNA, 20 bp, human
gacggcgcgtggcgtgagac

SEQ ID NO: 366692 - DNA, 20 bp, human
gggcgcgcgtatcggcgccg

SEQ ID NO: 366693 - DNA, 20 bp, human
gagaaggacggcggcgtgag

SEQ ID NO: 366694 - DNA, 20 bp, human
ggcgtggcgtgagacggggc

SEQ ID NO: 366695 - DNA, 20 bp, human
gaggcggccgtcctgtcaac

SEQ ID NO: 366696 - DNA, 20 bp, human
gtcaggaggtggatacttgg

SEQ ID NO: 366697 - DNA, 20 bp, human
gtgaccttcctaggtgtggt

SEQ ID NO: 366698 - DNA, 20 bp, human
gctgcccaccacacctagga

SEQ ID NO: 366699 - DNA, 20 bp, human
gcacgctgcccaccacacct

SEQ ID NO: 366700 - DNA, 20 bp, human
gacacctaggaaggtcacag

SEQ ID NO: 366701 - DNA, 20 bp, human
gggtggatacttgggggaag

SEQ ID NO: 366702 - DNA, 20 bp, human
ggataacatatttattggtt

SEQ ID NO: 366703 - DNA, 20 bp, human
gatgagttcatctaaccctg

SEQ ID NO: 366704 - DNA, 20 bp, human
gctccaaattccaacccact

SEQ ID NO: 366705 - DNA, 20 bp, human
gtttattggtttgggggatc

SEQ ID NO: 366706 - DNA, 20 bp, human
gccagcgcctagcaccctga

SEQ ID NO: 366707 - DNA, 20 bp, human
gggtgcctgagtggtccctc

SEQ ID NO: 366708 - DNA, 20 bp, human
gggaacggagggcgtagctt

SEQ ID NO: 366709 - DNA, 20 bp, human
ggcaccctgagggaccactc

SEQ ID NO: 366710 - DNA, 20 bp, human
gtggcagaggtggggctatt

SEQ ID NO: 366711 - DNA, 20 bp, human
gggcggggctacgaagaaac

SEQ ID NO: 366712 - DNA, 20 bp, human
ggaaactggcgctaccggtg

SEQ ID NO: 366713 - DNA, 20 bp, human
gcagaggcgagaggaacgga

SEQ ID NO: 366714 - DNA, 20 bp, human
gcaggcgaggattggaatct

SEQ ID NO: 366715 - DNA, 20 bp, human
gaactgtcggccaatcgctg

SEQ ID NO: 366716 - DNA, 20 bp, human
gctggcccgaggctggtcgg

SEQ ID NO: 366717 - DNA, 20 bp, human
gccagcctcgggccaggcta

SEQ ID NO: 366718 - DNA, 20 bp, human
gatggggcgggcccgcgtga

SEQ ID NO: 366719 - DNA, 20 bp, human
gctggagggtccggggtccg

SEQ ID NO: 366720 - DNA, 20 bp, human
gtacgccctagcctggcccg

SEQ ID NO: 366721 - DNA, 20 bp, human
gccaggctagggcgtagacg

SEQ ID NO: 366722 - DNA, 20 bp, human
ggggcccgccccatgccggg

SEQ ID NO: 366723 - DNA, 20 bp, human
gccgaggccgcggatatcat

SEQ ID NO: 366724 - DNA, 20 bp, human
gcccacccccgaccagcctc

SEQ ID NO: 366725 - DNA, 20 bp, human
gactatgcccatgatatccg

SEQ ID NO: 366726 - DNA, 20 bp, human
gaacgctgagggcataacga

SEQ ID NO: 366727 - DNA, 20 bp, human
ggcgcctgcgtgttctggtt

SEQ ID NO: 366728 - DNA, 20 bp, human
gttaaggcgcctgcgtgttc

SEQ ID NO: 366729 - DNA, 20 bp, human
gggcataacgaaggtaaaga

SEQ ID NO: 366730 - DNA, 20 bp, human
ggcggcacatcctcactcct

SEQ ID NO: 366731 - DNA, 20 bp, human
gccgcacttccgagaactga

SEQ ID NO: 366732 - DNA, 20 bp, human
gtggtagccatcttggattt

SEQ ID NO: 366733 - DNA, 20 bp, human
ggaagatccagttgtaaatg

SEQ ID NO: 366734 - DNA, 20 bp, human
gccaggaggccgtcagttct

SEQ ID NO: 366735 - DNA, 20 bp, human
gtcaaaggctcaaacgccat

SEQ ID NO: 366736 - DNA, 20 bp, human
gcttcccaggggaaagatag

SEQ ID NO: 366737 - DNA, 20 bp, human
gaaaacccctatctttcccc

SEQ ID NO: 366738 - DNA, 20 bp, human
gtgactgaagaagagtctgg

SEQ ID NO: 366739 - DNA, 20 bp, human
gactcacacgggggagtcgg

SEQ ID NO: 366740 - DNA, 20 bp, human
gcccagctggaggggtgcca

SEQ ID NO: 366741 - DNA, 20 bp, human
gtcagaaacacagccttcct

SEQ ID NO: 366742 - DNA, 20 bp, human
ggagggaagagccagtccac

SEQ ID NO: 366743 - DNA, 20 bp, human
gggcctggtgagtcactcct

SEQ ID NO: 366744 - DNA, 20 bp, human
gacgtgaggtcagaggagaa

SEQ ID NO: 366745 - DNA, 20 bp, human
gggggcagacctcacccagg

SEQ ID NO: 366746 - DNA, 20 bp, human
gtcttccggcaaccattaaa

SEQ ID NO: 366747 - DNA, 20 bp, human
gttaaagggcacggttgcta

SEQ ID NO: 366748 - DNA, 20 bp, human
gggttgctagggagacgcgg

SEQ ID NO: 366749 - DNA, 20 bp, human
ggtaggaatagggcctgcat

SEQ ID NO: 366750 - DNA, 20 bp, human
gggagggagccgataacccg

SEQ ID NO: 366751 - DNA, 20 bp, human
gcacggttgctagggagacg

SEQ ID NO: 366752 - DNA, 20 bp, human
gggagccgataacccgcggg

SEQ ID NO: 366753 - DNA, 20 bp, human
gctggggcgtagctgtgaca

SEQ ID NO: 366754 - DNA, 20 bp, human
ggagaactggtgtaggaata

SEQ ID NO: 366755 - DNA, 20 bp, human
gttggaaacccggaagtctt

SEQ ID NO: 366756 - DNA, 20 bp, human
gcctgacacctgggtcccga

SEQ ID NO: 366757 - DNA, 20 bp, human
ggtgacaggcaccagagagc

SEQ ID NO: 366758 - DNA, 20 bp, human
gtcctgggaaggtccagaga

SEQ ID NO: 366759 - DNA, 20 bp, human
gactgggacaagggtcccgg

SEQ ID NO: 366760 - DNA, 20 bp, human
gggaaccggggcagcgggaa

SEQ ID NO: 366761 - DNA, 20 bp, human
gacacaggagagagcacggg

SEQ ID NO: 366762 - DNA, 20 bp, human
gaggggtcctgagcaaatcc

SEQ ID NO: 366763 - DNA, 20 bp, human
gccaggtgtcaggaaaacac

SEQ ID NO: 366764 - DNA, 20 bp, human
ggcctgggcttggacctgga

SEQ ID NO: 366765 - DNA, 20 bp, human
ggaggtgtttggatgtgatg

SEQ ID NO: 366766 - DNA, 20 bp, human
gagcccgcgcagccggtgac

SEQ ID NO: 366767 - DNA, 20 bp, human
gaagaggataacccggagaa

SEQ ID NO: 366768 - DNA, 20 bp, human
gcagcactctgggtggataa

SEQ ID NO: 366769 - DNA, 20 bp, human
ggctcatcccagacacaaag

SEQ ID NO: 366770 - DNA, 20 bp, human
ggataagggtgcgctccgcg

SEQ ID NO: 366771 - DNA, 20 bp, human
gcttaaaggcacagcactct

SEQ ID NO: 366772 - DNA, 20 bp, human
gtctgaagttggcaaggaag

SEQ ID NO: 366773 - DNA, 20 bp, human
gaggataacccggagaaggg

SEQ ID NO: 366774 - DNA, 20 bp, human
gcgcccccagtggaccttaa

SEQ ID NO: 366775 - DNA, 20 bp, human
gcgccctccggcacttggag

SEQ ID NO: 366776 - DNA, 20 bp, human
gcaggaggaggagtcgtgga

SEQ ID NO: 366777 - DNA, 20 bp, human
gctcgcaggaggaggagtcg

SEQ ID NO: 366778 - DNA, 20 bp, human
ggagtggcccagctcgcagg

SEQ ID NO: 366779 - DNA, 20 bp, human
gctgacccggcgagaggaag

SEQ ID NO: 366780 - DNA, 20 bp, human
gtgccgagggcgagcacggg

SEQ ID NO: 366781 - DNA, 20 bp, human
gtcgccgggtcaggtgccga

SEQ ID NO: 366782 - DNA, 20 bp, human
ggaggaggagtcgtggaggg

SEQ ID NO: 366783 - DNA, 20 bp, human
ggcggcgcggagagcagtcc

SEQ ID NO: 366784 - DNA, 20 bp, human
ggctgagtggcccagctcgc

SEQ ID NO: 366785 - DNA, 20 bp, human
gacccggcgagaggaagggg

SEQ ID NO: 366786 - DNA, 20 bp, human
ggcggagcccgcatcctgac

SEQ ID NO: 366787 - DNA, 20 bp, human
ggcctgcggccaggagaagt

SEQ ID NO: 366788 - DNA, 20 bp, human
gccgcggcggggcaggtaga

SEQ ID NO: 366789 - DNA, 20 bp, human
gtcgccccgcagaaccgaca

SEQ ID NO: 366790 - DNA, 20 bp, human
ggggccttgtcggttctgcg

SEQ ID NO: 366791 - DNA, 20 bp, human
ggcgctgttggggtcacgtg

SEQ ID NO: 366792 - DNA, 20 bp, human
gcggcatcaagggtgaagca

SEQ ID NO: 366793 - DNA, 20 bp, human
gtaggctggcgacatctggc

SEQ ID NO: 366794 - DNA, 20 bp, human
gccacgccagcacacctgtc

SEQ ID NO: 366795 - DNA, 20 bp, human
ggcgctgcgccccaacctcg

SEQ ID NO: 366796 - DNA, 20 bp, human
gcccgccccggggtcggtca

SEQ ID NO: 366797 - DNA, 20 bp, human
gggggcgcagcgtgacgctc

SEQ ID NO: 366798 - DNA, 20 bp, human
gtgtgaagatgtgttgccag

SEQ ID NO: 366799 - DNA, 20 bp, human
gaccatgaccgaccccgggg

SEQ ID NO: 366800 - DNA, 20 bp, human
gtgacgctctgggcgccgct

SEQ ID NO: 366801 - DNA, 20 bp, human
ggcagaccatgaccgacccc

SEQ ID NO: 366802 - DNA, 20 bp, human
ggtttcttctcggatcccag

SEQ ID NO: 366803 - DNA, 20 bp, human
gcacatcttcacagtgtccg

SEQ ID NO: 366804 - DNA, 20 bp, human
gtcttgaaagggaaaaaagt

SEQ ID NO: 366805 - DNA, 20 bp, human
gttcacagtgtccgtggaga

SEQ ID NO: 366806 - DNA, 20 bp, human
gcggaagcaaagaggattgt

SEQ ID NO: 366807 - DNA, 20 bp, human
gctggctctcccaaacagac

SEQ ID NO: 366808 - DNA, 20 bp, human
gaaagagagcggaagcaaag

SEQ ID NO: 366809 - DNA, 20 bp, human
gtcagttggccggtctgttt

SEQ ID NO: 366810 - DNA, 20 bp, human
gaactgacgtagtcgcgaaa

SEQ ID NO: 366811 - DNA, 20 bp, human
ggagagccaggcgactaatc

SEQ ID NO: 366812 - DNA, 20 bp, human
gaaacggttaatgtcgaggc

SEQ ID NO: 366813 - DNA, 20 bp, human
gcgcgactacgtcagttggc

SEQ ID NO: 366814 - DNA, 20 bp, human
gaaactgcaaattcggagtt

SEQ ID NO: 366815 - DNA, 20 bp, human
gtgcgtcgcttaagtgaggg

SEQ ID NO: 366816 - DNA, 20 bp, human
ggtgcggggcgggacgtctc

SEQ ID NO: 366817 - DNA, 20 bp, human
gggcgcggttcgctggagtg

SEQ ID NO: 366818 - DNA, 20 bp, human
gtccggggagcgcagccaat

SEQ ID NO: 366819 - DNA, 20 bp, human
ggaacccccagcggccccta

SEQ ID NO: 366820 - DNA, 20 bp, human
ggttcgctggagtgcggggc

SEQ ID NO: 366821 - DNA, 20 bp, human
gtccagcgaaccgcgcccat

SEQ ID NO: 366822 - DNA, 20 bp, human
gcctgcgtgcctcgcctctg

SEQ ID NO: 366823 - DNA, 20 bp, human
gcgggacgcagcgggattcc

SEQ ID NO: 366824 - DNA, 20 bp, human
gctggctcccggcataccta

SEQ ID NO: 366825 - DNA, 20 bp, human
gatacctaggggtgcggggc

SEQ ID NO: 366826 - DNA, 20 bp, human
gtttctgggtggttggccct

SEQ ID NO: 366827 - DNA, 20 bp, human
gtggacctgggggacgcaga

SEQ ID NO: 366828 - DNA, 20 bp, human
gccgccgacaagcagtacaa

SEQ ID NO: 366829 - DNA, 20 bp, human
gatgcccttgtactgcttgt

SEQ ID NO: 366830 - DNA, 20 bp, human
gaaaggatgcaccctgtagc

SEQ ID NO: 366831 - DNA, 20 bp, human
gcttgctggcgtgctggacc

SEQ ID NO: 366832 - DNA, 20 bp, human
ggggtgttcagaccagaccc

SEQ ID NO: 366833 - DNA, 20 bp, human
ggatctgcttgctggcgtgc

SEQ ID NO: 366834 - DNA, 20 bp, human
gaacaccctctgcgtccccc

SEQ ID NO: 366835 - DNA, 20 bp, human
gagtgacttgtgtcaaaaaa

SEQ ID NO: 366836 - DNA, 20 bp, human
ggtaggagttagagctgtgt

SEQ ID NO: 366837 - DNA, 20 bp, human
gcgggagttgaactgtaatc

SEQ ID NO: 366838 - DNA, 20 bp, human
gttacctgatcggctgatcc

SEQ ID NO: 366839 - DNA, 20 bp, human
gtccagccatgttacctgat

SEQ ID NO: 366840 - DNA, 20 bp, human
gatcagccgatcaggtaaca

SEQ ID NO: 366841 - DNA, 20 bp, human
gctacagattgctgagtcat

SEQ ID NO: 366842 - DNA, 20 bp, human
ggccctgccgggggggctta

SEQ ID NO: 366843 - DNA, 20 bp, human
ggtccctaagcccccccggc

SEQ ID NO: 366844 - DNA, 20 bp, human
gactcccggatcagccgatc

SEQ ID NO: 366845 - DNA, 20 bp, human
gactgtaatcaggggcttgt

SEQ ID NO: 366846 - DNA, 20 bp, human
ggagagccgcggcttggaga

SEQ ID NO: 366847 - DNA, 20 bp, human
gctcgcttgaggaccttctc

SEQ ID NO: 366848 - DNA, 20 bp, human
gtccgcccaaggtgccgatg

SEQ ID NO: 366849 - DNA, 20 bp, human
ggctctcgccagacccgaga

SEQ ID NO: 366850 - DNA, 20 bp, human
gccaaggtgccgatggggaa

SEQ ID NO: 366851 - DNA, 20 bp, human
gccactcctcacagaggtgt

SEQ ID NO: 366852 - DNA, 20 bp, human
gctcaagcgagggtgacctc

SEQ ID NO: 366853 - DNA, 20 bp, human
gcagcgatcagatccggcca

SEQ ID NO: 366854 - DNA, 20 bp, human
gcagagccagcgatcagatc

SEQ ID NO: 366855 - DNA, 20 bp, human
gtcccctgaggccctgaact

SEQ ID NO: 366856 - DNA, 20 bp, human
ggctctgccgggcgcgtccc

SEQ ID NO: 366857 - DNA, 20 bp, human
ggcggcacgaggtaagtgta

SEQ ID NO: 366858 - DNA, 20 bp, human
gaggagcagcagtgcgttcc

SEQ ID NO: 366859 - DNA, 20 bp, human
ggggaggggatcccagagga

SEQ ID NO: 366860 - DNA, 20 bp, human
gaggccagtggccacttccc

SEQ ID NO: 366861 - DNA, 20 bp, human
ggcggctcggactcgggatc

SEQ ID NO: 366862 - DNA, 20 bp, human
gctgcggtggcccggggaag

SEQ ID NO: 366863 - DNA, 20 bp, human
ggcgcgctgctgctagtcct

SEQ ID NO: 366864 - DNA, 20 bp, human
gacggggcagctcatggcgg

SEQ ID NO: 366865 - DNA, 20 bp, human
gacaagggcagggcacacta

SEQ ID NO: 366866 - DNA, 20 bp, human
gactcggcccagaccgggga

SEQ ID NO: 366867 - DNA, 20 bp, human
gcagaagagcacaagctgga

SEQ ID NO: 366868 - DNA, 20 bp, human
gcgcggaggagtcaacgcca

SEQ ID NO: 366869 - DNA, 20 bp, human
gcagagggcggcaccctccc

SEQ ID NO: 366870 - DNA, 20 bp, human
ggctggaaggattcttagag

SEQ ID NO: 366871 - DNA, 20 bp, human
gaacgccacggaagcagcgg

SEQ ID NO: 366872 - DNA, 20 bp, human
gccggtctgggccgagttat

SEQ ID NO: 366873 - DNA, 20 bp, human
gtccagggcagccaatcgcg

SEQ ID NO: 366874 - DNA, 20 bp, human
gctaccaccagccaataact

SEQ ID NO: 366875 - DNA, 20 bp, human
gagggcagccaatcgcgagg

SEQ ID NO: 366876 - DNA, 20 bp, human
gactccatggaatctgtcat

SEQ ID NO: 366877 - DNA, 20 bp, human
gggaatgcagatatggcctg

SEQ ID NO: 366878 - DNA, 20 bp, human
gtataggctatgtaagacag

SEQ ID NO: 366879 - DNA, 20 bp, human
gagattaaaccaccagtggg

SEQ ID NO: 366880 - DNA, 20 bp, human
gtgtgtgtacgtaatttcat

SEQ ID NO: 366881 - DNA, 20 bp, human
ggcattaaaccacccactgg

SEQ ID NO: 366882 - DNA, 20 bp, human
gtaatctcacaaggaacttg

SEQ ID NO: 366883 - DNA, 20 bp, human
gactaaactctcatctaaac

SEQ ID NO: 366884 - DNA, 20 bp, human
ggtcatgggctgcagaagtg

SEQ ID NO: 366885 - DNA, 20 bp, human
gctgtggtgggggcagaaat

SEQ ID NO: 366886 - DNA, 20 bp, human
gggaaggctgagactcttac

SEQ ID NO: 366887 - DNA, 20 bp, human
ggatccgggtggcccctgcg

SEQ ID NO: 366888 - DNA, 20 bp, human
gccttcccggttcgggaaag

SEQ ID NO: 366889 - DNA, 20 bp, human
gcaacagacaccttggtcga

SEQ ID NO: 366890 - DNA, 20 bp, human
gaacgggatgagtgaggatc

SEQ ID NO: 366891 - DNA, 20 bp, human
gaacccttgagattagtaac

SEQ ID NO: 366892 - DNA, 20 bp, human
gagtctcagccttcccggtt

SEQ ID NO: 366893 - DNA, 20 bp, human
ggctctcataccacatgggg

SEQ ID NO: 366894 - DNA, 20 bp, human
gggtgctctcataccacatg

SEQ ID NO: 366895 - DNA, 20 bp, human
ggagagcgctataaaggcag

SEQ ID NO: 366896 - DNA, 20 bp, human
gccccggcgtcccagcgcgg

SEQ ID NO: 366897 - DNA, 20 bp, human
gaccctccgcgctgggacgc

SEQ ID NO: 366898 - DNA, 20 bp, human
gtgcttgggaagagatccgt

SEQ ID NO: 366899 - DNA, 20 bp, human
gcgggcatccctgccgccta

SEQ ID NO: 366900 - DNA, 20 bp, human
gttgggaagagatccgtagg

SEQ ID NO: 366901 - DNA, 20 bp, human
gagaaactcctgggcggtat

SEQ ID NO: 366902 - DNA, 20 bp, human
gaagagatccgtaggcggca

SEQ ID NO: 366903 - DNA, 20 bp, human
gcggggcgggctcgggttac

SEQ ID NO: 366904 - DNA, 20 bp, human
gctcatcagagtatatttgc

SEQ ID NO: 366905 - DNA, 20 bp, human
ggaagcaagcacaatacaca

SEQ ID NO: 366906 - DNA, 20 bp, human
gcctctgcccggagctggat

SEQ ID NO: 366907 - DNA, 20 bp, human
ggagcagcgagaggcctcat

SEQ ID NO: 366908 - DNA, 20 bp, human
gcgctggggcggggcctaag

SEQ ID NO: 366909 - DNA, 20 bp, human
ggccagctgcgctctcccgg

SEQ ID NO: 366910 - DNA, 20 bp, human
ggggcaggacggggaggctt

SEQ ID NO: 366911 - DNA, 20 bp, human
gcggaaggtgctcacggagt

SEQ ID NO: 366912 - DNA, 20 bp, human
ggcctcataggccaggtcgc

SEQ ID NO: 366913 - DNA, 20 bp, human
gtgggccaatcagcgcgctg

SEQ ID NO: 366914 - DNA, 20 bp, human
ggctaatcccggggcaggac

SEQ ID NO: 366915 - DNA, 20 bp, human
gtctcccgggggctaatccc

SEQ ID NO: 366916 - DNA, 20 bp, human
ggggctatgctaatgaaacc

SEQ ID NO: 366917 - DNA, 20 bp, human
gtggttaatgaggtagttct

SEQ ID NO: 366918 - DNA, 20 bp, human
gtttttggctgcaatcccaa

SEQ ID NO: 366919 - DNA, 20 bp, human
gaactacctcattaaccatt

SEQ ID NO: 366920 - DNA, 20 bp, human
gggactagctggatatttcc

SEQ ID NO: 366921 - DNA, 20 bp, human
gccagggaataaaaatggta

SEQ ID NO: 366922 - DNA, 20 bp, human
gagactacagtgaatataag

SEQ ID NO: 366923 - DNA, 20 bp, human
gcactgtagtcttatgtttt

SEQ ID NO: 366924 - DNA, 20 bp, human
gaaaatcataaaactgccag

SEQ ID NO: 366925 - DNA, 20 bp, human
gggtagttctgggcgtgtgt

SEQ ID NO: 366926 - DNA, 20 bp, human
gcaaggggatcccacgactc

SEQ ID NO: 366927 - DNA, 20 bp, human
gccacgactcaggtatgagg

SEQ ID NO: 366928 - DNA, 20 bp, human
gctagggacagggatagggt

SEQ ID NO: 366929 - DNA, 20 bp, human
gatcccacgactcaggtatg

SEQ ID NO: 366930 - DNA, 20 bp, human
ggacccaggtaccactttcc

SEQ ID NO: 366931 - DNA, 20 bp, human
gcacccaggtctccaaccat

SEQ ID NO: 366932 - DNA, 20 bp, human
gcccgcgggctaggccacaa

SEQ ID NO: 366933 - DNA, 20 bp, human
ggtgggatccccttggtatt

SEQ ID NO: 366934 - DNA, 20 bp, human
gagaaggagccttggtatac

SEQ ID NO: 366935 - DNA, 20 bp, human
gggtaattcactaacgtctc

SEQ ID NO: 366936 - DNA, 20 bp, human
ggtgagccccggcttctgat

SEQ ID NO: 366937 - DNA, 20 bp, human
ggaatgtgacctattgtctt

SEQ ID NO: 366938 - DNA, 20 bp, human
ggggagcagggctgtgtgat

SEQ ID NO: 366939 - DNA, 20 bp, human
gtcccccaaggcggccctgg

SEQ ID NO: 366940 - DNA, 20 bp, human
gtgacctattgtcttcgggg

SEQ ID NO: 366941 - DNA, 20 bp, human
ggataggaaaaggagataag

SEQ ID NO: 366942 - DNA, 20 bp, human
gcccaccggctcccccaagg

SEQ ID NO: 366943 - DNA, 20 bp, human
gagggccacggggtgagccc

SEQ ID NO: 366944 - DNA, 20 bp, human
ggacaataggtcacattcag

SEQ ID NO: 366945 - DNA, 20 bp, human
gtgccccaccggctccccca

SEQ ID NO: 366946 - DNA, 20 bp, human
gtgaccaatcccaggcctgg

SEQ ID NO: 366947 - DNA, 20 bp, human
gcgggtgtaaaagcctggaa

SEQ ID NO: 366948 - DNA, 20 bp, human
ggcggggactgttgtaagat

SEQ ID NO: 366949 - DNA, 20 bp, human
gcctggaaaggggcgatgcc

SEQ ID NO: 366950 - DNA, 20 bp, human
gaaggatgggctcaaaaata

SEQ ID NO: 366951 - DNA, 20 bp, human
gagagcggacccagggtccg

SEQ ID NO: 366952 - DNA, 20 bp, human
gctaactaggaaccagacca

SEQ ID NO: 366953 - DNA, 20 bp, human
gaactggggtggggcttgaa

SEQ ID NO: 366954 - DNA, 20 bp, human
ggggctagaagcataaccta

SEQ ID NO: 366955 - DNA, 20 bp, human
ggtggggcggagcgggtcgt

SEQ ID NO: 366956 - DNA, 20 bp, human
gccacttcccagctcgagtc

SEQ ID NO: 366957 - DNA, 20 bp, human
gacgcggtcctcccggggct

SEQ ID NO: 366958 - DNA, 20 bp, human
gcagtcctgcccggaacccc

SEQ ID NO: 366959 - DNA, 20 bp, human
gaggtggctgccccccacaa

SEQ ID NO: 366960 - DNA, 20 bp, human
gctctcccggccctcccacg

SEQ ID NO: 366961 - DNA, 20 bp, human
ggaggctcctggtgagccgc

SEQ ID NO: 366962 - DNA, 20 bp, human
gggaggtctggggtcaagtc

SEQ ID NO: 366963 - DNA, 20 bp, human
gcagacctccagactcgagc

SEQ ID NO: 366964 - DNA, 20 bp, human
gtcagccggccagtcctgcc

SEQ ID NO: 366965 - DNA, 20 bp, human
gaaagcccttgggaccagga

SEQ ID NO: 366966 - DNA, 20 bp, human
gagccgcgagcagtccggga

SEQ ID NO: 366967 - DNA, 20 bp, human
gcgcgcctagggcggagcgt

SEQ ID NO: 366968 - DNA, 20 bp, human
gctccctcccggactgctcg

SEQ ID NO: 366969 - DNA, 20 bp, human
gtagggcggagcgtaggctg

SEQ ID NO: 366970 - DNA, 20 bp, human
gcaccctaccaggtcctggg

SEQ ID NO: 366971 - DNA, 20 bp, human
gccgggagggagcgcgccta

SEQ ID NO: 366972 - DNA, 20 bp, human
ggcaaccccaggggatgggt

SEQ ID NO: 366973 - DNA, 20 bp, human
gagaaacccgggaggagtgc

SEQ ID NO: 366974 - DNA, 20 bp, human
gcggagagcagaaacccggg

SEQ ID NO: 366975 - DNA, 20 bp, human
gtgcgagccgcgagcagtcc

SEQ ID NO: 366976 - DNA, 20 bp, human
gtgtctcctcgcggactcgg

SEQ ID NO: 366977 - DNA, 20 bp, human
gcctgctcgcgcaacggctt

SEQ ID NO: 366978 - DNA, 20 bp, human
gctcgcgcaacggcttcggg

SEQ ID NO: 366979 - DNA, 20 bp, human
ggcaagggccggggtcggca

SEQ ID NO: 366980 - DNA, 20 bp, human
gtgctccgggttttcggctg

SEQ ID NO: 366981 - DNA, 20 bp, human
ggagtccgcgaggagacagg

SEQ ID NO: 366982 - DNA, 20 bp, human
gggagacccccgagtccgcg

SEQ ID NO: 366983 - DNA, 20 bp, human
gaagcccgcctgtctcctcg

SEQ ID NO: 366984 - DNA, 20 bp, human
gaaacccggagcacgctctc

SEQ ID NO: 366985 - DNA, 20 bp, human
gagacaggcgggcttcaccc

SEQ ID NO: 366986 - DNA, 20 bp, human
ggacgctttcagatcctaga

SEQ ID NO: 366987 - DNA, 20 bp, human
gggaccggaaggtgtccccg

SEQ ID NO: 366988 - DNA, 20 bp, human
gggggcttctcgattttcga

SEQ ID NO: 366989 - DNA, 20 bp, human
ggaagtagaggaagccttcg

SEQ ID NO: 366990 - DNA, 20 bp, human
gtactggccatggaccgcga

SEQ ID NO: 366991 - DNA, 20 bp, human
gggactttcctgtcgtaaga

SEQ ID NO: 366992 - DNA, 20 bp, human
gaaccctgcctcggaccgga

SEQ ID NO: 366993 - DNA, 20 bp, human
ggggccgcggtagcccacga

SEQ ID NO: 366994 - DNA, 20 bp, human
gtaggatctgaaagcgtccg

SEQ ID NO: 366995 - DNA, 20 bp, human
gacaccttccggtccgaggc

SEQ ID NO: 366996 - DNA, 20 bp, human
gacactcggagtgcgagctg

SEQ ID NO: 366997 - DNA, 20 bp, human
gccacgcgcccgctggaaag

SEQ ID NO: 366998 - DNA, 20 bp, human
ggccccgcgactggcgtctc

SEQ ID NO: 366999 - DNA, 20 bp, human
gtaggggcacccctttccag

SEQ ID NO: 367000 - DNA, 20 bp, human
ggagcctggaggccgaaggt

SEQ ID NO: 367001 - DNA, 20 bp, human
ggtcccggagaactgctcct

SEQ ID NO: 367002 - DNA, 20 bp, human
ggcgagctgcggctggggta

SEQ ID NO: 367003 - DNA, 20 bp, human
gtttcggaggagaatacact

SEQ ID NO: 367004 - DNA, 20 bp, human
gcagggctaaccacatcccc

SEQ ID NO: 367005 - DNA, 20 bp, human
gcctctgacgcaacgggtcc

SEQ ID NO: 367006 - DNA, 20 bp, human
gtacctggcagggagtcaag

SEQ ID NO: 367007 - DNA, 20 bp, human
ggagtcaagcggcatcaggc

SEQ ID NO: 367008 - DNA, 20 bp, human
gtgaggcagcaagttaactt

SEQ ID NO: 367009 - DNA, 20 bp, human
ggtgtcaggacaccccggat

SEQ ID NO: 367010 - DNA, 20 bp, human
gtgcttaggaagtacctggc

SEQ ID NO: 367011 - DNA, 20 bp, human
gttgctgcctcatctggtgg

SEQ ID NO: 367012 - DNA, 20 bp, human
gcagggagtcaagcggcatc

SEQ ID NO: 367013 - DNA, 20 bp, human
ggggacctcagcatgtcctt

SEQ ID NO: 367014 - DNA, 20 bp, human
gggagaagcccggagtctcc

SEQ ID NO: 367015 - DNA, 20 bp, human
gaacttgctgcctcatctgg

SEQ ID NO: 367016 - DNA, 20 bp, human
ggggaccccaacacggtctc

SEQ ID NO: 367017 - DNA, 20 bp, human
gagggagccaggttgcaagt

SEQ ID NO: 367018 - DNA, 20 bp, human
gtggaagaagcggccctaat

SEQ ID NO: 367019 - DNA, 20 bp, human
gagcaggcccacttgcaacc

SEQ ID NO: 367020 - DNA, 20 bp, human
ggccctaataggcctggaag

SEQ ID NO: 367021 - DNA, 20 bp, human
gaacacggtctcagggatac

SEQ ID NO: 367022 - DNA, 20 bp, human
gcagggtggggaccccaaca

SEQ ID NO: 367023 - DNA, 20 bp, human
gagggaaataatcacatagg

SEQ ID NO: 367024 - DNA, 20 bp, human
ggggagggaaataatcacat

SEQ ID NO: 367025 - DNA, 20 bp, human
gcagagtccagggtcggagt

SEQ ID NO: 367026 - DNA, 20 bp, human
gccacctctgcataagtctt

SEQ ID NO: 367027 - DNA, 20 bp, human
ggagcctgccctcaatgtag

SEQ ID NO: 367028 - DNA, 20 bp, human
gcctgccctcaatgtagagg

SEQ ID NO: 367029 - DNA, 20 bp, human
gtccacctccagaggctcaa

SEQ ID NO: 367030 - DNA, 20 bp, human
gggcagcttgggtggggcat

SEQ ID NO: 367031 - DNA, 20 bp, human
gtacccagtgcctagtccag

SEQ ID NO: 367032 - DNA, 20 bp, human
gcataaaactaaccaatggc

SEQ ID NO: 367033 - DNA, 20 bp, human
gcattacccaccactggact

SEQ ID NO: 367034 - DNA, 20 bp, human
gagtggtgggtaatgcttac

SEQ ID NO: 367035 - DNA, 20 bp, human
gcagtgcctagtccagtggt

SEQ ID NO: 367036 - DNA, 20 bp, human
gcctggggagaaaactcttg

SEQ ID NO: 367037 - DNA, 20 bp, human
gagagaggcgggcgggttgg

SEQ ID NO: 367038 - DNA, 20 bp, human
gtctccccaggagtgcaaat

SEQ ID NO: 367039 - DNA, 20 bp, human
gactagggctgacacctggt

SEQ ID NO: 367040 - DNA, 20 bp, human
gataatctcctgaatgacta

SEQ ID NO: 367041 - DNA, 20 bp, human
gaatgactagggctgacacc

SEQ ID NO: 367042 - DNA, 20 bp, human
ggcaaataggatgccaaaaa

SEQ ID NO: 367043 - DNA, 20 bp, human
gaaggaaaagattaataagg

SEQ ID NO: 367044 - DNA, 20 bp, human
gaaaagattaataaggtggg

SEQ ID NO: 367045 - DNA, 20 bp, human
gagtctttaacaccacccac

SEQ ID NO: 367046 - DNA, 20 bp, human
gccgcctggtcgtgttattg

SEQ ID NO: 367047 - DNA, 20 bp, human
ggctgtctgtccatcgtgtg

SEQ ID NO: 367048 - DNA, 20 bp, human
gagtcgccgcggggtggcag

SEQ ID NO: 367049 - DNA, 20 bp, human
gccgagcccctgcgccccca

SEQ ID NO: 367050 - DNA, 20 bp, human
gtgagcagcgggtgtgtaaa

SEQ ID NO: 367051 - DNA, 20 bp, human
gcagggcggggcgagctcag

SEQ ID NO: 367052 - DNA, 20 bp, human
gtcggggccggtctgagcag

SEQ ID NO: 367053 - DNA, 20 bp, human
gccatcgtgtggggtacatg

SEQ ID NO: 367054 - DNA, 20 bp, human
gggagtgggccgtggagcgt

SEQ ID NO: 367055 - DNA, 20 bp, human
gtggacagacagccttggtg

SEQ ID NO: 367056 - DNA, 20 bp, human
ggacggggttaggggcccaa

SEQ ID NO: 367057 - DNA, 20 bp, human
gagggcccctcccactgagt

SEQ ID NO: 367058 - DNA, 20 bp, human
gagaccagagccgactcagt

SEQ ID NO: 367059 - DNA, 20 bp, human
gcagctgcgtccagtcctcg

SEQ ID NO: 367060 - DNA, 20 bp, human
gcgccagtcccaggcccgaa

SEQ ID NO: 367061 - DNA, 20 bp, human
gggcacccgaggctccggaa

SEQ ID NO: 367062 - DNA, 20 bp, human
gtcagtgggaggggcccttc

SEQ ID NO: 367063 - DNA, 20 bp, human
gagagccgactcagtgggag

SEQ ID NO: 367064 - DNA, 20 bp, human
gctcgggtgcccaaaggcgc

SEQ ID NO: 367065 - DNA, 20 bp, human
gtctcagggaggcgacccag

SEQ ID NO: 367066 - DNA, 20 bp, human
ggggtcccggatccctgcgg

SEQ ID NO: 367067 - DNA, 20 bp, human
gcgcctcagggactcgactc

SEQ ID NO: 367068 - DNA, 20 bp, human
gccccccgtcctctccgcgg

SEQ ID NO: 367069 - DNA, 20 bp, human
gatccctgcggcggagggga

SEQ ID NO: 367070 - DNA, 20 bp, human
ggggacccgcccccgcggag

SEQ ID NO: 367071 - DNA, 20 bp, human
gagccagagtcgagtccctg

SEQ ID NO: 367072 - DNA, 20 bp, human
gcgccctgcaccggaatctg

SEQ ID NO: 367073 - DNA, 20 bp, human
gccccgccgagagctctgta

SEQ ID NO: 367074 - DNA, 20 bp, human
gttccgcaggcccctaggtg

SEQ ID NO: 367075 - DNA, 20 bp, human
gggacctgggctccgccccg

SEQ ID NO: 367076 - DNA, 20 bp, human
ggcgccggggctcccccttc

SEQ ID NO: 367077 - DNA, 20 bp, human
gtgggcagtgcgtttaagac

SEQ ID NO: 367078 - DNA, 20 bp, human
gtagaagcggcctttggaga

SEQ ID NO: 367079 - DNA, 20 bp, human
gtggctgaggtcaagtgtga

SEQ ID NO: 367080 - DNA, 20 bp, human
ggcgcgccggcagaagacaa

SEQ ID NO: 367081 - DNA, 20 bp, human
gtttgcaaacggggaagcgg

SEQ ID NO: 367082 - DNA, 20 bp, human
gctgccaagcccagtggtcc

SEQ ID NO: 367083 - DNA, 20 bp, human
gggtctgagacagtggggtc

SEQ ID NO: 367084 - DNA, 20 bp, human
ggcactgcccatgcttgcga

SEQ ID NO: 367085 - DNA, 20 bp, human
ggcgtgctgccgcgaggggc

SEQ ID NO: 367086 - DNA, 20 bp, human
gagggagagaggaggtagaa

SEQ ID NO: 367087 - DNA, 20 bp, human
gggaggagagaggagcgaga

SEQ ID NO: 367088 - DNA, 20 bp, human
ggggaaagagaggaggaatg

SEQ ID NO: 367089 - DNA, 20 bp, human
gagaggaggagtggggagaa

SEQ ID NO: 367090 - DNA, 20 bp, human
gaggggaagagaggaggagt

SEQ ID NO: 367091 - DNA, 20 bp, human
ggagagcaggaggagggtaa

SEQ ID NO: 367092 - DNA, 20 bp, human
gagcaggaggagggtaatgg

SEQ ID NO: 367093 - DNA, 20 bp, human
ggggtaatggaggactttgg

SEQ ID NO: 367094 - DNA, 20 bp, human
gaatggaggactttggagga

SEQ ID NO: 367095 - DNA, 20 bp, human
gggagggtaatggaggactt

SEQ ID NO: 367096 - DNA, 20 bp, human
ggcagagcgccgcccaggac

SEQ ID NO: 367097 - DNA, 20 bp, human
gtggcgacgccggtgtgtca

SEQ ID NO: 367098 - DNA, 20 bp, human
gcctcgctcaggctgccgat

SEQ ID NO: 367099 - DNA, 20 bp, human
gagcgaggcagtggttaggg

SEQ ID NO: 367100 - DNA, 20 bp, human
gggcagcctgagcgaggcag

SEQ ID NO: 367101 - DNA, 20 bp, human
gtgggcggcgctctgcgggg

SEQ ID NO: 367102 - DNA, 20 bp, human
ggcagagagaacgagccgat

SEQ ID NO: 367103 - DNA, 20 bp, human
gttgctagagaaggccgcgg

SEQ ID NO: 367104 - DNA, 20 bp, human
gcctgagcgaggcagtggtt

SEQ ID NO: 367105 - DNA, 20 bp, human
ggggtgacttcggtgcacta

SEQ ID NO: 367106 - DNA, 20 bp, human
gaggcctggaggcgggacgg

SEQ ID NO: 367107 - DNA, 20 bp, human
ggggagcccaggaccgcccc

SEQ ID NO: 367108 - DNA, 20 bp, human
ggggaggactaccaacgaag

SEQ ID NO: 367109 - DNA, 20 bp, human
gactaccaacgaaggggacc

SEQ ID NO: 367110 - DNA, 20 bp, human
gtggctggccgacgtggcgt

SEQ ID NO: 367111 - DNA, 20 bp, human
gcccaagcgtggagtgaatg

SEQ ID NO: 367112 - DNA, 20 bp, human
gctggccgacgtggcgttgg

SEQ ID NO: 367113 - DNA, 20 bp, human
gcgtgtggggtcttctacca

SEQ ID NO: 367114 - DNA, 20 bp, human
gggccggaaagtttgtccgg

SEQ ID NO: 367115 - DNA, 20 bp, human
gaccagcaagccatcctccc

SEQ ID NO: 367116 - DNA, 20 bp, human
ggccctccgcgacactctag

SEQ ID NO: 367117 - DNA, 20 bp, human
gagccgctagagtgtcgcgg

SEQ ID NO: 367118 - DNA, 20 bp, human
gaggcctgagactcaagctc

SEQ ID NO: 367119 - DNA, 20 bp, human
gttcgcgcaacgctaaacga

SEQ ID NO: 367120 - DNA, 20 bp, human
gagagcggccgcaccagctg

SEQ ID NO: 367121 - DNA, 20 bp, human
gtaaacgatggccgggacta

SEQ ID NO: 367122 - DNA, 20 bp, human
gcagagccgctagagtgtcg

SEQ ID NO: 367123 - DNA, 20 bp, human
gcgcaacgctaaacgatggc

SEQ ID NO: 367124 - DNA, 20 bp, human
ggacgcaggtgagctcccag

SEQ ID NO: 367125 - DNA, 20 bp, human
gcgcgaaccctcagctggtg

SEQ ID NO: 367126 - DNA, 20 bp, human
ggatgcagagttggaagcaa

SEQ ID NO: 367127 - DNA, 20 bp, human
gattccaagcagcctatcac

SEQ ID NO: 367128 - DNA, 20 bp, human
gggaactcagacggagtgtt

SEQ ID NO: 367129 - DNA, 20 bp, human
gacagcctgtgtcaccgaaa

SEQ ID NO: 367130 - DNA, 20 bp, human
gcaagcagcctatcacaggc

SEQ ID NO: 367131 - DNA, 20 bp, human
gtatgcaaagacataccaga

SEQ ID NO: 367132 - DNA, 20 bp, human
gttgcccttttcggtgacac

SEQ ID NO: 367133 - DNA, 20 bp, human
ggcagcctatcacaggcagg

SEQ ID NO: 367134 - DNA, 20 bp, human
ggcctatcacaggcaggggg

SEQ ID NO: 367135 - DNA, 20 bp, human
gagtgtttggccattagcta

SEQ ID NO: 367136 - DNA, 20 bp, human
gtgggtgcgacctctgacct

SEQ ID NO: 367137 - DNA, 20 bp, human
gctaaaccccgccctcccgg

SEQ ID NO: 367138 - DNA, 20 bp, human
ggaggtcgcacccaccggga

SEQ ID NO: 367139 - DNA, 20 bp, human
gagggcggggtttaggggtc

SEQ ID NO: 367140 - DNA, 20 bp, human
gcctggccccgcccaaggag

SEQ ID NO: 367141 - DNA, 20 bp, human
gacctaggctccctcattta

SEQ ID NO: 367142 - DNA, 20 bp, human
gatgagggagcctaggtcag

SEQ ID NO: 367143 - DNA, 20 bp, human
gtccaccgctgcagctcgga

SEQ ID NO: 367144 - DNA, 20 bp, human
ggtcagaggtcgcacccacc

SEQ ID NO: 367145 - DNA, 20 bp, human
ggccctaaatgagggagcct

SEQ ID NO: 367146 - DNA, 20 bp, human
gaggtgggcgaataactctg

SEQ ID NO: 367147 - DNA, 20 bp, human
gtaagagtttactttctgtt

SEQ ID NO: 367148 - DNA, 20 bp, human
gggcgaataactctgaggtc

SEQ ID NO: 367149 - DNA, 20 bp, human
ggccaggtttcttgaatgtt

SEQ ID NO: 367150 - DNA, 20 bp, human
ggttaggtttgggaatagaa

SEQ ID NO: 367151 - DNA, 20 bp, human
gacctaacattcaagaaacc

SEQ ID NO: 367152 - DNA, 20 bp, human
gctgctcccagtgcagaccc

SEQ ID NO: 367153 - DNA, 20 bp, human
gtctgctcctgggtctgcac

SEQ ID NO: 367154 - DNA, 20 bp, human
gtactttctgtttgggaaat

SEQ ID NO: 367155 - DNA, 20 bp, human
gtttcttgaatgttaggttt

SEQ ID NO: 367156 - DNA, 20 bp, human
ggcggcagctgaatattgat

SEQ ID NO: 367157 - DNA, 20 bp, human
gccgctgagaagattagact

SEQ ID NO: 367158 - DNA, 20 bp, human
gagattagacttggactctc

SEQ ID NO: 367159 - DNA, 20 bp, human
ggctttgcctcagcaacctg

SEQ ID NO: 367160 - DNA, 20 bp, human
gagacttggactctcaggtc

SEQ ID NO: 367161 - DNA, 20 bp, human
gacaaaggtattgaagccac

SEQ ID NO: 367162 - DNA, 20 bp, human
gttctttcctagtggaacaa

SEQ ID NO: 367163 - DNA, 20 bp, human
gcagaggcaatcacatttca

SEQ ID NO: 367164 - DNA, 20 bp, human
gccacagcactaattatctg

SEQ ID NO: 367165 - DNA, 20 bp, human
ggagctgcgaataaacaggc

SEQ ID NO: 367166 - DNA, 20 bp, human
gtctagctgctattagaaga

SEQ ID NO: 367167 - DNA, 20 bp, human
ggatgtggttttaagagagg

SEQ ID NO: 367168 - DNA, 20 bp, human
ggggagggcgttattgtctg

SEQ ID NO: 367169 - DNA, 20 bp, human
ggctgctattagaagaggga

SEQ ID NO: 367170 - DNA, 20 bp, human
ggatcacaagattgcttcag

SEQ ID NO: 367171 - DNA, 20 bp, human
gaagcaatcttgtgatctct

SEQ ID NO: 367172 - DNA, 20 bp, human
gtatgctctcgcatctgctt

SEQ ID NO: 367173 - DNA, 20 bp, human
gcgttattgtctgtggggcg

SEQ ID NO: 367174 - DNA, 20 bp, human
gcaaagggtggagcctgaaa

SEQ ID NO: 367175 - DNA, 20 bp, human
gagattgcttcaggggggtg

SEQ ID NO: 367176 - DNA, 20 bp, human
gcggaggggcgtggcctcat

SEQ ID NO: 367177 - DNA, 20 bp, human
gccgcctggggtttagagtt

SEQ ID NO: 367178 - DNA, 20 bp, human
ggtctcgccagccacgcgga

SEQ ID NO: 367179 - DNA, 20 bp, human
gttggtggggcgggccaatg

SEQ ID NO: 367180 - DNA, 20 bp, human
ggggcggagtcctaacacgt

SEQ ID NO: 367181 - DNA, 20 bp, human
gttcccgccagcctccgact

SEQ ID NO: 367182 - DNA, 20 bp, human
gcggagggggcgtggccttc

SEQ ID NO: 367183 - DNA, 20 bp, human
ggcccgggatcctagctggt

SEQ ID NO: 367184 - DNA, 20 bp, human
gggcggggccttttgttcca

SEQ ID NO: 367185 - DNA, 20 bp, human
ggtgaagggcgtggcccgcg

SEQ ID NO: 367186 - DNA, 20 bp, human
gagcgcgggagcgacccgga

SEQ ID NO: 367187 - DNA, 20 bp, human
gccaatgcgcgcgccgggac

SEQ ID NO: 367188 - DNA, 20 bp, human
gcgagcgcgcccgtggggaa

SEQ ID NO: 367189 - DNA, 20 bp, human
gccggcccggcacagctccg

SEQ ID NO: 367190 - DNA, 20 bp, human
gtcccgcgctggcctaggga

SEQ ID NO: 367191 - DNA, 20 bp, human
ggcctcgaagcgctggccgg

SEQ ID NO: 367192 - DNA, 20 bp, human
gggccagcgcgggagcgacc

SEQ ID NO: 367193 - DNA, 20 bp, human
gcgggcggcggccggatcca

SEQ ID NO: 367194 - DNA, 20 bp, human
ggggccgggcagcctccggg

SEQ ID NO: 367195 - DNA, 20 bp, human
ggcggcgtccacaccgcagg

SEQ ID NO: 367196 - DNA, 20 bp, human
gagtaagtgggtgccccctg

SEQ ID NO: 367197 - DNA, 20 bp, human
gaatctgagggcaacagatt

SEQ ID NO: 367198 - DNA, 20 bp, human
ggtcctgatggaacagtcta

SEQ ID NO: 367199 - DNA, 20 bp, human
gaggcccagcattgtcctga

SEQ ID NO: 367200 - DNA, 20 bp, human
gtacctggtgtcatgtaggg

SEQ ID NO: 367201 - DNA, 20 bp, human
ggttccatcaggacaatgct

SEQ ID NO: 367202 - DNA, 20 bp, human
ggctaaagtctctaccagtc

SEQ ID NO: 367203 - DNA, 20 bp, human
gcaggctcatggtgaatgac

SEQ ID NO: 367204 - DNA, 20 bp, human
gaaatgaaacgtctggggtt

SEQ ID NO: 367205 - DNA, 20 bp, human
gcatgacaccaggtaatctg

SEQ ID NO: 367206 - DNA, 20 bp, human
gcgtactcgctcccgcgggg

SEQ ID NO: 367207 - DNA, 20 bp, human
ggggacccccatcctgtctt

SEQ ID NO: 367208 - DNA, 20 bp, human
ggcaccgcgtgcgcccccga

SEQ ID NO: 367209 - DNA, 20 bp, human
ggccccggacgatccagcag

SEQ ID NO: 367210 - DNA, 20 bp, human
ggcccctgctggatcgtccg

SEQ ID NO: 367211 - DNA, 20 bp, human
ggacacgccggccaatgggg

SEQ ID NO: 367212 - DNA, 20 bp, human
gcggccctgcagagacacgc

SEQ ID NO: 367213 - DNA, 20 bp, human
gtggccggcgtgtctctgca

SEQ ID NO: 367214 - DNA, 20 bp, human
gccacagccaatagcggcca

SEQ ID NO: 367215 - DNA, 20 bp, human
gcggccaatggggcggccgc

SEQ ID NO: 367216 - DNA, 20 bp, human
gctagggagctttcggcttg

SEQ ID NO: 367217 - DNA, 20 bp, human
gaagctccctagttgcacca

SEQ ID NO: 367218 - DNA, 20 bp, human
ggactttcagagacccagtg

SEQ ID NO: 367219 - DNA, 20 bp, human
gtctctccttggtgcaacta

SEQ ID NO: 367220 - DNA, 20 bp, human
gagaccggctgtttctcccc

SEQ ID NO: 367221 - DNA, 20 bp, human
ggcagggtccagagagcaaa

SEQ ID NO: 367222 - DNA, 20 bp, human
gtccaggtcacagcctcact

SEQ ID NO: 367223 - DNA, 20 bp, human
gtccaaggagaatttgctcc

SEQ ID NO: 367224 - DNA, 20 bp, human
ggctcctggggaaagtcagc

SEQ ID NO: 367225 - DNA, 20 bp, human
gaaaaaacattgcctgacat

SEQ ID NO: 367226 - DNA, 20 bp, human
gcgcgctggaaccgccccta

SEQ ID NO: 367227 - DNA, 20 bp, human
ggcggtccaaggtacaggtg

SEQ ID NO: 367228 - DNA, 20 bp, human
ggcggagcggtccaaggtac

SEQ ID NO: 367229 - DNA, 20 bp, human
ggaccgctccgccctagggg

SEQ ID NO: 367230 - DNA, 20 bp, human
ggggagaacaaccacccaat

SEQ ID NO: 367231 - DNA, 20 bp, human
gtggggcggagtttccgtct

SEQ ID NO: 367232 - DNA, 20 bp, human
gcacattaaagcagaccaat

SEQ ID NO: 367233 - DNA, 20 bp, human
ggtccaaggtacaggtgggg

SEQ ID NO: 367234 - DNA, 20 bp, human
ggtagtgcgagcccatagac

SEQ ID NO: 367235 - DNA, 20 bp, human
gcggggctagcgaatcagct

SEQ ID NO: 367236 - DNA, 20 bp, human
ggggaggtatcctaggttaa

SEQ ID NO: 367237 - DNA, 20 bp, human
gctctccaggattgccaccc

SEQ ID NO: 367238 - DNA, 20 bp, human
ggggtgactgccattaacct

SEQ ID NO: 367239 - DNA, 20 bp, human
gtggtaacaaagcctggagc

SEQ ID NO: 367240 - DNA, 20 bp, human
gcaggggcagagctgtatgc

SEQ ID NO: 367241 - DNA, 20 bp, human
gcattctgttccaagcatta

SEQ ID NO: 367242 - DNA, 20 bp, human
gaggatacctccctaatgct

SEQ ID NO: 367243 - DNA, 20 bp, human
gtctgttccaagcattaggg

SEQ ID NO: 367244 - DNA, 20 bp, human
gcatgcctgaacaggcaacg

SEQ ID NO: 367245 - DNA, 20 bp, human
ggcaatgaaacagtccaaaa

SEQ ID NO: 367246 - DNA, 20 bp, human
gacgccgaggctgtcgtgag

SEQ ID NO: 367247 - DNA, 20 bp, human
ggcccggcacgcttccccat

SEQ ID NO: 367248 - DNA, 20 bp, human
gaccaatggggaagcgtgcc

SEQ ID NO: 367249 - DNA, 20 bp, human
ggaccccctcacgacagcct

SEQ ID NO: 367250 - DNA, 20 bp, human
ggcccagccacgctcactat

SEQ ID NO: 367251 - DNA, 20 bp, human
gcgggtccgtgtgaaaacgg

SEQ ID NO: 367252 - DNA, 20 bp, human
ggagggggtcctgaccaatg

SEQ ID NO: 367253 - DNA, 20 bp, human
ggtcgcggctccaacagata

SEQ ID NO: 367254 - DNA, 20 bp, human
gaggccccgcccctatctgt

SEQ ID NO: 367255 - DNA, 20 bp, human
gtattggatggagcctcgga

SEQ ID NO: 367256 - DNA, 20 bp, human
ggtcccacaaagagagacat

SEQ ID NO: 367257 - DNA, 20 bp, human
gagccgatgtctctctttgt

SEQ ID NO: 367258 - DNA, 20 bp, human
gagtcaggcccaggccgcga

SEQ ID NO: 367259 - DNA, 20 bp, human
gaaagagagacatcggctcg

SEQ ID NO: 367260 - DNA, 20 bp, human
ggcagagaggggcgctgcgg

SEQ ID NO: 367261 - DNA, 20 bp, human
ggggacaggactgtgcagag

SEQ ID NO: 367262 - DNA, 20 bp, human
gttcccctccctcgcggcct

SEQ ID NO: 367263 - DNA, 20 bp, human
ggtgaatcccacctctgcat

SEQ ID NO: 367264 - DNA, 20 bp, human
gcaggagaagcggggtgtct

SEQ ID NO: 367265 - DNA, 20 bp, human
gggaggagagggggcgtgtc

SEQ ID NO: 367266 - DNA, 20 bp, human
gcctgcgcccatggggcccg

SEQ ID NO: 367267 - DNA, 20 bp, human
gtgggctccgcgggccccat

SEQ ID NO: 367268 - DNA, 20 bp, human
gcacctgtgcctgcgcccat

SEQ ID NO: 367269 - DNA, 20 bp, human
gaaggctggcaaacttctcg

SEQ ID NO: 367270 - DNA, 20 bp, human
ggccccatgggcgcaggcac

SEQ ID NO: 367271 - DNA, 20 bp, human
gggtcccgacggcaggaatg

SEQ ID NO: 367272 - DNA, 20 bp, human
gtgcaaaagcccgcggggaa

SEQ ID NO: 367273 - DNA, 20 bp, human
gtcgccggctgcaaaaggcc

SEQ ID NO: 367274 - DNA, 20 bp, human
ggcccgcggagcccacctgc

SEQ ID NO: 367275 - DNA, 20 bp, human
ggcgcaccccgcgcgggaga

SEQ ID NO: 367276 - DNA, 20 bp, human
ggctctggcgcggggaaatg

SEQ ID NO: 367277 - DNA, 20 bp, human
gcgctcccgggctctggcgc

SEQ ID NO: 367278 - DNA, 20 bp, human
ggagcctggaggcggagctt

SEQ ID NO: 367279 - DNA, 20 bp, human
gctagctcgcctgggggacg

SEQ ID NO: 367280 - DNA, 20 bp, human
ggtgacacagggagattcca

SEQ ID NO: 367281 - DNA, 20 bp, human
gtgggggcggggcttaaggg

SEQ ID NO: 367282 - DNA, 20 bp, human
gagtggtggtcgttgggcga

SEQ ID NO: 367283 - DNA, 20 bp, human
ggcacagagtggtggtcgtt

SEQ ID NO: 367284 - DNA, 20 bp, human
gggcagcgggatctgcagtt

SEQ ID NO: 367285 - DNA, 20 bp, human
gaatggggctttggcagtgg

SEQ ID NO: 367286 - DNA, 20 bp, human
gtggcccccaatccagcctc

SEQ ID NO: 367287 - DNA, 20 bp, human
ggggaggcaagtgcggtcgg

SEQ ID NO: 367288 - DNA, 20 bp, human
gtggccagtgagtgacccct

SEQ ID NO: 367289 - DNA, 20 bp, human
gctggggcgcccgcgatggg

SEQ ID NO: 367290 - DNA, 20 bp, human
ggggctggggcgcccgcgat

SEQ ID NO: 367291 - DNA, 20 bp, human
gcaactgaggggactttggg

SEQ ID NO: 367292 - DNA, 20 bp, human
gtctcgccccgaggctggat

SEQ ID NO: 367293 - DNA, 20 bp, human
gcggtcggagggtcacgccg

SEQ ID NO: 367294 - DNA, 20 bp, human
gtccaccgaaagtgtgtctc

SEQ ID NO: 367295 - DNA, 20 bp, human
gggtcggcgcgaggacacgc

SEQ ID NO: 367296 - DNA, 20 bp, human
gcagggagcgccacccggag

SEQ ID NO: 367297 - DNA, 20 bp, human
gacccggagaggctgatagg

SEQ ID NO: 367298 - DNA, 20 bp, human
ggggaggagcctaagggacg

SEQ ID NO: 367299 - DNA, 20 bp, human
ggagcctaagggacgaggaa

SEQ ID NO: 367300 - DNA, 20 bp, human
gcaatgcgacacaacgtggc

SEQ ID NO: 367301 - DNA, 20 bp, human
gtagggacaggtaagtgcac

SEQ ID NO: 367302 - DNA, 20 bp, human
gtcgcctttcctcgtccctt

SEQ ID NO: 367303 - DNA, 20 bp, human
gtgcgacacaacgtggcggg

SEQ ID NO: 367304 - DNA, 20 bp, human
ggcaaggctgggcactcccc

SEQ ID NO: 367305 - DNA, 20 bp, human
gagtacagcggattcctgta

SEQ ID NO: 367306 - DNA, 20 bp, human
gcggctgtccctgcactccg

SEQ ID NO: 367307 - DNA, 20 bp, human
gctgtccctgcactccgtgg

SEQ ID NO: 367308 - DNA, 20 bp, human
gtggcggaaggcggctagag

SEQ ID NO: 367309 - DNA, 20 bp, human
gagctctccgagagattggt

SEQ ID NO: 367310 - DNA, 20 bp, human
gtgcagggacagccgggaag

SEQ ID NO: 367311 - DNA, 20 bp, human
gacctgaagcgttgaggtta

SEQ ID NO: 367312 - DNA, 20 bp, human
gcaggtcccgaccaatctct

SEQ ID NO: 367313 - DNA, 20 bp, human
gtgcactccgtggcggaagg

SEQ ID NO: 367314 - DNA, 20 bp, human
gtggggcaccagtgggcgat

SEQ ID NO: 367315 - DNA, 20 bp, human
gcccttaacctcaacgcttc

SEQ ID NO: 367316 - DNA, 20 bp, human
gaggaggtggcaactaccag

SEQ ID NO: 367317 - DNA, 20 bp, human
gagggcgtggcttgcggcgg

SEQ ID NO: 367318 - DNA, 20 bp, human
ggggccgcgcaacgcgtcct

SEQ ID NO: 367319 - DNA, 20 bp, human
gagaaaggtgctggagctgt

SEQ ID NO: 367320 - DNA, 20 bp, human
ggcgcaacgcgtcctgggac

SEQ ID NO: 367321 - DNA, 20 bp, human
gacgcgtcctgggacaggaa

SEQ ID NO: 367322 - DNA, 20 bp, human
gaatcctgccacccggactc

SEQ ID NO: 367323 - DNA, 20 bp, human
gaggtggcgacctgcagact

SEQ ID NO: 367324 - DNA, 20 bp, human
gcggagggcgtggcttgcgg

SEQ ID NO: 367325 - DNA, 20 bp, human
gcggccccggacaagcgctg

SEQ ID NO: 367326 - DNA, 20 bp, human
gtctcccaggagcaactcag

SEQ ID NO: 367327 - DNA, 20 bp, human
gtgaccttcggagcacacgt

SEQ ID NO: 367328 - DNA, 20 bp, human
gtctctcctaggaccatttt

SEQ ID NO: 367329 - DNA, 20 bp, human
gtcacccacgtgtgctccga

SEQ ID NO: 367330 - DNA, 20 bp, human
gctattgaaagggaggacaa

SEQ ID NO: 367331 - DNA, 20 bp, human
gcacccaaggaaaccctatc

SEQ ID NO: 367332 - DNA, 20 bp, human
gggaactggcatgcctgata

SEQ ID NO: 367333 - DNA, 20 bp, human
gcagcctaaaattatttctt

SEQ ID NO: 367334 - DNA, 20 bp, human
ggctacaaattgctgatgta

SEQ ID NO: 367335 - DNA, 20 bp, human
ggaagcctctgagttgctcc

SEQ ID NO: 367336 - DNA, 20 bp, human
gggacccagactcccaaagt

SEQ ID NO: 367337 - DNA, 20 bp, human
gaacacgttgagcaccaata

SEQ ID NO: 367338 - DNA, 20 bp, human
gggaaggaaggcctccctat

SEQ ID NO: 367339 - DNA, 20 bp, human
gggagtctgggtccccggga

SEQ ID NO: 367340 - DNA, 20 bp, human
gtgcctgggtgacccggaaa

SEQ ID NO: 367341 - DNA, 20 bp, human
gacgcctgccgtggaggtag

SEQ ID NO: 367342 - DNA, 20 bp, human
gcaaccaagcgcaaaagtac

SEQ ID NO: 367343 - DNA, 20 bp, human
gtcccaaaggacagctttcc

SEQ ID NO: 367344 - DNA, 20 bp, human
ggtcacttccgctacctcca

SEQ ID NO: 367345 - DNA, 20 bp, human
gtggcaggctctaggtagag

SEQ ID NO: 367346 - DNA, 20 bp, human
gtggggcaaaggcaaatgag

SEQ ID NO: 367347 - DNA, 20 bp, human
gcgaactccagcacggtctc

SEQ ID NO: 367348 - DNA, 20 bp, human
ggcaaatgagaggctcgcgc

SEQ ID NO: 367349 - DNA, 20 bp, human
gacgagcgccgagtgacgtc

SEQ ID NO: 367350 - DNA, 20 bp, human
gactgggctctggagaaggt

SEQ ID NO: 367351 - DNA, 20 bp, human
gtaccgaccaatccctgcaa

SEQ ID NO: 367352 - DNA, 20 bp, human
gtctggaccgaaagtagact

SEQ ID NO: 367353 - DNA, 20 bp, human
gggagaggcctgacgtcact

SEQ ID NO: 367354 - DNA, 20 bp, human
gccgaaagtagactgggctc

SEQ ID NO: 367355 - DNA, 20 bp, human
gacgtcgtaaaatgccgcgg

SEQ ID NO: 367356 - DNA, 20 bp, human
gcgcccgaggacgccgaagt

SEQ ID NO: 367357 - DNA, 20 bp, human
gaacctggggcgaggcgcct

SEQ ID NO: 367358 - DNA, 20 bp, human
gcctcagcccttgggaacct

SEQ ID NO: 367359 - DNA, 20 bp, human
gacgccaagcctcagccctt

SEQ ID NO: 367360 - DNA, 20 bp, human
gcgcgggcgcctgggagttg

SEQ ID NO: 367361 - DNA, 20 bp, human
gccgaagtagggcgcgtgtg

SEQ ID NO: 367362 - DNA, 20 bp, human
ggccctacttcggcgtcctc

SEQ ID NO: 367363 - DNA, 20 bp, human
gggctgaggcttggcgttcc

SEQ ID NO: 367364 - DNA, 20 bp, human
gcccttgggaacctggggcg

SEQ ID NO: 367365 - DNA, 20 bp, human
gaggcgcctgggtctcggcc

SEQ ID NO: 367366 - DNA, 20 bp, human
gaggaaatacccggaggcag

SEQ ID NO: 367367 - DNA, 20 bp, human
gggagggagcgcgtgaaaga

SEQ ID NO: 367368 - DNA, 20 bp, human
gcccggaggcaggggacgtg

SEQ ID NO: 367369 - DNA, 20 bp, human
gggagagaggaaatacccgg

SEQ ID NO: 367370 - DNA, 20 bp, human
gcctcggaatcaggcggtgc

SEQ ID NO: 367371 - DNA, 20 bp, human
gccgaggggcgggagcgcat

SEQ ID NO: 367372 - DNA, 20 bp, human
gcccgcccctcggaatcagg

SEQ ID NO: 367373 - DNA, 20 bp, human
gaagaagggcgcccttggga

SEQ ID NO: 367374 - DNA, 20 bp, human
ggccccagatcctctggcta

SEQ ID NO: 367375 - DNA, 20 bp, human
gccttgggaaggaggcggga

SEQ ID NO: 367376 - DNA, 20 bp, human
gttggctgccggaaccttcg

SEQ ID NO: 367377 - DNA, 20 bp, human
gcggggcgccgcccaaactc

SEQ ID NO: 367378 - DNA, 20 bp, human
gttccggcagccaagattgc

SEQ ID NO: 367379 - DNA, 20 bp, human
ggctgccggaaccttcgggg

SEQ ID NO: 367380 - DNA, 20 bp, human
gcgccacagtcgctgtcaca

SEQ ID NO: 367381 - DNA, 20 bp, human
gtaatcctccccgaaggttc

SEQ ID NO: 367382 - DNA, 20 bp, human
gcctccagagcaagccaatc

SEQ ID NO: 367383 - DNA, 20 bp, human
gaatcagggacacgctctcg

SEQ ID NO: 367384 - DNA, 20 bp, human
gaagggacctgttagagact

SEQ ID NO: 367385 - DNA, 20 bp, human
gccggcgcaccgtgcggccg

SEQ ID NO: 367386 - DNA, 20 bp, human
gtaactgggaggaatctcag

SEQ ID NO: 367387 - DNA, 20 bp, human
gtgtctgggtcgtggttgat

SEQ ID NO: 367388 - DNA, 20 bp, human
gtcaggggtgaggttaattg

SEQ ID NO: 367389 - DNA, 20 bp, human
ggggaggaatctcaggggtg

SEQ ID NO: 367390 - DNA, 20 bp, human
ggcatggggaatctatggtc

SEQ ID NO: 367391 - DNA, 20 bp, human
gtggcctgacaggactcccc

SEQ ID NO: 367392 - DNA, 20 bp, human
ggggtcaagggcaaagtccc

SEQ ID NO: 367393 - DNA, 20 bp, human
gctgtcaggccaggaacgag

SEQ ID NO: 367394 - DNA, 20 bp, human
gctgacgattagcaattaac

SEQ ID NO: 367395 - DNA, 20 bp, human
gtgtctgtaagtctcccagg

SEQ ID NO: 367396 - DNA, 20 bp, human
gtctgtggccaaaagagctg

SEQ ID NO: 367397 - DNA, 20 bp, human
ggtcctaaggccagtgtgat

SEQ ID NO: 367398 - DNA, 20 bp, human
gatgtggaagcgagctgcag

SEQ ID NO: 367399 - DNA, 20 bp, human
gccaaggcgggccccggctc

SEQ ID NO: 367400 - DNA, 20 bp, human
gcggctctggtgtccaggtc

SEQ ID NO: 367401 - DNA, 20 bp, human
gtgacagcatgctaccaagg

SEQ ID NO: 367402 - DNA, 20 bp, human
gcctctctggcctggtccta

SEQ ID NO: 367403 - DNA, 20 bp, human
gagagcttcaggtccggacc

SEQ ID NO: 367404 - DNA, 20 bp, human
gtggctctagcctatcacac

SEQ ID NO: 367405 - DNA, 20 bp, human
ggataggctagagccatatg

SEQ ID NO: 367406 - DNA, 20 bp, human
gcagcgggcgaagtcgcgat

SEQ ID NO: 367407 - DNA, 20 bp, human
gcaggtaggcagtgccccgg

SEQ ID NO: 367408 - DNA, 20 bp, human
ggagctgttgggataagcat

SEQ ID NO: 367409 - DNA, 20 bp, human
gtctaggtccgcaatgggaa

SEQ ID NO: 367410 - DNA, 20 bp, human
ggcggtcctggaatgtgcga

SEQ ID NO: 367411 - DNA, 20 bp, human
ggagtgcgcagcagaggaga

SEQ ID NO: 367412 - DNA, 20 bp, human
gcactctcctggttttatag

SEQ ID NO: 367413 - DNA, 20 bp, human
ggcgaggggcgtgatgacag

SEQ ID NO: 367414 - DNA, 20 bp, human
gaaaccagctaattccagta

SEQ ID NO: 367415 - DNA, 20 bp, human
gccttccctggggctaagac

SEQ ID NO: 367416 - DNA, 20 bp, human
gtctccatcctgtcactctg

SEQ ID NO: 367417 - DNA, 20 bp, human
ggccccactccaggagggtt

SEQ ID NO: 367418 - DNA, 20 bp, human
ggggctctgaatcaggccga

SEQ ID NO: 367419 - DNA, 20 bp, human
gtgggtggagtgtgtctctt

SEQ ID NO: 367420 - DNA, 20 bp, human
ggcccaaccctcctggagtg

SEQ ID NO: 367421 - DNA, 20 bp, human
gccccgccccgcagtgccct

SEQ ID NO: 367422 - DNA, 20 bp, human
gtgaggatgcccagtaccga

SEQ ID NO: 367423 - DNA, 20 bp, human
gcaggagggtacccccgtga

SEQ ID NO: 367424 - DNA, 20 bp, human
gtgattcagagcccacccct

SEQ ID NO: 367425 - DNA, 20 bp, human
gggcaccggccctcggtact

SEQ ID NO: 367426 - DNA, 20 bp, human
gcggccgcgtcctaggtgac

SEQ ID NO: 367427 - DNA, 20 bp, human
gtcggccacgcactaaaact

SEQ ID NO: 367428 - DNA, 20 bp, human
ggtgacaggtgtgtgaaatt

SEQ ID NO: 367429 - DNA, 20 bp, human
gtggggagaacgcggatcga

SEQ ID NO: 367430 - DNA, 20 bp, human
ggcctcgccggcctcccggt

SEQ ID NO: 367431 - DNA, 20 bp, human
gccaagctacaccccaaaat

SEQ ID NO: 367432 - DNA, 20 bp, human
gtcggcctagagcgcctcgc

SEQ ID NO: 367433 - DNA, 20 bp, human
gcgcccccgcgcaggacacc

SEQ ID NO: 367434 - DNA, 20 bp, human
ggaccacaaggggcggtccc

SEQ ID NO: 367435 - DNA, 20 bp, human
gtgacaggagtgaatcccca

SEQ ID NO: 367436 - DNA, 20 bp, human
ggggccgatgaagctctgta

SEQ ID NO: 367437 - DNA, 20 bp, human
gagtctaggagacaagatcg

SEQ ID NO: 367438 - DNA, 20 bp, human
gcgggtctagtgacaggaat

SEQ ID NO: 367439 - DNA, 20 bp, human
gacgaacggcaggataaggc

SEQ ID NO: 367440 - DNA, 20 bp, human
gagagccgggatcgtcaggg

SEQ ID NO: 367441 - DNA, 20 bp, human
gcatccctacagagcttcat

SEQ ID NO: 367442 - DNA, 20 bp, human
ggagagcacacgggaatctg

SEQ ID NO: 367443 - DNA, 20 bp, human
ggaagctctgtagggatggt

SEQ ID NO: 367444 - DNA, 20 bp, human
ggaaagcgcgatcagtgaag

SEQ ID NO: 367445 - DNA, 20 bp, human
gacaagatcgggggatgatc

SEQ ID NO: 367446 - DNA, 20 bp, human
gacggtgaagcaggaaccag

SEQ ID NO: 367447 - DNA, 20 bp, human
gtccctaaggcgacgcacct

SEQ ID NO: 367448 - DNA, 20 bp, human
ggctgccaagtgccgagctg

SEQ ID NO: 367449 - DNA, 20 bp, human
gcggaagccggagcatttgg

SEQ ID NO: 367450 - DNA, 20 bp, human
ggccccaggcctccacgcga

SEQ ID NO: 367451 - DNA, 20 bp, human
gcaaacagacagtcccgcag

SEQ ID NO: 367452 - DNA, 20 bp, human
gagcccaggtgcgtcgcctt

SEQ ID NO: 367453 - DNA, 20 bp, human
gatggagtgacactcgtcga

SEQ ID NO: 367454 - DNA, 20 bp, human
ggcagccccagctcggcact

SEQ ID NO: 367455 - DNA, 20 bp, human
gctctggcaaatgccgttcc

SEQ ID NO: 367456 - DNA, 20 bp, human
gtgtgagcgcactcacgacc

SEQ ID NO: 367457 - DNA, 20 bp, human
gcctgagactcgacgggagg

SEQ ID NO: 367458 - DNA, 20 bp, human
gcaggggtggtgcgtgtaaa

SEQ ID NO: 367459 - DNA, 20 bp, human
ggggacacggggcgggacac

SEQ ID NO: 367460 - DNA, 20 bp, human
gtatctgagagaggcgtact

SEQ ID NO: 367461 - DNA, 20 bp, human
gcagcctgagactcgacggg

SEQ ID NO: 367462 - DNA, 20 bp, human
ggggcgtctggatccccgaa

SEQ ID NO: 367463 - DNA, 20 bp, human
gggggcagtcggcacgaggg

SEQ ID NO: 367464 - DNA, 20 bp, human
gacgcagcctgagactcgac

SEQ ID NO: 367465 - DNA, 20 bp, human
ggccccggccatctttacgg

SEQ ID NO: 367466 - DNA, 20 bp, human
gggcacgtgacgtgagaaag

SEQ ID NO: 367467 - DNA, 20 bp, human
ggagagtctagtgtcacgtg

SEQ ID NO: 367468 - DNA, 20 bp, human
gctagtgtcacgtgaggccc

SEQ ID NO: 367469 - DNA, 20 bp, human
gtcacgtgaggccccggtgg

SEQ ID NO: 367470 - DNA, 20 bp, human
gaggacagacagctcgcaga

SEQ ID NO: 367471 - DNA, 20 bp, human
gtggcagcacccgaggggac

SEQ ID NO: 367472 - DNA, 20 bp, human
gtgcctgcgcaatgggtgtc

SEQ ID NO: 367473 - DNA, 20 bp, human
ggtagcggccggccccgcga

SEQ ID NO: 367474 - DNA, 20 bp, human
gggggccgaagggagacctg

SEQ ID NO: 367475 - DNA, 20 bp, human
ggacagctcgcagagggcga

SEQ ID NO: 367476 - DNA, 20 bp, human
gtggctgcgctgtgcgaaga

SEQ ID NO: 367477 - DNA, 20 bp, human
ggggcgggaggaggtgtggt

SEQ ID NO: 367478 - DNA, 20 bp, human
ggtggctctaggacaccctg

SEQ ID NO: 367479 - DNA, 20 bp, human
ggcacagcgcagccaattgg

SEQ ID NO: 367480 - DNA, 20 bp, human
ggggatggagccaaggtccc

SEQ ID NO: 367481 - DNA, 20 bp, human
gcgaagacggacaggtaggc

SEQ ID NO: 367482 - DNA, 20 bp, human
gcgtagaataatgacgtata

SEQ ID NO: 367483 - DNA, 20 bp, human
gttcgcacagcgcagccaat

SEQ ID NO: 367484 - DNA, 20 bp, human
gtgtgcgaagacggacaggt

SEQ ID NO: 367485 - DNA, 20 bp, human
ggcgctgtgcgaagacggac

SEQ ID NO: 367486 - DNA, 20 bp, human
gcctctgggacgcttatgaa

SEQ ID NO: 367487 - DNA, 20 bp, human
gccgggcgggcgcctcttca

SEQ ID NO: 367488 - DNA, 20 bp, human
gcgcggcccggaggcagacg

SEQ ID NO: 367489 - DNA, 20 bp, human
ggggcgctgtggtccggcgg

SEQ ID NO: 367490 - DNA, 20 bp, human
gaagggcgatgacgaagcac

SEQ ID NO: 367491 - DNA, 20 bp, human
gccggaggcagacgcggctt

SEQ ID NO: 367492 - DNA, 20 bp, human
ggcagacgcggcttgggttc

SEQ ID NO: 367493 - DNA, 20 bp, human
gcgggcgcctcttcagggct

SEQ ID NO: 367494 - DNA, 20 bp, human
gccaggccgcgtggggtgga

SEQ ID NO: 367495 - DNA, 20 bp, human
gtggggtggagggggaaccg

SEQ ID NO: 367496 - DNA, 20 bp, human
ggaaacccgaggggcttcag

SEQ ID NO: 367497 - DNA, 20 bp, human
gcacgcgcgcagggacacat

SEQ ID NO: 367498 - DNA, 20 bp, human
gggtgggccgggcggtgcga

SEQ ID NO: 367499 - DNA, 20 bp, human
gaggccggcactgcctaggt

SEQ ID NO: 367500 - DNA, 20 bp, human
gcgcccgccaccggccacac

SEQ ID NO: 367501 - DNA, 20 bp, human
ggagcatgcgcgggaggtaa

SEQ ID NO: 367502 - DNA, 20 bp, human
gcgtggccccgcctcccgac

SEQ ID NO: 367503 - DNA, 20 bp, human
gcggcccacctaggcagtgc

SEQ ID NO: 367504 - DNA, 20 bp, human
gggtagaggtaaaggctgaa

SEQ ID NO: 367505 - DNA, 20 bp, human
gcgctaggccggcactgcct

SEQ ID NO: 367506 - DNA, 20 bp, human
ggctccgccagagaggacag

SEQ ID NO: 367507 - DNA, 20 bp, human
gccaggcagctccgccagag

SEQ ID NO: 367508 - DNA, 20 bp, human
gctatcgcgcgagtcatgcc

SEQ ID NO: 367509 - DNA, 20 bp, human
ggggacatgtagtctggccg

SEQ ID NO: 367510 - DNA, 20 bp, human
gctcgtccccctgtcctctc

SEQ ID NO: 367511 - DNA, 20 bp, human
gcagagcgctgaaagtaact

SEQ ID NO: 367512 - DNA, 20 bp, human
gaggcggccgcgggtcttgc

SEQ ID NO: 367513 - DNA, 20 bp, human
gacgtcgcatcctgaggtaa

SEQ ID NO: 367514 - DNA, 20 bp, human
ggtccccctgtcctctctgg

SEQ ID NO: 367515 - DNA, 20 bp, human
gcggggctcggacgccccct

SEQ ID NO: 367516 - DNA, 20 bp, human
gtaaagcgacagccccagag

SEQ ID NO: 367517 - DNA, 20 bp, human
gggcgaactccgcctctctg

SEQ ID NO: 367518 - DNA, 20 bp, human
ggggctgcaacgcgagtctc

SEQ ID NO: 367519 - DNA, 20 bp, human
gggcggacggagctgagggt

SEQ ID NO: 367520 - DNA, 20 bp, human
gccggggcggacggagctga

SEQ ID NO: 367521 - DNA, 20 bp, human
gtccgctgcccgctgctggc

SEQ ID NO: 367522 - DNA, 20 bp, human
gggagcccttccaggaagca

SEQ ID NO: 367523 - DNA, 20 bp, human
gccgcccgggtcctgggtcg

SEQ ID NO: 367524 - DNA, 20 bp, human
gtccggaggtggaggggtcc

SEQ ID NO: 367525 - DNA, 20 bp, human
ggggtctcgggcttgggaga

SEQ ID NO: 367526 - DNA, 20 bp, human
gtccgccggaagctacccag

SEQ ID NO: 367527 - DNA, 20 bp, human
gaggtggtctggtctttctg

SEQ ID NO: 367528 - DNA, 20 bp, human
gcggggcgtctgttgtggtc

SEQ ID NO: 367529 - DNA, 20 bp, human
gctgttgtggtcgggttctg

SEQ ID NO: 367530 - DNA, 20 bp, human
ggtcctccgcgaagtccctc

SEQ ID NO: 367531 - DNA, 20 bp, human
ggggggcggggcgtctgttg

SEQ ID NO: 367532 - DNA, 20 bp, human
gagcctgagggacttcgcgg

SEQ ID NO: 367533 - DNA, 20 bp, human
gccggcctcgcacttccggt

SEQ ID NO: 367534 - DNA, 20 bp, human
gcgcccgtgccgcggttcgg

SEQ ID NO: 367535 - DNA, 20 bp, human
gcggaagctacccaggggct

SEQ ID NO: 367536 - DNA, 20 bp, human
gcacgcgctgggtctctccg

SEQ ID NO: 367537 - DNA, 20 bp, human
gtccgcggggcgcgtacctg

SEQ ID NO: 367538 - DNA, 20 bp, human
gacgccggggttcacacccc

SEQ ID NO: 367539 - DNA, 20 bp, human
ggccaagcggggagtcgagg

SEQ ID NO: 367540 - DNA, 20 bp, human
gaacgcggggtcagagagta

SEQ ID NO: 367541 - DNA, 20 bp, human
ggactgtcacccggagtctg

SEQ ID NO: 367542 - DNA, 20 bp, human
ggccgcctgtccccgcccag

SEQ ID NO: 367543 - DNA, 20 bp, human
gacccctggagactttgctc

SEQ ID NO: 367544 - DNA, 20 bp, human
gccccggcgtccctgcccct

SEQ ID NO: 367545 - DNA, 20 bp, human
ggcgcagggcgactgtcacc

SEQ ID NO: 367546 - DNA, 20 bp, human
gcggccctggagaccgaagg

SEQ ID NO: 367547 - DNA, 20 bp, human
gcagggccggcaatgcgctg

SEQ ID NO: 367548 - DNA, 20 bp, human
ggaaggaggtgcctggaacc

SEQ ID NO: 367549 - DNA, 20 bp, human
gtggacttcaccctggttcc

SEQ ID NO: 367550 - DNA, 20 bp, human
gccggcctcgggcgctcgca

SEQ ID NO: 367551 - DNA, 20 bp, human
gtgcgcgctggacttcaccc

SEQ ID NO: 367552 - DNA, 20 bp, human
ggcgggaggaccctgcgcgc

SEQ ID NO: 367553 - DNA, 20 bp, human
gcaactccccagcgcattgc

SEQ ID NO: 367554 - DNA, 20 bp, human
gaagagggcgcggcaggaac

SEQ ID NO: 367555 - DNA, 20 bp, human
gtactgaagcgtttctttcc

SEQ ID NO: 367556 - DNA, 20 bp, human
gacgctctgcggagggaagc

SEQ ID NO: 367557 - DNA, 20 bp, human
gagggaagacgctctgcgga

SEQ ID NO: 367558 - DNA, 20 bp, human
gtccggggaggcagtgacga

SEQ ID NO: 367559 - DNA, 20 bp, human
gcgtcagggaagacgctctg

SEQ ID NO: 367560 - DNA, 20 bp, human
gccgcgcggtttcaccgtca

SEQ ID NO: 367561 - DNA, 20 bp, human
gctgccgcagggcgggacgg

SEQ ID NO: 367562 - DNA, 20 bp, human
gaagtggcagaggtggcggg

SEQ ID NO: 367563 - DNA, 20 bp, human
gcgcgggacacaacccaccg

SEQ ID NO: 367564 - DNA, 20 bp, human
gagcgacagctatttgtaag

SEQ ID NO: 367565 - DNA, 20 bp, human
ggtccctcccggtgcagcgg

SEQ ID NO: 367566 - DNA, 20 bp, human
ggaggccggaagcggaagaa

SEQ ID NO: 367567 - DNA, 20 bp, human
ggccggaagcgcatctacag

SEQ ID NO: 367568 - DNA, 20 bp, human
gggcgcggagggatgacgcg

SEQ ID NO: 367569 - DNA, 20 bp, human
gagccggagctcgaacggga

SEQ ID NO: 367570 - DNA, 20 bp, human
gcgggagccggagctcgaac

SEQ ID NO: 367571 - DNA, 20 bp, human
gtccactgtagatgcgcttc

SEQ ID NO: 367572 - DNA, 20 bp, human
gtgggcctgcactcgagacg

SEQ ID NO: 367573 - DNA, 20 bp, human
gagctccggctcccggtcac

SEQ ID NO: 367574 - DNA, 20 bp, human
ggtgccacctgagacgtggg

SEQ ID NO: 367575 - DNA, 20 bp, human
gcgaggaggcagcgaccaat

SEQ ID NO: 367576 - DNA, 20 bp, human
ggcagaaggggggggaaccg

SEQ ID NO: 367577 - DNA, 20 bp, human
gctaagttaagcctattcag

SEQ ID NO: 367578 - DNA, 20 bp, human
gaataagaaatccactgaat

SEQ ID NO: 367579 - DNA, 20 bp, human
gagggtttactgcccaggtt

SEQ ID NO: 367580 - DNA, 20 bp, human
gtcagtggatttcttattcc

SEQ ID NO: 367581 - DNA, 20 bp, human
gtattcctggaacccaaacc

SEQ ID NO: 367582 - DNA, 20 bp, human
gctgcccaggtttgggttcc

SEQ ID NO: 367583 - DNA, 20 bp, human
gccaccaggcggccgcggag

SEQ ID NO: 367584 - DNA, 20 bp, human
gtggagtagaacggctcggg

SEQ ID NO: 367585 - DNA, 20 bp, human
ggcctggagtagaacggctc

SEQ ID NO: 367586 - DNA, 20 bp, human
ggcccgagcagaaccaacgg

SEQ ID NO: 367587 - DNA, 20 bp, human
gagcccgggcggaaccgccc

SEQ ID NO: 367588 - DNA, 20 bp, human
gccgcccgggcggttccgcc

SEQ ID NO: 367589 - DNA, 20 bp, human
gggcagaaggggggggaccg

SEQ ID NO: 367590 - DNA, 20 bp, human
gctaagttaagcctattcag

SEQ ID NO: 367591 - DNA, 20 bp, human
gaataagaaatccactgaat

SEQ ID NO: 367592 - DNA, 20 bp, human
gagggtttactgcccaggtt

SEQ ID NO: 367593 - DNA, 20 bp, human
gtattcctggaacccaaacc

SEQ ID NO: 367594 - DNA, 20 bp, human
gctgcccaggtttgggttcc

SEQ ID NO: 367595 - DNA, 20 bp, human
gtcagtggatttcttattcc

SEQ ID NO: 367596 - DNA, 20 bp, human
gaggcgttaggtgaccaagg

SEQ ID NO: 367597 - DNA, 20 bp, human
gcgcgcgacgcttgcgtctt

SEQ ID NO: 367598 - DNA, 20 bp, human
gaacggccgctaccctgcgc

SEQ ID NO: 367599 - DNA, 20 bp, human
gttaggtgaccaagggggtc

SEQ ID NO: 367600 - DNA, 20 bp, human
gttgctagacaacttctctc

SEQ ID NO: 367601 - DNA, 20 bp, human
gtctgggtccccgaccccct

SEQ ID NO: 367602 - DNA, 20 bp, human
ggcccgcagccacgtgactc

SEQ ID NO: 367603 - DNA, 20 bp, human
gcaagaaaggggtcctagat

SEQ ID NO: 367604 - DNA, 20 bp, human
gcgcaagcgtcgcgcgccca

SEQ ID NO: 367605 - DNA, 20 bp, human
ggtccagtcaggtaggcgtt

SEQ ID NO: 367606 - DNA, 20 bp, human
gcagatgcgcaggccccggg

SEQ ID NO: 367607 - DNA, 20 bp, human
gcccccctggcggcgaagag

SEQ ID NO: 367608 - DNA, 20 bp, human
gcaagaccgccctcccggtc

SEQ ID NO: 367609 - DNA, 20 bp, human
ggctccctacacggaaaatt

SEQ ID NO: 367610 - DNA, 20 bp, human
gaccacgccagctcgtgggg

SEQ ID NO: 367611 - DNA, 20 bp, human
gcggggcaagaccgccctcc

SEQ ID NO: 367612 - DNA, 20 bp, human
gcgccctcccggtccggggg

SEQ ID NO: 367613 - DNA, 20 bp, human
ggctgtgagcgggaggcgtt

SEQ ID NO: 367614 - DNA, 20 bp, human
gggggaaatgccaggccgat

SEQ ID NO: 367615 - DNA, 20 bp, human
gcgggcggaggagggctgat

SEQ ID NO: 367616 - DNA, 20 bp, human
gcggggcagtagagggtcgg

SEQ ID NO: 367617 - DNA, 20 bp, human
gtctgcggacggggcagtag

SEQ ID NO: 367618 - DNA, 20 bp, human
gaatccccgccaactccaca

SEQ ID NO: 367619 - DNA, 20 bp, human
gggacggggcagtagagggt

SEQ ID NO: 367620 - DNA, 20 bp, human
gccggggccggcacctgtct

SEQ ID NO: 367621 - DNA, 20 bp, human
gccgcggaatccagcaccac

SEQ ID NO: 367622 - DNA, 20 bp, human
gtcacggagtgagagaccga

SEQ ID NO: 367623 - DNA, 20 bp, human
gaggcccacggtctaggttg

SEQ ID NO: 367624 - DNA, 20 bp, human
gaatccagcaccaccggcct

SEQ ID NO: 367625 - DNA, 20 bp, human
gggcagcgccctctggcgag

SEQ ID NO: 367626 - DNA, 20 bp, human
gggtcgctgaaggagccgag

SEQ ID NO: 367627 - DNA, 20 bp, human
ggggcttgacagttaatgat

SEQ ID NO: 367628 - DNA, 20 bp, human
gcgctgaaggagccgagcgg

SEQ ID NO: 367629 - DNA, 20 bp, human
gtgggtgccgctcaacaata

SEQ ID NO: 367630 - DNA, 20 bp, human
ggccggctggggctccgctc

SEQ ID NO: 367631 - DNA, 20 bp, human
gacgggaggcggtgcctgtg

SEQ ID NO: 367632 - DNA, 20 bp, human
gagtgccgggtcccggaaga

SEQ ID NO: 367633 - DNA, 20 bp, human
gcattaactgtcaagcccta

SEQ ID NO: 367634 - DNA, 20 bp, human
gagccgagcggaggagcgag

SEQ ID NO: 367635 - DNA, 20 bp, human
ggagccccagccggccgcac

SEQ ID NO: 367636 - DNA, 20 bp, human
gagaggctgcagtcaggacc

SEQ ID NO: 367637 - DNA, 20 bp, human
gaaagggcttctcagagagg

SEQ ID NO: 367638 - DNA, 20 bp, human
gaggcgctggtccttttaaa

SEQ ID NO: 367639 - DNA, 20 bp, human
gagcaggtgagctgcggggt

SEQ ID NO: 367640 - DNA, 20 bp, human
gaaggaccagcgcctgcgga

SEQ ID NO: 367641 - DNA, 20 bp, human
ggctgaggcttaagttctca

SEQ ID NO: 367642 - DNA, 20 bp, human
gtgcggggctgggcgtcccg

SEQ ID NO: 367643 - DNA, 20 bp, human
ggtctcccctccgcaggcgc

SEQ ID NO: 367644 - DNA, 20 bp, human
gctcagggtctcccctccgc

SEQ ID NO: 367645 - DNA, 20 bp, human
gcaaaaaaatagctgtccac

SEQ ID NO: 367646 - DNA, 20 bp, human
ggcgcacaggggccaggcgg

SEQ ID NO: 367647 - DNA, 20 bp, human
ggctccgcctggaagccttg

SEQ ID NO: 367648 - DNA, 20 bp, human
ggcgcgaggtgcgggctccg

SEQ ID NO: 367649 - DNA, 20 bp, human
gccggtgccccaaggcttcc

SEQ ID NO: 367650 - DNA, 20 bp, human
ggcggggaggcgtcgggtcg

SEQ ID NO: 367651 - DNA, 20 bp, human
ggagcgcgtccggtgcccca

SEQ ID NO: 367652 - DNA, 20 bp, human
gcgagagcgcacagctggga

SEQ ID NO: 367653 - DNA, 20 bp, human
gccggggcggagcgcacgcc

SEQ ID NO: 367654 - DNA, 20 bp, human
gtgcccacttcccgcctccc

SEQ ID NO: 367655 - DNA, 20 bp, human
gttgagtcaaaagagaaggg

SEQ ID NO: 367656 - DNA, 20 bp, human
gagaaggcgacggtggccag

SEQ ID NO: 367657 - DNA, 20 bp, human
gcggggagaagacacttctg

SEQ ID NO: 367658 - DNA, 20 bp, human
gcgagaggagaaggcgacgg

SEQ ID NO: 367659 - DNA, 20 bp, human
ggaaagggatgtttggtcag

SEQ ID NO: 367660 - DNA, 20 bp, human
gcccaaccccacctgatgaa

SEQ ID NO: 367661 - DNA, 20 bp, human
ggcgcgagaggagaaggcga

SEQ ID NO: 367662 - DNA, 20 bp, human
ggtgggcgtcggaggtgagg

SEQ ID NO: 367663 - DNA, 20 bp, human
gaccaaacatccctttcatc

SEQ ID NO: 367664 - DNA, 20 bp, human
gcggcggagcggcccccact

SEQ ID NO: 367665 - DNA, 20 bp, human
gcaaggactgactaacgcgg

SEQ ID NO: 367666 - DNA, 20 bp, human
gtgacgtcataggggcgcga

SEQ ID NO: 367667 - DNA, 20 bp, human
ggcgaggcttggcggagcta

SEQ ID NO: 367668 - DNA, 20 bp, human
gcgcggtcgcgtatgcagcg

SEQ ID NO: 367669 - DNA, 20 bp, human
ggcgcgcgggtgacgtcata

SEQ ID NO: 367670 - DNA, 20 bp, human
gggctctggtcgccgagcga

SEQ ID NO: 367671 - DNA, 20 bp, human
gcccggaagcggtggcgcgc

SEQ ID NO: 367672 - DNA, 20 bp, human
gagctaggggaagtaatgcg

SEQ ID NO: 367673 - DNA, 20 bp, human
ggaaagcgagcgtgggtgtc

SEQ ID NO: 367674 - DNA, 20 bp, human
gcgtcataggggcgcgacgg

SEQ ID NO: 367675 - DNA, 20 bp, human
ggtcgccgagcgagggctcg

SEQ ID NO: 367676 - DNA, 20 bp, human
gaaagcgctccaggacgact

SEQ ID NO: 367677 - DNA, 20 bp, human
gtcgtcctggagcgctttgg

SEQ ID NO: 367678 - DNA, 20 bp, human
ggctcaggcgcgctccccgg

SEQ ID NO: 367679 - DNA, 20 bp, human
ggcgctctgccgagtcgtcc

SEQ ID NO: 367680 - DNA, 20 bp, human
ggtggccaccaaagcgctcc

SEQ ID NO: 367681 - DNA, 20 bp, human
gcgctcgcgcaggagacccc

SEQ ID NO: 367682 - DNA, 20 bp, human
ggcgccgggccccgtcaccc

SEQ ID NO: 367683 - DNA, 20 bp, human
gcctgggccgtgatttgcca

SEQ ID NO: 367684 - DNA, 20 bp, human
gggtggccacgccgtggccc

SEQ ID NO: 367685 - DNA, 20 bp, human
ggtggctcaggcgcgctccc

SEQ ID NO: 367686 - DNA, 20 bp, human
ggacgcgcgcggtctccttg

SEQ ID NO: 367687 - DNA, 20 bp, human
ggtgcccacagctggctcta

SEQ ID NO: 367688 - DNA, 20 bp, human
gacccgctgcctccctggtc

SEQ ID NO: 367689 - DNA, 20 bp, human
ggggcaccacagcccgacca

SEQ ID NO: 367690 - DNA, 20 bp, human
gtgggctgccgctcttccgg

SEQ ID NO: 367691 - DNA, 20 bp, human
gcccccgggcgccagggctt

SEQ ID NO: 367692 - DNA, 20 bp, human
gtccgctggcctcttaacct

SEQ ID NO: 367693 - DNA, 20 bp, human
ggggagacccgctgcctccc

SEQ ID NO: 367694 - DNA, 20 bp, human
gacgccttagagccagctgt

SEQ ID NO: 367695 - DNA, 20 bp, human
gtgtcatggcacagacaagg

SEQ ID NO: 367696 - DNA, 20 bp, human
gtaagctagaggggcccggg

SEQ ID NO: 367697 - DNA, 20 bp, human
gctccaagggcgtaagctag

SEQ ID NO: 367698 - DNA, 20 bp, human
gccggcgccagtcaggttgt

SEQ ID NO: 367699 - DNA, 20 bp, human
gggacaggcaagaaagggta

SEQ ID NO: 367700 - DNA, 20 bp, human
gaaaatggcgggtggactcg

SEQ ID NO: 367701 - DNA, 20 bp, human
gccgggcgggcgctttcccg

SEQ ID NO: 367702 - DNA, 20 bp, human
gacttcctctacccgcgagg

SEQ ID NO: 367703 - DNA, 20 bp, human
ggcgtaagctagaggggccc

SEQ ID NO: 367704 - DNA, 20 bp, human
gctctacccgcgaggtggga

SEQ ID NO: 367705 - DNA, 20 bp, human
gcccctctagcttacgccct

SEQ ID NO: 367706 - DNA, 20 bp, human
gggcgctggggactgcgaat

SEQ ID NO: 367707 - DNA, 20 bp, human
gtgaacagggcattgatctt

SEQ ID NO: 367708 - DNA, 20 bp, human
gctggaaggactatgttcct

SEQ ID NO: 367709 - DNA, 20 bp, human
gaaaaggcgcggccgctcaa

SEQ ID NO: 367710 - DNA, 20 bp, human
ggcagtaataggtcgccagg

SEQ ID NO: 367711 - DNA, 20 bp, human
gtattactgccactgctgga

SEQ ID NO: 367712 - DNA, 20 bp, human
gtgcgaataggaactgaaca

SEQ ID NO: 367713 - DNA, 20 bp, human
gactatgttcctgggcgctg

SEQ ID NO: 367714 - DNA, 20 bp, human
gagcactgtcccttgagttg

SEQ ID NO: 367715 - DNA, 20 bp, human
gtcacaaacccacaactcaa

SEQ ID NO: 367716 - DNA, 20 bp, human
gcagaagtgaggcactgctt

SEQ ID NO: 367717 - DNA, 20 bp, human
ggctagacaaggcagaagtg

SEQ ID NO: 367718 - DNA, 20 bp, human
gaatcctgacctaaggaata

SEQ ID NO: 367719 - DNA, 20 bp, human
ggccttgtctagctgtactc

SEQ ID NO: 367720 - DNA, 20 bp, human
ggtgcaaagtacacagaggc

SEQ ID NO: 367721 - DNA, 20 bp, human
ggtagcaccacgtataccaa

SEQ ID NO: 367722 - DNA, 20 bp, human
gtccgcattccctattcctt

SEQ ID NO: 367723 - DNA, 20 bp, human
gaaaagtgcaaagtacacag

SEQ ID NO: 367724 - DNA, 20 bp, human
gggcactgcttgggaggagt

SEQ ID NO: 367725 - DNA, 20 bp, human
gtatatatgtacaagctctt

SEQ ID NO: 367726 - DNA, 20 bp, human
gccagtggacgaggactcct

SEQ ID NO: 367727 - DNA, 20 bp, human
gaggcatcacccattcgtat

SEQ ID NO: 367728 - DNA, 20 bp, human
gtaagtaataccaatacgaa

SEQ ID NO: 367729 - DNA, 20 bp, human
gctctggccaagctggaacg

SEQ ID NO: 367730 - DNA, 20 bp, human
gtgtgtgcccgggctggctc

SEQ ID NO: 367731 - DNA, 20 bp, human
gagaatggggtgctgcaaga

SEQ ID NO: 367732 - DNA, 20 bp, human
gcagtggtgtgtgcccgggc

SEQ ID NO: 367733 - DNA, 20 bp, human
gaacctagcccaatttgtca

SEQ ID NO: 367734 - DNA, 20 bp, human
ggggctggctctggccaagc

SEQ ID NO: 367735 - DNA, 20 bp, human
gctgtggagccagtgagaca

SEQ ID NO: 367736 - DNA, 20 bp, human
ggggtgaagagtggcttgta

SEQ ID NO: 367737 - DNA, 20 bp, human
ggtatggcctgccagtgatt

SEQ ID NO: 367738 - DNA, 20 bp, human
gctgctcagaatttctatac

SEQ ID NO: 367739 - DNA, 20 bp, human
gccatgctgggaatatatta

SEQ ID NO: 367740 - DNA, 20 bp, human
ggtaatggagagtttcagct

SEQ ID NO: 367741 - DNA, 20 bp, human
gtgggccacatctgcatccc

SEQ ID NO: 367742 - DNA, 20 bp, human
gagctggattatgttctgtt

SEQ ID NO: 367743 - DNA, 20 bp, human
ggcactcccttccaaatcac

SEQ ID NO: 367744 - DNA, 20 bp, human
gctgctgcagctcattggct

SEQ ID NO: 367745 - DNA, 20 bp, human
ggagagtttcagctaggggg

SEQ ID NO: 367746 - DNA, 20 bp, human
ggtaacccgagaggagggtt

SEQ ID NO: 367747 - DNA, 20 bp, human
gccgggttgggtaacccgag

SEQ ID NO: 367748 - DNA, 20 bp, human
gactgctgcgaggccgggtt

SEQ ID NO: 367749 - DNA, 20 bp, human
ggagctatgggcccgggtct

SEQ ID NO: 367750 - DNA, 20 bp, human
gcggcctcgcagcagtcctc

SEQ ID NO: 367751 - DNA, 20 bp, human
gaacctgagatcagcgaggg

SEQ ID NO: 367752 - DNA, 20 bp, human
ggggcaccgccggcgagggg

SEQ ID NO: 367753 - DNA, 20 bp, human
gcggcgggcaccgccggcga

SEQ ID NO: 367754 - DNA, 20 bp, human
gggttgggtaacccgagagg

SEQ ID NO: 367755 - DNA, 20 bp, human
ggttacccaaccctcctctc

SEQ ID NO: 367756 - DNA, 20 bp, human
gaaggcgcgggccatgaccc

SEQ ID NO: 367757 - DNA, 20 bp, human
ggggcagtgccgcaaggcgt

SEQ ID NO: 367758 - DNA, 20 bp, human
gcgggccagggaaagtgaaa

SEQ ID NO: 367759 - DNA, 20 bp, human
gtcatggcccgcgccttccc

SEQ ID NO: 367760 - DNA, 20 bp, human
gccggggctggtgcgaccct

SEQ ID NO: 367761 - DNA, 20 bp, human
gcacgcccacgtccccatcg

SEQ ID NO: 367762 - DNA, 20 bp, human
gcccgcgcccggctccctga

SEQ ID NO: 367763 - DNA, 20 bp, human
gggcggctggtccccggagg

SEQ ID NO: 367764 - DNA, 20 bp, human
gggactgcccggaggccggt

SEQ ID NO: 367765 - DNA, 20 bp, human
gtctgccgcgatggggacgt

SEQ ID NO: 367766 - DNA, 20 bp, human
gaagcgctgcggggtagtgc

SEQ ID NO: 367767 - DNA, 20 bp, human
gtctgcctcaccacccgctg

SEQ ID NO: 367768 - DNA, 20 bp, human
gtcggagcccatggcttttt

SEQ ID NO: 367769 - DNA, 20 bp, human
gcctcagagctgtcgggcag

SEQ ID NO: 367770 - DNA, 20 bp, human
ggcgctggacccgaccccga

SEQ ID NO: 367771 - DNA, 20 bp, human
gtcctgtcctaaaaagccat

SEQ ID NO: 367772 - DNA, 20 bp, human
gcgggacacgagacgctgga

SEQ ID NO: 367773 - DNA, 20 bp, human
gtaggacaggaagcgctgcg

SEQ ID NO: 367774 - DNA, 20 bp, human
gcgacagctctgaggtgctg

SEQ ID NO: 367775 - DNA, 20 bp, human
gacgactggcgggtttgcgc

SEQ ID NO: 367776 - DNA, 20 bp, human
gaaccctggtcgcaccgcca

SEQ ID NO: 367777 - DNA, 20 bp, human
gcgcagcagcagagttctgt

SEQ ID NO: 367778 - DNA, 20 bp, human
gtcctccgcgccggcaggtg

SEQ ID NO: 367779 - DNA, 20 bp, human
ggttagctgcaaaagacgag

SEQ ID NO: 367780 - DNA, 20 bp, human
gcacgtgaccctcccgtcgc

SEQ ID NO: 367781 - DNA, 20 bp, human
ggcagctaacattactggcc

SEQ ID NO: 367782 - DNA, 20 bp, human
gggcaggtgaggccgcgtgg

SEQ ID NO: 367783 - DNA, 20 bp, human
ggcggtgcgaccagggtttc

SEQ ID NO: 367784 - DNA, 20 bp, human
gcttttgcagctaacattac

SEQ ID NO: 367785 - DNA, 20 bp, human
gctcccagcgtgccccgcga

SEQ ID NO: 367786 - DNA, 20 bp, human
ggggagtaagtcgacgtccc

SEQ ID NO: 367787 - DNA, 20 bp, human
gcaaggagcagcgtgaccag

SEQ ID NO: 367788 - DNA, 20 bp, human
ggccgtgcccagcccctaag

SEQ ID NO: 367789 - DNA, 20 bp, human
gaacgagcatagcgcccctt

SEQ ID NO: 367790 - DNA, 20 bp, human
gcgggagcccgaataggacg

SEQ ID NO: 367791 - DNA, 20 bp, human
gtcgacgtccccggcatgtg

SEQ ID NO: 367792 - DNA, 20 bp, human
gacgtccccggcatgtgggg

SEQ ID NO: 367793 - DNA, 20 bp, human
gagcccgaataggacggggc

SEQ ID NO: 367794 - DNA, 20 bp, human
gggggaggggagtcacctga

SEQ ID NO: 367795 - DNA, 20 bp, human
gcgctatgctcgttcgtcca

SEQ ID NO: 367796 - DNA, 20 bp, human
ggctggcggagattgagcaa

SEQ ID NO: 367797 - DNA, 20 bp, human
gacgatgcagcgaccgcggc

SEQ ID NO: 367798 - DNA, 20 bp, human
gtctgacgatgcagcgaccg

SEQ ID NO: 367799 - DNA, 20 bp, human
ggtgcccggcgcactgaagc

SEQ ID NO: 367800 - DNA, 20 bp, human
gaagagcgggcgcacaggag

SEQ ID NO: 367801 - DNA, 20 bp, human
gaatgagagcccttagggat

SEQ ID NO: 367802 - DNA, 20 bp, human
gtcgtcagagagctgcaaga

SEQ ID NO: 367803 - DNA, 20 bp, human
gtgacaccatgtgaccggca

SEQ ID NO: 367804 - DNA, 20 bp, human
gaggggaggagaccgcgcgc

SEQ ID NO: 367805 - DNA, 20 bp, human
ggcggctaaaggggcaccgg

SEQ ID NO: 367806 - DNA, 20 bp, human
gaagtgacggccagggggta

SEQ ID NO: 367807 - DNA, 20 bp, human
gcaacggagcccgtggaagg

SEQ ID NO: 367808 - DNA, 20 bp, human
gaatgagaggcgggcccgga

SEQ ID NO: 367809 - DNA, 20 bp, human
gccgcggcggcagctgagtt

SEQ ID NO: 367810 - DNA, 20 bp, human
ggggccccagttcaacgagc

SEQ ID NO: 367811 - DNA, 20 bp, human
gcgggcggaaactgggccgg

SEQ ID NO: 367812 - DNA, 20 bp, human
gacgcgagccaatgagaggc

SEQ ID NO: 367813 - DNA, 20 bp, human
gcctccagctcgttgaactg

SEQ ID NO: 367814 - DNA, 20 bp, human
gccagggggtagggtttggt

SEQ ID NO: 367815 - DNA, 20 bp, human
ggccccgggcacaggtcggc

SEQ ID NO: 367816 - DNA, 20 bp, human
gactctgtgagatcggggca

SEQ ID NO: 367817 - DNA, 20 bp, human
gcgaggaggaggtgctaata

SEQ ID NO: 367818 - DNA, 20 bp, human
gggagaagctaacttaggaa

SEQ ID NO: 367819 - DNA, 20 bp, human
ggcaaaggagaagctaactt

SEQ ID NO: 367820 - DNA, 20 bp, human
ggaggcgggggtgtgaaggg

SEQ ID NO: 367821 - DNA, 20 bp, human
ggaggtgctaatagggaaga

SEQ ID NO: 367822 - DNA, 20 bp, human
gtgcttctgcgttcttacct

SEQ ID NO: 367823 - DNA, 20 bp, human
gttaggaacggactgcaacg

SEQ ID NO: 367824 - DNA, 20 bp, human
gaagaggggtagcgaggagg

SEQ ID NO: 367825 - DNA, 20 bp, human
gggaacggactgcaacgagg

SEQ ID NO: 367826 - DNA, 20 bp, human
gcgcgggcgcgggccgcaga

SEQ ID NO: 367827 - DNA, 20 bp, human
gcaccccggggacgcgtcag

SEQ ID NO: 367828 - DNA, 20 bp, human
gctagaaagctggagagagt

SEQ ID NO: 367829 - DNA, 20 bp, human
gggcctaggtctgggcgggt

SEQ ID NO: 367830 - DNA, 20 bp, human
gccggggacgcgtcagtggg

SEQ ID NO: 367831 - DNA, 20 bp, human
gtgcgagcggcgggttatag

SEQ ID NO: 367832 - DNA, 20 bp, human
gcaaagagaaggcgcccggg

SEQ ID NO: 367833 - DNA, 20 bp, human
gggagcagccctgcgagcgg

SEQ ID NO: 367834 - DNA, 20 bp, human
gggctttgcgggagagtctt

SEQ ID NO: 367835 - DNA, 20 bp, human
gttgggggcgcctgcgggcg

SEQ ID NO: 367836 - DNA, 20 bp, human
gcgttagggagcccctaggt

SEQ ID NO: 367837 - DNA, 20 bp, human
gtaggggctccctaacgctc

SEQ ID NO: 367838 - DNA, 20 bp, human
gggggcaggccgggagcaaa

SEQ ID NO: 367839 - DNA, 20 bp, human
gctggtcgggggaatggcgg

SEQ ID NO: 367840 - DNA, 20 bp, human
gagctctgctctcccaccta

SEQ ID NO: 367841 - DNA, 20 bp, human
gaggggcggcctgagcgtta

SEQ ID NO: 367842 - DNA, 20 bp, human
gagactcaacggagtccctc

SEQ ID NO: 367843 - DNA, 20 bp, human
gaacagcgacgcgggatgaa

SEQ ID NO: 367844 - DNA, 20 bp, human
gggactccgttgagtcttgt

SEQ ID NO: 367845 - DNA, 20 bp, human
gctccgttgagtcttgtggg

SEQ ID NO: 367846 - DNA, 20 bp, human
gacgcaagttggacagaagg

SEQ ID NO: 367847 - DNA, 20 bp, human
gtctctattaagattttact

SEQ ID NO: 367848 - DNA, 20 bp, human
gttgtctcgttcactcccac

SEQ ID NO: 367849 - DNA, 20 bp, human
gttcaagagctgacgcaagt

SEQ ID NO: 367850 - DNA, 20 bp, human
gacattgatttaaagaccag

SEQ ID NO: 367851 - DNA, 20 bp, human
gatcactgaaagttttagct

SEQ ID NO: 367852 - DNA, 20 bp, human
gtattaagattttactaggt

SEQ ID NO: 367853 - DNA, 20 bp, human
gctatttgcttttagaattt

SEQ ID NO: 367854 - DNA, 20 bp, human
gctgaaagttttagcttggt

SEQ ID NO: 367855 - DNA, 20 bp, human
gcttgagtaactgtaccgtt

SEQ ID NO: 367856 - DNA, 20 bp, human
ggcccctagatgctgctggg

SEQ ID NO: 367857 - DNA, 20 bp, human
gcacaccccagtggccgccc

SEQ ID NO: 367858 - DNA, 20 bp, human
gaggccgcccagcagcatct

SEQ ID NO: 367859 - DNA, 20 bp, human
ggcatctaggggcgtggctg

SEQ ID NO: 367860 - DNA, 20 bp, human
ggcccaggacgtgcggtcac

SEQ ID NO: 367861 - DNA, 20 bp, human
gagtggccgcccaggacgtg

SEQ ID NO: 367862 - DNA, 20 bp, human
gtccagtgaccgcacgtcct

SEQ ID NO: 367863 - DNA, 20 bp, human
gggcaactttggcttacggc

SEQ ID NO: 367864 - DNA, 20 bp, human
gttacactgcatactcctaa

SEQ ID NO: 367865 - DNA, 20 bp, human
ggacaggacaaacacagggt

SEQ ID NO: 367866 - DNA, 20 bp, human
gatgcctgtcatatgcctgg

SEQ ID NO: 367867 - DNA, 20 bp, human
gcacgtggcttgcctgggac

SEQ ID NO: 367868 - DNA, 20 bp, human
gtgcgggaggagattagctg

SEQ ID NO: 367869 - DNA, 20 bp, human
gcctggagcccctgtcttgt

SEQ ID NO: 367870 - DNA, 20 bp, human
gccgcctggccacgcggtga

SEQ ID NO: 367871 - DNA, 20 bp, human
gagcaagccggtccagttca

SEQ ID NO: 367872 - DNA, 20 bp, human
ggctggaaagggcatatctg

SEQ ID NO: 367873 - DNA, 20 bp, human
gtccttgcagggacacgtgt

SEQ ID NO: 367874 - DNA, 20 bp, human
gaactcggtaggccacggga

SEQ ID NO: 367875 - DNA, 20 bp, human
gcaggggagcaggaacagac

SEQ ID NO: 367876 - DNA, 20 bp, human
gatgacgcgcgccctcttcg

SEQ ID NO: 367877 - DNA, 20 bp, human
gacccacatccgatcggtac

SEQ ID NO: 367878 - DNA, 20 bp, human
gctcccgctccggtaccgat

SEQ ID NO: 367879 - DNA, 20 bp, human
gtgggtcgcgggtggatggg

SEQ ID NO: 367880 - DNA, 20 bp, human
gaccgatcggatgtgggtcg

SEQ ID NO: 367881 - DNA, 20 bp, human
gttaggggctaatggtccag

SEQ ID NO: 367882 - DNA, 20 bp, human
ggaagtacggaatgccggaa

SEQ ID NO: 367883 - DNA, 20 bp, human
gtccaggccctggtgaagta

SEQ ID NO: 367884 - DNA, 20 bp, human
ggatgtgggtcgcgggtgga

SEQ ID NO: 367885 - DNA, 20 bp, human
ggcgacgtggggaattggaa

SEQ ID NO: 367886 - DNA, 20 bp, human
gggctcagggcagtgctgtc

SEQ ID NO: 367887 - DNA, 20 bp, human
gtggacgcgaggctggctca

SEQ ID NO: 367888 - DNA, 20 bp, human
gctgtcgggctgaggattca

SEQ ID NO: 367889 - DNA, 20 bp, human
gtaagaggataaacacgagc

SEQ ID NO: 367890 - DNA, 20 bp, human
gtgtcccgcggccgcccgag

SEQ ID NO: 367891 - DNA, 20 bp, human
gagctggctggacgcgaggc

SEQ ID NO: 367892 - DNA, 20 bp, human
gcacgagctggctggacgcg

SEQ ID NO: 367893 - DNA, 20 bp, human
gggcccaccgccaccgggac

SEQ ID NO: 367894 - DNA, 20 bp, human
gaggataaacacgagctggc

SEQ ID NO: 367895 - DNA, 20 bp, human
gcatcacatgacgcccgctc

SEQ ID NO: 367896 - DNA, 20 bp, human
ggggggagagaggattgatg

SEQ ID NO: 367897 - DNA, 20 bp, human
gagtgagaataatgtgggta

SEQ ID NO: 367898 - DNA, 20 bp, human
gaaggggtgaggttgccttg

SEQ ID NO: 367899 - DNA, 20 bp, human
ggatgggaatggggggagag

SEQ ID NO: 367900 - DNA, 20 bp, human
gtggggatgaggaaggttgg

SEQ ID NO: 367901 - DNA, 20 bp, human
gtggtaaggaccaggaactg

SEQ ID NO: 367902 - DNA, 20 bp, human
ggccctcccactagacccca

SEQ ID NO: 367903 - DNA, 20 bp, human
gtggctcagttgcatttctt

SEQ ID NO: 367904 - DNA, 20 bp, human
ggtagggaatgggagacgaa

SEQ ID NO: 367905 - DNA, 20 bp, human
gcaagattcgagcttggcca

SEQ ID NO: 367906 - DNA, 20 bp, human
ggggctgggccctgcggtga

SEQ ID NO: 367907 - DNA, 20 bp, human
gctcccagagggctctgcga

SEQ ID NO: 367908 - DNA, 20 bp, human
ggcagccggcgcgcccaggt

SEQ ID NO: 367909 - DNA, 20 bp, human
gccagccccgaggcttcagg

SEQ ID NO: 367910 - DNA, 20 bp, human
gccagcctcctgaagcctcg

SEQ ID NO: 367911 - DNA, 20 bp, human
gccaggtgggcgagtccagt

SEQ ID NO: 367912 - DNA, 20 bp, human
ggatgcggcacctccatcga

SEQ ID NO: 367913 - DNA, 20 bp, human
gaagaggggtgatccctcga

SEQ ID NO: 367914 - DNA, 20 bp, human
gaggaactggagcaaactcg

SEQ ID NO: 367915 - DNA, 20 bp, human
ggcaatagcctgggtcgcag

SEQ ID NO: 367916 - DNA, 20 bp, human
ggggccctggggcgcatctg

SEQ ID NO: 367917 - DNA, 20 bp, human
ggggcggagcaggcgacctg

SEQ ID NO: 367918 - DNA, 20 bp, human
gcgagtgggcggggacagac

SEQ ID NO: 367919 - DNA, 20 bp, human
gaccgggagtgacgtcagtt

SEQ ID NO: 367920 - DNA, 20 bp, human
gagcaatcagagatcgggag

SEQ ID NO: 367921 - DNA, 20 bp, human
gaatggcagcaccgagtggg

SEQ ID NO: 367922 - DNA, 20 bp, human
ggcagtcggtcgtgggtacg

SEQ ID NO: 367923 - DNA, 20 bp, human
gtgccaatggcagcaccgag

SEQ ID NO: 367924 - DNA, 20 bp, human
gacccacgaccgactgccaa

SEQ ID NO: 367925 - DNA, 20 bp, human
ggccattggcagtcggtcgt

SEQ ID NO: 367926 - DNA, 20 bp, human
gcccatagcgtagcacccat

SEQ ID NO: 367927 - DNA, 20 bp, human
gcccataggcggacggggtg

SEQ ID NO: 367928 - DNA, 20 bp, human
ggacggggtgcggctgcgca

SEQ ID NO: 367929 - DNA, 20 bp, human
ggccgcaccccgtccgccta

SEQ ID NO: 367930 - DNA, 20 bp, human
gtagcacccataggcggacg

SEQ ID NO: 367931 - DNA, 20 bp, human
gcacacggcactcgagtgtg

SEQ ID NO: 367932 - DNA, 20 bp, human
gaaaggagtcgcactactca

SEQ ID NO: 367933 - DNA, 20 bp, human
gtgacaccctgctacgcttg

SEQ ID NO: 367934 - DNA, 20 bp, human
gcccccgcggcgttctttct

SEQ ID NO: 367935 - DNA, 20 bp, human
gactactcacggattccaca

SEQ ID NO: 367936 - DNA, 20 bp, human
gcaggctcaggaacagatct

SEQ ID NO: 367937 - DNA, 20 bp, human
gcacagccgtctgcaggctc

SEQ ID NO: 367938 - DNA, 20 bp, human
gcgagtgactgcagccctaa

SEQ ID NO: 367939 - DNA, 20 bp, human
ggctcaggaacagatctggg

SEQ ID NO: 367940 - DNA, 20 bp, human
gggcgggagggccacgtgtg

SEQ ID NO: 367941 - DNA, 20 bp, human
ggcctgaagaatagattctc

SEQ ID NO: 367942 - DNA, 20 bp, human
gggtgtttgtagcttccctt

SEQ ID NO: 367943 - DNA, 20 bp, human
gtgctctgctgcgcacccag

SEQ ID NO: 367944 - DNA, 20 bp, human
gcagtcactcgcagactgct

SEQ ID NO: 367945 - DNA, 20 bp, human
gctggttcacagccgtctgc

SEQ ID NO: 367946 - DNA, 20 bp, human
gtaggtgagcctaagaaaat

SEQ ID NO: 367947 - DNA, 20 bp, human
ggggacagaatctaggtcaa

SEQ ID NO: 367948 - DNA, 20 bp, human
gcaaggtaatcaaatcagtg

SEQ ID NO: 367949 - DNA, 20 bp, human
gttgaaaggcaagtgacagt

SEQ ID NO: 367950 - DNA, 20 bp, human
gacaatgaaggtggataaaa

SEQ ID NO: 367951 - DNA, 20 bp, human
gatggagagagctgctctga

SEQ ID NO: 367952 - DNA, 20 bp, human
gtctgtctggtagattttca

SEQ ID NO: 367953 - DNA, 20 bp, human
gtaagaactaccaccggtgc

SEQ ID NO: 367954 - DNA, 20 bp, human
ggatgtaggtagcataaatg

SEQ ID NO: 367955 - DNA, 20 bp, human
gattacagaatcaactggag

SEQ ID NO: 367956 - DNA, 20 bp, human
ggtgacgctatgtttagttt

SEQ ID NO: 367957 - DNA, 20 bp, human
ggtaaccaaaggaatttctg

SEQ ID NO: 367958 - DNA, 20 bp, human
gtgcctgcaacatgtttgaa

SEQ ID NO: 367959 - DNA, 20 bp, human
gaaaggattcattaattggg

SEQ ID NO: 367960 - DNA, 20 bp, human
gttgcaggcacaataattga

SEQ ID NO: 367961 - DNA, 20 bp, human
gctacacagcgggggtctgt

SEQ ID NO: 367962 - DNA, 20 bp, human
gggtgctttcctgccatttg

SEQ ID NO: 367963 - DNA, 20 bp, human
gtataacttgtaccacctgt

SEQ ID NO: 367964 - DNA, 20 bp, human
ggagaatctagcaagctttt

SEQ ID NO: 367965 - DNA, 20 bp, human
gaagttataggacccaggtt

SEQ ID NO: 367966 - DNA, 20 bp, human
ggcggggaccgcgatcgacc

SEQ ID NO: 367967 - DNA, 20 bp, human
gagaccacgccgcccaggtc

SEQ ID NO: 367968 - DNA, 20 bp, human
gtgggcagggacggaagcgg

SEQ ID NO: 367969 - DNA, 20 bp, human
ggccggaggggagggtcggt

SEQ ID NO: 367970 - DNA, 20 bp, human
ggcgccgcgtgccgcggggt

SEQ ID NO: 367971 - DNA, 20 bp, human
gggcgcctcgggttccggac

SEQ ID NO: 367972 - DNA, 20 bp, human
gcgcgcggccacgtcacaag

SEQ ID NO: 367973 - DNA, 20 bp, human
ggggcgcttccgcctcgcgg

SEQ ID NO: 367974 - DNA, 20 bp, human
gagagggcgcacttccgttt

SEQ ID NO: 367975 - DNA, 20 bp, human
gcacgcggcgcctcgggttc

SEQ ID NO: 367976 - DNA, 20 bp, human
ggggagtcacggccggatga

SEQ ID NO: 367977 - DNA, 20 bp, human
gggtcctcgggagtcacggc

SEQ ID NO: 367978 - DNA, 20 bp, human
gcgccccggggctgccacgt

SEQ ID NO: 367979 - DNA, 20 bp, human
gtcacggccggatgaaggat

SEQ ID NO: 367980 - DNA, 20 bp, human
gcgggcgccgaccacagcca

SEQ ID NO: 367981 - DNA, 20 bp, human
gcccagggagcaggtcttca

SEQ ID NO: 367982 - DNA, 20 bp, human
gcccgctcccatccttcatc

SEQ ID NO: 367983 - DNA, 20 bp, human
gtgggtaggactctcctcca

SEQ ID NO: 367984 - DNA, 20 bp, human
ggggagcaggtcttcacggg

SEQ ID NO: 367985 - DNA, 20 bp, human
ggacgcgccgggtatatagc

SEQ ID NO: 367986 - DNA, 20 bp, human
ggcagggagtctggagtttc

SEQ ID NO: 367987 - DNA, 20 bp, human
gcagggggagggctagaagc

SEQ ID NO: 367988 - DNA, 20 bp, human
gaggaggagaagacgccact

SEQ ID NO: 367989 - DNA, 20 bp, human
gagtcatgccattgaagagg

SEQ ID NO: 367990 - DNA, 20 bp, human
gctcaggaaggcgtgaacca

SEQ ID NO: 367991 - DNA, 20 bp, human
gattagtcatgccattgaag

SEQ ID NO: 367992 - DNA, 20 bp, human
gctgtgcctggcagggagtc

SEQ ID NO: 367993 - DNA, 20 bp, human
gcacctggaggtaaagaggt

SEQ ID NO: 367994 - DNA, 20 bp, human
gtaagactatccgtagctct

SEQ ID NO: 367995 - DNA, 20 bp, human
ggtcttagttcatgtgcttg

SEQ ID NO: 367996 - DNA, 20 bp, human
gaggtggagtcgcatatgag

SEQ ID NO: 367997 - DNA, 20 bp, human
gtcccgccggggccgcttgg

SEQ ID NO: 367998 - DNA, 20 bp, human
gggcgggcgcagccaccaag

SEQ ID NO: 367999 - DNA, 20 bp, human
gcctgtgccggtaggagagg

SEQ ID NO: 368000 - DNA, 20 bp, human
gggctgcgcccgccgctcag

SEQ ID NO: 368001 - DNA, 20 bp, human
gtctcctaccggcacaggaa

SEQ ID NO: 368002 - DNA, 20 bp, human
gcccggcgggaaacccggat

SEQ ID NO: 368003 - DNA, 20 bp, human
gtggcctccccgagacccgc

SEQ ID NO: 368004 - DNA, 20 bp, human
ggggtctcggggaggccaat

SEQ ID NO: 368005 - DNA, 20 bp, human
ggcgaggaacggttccggca

SEQ ID NO: 368006 - DNA, 20 bp, human
gagcccaagcccccccacga

SEQ ID NO: 368007 - DNA, 20 bp, human
ggggagtgtgggcgtgggaa

SEQ ID NO: 368008 - DNA, 20 bp, human
gcgcctcccgcggtgatctg

SEQ ID NO: 368009 - DNA, 20 bp, human
gcggggccccagatcaccgc

SEQ ID NO: 368010 - DNA, 20 bp, human
gcgcgggagccctcgtgggg

SEQ ID NO: 368011 - DNA, 20 bp, human
gaagtggaggaggaacgcgg

SEQ ID NO: 368012 - DNA, 20 bp, human
gggccccagatcaccgcggg

SEQ ID NO: 368013 - DNA, 20 bp, human
gagccctcgtgggggggctt

SEQ ID NO: 368014 - DNA, 20 bp, human
ggctgtggcccccgtggcta

SEQ ID NO: 368015 - DNA, 20 bp, human
gcatctggcgcccactcacc

SEQ ID NO: 368016 - DNA, 20 bp, human
gcctgggttaaccattccag

SEQ ID NO: 368017 - DNA, 20 bp, human
gcactgcctgtgggggtcga

SEQ ID NO: 368018 - DNA, 20 bp, human
gctgcatgaggacctctccc

SEQ ID NO: 368019 - DNA, 20 bp, human
ggctgggctaggacccgccc

SEQ ID NO: 368020 - DNA, 20 bp, human
ggttggggaggatctgccac

SEQ ID NO: 368021 - DNA, 20 bp, human
gtgggccccttcccctggac

SEQ ID NO: 368022 - DNA, 20 bp, human
gctgcaggaatacctgggag

SEQ ID NO: 368023 - DNA, 20 bp, human
gtcctgcagagctctgtgat

SEQ ID NO: 368024 - DNA, 20 bp, human
ggttgtccagggccagactg

SEQ ID NO: 368025 - DNA, 20 bp, human
gggcagtggctccaggctgt

SEQ ID NO: 368026 - DNA, 20 bp, human
gaccccgccccaaggcaggt

SEQ ID NO: 368027 - DNA, 20 bp, human
gaaggtggggtgtccctaga

SEQ ID NO: 368028 - DNA, 20 bp, human
ggtggggtgtccctagaagg

SEQ ID NO: 368029 - DNA, 20 bp, human
gaaaggggaagccctgcggg

SEQ ID NO: 368030 - DNA, 20 bp, human
gcccccagctggaaccaaga

SEQ ID NO: 368031 - DNA, 20 bp, human
gggtgtccctagaaggtgga

SEQ ID NO: 368032 - DNA, 20 bp, human
gggagaggaaacaaggatct

SEQ ID NO: 368033 - DNA, 20 bp, human
ggtggggtggaagtacatga

SEQ ID NO: 368034 - DNA, 20 bp, human
gccaaggaatatggggatgg

SEQ ID NO: 368035 - DNA, 20 bp, human
gactaggcatttgggaaggt

SEQ ID NO: 368036 - DNA, 20 bp, human
ggggcgctggctagcgagta

SEQ ID NO: 368037 - DNA, 20 bp, human
gagccccgggtccttcggga

SEQ ID NO: 368038 - DNA, 20 bp, human
ggctgggagccgggtcgtaa

SEQ ID NO: 368039 - DNA, 20 bp, human
ggggaccctcccgaaggacc

SEQ ID NO: 368040 - DNA, 20 bp, human
gtggctcgggaccctcccga

SEQ ID NO: 368041 - DNA, 20 bp, human
gggaaaagcggatccgtctg

SEQ ID NO: 368042 - DNA, 20 bp, human
gccagccgagggccagacgg

SEQ ID NO: 368043 - DNA, 20 bp, human
gctagcgcattgtaagcagt

SEQ ID NO: 368044 - DNA, 20 bp, human
gacccggggctcatgtgcct

SEQ ID NO: 368045 - DNA, 20 bp, human
ggagcgaaatccgacccgag

SEQ ID NO: 368046 - DNA, 20 bp, human
gcggcccaagacatgatccc

SEQ ID NO: 368047 - DNA, 20 bp, human
gaggcgggctaacaggccgg

SEQ ID NO: 368048 - DNA, 20 bp, human
ggcgaggcgggctaacaggc

SEQ ID NO: 368049 - DNA, 20 bp, human
gggtgctaaggccctcggga

SEQ ID NO: 368050 - DNA, 20 bp, human
gtggggtcgcgtcccggtgg

SEQ ID NO: 368051 - DNA, 20 bp, human
gtagttggaaaccgaggagg

SEQ ID NO: 368052 - DNA, 20 bp, human
gaggggaggctggacgggac

SEQ ID NO: 368053 - DNA, 20 bp, human
ggtgggcgaggcgggctaac

SEQ ID NO: 368054 - DNA, 20 bp, human
gggtaaaggcattagggcga

SEQ ID NO: 368055 - DNA, 20 bp, human
gtgacacgcatgcgcgagtg

SEQ ID NO: 368056 - DNA, 20 bp, human
gtggacgcgcgcgggagttc

SEQ ID NO: 368057 - DNA, 20 bp, human
gaggtaaccctcaggagtga

SEQ ID NO: 368058 - DNA, 20 bp, human
gaatgagcagcgcccgcgga

SEQ ID NO: 368059 - DNA, 20 bp, human
gagcagcgcccgcggaggga

SEQ ID NO: 368060 - DNA, 20 bp, human
gaccgccggccttccctccg

SEQ ID NO: 368061 - DNA, 20 bp, human
gtaaccctcaggagtgaggg

SEQ ID NO: 368062 - DNA, 20 bp, human
ggggtcaccacgtgctacgg

SEQ ID NO: 368063 - DNA, 20 bp, human
gagagggcatggctgatgct

SEQ ID NO: 368064 - DNA, 20 bp, human
ggaaactccgcgatccgctc

SEQ ID NO: 368065 - DNA, 20 bp, human
ggagttcaggctggggaaat

SEQ ID NO: 368066 - DNA, 20 bp, human
gatacggctcaagtgatcac

SEQ ID NO: 368067 - DNA, 20 bp, human
gtacaaccgacctccggccc

SEQ ID NO: 368068 - DNA, 20 bp, human
gagggggtggttagacaatc

SEQ ID NO: 368069 - DNA, 20 bp, human
ggcggcaacgtaagtatcct

SEQ ID NO: 368070 - DNA, 20 bp, human
gggggaggggaaaacgtatg

SEQ ID NO: 368071 - DNA, 20 bp, human
gccgggttacaaccgacctc

SEQ ID NO: 368072 - DNA, 20 bp, human
gttgccgccatttttgagta

SEQ ID NO: 368073 - DNA, 20 bp, human
gtccccgccactctagtcgg

SEQ ID NO: 368074 - DNA, 20 bp, human
gtaagctcgtgtaacggcgg

SEQ ID NO: 368075 - DNA, 20 bp, human
ggcaacgcaaaagagccttt

SEQ ID NO: 368076 - DNA, 20 bp, human
gcgggcagatcaccaagggc

SEQ ID NO: 368077 - DNA, 20 bp, human
gagtccagccaaggaagaaa

SEQ ID NO: 368078 - DNA, 20 bp, human
gaaaaatctcgggactggcg

SEQ ID NO: 368079 - DNA, 20 bp, human
gttaccctttcttccttggc

SEQ ID NO: 368080 - DNA, 20 bp, human
gggctggactttgtccagct

SEQ ID NO: 368081 - DNA, 20 bp, human
gagaaagggtaaaagtacag

SEQ ID NO: 368082 - DNA, 20 bp, human
gaaaaaaaaaatctcgggac

SEQ ID NO: 368083 - DNA, 20 bp, human
gctgcaacgtctgtcttccg

SEQ ID NO: 368084 - DNA, 20 bp, human
gtgtgagccaagatgcccag

SEQ ID NO: 368085 - DNA, 20 bp, human
gaaaaaaaaaaatctccact

SEQ ID NO: 368086 - DNA, 20 bp, human
gggactgccccagccgtggg

SEQ ID NO: 368087 - DNA, 20 bp, human
gaggccggggagagcgttct

SEQ ID NO: 368088 - DNA, 20 bp, human
gaaactgcgcggaggcacag

SEQ ID NO: 368089 - DNA, 20 bp, human
gggtccgagggtccaggtag

SEQ ID NO: 368090 - DNA, 20 bp, human
gtacctccggttgaatctgg

SEQ ID NO: 368091 - DNA, 20 bp, human
gaaggacaatgtgccgggga

SEQ ID NO: 368092 - DNA, 20 bp, human
ggctaccggcgcagaagtgg

SEQ ID NO: 368093 - DNA, 20 bp, human
gcctcactccgtcacgaggg

SEQ ID NO: 368094 - DNA, 20 bp, human
ggggaagggggaacagtcgt

SEQ ID NO: 368095 - DNA, 20 bp, human
ggagtcacccaccctcgtga

SEQ ID NO: 368096 - DNA, 20 bp, human
ggcccggcgcgcaaggttga

SEQ ID NO: 368097 - DNA, 20 bp, human
gcaagggcgcggggacggcc

SEQ ID NO: 368098 - DNA, 20 bp, human
gtccccgcgcccttgcccgg

SEQ ID NO: 368099 - DNA, 20 bp, human
gacgcccgggcggccctgaa

SEQ ID NO: 368100 - DNA, 20 bp, human
gccgtccccgcgcccttgcc

SEQ ID NO: 368101 - DNA, 20 bp, human
gcggccgcagacaccctgcg

SEQ ID NO: 368102 - DNA, 20 bp, human
gtggacgcttgcgcccgggg

SEQ ID NO: 368103 - DNA, 20 bp, human
gactcctccgggcaagggcg

SEQ ID NO: 368104 - DNA, 20 bp, human
ggggcgactcctccgggcaa

SEQ ID NO: 368105 - DNA, 20 bp, human
gcggttggacgcttgcgccc

SEQ ID NO: 368106 - DNA, 20 bp, human
ggggtgggtgcagctggatt

SEQ ID NO: 368107 - DNA, 20 bp, human
gaggagccccaaaggtctac

SEQ ID NO: 368108 - DNA, 20 bp, human
ggctggattcggttgggatg

SEQ ID NO: 368109 - DNA, 20 bp, human
ggccccaaaggtctacgggg

SEQ ID NO: 368110 - DNA, 20 bp, human
ggaaaaaagagggcttgaaa

SEQ ID NO: 368111 - DNA, 20 bp, human
gcacccaccccgtagacctt

SEQ ID NO: 368112 - DNA, 20 bp, human
gtgaatgtcgtgtgaaagaa

SEQ ID NO: 368113 - DNA, 20 bp, human
gctaaagtgaaggagtgaac

SEQ ID NO: 368114 - DNA, 20 bp, human
gggatcgccataaagtggag

SEQ ID NO: 368115 - DNA, 20 bp, human
gtctcaatcaggagccccaa

SEQ ID NO: 368116 - DNA, 20 bp, human
gcggtggcaaacgtgatctg

SEQ ID NO: 368117 - DNA, 20 bp, human
gggcgccggggaaacgcagt

SEQ ID NO: 368118 - DNA, 20 bp, human
gaacgtgatctggggcagac

SEQ ID NO: 368119 - DNA, 20 bp, human
gcctcctgggcacgaagcga

SEQ ID NO: 368120 - DNA, 20 bp, human
gtcccagcgcccatcggccc

SEQ ID NO: 368121 - DNA, 20 bp, human
gcaacagcagcagccaatca

SEQ ID NO: 368122 - DNA, 20 bp, human
gtgatctggggcagactggg

SEQ ID NO: 368123 - DNA, 20 bp, human
gggactcgggcccaactggt

SEQ ID NO: 368124 - DNA, 20 bp, human
gcccctccccagtccctgat

SEQ ID NO: 368125 - DNA, 20 bp, human
gccaccggcagccaaccagt

SEQ ID NO: 368126 - DNA, 20 bp, human
gcggggcggtgctgtcgctc

SEQ ID NO: 368127 - DNA, 20 bp, human
ggggcgctggatgacggcaa

SEQ ID NO: 368128 - DNA, 20 bp, human
ggcagacagctgtcgggaac

SEQ ID NO: 368129 - DNA, 20 bp, human
gtcccgacagctgtctgcca

SEQ ID NO: 368130 - DNA, 20 bp, human
gcggggcggcggggagtcag

SEQ ID NO: 368131 - DNA, 20 bp, human
gcagcagcgcatagtgtggg

SEQ ID NO: 368132 - DNA, 20 bp, human
gcccgcgggccacatcacca

SEQ ID NO: 368133 - DNA, 20 bp, human
gggccacatcaccaaggccc

SEQ ID NO: 368134 - DNA, 20 bp, human
gttggagcaggcggtgaagt

SEQ ID NO: 368135 - DNA, 20 bp, human
ggaacgggggcgctggatga

SEQ ID NO: 368136 - DNA, 20 bp, human
gggggccccagctgcgagga

SEQ ID NO: 368137 - DNA, 20 bp, human
ggggatcgcggggacggaag

SEQ ID NO: 368138 - DNA, 20 bp, human
gatcgcggggacggaagtgg

SEQ ID NO: 368139 - DNA, 20 bp, human
gtacgggagaggcgcctatg

SEQ ID NO: 368140 - DNA, 20 bp, human
gctcccgcgggggcgccagt

SEQ ID NO: 368141 - DNA, 20 bp, human
gcgggccctcctcgcagctg

SEQ ID NO: 368142 - DNA, 20 bp, human
gcgcccccgcgggagcgcta

SEQ ID NO: 368143 - DNA, 20 bp, human
ggaaaacgaaaggcatgtgt

SEQ ID NO: 368144 - DNA, 20 bp, human
gcggccgggcggccggacct

SEQ ID NO: 368145 - DNA, 20 bp, human
gcgcgggagcgctacgggag

SEQ ID NO: 368146 - DNA, 20 bp, human
gaagctgggcttggatgaag

SEQ ID NO: 368147 - DNA, 20 bp, human
gggagagtgtccgggaccag

SEQ ID NO: 368148 - DNA, 20 bp, human
gtgccagagggagagtgtcc

SEQ ID NO: 368149 - DNA, 20 bp, human
gaaactcgacctaaggggag

SEQ ID NO: 368150 - DNA, 20 bp, human
gggggcggggagcgacaact

SEQ ID NO: 368151 - DNA, 20 bp, human
gctgcctgatgttagtctgg

SEQ ID NO: 368152 - DNA, 20 bp, human
gccaaggcggccctgaatcg

SEQ ID NO: 368153 - DNA, 20 bp, human
ggggtccagggtggaaatgt

SEQ ID NO: 368154 - DNA, 20 bp, human
ggtctcctcggaagaagcgg

SEQ ID NO: 368155 - DNA, 20 bp, human
gggaagcagtgttttccgag

SEQ ID NO: 368156 - DNA, 20 bp, human
gcgcgagcagaagccggttc

SEQ ID NO: 368157 - DNA, 20 bp, human
gctccgagtccggccggaac

SEQ ID NO: 368158 - DNA, 20 bp, human
ggggcgggcccgacacacgc

SEQ ID NO: 368159 - DNA, 20 bp, human
gcggggggctggctgctgat

SEQ ID NO: 368160 - DNA, 20 bp, human
gcgggcccgacacacgccgg

SEQ ID NO: 368161 - DNA, 20 bp, human
ggggtccgaggccatggaaa

SEQ ID NO: 368162 - DNA, 20 bp, human
ggggcgtagggagaaaacgt

SEQ ID NO: 368163 - DNA, 20 bp, human
ggaacccagcgtgggagacg

SEQ ID NO: 368164 - DNA, 20 bp, human
gtcttggggtcggaataaaa

SEQ ID NO: 368165 - DNA, 20 bp, human
ggcgctgtgactcgggttga

SEQ ID NO: 368166 - DNA, 20 bp, human
gacaccgctggggttctagg

SEQ ID NO: 368167 - DNA, 20 bp, human
gaggctgaaaggcagcgagg

SEQ ID NO: 368168 - DNA, 20 bp, human
ggaaccccctagaaccccag

SEQ ID NO: 368169 - DNA, 20 bp, human
gggagggaaagacaccgctg

SEQ ID NO: 368170 - DNA, 20 bp, human
gtagagggagaagtttcaag

SEQ ID NO: 368171 - DNA, 20 bp, human
gcattcaactaacttggtta

SEQ ID NO: 368172 - DNA, 20 bp, human
gtcaagagggagaggtaaaa

SEQ ID NO: 368173 - DNA, 20 bp, human
gactcgctcaggcccaccta

SEQ ID NO: 368174 - DNA, 20 bp, human
gcaactaacttggttagggg

SEQ ID NO: 368175 - DNA, 20 bp, human
gagctctgggagtgtgaaac

SEQ ID NO: 368176 - DNA, 20 bp, human
ggaagggcccggccttgttc

SEQ ID NO: 368177 - DNA, 20 bp, human
gtgggggcggggagtctgat

SEQ ID NO: 368178 - DNA, 20 bp, human
gcagcacggcgctgcactgg

SEQ ID NO: 368179 - DNA, 20 bp, human
gtggagggcaacgcggtctg

SEQ ID NO: 368180 - DNA, 20 bp, human
gcaccagcacggcgctgcac

SEQ ID NO: 368181 - DNA, 20 bp, human
gtctctgcctcgaggctgga

SEQ ID NO: 368182 - DNA, 20 bp, human
ggcccttccgcgcgtgtcag

SEQ ID NO: 368183 - DNA, 20 bp, human
gcagctctctgcctcgaggc

SEQ ID NO: 368184 - DNA, 20 bp, human
gtcgaggctggagggcaacg

SEQ ID NO: 368185 - DNA, 20 bp, human
gcgggaggcggggggacaga

SEQ ID NO: 368186 - DNA, 20 bp, human
ggggagcctcgagagggcga

SEQ ID NO: 368187 - DNA, 20 bp, human
gcccgcgcgcctcctccaat

SEQ ID NO: 368188 - DNA, 20 bp, human
gtccaatgggagcctcgaga

SEQ ID NO: 368189 - DNA, 20 bp, human
ggccctctcgaggctcccat

SEQ ID NO: 368190 - DNA, 20 bp, human
gagcctcgagagggcgaggg

SEQ ID NO: 368191 - DNA, 20 bp, human
gtcgaggctcccattggagg

SEQ ID NO: 368192 - DNA, 20 bp, human
gccccgccctcgccctctcg

SEQ ID NO: 368193 - DNA, 20 bp, human
gtctcaagtaaccctcttga

SEQ ID NO: 368194 - DNA, 20 bp, human
ggttacttgagagctaagac

SEQ ID NO: 368195 - DNA, 20 bp, human
gcaccatgcacaccctcaag

SEQ ID NO: 368196 - DNA, 20 bp, human
gaagccgcagggttcccggg

SEQ ID NO: 368197 - DNA, 20 bp, human
gaaccctgcggcttcaccct

SEQ ID NO: 368198 - DNA, 20 bp, human
ggggcagctgcccagactaa

SEQ ID NO: 368199 - DNA, 20 bp, human
ggtgaagccgcagggttccc

SEQ ID NO: 368200 - DNA, 20 bp, human
gccgcagggttcccgggtgg

SEQ ID NO: 368201 - DNA, 20 bp, human
gccacggaaacgccctttca

SEQ ID NO: 368202 - DNA, 20 bp, human
gcctgggaacaccctgccac

SEQ ID NO: 368203 - DNA, 20 bp, human
ggggcggggaaggctaaatg

SEQ ID NO: 368204 - DNA, 20 bp, human
gggtggccaggggttctagg

SEQ ID NO: 368205 - DNA, 20 bp, human
gcctcccgggtcccttagtc

SEQ ID NO: 368206 - DNA, 20 bp, human
gggaaggtgcgtgaaggcgg

SEQ ID NO: 368207 - DNA, 20 bp, human
gccggcgccgccacgacctt

SEQ ID NO: 368208 - DNA, 20 bp, human
ggggagccgctgcctcgagg

SEQ ID NO: 368209 - DNA, 20 bp, human
ggggactcgacccttccccg

SEQ ID NO: 368210 - DNA, 20 bp, human
ggctcctcccccgagggccg

SEQ ID NO: 368211 - DNA, 20 bp, human
gaacccatgccgggaagagg

SEQ ID NO: 368212 - DNA, 20 bp, human
gaggcgcagaggcgaacggg

SEQ ID NO: 368213 - DNA, 20 bp, human
gtcgcagcctcggccctcgg

SEQ ID NO: 368214 - DNA, 20 bp, human
gcggaagcgtccggcaggga

SEQ ID NO: 368215 - DNA, 20 bp, human
gcccggggctcctcccccga

SEQ ID NO: 368216 - DNA, 20 bp, human
ggtacggcagttaaggtagt

SEQ ID NO: 368217 - DNA, 20 bp, human
gcatgccaggtcgttcactg

SEQ ID NO: 368218 - DNA, 20 bp, human
ggggtggggctgtgacgtgt

SEQ ID NO: 368219 - DNA, 20 bp, human
ggctcagggctatttcctgg

SEQ ID NO: 368220 - DNA, 20 bp, human
gaaggaactagagtgtgtcg

SEQ ID NO: 368221 - DNA, 20 bp, human
gtgggagtgtacggcagtta

SEQ ID NO: 368222 - DNA, 20 bp, human
gtgtcggggaccacaggcgg

SEQ ID NO: 368223 - DNA, 20 bp, human
gcggaccacagtgaacgacc

SEQ ID NO: 368224 - DNA, 20 bp, human
gactttgtgcccagcgggct

SEQ ID NO: 368225 - DNA, 20 bp, human
ggctgtgacgtgtgggaggg

SEQ ID NO: 368226 - DNA, 20 bp, human
gggctcagacgggacaccgg

SEQ ID NO: 368227 - DNA, 20 bp, human
gccgccagcccccatccaac

SEQ ID NO: 368228 - DNA, 20 bp, human
ggagagaccgcggccatctg

SEQ ID NO: 368229 - DNA, 20 bp, human
gtcagacgggacaccggggg

SEQ ID NO: 368230 - DNA, 20 bp, human
ggcggtagccggttggatgg

SEQ ID NO: 368231 - DNA, 20 bp, human
gtctactggaaagacaacgg

SEQ ID NO: 368232 - DNA, 20 bp, human
gggaaagacaacggtggcgg

SEQ ID NO: 368233 - DNA, 20 bp, human
gactggaaagacaacggtgg

SEQ ID NO: 368234 - DNA, 20 bp, human
gccacagcagcgcaagaggg

SEQ ID NO: 368235 - DNA, 20 bp, human
gctcctgggccgggtcgcaa

SEQ ID NO: 368236 - DNA, 20 bp, human
ggggagcccggtgtcctcct

SEQ ID NO: 368237 - DNA, 20 bp, human
ggggccccgcgcggatgcgg

SEQ ID NO: 368238 - DNA, 20 bp, human
gcgtgcgcgaagcaccggga

SEQ ID NO: 368239 - DNA, 20 bp, human
gccactgcgcacatgggcac

SEQ ID NO: 368240 - DNA, 20 bp, human
gccgtcgtgcgcgaagcacc

SEQ ID NO: 368241 - DNA, 20 bp, human
gtcctcctgggcccttcccg

SEQ ID NO: 368242 - DNA, 20 bp, human
gtgcttcgcgcacgacggcg

SEQ ID NO: 368243 - DNA, 20 bp, human
ggaaaacggtgagaactgtg

SEQ ID NO: 368244 - DNA, 20 bp, human
gaccgggacgggcctcccgc

SEQ ID NO: 368245 - DNA, 20 bp, human
gggatctgccaggatcccgg

SEQ ID NO: 368246 - DNA, 20 bp, human
gagagggaacagtacaaagg

SEQ ID NO: 368247 - DNA, 20 bp, human
gcagctgtgaatcagccctc

SEQ ID NO: 368248 - DNA, 20 bp, human
gaacgtcttatggagccaga

SEQ ID NO: 368249 - DNA, 20 bp, human
ggagagagggaacagtacaa

SEQ ID NO: 368250 - DNA, 20 bp, human
gacaagttatgatgagaggg

SEQ ID NO: 368251 - DNA, 20 bp, human
gatcacaagttatgatgaga

SEQ ID NO: 368252 - DNA, 20 bp, human
ggtaataacgtgtgtgtgag

SEQ ID NO: 368253 - DNA, 20 bp, human
gcatgtgtgtgtgagaagcc

SEQ ID NO: 368254 - DNA, 20 bp, human
gaacttgtgatcttagaggc

SEQ ID NO: 368255 - DNA, 20 bp, human
gaccatctctgttggttgct

SEQ ID NO: 368256 - DNA, 20 bp, human
ggggtggggctggtacccag

SEQ ID NO: 368257 - DNA, 20 bp, human
ggcgacgggcagcccccgcg

SEQ ID NO: 368258 - DNA, 20 bp, human
gcctgccctaggtaatgata

SEQ ID NO: 368259 - DNA, 20 bp, human
ggctgcgaggggggatagag

SEQ ID NO: 368260 - DNA, 20 bp, human
gggtaatgatagggcagtct

SEQ ID NO: 368261 - DNA, 20 bp, human
ggcgaggcgggacggaggtg

SEQ ID NO: 368262 - DNA, 20 bp, human
gactgccctatcattaccta

SEQ ID NO: 368263 - DNA, 20 bp, human
gcccaggggaagaaagcggg

SEQ ID NO: 368264 - DNA, 20 bp, human
gtggcgagcgacagaggggg

SEQ ID NO: 368265 - DNA, 20 bp, human
gggggctgcccgtcgcggcg

SEQ ID NO: 368266 - DNA, 20 bp, human
gtagccagggctgcaggaca

SEQ ID NO: 368267 - DNA, 20 bp, human
gaggaggtctagatatgaag

SEQ ID NO: 368268 - DNA, 20 bp, human
gaggaagcttccggaatctc

SEQ ID NO: 368269 - DNA, 20 bp, human
gcaacagctaccccaggcct

SEQ ID NO: 368270 - DNA, 20 bp, human
gatgggtggctgtgctgata

SEQ ID NO: 368271 - DNA, 20 bp, human
gagagcacaaaatgcaggtc

SEQ ID NO: 368272 - DNA, 20 bp, human
gcctgaagagcacaaaatgc

SEQ ID NO: 368273 - DNA, 20 bp, human
ggtcctgacagcatgagtgg

SEQ ID NO: 368274 - DNA, 20 bp, human
gcaggccttggaagagagaa

SEQ ID NO: 368275 - DNA, 20 bp, human
gggcctttggcctgagattc

SEQ ID NO: 368276 - DNA, 20 bp, human
gtgcacccgcggcgagagtc

SEQ ID NO: 368277 - DNA, 20 bp, human
gtacaggtgaggtcatcccg

SEQ ID NO: 368278 - DNA, 20 bp, human
ggcccagccaggtgcacccg

SEQ ID NO: 368279 - DNA, 20 bp, human
ggctgggcgtgggccagcga

SEQ ID NO: 368280 - DNA, 20 bp, human
ggccgcgggtgcacctggct

SEQ ID NO: 368281 - DNA, 20 bp, human
gctctcgccgcgggtgcacc

SEQ ID NO: 368282 - DNA, 20 bp, human
gcccgccggacatttaagga

SEQ ID NO: 368283 - DNA, 20 bp, human
gaccagcgacgcgtggcgtg

SEQ ID NO: 368284 - DNA, 20 bp, human
ggaggtcatcccgcgggctg

SEQ ID NO: 368285 - DNA, 20 bp, human
gtccggtggcctcaggtcac

SEQ ID NO: 368286 - DNA, 20 bp, human
gtaggactggcgacagtcca

SEQ ID NO: 368287 - DNA, 20 bp, human
gcgccaggagccagcactcg

SEQ ID NO: 368288 - DNA, 20 bp, human
gcctggcgccagcacccccg

SEQ ID NO: 368289 - DNA, 20 bp, human
gcaggagcagcgtgacccgt

SEQ ID NO: 368290 - DNA, 20 bp, human
ggggagcgcaccgcgagtgc

SEQ ID NO: 368291 - DNA, 20 bp, human
gaccccccaccaccggggca

SEQ ID NO: 368292 - DNA, 20 bp, human
ggacctcccgcggatctctg

SEQ ID NO: 368293 - DNA, 20 bp, human
gactctgcctgaggtggcga

SEQ ID NO: 368294 - DNA, 20 bp, human
ggtccagggaagccaggcgc

SEQ ID NO: 368295 - DNA, 20 bp, human
gcaccgcgagtgctggctcc

SEQ ID NO: 368296 - DNA, 20 bp, human
gatccactagccactctcca

SEQ ID NO: 368297 - DNA, 20 bp, human
gtccaggggagagtgacgtc

SEQ ID NO: 368298 - DNA, 20 bp, human
gtcccctggagagtggctag

SEQ ID NO: 368299 - DNA, 20 bp, human
ggatccactccgggcctccg

SEQ ID NO: 368300 - DNA, 20 bp, human
gcactccgggcctccgaggg

SEQ ID NO: 368301 - DNA, 20 bp, human
ggtcgcgcgggatccactcc

SEQ ID NO: 368302 - DNA, 20 bp, human
ggcggcccaccactcaacag

SEQ ID NO: 368303 - DNA, 20 bp, human
ggaccgctgggcccaatcgc

SEQ ID NO: 368304 - DNA, 20 bp, human
ggcgctgtcactgttctacc

SEQ ID NO: 368305 - DNA, 20 bp, human
gagggccgctgaccgaccga

SEQ ID NO: 368306 - DNA, 20 bp, human
ggacccgcaggcgtccgcag

SEQ ID NO: 368307 - DNA, 20 bp, human
gaacctgaaacccccagcgg

SEQ ID NO: 368308 - DNA, 20 bp, human
gagtcctggcgtccgagacg

SEQ ID NO: 368309 - DNA, 20 bp, human
gcggacgccaggactcaccc

SEQ ID NO: 368310 - DNA, 20 bp, human
gcggctctccacctccgctg

SEQ ID NO: 368311 - DNA, 20 bp, human
gcctggctgcgcgctcagtc

SEQ ID NO: 368312 - DNA, 20 bp, human
gcaccactgcggacgcctgc

SEQ ID NO: 368313 - DNA, 20 bp, human
gacaccctaaccagcatcaa

SEQ ID NO: 368314 - DNA, 20 bp, human
gctaacggaacgcgctccgg

SEQ ID NO: 368315 - DNA, 20 bp, human
gggctgggtcctccacgtct

SEQ ID NO: 368316 - DNA, 20 bp, human
gcctactgcctcagccacta

SEQ ID NO: 368317 - DNA, 20 bp, human
gaggaacctgtcctccctag

SEQ ID NO: 368318 - DNA, 20 bp, human
gagggactcagtgccctagg

SEQ ID NO: 368319 - DNA, 20 bp, human
ggggatgagccctgcctcct

SEQ ID NO: 368320 - DNA, 20 bp, human
gggctaccatggcaacttgt

SEQ ID NO: 368321 - DNA, 20 bp, human
gtggctgatgagtaaggggc

SEQ ID NO: 368322 - DNA, 20 bp, human
gacacaacaggcagcggtct

SEQ ID NO: 368323 - DNA, 20 bp, human
gcagcctggctgatgagtaa

SEQ ID NO: 368324 - DNA, 20 bp, human
gccactgggcgtcctgtacc

SEQ ID NO: 368325 - DNA, 20 bp, human
ggcaggaggaggggctacca

SEQ ID NO: 368326 - DNA, 20 bp, human
gacacggcgggtctggggat

SEQ ID NO: 368327 - DNA, 20 bp, human
gaagctgccgtgtcgtttgg

SEQ ID NO: 368328 - DNA, 20 bp, human
ggggaatgctgctaaaaagg

SEQ ID NO: 368329 - DNA, 20 bp, human
gcggcagcttcgcaaagcgg

SEQ ID NO: 368330 - DNA, 20 bp, human
gcagcttcgcaaagcggcgg

SEQ ID NO: 368331 - DNA, 20 bp, human
gaatccggacacggcgggtc

SEQ ID NO: 368332 - DNA, 20 bp, human
gacacggcagcttcgcaaag

SEQ ID NO: 368333 - DNA, 20 bp, human
gcggtggcgtctgcggttcc

SEQ ID NO: 368334 - DNA, 20 bp, human
gctcccgcggctccggctgg

SEQ ID NO: 368335 - DNA, 20 bp, human
gtgtccggattgttggacct

SEQ ID NO: 368336 - DNA, 20 bp, human
gggcaccgggcgctgaagca

SEQ ID NO: 368337 - DNA, 20 bp, human
gcggggctccctgtcgccgg

SEQ ID NO: 368338 - DNA, 20 bp, human
gcgctgaagcaaggctgcgc

SEQ ID NO: 368339 - DNA, 20 bp, human
ggctcggggctccctgtcgc

SEQ ID NO: 368340 - DNA, 20 bp, human
gaagggggcgggcagcgcag

SEQ ID NO: 368341 - DNA, 20 bp, human
ggaaggagccagctggcacc

SEQ ID NO: 368342 - DNA, 20 bp, human
gtcgtctgagacgaaggcgc

SEQ ID NO: 368343 - DNA, 20 bp, human
ggctgcgctggcaccggtcc

SEQ ID NO: 368344 - DNA, 20 bp, human
ggctccctgtcgccggtggc

SEQ ID NO: 368345 - DNA, 20 bp, human
gccctccccaggactggcgg

SEQ ID NO: 368346 - DNA, 20 bp, human
gcaggagaaccatggggacc

SEQ ID NO: 368347 - DNA, 20 bp, human
gagggccccgagaggccttg

SEQ ID NO: 368348 - DNA, 20 bp, human
gcacccagtgggagcggggt

SEQ ID NO: 368349 - DNA, 20 bp, human
ggaagagtcaggagaaccat

SEQ ID NO: 368350 - DNA, 20 bp, human
gaggcgggggcatgagtcag

SEQ ID NO: 368351 - DNA, 20 bp, human
gaggcctctcggggccctcc

SEQ ID NO: 368352 - DNA, 20 bp, human
gggaccaggagggccccgag

SEQ ID NO: 368353 - DNA, 20 bp, human
gactcacagctgtccagatg

SEQ ID NO: 368354 - DNA, 20 bp, human
ggggggctggccaggcgggt

SEQ ID NO: 368355 - DNA, 20 bp, human
gccagtggggcgggcagatt

SEQ ID NO: 368356 - DNA, 20 bp, human
gcaggtgtgggcagtgatac

SEQ ID NO: 368357 - DNA, 20 bp, human
gttaccggcccagggatcca

SEQ ID NO: 368358 - DNA, 20 bp, human
ggccagcagcccgagtgagt

SEQ ID NO: 368359 - DNA, 20 bp, human
gtgtcaaaatcagactgatc

SEQ ID NO: 368360 - DNA, 20 bp, human
gaaaatcagactgatctggt

SEQ ID NO: 368361 - DNA, 20 bp, human
gggcagtgatacagggcttg

SEQ ID NO: 368362 - DNA, 20 bp, human
gcacatggctcctactcact

SEQ ID NO: 368363 - DNA, 20 bp, human
ggcaatgctacaagtctaat

SEQ ID NO: 368364 - DNA, 20 bp, human
ggatcaggtagctctgaagc

SEQ ID NO: 368365 - DNA, 20 bp, human
gtctgcttagtattcggatc

SEQ ID NO: 368366 - DNA, 20 bp, human
gccggcgcgcacaggctcga

SEQ ID NO: 368367 - DNA, 20 bp, human
ggaggtccccggtcgaaagg

SEQ ID NO: 368368 - DNA, 20 bp, human
gacccagcgtcgcgagttta

SEQ ID NO: 368369 - DNA, 20 bp, human
ggggccaaaccgagtagacc

SEQ ID NO: 368370 - DNA, 20 bp, human
gcgaaggagccgggtctact

SEQ ID NO: 368371 - DNA, 20 bp, human
gcccgggcgcggcgtctgag

SEQ ID NO: 368372 - DNA, 20 bp, human
gtagcccggggaatgcacgg

SEQ ID NO: 368373 - DNA, 20 bp, human
gccgcgccctcacccgcggg

SEQ ID NO: 368374 - DNA, 20 bp, human
gcctcagtcgcacagctcgg

SEQ ID NO: 368375 - DNA, 20 bp, human
gagcgggcgtggccctgcgg

SEQ ID NO: 368376 - DNA, 20 bp, human
gggcgcaggcgccaatcaca

SEQ ID NO: 368377 - DNA, 20 bp, human
gaccgaagggtgggtttcga

SEQ ID NO: 368378 - DNA, 20 bp, human
gaacgtaaagaccgaagggt

SEQ ID NO: 368379 - DNA, 20 bp, human
gtcccagtggcgtctgtagg

SEQ ID NO: 368380 - DNA, 20 bp, human
gcgggatgctgtgcagaacg

SEQ ID NO: 368381 - DNA, 20 bp, human
gagaaaaacaaaacggttat

SEQ ID NO: 368382 - DNA, 20 bp, human
ggacctcaggaccctgtgat

SEQ ID NO: 368383 - DNA, 20 bp, human
gtggcgtctgtaggcggcga

SEQ ID NO: 368384 - DNA, 20 bp, human
ggacctggagcgttgcgaag

SEQ ID NO: 368385 - DNA, 20 bp, human
gaatgcccaagtccctccag

SEQ ID NO: 368386 - DNA, 20 bp, human
gccaagggacggcatcctcg

SEQ ID NO: 368387 - DNA, 20 bp, human
ggccccgagtggagaagctt

SEQ ID NO: 368388 - DNA, 20 bp, human
gcgggggcggcccctggtgc

SEQ ID NO: 368389 - DNA, 20 bp, human
gccccccggcgcaccgtgcg

SEQ ID NO: 368390 - DNA, 20 bp, human
ggggatccctagcgtgagaa

SEQ ID NO: 368391 - DNA, 20 bp, human
gccgtcccttggctccatta

SEQ ID NO: 368392 - DNA, 20 bp, human
gcccgcctccccacccgcga

SEQ ID NO: 368393 - DNA, 20 bp, human
gccccaagcttctccactcg

SEQ ID NO: 368394 - DNA, 20 bp, human
gcggtcccgccttcgcgggt

SEQ ID NO: 368395 - DNA, 20 bp, human
gggtgccgtaatggagccaa

SEQ ID NO: 368396 - DNA, 20 bp, human
gtggagcggtggccacgtgg

SEQ ID NO: 368397 - DNA, 20 bp, human
gaggccagccgggtctgaga

SEQ ID NO: 368398 - DNA, 20 bp, human
ggggccagtgtgaccaatag

SEQ ID NO: 368399 - DNA, 20 bp, human
gctgggtggcacgtgggcag

SEQ ID NO: 368400 - DNA, 20 bp, human
gggagctcgcctgccacgac

SEQ ID NO: 368401 - DNA, 20 bp, human
ggcccagaggggcacgtgac

SEQ ID NO: 368402 - DNA, 20 bp, human
ggcgggcctgggtggcacgt

SEQ ID NO: 368403 - DNA, 20 bp, human
gcaagtctgcacgcgggcca

SEQ ID NO: 368404 - DNA, 20 bp, human
gcgagctccgcccagaaccc

SEQ ID NO: 368405 - DNA, 20 bp, human
gcgggtctgagacgggttgc

SEQ ID NO: 368406 - DNA, 20 bp, human
gcccgcccgctcccattgtg

SEQ ID NO: 368407 - DNA, 20 bp, human
gaaggggcgcacgggcaggt

SEQ ID NO: 368408 - DNA, 20 bp, human
ggcgccccacgcatcgctgg

SEQ ID NO: 368409 - DNA, 20 bp, human
gcgggccgcacaatgggagc

SEQ ID NO: 368410 - DNA, 20 bp, human
gggaggctaaaagcagggtt

SEQ ID NO: 368411 - DNA, 20 bp, human
gccagcccccagcgatgcgt

SEQ ID NO: 368412 - DNA, 20 bp, human
ggccggggcggggtgagtca

SEQ ID NO: 368413 - DNA, 20 bp, human
gcagggttggggagcgaatc

SEQ ID NO: 368414 - DNA, 20 bp, human
gagcgaatctgggggattgt

SEQ ID NO: 368415 - DNA, 20 bp, human
gctgcggggcccgcgcgtgg

SEQ ID NO: 368416 - DNA, 20 bp, human
ggagcgcgcacccacccagg

SEQ ID NO: 368417 - DNA, 20 bp, human
ggaaaggggaaaggtggcgc

SEQ ID NO: 368418 - DNA, 20 bp, human
gcggcgcagacaacttcccg

SEQ ID NO: 368419 - DNA, 20 bp, human
gtgaacggcccgcgaggaaa

SEQ ID NO: 368420 - DNA, 20 bp, human
gccccagcctccaaccccgg

SEQ ID NO: 368421 - DNA, 20 bp, human
gtcccgggctcgcgcctcca

SEQ ID NO: 368422 - DNA, 20 bp, human
gagagcggggcaaaggcgct

SEQ ID NO: 368423 - DNA, 20 bp, human
gggcaaagttgtgactactt

SEQ ID NO: 368424 - DNA, 20 bp, human
gcgctcgccgcgcaccacac

SEQ ID NO: 368425 - DNA, 20 bp, human
ggcgcgggagagcggggcaa

SEQ ID NO: 368426 - DNA, 20 bp, human
gaatgtgtgaaggactgggg

SEQ ID NO: 368427 - DNA, 20 bp, human
gtaagcaccaggggaggtgt

SEQ ID NO: 368428 - DNA, 20 bp, human
gtgtagagagaatataggtg

SEQ ID NO: 368429 - DNA, 20 bp, human
gaaggaatgtgtgaaggact

SEQ ID NO: 368430 - DNA, 20 bp, human
gaggaagcactcatggggaa

SEQ ID NO: 368431 - DNA, 20 bp, human
ggagaagaaggggggtttga

SEQ ID NO: 368432 - DNA, 20 bp, human
gggcctgcagagaggatcct

SEQ ID NO: 368433 - DNA, 20 bp, human
gagggtgagagagaaatctc

SEQ ID NO: 368434 - DNA, 20 bp, human
gtacccctgcctttataaag

SEQ ID NO: 368435 - DNA, 20 bp, human
gacctcccctggtgcttaac

SEQ ID NO: 368436 - DNA, 20 bp, human
gaggactggagatgggtgat

SEQ ID NO: 368437 - DNA, 20 bp, human
ggcgaggtagagacccactc

SEQ ID NO: 368438 - DNA, 20 bp, human
gtggtgggagttggagctaa

SEQ ID NO: 368439 - DNA, 20 bp, human
gtggccgggggttaccaggc

SEQ ID NO: 368440 - DNA, 20 bp, human
gagttggagctaagggagca

SEQ ID NO: 368441 - DNA, 20 bp, human
gtgtgctcgggatagcccat

SEQ ID NO: 368442 - DNA, 20 bp, human
gactctggccgggggttacc

SEQ ID NO: 368443 - DNA, 20 bp, human
gcatcagccccaagtggaaa

SEQ ID NO: 368444 - DNA, 20 bp, human
gtagagacccactctggccg

SEQ ID NO: 368445 - DNA, 20 bp, human
ggtggaaagggttgaaaatt

SEQ ID NO: 368446 - DNA, 20 bp, human
gcccggcgccgggctcgtca

SEQ ID NO: 368447 - DNA, 20 bp, human
gtcctgaggaggtggcacgg

SEQ ID NO: 368448 - DNA, 20 bp, human
gccgctaggccaccgggaga

SEQ ID NO: 368449 - DNA, 20 bp, human
gggaaggaggagagccgcgt

SEQ ID NO: 368450 - DNA, 20 bp, human
gggggcggtgcgtcctgagg

SEQ ID NO: 368451 - DNA, 20 bp, human
gggcggtgccagactggcag

SEQ ID NO: 368452 - DNA, 20 bp, human
gggccgcgccgctaggccac

SEQ ID NO: 368453 - DNA, 20 bp, human
gtcccggtggcctagcggcg

SEQ ID NO: 368454 - DNA, 20 bp, human
gaagtccgccagccgccgat

SEQ ID NO: 368455 - DNA, 20 bp, human
gagcctcctcagcgcgcccg

SEQ ID NO: 368456 - DNA, 20 bp, human
gggtaccctgggctaccgcg

SEQ ID NO: 368457 - DNA, 20 bp, human
gagcacgggaggacgctgtc

SEQ ID NO: 368458 - DNA, 20 bp, human
gacgggaggacgctgtccgg

SEQ ID NO: 368459 - DNA, 20 bp, human
gaggcaaccgggcccgggag

SEQ ID NO: 368460 - DNA, 20 bp, human
gccctccccgcggtagccca

SEQ ID NO: 368461 - DNA, 20 bp, human
gttccaaggcaaccgggccc

SEQ ID NO: 368462 - DNA, 20 bp, human
gacgctgtccggcggtaccc

SEQ ID NO: 368463 - DNA, 20 bp, human
gaggcggtttccaaggcaac

SEQ ID NO: 368464 - DNA, 20 bp, human
gcggggagccaaccgctccc

SEQ ID NO: 368465 - DNA, 20 bp, human
gaccctgggctaccgcgggg

SEQ ID NO: 368466 - DNA, 20 bp, human
gaagtaggggagtaggtgac

SEQ ID NO: 368467 - DNA, 20 bp, human
ggggtggggtaagcaagtag

SEQ ID NO: 368468 - DNA, 20 bp, human
ggtaggtgaccggtagagtc

SEQ ID NO: 368469 - DNA, 20 bp, human
ggccccaggttgggcatttc

SEQ ID NO: 368470 - DNA, 20 bp, human
gtctccagaaatgcccaacc

SEQ ID NO: 368471 - DNA, 20 bp, human
ggcacaacacaaacagaaca

SEQ ID NO: 368472 - DNA, 20 bp, human
gtgctgactccagactctac

SEQ ID NO: 368473 - DNA, 20 bp, human
gacagggtaagggagatagc

SEQ ID NO: 368474 - DNA, 20 bp, human
ggggcatttctggagagcct

SEQ ID NO: 368475 - DNA, 20 bp, human
gggggggcagcaaaatctgg

SEQ ID NO: 368476 - DNA, 20 bp, human
gccctaggaaggggactgac

SEQ ID NO: 368477 - DNA, 20 bp, human
gactgaccgggacatggaag

SEQ ID NO: 368478 - DNA, 20 bp, human
gaggagaggggcgcgagttc

SEQ ID NO: 368479 - DNA, 20 bp, human
gcacccgcggagccctagga

SEQ ID NO: 368480 - DNA, 20 bp, human
gagttccggttcggcgtcgg

SEQ ID NO: 368481 - DNA, 20 bp, human
gaggtctggaccagggtact

SEQ ID NO: 368482 - DNA, 20 bp, human
gcctccctccgacgccgaac

SEQ ID NO: 368483 - DNA, 20 bp, human
ggaaggcgctcggaggagag

SEQ ID NO: 368484 - DNA, 20 bp, human
gaaggggactgaccgggaca

SEQ ID NO: 368485 - DNA, 20 bp, human
gatggaagaggtctggacca

SEQ ID NO: 368486 - DNA, 20 bp, human
gtctgcagcggggagactca

SEQ ID NO: 368487 - DNA, 20 bp, human
gactggcagcaaaatcctat

SEQ ID NO: 368488 - DNA, 20 bp, human
gagttccagcaggttcttca

SEQ ID NO: 368489 - DNA, 20 bp, human
gcacctgtccaagaggtggg

SEQ ID NO: 368490 - DNA, 20 bp, human
ggtgctgtcagcctgatgtg

SEQ ID NO: 368491 - DNA, 20 bp, human
gctgaggcctcggccgtgtt

SEQ ID NO: 368492 - DNA, 20 bp, human
gaaggcacctgtccaagagg

SEQ ID NO: 368493 - DNA, 20 bp, human
gaggcttgggcactctgcag

SEQ ID NO: 368494 - DNA, 20 bp, human
ggcccttccaggagccttct

SEQ ID NO: 368495 - DNA, 20 bp, human
gcttcaggggccgctgacca

SEQ ID NO: 368496 - DNA, 20 bp, human
gctggccttagcacacgccc

SEQ ID NO: 368497 - DNA, 20 bp, human
gaaggccagagctaccagat

SEQ ID NO: 368498 - DNA, 20 bp, human
gcaccctggagtgatacaga

SEQ ID NO: 368499 - DNA, 20 bp, human
ggagccttctgtatcactcc

SEQ ID NO: 368500 - DNA, 20 bp, human
gcctgcctgtccagaggatc

SEQ ID NO: 368501 - DNA, 20 bp, human
ggatggaacccacagaccgc

SEQ ID NO: 368502 - DNA, 20 bp, human
gcaggcctgggcgtgtgcta

SEQ ID NO: 368503 - DNA, 20 bp, human
gaatgaaagcactgggctac

SEQ ID NO: 368504 - DNA, 20 bp, human
gactgggctactggtgcttt

SEQ ID NO: 368505 - DNA, 20 bp, human
ggtgcactcagagtgcaaac

SEQ ID NO: 368506 - DNA, 20 bp, human
gcggcagtccccggacccag

SEQ ID NO: 368507 - DNA, 20 bp, human
ggggacccctgcgcacctgg

SEQ ID NO: 368508 - DNA, 20 bp, human
gtgcctcaggggggcatccc

SEQ ID NO: 368509 - DNA, 20 bp, human
ggggccgcctccccggcgga

SEQ ID NO: 368510 - DNA, 20 bp, human
ggctggcggtctgcctgaga

SEQ ID NO: 368511 - DNA, 20 bp, human
gactgccggatccggaggtg

SEQ ID NO: 368512 - DNA, 20 bp, human
gagtccccggacccagcggc

SEQ ID NO: 368513 - DNA, 20 bp, human
ggtccccgcacctccggatc

SEQ ID NO: 368514 - DNA, 20 bp, human
gctccggatccggcagtccc

SEQ ID NO: 368515 - DNA, 20 bp, human
ggcaggggtccccgcacctc

SEQ ID NO: 368516 - DNA, 20 bp, human
gaagccccagggagcggaac

SEQ ID NO: 368517 - DNA, 20 bp, human
ggggcttccccgagcgccgt

SEQ ID NO: 368518 - DNA, 20 bp, human
gggcgggcccggaaccgcca

SEQ ID NO: 368519 - DNA, 20 bp, human
gggcgggcgttgagaggaac

SEQ ID NO: 368520 - DNA, 20 bp, human
ggggcagccatgaccaccga

SEQ ID NO: 368521 - DNA, 20 bp, human
gcgggcgggcgggcgttgag

SEQ ID NO: 368522 - DNA, 20 bp, human
gtcgcccgttccgctccctg

SEQ ID NO: 368523 - DNA, 20 bp, human
gcgccccggaagctggtcgg

SEQ ID NO: 368524 - DNA, 20 bp, human
gcgcccgccgaccagcttcc

SEQ ID NO: 368525 - DNA, 20 bp, human
gtcggccgaggactggtggt

SEQ ID NO: 368526 - DNA, 20 bp, human
gggcagagcgggactgctag

SEQ ID NO: 368527 - DNA, 20 bp, human
gtgccaagaggacccaagga

SEQ ID NO: 368528 - DNA, 20 bp, human
gcacacggaattccctcaca

SEQ ID NO: 368529 - DNA, 20 bp, human
gctgggaggagccactcctg

SEQ ID NO: 368530 - DNA, 20 bp, human
gtctgactgcgttacacccc

SEQ ID NO: 368531 - DNA, 20 bp, human
gttgactaatagcacaggtg

SEQ ID NO: 368532 - DNA, 20 bp, human
gggagtggctcctcccagag

SEQ ID NO: 368533 - DNA, 20 bp, human
gcagaaaggccactgagcat

SEQ ID NO: 368534 - DNA, 20 bp, human
gcattgggttcgctcagtga

SEQ ID NO: 368535 - DNA, 20 bp, human
ggggtgaggcgtggccacaa

SEQ ID NO: 368536 - DNA, 20 bp, human
gcagccgggtgctccttcct

SEQ ID NO: 368537 - DNA, 20 bp, human
gaggggacctgggactttga

SEQ ID NO: 368538 - DNA, 20 bp, human
gctgtcctgcgaatggggag

SEQ ID NO: 368539 - DNA, 20 bp, human
gcagccgcaaggcatcgcag

SEQ ID NO: 368540 - DNA, 20 bp, human
gctggcccctccccattcgc

SEQ ID NO: 368541 - DNA, 20 bp, human
gagggagcagggcagtagcg

SEQ ID NO: 368542 - DNA, 20 bp, human
gaaggcatgggactagtcca

SEQ ID NO: 368543 - DNA, 20 bp, human
gaagagctgtcctgcgaatg

SEQ ID NO: 368544 - DNA, 20 bp, human
ggcccggagctgcttcctga

SEQ ID NO: 368545 - DNA, 20 bp, human
gggactagtccaaggatggg

SEQ ID NO: 368546 - DNA, 20 bp, human
gcctgggagaagcaagtggg

SEQ ID NO: 368547 - DNA, 20 bp, human
ggggatctgcaccccaccat

SEQ ID NO: 368548 - DNA, 20 bp, human
gatcccagagcgcaggagtc

SEQ ID NO: 368549 - DNA, 20 bp, human
gaaaggctgggttgcttaat

SEQ ID NO: 368550 - DNA, 20 bp, human
ggccccctccgagttcaagg

SEQ ID NO: 368551 - DNA, 20 bp, human
gtccctgactcctgcgctct

SEQ ID NO: 368552 - DNA, 20 bp, human
gggtgcagatcccagagcgc

SEQ ID NO: 368553 - DNA, 20 bp, human
ggcttcctcaccccatggtg

SEQ ID NO: 368554 - DNA, 20 bp, human
ggctgtgagtggactgagca

SEQ ID NO: 368555 - DNA, 20 bp, human
ggcctccttgaactcggagg

SEQ ID NO: 368556 - DNA, 20 bp, human
gaaaggggttgcacaagcaa

SEQ ID NO: 368557 - DNA, 20 bp, human
gtctgaagagtatatggaaa

SEQ ID NO: 368558 - DNA, 20 bp, human
gaatgctggcggcggatgga

SEQ ID NO: 368559 - DNA, 20 bp, human
gtactcttcagacagaggca

SEQ ID NO: 368560 - DNA, 20 bp, human
gcagaggcatggcaaagaac

SEQ ID NO: 368561 - DNA, 20 bp, human
gacagaggcaaagtgccagg

SEQ ID NO: 368562 - DNA, 20 bp, human
ggttcctgttgctgccactg

SEQ ID NO: 368563 - DNA, 20 bp, human
gggaggaaaaatgctggcgg

SEQ ID NO: 368564 - DNA, 20 bp, human
ggttgctgccactgcggtga

SEQ ID NO: 368565 - DNA, 20 bp, human
gcaggcttgggacgagctgg

SEQ ID NO: 368566 - DNA, 20 bp, human
gtcacgaattaaaaatgctg

SEQ ID NO: 368567 - DNA, 20 bp, human
gcactgcctcagacaattgc

SEQ ID NO: 368568 - DNA, 20 bp, human
gataaccactgggggtggaa

SEQ ID NO: 368569 - DNA, 20 bp, human
ggtgtgcctgcaattgtctg

SEQ ID NO: 368570 - DNA, 20 bp, human
gcgaattaaaaatgctgagg

SEQ ID NO: 368571 - DNA, 20 bp, human
gtcactctcccttcttcaag

SEQ ID NO: 368572 - DNA, 20 bp, human
gtgagccaggactcgagcaa

SEQ ID NO: 368573 - DNA, 20 bp, human
ggataaaacagcatgttatc

SEQ ID NO: 368574 - DNA, 20 bp, human
ggcacagataatagccaatg

SEQ ID NO: 368575 - DNA, 20 bp, human
gtgaaattaataaccactgg

SEQ ID NO: 368576 - DNA, 20 bp, human
gaaggctgaaggctggtctt

SEQ ID NO: 368577 - DNA, 20 bp, human
gggggagcgggaatgagacc

SEQ ID NO: 368578 - DNA, 20 bp, human
gcaggtcatatcaaggctga

SEQ ID NO: 368579 - DNA, 20 bp, human
gggggagagggcggatgcta

SEQ ID NO: 368580 - DNA, 20 bp, human
gttcaagagcactctttcct

SEQ ID NO: 368581 - DNA, 20 bp, human
ggagcgggaatgagacctgg

SEQ ID NO: 368582 - DNA, 20 bp, human
ggaaggatgagcgggaattg

SEQ ID NO: 368583 - DNA, 20 bp, human
ggctgaatcaggtcatatca

SEQ ID NO: 368584 - DNA, 20 bp, human
gtgagacctgggggacttgt

SEQ ID NO: 368585 - DNA, 20 bp, human
gagggtcactcgccctcctc

SEQ ID NO: 368586 - DNA, 20 bp, human
gtcggactcacaatcgtctc

SEQ ID NO: 368587 - DNA, 20 bp, human
ggcgaccaggtgcgggtata

SEQ ID NO: 368588 - DNA, 20 bp, human
ggcgggccacggcagatccc

SEQ ID NO: 368589 - DNA, 20 bp, human
gtgctccggcaccccgtgac

SEQ ID NO: 368590 - DNA, 20 bp, human
gggtctaaggcgcagtctga

SEQ ID NO: 368591 - DNA, 20 bp, human
gacggcagatccccggtcac

SEQ ID NO: 368592 - DNA, 20 bp, human
gtgagtccgaggagcagcgc

SEQ ID NO: 368593 - DNA, 20 bp, human
ggcgccccccagaatgacga

SEQ ID NO: 368594 - DNA, 20 bp, human
gccttccccacaacggtcta

SEQ ID NO: 368595 - DNA, 20 bp, human
gtacccgcccacctcgtgga

SEQ ID NO: 368596 - DNA, 20 bp, human
gaggggcggtgctgcagacg

SEQ ID NO: 368597 - DNA, 20 bp, human
gggcaggcagggtcgcgagg

SEQ ID NO: 368598 - DNA, 20 bp, human
gagcccgccggccgcggcta

SEQ ID NO: 368599 - DNA, 20 bp, human
gcgccggccgcggctagggg

SEQ ID NO: 368600 - DNA, 20 bp, human
gatggcaggaggcggggtag

SEQ ID NO: 368601 - DNA, 20 bp, human
ggggcggcggcaaggcgcgc

SEQ ID NO: 368602 - DNA, 20 bp, human
gaggtagcaggcatggcagg

SEQ ID NO: 368603 - DNA, 20 bp, human
gaggggcaggcagggtcgcg

SEQ ID NO: 368604 - DNA, 20 bp, human
gggttcgagagctaggtagc

SEQ ID NO: 368605 - DNA, 20 bp, human
ggcagcaccgcccctagccg

SEQ ID NO: 368606 - DNA, 20 bp, human
gcaccagtgagtgctagcct

SEQ ID NO: 368607 - DNA, 20 bp, human
ggctagcactcactggtgga

SEQ ID NO: 368608 - DNA, 20 bp, human
gactcactggtggagggctg

SEQ ID NO: 368609 - DNA, 20 bp, human
gaggtagagtgtgagaatga

SEQ ID NO: 368610 - DNA, 20 bp, human
ggggagaaggacagactaga

SEQ ID NO: 368611 - DNA, 20 bp, human
gatgaggggagaatttgagg

SEQ ID NO: 368612 - DNA, 20 bp, human
gggatgcagggccagaaatg

SEQ ID NO: 368613 - DNA, 20 bp, human
ggaaatgaggggagaatttg

SEQ ID NO: 368614 - DNA, 20 bp, human
gcaggagggaccgaatgcaa

SEQ ID NO: 368615 - DNA, 20 bp, human
ggtgtgagaatgagggatgc

SEQ ID NO: 368616 - DNA, 20 bp, human
gactccgcctccagacctag

SEQ ID NO: 368617 - DNA, 20 bp, human
gcagggggtggtatcgggga

SEQ ID NO: 368618 - DNA, 20 bp, human
gcaggggatcacagtgcatg

SEQ ID NO: 368619 - DNA, 20 bp, human
ggggagcagctcgtgattgt

SEQ ID NO: 368620 - DNA, 20 bp, human
gtggctgcagggggtggtat

SEQ ID NO: 368621 - DNA, 20 bp, human
ggggacagacaggccaggac

SEQ ID NO: 368622 - DNA, 20 bp, human
gcagtgacagctgtgatcag

SEQ ID NO: 368623 - DNA, 20 bp, human
gaggtcgccttggggcttac

SEQ ID NO: 368624 - DNA, 20 bp, human
gtccagggctgaaagggtgc

SEQ ID NO: 368625 - DNA, 20 bp, human
gtgcccgcccctaggtctgg

SEQ ID NO: 368626 - DNA, 20 bp, human
ggcgagcagcggagcaccaa

SEQ ID NO: 368627 - DNA, 20 bp, human
gaggccacgcccggggaaga

SEQ ID NO: 368628 - DNA, 20 bp, human
gcagcggagcaccaagggaa

SEQ ID NO: 368629 - DNA, 20 bp, human
gccgccctgctcctcgctct

SEQ ID NO: 368630 - DNA, 20 bp, human
gtccggacgcggggaacacc

SEQ ID NO: 368631 - DNA, 20 bp, human
gctcgctctgggcgtggaaa

SEQ ID NO: 368632 - DNA, 20 bp, human
gtccccgggcgtggcctaag

SEQ ID NO: 368633 - DNA, 20 bp, human
gagccccagggcgactggac

SEQ ID NO: 368634 - DNA, 20 bp, human
gaaatggcgcctcacgaccc

SEQ ID NO: 368635 - DNA, 20 bp, human
gcagggtcgtaagactaccc

SEQ ID NO: 368636 - DNA, 20 bp, human
gtctcaggatggggatacca

SEQ ID NO: 368637 - DNA, 20 bp, human
gaaacggggcccaaggagct

SEQ ID NO: 368638 - DNA, 20 bp, human
gggtgctagggcgtgtgcta

SEQ ID NO: 368639 - DNA, 20 bp, human
gatccggaggcggacgtcag

SEQ ID NO: 368640 - DNA, 20 bp, human
gagtagcaggtacttgtctc

SEQ ID NO: 368641 - DNA, 20 bp, human
gctgccctcgcgaggagggt

SEQ ID NO: 368642 - DNA, 20 bp, human
ggtgggtgtgcgggatgcga

SEQ ID NO: 368643 - DNA, 20 bp, human
ggtgcgggatgcgaaggaaa

SEQ ID NO: 368644 - DNA, 20 bp, human
gtcgactgggaatcacccta

SEQ ID NO: 368645 - DNA, 20 bp, human
gggacgctgccctcgcgagg

SEQ ID NO: 368646 - DNA, 20 bp, human
gggtgacagtagattaatgc

SEQ ID NO: 368647 - DNA, 20 bp, human
gagtccgggtccttacggaa

SEQ ID NO: 368648 - DNA, 20 bp, human
gtcaacagtccgggtcctta

SEQ ID NO: 368649 - DNA, 20 bp, human
gaggacccggactgttgaac

SEQ ID NO: 368650 - DNA, 20 bp, human
gacgatcgatgacctgtcta

SEQ ID NO: 368651 - DNA, 20 bp, human
gtaaataagcaggcgaccgg

SEQ ID NO: 368652 - DNA, 20 bp, human
ggtccctttccgtaaggacc

SEQ ID NO: 368653 - DNA, 20 bp, human
ggtggaggaatgtgggacaa

SEQ ID NO: 368654 - DNA, 20 bp, human
ggacaggtcatcgatcgtaa

SEQ ID NO: 368655 - DNA, 20 bp, human
gttaaatggtgcgtcccctc

SEQ ID NO: 368656 - DNA, 20 bp, human
gtgtgcacgtagtggcagca

SEQ ID NO: 368657 - DNA, 20 bp, human
gtccctaaccccagatgagc

SEQ ID NO: 368658 - DNA, 20 bp, human
gaggactgtatgtgccagca

SEQ ID NO: 368659 - DNA, 20 bp, human
gccaaggcccagggaagtaa

SEQ ID NO: 368660 - DNA, 20 bp, human
gctaaccccagatgagcagg

SEQ ID NO: 368661 - DNA, 20 bp, human
gtgtatgtgtgtgcacgtag

SEQ ID NO: 368662 - DNA, 20 bp, human
gaggcccagggaagtaaagg

SEQ ID NO: 368663 - DNA, 20 bp, human
gggaatgggagtacatgagg

SEQ ID NO: 368664 - DNA, 20 bp, human
gcagaatattggaaccccag

SEQ ID NO: 368665 - DNA, 20 bp, human
gtgccccaagcaccattagt

SEQ ID NO: 368666 - DNA, 20 bp, human
gagtgcttgctgtgaaagac

SEQ ID NO: 368667 - DNA, 20 bp, human
ggagaggggaggcgtagaag

SEQ ID NO: 368668 - DNA, 20 bp, human
gggcggagggtcgcggggaa

SEQ ID NO: 368669 - DNA, 20 bp, human
gacccacagagggcgaaaag

SEQ ID NO: 368670 - DNA, 20 bp, human
gggcagggctatacccgagc

SEQ ID NO: 368671 - DNA, 20 bp, human
ggggctatacccgagctggg

SEQ ID NO: 368672 - DNA, 20 bp, human
gggaagcagtactgcaaggc

SEQ ID NO: 368673 - DNA, 20 bp, human
gagcgagtccggagggatgg

SEQ ID NO: 368674 - DNA, 20 bp, human
gtgggagtgtgtgtaagagt

SEQ ID NO: 368675 - DNA, 20 bp, human
gctggcggcgaagctgcaag

SEQ ID NO: 368676 - DNA, 20 bp, human
gcaggggctccgcgcgctca

SEQ ID NO: 368677 - DNA, 20 bp, human
ggggaggtagtcagacacgc

SEQ ID NO: 368678 - DNA, 20 bp, human
ggcgcgctcaaggtgctcgc

SEQ ID NO: 368679 - DNA, 20 bp, human
gcacgccacctcagcccggc

SEQ ID NO: 368680 - DNA, 20 bp, human
gggacggtggtagaactttg

SEQ ID NO: 368681 - DNA, 20 bp, human
gcagcgcggagactgggact

SEQ ID NO: 368682 - DNA, 20 bp, human
ggggaaggacgggcgctgca

SEQ ID NO: 368683 - DNA, 20 bp, human
gtggcctgctgggccaagag

SEQ ID NO: 368684 - DNA, 20 bp, human
gaactttggggtttggtgag

SEQ ID NO: 368685 - DNA, 20 bp, human
gaggtggcgtgggcgccctg

SEQ ID NO: 368686 - DNA, 20 bp, human
gacagagggcaggtacttgg

SEQ ID NO: 368687 - DNA, 20 bp, human
ggaggtgacctcactgacga

SEQ ID NO: 368688 - DNA, 20 bp, human
gacctcactgacgagggcaa

SEQ ID NO: 368689 - DNA, 20 bp, human
gagaagggttgtgaaggtcc

SEQ ID NO: 368690 - DNA, 20 bp, human
gtcactgacgagggcaaggg

SEQ ID NO: 368691 - DNA, 20 bp, human
ggggactgtgcccacgggga

SEQ ID NO: 368692 - DNA, 20 bp, human
gctggagtctctggtaagag

SEQ ID NO: 368693 - DNA, 20 bp, human
gataaactgagaaccttggg

SEQ ID NO: 368694 - DNA, 20 bp, human
gagtcacgacagctaggcaa

SEQ ID NO: 368695 - DNA, 20 bp, human
gtctgtctggtcccaatcct

SEQ ID NO: 368696 - DNA, 20 bp, human
ggggaagcgcacatgagctc

SEQ ID NO: 368697 - DNA, 20 bp, human
ggtccagtggccgaggggag

SEQ ID NO: 368698 - DNA, 20 bp, human
gctgcgaaatcactcatgtg

SEQ ID NO: 368699 - DNA, 20 bp, human
ggggttgtccagtggccgag

SEQ ID NO: 368700 - DNA, 20 bp, human
gagcacttgtgttggagaca

SEQ ID NO: 368701 - DNA, 20 bp, human
gtgagtgatttcgcagtctg

SEQ ID NO: 368702 - DNA, 20 bp, human
ggtgcacgccctggcaggtc

SEQ ID NO: 368703 - DNA, 20 bp, human
gggagtgtgcacgccctggc

SEQ ID NO: 368704 - DNA, 20 bp, human
gctggtgagcttatgaagtg

SEQ ID NO: 368705 - DNA, 20 bp, human
gtggttccagaacgcctctg

SEQ ID NO: 368706 - DNA, 20 bp, human
ggcaggagattgctacatgt

SEQ ID NO: 368707 - DNA, 20 bp, human
gaccggaagggactaaagtg

SEQ ID NO: 368708 - DNA, 20 bp, human
gccagccctgggaaagggct

SEQ ID NO: 368709 - DNA, 20 bp, human
gctacacagctctgagtcaa

SEQ ID NO: 368710 - DNA, 20 bp, human
gagggactaaagtgaggctc

SEQ ID NO: 368711 - DNA, 20 bp, human
gctacatgtaggcttatctg

SEQ ID NO: 368712 - DNA, 20 bp, human
gagccaccttgcccaggggt

SEQ ID NO: 368713 - DNA, 20 bp, human
ggtagtgtcaattaccggaa

SEQ ID NO: 368714 - DNA, 20 bp, human
gacactactggacacccagg

SEQ ID NO: 368715 - DNA, 20 bp, human
ggtggctcactctggcaggt

SEQ ID NO: 368716 - DNA, 20 bp, human
ggaggagaagggtaggctgt

SEQ ID NO: 368717 - DNA, 20 bp, human
ggctcggcccgcccgtgtta

SEQ ID NO: 368718 - DNA, 20 bp, human
gcggtaggcggccgtaacac

SEQ ID NO: 368719 - DNA, 20 bp, human
gtaggcggccgtaacacggg

SEQ ID NO: 368720 - DNA, 20 bp, human
gggggcgcggaggggtagcc

SEQ ID NO: 368721 - DNA, 20 bp, human
gacggaggcgcccacgtgct

SEQ ID NO: 368722 - DNA, 20 bp, human
ggcacgggatacaggcgcgc

SEQ ID NO: 368723 - DNA, 20 bp, human
gacgggcgggccgagcacgt

SEQ ID NO: 368724 - DNA, 20 bp, human
gtcactgagacaaaagtcag

SEQ ID NO: 368725 - DNA, 20 bp, human
gatgtgtgagggtgtgacgg

SEQ ID NO: 368726 - DNA, 20 bp, human
ggcctgaagcgtggcatcgt

SEQ ID NO: 368727 - DNA, 20 bp, human
gcatcgtgggtgtcggggtg

SEQ ID NO: 368728 - DNA, 20 bp, human
gcgtggcatcgtgggtgtcg

SEQ ID NO: 368729 - DNA, 20 bp, human
gcaggcggggctctaagaca

SEQ ID NO: 368730 - DNA, 20 bp, human
gacccacgatgccacgcttc

SEQ ID NO: 368731 - DNA, 20 bp, human
ggtggcgcgtgagcagtcag

SEQ ID NO: 368732 - DNA, 20 bp, human
gctaagacaaggcctttctc

SEQ ID NO: 368733 - DNA, 20 bp, human
gtagagccccgcctgaagcg

SEQ ID NO: 368734 - DNA, 20 bp, human
gcggcgcatgcgcagagaat

SEQ ID NO: 368735 - DNA, 20 bp, human
gcgcatgcgcagagaatcgg

SEQ ID NO: 368736 - DNA, 20 bp, human
ggcagcgagcgaggctctga

SEQ ID NO: 368737 - DNA, 20 bp, human
gggtctgcatcccctgacca

SEQ ID NO: 368738 - DNA, 20 bp, human
gaggctctgatggccgacgt

SEQ ID NO: 368739 - DNA, 20 bp, human
ggggccccattcctctccga

SEQ ID NO: 368740 - DNA, 20 bp, human
ggagaggaatggggccccaa

SEQ ID NO: 368741 - DNA, 20 bp, human
gtctgccctcggagaggaat

SEQ ID NO: 368742 - DNA, 20 bp, human
gcgacgtaggcggagagggt

SEQ ID NO: 368743 - DNA, 20 bp, human
gagccctggcgagggctcca

SEQ ID NO: 368744 - DNA, 20 bp, human
ggcgtcaatgcgaggctctc

SEQ ID NO: 368745 - DNA, 20 bp, human
gggctctcgggcagcgagcg

SEQ ID NO: 368746 - DNA, 20 bp, human
ggaacacagagcatgcgaga

SEQ ID NO: 368747 - DNA, 20 bp, human
gcaaacggtcctcatggtgc

SEQ ID NO: 368748 - DNA, 20 bp, human
gtccttgcaaacggtcctca

SEQ ID NO: 368749 - DNA, 20 bp, human
gggccctggctctgacgcca

SEQ ID NO: 368750 - DNA, 20 bp, human
gcctcccaagagcagctgag

SEQ ID NO: 368751 - DNA, 20 bp, human
ggagaaggagcagaggacgt

SEQ ID NO: 368752 - DNA, 20 bp, human
gacaggcacccaccgtgcgt

SEQ ID NO: 368753 - DNA, 20 bp, human
gagcagaggacgtgggtgcc

SEQ ID NO: 368754 - DNA, 20 bp, human
gtctgcaacaaaaaaacttg

SEQ ID NO: 368755 - DNA, 20 bp, human
ggccaggcccggcgtttgcc

SEQ ID NO: 368756 - DNA, 20 bp, human
gcaaccggaggctgctccgt

SEQ ID NO: 368757 - DNA, 20 bp, human
ggttgcccgaaggcagtggg

SEQ ID NO: 368758 - DNA, 20 bp, human
ggcagcctccggttgcccga

SEQ ID NO: 368759 - DNA, 20 bp, human
gtccggttgcccgaaggcag

SEQ ID NO: 368760 - DNA, 20 bp, human
gtgcagggtgcgtctgcgga

SEQ ID NO: 368761 - DNA, 20 bp, human
gccccggggagaaagaacca

SEQ ID NO: 368762 - DNA, 20 bp, human
ggccaggggctcccagaccg

SEQ ID NO: 368763 - DNA, 20 bp, human
gctgcagagacgcccggccc

SEQ ID NO: 368764 - DNA, 20 bp, human
gtacaaacgccggtgcaccc

SEQ ID NO: 368765 - DNA, 20 bp, human
ggcgcccacggagcagcctc

SEQ ID NO: 368766 - DNA, 20 bp, human
gccccgtggtgggagatcag

SEQ ID NO: 368767 - DNA, 20 bp, human
gagggtggcgcgggttccca

SEQ ID NO: 368768 - DNA, 20 bp, human
gggtctgcgtcgcgtcagaa

SEQ ID NO: 368769 - DNA, 20 bp, human
gtgacagcgcggccggggat

SEQ ID NO: 368770 - DNA, 20 bp, human
gtgctcggcgcaggatagaa

SEQ ID NO: 368771 - DNA, 20 bp, human
gccgcccgaacgccacacgg

SEQ ID NO: 368772 - DNA, 20 bp, human
gaggaggccaaaaaaggact

SEQ ID NO: 368773 - DNA, 20 bp, human
gtggtgggagatcagaggcc

SEQ ID NO: 368774 - DNA, 20 bp, human
gctaatggagactgacagcg

SEQ ID NO: 368775 - DNA, 20 bp, human
ggtcactcgctccccgtggt

SEQ ID NO: 368776 - DNA, 20 bp, human
gagggaaggcgcccacttcg

SEQ ID NO: 368777 - DNA, 20 bp, human
gcccgagattgcagaggaca

SEQ ID NO: 368778 - DNA, 20 bp, human
ggacagggcggagtcccctg

SEQ ID NO: 368779 - DNA, 20 bp, human
gaatgacaggtgagtggccg

SEQ ID NO: 368780 - DNA, 20 bp, human
gaaggcacccgagattgcag

SEQ ID NO: 368781 - DNA, 20 bp, human
gccaccccgcccgatcgtcg

SEQ ID NO: 368782 - DNA, 20 bp, human
gtaggcgctcgataaatgac

SEQ ID NO: 368783 - DNA, 20 bp, human
ggctgcggaactcctcgaag

SEQ ID NO: 368784 - DNA, 20 bp, human
ggtgtgccaggcgttgtctg

SEQ ID NO: 368785 - DNA, 20 bp, human
ggacgcgaggaagacaccta

SEQ ID NO: 368786 - DNA, 20 bp, human
gcccgcctcccggacgcaga

SEQ ID NO: 368787 - DNA, 20 bp, human
gcccccgcaccccgtgtccg

SEQ ID NO: 368788 - DNA, 20 bp, human
gaggaggagccaggacgcga

SEQ ID NO: 368789 - DNA, 20 bp, human
ggacgcgagggcgaccccgt

SEQ ID NO: 368790 - DNA, 20 bp, human
ggctcccagccatctgcgtc

SEQ ID NO: 368791 - DNA, 20 bp, human
gcggggcggaccctgtctac

SEQ ID NO: 368792 - DNA, 20 bp, human
gtgggagcaagcggcggcca

SEQ ID NO: 368793 - DNA, 20 bp, human
gctcccggacgcagatggct

SEQ ID NO: 368794 - DNA, 20 bp, human
gcgtcccggagcctcggaca

SEQ ID NO: 368795 - DNA, 20 bp, human
gggctcttatccagtagaca

SEQ ID NO: 368796 - DNA, 20 bp, human
gaggggccgcgctacggggc

SEQ ID NO: 368797 - DNA, 20 bp, human
gagggaggggccgcgctacg

SEQ ID NO: 368798 - DNA, 20 bp, human
ggctccgcgctcccgctgga

SEQ ID NO: 368799 - DNA, 20 bp, human
gcgagcgcaaccccatccag

SEQ ID NO: 368800 - DNA, 20 bp, human
gggaggctgcacaaaggagc

SEQ ID NO: 368801 - DNA, 20 bp, human
ggatggggttgcgctcgcca

SEQ ID NO: 368802 - DNA, 20 bp, human
gcccacaggacggcacacag

SEQ ID NO: 368803 - DNA, 20 bp, human
gagagagcagctttcgggat

SEQ ID NO: 368804 - DNA, 20 bp, human
gggttgcgctcgccagggag

SEQ ID NO: 368805 - DNA, 20 bp, human
gtgagactctggggacggag

SEQ ID NO: 368806 - DNA, 20 bp, human
gaaaccgaaaccggcaggag

SEQ ID NO: 368807 - DNA, 20 bp, human
gggcggctgcgccttgcctt

SEQ ID NO: 368808 - DNA, 20 bp, human
gctcccgctggagtgacaac

SEQ ID NO: 368809 - DNA, 20 bp, human
gcgggagggggctgcgtgtt

SEQ ID NO: 368810 - DNA, 20 bp, human
gtcagtcatcgcagagctgt

SEQ ID NO: 368811 - DNA, 20 bp, human
gactgactgtctggaagggt

SEQ ID NO: 368812 - DNA, 20 bp, human
gagcaatggaatctagtgaa

SEQ ID NO: 368813 - DNA, 20 bp, human
gagagtggatcgggctgtag

SEQ ID NO: 368814 - DNA, 20 bp, human
gacagcccgatccactctgt

SEQ ID NO: 368815 - DNA, 20 bp, human
gcaactggccagcatactct

SEQ ID NO: 368816 - DNA, 20 bp, human
gcaaacacgcacgcgcgcat

SEQ ID NO: 368817 - DNA, 20 bp, human
gcgtgtgtccgcacttgggg

SEQ ID NO: 368818 - DNA, 20 bp, human
ggtgaaggaaaggactaggc

SEQ ID NO: 368819 - DNA, 20 bp, human
gacaacagacacgcgaggtc

SEQ ID NO: 368820 - DNA, 20 bp, human
gcgcgcgcgctcggcgagcc

SEQ ID NO: 368821 - DNA, 20 bp, human
gcgcacaccctcatgccgcg

SEQ ID NO: 368822 - DNA, 20 bp, human
gcgttcgccgcgcggcatga

SEQ ID NO: 368823 - DNA, 20 bp, human
ggagccctgggcctcatcct

SEQ ID NO: 368824 - DNA, 20 bp, human
gctcggacacacaaagaacc

SEQ ID NO: 368825 - DNA, 20 bp, human
gtccagccccgccccaagtg

SEQ ID NO: 368826 - DNA, 20 bp, human
gtggggaggggggttcgcga

SEQ ID NO: 368827 - DNA, 20 bp, human
gccctgagcgagtggggagg

SEQ ID NO: 368828 - DNA, 20 bp, human
ggcccccgcacgcagagctg

SEQ ID NO: 368829 - DNA, 20 bp, human
gtggagagccctgagcgagt

SEQ ID NO: 368830 - DNA, 20 bp, human
gacagctgacggacggacgg

SEQ ID NO: 368831 - DNA, 20 bp, human
gcagcaaagacgacgcaggg

SEQ ID NO: 368832 - DNA, 20 bp, human
gctgacggacggacggcggg

SEQ ID NO: 368833 - DNA, 20 bp, human
gaggtcacgcagaaagccga

SEQ ID NO: 368834 - DNA, 20 bp, human
gggttcgcgacggaaaccct

SEQ ID NO: 368835 - DNA, 20 bp, human
gcagacagacagctgacgga

SEQ ID NO: 368836 - DNA, 20 bp, human
ggggcggagtgtgacgagga

SEQ ID NO: 368837 - DNA, 20 bp, human
gaggtgggcggagtgtgacg

SEQ ID NO: 368838 - DNA, 20 bp, human
gggagtgtgacgaggagggc

SEQ ID NO: 368839 - DNA, 20 bp, human
gcggggaagagagggatagt

SEQ ID NO: 368840 - DNA, 20 bp, human
ggccgccgccgggaaggaga

SEQ ID NO: 368841 - DNA, 20 bp, human
gagggatagtcggagcgagg

SEQ ID NO: 368842 - DNA, 20 bp, human
ggagagggatagtcggagcg

SEQ ID NO: 368843 - DNA, 20 bp, human
ggcagcccaggcttcccggc

SEQ ID NO: 368844 - DNA, 20 bp, human
ggcctctgtgtctccacagt

SEQ ID NO: 368845 - DNA, 20 bp, human
gtctcttccccgtccccggc

SEQ ID NO: 368846 - DNA, 20 bp, human
ggagcctgagaagtcggcac

SEQ ID NO: 368847 - DNA, 20 bp, human
gagaagtcggcacgggagga

SEQ ID NO: 368848 - DNA, 20 bp, human
gccaggggagccgttcgggt

SEQ ID NO: 368849 - DNA, 20 bp, human
gcctgagaagtcggcacggg

SEQ ID NO: 368850 - DNA, 20 bp, human
ggagccgttcgggtagggga

SEQ ID NO: 368851 - DNA, 20 bp, human
gacggccaggggagccgttc

SEQ ID NO: 368852 - DNA, 20 bp, human
gctcactcccaggggttcgt

SEQ ID NO: 368853 - DNA, 20 bp, human
ggagaggggaggacggccag

SEQ ID NO: 368854 - DNA, 20 bp, human
gaaggcctggggcactatgg

SEQ ID NO: 368855 - DNA, 20 bp, human
gtcggcgcggcacagagcct

SEQ ID NO: 368856 - DNA, 20 bp, human
gctactgagaaggcgagcgg

SEQ ID NO: 368857 - DNA, 20 bp, human
ggctcagattggcggagaaa

SEQ ID NO: 368858 - DNA, 20 bp, human
gccgcgctcccattggtgcc

SEQ ID NO: 368859 - DNA, 20 bp, human
gcagccgccccgcccaccaa

SEQ ID NO: 368860 - DNA, 20 bp, human
gcgccgcgggaaccccaggt

SEQ ID NO: 368861 - DNA, 20 bp, human
gcgctcggccgcgtcaccgc

SEQ ID NO: 368862 - DNA, 20 bp, human
ggtcaccgccgggcaccaat

SEQ ID NO: 368863 - DNA, 20 bp, human
gtggcgcggtgcgctcagat

SEQ ID NO: 368864 - DNA, 20 bp, human
gccgcccaccaagggcgcgt

SEQ ID NO: 368865 - DNA, 20 bp, human
gccccaacctggggttcccg

SEQ ID NO: 368866 - DNA, 20 bp, human
gcgttccctttaagggaggt

SEQ ID NO: 368867 - DNA, 20 bp, human
gacttggggcagatctagga

SEQ ID NO: 368868 - DNA, 20 bp, human
gcctcaggaggcacgagaaa

SEQ ID NO: 368869 - DNA, 20 bp, human
gctcccaggcggacaacctc

SEQ ID NO: 368870 - DNA, 20 bp, human
gggacttcccagttgggcga

SEQ ID NO: 368871 - DNA, 20 bp, human
gcattcttggggccgggttg

SEQ ID NO: 368872 - DNA, 20 bp, human
gctcccccacctcccttaaa

SEQ ID NO: 368873 - DNA, 20 bp, human
gcgatcgccgagcaagtgca

SEQ ID NO: 368874 - DNA, 20 bp, human
gtcccagttgggcgaaggaa

SEQ ID NO: 368875 - DNA, 20 bp, human
gggcgctgtcccggctgcga

SEQ ID NO: 368876 - DNA, 20 bp, human
gcatgtggctgatgcaaacc

SEQ ID NO: 368877 - DNA, 20 bp, human
gaatccagaagtagtaaatt

SEQ ID NO: 368878 - DNA, 20 bp, human
ggtaagttggtgtgacaggc

SEQ ID NO: 368879 - DNA, 20 bp, human
gacgagttgctttaaatctc

SEQ ID NO: 368880 - DNA, 20 bp, human
ggttccgaatttactacttc

SEQ ID NO: 368881 - DNA, 20 bp, human
gatgatgatgcaaattctcc

SEQ ID NO: 368882 - DNA, 20 bp, human
gtgtagtaagttggtgtgac

SEQ ID NO: 368883 - DNA, 20 bp, human
gtttgttctctaaaaagctt

SEQ ID NO: 368884 - DNA, 20 bp, human
gtcatttagctgtagtaagt

SEQ ID NO: 368885 - DNA, 20 bp, human
gaaatagttacttcatttta

SEQ ID NO: 368886 - DNA, 20 bp, human
gggaagcagtgaagtagagt

SEQ ID NO: 368887 - DNA, 20 bp, human
gaccaagatgtagaagggtt

SEQ ID NO: 368888 - DNA, 20 bp, human
ggggaactgggaaggcattt

SEQ ID NO: 368889 - DNA, 20 bp, human
gccttcccagttccctgctc

SEQ ID NO: 368890 - DNA, 20 bp, human
gaccaaacccttctacatct

SEQ ID NO: 368891 - DNA, 20 bp, human
ggtttccagagcagggaact

SEQ ID NO: 368892 - DNA, 20 bp, human
gcaaaatagaggtggaaggt

SEQ ID NO: 368893 - DNA, 20 bp, human
gaggctatacttaacgaaaa

SEQ ID NO: 368894 - DNA, 20 bp, human
gaaatagaccaagatgtaga

SEQ ID NO: 368895 - DNA, 20 bp, human
ggagccatcacacatggcta

SEQ ID NO: 368896 - DNA, 20 bp, human
gaggccatgtgactccaagg

SEQ ID NO: 368897 - DNA, 20 bp, human
gtgggaggtggtctggtgcc

SEQ ID NO: 368898 - DNA, 20 bp, human
gcactggaggtcacaactgg

SEQ ID NO: 368899 - DNA, 20 bp, human
ggtggtctggtgccaggctt

SEQ ID NO: 368900 - DNA, 20 bp, human
gcaggcacggggaggggttc

SEQ ID NO: 368901 - DNA, 20 bp, human
ggccagcgaggagttgtgag

SEQ ID NO: 368902 - DNA, 20 bp, human
gagcaacgaaggctccgcag

SEQ ID NO: 368903 - DNA, 20 bp, human
ggcttgggcccagtatgtaa

SEQ ID NO: 368904 - DNA, 20 bp, human
ggcagcctgacataagacac

SEQ ID NO: 368905 - DNA, 20 bp, human
gacctccagtgtcttatgtc

SEQ ID NO: 368906 - DNA, 20 bp, human
gccgcgctgaccaatccccg

SEQ ID NO: 368907 - DNA, 20 bp, human
gataaacttcgtgctctcct

SEQ ID NO: 368908 - DNA, 20 bp, human
gccccggggtgggcggtgtg

SEQ ID NO: 368909 - DNA, 20 bp, human
gcaccgcccaccccggggat

SEQ ID NO: 368910 - DNA, 20 bp, human
ggctgaccaatccccggggt

SEQ ID NO: 368911 - DNA, 20 bp, human
gagccccgggctaggccggt

SEQ ID NO: 368912 - DNA, 20 bp, human
gcccgggtggctacacagag

SEQ ID NO: 368913 - DNA, 20 bp, human
gcctggagccgagcacacgt

SEQ ID NO: 368914 - DNA, 20 bp, human
gcgcccaccggcctagcccg

SEQ ID NO: 368915 - DNA, 20 bp, human
gtgggaggaccaaacctcaa

SEQ ID NO: 368916 - DNA, 20 bp, human
gcaggcttgctagtgaggat

SEQ ID NO: 368917 - DNA, 20 bp, human
gcacgccaggcttgctagtg

SEQ ID NO: 368918 - DNA, 20 bp, human
ggcggagccggtaacgtcat

SEQ ID NO: 368919 - DNA, 20 bp, human
gcgtgccggggagcgagaaa

SEQ ID NO: 368920 - DNA, 20 bp, human
ggaggatgggacgcagtctc

SEQ ID NO: 368921 - DNA, 20 bp, human
gtctcgctccccggcacgcc

SEQ ID NO: 368922 - DNA, 20 bp, human
ggtgtgtagcgaggaggatt

SEQ ID NO: 368923 - DNA, 20 bp, human
ggacgaccagcgagacaaat

SEQ ID NO: 368924 - DNA, 20 bp, human
gccgcctcctggtgtatata

SEQ ID NO: 368925 - DNA, 20 bp, human
gcagaggtggaaaatctcat

SEQ ID NO: 368926 - DNA, 20 bp, human
gatggagaaggtcagaccgc

SEQ ID NO: 368927 - DNA, 20 bp, human
gaacctccccgaactgacct

SEQ ID NO: 368928 - DNA, 20 bp, human
gtgggtggggttcatgtact

SEQ ID NO: 368929 - DNA, 20 bp, human
gtgggcagggtgaaatatct

SEQ ID NO: 368930 - DNA, 20 bp, human
gcggagctcaccggggtcta

SEQ ID NO: 368931 - DNA, 20 bp, human
ggtgctgtggggcctgtctg

SEQ ID NO: 368932 - DNA, 20 bp, human
ggaggtgcctaggctaggaa

SEQ ID NO: 368933 - DNA, 20 bp, human
gttgcgaggtcgggcagagt

SEQ ID NO: 368934 - DNA, 20 bp, human
gttagatgaagacatgggtc

SEQ ID NO: 368935 - DNA, 20 bp, human
gggtctggcagagtggcctg

SEQ ID NO: 368936 - DNA, 20 bp, human
gggcctgggaatagcccgcc

SEQ ID NO: 368937 - DNA, 20 bp, human
gagcctggcgggctattccc

SEQ ID NO: 368938 - DNA, 20 bp, human
gagcctgggggctgcatcag

SEQ ID NO: 368939 - DNA, 20 bp, human
gggggctgcatcagtggggc

SEQ ID NO: 368940 - DNA, 20 bp, human
ggatgagaggatgacctgag

SEQ ID NO: 368941 - DNA, 20 bp, human
gcagcctccttccagcctgg

SEQ ID NO: 368942 - DNA, 20 bp, human
ggctgcaggagcttcccctc

SEQ ID NO: 368943 - DNA, 20 bp, human
gctgcagcctccttccagcc

SEQ ID NO: 368944 - DNA, 20 bp, human
ggtgctccgagctgggccga

SEQ ID NO: 368945 - DNA, 20 bp, human
gatagcccgccaggctgggc

SEQ ID NO: 368946 - DNA, 20 bp, human
gtccacagcggacattcccg

SEQ ID NO: 368947 - DNA, 20 bp, human
gacggaactgtgtcccgacg

SEQ ID NO: 368948 - DNA, 20 bp, human
gagttagatggggcctccga

SEQ ID NO: 368949 - DNA, 20 bp, human
ggaggccccatctaactcca

SEQ ID NO: 368950 - DNA, 20 bp, human
ggtggccgggcccagttcac

SEQ ID NO: 368951 - DNA, 20 bp, human
gccacggcctggccggtacg

SEQ ID NO: 368952 - DNA, 20 bp, human
gagataggaacggggtgcgg

SEQ ID NO: 368953 - DNA, 20 bp, human
gtggccggtacggggtccgc

SEQ ID NO: 368954 - DNA, 20 bp, human
ggtcaagtgcgagataggaa

SEQ ID NO: 368955 - DNA, 20 bp, human
gtcccgcggggagctctcat

SEQ ID NO: 368956 - DNA, 20 bp, human
gggagctcgcggggtgtgat

SEQ ID NO: 368957 - DNA, 20 bp, human
ggtaaaagtggtagcagcgg

SEQ ID NO: 368958 - DNA, 20 bp, human
ggagcactgtgggagctcgc

SEQ ID NO: 368959 - DNA, 20 bp, human
gtggtagcagcggaggcgag

SEQ ID NO: 368960 - DNA, 20 bp, human
ggtcctggcggcctccatag

SEQ ID NO: 368961 - DNA, 20 bp, human
gagcgacgcggtcgagtcag

SEQ ID NO: 368962 - DNA, 20 bp, human
gggtgaggcgctgggtatgc

SEQ ID NO: 368963 - DNA, 20 bp, human
gagaactcgtggcccagtta

SEQ ID NO: 368964 - DNA, 20 bp, human
gagcggagggtttcccgcgg

SEQ ID NO: 368965 - DNA, 20 bp, human
gcggaagcgcagtgcggagc

SEQ ID NO: 368966 - DNA, 20 bp, human
gtcccagagcaagttagctg

SEQ ID NO: 368967 - DNA, 20 bp, human
ggccccttttgcagatgtga

SEQ ID NO: 368968 - DNA, 20 bp, human
gaagcaaccatctgggtcca

SEQ ID NO: 368969 - DNA, 20 bp, human
ggaggtgaggcagcccgcaa

SEQ ID NO: 368970 - DNA, 20 bp, human
ggtgaagggccagtgaacct

SEQ ID NO: 368971 - DNA, 20 bp, human
gctctgggacagcttcccca

SEQ ID NO: 368972 - DNA, 20 bp, human
gggcccttcacatctgcaaa

SEQ ID NO: 368973 - DNA, 20 bp, human
gaggggcagctaggagctct

SEQ ID NO: 368974 - DNA, 20 bp, human
gtgaggcagcccgcaaagga

SEQ ID NO: 368975 - DNA, 20 bp, human
ggctgaggacaggacagtag

SEQ ID NO: 368976 - DNA, 20 bp, human
ggccggctgtgcagtagaac

SEQ ID NO: 368977 - DNA, 20 bp, human
gtagaacggggatcgaaaag

SEQ ID NO: 368978 - DNA, 20 bp, human
gtctcccggaacagttgacg

SEQ ID NO: 368979 - DNA, 20 bp, human
gctcccgaaaccagagggat

SEQ ID NO: 368980 - DNA, 20 bp, human
gccactctcccgaaaccaga

SEQ ID NO: 368981 - DNA, 20 bp, human
gaaggcggaagcagaagacg

SEQ ID NO: 368982 - DNA, 20 bp, human
gccttccacgtcaactgttc

SEQ ID NO: 368983 - DNA, 20 bp, human
gccaaacagcactgagaaaa

SEQ ID NO: 368984 - DNA, 20 bp, human
ggcacagagcagaaccatcc

SEQ ID NO: 368985 - DNA, 20 bp, human
gagagaagcacgttagtgtg

SEQ ID NO: 368986 - DNA, 20 bp, human
gaaggtacagaggtcaataa

SEQ ID NO: 368987 - DNA, 20 bp, human
gacgccacacaaaaaagggg

SEQ ID NO: 368988 - DNA, 20 bp, human
gagatacgccacacaaaaaa

SEQ ID NO: 368989 - DNA, 20 bp, human
gaacaaaacaaaaacggttt

SEQ ID NO: 368990 - DNA, 20 bp, human
gagtggtgaagccccatcac

SEQ ID NO: 368991 - DNA, 20 bp, human
ggtcttgtgcccaggagcaa

SEQ ID NO: 368992 - DNA, 20 bp, human
gcagctgcagggaggacacg

SEQ ID NO: 368993 - DNA, 20 bp, human
gtaaaaagtgtagacgattt

SEQ ID NO: 368994 - DNA, 20 bp, human
gtagacgatttgggaccatc

SEQ ID NO: 368995 - DNA, 20 bp, human
gaggcaggcccttggcttgg

SEQ ID NO: 368996 - DNA, 20 bp, human
gatcgcctggggagcccaag

SEQ ID NO: 368997 - DNA, 20 bp, human
gggccccctgcgcgcccctt

SEQ ID NO: 368998 - DNA, 20 bp, human
ggctccccaggcgatcgcgt

SEQ ID NO: 368999 - DNA, 20 bp, human
gaaaagctgctcgccggcag

SEQ ID NO: 369000 - DNA, 20 bp, human
ggccccgacgcgatcgcctg

SEQ ID NO: 369001 - DNA, 20 bp, human
ggcactgcggggccgagagc

SEQ ID NO: 369002 - DNA, 20 bp, human
gtcagaggtgagaaacgggt

SEQ ID NO: 369003 - DNA, 20 bp, human
gctcgccggcagaggctggg

SEQ ID NO: 369004 - DNA, 20 bp, human
ggaagggctccccacccgct

SEQ ID NO: 369005 - DNA, 20 bp, human
ggatcgcgtcggggcaaagc

SEQ ID NO: 369006 - DNA, 20 bp, human
gacagcttggagttactgtt

SEQ ID NO: 369007 - DNA, 20 bp, human
gtatggaagcgaaagccgaa

SEQ ID NO: 369008 - DNA, 20 bp, human
gggatcatgtggtgggaaat

SEQ ID NO: 369009 - DNA, 20 bp, human
gtagtgacaggatcatgtgg

SEQ ID NO: 369010 - DNA, 20 bp, human
gatgtggtgggaaatgggcc

SEQ ID NO: 369011 - DNA, 20 bp, human
gtaaacatggtttgcatagc

SEQ ID NO: 369012 - DNA, 20 bp, human
gctagtgacagcatgtatat

SEQ ID NO: 369013 - DNA, 20 bp, human
gcaccctaaaagctttatgt

SEQ ID NO: 369014 - DNA, 20 bp, human
ggcatagtgacaggatcatg

SEQ ID NO: 369015 - DNA, 20 bp, human
gttagagaaggcatcatact

SEQ ID NO: 369016 - DNA, 20 bp, human
ggtgctgaacccggaggctg

SEQ ID NO: 369017 - DNA, 20 bp, human
gcctccgggttcagcaccag

SEQ ID NO: 369018 - DNA, 20 bp, human
gaggcaggggacagcaccgg

SEQ ID NO: 369019 - DNA, 20 bp, human
gaggagaggggagggacacg

SEQ ID NO: 369020 - DNA, 20 bp, human
gcagtctcccagccatacaa

SEQ ID NO: 369021 - DNA, 20 bp, human
ggtagctgttggcccttgta

SEQ ID NO: 369022 - DNA, 20 bp, human
ggacttacagaactaggggg

SEQ ID NO: 369023 - DNA, 20 bp, human
gcaggcacagtatgtgaatt

SEQ ID NO: 369024 - DNA, 20 bp, human
gtcagggctgcctgtatgta

SEQ ID NO: 369025 - DNA, 20 bp, human
gcaacagctgccatacatac

SEQ ID NO: 369026 - DNA, 20 bp, human
gcgcggcttgtcagtcagtg

SEQ ID NO: 369027 - DNA, 20 bp, human
ggcgccaggctccaacgact

SEQ ID NO: 369028 - DNA, 20 bp, human
gggccacccaccctagtcgt

SEQ ID NO: 369029 - DNA, 20 bp, human
gggaacgtcaccctatcagc

SEQ ID NO: 369030 - DNA, 20 bp, human
gcctaggggaggagttgagg

SEQ ID NO: 369031 - DNA, 20 bp, human
gcggcagcacgtcaaaacgg

SEQ ID NO: 369032 - DNA, 20 bp, human
gaggctccaacgactagggt

SEQ ID NO: 369033 - DNA, 20 bp, human
gagggtccacccaggcctag

SEQ ID NO: 369034 - DNA, 20 bp, human
gcctggagctcccaactcgg

SEQ ID NO: 369035 - DNA, 20 bp, human
gtcccaactcggcggaatcc

SEQ ID NO: 369036 - DNA, 20 bp, human
gagctcccggggagcttcgt

SEQ ID NO: 369037 - DNA, 20 bp, human
gggcccggacgggaagagta

SEQ ID NO: 369038 - DNA, 20 bp, human
gcccttaaaggtacagctcc

SEQ ID NO: 369039 - DNA, 20 bp, human
gcccgggagctgtaccttta

SEQ ID NO: 369040 - DNA, 20 bp, human
gaagaccctacgaagctccc

SEQ ID NO: 369041 - DNA, 20 bp, human
gggcggggcgagccccgagg

SEQ ID NO: 369042 - DNA, 20 bp, human
gtcctgcagtccttacccat

SEQ ID NO: 369043 - DNA, 20 bp, human
gtaggaggttcatttcccga

SEQ ID NO: 369044 - DNA, 20 bp, human
gcctcaggacacgccccctc

SEQ ID NO: 369045 - DNA, 20 bp, human
ggtaatgaatggtgacaaag

SEQ ID NO: 369046 - DNA, 20 bp, human
gtccctaaggccaaccatca

SEQ ID NO: 369047 - DNA, 20 bp, human
gtgctgcaagttctgtacaa

SEQ ID NO: 369048 - DNA, 20 bp, human
gctaactcctccgcctgtct

SEQ ID NO: 369049 - DNA, 20 bp, human
gaaaatctgggccacagatg

SEQ ID NO: 369050 - DNA, 20 bp, human
gtaccctgatggttggcctt

SEQ ID NO: 369051 - DNA, 20 bp, human
gtggtccaaggggaagtcct

SEQ ID NO: 369052 - DNA, 20 bp, human
gaggatgtgctctagttggg

SEQ ID NO: 369053 - DNA, 20 bp, human
gcgtctgggccctgctgaca

SEQ ID NO: 369054 - DNA, 20 bp, human
gtgggttccagcaataaaga

SEQ ID NO: 369055 - DNA, 20 bp, human
gttgaggatgtgctctagtt

SEQ ID NO: 369056 - DNA, 20 bp, human
gagggaaagaagtatcgcgt

SEQ ID NO: 369057 - DNA, 20 bp, human
gcagcggcccctgtcgccga

SEQ ID NO: 369058 - DNA, 20 bp, human
gcaccagcgagcagccggtg

SEQ ID NO: 369059 - DNA, 20 bp, human
ggtatcgcgtaggaagagga

SEQ ID NO: 369060 - DNA, 20 bp, human
gtctctctagcccgccgcac

SEQ ID NO: 369061 - DNA, 20 bp, human
gcgccgcaccggctgctcgc

SEQ ID NO: 369062 - DNA, 20 bp, human
gagaagtatcgcgtaggaag

SEQ ID NO: 369063 - DNA, 20 bp, human
gcacatctgcagtctcataa

SEQ ID NO: 369064 - DNA, 20 bp, human
gcaggggccgctgcgctggg

SEQ ID NO: 369065 - DNA, 20 bp, human
gacttctttccctcggcgac

SEQ ID NO: 369066 - DNA, 20 bp, human
gagggaagggcgcgactcgt

SEQ ID NO: 369067 - DNA, 20 bp, human
gacgtccgacgctgcctccg

SEQ ID NO: 369068 - DNA, 20 bp, human
gccgcagggcaggaggacaa

SEQ ID NO: 369069 - DNA, 20 bp, human
gagagccagcgaactgtggg

SEQ ID NO: 369070 - DNA, 20 bp, human
ggggaggcgccacaggctcg

SEQ ID NO: 369071 - DNA, 20 bp, human
ggcaacgggcgcatggtggc

SEQ ID NO: 369072 - DNA, 20 bp, human
gcaccggggtgtccccttgg

SEQ ID NO: 369073 - DNA, 20 bp, human
gcccagagccagcgaactgt

SEQ ID NO: 369074 - DNA, 20 bp, human
gcggggccccagtgaccgcg

SEQ ID NO: 369075 - DNA, 20 bp, human
gggagctgtctccgccccgg

SEQ ID NO: 369076 - DNA, 20 bp, human
gacctccaggccgcgggctc

SEQ ID NO: 369077 - DNA, 20 bp, human
gaaggcggccgcgcagtccc

SEQ ID NO: 369078 - DNA, 20 bp, human
gggcccggggccccgaccgg

SEQ ID NO: 369079 - DNA, 20 bp, human
gactgcgcggccgccttcct

SEQ ID NO: 369080 - DNA, 20 bp, human
gtccaggccgcgggctccgg

SEQ ID NO: 369081 - DNA, 20 bp, human
gacccggcgcgctccggtgc

SEQ ID NO: 369082 - DNA, 20 bp, human
ggagcgcgccgggtcctcgc

SEQ ID NO: 369083 - DNA, 20 bp, human
ggctgtgctccccacgcccc

SEQ ID NO: 369084 - DNA, 20 bp, human
gagcgcggggtgggcgtgcg

SEQ ID NO: 369085 - DNA, 20 bp, human
gtcgcggcaagagcgagccc

SEQ ID NO: 369086 - DNA, 20 bp, human
gccgaattcccggttctggg

SEQ ID NO: 369087 - DNA, 20 bp, human
ggacctccgcgggccaatag

SEQ ID NO: 369088 - DNA, 20 bp, human
gccgccccgcgcgttcccaa

SEQ ID NO: 369089 - DNA, 20 bp, human
gcccgcgcgttcccaatggc

SEQ ID NO: 369090 - DNA, 20 bp, human
gtcggcgcggcgccccgcgg

SEQ ID NO: 369091 - DNA, 20 bp, human
gcaggcctgcagccccctat

SEQ ID NO: 369092 - DNA, 20 bp, human
gcccccggggtaaggagccg

SEQ ID NO: 369093 - DNA, 20 bp, human
gggcgctccggccgggtgaa

SEQ ID NO: 369094 - DNA, 20 bp, human
gcaggcctgggcgctccggc

SEQ ID NO: 369095 - DNA, 20 bp, human
gtgagggtggggacctccgc

SEQ ID NO: 369096 - DNA, 20 bp, human
gtggccgggcgcggaggtag

SEQ ID NO: 369097 - DNA, 20 bp, human
gaaggcggctgcccagagta

SEQ ID NO: 369098 - DNA, 20 bp, human
gagaggtcccggtggttaag

SEQ ID NO: 369099 - DNA, 20 bp, human
gagtcccagccgtcccggcc

SEQ ID NO: 369100 - DNA, 20 bp, human
ggggccaaagggtaagaaca

SEQ ID NO: 369101 - DNA, 20 bp, human
ggggggaggcggcagggcta

SEQ ID NO: 369102 - DNA, 20 bp, human
gccaagggaccccgacaaag

SEQ ID NO: 369103 - DNA, 20 bp, human
ggggcgacgggttggacaaa

SEQ ID NO: 369104 - DNA, 20 bp, human
gaaaggcgctggcaccaagg

SEQ ID NO: 369105 - DNA, 20 bp, human
gaggggaccccttaaccacc

SEQ ID NO: 369106 - DNA, 20 bp, human
ggccctggctccccggggat

SEQ ID NO: 369107 - DNA, 20 bp, human
gcaggctggagccttcgcag

SEQ ID NO: 369108 - DNA, 20 bp, human
gggaggcggctgtgtggttg

SEQ ID NO: 369109 - DNA, 20 bp, human
gcagagggaggtagataagt

SEQ ID NO: 369110 - DNA, 20 bp, human
gtaggcttccgtcccaagaa

SEQ ID NO: 369111 - DNA, 20 bp, human
ggggaggtagataagtgggg

SEQ ID NO: 369112 - DNA, 20 bp, human
gtggagccttcgcaggggag

SEQ ID NO: 369113 - DNA, 20 bp, human
gctggctccccggggatggg

SEQ ID NO: 369114 - DNA, 20 bp, human
gaggaccgtcctgtgttctg

SEQ ID NO: 369115 - DNA, 20 bp, human
gggaagcctagctgggtggg

SEQ ID NO: 369116 - DNA, 20 bp, human
ggtcaagggtgttgtattgc

SEQ ID NO: 369117 - DNA, 20 bp, human
ggatcaggtagctccttctt

SEQ ID NO: 369118 - DNA, 20 bp, human
gaatgactgctcatggagtc

SEQ ID NO: 369119 - DNA, 20 bp, human
gcctttctctgagggttctc

SEQ ID NO: 369120 - DNA, 20 bp, human
ggaggtggtaacaacaagga

SEQ ID NO: 369121 - DNA, 20 bp, human
gtctctatacatgaggaaga

SEQ ID NO: 369122 - DNA, 20 bp, human
gtcaaaacaaatgagaggac

SEQ ID NO: 369123 - DNA, 20 bp, human
ggaaggaggtggtaacaaca

SEQ ID NO: 369124 - DNA, 20 bp, human
gcatttgttttgaatgacca

SEQ ID NO: 369125 - DNA, 20 bp, human
gccacggcttcaggtagctc

SEQ ID NO: 369126 - DNA, 20 bp, human
gatacccccaagccaggtcc

SEQ ID NO: 369127 - DNA, 20 bp, human
ggggcagcccgcagcgggaa

SEQ ID NO: 369128 - DNA, 20 bp, human
gactacgagagtccgaggca

SEQ ID NO: 369129 - DNA, 20 bp, human
gcccgcgtcacaggcacgtg

SEQ ID NO: 369130 - DNA, 20 bp, human
ggggtctcggagcctggacc

SEQ ID NO: 369131 - DNA, 20 bp, human
ggactcgaaggagtaggttg

SEQ ID NO: 369132 - DNA, 20 bp, human
gcccctggggcagcccgcag

SEQ ID NO: 369133 - DNA, 20 bp, human
gggcgcggactcgaaggagt

SEQ ID NO: 369134 - DNA, 20 bp, human
gcaccgctctggatctggtg

SEQ ID NO: 369135 - DNA, 20 bp, human
gccccgactacgagagtccg

SEQ ID NO: 369136 - DNA, 20 bp, human
gggcggccgccggtgaggta

SEQ ID NO: 369137 - DNA, 20 bp, human
gacctgggacagaggggcaa

SEQ ID NO: 369138 - DNA, 20 bp, human
ggaacctggcagagcgagct

SEQ ID NO: 369139 - DNA, 20 bp, human
gcgtgtgacctgggacagag

SEQ ID NO: 369140 - DNA, 20 bp, human
gcctgtgggtgcgtgtgacc

SEQ ID NO: 369141 - DNA, 20 bp, human
gcggtcggaccactccccga

SEQ ID NO: 369142 - DNA, 20 bp, human
gagggctcacgggaaagggg

SEQ ID NO: 369143 - DNA, 20 bp, human
gaggcgctgccgggaatgaa

SEQ ID NO: 369144 - DNA, 20 bp, human
gccgccgccgccgctcttaa

SEQ ID NO: 369145 - DNA, 20 bp, human
gggggcccgggggtagccgt

SEQ ID NO: 369146 - DNA, 20 bp, human
gggccggcccgcagacccga

SEQ ID NO: 369147 - DNA, 20 bp, human
gcggcgcctagcgggagcat

SEQ ID NO: 369148 - DNA, 20 bp, human
gccaggcagtctggggtcgt

SEQ ID NO: 369149 - DNA, 20 bp, human
gcggtctcgagtcccgtctc

SEQ ID NO: 369150 - DNA, 20 bp, human
ggggggacgaacaggtgcgc

SEQ ID NO: 369151 - DNA, 20 bp, human
ggcggcggctgcccatgaac

SEQ ID NO: 369152 - DNA, 20 bp, human
gtcgccgtggcgccagagac

SEQ ID NO: 369153 - DNA, 20 bp, human
gcaaccgagccacccaggcg

SEQ ID NO: 369154 - DNA, 20 bp, human
gcggggtgagaagcgcagag

SEQ ID NO: 369155 - DNA, 20 bp, human
gtcccctttcggaagtgcgg

SEQ ID NO: 369156 - DNA, 20 bp, human
gagggtgggagaaagcgcgt

SEQ ID NO: 369157 - DNA, 20 bp, human
ggtgggagaaagcgcgtggg

SEQ ID NO: 369158 - DNA, 20 bp, human
ggggaaaagccggaatctct

SEQ ID NO: 369159 - DNA, 20 bp, human
gcctccgtctcagtggcccg

SEQ ID NO: 369160 - DNA, 20 bp, human
gcacagggcggggacgtttt

SEQ ID NO: 369161 - DNA, 20 bp, human
gacaagcgtcccgaaagccc

SEQ ID NO: 369162 - DNA, 20 bp, human
gtcggtcccaggtggtcatg

SEQ ID NO: 369163 - DNA, 20 bp, human
gacagagggccgccctcgcg

SEQ ID NO: 369164 - DNA, 20 bp, human
gggcctcggccgcgcgaggg

SEQ ID NO: 369165 - DNA, 20 bp, human
gagggtgcttgcttgccctc

SEQ ID NO: 369166 - DNA, 20 bp, human
gagaaaacgttgctagtgta

SEQ ID NO: 369167 - DNA, 20 bp, human
gtcgagtttgaaaagagaca

SEQ ID NO: 369168 - DNA, 20 bp, human
ggtgaagttgagtcaggaat

SEQ ID NO: 369169 - DNA, 20 bp, human
gccatctgaatactaagcca

SEQ ID NO: 369170 - DNA, 20 bp, human
gaaggcatagggtttcttat

SEQ ID NO: 369171 - DNA, 20 bp, human
gatgctaagatcttgaatca

SEQ ID NO: 369172 - DNA, 20 bp, human
gtcacaatgggattcactta

SEQ ID NO: 369173 - DNA, 20 bp, human
gcagcttaagaagacttatt

SEQ ID NO: 369174 - DNA, 20 bp, human
gtggcaggtcttggttagag

SEQ ID NO: 369175 - DNA, 20 bp, human
gagtgtaatatcttttcagg

SEQ ID NO: 369176 - DNA, 20 bp, human
gggcagaggcgagggttctg

SEQ ID NO: 369177 - DNA, 20 bp, human
gtggctgtccgcgccggcag

SEQ ID NO: 369178 - DNA, 20 bp, human
gacgtcttggctgtccgcgc

SEQ ID NO: 369179 - DNA, 20 bp, human
gcctgcgcggaagtctatcc

SEQ ID NO: 369180 - DNA, 20 bp, human
gaagagacgtcgaaaggaaa

SEQ ID NO: 369181 - DNA, 20 bp, human
gagccacgcgccacccaggt

SEQ ID NO: 369182 - DNA, 20 bp, human
ggcgcgtttaagtgacgtct

SEQ ID NO: 369183 - DNA, 20 bp, human
gatagacttccgcgcagggg

SEQ ID NO: 369184 - DNA, 20 bp, human
ggtaaaggacgctgtggtgg

SEQ ID NO: 369185 - DNA, 20 bp, human
gcttctgaatattgactcat

SEQ ID NO: 369186 - DNA, 20 bp, human
gaggtacagctaaaaggtgg

SEQ ID NO: 369187 - DNA, 20 bp, human
gcctccctgggcgggtccgc

SEQ ID NO: 369188 - DNA, 20 bp, human
gtcagctgcggtgggaagat

SEQ ID NO: 369189 - DNA, 20 bp, human
gacaacttagaggttggttt

SEQ ID NO: 369190 - DNA, 20 bp, human
gcaggtgttaagcgataaag

SEQ ID NO: 369191 - DNA, 20 bp, human
gacgtcccggggcctcggag

SEQ ID NO: 369192 - DNA, 20 bp, human
gctgagaagacacttctaag

SEQ ID NO: 369193 - DNA, 20 bp, human
gctctctgggtaagctttcc

SEQ ID NO: 369194 - DNA, 20 bp, human
gcgaccatgggcccacgtcc

SEQ ID NO: 369195 - DNA, 20 bp, human
ggcggtgtctcgtcatctcc

SEQ ID NO: 369196 - DNA, 20 bp, human
gacaatggcgcaatttctgt

SEQ ID NO: 369197 - DNA, 20 bp, human
gccatcatctcttacttgat

SEQ ID NO: 369198 - DNA, 20 bp, human
gtcaggcatttgacggctta

SEQ ID NO: 369199 - DNA, 20 bp, human
gacaaggtgaactttcactc

SEQ ID NO: 369200 - DNA, 20 bp, human
gaagctaaccggtgcagact

SEQ ID NO: 369201 - DNA, 20 bp, human
gcattgctcctgtatatctc

SEQ ID NO: 369202 - DNA, 20 bp, human
gtatgaggacgcaggttgct

SEQ ID NO: 369203 - DNA, 20 bp, human
gtcaaatgcctgagatatac

SEQ ID NO: 369204 - DNA, 20 bp, human
gtgcagactaggggcgagtt

SEQ ID NO: 369205 - DNA, 20 bp, human
gttcccagaattctagtaaa

SEQ ID NO: 369206 - DNA, 20 bp, human
gacttggcttcttctggatt

SEQ ID NO: 369207 - DNA, 20 bp, human
gtcccaagaactagatcact

SEQ ID NO: 369208 - DNA, 20 bp, human
ggccaagtgatctagttctt

SEQ ID NO: 369209 - DNA, 20 bp, human
gttgggggtggggataatgt

SEQ ID NO: 369210 - DNA, 20 bp, human
gcaagaaaccaatgagaagt

SEQ ID NO: 369211 - DNA, 20 bp, human
gagcctgctttcgttctgat

SEQ ID NO: 369212 - DNA, 20 bp, human
gtagatcacttggcttcttc

SEQ ID NO: 369213 - DNA, 20 bp, human
gactacacttagcttttgaa

SEQ ID NO: 369214 - DNA, 20 bp, human
gagccaatcagaacgaaagc

SEQ ID NO: 369215 - DNA, 20 bp, human
ggcttcttctggattggggg

SEQ ID NO: 369216 - DNA, 20 bp, human
ggagcattctttttccccta

SEQ ID NO: 369217 - DNA, 20 bp, human
gagagtcagagtcagcccta

SEQ ID NO: 369218 - DNA, 20 bp, human
gggctgactctgactctgta

SEQ ID NO: 369219 - DNA, 20 bp, human
ggaacaaaggacatgttgtt

SEQ ID NO: 369220 - DNA, 20 bp, human
ggaagctacccctttgctaa

SEQ ID NO: 369221 - DNA, 20 bp, human
gcctgagcctacacaatgta

SEQ ID NO: 369222 - DNA, 20 bp, human
ggggcttatggtaaaagact

SEQ ID NO: 369223 - DNA, 20 bp, human
gcctttgctaaaggaaataa

SEQ ID NO: 369224 - DNA, 20 bp, human
gaagtaaaaattgtttgcat

SEQ ID NO: 369225 - DNA, 20 bp, human
gggcaattcaaggtgaacaa

SEQ ID NO: 369226 - DNA, 20 bp, human
gaaagccattcccaaaagta

SEQ ID NO: 369227 - DNA, 20 bp, human
ggagcaatgacataataagg

SEQ ID NO: 369228 - DNA, 20 bp, human
gtgaactcttaaaactaact

SEQ ID NO: 369229 - DNA, 20 bp, human
gacgtggtatgtatggagac

SEQ ID NO: 369230 - DNA, 20 bp, human
gctagagcaatgacataata

SEQ ID NO: 369231 - DNA, 20 bp, human
gcttatgtaccaagcaaaga

SEQ ID NO: 369232 - DNA, 20 bp, human
gggttctaacgtggtatgta

SEQ ID NO: 369233 - DNA, 20 bp, human
gcataagtatggttctaacg

SEQ ID NO: 369234 - DNA, 20 bp, human
gtaaggtggttaatcatcac

SEQ ID NO: 369235 - DNA, 20 bp, human
gaaatgccaatgtaacctgt

SEQ ID NO: 369236 - DNA, 20 bp, human
gggacaatgacctaataaga

SEQ ID NO: 369237 - DNA, 20 bp, human
gtgaactcctagaattagct

SEQ ID NO: 369238 - DNA, 20 bp, human
gcacatgtaacaagcaaaga

SEQ ID NO: 369239 - DNA, 20 bp, human
gtttaaaagataggcttctg

SEQ ID NO: 369240 - DNA, 20 bp, human
gggacactggatatctcaca

SEQ ID NO: 369241 - DNA, 20 bp, human
gaatgctaatgtaacatgta

SEQ ID NO: 369242 - DNA, 20 bp, human
gtccttacatcaatgtgtaa

SEQ ID NO: 369243 - DNA, 20 bp, human
gatatgacgtacatggacac

SEQ ID NO: 369244 - DNA, 20 bp, human
gggatctaatatgacgtaca

SEQ ID NO: 369245 - DNA, 20 bp, human
gtcctttacacattgatgta

SEQ ID NO: 369246 - DNA, 20 bp, human
gtcaatgctggacacagagg

SEQ ID NO: 369247 - DNA, 20 bp, human
gcctgtggtcaggaaatagc

SEQ ID NO: 369248 - DNA, 20 bp, human
gcagcattgacctagtcctg

SEQ ID NO: 369249 - DNA, 20 bp, human
gattctctaatattcattca

SEQ ID NO: 369250 - DNA, 20 bp, human
gttgacctagtcctgtggtc

SEQ ID NO: 369251 - DNA, 20 bp, human
gctatgtgcaagtcatcatt

SEQ ID NO: 369252 - DNA, 20 bp, human
gagattacaagatttatgaa

SEQ ID NO: 369253 - DNA, 20 bp, human
gattataatctctttaggct

SEQ ID NO: 369254 - DNA, 20 bp, human
gatttcctgaccacaggact

SEQ ID NO: 369255 - DNA, 20 bp, human
gacatagtggatactcaaaa

SEQ ID NO: 369256 - DNA, 20 bp, human
ggatcccagtgatgtcccta

SEQ ID NO: 369257 - DNA, 20 bp, human
gcaactccgcagggggcaga

SEQ ID NO: 369258 - DNA, 20 bp, human
gacgtgcatctcagctccca

SEQ ID NO: 369259 - DNA, 20 bp, human
gcgtgataaagctttcttta

SEQ ID NO: 369260 - DNA, 20 bp, human
ggcagcaaattgcaaagaaa

SEQ ID NO: 369261 - DNA, 20 bp, human
gtattccttagggacatcac

SEQ ID NO: 369262 - DNA, 20 bp, human
gggcttaaaaactttctgga

SEQ ID NO: 369263 - DNA, 20 bp, human
ggagctgagatgcacgtcag

SEQ ID NO: 369264 - DNA, 20 bp, human
gcagcaagtaagatcacaag

SEQ ID NO: 369265 - DNA, 20 bp, human
gctgcggagttgtgttttct

SEQ ID NO: 369266 - DNA, 20 bp, human
gcggcaggcgggatcttctc

SEQ ID NO: 369267 - DNA, 20 bp, human
ggaagatcccgcctgccggg

SEQ ID NO: 369268 - DNA, 20 bp, human
gcggcgtcacacctgtctga

SEQ ID NO: 369269 - DNA, 20 bp, human
gcgggggcaggaggttgcaa

SEQ ID NO: 369270 - DNA, 20 bp, human
gagggtgggcgaagcgaagg

SEQ ID NO: 369271 - DNA, 20 bp, human
gaacgtcgggaggggtgctg

SEQ ID NO: 369272 - DNA, 20 bp, human
gcgccgccgccccctcagac

SEQ ID NO: 369273 - DNA, 20 bp, human
gcacccctcccgacgttctt

SEQ ID NO: 369274 - DNA, 20 bp, human
ggggactggcgaagagaggg

SEQ ID NO: 369275 - DNA, 20 bp, human
gcaggaaggctgggatatga

SEQ ID NO: 369276 - DNA, 20 bp, human
gctgttagcagcagagaggt

SEQ ID NO: 369277 - DNA, 20 bp, human
gagcaggggaaaatacctaa

SEQ ID NO: 369278 - DNA, 20 bp, human
gtctgctgctaacagagcag

SEQ ID NO: 369279 - DNA, 20 bp, human
ggggccctcctatcaaggga

SEQ ID NO: 369280 - DNA, 20 bp, human
gtatggggccctcctatcaa

SEQ ID NO: 369281 - DNA, 20 bp, human
ggtggaaggttggggagctt

SEQ ID NO: 369282 - DNA, 20 bp, human
gatacctaagggaaatgctg

SEQ ID NO: 369283 - DNA, 20 bp, human
gttgcctcagcatttccctt

SEQ ID NO: 369284 - DNA, 20 bp, human
ggggtggagctcatggtaga

SEQ ID NO: 369285 - DNA, 20 bp, human
ggggaacaagggctctctat

SEQ ID NO: 369286 - DNA, 20 bp, human
gggcaaggggaaccgggcga

SEQ ID NO: 369287 - DNA, 20 bp, human
ggccggcgggcaaggggaac

SEQ ID NO: 369288 - DNA, 20 bp, human
gagtccttgcggagtaaggg

SEQ ID NO: 369289 - DNA, 20 bp, human
ggccccgcggcggagactgg

SEQ ID NO: 369290 - DNA, 20 bp, human
gaaccgggcgatggcagcgg

SEQ ID NO: 369291 - DNA, 20 bp, human
gaggcacgggaggcgggctt

SEQ ID NO: 369292 - DNA, 20 bp, human
ggcccgccgctgccatcgcc

SEQ ID NO: 369293 - DNA, 20 bp, human
gtgccccgcagcgccaccta

SEQ ID NO: 369294 - DNA, 20 bp, human
gggcaggctgttcccaggaa

SEQ ID NO: 369295 - DNA, 20 bp, human
ggcgcaccggcagcgaggag

SEQ ID NO: 369296 - DNA, 20 bp, human
gggaccagggcgtctctctc

SEQ ID NO: 369297 - DNA, 20 bp, human
gaacgcgcggcgggggacca

SEQ ID NO: 369298 - DNA, 20 bp, human
ggctccggagagagacgccc

SEQ ID NO: 369299 - DNA, 20 bp, human
gcgccccctcctccccccca

SEQ ID NO: 369300 - DNA, 20 bp, human
gccaggaggcggcagcgctc

SEQ ID NO: 369301 - DNA, 20 bp, human
gtcccgcctctgtgccctgg

SEQ ID NO: 369302 - DNA, 20 bp, human
gggtccttggagctggagcg

SEQ ID NO: 369303 - DNA, 20 bp, human
gcgcccccgccgcagaggga

SEQ ID NO: 369304 - DNA, 20 bp, human
gcgccgctgccattggccgt

SEQ ID NO: 369305 - DNA, 20 bp, human
gcctcaccccccacggccaa

SEQ ID NO: 369306 - DNA, 20 bp, human
ggctcaggtcagaaccgcag

SEQ ID NO: 369307 - DNA, 20 bp, human
gtgggcgtgccacccggcgg

SEQ ID NO: 369308 - DNA, 20 bp, human
gcggcggcggccgagtagag

SEQ ID NO: 369309 - DNA, 20 bp, human
gaccgcaggggcttgggcgg

SEQ ID NO: 369310 - DNA, 20 bp, human
gcaaccggaaggcgcggcgt

SEQ ID NO: 369311 - DNA, 20 bp, human
ggtcagaaccgcaggggctt

SEQ ID NO: 369312 - DNA, 20 bp, human
gagaaccgcaggggcttggg

SEQ ID NO: 369313 - DNA, 20 bp, human
ggcgccccagcctgtggctt

SEQ ID NO: 369314 - DNA, 20 bp, human
gggactccggtcgaaggctg

SEQ ID NO: 369315 - DNA, 20 bp, human
ggcctcaaggaccaaccgga

SEQ ID NO: 369316 - DNA, 20 bp, human
gggtccgcggcagacaatga

SEQ ID NO: 369317 - DNA, 20 bp, human
ggagtaatggagtaggagta

SEQ ID NO: 369318 - DNA, 20 bp, human
gatggagtaggagtacggaa

SEQ ID NO: 369319 - DNA, 20 bp, human
gaaagcaaacgcaatgttta

SEQ ID NO: 369320 - DNA, 20 bp, human
gtgtgcacactggtgtgcgt

SEQ ID NO: 369321 - DNA, 20 bp, human
ggcaatgtttaaggcagaag

SEQ ID NO: 369322 - DNA, 20 bp, human
gctgtcccaatttttctaaa

SEQ ID NO: 369323 - DNA, 20 bp, human
gtctccctcattgtctgccg

SEQ ID NO: 369324 - DNA, 20 bp, human
gctattttgagtaatggagt

SEQ ID NO: 369325 - DNA, 20 bp, human
gcgcgctctgggacttagtg

SEQ ID NO: 369326 - DNA, 20 bp, human
gcggtctctagaaaagtcag

SEQ ID NO: 369327 - DNA, 20 bp, human
gaggcttgggtgacaggcga

SEQ ID NO: 369328 - DNA, 20 bp, human
gcacagagacgcgcccggag

SEQ ID NO: 369329 - DNA, 20 bp, human
ggaggagaggcttgggtgac

SEQ ID NO: 369330 - DNA, 20 bp, human
gtggagcggaggagaggctt

SEQ ID NO: 369331 - DNA, 20 bp, human
gtcggggcttcagcgctctt

SEQ ID NO: 369332 - DNA, 20 bp, human
gcccgcagccacgcaggtga

SEQ ID NO: 369333 - DNA, 20 bp, human
gcgcgtgtgtctgtttggag

SEQ ID NO: 369334 - DNA, 20 bp, human
gagacaagatacttggtcgg

SEQ ID NO: 369335 - DNA, 20 bp, human
gcccttcacctgcgtggctg

SEQ ID NO: 369336 - DNA, 20 bp, human
gaaagtaagtctggggaaac

SEQ ID NO: 369337 - DNA, 20 bp, human
gacgtcctcccgggggttga

SEQ ID NO: 369338 - DNA, 20 bp, human
gaatgtaagcgaagagtagt

SEQ ID NO: 369339 - DNA, 20 bp, human
gtcaaccgtcaacccccggg

SEQ ID NO: 369340 - DNA, 20 bp, human
gttctcaaccgtcaaccccc

SEQ ID NO: 369341 - DNA, 20 bp, human
gcaccataataaagtaagtc

SEQ ID NO: 369342 - DNA, 20 bp, human
gagtagtaggatatgaaacg

SEQ ID NO: 369343 - DNA, 20 bp, human
gccgcacgtggaagaaaaga

SEQ ID NO: 369344 - DNA, 20 bp, human
gccccagacttactttatta

SEQ ID NO: 369345 - DNA, 20 bp, human
gtctagtgagatttttcagt

SEQ ID NO: 369346 - DNA, 20 bp, human
gggagggagcgaggagacgg

SEQ ID NO: 369347 - DNA, 20 bp, human
gcaggagccgacagctgctt

SEQ ID NO: 369348 - DNA, 20 bp, human
gctacgtggcaacagtcaga

SEQ ID NO: 369349 - DNA, 20 bp, human
gaggagatgcaagagccaat

SEQ ID NO: 369350 - DNA, 20 bp, human
gttaacgcggcagagttcgc

SEQ ID NO: 369351 - DNA, 20 bp, human
gtcctgcgtgggatgtgcgt

SEQ ID NO: 369352 - DNA, 20 bp, human
gggctcttgcatctcctgcg

SEQ ID NO: 369353 - DNA, 20 bp, human
gcaggcaccgggagagaaga

SEQ ID NO: 369354 - DNA, 20 bp, human
gagatgcaagagccaatggg

SEQ ID NO: 369355 - DNA, 20 bp, human
ggggatctgggcaagtcgag

SEQ ID NO: 369356 - DNA, 20 bp, human
gaatgcgagtacagctggaa

SEQ ID NO: 369357 - DNA, 20 bp, human
gtgggcaattgtcactattt

SEQ ID NO: 369358 - DNA, 20 bp, human
gagggcagctgtggatggac

SEQ ID NO: 369359 - DNA, 20 bp, human
gaggcccaggctacagtccg

SEQ ID NO: 369360 - DNA, 20 bp, human
gagaaatgcaggccacgctg

SEQ ID NO: 369361 - DNA, 20 bp, human
ggagtcgataataaagagtg

SEQ ID NO: 369362 - DNA, 20 bp, human
gccctggagaccagtctgat

SEQ ID NO: 369363 - DNA, 20 bp, human
ggggtccacgctggcatctg

SEQ ID NO: 369364 - DNA, 20 bp, human
gaggacaaaggtgcaaggag

SEQ ID NO: 369365 - DNA, 20 bp, human
gagcccgcggactgtagcct

SEQ ID NO: 369366 - DNA, 20 bp, human
gtccccccttgaggctagaa

SEQ ID NO: 369367 - DNA, 20 bp, human
gcctgccattctagcctcaa

SEQ ID NO: 369368 - DNA, 20 bp, human
gtggcaggcctaaaatgagt

SEQ ID NO: 369369 - DNA, 20 bp, human
gagcacatattccccccttg

SEQ ID NO: 369370 - DNA, 20 bp, human
ggtgggccaaagactagttc

SEQ ID NO: 369371 - DNA, 20 bp, human
ggccattctagcctcaaggg

SEQ ID NO: 369372 - DNA, 20 bp, human
gtttagccagaactagtctt

SEQ ID NO: 369373 - DNA, 20 bp, human
gaccaaagcagcatttttcc

SEQ ID NO: 369374 - DNA, 20 bp, human
gacaacaactattaggatta

SEQ ID NO: 369375 - DNA, 20 bp, human
gacaactattaggattatgg

SEQ ID NO: 369376 - DNA, 20 bp, human
gaaccaatgggtcccaggca

SEQ ID NO: 369377 - DNA, 20 bp, human
gagcgtggcaaagtgttccc

SEQ ID NO: 369378 - DNA, 20 bp, human
gagggcatggacgcgccaat

SEQ ID NO: 369379 - DNA, 20 bp, human
gacggtgcggagagctaaag

SEQ ID NO: 369380 - DNA, 20 bp, human
gggagctccgcagtccccgt

SEQ ID NO: 369381 - DNA, 20 bp, human
gctgggcaggtcccacacag

SEQ ID NO: 369382 - DNA, 20 bp, human
gggactagaccctagggcgt

SEQ ID NO: 369383 - DNA, 20 bp, human
ggagggtccctgctcctacg

SEQ ID NO: 369384 - DNA, 20 bp, human
gcaaactagccgaaccccaa

SEQ ID NO: 369385 - DNA, 20 bp, human
gtgcggagagctaaaggggt

SEQ ID NO: 369386 - DNA, 20 bp, human
gtagccttgccagaataagt

SEQ ID NO: 369387 - DNA, 20 bp, human
gaataagtaggcatggataa

SEQ ID NO: 369388 - DNA, 20 bp, human
gtggagatatattttaatgt

SEQ ID NO: 369389 - DNA, 20 bp, human
gtggcaaggctaaggatatt

SEQ ID NO: 369390 - DNA, 20 bp, human
gtcaaagataatttccagtt

SEQ ID NO: 369391 - DNA, 20 bp, human
gacgttgcaatcctcctgcc

SEQ ID NO: 369392 - DNA, 20 bp, human
gttgccagaataagtaggca

SEQ ID NO: 369393 - DNA, 20 bp, human
gcttcaaaactatcaattac

SEQ ID NO: 369394 - DNA, 20 bp, human
ggaatcttgctctgttatgc

SEQ ID NO: 369395 - DNA, 20 bp, human
gaagaaaatattgtaatctt

SEQ ID NO: 369396 - DNA, 20 bp, human
gtccacgtaacgatgcgatt

SEQ ID NO: 369397 - DNA, 20 bp, human
gcttgcaactacaacagtct

SEQ ID NO: 369398 - DNA, 20 bp, human
gggacatggggtggataccc

SEQ ID NO: 369399 - DNA, 20 bp, human
gggtaaaccttgggtggact

SEQ ID NO: 369400 - DNA, 20 bp, human
gccggggcgggacatcgcgc

SEQ ID NO: 369401 - DNA, 20 bp, human
gaactcagctgatataagcc

SEQ ID NO: 369402 - DNA, 20 bp, human
gaagactccgagcggggcca

SEQ ID NO: 369403 - DNA, 20 bp, human
gtccgagcctgtggcgtccc

SEQ ID NO: 369404 - DNA, 20 bp, human
ggcgagacgcgttggtacat

SEQ ID NO: 369405 - DNA, 20 bp, human
gagtcttggtaaaccttggg

SEQ ID NO: 369406 - DNA, 20 bp, human
gagccaagctgcatggtggg

SEQ ID NO: 369407 - DNA, 20 bp, human
gaggtgacctgcatgggaac

SEQ ID NO: 369408 - DNA, 20 bp, human
gacactggaagcagacccag

SEQ ID NO: 369409 - DNA, 20 bp, human
gtgaagagacatcactaagt

SEQ ID NO: 369410 - DNA, 20 bp, human
gcaccatgcagcttggctgt

SEQ ID NO: 369411 - DNA, 20 bp, human
gcgctgaaagaggtggcaag

SEQ ID NO: 369412 - DNA, 20 bp, human
gggtgactgactaaagaggg

SEQ ID NO: 369413 - DNA, 20 bp, human
ggctctactgagtactgaca

SEQ ID NO: 369414 - DNA, 20 bp, human
gtgcatggtgggtgggccgc

SEQ ID NO: 369415 - DNA, 20 bp, human
gaaccagggttataggaagt

SEQ ID NO: 369416 - DNA, 20 bp, human
gcgggaccgcagacctggaa

SEQ ID NO: 369417 - DNA, 20 bp, human
gagggtataggccgcgagat

SEQ ID NO: 369418 - DNA, 20 bp, human
gcagcccgtggcaagggtcc

SEQ ID NO: 369419 - DNA, 20 bp, human
gcttccggatcagagggtat

SEQ ID NO: 369420 - DNA, 20 bp, human
gtccgaaaggcgtcctcccc

SEQ ID NO: 369421 - DNA, 20 bp, human
gccggctctgacggtagaag

SEQ ID NO: 369422 - DNA, 20 bp, human
gactctggcgactgagcccg

SEQ ID NO: 369423 - DNA, 20 bp, human
gaatctgcttccggatcaga

SEQ ID NO: 369424 - DNA, 20 bp, human
gctaccgtcagagccggccc

SEQ ID NO: 369425 - DNA, 20 bp, human
gggtcccgggccggctctga

SEQ ID NO: 369426 - DNA, 20 bp, human
gtctcccgacgaccactcag

SEQ ID NO: 369427 - DNA, 20 bp, human
ggcaggcggcgaaacggcag

SEQ ID NO: 369428 - DNA, 20 bp, human
gggccccagctgctagtcca

SEQ ID NO: 369429 - DNA, 20 bp, human
gctgctgcgaggaggaaaat

SEQ ID NO: 369430 - DNA, 20 bp, human
gctcctcgcagcagtcagtt

SEQ ID NO: 369431 - DNA, 20 bp, human
ggagtggtcgtcgggagagg

SEQ ID NO: 369432 - DNA, 20 bp, human
gtgtacagccaggacttggc

SEQ ID NO: 369433 - DNA, 20 bp, human
gcagccgctgagtggtcgtc

SEQ ID NO: 369434 - DNA, 20 bp, human
ggggagggcgccttgggcgg

SEQ ID NO: 369435 - DNA, 20 bp, human
ggacggagggagggcgcctt

SEQ ID NO: 369436 - DNA, 20 bp, human
ggcggagctgcggcttatct

SEQ ID NO: 369437 - DNA, 20 bp, human
ggcctcttggagttcctcgc

SEQ ID NO: 369438 - DNA, 20 bp, human
gacaagagccgggttccgga

SEQ ID NO: 369439 - DNA, 20 bp, human
ggctgctgcgaagactgagt

SEQ ID NO: 369440 - DNA, 20 bp, human
ggtactggagaatggctcgg

SEQ ID NO: 369441 - DNA, 20 bp, human
gagaatggctcggtggcagg

SEQ ID NO: 369442 - DNA, 20 bp, human
gctccgcggcagacacctga

SEQ ID NO: 369443 - DNA, 20 bp, human
gagaccgcgaggaccggtcc

SEQ ID NO: 369444 - DNA, 20 bp, human
gcttatctgggagacgagcg

SEQ ID NO: 369445 - DNA, 20 bp, human
gctgagtggggactgactgg

SEQ ID NO: 369446 - DNA, 20 bp, human
ggacgcggggcccacccctc

SEQ ID NO: 369447 - DNA, 20 bp, human
ggacgcgcggcgcagccaat

SEQ ID NO: 369448 - DNA, 20 bp, human
ggggccgggttggggacctg

SEQ ID NO: 369449 - DNA, 20 bp, human
ggcgtcatgtcgactaagtt

SEQ ID NO: 369450 - DNA, 20 bp, human
ggagcgaccgagagcctgga

SEQ ID NO: 369451 - DNA, 20 bp, human
gacctggggcgagcgcaatg

SEQ ID NO: 369452 - DNA, 20 bp, human
gcagtgagcacggcagacac

SEQ ID NO: 369453 - DNA, 20 bp, human
gactaagttgggaactttgc

SEQ ID NO: 369454 - DNA, 20 bp, human
gtggtcgggggggggccgga

SEQ ID NO: 369455 - DNA, 20 bp, human
gactaggtgcggtagggaag

SEQ ID NO: 369456 - DNA, 20 bp, human
gcctgtgcatggctgtgcgt

SEQ ID NO: 369457 - DNA, 20 bp, human
gagtagatgagattctgtaa

SEQ ID NO: 369458 - DNA, 20 bp, human
ggctgcccagccaatggcgc

SEQ ID NO: 369459 - DNA, 20 bp, human
gactcacgctgcccagccaa

SEQ ID NO: 369460 - DNA, 20 bp, human
ggcacctcggggggacttct

SEQ ID NO: 369461 - DNA, 20 bp, human
gaactggacagcacctcggg

SEQ ID NO: 369462 - DNA, 20 bp, human
gcggggggcgagttgtctga

SEQ ID NO: 369463 - DNA, 20 bp, human
ggcctcaacaacagaagccg

SEQ ID NO: 369464 - DNA, 20 bp, human
gagagcgcgagaatgagggg

SEQ ID NO: 369465 - DNA, 20 bp, human
gagggtttgcagcgtagtac

SEQ ID NO: 369466 - DNA, 20 bp, human
ggggctgtgcacccaggacg

SEQ ID NO: 369467 - DNA, 20 bp, human
gtggggtgattgataagtga

SEQ ID NO: 369468 - DNA, 20 bp, human
gagcccggatatttgatctg

SEQ ID NO: 369469 - DNA, 20 bp, human
gggagggtgtccagctcgga

SEQ ID NO: 369470 - DNA, 20 bp, human
gcccagggtggaagccgcaa

SEQ ID NO: 369471 - DNA, 20 bp, human
ggcagcgcttgtcagagaaa

SEQ ID NO: 369472 - DNA, 20 bp, human
gaccccacagatcaaatatc

SEQ ID NO: 369473 - DNA, 20 bp, human
ggagcactgctcacgcctct

SEQ ID NO: 369474 - DNA, 20 bp, human
gggtggaagccgcaagggct

SEQ ID NO: 369475 - DNA, 20 bp, human
gggtcggtaccatgtccaag

SEQ ID NO: 369476 - DNA, 20 bp, human
gaaagtggcacttttaaagc

SEQ ID NO: 369477 - DNA, 20 bp, human
ggccgccgcgagcgtctcct

SEQ ID NO: 369478 - DNA, 20 bp, human
ggccaaggagacgctcgcgg

SEQ ID NO: 369479 - DNA, 20 bp, human
gcgacctggcgctccagttt

SEQ ID NO: 369480 - DNA, 20 bp, human
gcggcgatgggctgatctgg

SEQ ID NO: 369481 - DNA, 20 bp, human
gttggtgcgcgatttggggg

SEQ ID NO: 369482 - DNA, 20 bp, human
gcaccaagggagcggcgctc

SEQ ID NO: 369483 - DNA, 20 bp, human
gcccttggtgcgcgatttgg

SEQ ID NO: 369484 - DNA, 20 bp, human
gcaggccaaggagacgctcg

SEQ ID NO: 369485 - DNA, 20 bp, human
ggagtcaatataggaaacgc

SEQ ID NO: 369486 - DNA, 20 bp, human
gtctcccgaaggtactccgt

SEQ ID NO: 369487 - DNA, 20 bp, human
ggtggtagttgggagacatt

SEQ ID NO: 369488 - DNA, 20 bp, human
gtcccagctcaagccctata

SEQ ID NO: 369489 - DNA, 20 bp, human
ggggacccacggagtacctt

SEQ ID NO: 369490 - DNA, 20 bp, human
gttgggagacattagggaaa

SEQ ID NO: 369491 - DNA, 20 bp, human
ggctttggtggtgaccggga

SEQ ID NO: 369492 - DNA, 20 bp, human
gtcagctgctaaagcctctt

SEQ ID NO: 369493 - DNA, 20 bp, human
gcccagtcaaactcccctcc

SEQ ID NO: 369494 - DNA, 20 bp, human
gggagtaccttcgggagacg

SEQ ID NO: 369495 - DNA, 20 bp, human
gagctcaagccctataaggg

SEQ ID NO: 369496 - DNA, 20 bp, human
ggggctgaccgtcacgttgg

SEQ ID NO: 369497 - DNA, 20 bp, human
ggcaactgtgagtacccctg

SEQ ID NO: 369498 - DNA, 20 bp, human
ggagaggcgcctcgcggtag

SEQ ID NO: 369499 - DNA, 20 bp, human
gctgcagcggcgggataggg

SEQ ID NO: 369500 - DNA, 20 bp, human
gagcgggtgcgagcgctcgg

SEQ ID NO: 369501 - DNA, 20 bp, human
gggcgcgaacccaggccgga

SEQ ID NO: 369502 - DNA, 20 bp, human
ggctcccggcccctaccgcg

SEQ ID NO: 369503 - DNA, 20 bp, human
ggcggggctgaccgtcacgt

SEQ ID NO: 369504 - DNA, 20 bp, human
ggttctgcagcggcgggata

SEQ ID NO: 369505 - DNA, 20 bp, human
gcgtgcgccactgaccaggg

SEQ ID NO: 369506 - DNA, 20 bp, human
ggacttcggtagtgaggcaa

SEQ ID NO: 369507 - DNA, 20 bp, human
ggcaaggttgaccagagaaa

SEQ ID NO: 369508 - DNA, 20 bp, human
gcgcatgctgcgttggttaa

SEQ ID NO: 369509 - DNA, 20 bp, human
ggcgggctggagtcgacttg

SEQ ID NO: 369510 - DNA, 20 bp, human
gcaggggcgtttaataacgc

SEQ ID NO: 369511 - DNA, 20 bp, human
gggaacctatgccttttctc

SEQ ID NO: 369512 - DNA, 20 bp, human
gcggtagtgaggcaaaggca

SEQ ID NO: 369513 - DNA, 20 bp, human
gtggagtcgacttggggatc

SEQ ID NO: 369514 - DNA, 20 bp, human
ggggacccaacctcgctgaa

SEQ ID NO: 369515 - DNA, 20 bp, human
gcagacgtgtcgagatgaat

SEQ ID NO: 369516 - DNA, 20 bp, human
gcaagagacagctccacctt

SEQ ID NO: 369517 - DNA, 20 bp, human
ggaccatttgcagaaagagg

SEQ ID NO: 369518 - DNA, 20 bp, human
gctcttgtgttatatgacac

SEQ ID NO: 369519 - DNA, 20 bp, human
ggcagattaaaacgctctga

SEQ ID NO: 369520 - DNA, 20 bp, human
gaattcacttgcactatatt

SEQ ID NO: 369521 - DNA, 20 bp, human
gtagtgcaagtgaattttga

SEQ ID NO: 369522 - DNA, 20 bp, human
gacttagagtccctaacata

SEQ ID NO: 369523 - DNA, 20 bp, human
gttattgaatattagctcta

SEQ ID NO: 369524 - DNA, 20 bp, human
gaaaacgctctgatggggaa

SEQ ID NO: 369525 - DNA, 20 bp, human
gctgatggggaagggcttaa

SEQ ID NO: 369526 - DNA, 20 bp, human
gtgagcggagcacggggctc

SEQ ID NO: 369527 - DNA, 20 bp, human
gcacggggctcggggtgcgg

SEQ ID NO: 369528 - DNA, 20 bp, human
ggcggcgccccagacccgag

SEQ ID NO: 369529 - DNA, 20 bp, human
gcgcgctacgtccctcagac

SEQ ID NO: 369530 - DNA, 20 bp, human
gtcagactggctgcccccga

SEQ ID NO: 369531 - DNA, 20 bp, human
gtcaccgcgcgctcgcgtgg

SEQ ID NO: 369532 - DNA, 20 bp, human
gctccaggccgaggctgtgt

SEQ ID NO: 369533 - DNA, 20 bp, human
ggggccccaggtacagtgag

SEQ ID NO: 369534 - DNA, 20 bp, human
gtccgctcacgcgaaccctc

SEQ ID NO: 369535 - DNA, 20 bp, human
gcgcgagcgcgcggtgagca

SEQ ID NO: 369536 - DNA, 20 bp, human
gcggaagccgtgttggtaga

SEQ ID NO: 369537 - DNA, 20 bp, human
gcaggcgccatcttagttaa

SEQ ID NO: 369538 - DNA, 20 bp, human
ggggaacgcgcacccttcaa

SEQ ID NO: 369539 - DNA, 20 bp, human
ggggtaggagggcccttgaa

SEQ ID NO: 369540 - DNA, 20 bp, human
ggctggaagcttcaaacctc

SEQ ID NO: 369541 - DNA, 20 bp, human
gggtcgttaaggttgtcccg

SEQ ID NO: 369542 - DNA, 20 bp, human
gggactacggcgcgggagag

SEQ ID NO: 369543 - DNA, 20 bp, human
gtttctgccctctaccaaca

SEQ ID NO: 369544 - DNA, 20 bp, human
gacaaccttaacgaccattt

SEQ ID NO: 369545 - DNA, 20 bp, human
gttaacgaccattttggtta

SEQ ID NO: 369546 - DNA, 20 bp, human
gcaccccagggtagcagcgc

SEQ ID NO: 369547 - DNA, 20 bp, human
ggacctgcgctgctaccctg

SEQ ID NO: 369548 - DNA, 20 bp, human
gaaaaatagctctgcgggcg

SEQ ID NO: 369549 - DNA, 20 bp, human
gccagcctagccaccagacg

SEQ ID NO: 369550 - DNA, 20 bp, human
gtgggcggggcctcgatggg

SEQ ID NO: 369551 - DNA, 20 bp, human
ggcgtgggcggggcctcgat

SEQ ID NO: 369552 - DNA, 20 bp, human
gagcgcgcatcgcgcacccc

SEQ ID NO: 369553 - DNA, 20 bp, human
gggatgccgcccaccccgtc

SEQ ID NO: 369554 - DNA, 20 bp, human
gcggctaaaaatagctctgc

SEQ ID NO: 369555 - DNA, 20 bp, human
gcggcccgaagcacccggcc

SEQ ID NO: 369556 - DNA, 20 bp, human
gcgcccggcgctaagaggcg

SEQ ID NO: 369557 - DNA, 20 bp, human
gagcgccgggcgcatcgcgc

SEQ ID NO: 369558 - DNA, 20 bp, human
gaaaccccgcctcttagcgc

SEQ ID NO: 369559 - DNA, 20 bp, human
ggccgccgacggcagctgga

SEQ ID NO: 369560 - DNA, 20 bp, human
ggtagcgagccttgacctct

SEQ ID NO: 369561 - DNA, 20 bp, human
gcgatgcgcccggcgctaag

SEQ ID NO: 369562 - DNA, 20 bp, human
ggcaaggctggggcaaaacc

SEQ ID NO: 369563 - DNA, 20 bp, human
gcggcccctccagctgccgt

SEQ ID NO: 369564 - DNA, 20 bp, human
gctgacccaactctgcccag

SEQ ID NO: 369565 - DNA, 20 bp, human
gctggggcaaaacccgggcc

SEQ ID NO: 369566 - DNA, 20 bp, human
gtcaaaggaacaccctccga

SEQ ID NO: 369567 - DNA, 20 bp, human
gaacaccctccgaaggttcg

SEQ ID NO: 369568 - DNA, 20 bp, human
gttcgaggctatttgtgttc

SEQ ID NO: 369569 - DNA, 20 bp, human
gcactgatgaaacatctcaa

SEQ ID NO: 369570 - DNA, 20 bp, human
gacacctcacaggctgacta

SEQ ID NO: 369571 - DNA, 20 bp, human
gatagcctcgaaccttcgga

SEQ ID NO: 369572 - DNA, 20 bp, human
gcagtgattgccagcttcca

SEQ ID NO: 369573 - DNA, 20 bp, human
gacaaatagcctcgaacctt

SEQ ID NO: 369574 - DNA, 20 bp, human
gtaaagtagtccgtggaagc

SEQ ID NO: 369575 - DNA, 20 bp, human
ggtggcaaattggcagccaa

SEQ ID NO: 369576 - DNA, 20 bp, human
ggcaactatcagaaaagaaa

SEQ ID NO: 369577 - DNA, 20 bp, human
gaaagggaagagattggcct

SEQ ID NO: 369578 - DNA, 20 bp, human
gagccttataggtggagaga

SEQ ID NO: 369579 - DNA, 20 bp, human
gcccaggccattagccttat

SEQ ID NO: 369580 - DNA, 20 bp, human
gggaagttggttgattaaag

SEQ ID NO: 369581 - DNA, 20 bp, human
gaaacaatctccttggtgtc

SEQ ID NO: 369582 - DNA, 20 bp, human
gtgtcaggatttctggtctc

SEQ ID NO: 369583 - DNA, 20 bp, human
gtatgccaggtaaggctatg

SEQ ID NO: 369584 - DNA, 20 bp, human
gtccttggtgtcaggatttc

SEQ ID NO: 369585 - DNA, 20 bp, human
gggagaggccgaaagaattc

SEQ ID NO: 369586 - DNA, 20 bp, human
gggcggtgcgctcccttgtg

SEQ ID NO: 369587 - DNA, 20 bp, human
gagcggcgcgctcggtcgag

SEQ ID NO: 369588 - DNA, 20 bp, human
ggccgccagcacccggatga

SEQ ID NO: 369589 - DNA, 20 bp, human
ggcggccgtcatccgggtgc

SEQ ID NO: 369590 - DNA, 20 bp, human
ggctgctgcaggttgcgcta

SEQ ID NO: 369591 - DNA, 20 bp, human
ggacctcccagtccacacaa

SEQ ID NO: 369592 - DNA, 20 bp, human
ggccgtcatccgggtgctgg

SEQ ID NO: 369593 - DNA, 20 bp, human
ggctgcaggttgcgctaggg

SEQ ID NO: 369594 - DNA, 20 bp, human
ggcacgcgcggccgtcatcc

SEQ ID NO: 369595 - DNA, 20 bp, human
gtgcgcgttggcgcagggac

SEQ ID NO: 369596 - DNA, 20 bp, human
gctccagtgctcctgcgccg

SEQ ID NO: 369597 - DNA, 20 bp, human
gttgtggggagtttcaagtt

SEQ ID NO: 369598 - DNA, 20 bp, human
gctcgcgtttcccacggcgc

SEQ ID NO: 369599 - DNA, 20 bp, human
ggcgtatcgcgctatttacc

SEQ ID NO: 369600 - DNA, 20 bp, human
gcatccggaagttaccgcag

SEQ ID NO: 369601 - DNA, 20 bp, human
gttgaaactccccacaagcc

SEQ ID NO: 369602 - DNA, 20 bp, human
gcggccactgcggtaacttc

SEQ ID NO: 369603 - DNA, 20 bp, human
gcacatgcgcactaatttcc

SEQ ID NO: 369604 - DNA, 20 bp, human
gagagttctcgcgtttccca

SEQ ID NO: 369605 - DNA, 20 bp, human
gaatttcctggcggggccgg

SEQ ID NO: 369606 - DNA, 20 bp, human
gggaacatggcagacgggca

SEQ ID NO: 369607 - DNA, 20 bp, human
ggtcccaggaccactggaca

SEQ ID NO: 369608 - DNA, 20 bp, human
gcccagaagccggtgcccaa

SEQ ID NO: 369609 - DNA, 20 bp, human
gacagtgagttccccagtgt

SEQ ID NO: 369610 - DNA, 20 bp, human
gtctgccaccgcccagaagc

SEQ ID NO: 369611 - DNA, 20 bp, human
gagaaccggccgtgtgagtc

SEQ ID NO: 369612 - DNA, 20 bp, human
gagccatgtccagtggtcct

SEQ ID NO: 369613 - DNA, 20 bp, human
gtggcctatgtgaaccccag

SEQ ID NO: 369614 - DNA, 20 bp, human
gacatgggggctcatcagag

SEQ ID NO: 369615 - DNA, 20 bp, human
ggctagagcaacaagggcag

SEQ ID NO: 369616 - DNA, 20 bp, human
gggaaagcccggctgcttga

SEQ ID NO: 369617 - DNA, 20 bp, human
gagcgcgtaccattcagcat

SEQ ID NO: 369618 - DNA, 20 bp, human
gaagcccggctgcttgaggg

SEQ ID NO: 369619 - DNA, 20 bp, human
gcctgaggaaggtgggactc

SEQ ID NO: 369620 - DNA, 20 bp, human
gttgacgtacgccttagtaa

SEQ ID NO: 369621 - DNA, 20 bp, human
gttacaggagccacttccgc

SEQ ID NO: 369622 - DNA, 20 bp, human
ggctctgattggctgacaca

SEQ ID NO: 369623 - DNA, 20 bp, human
gcctggaccgctggaaagcc

SEQ ID NO: 369624 - DNA, 20 bp, human
gacgtacgccttagtaaggg

SEQ ID NO: 369625 - DNA, 20 bp, human
gaagcagccgggctttccag

SEQ ID NO: 369626 - DNA, 20 bp, human
gggaaagcccggctgcttga

SEQ ID NO: 369627 - DNA, 20 bp, human
gttgacgtacgccttagtaa

SEQ ID NO: 369628 - DNA, 20 bp, human
gaagcccggctgcttgaggg

SEQ ID NO: 369629 - DNA, 20 bp, human
gttacaggagccacttccgc

SEQ ID NO: 369630 - DNA, 20 bp, human
ggtaaggcagcaaggtagcg

SEQ ID NO: 369631 - DNA, 20 bp, human
gggcggcagtccagctggaa

SEQ ID NO: 369632 - DNA, 20 bp, human
ggtgagttttccagcggaag

SEQ ID NO: 369633 - DNA, 20 bp, human
gcgtggccggcgcccgagct

SEQ ID NO: 369634 - DNA, 20 bp, human
gacgtacgccttagtaaggg

SEQ ID NO: 369635 - DNA, 20 bp, human
gcaaggggaaaagagctcgg

SEQ ID NO: 369636 - DNA, 20 bp, human
gcggcgccgcagaggaagac

SEQ ID NO: 369637 - DNA, 20 bp, human
gccgcggcggccagcgcttc

SEQ ID NO: 369638 - DNA, 20 bp, human
gcggaagcggcgcttgcttc

SEQ ID NO: 369639 - DNA, 20 bp, human
gggcggccagcgcttccggt

SEQ ID NO: 369640 - DNA, 20 bp, human
gtcctgccgaccggaagcgc

SEQ ID NO: 369641 - DNA, 20 bp, human
gcgcttccggtcttcctctg

SEQ ID NO: 369642 - DNA, 20 bp, human
gcgccccgcctcctgccgac

SEQ ID NO: 369643 - DNA, 20 bp, human
gaagcggcgcttgcttcagg

SEQ ID NO: 369644 - DNA, 20 bp, human
ggccagcgcttccggtcggc

SEQ ID NO: 369645 - DNA, 20 bp, human
gcgcaggcaatgctccgcgg

SEQ ID NO: 369646 - DNA, 20 bp, human
gtggcagcgaaacacttcga

SEQ ID NO: 369647 - DNA, 20 bp, human
gggacgcaggctatttttaa

SEQ ID NO: 369648 - DNA, 20 bp, human
gcaaacgcgcgcggagaccc

SEQ ID NO: 369649 - DNA, 20 bp, human
gatctgggcagcttcgctgc

SEQ ID NO: 369650 - DNA, 20 bp, human
ggaaacacttcgatggcccg

SEQ ID NO: 369651 - DNA, 20 bp, human
gtcgctgccatcttaaatcc

SEQ ID NO: 369652 - DNA, 20 bp, human
ggcctctgttcagaatatcg

SEQ ID NO: 369653 - DNA, 20 bp, human
gcccaaacacaaaatgatct

SEQ ID NO: 369654 - DNA, 20 bp, human
gttgctaatgagagtcattg

SEQ ID NO: 369655 - DNA, 20 bp, human
gagtgggcccaaaacaaaaa

SEQ ID NO: 369656 - DNA, 20 bp, human
gtggggctgccggtagaagg

SEQ ID NO: 369657 - DNA, 20 bp, human
gccgggccgggaatttggag

SEQ ID NO: 369658 - DNA, 20 bp, human
ggctcccccgcgccgtcctc

SEQ ID NO: 369659 - DNA, 20 bp, human
ggcggcggcgcgcgggtgag

SEQ ID NO: 369660 - DNA, 20 bp, human
gggaatttggagaggatccc

SEQ ID NO: 369661 - DNA, 20 bp, human
gggccgcgctgcgctcacgc

SEQ ID NO: 369662 - DNA, 20 bp, human
gccggggccggaggacggcg

SEQ ID NO: 369663 - DNA, 20 bp, human
gcggagccacccccttctac

SEQ ID NO: 369664 - DNA, 20 bp, human
ggccggccgggccgggaatt

SEQ ID NO: 369665 - DNA, 20 bp, human
gcgctccaccgggactaaaa

SEQ ID NO: 369666 - DNA, 20 bp, human
gtgcctcgcgccctaacggg

SEQ ID NO: 369667 - DNA, 20 bp, human
gggcgggtatggaagacgga

SEQ ID NO: 369668 - DNA, 20 bp, human
gaagccgcgcggggcgggta

SEQ ID NO: 369669 - DNA, 20 bp, human
gaggccgagcaccgcgggaa

SEQ ID NO: 369670 - DNA, 20 bp, human
gggcgtgcctcgcgccctaa

SEQ ID NO: 369671 - DNA, 20 bp, human
ggccccgcgcggctttcggc

SEQ ID NO: 369672 - DNA, 20 bp, human
gcgggggcctcgaatcggaa

SEQ ID NO: 369673 - DNA, 20 bp, human
gcggggcgggccgtaggcaa

SEQ ID NO: 369674 - DNA, 20 bp, human
gggctggaggcgccaatcag

SEQ ID NO: 369675 - DNA, 20 bp, human
ggccgtaggcaaagggaggt

SEQ ID NO: 369676 - DNA, 20 bp, human
gcgggaggaggagggtggcg

SEQ ID NO: 369677 - DNA, 20 bp, human
gccgcccgggtcgcccacgt

SEQ ID NO: 369678 - DNA, 20 bp, human
gacccgggcggcggcagtcc

SEQ ID NO: 369679 - DNA, 20 bp, human
gagaggggcctcgggcggga

SEQ ID NO: 369680 - DNA, 20 bp, human
ggcgcccagcacgcccacgt

SEQ ID NO: 369681 - DNA, 20 bp, human
gcggggcggtgaggccgcag

SEQ ID NO: 369682 - DNA, 20 bp, human
gcaaccgagccgcccgagtg

SEQ ID NO: 369683 - DNA, 20 bp, human
ggggcgccctccccggagca

SEQ ID NO: 369684 - DNA, 20 bp, human
gcgagtgtggactccgagag

SEQ ID NO: 369685 - DNA, 20 bp, human
gtcgcccacgtgggcgtgct

SEQ ID NO: 369686 - DNA, 20 bp, human
gccgctccgagtgacgggga

SEQ ID NO: 369687 - DNA, 20 bp, human
gcgcgcgcggggaccacatc

SEQ ID NO: 369688 - DNA, 20 bp, human
gcccgcgcgcgcatgctcag

SEQ ID NO: 369689 - DNA, 20 bp, human
gcctcccgctccgagtgacg

SEQ ID NO: 369690 - DNA, 20 bp, human
gtcagcgcgggcggaggcga

SEQ ID NO: 369691 - DNA, 20 bp, human
gggagagctcggcgtagagt

SEQ ID NO: 369692 - DNA, 20 bp, human
gtccgcccgcgctgaggccc

SEQ ID NO: 369693 - DNA, 20 bp, human
ggctctgcgcaggcgcctac

SEQ ID NO: 369694 - DNA, 20 bp, human
gcggcgggcggctctgaatc

SEQ ID NO: 369695 - DNA, 20 bp, human
gacagggcagcgccagccgg

SEQ ID NO: 369696 - DNA, 20 bp, human
ggaggggtgtcttgcccggg

SEQ ID NO: 369697 - DNA, 20 bp, human
gagaggcggagtgaccgctg

SEQ ID NO: 369698 - DNA, 20 bp, human
gaccgctgcgggaccgaggg

SEQ ID NO: 369699 - DNA, 20 bp, human
ggtgaccgctgcgggaccga

SEQ ID NO: 369700 - DNA, 20 bp, human
gagggaggggtgtcttgccc

SEQ ID NO: 369701 - DNA, 20 bp, human
gccaggacccggatgaggga

SEQ ID NO: 369702 - DNA, 20 bp, human
gcgcccgctcgcccaggacc

SEQ ID NO: 369703 - DNA, 20 bp, human
gtcgcccaggacccggatga

SEQ ID NO: 369704 - DNA, 20 bp, human
gcccgggaggacgcccgctg

SEQ ID NO: 369705 - DNA, 20 bp, human
ggcgccgtgcgcgtgtcccg

SEQ ID NO: 369706 - DNA, 20 bp, human
gaggagcgccgcggagtcat

SEQ ID NO: 369707 - DNA, 20 bp, human
gggagcctccggccctgcaa

SEQ ID NO: 369708 - DNA, 20 bp, human
gtagactggcatatgatggg

SEQ ID NO: 369709 - DNA, 20 bp, human
gcccggggcgggccgagctc

SEQ ID NO: 369710 - DNA, 20 bp, human
gtccaaggggccggctcccg

SEQ ID NO: 369711 - DNA, 20 bp, human
gggccctcagtgtgcgtttg

SEQ ID NO: 369712 - DNA, 20 bp, human
gcgtcccattgcagggccgg

SEQ ID NO: 369713 - DNA, 20 bp, human
gtgtctagactggcatatga

SEQ ID NO: 369714 - DNA, 20 bp, human
ggcacactgagggcccccgg

SEQ ID NO: 369715 - DNA, 20 bp, human
ggccgccaaagtgtctagac

SEQ ID NO: 369716 - DNA, 20 bp, human
gggtccaggcccgccaagga

SEQ ID NO: 369717 - DNA, 20 bp, human
gtgggagaggcgtgctataa

SEQ ID NO: 369718 - DNA, 20 bp, human
ggaccccttcggggcaacac

SEQ ID NO: 369719 - DNA, 20 bp, human
ggcactgctcctgcagtctg

SEQ ID NO: 369720 - DNA, 20 bp, human
gccctcctgggaagagactg

SEQ ID NO: 369721 - DNA, 20 bp, human
gttgccccgaaggggtctac

SEQ ID NO: 369722 - DNA, 20 bp, human
gcgcacccggaaagacgttg

SEQ ID NO: 369723 - DNA, 20 bp, human
gtatgcacactccccctgga

SEQ ID NO: 369724 - DNA, 20 bp, human
gagtgcccgtagaccccttc

SEQ ID NO: 369725 - DNA, 20 bp, human
gacctggaagggaaccccca

SEQ ID NO: 369726 - DNA, 20 bp, human
gtccgggagccgcagaggag

SEQ ID NO: 369727 - DNA, 20 bp, human
gccgacctggaaagcggcca

SEQ ID NO: 369728 - DNA, 20 bp, human
gagtgcgccgacctggaaag

SEQ ID NO: 369729 - DNA, 20 bp, human
ggggaccgagagggcagcgc

SEQ ID NO: 369730 - DNA, 20 bp, human
gcaggtcggcgcactaatac

SEQ ID NO: 369731 - DNA, 20 bp, human
ggggagcgagaccggcccca

SEQ ID NO: 369732 - DNA, 20 bp, human
gcgagcctggggtcgcgcag

SEQ ID NO: 369733 - DNA, 20 bp, human
gcaagtgagagtcactatca

SEQ ID NO: 369734 - DNA, 20 bp, human
gggccccacggccacgtgcg

SEQ ID NO: 369735 - DNA, 20 bp, human
gcgcactaatacgggcgatg

SEQ ID NO: 369736 - DNA, 20 bp, human
ggccgaacgaggaccccgag

SEQ ID NO: 369737 - DNA, 20 bp, human
gcaggaaccgaaacccggag

SEQ ID NO: 369738 - DNA, 20 bp, human
gtaaagtgacaatcggagaa

SEQ ID NO: 369739 - DNA, 20 bp, human
gctcgcggcgagaaaggaag

SEQ ID NO: 369740 - DNA, 20 bp, human
ggcgagaaaggaagcggctc

SEQ ID NO: 369741 - DNA, 20 bp, human
ggggaccagattggagccgc

SEQ ID NO: 369742 - DNA, 20 bp, human
gttagcccgcggctccaatc

SEQ ID NO: 369743 - DNA, 20 bp, human
ggaaaggaagcggctccgga

SEQ ID NO: 369744 - DNA, 20 bp, human
gccgagcctcgcggcgagaa

SEQ ID NO: 369745 - DNA, 20 bp, human
gaggctgcctttcctcccgg

SEQ ID NO: 369746 - DNA, 20 bp, human
gtcgcgccgaggcttccggg

SEQ ID NO: 369747 - DNA, 20 bp, human
gcgcatgcgccgaacctacg

SEQ ID NO: 369748 - DNA, 20 bp, human
gcggcacgcaccaccctagc

SEQ ID NO: 369749 - DNA, 20 bp, human
gcaccaccctagccggcgag

SEQ ID NO: 369750 - DNA, 20 bp, human
gagcccgggccccgtaggtt

SEQ ID NO: 369751 - DNA, 20 bp, human
gcaaatgggcaagtcaaagt

SEQ ID NO: 369752 - DNA, 20 bp, human
gcccctcccctcgccggcta

SEQ ID NO: 369753 - DNA, 20 bp, human
gtgggtcgcgccgaggcttc

SEQ ID NO: 369754 - DNA, 20 bp, human
ggcccaaggtgattcccgaa

SEQ ID NO: 369755 - DNA, 20 bp, human
gggcaggccggtcaaggagg

SEQ ID NO: 369756 - DNA, 20 bp, human
gcctctcgggaaccaatccg

SEQ ID NO: 369757 - DNA, 20 bp, human
gcccccgcttctccacggat

SEQ ID NO: 369758 - DNA, 20 bp, human
ggaaccaatccgtggagaag

SEQ ID NO: 369759 - DNA, 20 bp, human
gcacgccccctgcgtgtcct

SEQ ID NO: 369760 - DNA, 20 bp, human
gaagagctgccggaagtagg

SEQ ID NO: 369761 - DNA, 20 bp, human
gtcccgagaggcggagctga

SEQ ID NO: 369762 - DNA, 20 bp, human
gaggaagagctgccggaagt

SEQ ID NO: 369763 - DNA, 20 bp, human
ggaagagaatgaatggagcc

SEQ ID NO: 369764 - DNA, 20 bp, human
ggaagcggggggcgggcctt

SEQ ID NO: 369765 - DNA, 20 bp, human
gcggggcgcatgcgcgagct

SEQ ID NO: 369766 - DNA, 20 bp, human
gcaactgaggataaacagtg

SEQ ID NO: 369767 - DNA, 20 bp, human
ggcaatgagggttcacagaa

SEQ ID NO: 369768 - DNA, 20 bp, human
ggggccctctggtcccagtc

SEQ ID NO: 369769 - DNA, 20 bp, human
gccagcaaatcatgcaatga

SEQ ID NO: 369770 - DNA, 20 bp, human
gacggactgtgtgagctcaa

SEQ ID NO: 369771 - DNA, 20 bp, human
gaatgcaatcatcatgatag

SEQ ID NO: 369772 - DNA, 20 bp, human
gggcccgggggagagtgaca

SEQ ID NO: 369773 - DNA, 20 bp, human
gagtgacttggagctcaggg

SEQ ID NO: 369774 - DNA, 20 bp, human
gggaagtgacttggagctca

SEQ ID NO: 369775 - DNA, 20 bp, human
gtagccagactgggaccaga

SEQ ID NO: 369776 - DNA, 20 bp, human
gggcgggaacccacaactcg

SEQ ID NO: 369777 - DNA, 20 bp, human
gggggggaggccatgacgta

SEQ ID NO: 369778 - DNA, 20 bp, human
ggccggcccgggctctgggt

SEQ ID NO: 369779 - DNA, 20 bp, human
gaaggggggagagtgacggg

SEQ ID NO: 369780 - DNA, 20 bp, human
gtctcgcgatcgttgagggg

SEQ ID NO: 369781 - DNA, 20 bp, human
ggagctcaggctcactgttg

SEQ ID NO: 369782 - DNA, 20 bp, human
gtgagtgtggggcgcggaca

SEQ ID NO: 369783 - DNA, 20 bp, human
gtgagcgaaggggttggaag

SEQ ID NO: 369784 - DNA, 20 bp, human
gggagtctcgcgatcgttga

SEQ ID NO: 369785 - DNA, 20 bp, human
gcaactgttgcctgagtgtg

SEQ ID NO: 369786 - DNA, 20 bp, human
gaacccgcgcccggacgggc

SEQ ID NO: 369787 - DNA, 20 bp, human
gggagcccgagtttaggaag

SEQ ID NO: 369788 - DNA, 20 bp, human
gcgtcttccggcgcccgcgg

SEQ ID NO: 369789 - DNA, 20 bp, human
gccaactgcggcgcgtcttc

SEQ ID NO: 369790 - DNA, 20 bp, human
gcgccaacccgcgcccggac

SEQ ID NO: 369791 - DNA, 20 bp, human
gtcgcctcctccgcgggcgc

SEQ ID NO: 369792 - DNA, 20 bp, human
gcccgagtttaggaagagga

SEQ ID NO: 369793 - DNA, 20 bp, human
gctccctgcccgtccgggcg

SEQ ID NO: 369794 - DNA, 20 bp, human
gccgctcctccctgcccgtc

SEQ ID NO: 369795 - DNA, 20 bp, human
ggcgccgcggggctcctcca

SEQ ID NO: 369796 - DNA, 20 bp, human
gcaggcggcggaagctggag

SEQ ID NO: 369797 - DNA, 20 bp, human
ggaagctggagaggccgccg

SEQ ID NO: 369798 - DNA, 20 bp, human
gggccgccgcggtgctgagg

SEQ ID NO: 369799 - DNA, 20 bp, human
gccgatgcaccgccccactc

SEQ ID NO: 369800 - DNA, 20 bp, human
gcccgtccctgggcggacgg

SEQ ID NO: 369801 - DNA, 20 bp, human
gctccccctcagcaccgcgg

SEQ ID NO: 369802 - DNA, 20 bp, human
gcggacgcgcgtgcttcctc

SEQ ID NO: 369803 - DNA, 20 bp, human
ggtgcgcgcccgtccctggg

SEQ ID NO: 369804 - DNA, 20 bp, human
ggggccatcgcggcccgagt

SEQ ID NO: 369805 - DNA, 20 bp, human
gagagcggacgccactgcgg

SEQ ID NO: 369806 - DNA, 20 bp, human
gcggctagagatctggaaga

SEQ ID NO: 369807 - DNA, 20 bp, human
gagggagcgctcggaggtgt

SEQ ID NO: 369808 - DNA, 20 bp, human
gtagagaagggcggagggtt

SEQ ID NO: 369809 - DNA, 20 bp, human
gcactcgcgagattccttat

SEQ ID NO: 369810 - DNA, 20 bp, human
gcgcgagtgttgaaagtcgg

SEQ ID NO: 369811 - DNA, 20 bp, human
gctggaagagggcgggccaa

SEQ ID NO: 369812 - DNA, 20 bp, human
gcccgagccggctagagatc

SEQ ID NO: 369813 - DNA, 20 bp, human
gacctccagggagcgctcgg

SEQ ID NO: 369814 - DNA, 20 bp, human
gggccggctgatttagagaa

SEQ ID NO: 369815 - DNA, 20 bp, human
gctcgggagagaagagtggg

SEQ ID NO: 369816 - DNA, 20 bp, human
gcgtctccgccggcttgtaa

SEQ ID NO: 369817 - DNA, 20 bp, human
gcaatctggcccttacaagc

SEQ ID NO: 369818 - DNA, 20 bp, human
ggcgcgcgcctcgacattgt

SEQ ID NO: 369819 - DNA, 20 bp, human
gaattcgtacccgtctccgc

SEQ ID NO: 369820 - DNA, 20 bp, human
gaacacacaggaaggttcag

SEQ ID NO: 369821 - DNA, 20 bp, human
gcgctcttaaggtttctccg

SEQ ID NO: 369822 - DNA, 20 bp, human
ggcgcgagccgacaatgtcg

SEQ ID NO: 369823 - DNA, 20 bp, human
ggtcggctcgcgcgttgttt

SEQ ID NO: 369824 - DNA, 20 bp, human
ggggaccttccaaaacacca

SEQ ID NO: 369825 - DNA, 20 bp, human
gacaaaggtacagaacaatc

SEQ ID NO: 369826 - DNA, 20 bp, human
gatgagacgagaacgcgagc

SEQ ID NO: 369827 - DNA, 20 bp, human
ggagctgcaacgtcatgggc

SEQ ID NO: 369828 - DNA, 20 bp, human
gacgggagctgcaacgtcat

SEQ ID NO: 369829 - DNA, 20 bp, human
gccagcctggaggaggaagt

SEQ ID NO: 369830 - DNA, 20 bp, human
gaggcctggccgctacaata

SEQ ID NO: 369831 - DNA, 20 bp, human
ggggaaatgtagttcagcgg

SEQ ID NO: 369832 - DNA, 20 bp, human
gccgggagcctggcgagaaa

SEQ ID NO: 369833 - DNA, 20 bp, human
gtgtagcggccaggcctgaa

SEQ ID NO: 369834 - DNA, 20 bp, human
ggtcatgggcggggcgaaag

SEQ ID NO: 369835 - DNA, 20 bp, human
ggcctccctgggtgagaaag

SEQ ID NO: 369836 - DNA, 20 bp, human
gcaggctgcctcccaagtcg

SEQ ID NO: 369837 - DNA, 20 bp, human
gaggaggaggacctagtatc

SEQ ID NO: 369838 - DNA, 20 bp, human
ggagaaagagaaattagtcg

SEQ ID NO: 369839 - DNA, 20 bp, human
ggcctccgcggaccccttaa

SEQ ID NO: 369840 - DNA, 20 bp, human
gaaggccgggcgcgcctccg

SEQ ID NO: 369841 - DNA, 20 bp, human
ggaagctaaggcacgagatt

SEQ ID NO: 369842 - DNA, 20 bp, human
gcggacaaaaatagccaatg

SEQ ID NO: 369843 - DNA, 20 bp, human
ggtcctctacaccacgactt

SEQ ID NO: 369844 - DNA, 20 bp, human
ggccgctcaaacaaaaggcc

SEQ ID NO: 369845 - DNA, 20 bp, human
gtggtgtagaggacttctca

SEQ ID NO: 369846 - DNA, 20 bp, human
gcaggccagatgtgcactgc

SEQ ID NO: 369847 - DNA, 20 bp, human
gcctgggcagatgcctgagt

SEQ ID NO: 369848 - DNA, 20 bp, human
ggccgaaagcgtggcgcctg

SEQ ID NO: 369849 - DNA, 20 bp, human
gcccccaggcgccacgcttt

SEQ ID NO: 369850 - DNA, 20 bp, human
ggcccaggcctttcggaact

SEQ ID NO: 369851 - DNA, 20 bp, human
gcatcaagcaacagacaaac

SEQ ID NO: 369852 - DNA, 20 bp, human
gaacagaaccaagttccgaa

SEQ ID NO: 369853 - DNA, 20 bp, human
gaccaagttccgaaaggcct

SEQ ID NO: 369854 - DNA, 20 bp, human
gagacaaacaggccttgagg

SEQ ID NO: 369855 - DNA, 20 bp, human
gataagggtcgcagcaccac

SEQ ID NO: 369856 - DNA, 20 bp, human
gcggaggatggcggaagagg

SEQ ID NO: 369857 - DNA, 20 bp, human
gctacggaggatggcggaag

SEQ ID NO: 369858 - DNA, 20 bp, human
gcgcatgcgtagcactcgtg

SEQ ID NO: 369859 - DNA, 20 bp, human
ggggcgtccgcgccggaaga

SEQ ID NO: 369860 - DNA, 20 bp, human
ggctacgcatgcgcgtgcgc

SEQ ID NO: 369861 - DNA, 20 bp, human
ggcccggcgcagtcccagtc

SEQ ID NO: 369862 - DNA, 20 bp, human
ggtccgcgccggaagagggt

SEQ ID NO: 369863 - DNA, 20 bp, human
gtgcagcctacggaggatgg

SEQ ID NO: 369864 - DNA, 20 bp, human
gcaaaaaccggcgctcacta

SEQ ID NO: 369865 - DNA, 20 bp, human
gcgcaggacgtgctattcca

SEQ ID NO: 369866 - DNA, 20 bp, human
gcgcgcccggcctgccggca

SEQ ID NO: 369867 - DNA, 20 bp, human
gaggcgcgggccgaccctgg

SEQ ID NO: 369868 - DNA, 20 bp, human
ggaagcgtccttctccccgg

SEQ ID NO: 369869 - DNA, 20 bp, human
gaagagcgatctcaggagaa

SEQ ID NO: 369870 - DNA, 20 bp, human
gccggggaggccgccagggt

SEQ ID NO: 369871 - DNA, 20 bp, human
gaggtgacactcccgagctg

SEQ ID NO: 369872 - DNA, 20 bp, human
gctggcggcctccccggcag

SEQ ID NO: 369873 - DNA, 20 bp, human
gccgagctgaggcaaaaaga

SEQ ID NO: 369874 - DNA, 20 bp, human
gagaaggacgcttcctggag

SEQ ID NO: 369875 - DNA, 20 bp, human
gagggaaagggcttcgcgtc

SEQ ID NO: 369876 - DNA, 20 bp, human
ggcgcccccaggccgacggg

SEQ ID NO: 369877 - DNA, 20 bp, human
gcatcagagggctcgagttg

SEQ ID NO: 369878 - DNA, 20 bp, human
gctcgagttggggttgagac

SEQ ID NO: 369879 - DNA, 20 bp, human
gggaacaggcgggcgctcgg

SEQ ID NO: 369880 - DNA, 20 bp, human
ggaagagctctgcaatagag

SEQ ID NO: 369881 - DNA, 20 bp, human
gccgccttcacggtccggga

SEQ ID NO: 369882 - DNA, 20 bp, human
gaatagagaggccgcgtgag

SEQ ID NO: 369883 - DNA, 20 bp, human
ggctcagggcagcgagacta

SEQ ID NO: 369884 - DNA, 20 bp, human
ggcggggcgactagcggaaa

SEQ ID NO: 369885 - DNA, 20 bp, human
gagtcccgggctatgagcaa

SEQ ID NO: 369886 - DNA, 20 bp, human
gcctctgggtaactcgactc

SEQ ID NO: 369887 - DNA, 20 bp, human
ggtcccgaaccgggtctgtg

SEQ ID NO: 369888 - DNA, 20 bp, human
gagcggaatctgtcccgaac

SEQ ID NO: 369889 - DNA, 20 bp, human
gcgggagagagtagtagcaa

SEQ ID NO: 369890 - DNA, 20 bp, human
ggatccggaatctcccgggc

SEQ ID NO: 369891 - DNA, 20 bp, human
gtggccgcggaattcggtga

SEQ ID NO: 369892 - DNA, 20 bp, human
gcgggcccgccttccgtccc

SEQ ID NO: 369893 - DNA, 20 bp, human
gttccgtccccggcctccgg

SEQ ID NO: 369894 - DNA, 20 bp, human
ggaagcgccgagtgaggcgc

SEQ ID NO: 369895 - DNA, 20 bp, human
gcgggcggccaaacctccgg

SEQ ID NO: 369896 - DNA, 20 bp, human
ggagctggcgagcacaccga

SEQ ID NO: 369897 - DNA, 20 bp, human
gccagctcggaggccctcgg

SEQ ID NO: 369898 - DNA, 20 bp, human
gcacacacgcgcatgcacgt

SEQ ID NO: 369899 - DNA, 20 bp, human
gggagcgtctgcaaagagcg

SEQ ID NO: 369900 - DNA, 20 bp, human
gggtgtgctcgccagctcgg

SEQ ID NO: 369901 - DNA, 20 bp, human
gcgtcgccccatccagccgt

SEQ ID NO: 369902 - DNA, 20 bp, human
gagcacaccgacggctggat

SEQ ID NO: 369903 - DNA, 20 bp, human
gctacgacacatctgtgtac

SEQ ID NO: 369904 - DNA, 20 bp, human
ggactgcgtgtgtgactcgt

SEQ ID NO: 369905 - DNA, 20 bp, human
gtctggccagggcccgccga

SEQ ID NO: 369906 - DNA, 20 bp, human
gggtctgcctgttgactcgg

SEQ ID NO: 369907 - DNA, 20 bp, human
gtgttgactcggcggggacg

SEQ ID NO: 369908 - DNA, 20 bp, human
gttggacagcgggcttggaa

SEQ ID NO: 369909 - DNA, 20 bp, human
gcggcggcggcgtgggccgt

SEQ ID NO: 369910 - DNA, 20 bp, human
gtccaaacagcgcagataag

SEQ ID NO: 369911 - DNA, 20 bp, human
gtctgcgctgtttggacagc

SEQ ID NO: 369912 - DNA, 20 bp, human
gctgcagcccgaagccgccg

SEQ ID NO: 369913 - DNA, 20 bp, human
gcgtgggccgtgggccgtca

SEQ ID NO: 369914 - DNA, 20 bp, human
ggccgcttatctgcgctgtt

SEQ ID NO: 369915 - DNA, 20 bp, human
gcgcggggaggggacgccag

SEQ ID NO: 369916 - DNA, 20 bp, human
gagaataggcctgggtttag

SEQ ID NO: 369917 - DNA, 20 bp, human
ggcccgacctaacacagaat

SEQ ID NO: 369918 - DNA, 20 bp, human
gagtgtggaaagtgcgagtg

SEQ ID NO: 369919 - DNA, 20 bp, human
gcgaccgaggaagtggcggg

SEQ ID NO: 369920 - DNA, 20 bp, human
ggggagttttgaggatccaa

SEQ ID NO: 369921 - DNA, 20 bp, human
gcgaggccgcggaaccactg

SEQ ID NO: 369922 - DNA, 20 bp, human
ggaggtgccgagccttgcgg

SEQ ID NO: 369923 - DNA, 20 bp, human
gcctcacagccgctaaaccc

SEQ ID NO: 369924 - DNA, 20 bp, human
gcccaggcctattctgtgtt

SEQ ID NO: 369925 - DNA, 20 bp, human
ggggaaagtatcaaaattcg

SEQ ID NO: 369926 - DNA, 20 bp, human
gcgaggagcgagctgacgac

SEQ ID NO: 369927 - DNA, 20 bp, human
gggaaggcgaaaatcccgtt

SEQ ID NO: 369928 - DNA, 20 bp, human
gccccggaggagttgttgct

SEQ ID NO: 369929 - DNA, 20 bp, human
gctcctgcggaccagatccc

SEQ ID NO: 369930 - DNA, 20 bp, human
gagcgagctgacgactggcg

SEQ ID NO: 369931 - DNA, 20 bp, human
gcagttcttgaggttcaagg

SEQ ID NO: 369932 - DNA, 20 bp, human
gcgcccagcaacaactcctc

SEQ ID NO: 369933 - DNA, 20 bp, human
gcccctggtcccactcctgc

SEQ ID NO: 369934 - DNA, 20 bp, human
ggccatgcaacaagaaaggg

SEQ ID NO: 369935 - DNA, 20 bp, human
ggactgatgttgcgtatacg

SEQ ID NO: 369936 - DNA, 20 bp, human
ggctcccagtgacgccgcag

SEQ ID NO: 369937 - DNA, 20 bp, human
gcggctccttcggtcgggca

SEQ ID NO: 369938 - DNA, 20 bp, human
gcgacggaaaactgcgctaa

SEQ ID NO: 369939 - DNA, 20 bp, human
gtgtacctctgcggcgtcac

SEQ ID NO: 369940 - DNA, 20 bp, human
gaaggtcggctccttcggtc

SEQ ID NO: 369941 - DNA, 20 bp, human
ggggagcgtctgtacctctg

SEQ ID NO: 369942 - DNA, 20 bp, human
gaacccatggaaagcctaag

SEQ ID NO: 369943 - DNA, 20 bp, human
gagaacaggcgacgaaaata

SEQ ID NO: 369944 - DNA, 20 bp, human
ggctgtagcgcaggcaaggt

SEQ ID NO: 369945 - DNA, 20 bp, human
ggggaaaggagatgagttct

SEQ ID NO: 369946 - DNA, 20 bp, human
ggacccggggccgaggtgtg

SEQ ID NO: 369947 - DNA, 20 bp, human
ggcccctgccggggagtccc

SEQ ID NO: 369948 - DNA, 20 bp, human
ggcaggggcctgggcactac

SEQ ID NO: 369949 - DNA, 20 bp, human
gggtccctctagttcgcgtt

SEQ ID NO: 369950 - DNA, 20 bp, human
gcgaactagagggaccgagg

SEQ ID NO: 369951 - DNA, 20 bp, human
gtggcgaagcgcgaggaccc

SEQ ID NO: 369952 - DNA, 20 bp, human
gcaccgcagactggagaagg

SEQ ID NO: 369953 - DNA, 20 bp, human
gagaatgagagtctcgataa

SEQ ID NO: 369954 - DNA, 20 bp, human
gagctcctaggcaccagcac

SEQ ID NO: 369955 - DNA, 20 bp, human
ggtccgaggccagtacgggg

SEQ ID NO: 369956 - DNA, 20 bp, human
gcgtaggaggagtcaagttc

SEQ ID NO: 369957 - DNA, 20 bp, human
gtgcagccttcacagggcgt

SEQ ID NO: 369958 - DNA, 20 bp, human
ggccaagagggagactccga

SEQ ID NO: 369959 - DNA, 20 bp, human
gaaaatggcggcgctcgtgg

SEQ ID NO: 369960 - DNA, 20 bp, human
gtcggaaaatctatgaccgt

SEQ ID NO: 369961 - DNA, 20 bp, human
gccaccaaaaaacgctgtgg

SEQ ID NO: 369962 - DNA, 20 bp, human
gggagcgagcggcgctttgg

SEQ ID NO: 369963 - DNA, 20 bp, human
gaatccaccaaaaaacgctg

SEQ ID NO: 369964 - DNA, 20 bp, human
gtgcaaggtggttccgtccg

SEQ ID NO: 369965 - DNA, 20 bp, human
gcggaacctttccccctttg

SEQ ID NO: 369966 - DNA, 20 bp, human
gcgcaggagcgacaataaga

SEQ ID NO: 369967 - DNA, 20 bp, human
gcgcatgcgcgaactcctgg

SEQ ID NO: 369968 - DNA, 20 bp, human
gctaccgcgtaggtcccgcc

SEQ ID NO: 369969 - DNA, 20 bp, human
gagcccgccctcttctgaag

SEQ ID NO: 369970 - DNA, 20 bp, human
gactcctggcgggacctacg

SEQ ID NO: 369971 - DNA, 20 bp, human
gcgagggattcttttctctg

SEQ ID NO: 369972 - DNA, 20 bp, human
gaggagcgacaataagatgg

SEQ ID NO: 369973 - DNA, 20 bp, human
gacgcggcacgtcatccgag

SEQ ID NO: 369974 - DNA, 20 bp, human
ggtgccgcgtagaagtatcg

SEQ ID NO: 369975 - DNA, 20 bp, human
gctgcgcatgcgcgaactcc

SEQ ID NO: 369976 - DNA, 20 bp, human
gtggaggtgggttttttcgt

SEQ ID NO: 369977 - DNA, 20 bp, human
gcatactgaaactaattcta

SEQ ID NO: 369978 - DNA, 20 bp, human
gtatcaattctttgctaagt

SEQ ID NO: 369979 - DNA, 20 bp, human
gctcaatcataaacgttttt

SEQ ID NO: 369980 - DNA, 20 bp, human
gattgttggtattaagtcat

SEQ ID NO: 369981 - DNA, 20 bp, human
gtgtgggttttggatatggt

SEQ ID NO: 369982 - DNA, 20 bp, human
gatacatagaaattactgtt

SEQ ID NO: 369983 - DNA, 20 bp, human
gaggaaggaaggtagtaacc

SEQ ID NO: 369984 - DNA, 20 bp, human
gaataccaacaattgttttc

SEQ ID NO: 369985 - DNA, 20 bp, human
gggttttttcgttggctggt

SEQ ID NO: 369986 - DNA, 20 bp, human
gaggactgggtggagacgtt

SEQ ID NO: 369987 - DNA, 20 bp, human
gtgagggcgaaacagcaggc

SEQ ID NO: 369988 - DNA, 20 bp, human
gcaggcgcggcgcgagatcg

SEQ ID NO: 369989 - DNA, 20 bp, human
gtgggcctcgcacagcgcgg

SEQ ID NO: 369990 - DNA, 20 bp, human
gagcgcgcggtaacagttcg

SEQ ID NO: 369991 - DNA, 20 bp, human
ggcgggcctgctgacgtcgc

SEQ ID NO: 369992 - DNA, 20 bp, human
gcccaagcgcccatccaccc

SEQ ID NO: 369993 - DNA, 20 bp, human
gagactgagggcgaaacagc

SEQ ID NO: 369994 - DNA, 20 bp, human
gaggacgaagagccaacgac

SEQ ID NO: 369995 - DNA, 20 bp, human
gcgggagctctcacctggaa

SEQ ID NO: 369996 - DNA, 20 bp, human
gccgcagtgaccggactcgg

SEQ ID NO: 369997 - DNA, 20 bp, human
ggctccgcagtgaccggact

SEQ ID NO: 369998 - DNA, 20 bp, human
gcactcacctcccccgagtc

SEQ ID NO: 369999 - DNA, 20 bp, human
gaaagccgagcgggccccat

SEQ ID NO: 370000 - DNA, 20 bp, human
gcgggcggctccgcagtgac

SEQ ID NO: 370001 - DNA, 20 bp, human
gccggcctctcagactccgg

SEQ ID NO: 370002 - DNA, 20 bp, human
gcgaaaccccgcaactgcgc

SEQ ID NO: 370003 - DNA, 20 bp, human
gggcgcgggcggagcccgaa

SEQ ID NO: 370004 - DNA, 20 bp, human
ggaagtgccccttagcgggt

SEQ ID NO: 370005 - DNA, 20 bp, human
gcgcgccgccggagtctgag

SEQ ID NO: 370006 - DNA, 20 bp, human
gcgcggcggcgggaagcttc

SEQ ID NO: 370007 - DNA, 20 bp, human
gggggcggggcgaatccagc

SEQ ID NO: 370008 - DNA, 20 bp, human
gccctcgcgaagttggaagg

SEQ ID NO: 370009 - DNA, 20 bp, human
gcctctgaggactacccgca

SEQ ID NO: 370010 - DNA, 20 bp, human
gccctcggccctcgcgaagt

SEQ ID NO: 370011 - DNA, 20 bp, human
gaaggaggctgagtctttcg

SEQ ID NO: 370012 - DNA, 20 bp, human
gcggccctcgcgaagttgga

SEQ ID NO: 370013 - DNA, 20 bp, human
gccgcggcccgccactcctg

SEQ ID NO: 370014 - DNA, 20 bp, human
gaggccgaggcgggagagca

SEQ ID NO: 370015 - DNA, 20 bp, human
gtagtcctcagaggccgagg

SEQ ID NO: 370016 - DNA, 20 bp, human
ggctgtatgttaatgtacta

SEQ ID NO: 370017 - DNA, 20 bp, human
gttgtactgagtgacctttc

SEQ ID NO: 370018 - DNA, 20 bp, human
gcatcatcataaaagatctg

SEQ ID NO: 370019 - DNA, 20 bp, human
gaaatgttatagtgcattcc

SEQ ID NO: 370020 - DNA, 20 bp, human
gttaatgactgtgtacatta

SEQ ID NO: 370021 - DNA, 20 bp, human
gatacattaacgtaacgtat

SEQ ID NO: 370022 - DNA, 20 bp, human
gcactcttcaaacctaattt

SEQ ID NO: 370023 - DNA, 20 bp, human
gctaaatacttgttatggct

SEQ ID NO: 370024 - DNA, 20 bp, human
ggaacttatctcgtggacac

SEQ ID NO: 370025 - DNA, 20 bp, human
gcacagtcattaattataca

SEQ ID NO: 370026 - DNA, 20 bp, human
gatattgcatagatcttttt

SEQ ID NO: 370027 - DNA, 20 bp, human
gtcaaattagatgactgttc

SEQ ID NO: 370028 - DNA, 20 bp, human
gtggaattcgattactcatc

SEQ ID NO: 370029 - DNA, 20 bp, human
ggacgctttctgaagtaaac

SEQ ID NO: 370030 - DNA, 20 bp, human
gagtggagttttggagtccg

SEQ ID NO: 370031 - DNA, 20 bp, human
gtctaatttgagtggagttt

SEQ ID NO: 370032 - DNA, 20 bp, human
gaaatacaggtgtaggaata

SEQ ID NO: 370033 - DNA, 20 bp, human
gtttggagtccgtggtcaga

SEQ ID NO: 370034 - DNA, 20 bp, human
gatagatctttttgggatgc

SEQ ID NO: 370035 - DNA, 20 bp, human
gatcgaattccatctgacca

SEQ ID NO: 370036 - DNA, 20 bp, human
gaggaaatgaaggaattctg

SEQ ID NO: 370037 - DNA, 20 bp, human
gctgggtccctctgcctgtc

SEQ ID NO: 370038 - DNA, 20 bp, human
gaggctatttctacatggct

SEQ ID NO: 370039 - DNA, 20 bp, human
gctataaaccagacaggcag

SEQ ID NO: 370040 - DNA, 20 bp, human
gaatagcctataaaccagac

SEQ ID NO: 370041 - DNA, 20 bp, human
gctaaaagaaacttagtatc

SEQ ID NO: 370042 - DNA, 20 bp, human
gattgcagctctcagatttt

SEQ ID NO: 370043 - DNA, 20 bp, human
gaaagaggagaactcctagc

SEQ ID NO: 370044 - DNA, 20 bp, human
gagtattaagttatataaac

SEQ ID NO: 370045 - DNA, 20 bp, human
gagagtgaagttggacttta

SEQ ID NO: 370046 - DNA, 20 bp, human
gcagccagcgagttagggtt

SEQ ID NO: 370047 - DNA, 20 bp, human
gggaagcgacagtctgagcc

SEQ ID NO: 370048 - DNA, 20 bp, human
gcgacagtctgagccgggaa

SEQ ID NO: 370049 - DNA, 20 bp, human
gagcgagttagggttaggac

SEQ ID NO: 370050 - DNA, 20 bp, human
ggggggcagccagcgagtta

SEQ ID NO: 370051 - DNA, 20 bp, human
ggagccgggaacggggaaga

SEQ ID NO: 370052 - DNA, 20 bp, human
gggcgagaacccaggtcgct

SEQ ID NO: 370053 - DNA, 20 bp, human
gggaggattcggcttcccgg

SEQ ID NO: 370054 - DNA, 20 bp, human
ggggttaggacgggaggatt

SEQ ID NO: 370055 - DNA, 20 bp, human
gaggcggggagcgcaagcgg

SEQ ID NO: 370056 - DNA, 20 bp, human
gcatgcttatgggttagcta

SEQ ID NO: 370057 - DNA, 20 bp, human
ggctggagagtctgtctctt

SEQ ID NO: 370058 - DNA, 20 bp, human
gtggacataggggtgtgtct

SEQ ID NO: 370059 - DNA, 20 bp, human
ggagaattatggtgtcatag

SEQ ID NO: 370060 - DNA, 20 bp, human
gctatgcctagctcactcac

SEQ ID NO: 370061 - DNA, 20 bp, human
gtaggttattgcatgcttat

SEQ ID NO: 370062 - DNA, 20 bp, human
gaaagtgaagtgtagctcaa

SEQ ID NO: 370063 - DNA, 20 bp, human
gaagcacaggggtcaggttt

SEQ ID NO: 370064 - DNA, 20 bp, human
gagctaggcatagagtcttg

SEQ ID NO: 370065 - DNA, 20 bp, human
ggagctacacttcacttttt

SEQ ID NO: 370066 - DNA, 20 bp, human
gtggcagaggggaacgtgct

SEQ ID NO: 370067 - DNA, 20 bp, human
ggcggcgggaaggtggcaga

SEQ ID NO: 370068 - DNA, 20 bp, human
gcaaccactgccgggaagga

SEQ ID NO: 370069 - DNA, 20 bp, human
ggggaacgtgcttggacgag

SEQ ID NO: 370070 - DNA, 20 bp, human
gagaggggcggagtgagacg

SEQ ID NO: 370071 - DNA, 20 bp, human
ggaggggcgcgggacagtct

SEQ ID NO: 370072 - DNA, 20 bp, human
ggctccgggcgcgaggtctg

SEQ ID NO: 370073 - DNA, 20 bp, human
gagcaccgaatccagtatct

SEQ ID NO: 370074 - DNA, 20 bp, human
gtcctcgtagacttccgagc

SEQ ID NO: 370075 - DNA, 20 bp, human
gcgcgcgccccacagcgacc

SEQ ID NO: 370076 - DNA, 20 bp, human
gagccaagcccaggccagat

SEQ ID NO: 370077 - DNA, 20 bp, human
gtccaaagagtgagaacagt

SEQ ID NO: 370078 - DNA, 20 bp, human
gggctaaggtcagcggcccc

SEQ ID NO: 370079 - DNA, 20 bp, human
gttacaatgccactggcatc

SEQ ID NO: 370080 - DNA, 20 bp, human
gacatgtctgccattggcta

SEQ ID NO: 370081 - DNA, 20 bp, human
gtgccattggctaaggtcag

SEQ ID NO: 370082 - DNA, 20 bp, human
ggacatgtgagtgagcctgt

SEQ ID NO: 370083 - DNA, 20 bp, human
gtcactcacatgtctgccat

SEQ ID NO: 370084 - DNA, 20 bp, human
gctcatgtctctagcacttt

SEQ ID NO: 370085 - DNA, 20 bp, human
gagtgggatttgaagccttg

SEQ ID NO: 370086 - DNA, 20 bp, human
gcggcactgcgcgagtggga

SEQ ID NO: 370087 - DNA, 20 bp, human
gtgggcgtggccgcggtctt

SEQ ID NO: 370088 - DNA, 20 bp, human
gccgtcagaacaggcctcag

SEQ ID NO: 370089 - DNA, 20 bp, human
gacgcggactgagggagccg

SEQ ID NO: 370090 - DNA, 20 bp, human
gccgggcggacccaagaccg

SEQ ID NO: 370091 - DNA, 20 bp, human
gcatggtggcgtcacgagag

SEQ ID NO: 370092 - DNA, 20 bp, human
gggtggcgtcacgagagtgg

SEQ ID NO: 370093 - DNA, 20 bp, human
gtccgcccggccgtcagaac

SEQ ID NO: 370094 - DNA, 20 bp, human
ggaggcctgttctgacggcc

SEQ ID NO: 370095 - DNA, 20 bp, human
gcctcagtccgcgtcctgct

SEQ ID NO: 370096 - DNA, 20 bp, human
gcgcggagttgccgaggtgg

SEQ ID NO: 370097 - DNA, 20 bp, human
ggagaccgggagccttactg

SEQ ID NO: 370098 - DNA, 20 bp, human
gggaagcctccgccgcagta

SEQ ID NO: 370099 - DNA, 20 bp, human
gcggcggaggcttccgacgg

SEQ ID NO: 370100 - DNA, 20 bp, human
gtgcgtgcaaggaggcggga

SEQ ID NO: 370101 - DNA, 20 bp, human
gacggtgcgtgcaaggaggc

SEQ ID NO: 370102 - DNA, 20 bp, human
gcggggctgatgacgaacac

SEQ ID NO: 370103 - DNA, 20 bp, human
gccgctccaggatgcacgag

SEQ ID NO: 370104 - DNA, 20 bp, human
ggggagcctcgggctgtcac

SEQ ID NO: 370105 - DNA, 20 bp, human
ggggagccttactgcggcgg

SEQ ID NO: 370106 - DNA, 20 bp, human
ggcgaggaggggtaccgact

SEQ ID NO: 370107 - DNA, 20 bp, human
ggactggggcgggagtactt

SEQ ID NO: 370108 - DNA, 20 bp, human
gtcgcggcgcaggcgtggac

SEQ ID NO: 370109 - DNA, 20 bp, human
ggaccccgcgccaagaggcg

SEQ ID NO: 370110 - DNA, 20 bp, human
gtagcggcctctcgcggcgc

SEQ ID NO: 370111 - DNA, 20 bp, human
gaatgctcggcgctctcgcg

SEQ ID NO: 370112 - DNA, 20 bp, human
gtgggaagcgcgtgcagaag

SEQ ID NO: 370113 - DNA, 20 bp, human
gttggcgcggggtcgcaatt

SEQ ID NO: 370114 - DNA, 20 bp, human
gtcggcgctctcgcgaggag

SEQ ID NO: 370115 - DNA, 20 bp, human
gaagcggaggtgctgctcat

SEQ ID NO: 370116 - DNA, 20 bp, human
gttggcgcccgccgggcctg

SEQ ID NO: 370117 - DNA, 20 bp, human
gagtggagatcccctgtctt

SEQ ID NO: 370118 - DNA, 20 bp, human
gtcttcgccgcccaagggcc

SEQ ID NO: 370119 - DNA, 20 bp, human
ggcacggcatgctgggagcg

SEQ ID NO: 370120 - DNA, 20 bp, human
gagacctcttcgccgcccaa

SEQ ID NO: 370121 - DNA, 20 bp, human
gaatcaaggacctgcggtgt

SEQ ID NO: 370122 - DNA, 20 bp, human
gcggccctccggtgctttcc

SEQ ID NO: 370123 - DNA, 20 bp, human
gcgggcagtcaggtgtaaac

SEQ ID NO: 370124 - DNA, 20 bp, human
gggacctgcggtgtgggtgg

SEQ ID NO: 370125 - DNA, 20 bp, human
ggcgtccaatcaaggacctg

SEQ ID NO: 370126 - DNA, 20 bp, human
ggggcagcatggcgtctttc

SEQ ID NO: 370127 - DNA, 20 bp, human
gaagttgccagaactaactc

SEQ ID NO: 370128 - DNA, 20 bp, human
gccactggtccgcaactgtg

SEQ ID NO: 370129 - DNA, 20 bp, human
ggaggcggccaaagcttaac

SEQ ID NO: 370130 - DNA, 20 bp, human
gacggacagtgtacccactg

SEQ ID NO: 370131 - DNA, 20 bp, human
gttagttctggcaacttccc

SEQ ID NO: 370132 - DNA, 20 bp, human
ggatggcagccgcacagttg

SEQ ID NO: 370133 - DNA, 20 bp, human
gcgcctgccaaatctcgcga

SEQ ID NO: 370134 - DNA, 20 bp, human
gccaataaagtttttcgcaa

SEQ ID NO: 370135 - DNA, 20 bp, human
gttctggcaacttcccggga

SEQ ID NO: 370136 - DNA, 20 bp, human
gcccgccgccggttccagag

SEQ ID NO: 370137 - DNA, 20 bp, human
ggggaccggagcgagagcct

SEQ ID NO: 370138 - DNA, 20 bp, human
gcgcgcgcgccgcccgtctg

SEQ ID NO: 370139 - DNA, 20 bp, human
gcccgcccctctggaaccgg

SEQ ID NO: 370140 - DNA, 20 bp, human
ggcgcggcgccggtgagctg

SEQ ID NO: 370141 - DNA, 20 bp, human
gctgcgcgtgcgcagaggtg

SEQ ID NO: 370142 - DNA, 20 bp, human
gcggccaccgtcgttcggaa

SEQ ID NO: 370143 - DNA, 20 bp, human
gctccctttccgaacgacgg

SEQ ID NO: 370144 - DNA, 20 bp, human
gccggagcgagagcctgggt

SEQ ID NO: 370145 - DNA, 20 bp, human
gcggggaaaggccgggaggt

SEQ ID NO: 370146 - DNA, 20 bp, human
ggaagtcggcgaccgggcga

SEQ ID NO: 370147 - DNA, 20 bp, human
ggggacactccgacccgggg

SEQ ID NO: 370148 - DNA, 20 bp, human
ggagaggcggaaatcactga

SEQ ID NO: 370149 - DNA, 20 bp, human
gcactccgacccggggggga

SEQ ID NO: 370150 - DNA, 20 bp, human
gtctacgcgcgagggaagac

SEQ ID NO: 370151 - DNA, 20 bp, human
ggcgcagggacactccgacc

SEQ ID NO: 370152 - DNA, 20 bp, human
gagcagaggaagtcggcgac

SEQ ID NO: 370153 - DNA, 20 bp, human
ggctgctgctctggcccgtg

SEQ ID NO: 370154 - DNA, 20 bp, human
gaaaagggagcgctacagag

SEQ ID NO: 370155 - DNA, 20 bp, human
gtgggattgcccccttgcgc

SEQ ID NO: 370156 - DNA, 20 bp, human
gaaaactgggactactgcgg

SEQ ID NO: 370157 - DNA, 20 bp, human
gtgaggaaacaaactaggag

SEQ ID NO: 370158 - DNA, 20 bp, human
ggaggcggaactcaagtgac

SEQ ID NO: 370159 - DNA, 20 bp, human
gaacaaaactgggactactg

SEQ ID NO: 370160 - DNA, 20 bp, human
ggcaggaactgaagaagcgg

SEQ ID NO: 370161 - DNA, 20 bp, human
gagccggtcggttttactaa

SEQ ID NO: 370162 - DNA, 20 bp, human
gggaggaaggatttcaaaat

SEQ ID NO: 370163 - DNA, 20 bp, human
gactcaagtgacgggaaagc

SEQ ID NO: 370164 - DNA, 20 bp, human
gttcaaaattggacgaaagc

SEQ ID NO: 370165 - DNA, 20 bp, human
ggtcggttttactaacggac

SEQ ID NO: 370166 - DNA, 20 bp, human
gtcagcacgcatgcgggttc

SEQ ID NO: 370167 - DNA, 20 bp, human
ggggagagcggcccggatct

SEQ ID NO: 370168 - DNA, 20 bp, human
ggatacgccgaggagccggc

SEQ ID NO: 370169 - DNA, 20 bp, human
gcgcaggacgagtcgcctga

SEQ ID NO: 370170 - DNA, 20 bp, human
gtagggaaatggatacgccg

SEQ ID NO: 370171 - DNA, 20 bp, human
gtcgtcctgcgcatgcgctg

SEQ ID NO: 370172 - DNA, 20 bp, human
ggcgcattgagtcagagccg

SEQ ID NO: 370173 - DNA, 20 bp, human
gaatgcgcgtgcgcgcggtt

SEQ ID NO: 370174 - DNA, 20 bp, human
gcgcatgcgggttccggagc

SEQ ID NO: 370175 - DNA, 20 bp, human
ggggcaggtcagaccctgaa

SEQ ID NO: 370176 - DNA, 20 bp, human
ggccatgcggggaagggcta

SEQ ID NO: 370177 - DNA, 20 bp, human
ggtggcggggctagagtggt

SEQ ID NO: 370178 - DNA, 20 bp, human
ggagacgcctcgtccggaag

SEQ ID NO: 370179 - DNA, 20 bp, human
gccagcagcggggaggtgtc

SEQ ID NO: 370180 - DNA, 20 bp, human
gggaagggctagggccgcag

SEQ ID NO: 370181 - DNA, 20 bp, human
gggctagggccgcagcgggg

SEQ ID NO: 370182 - DNA, 20 bp, human
gacctcctggccccggggct

SEQ ID NO: 370183 - DNA, 20 bp, human
gaaggtctggggccagtagc

SEQ ID NO: 370184 - DNA, 20 bp, human
gcgggaagggaagcaggtgt

SEQ ID NO: 370185 - DNA, 20 bp, human
gcctgcggagcccagagacg

SEQ ID NO: 370186 - DNA, 20 bp, human
gccgccccacggggtccgcg

SEQ ID NO: 370187 - DNA, 20 bp, human
ggcagggcacgtgctgacgt

SEQ ID NO: 370188 - DNA, 20 bp, human
gctctggccccagcggtcac

SEQ ID NO: 370189 - DNA, 20 bp, human
gagggcgccagtgaccgctg

SEQ ID NO: 370190 - DNA, 20 bp, human
gggcctgggccaggacagtt

SEQ ID NO: 370191 - DNA, 20 bp, human
gtaggccacgcggaccccgt

SEQ ID NO: 370192 - DNA, 20 bp, human
ggccagagccctgccgggaa

SEQ ID NO: 370193 - DNA, 20 bp, human
gggcggggcggaacctggca

SEQ ID NO: 370194 - DNA, 20 bp, human
ggttaggctaaactgactct

SEQ ID NO: 370195 - DNA, 20 bp, human
gcagtttagcctaactgtcc

SEQ ID NO: 370196 - DNA, 20 bp, human
gggcccgggcagaagacctg

SEQ ID NO: 370197 - DNA, 20 bp, human
gtggaggctgaagtccacgt

SEQ ID NO: 370198 - DNA, 20 bp, human
gctgaagtccacgtaggccc

SEQ ID NO: 370199 - DNA, 20 bp, human
gaatgcaccgctacgtgctc

SEQ ID NO: 370200 - DNA, 20 bp, human
gccccggcggggagccgctg

SEQ ID NO: 370201 - DNA, 20 bp, human
gcggagtagtgcactctcgt

SEQ ID NO: 370202 - DNA, 20 bp, human
gcaccgccaggcttggacaa

SEQ ID NO: 370203 - DNA, 20 bp, human
gcacccggcctacaccccag

SEQ ID NO: 370204 - DNA, 20 bp, human
ggcagtgagcagcgcgcccc

SEQ ID NO: 370205 - DNA, 20 bp, human
ggctacgtgctcaggcgcag

SEQ ID NO: 370206 - DNA, 20 bp, human
gaaacctcccggccaacaga

SEQ ID NO: 370207 - DNA, 20 bp, human
gtggacgtcgcgccctctgt

SEQ ID NO: 370208 - DNA, 20 bp, human
ggggccccactgcgctgaaa

SEQ ID NO: 370209 - DNA, 20 bp, human
ggcgcagtggggcccagttg

SEQ ID NO: 370210 - DNA, 20 bp, human
ggcgccctctgttggccggg

SEQ ID NO: 370211 - DNA, 20 bp, human
gtctctcggagcgcagggat

SEQ ID NO: 370212 - DNA, 20 bp, human
gaagctaggcgtccgcaact

SEQ ID NO: 370213 - DNA, 20 bp, human
gacgtccatttcagcgcagt

SEQ ID NO: 370214 - DNA, 20 bp, human
gcactggccgccggctctct

SEQ ID NO: 370215 - DNA, 20 bp, human
ggtcgcgccctctgttggcc

SEQ ID NO: 370216 - DNA, 20 bp, human
ggcgacttgagcaagaccaa

SEQ ID NO: 370217 - DNA, 20 bp, human
gagcagcgaagcccgagtgg

SEQ ID NO: 370218 - DNA, 20 bp, human
gggacgggcagccagatccg

SEQ ID NO: 370219 - DNA, 20 bp, human
ggaaagcagcgaagcccgag

SEQ ID NO: 370220 - DNA, 20 bp, human
ggcccacggtcgtccgactg

SEQ ID NO: 370221 - DNA, 20 bp, human
ggcctcagtcggacgaccgt

SEQ ID NO: 370222 - DNA, 20 bp, human
ggagctgccccagcggtagg

SEQ ID NO: 370223 - DNA, 20 bp, human
gccgagtggcggtgcattct

SEQ ID NO: 370224 - DNA, 20 bp, human
gtgcagagcctggtggagtc

SEQ ID NO: 370225 - DNA, 20 bp, human
ggggacggcgttgtctcgca

SEQ ID NO: 370226 - DNA, 20 bp, human
gcccacgcacagcgtgtcgt

SEQ ID NO: 370227 - DNA, 20 bp, human
gcgcctgccctgtgcgtccc

SEQ ID NO: 370228 - DNA, 20 bp, human
gagtgcgggggatgtagttc

SEQ ID NO: 370229 - DNA, 20 bp, human
gccggcttcccgggacgcac

SEQ ID NO: 370230 - DNA, 20 bp, human
gcatgcgcatgctcggcagg

SEQ ID NO: 370231 - DNA, 20 bp, human
ggacgcacagggcaggcgct

SEQ ID NO: 370232 - DNA, 20 bp, human
ggaggactgtgaagcaatcg

SEQ ID NO: 370233 - DNA, 20 bp, human
ggggcatgcgcatgctcggc

SEQ ID NO: 370234 - DNA, 20 bp, human
gccggcagatccgggtcttg

SEQ ID NO: 370235 - DNA, 20 bp, human
gcgtaggcgtccgaagccgc

SEQ ID NO: 370236 - DNA, 20 bp, human
gccgggcgtgagtaagtcta

SEQ ID NO: 370237 - DNA, 20 bp, human
gggctcgggtcgcctgtggg

SEQ ID NO: 370238 - DNA, 20 bp, human
gacgtcctgcggggaccaag

SEQ ID NO: 370239 - DNA, 20 bp, human
gtcctgcggggaccaagtgg

SEQ ID NO: 370240 - DNA, 20 bp, human
gttggaggacgcgggagggt

SEQ ID NO: 370241 - DNA, 20 bp, human
gtggcggctcgggtcgcctg

SEQ ID NO: 370242 - DNA, 20 bp, human
gcaatggcgcagccggaaac

SEQ ID NO: 370243 - DNA, 20 bp, human
gtcttgggacctcgagttgg

SEQ ID NO: 370244 - DNA, 20 bp, human
gggcttcaggactcgaggag

SEQ ID NO: 370245 - DNA, 20 bp, human
ggggtcttgggacctcgagt

SEQ ID NO: 370246 - DNA, 20 bp, human
gtacccgcggcgtggttgca

SEQ ID NO: 370247 - DNA, 20 bp, human
gcgcgggtaccccgcctctg

SEQ ID NO: 370248 - DNA, 20 bp, human
gcaaaccgggagtccggggt

SEQ ID NO: 370249 - DNA, 20 bp, human
gccgcggcgtggttgcaggg

SEQ ID NO: 370250 - DNA, 20 bp, human
gaggcggggtacccgcggcg

SEQ ID NO: 370251 - DNA, 20 bp, human
gtgcggctgcgcagacgcgg

SEQ ID NO: 370252 - DNA, 20 bp, human
gtccaggtgcaggcttcccg

SEQ ID NO: 370253 - DNA, 20 bp, human
gcccacgcgcctccaggtgc

SEQ ID NO: 370254 - DNA, 20 bp, human
ggggagtggatgagccgcag

SEQ ID NO: 370255 - DNA, 20 bp, human
gagcacgtaggttatgttcg

SEQ ID NO: 370256 - DNA, 20 bp, human
gtcgggaaaggtagtaacct

SEQ ID NO: 370257 - DNA, 20 bp, human
ggcactgaagtattcactga

SEQ ID NO: 370258 - DNA, 20 bp, human
ggaaactgtcagctccattg

SEQ ID NO: 370259 - DNA, 20 bp, human
gacttcctgaaggaaatatc

SEQ ID NO: 370260 - DNA, 20 bp, human
gtggaagataatgtcgggaa

SEQ ID NO: 370261 - DNA, 20 bp, human
gtagggctggaagataatgt

SEQ ID NO: 370262 - DNA, 20 bp, human
gtctattggttgaaccacaa

SEQ ID NO: 370263 - DNA, 20 bp, human
gaaacttgaatagagctgtc

SEQ ID NO: 370264 - DNA, 20 bp, human
ggatggagctgtgcttctat

SEQ ID NO: 370265 - DNA, 20 bp, human
gccagcctgatatttccttc

SEQ ID NO: 370266 - DNA, 20 bp, human
gggccggcaggaaatgacga

SEQ ID NO: 370267 - DNA, 20 bp, human
gactccggggtaaagagccc

SEQ ID NO: 370268 - DNA, 20 bp, human
gggccgccgctgcgtctctc

SEQ ID NO: 370269 - DNA, 20 bp, human
gagcccgggagtcgggccgg

SEQ ID NO: 370270 - DNA, 20 bp, human
gccgcccccgggcgcgtgag

SEQ ID NO: 370271 - DNA, 20 bp, human
ggggggtcgcggcgcggtag

SEQ ID NO: 370272 - DNA, 20 bp, human
gcgcgtgccgcctccggagc

SEQ ID NO: 370273 - DNA, 20 bp, human
gccagcgctgctccgctccg

SEQ ID NO: 370274 - DNA, 20 bp, human
gtcccgggctcccgcgggtg

SEQ ID NO: 370275 - DNA, 20 bp, human
gcaggcgcaatgtagccggg

SEQ ID NO: 370276 - DNA, 20 bp, human
gagtactcaaccagtatgtg

SEQ ID NO: 370277 - DNA, 20 bp, human
gtaggcagcagcagcttcaa

SEQ ID NO: 370278 - DNA, 20 bp, human
ggagagcatcaataatggga

SEQ ID NO: 370279 - DNA, 20 bp, human
gcagagggcatgcgatatgt

SEQ ID NO: 370280 - DNA, 20 bp, human
gtttggagagcatcaataat

SEQ ID NO: 370281 - DNA, 20 bp, human
ggtgaggaaagactggttag

SEQ ID NO: 370282 - DNA, 20 bp, human
gagctcaggggatgcctctt

SEQ ID NO: 370283 - DNA, 20 bp, human
gaggctcttacaatgggcaa

SEQ ID NO: 370284 - DNA, 20 bp, human
gtggtgctcacttcagctgt

SEQ ID NO: 370285 - DNA, 20 bp, human
gttagctgagtactgttcaa

SEQ ID NO: 370286 - DNA, 20 bp, human
gcagcacggaatcccgggga

SEQ ID NO: 370287 - DNA, 20 bp, human
ggcggagcggagaaagagac

SEQ ID NO: 370288 - DNA, 20 bp, human
gccgcacagcacggaatccc

SEQ ID NO: 370289 - DNA, 20 bp, human
ggaatcccggggaaggcgga

SEQ ID NO: 370290 - DNA, 20 bp, human
gcacggaatcccggggaagg

SEQ ID NO: 370291 - DNA, 20 bp, human
ggcttccgggccttgaggga

SEQ ID NO: 370292 - DNA, 20 bp, human
ggggcgctggcgttggattg

SEQ ID NO: 370293 - DNA, 20 bp, human
gtagacagaacagggcccgc

SEQ ID NO: 370294 - DNA, 20 bp, human
ggtaaagaaggcgatggtaa

SEQ ID NO: 370295 - DNA, 20 bp, human
gaaggaaagtagacagaaca

SEQ ID NO: 370296 - DNA, 20 bp, human
gatacccagatcttcaaggt

SEQ ID NO: 370297 - DNA, 20 bp, human
gctcagagtcgctgtcatca

SEQ ID NO: 370298 - DNA, 20 bp, human
gtcccgcacatggagttctg

SEQ ID NO: 370299 - DNA, 20 bp, human
ggacctgagaactctacatg

SEQ ID NO: 370300 - DNA, 20 bp, human
gtcccacatgtagagttctc

SEQ ID NO: 370301 - DNA, 20 bp, human
gacctcagaactccatgtgc

SEQ ID NO: 370302 - DNA, 20 bp, human
gttgccaaccttgaagatct

SEQ ID NO: 370303 - DNA, 20 bp, human
gagcttgtgctgtggagata

SEQ ID NO: 370304 - DNA, 20 bp, human
gaacccaggaaacctacact

SEQ ID NO: 370305 - DNA, 20 bp, human
gtcctgtggagtgtctcatt

SEQ ID NO: 370306 - DNA, 20 bp, human
ggctggggagaaggttgtca

SEQ ID NO: 370307 - DNA, 20 bp, human
gttgtcagggtaaggaccac

SEQ ID NO: 370308 - DNA, 20 bp, human
ggtgctggaaccaatcgttg

SEQ ID NO: 370309 - DNA, 20 bp, human
gggagaaggttgtcagggta

SEQ ID NO: 370310 - DNA, 20 bp, human
gctagctgctcaagggtcgt

SEQ ID NO: 370311 - DNA, 20 bp, human
ggcccagcaggtgcgctccc

SEQ ID NO: 370312 - DNA, 20 bp, human
gggaggaagacgccggcctg

SEQ ID NO: 370313 - DNA, 20 bp, human
ggcttctaggaggtaggtgg

SEQ ID NO: 370314 - DNA, 20 bp, human
ggagtgaagaagccacaggc

SEQ ID NO: 370315 - DNA, 20 bp, human
gtccacaccacctgaggcct

SEQ ID NO: 370316 - DNA, 20 bp, human
gaagccaagcgacatgtcca

SEQ ID NO: 370317 - DNA, 20 bp, human
gggagagaccagggcgtctc

SEQ ID NO: 370318 - DNA, 20 bp, human
gagcccgcaggggacgctgg

SEQ ID NO: 370319 - DNA, 20 bp, human
gcccctgcgggctgcgttcg

SEQ ID NO: 370320 - DNA, 20 bp, human
ggggctgcgttcggggagaa

SEQ ID NO: 370321 - DNA, 20 bp, human
gcaaagcaggatctgagtcc

SEQ ID NO: 370322 - DNA, 20 bp, human
gtccccgaacgcagcccgca

SEQ ID NO: 370323 - DNA, 20 bp, human
gtagccgtggacatgtcgct

SEQ ID NO: 370324 - DNA, 20 bp, human
gactccatggatgacataga

SEQ ID NO: 370325 - DNA, 20 bp, human
ggggccacccacagtggcgt

SEQ ID NO: 370326 - DNA, 20 bp, human
gaagccgagcagggcctcga

SEQ ID NO: 370327 - DNA, 20 bp, human
gggcgcaggcgcctcagctc

SEQ ID NO: 370328 - DNA, 20 bp, human
gcgccctgccgtgctctgat

SEQ ID NO: 370329 - DNA, 20 bp, human
gtgctccctgaagccgagca

SEQ ID NO: 370330 - DNA, 20 bp, human
gggccgggccggcgccacgt

SEQ ID NO: 370331 - DNA, 20 bp, human
gagaacgggcggggcggtct

SEQ ID NO: 370332 - DNA, 20 bp, human
ggaggtgggacggcccaaaa

SEQ ID NO: 370333 - DNA, 20 bp, human
gcccgctgcagtctgattgg

SEQ ID NO: 370334 - DNA, 20 bp, human
gggcgcctcagctctggagg

SEQ ID NO: 370335 - DNA, 20 bp, human
gtgggctgtccttccctttt

SEQ ID NO: 370336 - DNA, 20 bp, human
gcggcacaagggcctcccca

SEQ ID NO: 370337 - DNA, 20 bp, human
gaggtgagggccttctgctg

SEQ ID NO: 370338 - DNA, 20 bp, human
gagaaggccctcacctcaca

SEQ ID NO: 370339 - DNA, 20 bp, human
ggacgccttcagatgctgag

SEQ ID NO: 370340 - DNA, 20 bp, human
gggaggctctggcatccgag

SEQ ID NO: 370341 - DNA, 20 bp, human
gaggaacaacagtaaacagt

SEQ ID NO: 370342 - DNA, 20 bp, human
gcagcatctgaaggcgtctt

SEQ ID NO: 370343 - DNA, 20 bp, human
gaccccagccccgctgtcaa

SEQ ID NO: 370344 - DNA, 20 bp, human
gcacaaaaccccagtgagtc

SEQ ID NO: 370345 - DNA, 20 bp, human
gcagagggagggaccagcca

SEQ ID NO: 370346 - DNA, 20 bp, human
gcacccagctgacacagctc

SEQ ID NO: 370347 - DNA, 20 bp, human
gagaccaagggcttgcttcg

SEQ ID NO: 370348 - DNA, 20 bp, human
gtagtggtacctcaagacaa

SEQ ID NO: 370349 - DNA, 20 bp, human
gactaggtggaagtcaccag

SEQ ID NO: 370350 - DNA, 20 bp, human
ggactggcacagctccctcg

SEQ ID NO: 370351 - DNA, 20 bp, human
ggggactgagggccaccact

SEQ ID NO: 370352 - DNA, 20 bp, human
gctcccgagagcaggttcat

SEQ ID NO: 370353 - DNA, 20 bp, human
gagcccccgaagcaagccct

SEQ ID NO: 370354 - DNA, 20 bp, human
gactgagggccaccactagg

SEQ ID NO: 370355 - DNA, 20 bp, human
gacctgacaaacttgttctg

SEQ ID NO: 370356 - DNA, 20 bp, human
ggtgcccagggagcagacaa

SEQ ID NO: 370357 - DNA, 20 bp, human
ggcctcctggaactgtttct

SEQ ID NO: 370358 - DNA, 20 bp, human
gagcagacaaaggcaccaat

SEQ ID NO: 370359 - DNA, 20 bp, human
gaggatgtgagggcccgcta

SEQ ID NO: 370360 - DNA, 20 bp, human
gttcccccagaaacagttcc

SEQ ID NO: 370361 - DNA, 20 bp, human
gtggggctgggactggcgta

SEQ ID NO: 370362 - DNA, 20 bp, human
ggctggcgcctggtgcctcc

SEQ ID NO: 370363 - DNA, 20 bp, human
gaccaatgggaagcctcagg

SEQ ID NO: 370364 - DNA, 20 bp, human
gaagtgttgctccccccctg

SEQ ID NO: 370365 - DNA, 20 bp, human
gcaaccacacaatgttgctg

SEQ ID NO: 370366 - DNA, 20 bp, human
gaggccccgagagccagaat

SEQ ID NO: 370367 - DNA, 20 bp, human
gggaggagcggggtctcctg

SEQ ID NO: 370368 - DNA, 20 bp, human
gagccagaatgggaggagcg

SEQ ID NO: 370369 - DNA, 20 bp, human
gcctcccattctggctctcg

SEQ ID NO: 370370 - DNA, 20 bp, human
gcctaaagcaacagtggcga

SEQ ID NO: 370371 - DNA, 20 bp, human
gtgcaggccagaccccctta

SEQ ID NO: 370372 - DNA, 20 bp, human
ggggcgctcgcgctccccta

SEQ ID NO: 370373 - DNA, 20 bp, human
gcgagggctgggccaatcga

SEQ ID NO: 370374 - DNA, 20 bp, human
gctgggccaatcgaaggtca

SEQ ID NO: 370375 - DNA, 20 bp, human
gtcgaaggtcaaggctggga

SEQ ID NO: 370376 - DNA, 20 bp, human
gggaaaggctagcactggat

SEQ ID NO: 370377 - DNA, 20 bp, human
gggcgcgaggtcctcagaac

SEQ ID NO: 370378 - DNA, 20 bp, human
ggaaccggaaaggctagcac

SEQ ID NO: 370379 - DNA, 20 bp, human
ggaggtcctcagaaccggaa

SEQ ID NO: 370380 - DNA, 20 bp, human
ggacctcgcgcccctccttg

SEQ ID NO: 370381 - DNA, 20 bp, human
gagcccgcagaccccaagga

SEQ ID NO: 370382 - DNA, 20 bp, human
gagcgtcccctgtcttccgg

SEQ ID NO: 370383 - DNA, 20 bp, human
gaggctgcggcgcagcggcg

SEQ ID NO: 370384 - DNA, 20 bp, human
gcgcctgctagagagagcgg

SEQ ID NO: 370385 - DNA, 20 bp, human
gcgcagcctccggaagacag

SEQ ID NO: 370386 - DNA, 20 bp, human
ggcagtagttctatcctctt

SEQ ID NO: 370387 - DNA, 20 bp, human
gctactgcaaggatgggttt

SEQ ID NO: 370388 - DNA, 20 bp, human
ggatagaactactgcaagga

SEQ ID NO: 370389 - DNA, 20 bp, human
gtgtcaaataaggagactgg

SEQ ID NO: 370390 - DNA, 20 bp, human
gagaaattctagatggatcc

SEQ ID NO: 370391 - DNA, 20 bp, human
gagctgtcaaataaggagac

SEQ ID NO: 370392 - DNA, 20 bp, human
gagaattattcaagcctaag

SEQ ID NO: 370393 - DNA, 20 bp, human
gtgcatagttagataccatg

SEQ ID NO: 370394 - DNA, 20 bp, human
gaccttatttaatatgatgt

SEQ ID NO: 370395 - DNA, 20 bp, human
gttttgcatagcatggcaaa

SEQ ID NO: 370396 - DNA, 20 bp, human
ggggccgcgcgcacaatcac

SEQ ID NO: 370397 - DNA, 20 bp, human
gcaaagcggcagcgcgcgga

SEQ ID NO: 370398 - DNA, 20 bp, human
gccgcggtcggcctcgtact

SEQ ID NO: 370399 - DNA, 20 bp, human
gtcggcctcgtactaggtga

SEQ ID NO: 370400 - DNA, 20 bp, human
gtgggccgtcacctagtacg

SEQ ID NO: 370401 - DNA, 20 bp, human
gagcgcccggaaacccagtt

SEQ ID NO: 370402 - DNA, 20 bp, human
gcatcccgcgcgcgcaagcc

SEQ ID NO: 370403 - DNA, 20 bp, human
gcccgagagactaaaggggt

SEQ ID NO: 370404 - DNA, 20 bp, human
ggcgcgctgccgctttgccc

SEQ ID NO: 370405 - DNA, 20 bp, human
gctgggccggcgtgcgcctc

SEQ ID NO: 370406 - DNA, 20 bp, human
ggcagcgggggaatgacctt

SEQ ID NO: 370407 - DNA, 20 bp, human
gagtatgtatctggcagcgg

SEQ ID NO: 370408 - DNA, 20 bp, human
gtcagagataagtatgtatc

SEQ ID NO: 370409 - DNA, 20 bp, human
gactcagctactaattgtag

SEQ ID NO: 370410 - DNA, 20 bp, human
gtagtctgatgaatgctgat

SEQ ID NO: 370411 - DNA, 20 bp, human
gacaacaagttttgcttggt

SEQ ID NO: 370412 - DNA, 20 bp, human
gaggaagaatttctacttgt

SEQ ID NO: 370413 - DNA, 20 bp, human
gtgctgataggattgctggc

SEQ ID NO: 370414 - DNA, 20 bp, human
gcataagtacttaggtacag

SEQ ID NO: 370415 - DNA, 20 bp, human
gtttctagacataagtactt

SEQ ID NO: 370416 - DNA, 20 bp, human
gtatcgccctcccacatttg

SEQ ID NO: 370417 - DNA, 20 bp, human
gcgtgagaagttactacaag

SEQ ID NO: 370418 - DNA, 20 bp, human
gcacactggagttcgagacg

SEQ ID NO: 370419 - DNA, 20 bp, human
gaatatacacgccacaaatg

SEQ ID NO: 370420 - DNA, 20 bp, human
gaacaaggaaagacaaacat

SEQ ID NO: 370421 - DNA, 20 bp, human
gttctcacgctttctacgag

SEQ ID NO: 370422 - DNA, 20 bp, human
ggaaagacaaacatgggggc

SEQ ID NO: 370423 - DNA, 20 bp, human
gcttacatttacttttccaa

SEQ ID NO: 370424 - DNA, 20 bp, human
gtacttttccaagggggagg

SEQ ID NO: 370425 - DNA, 20 bp, human
gcaggttttaaattcctagt

SEQ ID NO: 370426 - DNA, 20 bp, human
gtatcgccctcccacatttg

SEQ ID NO: 370427 - DNA, 20 bp, human
gcgtgagaagttactacaag

SEQ ID NO: 370428 - DNA, 20 bp, human
gaacaaggaaagacaaacat

SEQ ID NO: 370429 - DNA, 20 bp, human
gcacactggagttcgagacg

SEQ ID NO: 370430 - DNA, 20 bp, human
ggaaagacaaacatgggggc

SEQ ID NO: 370431 - DNA, 20 bp, human
gaatatacacgccacaaatg

SEQ ID NO: 370432 - DNA, 20 bp, human
gttctcacgctttctacgag

SEQ ID NO: 370433 - DNA, 20 bp, human
gcttacatttacttttccaa

SEQ ID NO: 370434 - DNA, 20 bp, human
gtacttttccaagggggagg

SEQ ID NO: 370435 - DNA, 20 bp, human
gcaggttttaaattcctagt

SEQ ID NO: 370436 - DNA, 20 bp, human
ggctgtcagggacacgaagt

SEQ ID NO: 370437 - DNA, 20 bp, human
ggcggggcctaggaaggaaa

SEQ ID NO: 370438 - DNA, 20 bp, human
ggtcagggacacgaagtagg

SEQ ID NO: 370439 - DNA, 20 bp, human
ggcgccctctagccagtccc

SEQ ID NO: 370440 - DNA, 20 bp, human
gaacgccgggcactggaagg

SEQ ID NO: 370441 - DNA, 20 bp, human
gacagccagggactggctag

SEQ ID NO: 370442 - DNA, 20 bp, human
gaggaacgccgggcactgga

SEQ ID NO: 370443 - DNA, 20 bp, human
gaagtaggcggggcctagga

SEQ ID NO: 370444 - DNA, 20 bp, human
gttcgccaggcgcggaatgc

SEQ ID NO: 370445 - DNA, 20 bp, human
gaggaaggaaatggcgtagc

SEQ ID NO: 370446 - DNA, 20 bp, human
gtggaggggcccgggctagg

SEQ ID NO: 370447 - DNA, 20 bp, human
gctcaggatgggaaagacag

SEQ ID NO: 370448 - DNA, 20 bp, human
ggggcaccttgcttggtctg

SEQ ID NO: 370449 - DNA, 20 bp, human
gactggacgaaggagcggag

SEQ ID NO: 370450 - DNA, 20 bp, human
ggcgcgagcgtcagcgtccc

SEQ ID NO: 370451 - DNA, 20 bp, human
ggggatgcctgaagtcaacg

SEQ ID NO: 370452 - DNA, 20 bp, human
gggcccgggctagggggatc

SEQ ID NO: 370453 - DNA, 20 bp, human
gtgggggagggactggacga

SEQ ID NO: 370454 - DNA, 20 bp, human
gtcaccagatccccctagcc

SEQ ID NO: 370455 - DNA, 20 bp, human
gctgcaaggagagactcggc

SEQ ID NO: 370456 - DNA, 20 bp, human
gctcccgcggagctcctcgg

SEQ ID NO: 370457 - DNA, 20 bp, human
ggctccgcgggagtaggccc

SEQ ID NO: 370458 - DNA, 20 bp, human
ggggcaagaggagccactcg

SEQ ID NO: 370459 - DNA, 20 bp, human
gcccccgccgaggagctccg

SEQ ID NO: 370460 - DNA, 20 bp, human
ggcggggggttgaccacgag

SEQ ID NO: 370461 - DNA, 20 bp, human
gaggtgaaagccaatgggag

SEQ ID NO: 370462 - DNA, 20 bp, human
gcacggcgggcctgattgac

SEQ ID NO: 370463 - DNA, 20 bp, human
gctcccggggcctactcccg

SEQ ID NO: 370464 - DNA, 20 bp, human
ggggctgtggcgttggagtg

SEQ ID NO: 370465 - DNA, 20 bp, human
gcgtggtcaaccccccgccg

SEQ ID NO: 370466 - DNA, 20 bp, human
gagagtgcgcgcggggaagg

SEQ ID NO: 370467 - DNA, 20 bp, human
gtctgggccgcagcgggcac

SEQ ID NO: 370468 - DNA, 20 bp, human
gtgcggagcgagaggtggag

SEQ ID NO: 370469 - DNA, 20 bp, human
gggccactgcgcagccctgg

SEQ ID NO: 370470 - DNA, 20 bp, human
gcccacgcgcgcgcaccctc

SEQ ID NO: 370471 - DNA, 20 bp, human
gcgcgggtctgcggagcgag

SEQ ID NO: 370472 - DNA, 20 bp, human
ggccgcagcgggcaccggag

SEQ ID NO: 370473 - DNA, 20 bp, human
gccgcgccagggaggcctct

SEQ ID NO: 370474 - DNA, 20 bp, human
ggtccaggcccggtccgcgc

SEQ ID NO: 370475 - DNA, 20 bp, human
gggccaccagggctgcgcag

SEQ ID NO: 370476 - DNA, 20 bp, human
gggggtgcgggcccagatgt

SEQ ID NO: 370477 - DNA, 20 bp, human
gcgggcccagatgtgggcgt

SEQ ID NO: 370478 - DNA, 20 bp, human
ggatccctgcctcggaaacc

SEQ ID NO: 370479 - DNA, 20 bp, human
ggggtcccacgcccacatct

SEQ ID NO: 370480 - DNA, 20 bp, human
ggcagggatccagcagtctc

SEQ ID NO: 370481 - DNA, 20 bp, human
gaggggacccacagcgggac

SEQ ID NO: 370482 - DNA, 20 bp, human
gccggggcctgtcccgctgt

SEQ ID NO: 370483 - DNA, 20 bp, human
gaggccccggcgtgtagcac

SEQ ID NO: 370484 - DNA, 20 bp, human
gtgtgggtcccctgcgggag

SEQ ID NO: 370485 - DNA, 20 bp, human
gcggggccccacacaggccg

SEQ ID NO: 370486 - DNA, 20 bp, human
gcggagcccctggtgacctc

SEQ ID NO: 370487 - DNA, 20 bp, human
gtcccgcggctgtgacctca

SEQ ID NO: 370488 - DNA, 20 bp, human
gtcaacgctgcggaggcgga

SEQ ID NO: 370489 - DNA, 20 bp, human
gcgcggctgtgacctcaagg

SEQ ID NO: 370490 - DNA, 20 bp, human
gagagggggcggaatcgggg

SEQ ID NO: 370491 - DNA, 20 bp, human
gggggtggggactctccctg

SEQ ID NO: 370492 - DNA, 20 bp, human
gcccgcagcccgtgcgcccg

SEQ ID NO: 370493 - DNA, 20 bp, human
ggcagagcatggggaatcga

SEQ ID NO: 370494 - DNA, 20 bp, human
gcagggagagggggcggaat

SEQ ID NO: 370495 - DNA, 20 bp, human
ggcggctgtcaacgctgcgg

SEQ ID NO: 370496 - DNA, 20 bp, human
gggcccccgcacgctaggtg

SEQ ID NO: 370497 - DNA, 20 bp, human
ggagcgacgcgcagtgtttg

SEQ ID NO: 370498 - DNA, 20 bp, human
gccgcgcgctaggaccctgg

SEQ ID NO: 370499 - DNA, 20 bp, human
gtcacctgcagcggccgctc

SEQ ID NO: 370500 - DNA, 20 bp, human
gggagggccgcccacgacgg

SEQ ID NO: 370501 - DNA, 20 bp, human
gcacggctgcggccttgcca

SEQ ID NO: 370502 - DNA, 20 bp, human
gcgaccgccggggacgagct

SEQ ID NO: 370503 - DNA, 20 bp, human
gctcctgcgagcggcggagg

SEQ ID NO: 370504 - DNA, 20 bp, human
gcggccgagagcgggtagcg

SEQ ID NO: 370505 - DNA, 20 bp, human
ggcggcgcctgcagtccacg

SEQ ID NO: 370506 - DNA, 20 bp, human
ggccccgcccgcaggttcct

SEQ ID NO: 370507 - DNA, 20 bp, human
gaaactccgccggtctctgg

SEQ ID NO: 370508 - DNA, 20 bp, human
gaggggaggacgcccccaat

SEQ ID NO: 370509 - DNA, 20 bp, human
gaggctgtgcgaaactccgc

SEQ ID NO: 370510 - DNA, 20 bp, human
ggcgaaactccgccggtctc

SEQ ID NO: 370511 - DNA, 20 bp, human
gccccaatgggcagactcct

SEQ ID NO: 370512 - DNA, 20 bp, human
ggggtcagaggaatgaagcg

SEQ ID NO: 370513 - DNA, 20 bp, human
ggcggggtccgggtcaccat

SEQ ID NO: 370514 - DNA, 20 bp, human
gggtcttgaaggagagaccc

SEQ ID NO: 370515 - DNA, 20 bp, human
gcacatcccccagagaccgg

SEQ ID NO: 370516 - DNA, 20 bp, human
gctggggagaaagtaccttg

SEQ ID NO: 370517 - DNA, 20 bp, human
ggcggggaagagaaatggcg

SEQ ID NO: 370518 - DNA, 20 bp, human
gagaaagtaccttggggcgc

SEQ ID NO: 370519 - DNA, 20 bp, human
gtccctgcagcgtcaacgtc

SEQ ID NO: 370520 - DNA, 20 bp, human
gaggcgcgtgcgcaaagcga

SEQ ID NO: 370521 - DNA, 20 bp, human
ggcgcaaagcgaaggccggc

SEQ ID NO: 370522 - DNA, 20 bp, human
ggtggtgggcgcagccgcta

SEQ ID NO: 370523 - DNA, 20 bp, human
gaagtaccttggggcgccgg

SEQ ID NO: 370524 - DNA, 20 bp, human
ggcgtgcgcaaagcgaaggc

SEQ ID NO: 370525 - DNA, 20 bp, human
ggagcggcgctctaggagcc

SEQ ID NO: 370526 - DNA, 20 bp, human
gggagacagaagacggctgc

SEQ ID NO: 370527 - DNA, 20 bp, human
gcactgacatactggtgctt

SEQ ID NO: 370528 - DNA, 20 bp, human
gtccgactgatcacgtgcaa

SEQ ID NO: 370529 - DNA, 20 bp, human
gcaggcgaactgactcgctg

SEQ ID NO: 370530 - DNA, 20 bp, human
gattccgactcgtgtatcag

SEQ ID NO: 370531 - DNA, 20 bp, human
gtggacgtctaattgctcaa

SEQ ID NO: 370532 - DNA, 20 bp, human
ggtcagtgtttggcctagga

SEQ ID NO: 370533 - DNA, 20 bp, human
gatcgctaaacagcagctga

SEQ ID NO: 370534 - DNA, 20 bp, human
gatgtcaaacactgacatac

SEQ ID NO: 370535 - DNA, 20 bp, human
gacgtccaggcatccgcagc

SEQ ID NO: 370536 - DNA, 20 bp, human
gcagactgaggaatgtgaga

SEQ ID NO: 370537 - DNA, 20 bp, human
ggcccagcagggtatgatct

SEQ ID NO: 370538 - DNA, 20 bp, human
ggggcaaacaacagaattgc

SEQ ID NO: 370539 - DNA, 20 bp, human
ggtattggcaagccccggaa

SEQ ID NO: 370540 - DNA, 20 bp, human
gaattgccggtcagcacatc

SEQ ID NO: 370541 - DNA, 20 bp, human
gatgtgagagggcttctagg

SEQ ID NO: 370542 - DNA, 20 bp, human
gttggcaagccccggaaagg

SEQ ID NO: 370543 - DNA, 20 bp, human
ggctggaggaaggtacttgg

SEQ ID NO: 370544 - DNA, 20 bp, human
gttgtttgcccctccctctt

SEQ ID NO: 370545 - DNA, 20 bp, human
gggcataccggacccttaag

SEQ ID NO: 370546 - DNA, 20 bp, human
gggctcaaatgtcagccggg

SEQ ID NO: 370547 - DNA, 20 bp, human
ggtcagccgggaggtggcta

SEQ ID NO: 370548 - DNA, 20 bp, human
gtccgaaaggcttgaccgtg

SEQ ID NO: 370549 - DNA, 20 bp, human
gatcttctggaagattagga

SEQ ID NO: 370550 - DNA, 20 bp, human
ggtaccatgcctctcagcag

SEQ ID NO: 370551 - DNA, 20 bp, human
gcagtagagcagagtgggca

SEQ ID NO: 370552 - DNA, 20 bp, human
gacaggctggtgaggttcca

SEQ ID NO: 370553 - DNA, 20 bp, human
gtacgctggctgcctccgaa

SEQ ID NO: 370554 - DNA, 20 bp, human
gtccgcacggtcaagccttt

SEQ ID NO: 370555 - DNA, 20 bp, human
ggcaggctcaaatgtcagcc

SEQ ID NO: 370556 - DNA, 20 bp, human
gacttcagggaaacaatctg

SEQ ID NO: 370557 - DNA, 20 bp, human
gtctgttggcagtaaaagaa

SEQ ID NO: 370558 - DNA, 20 bp, human
ggaaacaacaaatattgaac

SEQ ID NO: 370559 - DNA, 20 bp, human
gtggcccattaaaattactc

SEQ ID NO: 370560 - DNA, 20 bp, human
gatgctcttcaaacaaagat

SEQ ID NO: 370561 - DNA, 20 bp, human
gtactcgggatagaaaaagt

SEQ ID NO: 370562 - DNA, 20 bp, human
gtattgcaaaagatttctgt

SEQ ID NO: 370563 - DNA, 20 bp, human
gtatcccgagtaattttaat

SEQ ID NO: 370564 - DNA, 20 bp, human
ggtctttttccgcatttttt

SEQ ID NO: 370565 - DNA, 20 bp, human
gttggaaataaaataacttc

SEQ ID NO: 370566 - DNA, 20 bp, human
ggaaacagcaaatgttgaac

SEQ ID NO: 370567 - DNA, 20 bp, human
ggccccagattgtttttctg

SEQ ID NO: 370568 - DNA, 20 bp, human
gtcacctcagaaaaacaatc

SEQ ID NO: 370569 - DNA, 20 bp, human
ggttgatgctcttcaaagat

SEQ ID NO: 370570 - DNA, 20 bp, human
gtgcacgcaggtacgatgca

SEQ ID NO: 370571 - DNA, 20 bp, human
gcaatttggcagtctttttc

SEQ ID NO: 370572 - DNA, 20 bp, human
gaacatgatcaggagaacct

SEQ ID NO: 370573 - DNA, 20 bp, human
ggatggcccattaaatcact

SEQ ID NO: 370574 - DNA, 20 bp, human
gtagctcttatatattgtaa

SEQ ID NO: 370575 - DNA, 20 bp, human
gtctgttccaagtgatttaa

SEQ ID NO: 370576 - DNA, 20 bp, human
gagccccgaacttggagcgc

SEQ ID NO: 370577 - DNA, 20 bp, human
gacccggcgctccaagttcg

SEQ ID NO: 370578 - DNA, 20 bp, human
gtgtgaggcctcgctaatgg

SEQ ID NO: 370579 - DNA, 20 bp, human
gtcgctaatggtggaaacgt

SEQ ID NO: 370580 - DNA, 20 bp, human
gggtgtgtggggaggcgtaa

SEQ ID NO: 370581 - DNA, 20 bp, human
gccccggcgtgcgtcaccaa

SEQ ID NO: 370582 - DNA, 20 bp, human
ggccgctcccgccatccgtt

SEQ ID NO: 370583 - DNA, 20 bp, human
ggggtgtgaggcctcgctaa

SEQ ID NO: 370584 - DNA, 20 bp, human
gacttggagcgccgggtgtg

SEQ ID NO: 370585 - DNA, 20 bp, human
gtaaacctaaggtgacctaa

SEQ ID NO: 370586 - DNA, 20 bp, human
gggtctcaggaacaaagagg

SEQ ID NO: 370587 - DNA, 20 bp, human
ggtgggaggtacccaatcga

SEQ ID NO: 370588 - DNA, 20 bp, human
ggccagggaggtcggaaatt

SEQ ID NO: 370589 - DNA, 20 bp, human
gtcccaatggggcacgagag

SEQ ID NO: 370590 - DNA, 20 bp, human
ggggcggggccttcctctcg

SEQ ID NO: 370591 - DNA, 20 bp, human
gcgccagccaaccctcgatt

SEQ ID NO: 370592 - DNA, 20 bp, human
gctccctggcccgcgagggg

SEQ ID NO: 370593 - DNA, 20 bp, human
ggtcggaaattgggagtctt

SEQ ID NO: 370594 - DNA, 20 bp, human
ggagaaaggggtggagtcga

SEQ ID NO: 370595 - DNA, 20 bp, human
gcgactcgctaaagccaccg

SEQ ID NO: 370596 - DNA, 20 bp, human
gacatggggcccaatcacga

SEQ ID NO: 370597 - DNA, 20 bp, human
gccccaaagctgggatggtt

SEQ ID NO: 370598 - DNA, 20 bp, human
ggaagtccgtggttcagtct

SEQ ID NO: 370599 - DNA, 20 bp, human
gaaagccagaacctaccgag

SEQ ID NO: 370600 - DNA, 20 bp, human
gtgcttccccaaagctggga

SEQ ID NO: 370601 - DNA, 20 bp, human
gccaggccagagctctctga

SEQ ID NO: 370602 - DNA, 20 bp, human
ggaacctaccgaggggcatc

SEQ ID NO: 370603 - DNA, 20 bp, human
gttggctcctacttggacat

SEQ ID NO: 370604 - DNA, 20 bp, human
gttgggccccatgtccaagt

SEQ ID NO: 370605 - DNA, 20 bp, human
gaggagccaagactgaacca

SEQ ID NO: 370606 - DNA, 20 bp, human
gctaacggaggccccttggt

SEQ ID NO: 370607 - DNA, 20 bp, human
gatacagagtaggactggga

SEQ ID NO: 370608 - DNA, 20 bp, human
gcgtagtcgcagagtcaggg

SEQ ID NO: 370609 - DNA, 20 bp, human
ggcgcgtagtcgcagagtca

SEQ ID NO: 370610 - DNA, 20 bp, human
gcctccctatgcagcggcca

SEQ ID NO: 370611 - DNA, 20 bp, human
gggtgtcccggagtcgtccc

SEQ ID NO: 370612 - DNA, 20 bp, human
gaaggcccaggttcctccgg

SEQ ID NO: 370613 - DNA, 20 bp, human
gcggcgggcccacccgaaga

SEQ ID NO: 370614 - DNA, 20 bp, human
gccgctcctccggggtcgca

SEQ ID NO: 370615 - DNA, 20 bp, human
gctcagttaagagccgggga

SEQ ID NO: 370616 - DNA, 20 bp, human
ggtaggggcggagccctcag

SEQ ID NO: 370617 - DNA, 20 bp, human
gtaggggcgaggttcgcgta

SEQ ID NO: 370618 - DNA, 20 bp, human
gtgaacgaagagtaggggcg

SEQ ID NO: 370619 - DNA, 20 bp, human
gtgtccgccggaggtgtcgt

SEQ ID NO: 370620 - DNA, 20 bp, human
gaacacaccaacgacacctc

SEQ ID NO: 370621 - DNA, 20 bp, human
gggcgaggttcgcgtagggg

SEQ ID NO: 370622 - DNA, 20 bp, human
gatagagtgaacgaagagta

SEQ ID NO: 370623 - DNA, 20 bp, human
gagccagacgccgacccaag

SEQ ID NO: 370624 - DNA, 20 bp, human
gcagagaaatacgcatcagg

SEQ ID NO: 370625 - DNA, 20 bp, human
gcgccctctgacagcccctg

SEQ ID NO: 370626 - DNA, 20 bp, human
gttagtgcgccttccgggat

SEQ ID NO: 370627 - DNA, 20 bp, human
ggaaatgctccaatcccgga

SEQ ID NO: 370628 - DNA, 20 bp, human
gcaattcccagcgatcttta

SEQ ID NO: 370629 - DNA, 20 bp, human
gccccggcgctaaggacagt

SEQ ID NO: 370630 - DNA, 20 bp, human
gtacccgcagccacttccgc

SEQ ID NO: 370631 - DNA, 20 bp, human
ggggattggagcatttccgg

SEQ ID NO: 370632 - DNA, 20 bp, human
gaggaaccggaaacgggatg

SEQ ID NO: 370633 - DNA, 20 bp, human
gctaatttagtgcgccttcc

SEQ ID NO: 370634 - DNA, 20 bp, human
gagcgccgggggttgggttt

SEQ ID NO: 370635 - DNA, 20 bp, human
gtggaagggcgatgcccttt

SEQ ID NO: 370636 - DNA, 20 bp, human
gcacccaccgaccacaggaa

SEQ ID NO: 370637 - DNA, 20 bp, human
ggcgcccgaggcaggcgtgc

SEQ ID NO: 370638 - DNA, 20 bp, human
gccgccccagcgtacgtggc

SEQ ID NO: 370639 - DNA, 20 bp, human
gtcgcccgcacgcctgcctc

SEQ ID NO: 370640 - DNA, 20 bp, human
gcctcccacccaccgaccac

SEQ ID NO: 370641 - DNA, 20 bp, human
ggcgcggggcccggatcccg

SEQ ID NO: 370642 - DNA, 20 bp, human
gggtgaagaccccaacccgc

SEQ ID NO: 370643 - DNA, 20 bp, human
ggggcccggatcccgcgggt

SEQ ID NO: 370644 - DNA, 20 bp, human
ggcccccgccacgtacgctg

SEQ ID NO: 370645 - DNA, 20 bp, human
gcgccccgccccagcgtacg

SEQ ID NO: 370646 - DNA, 20 bp, human
gtgactgccggtgcccgcca

SEQ ID NO: 370647 - DNA, 20 bp, human
gccctcccagcgttccgcgt

SEQ ID NO: 370648 - DNA, 20 bp, human
ggggcgcgcgcagggtgccc

SEQ ID NO: 370649 - DNA, 20 bp, human
ggcagggagcaaagcggcgg

SEQ ID NO: 370650 - DNA, 20 bp, human
gtcacaccctccctgactgc

SEQ ID NO: 370651 - DNA, 20 bp, human
gcaggcagggagcaaagcgg

SEQ ID NO: 370652 - DNA, 20 bp, human
gtcccggcaggcagcggact

SEQ ID NO: 370653 - DNA, 20 bp, human
gcggagccgacgagtggcgg

SEQ ID NO: 370654 - DNA, 20 bp, human
ggcggcagctctgtggcacc

SEQ ID NO: 370655 - DNA, 20 bp, human
ggcagctctgtggcacctgg

SEQ ID NO: 370656 - DNA, 20 bp, human
gacaagagaacaagtgaact

SEQ ID NO: 370657 - DNA, 20 bp, human
ggctgagagcgagtagggaa

SEQ ID NO: 370658 - DNA, 20 bp, human
gcagtagctgagagcgagta

SEQ ID NO: 370659 - DNA, 20 bp, human
gcagaacagaaaatgaccat

SEQ ID NO: 370660 - DNA, 20 bp, human
gctccaggaaaagtagcaga

SEQ ID NO: 370661 - DNA, 20 bp, human
gcatgggttaatatggcata

SEQ ID NO: 370662 - DNA, 20 bp, human
gactccaactaaagccgaac

SEQ ID NO: 370663 - DNA, 20 bp, human
ggaacctctcaaaacttttc

SEQ ID NO: 370664 - DNA, 20 bp, human
ggaactgcaacaatcctgtt

SEQ ID NO: 370665 - DNA, 20 bp, human
gagttggagtagggaacatt

SEQ ID NO: 370666 - DNA, 20 bp, human
ggggctgcggctctttgtcg

SEQ ID NO: 370667 - DNA, 20 bp, human
gtcgcgcgcccccgcgggga

SEQ ID NO: 370668 - DNA, 20 bp, human
gggctccccgctccccggaa

SEQ ID NO: 370669 - DNA, 20 bp, human
gctccgggccgtttccggtg

SEQ ID NO: 370670 - DNA, 20 bp, human
ggcggggccgccctcccttc

SEQ ID NO: 370671 - DNA, 20 bp, human
gagcccctgtggcttctgcg

SEQ ID NO: 370672 - DNA, 20 bp, human
ggggccaggctgactgtcta

SEQ ID NO: 370673 - DNA, 20 bp, human
gcgggacgcgccctcctcct

SEQ ID NO: 370674 - DNA, 20 bp, human
ggctcccggcgagctgttat

SEQ ID NO: 370675 - DNA, 20 bp, human
ggcgcgctccgggccgtttc

SEQ ID NO: 370676 - DNA, 20 bp, human
gggacctgaaggtggtcgta

SEQ ID NO: 370677 - DNA, 20 bp, human
gcagatggagtctggaggga

SEQ ID NO: 370678 - DNA, 20 bp, human
gagcatgcgcagatggagtc

SEQ ID NO: 370679 - DNA, 20 bp, human
gcacacgtacgcccgagggg

SEQ ID NO: 370680 - DNA, 20 bp, human
gactgcgcagaagacaggcg

SEQ ID NO: 370681 - DNA, 20 bp, human
gcgcgcacacgtacgcccga

SEQ ID NO: 370682 - DNA, 20 bp, human
ggagccttacgaccaccttc

SEQ ID NO: 370683 - DNA, 20 bp, human
ggtcttctgcgcagtcgcca

SEQ ID NO: 370684 - DNA, 20 bp, human
gatgcgcagatggagtctgg

SEQ ID NO: 370685 - DNA, 20 bp, human
gggtcgtaaggctccgcgtg

SEQ ID NO: 370686 - DNA, 20 bp, human
ggcggtgcgcgcaacttctc

SEQ ID NO: 370687 - DNA, 20 bp, human
gcgcgcctcggccaatgcgg

SEQ ID NO: 370688 - DNA, 20 bp, human
gtgagccgcgcgcacgtcgg

SEQ ID NO: 370689 - DNA, 20 bp, human
gcccgcccccgacgtgcgcg

SEQ ID NO: 370690 - DNA, 20 bp, human
gctcgcttgggaccatgggt

SEQ ID NO: 370691 - DNA, 20 bp, human
gcccgcgccaggcctcgctt

SEQ ID NO: 370692 - DNA, 20 bp, human
ggccgcgcgcacgtcggggg

SEQ ID NO: 370693 - DNA, 20 bp, human
gcgctacgcagccgccgcat

SEQ ID NO: 370694 - DNA, 20 bp, human
gccctgagccgcgcgcacgt

SEQ ID NO: 370695 - DNA, 20 bp, human
gtgcgcagcgcgcgggaccc

SEQ ID NO: 370696 - DNA, 20 bp, human
gaaccccgcctcgacctgag

SEQ ID NO: 370697 - DNA, 20 bp, human
ggcctcaggggcactctcgc

SEQ ID NO: 370698 - DNA, 20 bp, human
gcacacagactctgatacag

SEQ ID NO: 370699 - DNA, 20 bp, human
ggttaagggtcataaggcgg

SEQ ID NO: 370700 - DNA, 20 bp, human
gaacctaaattcagacttgg

SEQ ID NO: 370701 - DNA, 20 bp, human
gcaggtcgaggcggggttaa

SEQ ID NO: 370702 - DNA, 20 bp, human
gtcaggggcactctcgccgg

SEQ ID NO: 370703 - DNA, 20 bp, human
gggtgtggcctctcaggtcg

SEQ ID NO: 370704 - DNA, 20 bp, human
gcctgaggctgcgaggtttt

SEQ ID NO: 370705 - DNA, 20 bp, human
gggcggggttaagggtcata

SEQ ID NO: 370706 - DNA, 20 bp, human
gcggggactcctccgaggcg

SEQ ID NO: 370707 - DNA, 20 bp, human
gtggcgcggaggtgacaaag

SEQ ID NO: 370708 - DNA, 20 bp, human
gtcacctccgcgccaatcgg

SEQ ID NO: 370709 - DNA, 20 bp, human
gctgctcggggagtggcctt

SEQ ID NO: 370710 - DNA, 20 bp, human
ggcgccagcgaaccccgcct

SEQ ID NO: 370711 - DNA, 20 bp, human
gcgcgtggcggtgagagccc

SEQ ID NO: 370712 - DNA, 20 bp, human
gctcggggagtggccttcgg

SEQ ID NO: 370713 - DNA, 20 bp, human
gacccccccggagtacttaa

SEQ ID NO: 370714 - DNA, 20 bp, human
gtggcggtgagagcccgggc

SEQ ID NO: 370715 - DNA, 20 bp, human
ggcgcagcgcgggtcgtccc

SEQ ID NO: 370716 - DNA, 20 bp, human
gcccagagagcgtggatcgc

SEQ ID NO: 370717 - DNA, 20 bp, human
gagagcgtggatcgcgggcg

SEQ ID NO: 370718 - DNA, 20 bp, human
gcccgcctggcttccagatg

SEQ ID NO: 370719 - DNA, 20 bp, human
gtgttcacagctgtcccaga

SEQ ID NO: 370720 - DNA, 20 bp, human
ggggcggggctcaccgagcg

SEQ ID NO: 370721 - DNA, 20 bp, human
gtcacagctgtcccagaggg

SEQ ID NO: 370722 - DNA, 20 bp, human
gcggggacacagtgtccgcc

SEQ ID NO: 370723 - DNA, 20 bp, human
gacgctctctgggagctagg

SEQ ID NO: 370724 - DNA, 20 bp, human
gtggtgcagcgccagcgcgc

SEQ ID NO: 370725 - DNA, 20 bp, human
gacactgtgtccccgcgcgc

SEQ ID NO: 370726 - DNA, 20 bp, human
ggggtcggtgtgtgactcgg

SEQ ID NO: 370727 - DNA, 20 bp, human
gccgcccgcgcacctgtcct

SEQ ID NO: 370728 - DNA, 20 bp, human
gacgccagagaattcccgtg

SEQ ID NO: 370729 - DNA, 20 bp, human
gccgacgcttccacattctg

SEQ ID NO: 370730 - DNA, 20 bp, human
gagtgggtggccaggcccga

SEQ ID NO: 370731 - DNA, 20 bp, human
ggccgccggtgtcctcccca

SEQ ID NO: 370732 - DNA, 20 bp, human
ggccacgggggcggaactga

SEQ ID NO: 370733 - DNA, 20 bp, human
gccagagaattcccgtgggg

SEQ ID NO: 370734 - DNA, 20 bp, human
gcccactcgccgtgagtgaa

SEQ ID NO: 370735 - DNA, 20 bp, human
gggtctcgggcaacacgccc

SEQ ID NO: 370736 - DNA, 20 bp, human
gccacgcagacggagagtct

SEQ ID NO: 370737 - DNA, 20 bp, human
gaaacccccagcaccgtgat

SEQ ID NO: 370738 - DNA, 20 bp, human
gggcaggactgaaatctatc

SEQ ID NO: 370739 - DNA, 20 bp, human
gtgaaaggcgatgaagagca

SEQ ID NO: 370740 - DNA, 20 bp, human
gtgggaattcactagttaac

SEQ ID NO: 370741 - DNA, 20 bp, human
gacacctcccagcttcgggc

SEQ ID NO: 370742 - DNA, 20 bp, human
gcggcgaacgggaagtgagc

SEQ ID NO: 370743 - DNA, 20 bp, human
gtgattggctccagctgcag

SEQ ID NO: 370744 - DNA, 20 bp, human
gactctccgtctgcgtggca

SEQ ID NO: 370745 - DNA, 20 bp, human
ggcgcgcgcaggcgcgacta

SEQ ID NO: 370746 - DNA, 20 bp, human
ggactcggttcccagtgcgc

SEQ ID NO: 370747 - DNA, 20 bp, human
gggctgcggcgcgcttgact

SEQ ID NO: 370748 - DNA, 20 bp, human
gtgaagacgaaacctcgggg

SEQ ID NO: 370749 - DNA, 20 bp, human
gggacggccatctttgatga

SEQ ID NO: 370750 - DNA, 20 bp, human
gaggggtaaaaggtagtgat

SEQ ID NO: 370751 - DNA, 20 bp, human
ggctctgccctcatcaaaga

SEQ ID NO: 370752 - DNA, 20 bp, human
gatagaaggtgaaaacacgc

SEQ ID NO: 370753 - DNA, 20 bp, human
ggtggacggggatgccccta

SEQ ID NO: 370754 - DNA, 20 bp, human
gccgtgcgggtgtttataga

SEQ ID NO: 370755 - DNA, 20 bp, human
gtttaatagccgcccagcga

SEQ ID NO: 370756 - DNA, 20 bp, human
ggggcgggcccaccgctgca

SEQ ID NO: 370757 - DNA, 20 bp, human
gcaactgagaggtcacgtgg

SEQ ID NO: 370758 - DNA, 20 bp, human
gcagttgctgacactagata

SEQ ID NO: 370759 - DNA, 20 bp, human
gagccgacctgcgcgatggt

SEQ ID NO: 370760 - DNA, 20 bp, human
gggggatggacagtaggctg

SEQ ID NO: 370761 - DNA, 20 bp, human
gcccgcgagcgcccgacctc

SEQ ID NO: 370762 - DNA, 20 bp, human
ggctgacactagatagggcg

SEQ ID NO: 370763 - DNA, 20 bp, human
gtcggagccgaccatcgcgc

SEQ ID NO: 370764 - DNA, 20 bp, human
ggcggctcgtgaggtgatgg

SEQ ID NO: 370765 - DNA, 20 bp, human
gactagatagggcgtggctg

SEQ ID NO: 370766 - DNA, 20 bp, human
gcgctggcggggcagaaacg

SEQ ID NO: 370767 - DNA, 20 bp, human
gacttccgccggagcggaaa

SEQ ID NO: 370768 - DNA, 20 bp, human
ggagccgcgcgcatgcgtgc

SEQ ID NO: 370769 - DNA, 20 bp, human
gcctgcgtcttctggttccg

SEQ ID NO: 370770 - DNA, 20 bp, human
gaaacggtgaggaccagcct

SEQ ID NO: 370771 - DNA, 20 bp, human
gtagagaggggcaccaggga

SEQ ID NO: 370772 - DNA, 20 bp, human
gcggaagtggctgtcggcga

SEQ ID NO: 370773 - DNA, 20 bp, human
gacaaagtcggcgtaggaga

SEQ ID NO: 370774 - DNA, 20 bp, human
ggtcctcaccgtttccgctc

SEQ ID NO: 370775 - DNA, 20 bp, human
gcgccggagcggaaacggtg

SEQ ID NO: 370776 - DNA, 20 bp, human
ggaagccccagggtcgtcct

SEQ ID NO: 370777 - DNA, 20 bp, human
ggcgggaggctggatcgaga

SEQ ID NO: 370778 - DNA, 20 bp, human
gggggcccaggacgaccctg

SEQ ID NO: 370779 - DNA, 20 bp, human
gggcggggagaggacgggat

SEQ ID NO: 370780 - DNA, 20 bp, human
ggaggaaggaggcgggaccg

SEQ ID NO: 370781 - DNA, 20 bp, human
ggtagggaagggttgttact

SEQ ID NO: 370782 - DNA, 20 bp, human
gcccgctgcccggaacacaa

SEQ ID NO: 370783 - DNA, 20 bp, human
ggctgggagaacaaggacct

SEQ ID NO: 370784 - DNA, 20 bp, human
gcggaacacaagggtaggga

SEQ ID NO: 370785 - DNA, 20 bp, human
gctgcccggaacacaagggt

SEQ ID NO: 370786 - DNA, 20 bp, human
gccaacgcccccaacgccca

SEQ ID NO: 370787 - DNA, 20 bp, human
gtgacacgcccgcctgtcaa

SEQ ID NO: 370788 - DNA, 20 bp, human
gcaagccggcggggagaaga

SEQ ID NO: 370789 - DNA, 20 bp, human
ggccgggagcttaaaggcga

SEQ ID NO: 370790 - DNA, 20 bp, human
gcatccccggcaagccggcg

SEQ ID NO: 370791 - DNA, 20 bp, human
gccgcgaggcgctccgccga

SEQ ID NO: 370792 - DNA, 20 bp, human
gcacacctgcccgccgactg

SEQ ID NO: 370793 - DNA, 20 bp, human
gttggccaagacgggcgagt

SEQ ID NO: 370794 - DNA, 20 bp, human
gccgacgagtcaggtgacgg

SEQ ID NO: 370795 - DNA, 20 bp, human
gaacccggacgagccctcgg

SEQ ID NO: 370796 - DNA, 20 bp, human
ggcagtaagcacacgaccgg

SEQ ID NO: 370797 - DNA, 20 bp, human
ggtggcaagagcccggataa

SEQ ID NO: 370798 - DNA, 20 bp, human
gaaggcggagctaaaggtgc

SEQ ID NO: 370799 - DNA, 20 bp, human
ggcaagagcccggataaagg

SEQ ID NO: 370800 - DNA, 20 bp, human
gcgtgtgcgcacgccgtagg

SEQ ID NO: 370801 - DNA, 20 bp, human
gcgcgcagtaagcacacgac

SEQ ID NO: 370802 - DNA, 20 bp, human
gtaaaggagagtgctagtaa

SEQ ID NO: 370803 - DNA, 20 bp, human
gagggtggatctcagcactc

SEQ ID NO: 370804 - DNA, 20 bp, human
gaagcgttctgatgttttac

SEQ ID NO: 370805 - DNA, 20 bp, human
gcggataaaggcggagctaa

SEQ ID NO: 370806 - DNA, 20 bp, human
gcggccccggcgcgctatct

SEQ ID NO: 370807 - DNA, 20 bp, human
gccgccccaatggaagtgaa

SEQ ID NO: 370808 - DNA, 20 bp, human
ggggagatcggcaccggaac

SEQ ID NO: 370809 - DNA, 20 bp, human
ggtgaaggggagatcggcac

SEQ ID NO: 370810 - DNA, 20 bp, human
gagggagggcatgggatcca

SEQ ID NO: 370811 - DNA, 20 bp, human
gcggcaccggaactggggcg

SEQ ID NO: 370812 - DNA, 20 bp, human
ggcccggggaaccgccccaa

SEQ ID NO: 370813 - DNA, 20 bp, human
gctccccttcacttccattg

SEQ ID NO: 370814 - DNA, 20 bp, human
ggtcagaaagaaccgcgcgg

SEQ ID NO: 370815 - DNA, 20 bp, human
ggggcggggcataagtgaag

SEQ ID NO: 370816 - DNA, 20 bp, human
gggaaggagtggggcgaaca

SEQ ID NO: 370817 - DNA, 20 bp, human
ggttcccgcaccgcccgggt

SEQ ID NO: 370818 - DNA, 20 bp, human
gctcgcggtgccgcgccctg

SEQ ID NO: 370819 - DNA, 20 bp, human
gaaccgcagcgggtggggct

SEQ ID NO: 370820 - DNA, 20 bp, human
gctggcgaggccgccctacc

SEQ ID NO: 370821 - DNA, 20 bp, human
gccgcgaggctctacgtgca

SEQ ID NO: 370822 - DNA, 20 bp, human
ggaggtggccctacgtgtag

SEQ ID NO: 370823 - DNA, 20 bp, human
gcaactgtctctgcccggta

SEQ ID NO: 370824 - DNA, 20 bp, human
gaacggttcccgcaccgccc

SEQ ID NO: 370825 - DNA, 20 bp, human
gcatgggcaggcccgcccca

SEQ ID NO: 370826 - DNA, 20 bp, human
gtctcagagcccaccctcga

SEQ ID NO: 370827 - DNA, 20 bp, human
gcaccctcgaaggtactgag

SEQ ID NO: 370828 - DNA, 20 bp, human
gctcgaaggtactgagaggg

SEQ ID NO: 370829 - DNA, 20 bp, human
gccagggtggccaggagcgc

SEQ ID NO: 370830 - DNA, 20 bp, human
gcgcgcccgcaacaggaggt

SEQ ID NO: 370831 - DNA, 20 bp, human
ggaaccgcgcccgcaacagg

SEQ ID NO: 370832 - DNA, 20 bp, human
gcccgcaacaggaggtaggc

SEQ ID NO: 370833 - DNA, 20 bp, human
gagggtggtgcggacgcctt

SEQ ID NO: 370834 - DNA, 20 bp, human
gacgccttggggggccaggg

SEQ ID NO: 370835 - DNA, 20 bp, human
gcggacgccttggggggcca

SEQ ID NO: 370836 - DNA, 20 bp, human
gtagcctggccactccgcgg

SEQ ID NO: 370837 - DNA, 20 bp, human
gtgcccgacacattgaggaa

SEQ ID NO: 370838 - DNA, 20 bp, human
gcgtcccccgcggagtggcc

SEQ ID NO: 370839 - DNA, 20 bp, human
gccgtagcctggccactccg

SEQ ID NO: 370840 - DNA, 20 bp, human
ggactcccggaaaccgagcg

SEQ ID NO: 370841 - DNA, 20 bp, human
gctacggcgggcgccggaag

SEQ ID NO: 370842 - DNA, 20 bp, human
gcagctcgtcccccgcggag

SEQ ID NO: 370843 - DNA, 20 bp, human
gaatcaaggtgttttgacac

SEQ ID NO: 370844 - DNA, 20 bp, human
gggggctgcccgacacattg

SEQ ID NO: 370845 - DNA, 20 bp, human
gcgaggagtgcgcccccttc

SEQ ID NO: 370846 - DNA, 20 bp, human
ggagtctagcgcgaaccggg

SEQ ID NO: 370847 - DNA, 20 bp, human
gcacaaggcctctactccta

SEQ ID NO: 370848 - DNA, 20 bp, human
gcaccggggtttctgggaaa

SEQ ID NO: 370849 - DNA, 20 bp, human
ggcactgccccgccccgtga

SEQ ID NO: 370850 - DNA, 20 bp, human
gcccagaaaccccggtgtct

SEQ ID NO: 370851 - DNA, 20 bp, human
gcgggcgccccctcacgggg

SEQ ID NO: 370852 - DNA, 20 bp, human
ggcgcggctccggttcccgg

SEQ ID NO: 370853 - DNA, 20 bp, human
gatggagtctagcgcgaacc

SEQ ID NO: 370854 - DNA, 20 bp, human
gtgtctccaccaagacaccg

SEQ ID NO: 370855 - DNA, 20 bp, human
gggtggagacagcatttccc

SEQ ID NO: 370856 - DNA, 20 bp, human
gaccagaaggggcccaagag

SEQ ID NO: 370857 - DNA, 20 bp, human
gggaaaggcggggacaagaa

SEQ ID NO: 370858 - DNA, 20 bp, human
ggggacgaggagcacgctgc

SEQ ID NO: 370859 - DNA, 20 bp, human
gaggacccagaggaaaggcg

SEQ ID NO: 370860 - DNA, 20 bp, human
ggctgacaaatcagcggtgg

SEQ ID NO: 370861 - DNA, 20 bp, human
gagaaggggcccaagagagg

SEQ ID NO: 370862 - DNA, 20 bp, human
gcccatccgagatagggacg

SEQ ID NO: 370863 - DNA, 20 bp, human
gcccatccccatccgagata

SEQ ID NO: 370864 - DNA, 20 bp, human
gaggacggcgacgaccagaa

SEQ ID NO: 370865 - DNA, 20 bp, human
gaaggcggggacaagaaggg

SEQ ID NO: 370866 - DNA, 20 bp, human
ggctccccgggccccccaac

SEQ ID NO: 370867 - DNA, 20 bp, human
ggggagggtcgctgtcagtc

SEQ ID NO: 370868 - DNA, 20 bp, human
gcgcccgcctacttcggctg

SEQ ID NO: 370869 - DNA, 20 bp, human
ggccaccactgccactgcgg

SEQ ID NO: 370870 - DNA, 20 bp, human
ggggacaaggaacgcagcgc

SEQ ID NO: 370871 - DNA, 20 bp, human
ggccccgctacgtcacaatg

SEQ ID NO: 370872 - DNA, 20 bp, human
gcccgcgcgcgcccgttggg

SEQ ID NO: 370873 - DNA, 20 bp, human
gggggcgcagcgcagcctga

SEQ ID NO: 370874 - DNA, 20 bp, human
ggggccgcattgtgacgtag

SEQ ID NO: 370875 - DNA, 20 bp, human
gcgcggcccgaagccggcgc

SEQ ID NO: 370876 - DNA, 20 bp, human
gcccgccccgggaggctcat

SEQ ID NO: 370877 - DNA, 20 bp, human
gttacggccggggcccccag

SEQ ID NO: 370878 - DNA, 20 bp, human
gaacgcggcgtgtgaagagt

SEQ ID NO: 370879 - DNA, 20 bp, human
ggcccgggacgcgcccctgg

SEQ ID NO: 370880 - DNA, 20 bp, human
gaagactcgcgtagtctgtt

SEQ ID NO: 370881 - DNA, 20 bp, human
gcgtagccgatgagcctccc

SEQ ID NO: 370882 - DNA, 20 bp, human
gtccccgccccctgtcagtc

SEQ ID NO: 370883 - DNA, 20 bp, human
gtacgcgagtcttacggccg

SEQ ID NO: 370884 - DNA, 20 bp, human
gcggcctgactgacaggggg

SEQ ID NO: 370885 - DNA, 20 bp, human
gccttcggcctgactgacag

SEQ ID NO: 370886 - DNA, 20 bp, human
gaaaccggttggaggatctg

SEQ ID NO: 370887 - DNA, 20 bp, human
gccagccctgcgtgcagtgg

SEQ ID NO: 370888 - DNA, 20 bp, human
gagggaggggatccgtgacc

SEQ ID NO: 370889 - DNA, 20 bp, human
gcaccctctccacacgggag

SEQ ID NO: 370890 - DNA, 20 bp, human
gcccgcccccactgcacgca

SEQ ID NO: 370891 - DNA, 20 bp, human
gtagccgctcccgtgtggag

SEQ ID NO: 370892 - DNA, 20 bp, human
gcctcaccttcctccaggat

SEQ ID NO: 370893 - DNA, 20 bp, human
ggggagggaacactgagcct

SEQ ID NO: 370894 - DNA, 20 bp, human
gcagggcagtaaatgaatga

SEQ ID NO: 370895 - DNA, 20 bp, human
gctctcctggcactctccag

SEQ ID NO: 370896 - DNA, 20 bp, human
ggctctgggcgctaattggg

SEQ ID NO: 370897 - DNA, 20 bp, human
gtaatgtcgggaggtgtagt

SEQ ID NO: 370898 - DNA, 20 bp, human
gctcttggtccccaaaacgg

SEQ ID NO: 370899 - DNA, 20 bp, human
gcagcggggaaggacgtcat

SEQ ID NO: 370900 - DNA, 20 bp, human
gaggcggggctccgcgagca

SEQ ID NO: 370901 - DNA, 20 bp, human
gcgcctcttggtccccaaaa

SEQ ID NO: 370902 - DNA, 20 bp, human
gcaaaacggtggtgagttcc

SEQ ID NO: 370903 - DNA, 20 bp, human
gtgcaaggatgggctaaata

SEQ ID NO: 370904 - DNA, 20 bp, human
gcgagtagaacgtgtggcgg

SEQ ID NO: 370905 - DNA, 20 bp, human
gcgccggccctcaggccaat

SEQ ID NO: 370906 - DNA, 20 bp, human
gggcccaggcgcctccacca

SEQ ID NO: 370907 - DNA, 20 bp, human
gaaggcgtgtcatcacgcgg

SEQ ID NO: 370908 - DNA, 20 bp, human
ggggcggggccatgcaaatc

SEQ ID NO: 370909 - DNA, 20 bp, human
gcagcccggcggtcactcgg

SEQ ID NO: 370910 - DNA, 20 bp, human
gagggcgggcccagcgtctc

SEQ ID NO: 370911 - DNA, 20 bp, human
ggagctcagtcccctggcgt

SEQ ID NO: 370912 - DNA, 20 bp, human
gttaaagcgccaggccccgt

SEQ ID NO: 370913 - DNA, 20 bp, human
gccgccctgggtccctaccc

SEQ ID NO: 370914 - DNA, 20 bp, human
gagcgccaggccccgtggga

SEQ ID NO: 370915 - DNA, 20 bp, human
gcgcggggagctcagtcccc

SEQ ID NO: 370916 - DNA, 20 bp, human
gcgaccccgcctttagctag

SEQ ID NO: 370917 - DNA, 20 bp, human
gtcgccgggccggtaggaac

SEQ ID NO: 370918 - DNA, 20 bp, human
gagcctcgcggcaggaaatg

SEQ ID NO: 370919 - DNA, 20 bp, human
gtcccagcactagccaagga

SEQ ID NO: 370920 - DNA, 20 bp, human
gccccaggcgcctacgtggg

SEQ ID NO: 370921 - DNA, 20 bp, human
gcatgtcccagcactagcca

SEQ ID NO: 370922 - DNA, 20 bp, human
gttggccactagctaaaggc

SEQ ID NO: 370923 - DNA, 20 bp, human
ggggccccaggcgcctacgt

SEQ ID NO: 370924 - DNA, 20 bp, human
gagctaaaggcggggtcgcc

SEQ ID NO: 370925 - DNA, 20 bp, human
gcggcaggaaatgcggctcg

SEQ ID NO: 370926 - DNA, 20 bp, human
gtggccgcagcgacaggctt

SEQ ID NO: 370927 - DNA, 20 bp, human
gtgggtgtggccgcagcgac

SEQ ID NO: 370928 - DNA, 20 bp, human
gagcctgggcaccccggaag

SEQ ID NO: 370929 - DNA, 20 bp, human
gccacccaagcctgtcgctg

SEQ ID NO: 370930 - DNA, 20 bp, human
gcacgtgactactccctagt

SEQ ID NO: 370931 - DNA, 20 bp, human
gaggctcccagaaatcctcg

SEQ ID NO: 370932 - DNA, 20 bp, human
gctttgccgcgaggatttct

SEQ ID NO: 370933 - DNA, 20 bp, human
gactcctggacttccgcttc

SEQ ID NO: 370934 - DNA, 20 bp, human
gggaaaaagcaaacctctca

SEQ ID NO: 370935 - DNA, 20 bp, human
gaaatgacgagtttaactcc

SEQ ID NO: 370936 - DNA, 20 bp, human
gggagcccgcgctgggacgg

SEQ ID NO: 370937 - DNA, 20 bp, human
ggggacggggcctcccagaa

SEQ ID NO: 370938 - DNA, 20 bp, human
ggcggagtcacgtgtgctcg

SEQ ID NO: 370939 - DNA, 20 bp, human
gagcacacgtgactccgccc

SEQ ID NO: 370940 - DNA, 20 bp, human
gagtcacgtgtgctcggggc

SEQ ID NO: 370941 - DNA, 20 bp, human
gaggaagggcgcctgtagtg

SEQ ID NO: 370942 - DNA, 20 bp, human
gtcccagcgcgggctcccat

SEQ ID NO: 370943 - DNA, 20 bp, human
gctcggggccggcaggcggt

SEQ ID NO: 370944 - DNA, 20 bp, human
gaaggcagcctgccggggtc

SEQ ID NO: 370945 - DNA, 20 bp, human
ggaaactgaggcacgctgca

SEQ ID NO: 370946 - DNA, 20 bp, human
gacaacgagcacacggggag

SEQ ID NO: 370947 - DNA, 20 bp, human
ggaggggaccagccagtcgg

SEQ ID NO: 370948 - DNA, 20 bp, human
gtggtggaaagcgtcttggt

SEQ ID NO: 370949 - DNA, 20 bp, human
gtcgccggcagctgcgtaag

SEQ ID NO: 370950 - DNA, 20 bp, human
gttgagctgggcgatcgatt

SEQ ID NO: 370951 - DNA, 20 bp, human
gctgccggcgagccgccgac

SEQ ID NO: 370952 - DNA, 20 bp, human
gaacagagacaacgagcaca

SEQ ID NO: 370953 - DNA, 20 bp, human
gacgagcacacggggagcgg

SEQ ID NO: 370954 - DNA, 20 bp, human
ggggccgcttacgcagctgc

SEQ ID NO: 370955 - DNA, 20 bp, human
gaaaataccggctggtgtgt

SEQ ID NO: 370956 - DNA, 20 bp, human
gagctgtcaggggaaatcgg

SEQ ID NO: 370957 - DNA, 20 bp, human
ggcaaggcgcccaaggagga

SEQ ID NO: 370958 - DNA, 20 bp, human
ggcggctggcgggacaaagc

SEQ ID NO: 370959 - DNA, 20 bp, human
ggcacctgcggccggcgcgc

SEQ ID NO: 370960 - DNA, 20 bp, human
ggcctcagccccgactcgcc

SEQ ID NO: 370961 - DNA, 20 bp, human
gttctgaccccggcgagtcg

SEQ ID NO: 370962 - DNA, 20 bp, human
gaggcgcccaaggaggatgg

SEQ ID NO: 370963 - DNA, 20 bp, human
gaaagcgggcaaggcgccca

SEQ ID NO: 370964 - DNA, 20 bp, human
gtcaggggaaatcggaggga

SEQ ID NO: 370965 - DNA, 20 bp, human
gtcactgtgacgtcagcgct

SEQ ID NO: 370966 - DNA, 20 bp, human
gaccagagtgcgggggtcta

SEQ ID NO: 370967 - DNA, 20 bp, human
gccttctgagcgggatatgt

SEQ ID NO: 370968 - DNA, 20 bp, human
gaagccgcgcgcacacggca

SEQ ID NO: 370969 - DNA, 20 bp, human
gtatcccgctcagaagggtg

SEQ ID NO: 370970 - DNA, 20 bp, human
ggggctggagactgaggtcg

SEQ ID NO: 370971 - DNA, 20 bp, human
gtgcgggggtctagggattc

SEQ ID NO: 370972 - DNA, 20 bp, human
gaggaaagacgcactgggga

SEQ ID NO: 370973 - DNA, 20 bp, human
ggccccgccccgcacttctg

SEQ ID NO: 370974 - DNA, 20 bp, human
gggccagaaccagagtgcgg

SEQ ID NO: 370975 - DNA, 20 bp, human
ggacccccgcactctggttc

SEQ ID NO: 370976 - DNA, 20 bp, human
gaatcgccctgtctattggt

SEQ ID NO: 370977 - DNA, 20 bp, human
gctcgagctcacattggtcc

SEQ ID NO: 370978 - DNA, 20 bp, human
gcagccactggcgcgccggg

SEQ ID NO: 370979 - DNA, 20 bp, human
ggcagaatcgccctgtctat

SEQ ID NO: 370980 - DNA, 20 bp, human
ggcactgccagcccgcacta

SEQ ID NO: 370981 - DNA, 20 bp, human
gaggccaagcgcgcacgcgc

SEQ ID NO: 370982 - DNA, 20 bp, human
ggcccgcctcgagctcacat

SEQ ID NO: 370983 - DNA, 20 bp, human
gctcgaggcgggcggcgcat

SEQ ID NO: 370984 - DNA, 20 bp, human
gctgccagcccgcactaggg

SEQ ID NO: 370985 - DNA, 20 bp, human
gtggcgcgccggggggggtg

SEQ ID NO: 370986 - DNA, 20 bp, human
gtgcatgtggacaaaaatgg

SEQ ID NO: 370987 - DNA, 20 bp, human
gtgtgcaacaacttccggga

SEQ ID NO: 370988 - DNA, 20 bp, human
gttgtgcatgtggacaaaaa

SEQ ID NO: 370989 - DNA, 20 bp, human
gtgttaggataatgggtata

SEQ ID NO: 370990 - DNA, 20 bp, human
gacgtcaaaacgagttgcga

SEQ ID NO: 370991 - DNA, 20 bp, human
gcccaaggctgaaccgtctg

SEQ ID NO: 370992 - DNA, 20 bp, human
gtgtcgggtaggatggaatc

SEQ ID NO: 370993 - DNA, 20 bp, human
gcaacaacttccgggagggc

SEQ ID NO: 370994 - DNA, 20 bp, human
ggaaagctgtgttaggataa

SEQ ID NO: 370995 - DNA, 20 bp, human
gaaacgagttgcgagggttc

SEQ ID NO: 370996 - DNA, 20 bp, human
gaacaggaaacgagcgtcgg

SEQ ID NO: 370997 - DNA, 20 bp, human
ggtaaaggtcaggccgaggc

SEQ ID NO: 370998 - DNA, 20 bp, human
ggataacaccctcgttgcgt

SEQ ID NO: 370999 - DNA, 20 bp, human
gacaaacaggaaacgagcgt

SEQ ID NO: 371000 - DNA, 20 bp, human
ggacagcagattctccgcgc

SEQ ID NO: 371001 - DNA, 20 bp, human
gtctgctgctaccaatgtaa

SEQ ID NO: 371002 - DNA, 20 bp, human
gtatcgaatatgcagttacc

SEQ ID NO: 371003 - DNA, 20 bp, human
gtaataaagtaaaatgtccc

SEQ ID NO: 371004 - DNA, 20 bp, human
gagattctccgcgccggcct

SEQ ID NO: 371005 - DNA, 20 bp, human
gtgctaccaatgtaaaggtc

SEQ ID NO: 371006 - DNA, 20 bp, human
gagacccagcgcgcctaggg

SEQ ID NO: 371007 - DNA, 20 bp, human
gctgacgcctagtacgtatg

SEQ ID NO: 371008 - DNA, 20 bp, human
ggaaacgcgctggctgactg

SEQ ID NO: 371009 - DNA, 20 bp, human
gcttgtgggtggaaacgcgc

SEQ ID NO: 371010 - DNA, 20 bp, human
gtaggcgcgctgggtcttgt

SEQ ID NO: 371011 - DNA, 20 bp, human
ggtcatgagagtgcgatacc

SEQ ID NO: 371012 - DNA, 20 bp, human
gcggagctggcgaccgccct

SEQ ID NO: 371013 - DNA, 20 bp, human
gccagcttggaagaaccaat

SEQ ID NO: 371014 - DNA, 20 bp, human
gagtgcgataccaggattgg

SEQ ID NO: 371015 - DNA, 20 bp, human
gggaatgcccggcacaggac

SEQ ID NO: 371016 - DNA, 20 bp, human
gtagggaagagtcccgggaa

SEQ ID NO: 371017 - DNA, 20 bp, human
ggtgacttgaacagcctata

SEQ ID NO: 371018 - DNA, 20 bp, human
gaccgcacgcgcaggcctct

SEQ ID NO: 371019 - DNA, 20 bp, human
gcagcaaaaatcattgggtg

SEQ ID NO: 371020 - DNA, 20 bp, human
gagcctatagggaagagtcc

SEQ ID NO: 371021 - DNA, 20 bp, human
gtcccagaggcctgcgcgtg

SEQ ID NO: 371022 - DNA, 20 bp, human
ggcgggactgttattttgag

SEQ ID NO: 371023 - DNA, 20 bp, human
gctcttgcgtgcatttgctc

SEQ ID NO: 371024 - DNA, 20 bp, human
gggcgaatatctttctggaa

SEQ ID NO: 371025 - DNA, 20 bp, human
gtcaagtcacgtggcgactg

SEQ ID NO: 371026 - DNA, 20 bp, human
gtgcagaagccagccccccg

SEQ ID NO: 371027 - DNA, 20 bp, human
gtactcaaggtgcccaaagg

SEQ ID NO: 371028 - DNA, 20 bp, human
gagagtctcgcggacatagg

SEQ ID NO: 371029 - DNA, 20 bp, human
gaggtactcaaggtgcccaa

SEQ ID NO: 371030 - DNA, 20 bp, human
ggggaagtgtgatcggaaag

SEQ ID NO: 371031 - DNA, 20 bp, human
gcccgcggctgaggtactca

SEQ ID NO: 371032 - DNA, 20 bp, human
gaggtcactaccccgccttt

SEQ ID NO: 371033 - DNA, 20 bp, human
gctcgcggacataggcggtt

SEQ ID NO: 371034 - DNA, 20 bp, human
gcggaaaggggcggagcatc

SEQ ID NO: 371035 - DNA, 20 bp, human
gggacataggcggttcggcg

SEQ ID NO: 371036 - DNA, 20 bp, human
gccgtcccggagaaaaaacc

SEQ ID NO: 371037 - DNA, 20 bp, human
ggaaaaaagggacaggtcct

SEQ ID NO: 371038 - DNA, 20 bp, human
gcggagaaaaaacccggatg

SEQ ID NO: 371039 - DNA, 20 bp, human
gtctacggaccaatcagtga

SEQ ID NO: 371040 - DNA, 20 bp, human
ggccttcctgggcccgtctg

SEQ ID NO: 371041 - DNA, 20 bp, human
ggcgccggttgagagaacta

SEQ ID NO: 371042 - DNA, 20 bp, human
ggggagccagtatagaaaaa

SEQ ID NO: 371043 - DNA, 20 bp, human
gcggcgattggctggcagaa

SEQ ID NO: 371044 - DNA, 20 bp, human
gatgctctacgcgacccggt

SEQ ID NO: 371045 - DNA, 20 bp, human
ggacggcccttcggatgctt

SEQ ID NO: 371046 - DNA, 20 bp, human
gcctccgggggcgttcttgc

SEQ ID NO: 371047 - DNA, 20 bp, human
gaagtcgtggcgcgcgcaca

SEQ ID NO: 371048 - DNA, 20 bp, human
gtcccgcgacggctggtgga

SEQ ID NO: 371049 - DNA, 20 bp, human
gcttccggcaagaacgcccc

SEQ ID NO: 371050 - DNA, 20 bp, human
gaggggatgtgtctcgttct

SEQ ID NO: 371051 - DNA, 20 bp, human
gagactccgaaacacaccct

SEQ ID NO: 371052 - DNA, 20 bp, human
ggcacgctgggacgtctcgc

SEQ ID NO: 371053 - DNA, 20 bp, human
gcattagcgcacctcgaggt

SEQ ID NO: 371054 - DNA, 20 bp, human
ggggacgtctcgctggcggg

SEQ ID NO: 371055 - DNA, 20 bp, human
gaagaacgcccccggaggcg

SEQ ID NO: 371056 - DNA, 20 bp, human
ggggactgggcgttaacatc

SEQ ID NO: 371057 - DNA, 20 bp, human
gctccggggccggaactcca

SEQ ID NO: 371058 - DNA, 20 bp, human
gaccgagaggttaatgggaa

SEQ ID NO: 371059 - DNA, 20 bp, human
gctcggcagaagctccgctc

SEQ ID NO: 371060 - DNA, 20 bp, human
gagagagccggggagggtga

SEQ ID NO: 371061 - DNA, 20 bp, human
ggtgtccaaacaggaactta

SEQ ID NO: 371062 - DNA, 20 bp, human
ggctctccttacgtcaaagc

SEQ ID NO: 371063 - DNA, 20 bp, human
gcggagcttctgccgagcag

SEQ ID NO: 371064 - DNA, 20 bp, human
gaacatccggctttgacgta

SEQ ID NO: 371065 - DNA, 20 bp, human
gaactccagggctagtgagc

SEQ ID NO: 371066 - DNA, 20 bp, human
ggctgcgagggaatagtgaa

SEQ ID NO: 371067 - DNA, 20 bp, human
gtgtgaggaccatgctgcga

SEQ ID NO: 371068 - DNA, 20 bp, human
ggcagagagattgccagccc

SEQ ID NO: 371069 - DNA, 20 bp, human
ggagacccggaagcatcgat

SEQ ID NO: 371070 - DNA, 20 bp, human
gcaggagaagagtccggaaa

SEQ ID NO: 371071 - DNA, 20 bp, human
ggactcttctcctgcccgca

SEQ ID NO: 371072 - DNA, 20 bp, human
gagagccgatcgatgcttcc

SEQ ID NO: 371073 - DNA, 20 bp, human
ggtgcgtctgccctgcgggc

SEQ ID NO: 371074 - DNA, 20 bp, human
ggcttcgcaaggtcgtggta

SEQ ID NO: 371075 - DNA, 20 bp, human
ggtggaaggcactgttgcgc

SEQ ID NO: 371076 - DNA, 20 bp, human
ggcctccagcagccgagcga

SEQ ID NO: 371077 - DNA, 20 bp, human
gcatctataggatggcggga

SEQ ID NO: 371078 - DNA, 20 bp, human
gctagtctcgtggggttccg

SEQ ID NO: 371079 - DNA, 20 bp, human
gggttccgcggtgtcgtcgc

SEQ ID NO: 371080 - DNA, 20 bp, human
gctataggatggcgggaagg

SEQ ID NO: 371081 - DNA, 20 bp, human
gagtactacgggccgctacg

SEQ ID NO: 371082 - DNA, 20 bp, human
gcttggattgaacctcgtag

SEQ ID NO: 371083 - DNA, 20 bp, human
gacagccagcgacgacaccg

SEQ ID NO: 371084 - DNA, 20 bp, human
gggctcgcgcctggaatgtc

SEQ ID NO: 371085 - DNA, 20 bp, human
gccacggcgccggctcctgt

SEQ ID NO: 371086 - DNA, 20 bp, human
gcgacggctgagggtatcga

SEQ ID NO: 371087 - DNA, 20 bp, human
ggctggaggttgccttgcga

SEQ ID NO: 371088 - DNA, 20 bp, human
ggataccctcagccgtcgca

SEQ ID NO: 371089 - DNA, 20 bp, human
gcagtcgcgctcctcgcggc

SEQ ID NO: 371090 - DNA, 20 bp, human
gtcgcggccggaagagagtg

SEQ ID NO: 371091 - DNA, 20 bp, human
ggctgggccgcactctcttc

SEQ ID NO: 371092 - DNA, 20 bp, human
ggttgccttgcgacggctga

SEQ ID NO: 371093 - DNA, 20 bp, human
ggccggaagcgcctactcca

SEQ ID NO: 371094 - DNA, 20 bp, human
ggccgcagtcgcgctcctcg

SEQ ID NO: 371095 - DNA, 20 bp, human
gagagcgcgcggagcactgc

SEQ ID NO: 371096 - DNA, 20 bp, human
gcccgccggccgtgacttcg

SEQ ID NO: 371097 - DNA, 20 bp, human
gcccctgcctacatccggaa

SEQ ID NO: 371098 - DNA, 20 bp, human
gagaatggcacgacccaaat

SEQ ID NO: 371099 - DNA, 20 bp, human
gaacgcgtcccagagggaag

SEQ ID NO: 371100 - DNA, 20 bp, human
gcccccgaagtcacggccgg

SEQ ID NO: 371101 - DNA, 20 bp, human
ggcgcccccgaagtcacggc

SEQ ID NO: 371102 - DNA, 20 bp, human
ggaaccaaccccaataccta

SEQ ID NO: 371103 - DNA, 20 bp, human
ggccagtcagaaccacacgg

SEQ ID NO: 371104 - DNA, 20 bp, human
gcgctcctcgcttcggagac

SEQ ID NO: 371105 - DNA, 20 bp, human
gctcccttaggtattggggt

SEQ ID NO: 371106 - DNA, 20 bp, human
gtcctcctcactccgcctgc

SEQ ID NO: 371107 - DNA, 20 bp, human
ggccgccgcaacgacccttg

SEQ ID NO: 371108 - DNA, 20 bp, human
ggttccggcaccggaaaaga

SEQ ID NO: 371109 - DNA, 20 bp, human
ggaagtgtgagcaccctctc

SEQ ID NO: 371110 - DNA, 20 bp, human
gcctgccggctgggaaacta

SEQ ID NO: 371111 - DNA, 20 bp, human
ggagaccgcgctcaacactg

SEQ ID NO: 371112 - DNA, 20 bp, human
gggaaaagagggctgatgac

SEQ ID NO: 371113 - DNA, 20 bp, human
gccggccccaagggtcgttg

SEQ ID NO: 371114 - DNA, 20 bp, human
gccagccggcaggcggagtg

SEQ ID NO: 371115 - DNA, 20 bp, human
gttgccgtccagcctgtcct

SEQ ID NO: 371116 - DNA, 20 bp, human
gcgtctgcgctgtggaaggt

SEQ ID NO: 371117 - DNA, 20 bp, human
gtccgagggaggccaaactg

SEQ ID NO: 371118 - DNA, 20 bp, human
gaagtgtgaaggtcacgcgg

SEQ ID NO: 371119 - DNA, 20 bp, human
gtcctacagcgccacctgga

SEQ ID NO: 371120 - DNA, 20 bp, human
ggaggcgtctgcgctgtgga

SEQ ID NO: 371121 - DNA, 20 bp, human
gcggaagtgtgaaggtcacg

SEQ ID NO: 371122 - DNA, 20 bp, human
gggtgccttcggttgtatag

SEQ ID NO: 371123 - DNA, 20 bp, human
gacggccactatacaaccga

SEQ ID NO: 371124 - DNA, 20 bp, human
gaggcgggaggaggtgcctt

SEQ ID NO: 371125 - DNA, 20 bp, human
gttcgctgcatggcctccga

SEQ ID NO: 371126 - DNA, 20 bp, human
gaggcaggaagggccgtggt

SEQ ID NO: 371127 - DNA, 20 bp, human
gcgcgcggaccttgggaaac

SEQ ID NO: 371128 - DNA, 20 bp, human
gctagagggcggtctgggag

SEQ ID NO: 371129 - DNA, 20 bp, human
gtctgggagaggctgtgtaa

SEQ ID NO: 371130 - DNA, 20 bp, human
ggctcagagccggtttccca

SEQ ID NO: 371131 - DNA, 20 bp, human
gggctctgagcatcgctgtg

SEQ ID NO: 371132 - DNA, 20 bp, human
ggcgtgctgattggaggaga

SEQ ID NO: 371133 - DNA, 20 bp, human
gcaggcggcgcgcggacctt

SEQ ID NO: 371134 - DNA, 20 bp, human
gggtccgcgcgccgcctgca

SEQ ID NO: 371135 - DNA, 20 bp, human
gctggttgctaggagatact

SEQ ID NO: 371136 - DNA, 20 bp, human
gaggacgcacccctccgtcc

SEQ ID NO: 371137 - DNA, 20 bp, human
gacgccagacgcaagacgcc

SEQ ID NO: 371138 - DNA, 20 bp, human
gccgtcctggccaatcgctg

SEQ ID NO: 371139 - DNA, 20 bp, human
gggaagctcaacgatgaccg

SEQ ID NO: 371140 - DNA, 20 bp, human
gacggaggggtgcgtcctct

SEQ ID NO: 371141 - DNA, 20 bp, human
ggaggcgctgagatatcgcg

SEQ ID NO: 371142 - DNA, 20 bp, human
gaattcagaaaggtgcctag

SEQ ID NO: 371143 - DNA, 20 bp, human
ggcgattggccaggacggag

SEQ ID NO: 371144 - DNA, 20 bp, human
gcaatcgctgaggacataac

SEQ ID NO: 371145 - DNA, 20 bp, human
ggagataacgggtattccac

SEQ ID NO: 371146 - DNA, 20 bp, human
gcccccaggtcattccggtg

SEQ ID NO: 371147 - DNA, 20 bp, human
gccctcaccggaatgacctg

SEQ ID NO: 371148 - DNA, 20 bp, human
ggcactgttgcaatgagagg

SEQ ID NO: 371149 - DNA, 20 bp, human
gacagtgctgtggggcccta

SEQ ID NO: 371150 - DNA, 20 bp, human
gagctgggacccctgcactg

SEQ ID NO: 371151 - DNA, 20 bp, human
gagacatgtccattgatccc

SEQ ID NO: 371152 - DNA, 20 bp, human
ggggggctactggaccccta

SEQ ID NO: 371153 - DNA, 20 bp, human
gcaggctggcgcgcatgctc

SEQ ID NO: 371154 - DNA, 20 bp, human
gcacgcctgcgcggccgcag

SEQ ID NO: 371155 - DNA, 20 bp, human
gcctggggggagggggctac

SEQ ID NO: 371156 - DNA, 20 bp, human
ggagccgagggccgccgtgt

SEQ ID NO: 371157 - DNA, 20 bp, human
gcggggcgggccactaagta

SEQ ID NO: 371158 - DNA, 20 bp, human
ggggcggggcttcgcgtcgg

SEQ ID NO: 371159 - DNA, 20 bp, human
gagcgccgagccccctgcgc

SEQ ID NO: 371160 - DNA, 20 bp, human
gctagcggggtgggtcagaa

SEQ ID NO: 371161 - DNA, 20 bp, human
gcgctcggaatgcccatcga

SEQ ID NO: 371162 - DNA, 20 bp, human
gagtaaggcgaaagcccggg

SEQ ID NO: 371163 - DNA, 20 bp, human
gtgggactacctagcggggt

SEQ ID NO: 371164 - DNA, 20 bp, human
gagggggcggggcttcgcgt

SEQ ID NO: 371165 - DNA, 20 bp, human
ggccgtgtgggactacctag

SEQ ID NO: 371166 - DNA, 20 bp, human
ggaggcacgctggcggtgaa

SEQ ID NO: 371167 - DNA, 20 bp, human
gagcgctggagagagtccgt

SEQ ID NO: 371168 - DNA, 20 bp, human
gcacgctggcggtgaagggc

SEQ ID NO: 371169 - DNA, 20 bp, human
ggtgaccgccgaggctgcgg

SEQ ID NO: 371170 - DNA, 20 bp, human
gcccaaagcaaggggagccg

SEQ ID NO: 371171 - DNA, 20 bp, human
ggctggagagagtccgtggg

SEQ ID NO: 371172 - DNA, 20 bp, human
gtccgtgggaggaggcacgc

SEQ ID NO: 371173 - DNA, 20 bp, human
gtgtgggcgcccacggagtg

SEQ ID NO: 371174 - DNA, 20 bp, human
gtgagcggccgctgggttgt

SEQ ID NO: 371175 - DNA, 20 bp, human
gctacgggctgggtatgaaa

SEQ ID NO: 371176 - DNA, 20 bp, human
gccggcgagaggcgagtgat

SEQ ID NO: 371177 - DNA, 20 bp, human
gtgggcaacccgaatgcggt

SEQ ID NO: 371178 - DNA, 20 bp, human
ggacgtgggcaacccgaatg

SEQ ID NO: 371179 - DNA, 20 bp, human
gggccggcgcagccgcttcc

SEQ ID NO: 371180 - DNA, 20 bp, human
gtccgtggggagccaatgga

SEQ ID NO: 371181 - DNA, 20 bp, human
gctcgcctctcgccggacgt

SEQ ID NO: 371182 - DNA, 20 bp, human
gcttctgcacctcccggaag

SEQ ID NO: 371183 - DNA, 20 bp, human
ggaattgcacggtagaggtc

SEQ ID NO: 371184 - DNA, 20 bp, human
ggttgcccacgtccggcgag

SEQ ID NO: 371185 - DNA, 20 bp, human
gcacgggagctgcccgggca

SEQ ID NO: 371186 - DNA, 20 bp, human
gcactcccgctcttggcaac

SEQ ID NO: 371187 - DNA, 20 bp, human
gtgaatgtggtccccttaat

SEQ ID NO: 371188 - DNA, 20 bp, human
ggcacatacacgcacgagag

SEQ ID NO: 371189 - DNA, 20 bp, human
gtgacaacgagcataaagaa

SEQ ID NO: 371190 - DNA, 20 bp, human
gcccgggagagcgcggattc

SEQ ID NO: 371191 - DNA, 20 bp, human
gtcacaggagctgcgttcgc

SEQ ID NO: 371192 - DNA, 20 bp, human
gagggtctaagaatcttcac

SEQ ID NO: 371193 - DNA, 20 bp, human
ggacgccagtgaactgagac

SEQ ID NO: 371194 - DNA, 20 bp, human
gtcaaaggtccacatggccc

SEQ ID NO: 371195 - DNA, 20 bp, human
ggattcttagaccctccacg

SEQ ID NO: 371196 - DNA, 20 bp, human
gagcggggatcagccgaagt

SEQ ID NO: 371197 - DNA, 20 bp, human
gagcgcccctctcccgactt

SEQ ID NO: 371198 - DNA, 20 bp, human
gtctgggggaagtgcaggat

SEQ ID NO: 371199 - DNA, 20 bp, human
gaaactggcgcgcgactctg

SEQ ID NO: 371200 - DNA, 20 bp, human
ggcccggggcgggtctgcgt

SEQ ID NO: 371201 - DNA, 20 bp, human
ggatcagccgaagtcgggag

SEQ ID NO: 371202 - DNA, 20 bp, human
ggggccgggcgcgcacccgc

SEQ ID NO: 371203 - DNA, 20 bp, human
gcgggagaggggcgcttcca

SEQ ID NO: 371204 - DNA, 20 bp, human
gctcccgcgggggtggatgg

SEQ ID NO: 371205 - DNA, 20 bp, human
ggcagacccgccccgggcga

SEQ ID NO: 371206 - DNA, 20 bp, human
gacagtgccatgctaacagt

SEQ ID NO: 371207 - DNA, 20 bp, human
gttcatgcctactgttagca

SEQ ID NO: 371208 - DNA, 20 bp, human
ggttagcatggcactgtaca

SEQ ID NO: 371209 - DNA, 20 bp, human
gatcaagcatcacttcccca

SEQ ID NO: 371210 - DNA, 20 bp, human
gtggtcttagggagtttagt

SEQ ID NO: 371211 - DNA, 20 bp, human
gagatgtagaccctggtctt

SEQ ID NO: 371212 - DNA, 20 bp, human
gctgtgaacagtactatgca

SEQ ID NO: 371213 - DNA, 20 bp, human
gcaaaatcagatgtagaccc

SEQ ID NO: 371214 - DNA, 20 bp, human
gaggtcagcgaggcatccct

SEQ ID NO: 371215 - DNA, 20 bp, human
ggtgactgaaccaaagagat

SEQ ID NO: 371216 - DNA, 20 bp, human
gccgttgaaggcggaaataa

SEQ ID NO: 371217 - DNA, 20 bp, human
gagggaggagccggaaactc

SEQ ID NO: 371218 - DNA, 20 bp, human
ggaaatgccccagccgttga

SEQ ID NO: 371219 - DNA, 20 bp, human
ggggcatttcccatcggcta

SEQ ID NO: 371220 - DNA, 20 bp, human
ggaactcccagcgttcgcaa

SEQ ID NO: 371221 - DNA, 20 bp, human
gaataacggcctgtaggcaa

SEQ ID NO: 371222 - DNA, 20 bp, human
gagaccccctccctagccga

SEQ ID NO: 371223 - DNA, 20 bp, human
gcctggtcaagtcatctagc

SEQ ID NO: 371224 - DNA, 20 bp, human
gcccagggcaggtgattcgt

SEQ ID NO: 371225 - DNA, 20 bp, human
ggccgacgaatcacctgccc

SEQ ID NO: 371226 - DNA, 20 bp, human
gcccccaggtcattccggtg

SEQ ID NO: 371227 - DNA, 20 bp, human
gccctcaccggaatgacctg

SEQ ID NO: 371228 - DNA, 20 bp, human
ggcactgttgcaatgagagg

SEQ ID NO: 371229 - DNA, 20 bp, human
gacagtgctgtggggcccta

SEQ ID NO: 371230 - DNA, 20 bp, human
gagctgggacccctgcactg

SEQ ID NO: 371231 - DNA, 20 bp, human
gagacatgtccattgatccc

SEQ ID NO: 371232 - DNA, 20 bp, human
ggggggctactggaccccta

SEQ ID NO: 371233 - DNA, 20 bp, human
gcaggctggcgcgcatgctc

SEQ ID NO: 371234 - DNA, 20 bp, human
gcacgcctgcgcggccgcag

SEQ ID NO: 371235 - DNA, 20 bp, human
gcctggggggagggggctac

SEQ ID NO: 371236 - DNA, 20 bp, human
gtattggcgtccctcgagca

SEQ ID NO: 371237 - DNA, 20 bp, human
gccggaggcggcatgcctat

SEQ ID NO: 371238 - DNA, 20 bp, human
gagaggatacacatattcag

SEQ ID NO: 371239 - DNA, 20 bp, human
gtgggagcataggggtttga

SEQ ID NO: 371240 - DNA, 20 bp, human
gccaggcattagaggtgagt

SEQ ID NO: 371241 - DNA, 20 bp, human
gccacctccaggtaagggat

SEQ ID NO: 371242 - DNA, 20 bp, human
gtgactctatcattgttgtc

SEQ ID NO: 371243 - DNA, 20 bp, human
gagaggtgagtgggagcata

SEQ ID NO: 371244 - DNA, 20 bp, human
gcggagtgccccgtcctggt

SEQ ID NO: 371245 - DNA, 20 bp, human
gttgctctgccgacgggtgg

SEQ ID NO: 371246 - DNA, 20 bp, human
gggtctggtcagaatacaaa

SEQ ID NO: 371247 - DNA, 20 bp, human
gcgggtctttccagatgatg

SEQ ID NO: 371248 - DNA, 20 bp, human
ggaaggagtgcgcgatgcgc

SEQ ID NO: 371249 - DNA, 20 bp, human
gcggggaacgggactgagta

SEQ ID NO: 371250 - DNA, 20 bp, human
gctggccgaaaaggccttct

SEQ ID NO: 371251 - DNA, 20 bp, human
gcccgccaaaacactctctt

SEQ ID NO: 371252 - DNA, 20 bp, human
ggcgcgatgcgcaggcgctc

SEQ ID NO: 371253 - DNA, 20 bp, human
ggcaggcgctctggccgaaa

SEQ ID NO: 371254 - DNA, 20 bp, human
gcagatgatgaggagcggaa

SEQ ID NO: 371255 - DNA, 20 bp, human
gccttgataaccgcttggtc

SEQ ID NO: 371256 - DNA, 20 bp, human
gagatcacggcagacctcac

SEQ ID NO: 371257 - DNA, 20 bp, human
gctagccattttataatatg

SEQ ID NO: 371258 - DNA, 20 bp, human
gctctgtggccaagttgcag

SEQ ID NO: 371259 - DNA, 20 bp, human
gtgaaaagtaaaagcatcgt

SEQ ID NO: 371260 - DNA, 20 bp, human
gcagcttgaggctgaagaaa

SEQ ID NO: 371261 - DNA, 20 bp, human
gacagtaaaaacatctgact

SEQ ID NO: 371262 - DNA, 20 bp, human
gcagatttttcaatgattta

SEQ ID NO: 371263 - DNA, 20 bp, human
gtaatttgaccactgcaact

SEQ ID NO: 371264 - DNA, 20 bp, human
ggtaggaaaaattgtctctg

SEQ ID NO: 371265 - DNA, 20 bp, human
gatctgttaattttttattc

SEQ ID NO: 371266 - DNA, 20 bp, human
gaggctgcgcagcaaatccg

SEQ ID NO: 371267 - DNA, 20 bp, human
gggaccccgtgggatccgag

SEQ ID NO: 371268 - DNA, 20 bp, human
ggggcagaaaagtaggagtt

SEQ ID NO: 371269 - DNA, 20 bp, human
gggcggcacccggccagctg

SEQ ID NO: 371270 - DNA, 20 bp, human
gagggccgcaagggaccccg

SEQ ID NO: 371271 - DNA, 20 bp, human
gttaacgagtggggccaaag

SEQ ID NO: 371272 - DNA, 20 bp, human
gcccctaggtctccgcccct

SEQ ID NO: 371273 - DNA, 20 bp, human
gggcggggcttaggcgctgg

SEQ ID NO: 371274 - DNA, 20 bp, human
ggatcccacggggtcccttg

SEQ ID NO: 371275 - DNA, 20 bp, human
gaacggtgcgaggagtggga

SEQ ID NO: 371276 - DNA, 20 bp, human
gtaggcgcggcgcccacagg

SEQ ID NO: 371277 - DNA, 20 bp, human
ggcggcggaagcactaggcg

SEQ ID NO: 371278 - DNA, 20 bp, human
gcgcggcgcccacaggcgga

SEQ ID NO: 371279 - DNA, 20 bp, human
gagcaggaggctagctctgc

SEQ ID NO: 371280 - DNA, 20 bp, human
gagcgccagccgtccgcctg

SEQ ID NO: 371281 - DNA, 20 bp, human
gtcaacgtccggactaatgg

SEQ ID NO: 371282 - DNA, 20 bp, human
gtaactgtggggtcagggtt

SEQ ID NO: 371283 - DNA, 20 bp, human
gcactaggcgcggcgcccac

SEQ ID NO: 371284 - DNA, 20 bp, human
ggcagggtgggggcgcacct

SEQ ID NO: 371285 - DNA, 20 bp, human
gaggaagcttaaggtgactc

SEQ ID NO: 371286 - DNA, 20 bp, human
ggcgttccgcccactgtcag

SEQ ID NO: 371287 - DNA, 20 bp, human
ggggagcagaggggtgtaag

SEQ ID NO: 371288 - DNA, 20 bp, human
gcgaatggatatccaatccg

SEQ ID NO: 371289 - DNA, 20 bp, human
ggaagccaatcagcggccag

SEQ ID NO: 371290 - DNA, 20 bp, human
gggatcccgactccagtccg

SEQ ID NO: 371291 - DNA, 20 bp, human
gcaaggccccggactggagt

SEQ ID NO: 371292 - DNA, 20 bp, human
gatcccccctccactcactt

SEQ ID NO: 371293 - DNA, 20 bp, human
gtgcacgcaggtgccgggtg

SEQ ID NO: 371294 - DNA, 20 bp, human
gtcagcgacgggcagccagt

SEQ ID NO: 371295 - DNA, 20 bp, human
ggggacttagtgaggatcca

SEQ ID NO: 371296 - DNA, 20 bp, human
gggccccgggctctgaatag

SEQ ID NO: 371297 - DNA, 20 bp, human
ggggcgcgcagcagtcagca

SEQ ID NO: 371298 - DNA, 20 bp, human
gtagagtggaggccatattc

SEQ ID NO: 371299 - DNA, 20 bp, human
gataccctgcctagcagcac

SEQ ID NO: 371300 - DNA, 20 bp, human
gggggatgcaggttcccggg

SEQ ID NO: 371301 - DNA, 20 bp, human
gatatggcctccactctaca

SEQ ID NO: 371302 - DNA, 20 bp, human
gcggccgctattcagagccc

SEQ ID NO: 371303 - DNA, 20 bp, human
gaaaatagaagggtggtcta

SEQ ID NO: 371304 - DNA, 20 bp, human
ggtattgggtactgcgtatt

SEQ ID NO: 371305 - DNA, 20 bp, human
gtgctgcgcgccctgtagag

SEQ ID NO: 371306 - DNA, 20 bp, human
ggtgaccgtctccatagcgc

SEQ ID NO: 371307 - DNA, 20 bp, human
gaggctgtcggcagtcggct

SEQ ID NO: 371308 - DNA, 20 bp, human
gcgggcgcctgggccaactt

SEQ ID NO: 371309 - DNA, 20 bp, human
gagaagcggaggtaggctgt

SEQ ID NO: 371310 - DNA, 20 bp, human
gcgcgccggcgctatggaga

SEQ ID NO: 371311 - DNA, 20 bp, human
gactcccagcggtcccaagt

SEQ ID NO: 371312 - DNA, 20 bp, human
ggaggtaggctgtcggcagt

SEQ ID NO: 371313 - DNA, 20 bp, human
gagcccctgcgcccgccaat

SEQ ID NO: 371314 - DNA, 20 bp, human
ggcgccggcgcgcggagaag

SEQ ID NO: 371315 - DNA, 20 bp, human
ggcgggccaacgctagtggg

SEQ ID NO: 371316 - DNA, 20 bp, human
gcgcgctactccggccagga

SEQ ID NO: 371317 - DNA, 20 bp, human
ggggtgctgtagtttcttcc

SEQ ID NO: 371318 - DNA, 20 bp, human
ggagagggaagaaggttgta

SEQ ID NO: 371319 - DNA, 20 bp, human
ggctactccggccaggaggg

SEQ ID NO: 371320 - DNA, 20 bp, human
gactgcgcgctactccggcc

SEQ ID NO: 371321 - DNA, 20 bp, human
gggaagactgcgcgctactc

SEQ ID NO: 371322 - DNA, 20 bp, human
ggacgctagaggctttgcgc

SEQ ID NO: 371323 - DNA, 20 bp, human
gcacgcgcggcggggggcgt

SEQ ID NO: 371324 - DNA, 20 bp, human
gtgcgctgggtgacgacttc

SEQ ID NO: 371325 - DNA, 20 bp, human
ggcagcgcccggcggctacg

SEQ ID NO: 371326 - DNA, 20 bp, human
gctgacgctgcgcctcccga

SEQ ID NO: 371327 - DNA, 20 bp, human
gaccctcgcagcagctgcgc

SEQ ID NO: 371328 - DNA, 20 bp, human
gggtccctctagcggcgcgg

SEQ ID NO: 371329 - DNA, 20 bp, human
gggcccagatgagcaggatt

SEQ ID NO: 371330 - DNA, 20 bp, human
gaaccccccgcgccgctaga

SEQ ID NO: 371331 - DNA, 20 bp, human
gccggccaagagccccagtc

SEQ ID NO: 371332 - DNA, 20 bp, human
ggcgacctcgcggtcacgtg

SEQ ID NO: 371333 - DNA, 20 bp, human
gcccagtccggcaggggaaa

SEQ ID NO: 371334 - DNA, 20 bp, human
gcggtcacgtgcggcaaggg

SEQ ID NO: 371335 - DNA, 20 bp, human
gaacccagggcccccaggta

SEQ ID NO: 371336 - DNA, 20 bp, human
ggtcactggaaagattggtt

SEQ ID NO: 371337 - DNA, 20 bp, human
gacagcgctgttccgatccc

SEQ ID NO: 371338 - DNA, 20 bp, human
gatcccgggtgcgcggccaa

SEQ ID NO: 371339 - DNA, 20 bp, human
gctcccttggccgcgcaccc

SEQ ID NO: 371340 - DNA, 20 bp, human
gactggacacaataagagtt

SEQ ID NO: 371341 - DNA, 20 bp, human
gaagcgtaaacccaggtcac

SEQ ID NO: 371342 - DNA, 20 bp, human
gtgtggtgaagcgtaaaccc

SEQ ID NO: 371343 - DNA, 20 bp, human
gtgaacgaaagcagggattt

SEQ ID NO: 371344 - DNA, 20 bp, human
gaaagcagggatttaggaag

SEQ ID NO: 371345 - DNA, 20 bp, human
gtgttccgatcccgggtgcg

SEQ ID NO: 371346 - DNA, 20 bp, human
gtggaaggaggggccgaact

SEQ ID NO: 371347 - DNA, 20 bp, human
gaggaggggccgaactgggc

SEQ ID NO: 371348 - DNA, 20 bp, human
gcttgggcccgggcagagac

SEQ ID NO: 371349 - DNA, 20 bp, human
gtccacacagcagggatctt

SEQ ID NO: 371350 - DNA, 20 bp, human
gaggggccgaactgggcggg

SEQ ID NO: 371351 - DNA, 20 bp, human
gggaagtgatgtcacggcat

SEQ ID NO: 371352 - DNA, 20 bp, human
gagcagctgcttttggggcg

SEQ ID NO: 371353 - DNA, 20 bp, human
gcccctccttccacacagca

SEQ ID NO: 371354 - DNA, 20 bp, human
gcgcccaccggaggagcgac

SEQ ID NO: 371355 - DNA, 20 bp, human
gaggagcgactggagttgat

SEQ ID NO: 371356 - DNA, 20 bp, human
ggcaacccgtagtgcggggc

SEQ ID NO: 371357 - DNA, 20 bp, human
gggaaattgtagtccgattg

SEQ ID NO: 371358 - DNA, 20 bp, human
ggctgcgcgcttcgcttctg

SEQ ID NO: 371359 - DNA, 20 bp, human
ggctccgcccgccgtggtca

SEQ ID NO: 371360 - DNA, 20 bp, human
gctgggaactgtagtctaaa

SEQ ID NO: 371361 - DNA, 20 bp, human
gagggagcccaaagtggagt

SEQ ID NO: 371362 - DNA, 20 bp, human
ggaggccccgccccgcacta

SEQ ID NO: 371363 - DNA, 20 bp, human
gtggccgtggctgttcgcga

SEQ ID NO: 371364 - DNA, 20 bp, human
ggcactacgggttgcaatga

SEQ ID NO: 371365 - DNA, 20 bp, human
gcgaagcgcgcagccccaat

SEQ ID NO: 371366 - DNA, 20 bp, human
ggcgcccggcttcgcggcac

SEQ ID NO: 371367 - DNA, 20 bp, human
gctccagctgcgctaatcca

SEQ ID NO: 371368 - DNA, 20 bp, human
ggcccgcgtcggctttgcgg

SEQ ID NO: 371369 - DNA, 20 bp, human
ggcttgctctcgcctggcaa

SEQ ID NO: 371370 - DNA, 20 bp, human
gcgcggcaccggccactaga

SEQ ID NO: 371371 - DNA, 20 bp, human
gccgagcccaccgcccgcgt

SEQ ID NO: 371372 - DNA, 20 bp, human
gcaaagccgacgcgggcggt

SEQ ID NO: 371373 - DNA, 20 bp, human
ggggccccgcccccgaccgg

SEQ ID NO: 371374 - DNA, 20 bp, human
gttagcgcagctggagacgt

SEQ ID NO: 371375 - DNA, 20 bp, human
ggccgccgcaaagccgacgc

SEQ ID NO: 371376 - DNA, 20 bp, human
gcgtgagcctgagcgcgcac

SEQ ID NO: 371377 - DNA, 20 bp, human
gtcgacccggaagctgtcgc

SEQ ID NO: 371378 - DNA, 20 bp, human
gtgcctaagcagtaaaggac

SEQ ID NO: 371379 - DNA, 20 bp, human
ggcttccgggtcgacgtcga

SEQ ID NO: 371380 - DNA, 20 bp, human
ggcggctcctcgccagcaga

SEQ ID NO: 371381 - DNA, 20 bp, human
gtcagagactacctcgcgca

SEQ ID NO: 371382 - DNA, 20 bp, human
ggcgcgtgctcgccaagagc

SEQ ID NO: 371383 - DNA, 20 bp, human
gtacctcgcgcagggccgtc

SEQ ID NO: 371384 - DNA, 20 bp, human
ggccgggcagcgccgctcct

SEQ ID NO: 371385 - DNA, 20 bp, human
ggccctgacggccctgcgcg

SEQ ID NO: 371386 - DNA, 20 bp, human
gtgggcgccgtcaagaggcc

SEQ ID NO: 371387 - DNA, 20 bp, human
gtgggaggaggcgggacaaa

SEQ ID NO: 371388 - DNA, 20 bp, human
gttgacggcgcccacccgga

SEQ ID NO: 371389 - DNA, 20 bp, human
gcaagtcggtggcgaaaaga

SEQ ID NO: 371390 - DNA, 20 bp, human
ggccacgtcccagactttct

SEQ ID NO: 371391 - DNA, 20 bp, human
gagtcgggtcagcaagtcgg

SEQ ID NO: 371392 - DNA, 20 bp, human
gtagcctagtcccgccaaga

SEQ ID NO: 371393 - DNA, 20 bp, human
gcctcttgacggcgcccacc

SEQ ID NO: 371394 - DNA, 20 bp, human
gacgtcccagactttctggg

SEQ ID NO: 371395 - DNA, 20 bp, human
ggccgtcaagaggccggggg

SEQ ID NO: 371396 - DNA, 20 bp, human
gcctgaattccagagatcaa

SEQ ID NO: 371397 - DNA, 20 bp, human
gaagaagaggtgggtacagc

SEQ ID NO: 371398 - DNA, 20 bp, human
gcagccagacctctgcaagg

SEQ ID NO: 371399 - DNA, 20 bp, human
gggctggggcgatcagaagc

SEQ ID NO: 371400 - DNA, 20 bp, human
gtcgagtccccgttgatctc

SEQ ID NO: 371401 - DNA, 20 bp, human
gcttccgggtagcgcaggga

SEQ ID NO: 371402 - DNA, 20 bp, human
gctgccgccttgcagaggtc

SEQ ID NO: 371403 - DNA, 20 bp, human
gtgtacccacctcttcttcc

SEQ ID NO: 371404 - DNA, 20 bp, human
gtttccctgccgccttgcag

SEQ ID NO: 371405 - DNA, 20 bp, human
ggagctaaatcccacagggc

SEQ ID NO: 371406 - DNA, 20 bp, human
gtctcccgagagaaaacgaa

SEQ ID NO: 371407 - DNA, 20 bp, human
ggaacccggccgacctccat

SEQ ID NO: 371408 - DNA, 20 bp, human
gagattggagatgacgtggg

SEQ ID NO: 371409 - DNA, 20 bp, human
gccgcagagtcatcccagtc

SEQ ID NO: 371410 - DNA, 20 bp, human
ggacagattggagatgacgt

SEQ ID NO: 371411 - DNA, 20 bp, human
gcggcaggaagctgcccgag

SEQ ID NO: 371412 - DNA, 20 bp, human
gaggtcggccgggttctgca

SEQ ID NO: 371413 - DNA, 20 bp, human
gcggggaggaacgcggtcct

SEQ ID NO: 371414 - DNA, 20 bp, human
ggagtcatcccagtccggcc

SEQ ID NO: 371415 - DNA, 20 bp, human
ggaagcctgggtcggcctga

SEQ ID NO: 371416 - DNA, 20 bp, human
gtgggcgcactagacttcgg

SEQ ID NO: 371417 - DNA, 20 bp, human
gaggtcccgcctaatcttct

SEQ ID NO: 371418 - DNA, 20 bp, human
gctagtgcgcccacagcgcg

SEQ ID NO: 371419 - DNA, 20 bp, human
ggtccgctccgggagagtta

SEQ ID NO: 371420 - DNA, 20 bp, human
gctgtgggcgcactagactt

SEQ ID NO: 371421 - DNA, 20 bp, human
ggtcctgagcctagaagatt

SEQ ID NO: 371422 - DNA, 20 bp, human
gcggcgcaagggaacgcccg

SEQ ID NO: 371423 - DNA, 20 bp, human
gagccctaactctcccggag

SEQ ID NO: 371424 - DNA, 20 bp, human
gcgcaagggaacgcccgggg

SEQ ID NO: 371425 - DNA, 20 bp, human
gcggactgaggaccccgggg

SEQ ID NO: 371426 - DNA, 20 bp, human
gtccgcagggcagggagcgc

SEQ ID NO: 371427 - DNA, 20 bp, human
ggatcagctgggcccgaaag

SEQ ID NO: 371428 - DNA, 20 bp, human
gcgggccggactcaggtctg

SEQ ID NO: 371429 - DNA, 20 bp, human
gggtgtgcgcgccaacgcgc

SEQ ID NO: 371430 - DNA, 20 bp, human
gcagctgggcccgaaagagg

SEQ ID NO: 371431 - DNA, 20 bp, human
ggggtttcgggcctaacggg

SEQ ID NO: 371432 - DNA, 20 bp, human
gcgcgccctgggcgtgccgg

SEQ ID NO: 371433 - DNA, 20 bp, human
gctgccctgcggactccggc

SEQ ID NO: 371434 - DNA, 20 bp, human
gctgatctccaccgcccgtt

SEQ ID NO: 371435 - DNA, 20 bp, human
ggctccagccggagtccgca

SEQ ID NO: 371436 - DNA, 20 bp, human
gaacagacggcatcctgtag

SEQ ID NO: 371437 - DNA, 20 bp, human
gaggggagcgtgggaaagag

SEQ ID NO: 371438 - DNA, 20 bp, human
gccgcccccgcgctgtgggt

SEQ ID NO: 371439 - DNA, 20 bp, human
gggtcgcgccctctccccgt

SEQ ID NO: 371440 - DNA, 20 bp, human
gtccgggccggggccccacg

SEQ ID NO: 371441 - DNA, 20 bp, human
gccgccctgaagtgcgtgtc

SEQ ID NO: 371442 - DNA, 20 bp, human
gctgaagtgcgtgtcgggcg

SEQ ID NO: 371443 - DNA, 20 bp, human
gagacggcatcctgtagagg

SEQ ID NO: 371444 - DNA, 20 bp, human
gagcggagagggagaattac

SEQ ID NO: 371445 - DNA, 20 bp, human
gaggcgcccacccacagcgc

SEQ ID NO: 371446 - DNA, 20 bp, human
ggggcgaaaagcggacaatc

SEQ ID NO: 371447 - DNA, 20 bp, human
ggcagggggcgggcgaaaag

SEQ ID NO: 371448 - DNA, 20 bp, human
gataacctcggctcaggccc

SEQ ID NO: 371449 - DNA, 20 bp, human
ggaactgcgtcttataacct

SEQ ID NO: 371450 - DNA, 20 bp, human
gcggggagcggtctgggcct

SEQ ID NO: 371451 - DNA, 20 bp, human
gtcaccccgcgccagcagct

SEQ ID NO: 371452 - DNA, 20 bp, human
ggccggccgcgggaccgact

SEQ ID NO: 371453 - DNA, 20 bp, human
ggcggacaatcgggcaccgt

SEQ ID NO: 371454 - DNA, 20 bp, human
ggccgagtcggtcccgcggc

SEQ ID NO: 371455 - DNA, 20 bp, human
gaagacgcagttcggaagca

SEQ ID NO: 371456 - DNA, 20 bp, human
gaagtcagagcagcaactca

SEQ ID NO: 371457 - DNA, 20 bp, human
gccaactcacctccaggtta

SEQ ID NO: 371458 - DNA, 20 bp, human
ggattccctgtctttgaacg

SEQ ID NO: 371459 - DNA, 20 bp, human
gagtattttccataacctgg

SEQ ID NO: 371460 - DNA, 20 bp, human
gaatagtattttccataacc

SEQ ID NO: 371461 - DNA, 20 bp, human
ggattgagcagaatggacgc

SEQ ID NO: 371462 - DNA, 20 bp, human
gccttcgggcctaactccaa

SEQ ID NO: 371463 - DNA, 20 bp, human
gggcccgaaggggctttcaa

SEQ ID NO: 371464 - DNA, 20 bp, human
gccgaaggggctttcaaagg

SEQ ID NO: 371465 - DNA, 20 bp, human
gaaaaaggaggcaagacaaa

SEQ ID NO: 371466 - DNA, 20 bp, human
gcgcgctcgcggtgcattgt

SEQ ID NO: 371467 - DNA, 20 bp, human
ggggaggggcactgcggact

SEQ ID NO: 371468 - DNA, 20 bp, human
ggggactcggggtcgcaaac

SEQ ID NO: 371469 - DNA, 20 bp, human
gccccgcggcggcgcgctcg

SEQ ID NO: 371470 - DNA, 20 bp, human
gtgaggagaagcggtgtcat

SEQ ID NO: 371471 - DNA, 20 bp, human
ggaggctggcgcagagagac

SEQ ID NO: 371472 - DNA, 20 bp, human
gaagcggtgtcatgggactc

SEQ ID NO: 371473 - DNA, 20 bp, human
gctcggaggcggaagcttga

SEQ ID NO: 371474 - DNA, 20 bp, human
gcgcggggctgcggccgagg

SEQ ID NO: 371475 - DNA, 20 bp, human
gagtgagccgtttctcccct

SEQ ID NO: 371476 - DNA, 20 bp, human
gcgaggcaacgttggacact

SEQ ID NO: 371477 - DNA, 20 bp, human
gcgcacttcctgccgggcgg

SEQ ID NO: 371478 - DNA, 20 bp, human
gaacgcgggtggaacggaac

SEQ ID NO: 371479 - DNA, 20 bp, human
gcccggcaggaagtgcgccc

SEQ ID NO: 371480 - DNA, 20 bp, human
ggtgcggagcaaatgtctaa

SEQ ID NO: 371481 - DNA, 20 bp, human
gggcctccgcgaggcaacgt

SEQ ID NO: 371482 - DNA, 20 bp, human
gggcaacgttggacactggg

SEQ ID NO: 371483 - DNA, 20 bp, human
ggtgggcggtgtggctgtgt

SEQ ID NO: 371484 - DNA, 20 bp, human
gcccagggcgcacttcctgc

SEQ ID NO: 371485 - DNA, 20 bp, human
gcccaccagcagccacgctt

SEQ ID NO: 371486 - DNA, 20 bp, human
gtggggctggggcgcatcca

SEQ ID NO: 371487 - DNA, 20 bp, human
ggtggccgatgtccggggtg

SEQ ID NO: 371488 - DNA, 20 bp, human
gccacccccaccccggacat

SEQ ID NO: 371489 - DNA, 20 bp, human
gccaacagtggccgatgtcc

SEQ ID NO: 371490 - DNA, 20 bp, human
gcccaggcgccacctatccc

SEQ ID NO: 371491 - DNA, 20 bp, human
ggataggtggcgcctggggc

SEQ ID NO: 371492 - DNA, 20 bp, human
gtctccaagaaggcccgtga

SEQ ID NO: 371493 - DNA, 20 bp, human
gtatcccgggaccagagcgg

SEQ ID NO: 371494 - DNA, 20 bp, human
ggctctggtcccgggatagg

SEQ ID NO: 371495 - DNA, 20 bp, human
gttggagaaaatgccaacag

SEQ ID NO: 371496 - DNA, 20 bp, human
gagctggggtcagagttcat

SEQ ID NO: 371497 - DNA, 20 bp, human
ggcaccgcgcgtgacgccat

SEQ ID NO: 371498 - DNA, 20 bp, human
ggccccgctacccaatcgaa

SEQ ID NO: 371499 - DNA, 20 bp, human
ggacacgcggcacggagagt

SEQ ID NO: 371500 - DNA, 20 bp, human
gtcccaggccccagctttta

SEQ ID NO: 371501 - DNA, 20 bp, human
gtggctgagggaaacgcggt

SEQ ID NO: 371502 - DNA, 20 bp, human
gccagcttttaagggacacg

SEQ ID NO: 371503 - DNA, 20 bp, human
gccaaggagtcgcctggagt

SEQ ID NO: 371504 - DNA, 20 bp, human
ggggcccggaacggcggcac

SEQ ID NO: 371505 - DNA, 20 bp, human
gtggaaggaggggcccggaa

SEQ ID NO: 371506 - DNA, 20 bp, human
ggggacgcacggaagtgcag

SEQ ID NO: 371507 - DNA, 20 bp, human
gagcctccggggctggtccc

SEQ ID NO: 371508 - DNA, 20 bp, human
gactgagcgccagcgagcga

SEQ ID NO: 371509 - DNA, 20 bp, human
ggcacttccgtgcgtcccgg

SEQ ID NO: 371510 - DNA, 20 bp, human
gtcccagggaccagccccgg

SEQ ID NO: 371511 - DNA, 20 bp, human
gtcgccaaaggggaggtgag

SEQ ID NO: 371512 - DNA, 20 bp, human
gggccagcgccctcgctcgc

SEQ ID NO: 371513 - DNA, 20 bp, human
gaaggaggggatcgccaaag

SEQ ID NO: 371514 - DNA, 20 bp, human
gaggggaggtggcggtccca

SEQ ID NO: 371515 - DNA, 20 bp, human
gcctgccccgccgggacgca

SEQ ID NO: 371516 - DNA, 20 bp, human
gcccctcttgtcaacctaga

SEQ ID NO: 371517 - DNA, 20 bp, human
ggggaggacacgcaagcccg

SEQ ID NO: 371518 - DNA, 20 bp, human
gagctgaccaggtcctccgc

SEQ ID NO: 371519 - DNA, 20 bp, human
gagccctctaggttgacaag

SEQ ID NO: 371520 - DNA, 20 bp, human
gcgcaagcccgcggaggacc

SEQ ID NO: 371521 - DNA, 20 bp, human
ggacaagaggggcgaggcga

SEQ ID NO: 371522 - DNA, 20 bp, human
ggcgtcgctagctgagagac

SEQ ID NO: 371523 - DNA, 20 bp, human
ggcgatggctagcggagggg

SEQ ID NO: 371524 - DNA, 20 bp, human
gtgtcaacctagagggctcc

SEQ ID NO: 371525 - DNA, 20 bp, human
ggaaagtgaacacttgaagt

SEQ ID NO: 371526 - DNA, 20 bp, human
gccaacgcgccaccagttag

SEQ ID NO: 371527 - DNA, 20 bp, human
ggccgacgaaagcctcgggt

SEQ ID NO: 371528 - DNA, 20 bp, human
gactccctgcctctaactgg

SEQ ID NO: 371529 - DNA, 20 bp, human
gagacgccggcccttccgct

SEQ ID NO: 371530 - DNA, 20 bp, human
gccccacccgaggctttcgt

SEQ ID NO: 371531 - DNA, 20 bp, human
gagtacctctccgagcggaa

SEQ ID NO: 371532 - DNA, 20 bp, human
gccggcccttccgctcggag

SEQ ID NO: 371533 - DNA, 20 bp, human
gggccggcgtctccgaagcg

SEQ ID NO: 371534 - DNA, 20 bp, human
gactggtggcgcgttggcgg

SEQ ID NO: 371535 - DNA, 20 bp, human
gactcagcccgagtccaaga

SEQ ID NO: 371536 - DNA, 20 bp, human
gtgagcgaggaaggttaaca

SEQ ID NO: 371537 - DNA, 20 bp, human
gggactcgagcgaccagcgc

SEQ ID NO: 371538 - DNA, 20 bp, human
ggggaactggagagctccct

SEQ ID NO: 371539 - DNA, 20 bp, human
gtcgagtccgtgagcgagga

SEQ ID NO: 371540 - DNA, 20 bp, human
ggacggggcgggccgtcctt

SEQ ID NO: 371541 - DNA, 20 bp, human
gagcgaccagcgccggggac

SEQ ID NO: 371542 - DNA, 20 bp, human
gacttcggtgccttgacctt

SEQ ID NO: 371543 - DNA, 20 bp, human
gtcgctggagccctcggggc

SEQ ID NO: 371544 - DNA, 20 bp, human
gtcgctcgagtccgtgagcg

SEQ ID NO: 371545 - DNA, 20 bp, human
gaagacccagacctcatggc

SEQ ID NO: 371546 - DNA, 20 bp, human
gtccggctacgttggagaaa

SEQ ID NO: 371547 - DNA, 20 bp, human
gcgggctggaggggcggaac

SEQ ID NO: 371548 - DNA, 20 bp, human
ggaactgccgggaccagcgc

SEQ ID NO: 371549 - DNA, 20 bp, human
gaactgggactctcggactc

SEQ ID NO: 371550 - DNA, 20 bp, human
ggaccagcgctggcccgggc

SEQ ID NO: 371551 - DNA, 20 bp, human
ggctacgttggagaaagggt

SEQ ID NO: 371552 - DNA, 20 bp, human
ggaaagggttggctgtaccc

SEQ ID NO: 371553 - DNA, 20 bp, human
gctcccccgagcgtgcccat

SEQ ID NO: 371554 - DNA, 20 bp, human
gtcactcggtggcccccgac

SEQ ID NO: 371555 - DNA, 20 bp, human
gtcctcgcattgacccagtc

SEQ ID NO: 371556 - DNA, 20 bp, human
gtggacggggaggggcatgt

SEQ ID NO: 371557 - DNA, 20 bp, human
ggcccgcaggggcggactgt

SEQ ID NO: 371558 - DNA, 20 bp, human
gtgtccacgtggacggggag

SEQ ID NO: 371559 - DNA, 20 bp, human
gagtccggaggtccaacctg

SEQ ID NO: 371560 - DNA, 20 bp, human
gtgactgggcgaggagagat

SEQ ID NO: 371561 - DNA, 20 bp, human
ggagagatgggagtgaatga

SEQ ID NO: 371562 - DNA, 20 bp, human
gaggagcgcggcgggcccgc

SEQ ID NO: 371563 - DNA, 20 bp, human
gcaggggcggactgtgggcg

SEQ ID NO: 371564 - DNA, 20 bp, human
ggactgtgggcgtggcgcgc

SEQ ID NO: 371565 - DNA, 20 bp, human
ggctccgtgtccacgtggac

SEQ ID NO: 371566 - DNA, 20 bp, human
gcgccctgggccctcggccg

SEQ ID NO: 371567 - DNA, 20 bp, human
ggcccggcctcctcgcctcc

SEQ ID NO: 371568 - DNA, 20 bp, human
gcggcggtgactgcccgggg

SEQ ID NO: 371569 - DNA, 20 bp, human
gctaccccgagcggctctgt

SEQ ID NO: 371570 - DNA, 20 bp, human
gcgcgcgcgccgcggtaaat

SEQ ID NO: 371571 - DNA, 20 bp, human
ggcgcgccgcggtaaatggg

SEQ ID NO: 371572 - DNA, 20 bp, human
gccgcggtaaatgggaggct

SEQ ID NO: 371573 - DNA, 20 bp, human
gagggcccagggcgcgcttc

SEQ ID NO: 371574 - DNA, 20 bp, human
gcccagggcgcgcttccggc

SEQ ID NO: 371575 - DNA, 20 bp, human
gccccgggcgcccttggtcg

SEQ ID NO: 371576 - DNA, 20 bp, human
gccccggcgccagtgctcgc

SEQ ID NO: 371577 - DNA, 20 bp, human
ggggcggagcctggcaacct

SEQ ID NO: 371578 - DNA, 20 bp, human
gagggccagcctgcgagcac

SEQ ID NO: 371579 - DNA, 20 bp, human
gcatcctattggtggtcccc

SEQ ID NO: 371580 - DNA, 20 bp, human
gtcgccggtatcatgatgtc

SEQ ID NO: 371581 - DNA, 20 bp, human
gagcctgcgagcactggcgc

SEQ ID NO: 371582 - DNA, 20 bp, human
gcaacctggggaccaccaat

SEQ ID NO: 371583 - DNA, 20 bp, human
gcaccgctgcgtcacgcgca

SEQ ID NO: 371584 - DNA, 20 bp, human
gtggtggtccccaggttgcc

SEQ ID NO: 371585 - DNA, 20 bp, human
gcacccggacatcatgatac

SEQ ID NO: 371586 - DNA, 20 bp, human
gtggtggttggggtgttagg

SEQ ID NO: 371587 - DNA, 20 bp, human
gagtggctgggtacatcttg

SEQ ID NO: 371588 - DNA, 20 bp, human
ggggcatctggatggtggtt

SEQ ID NO: 371589 - DNA, 20 bp, human
ggcggggtggatagcaccct

SEQ ID NO: 371590 - DNA, 20 bp, human
gggatggtggttggggtgtt

SEQ ID NO: 371591 - DNA, 20 bp, human
ggggcctctgggagtgcgat

SEQ ID NO: 371592 - DNA, 20 bp, human
gtcactctgctgtctgtcgc

SEQ ID NO: 371593 - DNA, 20 bp, human
gtaacctatcgcactcccag

SEQ ID NO: 371594 - DNA, 20 bp, human
gactggggcccctccaggaa

SEQ ID NO: 371595 - DNA, 20 bp, human
gtcccagcaggctgaaggtc

SEQ ID NO: 371596 - DNA, 20 bp, human
gcccgccgcggatgaacagg

SEQ ID NO: 371597 - DNA, 20 bp, human
gtcggagggaggggaaaggt

SEQ ID NO: 371598 - DNA, 20 bp, human
gacgcccgctcgagagccgg

SEQ ID NO: 371599 - DNA, 20 bp, human
gtccgcgtatccagtgacgg

SEQ ID NO: 371600 - DNA, 20 bp, human
gacctccccgccacacgcca

SEQ ID NO: 371601 - DNA, 20 bp, human
ggcagccgcctgttcatccg

SEQ ID NO: 371602 - DNA, 20 bp, human
ggcgtggcttccaccgtcac

SEQ ID NO: 371603 - DNA, 20 bp, human
gggatgctgcgcggctccgg

SEQ ID NO: 371604 - DNA, 20 bp, human
ggccacgcccgctcgagagc

SEQ ID NO: 371605 - DNA, 20 bp, human
gcgccggcgcccctggcgtg

SEQ ID NO: 371606 - DNA, 20 bp, human
gtgctggggcaggtgcgaac

SEQ ID NO: 371607 - DNA, 20 bp, human
ggggtcgccaagtccgaagg

SEQ ID NO: 371608 - DNA, 20 bp, human
gggctctcgcgcatgctccg

SEQ ID NO: 371609 - DNA, 20 bp, human
gggggcaggtgcgaacaggc

SEQ ID NO: 371610 - DNA, 20 bp, human
gcgtccggcgaggaccgctt

SEQ ID NO: 371611 - DNA, 20 bp, human
gccagcacccgcctctcgag

SEQ ID NO: 371612 - DNA, 20 bp, human
gacagggctctgcccccggc

SEQ ID NO: 371613 - DNA, 20 bp, human
gctccgggcagcaccgagag

SEQ ID NO: 371614 - DNA, 20 bp, human
gtcctcgccggacgccaccg

SEQ ID NO: 371615 - DNA, 20 bp, human
gcggcagaaagtggaacccg

SEQ ID NO: 371616 - DNA, 20 bp, human
ggggagcaagggaggcgcgt

SEQ ID NO: 371617 - DNA, 20 bp, human
gcggctgcgaccctggaggt

SEQ ID NO: 371618 - DNA, 20 bp, human
ggcgcggcgacgccccctac

SEQ ID NO: 371619 - DNA, 20 bp, human
gctgctgccgggtttccctc

SEQ ID NO: 371620 - DNA, 20 bp, human
gcgcgagcggagcgctgact

SEQ ID NO: 371621 - DNA, 20 bp, human
ggtcacgtgaggccgattcc

SEQ ID NO: 371622 - DNA, 20 bp, human
gcggggcccgcggtcacgtg

SEQ ID NO: 371623 - DNA, 20 bp, human
gagcggagcgctgactgggg

SEQ ID NO: 371624 - DNA, 20 bp, human
ggcgacgccccctacgggct

SEQ ID NO: 371625 - DNA, 20 bp, human
gccccgctactgctttaaag

SEQ ID NO: 371626 - DNA, 20 bp, human
ggagggcgggccgcgagcag

SEQ ID NO: 371627 - DNA, 20 bp, human
gtctccgcgcgcgtccctcc

SEQ ID NO: 371628 - DNA, 20 bp, human
gcgacgagaggcggccgagg

SEQ ID NO: 371629 - DNA, 20 bp, human
gcactactcgcagcagagaa

SEQ ID NO: 371630 - DNA, 20 bp, human
ggacaaagcgcgacgagagg

SEQ ID NO: 371631 - DNA, 20 bp, human
gtgccaggaacgcgccgccg

SEQ ID NO: 371632 - DNA, 20 bp, human
gggagacaaagcgcgacgag

SEQ ID NO: 371633 - DNA, 20 bp, human
gagtgtgaatgagaagttgg

SEQ ID NO: 371634 - DNA, 20 bp, human
gagccttcttagaagggagg

SEQ ID NO: 371635 - DNA, 20 bp, human
gctccccgagggcccaactg

SEQ ID NO: 371636 - DNA, 20 bp, human
gccagcgcaggtcccgacag

SEQ ID NO: 371637 - DNA, 20 bp, human
gaccacccggcgacctctgt

SEQ ID NO: 371638 - DNA, 20 bp, human
gaggtcccgacagaggtcgc

SEQ ID NO: 371639 - DNA, 20 bp, human
ggacctgcgctgggcgtggg

SEQ ID NO: 371640 - DNA, 20 bp, human
gcaaccggctaatttccacg

SEQ ID NO: 371641 - DNA, 20 bp, human
ggcgctgggcgtgggcgggt

SEQ ID NO: 371642 - DNA, 20 bp, human
gttgcccgggcaaatcaggg

SEQ ID NO: 371643 - DNA, 20 bp, human
gagggagctgaacacggaag

SEQ ID NO: 371644 - DNA, 20 bp, human
gcgggacctgcgctgggcgt

SEQ ID NO: 371645 - DNA, 20 bp, human
gtgtggatcctcagtggcgg

SEQ ID NO: 371646 - DNA, 20 bp, human
ggggagagaggcggtcacgt

SEQ ID NO: 371647 - DNA, 20 bp, human
ggcccgaagggaggggtcga

SEQ ID NO: 371648 - DNA, 20 bp, human
gcgaagggaggggtcgacgg

SEQ ID NO: 371649 - DNA, 20 bp, human
ggggctgcggcccgaaggga

SEQ ID NO: 371650 - DNA, 20 bp, human
ggtcgacggcggggagtctc

SEQ ID NO: 371651 - DNA, 20 bp, human
gccgtgtccggccggggaaa

SEQ ID NO: 371652 - DNA, 20 bp, human
gtcggagaagggcaagcgat

SEQ ID NO: 371653 - DNA, 20 bp, human
gaggggcacgcctctctgaa

SEQ ID NO: 371654 - DNA, 20 bp, human
gcctgagaggcggggtaaag

SEQ ID NO: 371655 - DNA, 20 bp, human
gagggggaatgtcacgtggt

SEQ ID NO: 371656 - DNA, 20 bp, human
gggcccgagtagtggacggg

SEQ ID NO: 371657 - DNA, 20 bp, human
gggggccgggcactaagtgg

SEQ ID NO: 371658 - DNA, 20 bp, human
gcgcgggcccgagtagtgga

SEQ ID NO: 371659 - DNA, 20 bp, human
gcgccccccgtccactactc

SEQ ID NO: 371660 - DNA, 20 bp, human
gaaccaggacagggactctg

SEQ ID NO: 371661 - DNA, 20 bp, human
gggaacccccacttagtgcc

SEQ ID NO: 371662 - DNA, 20 bp, human
gcccctccgctggtgcctgc

SEQ ID NO: 371663 - DNA, 20 bp, human
ggcggcgcctcggcccgagc

SEQ ID NO: 371664 - DNA, 20 bp, human
gcactaagtgggggttccga

SEQ ID NO: 371665 - DNA, 20 bp, human
gggccccggctaacgcggaa

SEQ ID NO: 371666 - DNA, 20 bp, human
gcgcccccggcccctattgg

SEQ ID NO: 371667 - DNA, 20 bp, human
gccagcgcgagcacgccctg

SEQ ID NO: 371668 - DNA, 20 bp, human
gaggcccaggccatcccatt

SEQ ID NO: 371669 - DNA, 20 bp, human
gcgcgcggcgtcactcgccg

SEQ ID NO: 371670 - DNA, 20 bp, human
gtgggggcggtgctcggcgg

SEQ ID NO: 371671 - DNA, 20 bp, human
gcgctcccaggaccagacca

SEQ ID NO: 371672 - DNA, 20 bp, human
gtcaccgccaataggggccg

SEQ ID NO: 371673 - DNA, 20 bp, human
gcccaagccgacgtcacttc

SEQ ID NO: 371674 - DNA, 20 bp, human
ggagcacgccctggggaaag

SEQ ID NO: 371675 - DNA, 20 bp, human
gggagcgcgccgctggcctt

SEQ ID NO: 371676 - DNA, 20 bp, human
gagtggccgggaatgactgg

SEQ ID NO: 371677 - DNA, 20 bp, human
ggcggggcggggggagtctc

SEQ ID NO: 371678 - DNA, 20 bp, human
gtgggcgaggcgcggaggtc

SEQ ID NO: 371679 - DNA, 20 bp, human
gcggggttctggacgtttcc

SEQ ID NO: 371680 - DNA, 20 bp, human
ggacccgaggctgccgcagg

SEQ ID NO: 371681 - DNA, 20 bp, human
gcgtgcgaggcgattggttt

SEQ ID NO: 371682 - DNA, 20 bp, human
gtgagcgcgtgcgaggcgat

SEQ ID NO: 371683 - DNA, 20 bp, human
gggcagcctcgggtcgcgag

SEQ ID NO: 371684 - DNA, 20 bp, human
gcccggccactcgcgacccg

SEQ ID NO: 371685 - DNA, 20 bp, human
gaggccgtgtgcgtgctgaa

SEQ ID NO: 371686 - DNA, 20 bp, human
ggccgcgcgccactcaagta

SEQ ID NO: 371687 - DNA, 20 bp, human
gggcacgcagggcacccccg

SEQ ID NO: 371688 - DNA, 20 bp, human
ggcagggcacccccggggtt

SEQ ID NO: 371689 - DNA, 20 bp, human
gcgggccgtaccaactccac

SEQ ID NO: 371690 - DNA, 20 bp, human
ggggatctggctgcactagg

SEQ ID NO: 371691 - DNA, 20 bp, human
gcgggcgggacaggcacgca

SEQ ID NO: 371692 - DNA, 20 bp, human
ggaccccagctgcgccgcaa

SEQ ID NO: 371693 - DNA, 20 bp, human
ggccctgggcgcggggtgta

SEQ ID NO: 371694 - DNA, 20 bp, human
gccagggcacgggagaaagg

SEQ ID NO: 371695 - DNA, 20 bp, human
gcgcccagggcacgggagaa

SEQ ID NO: 371696 - DNA, 20 bp, human
gcgaagcaattctacaaccc

SEQ ID NO: 371697 - DNA, 20 bp, human
gcagaggagtggtcagcgtg

SEQ ID NO: 371698 - DNA, 20 bp, human
gtctacaacccggggaggtc

SEQ ID NO: 371699 - DNA, 20 bp, human
ggcgtgagggagccagtcat

SEQ ID NO: 371700 - DNA, 20 bp, human
ggctgtgtgctgaaggtcac

SEQ ID NO: 371701 - DNA, 20 bp, human
gaagcaggccagacctcccc

SEQ ID NO: 371702 - DNA, 20 bp, human
gccgaaaacccaaaaatggg

SEQ ID NO: 371703 - DNA, 20 bp, human
gggcccgaaaacccaaaaat

SEQ ID NO: 371704 - DNA, 20 bp, human
gtcattgggccagttcaggg

SEQ ID NO: 371705 - DNA, 20 bp, human
gagccggtgaagtcgcggaa

SEQ ID NO: 371706 - DNA, 20 bp, human
ggcaacagcgaccccttcga

SEQ ID NO: 371707 - DNA, 20 bp, human
gcacgctcggcacggggcga

SEQ ID NO: 371708 - DNA, 20 bp, human
gcccgggccgcagccggact

SEQ ID NO: 371709 - DNA, 20 bp, human
gcgccagcctgaccctcgaa

SEQ ID NO: 371710 - DNA, 20 bp, human
ggcacgccgatcgctccctc

SEQ ID NO: 371711 - DNA, 20 bp, human
gcggagcccgagggagcgat

SEQ ID NO: 371712 - DNA, 20 bp, human
gggagcgatcggcgtgcggg

SEQ ID NO: 371713 - DNA, 20 bp, human
gcccgctcggggaaggcacc

SEQ ID NO: 371714 - DNA, 20 bp, human
gagccggactcggagcccga

SEQ ID NO: 371715 - DNA, 20 bp, human
gagcgagggagggatctgcg

SEQ ID NO: 371716 - DNA, 20 bp, human
gtagagactcgggctgatga

SEQ ID NO: 371717 - DNA, 20 bp, human
gctaacaaggtaagcttcag

SEQ ID NO: 371718 - DNA, 20 bp, human
gcgtgtgctccatgctgctc

SEQ ID NO: 371719 - DNA, 20 bp, human
gttagatggcactcagaggt

SEQ ID NO: 371720 - DNA, 20 bp, human
gtctgtcacctacactaaca

SEQ ID NO: 371721 - DNA, 20 bp, human
gtgctgctcgggatgcagag

SEQ ID NO: 371722 - DNA, 20 bp, human
ggagtgccatctaatagtat

SEQ ID NO: 371723 - DNA, 20 bp, human
gggaagaagctttcatcact

SEQ ID NO: 371724 - DNA, 20 bp, human
gtacctgcagctacatctgt

SEQ ID NO: 371725 - DNA, 20 bp, human
gatgacgtcagattatgtga

SEQ ID NO: 371726 - DNA, 20 bp, human
gcaacccgggccacactcca

SEQ ID NO: 371727 - DNA, 20 bp, human
gggcgcggccccctctaccc

SEQ ID NO: 371728 - DNA, 20 bp, human
gccgacatcccgggtagagg

SEQ ID NO: 371729 - DNA, 20 bp, human
gtcctgggctccgacatccc

SEQ ID NO: 371730 - DNA, 20 bp, human
ggaagctcagtagaggtcct

SEQ ID NO: 371731 - DNA, 20 bp, human
gacccgggatgtcggagccc

SEQ ID NO: 371732 - DNA, 20 bp, human
gggctcctggatgcttacaa

SEQ ID NO: 371733 - DNA, 20 bp, human
gagtagaggtccttggagtg

SEQ ID NO: 371734 - DNA, 20 bp, human
gtcagcttgctcaccgaaaa

SEQ ID NO: 371735 - DNA, 20 bp, human
gcaattacggaaagagctgg

SEQ ID NO: 371736 - DNA, 20 bp, human
gaaccccctccgctcggaga

SEQ ID NO: 371737 - DNA, 20 bp, human
gaccgcccgaggagccgcct

SEQ ID NO: 371738 - DNA, 20 bp, human
ggcgcccaaaggggccgctc

SEQ ID NO: 371739 - DNA, 20 bp, human
ggggtgcagacgagcctcag

SEQ ID NO: 371740 - DNA, 20 bp, human
ggccacccggtccccagtgg

SEQ ID NO: 371741 - DNA, 20 bp, human
gctgccgcccaaagcggcca

SEQ ID NO: 371742 - DNA, 20 bp, human
gcgcccgccagcatccgagg

SEQ ID NO: 371743 - DNA, 20 bp, human
gggccgcccgccagcatccg

SEQ ID NO: 371744 - DNA, 20 bp, human
ggctcccgaggcggctcctc

SEQ ID NO: 371745 - DNA, 20 bp, human
gctcccccttctccgagcgg

SEQ ID NO: 371746 - DNA, 20 bp, human
ggggcagagcacacgtgagg

SEQ ID NO: 371747 - DNA, 20 bp, human
ggcgacccccgggaaggtaa

SEQ ID NO: 371748 - DNA, 20 bp, human
gtcctgcgggggcatagagt

SEQ ID NO: 371749 - DNA, 20 bp, human
gagcgcatgcgctatggggg

SEQ ID NO: 371750 - DNA, 20 bp, human
ggggaaccgaggcgaccccc

SEQ ID NO: 371751 - DNA, 20 bp, human
gtagagcgcatgcgctatgg

SEQ ID NO: 371752 - DNA, 20 bp, human
ggtgctggaaagggactcgg

SEQ ID NO: 371753 - DNA, 20 bp, human
ggggctaggtggaaagcacg

SEQ ID NO: 371754 - DNA, 20 bp, human
gccgggctggctgcgtgggg

SEQ ID NO: 371755 - DNA, 20 bp, human
gtaggtggaaagcacgtggc

SEQ ID NO: 371756 - DNA, 20 bp, human
gtcaacgcggaacccgggtc

SEQ ID NO: 371757 - DNA, 20 bp, human
gaggggtcaacgcggaaccc

SEQ ID NO: 371758 - DNA, 20 bp, human
ggcgtgctcgccctcagctg

SEQ ID NO: 371759 - DNA, 20 bp, human
gtagtgacgcggtctcctaa

SEQ ID NO: 371760 - DNA, 20 bp, human
gggcccgccccctgcactaa

SEQ ID NO: 371761 - DNA, 20 bp, human
gagcagcaggccgctctgag

SEQ ID NO: 371762 - DNA, 20 bp, human
gccgctctgaggggtcaacg

SEQ ID NO: 371763 - DNA, 20 bp, human
ggctactcaagctgtcctgg

SEQ ID NO: 371764 - DNA, 20 bp, human
gacagcttgagtagcccccg

SEQ ID NO: 371765 - DNA, 20 bp, human
ggccccaggcgcccttaaag

SEQ ID NO: 371766 - DNA, 20 bp, human
gtcactgattggtccctcgg

SEQ ID NO: 371767 - DNA, 20 bp, human
gctcctctgctgtttctgag

SEQ ID NO: 371768 - DNA, 20 bp, human
ggtccggcccgctccaccga

SEQ ID NO: 371769 - DNA, 20 bp, human
gccggaccgggcattccctt

SEQ ID NO: 371770 - DNA, 20 bp, human
gggaaggcgagagaccgaat

SEQ ID NO: 371771 - DNA, 20 bp, human
gtggggactgacaacttatg

SEQ ID NO: 371772 - DNA, 20 bp, human
gggtctctcgccttcctgat

SEQ ID NO: 371773 - DNA, 20 bp, human
gcttcctgattggctccaaa

SEQ ID NO: 371774 - DNA, 20 bp, human
gcagggccgtgctcactgat

SEQ ID NO: 371775 - DNA, 20 bp, human
gagggaccaatcagtgagca

SEQ ID NO: 371776 - DNA, 20 bp, human
gcagaaaagtagtagtctcc

SEQ ID NO: 371777 - DNA, 20 bp, human
gttaatctaactctactttg

SEQ ID NO: 371778 - DNA, 20 bp, human
gaacgtgaggtgttatactg

SEQ ID NO: 371779 - DNA, 20 bp, human
gttaacatggaatgtaaata

SEQ ID NO: 371780 - DNA, 20 bp, human
gctgtacttggcctgtacta

SEQ ID NO: 371781 - DNA, 20 bp, human
gttaacccaggcattagttg

SEQ ID NO: 371782 - DNA, 20 bp, human
gctttccacaactaatgcct

SEQ ID NO: 371783 - DNA, 20 bp, human
gtacttttagacttgaaaga

SEQ ID NO: 371784 - DNA, 20 bp, human
gtgttaaaacaccttagtac

SEQ ID NO: 371785 - DNA, 20 bp, human
gtaacttttaatttaacgtg

SEQ ID NO: 371786 - DNA, 20 bp, human
gaaggggcgtgtgcgcggat

SEQ ID NO: 371787 - DNA, 20 bp, human
gcctctggaaccgtccactc

SEQ ID NO: 371788 - DNA, 20 bp, human
ggggcgtgtgcgcggatggg

SEQ ID NO: 371789 - DNA, 20 bp, human
gtggccgggcgctgccagag

SEQ ID NO: 371790 - DNA, 20 bp, human
gtgggaggcgaagaagtgtc

SEQ ID NO: 371791 - DNA, 20 bp, human
gggcccggccaggacggaaa

SEQ ID NO: 371792 - DNA, 20 bp, human
gcccctcattagcatgcctc

SEQ ID NO: 371793 - DNA, 20 bp, human
gccggcgggctcacaatgcc

SEQ ID NO: 371794 - DNA, 20 bp, human
gacactccgcggacaaccaa

SEQ ID NO: 371795 - DNA, 20 bp, human
gggctcacaatgccaggagc

SEQ ID NO: 371796 - DNA, 20 bp, human
gtggctgcatagcgctgctg

SEQ ID NO: 371797 - DNA, 20 bp, human
gagctctaacccatgtcatg

SEQ ID NO: 371798 - DNA, 20 bp, human
ggaggcagttgggattaaaa

SEQ ID NO: 371799 - DNA, 20 bp, human
ggggtcacgtgcaacacgag

SEQ ID NO: 371800 - DNA, 20 bp, human
gcccaactgcctcatgacat

SEQ ID NO: 371801 - DNA, 20 bp, human
gggatcggctcccaaaggtg

SEQ ID NO: 371802 - DNA, 20 bp, human
gcactggggaacgtggagtc

SEQ ID NO: 371803 - DNA, 20 bp, human
gcagctggatcggctcccaa

SEQ ID NO: 371804 - DNA, 20 bp, human
ggccgccaggcaaatgttat

SEQ ID NO: 371805 - DNA, 20 bp, human
ggtcctcctggcagctggat

SEQ ID NO: 371806 - DNA, 20 bp, human
ggtgaagagagttaatgtca

SEQ ID NO: 371807 - DNA, 20 bp, human
ggatacactgagcaatgctt

SEQ ID NO: 371808 - DNA, 20 bp, human
gagattggaagctgtgattt

SEQ ID NO: 371809 - DNA, 20 bp, human
gagttgggaggtgagatgat

SEQ ID NO: 371810 - DNA, 20 bp, human
gagagaaagaaagctgttga

SEQ ID NO: 371811 - DNA, 20 bp, human
gctgctgcgttttgccggaa

SEQ ID NO: 371812 - DNA, 20 bp, human
ggatgataagtgaaagtgtt

SEQ ID NO: 371813 - DNA, 20 bp, human
gcaagacaatggaaattctt

SEQ ID NO: 371814 - DNA, 20 bp, human
ggagagttaatgtcatggaa

SEQ ID NO: 371815 - DNA, 20 bp, human
ggaggcagcttctgagagcc

SEQ ID NO: 371816 - DNA, 20 bp, human
gcaggaaacccacaacgact

SEQ ID NO: 371817 - DNA, 20 bp, human
gtcgccaccccccactccag

SEQ ID NO: 371818 - DNA, 20 bp, human
gcagccggggttgtctgcaa

SEQ ID NO: 371819 - DNA, 20 bp, human
ggagtggggggtggcgatct

SEQ ID NO: 371820 - DNA, 20 bp, human
gtcgttgtgggtttcctggt

SEQ ID NO: 371821 - DNA, 20 bp, human
gtcagcattaacagcagccg

SEQ ID NO: 371822 - DNA, 20 bp, human
gtatctattggcagagactg

SEQ ID NO: 371823 - DNA, 20 bp, human
gcaatgaaccaagtcgttgt

SEQ ID NO: 371824 - DNA, 20 bp, human
gaaacaaacccaaagttgac

SEQ ID NO: 371825 - DNA, 20 bp, human
gaaactggaaatttaggtgc

SEQ ID NO: 371826 - DNA, 20 bp, human
gcgcccgcgcggccgatccc

SEQ ID NO: 371827 - DNA, 20 bp, human
ggggcgggaactaggggaag

SEQ ID NO: 371828 - DNA, 20 bp, human
gggagcggggcgggaactag

SEQ ID NO: 371829 - DNA, 20 bp, human
gggtcctagaggcgcccgcg

SEQ ID NO: 371830 - DNA, 20 bp, human
gaaagttcgcggctcgggag

SEQ ID NO: 371831 - DNA, 20 bp, human
gaggacgggcagccgaggtc

SEQ ID NO: 371832 - DNA, 20 bp, human
gcggggaaacggcgcaatca

SEQ ID NO: 371833 - DNA, 20 bp, human
gcccgccccgctcccgggat

SEQ ID NO: 371834 - DNA, 20 bp, human
ggggcgggcgcccggtcgtc

SEQ ID NO: 371835 - DNA, 20 bp, human
ggctgctccggggcccgtcg

SEQ ID NO: 371836 - DNA, 20 bp, human
ggcgctgcgcaccgggtctc

SEQ ID NO: 371837 - DNA, 20 bp, human
gcgcgggggcgcagagtggg

SEQ ID NO: 371838 - DNA, 20 bp, human
ggccgaggggaggtcgccgg

SEQ ID NO: 371839 - DNA, 20 bp, human
ggccgagctgcgctgcgcac

SEQ ID NO: 371840 - DNA, 20 bp, human
gggccgcgggggcgcagagt

SEQ ID NO: 371841 - DNA, 20 bp, human
gcgactgctccgggagcccg

SEQ ID NO: 371842 - DNA, 20 bp, human
ggacctcccctcggcctcgc

SEQ ID NO: 371843 - DNA, 20 bp, human
gcgcgggggcggtcgacccc

SEQ ID NO: 371844 - DNA, 20 bp, human
gagcctgtgtgtcccagcct

SEQ ID NO: 371845 - DNA, 20 bp, human
ggccgccggcgacctcccct

SEQ ID NO: 371846 - DNA, 20 bp, human
gccgccgcccaggcgctcgt

SEQ ID NO: 371847 - DNA, 20 bp, human
gcaggcgctcgtgggaagcc

SEQ ID NO: 371848 - DNA, 20 bp, human
gcagagaaaggagccggcga

SEQ ID NO: 371849 - DNA, 20 bp, human
ggggccgcgctcgggtacgc

SEQ ID NO: 371850 - DNA, 20 bp, human
gagccgggaaggaggaccgg

SEQ ID NO: 371851 - DNA, 20 bp, human
gggccctcgcgcgcctcgaa

SEQ ID NO: 371852 - DNA, 20 bp, human
gggtgcgcgctcggcgtcgc

SEQ ID NO: 371853 - DNA, 20 bp, human
gcttcccacgagcgcctggg

SEQ ID NO: 371854 - DNA, 20 bp, human
ggatccccttcccagctcgg

SEQ ID NO: 371855 - DNA, 20 bp, human
ggcggggcggcgcggacgag

SEQ ID NO: 371856 - DNA, 20 bp, human
ggggcgagcgggagctagga

SEQ ID NO: 371857 - DNA, 20 bp, human
gcgcccgttctcttgtccag

SEQ ID NO: 371858 - DNA, 20 bp, human
ggagctcagtggggaggatt

SEQ ID NO: 371859 - DNA, 20 bp, human
gtccggctggcgcgcctcgc

SEQ ID NO: 371860 - DNA, 20 bp, human
ggacaagagaacgggcgagc

SEQ ID NO: 371861 - DNA, 20 bp, human
gtgccggcccctcctggatc

SEQ ID NO: 371862 - DNA, 20 bp, human
gggcgcgcggggagggtaca

SEQ ID NO: 371863 - DNA, 20 bp, human
gtttctggaggagctcagtg

SEQ ID NO: 371864 - DNA, 20 bp, human
gggaaggaggtggctccggc

SEQ ID NO: 371865 - DNA, 20 bp, human
gggagggtacaggggtctcg

SEQ ID NO: 371866 - DNA, 20 bp, human
gtgggcggcgctagcgtgga

SEQ ID NO: 371867 - DNA, 20 bp, human
ggagcgagaagcccgggtgc

SEQ ID NO: 371868 - DNA, 20 bp, human
gggctgggagcgagaagccc

SEQ ID NO: 371869 - DNA, 20 bp, human
ggggagaagcgccgcacgca

SEQ ID NO: 371870 - DNA, 20 bp, human
ggttagctgcagaagaattg

SEQ ID NO: 371871 - DNA, 20 bp, human
gaaacagcgcgctgcagggc

SEQ ID NO: 371872 - DNA, 20 bp, human
ggaagcgccgcacgcagggg

SEQ ID NO: 371873 - DNA, 20 bp, human
gtcctcctttgtgccagcct

SEQ ID NO: 371874 - DNA, 20 bp, human
gaacaaaaatacgtggtggt

SEQ ID NO: 371875 - DNA, 20 bp, human
gaaaaacagcgcgctgcaga

SEQ ID NO: 371876 - DNA, 20 bp, human
ggctgccgccaggtcccgct

SEQ ID NO: 371877 - DNA, 20 bp, human
gcgaaccgagcgggacctgg

SEQ ID NO: 371878 - DNA, 20 bp, human
gcgcggcgccgtcacgtgtg

SEQ ID NO: 371879 - DNA, 20 bp, human
gggaagggacgcacccccac

SEQ ID NO: 371880 - DNA, 20 bp, human
gggcgccgcgccgaaccgag

SEQ ID NO: 371881 - DNA, 20 bp, human
gaggtgtgcccgccagggaa

SEQ ID NO: 371882 - DNA, 20 bp, human
gccctccctggcgcggggat

SEQ ID NO: 371883 - DNA, 20 bp, human
gcaggaatgaagagttgcat

SEQ ID NO: 371884 - DNA, 20 bp, human
gctgcgagcctcacacgtga

SEQ ID NO: 371885 - DNA, 20 bp, human
gagcgcagaaagtgcgcgaa

SEQ ID NO: 371886 - DNA, 20 bp, human
ggcttcgggggtcctggatt

SEQ ID NO: 371887 - DNA, 20 bp, human
ggtctcccgggcccggcttg

SEQ ID NO: 371888 - DNA, 20 bp, human
ggacaggcggccagcctatg

SEQ ID NO: 371889 - DNA, 20 bp, human
gggactgattggctggaacg

SEQ ID NO: 371890 - DNA, 20 bp, human
gtcgcgacgccaggagcccg

SEQ ID NO: 371891 - DNA, 20 bp, human
gacgcgagccaatgaggagt

SEQ ID NO: 371892 - DNA, 20 bp, human
gtccccggcccactcctcat

SEQ ID NO: 371893 - DNA, 20 bp, human
ggaggcgacgcgagccaatg

SEQ ID NO: 371894 - DNA, 20 bp, human
ggattcggatgctaagatgc

SEQ ID NO: 371895 - DNA, 20 bp, human
ggctaagatgcgggactgat

SEQ ID NO: 371896 - DNA, 20 bp, human
gagcgcagccacagcccggc

SEQ ID NO: 371897 - DNA, 20 bp, human
gccagggactccgagaaggg

SEQ ID NO: 371898 - DNA, 20 bp, human
gggcccgagaagtcgcaccc

SEQ ID NO: 371899 - DNA, 20 bp, human
gggcccagggactccgagaa

SEQ ID NO: 371900 - DNA, 20 bp, human
ggtccctgggcccttcgttt

SEQ ID NO: 371901 - DNA, 20 bp, human
gcaagggtgggtgatgacta

SEQ ID NO: 371902 - DNA, 20 bp, human
gcggccgcggcggcacctca

SEQ ID NO: 371903 - DNA, 20 bp, human
gaaagtggggcctgcaaggg

SEQ ID NO: 371904 - DNA, 20 bp, human
ggctgtggctgcgctcctgg

SEQ ID NO: 371905 - DNA, 20 bp, human
gtggcaaagtggggcctgca

SEQ ID NO: 371906 - DNA, 20 bp, human
gcctcggctgctgggactca

SEQ ID NO: 371907 - DNA, 20 bp, human
gctgtggaggtgactcgagt

SEQ ID NO: 371908 - DNA, 20 bp, human
ggtcacctccacagagctct

SEQ ID NO: 371909 - DNA, 20 bp, human
gggcgcctgtgcctgctccg

SEQ ID NO: 371910 - DNA, 20 bp, human
gggctccagcgctacaagag

SEQ ID NO: 371911 - DNA, 20 bp, human
ggaggtgactcgagtgggca

SEQ ID NO: 371912 - DNA, 20 bp, human
gggcgcgcatgctccgtgtt

SEQ ID NO: 371913 - DNA, 20 bp, human
gccgactcccgctacggccg

SEQ ID NO: 371914 - DNA, 20 bp, human
gggcgggcggtgagcagcgg

SEQ ID NO: 371915 - DNA, 20 bp, human
ggggcgagcgagcctcgcta

SEQ ID NO: 371916 - DNA, 20 bp, human
gacagccgccagcacgtggg

SEQ ID NO: 371917 - DNA, 20 bp, human
ggagctagaggagaagtctt

SEQ ID NO: 371918 - DNA, 20 bp, human
gctcacacgccccctctctc

SEQ ID NO: 371919 - DNA, 20 bp, human
gtcccaggtgacccagagag

SEQ ID NO: 371920 - DNA, 20 bp, human
gggctggcatgaagcagaga

SEQ ID NO: 371921 - DNA, 20 bp, human
ggagacagacaattaaaagc

SEQ ID NO: 371922 - DNA, 20 bp, human
gcatgccagccaatgaggac

SEQ ID NO: 371923 - DNA, 20 bp, human
gagaggagaagtctttgggg

SEQ ID NO: 371924 - DNA, 20 bp, human
gcccctctctctgggtcacc

SEQ ID NO: 371925 - DNA, 20 bp, human
gggtgccggagagcaggctt

SEQ ID NO: 371926 - DNA, 20 bp, human
gagaatacgcctgcctgcgt

SEQ ID NO: 371927 - DNA, 20 bp, human
gagtccaactctgaaatttc

SEQ ID NO: 371928 - DNA, 20 bp, human
gtctgtgagccgacgcaggc

SEQ ID NO: 371929 - DNA, 20 bp, human
gggagttcttcccagataac

SEQ ID NO: 371930 - DNA, 20 bp, human
gaatgaacgccaaacctcta

SEQ ID NO: 371931 - DNA, 20 bp, human
gccgaatgttaactagattc

SEQ ID NO: 371932 - DNA, 20 bp, human
gccaaatactctaaaatctg

SEQ ID NO: 371933 - DNA, 20 bp, human
ggaaagtacagaacaactgt

SEQ ID NO: 371934 - DNA, 20 bp, human
gaacctctatggatatataa

SEQ ID NO: 371935 - DNA, 20 bp, human
gtgttaactagattcaggaa

SEQ ID NO: 371936 - DNA, 20 bp, human
gacgccgcggtccgccaagg

SEQ ID NO: 371937 - DNA, 20 bp, human
ggggacgccgcggtccgcca

SEQ ID NO: 371938 - DNA, 20 bp, human
gtaggtgggtgtgttcccta

SEQ ID NO: 371939 - DNA, 20 bp, human
gctggtctcggttgctaggt

SEQ ID NO: 371940 - DNA, 20 bp, human
gcccgcgatgcagagggaac

SEQ ID NO: 371941 - DNA, 20 bp, human
ggcggtccgccaaggaggaa

SEQ ID NO: 371942 - DNA, 20 bp, human
gtagcaaccgagaccagagc

SEQ ID NO: 371943 - DNA, 20 bp, human
gaggcgcagcgctccagctc

SEQ ID NO: 371944 - DNA, 20 bp, human
gccgcccgccccagaattaa

SEQ ID NO: 371945 - DNA, 20 bp, human
gcggcaatgcacgttactct

SEQ ID NO: 371946 - DNA, 20 bp, human
gcggcctgactcttctggga

SEQ ID NO: 371947 - DNA, 20 bp, human
gtctccggcctgactcttct

SEQ ID NO: 371948 - DNA, 20 bp, human
gtacctgccttccacttccc

SEQ ID NO: 371949 - DNA, 20 bp, human
gccgcagagcagttcgctgc

SEQ ID NO: 371950 - DNA, 20 bp, human
gtggaaggcaggtaggcgac

SEQ ID NO: 371951 - DNA, 20 bp, human
gagccggtaggtgaggttgg

SEQ ID NO: 371952 - DNA, 20 bp, human
gtctccggcgccccctccaa

SEQ ID NO: 371953 - DNA, 20 bp, human
gcgccgccaacctcacctac

SEQ ID NO: 371954 - DNA, 20 bp, human
ggagagccagccggtaggtg

SEQ ID NO: 371955 - DNA, 20 bp, human
gcagggaggaggtgccgcca

SEQ ID NO: 371956 - DNA, 20 bp, human
gaggccgccctaggtaggtg

SEQ ID NO: 371957 - DNA, 20 bp, human
gaggcgaggccgccctaggt

SEQ ID NO: 371958 - DNA, 20 bp, human
gtctcggccacacctaccta

SEQ ID NO: 371959 - DNA, 20 bp, human
gcccacttccggcctcgcga

SEQ ID NO: 371960 - DNA, 20 bp, human
gaagacggcgcgaggaatgc

SEQ ID NO: 371961 - DNA, 20 bp, human
gacggcgcgaggaatgcagg

SEQ ID NO: 371962 - DNA, 20 bp, human
ggcgcggcccagtgaggcgg

SEQ ID NO: 371963 - DNA, 20 bp, human
gcggccacacctacctaggg

SEQ ID NO: 371964 - DNA, 20 bp, human
gctagggcggcctcgcctca

SEQ ID NO: 371965 - DNA, 20 bp, human
ggacagcggggagcggaagt

SEQ ID NO: 371966 - DNA, 20 bp, human
gcccccgcgcaggccttggg

SEQ ID NO: 371967 - DNA, 20 bp, human
gtcacctggccgtttggggt

SEQ ID NO: 371968 - DNA, 20 bp, human
ggggcccccgcgcaggcctt

SEQ ID NO: 371969 - DNA, 20 bp, human
ggcagaggcggcggtaccca

SEQ ID NO: 371970 - DNA, 20 bp, human
gctagagtgtagaggcgcga

SEQ ID NO: 371971 - DNA, 20 bp, human
ggcggcggtacccagggaag

SEQ ID NO: 371972 - DNA, 20 bp, human
gcgggcggtcccaccccaaa

SEQ ID NO: 371973 - DNA, 20 bp, human
ggggaccgcccgcgacccgg

SEQ ID NO: 371974 - DNA, 20 bp, human
ggctgggatgctgagaaccg

SEQ ID NO: 371975 - DNA, 20 bp, human
gggtcccaccccaaacggcc

SEQ ID NO: 371976 - DNA, 20 bp, human
ggtcctagcggagagaagaa

SEQ ID NO: 371977 - DNA, 20 bp, human
gggaaggagacagcgcgcag

SEQ ID NO: 371978 - DNA, 20 bp, human
ggcagcgggcagcccatccc

SEQ ID NO: 371979 - DNA, 20 bp, human
ggggcccagcagccatacgc

SEQ ID NO: 371980 - DNA, 20 bp, human
gctcggcggccccggctctc

SEQ ID NO: 371981 - DNA, 20 bp, human
ggggcagcccatcccgggct

SEQ ID NO: 371982 - DNA, 20 bp, human
ggcagcccgggcccggcgta

SEQ ID NO: 371983 - DNA, 20 bp, human
ggcgcgctggcgagtgacgt

SEQ ID NO: 371984 - DNA, 20 bp, human
ggagcgcgggctcgcggaga

SEQ ID NO: 371985 - DNA, 20 bp, human
gcggggccgtgcgctcggag

SEQ ID NO: 371986 - DNA, 20 bp, human
gggaggagccctgagtgttg

SEQ ID NO: 371987 - DNA, 20 bp, human
ggggcctgggcagtagggca

SEQ ID NO: 371988 - DNA, 20 bp, human
gtggaggggaggttaggccg

SEQ ID NO: 371989 - DNA, 20 bp, human
gggactagggagagacgtga

SEQ ID NO: 371990 - DNA, 20 bp, human
gttgggcttagtctgggagg

SEQ ID NO: 371991 - DNA, 20 bp, human
gggggaggttaggccgagga

SEQ ID NO: 371992 - DNA, 20 bp, human
gccctgagtgttggggatga

SEQ ID NO: 371993 - DNA, 20 bp, human
gagcctcagcaagatgggcc

SEQ ID NO: 371994 - DNA, 20 bp, human
gcaagatgggcctgggcagt

SEQ ID NO: 371995 - DNA, 20 bp, human
gtccttcatccccaacactc

SEQ ID NO: 371996 - DNA, 20 bp, human
gtgcaaagcagcccggaggg

SEQ ID NO: 371997 - DNA, 20 bp, human
gggggcctccgagttaataa

SEQ ID NO: 371998 - DNA, 20 bp, human
ggggctgctttgcaaagatg

SEQ ID NO: 371999 - DNA, 20 bp, human
gggagccggcccccagccat

SEQ ID NO: 372000 - DNA, 20 bp, human
ggggcggcccggggcgaacc

SEQ ID NO: 372001 - DNA, 20 bp, human
gctttgcaaagcagcccgga

SEQ ID NO: 372002 - DNA, 20 bp, human
gcactcccccagctagccaa

SEQ ID NO: 372003 - DNA, 20 bp, human
gcgccgcttccgagcatccc

SEQ ID NO: 372004 - DNA, 20 bp, human
gtctcccgggacccggtcct

SEQ ID NO: 372005 - DNA, 20 bp, human
gggcccggggcgaaccggga

SEQ ID NO: 372006 - DNA, 20 bp, human
gggcccggccgcagcccaag

SEQ ID NO: 372007 - DNA, 20 bp, human
gcgggcccaacggacggcgg

SEQ ID NO: 372008 - DNA, 20 bp, human
gaactggggagcgaggagct

SEQ ID NO: 372009 - DNA, 20 bp, human
gggcccggcccccgcgaact

SEQ ID NO: 372010 - DNA, 20 bp, human
gggcgctcgggcccaacgga

SEQ ID NO: 372011 - DNA, 20 bp, human
ggggccgtccgcatcctccg

SEQ ID NO: 372012 - DNA, 20 bp, human
gcctccggcaagttgcgtcc

SEQ ID NO: 372013 - DNA, 20 bp, human
gaggaggcagcggcgacgga

SEQ ID NO: 372014 - DNA, 20 bp, human
ggctcgggcccaacggacgg

SEQ ID NO: 372015 - DNA, 20 bp, human
gcggcccgcagacggcgagg

SEQ ID NO: 372016 - DNA, 20 bp, human
ggaaagctaaggtttacggg

SEQ ID NO: 372017 - DNA, 20 bp, human
gggtggggacttgcagaaga

SEQ ID NO: 372018 - DNA, 20 bp, human
gggaaacctctgttggaaag

SEQ ID NO: 372019 - DNA, 20 bp, human
gcctgcagccgggtccatcc

SEQ ID NO: 372020 - DNA, 20 bp, human
gtcccactgcccaggtatga

SEQ ID NO: 372021 - DNA, 20 bp, human
gctaaggtttacgggcggcg

SEQ ID NO: 372022 - DNA, 20 bp, human
gaggggaaagctaaggttta

SEQ ID NO: 372023 - DNA, 20 bp, human
gaccgcgcccggcagagatc

SEQ ID NO: 372024 - DNA, 20 bp, human
ggagaccgagagcgcgcagg

SEQ ID NO: 372025 - DNA, 20 bp, human
ggaccctcatacctgggcag

SEQ ID NO: 372026 - DNA, 20 bp, human
ggggcggcgactccccaacc

SEQ ID NO: 372027 - DNA, 20 bp, human
gaaacagagagcgcgactgg

SEQ ID NO: 372028 - DNA, 20 bp, human
gggcgcacctgccaacacgc

SEQ ID NO: 372029 - DNA, 20 bp, human
gagagcgcgactggtggggg

SEQ ID NO: 372030 - DNA, 20 bp, human
gcaaaagcggcgaagttcaa

SEQ ID NO: 372031 - DNA, 20 bp, human
gcgaagttcaaaggcgaggt

SEQ ID NO: 372032 - DNA, 20 bp, human
gcagagagcgcgactggtgg

SEQ ID NO: 372033 - DNA, 20 bp, human
gccaaagcaccgccgagggt

SEQ ID NO: 372034 - DNA, 20 bp, human
gagaggctagctctagactg

SEQ ID NO: 372035 - DNA, 20 bp, human
ggttggcaggtgcgccccct

SEQ ID NO: 372036 - DNA, 20 bp, human
gaggggaggcaatcagcaac

SEQ ID NO: 372037 - DNA, 20 bp, human
gggcaccctgagggtgttgg

SEQ ID NO: 372038 - DNA, 20 bp, human
ggaggcaatcagcaacgggc

SEQ ID NO: 372039 - DNA, 20 bp, human
gtcagcccgtaggtaaaccc

SEQ ID NO: 372040 - DNA, 20 bp, human
gggctggaaggcctgacatc

SEQ ID NO: 372041 - DNA, 20 bp, human
gccacccaagacctgatgtc

SEQ ID NO: 372042 - DNA, 20 bp, human
gaactccggagaccacaaag

SEQ ID NO: 372043 - DNA, 20 bp, human
ggggcccgagttgtgctgag

SEQ ID NO: 372044 - DNA, 20 bp, human
ggccaacatcctcagcccgt

SEQ ID NO: 372045 - DNA, 20 bp, human
gactgcccctggggcaagaa

SEQ ID NO: 372046 - DNA, 20 bp, human
gcaaggctacacctgccccc

SEQ ID NO: 372047 - DNA, 20 bp, human
gggcgggcgtggggttggac

SEQ ID NO: 372048 - DNA, 20 bp, human
gtggggttggactgggacgt

SEQ ID NO: 372049 - DNA, 20 bp, human
ggcgccgcgtcctctcccac

SEQ ID NO: 372050 - DNA, 20 bp, human
ggggactcggaccacggcct

SEQ ID NO: 372051 - DNA, 20 bp, human
ggctccggctagttttcccg

SEQ ID NO: 372052 - DNA, 20 bp, human
gtggactgggacgtgggact

SEQ ID NO: 372053 - DNA, 20 bp, human
gctcgaaaagccgtctggga

SEQ ID NO: 372054 - DNA, 20 bp, human
gcaggtgtagccttgggcgc

SEQ ID NO: 372055 - DNA, 20 bp, human
ggggcgcccgcagtgtcact

SEQ ID NO: 372056 - DNA, 20 bp, human
ggcctcagcggaatcccgcc

SEQ ID NO: 372057 - DNA, 20 bp, human
gcccccgggtgggaaagaaa

SEQ ID NO: 372058 - DNA, 20 bp, human
gaaggagagaccccccgggt

SEQ ID NO: 372059 - DNA, 20 bp, human
ggacccccgggcagtaactg

SEQ ID NO: 372060 - DNA, 20 bp, human
gcccgggggtccgactccgt

SEQ ID NO: 372061 - DNA, 20 bp, human
ggccgggcgggattccgctg

SEQ ID NO: 372062 - DNA, 20 bp, human
gagaagaaagggagcccccg

SEQ ID NO: 372063 - DNA, 20 bp, human
gcgcccgccccgccgccgat

SEQ ID NO: 372064 - DNA, 20 bp, human
ggctcagggccaatcggcgg

SEQ ID NO: 372065 - DNA, 20 bp, human
gtcccccgcgacctctcaga

SEQ ID NO: 372066 - DNA, 20 bp, human
ggggctgtcagggaataaat

SEQ ID NO: 372067 - DNA, 20 bp, human
gacagcccccgtcacatgga

SEQ ID NO: 372068 - DNA, 20 bp, human
gggatacaaaggtttctcag

SEQ ID NO: 372069 - DNA, 20 bp, human
gccgggttttgcatgaaagg

SEQ ID NO: 372070 - DNA, 20 bp, human
gacaaccatccatgtgacgg

SEQ ID NO: 372071 - DNA, 20 bp, human
ggtgacctgttgctgcgaga

SEQ ID NO: 372072 - DNA, 20 bp, human
gcatgtgacgggggctgtca

SEQ ID NO: 372073 - DNA, 20 bp, human
ggggacgcgggaagcagcta

SEQ ID NO: 372074 - DNA, 20 bp, human
ggctgcgagaggggatacaa

SEQ ID NO: 372075 - DNA, 20 bp, human
gcaaaacccggcagcgaggc

SEQ ID NO: 372076 - DNA, 20 bp, human
gccgatgggaaacccccaat

SEQ ID NO: 372077 - DNA, 20 bp, human
gagaacgcagagcgcagcaa

SEQ ID NO: 372078 - DNA, 20 bp, human
ggctgctggactgacgggtg

SEQ ID NO: 372079 - DNA, 20 bp, human
gtctcccgctgctggactga

SEQ ID NO: 372080 - DNA, 20 bp, human
gcgggagaggaagactcgag

SEQ ID NO: 372081 - DNA, 20 bp, human
gcgagaggcaggtgctgcgg

SEQ ID NO: 372082 - DNA, 20 bp, human
gtccgggcagggtgcgccga

SEQ ID NO: 372083 - DNA, 20 bp, human
gagaggaagactcgagaggc

SEQ ID NO: 372084 - DNA, 20 bp, human
gtcggcaggcgcgcctgaag

SEQ ID NO: 372085 - DNA, 20 bp, human
gtgggaaacccccaatcggc

SEQ ID NO: 372086 - DNA, 20 bp, human
ggggcgtggggtgaacgaaa

SEQ ID NO: 372087 - DNA, 20 bp, human
gcggaggacccgtgattgac

SEQ ID NO: 372088 - DNA, 20 bp, human
gtaggccaaagaggggcgtg

SEQ ID NO: 372089 - DNA, 20 bp, human
gacgtcactaggccaaagag

SEQ ID NO: 372090 - DNA, 20 bp, human
ggtccacgaggcccactcag

SEQ ID NO: 372091 - DNA, 20 bp, human
gaacctgaggaggtgacggg

SEQ ID NO: 372092 - DNA, 20 bp, human
gaaccccggggaatccgagc

SEQ ID NO: 372093 - DNA, 20 bp, human
gcaaatcagcaggaacccgc

SEQ ID NO: 372094 - DNA, 20 bp, human
gtccgcccctcgcaacccgg

SEQ ID NO: 372095 - DNA, 20 bp, human
gtacctgctcggattccccg

SEQ ID NO: 372096 - DNA, 20 bp, human
gtccaggccgctgacatcca

SEQ ID NO: 372097 - DNA, 20 bp, human
gtcggccctgagtaccacca

SEQ ID NO: 372098 - DNA, 20 bp, human
gccacccggagctgcgacaa

SEQ ID NO: 372099 - DNA, 20 bp, human
gaaagccctggtggtactca

SEQ ID NO: 372100 - DNA, 20 bp, human
gcttgtgcacgcgctctgtg

SEQ ID NO: 372101 - DNA, 20 bp, human
gggggcaagggtgacaagca

SEQ ID NO: 372102 - DNA, 20 bp, human
gggagcctggaacaggataa

SEQ ID NO: 372103 - DNA, 20 bp, human
gcgcagctccgggtggggga

SEQ ID NO: 372104 - DNA, 20 bp, human
gttcattccctggatgtcag

SEQ ID NO: 372105 - DNA, 20 bp, human
ggacgcaagacttcattccc

SEQ ID NO: 372106 - DNA, 20 bp, human
gagcgcgcgcccacctaggt

SEQ ID NO: 372107 - DNA, 20 bp, human
ggtggaggatccctggtcac

SEQ ID NO: 372108 - DNA, 20 bp, human
gaggtgaccgagggcctagt

SEQ ID NO: 372109 - DNA, 20 bp, human
ggccgcggaaagcagatctg

SEQ ID NO: 372110 - DNA, 20 bp, human
gacacagccgactaggccct

SEQ ID NO: 372111 - DNA, 20 bp, human
gcctcggtcacctgtgacca

SEQ ID NO: 372112 - DNA, 20 bp, human
gctagtcggctgtgtcattg

SEQ ID NO: 372113 - DNA, 20 bp, human
gaccagggatcctccacgat

SEQ ID NO: 372114 - DNA, 20 bp, human
ggttgccagcccacctaggt

SEQ ID NO: 372115 - DNA, 20 bp, human
ggcggtcccgccgatcgtgg

SEQ ID NO: 372116 - DNA, 20 bp, human
gaatgggaagcccgggggag

SEQ ID NO: 372117 - DNA, 20 bp, human
gcatcgggttccaagccaat

SEQ ID NO: 372118 - DNA, 20 bp, human
ggcggagattattattgcat

SEQ ID NO: 372119 - DNA, 20 bp, human
gcatgccaaacccctccccc

SEQ ID NO: 372120 - DNA, 20 bp, human
ggtttggcatgaggaagcgt

SEQ ID NO: 372121 - DNA, 20 bp, human
gaaggggcttggaacggggc

SEQ ID NO: 372122 - DNA, 20 bp, human
gagactgtgaaaggataaag

SEQ ID NO: 372123 - DNA, 20 bp, human
gtaaagccaaagctgtaaag

SEQ ID NO: 372124 - DNA, 20 bp, human
gtaacaaggggcttggaacg

SEQ ID NO: 372125 - DNA, 20 bp, human
ggtgtgtatagtgtgtgaag

SEQ ID NO: 372126 - DNA, 20 bp, human
ggaggatggagcatcggtga

SEQ ID NO: 372127 - DNA, 20 bp, human
gaaatacgaggatggagcat

SEQ ID NO: 372128 - DNA, 20 bp, human
gaatacgtccacatataaaa

SEQ ID NO: 372129 - DNA, 20 bp, human
gctggtgataatttcgttgt

SEQ ID NO: 372130 - DNA, 20 bp, human
gggaaaaagaaatacgagga

SEQ ID NO: 372131 - DNA, 20 bp, human
ggcatctgattacatttaca

SEQ ID NO: 372132 - DNA, 20 bp, human
gtatgtggacgtatttatac

SEQ ID NO: 372133 - DNA, 20 bp, human
gatcggaatcgtgatggtgt

SEQ ID NO: 372134 - DNA, 20 bp, human
gcttctcatttacacctata

SEQ ID NO: 372135 - DNA, 20 bp, human
gttggattatttcaatggtg

SEQ ID NO: 372136 - DNA, 20 bp, human
ggcgtgtggctccgcggagg

SEQ ID NO: 372137 - DNA, 20 bp, human
gagactggtcaaggagtcct

SEQ ID NO: 372138 - DNA, 20 bp, human
gtccgcggagccacacgctc

SEQ ID NO: 372139 - DNA, 20 bp, human
gaacggagagagcctagaaa

SEQ ID NO: 372140 - DNA, 20 bp, human
gcaaggctctagacaacctc

SEQ ID NO: 372141 - DNA, 20 bp, human
gtccttgaccagtctcttaa

SEQ ID NO: 372142 - DNA, 20 bp, human
ggccacacgctccggctgca

SEQ ID NO: 372143 - DNA, 20 bp, human
ggatttagaagacagagtat

SEQ ID NO: 372144 - DNA, 20 bp, human
gtgagtgacaagttgtttac

SEQ ID NO: 372145 - DNA, 20 bp, human
ggccggagcgtgtggctccg

SEQ ID NO: 372146 - DNA, 20 bp, human
ggcccctaaccacacaatga

SEQ ID NO: 372147 - DNA, 20 bp, human
gatagcactctcttgtattc

SEQ ID NO: 372148 - DNA, 20 bp, human
gtgtgctttgcagtggtatt

SEQ ID NO: 372149 - DNA, 20 bp, human
gtcagaaacaatggccaagc

SEQ ID NO: 372150 - DNA, 20 bp, human
gacggcattaaggatttatg

SEQ ID NO: 372151 - DNA, 20 bp, human
gtcagagtgtaaaactagat

SEQ ID NO: 372152 - DNA, 20 bp, human
ggcattaaggatttatgtgg

SEQ ID NO: 372153 - DNA, 20 bp, human
ggccgtcattgtgtggttag

SEQ ID NO: 372154 - DNA, 20 bp, human
gagatgttctgtcttcaata

SEQ ID NO: 372155 - DNA, 20 bp, human
gaaagaccattccattttag

SEQ ID NO: 372156 - DNA, 20 bp, human
gacccctgaaaaagaactcc

SEQ ID NO: 372157 - DNA, 20 bp, human
gataaaccataggagaaagt

SEQ ID NO: 372158 - DNA, 20 bp, human
gactagccaaatgcaaggat

SEQ ID NO: 372159 - DNA, 20 bp, human
ggtaagttttcataatggac

SEQ ID NO: 372160 - DNA, 20 bp, human
ggaaaatatgcagtaattac

SEQ ID NO: 372161 - DNA, 20 bp, human
gcctgaactagccaaatgca

SEQ ID NO: 372162 - DNA, 20 bp, human
gctttttcaggggtttagag

SEQ ID NO: 372163 - DNA, 20 bp, human
gataaaccaatccttgcatt

SEQ ID NO: 372164 - DNA, 20 bp, human
gagcttcttgaaagtattta

SEQ ID NO: 372165 - DNA, 20 bp, human
gttagggtgatagttagcaa

SEQ ID NO: 372166 - DNA, 20 bp, human
ggcaatattggatggaaatg

SEQ ID NO: 372167 - DNA, 20 bp, human
gcctgacaggaataccttgt

SEQ ID NO: 372168 - DNA, 20 bp, human
gtggaacccataagatgctt

SEQ ID NO: 372169 - DNA, 20 bp, human
ggcagtgtttgttctaccta

SEQ ID NO: 372170 - DNA, 20 bp, human
gaaaaagttgttaaagtaga

SEQ ID NO: 372171 - DNA, 20 bp, human
gtatagcctaagcatcttat

SEQ ID NO: 372172 - DNA, 20 bp, human
gtatgtgagcaaaacaattt

SEQ ID NO: 372173 - DNA, 20 bp, human
gattaaagaagtatactttc

SEQ ID NO: 372174 - DNA, 20 bp, human
gcttatgggttccacgcctt

SEQ ID NO: 372175 - DNA, 20 bp, human
gtatcttaaatgtgcctgac

SEQ ID NO: 372176 - DNA, 20 bp, human
gtgagcttcaaggacatgaa

SEQ ID NO: 372177 - DNA, 20 bp, human
gttgttaggagagaccattg

SEQ ID NO: 372178 - DNA, 20 bp, human
ggaaaaaggtggtaaaaagg

SEQ ID NO: 372179 - DNA, 20 bp, human
gcaaaagctggtagtctaac

SEQ ID NO: 372180 - DNA, 20 bp, human
gactaaaactacactcagtt

SEQ ID NO: 372181 - DNA, 20 bp, human
gatggaagttggagttacta

SEQ ID NO: 372182 - DNA, 20 bp, human
gaaaaggtagcatacttgat

SEQ ID NO: 372183 - DNA, 20 bp, human
gttccctcacagatggaagt

SEQ ID NO: 372184 - DNA, 20 bp, human
gaactcataagctcaaaagc

SEQ ID NO: 372185 - DNA, 20 bp, human
gtaggccagtgatgtgaaaa

SEQ ID NO: 372186 - DNA, 20 bp, human
gcgcctgggcgtgtctgccg

SEQ ID NO: 372187 - DNA, 20 bp, human
gagcagggcggggcaacctg

SEQ ID NO: 372188 - DNA, 20 bp, human
gctccgcggcagacacgccc

SEQ ID NO: 372189 - DNA, 20 bp, human
gtattcgctcattggctaga

SEQ ID NO: 372190 - DNA, 20 bp, human
gagggcggggcaacctgggg

SEQ ID NO: 372191 - DNA, 20 bp, human
gcacgtgagcttatgctccg

SEQ ID NO: 372192 - DNA, 20 bp, human
gctcacgtggattacctgta

SEQ ID NO: 372193 - DNA, 20 bp, human
gcctcgccggcggactgcag

SEQ ID NO: 372194 - DNA, 20 bp, human
ggatgtgagtaaagcccgcc

SEQ ID NO: 372195 - DNA, 20 bp, human
gggagtacgtattcgctcat

SEQ ID NO: 372196 - DNA, 20 bp, human
gcccgcgcccggctacccat

SEQ ID NO: 372197 - DNA, 20 bp, human
gcgccccgatcccccggagg

SEQ ID NO: 372198 - DNA, 20 bp, human
gacccgaggtcgccgcgcgg

SEQ ID NO: 372199 - DNA, 20 bp, human
ggccgcggagctttctttat

SEQ ID NO: 372200 - DNA, 20 bp, human
ggcgcgccccgatcccccgg

SEQ ID NO: 372201 - DNA, 20 bp, human
gagccgcgcggcgcccgcag

SEQ ID NO: 372202 - DNA, 20 bp, human
gggcctgcgggcgagacctc

SEQ ID NO: 372203 - DNA, 20 bp, human
gggagcgcgccccgatcccc

SEQ ID NO: 372204 - DNA, 20 bp, human
ggagacctcaggcgcgagac

SEQ ID NO: 372205 - DNA, 20 bp, human
gctccagagaggggagctcc

SEQ ID NO: 372206 - DNA, 20 bp, human
gggaggggatcgcagccaaa

SEQ ID NO: 372207 - DNA, 20 bp, human
gctgggtgacgaggcgggag

SEQ ID NO: 372208 - DNA, 20 bp, human
gcaccctaccgtccgccctt

SEQ ID NO: 372209 - DNA, 20 bp, human
gggcgggtggctctaaggtg

SEQ ID NO: 372210 - DNA, 20 bp, human
gcagccaaagggcggacggt

SEQ ID NO: 372211 - DNA, 20 bp, human
gggggatcgcagccaaaggg

SEQ ID NO: 372212 - DNA, 20 bp, human
gatcgcagccaaagggcgga

SEQ ID NO: 372213 - DNA, 20 bp, human
gctcctccctccccaaaatc

SEQ ID NO: 372214 - DNA, 20 bp, human
gtcagctgcctgccaaccct

SEQ ID NO: 372215 - DNA, 20 bp, human
gttggacccgattttgggga

SEQ ID NO: 372216 - DNA, 20 bp, human
gctccctgagacgtagggat

SEQ ID NO: 372217 - DNA, 20 bp, human
gaaaccagtcaaccggcagg

SEQ ID NO: 372218 - DNA, 20 bp, human
gaaggggcggggcctaggtt

SEQ ID NO: 372219 - DNA, 20 bp, human
gaacccggaccggacaggga

SEQ ID NO: 372220 - DNA, 20 bp, human
gctgccccgcccaatgaggg

SEQ ID NO: 372221 - DNA, 20 bp, human
gaagactcgcttgctctcca

SEQ ID NO: 372222 - DNA, 20 bp, human
gctgctgccccgcccaatga

SEQ ID NO: 372223 - DNA, 20 bp, human
gggataggcaaagctttgat

SEQ ID NO: 372224 - DNA, 20 bp, human
gagcccgcctgccggttgac

SEQ ID NO: 372225 - DNA, 20 bp, human
gccccgcccaatgagggagg

SEQ ID NO: 372226 - DNA, 20 bp, human
gcaggccccaagcaggaagt

SEQ ID NO: 372227 - DNA, 20 bp, human
gaaagggctccgcccaaatg

SEQ ID NO: 372228 - DNA, 20 bp, human
gcgacagactgactcagaaa

SEQ ID NO: 372229 - DNA, 20 bp, human
ggtgtccgtagcccagaagg

SEQ ID NO: 372230 - DNA, 20 bp, human
gtcggccgacttcctgcttg

SEQ ID NO: 372231 - DNA, 20 bp, human
gacagtgtccgtagcccaga

SEQ ID NO: 372232 - DNA, 20 bp, human
gcacaaacaagtggacaccc

SEQ ID NO: 372233 - DNA, 20 bp, human
gttaacctccttctgggcta

SEQ ID NO: 372234 - DNA, 20 bp, human
gcaagtggacacccgggagc

SEQ ID NO: 372235 - DNA, 20 bp, human
gtgctctgccctctaagagg

SEQ ID NO: 372236 - DNA, 20 bp, human
gagcctcacaagtgcccatg

SEQ ID NO: 372237 - DNA, 20 bp, human
gccaactgccaagacgtcct

SEQ ID NO: 372238 - DNA, 20 bp, human
ggggcacttgtgaggctccc

SEQ ID NO: 372239 - DNA, 20 bp, human
gcctctctccacctcctcat

SEQ ID NO: 372240 - DNA, 20 bp, human
gcaagccggaagctgaaggc

SEQ ID NO: 372241 - DNA, 20 bp, human
gcccagcggcaataggaact

SEQ ID NO: 372242 - DNA, 20 bp, human
gttgccaagccggaagctga

SEQ ID NO: 372243 - DNA, 20 bp, human
gtctctgggctgatcccaac

SEQ ID NO: 372244 - DNA, 20 bp, human
ggacaaacgcagtaaggggc

SEQ ID NO: 372245 - DNA, 20 bp, human
gtgaggctcccaggacgtct

SEQ ID NO: 372246 - DNA, 20 bp, human
gagccagccccacgaggcca

SEQ ID NO: 372247 - DNA, 20 bp, human
gcatgacgtctctcagtcaa

SEQ ID NO: 372248 - DNA, 20 bp, human
ggtcatggagattgggtgga

SEQ ID NO: 372249 - DNA, 20 bp, human
gtccccaccccttgctgagg

SEQ ID NO: 372250 - DNA, 20 bp, human
ggtctctcagtcaagggagg

SEQ ID NO: 372251 - DNA, 20 bp, human
gagacgtcatggagattggg

SEQ ID NO: 372252 - DNA, 20 bp, human
gctgtcttccgtggcctcgt

SEQ ID NO: 372253 - DNA, 20 bp, human
gtgagagacgtcatggagat

SEQ ID NO: 372254 - DNA, 20 bp, human
gttccgtggcctcgtggggc

SEQ ID NO: 372255 - DNA, 20 bp, human
ggaggtaaggtggcatcatg

SEQ ID NO: 372256 - DNA, 20 bp, human
ggcacaagcaagtggactcc

SEQ ID NO: 372257 - DNA, 20 bp, human
gtgagggtgagtcagtctgt

SEQ ID NO: 372258 - DNA, 20 bp, human
gagtccacttgcttgtgcaa

SEQ ID NO: 372259 - DNA, 20 bp, human
ggacttcctgctccgggtca

SEQ ID NO: 372260 - DNA, 20 bp, human
gccagccctgctcgtcctct

SEQ ID NO: 372261 - DNA, 20 bp, human
gcctcctttttcactccaag

SEQ ID NO: 372262 - DNA, 20 bp, human
gacggtgtctgtatcccagc

SEQ ID NO: 372263 - DNA, 20 bp, human
gacagatttctgcccaaatg

SEQ ID NO: 372264 - DNA, 20 bp, human
gtcggccgacttcctgctcc

SEQ ID NO: 372265 - DNA, 20 bp, human
gctgctctgccctcttaaga

SEQ ID NO: 372266 - DNA, 20 bp, human
ggtgcaatgtcactgatgga

SEQ ID NO: 372267 - DNA, 20 bp, human
gtgacattgcacagacctat

SEQ ID NO: 372268 - DNA, 20 bp, human
gcccgccaccgcccgagcga

SEQ ID NO: 372269 - DNA, 20 bp, human
gtattcaattggctttcggt

SEQ ID NO: 372270 - DNA, 20 bp, human
gctagacgcctctggttgat

SEQ ID NO: 372271 - DNA, 20 bp, human
gacgtcgctctagacgcctc

SEQ ID NO: 372272 - DNA, 20 bp, human
ggactttgcctccctccaat

SEQ ID NO: 372273 - DNA, 20 bp, human
ggcatcagccaattggaggg

SEQ ID NO: 372274 - DNA, 20 bp, human
gtccaagcgcttattggtga

SEQ ID NO: 372275 - DNA, 20 bp, human
gaataagcgcttggaacatt

SEQ ID NO: 372276 - DNA, 20 bp, human
ggtttgctcagtagcggcag

SEQ ID NO: 372277 - DNA, 20 bp, human
gcggcggctccaagagcgcg

SEQ ID NO: 372278 - DNA, 20 bp, human
gccagcagagcgagcggtga

SEQ ID NO: 372279 - DNA, 20 bp, human
gtgcccgggcgcagtcggcg

SEQ ID NO: 372280 - DNA, 20 bp, human
ggagccggggtgcttggagc

SEQ ID NO: 372281 - DNA, 20 bp, human
ggtgaggagcggctgaaccc

SEQ ID NO: 372282 - DNA, 20 bp, human
gagcgggggacgccaggcgt

SEQ ID NO: 372283 - DNA, 20 bp, human
gaccccggctccccggtccg

SEQ ID NO: 372284 - DNA, 20 bp, human
gtcgcacaggaagtacgact

SEQ ID NO: 372285 - DNA, 20 bp, human
ggtcgggccgcctttcgcac

SEQ ID NO: 372286 - DNA, 20 bp, human
gggtggagagtcggaggctc

SEQ ID NO: 372287 - DNA, 20 bp, human
gcgccgccgctgtcaatcaa

SEQ ID NO: 372288 - DNA, 20 bp, human
gagcgccagaggagccaggg

SEQ ID NO: 372289 - DNA, 20 bp, human
ggccccggcccccggcaggt

SEQ ID NO: 372290 - DNA, 20 bp, human
gggtcggcggccaatccgct

SEQ ID NO: 372291 - DNA, 20 bp, human
gggagagtcggaggctccgg

SEQ ID NO: 372292 - DNA, 20 bp, human
gaaggaataaccccgagaaa

SEQ ID NO: 372293 - DNA, 20 bp, human
gttggccgccgacctgccgg

SEQ ID NO: 372294 - DNA, 20 bp, human
gaccccttcccccagcggat

SEQ ID NO: 372295 - DNA, 20 bp, human
gataaccccgagaaaggggg

SEQ ID NO: 372296 - DNA, 20 bp, human
ggggccgccagccagtcaga

SEQ ID NO: 372297 - DNA, 20 bp, human
ggggccccggcgctcagagc

SEQ ID NO: 372298 - DNA, 20 bp, human
ggcgcggcgaggggcaaggg

SEQ ID NO: 372299 - DNA, 20 bp, human
gccgaggcatggacacccga

SEQ ID NO: 372300 - DNA, 20 bp, human
gcccaatcatcaaagaatag

SEQ ID NO: 372301 - DNA, 20 bp, human
gccaagcgcgggtctccagg

SEQ ID NO: 372302 - DNA, 20 bp, human
gcgtgtgcggcgagggtgca

SEQ ID NO: 372303 - DNA, 20 bp, human
gaggggcggcggtataatag

SEQ ID NO: 372304 - DNA, 20 bp, human
ggggtgtgcaagtaaataca

SEQ ID NO: 372305 - DNA, 20 bp, human
gggcaaggccccctttgatc

SEQ ID NO: 372306 - DNA, 20 bp, human
ggagagcgcgggtgagtcac

SEQ ID NO: 372307 - DNA, 20 bp, human
gggtccagccgagccctcaa

SEQ ID NO: 372308 - DNA, 20 bp, human
gagcgcgggtgagtcacggg

SEQ ID NO: 372309 - DNA, 20 bp, human
gacccagggggaatggataa

SEQ ID NO: 372310 - DNA, 20 bp, human
gcggggcgggtcttagaacc

SEQ ID NO: 372311 - DNA, 20 bp, human
gtgggggaggaaagataact

SEQ ID NO: 372312 - DNA, 20 bp, human
gcctcctcgcggccctggct

SEQ ID NO: 372313 - DNA, 20 bp, human
ggacgcaggactaagaccca

SEQ ID NO: 372314 - DNA, 20 bp, human
gcggccgcctttaacccttg

SEQ ID NO: 372315 - DNA, 20 bp, human
gtaacccttgagggctcggc

SEQ ID NO: 372316 - DNA, 20 bp, human
ggtggctgtacccatgtgag

SEQ ID NO: 372317 - DNA, 20 bp, human
gcacactcatggccaaacac

SEQ ID NO: 372318 - DNA, 20 bp, human
gcacacagtaccactcacat

SEQ ID NO: 372319 - DNA, 20 bp, human
ggcacacagtgacgcactgg

SEQ ID NO: 372320 - DNA, 20 bp, human
gagatccaggggggggatgg

SEQ ID NO: 372321 - DNA, 20 bp, human
gtctccatggtcagctgggg

SEQ ID NO: 372322 - DNA, 20 bp, human
gggggaagcaagcctctcca

SEQ ID NO: 372323 - DNA, 20 bp, human
gcccctggatctctaattag

SEQ ID NO: 372324 - DNA, 20 bp, human
ggcactgggaggaagactga

SEQ ID NO: 372325 - DNA, 20 bp, human
gcatgcatcacccctgtgtt

SEQ ID NO: 372326 - DNA, 20 bp, human
gcgcctgccgccgtggtgga

SEQ ID NO: 372327 - DNA, 20 bp, human
gtgacagtgtggtaaaggcg

SEQ ID NO: 372328 - DNA, 20 bp, human
ggcgcgcgccgtgaggtcat

SEQ ID NO: 372329 - DNA, 20 bp, human
ggcccggcgaggccgcagat

SEQ ID NO: 372330 - DNA, 20 bp, human
ggagggagctacaattgtgg

SEQ ID NO: 372331 - DNA, 20 bp, human
gtgcgagtgtgaccaggcgt

SEQ ID NO: 372332 - DNA, 20 bp, human
gggcggcgccgatgacctca

SEQ ID NO: 372333 - DNA, 20 bp, human
gggcgcggccagccaatctg

SEQ ID NO: 372334 - DNA, 20 bp, human
gggacagtgcggagactgga

SEQ ID NO: 372335 - DNA, 20 bp, human
gactcccccttccaccacgg

SEQ ID NO: 372336 - DNA, 20 bp, human
ggcccctcggagcgtctgat

SEQ ID NO: 372337 - DNA, 20 bp, human
gcagctagctagggccgcgg

SEQ ID NO: 372338 - DNA, 20 bp, human
gggggtgggggggagtagtg

SEQ ID NO: 372339 - DNA, 20 bp, human
gctccgaggggcccgagccc

SEQ ID NO: 372340 - DNA, 20 bp, human
gtgcgcctctcgcccaatga

SEQ ID NO: 372341 - DNA, 20 bp, human
ggctctgcctgcgccctcat

SEQ ID NO: 372342 - DNA, 20 bp, human
gagccaatcagacgctccga

SEQ ID NO: 372343 - DNA, 20 bp, human
gtggcacgcgccgggagccc

SEQ ID NO: 372344 - DNA, 20 bp, human
gattggctgcggggcagctc

SEQ ID NO: 372345 - DNA, 20 bp, human
gcctagctagctgacttgac

SEQ ID NO: 372346 - DNA, 20 bp, human
ggactgggaaagtgggttcc

SEQ ID NO: 372347 - DNA, 20 bp, human
gggctgcgaggactgcaaaa

SEQ ID NO: 372348 - DNA, 20 bp, human
gccagtcctgaggtcgcggg

SEQ ID NO: 372349 - DNA, 20 bp, human
gccgcctaggactgggaaag

SEQ ID NO: 372350 - DNA, 20 bp, human
gcgcgccggggcttgtactc

SEQ ID NO: 372351 - DNA, 20 bp, human
gctgaccgccgcctaggact

SEQ ID NO: 372352 - DNA, 20 bp, human
ggggaaagtgggttcccggc

SEQ ID NO: 372353 - DNA, 20 bp, human
gtgcaagcatggtcgcgccg

SEQ ID NO: 372354 - DNA, 20 bp, human
gagtgggttcccggcagggg

SEQ ID NO: 372355 - DNA, 20 bp, human
ggtcagggatggtaagtggg

SEQ ID NO: 372356 - DNA, 20 bp, human
ggcacccggaaggctcaagg

SEQ ID NO: 372357 - DNA, 20 bp, human
ggccctgggcagggaacttc

SEQ ID NO: 372358 - DNA, 20 bp, human
gaggctcaaggaggcgccct

SEQ ID NO: 372359 - DNA, 20 bp, human
gtgcgacaagtccctaggag

SEQ ID NO: 372360 - DNA, 20 bp, human
gccgcgtgcgacaagtccct

SEQ ID NO: 372361 - DNA, 20 bp, human
gaagggcggcgtcctctcct

SEQ ID NO: 372362 - DNA, 20 bp, human
gaacttccggttgcggggaa

SEQ ID NO: 372363 - DNA, 20 bp, human
gggcagggaacttccggttg

SEQ ID NO: 372364 - DNA, 20 bp, human
gcaaggaggcgccctgggca

SEQ ID NO: 372365 - DNA, 20 bp, human
gtcacacgaagagtatgtga

SEQ ID NO: 372366 - DNA, 20 bp, human
gtgggctagtcaaagctctg

SEQ ID NO: 372367 - DNA, 20 bp, human
gtgagtggaagggctcaggt

SEQ ID NO: 372368 - DNA, 20 bp, human
gggtgcacggggatgatggt

SEQ ID NO: 372369 - DNA, 20 bp, human
gaccctgagtggaagggctc

SEQ ID NO: 372370 - DNA, 20 bp, human
gcctctggaccctgagtgga

SEQ ID NO: 372371 - DNA, 20 bp, human
gggtacccagggatgttaac

SEQ ID NO: 372372 - DNA, 20 bp, human
ggttctagaaggccctccgt

SEQ ID NO: 372373 - DNA, 20 bp, human
gcaggctccaggccaacgga

SEQ ID NO: 372374 - DNA, 20 bp, human
ggtggggcagagatgtgcaa

SEQ ID NO: 372375 - DNA, 20 bp, human
gcacacacacactacactga

SEQ ID NO: 372376 - DNA, 20 bp, human
ggacctgccggggcgcaaga

SEQ ID NO: 372377 - DNA, 20 bp, human
gtggaatatggggtcactat

SEQ ID NO: 372378 - DNA, 20 bp, human
gtgtgctgtacacccgccaa

SEQ ID NO: 372379 - DNA, 20 bp, human
ggctctggggatgaggtcat

SEQ ID NO: 372380 - DNA, 20 bp, human
gaatatggggtcactatggg

SEQ ID NO: 372381 - DNA, 20 bp, human
ggcagagccctcttgcgccc

SEQ ID NO: 372382 - DNA, 20 bp, human
gctgccccgccgacctgccg

SEQ ID NO: 372383 - DNA, 20 bp, human
gagtgggtgtcacaatccaa

SEQ ID NO: 372384 - DNA, 20 bp, human
gtatccagggtccccgagcc

SEQ ID NO: 372385 - DNA, 20 bp, human
ggtgaccccatattccagat

SEQ ID NO: 372386 - DNA, 20 bp, human
gggcaagtgctaggggtcgt

SEQ ID NO: 372387 - DNA, 20 bp, human
gccaacaagcacttccgctt

SEQ ID NO: 372388 - DNA, 20 bp, human
gggctgcggtgccaaagagt

SEQ ID NO: 372389 - DNA, 20 bp, human
gcaaagagtcggtcccgaag

SEQ ID NO: 372390 - DNA, 20 bp, human
gcggttctgcgcacgctcag

SEQ ID NO: 372391 - DNA, 20 bp, human
ggcggccccatgttgactat

SEQ ID NO: 372392 - DNA, 20 bp, human
gttggcggacggggtctcaa

SEQ ID NO: 372393 - DNA, 20 bp, human
gagcagtgacgtcaccggca

SEQ ID NO: 372394 - DNA, 20 bp, human
gagagggaaggtagccttgc

SEQ ID NO: 372395 - DNA, 20 bp, human
gtccgccaatagtcaacatg

SEQ ID NO: 372396 - DNA, 20 bp, human
gagtctgagtgagagtgagt

SEQ ID NO: 372397 - DNA, 20 bp, human
gagagtgagtggggtgaaga

SEQ ID NO: 372398 - DNA, 20 bp, human
gaatatgacatgaaagaatt

SEQ ID NO: 372399 - DNA, 20 bp, human
ggtaccaaggatgagtgcta

SEQ ID NO: 372400 - DNA, 20 bp, human
gagaggtgaacaaggtacca

SEQ ID NO: 372401 - DNA, 20 bp, human
gctgttgcattggggattaa

SEQ ID NO: 372402 - DNA, 20 bp, human
gaggggcattctggaactct

SEQ ID NO: 372403 - DNA, 20 bp, human
ggggcacattccagtaaatt

SEQ ID NO: 372404 - DNA, 20 bp, human
gataatatgaggcccagtat

SEQ ID NO: 372405 - DNA, 20 bp, human
gacagtgttgggcgatgttg

SEQ ID NO: 372406 - DNA, 20 bp, human
ggacctgtgacatcaggacc

SEQ ID NO: 372407 - DNA, 20 bp, human
gagcaccctgaggactcaag

SEQ ID NO: 372408 - DNA, 20 bp, human
gtccagggacctgtgacatc

SEQ ID NO: 372409 - DNA, 20 bp, human
ggggagctggcatcttgcca

SEQ ID NO: 372410 - DNA, 20 bp, human
gtgtcctggagaccaaggat

SEQ ID NO: 372411 - DNA, 20 bp, human
gtcctgatgtcacaggtccc

SEQ ID NO: 372412 - DNA, 20 bp, human
gtggtggggaggtcatgtcc

SEQ ID NO: 372413 - DNA, 20 bp, human
ggacctgtgacatcacaacc

SEQ ID NO: 372414 - DNA, 20 bp, human
ggcaataagaaagagtggag

SEQ ID NO: 372415 - DNA, 20 bp, human
gtctgtccagagtctgtgac

SEQ ID NO: 372416 - DNA, 20 bp, human
gaaggtgaacctgtggccgt

SEQ ID NO: 372417 - DNA, 20 bp, human
gaccaattgggcataagagt

SEQ ID NO: 372418 - DNA, 20 bp, human
gtcaccttccccgccttcac

SEQ ID NO: 372419 - DNA, 20 bp, human
gcactggcagaggaccaatt

SEQ ID NO: 372420 - DNA, 20 bp, human
gcacgccccgacccgcagtc

SEQ ID NO: 372421 - DNA, 20 bp, human
gggcgacaggctgacggccg

SEQ ID NO: 372422 - DNA, 20 bp, human
ggtcctctgccagtgaaggc

SEQ ID NO: 372423 - DNA, 20 bp, human
gaccaactcttatgcccaat

SEQ ID NO: 372424 - DNA, 20 bp, human
ggccgtcagcctgtcgcctc

SEQ ID NO: 372425 - DNA, 20 bp, human
ggacaggctgacggccgggg

SEQ ID NO: 372426 - DNA, 20 bp, human
gggccgcgacttccccgacg

SEQ ID NO: 372427 - DNA, 20 bp, human
gaaggggcggtgggccgcga

SEQ ID NO: 372428 - DNA, 20 bp, human
gggggcgagaggtcgaggcg

SEQ ID NO: 372429 - DNA, 20 bp, human
gaaggtgaacctgtggccgt

SEQ ID NO: 372430 - DNA, 20 bp, human
gtcgaggcggggaggcgaag

SEQ ID NO: 372431 - DNA, 20 bp, human
ggggacggtggcgggtgtcg

SEQ ID NO: 372432 - DNA, 20 bp, human
gagtgcagccagagccggtg

SEQ ID NO: 372433 - DNA, 20 bp, human
gcgcgagggagaaggagcga

SEQ ID NO: 372434 - DNA, 20 bp, human
gggcgacaggctgacggccg

SEQ ID NO: 372435 - DNA, 20 bp, human
gcacgccccgacccgcagtc

SEQ ID NO: 372436 - DNA, 20 bp, human
ggatgacttctcattctcaa

SEQ ID NO: 372437 - DNA, 20 bp, human
gacgcctgaatgccttgggt

SEQ ID NO: 372438 - DNA, 20 bp, human
gtggaggggaccaagaaaca

SEQ ID NO: 372439 - DNA, 20 bp, human
gtgaatgccttgggtgggtt

SEQ ID NO: 372440 - DNA, 20 bp, human
gagaaagatgaaaggcatgg

SEQ ID NO: 372441 - DNA, 20 bp, human
ggctactatcccactgctgg

SEQ ID NO: 372442 - DNA, 20 bp, human
gcacgctactatcccactgc

SEQ ID NO: 372443 - DNA, 20 bp, human
gccctaatgttcatgagaac

SEQ ID NO: 372444 - DNA, 20 bp, human
gcacagctcttcccacgctc

SEQ ID NO: 372445 - DNA, 20 bp, human
ggagaagcgtttgaggacat

SEQ ID NO: 372446 - DNA, 20 bp, human
gggggtaaagagaatggaaa

SEQ ID NO: 372447 - DNA, 20 bp, human
gatcaacaggaggtgtctgg

SEQ ID NO: 372448 - DNA, 20 bp, human
ggacatcaacaggaggtgtc

SEQ ID NO: 372449 - DNA, 20 bp, human
gacccagtgacatcaacagg

SEQ ID NO: 372450 - DNA, 20 bp, human
gcacctcctgttgatgtcac

SEQ ID NO: 372451 - DNA, 20 bp, human
gtggacccagtgacatcaac

SEQ ID NO: 372452 - DNA, 20 bp, human
gagaaagatgaaaggcatgg

SEQ ID NO: 372453 - DNA, 20 bp, human
gtggaggggaccaagaaaca

SEQ ID NO: 372454 - DNA, 20 bp, human
gacgcctgaatgccttgggt

SEQ ID NO: 372455 - DNA, 20 bp, human
gccctaatgttcatgagaac

SEQ ID NO: 372456 - DNA, 20 bp, human
gaccagccccgggcacgtaa

SEQ ID NO: 372457 - DNA, 20 bp, human
gaagggttaccgggagtcca

SEQ ID NO: 372458 - DNA, 20 bp, human
gtgcccggggctggtccgtg

SEQ ID NO: 372459 - DNA, 20 bp, human
gagagctcgggcgcagctct

SEQ ID NO: 372460 - DNA, 20 bp, human
gcgggcacgtaagggttacc

SEQ ID NO: 372461 - DNA, 20 bp, human
gccgcgcctcccagttaccg

SEQ ID NO: 372462 - DNA, 20 bp, human
gaaaaccaagctgcttgggt

SEQ ID NO: 372463 - DNA, 20 bp, human
gcgttgccacggtaactggg

SEQ ID NO: 372464 - DNA, 20 bp, human
gccaagctgcttgggtagga

SEQ ID NO: 372465 - DNA, 20 bp, human
gacatcgttgccacggtaac

SEQ ID NO: 372466 - DNA, 20 bp, human
gcccagttcctgaaccacgt

SEQ ID NO: 372467 - DNA, 20 bp, human
gagagcgcgcggcagcttgg

SEQ ID NO: 372468 - DNA, 20 bp, human
gcccctcccccaacaccgtt

SEQ ID NO: 372469 - DNA, 20 bp, human
gaacaccgttcggaatcctt

SEQ ID NO: 372470 - DNA, 20 bp, human
ggcctccgtctccacagcaa

SEQ ID NO: 372471 - DNA, 20 bp, human
ggacggaggcggttgaccca

SEQ ID NO: 372472 - DNA, 20 bp, human
ggaggctgaaacagtgcaga

SEQ ID NO: 372473 - DNA, 20 bp, human
gaaagctgcacaactggagg

SEQ ID NO: 372474 - DNA, 20 bp, human
gagtcctaaaatttgaccgg

SEQ ID NO: 372475 - DNA, 20 bp, human
ggtcgggctacgttcttcta

SEQ ID NO: 372476 - DNA, 20 bp, human
ggggaggctccgtcaagagt

SEQ ID NO: 372477 - DNA, 20 bp, human
gcggagctggagccgggata

SEQ ID NO: 372478 - DNA, 20 bp, human
gtgaggggcggggcttcaga

SEQ ID NO: 372479 - DNA, 20 bp, human
gccaggagaccaactcttga

SEQ ID NO: 372480 - DNA, 20 bp, human
gtggagccgggatagggctg

SEQ ID NO: 372481 - DNA, 20 bp, human
gtcttgacggagcctccctg

SEQ ID NO: 372482 - DNA, 20 bp, human
ggtcctggacggttatggga

SEQ ID NO: 372483 - DNA, 20 bp, human
gaggggcggggaaaatcttg

SEQ ID NO: 372484 - DNA, 20 bp, human
ggcggggaaaatcttgtggt

SEQ ID NO: 372485 - DNA, 20 bp, human
ggcctcaatgttagcgtgag

SEQ ID NO: 372486 - DNA, 20 bp, human
gtggccgcgcgtcacggagc

SEQ ID NO: 372487 - DNA, 20 bp, human
gctgccctggccgcgcgtca

SEQ ID NO: 372488 - DNA, 20 bp, human
gacaacaaagtcagaaggag

SEQ ID NO: 372489 - DNA, 20 bp, human
gggagaggctgccatggcta

SEQ ID NO: 372490 - DNA, 20 bp, human
ggcttgctgtaaaagaggcc

SEQ ID NO: 372491 - DNA, 20 bp, human
gcagaaaaccccatctaaaa

SEQ ID NO: 372492 - DNA, 20 bp, human
gctgccatggctacggctcc

SEQ ID NO: 372493 - DNA, 20 bp, human
gtcacctggagccgtagcca

SEQ ID NO: 372494 - DNA, 20 bp, human
gaaacaacaacaaagtcaga

SEQ ID NO: 372495 - DNA, 20 bp, human
gctgagtgccattttagatg

SEQ ID NO: 372496 - DNA, 20 bp, human
gggcggttagcccagtaaac

SEQ ID NO: 372497 - DNA, 20 bp, human
gccgccggtgtctgaggtga

SEQ ID NO: 372498 - DNA, 20 bp, human
ggaaaacgctcgacaacgga

SEQ ID NO: 372499 - DNA, 20 bp, human
gcaggcgcgcgcgtacgctc

SEQ ID NO: 372500 - DNA, 20 bp, human
gacaccggggaggaccacgc

SEQ ID NO: 372501 - DNA, 20 bp, human
ggccctaccgccggtgtctg

SEQ ID NO: 372502 - DNA, 20 bp, human
ggaggtgagggctccgtcag

SEQ ID NO: 372503 - DNA, 20 bp, human
gacctcagacaccggcggta

SEQ ID NO: 372504 - DNA, 20 bp, human
gaagccgctcggcaccgctt

SEQ ID NO: 372505 - DNA, 20 bp, human
ggaggactgagggagaccta

SEQ ID NO: 372506 - DNA, 20 bp, human
ggcagtgcagggatactcga

SEQ ID NO: 372507 - DNA, 20 bp, human
gacggcgcgcgatgtcccgg

SEQ ID NO: 372508 - DNA, 20 bp, human
gccaagggagcctggttcga

SEQ ID NO: 372509 - DNA, 20 bp, human
gtcgaggactcggactgctg

SEQ ID NO: 372510 - DNA, 20 bp, human
gtgcctgggcgcactgagcg

SEQ ID NO: 372511 - DNA, 20 bp, human
gacgcccgagctcgaggact

SEQ ID NO: 372512 - DNA, 20 bp, human
gtcagtgcgcccaggcaccg

SEQ ID NO: 372513 - DNA, 20 bp, human
gtgtaaggagctccgacctc

SEQ ID NO: 372514 - DNA, 20 bp, human
gcagtccgagtcctcgagct

SEQ ID NO: 372515 - DNA, 20 bp, human
gccgacctccgggcagtgca

SEQ ID NO: 372516 - DNA, 20 bp, human
gctccggcctctgtctgcgg

SEQ ID NO: 372517 - DNA, 20 bp, human
gggaggccgccatgcaccgc

SEQ ID NO: 372518 - DNA, 20 bp, human
gccaggcccgcggtgcatgg

SEQ ID NO: 372519 - DNA, 20 bp, human
gaaggccggaaacacgtcgg

SEQ ID NO: 372520 - DNA, 20 bp, human
gcggtgcgtcttaaagggaa

SEQ ID NO: 372521 - DNA, 20 bp, human
gccaagatggcggacctact

SEQ ID NO: 372522 - DNA, 20 bp, human
gcaggctggggtggtttcga

SEQ ID NO: 372523 - DNA, 20 bp, human
gagactcggcgcaaggcccg

SEQ ID NO: 372524 - DNA, 20 bp, human
gccagcctgcgaattcccat

SEQ ID NO: 372525 - DNA, 20 bp, human
gggcgcagatcccaggcccg

SEQ ID NO: 372526 - DNA, 20 bp, human
gtgggcggacttgcaggtgg

SEQ ID NO: 372527 - DNA, 20 bp, human
gaagactgtttggacgtgga

SEQ ID NO: 372528 - DNA, 20 bp, human
gcggcattccgcctcagacg

SEQ ID NO: 372529 - DNA, 20 bp, human
gcctgcgcagaagtacagct

SEQ ID NO: 372530 - DNA, 20 bp, human
gtggaggcaagtcctctgcg

SEQ ID NO: 372531 - DNA, 20 bp, human
gtgccgccgggaccggaaag

SEQ ID NO: 372532 - DNA, 20 bp, human
gcagcctagtgctgttaggg

SEQ ID NO: 372533 - DNA, 20 bp, human
gggacctccctaacagcact

SEQ ID NO: 372534 - DNA, 20 bp, human
gaggcaagtcctctgcgggg

SEQ ID NO: 372535 - DNA, 20 bp, human
gcgcctcagacggggtttta

SEQ ID NO: 372536 - DNA, 20 bp, human
gaagacggtgcgggcgccaa

SEQ ID NO: 372537 - DNA, 20 bp, human
gggcgcccgcaccgtcttcg

SEQ ID NO: 372538 - DNA, 20 bp, human
ggggcggggccaagcgtctt

SEQ ID NO: 372539 - DNA, 20 bp, human
ggggcgggtcccaggggaaa

SEQ ID NO: 372540 - DNA, 20 bp, human
gacacccggcgccgcgaaga

SEQ ID NO: 372541 - DNA, 20 bp, human
ggcgccaatgggaaagactg

SEQ ID NO: 372542 - DNA, 20 bp, human
gcgaccgcagtctttcccat

SEQ ID NO: 372543 - DNA, 20 bp, human
ggggaaagactgcggtcggc

SEQ ID NO: 372544 - DNA, 20 bp, human
gcggcgccgcgaagacggtg

SEQ ID NO: 372545 - DNA, 20 bp, human
gccgccccgcggatgacgtg

SEQ ID NO: 372546 - DNA, 20 bp, human
ggaggaaagaaacttaaagg

SEQ ID NO: 372547 - DNA, 20 bp, human
ggaaagaaagcccacagtgg

SEQ ID NO: 372548 - DNA, 20 bp, human
ggtaccaggtggaccaacta

SEQ ID NO: 372549 - DNA, 20 bp, human
gcagcttctcaataaatggg

SEQ ID NO: 372550 - DNA, 20 bp, human
gttctttcctccctggtgtg

SEQ ID NO: 372551 - DNA, 20 bp, human
ggtttgggaaactggtgcaa

SEQ ID NO: 372552 - DNA, 20 bp, human
gcacctggtaccccatggac

SEQ ID NO: 372553 - DNA, 20 bp, human
gctctctgatcctccactgt

SEQ ID NO: 372554 - DNA, 20 bp, human
gaggaaagctgtttgctttg

SEQ ID NO: 372555 - DNA, 20 bp, human
gagtcagcttctcaataaat

SEQ ID NO: 372556 - DNA, 20 bp, human
ggggctactgctgagatgaa

SEQ ID NO: 372557 - DNA, 20 bp, human
gaatcctaggtctccaaaaa

SEQ ID NO: 372558 - DNA, 20 bp, human
ggagacctaggattcagtgt

SEQ ID NO: 372559 - DNA, 20 bp, human
gaaaagggagaattactatg

SEQ ID NO: 372560 - DNA, 20 bp, human
gagagcccacactgaatcct

SEQ ID NO: 372561 - DNA, 20 bp, human
gaactggatctctgagctct

SEQ ID NO: 372562 - DNA, 20 bp, human
gggactacctgtcttttaac

SEQ ID NO: 372563 - DNA, 20 bp, human
gacactgtaaaaccgtcact

SEQ ID NO: 372564 - DNA, 20 bp, human
ggagtattcttggattttta

SEQ ID NO: 372565 - DNA, 20 bp, human
gtttaaggaagaaagtagct

SEQ ID NO: 372566 - DNA, 20 bp, human
ggccaatggcggtcctaagg

SEQ ID NO: 372567 - DNA, 20 bp, human
ggccaccttaggaccgccat

SEQ ID NO: 372568 - DNA, 20 bp, human
gcggttcacatggaagcgag

SEQ ID NO: 372569 - DNA, 20 bp, human
gtaggaatgactgcggggaa

SEQ ID NO: 372570 - DNA, 20 bp, human
gccagccaatggcggtccta

SEQ ID NO: 372571 - DNA, 20 bp, human
gacttcataggaatgactgc

SEQ ID NO: 372572 - DNA, 20 bp, human
ggtgatgtcaaagccacctt

SEQ ID NO: 372573 - DNA, 20 bp, human
ggagtggtggcagatcagtt

SEQ ID NO: 372574 - DNA, 20 bp, human
gtaaaagtaaatggtcttca

SEQ ID NO: 372575 - DNA, 20 bp, human
gaggggtgacagggatgtag

SEQ ID NO: 372576 - DNA, 20 bp, human
gaaacccagggagttgtcag

SEQ ID NO: 372577 - DNA, 20 bp, human
gccacctctgacaactccct

SEQ ID NO: 372578 - DNA, 20 bp, human
gacaactccctgggtttgtg

SEQ ID NO: 372579 - DNA, 20 bp, human
gggtagtcctagggtggctt

SEQ ID NO: 372580 - DNA, 20 bp, human
gtgaaagttaatggtcttca

SEQ ID NO: 372581 - DNA, 20 bp, human
ggcagaaacctgaaagttaa

SEQ ID NO: 372582 - DNA, 20 bp, human
gcttcgtcttgctcccagga

SEQ ID NO: 372583 - DNA, 20 bp, human
gtttgtgggggaggggtgaa

SEQ ID NO: 372584 - DNA, 20 bp, human
gactaggtcatggtgagggt

SEQ ID NO: 372585 - DNA, 20 bp, human
ggtggcttcgtcttgctccc

SEQ ID NO: 372586 - DNA, 20 bp, human
gggagggaccacggggtgga

SEQ ID NO: 372587 - DNA, 20 bp, human
gcaggcagggttgggacgtt

SEQ ID NO: 372588 - DNA, 20 bp, human
gggcccccaggggcagaacc

SEQ ID NO: 372589 - DNA, 20 bp, human
ggccccggaacagatgaggc

SEQ ID NO: 372590 - DNA, 20 bp, human
gagggttgggacgtttggtc

SEQ ID NO: 372591 - DNA, 20 bp, human
gtgttctgggtcatccctcc

SEQ ID NO: 372592 - DNA, 20 bp, human
gcagctttggctatgggaga

SEQ ID NO: 372593 - DNA, 20 bp, human
gtgccctctgaacaagaaag

SEQ ID NO: 372594 - DNA, 20 bp, human
gggaaaccactcagagctct

SEQ ID NO: 372595 - DNA, 20 bp, human
ggccctggcactctgtgagt

SEQ ID NO: 372596 - DNA, 20 bp, human
gcatgagaggccagcctgct

SEQ ID NO: 372597 - DNA, 20 bp, human
gaggctggcctctcatgcga

SEQ ID NO: 372598 - DNA, 20 bp, human
gaattctggtggcgtggatg

SEQ ID NO: 372599 - DNA, 20 bp, human
gatattctggccaagttatg

SEQ ID NO: 372600 - DNA, 20 bp, human
ggggagtagggattaaagga

SEQ ID NO: 372601 - DNA, 20 bp, human
gtctcatgcgagggctttac

SEQ ID NO: 372602 - DNA, 20 bp, human
ggagccaagtgcttatattc

SEQ ID NO: 372603 - DNA, 20 bp, human
gcagtggagagctgtgttga

SEQ ID NO: 372604 - DNA, 20 bp, human
ggtgacagacgagaatttgg

SEQ ID NO: 372605 - DNA, 20 bp, human
gcagcctgctagggaaatcc

SEQ ID NO: 372606 - DNA, 20 bp, human
gcacacgcgtacaggggccc

SEQ ID NO: 372607 - DNA, 20 bp, human
ggggccgcacacgcgtacag

SEQ ID NO: 372608 - DNA, 20 bp, human
gaggacagcgacaggaaggg

SEQ ID NO: 372609 - DNA, 20 bp, human
ggtgagccgaactgcacatt

SEQ ID NO: 372610 - DNA, 20 bp, human
gggcccgagccaccgactgc

SEQ ID NO: 372611 - DNA, 20 bp, human
ggagtgggaaagccgagagg

SEQ ID NO: 372612 - DNA, 20 bp, human
gcgcgcgccggagaaaaaca

SEQ ID NO: 372613 - DNA, 20 bp, human
gtgtgcagttcggctcacgt

SEQ ID NO: 372614 - DNA, 20 bp, human
gtccacggaagggggaattg

SEQ ID NO: 372615 - DNA, 20 bp, human
gcgacctaagtcttctccga

SEQ ID NO: 372616 - DNA, 20 bp, human
gtcagaatcagggactggaa

SEQ ID NO: 372617 - DNA, 20 bp, human
gctcaactcccagcaaacaa

SEQ ID NO: 372618 - DNA, 20 bp, human
gaaagggatatgccagggag

SEQ ID NO: 372619 - DNA, 20 bp, human
gtcaggaccctgggtcacat

SEQ ID NO: 372620 - DNA, 20 bp, human
gatcagggactggaagggat

SEQ ID NO: 372621 - DNA, 20 bp, human
gctgtgactcacaaaggctc

SEQ ID NO: 372622 - DNA, 20 bp, human
gaggagtcagaatcagggac

SEQ ID NO: 372623 - DNA, 20 bp, human
ggttgagctgtgactcacaa

SEQ ID NO: 372624 - DNA, 20 bp, human
gcacagtaggagtcagaatc

SEQ ID NO: 372625 - DNA, 20 bp, human
gctcacaaaggctctggtcc

SEQ ID NO: 372626 - DNA, 20 bp, human
gtggggtccccggctgtggt

SEQ ID NO: 372627 - DNA, 20 bp, human
gacactaccaaccacagccg

SEQ ID NO: 372628 - DNA, 20 bp, human
ggggaactgtttttgatggg

SEQ ID NO: 372629 - DNA, 20 bp, human
gtggcctgatatggggcggg

SEQ ID NO: 372630 - DNA, 20 bp, human
gggcgtggcctgatatgggg

SEQ ID NO: 372631 - DNA, 20 bp, human
ggagggagtgagctaaccgg

SEQ ID NO: 372632 - DNA, 20 bp, human
ggggggcgtggcctgatatg

SEQ ID NO: 372633 - DNA, 20 bp, human
gttttgatgggtggggtccc

SEQ ID NO: 372634 - DNA, 20 bp, human
gcctgagggagtgagctaac

SEQ ID NO: 372635 - DNA, 20 bp, human
gcttccccccgccccatatc

SEQ ID NO: 372636 - DNA, 20 bp, human
gatcgcgcccacaagtggcg

SEQ ID NO: 372637 - DNA, 20 bp, human
gggcccatcgcgcccacaag

SEQ ID NO: 372638 - DNA, 20 bp, human
gagtgacccgcgccacttgt

SEQ ID NO: 372639 - DNA, 20 bp, human
gtgaaacgtcccgtgccacg

SEQ ID NO: 372640 - DNA, 20 bp, human
gcaactcaagaggaaagact

SEQ ID NO: 372641 - DNA, 20 bp, human
ggtgggcgcgatgggcctcg

SEQ ID NO: 372642 - DNA, 20 bp, human
ggcgatgggcctcgtggcac

SEQ ID NO: 372643 - DNA, 20 bp, human
gtatgatcaataaaataatc

SEQ ID NO: 372644 - DNA, 20 bp, human
gattgcttttagaatctgaa

SEQ ID NO: 372645 - DNA, 20 bp, human
gacatcaagtgcaactcaag

SEQ ID NO: 372646 - DNA, 20 bp, human
gagtaggaagaggggattat

SEQ ID NO: 372647 - DNA, 20 bp, human
gctactgcgagtaggaagag

SEQ ID NO: 372648 - DNA, 20 bp, human
gaaggggaaagcagtaaacg

SEQ ID NO: 372649 - DNA, 20 bp, human
ggaaccccgggagtgagcta

SEQ ID NO: 372650 - DNA, 20 bp, human
ggaagaggggattataggaa

SEQ ID NO: 372651 - DNA, 20 bp, human
gtgaacaaaaagtcgaaccc

SEQ ID NO: 372652 - DNA, 20 bp, human
gagtaaacgcggagaactaa

SEQ ID NO: 372653 - DNA, 20 bp, human
gtaaaccatagctcactccc

SEQ ID NO: 372654 - DNA, 20 bp, human
ggcttccggaagccgacagg

SEQ ID NO: 372655 - DNA, 20 bp, human
gtaccggtctccatggtaac

SEQ ID NO: 372656 - DNA, 20 bp, human
ggggcacccagaaccccgaa

SEQ ID NO: 372657 - DNA, 20 bp, human
gcccagaaccccgaatgggg

SEQ ID NO: 372658 - DNA, 20 bp, human
ggcgcggctgtcacccaggg

SEQ ID NO: 372659 - DNA, 20 bp, human
gagtccacccctggggcgcg

SEQ ID NO: 372660 - DNA, 20 bp, human
gctgagacgcgcagccgcgc

SEQ ID NO: 372661 - DNA, 20 bp, human
ggcgtctcagtccacccctg

SEQ ID NO: 372662 - DNA, 20 bp, human
ggaaaggcgaaagaataaag

SEQ ID NO: 372663 - DNA, 20 bp, human
gtgcttttctggacacgcgt

SEQ ID NO: 372664 - DNA, 20 bp, human
gtcctccccattcggggttc

SEQ ID NO: 372665 - DNA, 20 bp, human
gcagcattcctccccattcg

SEQ ID NO: 372666 - DNA, 20 bp, human
gttgaagcagggtaactcat

SEQ ID NO: 372667 - DNA, 20 bp, human
gcaccatgggtcagccaatc

SEQ ID NO: 372668 - DNA, 20 bp, human
gccaagagcccctgcatttc

SEQ ID NO: 372669 - DNA, 20 bp, human
gcacccagagcctgaaatgc

SEQ ID NO: 372670 - DNA, 20 bp, human
gacccatggtgatgtgacaa

SEQ ID NO: 372671 - DNA, 20 bp, human
gatgcaggggctcttggcaa

SEQ ID NO: 372672 - DNA, 20 bp, human
gcatgggtcagccaatcagg

SEQ ID NO: 372673 - DNA, 20 bp, human
ggcccctgcatttcaggctc

SEQ ID NO: 372674 - DNA, 20 bp, human
gcaggcaggaggatggggtc

SEQ ID NO: 372675 - DNA, 20 bp, human
gggccattgtcacatcacca

SEQ ID NO: 372676 - DNA, 20 bp, human
gcgaagagcgaggacgaaac

SEQ ID NO: 372677 - DNA, 20 bp, human
gaggcggaggacaaagcgga

SEQ ID NO: 372678 - DNA, 20 bp, human
ggacgcaagccgctcggcct

SEQ ID NO: 372679 - DNA, 20 bp, human
gccaccatccctaggccgag

SEQ ID NO: 372680 - DNA, 20 bp, human
ggggaagcggtcgatgcccg

SEQ ID NO: 372681 - DNA, 20 bp, human
gccggccagccaccatccct

SEQ ID NO: 372682 - DNA, 20 bp, human
ggagcggcttgcgtcacgtc

SEQ ID NO: 372683 - DNA, 20 bp, human
ggcgcgctggctccgggaag

SEQ ID NO: 372684 - DNA, 20 bp, human
ggacggagactacaacccag

SEQ ID NO: 372685 - DNA, 20 bp, human
gtgaggcgggcccgaagaga

SEQ ID NO: 372686 - DNA, 20 bp, human
ggtctccgagcgtcgccctg

SEQ ID NO: 372687 - DNA, 20 bp, human
gtccgagcgtcgccctgcgg

SEQ ID NO: 372688 - DNA, 20 bp, human
gcacagaatgggtcctccca

SEQ ID NO: 372689 - DNA, 20 bp, human
gtgggagatgctagggacat

SEQ ID NO: 372690 - DNA, 20 bp, human
gcaggcacccgagccttggg

SEQ ID NO: 372691 - DNA, 20 bp, human
ggcgaggcctgcaccggcgc

SEQ ID NO: 372692 - DNA, 20 bp, human
ggagcgcagaattgcagatc

SEQ ID NO: 372693 - DNA, 20 bp, human
gaatgggtcctcccaaggct

SEQ ID NO: 372694 - DNA, 20 bp, human
gctagggctgggagatgcta

SEQ ID NO: 372695 - DNA, 20 bp, human
gtccgccgcagggcgacgct

SEQ ID NO: 372696 - DNA, 20 bp, human
gactctccccagactgtgtg

SEQ ID NO: 372697 - DNA, 20 bp, human
gagaaaccccacacagtctg

SEQ ID NO: 372698 - DNA, 20 bp, human
gcgagcacataccctatgcc

SEQ ID NO: 372699 - DNA, 20 bp, human
gtggcccaataatcactgtg

SEQ ID NO: 372700 - DNA, 20 bp, human
ggaactgaaagtgctctgaa

SEQ ID NO: 372701 - DNA, 20 bp, human
gtgctgagtactggggtcac

SEQ ID NO: 372702 - DNA, 20 bp, human
gcctggagctcgcagactgg

SEQ ID NO: 372703 - DNA, 20 bp, human
gtgaaccagtgacaagctgg

SEQ ID NO: 372704 - DNA, 20 bp, human
gtatgccaggtgctgagtac

SEQ ID NO: 372705 - DNA, 20 bp, human
gaggatggtaggagctggat

SEQ ID NO: 372706 - DNA, 20 bp, human
gcccctgcagagcgtctctg

SEQ ID NO: 372707 - DNA, 20 bp, human
gctctctgggcaaaactcta

SEQ ID NO: 372708 - DNA, 20 bp, human
gcgggaatcaggctgttcgc

SEQ ID NO: 372709 - DNA, 20 bp, human
gttagacgatggtggggctg

SEQ ID NO: 372710 - DNA, 20 bp, human
gccacagtgtgagaacgcca

SEQ ID NO: 372711 - DNA, 20 bp, human
gttctcacactgtggaccca

SEQ ID NO: 372712 - DNA, 20 bp, human
ggctgcgggagcttgcggga

SEQ ID NO: 372713 - DNA, 20 bp, human
gcctcaccccctggccctta

SEQ ID NO: 372714 - DNA, 20 bp, human
gccggggctgcgggagcttg

SEQ ID NO: 372715 - DNA, 20 bp, human
ggggcacactttttagacga

SEQ ID NO: 372716 - DNA, 20 bp, human
gtaaaggagccgcctggagc

SEQ ID NO: 372717 - DNA, 20 bp, human
gacggcgaggatcacccccg

SEQ ID NO: 372718 - DNA, 20 bp, human
ggcgaggggccgcctcttaa

SEQ ID NO: 372719 - DNA, 20 bp, human
ggggacttcctatgttagcg

SEQ ID NO: 372720 - DNA, 20 bp, human
gaaactgctgacaaccctta

SEQ ID NO: 372721 - DNA, 20 bp, human
gaggcggctcctttaagagg

SEQ ID NO: 372722 - DNA, 20 bp, human
gtccccgccccccgttgcca

SEQ ID NO: 372723 - DNA, 20 bp, human
gtgtggcgtcgcattctcat

SEQ ID NO: 372724 - DNA, 20 bp, human
gcccctcgccccgctaacat

SEQ ID NO: 372725 - DNA, 20 bp, human
gagctggcgggggcggaaga

SEQ ID NO: 372726 - DNA, 20 bp, human
gagaacctggacatgacaat

SEQ ID NO: 372727 - DNA, 20 bp, human
gtatctgggtgactcgttca

SEQ ID NO: 372728 - DNA, 20 bp, human
gaccaggagctgggtgttct

SEQ ID NO: 372729 - DNA, 20 bp, human
gtcaaggaacaaaactatct

SEQ ID NO: 372730 - DNA, 20 bp, human
ggggtgactcgttcaaggtt

SEQ ID NO: 372731 - DNA, 20 bp, human
ggtgaaggggagggtctatg

SEQ ID NO: 372732 - DNA, 20 bp, human
gtggacatgacaataggatg

SEQ ID NO: 372733 - DNA, 20 bp, human
ggttaaaagagcaccagacc

SEQ ID NO: 372734 - DNA, 20 bp, human
ggccttgtagagtaagactt

SEQ ID NO: 372735 - DNA, 20 bp, human
gtacctcattaggagttttg

SEQ ID NO: 372736 - DNA, 20 bp, human
ggggcggggcctggtgaaag

SEQ ID NO: 372737 - DNA, 20 bp, human
ggcggtgacaggaggctctc

SEQ ID NO: 372738 - DNA, 20 bp, human
gcgcggggaagcaggtgcgc

SEQ ID NO: 372739 - DNA, 20 bp, human
gcgggcgacgcggtgacagg

SEQ ID NO: 372740 - DNA, 20 bp, human
gcccgggcggagccgactcc

SEQ ID NO: 372741 - DNA, 20 bp, human
gctctcggggtgcctcgcgc

SEQ ID NO: 372742 - DNA, 20 bp, human
gggtccgcggccgtgacgct

SEQ ID NO: 372743 - DNA, 20 bp, human
gagacgggcgacgcggtgac

SEQ ID NO: 372744 - DNA, 20 bp, human
ggggctgggtccctgtctcg

SEQ ID NO: 372745 - DNA, 20 bp, human
ggggcggagccgactcccgg

SEQ ID NO: 372746 - DNA, 20 bp, human
ggtcaccagccccgtagcca

SEQ ID NO: 372747 - DNA, 20 bp, human
gtcctcacagccctggctac

SEQ ID NO: 372748 - DNA, 20 bp, human
ggacctgaagatgaatgcgt

SEQ ID NO: 372749 - DNA, 20 bp, human
gaaagccagggtggctccta

SEQ ID NO: 372750 - DNA, 20 bp, human
gccagcagagaggtgtctga

SEQ ID NO: 372751 - DNA, 20 bp, human
gatgaaggaggacaccaggc

SEQ ID NO: 372752 - DNA, 20 bp, human
gaggtagctcacatggaccc

SEQ ID NO: 372753 - DNA, 20 bp, human
gtggggaacatggatttttg

SEQ ID NO: 372754 - DNA, 20 bp, human
ggtgtctgaaggcagcgctc

SEQ ID NO: 372755 - DNA, 20 bp, human
ggtgacccacacctcctgtg

SEQ ID NO: 372756 - DNA, 20 bp, human
ggagtggcaaggtagggcag

SEQ ID NO: 372757 - DNA, 20 bp, human
gagtcacagaaggtttctaa

SEQ ID NO: 372758 - DNA, 20 bp, human
ggaaatggagtggcaaggta

SEQ ID NO: 372759 - DNA, 20 bp, human
gtaaggcagaaacgttctgt

SEQ ID NO: 372760 - DNA, 20 bp, human
gagaaggtttctaagggtgc

SEQ ID NO: 372761 - DNA, 20 bp, human
gcccaggcattgccactctc

SEQ ID NO: 372762 - DNA, 20 bp, human
gaaacagtaaagcgggactt

SEQ ID NO: 372763 - DNA, 20 bp, human
gtatatgacatgaaaaggga

SEQ ID NO: 372764 - DNA, 20 bp, human
gtcctgagagtggcaatgcc

SEQ ID NO: 372765 - DNA, 20 bp, human
gccaggagagtcagctgggc

SEQ ID NO: 372766 - DNA, 20 bp, human
gactgaggactgtctctgac

SEQ ID NO: 372767 - DNA, 20 bp, human
gagtgggaaggagcgatttg

SEQ ID NO: 372768 - DNA, 20 bp, human
gctatgaaatgggtgggctc

SEQ ID NO: 372769 - DNA, 20 bp, human
gggcttgtatcacacagctg

SEQ ID NO: 372770 - DNA, 20 bp, human
ggctcaggcctagatctcca

SEQ ID NO: 372771 - DNA, 20 bp, human
gcaaaggctatgaaatgggt

SEQ ID NO: 372772 - DNA, 20 bp, human
gcctggctctccttgtacct

SEQ ID NO: 372773 - DNA, 20 bp, human
ggatgaaagtagaaaatgta

SEQ ID NO: 372774 - DNA, 20 bp, human
gagtagaaaatgtaaggtgt

SEQ ID NO: 372775 - DNA, 20 bp, human
gccttgtaccttggagatct

SEQ ID NO: 372776 - DNA, 20 bp, human
gcgagtgaggcgtcctccga

SEQ ID NO: 372777 - DNA, 20 bp, human
ggccccacccccgaggtctt

SEQ ID NO: 372778 - DNA, 20 bp, human
gaggcgtcctccgaaggctg

SEQ ID NO: 372779 - DNA, 20 bp, human
gtcgggcccgcagccttcgg

SEQ ID NO: 372780 - DNA, 20 bp, human
gtcctctccgaagacctcgg

SEQ ID NO: 372781 - DNA, 20 bp, human
gcccgcccgaaacctaaatg

SEQ ID NO: 372782 - DNA, 20 bp, human
gacccccgaggtcttcggag

SEQ ID NO: 372783 - DNA, 20 bp, human
gggccctgggaccacgaaaa

SEQ ID NO: 372784 - DNA, 20 bp, human
gctccctgcctgtggggtcg

SEQ ID NO: 372785 - DNA, 20 bp, human
gtctcgctctaggcccgctg

SEQ ID NO: 372786 - DNA, 20 bp, human
ggcacccggcggggacttcc

SEQ ID NO: 372787 - DNA, 20 bp, human
ggacccgggcttgcgtcgga

SEQ ID NO: 372788 - DNA, 20 bp, human
ggtggccggtcccgccagag

SEQ ID NO: 372789 - DNA, 20 bp, human
gtccgggcggtgtcaggtcc

SEQ ID NO: 372790 - DNA, 20 bp, human
gcgcggaggtgtggggaccc

SEQ ID NO: 372791 - DNA, 20 bp, human
ggccccacttccggtcgcac

SEQ ID NO: 372792 - DNA, 20 bp, human
gcatcccgtgcgaccggaag

SEQ ID NO: 372793 - DNA, 20 bp, human
gtgctctcgcgagaggatgg

SEQ ID NO: 372794 - DNA, 20 bp, human
gcccgcccctctggcgggac

SEQ ID NO: 372795 - DNA, 20 bp, human
gtggggacccgggcttgcgt

SEQ ID NO: 372796 - DNA, 20 bp, human
ggggcggggcggagtcttat

SEQ ID NO: 372797 - DNA, 20 bp, human
gcggggccgggtatcgaggg

SEQ ID NO: 372798 - DNA, 20 bp, human
gccgcggggccgggtatcga

SEQ ID NO: 372799 - DNA, 20 bp, human
gagtaaagcggaagtacggg

SEQ ID NO: 372800 - DNA, 20 bp, human
gtatcgagggaggcaaagct

SEQ ID NO: 372801 - DNA, 20 bp, human
ggctggcggcgcggtctcgt

SEQ ID NO: 372802 - DNA, 20 bp, human
ggctgctgcggcgcttgcgc

SEQ ID NO: 372803 - DNA, 20 bp, human
ggcggcgcggtctcgtgggg

SEQ ID NO: 372804 - DNA, 20 bp, human
ggtggtgtggctgcggtctg

SEQ ID NO: 372805 - DNA, 20 bp, human
gttactcagattttggaccg

SEQ ID NO: 372806 - DNA, 20 bp, human
gagtgcacagcgtggtggga

SEQ ID NO: 372807 - DNA, 20 bp, human
gccggggcagaagtcagcga

SEQ ID NO: 372808 - DNA, 20 bp, human
gggcatctgtgaaagaagat

SEQ ID NO: 372809 - DNA, 20 bp, human
ggtgaaagaagataggttcc

SEQ ID NO: 372810 - DNA, 20 bp, human
gactcaggggattacggcgc

SEQ ID NO: 372811 - DNA, 20 bp, human
gtaagtggcagttccgttcc

SEQ ID NO: 372812 - DNA, 20 bp, human
gcactgctgcgctccactca

SEQ ID NO: 372813 - DNA, 20 bp, human
gcgctccactcaggggatta

SEQ ID NO: 372814 - DNA, 20 bp, human
gagcgcagcagtgcacagcg

SEQ ID NO: 372815 - DNA, 20 bp, human
ggggcaacggacgaattaag

SEQ ID NO: 372816 - DNA, 20 bp, human
ggaaacgttagacgacgctc

SEQ ID NO: 372817 - DNA, 20 bp, human
ggggcctctgggtagagcgt

SEQ ID NO: 372818 - DNA, 20 bp, human
gagctgagtgaaggccgaaa

SEQ ID NO: 372819 - DNA, 20 bp, human
gagattgcgcgcatgcgcta

SEQ ID NO: 372820 - DNA, 20 bp, human
gcatgcgcgcaatctgcttc

SEQ ID NO: 372821 - DNA, 20 bp, human
gtgaaggccgaaagggccaa

SEQ ID NO: 372822 - DNA, 20 bp, human
gacaccaacgctctacccag

SEQ ID NO: 372823 - DNA, 20 bp, human
ggttgctagcagctgagtga

SEQ ID NO: 372824 - DNA, 20 bp, human
gcaactcgatttcacgaaag

SEQ ID NO: 372825 - DNA, 20 bp, human
gagacgacgctcgggcctct

SEQ ID NO: 372826 - DNA, 20 bp, human
ggcggggcttccgaaggggc

SEQ ID NO: 372827 - DNA, 20 bp, human
gcgcccaaagccggacgaaa

SEQ ID NO: 372828 - DNA, 20 bp, human
gcgaggcggagtcgggcagg

SEQ ID NO: 372829 - DNA, 20 bp, human
ggggcgcagactcgttgtca

SEQ ID NO: 372830 - DNA, 20 bp, human
ggagcgaggcggagtcgggc

SEQ ID NO: 372831 - DNA, 20 bp, human
gggaacccaggctggaccgc

SEQ ID NO: 372832 - DNA, 20 bp, human
gacgccgagcgaggcggagt

SEQ ID NO: 372833 - DNA, 20 bp, human
gtgacgaacgccgagcgagg

SEQ ID NO: 372834 - DNA, 20 bp, human
gttgcctcaccccgcccctt

SEQ ID NO: 372835 - DNA, 20 bp, human
ggagctgctgtttgtataat

SEQ ID NO: 372836 - DNA, 20 bp, human
gtgggcaacagcgaccgtga

SEQ ID NO: 372837 - DNA, 20 bp, human
gagctgatggaaagaagatc

SEQ ID NO: 372838 - DNA, 20 bp, human
gtgcccccagccggagagac

SEQ ID NO: 372839 - DNA, 20 bp, human
gagggccagtctctccggct

SEQ ID NO: 372840 - DNA, 20 bp, human
gtgagggcgcgcgtctgcgc

SEQ ID NO: 372841 - DNA, 20 bp, human
gaaaaggctggacaccgtta

SEQ ID NO: 372842 - DNA, 20 bp, human
gcattctgacatggtaattg

SEQ ID NO: 372843 - DNA, 20 bp, human
gccgtctagcacgccagaca

SEQ ID NO: 372844 - DNA, 20 bp, human
gtacagaaactacaaggctt

SEQ ID NO: 372845 - DNA, 20 bp, human
gttactgtaaacactgtcag

SEQ ID NO: 372846 - DNA, 20 bp, human
ggatcccagagcaacagact

SEQ ID NO: 372847 - DNA, 20 bp, human
gctgcgggatacccggtact

SEQ ID NO: 372848 - DNA, 20 bp, human
gcgggatacccggtactagg

SEQ ID NO: 372849 - DNA, 20 bp, human
gctgacaggaggtcgctctg

SEQ ID NO: 372850 - DNA, 20 bp, human
gtatcccgcaggcggggctg

SEQ ID NO: 372851 - DNA, 20 bp, human
gtgtccctgcgggaagagca

SEQ ID NO: 372852 - DNA, 20 bp, human
gggtactaggaggacagttg

SEQ ID NO: 372853 - DNA, 20 bp, human
gggagagacctggcggggaa

SEQ ID NO: 372854 - DNA, 20 bp, human
gaggtcgctctgcggaagac

SEQ ID NO: 372855 - DNA, 20 bp, human
gaccgggtatcccgcaggcg

SEQ ID NO: 372856 - DNA, 20 bp, human
ggcccacttgataacctgtc

SEQ ID NO: 372857 - DNA, 20 bp, human
gcacatgctcggaaccctgt

SEQ ID NO: 372858 - DNA, 20 bp, human
ggcttctggggcagcccaca

SEQ ID NO: 372859 - DNA, 20 bp, human
gctgccttccccaggtgtgc

SEQ ID NO: 372860 - DNA, 20 bp, human
gagcctgacaggttatcaag

SEQ ID NO: 372861 - DNA, 20 bp, human
gggacgcaactgccactggg

SEQ ID NO: 372862 - DNA, 20 bp, human
gcctcctgcacacctgggga

SEQ ID NO: 372863 - DNA, 20 bp, human
ggcggctgaccaagacaaaa

SEQ ID NO: 372864 - DNA, 20 bp, human
gtggcagcttgggcagccaa

SEQ ID NO: 372865 - DNA, 20 bp, human
ggcgtccgttggggcttctg

SEQ ID NO: 372866 - DNA, 20 bp, human
gtgtttggaggcataaggga

SEQ ID NO: 372867 - DNA, 20 bp, human
ggcagtgataccacaaataa

SEQ ID NO: 372868 - DNA, 20 bp, human
gaggatcactaggtcaaact

SEQ ID NO: 372869 - DNA, 20 bp, human
gtgaataataaagtacacta

SEQ ID NO: 372870 - DNA, 20 bp, human
gggcaaaactgtaaagtctt

SEQ ID NO: 372871 - DNA, 20 bp, human
gagttcccccgatcaaatat

SEQ ID NO: 372872 - DNA, 20 bp, human
gttgacctagtgatcctcat

SEQ ID NO: 372873 - DNA, 20 bp, human
gtcttcccatatttgatcgg

SEQ ID NO: 372874 - DNA, 20 bp, human
gacatgtgagggtactagga

SEQ ID NO: 372875 - DNA, 20 bp, human
ggtggtatcactgcagaatt

SEQ ID NO: 372876 - DNA, 20 bp, human
gggcagcaattaacttgcgg

SEQ ID NO: 372877 - DNA, 20 bp, human
gaggggaagtgctatgacac

SEQ ID NO: 372878 - DNA, 20 bp, human
gagcaattaacttgcggtgg

SEQ ID NO: 372879 - DNA, 20 bp, human
gttaacttgcggtgggggag

SEQ ID NO: 372880 - DNA, 20 bp, human
gctagcacggaactggaacc

SEQ ID NO: 372881 - DNA, 20 bp, human
gatctgctggggaaacccag

SEQ ID NO: 372882 - DNA, 20 bp, human
gtcacggaagaggcaccatg

SEQ ID NO: 372883 - DNA, 20 bp, human
ggcgggcagcaattaacttg

SEQ ID NO: 372884 - DNA, 20 bp, human
gtctgacctcacaataccca

SEQ ID NO: 372885 - DNA, 20 bp, human
gggcaccatgagggtgaagt

SEQ ID NO: 372886 - DNA, 20 bp, human
gggtcctgagtgcccgtcac

SEQ ID NO: 372887 - DNA, 20 bp, human
gtgcacctgagtgcccttgg

SEQ ID NO: 372888 - DNA, 20 bp, human
ggcagaaagcacaacccagt

SEQ ID NO: 372889 - DNA, 20 bp, human
gaggaccaccaagggcactc

SEQ ID NO: 372890 - DNA, 20 bp, human
gcccccgttgtcttgatctg

SEQ ID NO: 372891 - DNA, 20 bp, human
gcgcccgggctgaatgaagg

SEQ ID NO: 372892 - DNA, 20 bp, human
gagcccgggcggccagatta

SEQ ID NO: 372893 - DNA, 20 bp, human
gctcaggtgcagatgcccct

SEQ ID NO: 372894 - DNA, 20 bp, human
gagccacagcccactgacga

SEQ ID NO: 372895 - DNA, 20 bp, human
ggggcggccagattagggga

SEQ ID NO: 372896 - DNA, 20 bp, human
gaggaaagggatgagaaatc

SEQ ID NO: 372897 - DNA, 20 bp, human
ggaactgaggcggggaggaa

SEQ ID NO: 372898 - DNA, 20 bp, human
gaggtgttgaagcttggggt

SEQ ID NO: 372899 - DNA, 20 bp, human
gaagccagggaaaccccggc

SEQ ID NO: 372900 - DNA, 20 bp, human
ggtgctcccacgggcaggat

SEQ ID NO: 372901 - DNA, 20 bp, human
gcaagcttcaacacctgccg

SEQ ID NO: 372902 - DNA, 20 bp, human
ggatgctcctaaaacattcc

SEQ ID NO: 372903 - DNA, 20 bp, human
ggaaatctggaactgaggcg

SEQ ID NO: 372904 - DNA, 20 bp, human
gcgtgggagcactgcgtcta

SEQ ID NO: 372905 - DNA, 20 bp, human
ggcaggcaggaggcacacgg

SEQ ID NO: 372906 - DNA, 20 bp, human
gcatctgcaagctttgtgga

SEQ ID NO: 372907 - DNA, 20 bp, human
gaaggcgctctgtaagtggt

SEQ ID NO: 372908 - DNA, 20 bp, human
ggctctctggccattggtac

SEQ ID NO: 372909 - DNA, 20 bp, human
gtggaggctcctgagaggta

SEQ ID NO: 372910 - DNA, 20 bp, human
gagccatggcccggcgtcac

SEQ ID NO: 372911 - DNA, 20 bp, human
gccccctgtctgtcaccccc

SEQ ID NO: 372912 - DNA, 20 bp, human
gtccttgctccgtacctctc

SEQ ID NO: 372913 - DNA, 20 bp, human
gtggcccggcgtcacaggca

SEQ ID NO: 372914 - DNA, 20 bp, human
gtcctgagaggtacggagca

SEQ ID NO: 372915 - DNA, 20 bp, human
gaggagctccagccatggcc

SEQ ID NO: 372916 - DNA, 20 bp, human
gggcgcgcacgcgcccgaga

SEQ ID NO: 372917 - DNA, 20 bp, human
gcacgcgcccgagagggctc

SEQ ID NO: 372918 - DNA, 20 bp, human
gcgagccgctgcctgggcga

SEQ ID NO: 372919 - DNA, 20 bp, human
gccgaccctcgcccaggcag

SEQ ID NO: 372920 - DNA, 20 bp, human
gggcggcggtggctctagaa

SEQ ID NO: 372921 - DNA, 20 bp, human
gtcagggcgcgtactcgcgc

SEQ ID NO: 372922 - DNA, 20 bp, human
gcgcgccaagctcgaggctg

SEQ ID NO: 372923 - DNA, 20 bp, human
gcaccggagaccgagaagat

SEQ ID NO: 372924 - DNA, 20 bp, human
ggggtgatctgctggatctc

SEQ ID NO: 372925 - DNA, 20 bp, human
gtggcgcgccggattcgcgc

SEQ ID NO: 372926 - DNA, 20 bp, human
gaggaggcggcggaacaccc

SEQ ID NO: 372927 - DNA, 20 bp, human
ggctagggagggcgtgtgga

SEQ ID NO: 372928 - DNA, 20 bp, human
ggcagcgctgtgtttgcgag

SEQ ID NO: 372929 - DNA, 20 bp, human
gtgtttgcgagcgggagcga

SEQ ID NO: 372930 - DNA, 20 bp, human
gcctggtgagtgacaccgag

SEQ ID NO: 372931 - DNA, 20 bp, human
ggggagtttcggtgaagtgg

SEQ ID NO: 372932 - DNA, 20 bp, human
ggtgagtgacaccgagggga

SEQ ID NO: 372933 - DNA, 20 bp, human
gaaaggcgaggaagtcggtc

SEQ ID NO: 372934 - DNA, 20 bp, human
gggaaaaagtgctggagctc

SEQ ID NO: 372935 - DNA, 20 bp, human
gggaacaccccgggttggtc

SEQ ID NO: 372936 - DNA, 20 bp, human
gggtcatcaccgatgactga

SEQ ID NO: 372937 - DNA, 20 bp, human
ggcgcaccaggccagaccaa

SEQ ID NO: 372938 - DNA, 20 bp, human
ggccaataggcatggggaac

SEQ ID NO: 372939 - DNA, 20 bp, human
gctctcccgcgcaggcgcat

SEQ ID NO: 372940 - DNA, 20 bp, human
gccactcctccgtcagtcat

SEQ ID NO: 372941 - DNA, 20 bp, human
gccgcgcaggcgcatcggga

SEQ ID NO: 372942 - DNA, 20 bp, human
gcatcaccgatgactgacgg

SEQ ID NO: 372943 - DNA, 20 bp, human
gggtgatgaccaatcggcgc

SEQ ID NO: 372944 - DNA, 20 bp, human
ggaccaatcggcgcaggaag

SEQ ID NO: 372945 - DNA, 20 bp, human
gaagcaatggccaataggca

SEQ ID NO: 372946 - DNA, 20 bp, human
gagcgcaggctctccttgac

SEQ ID NO: 372947 - DNA, 20 bp, human
ggattctcgaggggaaaatg

SEQ ID NO: 372948 - DNA, 20 bp, human
gtcacccttggattctcgag

SEQ ID NO: 372949 - DNA, 20 bp, human
gtttcccctcgagaatccaa

SEQ ID NO: 372950 - DNA, 20 bp, human
gttgtcgtgggcgagccctt

SEQ ID NO: 372951 - DNA, 20 bp, human
gaggctctccttgacaggat

SEQ ID NO: 372952 - DNA, 20 bp, human
ggattggttgaactcaccct

SEQ ID NO: 372953 - DNA, 20 bp, human
gcgggtcacagcggagactc

SEQ ID NO: 372954 - DNA, 20 bp, human
ggggtggcgggaagtgcact

SEQ ID NO: 372955 - DNA, 20 bp, human
gcaaggagagcctgcgctat

SEQ ID NO: 372956 - DNA, 20 bp, human
gctgccgccggggtcctcgc

SEQ ID NO: 372957 - DNA, 20 bp, human
gcgggctggctgggcgtagt

SEQ ID NO: 372958 - DNA, 20 bp, human
gctgacggcgaacacttcac

SEQ ID NO: 372959 - DNA, 20 bp, human
gaagcccgggagagcgatgg

SEQ ID NO: 372960 - DNA, 20 bp, human
gccgcccttactgcaggcga

SEQ ID NO: 372961 - DNA, 20 bp, human
ggggaaaaaggccgtcgcca

SEQ ID NO: 372962 - DNA, 20 bp, human
gacgcccagccagcccgcag

SEQ ID NO: 372963 - DNA, 20 bp, human
gaacgcgggcggccagacaa

SEQ ID NO: 372964 - DNA, 20 bp, human
gcggctgccacggagctaga

SEQ ID NO: 372965 - DNA, 20 bp, human
ggcgcgatgcctcgacaagg

SEQ ID NO: 372966 - DNA, 20 bp, human
gcgacggcagacagtgtagg

SEQ ID NO: 372967 - DNA, 20 bp, human
gacgcgacggcagacagtgt

SEQ ID NO: 372968 - DNA, 20 bp, human
ggcgccgcgcggagtcaatc

SEQ ID NO: 372969 - DNA, 20 bp, human
gcggctccgagatccccggg

SEQ ID NO: 372970 - DNA, 20 bp, human
gtcagcctccgaggggtctg

SEQ ID NO: 372971 - DNA, 20 bp, human
ggcgaggtagtcagaggacg

SEQ ID NO: 372972 - DNA, 20 bp, human
gggcaggcaccgcagtggag

SEQ ID NO: 372973 - DNA, 20 bp, human
ggctggcgcgaggtagtcag

SEQ ID NO: 372974 - DNA, 20 bp, human
ggtaggcggcaaccgacggc

SEQ ID NO: 372975 - DNA, 20 bp, human
gcagtgtaggcggcaaccga

SEQ ID NO: 372976 - DNA, 20 bp, human
ggcacggggcggcgcggaaa

SEQ ID NO: 372977 - DNA, 20 bp, human
gacccacagcgcgcacgggg

SEQ ID NO: 372978 - DNA, 20 bp, human
gaccaatcagcgacgagtga

SEQ ID NO: 372979 - DNA, 20 bp, human
gcgcgctcgcgtcggaggac

SEQ ID NO: 372980 - DNA, 20 bp, human
gttaggccgcgacggagggg

SEQ ID NO: 372981 - DNA, 20 bp, human
ggcgttaggccgcgacggag

SEQ ID NO: 372982 - DNA, 20 bp, human
gaaagggagagactcagccg

SEQ ID NO: 372983 - DNA, 20 bp, human
gcgcgctgtgggtgtgtttc

SEQ ID NO: 372984 - DNA, 20 bp, human
gtcagcgacgagtgagggag

SEQ ID NO: 372985 - DNA, 20 bp, human
gcggagaagcaatttagaag

SEQ ID NO: 372986 - DNA, 20 bp, human
ggaagttggccagagatgtt

SEQ ID NO: 372987 - DNA, 20 bp, human
ggtaaagggaatgtcaaaca

SEQ ID NO: 372988 - DNA, 20 bp, human
gaaaataggcaatagcgaaa

SEQ ID NO: 372989 - DNA, 20 bp, human
gctctggaggccacaggacg

SEQ ID NO: 372990 - DNA, 20 bp, human
gaggctcgctatttgataac

SEQ ID NO: 372991 - DNA, 20 bp, human
gctgccgccgcgctctgggt

SEQ ID NO: 372992 - DNA, 20 bp, human
gaaaatctcgctgtatcaga

SEQ ID NO: 372993 - DNA, 20 bp, human
gcaaaggcaacaactgtaaa

SEQ ID NO: 372994 - DNA, 20 bp, human
gtcagaaggcagtaaacagt

SEQ ID NO: 372995 - DNA, 20 bp, human
ggagccgccaggaaacccca

SEQ ID NO: 372996 - DNA, 20 bp, human
ggatacgtcgagtgggtcca

SEQ ID NO: 372997 - DNA, 20 bp, human
ggacccactcgacgtatctc

SEQ ID NO: 372998 - DNA, 20 bp, human
gaggagggggagacctgcaa

SEQ ID NO: 372999 - DNA, 20 bp, human
ggcgccagagatacgtcgag

SEQ ID NO: 373000 - DNA, 20 bp, human
gatccatgccctgacagcta

SEQ ID NO: 373001 - DNA, 20 bp, human
gagacctgcaagggttaatc

SEQ ID NO: 373002 - DNA, 20 bp, human
gcaggtctccccctccttgc

SEQ ID NO: 373003 - DNA, 20 bp, human
gcagccgcgagatgaagagt

SEQ ID NO: 373004 - DNA, 20 bp, human
gctcaccgccactgtgtgac

SEQ ID NO: 373005 - DNA, 20 bp, human
gtgagggtgggcaccaacta

SEQ ID NO: 373006 - DNA, 20 bp, human
gtgtgcaagtggcgcgccgt

SEQ ID NO: 373007 - DNA, 20 bp, human
gatgcgcagtagctgtagga

SEQ ID NO: 373008 - DNA, 20 bp, human
gtgcgcctgcgccaagccca

SEQ ID NO: 373009 - DNA, 20 bp, human
gcggacgtctcgtgagacgt

SEQ ID NO: 373010 - DNA, 20 bp, human
ggagacgtgggacttctcgc

SEQ ID NO: 373011 - DNA, 20 bp, human
ggacgtccgcccaagccgcg

SEQ ID NO: 373012 - DNA, 20 bp, human
ggcacatgcgcagtagctgt

SEQ ID NO: 373013 - DNA, 20 bp, human
gccgcccaagccgcgcggaa

SEQ ID NO: 373014 - DNA, 20 bp, human
gtctaggggaacagtgtcgc

SEQ ID NO: 373015 - DNA, 20 bp, human
gttaacgccagtattaccac

SEQ ID NO: 373016 - DNA, 20 bp, human
gagcgcgcacagccggccga

SEQ ID NO: 373017 - DNA, 20 bp, human
gcccccgcccgcccgagcct

SEQ ID NO: 373018 - DNA, 20 bp, human
ggaggtaggtcgaatgaaga

SEQ ID NO: 373019 - DNA, 20 bp, human
gcgggcaggcgggataacgg

SEQ ID NO: 373020 - DNA, 20 bp, human
gggcctggttgtctaatcga

SEQ ID NO: 373021 - DNA, 20 bp, human
gccggcgcgcactcccaggc

SEQ ID NO: 373022 - DNA, 20 bp, human
gcaggcgggataacggagga

SEQ ID NO: 373023 - DNA, 20 bp, human
gcccgcccgagcctcggccg

SEQ ID NO: 373024 - DNA, 20 bp, human
ggcctcgcgctccctcgctc

SEQ ID NO: 373025 - DNA, 20 bp, human
ggcgcgggcaggcgggataa

SEQ ID NO: 373026 - DNA, 20 bp, human
gtaatctttggcagattggt

SEQ ID NO: 373027 - DNA, 20 bp, human
gcatacactatctactagct

SEQ ID NO: 373028 - DNA, 20 bp, human
gattggtaggttactctgta

SEQ ID NO: 373029 - DNA, 20 bp, human
ggaaagatttcaatataggc

SEQ ID NO: 373030 - DNA, 20 bp, human
gggtttttaactcttcaaga

SEQ ID NO: 373031 - DNA, 20 bp, human
gcagataattgagtaataaa

SEQ ID NO: 373032 - DNA, 20 bp, human
gttttactaataaatagcag

SEQ ID NO: 373033 - DNA, 20 bp, human
gatttattagtaaaaatgag

SEQ ID NO: 373034 - DNA, 20 bp, human
gcacatatatcaagaattct

SEQ ID NO: 373035 - DNA, 20 bp, human
gctgttaaaacttgaggcaa

SEQ ID NO: 373036 - DNA, 20 bp, human
ggggtgccgactggactcac

SEQ ID NO: 373037 - DNA, 20 bp, human
ggactcactggcagagaggc

SEQ ID NO: 373038 - DNA, 20 bp, human
ggaaggccctgattggtgga

SEQ ID NO: 373039 - DNA, 20 bp, human
ggcagcccgtccaccaatca

SEQ ID NO: 373040 - DNA, 20 bp, human
gcaagcctcgccccccagga

SEQ ID NO: 373041 - DNA, 20 bp, human
gtatgagacccggactgcga

SEQ ID NO: 373042 - DNA, 20 bp, human
gagttgatgaagctttggag

SEQ ID NO: 373043 - DNA, 20 bp, human
gctacaagaggggtgaaggc

SEQ ID NO: 373044 - DNA, 20 bp, human
gctctgccagtgagtccagt

SEQ ID NO: 373045 - DNA, 20 bp, human
ggcttcatcaactacaagag

SEQ ID NO: 373046 - DNA, 20 bp, human
gaggaaggagcacatgagga

SEQ ID NO: 373047 - DNA, 20 bp, human
gaagggcccagaagtcagga

SEQ ID NO: 373048 - DNA, 20 bp, human
gaaggaagggcccagaagtc

SEQ ID NO: 373049 - DNA, 20 bp, human
gagtcaggaaggagcacatg

SEQ ID NO: 373050 - DNA, 20 bp, human
ggtgctccttcctgacttct

SEQ ID NO: 373051 - DNA, 20 bp, human
gacagaaaaacgggagaatg

SEQ ID NO: 373052 - DNA, 20 bp, human
gtgttctgaggacagaaaaa

SEQ ID NO: 373053 - DNA, 20 bp, human
ggaaaaacgggagaatgggg

SEQ ID NO: 373054 - DNA, 20 bp, human
ggggaagaatggaggtactg

SEQ ID NO: 373055 - DNA, 20 bp, human
ggacagaaggaaagatggct

SEQ ID NO: 373056 - DNA, 20 bp, human
gtggggtgactcatgagaca

SEQ ID NO: 373057 - DNA, 20 bp, human
gcaggcaggtgctggggaat

SEQ ID NO: 373058 - DNA, 20 bp, human
gtgactcatgagacagggtg

SEQ ID NO: 373059 - DNA, 20 bp, human
ggcagtgagtaccagtgtga

SEQ ID NO: 373060 - DNA, 20 bp, human
ggggcttgtttgatgacctg

SEQ ID NO: 373061 - DNA, 20 bp, human
gtgcctgcccatgcaccttt

SEQ ID NO: 373062 - DNA, 20 bp, human
gagtaccagtgtgagggaat

SEQ ID NO: 373063 - DNA, 20 bp, human
ggcactaggaagacaggaca

SEQ ID NO: 373064 - DNA, 20 bp, human
gatggccacgccaagctctg

SEQ ID NO: 373065 - DNA, 20 bp, human
gagtcaccccaaaggtgcat

SEQ ID NO: 373066 - DNA, 20 bp, human
gaagggcccagaagtcagga

SEQ ID NO: 373067 - DNA, 20 bp, human
gaaggaagggcccagaagtc

SEQ ID NO: 373068 - DNA, 20 bp, human
gaggaaggagcacatgagga

SEQ ID NO: 373069 - DNA, 20 bp, human
gagtcaggaaggagcacatg

SEQ ID NO: 373070 - DNA, 20 bp, human
ggtgctccttcctgacttct

SEQ ID NO: 373071 - DNA, 20 bp, human
gacagaaaaacgggagaatg

SEQ ID NO: 373072 - DNA, 20 bp, human
gtgttctgaggacagaaaaa

SEQ ID NO: 373073 - DNA, 20 bp, human
ggaaaaacgggagaatgggg

SEQ ID NO: 373074 - DNA, 20 bp, human
ggggaagaatggaggtactg

SEQ ID NO: 373075 - DNA, 20 bp, human
ggacagaaggaaagatggct

SEQ ID NO: 373076 - DNA, 20 bp, human
gtggggtgactcatgagaca

SEQ ID NO: 373077 - DNA, 20 bp, human
gcaggcaggtgctggggaat

SEQ ID NO: 373078 - DNA, 20 bp, human
gtgactcatgagacagggtg

SEQ ID NO: 373079 - DNA, 20 bp, human
gtgcctgcccatgcaccttt

SEQ ID NO: 373080 - DNA, 20 bp, human
gaaaaggcaatcagctataa

SEQ ID NO: 373081 - DNA, 20 bp, human
ggcagtgagtaccagtgtga

SEQ ID NO: 373082 - DNA, 20 bp, human
ggggcttgtttgatgacctg

SEQ ID NO: 373083 - DNA, 20 bp, human
gagtcaccccaaaggtgcat

SEQ ID NO: 373084 - DNA, 20 bp, human
gccacctcccctctcccaaa

SEQ ID NO: 373085 - DNA, 20 bp, human
gagtaccagtgtgagggaat

SEQ ID NO: 373086 - DNA, 20 bp, human
gtaacgtgtcctctgcccta

SEQ ID NO: 373087 - DNA, 20 bp, human
ggtcataggtcattccaacc

SEQ ID NO: 373088 - DNA, 20 bp, human
ggagtccaagagatattttg

SEQ ID NO: 373089 - DNA, 20 bp, human
gtggactcaaagatgcctta

SEQ ID NO: 373090 - DNA, 20 bp, human
gtcatcaagtcaatgttcct

SEQ ID NO: 373091 - DNA, 20 bp, human
gcaaagatgccttagggcag

SEQ ID NO: 373092 - DNA, 20 bp, human
gtcggaatctctgatgtcat

SEQ ID NO: 373093 - DNA, 20 bp, human
gatcatgtacaagagatccc

SEQ ID NO: 373094 - DNA, 20 bp, human
gtacacccagtacagaatct

SEQ ID NO: 373095 - DNA, 20 bp, human
gactgtccgagattctgtac

SEQ ID NO: 373096 - DNA, 20 bp, human
ggaggaatgtggagaccctg

SEQ ID NO: 373097 - DNA, 20 bp, human
gcggggtgaacggtatctcc

SEQ ID NO: 373098 - DNA, 20 bp, human
gctaaacttgagggggtgtt

SEQ ID NO: 373099 - DNA, 20 bp, human
gttggacaatgctcagaggt

SEQ ID NO: 373100 - DNA, 20 bp, human
gcaccccctcaagtttagag

SEQ ID NO: 373101 - DNA, 20 bp, human
gctctccactctaaacttga

SEQ ID NO: 373102 - DNA, 20 bp, human
gccaagaaaagagatcagtc

SEQ ID NO: 373103 - DNA, 20 bp, human
gagtctagtctggtgagaga

SEQ ID NO: 373104 - DNA, 20 bp, human
gctcttttcttggagatccg

SEQ ID NO: 373105 - DNA, 20 bp, human
ggtcatcggtcattccaaac

SEQ ID NO: 373106 - DNA, 20 bp, human
gcctctccatccatgggtgg

SEQ ID NO: 373107 - DNA, 20 bp, human
gacccaacaagagaagccag

SEQ ID NO: 373108 - DNA, 20 bp, human
gtgggggctctcgttatgga

SEQ ID NO: 373109 - DNA, 20 bp, human
ggacttatgagatcaccctc

SEQ ID NO: 373110 - DNA, 20 bp, human
gtaacgagagcccccaccca

SEQ ID NO: 373111 - DNA, 20 bp, human
gacacagaggttttgctggg

SEQ ID NO: 373112 - DNA, 20 bp, human
gtcagcagtgcgggggaaga

SEQ ID NO: 373113 - DNA, 20 bp, human
ggatctcataagtcccctag

SEQ ID NO: 373114 - DNA, 20 bp, human
gggccagacctctccatcca

SEQ ID NO: 373115 - DNA, 20 bp, human
gagccagtatgtgtcaccag

SEQ ID NO: 373116 - DNA, 20 bp, human
gcggaaatggggtccacatc

SEQ ID NO: 373117 - DNA, 20 bp, human
ggagatgagacactgagagc

SEQ ID NO: 373118 - DNA, 20 bp, human
gtacactggaggttttctaa

SEQ ID NO: 373119 - DNA, 20 bp, human
ggcccccggccgccggctga

SEQ ID NO: 373120 - DNA, 20 bp, human
gaggaggcgttgggcggtga

SEQ ID NO: 373121 - DNA, 20 bp, human
gccagtgtagagtgcggaaa

SEQ ID NO: 373122 - DNA, 20 bp, human
gagtgcaggaaaaaccgaat

SEQ ID NO: 373123 - DNA, 20 bp, human
gaccagaggatgagcagata

SEQ ID NO: 373124 - DNA, 20 bp, human
gaaaaaccgaataggctggg

SEQ ID NO: 373125 - DNA, 20 bp, human
ggggcgtcccaagccagatg

SEQ ID NO: 373126 - DNA, 20 bp, human
ggggctgcggccgtctgcgc

SEQ ID NO: 373127 - DNA, 20 bp, human
gacggacgcgagccggagat

SEQ ID NO: 373128 - DNA, 20 bp, human
ggcgcgacccagtgccgaga

SEQ ID NO: 373129 - DNA, 20 bp, human
ggccgtctgcgcaggcgtcg

SEQ ID NO: 373130 - DNA, 20 bp, human
gcagtgaaggaatgtaggcg

SEQ ID NO: 373131 - DNA, 20 bp, human
gtgccgagacggacgcgagc

SEQ ID NO: 373132 - DNA, 20 bp, human
gggctccagcccaagacctg

SEQ ID NO: 373133 - DNA, 20 bp, human
gctccggctcgcgtccgtct

SEQ ID NO: 373134 - DNA, 20 bp, human
gtggcactcccggtacataa

SEQ ID NO: 373135 - DNA, 20 bp, human
ggcaaggcgggtcccttcag

SEQ ID NO: 373136 - DNA, 20 bp, human
gtacccaggagagtcgggaa

SEQ ID NO: 373137 - DNA, 20 bp, human
gtggtcccaaaatggatgag

SEQ ID NO: 373138 - DNA, 20 bp, human
ggggcctgagaggaggtagc

SEQ ID NO: 373139 - DNA, 20 bp, human
gaaagctcgggcctgagagg

SEQ ID NO: 373140 - DNA, 20 bp, human
gggcccgagctttgaaaagg

SEQ ID NO: 373141 - DNA, 20 bp, human
gaagggggatccccacccta

SEQ ID NO: 373142 - DNA, 20 bp, human
gtcctgcatctgcaccccta

SEQ ID NO: 373143 - DNA, 20 bp, human
gaccctaggggtgcagatgc

SEQ ID NO: 373144 - DNA, 20 bp, human
gctgagaggaggtagcgggg

SEQ ID NO: 373145 - DNA, 20 bp, human
ggctggtcactaggtggcgt

SEQ ID NO: 373146 - DNA, 20 bp, human
gaccccctccacaaagtggt

SEQ ID NO: 373147 - DNA, 20 bp, human
ggctccctaacttctctcac

SEQ ID NO: 373148 - DNA, 20 bp, human
gtagagaagaggggacgcta

SEQ ID NO: 373149 - DNA, 20 bp, human
gcgcaggaggaagccgttgg

SEQ ID NO: 373150 - DNA, 20 bp, human
gggcgaggcgggaacactta

SEQ ID NO: 373151 - DNA, 20 bp, human
gcctgagcgtgcgccagcgc

SEQ ID NO: 373152 - DNA, 20 bp, human
gaatcctaccactttgtgga

SEQ ID NO: 373153 - DNA, 20 bp, human
ggatacgcttccatagcaaa

SEQ ID NO: 373154 - DNA, 20 bp, human
ggtggaaggatcaacccagg

SEQ ID NO: 373155 - DNA, 20 bp, human
ggacgtggaaggatcaaccc

SEQ ID NO: 373156 - DNA, 20 bp, human
gcctccccgggggaagtagg

SEQ ID NO: 373157 - DNA, 20 bp, human
gggtgggggtaaggcggcga

SEQ ID NO: 373158 - DNA, 20 bp, human
ggggctccggaggcagatgc

SEQ ID NO: 373159 - DNA, 20 bp, human
ggaccggtggtcgtgtaggg

SEQ ID NO: 373160 - DNA, 20 bp, human
gggcgttaggaggtgaccgg

SEQ ID NO: 373161 - DNA, 20 bp, human
ggaagtagggggacaggaca

SEQ ID NO: 373162 - DNA, 20 bp, human
gggtgaccggtggtcgtgta

SEQ ID NO: 373163 - DNA, 20 bp, human
gtgcctccctacacgaccac

SEQ ID NO: 373164 - DNA, 20 bp, human
gcatgtgcctagggctccgg

SEQ ID NO: 373165 - DNA, 20 bp, human
gtcctcccgcggggcctctc

SEQ ID NO: 373166 - DNA, 20 bp, human
gagcgggctttgctcttgtc

SEQ ID NO: 373167 - DNA, 20 bp, human
gaaggcagatcccgcggctt

SEQ ID NO: 373168 - DNA, 20 bp, human
gtccccgagcaagacagggg

SEQ ID NO: 373169 - DNA, 20 bp, human
gtggacgtgtcagaacaaat

SEQ ID NO: 373170 - DNA, 20 bp, human
gttcccacgggcaccttctt

SEQ ID NO: 373171 - DNA, 20 bp, human
gtcagggcaagtgtccctat

SEQ ID NO: 373172 - DNA, 20 bp, human
ggtgccttgactcaaggtgt

SEQ ID NO: 373173 - DNA, 20 bp, human
ggcactgcgctgtgccaata

SEQ ID NO: 373174 - DNA, 20 bp, human
gggccccacaccttgagtca

SEQ ID NO: 373175 - DNA, 20 bp, human
gtgtcagaacaaatgggtca

SEQ ID NO: 373176 - DNA, 20 bp, human
gaccctgagtcctggacccg

SEQ ID NO: 373177 - DNA, 20 bp, human
gcccgtgtctatgccgagac

SEQ ID NO: 373178 - DNA, 20 bp, human
ggccccttggcacactggaa

SEQ ID NO: 373179 - DNA, 20 bp, human
ggggagtgaacgggtcacaa

SEQ ID NO: 373180 - DNA, 20 bp, human
ggaccctctcgcctgagtcc

SEQ ID NO: 373181 - DNA, 20 bp, human
gggaaggacaaaggctgatg

SEQ ID NO: 373182 - DNA, 20 bp, human
gtctgccaaggcctggactc

SEQ ID NO: 373183 - DNA, 20 bp, human
gatgggggcagatgtcaaac

SEQ ID NO: 373184 - DNA, 20 bp, human
ggagggtcagccacgggtcc

SEQ ID NO: 373185 - DNA, 20 bp, human
gagccctggggaagtgacga

SEQ ID NO: 373186 - DNA, 20 bp, human
gcgcgccagtgggaagcgtc

SEQ ID NO: 373187 - DNA, 20 bp, human
gggaccgggcgacgaagtga

SEQ ID NO: 373188 - DNA, 20 bp, human
gcgcgtcctcccgcctgcca

SEQ ID NO: 373189 - DNA, 20 bp, human
ggaagtgagggactacaggc

SEQ ID NO: 373190 - DNA, 20 bp, human
gcgggcggcagcgactacga

SEQ ID NO: 373191 - DNA, 20 bp, human
ggcagcgactacgacggagc

SEQ ID NO: 373192 - DNA, 20 bp, human
gtcgggccgcgcgcgccagt

SEQ ID NO: 373193 - DNA, 20 bp, human
gggagcgcgagggtcggctt

SEQ ID NO: 373194 - DNA, 20 bp, human
ggtcctcccgcctgccaagg

SEQ ID NO: 373195 - DNA, 20 bp, human
gaagctgagttcctcccagc

SEQ ID NO: 373196 - DNA, 20 bp, human
gtgaactcttcccataccaa

SEQ ID NO: 373197 - DNA, 20 bp, human
gctggcagtgagaatacgaa

SEQ ID NO: 373198 - DNA, 20 bp, human
gagggagaaagtgtagtctg

SEQ ID NO: 373199 - DNA, 20 bp, human
gacactttctcccttggtat

SEQ ID NO: 373200 - DNA, 20 bp, human
ggtggcatcttcttggagtt

SEQ ID NO: 373201 - DNA, 20 bp, human
gtccagaagtggcatcttct

SEQ ID NO: 373202 - DNA, 20 bp, human
gagctctgtaacactaactc

SEQ ID NO: 373203 - DNA, 20 bp, human
gccacttctggagagagaat

SEQ ID NO: 373204 - DNA, 20 bp, human
gcaaacattagccccctgtt

SEQ ID NO: 373205 - DNA, 20 bp, human
gtgtgggtgctgtgactact

SEQ ID NO: 373206 - DNA, 20 bp, human
ggggctcggcccatcctgcg

SEQ ID NO: 373207 - DNA, 20 bp, human
gcgagcatgcgcactaggaa

SEQ ID NO: 373208 - DNA, 20 bp, human
gcctcctgggaccgcgtgca

SEQ ID NO: 373209 - DNA, 20 bp, human
gtatccctaccgcgcaggat

SEQ ID NO: 373210 - DNA, 20 bp, human
gcatgcgcactaggaagggg

SEQ ID NO: 373211 - DNA, 20 bp, human
gtgggaccgcgtgcaggggg

SEQ ID NO: 373212 - DNA, 20 bp, human
ggtaggtccgcgcctggtgt

SEQ ID NO: 373213 - DNA, 20 bp, human
gcgcgcaagcgcagcggcat

SEQ ID NO: 373214 - DNA, 20 bp, human
gaggcgcggacctacgaagg

SEQ ID NO: 373215 - DNA, 20 bp, human
ggacgcccggctactgcgtg

SEQ ID NO: 373216 - DNA, 20 bp, human
ggagacctctcggctgtctc

SEQ ID NO: 373217 - DNA, 20 bp, human
ggactcccgcggagacctct

SEQ ID NO: 373218 - DNA, 20 bp, human
gcagagtgggactggcgtca

SEQ ID NO: 373219 - DNA, 20 bp, human
gactggcgtcagggcagatg

SEQ ID NO: 373220 - DNA, 20 bp, human
ggccccccacaggaaacgaa

SEQ ID NO: 373221 - DNA, 20 bp, human
gccactctgcttaactgctc

SEQ ID NO: 373222 - DNA, 20 bp, human
ggacagccgagaggtctccg

SEQ ID NO: 373223 - DNA, 20 bp, human
ggtacgtagcggctcccgct

SEQ ID NO: 373224 - DNA, 20 bp, human
gttggcccggcggttacttc

SEQ ID NO: 373225 - DNA, 20 bp, human
gactgctctggcatgcttga

SEQ ID NO: 373226 - DNA, 20 bp, human
ggccccgcgcagaccccccc

SEQ ID NO: 373227 - DNA, 20 bp, human
gcggtcccctgcggccacgt

SEQ ID NO: 373228 - DNA, 20 bp, human
gaggctgcagagacattgag

SEQ ID NO: 373229 - DNA, 20 bp, human
gagagcctagtagagagtgt

SEQ ID NO: 373230 - DNA, 20 bp, human
gagcgcttgtagccgctaga

SEQ ID NO: 373231 - DNA, 20 bp, human
gttgccagcggattcatcac

SEQ ID NO: 373232 - DNA, 20 bp, human
ggccgcgcggccccgcccgt

SEQ ID NO: 373233 - DNA, 20 bp, human
gtagccgctagagggagcgc

SEQ ID NO: 373234 - DNA, 20 bp, human
ggcaggggaccgtgcctggg

SEQ ID NO: 373235 - DNA, 20 bp, human
gcacgcgcgcgtcttgccag

SEQ ID NO: 373236 - DNA, 20 bp, human
gtgcggctggcgtgaggaga

SEQ ID NO: 373237 - DNA, 20 bp, human
gggtacgtagggcagaacta

SEQ ID NO: 373238 - DNA, 20 bp, human
gagagggctgagttacgtct

SEQ ID NO: 373239 - DNA, 20 bp, human
gtctgccctacgtacctagg

SEQ ID NO: 373240 - DNA, 20 bp, human
ggggccacgtcgcgaggaag

SEQ ID NO: 373241 - DNA, 20 bp, human
gtccgtgggatgcttggctg

SEQ ID NO: 373242 - DNA, 20 bp, human
ggccctacgtacctaggagg

SEQ ID NO: 373243 - DNA, 20 bp, human
gagggcggggccacgtcgcg

SEQ ID NO: 373244 - DNA, 20 bp, human
gtcctcctcctaggtacgta

SEQ ID NO: 373245 - DNA, 20 bp, human
gaggaggcgcctggcccctt

SEQ ID NO: 373246 - DNA, 20 bp, human
gcctgagcccgtctacctcg

SEQ ID NO: 373247 - DNA, 20 bp, human
gggggcgcgcgtctgcgagg

SEQ ID NO: 373248 - DNA, 20 bp, human
gcccgggcagggtccctcgt

SEQ ID NO: 373249 - DNA, 20 bp, human
gtagacgggctcaggctcgg

SEQ ID NO: 373250 - DNA, 20 bp, human
gagggttcggtcacaggcga

SEQ ID NO: 373251 - DNA, 20 bp, human
gaggcagccacgaggtagac

SEQ ID NO: 373252 - DNA, 20 bp, human
ggctgcctgaggcccgggta

SEQ ID NO: 373253 - DNA, 20 bp, human
ggcagcctgcgtcacccgca

SEQ ID NO: 373254 - DNA, 20 bp, human
gggcctggcgggtgaataac

SEQ ID NO: 373255 - DNA, 20 bp, human
gcggagcgctccgaagtcag

SEQ ID NO: 373256 - DNA, 20 bp, human
gcaggtggtggttgatggga

SEQ ID NO: 373257 - DNA, 20 bp, human
ggcatttgggacacaatcgt

SEQ ID NO: 373258 - DNA, 20 bp, human
gtgttcatacagtggcattt

SEQ ID NO: 373259 - DNA, 20 bp, human
gtatggaagtagatctttat

SEQ ID NO: 373260 - DNA, 20 bp, human
gataaataaaacgtccactg

SEQ ID NO: 373261 - DNA, 20 bp, human
ggcccttcctggattgattg

SEQ ID NO: 373262 - DNA, 20 bp, human
gagggctcctcactgacata

SEQ ID NO: 373263 - DNA, 20 bp, human
gtattcacgaattctctttt

SEQ ID NO: 373264 - DNA, 20 bp, human
gatggggaaaagagaatttg

SEQ ID NO: 373265 - DNA, 20 bp, human
gatagtcgacatcatgtagt

SEQ ID NO: 373266 - DNA, 20 bp, human
gccacgagctggttcccgcc

SEQ ID NO: 373267 - DNA, 20 bp, human
gcggccctacccagtcggtc

SEQ ID NO: 373268 - DNA, 20 bp, human
gacggcccgcgcccacggcc

SEQ ID NO: 373269 - DNA, 20 bp, human
gccgcttcctaggacccggg

SEQ ID NO: 373270 - DNA, 20 bp, human
gggcgcgcttgccgcttcct

SEQ ID NO: 373271 - DNA, 20 bp, human
ggccgcgagcgcagtgtctg

SEQ ID NO: 373272 - DNA, 20 bp, human
gcagctcgtggcccggccgt

SEQ ID NO: 373273 - DNA, 20 bp, human
gtggttcccgcccgggtcct

SEQ ID NO: 373274 - DNA, 20 bp, human
gccactgtagggaacggcgg

SEQ ID NO: 373275 - DNA, 20 bp, human
ggctccagtccctcagacgt

SEQ ID NO: 373276 - DNA, 20 bp, human
gggaagggccagcacgtcgg

SEQ ID NO: 373277 - DNA, 20 bp, human
gctgactagccgggcgataa

SEQ ID NO: 373278 - DNA, 20 bp, human
gaccaagtggaggtactcgg

SEQ ID NO: 373279 - DNA, 20 bp, human
gaacaagcgcaacgtccaag

SEQ ID NO: 373280 - DNA, 20 bp, human
gcgcaacgtccaagagggaa

SEQ ID NO: 373281 - DNA, 20 bp, human
gggcagagagcatagagcgc

SEQ ID NO: 373282 - DNA, 20 bp, human
gacgtcacatgggtgcgacg

SEQ ID NO: 373283 - DNA, 20 bp, human
gaggtccggaaagagagaac

SEQ ID NO: 373284 - DNA, 20 bp, human
gcgagaacacggcctgggta

SEQ ID NO: 373285 - DNA, 20 bp, human
gcacgatccggacttctctg

SEQ ID NO: 373286 - DNA, 20 bp, human
ggagtggcgcgcaaccagtg

SEQ ID NO: 373287 - DNA, 20 bp, human
gaggggagacgatggtggtt

SEQ ID NO: 373288 - DNA, 20 bp, human
gtacgccagcgagaaaggga

SEQ ID NO: 373289 - DNA, 20 bp, human
gcctcgagcaactgagactg

SEQ ID NO: 373290 - DNA, 20 bp, human
gcgctcctgcaagatcagag

SEQ ID NO: 373291 - DNA, 20 bp, human
gcctgcaagatcagagagga

SEQ ID NO: 373292 - DNA, 20 bp, human
gggcagaaaggtgggagcgt

SEQ ID NO: 373293 - DNA, 20 bp, human
ggcaagatcagagaggacgg

SEQ ID NO: 373294 - DNA, 20 bp, human
gcattcgtgcccagaagcat

SEQ ID NO: 373295 - DNA, 20 bp, human
gtggttgcgcgccactcctc

SEQ ID NO: 373296 - DNA, 20 bp, human
gggtgactgttggctacata

SEQ ID NO: 373297 - DNA, 20 bp, human
gctgagagggatgactttgg

SEQ ID NO: 373298 - DNA, 20 bp, human
gtggggcaggtggtgctcaa

SEQ ID NO: 373299 - DNA, 20 bp, human
ggctacatacaggaagtctc

SEQ ID NO: 373300 - DNA, 20 bp, human
gggactgagagggatgactt

SEQ ID NO: 373301 - DNA, 20 bp, human
gcaggtggtgctcaaagggc

SEQ ID NO: 373302 - DNA, 20 bp, human
gcatacaggaagtctctggc

SEQ ID NO: 373303 - DNA, 20 bp, human
ggctgggagatagtcccctt

SEQ ID NO: 373304 - DNA, 20 bp, human
gaccccaatgaggtgactgt

SEQ ID NO: 373305 - DNA, 20 bp, human
ggctggcctgggaagccatg

SEQ ID NO: 373306 - DNA, 20 bp, human
gggcagggatggcgggccag

SEQ ID NO: 373307 - DNA, 20 bp, human
ggctgggccaagatataaat

SEQ ID NO: 373308 - DNA, 20 bp, human
gatccctgccatgtgacaaa

SEQ ID NO: 373309 - DNA, 20 bp, human
gcaggggctgtctggatttg

SEQ ID NO: 373310 - DNA, 20 bp, human
gtggggatccccgtggggct

SEQ ID NO: 373311 - DNA, 20 bp, human
gtgggtgtgtggtccggcgg

SEQ ID NO: 373312 - DNA, 20 bp, human
gtggatttggggatccccgt

SEQ ID NO: 373313 - DNA, 20 bp, human
ggatgtgtgaggtgacggga

SEQ ID NO: 373314 - DNA, 20 bp, human
ggggctggggttcactgaag

SEQ ID NO: 373315 - DNA, 20 bp, human
gaaacggaggatctggaccc

SEQ ID NO: 373316 - DNA, 20 bp, human
gaggggctattattttgaag

SEQ ID NO: 373317 - DNA, 20 bp, human
gtgcaacctaagttgggcgg

SEQ ID NO: 373318 - DNA, 20 bp, human
gaagagctgcaacctaagtt

SEQ ID NO: 373319 - DNA, 20 bp, human
gagctgcaacctaagttggg

SEQ ID NO: 373320 - DNA, 20 bp, human
ggttgggcgggggattcatg

SEQ ID NO: 373321 - DNA, 20 bp, human
ggggttagaagtttccggtg

SEQ ID NO: 373322 - DNA, 20 bp, human
gtcagattgcatagccccac

SEQ ID NO: 373323 - DNA, 20 bp, human
gtatgattagtagacaccag

SEQ ID NO: 373324 - DNA, 20 bp, human
gagagtatagagtccagaat

SEQ ID NO: 373325 - DNA, 20 bp, human
ggggtgggcctgagttgcct

SEQ ID NO: 373326 - DNA, 20 bp, human
ggcctcccaaagcctatctc

SEQ ID NO: 373327 - DNA, 20 bp, human
gtatacgcaagggcgtgggg

SEQ ID NO: 373328 - DNA, 20 bp, human
ggcaacagcccggaagccgc

SEQ ID NO: 373329 - DNA, 20 bp, human
gtccggcgagcccagtgcgc

SEQ ID NO: 373330 - DNA, 20 bp, human
ggctcgccggatatacgcaa

SEQ ID NO: 373331 - DNA, 20 bp, human
gtaacccagccagcggcttc

SEQ ID NO: 373332 - DNA, 20 bp, human
gatctcgggtcctgagtcta

SEQ ID NO: 373333 - DNA, 20 bp, human
gggttcctctgcaaggttca

SEQ ID NO: 373334 - DNA, 20 bp, human
gacccgagataggctttggg

SEQ ID NO: 373335 - DNA, 20 bp, human
gccacgcccttgcgtatatc

SEQ ID NO: 373336 - DNA, 20 bp, human
gcgctccagggcctcccgga

SEQ ID NO: 373337 - DNA, 20 bp, human
gtccgcggggcactccttcc

SEQ ID NO: 373338 - DNA, 20 bp, human
ggcccggaaggagtgccccg

SEQ ID NO: 373339 - DNA, 20 bp, human
gcccgactaggccatccggg

SEQ ID NO: 373340 - DNA, 20 bp, human
ggcctcccggatggcctagt

SEQ ID NO: 373341 - DNA, 20 bp, human
gaaggaagctcgactctccg

SEQ ID NO: 373342 - DNA, 20 bp, human
gagagtcgagcttccttccc

SEQ ID NO: 373343 - DNA, 20 bp, human
ggaactccccaggagctcgc

SEQ ID NO: 373344 - DNA, 20 bp, human
gctccggccccggcgctcca

SEQ ID NO: 373345 - DNA, 20 bp, human
ggatacttaaggaatgggag

SEQ ID NO: 373346 - DNA, 20 bp, human
gccccggcgcctggcgccga

SEQ ID NO: 373347 - DNA, 20 bp, human
gcgcctgcgcagtcggccgt

SEQ ID NO: 373348 - DNA, 20 bp, human
gcgccgacggccgactgcgc

SEQ ID NO: 373349 - DNA, 20 bp, human
ggccgccagccaggtgagag

SEQ ID NO: 373350 - DNA, 20 bp, human
ggcggggcacaggttcctga

SEQ ID NO: 373351 - DNA, 20 bp, human
ggcggccgtcgcagttcggc

SEQ ID NO: 373352 - DNA, 20 bp, human
ggtccgcggcgagggagcgg

SEQ ID NO: 373353 - DNA, 20 bp, human
gcgtgcgccctgactgttgg

SEQ ID NO: 373354 - DNA, 20 bp, human
gggcgcgcacctggcagtcc

SEQ ID NO: 373355 - DNA, 20 bp, human
ggggacgcgagccctttaaa

SEQ ID NO: 373356 - DNA, 20 bp, human
ggaggggctagagagcttga

SEQ ID NO: 373357 - DNA, 20 bp, human
gcatttgcatatggtcgtaa

SEQ ID NO: 373358 - DNA, 20 bp, human
ggtgagaaatgtctgaaaga

SEQ ID NO: 373359 - DNA, 20 bp, human
ggagttatgtgattggatag

SEQ ID NO: 373360 - DNA, 20 bp, human
ggaattaagaatctatggat

SEQ ID NO: 373361 - DNA, 20 bp, human
gtatctgtgagttatgtgat

SEQ ID NO: 373362 - DNA, 20 bp, human
gtgtaggcatattttagatt

SEQ ID NO: 373363 - DNA, 20 bp, human
gttggatagaggtgtgtatt

SEQ ID NO: 373364 - DNA, 20 bp, human
gttatacatgtgcatgtgct

SEQ ID NO: 373365 - DNA, 20 bp, human
gctccataaatgtatacaca

SEQ ID NO: 373366 - DNA, 20 bp, human
gaagctgcgctacggaaaga

SEQ ID NO: 373367 - DNA, 20 bp, human
gaaggggccacagggttccg

SEQ ID NO: 373368 - DNA, 20 bp, human
ggactggtggaatcccgatg

SEQ ID NO: 373369 - DNA, 20 bp, human
gcaggctgtgtggtgggcgt

SEQ ID NO: 373370 - DNA, 20 bp, human
gtgggcaggaagctgcgcta

SEQ ID NO: 373371 - DNA, 20 bp, human
gagagcccatagctccgccg

SEQ ID NO: 373372 - DNA, 20 bp, human
gactgtggcacgaactactc

SEQ ID NO: 373373 - DNA, 20 bp, human
ggtagccccggcggagctat

SEQ ID NO: 373374 - DNA, 20 bp, human
gcagggcaggcagactaaga

SEQ ID NO: 373375 - DNA, 20 bp, human
gctgcgctacggaaagaggg

SEQ ID NO: 373376 - DNA, 20 bp, human
ggggcgtggaaggtgctcct

SEQ ID NO: 373377 - DNA, 20 bp, human
ggcaggggcgcagagggttg

SEQ ID NO: 373378 - DNA, 20 bp, human
ggctgcgagaccgagagcct

SEQ ID NO: 373379 - DNA, 20 bp, human
gctgtggtacaggttggtgg

SEQ ID NO: 373380 - DNA, 20 bp, human
gccaacctgtaccacagccc

SEQ ID NO: 373381 - DNA, 20 bp, human
gcggcgcagcagcgactagt

SEQ ID NO: 373382 - DNA, 20 bp, human
gggctccacagcttctgatt

SEQ ID NO: 373383 - DNA, 20 bp, human
gcacctctctctcactgcat

SEQ ID NO: 373384 - DNA, 20 bp, human
ggcgccacgcggtgtttggc

SEQ ID NO: 373385 - DNA, 20 bp, human
gttgaggttaggtgagggga

SEQ ID NO: 373386 - DNA, 20 bp, human
ggggcagcagaccgccagaa

SEQ ID NO: 373387 - DNA, 20 bp, human
gggaaacggtcgaggggcgg

SEQ ID NO: 373388 - DNA, 20 bp, human
gcagaccgccagaaaggagg

SEQ ID NO: 373389 - DNA, 20 bp, human
ggagggaaacggtcgagggg

SEQ ID NO: 373390 - DNA, 20 bp, human
gctgccgcccgcagagcgga

SEQ ID NO: 373391 - DNA, 20 bp, human
ggatggagccactgtgtagg

SEQ ID NO: 373392 - DNA, 20 bp, human
gccgccttccgctctgcggg

SEQ ID NO: 373393 - DNA, 20 bp, human
gcagcagaccgccagaaagg

SEQ ID NO: 373394 - DNA, 20 bp, human
gcggaaggcgggatggctgg

SEQ ID NO: 373395 - DNA, 20 bp, human
gggaggggagtcggcctgtc

SEQ ID NO: 373396 - DNA, 20 bp, human
ggcaaggcaaagattctgtc

SEQ ID NO: 373397 - DNA, 20 bp, human
gggtgggcctgaaacatgca

SEQ ID NO: 373398 - DNA, 20 bp, human
gaaggtgaaaggagccaggt

SEQ ID NO: 373399 - DNA, 20 bp, human
gcagcaaggccccacctact

SEQ ID NO: 373400 - DNA, 20 bp, human
gtagttctggatagatgagc

SEQ ID NO: 373401 - DNA, 20 bp, human
gtgggactggaagggtcata

SEQ ID NO: 373402 - DNA, 20 bp, human
gtgatccctaactccctctg

SEQ ID NO: 373403 - DNA, 20 bp, human
gacaaccacagagggagtta

SEQ ID NO: 373404 - DNA, 20 bp, human
gtgtgatatagcccagtagg

SEQ ID NO: 373405 - DNA, 20 bp, human
gacagagtcaatcaataacc

SEQ ID NO: 373406 - DNA, 20 bp, human
gggaacaggacacatcagag

SEQ ID NO: 373407 - DNA, 20 bp, human
gacatcagaggggttggttc

SEQ ID NO: 373408 - DNA, 20 bp, human
gagaggggttggttccggag

SEQ ID NO: 373409 - DNA, 20 bp, human
gcaaggacgtacagcagtgg

SEQ ID NO: 373410 - DNA, 20 bp, human
gtctgagtttgatccctctc

SEQ ID NO: 373411 - DNA, 20 bp, human
gcaggacacatcagaggggt

SEQ ID NO: 373412 - DNA, 20 bp, human
gcctgagaacaagaagtact

SEQ ID NO: 373413 - DNA, 20 bp, human
ggctgggaccaccttgaatt

SEQ ID NO: 373414 - DNA, 20 bp, human
gtggcatgagtttactttaa

SEQ ID NO: 373415 - DNA, 20 bp, human
gcaggtctgtctcttcctgc

SEQ ID NO: 373416 - DNA, 20 bp, human
ggtactgaggatacaatggg

SEQ ID NO: 373417 - DNA, 20 bp, human
gatagtactgaggatacaat

SEQ ID NO: 373418 - DNA, 20 bp, human
gatcctcagtactatgtatt

SEQ ID NO: 373419 - DNA, 20 bp, human
gaaatcataggttactctgt

SEQ ID NO: 373420 - DNA, 20 bp, human
gcaagcaaagaatacctctt

SEQ ID NO: 373421 - DNA, 20 bp, human
gtgctctgaaatattgtctc

SEQ ID NO: 373422 - DNA, 20 bp, human
gaaaaaagatggggctattg

SEQ ID NO: 373423 - DNA, 20 bp, human
gcataagtgtattattttag

SEQ ID NO: 373424 - DNA, 20 bp, human
gtgagaagttcatgttgtct

SEQ ID NO: 373425 - DNA, 20 bp, human
gggcatgcttgtctatacca

SEQ ID NO: 373426 - DNA, 20 bp, human
gaggagccgtgaagggtcgg

SEQ ID NO: 373427 - DNA, 20 bp, human
ggtcgggggagaaccggaaa

SEQ ID NO: 373428 - DNA, 20 bp, human
gaagaggagccgtgaagggt

SEQ ID NO: 373429 - DNA, 20 bp, human
gcgggaagaggagccgtgaa

SEQ ID NO: 373430 - DNA, 20 bp, human
ggaaggggcggggcgagaat

SEQ ID NO: 373431 - DNA, 20 bp, human
ggctccacaagggtccccct

SEQ ID NO: 373432 - DNA, 20 bp, human
ggagaaaggtagaaggacgg

SEQ ID NO: 373433 - DNA, 20 bp, human
gcctccccccaaggagacga

SEQ ID NO: 373434 - DNA, 20 bp, human
ggggagaaccggaaagggct

SEQ ID NO: 373435 - DNA, 20 bp, human
ggtccccctaggactgtcac

SEQ ID NO: 373436 - DNA, 20 bp, human
ggcacgctgacatccggaaa

SEQ ID NO: 373437 - DNA, 20 bp, human
gtccggaaagggcttgctct

SEQ ID NO: 373438 - DNA, 20 bp, human
gcaatctgagggttggagca

SEQ ID NO: 373439 - DNA, 20 bp, human
gggagagcggcactataaat

SEQ ID NO: 373440 - DNA, 20 bp, human
gagcgtgcaaagattaactc

SEQ ID NO: 373441 - DNA, 20 bp, human
gacctagagcaagccctttc

SEQ ID NO: 373442 - DNA, 20 bp, human
gtaactctggtctctccatc

SEQ ID NO: 373443 - DNA, 20 bp, human
gttcgtgcatgggtgatctg

SEQ ID NO: 373444 - DNA, 20 bp, human
gaggtcccagagttggttgc

SEQ ID NO: 373445 - DNA, 20 bp, human
gtccagagtgacaaaaagtt

SEQ ID NO: 373446 - DNA, 20 bp, human
ggactccatcaattgcgttc

SEQ ID NO: 373447 - DNA, 20 bp, human
gtaaaggatggaagctaaag

SEQ ID NO: 373448 - DNA, 20 bp, human
gtcccccagaacgcaattga

SEQ ID NO: 373449 - DNA, 20 bp, human
gactggactcccttcataag

SEQ ID NO: 373450 - DNA, 20 bp, human
gcaactttgagtagggtctg

SEQ ID NO: 373451 - DNA, 20 bp, human
gaactcagacacttcagaac

SEQ ID NO: 373452 - DNA, 20 bp, human
gcatcctttaggatcctgtc

SEQ ID NO: 373453 - DNA, 20 bp, human
gctcctctcccacttatgaa

SEQ ID NO: 373454 - DNA, 20 bp, human
gtccatcaattgcgttctgg

SEQ ID NO: 373455 - DNA, 20 bp, human
gaggaattcggttattatat

SEQ ID NO: 373456 - DNA, 20 bp, human
gtatacaaagttatacttaa

SEQ ID NO: 373457 - DNA, 20 bp, human
gtgacaaacagaagattgtc

SEQ ID NO: 373458 - DNA, 20 bp, human
gatgtctcaaatgctcagtt

SEQ ID NO: 373459 - DNA, 20 bp, human
gaaagttatacttaagggtg

SEQ ID NO: 373460 - DNA, 20 bp, human
gttgttctgtaaaactgaat

SEQ ID NO: 373461 - DNA, 20 bp, human
gagatagccacacctatctc

SEQ ID NO: 373462 - DNA, 20 bp, human
gcaggaaaattccctttaac

SEQ ID NO: 373463 - DNA, 20 bp, human
gacaaaacagtgatgataac

SEQ ID NO: 373464 - DNA, 20 bp, human
gaagaaaccaggagttagag

SEQ ID NO: 373465 - DNA, 20 bp, human
gagcgtctcattccggagat

SEQ ID NO: 373466 - DNA, 20 bp, human
gcacaggataatggaatctt

SEQ ID NO: 373467 - DNA, 20 bp, human
gaaactgcataggactcatg

SEQ ID NO: 373468 - DNA, 20 bp, human
gcattatagggatgattcac

SEQ ID NO: 373469 - DNA, 20 bp, human
gtcatccaaggtgtacctaa

SEQ ID NO: 373470 - DNA, 20 bp, human
gggtccaagtgagtaaccac

SEQ ID NO: 373471 - DNA, 20 bp, human
gcccatcaatcttaaaaatt

SEQ ID NO: 373472 - DNA, 20 bp, human
gagagaatgtcattttctac

SEQ ID NO: 373473 - DNA, 20 bp, human
gtctctattaataagatctg

SEQ ID NO: 373474 - DNA, 20 bp, human
gttagagtccagatcatcca

SEQ ID NO: 373475 - DNA, 20 bp, human
ggtggtctgaatgtatttta

SEQ ID NO: 373476 - DNA, 20 bp, human
gaagtggcagttcagtaaca

SEQ ID NO: 373477 - DNA, 20 bp, human
gaaggactgtaacacagccc

SEQ ID NO: 373478 - DNA, 20 bp, human
gggtgtaatcagtctaatcg

SEQ ID NO: 373479 - DNA, 20 bp, human
ggatgacctcacaggaaagg

SEQ ID NO: 373480 - DNA, 20 bp, human
gatcctctggatgacctcac

SEQ ID NO: 373481 - DNA, 20 bp, human
gggtgccaagatataaacgt

SEQ ID NO: 373482 - DNA, 20 bp, human
gaagccttttggattgataa

SEQ ID NO: 373483 - DNA, 20 bp, human
gtgaaccaatgaagcaaact

SEQ ID NO: 373484 - DNA, 20 bp, human
gttcttaacagtcccacctt

SEQ ID NO: 373485 - DNA, 20 bp, human
gtacacctacgtttatatct

SEQ ID NO: 373486 - DNA, 20 bp, human
gagtaaagaatgcttgccaa

SEQ ID NO: 373487 - DNA, 20 bp, human
gacaccaagtaacaacatta

SEQ ID NO: 373488 - DNA, 20 bp, human
gacaacatgtgtaagtcaac

SEQ ID NO: 373489 - DNA, 20 bp, human
gtcaaatgtccaaagatttt

SEQ ID NO: 373490 - DNA, 20 bp, human
ggttctttcctcaggtcatt

SEQ ID NO: 373491 - DNA, 20 bp, human
gtctttactaactctttttc

SEQ ID NO: 373492 - DNA, 20 bp, human
gtagggaagattacaagtaa

SEQ ID NO: 373493 - DNA, 20 bp, human
ggtgactgctcttcagaaat

SEQ ID NO: 373494 - DNA, 20 bp, human
gcttcatttcctggtcagtg

SEQ ID NO: 373495 - DNA, 20 bp, human
gcagagatccctcactgacc

SEQ ID NO: 373496 - DNA, 20 bp, human
gtggggactagctattaaaa

SEQ ID NO: 373497 - DNA, 20 bp, human
gatagctagtccccaaaccc

SEQ ID NO: 373498 - DNA, 20 bp, human
gcacaagaaaagaatcccca

SEQ ID NO: 373499 - DNA, 20 bp, human
ggaaatgtctgcgagccatg

SEQ ID NO: 373500 - DNA, 20 bp, human
gaagctcttgcaggtgttgt

SEQ ID NO: 373501 - DNA, 20 bp, human
gagtgactatgagaaaactc

SEQ ID NO: 373502 - DNA, 20 bp, human
gatgactcatggtttaatta

SEQ ID NO: 373503 - DNA, 20 bp, human
gatggaagtattagtatcta

SEQ ID NO: 373504 - DNA, 20 bp, human
gcaggtgttgtaggtagaat

SEQ ID NO: 373505 - DNA, 20 bp, human
gcaattacgtacataatcag

SEQ ID NO: 373506 - DNA, 20 bp, human
gacggacaggcggaccgcta

SEQ ID NO: 373507 - DNA, 20 bp, human
gagcaccccaggatcgaaga

SEQ ID NO: 373508 - DNA, 20 bp, human
ggcagcgcaccgggcgtggg

SEQ ID NO: 373509 - DNA, 20 bp, human
ggcagcgcaagggtgaatgt

SEQ ID NO: 373510 - DNA, 20 bp, human
ggagcccgagagcccctccg

SEQ ID NO: 373511 - DNA, 20 bp, human
gggcggggccggcagcgcaa

SEQ ID NO: 373512 - DNA, 20 bp, human
gcgtgcgccctcttcgatcc

SEQ ID NO: 373513 - DNA, 20 bp, human
ggccgcagcgcaccgggcgt

SEQ ID NO: 373514 - DNA, 20 bp, human
gagcgcatacccagccggga

SEQ ID NO: 373515 - DNA, 20 bp, human
gcttcccggagctgacagtg

SEQ ID NO: 373516 - DNA, 20 bp, human
ggccccgccaggttctgttg

SEQ ID NO: 373517 - DNA, 20 bp, human
ggggcccgcccctggtgccg

SEQ ID NO: 373518 - DNA, 20 bp, human
ggaggcgggcagaaaaccac

SEQ ID NO: 373519 - DNA, 20 bp, human
ggcccccaacagaacctggc

SEQ ID NO: 373520 - DNA, 20 bp, human
ggaagaggcggggcttgcgc

SEQ ID NO: 373521 - DNA, 20 bp, human
gtcttccccggcaccagggg

SEQ ID NO: 373522 - DNA, 20 bp, human
gcacctgcgcggccgctccc

SEQ ID NO: 373523 - DNA, 20 bp, human
gcaaagggcaggcacctgcg

SEQ ID NO: 373524 - DNA, 20 bp, human
ggcgggcccaggtgcgccca

SEQ ID NO: 373525 - DNA, 20 bp, human
gggcttggtgacgacgtcgg

SEQ ID NO: 373526 - DNA, 20 bp, human
gtgggtggccagatcagata

SEQ ID NO: 373527 - DNA, 20 bp, human
ggagaggtgaagctgtgctt

SEQ ID NO: 373528 - DNA, 20 bp, human
gggtactaaagtagcctggg

SEQ ID NO: 373529 - DNA, 20 bp, human
ggattcccgtgtagacttaa

SEQ ID NO: 373530 - DNA, 20 bp, human
gcatgaaaagcctgagttaa

SEQ ID NO: 373531 - DNA, 20 bp, human
gtgggagcacccagatggga

SEQ ID NO: 373532 - DNA, 20 bp, human
gctcctggccttatctgatc

SEQ ID NO: 373533 - DNA, 20 bp, human
gagtggtactaaagtagcct

SEQ ID NO: 373534 - DNA, 20 bp, human
ggctgaacactctgttcctg

SEQ ID NO: 373535 - DNA, 20 bp, human
ggctactttagtaccacttc

SEQ ID NO: 373536 - DNA, 20 bp, human
gttgagctcacctaccccaa

SEQ ID NO: 373537 - DNA, 20 bp, human
gtacccagccatgaagctga

SEQ ID NO: 373538 - DNA, 20 bp, human
gacatgggactcactatcaa

SEQ ID NO: 373539 - DNA, 20 bp, human
gtagaagcaatagaaactta

SEQ ID NO: 373540 - DNA, 20 bp, human
ggccaggactggacattact

SEQ ID NO: 373541 - DNA, 20 bp, human
ggggtagaatcatcagagtg

SEQ ID NO: 373542 - DNA, 20 bp, human
gctaccccaagggccaggac

SEQ ID NO: 373543 - DNA, 20 bp, human
gttgggcttgatacttgaga

SEQ ID NO: 373544 - DNA, 20 bp, human
gatgtccagtcctggccctt

SEQ ID NO: 373545 - DNA, 20 bp, human
gatcaagggtctaatcagtt

SEQ ID NO: 373546 - DNA, 20 bp, human
gccagcgcccgccccttagg

SEQ ID NO: 373547 - DNA, 20 bp, human
gcgtgcggccccctaagggg

SEQ ID NO: 373548 - DNA, 20 bp, human
gggcccgtgcggccccctaa

SEQ ID NO: 373549 - DNA, 20 bp, human
ggcgaccgggccccccgacc

SEQ ID NO: 373550 - DNA, 20 bp, human
gggccgggggatgcacgctc

SEQ ID NO: 373551 - DNA, 20 bp, human
gcgggggatgcacgctctgg

SEQ ID NO: 373552 - DNA, 20 bp, human
gggccggcggctgtctgacc

SEQ ID NO: 373553 - DNA, 20 bp, human
gtcggggggcccggtcgcaa

SEQ ID NO: 373554 - DNA, 20 bp, human
ggaccaggcgagtgcccggg

SEQ ID NO: 373555 - DNA, 20 bp, human
gccggccggtagcgacgcga

SEQ ID NO: 373556 - DNA, 20 bp, human
gggcgcgggtaggtgcggag

SEQ ID NO: 373557 - DNA, 20 bp, human
ggagaggcccggagggggac

SEQ ID NO: 373558 - DNA, 20 bp, human
ggccggggtgcgaacccctc

SEQ ID NO: 373559 - DNA, 20 bp, human
gcctgcccagcaccccggag

SEQ ID NO: 373560 - DNA, 20 bp, human
gcccggagggggacgggtga

SEQ ID NO: 373561 - DNA, 20 bp, human
gaggaccggggggagggttg

SEQ ID NO: 373562 - DNA, 20 bp, human
gcgcgagcgcctcaggttgg

SEQ ID NO: 373563 - DNA, 20 bp, human
gtcaccttgcccggggctcg

SEQ ID NO: 373564 - DNA, 20 bp, human
gaccctgcgacaacccctgg

SEQ ID NO: 373565 - DNA, 20 bp, human
gcatcggccgtctgggtctg

SEQ ID NO: 373566 - DNA, 20 bp, human
ggatggaagtggtgatgcta

SEQ ID NO: 373567 - DNA, 20 bp, human
ggaagtggtgatgctaggga

SEQ ID NO: 373568 - DNA, 20 bp, human
ggagggaggcagggaagcgt

SEQ ID NO: 373569 - DNA, 20 bp, human
gggcccccagccagactcgg

SEQ ID NO: 373570 - DNA, 20 bp, human
ggctgtgggagcaggcgggt

SEQ ID NO: 373571 - DNA, 20 bp, human
gcggggtgcctgggggtctg

SEQ ID NO: 373572 - DNA, 20 bp, human
ggagctgggggtcaccacag

SEQ ID NO: 373573 - DNA, 20 bp, human
gtgtgagcctgagaactcaa

SEQ ID NO: 373574 - DNA, 20 bp, human
gtctgcacccttgagttctc

SEQ ID NO: 373575 - DNA, 20 bp, human
gaagaggaagcccccgagtc

SEQ ID NO: 373576 - DNA, 20 bp, human
ggtggcaggtcacgtgtcga

SEQ ID NO: 373577 - DNA, 20 bp, human
gcctcttgggcgttccgccc

SEQ ID NO: 373578 - DNA, 20 bp, human
gtgacgctccagggaccgca

SEQ ID NO: 373579 - DNA, 20 bp, human
ggtgacctgccacccgacta

SEQ ID NO: 373580 - DNA, 20 bp, human
gggaaagttcctggttactc

SEQ ID NO: 373581 - DNA, 20 bp, human
gcccaagaggcttccgtagt

SEQ ID NO: 373582 - DNA, 20 bp, human
ggcgactccacctagtcacg

SEQ ID NO: 373583 - DNA, 20 bp, human
gtgagcagcgcgatggatgg

SEQ ID NO: 373584 - DNA, 20 bp, human
gtcacatgacatgtgagccc

SEQ ID NO: 373585 - DNA, 20 bp, human
ggtgacggccggccggtcgc

SEQ ID NO: 373586 - DNA, 20 bp, human
gcagtcacgccggggccgac

SEQ ID NO: 373587 - DNA, 20 bp, human
gccccagggcagcacgtgcg

SEQ ID NO: 373588 - DNA, 20 bp, human
ggagcccctcctgccaatgg

SEQ ID NO: 373589 - DNA, 20 bp, human
gaatgggggcgcagtcacgc

SEQ ID NO: 373590 - DNA, 20 bp, human
gcacgcccgaggcaggggtt

SEQ ID NO: 373591 - DNA, 20 bp, human
gagcgggagagggtttgctc

SEQ ID NO: 373592 - DNA, 20 bp, human
ggaggcaggggttgggtgaa

SEQ ID NO: 373593 - DNA, 20 bp, human
ggccccgcacgtgctgccct

SEQ ID NO: 373594 - DNA, 20 bp, human
ggcgcccccattggcaggag

SEQ ID NO: 373595 - DNA, 20 bp, human
ggcccgcgcccaatcagctc

SEQ ID NO: 373596 - DNA, 20 bp, human
gggtctcagaggctgacgat

SEQ ID NO: 373597 - DNA, 20 bp, human
gcctccgtagcaggtctcag

SEQ ID NO: 373598 - DNA, 20 bp, human
gttgtccagtccccagggtg

SEQ ID NO: 373599 - DNA, 20 bp, human
gcagcctctgagacctgcta

SEQ ID NO: 373600 - DNA, 20 bp, human
ggaagctgcaggctagatca

SEQ ID NO: 373601 - DNA, 20 bp, human
ggacgatggggaaatcgcac

SEQ ID NO: 373602 - DNA, 20 bp, human
ggtgaagctgccgtggggtc

SEQ ID NO: 373603 - DNA, 20 bp, human
gagcccttgtcctccgtagc

SEQ ID NO: 373604 - DNA, 20 bp, human
ggacctgctacggaggacaa

SEQ ID NO: 373605 - DNA, 20 bp, human
gcactggtgaagctgccgtg

SEQ ID NO: 373606 - DNA, 20 bp, human
gcctgcgcgacccacactca

SEQ ID NO: 373607 - DNA, 20 bp, human
gcaggcgtatgcgtagagca

SEQ ID NO: 373608 - DNA, 20 bp, human
gtcagggaggcgcccgcctc

SEQ ID NO: 373609 - DNA, 20 bp, human
gcgtggagtgcgcaagcgca

SEQ ID NO: 373610 - DNA, 20 bp, human
ggcgggcgcctccctgagtg

SEQ ID NO: 373611 - DNA, 20 bp, human
ggcgcaagcgcagggctctc

SEQ ID NO: 373612 - DNA, 20 bp, human
gagcgcagggctctcaggcg

SEQ ID NO: 373613 - DNA, 20 bp, human
ggagctgagagatgtttgtg

SEQ ID NO: 373614 - DNA, 20 bp, human
gcctgtccagccccgcctct

SEQ ID NO: 373615 - DNA, 20 bp, human
ggcgcgacccacactcaggg

SEQ ID NO: 373616 - DNA, 20 bp, human
gtgagccagagacggggcac

SEQ ID NO: 373617 - DNA, 20 bp, human
ggctcacgggatgtgtggag

SEQ ID NO: 373618 - DNA, 20 bp, human
gagttggggtgagaataagt

SEQ ID NO: 373619 - DNA, 20 bp, human
gtcagagtaaggcaggagtc

SEQ ID NO: 373620 - DNA, 20 bp, human
gacagatgacaccgagggcc

SEQ ID NO: 373621 - DNA, 20 bp, human
gctctggctcacgggatgtg

SEQ ID NO: 373622 - DNA, 20 bp, human
ggatggggttactggggctc

SEQ ID NO: 373623 - DNA, 20 bp, human
gcatcccgtgagccagagac

SEQ ID NO: 373624 - DNA, 20 bp, human
gcaatgacagatgacaccga

SEQ ID NO: 373625 - DNA, 20 bp, human
gtgggtgggcggcagggtct

SEQ ID NO: 373626 - DNA, 20 bp, human
gaccacgttccgggctgggg

SEQ ID NO: 373627 - DNA, 20 bp, human
gaggcagcgcgcggccacca

SEQ ID NO: 373628 - DNA, 20 bp, human
gagcgcgcgagccaaggctc

SEQ ID NO: 373629 - DNA, 20 bp, human
gcgccgggaaggctgatcgc

SEQ ID NO: 373630 - DNA, 20 bp, human
gatgtgaatgaccacgttcc

SEQ ID NO: 373631 - DNA, 20 bp, human
gaaagcggccagacgctcgg

SEQ ID NO: 373632 - DNA, 20 bp, human
ggagcagagcacatcgctgc

SEQ ID NO: 373633 - DNA, 20 bp, human
ggatgccgccctcctatcag

SEQ ID NO: 373634 - DNA, 20 bp, human
gctgtcgggcaggcagcgcg

SEQ ID NO: 373635 - DNA, 20 bp, human
gaggctgcgtcacgaatccg

SEQ ID NO: 373636 - DNA, 20 bp, human
ggggccccaggatctccccg

SEQ ID NO: 373637 - DNA, 20 bp, human
gcccggggaagatgggatgg

SEQ ID NO: 373638 - DNA, 20 bp, human
gcttccccggggagatcctg

SEQ ID NO: 373639 - DNA, 20 bp, human
gggatctccccggggaagat

SEQ ID NO: 373640 - DNA, 20 bp, human
gtgtccctgagctccctcaa

SEQ ID NO: 373641 - DNA, 20 bp, human
gagagaggctgcgccagcag

SEQ ID NO: 373642 - DNA, 20 bp, human
ggagagggcacaaaactctc

SEQ ID NO: 373643 - DNA, 20 bp, human
gagggagctcagggacattt

SEQ ID NO: 373644 - DNA, 20 bp, human
gcgtttggcgctctcatcga

SEQ ID NO: 373645 - DNA, 20 bp, human
gcaggctcaggtgtcggaaa

SEQ ID NO: 373646 - DNA, 20 bp, human
gaaaaaacggaggtcgggga

SEQ ID NO: 373647 - DNA, 20 bp, human
ggtagctgggatccagcgag

SEQ ID NO: 373648 - DNA, 20 bp, human
ggatccagcgagaggaaggt

SEQ ID NO: 373649 - DNA, 20 bp, human
gtcccagctacagttggctc

SEQ ID NO: 373650 - DNA, 20 bp, human
gtatcccaccttcctctcgc

SEQ ID NO: 373651 - DNA, 20 bp, human
ggaggaaaaaaacggaggtc

SEQ ID NO: 373652 - DNA, 20 bp, human
gagatccgcgcgcgaaggga

SEQ ID NO: 373653 - DNA, 20 bp, human
ggctggatcccagctacagt

SEQ ID NO: 373654 - DNA, 20 bp, human
gtccagccaagcgtcctatc

SEQ ID NO: 373655 - DNA, 20 bp, human
gagaggttacaaagcagata

SEQ ID NO: 373656 - DNA, 20 bp, human
ggtggaacatgtcagactgg

SEQ ID NO: 373657 - DNA, 20 bp, human
gaacgagagcagcgcgagga

SEQ ID NO: 373658 - DNA, 20 bp, human
gccgctaatcgccagttcgg

SEQ ID NO: 373659 - DNA, 20 bp, human
ggtggcataccggaccctgt

SEQ ID NO: 373660 - DNA, 20 bp, human
gagggtccggagtgtagctg

SEQ ID NO: 373661 - DNA, 20 bp, human
gcgccgtcctccagagggtc

SEQ ID NO: 373662 - DNA, 20 bp, human
ggcgccgctaatcgccagtt

SEQ ID NO: 373663 - DNA, 20 bp, human
ggaggacggcgctcagagga

SEQ ID NO: 373664 - DNA, 20 bp, human
gcaacgtcgcaaaataaaca

SEQ ID NO: 373665 - DNA, 20 bp, human
ggcagcagcctcctaggcga

SEQ ID NO: 373666 - DNA, 20 bp, human
gccgacccggggaaggtcgc

SEQ ID NO: 373667 - DNA, 20 bp, human
ggggaaagctcagggcgtgg

SEQ ID NO: 373668 - DNA, 20 bp, human
ggaagagggtgatccgaccc

SEQ ID NO: 373669 - DNA, 20 bp, human
gtcgctgggcagggcgagtt

SEQ ID NO: 373670 - DNA, 20 bp, human
gcctgcccagcgaccttccc

SEQ ID NO: 373671 - DNA, 20 bp, human
gcgagaggcagataggacgt

SEQ ID NO: 373672 - DNA, 20 bp, human
gataggacgtgggagaaagg

SEQ ID NO: 373673 - DNA, 20 bp, human
gcgccctgagctttcccgaa

SEQ ID NO: 373674 - DNA, 20 bp, human
gcggcctggcctccagcgag

SEQ ID NO: 373675 - DNA, 20 bp, human
gaggaaggcgcttgttggaa

SEQ ID NO: 373676 - DNA, 20 bp, human
gaagataggcggagtcttga

SEQ ID NO: 373677 - DNA, 20 bp, human
ggcgcactaggaaagatagg

SEQ ID NO: 373678 - DNA, 20 bp, human
gaatggggaggaggccgcgc

SEQ ID NO: 373679 - DNA, 20 bp, human
gataggcggagtcttgaggg

SEQ ID NO: 373680 - DNA, 20 bp, human
gcatgcgcactaggaaagat

SEQ ID NO: 373681 - DNA, 20 bp, human
ggcgtctcggggccaagtca

SEQ ID NO: 373682 - DNA, 20 bp, human
gcgccccggctggtgtgtgt

SEQ ID NO: 373683 - DNA, 20 bp, human
gcagggcccggggatttgag

SEQ ID NO: 373684 - DNA, 20 bp, human
ggggcctgagtaaaaagagg

SEQ ID NO: 373685 - DNA, 20 bp, human
gctagtgcgcatgcgtctcg

SEQ ID NO: 373686 - DNA, 20 bp, human
gagtgcccggcgctgtagga

SEQ ID NO: 373687 - DNA, 20 bp, human
gcggaagtgcccggcgctgt

SEQ ID NO: 373688 - DNA, 20 bp, human
ggccgctgctgcatggcact

SEQ ID NO: 373689 - DNA, 20 bp, human
ggcgctgtaggagggagcaa

SEQ ID NO: 373690 - DNA, 20 bp, human
gcaagcgcggcggcaaatcc

SEQ ID NO: 373691 - DNA, 20 bp, human
gagcccagacgggcccgcgg

SEQ ID NO: 373692 - DNA, 20 bp, human
gcgcctagccagagcggtgc

SEQ ID NO: 373693 - DNA, 20 bp, human
gggcggcttcccaagcgcgg

SEQ ID NO: 373694 - DNA, 20 bp, human
gcgcgcgcacgcgccctcgc

SEQ ID NO: 373695 - DNA, 20 bp, human
gcggggctggagtcgtaact

SEQ ID NO: 373696 - DNA, 20 bp, human
gttagggatcccatgaaaaa

SEQ ID NO: 373697 - DNA, 20 bp, human
gcatccaggaagagcactta

SEQ ID NO: 373698 - DNA, 20 bp, human
ggcggagagattgtgtcatg

SEQ ID NO: 373699 - DNA, 20 bp, human
gttaaccacaaaaccagagg

SEQ ID NO: 373700 - DNA, 20 bp, human
ggctcccacacttccccctc

SEQ ID NO: 373701 - DNA, 20 bp, human
ggacatcctccaccaacaca

SEQ ID NO: 373702 - DNA, 20 bp, human
gtgcagcagcatttaaattc

SEQ ID NO: 373703 - DNA, 20 bp, human
gatgaaaaagggagaaagta

SEQ ID NO: 373704 - DNA, 20 bp, human
ggctttttcatttacgggat

SEQ ID NO: 373705 - DNA, 20 bp, human
gagcttgttacttagacaaa

SEQ ID NO: 373706 - DNA, 20 bp, human
gaaaaaggtacctaagggtc

SEQ ID NO: 373707 - DNA, 20 bp, human
gtatagtcacccggaccctt

SEQ ID NO: 373708 - DNA, 20 bp, human
gtatctcataggggaatgaa

SEQ ID NO: 373709 - DNA, 20 bp, human
gcatcaagactagtgaagaa

SEQ ID NO: 373710 - DNA, 20 bp, human
gctaccacttaactgcactg

SEQ ID NO: 373711 - DNA, 20 bp, human
gagagttccttcttgttcca

SEQ ID NO: 373712 - DNA, 20 bp, human
gattacaaaaaggtacctaa

SEQ ID NO: 373713 - DNA, 20 bp, human
ggcagttaagtggtaggaaa

SEQ ID NO: 373714 - DNA, 20 bp, human
ggaaagcacagtgtgaagtt

SEQ ID NO: 373715 - DNA, 20 bp, human
gtagatgtgctttatctgag

SEQ ID NO: 373716 - DNA, 20 bp, human
gcaaactggaacctttccat

SEQ ID NO: 373717 - DNA, 20 bp, human
gaaaaggcatcaagaggctc

SEQ ID NO: 373718 - DNA, 20 bp, human
ggaaaaataaacagcacacg

SEQ ID NO: 373719 - DNA, 20 bp, human
gcaaggcaaaaggcatcaag

SEQ ID NO: 373720 - DNA, 20 bp, human
gttcaaaagtgtcctcaaac

SEQ ID NO: 373721 - DNA, 20 bp, human
ggataaagacagctcctctt

SEQ ID NO: 373722 - DNA, 20 bp, human
gaactttagcccaaggcaaa

SEQ ID NO: 373723 - DNA, 20 bp, human
gacagaaacaattgatcctg

SEQ ID NO: 373724 - DNA, 20 bp, human
gagcagaaaatattgacccc

SEQ ID NO: 373725 - DNA, 20 bp, human
ggctgacttttcctatggaa

SEQ ID NO: 373726 - DNA, 20 bp, human
ggctacgaggccaccggctg

SEQ ID NO: 373727 - DNA, 20 bp, human
gaacactcgggtagttactg

SEQ ID NO: 373728 - DNA, 20 bp, human
gcgggagaacggatttctca

SEQ ID NO: 373729 - DNA, 20 bp, human
gggggaaactgagacccgtt

SEQ ID NO: 373730 - DNA, 20 bp, human
gcggccccgcccgtaagatg

SEQ ID NO: 373731 - DNA, 20 bp, human
gcgccgggacgcctggatac

SEQ ID NO: 373732 - DNA, 20 bp, human
gatgacaggcagatgaatta

SEQ ID NO: 373733 - DNA, 20 bp, human
gccgttctcccgccaggctt

SEQ ID NO: 373734 - DNA, 20 bp, human
gggctcagacccgcagccgg

SEQ ID NO: 373735 - DNA, 20 bp, human
gggaagtcgcgctgctgtgg

SEQ ID NO: 373736 - DNA, 20 bp, human
gacacggcgcgacaagatgg

SEQ ID NO: 373737 - DNA, 20 bp, human
gcgcggcggaatctggagcc

SEQ ID NO: 373738 - DNA, 20 bp, human
ggccacacggcgcgacaaga

SEQ ID NO: 373739 - DNA, 20 bp, human
ggcccgagctccacgccccc

SEQ ID NO: 373740 - DNA, 20 bp, human
ggaggtcaaagggcgcgggg

SEQ ID NO: 373741 - DNA, 20 bp, human
gtacatcgacaagacgatcc

SEQ ID NO: 373742 - DNA, 20 bp, human
ggcgcgtgggggaggtcaaa

SEQ ID NO: 373743 - DNA, 20 bp, human
gaagcagagcgcatgagacc

SEQ ID NO: 373744 - DNA, 20 bp, human
gcaagatggcggtgagcgcg

SEQ ID NO: 373745 - DNA, 20 bp, human
ggtgagcgcgcggcggaatc

SEQ ID NO: 373746 - DNA, 20 bp, human
gtctctgcccagaccctagt

SEQ ID NO: 373747 - DNA, 20 bp, human
gcccaaccctgggagaccag

SEQ ID NO: 373748 - DNA, 20 bp, human
gttggggggcatcattctag

SEQ ID NO: 373749 - DNA, 20 bp, human
gtgcccctgggaggggtatt

SEQ ID NO: 373750 - DNA, 20 bp, human
gacctggtctaaacccacta

SEQ ID NO: 373751 - DNA, 20 bp, human
gacagcagcgccctcggctg

SEQ ID NO: 373752 - DNA, 20 bp, human
ggcagtctggccacctgtcc

SEQ ID NO: 373753 - DNA, 20 bp, human
gtggccctggtttccaggac

SEQ ID NO: 373754 - DNA, 20 bp, human
gaccctagtgggtttagacc

SEQ ID NO: 373755 - DNA, 20 bp, human
gtgtgcaataggtacagcta

SEQ ID NO: 373756 - DNA, 20 bp, human
gggaggcggcccaactgctc

SEQ ID NO: 373757 - DNA, 20 bp, human
gcagcagccgcctagaaccc

SEQ ID NO: 373758 - DNA, 20 bp, human
gacacccgccgaggggagga

SEQ ID NO: 373759 - DNA, 20 bp, human
gagccgacgtctctgcgcat

SEQ ID NO: 373760 - DNA, 20 bp, human
gcgcagagacgtcggctcct

SEQ ID NO: 373761 - DNA, 20 bp, human
ggggcggaagagggtacccg

SEQ ID NO: 373762 - DNA, 20 bp, human
ggcagcagcccctcggagag

SEQ ID NO: 373763 - DNA, 20 bp, human
gcgcatgggcccggctcgag

SEQ ID NO: 373764 - DNA, 20 bp, human
gctcggagaggggcggaaga

SEQ ID NO: 373765 - DNA, 20 bp, human
gacatctccgcgtggggagg

SEQ ID NO: 373766 - DNA, 20 bp, human
gccaagtgggacaacagaga

SEQ ID NO: 373767 - DNA, 20 bp, human
gcaggggtgctggttccctt

SEQ ID NO: 373768 - DNA, 20 bp, human
gagaagcaggggttactggt

SEQ ID NO: 373769 - DNA, 20 bp, human
gagcccagtccgtgccaagt

SEQ ID NO: 373770 - DNA, 20 bp, human
ggccccgccgacacccgtag

SEQ ID NO: 373771 - DNA, 20 bp, human
ggtcccacttggcacggact

SEQ ID NO: 373772 - DNA, 20 bp, human
gggaccgctacgggtgtcgg

SEQ ID NO: 373773 - DNA, 20 bp, human
gcaagggaaccagatcccaa

SEQ ID NO: 373774 - DNA, 20 bp, human
gtcgggccgcgagcgcccag

SEQ ID NO: 373775 - DNA, 20 bp, human
gagcttgcgggcgaagaaca

SEQ ID NO: 373776 - DNA, 20 bp, human
gcgcgcacgcacaccgagca

SEQ ID NO: 373777 - DNA, 20 bp, human
ggggcgcccgcgagagaagg

SEQ ID NO: 373778 - DNA, 20 bp, human
gcggccgggagaagtcgcga

SEQ ID NO: 373779 - DNA, 20 bp, human
gagtggctcgacaacgattt

SEQ ID NO: 373780 - DNA, 20 bp, human
gcggggtgcccaggctgtga

SEQ ID NO: 373781 - DNA, 20 bp, human
ggctgccgagcggggtgccc

SEQ ID NO: 373782 - DNA, 20 bp, human
gggcctccggggaaagcggg

SEQ ID NO: 373783 - DNA, 20 bp, human
ggcagccgctgcccgaaccg

SEQ ID NO: 373784 - DNA, 20 bp, human
ggcgcccccggttcgggcag

SEQ ID NO: 373785 - DNA, 20 bp, human
gacagcctgggcaccccgct

SEQ ID NO: 373786 - DNA, 20 bp, human
gaaccctcggatgactcatc

SEQ ID NO: 373787 - DNA, 20 bp, human
ggtaccggatgagtcatccg

SEQ ID NO: 373788 - DNA, 20 bp, human
ggggttagtccgcattttat

SEQ ID NO: 373789 - DNA, 20 bp, human
ggagactgaatcatatatgg

SEQ ID NO: 373790 - DNA, 20 bp, human
gacaacaggcctataaaatg

SEQ ID NO: 373791 - DNA, 20 bp, human
ggacgaaattctttggtttg

SEQ ID NO: 373792 - DNA, 20 bp, human
gtgctgacctgagaaccagc

SEQ ID NO: 373793 - DNA, 20 bp, human
gttctccagaatgtaatctc

SEQ ID NO: 373794 - DNA, 20 bp, human
gcacttctcaggcagccagc

SEQ ID NO: 373795 - DNA, 20 bp, human
gtcatcctttcatcaatgat

SEQ ID NO: 373796 - DNA, 20 bp, human
gtcacccagcaacgggagat

SEQ ID NO: 373797 - DNA, 20 bp, human
ggaggctcagagggagacgg

SEQ ID NO: 373798 - DNA, 20 bp, human
gccccagccgagggaagcca

SEQ ID NO: 373799 - DNA, 20 bp, human
gggcagaggaagtcagaaac

SEQ ID NO: 373800 - DNA, 20 bp, human
gcaggggggaaagatgggat

SEQ ID NO: 373801 - DNA, 20 bp, human
gcggggtaaaatggttctga

SEQ ID NO: 373802 - DNA, 20 bp, human
gcctgcccatctcccgttgc

SEQ ID NO: 373803 - DNA, 20 bp, human
gagccctccgcccagtaatc

SEQ ID NO: 373804 - DNA, 20 bp, human
ggacactgatcccgattact

SEQ ID NO: 373805 - DNA, 20 bp, human
gaccctggcgtcccaacctt

SEQ ID NO: 373806 - DNA, 20 bp, human
gggagggtcagattcctcag

SEQ ID NO: 373807 - DNA, 20 bp, human
ggaagtgagggaaaaacgtt

SEQ ID NO: 373808 - DNA, 20 bp, human
gcaggggccgtggtgactca

SEQ ID NO: 373809 - DNA, 20 bp, human
gacggcccctgggcaggcga

SEQ ID NO: 373810 - DNA, 20 bp, human
gagtggggctccaagaccgt

SEQ ID NO: 373811 - DNA, 20 bp, human
gcccaaaagaagcagtgaaa

SEQ ID NO: 373812 - DNA, 20 bp, human
gccgtggtgactcacgggca

SEQ ID NO: 373813 - DNA, 20 bp, human
gcgggcagggaggcgacatc

SEQ ID NO: 373814 - DNA, 20 bp, human
ggcgatggagcgtggctggg

SEQ ID NO: 373815 - DNA, 20 bp, human
gacgctccatcgccgcccaa

SEQ ID NO: 373816 - DNA, 20 bp, human
ggagggtggcagtgaaaatt

SEQ ID NO: 373817 - DNA, 20 bp, human
gtaccatcctcatcaccggt

SEQ ID NO: 373818 - DNA, 20 bp, human
gagccctgcacctgggtctg

SEQ ID NO: 373819 - DNA, 20 bp, human
ggggtgagcagcaggcttca

SEQ ID NO: 373820 - DNA, 20 bp, human
gagtgccaaaaaatatcagg

SEQ ID NO: 373821 - DNA, 20 bp, human
ggagtcatgtgtgacaggtg

SEQ ID NO: 373822 - DNA, 20 bp, human
gcaaggaaatagaagctctc

SEQ ID NO: 373823 - DNA, 20 bp, human
gtgccctgtcccacagaaca

SEQ ID NO: 373824 - DNA, 20 bp, human
gcactcttgcacacatgaat

SEQ ID NO: 373825 - DNA, 20 bp, human
gtcaaggcaagccctgcacc

SEQ ID NO: 373826 - DNA, 20 bp, human
gaaatgtaatgggggagtta

SEQ ID NO: 373827 - DNA, 20 bp, human
gaggctttctacatggtact

SEQ ID NO: 373828 - DNA, 20 bp, human
gaccagaagcaaaaccatag

SEQ ID NO: 373829 - DNA, 20 bp, human
gctactaaagctggcttctg

SEQ ID NO: 373830 - DNA, 20 bp, human
gaagccatcctataagtcac

SEQ ID NO: 373831 - DNA, 20 bp, human
ggatataagttgccttgggt

SEQ ID NO: 373832 - DNA, 20 bp, human
ggaagagaactccaataaaa

SEQ ID NO: 373833 - DNA, 20 bp, human
gctggcttctgagggacatg

SEQ ID NO: 373834 - DNA, 20 bp, human
gaaaaatgccctactaaagc

SEQ ID NO: 373835 - DNA, 20 bp, human
gtatttggacaagcagagat

SEQ ID NO: 373836 - DNA, 20 bp, human
ggggagcaaagggtgttcag

SEQ ID NO: 373837 - DNA, 20 bp, human
gggggtgaatcacatctgac

SEQ ID NO: 373838 - DNA, 20 bp, human
gaaaagttgagtcaacaggt

SEQ ID NO: 373839 - DNA, 20 bp, human
gagcacaggtgacacttgta

SEQ ID NO: 373840 - DNA, 20 bp, human
ggaatcacatctgacaggta

SEQ ID NO: 373841 - DNA, 20 bp, human
ggttcagggggataaagccc

SEQ ID NO: 373842 - DNA, 20 bp, human
gggtgtagtgtttacaggaa

SEQ ID NO: 373843 - DNA, 20 bp, human
gaaggaaacaggatccatct

SEQ ID NO: 373844 - DNA, 20 bp, human
ggtttacaggaagggtggtg

SEQ ID NO: 373845 - DNA, 20 bp, human
gtcccaggtgtagtgtttac

SEQ ID NO: 373846 - DNA, 20 bp, human
gccatggtgaataccacttc

SEQ ID NO: 373847 - DNA, 20 bp, human
gtaggaagaaagagagcacc

SEQ ID NO: 373848 - DNA, 20 bp, human
ggcaagagcaaatcatcttt

SEQ ID NO: 373849 - DNA, 20 bp, human
ggatttaagcagagaataat

SEQ ID NO: 373850 - DNA, 20 bp, human
gctcttgctccactggagca

SEQ ID NO: 373851 - DNA, 20 bp, human
gctggaccattggaaatgtg

SEQ ID NO: 373852 - DNA, 20 bp, human
ggcctgttattgtgctgtgt

SEQ ID NO: 373853 - DNA, 20 bp, human
gaatatgagactcataatac

SEQ ID NO: 373854 - DNA, 20 bp, human
gcttgagccaggccacaggt

SEQ ID NO: 373855 - DNA, 20 bp, human
gactcataatactggaccat

SEQ ID NO: 373856 - DNA, 20 bp, human
gactcacagaagccatgcct

SEQ ID NO: 373857 - DNA, 20 bp, human
gtcaggagagcttaacccag

SEQ ID NO: 373858 - DNA, 20 bp, human
ggccaatgtgctaggaggaa

SEQ ID NO: 373859 - DNA, 20 bp, human
gcattcaggtaaagtgaatg

SEQ ID NO: 373860 - DNA, 20 bp, human
gtactggatcagcattgttt

SEQ ID NO: 373861 - DNA, 20 bp, human
gcctccacggaactgtaaac

SEQ ID NO: 373862 - DNA, 20 bp, human
gcacattggcaaattgcatg

SEQ ID NO: 373863 - DNA, 20 bp, human
gctccctgtttacagttccg

SEQ ID NO: 373864 - DNA, 20 bp, human
gatccatgactggcatgagc

SEQ ID NO: 373865 - DNA, 20 bp, human
ggtacaacaataaggcattc

SEQ ID NO: 373866 - DNA, 20 bp, human
gctcaaactgggaaacatca

SEQ ID NO: 373867 - DNA, 20 bp, human
gcacactggcaaattgtacg

SEQ ID NO: 373868 - DNA, 20 bp, human
gtgtacgaggaaagaagggg

SEQ ID NO: 373869 - DNA, 20 bp, human
gtgctagaaggacctaacaa

SEQ ID NO: 373870 - DNA, 20 bp, human
gtcactgccttcaaaaccag

SEQ ID NO: 373871 - DNA, 20 bp, human
gaattgtacgaggaaagaag

SEQ ID NO: 373872 - DNA, 20 bp, human
gttaggtccttctagcacac

SEQ ID NO: 373873 - DNA, 20 bp, human
ggaagcatcatatctacctc

SEQ ID NO: 373874 - DNA, 20 bp, human
gttttgctaagttgtatgcc

SEQ ID NO: 373875 - DNA, 20 bp, human
gccagagaggagagttgacc

SEQ ID NO: 373876 - DNA, 20 bp, human
gaaacggaactgcctaaaat

SEQ ID NO: 373877 - DNA, 20 bp, human
gctgttctgaggtctcccgc

SEQ ID NO: 373878 - DNA, 20 bp, human
gcaggagtttaggagtcatg

SEQ ID NO: 373879 - DNA, 20 bp, human
gtactggaccagcccatttt

SEQ ID NO: 373880 - DNA, 20 bp, human
gggaactgcctaaaatgggc

SEQ ID NO: 373881 - DNA, 20 bp, human
gtgacagggaatctcaaaaa

SEQ ID NO: 373882 - DNA, 20 bp, human
gaattggcaaattatactaa

SEQ ID NO: 373883 - DNA, 20 bp, human
gaggcagttccgtttccccc

SEQ ID NO: 373884 - DNA, 20 bp, human
gaagtcctgtgatcacaggt

SEQ ID NO: 373885 - DNA, 20 bp, human
gcaaggctgtctttcttgat

SEQ ID NO: 373886 - DNA, 20 bp, human
gttctctaaccggttgtcaa

SEQ ID NO: 373887 - DNA, 20 bp, human
gtatccatatctggcatgag

SEQ ID NO: 373888 - DNA, 20 bp, human
gcgtcagagagataattgga

SEQ ID NO: 373889 - DNA, 20 bp, human
gaaagagagcccttgacaac

SEQ ID NO: 373890 - DNA, 20 bp, human
gaagtggaactgcctaaaac

SEQ ID NO: 373891 - DNA, 20 bp, human
gaggcagttccacttcccac

SEQ ID NO: 373892 - DNA, 20 bp, human
gcaggggaggtaagatagga

SEQ ID NO: 373893 - DNA, 20 bp, human
gcctccctgggattataaac

SEQ ID NO: 373894 - DNA, 20 bp, human
gagctagagtggatcaggac

SEQ ID NO: 373895 - DNA, 20 bp, human
gggaaagtagaggtagagtt

SEQ ID NO: 373896 - DNA, 20 bp, human
ggcagggcctcagtgagtca

SEQ ID NO: 373897 - DNA, 20 bp, human
gaagtggaactacccaaaac

SEQ ID NO: 373898 - DNA, 20 bp, human
gtgttctgggatctttccac

SEQ ID NO: 373899 - DNA, 20 bp, human
gggttcatgtacaaacaata

SEQ ID NO: 373900 - DNA, 20 bp, human
ggtcagggcacttaatccag

SEQ ID NO: 373901 - DNA, 20 bp, human
gagtttcagtgacagcaaag

SEQ ID NO: 373902 - DNA, 20 bp, human
gaggagagttgacctggctg

SEQ ID NO: 373903 - DNA, 20 bp, human
gaagctgtatgaccacagcc

SEQ ID NO: 373904 - DNA, 20 bp, human
gagagcatcttatttacctc

SEQ ID NO: 373905 - DNA, 20 bp, human
gttttagttgggacattgct

SEQ ID NO: 373906 - DNA, 20 bp, human
ggggctctcttttttgactg

SEQ ID NO: 373907 - DNA, 20 bp, human
ggcattcagtaaagtggatc

SEQ ID NO: 373908 - DNA, 20 bp, human
gtgccaatgcgctaaaagga

SEQ ID NO: 373909 - DNA, 20 bp, human
gaatatggcattcagtaaag

SEQ ID NO: 373910 - DNA, 20 bp, human
gggcagttacactttctgct

SEQ ID NO: 373911 - DNA, 20 bp, human
gatcactgtcaggccagttg

SEQ ID NO: 373912 - DNA, 20 bp, human
ggagagacctaacaaaggcc

SEQ ID NO: 373913 - DNA, 20 bp, human
gttacactttctgctgggag

SEQ ID NO: 373914 - DNA, 20 bp, human
gtagtttgataatcactgtc

SEQ ID NO: 373915 - DNA, 20 bp, human
gaatttgccaatgcgctaaa

SEQ ID NO: 373916 - DNA, 20 bp, human
gtgggcatgtgcaactgaat

SEQ ID NO: 373917 - DNA, 20 bp, human
gtcacttgggacattatctc

SEQ ID NO: 373918 - DNA, 20 bp, human
gactgtgcacttatcctgct

SEQ ID NO: 373919 - DNA, 20 bp, human
gagtgcacagtgattcactt

SEQ ID NO: 373920 - DNA, 20 bp, human
ggggcaggcagccctacaca

SEQ ID NO: 373921 - DNA, 20 bp, human
ggagaacacagctagatact

SEQ ID NO: 373922 - DNA, 20 bp, human
gactttggaagctgggaagt

SEQ ID NO: 373923 - DNA, 20 bp, human
gctgcaggatcagcacatac

SEQ ID NO: 373924 - DNA, 20 bp, human
gagcaccatctctaattata

SEQ ID NO: 373925 - DNA, 20 bp, human
gttacatgcaagtggtattt

SEQ ID NO: 373926 - DNA, 20 bp, human
gaaagggtggacagtgagtc

SEQ ID NO: 373927 - DNA, 20 bp, human
gaagcccaataggactaatc

SEQ ID NO: 373928 - DNA, 20 bp, human
gtggctaaagattagggccc

SEQ ID NO: 373929 - DNA, 20 bp, human
ggcaaccacaccacaaaggg

SEQ ID NO: 373930 - DNA, 20 bp, human
gacagcaaccacaccacaaa

SEQ ID NO: 373931 - DNA, 20 bp, human
ggaggaagtaccatgctcct

SEQ ID NO: 373932 - DNA, 20 bp, human
ggggcaaaggtcttcttgaa

SEQ ID NO: 373933 - DNA, 20 bp, human
gcctggctcgttctagtcct

SEQ ID NO: 373934 - DNA, 20 bp, human
gctgtccaccctttgtggtg

SEQ ID NO: 373935 - DNA, 20 bp, human
gtagccagattagtcctatt

SEQ ID NO: 373936 - DNA, 20 bp, human
gtccctgaatttgagatcat

SEQ ID NO: 373937 - DNA, 20 bp, human
ggctgctcagggatcatctg

SEQ ID NO: 373938 - DNA, 20 bp, human
gtcaactttaccttattctc

SEQ ID NO: 373939 - DNA, 20 bp, human
gatcccatgatctcaaattc

SEQ ID NO: 373940 - DNA, 20 bp, human
gttgagatcatgggatgctt

SEQ ID NO: 373941 - DNA, 20 bp, human
gaaagtcttagtggcttttc

SEQ ID NO: 373942 - DNA, 20 bp, human
gaggctccatttacacgatg

SEQ ID NO: 373943 - DNA, 20 bp, human
gactcttggctgtgtgtcat

SEQ ID NO: 373944 - DNA, 20 bp, human
gttcttccacatcgtgtaaa

SEQ ID NO: 373945 - DNA, 20 bp, human
ggtaggtttttagatgtacc

SEQ ID NO: 373946 - DNA, 20 bp, human
gcagctcaggtgcagagact

SEQ ID NO: 373947 - DNA, 20 bp, human
gccctgaaggaagtgcaggt

SEQ ID NO: 373948 - DNA, 20 bp, human
gtggtgggttaaatcagctc

SEQ ID NO: 373949 - DNA, 20 bp, human
gaagtgggtgaggaattccc

SEQ ID NO: 373950 - DNA, 20 bp, human
gaggaccacaccaagtgccc

SEQ ID NO: 373951 - DNA, 20 bp, human
ggggtggctttcatcaaaac

SEQ ID NO: 373952 - DNA, 20 bp, human
ggcagcaatttgcagaaaaa

SEQ ID NO: 373953 - DNA, 20 bp, human
gcaggttgggggccctataa

SEQ ID NO: 373954 - DNA, 20 bp, human
ggggtgaggaattccctggg

SEQ ID NO: 373955 - DNA, 20 bp, human
gtccctgggaggtggtaatc

SEQ ID NO: 373956 - DNA, 20 bp, human
gtgaaccgagcgtgacgttg

SEQ ID NO: 373957 - DNA, 20 bp, human
gctattgcggaagtgagggg

SEQ ID NO: 373958 - DNA, 20 bp, human
gacactgcgcctgcgcaagt

SEQ ID NO: 373959 - DNA, 20 bp, human
gtgcgcaagatgagctattg

SEQ ID NO: 373960 - DNA, 20 bp, human
gtgagctattgcggaagtga

SEQ ID NO: 373961 - DNA, 20 bp, human
gtgggtctagacagccgcgg

SEQ ID NO: 373962 - DNA, 20 bp, human
gcctagtgggcgcagaacct

SEQ ID NO: 373963 - DNA, 20 bp, human
gcaaggccaaccgagctcct

SEQ ID NO: 373964 - DNA, 20 bp, human
gagctcggttggccttgggt

SEQ ID NO: 373965 - DNA, 20 bp, human
ggcgctcggcccacttgcgc

SEQ ID NO: 373966 - DNA, 20 bp, human
ggaggcgtgtcctggagtgg

SEQ ID NO: 373967 - DNA, 20 bp, human
gctgcccgaaaacctggaac

SEQ ID NO: 373968 - DNA, 20 bp, human
gtatcaccggaggcgtgtcc

SEQ ID NO: 373969 - DNA, 20 bp, human
gtggtacacataaacgaaag

SEQ ID NO: 373970 - DNA, 20 bp, human
gtgacacatgatatcaccgg

SEQ ID NO: 373971 - DNA, 20 bp, human
gtagggcaacatttccaagt

SEQ ID NO: 373972 - DNA, 20 bp, human
gttgcagagcggtctcactc

SEQ ID NO: 373973 - DNA, 20 bp, human
gaaagaggaaacgatagtta

SEQ ID NO: 373974 - DNA, 20 bp, human
gagctgaaattctgcgtagc

SEQ ID NO: 373975 - DNA, 20 bp, human
gaaatcctgttccaggtttt

SEQ ID NO: 373976 - DNA, 20 bp, human
gcggccgcggcagcagtaaa

SEQ ID NO: 373977 - DNA, 20 bp, human
ggcgtcatgtggatccgagg

SEQ ID NO: 373978 - DNA, 20 bp, human
ggaggcagggagctctgcgg

SEQ ID NO: 373979 - DNA, 20 bp, human
ggcctcctccggaaaggcga

SEQ ID NO: 373980 - DNA, 20 bp, human
gctccctgcctcctccggaa

SEQ ID NO: 373981 - DNA, 20 bp, human
gcccgcggagccaatgagct

SEQ ID NO: 373982 - DNA, 20 bp, human
gtgcgccctcgcctttccgg

SEQ ID NO: 373983 - DNA, 20 bp, human
gccaacggcgagcccccccc

SEQ ID NO: 373984 - DNA, 20 bp, human
ggcatccggtcccagctcat

SEQ ID NO: 373985 - DNA, 20 bp, human
gacgccatttactgctgccg

SEQ ID NO: 373986 - DNA, 20 bp, human
gaggcggaggcgaaagagga

SEQ ID NO: 373987 - DNA, 20 bp, human
gaggggaaggaaaatactgg

SEQ ID NO: 373988 - DNA, 20 bp, human
gggaaggaaaatactggagg

SEQ ID NO: 373989 - DNA, 20 bp, human
gtagacacagggtatctcaa

SEQ ID NO: 373990 - DNA, 20 bp, human
gatctgtcagattggaggag

SEQ ID NO: 373991 - DNA, 20 bp, human
gttcggttcatctgtcagat

SEQ ID NO: 373992 - DNA, 20 bp, human
gaactgcagttgtagacaca

SEQ ID NO: 373993 - DNA, 20 bp, human
gggttcatctgtcagattgg

SEQ ID NO: 373994 - DNA, 20 bp, human
gtcttgtgaatgggttatag

SEQ ID NO: 373995 - DNA, 20 bp, human
gttctggaggtcttgtgaat

SEQ ID NO: 373996 - DNA, 20 bp, human
ggcccgcagtggcgtgaagg

SEQ ID NO: 373997 - DNA, 20 bp, human
gtcgcgattctatgaatggg

SEQ ID NO: 373998 - DNA, 20 bp, human
gagccagtcccagcaatcac

SEQ ID NO: 373999 - DNA, 20 bp, human
gaacccgtgattgctgggac

SEQ ID NO: 374000 - DNA, 20 bp, human
gatcttaacccgtgattgct

SEQ ID NO: 374001 - DNA, 20 bp, human
gcctctttgtaaaagaacga

SEQ ID NO: 374002 - DNA, 20 bp, human
gcggagcgcatgcgcgctca

SEQ ID NO: 374003 - DNA, 20 bp, human
gcgttcgcgattctatgaat

SEQ ID NO: 374004 - DNA, 20 bp, human
ggtaaaagaacgacggctcc

SEQ ID NO: 374005 - DNA, 20 bp, human
gcaggcccgcagtggcgtga

SEQ ID NO: 374006 - DNA, 20 bp, human
gcctgcctgcgccttccgat

SEQ ID NO: 374007 - DNA, 20 bp, human
gagcaacggcctctgacgac

SEQ ID NO: 374008 - DNA, 20 bp, human
ggcaggcagggtgtggggcg

SEQ ID NO: 374009 - DNA, 20 bp, human
gggccccggtctggtcaacc

SEQ ID NO: 374010 - DNA, 20 bp, human
gtgccctgggtacccagctc

SEQ ID NO: 374011 - DNA, 20 bp, human
ggtcagaggccgttgctgat

SEQ ID NO: 374012 - DNA, 20 bp, human
gacagccgggttgaccagac

SEQ ID NO: 374013 - DNA, 20 bp, human
gggcgccggggagacgggac

SEQ ID NO: 374014 - DNA, 20 bp, human
ggcctctaggagtgaaggaa

SEQ ID NO: 374015 - DNA, 20 bp, human
gtgcaggtgcccgtcgtcag

SEQ ID NO: 374016 - DNA, 20 bp, human
gcgggcggccgccaaggtag

SEQ ID NO: 374017 - DNA, 20 bp, human
gcctcgcgcaccacgtgcta

SEQ ID NO: 374018 - DNA, 20 bp, human
gaataagcagcattaaccgc

SEQ ID NO: 374019 - DNA, 20 bp, human
ggatggctgtgtctgtaagc

SEQ ID NO: 374020 - DNA, 20 bp, human
gccgcgcagtgttatgacgt

SEQ ID NO: 374021 - DNA, 20 bp, human
ggcaccacgtgctaggggag

SEQ ID NO: 374022 - DNA, 20 bp, human
gatgacgtaggcgacgcccg

SEQ ID NO: 374023 - DNA, 20 bp, human
gcgcccgctcccctagcacg

SEQ ID NO: 374024 - DNA, 20 bp, human
ggcacgtggtgcgcgagggg

SEQ ID NO: 374025 - DNA, 20 bp, human
gtctgttctgtttctgcccg

SEQ ID NO: 374026 - DNA, 20 bp, human
gggaagacgcggagaatcaa

SEQ ID NO: 374027 - DNA, 20 bp, human
ggccctgtccggtctctccc

SEQ ID NO: 374028 - DNA, 20 bp, human
gcaaggggccggggagagac

SEQ ID NO: 374029 - DNA, 20 bp, human
gggccgggagggcgcaatgc

SEQ ID NO: 374030 - DNA, 20 bp, human
gcgggcctgcggatgtggga

SEQ ID NO: 374031 - DNA, 20 bp, human
gctggcctgcgaggaagacg

SEQ ID NO: 374032 - DNA, 20 bp, human
gacgcggagaatcaaggggc

SEQ ID NO: 374033 - DNA, 20 bp, human
ggccggggagagaccggaca

SEQ ID NO: 374034 - DNA, 20 bp, human
gcacgccgtcccacatccgc

SEQ ID NO: 374035 - DNA, 20 bp, human
ggggtggggctagtggcgcg

SEQ ID NO: 374036 - DNA, 20 bp, human
gagagggctgcggactaagg

SEQ ID NO: 374037 - DNA, 20 bp, human
gcccgagcgcgacttctgtg

SEQ ID NO: 374038 - DNA, 20 bp, human
ggggcggccgaaccagcgcc

SEQ ID NO: 374039 - DNA, 20 bp, human
gaacaccagggcggcggctc

SEQ ID NO: 374040 - DNA, 20 bp, human
gggtccgtgcgcccgaggtc

SEQ ID NO: 374041 - DNA, 20 bp, human
gcgggccggcaacaccaggg

SEQ ID NO: 374042 - DNA, 20 bp, human
ggccggcaacaccagggcgg

SEQ ID NO: 374043 - DNA, 20 bp, human
gagggcggcggctcgggaga

SEQ ID NO: 374044 - DNA, 20 bp, human
gcggaccactcagcactgca

SEQ ID NO: 374045 - DNA, 20 bp, human
ggcggactaagggggcggag

SEQ ID NO: 374046 - DNA, 20 bp, human
ggccgtgggcggcgatgaga

SEQ ID NO: 374047 - DNA, 20 bp, human
gccgaggccacgcccctgtg

SEQ ID NO: 374048 - DNA, 20 bp, human
gtcggggagggtcacagccc

SEQ ID NO: 374049 - DNA, 20 bp, human
gggctgctgccggtatagag

SEQ ID NO: 374050 - DNA, 20 bp, human
gggagctgcacggccgtggg

SEQ ID NO: 374051 - DNA, 20 bp, human
gcaccccgggcggttaacct

SEQ ID NO: 374052 - DNA, 20 bp, human
gctcggagctgcacggccgt

SEQ ID NO: 374053 - DNA, 20 bp, human
gcgcccggggtgggctccac

SEQ ID NO: 374054 - DNA, 20 bp, human
gtaacctcgggtctcagtcc

SEQ ID NO: 374055 - DNA, 20 bp, human
gagcccgggactgagacccg

SEQ ID NO: 374056 - DNA, 20 bp, human
gctcgcgcgcacattggacc

SEQ ID NO: 374057 - DNA, 20 bp, human
gcccctgcgcccattggctc

SEQ ID NO: 374058 - DNA, 20 bp, human
gcgcttgggaactgaccaat

SEQ ID NO: 374059 - DNA, 20 bp, human
gcgtctgcgccggaacctgc

SEQ ID NO: 374060 - DNA, 20 bp, human
ggcgcacattggacccgggt

SEQ ID NO: 374061 - DNA, 20 bp, human
gcacacctgtctcggagctt

SEQ ID NO: 374062 - DNA, 20 bp, human
ggccgcgttgaccggaaagt

SEQ ID NO: 374063 - DNA, 20 bp, human
ggctttgtctccaaccgctt

SEQ ID NO: 374064 - DNA, 20 bp, human
ggatccggtcccgcaggttc

SEQ ID NO: 374065 - DNA, 20 bp, human
gtctcccgaagctccgagac

SEQ ID NO: 374066 - DNA, 20 bp, human
gagggtgggtgcccctgacg

SEQ ID NO: 374067 - DNA, 20 bp, human
gccagctggtggcctcgaga

SEQ ID NO: 374068 - DNA, 20 bp, human
gcgcccgcgcccctgtgcca

SEQ ID NO: 374069 - DNA, 20 bp, human
gccggggcgcgggatggtgg

SEQ ID NO: 374070 - DNA, 20 bp, human
gggaatgaatgcgagagcta

SEQ ID NO: 374071 - DNA, 20 bp, human
ggagtgagcgggcgagtggg

SEQ ID NO: 374072 - DNA, 20 bp, human
gcggcgccgccaccttctcg

SEQ ID NO: 374073 - DNA, 20 bp, human
ggcgccgccgccttggcaca

SEQ ID NO: 374074 - DNA, 20 bp, human
gagggagtgagcgggcgagt

SEQ ID NO: 374075 - DNA, 20 bp, human
gcacccgaggcgcaggaagt

SEQ ID NO: 374076 - DNA, 20 bp, human
gtgggtgactcagcagtttt

SEQ ID NO: 374077 - DNA, 20 bp, human
gtcgattgtgtatggctgat

SEQ ID NO: 374078 - DNA, 20 bp, human
gagataatgtcgattgtgta

SEQ ID NO: 374079 - DNA, 20 bp, human
ggattctaggaccaagcaag

SEQ ID NO: 374080 - DNA, 20 bp, human
gagaccaaattgttgaggtt

SEQ ID NO: 374081 - DNA, 20 bp, human
gttaagtcaacgaattatcc

SEQ ID NO: 374082 - DNA, 20 bp, human
gggctgacttctgatatata

SEQ ID NO: 374083 - DNA, 20 bp, human
gagaggtagactttttccat

SEQ ID NO: 374084 - DNA, 20 bp, human
ggtactcttaatcatttaaa

SEQ ID NO: 374085 - DNA, 20 bp, human
gaacttttttgtgacatcat

SEQ ID NO: 374086 - DNA, 20 bp, human
gagggccgagcgatcccgga

SEQ ID NO: 374087 - DNA, 20 bp, human
ggggcgcgcgcaaggggtga

SEQ ID NO: 374088 - DNA, 20 bp, human
gcgcgccggcggagcaaagg

SEQ ID NO: 374089 - DNA, 20 bp, human
gcccgaccgcccggcggaaa

SEQ ID NO: 374090 - DNA, 20 bp, human
gggaaagggccgagcgatcc

SEQ ID NO: 374091 - DNA, 20 bp, human
gagccgaagcgacaatgcgg

SEQ ID NO: 374092 - DNA, 20 bp, human
gttcccccgcattgtcgctt

SEQ ID NO: 374093 - DNA, 20 bp, human
gcgccccggcgctgcgcgag

SEQ ID NO: 374094 - DNA, 20 bp, human
gggctcgccgcccgaccgcc

SEQ ID NO: 374095 - DNA, 20 bp, human
gatcgctcggccctttccgc

SEQ ID NO: 374096 - DNA, 20 bp, human
gggaccagatagtcccgcgg

SEQ ID NO: 374097 - DNA, 20 bp, human
gcaggtgcccccaggcgcgg

SEQ ID NO: 374098 - DNA, 20 bp, human
gcccaggcgcggaggctgat

SEQ ID NO: 374099 - DNA, 20 bp, human
gcccccgccgcgggactatc

SEQ ID NO: 374100 - DNA, 20 bp, human
gagccccctgaggcgggaag

SEQ ID NO: 374101 - DNA, 20 bp, human
gtaggggcaatgaacgacga

SEQ ID NO: 374102 - DNA, 20 bp, human
gggcgcggaggctgattggc

SEQ ID NO: 374103 - DNA, 20 bp, human
gtgattggcaggtgcgtgag

SEQ ID NO: 374104 - DNA, 20 bp, human
gagccgggctgaggcccggc

SEQ ID NO: 374105 - DNA, 20 bp, human
gagggacagattgttcccgg

SEQ ID NO: 374106 - DNA, 20 bp, human
gggcgtgcgggagggatccc

SEQ ID NO: 374107 - DNA, 20 bp, human
gccgctgggaggatgaggtc

SEQ ID NO: 374108 - DNA, 20 bp, human
gagagggcgggcgaagcaga

SEQ ID NO: 374109 - DNA, 20 bp, human
gccgccccggccagcctggt

SEQ ID NO: 374110 - DNA, 20 bp, human
gcgaggctcggctccctggg

SEQ ID NO: 374111 - DNA, 20 bp, human
gcacacacaagcgcactccc

SEQ ID NO: 374112 - DNA, 20 bp, human
ggggaggatgaggtccgggc

SEQ ID NO: 374113 - DNA, 20 bp, human
gtacccgagcaggacaatag

SEQ ID NO: 374114 - DNA, 20 bp, human
ggcaacagcggcactgattc

SEQ ID NO: 374115 - DNA, 20 bp, human
gaggagaggagggcgctcgc

SEQ ID NO: 374116 - DNA, 20 bp, human
gagatgagccagtggtaaca

SEQ ID NO: 374117 - DNA, 20 bp, human
gaagctcaccctgttaccac

SEQ ID NO: 374118 - DNA, 20 bp, human
gaaacgggccctcatcttca

SEQ ID NO: 374119 - DNA, 20 bp, human
ggcctgaaatggtcaagtaa

SEQ ID NO: 374120 - DNA, 20 bp, human
gggggcagtacataacctaa

SEQ ID NO: 374121 - DNA, 20 bp, human
gtgagctgagttctctaatc

SEQ ID NO: 374122 - DNA, 20 bp, human
ggagggcccgtttctatcca

SEQ ID NO: 374123 - DNA, 20 bp, human
gtagatgacaccactagtta

SEQ ID NO: 374124 - DNA, 20 bp, human
ggtaagggcactcaaagaat

SEQ ID NO: 374125 - DNA, 20 bp, human
gaactcacagagtgccaggt

SEQ ID NO: 374126 - DNA, 20 bp, human
ggccaggcgagcctcaccca

SEQ ID NO: 374127 - DNA, 20 bp, human
gggagcctggagcggatctg

SEQ ID NO: 374128 - DNA, 20 bp, human
gcgtgagctacgagaggccg

SEQ ID NO: 374129 - DNA, 20 bp, human
gtccacctcccggagagggg

SEQ ID NO: 374130 - DNA, 20 bp, human
gcgcggctcaggtcaagggg

SEQ ID NO: 374131 - DNA, 20 bp, human
gggcctcccagaaccagcaa

SEQ ID NO: 374132 - DNA, 20 bp, human
gcgcccgcggctcaggtcaa

SEQ ID NO: 374133 - DNA, 20 bp, human
ggctgagtgacaagttatct

SEQ ID NO: 374134 - DNA, 20 bp, human
gtgcgccccagatccgctcc

SEQ ID NO: 374135 - DNA, 20 bp, human
gtctaagtggcgcgcagaga

SEQ ID NO: 374136 - DNA, 20 bp, human
gtgaccccgtgagaccccac

SEQ ID NO: 374137 - DNA, 20 bp, human
gtgcacggctgcactcgcga

SEQ ID NO: 374138 - DNA, 20 bp, human
gcgcgcaagcgcgtggatgc

SEQ ID NO: 374139 - DNA, 20 bp, human
ggtggcgagcgtgaccccgt

SEQ ID NO: 374140 - DNA, 20 bp, human
ggccacgctgccatactcgc

SEQ ID NO: 374141 - DNA, 20 bp, human
gcgccgtcactccctcctgt

SEQ ID NO: 374142 - DNA, 20 bp, human
ggccgggtgtgactgcgcgt

SEQ ID NO: 374143 - DNA, 20 bp, human
gtcacacgcggcgtccacac

SEQ ID NO: 374144 - DNA, 20 bp, human
gtgaagctgtgcgtgatgtg

SEQ ID NO: 374145 - DNA, 20 bp, human
ggcgcagtcacacccggccg

SEQ ID NO: 374146 - DNA, 20 bp, human
ggcacgctggctcaagggga

SEQ ID NO: 374147 - DNA, 20 bp, human
gactgcagcaccccatgcgg

SEQ ID NO: 374148 - DNA, 20 bp, human
gaggccccaagagggtacag

SEQ ID NO: 374149 - DNA, 20 bp, human
ggggtgacctggaactgcga

SEQ ID NO: 374150 - DNA, 20 bp, human
gcggtggcagggccgctcca

SEQ ID NO: 374151 - DNA, 20 bp, human
gctggagttggagaagttgc

SEQ ID NO: 374152 - DNA, 20 bp, human
gctgtctgggccacgccctg

SEQ ID NO: 374153 - DNA, 20 bp, human
gagcggccctgccaccgcat

SEQ ID NO: 374154 - DNA, 20 bp, human
gggaacagcccatagactga

SEQ ID NO: 374155 - DNA, 20 bp, human
gggggtgctgcagtctgcgt

SEQ ID NO: 374156 - DNA, 20 bp, human
ggggagggtaataggacaca

SEQ ID NO: 374157 - DNA, 20 bp, human
gttgcgcactggttgacagg

SEQ ID NO: 374158 - DNA, 20 bp, human
gcctactcgcacttgcgcac

SEQ ID NO: 374159 - DNA, 20 bp, human
gtaccctccctgctggattc

SEQ ID NO: 374160 - DNA, 20 bp, human
gcacttgcgcactggttgac

SEQ ID NO: 374161 - DNA, 20 bp, human
gcaggaggctggacggggtc

SEQ ID NO: 374162 - DNA, 20 bp, human
ggttgacaggaggctggacg

SEQ ID NO: 374163 - DNA, 20 bp, human
gcagctgatgaccaagtgta

SEQ ID NO: 374164 - DNA, 20 bp, human
gctccctgctggattcagga

SEQ ID NO: 374165 - DNA, 20 bp, human
ggcactggttgacaggaggc

SEQ ID NO: 374166 - DNA, 20 bp, human
gcggcggggacctgccgaga

SEQ ID NO: 374167 - DNA, 20 bp, human
gcgcctcgccggtggagagg

SEQ ID NO: 374168 - DNA, 20 bp, human
gtgaggaccgctgaccaatc

SEQ ID NO: 374169 - DNA, 20 bp, human
gggacctgccgagagggatg

SEQ ID NO: 374170 - DNA, 20 bp, human
gcccgggcgggccttcacag

SEQ ID NO: 374171 - DNA, 20 bp, human
gggaccacatccctctcggc

SEQ ID NO: 374172 - DNA, 20 bp, human
gctcaggaccacatccctct

SEQ ID NO: 374173 - DNA, 20 bp, human
gacgcagcgaagggaaaaag

SEQ ID NO: 374174 - DNA, 20 bp, human
gggccaaggccacgcagcga

SEQ ID NO: 374175 - DNA, 20 bp, human
gcctaccccggacctggatg

SEQ ID NO: 374176 - DNA, 20 bp, human
gtggggactgaacaacccag

SEQ ID NO: 374177 - DNA, 20 bp, human
gcaattacatgcaggagaga

SEQ ID NO: 374178 - DNA, 20 bp, human
gtccccagaaggagccagca

SEQ ID NO: 374179 - DNA, 20 bp, human
gccagtggcaaagtgtgagg

SEQ ID NO: 374180 - DNA, 20 bp, human
ggtccatgctggctccttct

SEQ ID NO: 374181 - DNA, 20 bp, human
ggatgaaaaaggtatagtga

SEQ ID NO: 374182 - DNA, 20 bp, human
gcattcagaggtggttgcca

SEQ ID NO: 374183 - DNA, 20 bp, human
gcctggagggatgaggcaaa

SEQ ID NO: 374184 - DNA, 20 bp, human
gtaaaggagattgtccatgc

SEQ ID NO: 374185 - DNA, 20 bp, human
gcgtcaaaatgtgaactcca

SEQ ID NO: 374186 - DNA, 20 bp, human
gacgacgcgacgcgaggtag

SEQ ID NO: 374187 - DNA, 20 bp, human
ggatgcccgggcggggaaac

SEQ ID NO: 374188 - DNA, 20 bp, human
gtggccaatgagcgcgggtc

SEQ ID NO: 374189 - DNA, 20 bp, human
gccgcccgacccgcgctcat

SEQ ID NO: 374190 - DNA, 20 bp, human
ggcccgggcggggaaacggg

SEQ ID NO: 374191 - DNA, 20 bp, human
gtctcgcggggaccgttctc

SEQ ID NO: 374192 - DNA, 20 bp, human
gcggcctggccaatgagcgc

SEQ ID NO: 374193 - DNA, 20 bp, human
gcgggccggccggtggtggg

SEQ ID NO: 374194 - DNA, 20 bp, human
ggcccacgctagccggagaa

SEQ ID NO: 374195 - DNA, 20 bp, human
ggcgacgcgaggtagcggcc

SEQ ID NO: 374196 - DNA, 20 bp, human
gtggcagcgtatgagaagtt

SEQ ID NO: 374197 - DNA, 20 bp, human
ggctccgagagcaacagagg

SEQ ID NO: 374198 - DNA, 20 bp, human
gacgctgccactcttagtcc

SEQ ID NO: 374199 - DNA, 20 bp, human
gccctcccccccttgctcta

SEQ ID NO: 374200 - DNA, 20 bp, human
ggggaggggagtgttgcagc

SEQ ID NO: 374201 - DNA, 20 bp, human
ggaaagcgccccctctcgag

SEQ ID NO: 374202 - DNA, 20 bp, human
ggatcgcccaggactaagag

SEQ ID NO: 374203 - DNA, 20 bp, human
ggggaccagcctctcgagag

SEQ ID NO: 374204 - DNA, 20 bp, human
gtcttctggaaggagtcgct

SEQ ID NO: 374205 - DNA, 20 bp, human
ggaggcgtcgctgtcacctc

SEQ ID NO: 374206 - DNA, 20 bp, human
gtaaaagcggaagttacgca

SEQ ID NO: 374207 - DNA, 20 bp, human
gggactcgcgagcgctgtgg

SEQ ID NO: 374208 - DNA, 20 bp, human
gctgctggcgtcgacccgag

SEQ ID NO: 374209 - DNA, 20 bp, human
ggccggaagtggtcccgcag

SEQ ID NO: 374210 - DNA, 20 bp, human
gaaaggatataggccgtgga

SEQ ID NO: 374211 - DNA, 20 bp, human
gggcgtcgacccgaggggca

SEQ ID NO: 374212 - DNA, 20 bp, human
gccgcgcgcccgggccacca

SEQ ID NO: 374213 - DNA, 20 bp, human
gaaacgtgatacgtggctgc

SEQ ID NO: 374214 - DNA, 20 bp, human
ggcgctgtggcggccctgaa

SEQ ID NO: 374215 - DNA, 20 bp, human
ggatataggccgtggaggga

SEQ ID NO: 374216 - DNA, 20 bp, human
gtctttctggcatgaggagt

SEQ ID NO: 374217 - DNA, 20 bp, human
gcaacctagaaattaaggag

SEQ ID NO: 374218 - DNA, 20 bp, human
gcactgggcaggaatttaag

SEQ ID NO: 374219 - DNA, 20 bp, human
gttgaggtcaggattgtgag

SEQ ID NO: 374220 - DNA, 20 bp, human
gacatgctgcggttgaggtc

SEQ ID NO: 374221 - DNA, 20 bp, human
gagggccagagaataaacac

SEQ ID NO: 374222 - DNA, 20 bp, human
ggcacccggtgtttattctc

SEQ ID NO: 374223 - DNA, 20 bp, human
gagcctctaggtgctatgaa

SEQ ID NO: 374224 - DNA, 20 bp, human
gacaaaggagacagacacta

SEQ ID NO: 374225 - DNA, 20 bp, human
gaagtggtcaaaacatgctg

SEQ ID NO: 374226 - DNA, 20 bp, human
gagggcgcgcaccgcgcggt

SEQ ID NO: 374227 - DNA, 20 bp, human
gggtgcgcgccctcattggc

SEQ ID NO: 374228 - DNA, 20 bp, human
gaggttgcgccgcctccgat

SEQ ID NO: 374229 - DNA, 20 bp, human
gtgccgccgccggccaatga

SEQ ID NO: 374230 - DNA, 20 bp, human
gcacgcggggcgcgcggtat

SEQ ID NO: 374231 - DNA, 20 bp, human
gggaggcggcgcaacctgcg

SEQ ID NO: 374232 - DNA, 20 bp, human
ggcgcggtgcgcgccctcat

SEQ ID NO: 374233 - DNA, 20 bp, human
gaccgcgcggtaggccgaga

SEQ ID NO: 374234 - DNA, 20 bp, human
gtgcgcggcgacgccccgaa

SEQ ID NO: 374235 - DNA, 20 bp, human
ggacgccccgaaaggcgcta

SEQ ID NO: 374236 - DNA, 20 bp, human
gcctgcggggccgcccttca

SEQ ID NO: 374237 - DNA, 20 bp, human
ggcacataggaggacccagt

SEQ ID NO: 374238 - DNA, 20 bp, human
ggggcacggcgggacttttc

SEQ ID NO: 374239 - DNA, 20 bp, human
ggcaggctggggcgcacagg

SEQ ID NO: 374240 - DNA, 20 bp, human
gccgtgagcgctcaacgccc

SEQ ID NO: 374241 - DNA, 20 bp, human
gcggaagcgtcaggtggcct

SEQ ID NO: 374242 - DNA, 20 bp, human
gaacaagcgtccatccggcc

SEQ ID NO: 374243 - DNA, 20 bp, human
gcccgcaggctggggcgcac

SEQ ID NO: 374244 - DNA, 20 bp, human
gcgcgcaggcaggggtaagc

SEQ ID NO: 374245 - DNA, 20 bp, human
gggaaagcgaggctcccccc

SEQ ID NO: 374246 - DNA, 20 bp, human
gagaggggtcagcaatgagg

SEQ ID NO: 374247 - DNA, 20 bp, human
gagcgaggggtagcggggaa

SEQ ID NO: 374248 - DNA, 20 bp, human
ggaaggggagagtagtgaag

SEQ ID NO: 374249 - DNA, 20 bp, human
gaagagaggggtcagcaatg

SEQ ID NO: 374250 - DNA, 20 bp, human
gccgggagacctggagcgag

SEQ ID NO: 374251 - DNA, 20 bp, human
gccccgccccgcctcgagag

SEQ ID NO: 374252 - DNA, 20 bp, human
ggcaccggggcaatgaagag

SEQ ID NO: 374253 - DNA, 20 bp, human
gagagactccgcccctctcg

SEQ ID NO: 374254 - DNA, 20 bp, human
gggctctcgcgccgcgacga

SEQ ID NO: 374255 - DNA, 20 bp, human
gaccctgatcccaggtgcag

SEQ ID NO: 374256 - DNA, 20 bp, human
gcagctgcgcccgcggagtc

SEQ ID NO: 374257 - DNA, 20 bp, human
ggccgcgcccgtgggtgctc

SEQ ID NO: 374258 - DNA, 20 bp, human
ggcgcccgcggagtccggtc

SEQ ID NO: 374259 - DNA, 20 bp, human
ggggcccgaggagaacgccg

SEQ ID NO: 374260 - DNA, 20 bp, human
ggggcccgggccgcgcccgt

SEQ ID NO: 374261 - DNA, 20 bp, human
gacccgtggggttctcggag

SEQ ID NO: 374262 - DNA, 20 bp, human
gggagccgcggcgttctcct

SEQ ID NO: 374263 - DNA, 20 bp, human
gtggctgtggctggcgttcc

SEQ ID NO: 374264 - DNA, 20 bp, human
ggctccggaccggactccgc

SEQ ID NO: 374265 - DNA, 20 bp, human
gggctccagcagcaaacaag

SEQ ID NO: 374266 - DNA, 20 bp, human
gtccccacagcggctcccga

SEQ ID NO: 374267 - DNA, 20 bp, human
gccggggcggcccctcacgc

SEQ ID NO: 374268 - DNA, 20 bp, human
gagccgctgtggggaccctg

SEQ ID NO: 374269 - DNA, 20 bp, human
ggggttgccggaatccgtgg

SEQ ID NO: 374270 - DNA, 20 bp, human
gaaccagcatccatcctcca

SEQ ID NO: 374271 - DNA, 20 bp, human
gtgccgcagggtccccacag

SEQ ID NO: 374272 - DNA, 20 bp, human
ggggcagcgcgtcatttccg

SEQ ID NO: 374273 - DNA, 20 bp, human
ggcaactccctaagactcga

SEQ ID NO: 374274 - DNA, 20 bp, human
gtgccggaatccgtggagga

SEQ ID NO: 374275 - DNA, 20 bp, human
ggatgctggttcacaaccgt

SEQ ID NO: 374276 - DNA, 20 bp, human
gaaggcgcggcgctaccgaa

SEQ ID NO: 374277 - DNA, 20 bp, human
ggctagagcgaggatcccga

SEQ ID NO: 374278 - DNA, 20 bp, human
ggcggagccaggctggacgg

SEQ ID NO: 374279 - DNA, 20 bp, human
ggagccaggctggacggagg

SEQ ID NO: 374280 - DNA, 20 bp, human
gcggtagcgccgcgccttgg
